United States Patent 7,888,497 (BIOINFORMATICALLY DETECTABLE GROUP OF NOVEL REGULATORY OLIGONUCLEOTIDES AND USES THEREOF) - sequence listing, part 149

SEQ ID NO: 6318838 - DNA, 23 bp, Homo sapiens
ggatggaaataacgggtggcatt

SEQ ID NO: 6318839 - DNA, 14 bp, Homo sapiens
ggatggaagaaaga

SEQ ID NO: 6318840 - DNA, 12 bp, Homo sapiens
ggatggaaggag

SEQ ID NO: 6318841 - DNA, 15 bp, Homo sapiens
ggatggaaggagact

SEQ ID NO: 6318842 - DNA, 19 bp, Homo sapiens
ggatggaaggagagaggtt

SEQ ID NO: 6318843 - DNA, 19 bp, Homo sapiens
ggatggaaggttggatgga

SEQ ID NO: 6318844 - DNA, 16 bp, Homo sapiens
ggatggaatcacagcc

SEQ ID NO: 6318845 - DNA, 20 bp, Homo sapiens
ggatggacagaatgatggac

SEQ ID NO: 6318846 - DNA, 14 bp, Homo sapiens
ggatggacagacac

SEQ ID NO: 6318847 - DNA, 22 bp, Homo sapiens
ggatggacagacacctccccct

SEQ ID NO: 6318848 - DNA, 12 bp, Homo sapiens
ggatggacagat

SEQ ID NO: 6318849 - DNA, 14 bp, Homo sapiens
ggatggacagatgg

SEQ ID NO: 6318850 - DNA, 23 bp, Homo sapiens
ggatggactcttctcggctcagg

SEQ ID NO: 6318851 - DNA, 12 bp, Homo sapiens
ggatggactggc

SEQ ID NO: 6318852 - DNA, 23 bp, Homo sapiens
ggatggacttgtgattggctgca

SEQ ID NO: 6318853 - DNA, 18 bp, Homo sapiens
ggatggagaaagaagtgg

SEQ ID NO: 6318854 - DNA, 19 bp, Homo sapiens
ggatggagaatgccagccc

SEQ ID NO: 6318855 - DNA, 21 bp, Homo sapiens
ggatggagaatgccagcccaa

SEQ ID NO: 6318856 - DNA, 16 bp, Homo sapiens
ggatggagagagggga

SEQ ID NO: 6318857 - DNA, 16 bp, Homo sapiens
ggatggagaggcggcc

SEQ ID NO: 6318858 - DNA, 18 bp, Homo sapiens
ggatggagaggcggcctc

SEQ ID NO: 6318859 - DNA, 21 bp, Homo sapiens
ggatggagcccaggcgggagc

SEQ ID NO: 6318860 - DNA, 14 bp, Homo sapiens
ggatggaggagaaa

SEQ ID NO: 6318861 - DNA, 15 bp, Homo sapiens
ggatggaggccagag

SEQ ID NO: 6318862 - DNA, 19 bp, Homo sapiens
ggatggaggggtggtcctg

SEQ ID NO: 6318863 - DNA, 14 bp, Homo sapiens
ggatggatggacag

SEQ ID NO: 6318864 - DNA, 11 bp, Homo sapiens
ggatggatggc

SEQ ID NO: 6318865 - DNA, 13 bp, Homo sapiens
ggatggatggcac

SEQ ID NO: 6318866 - DNA, 16 bp, Homo sapiens
ggatggattgcagtcc

SEQ ID NO: 6318867 - DNA, 15 bp, Homo sapiens
ggatggcaccctgga

SEQ ID NO: 6318868 - DNA, 21 bp, Homo sapiens
ggatggcaccctggaaccggg

SEQ ID NO: 6318869 - DNA, 22 bp, Homo sapiens
ggatggcaggacgtgggctggg

SEQ ID NO: 6318870 - DNA, 21 bp, Homo sapiens
ggatggcagtggctgtgaagg

SEQ ID NO: 6318871 - DNA, 14 bp, Homo sapiens
ggatggcagtgtgg

SEQ ID NO: 6318872 - DNA, 20 bp, Homo sapiens
ggatggcatctagccagagg

SEQ ID NO: 6318873 - DNA, 23 bp, Homo sapiens
ggatggcatctagccagaggctg

SEQ ID NO: 6318874 - DNA, 16 bp, Homo sapiens
ggatggccaggtacaa

SEQ ID NO: 6318875 - DNA, 15 bp, Homo sapiens
ggatggccagtgtct

SEQ ID NO: 6318876 - DNA, 22 bp, Homo sapiens
ggatggccagtgtctgtcccgg

SEQ ID NO: 6318877 - DNA, 21 bp, Homo sapiens
ggatggcccagcaggcaggca

SEQ ID NO: 6318878 - DNA, 16 bp, Homo sapiens
ggatggcccctccttg

SEQ ID NO: 6318879 - DNA, 15 bp, Homo sapiens
ggatggccgggctgc

SEQ ID NO: 6318880 - DNA, 18 bp, Homo sapiens
ggatggccgtggatggcc

SEQ ID NO: 6318881 - DNA, 18 bp, Homo sapiens
ggatggcctctggggcag

SEQ ID NO: 6318882 - DNA, 15 bp, Homo sapiens
ggatggcctggaacc

SEQ ID NO: 6318883 - DNA, 16 bp, Homo sapiens
ggatggcctggccagg

SEQ ID NO: 6318884 - DNA, 17 bp, Homo sapiens
ggatggcctttccttcc

SEQ ID NO: 6318885 - DNA, 19 bp, Homo sapiens
ggatggcctttccttccct

SEQ ID NO: 6318886 - DNA, 21 bp, Homo sapiens
ggatggcgtgtcccctgcctg

SEQ ID NO: 6318887 - DNA, 13 bp, Homo sapiens
ggatgggaaaaac

SEQ ID NO: 6318888 - DNA, 18 bp, Homo sapiens
ggatgggaacactggtgg

SEQ ID NO: 6318889 - DNA, 18 bp, Homo sapiens
ggatgggaagaaaaagga

SEQ ID NO: 6318890 - DNA, 20 bp, Homo sapiens
ggatgggaagatggtagcag

SEQ ID NO: 6318891 - DNA, 12 bp, Homo sapiens
ggatgggaagga

SEQ ID NO: 6318892 - DNA, 15 bp, Homo sapiens
ggatgggaaggaggg

SEQ ID NO: 6318893 - DNA, 17 bp, Homo sapiens
ggatgggaaggagggag

SEQ ID NO: 6318894 - DNA, 12 bp, Homo sapiens
ggatgggaggag

SEQ ID NO: 6318895 - DNA, 14 bp, Homo sapiens
ggatgggaggctcc

SEQ ID NO: 6318896 - DNA, 19 bp, Homo sapiens
ggatgggaggtatgggctg

SEQ ID NO: 6318897 - DNA, 16 bp, Homo sapiens
ggatgggagtgggcac

SEQ ID NO: 6318898 - DNA, 22 bp, Homo sapiens
ggatgggatcctctccaccctc

SEQ ID NO: 6318899 - DNA, 15 bp, Homo sapiens
ggatgggatttcatg

SEQ ID NO: 6318900 - DNA, 16 bp, Homo sapiens
ggatgggcacaggctg

SEQ ID NO: 6318901 - DNA, 23 bp, Homo sapiens
ggatgggccacccaccagggctc

SEQ ID NO: 6318902 - DNA, 14 bp, Homo sapiens
ggatgggccctgca

SEQ ID NO: 6318903 - DNA, 15 bp, Homo sapiens
ggatgggctcgctga

SEQ ID NO: 6318904 - DNA, 14 bp, Homo sapiens
ggatggggaggaag

SEQ ID NO: 6318905 - DNA, 22 bp, Homo sapiens
ggatggggaggaagagagagac

SEQ ID NO: 6318906 - DNA, 14 bp, Homo sapiens
ggatggggaggggc

SEQ ID NO: 6318907 - DNA, 23 bp, Homo sapiens
ggatggggcagagcttctcctga

SEQ ID NO: 6318908 - DNA, 12 bp, Homo sapiens
gtatttatgtaa

SEQ ID NO: 6318909 - DNA, 18 bp, Homo sapiens
gtatttatgtaatttgta

SEQ ID NO: 6318910 - DNA, 20 bp, Homo sapiens
gtatttatgtaatttgtaca

SEQ ID NO: 6318911 - DNA, 13 bp, Homo sapiens
gtatttattaatt

SEQ ID NO: 6318912 - DNA, 18 bp, Homo sapiens
gtatttattaccgtcaca

SEQ ID NO: 6318913 - DNA, 14 bp, Homo sapiens
gtatttattatttg

SEQ ID NO: 6318914 - DNA, 16 bp, Homo sapiens
gtatttattatttgaa

SEQ ID NO: 6318915 - DNA, 17 bp, Homo sapiens
gtatttattcaataaag

SEQ ID NO: 6318916 - DNA, 20 bp, Homo sapiens
gtatttattcaataaagtat

SEQ ID NO: 6318917 - DNA, 15 bp, Homo sapiens
gtatttattccatat

SEQ ID NO: 6318918 - DNA, 23 bp, Homo sapiens
gtatttattctctatttattggg

SEQ ID NO: 6318919 - DNA, 12 bp, Homo sapiens
gtatttattctt

SEQ ID NO: 6318920 - DNA, 12 bp, Homo sapiens
gtatttattgtc

SEQ ID NO: 6318921 - DNA, 14 bp, Homo sapiens
gtatttatttaaaa

SEQ ID NO: 6318922 - DNA, 18 bp, Homo sapiens
gtatttatttaaaactct

SEQ ID NO: 6318923 - DNA, 13 bp, Homo sapiens
gtatttattttaa

SEQ ID NO: 6318924 - DNA, 15 bp, Homo sapiens
gtatttattttgtaa

SEQ ID NO: 6318925 - DNA, 23 bp, Homo sapiens
gtatttattttgtaattatgatt

SEQ ID NO: 6318926 - DNA, 13 bp, Homo sapiens
gtatttcaaatat

SEQ ID NO: 6318927 - DNA, 13 bp, Homo sapiens
gtatttcaaattg

SEQ ID NO: 6318928 - DNA, 15 bp, Homo sapiens
gtatttcaactgctg

SEQ ID NO: 6318929 - DNA, 22 bp, Homo sapiens
gtatttcagggacctcaggggc

SEQ ID NO: 6318930 - DNA, 15 bp, Homo sapiens
gtatttcatgtggct

SEQ ID NO: 6318931 - DNA, 16 bp, Homo sapiens
gtatttcatgtggctg

SEQ ID NO: 6318932 - DNA, 23 bp, Homo sapiens
gtatttcattgctgtgtcacact

SEQ ID NO: 6318933 - DNA, 13 bp, Homo sapiens
gtatttcatttct

SEQ ID NO: 6318934 - DNA, 14 bp, Homo sapiens
gtatttcatttctt

SEQ ID NO: 6318935 - DNA, 12 bp, Homo sapiens
gtatttcccagc

SEQ ID NO: 6318936 - DNA, 12 bp, Homo sapiens
gtatttcccttc

SEQ ID NO: 6318937 - DNA, 17 bp, Homo sapiens
gtatttcctgcttccct

SEQ ID NO: 6318938 - DNA, 10 bp, Homo sapiens
gtatttcctt

SEQ ID NO: 6318939 - DNA, 22 bp, Homo sapiens
gtatttccttccactgtagcta

SEQ ID NO: 6318940 - DNA, 12 bp, Homo sapiens
gtatttctatat

SEQ ID NO: 6318941 - DNA, 17 bp, Homo sapiens
gtatttctatatttatt

SEQ ID NO: 6318942 - DNA, 17 bp, Homo sapiens
gtatttctatgaaatat

SEQ ID NO: 6318943 - DNA, 23 bp, Homo sapiens
gtatttctcataggctatgccat

SEQ ID NO: 6318944 - DNA, 14 bp, Homo sapiens
gtatttctccagac

SEQ ID NO: 6318945 - DNA, 15 bp, Homo sapiens
gtatttctccagacc

SEQ ID NO: 6318946 - DNA, 17 bp, Homo sapiens
gtatttctccagaccca

SEQ ID NO: 6318947 - DNA, 14 bp, Homo sapiens
gtatttctctgtga

SEQ ID NO: 6318948 - DNA, 15 bp, Homo sapiens
gtatttctctgtgaa

SEQ ID NO: 6318949 - DNA, 16 bp, Homo sapiens
gtatttctcttgtcct

SEQ ID NO: 6318950 - DNA, 19 bp, Homo sapiens
gtatttctggtgtatattt

SEQ ID NO: 6318951 - DNA, 20 bp, Homo sapiens
gtatttctgtagaatgctgt

SEQ ID NO: 6318952 - DNA, 11 bp, Homo sapiens
gtatttctgtg

SEQ ID NO: 6318953 - DNA, 15 bp, Homo sapiens
gtatttctgttcctt

SEQ ID NO: 6318954 - DNA, 18 bp, Homo sapiens
gtatttcttaagaattca

SEQ ID NO: 6318955 - DNA, 19 bp, Homo sapiens
gtatttcttatttgaaagt

SEQ ID NO: 6318956 - DNA, 14 bp, Homo sapiens
gtatttcttttata

SEQ ID NO: 6318957 - DNA, 18 bp, Homo sapiens
gtatttcttttatatata

SEQ ID NO: 6318958 - DNA, 21 bp, Homo sapiens
gtatttcttttatatataaaa

SEQ ID NO: 6318959 - DNA, 21 bp, Homo sapiens
gtatttcttttttttaataag

SEQ ID NO: 6318960 - DNA, 19 bp, Homo sapiens
gtatttgaaaattttactt

SEQ ID NO: 6318961 - DNA, 21 bp, Homo sapiens
gtatttgaattaaaacttctt

SEQ ID NO: 6318962 - DNA, 17 bp, Homo sapiens
gtatttgagaagataat

SEQ ID NO: 6318963 - DNA, 18 bp, Homo sapiens
gtatttgagaagataatc

SEQ ID NO: 6318964 - DNA, 18 bp, Homo sapiens
gtatttgaggaaactcat

SEQ ID NO: 6318965 - DNA, 14 bp, Homo sapiens
gtatttgatgtaca

SEQ ID NO: 6318966 - DNA, 15 bp, Homo sapiens
gtatttgatgtattc

SEQ ID NO: 6318967 - DNA, 19 bp, Homo sapiens
gtatttgcaccaacatagt

SEQ ID NO: 6318968 - DNA, 12 bp, Homo sapiens
gtatttgctaat

SEQ ID NO: 6318969 - DNA, 12 bp, Homo sapiens
gtatttgctttt

SEQ ID NO: 6318970 - DNA, 16 bp, Homo sapiens
gtatttggaaaatgtt

SEQ ID NO: 6318971 - DNA, 23 bp, Homo sapiens
gtatttggaagcaacgtgttaat

SEQ ID NO: 6318972 - DNA, 21 bp, Homo sapiens
gtatttgggaaacttgtcact

SEQ ID NO: 6318973 - DNA, 22 bp, Homo sapiens
gtatttgggaaacttgtcactt

SEQ ID NO: 6318974 - DNA, 12 bp, Homo sapiens
gtatttgggttt

SEQ ID NO: 6318975 - DNA, 21 bp, Homo sapiens
gtatttggtccaaaaaaagga

SEQ ID NO: 6318976 - DNA, 14 bp, Homo sapiens
gtatttgtattaat

SEQ ID NO: 6318977 - DNA, 15 bp, Homo sapiens
gtatttgtattaata

SEQ ID NO: 6318978 - DNA, 18 bp, Homo sapiens
gtatttgtattaataaag

SEQ ID NO: 6318979 - DNA, 20 bp, Homo sapiens
gtatttgtattaataaagca

SEQ ID NO: 6318980 - DNA, 15 bp, Homo sapiens
gtatttgtgactttt

SEQ ID NO: 6318981 - DNA, 18 bp, Homo sapiens
gtatttgttaatttagaa

SEQ ID NO: 6318982 - DNA, 17 bp, Homo sapiens
gtatttgttaatttctt

SEQ ID NO: 6318983 - DNA, 16 bp, Homo sapiens
gtatttgttatttatt

SEQ ID NO: 6318984 - DNA, 16 bp, Homo sapiens
gtatttgttcatgttt

SEQ ID NO: 6318985 - DNA, 22 bp, Homo sapiens
gtatttgttcatgtttggtgca

SEQ ID NO: 6318986 - DNA, 17 bp, Homo sapiens
gtatttgtttgtagctt

SEQ ID NO: 6318987 - DNA, 20 bp, Homo sapiens
gtattttaaaagaatgatta

SEQ ID NO: 6318988 - DNA, 12 bp, Homo sapiens
gtattttaaaat

SEQ ID NO: 6318989 - DNA, 15 bp, Homo sapiens
gtattttaagcattc

SEQ ID NO: 6318990 - DNA, 13 bp, Homo sapiens
gtattttaatcac

SEQ ID NO: 6318991 - DNA, 14 bp, Homo sapiens
gtattttaatcctg

SEQ ID NO: 6318992 - DNA, 19 bp, Homo sapiens
gtattttaggcagggattt

SEQ ID NO: 6318993 - DNA, 21 bp, Homo sapiens
gtattttagtaagagattcct

SEQ ID NO: 6318994 - DNA, 21 bp, Homo sapiens
gtattttataaaattaaagaa

SEQ ID NO: 6318995 - DNA, 22 bp, Homo sapiens
gtattttatcttattttctcaa

SEQ ID NO: 6318996 - DNA, 22 bp, Homo sapiens
gtattttatctttgattctcct

SEQ ID NO: 6318997 - DNA, 19 bp, Homo sapiens
gtattttattaaagcaaca

SEQ ID NO: 6318998 - DNA, 13 bp, Homo sapiens
gtattttattgta

SEQ ID NO: 6318999 - DNA, 13 bp, Homo sapiens
gtattttcaaaga

SEQ ID NO: 6319000 - DNA, 15 bp, Homo sapiens
gtattttcagagaac

SEQ ID NO: 6319001 - DNA, 12 bp, Homo sapiens
gtattttcagtc

SEQ ID NO: 6319002 - DNA, 15 bp, Homo sapiens
gtattttcatgaaaa

SEQ ID NO: 6319003 - DNA, 16 bp, Homo sapiens
gtattttcatgaaaat

SEQ ID NO: 6319004 - DNA, 21 bp, Homo sapiens
gtattttccagccttatgtgt

SEQ ID NO: 6319005 - DNA, 23 bp, Homo sapiens
gtattttccatacacatccccag

SEQ ID NO: 6319006 - DNA, 17 bp, Homo sapiens
gtattttcctccaaagt

SEQ ID NO: 6319007 - DNA, 13 bp, Homo sapiens
gtattttcctgga

SEQ ID NO: 6319008 - DNA, 16 bp, Homo sapiens
gtattttcctgtaaaa

SEQ ID NO: 6319009 - DNA, 18 bp, Homo sapiens
gtattttcgggattcttt

SEQ ID NO: 6319010 - DNA, 19 bp, Homo sapiens
gtattttcgtgcatttgtg

SEQ ID NO: 6319011 - DNA, 19 bp, Homo sapiens
gtattttctagactgtgaa

SEQ ID NO: 6319012 - DNA, 12 bp, Homo sapiens
gtattttctcca

SEQ ID NO: 6319013 - DNA, 20 bp, Homo sapiens
gtattttcttcccaaatcaa

SEQ ID NO: 6319014 - DNA, 23 bp, Homo sapiens
gtattttcttcccatttgtaatg

SEQ ID NO: 6319015 - DNA, 13 bp, Homo sapiens
gtattttctttct

SEQ ID NO: 6319016 - DNA, 18 bp, Homo sapiens
gtattttctttctctact

SEQ ID NO: 6319017 - DNA, 23 bp, Homo sapiens
gtattttgaagaatatttaagaa

SEQ ID NO: 6319018 - DNA, 18 bp, Homo sapiens
gtattttgaagtttacat

SEQ ID NO: 6319019 - DNA, 15 bp, Homo sapiens
gtattttgaatacca

SEQ ID NO: 6319020 - DNA, 12 bp, Homo sapiens
gtattttgagat

SEQ ID NO: 6319021 - DNA, 17 bp, Homo sapiens
gtattttgctatatata

SEQ ID NO: 6319022 - DNA, 17 bp, Homo sapiens
gtattttgtatttaaaa

SEQ ID NO: 6319023 - DNA, 14 bp, Homo sapiens
gtattttgtcagtt

SEQ ID NO: 6319024 - DNA, 16 bp, Homo sapiens
gtattttgtgatgaat

SEQ ID NO: 6319025 - DNA, 24 bp, Homo sapiens
gtattttgtgtcctccaggagctt

SEQ ID NO: 6319026 - DNA, 17 bp, Homo sapiens
gtattttgttaaagctg

SEQ ID NO: 6319027 - DNA, 19 bp, Homo sapiens
gtatttttaaaaaatatgt

SEQ ID NO: 6319028 - DNA, 18 bp, Homo sapiens
gtatttttaatgggggta

SEQ ID NO: 6319029 - DNA, 15 bp, Homo sapiens
gtatttttactatta

SEQ ID NO: 6319030 - DNA, 11 bp, Homo sapiens
gtatttttagt

SEQ ID NO: 6319031 - DNA, 19 bp, Homo sapiens
gtatttttagtagagacag

SEQ ID NO: 6319032 - DNA, 22 bp, Homo sapiens
gtatttttagtagagacagtgt

SEQ ID NO: 6319033 - DNA, 17 bp, Homo sapiens
gtatttttataatgact

SEQ ID NO: 6319034 - DNA, 23 bp, Homo sapiens
gtatttttataattttatctgta

SEQ ID NO: 6319035 - DNA, 14 bp, Homo sapiens
gtatttttatataa

SEQ ID NO: 6319036 - DNA, 15 bp, Homo sapiens
gtatttttattcatg

SEQ ID NO: 6319037 - DNA, 16 bp, Homo sapiens
gtatttttattcatgt

SEQ ID NO: 6319038 - DNA, 16 bp, Homo sapiens
gtatttttattttcct

SEQ ID NO: 6319039 - DNA, 17 bp, Homo sapiens
gtatttttatttttgca

SEQ ID NO: 6319040 - DNA, 13 bp, Homo sapiens
gtatttttcagat

SEQ ID NO: 6319041 - DNA, 16 bp, Homo sapiens
gtatttttctatttct

SEQ ID NO: 6319042 - DNA, 19 bp, Homo sapiens
gtatttttctgacttttac

SEQ ID NO: 6319043 - DNA, 13 bp, Homo sapiens
gtatttttcttga

SEQ ID NO: 6319044 - DNA, 15 bp, Homo sapiens
gtatttttgaataaa

SEQ ID NO: 6319045 - DNA, 16 bp, Homo sapiens
gtatttttgacagaat

SEQ ID NO: 6319046 - DNA, 23 bp, Homo sapiens
gtatttttgattaacaatgtatt

SEQ ID NO: 6319047 - DNA, 21 bp, Homo sapiens
gtatttttgggctattgcata

SEQ ID NO: 6319048 - DNA, 17 bp, Homo sapiens
gtatttttgttaggttt

SEQ ID NO: 6319049 - DNA, 18 bp, Homo sapiens
gtatttttgttagtttac

SEQ ID NO: 6319050 - DNA, 21 bp, Homo sapiens
gtatttttgttagtttacaat

SEQ ID NO: 6319051 - DNA, 19 bp, Homo sapiens
gtatttttgttgcagtgta

SEQ ID NO: 6319052 - DNA, 15 bp, Homo sapiens
gtattttttaaaaca

SEQ ID NO: 6319053 - DNA, 17 bp, Homo sapiens
gtattttttaaaacact

SEQ ID NO: 6319054 - DNA, 15 bp, Homo sapiens
gtattttttaaagct

SEQ ID NO: 6319055 - DNA, 23 bp, Homo sapiens
gtattttttacttttcacactgt

SEQ ID NO: 6319056 - DNA, 16 bp, Homo sapiens
gtattttttatttaca

SEQ ID NO: 6319057 - DNA, 21 bp, Homo sapiens
gtattttttatttacatttta

SEQ ID NO: 6319058 - DNA, 21 bp, Homo sapiens
gtattttttcaagttgtaaat

SEQ ID NO: 6319059 - DNA, 14 bp, Homo sapiens
gtattttttccttt

SEQ ID NO: 6319060 - DNA, 16 bp, Homo sapiens
gtatttttttaaatca

SEQ ID NO: 6319061 - DNA, 15 bp, Homo sapiens
gtatttttttactaa

SEQ ID NO: 6319062 - DNA, 22 bp, Homo sapiens
gtatttttttccaagtgtataa

SEQ ID NO: 6319063 - DNA, 16 bp, Homo sapiens
gtatttttttgcaagt

SEQ ID NO: 6319064 - DNA, 22 bp, Homo sapiens
gtatttttttttctaagagaag

SEQ ID NO: 6319065 - DNA, 16 bp, Homo sapiens
gtattttttttttcca

SEQ ID NO: 6319066 - DNA, 13 bp, Homo sapiens
gtcaaaaaccaga

SEQ ID NO: 6319067 - DNA, 23 bp, Homo sapiens
gtcaaaaagggcttgaggtgaat

SEQ ID NO: 6319068 - DNA, 14 bp, Homo sapiens
gtcaaaaatatttt

SEQ ID NO: 6319069 - DNA, 17 bp, Homo sapiens
gtcaaaaatatttttat

SEQ ID NO: 6319070 - DNA, 22 bp, Homo sapiens
gtcaaaaatatttttatgtgaa

SEQ ID NO: 6319071 - DNA, 13 bp, Homo sapiens
gtcaaaaattttg

SEQ ID NO: 6319072 - DNA, 13 bp, Homo sapiens
gtcaaaacactgt

SEQ ID NO: 6319073 - DNA, 14 bp, Homo sapiens
gtcaaaacactgtg

SEQ ID NO: 6319074 - DNA, 15 bp, Homo sapiens
gtcaaaacactgtgg

SEQ ID NO: 6319075 - DNA, 14 bp, Homo sapiens
gtcaaaacacttgt

SEQ ID NO: 6319076 - DNA, 13 bp, Homo sapiens
gtcaaaacagatt

SEQ ID NO: 6319077 - DNA, 21 bp, Homo sapiens
gtcaaaactccactcagcaca

SEQ ID NO: 6319078 - DNA, 13 bp, Homo sapiens
gtcaaaaggaaca

SEQ ID NO: 6319079 - DNA, 22 bp, Homo sapiens
gtcaaaaggaacaaaaattaca

SEQ ID NO: 6319080 - DNA, 17 bp, Homo sapiens
gtcaaaagtagaacttt

SEQ ID NO: 6319081 - DNA, 23 bp, Homo sapiens
gtcaaaagtagaactttgtatag

SEQ ID NO: 6319082 - DNA, 15 bp, Homo sapiens
gtcaaaagttggact

SEQ ID NO: 6319083 - DNA, 15 bp, Homo sapiens
gtcaaaagttggtgt

SEQ ID NO: 6319084 - DNA, 21 bp, Homo sapiens
gtcaaaataaagattctcaca

SEQ ID NO: 6319085 - DNA, 17 bp, Homo sapiens
gtcaaaatcatgaatat

SEQ ID NO: 6319086 - DNA, 15 bp, Homo sapiens
gtcaaaattggattt

SEQ ID NO: 6319087 - DNA, 13 bp, Homo sapiens
gtcaaaatttgct

SEQ ID NO: 6319088 - DNA, 17 bp, Homo sapiens
gtcaaacaaagccagaa

SEQ ID NO: 6319089 - DNA, 17 bp, Homo sapiens
ggatggggcggcctgca

SEQ ID NO: 6319090 - DNA, 15 bp, Homo sapiens
ggatgggggaactca

SEQ ID NO: 6319091 - DNA, 22 bp, Homo sapiens
ggatgggggaactcagatccag

SEQ ID NO: 6319092 - DNA, 23 bp, Homo sapiens
ggatgggggaactcagatccagg

SEQ ID NO: 6319093 - DNA, 14 bp, Homo sapiens
ggatgggggagagg

SEQ ID NO: 6319094 - DNA, 18 bp, Homo sapiens
ggatgggggctcctggca

SEQ ID NO: 6319095 - DNA, 15 bp, Homo sapiens
ggatggggggatttt

SEQ ID NO: 6319096 - DNA, 23 bp, Homo sapiens
ggatgggggtcctggtatgtctc

SEQ ID NO: 6319097 - DNA, 17 bp, Homo sapiens
ggatgggggtgcaggca

SEQ ID NO: 6319098 - DNA, 16 bp, Homo sapiens
ggatgggggtggctgg

SEQ ID NO: 6319099 - DNA, 19 bp, Homo sapiens
ggatgggggtggctgggac

SEQ ID NO: 6319100 - DNA, 20 bp, Homo sapiens
ggatggggttgggctctgcg

SEQ ID NO: 6319101 - DNA, 15 bp, Homo sapiens
ggatgggtcagagct

SEQ ID NO: 6319102 - DNA, 16 bp, Homo sapiens
ggatgggtggatggcc

SEQ ID NO: 6319103 - DNA, 14 bp, Homo sapiens
ggatgggtgtggga

SEQ ID NO: 6319104 - DNA, 15 bp, Homo sapiens
ggatggtcaggccca

SEQ ID NO: 6319105 - DNA, 16 bp, Homo sapiens
ggatggtcaggcccag

SEQ ID NO: 6319106 - DNA, 19 bp, Homo sapiens
ggatggtcatcgtgacagc

SEQ ID NO: 6319107 - DNA, 14 bp, Homo sapiens
ggatggtccaggat

SEQ ID NO: 6319108 - DNA, 14 bp, Homo sapiens
ggatggtcctgggg

SEQ ID NO: 6319109 - DNA, 16 bp, Homo sapiens
ggatggtcctggggct

SEQ ID NO: 6319110 - DNA, 22 bp, Homo sapiens
ggatggtcctggggctctgtgc

SEQ ID NO: 6319111 - DNA, 18 bp, Homo sapiens
ggatggtctccacctgtg

SEQ ID NO: 6319112 - DNA, 21 bp, Homo sapiens
ggatggtcttacagcaggcag

SEQ ID NO: 6319113 - DNA, 16 bp, Homo sapiens
ggatggtgactcctga

SEQ ID NO: 6319114 - DNA, 13 bp, Homo sapiens
ggatggtgacttt

SEQ ID NO: 6319115 - DNA, 14 bp, Homo sapiens
ggatggtgatggag

SEQ ID NO: 6319116 - DNA, 13 bp, Homo sapiens
ggatggtgcccct

SEQ ID NO: 6319117 - DNA, 14 bp, Homo sapiens
ggatggtggtgcat

SEQ ID NO: 6319118 - DNA, 16 bp, Homo sapiens
ggatggtggtgcatcc

SEQ ID NO: 6319119 - DNA, 16 bp, Homo sapiens
ggatggttccccagga

SEQ ID NO: 6319120 - DNA, 15 bp, Homo sapiens
ggatggttctgtgac

SEQ ID NO: 6319121 - DNA, 16 bp, Homo sapiens
ggatgtaaacagtgcc

SEQ ID NO: 6319122 - DNA, 17 bp, Homo sapiens
ggatgtaaacagtgcct

SEQ ID NO: 6319123 - DNA, 19 bp, Homo sapiens
ggatgtaaacagtgcctgc

SEQ ID NO: 6319124 - DNA, 13 bp, Homo sapiens
ggatgtaaatcct

SEQ ID NO: 6319125 - DNA, 14 bp, Homo sapiens
ggatgtaatatagg

SEQ ID NO: 6319126 - DNA, 17 bp, Homo sapiens
ggatgtaattagctctg

SEQ ID NO: 6319127 - DNA, 19 bp, Homo sapiens
ggatgtaattagctctggg

SEQ ID NO: 6319128 - DNA, 18 bp, Homo sapiens
ggatgtagagagaacagg

SEQ ID NO: 6319129 - DNA, 19 bp, Homo sapiens
ggatgtagcttttcacctt

SEQ ID NO: 6319130 - DNA, 17 bp, Homo sapiens
ggatgtagtgattaaat

SEQ ID NO: 6319131 - DNA, 14 bp, Homo sapiens
ggatgtataaattt

SEQ ID NO: 6319132 - DNA, 17 bp, Homo sapiens
ggatgtataatacatcc

SEQ ID NO: 6319133 - DNA, 22 bp, Homo sapiens
ggatgtatccatgggggcaggg

SEQ ID NO: 6319134 - DNA, 20 bp, Homo sapiens
ggatgtatgaatacagcagc

SEQ ID NO: 6319135 - DNA, 15 bp, Homo sapiens
ggatgtatgtgtata

SEQ ID NO: 6319136 - DNA, 23 bp, Homo sapiens
ggatgtatttgtagccagtctcc

SEQ ID NO: 6319137 - DNA, 22 bp, Homo sapiens
ggatgtcaccaagaaggggctc

SEQ ID NO: 6319138 - DNA, 22 bp, Homo sapiens
ggatgtcagcagacacacatgg

SEQ ID NO: 6319139 - DNA, 19 bp, Homo sapiens
ggatgtcatgtctgcttgt

SEQ ID NO: 6319140 - DNA, 16 bp, Homo sapiens
ggatgtccagagctgg

SEQ ID NO: 6319141 - DNA, 22 bp, Homo sapiens
ggatgtccccaatgctgtacct

SEQ ID NO: 6319142 - DNA, 16 bp, Homo sapiens
ggatgtcccctgtccc

SEQ ID NO: 6319143 - DNA, 17 bp, Homo sapiens
ggatgtcccctgtccca

SEQ ID NO: 6319144 - DNA, 19 bp, Homo sapiens
ggatgtccgttccaggagc

SEQ ID NO: 6319145 - DNA, 22 bp, Homo sapiens
ggatgtccgttccaggagcaca

SEQ ID NO: 6319146 - DNA, 23 bp, Homo sapiens
ggatgtcctctttactcccttcc

SEQ ID NO: 6319147 - DNA, 14 bp, Homo sapiens
ggatgtctgccaat

SEQ ID NO: 6319148 - DNA, 14 bp, Homo sapiens
ggatgtcttccttg

SEQ ID NO: 6319149 - DNA, 18 bp, Homo sapiens
ggatgtcttgagatgtat

SEQ ID NO: 6319150 - DNA, 22 bp, Homo sapiens
ggatgtgaattgcctgcagaga

SEQ ID NO: 6319151 - DNA, 16 bp, Homo sapiens
ggatgtgacagtggcg

SEQ ID NO: 6319152 - DNA, 18 bp, Homo sapiens
ggatgtgagccccagggg

SEQ ID NO: 6319153 - DNA, 22 bp, Homo sapiens
ggatgtgcacggcagcttgagc

SEQ ID NO: 6319154 - DNA, 18 bp, Homo sapiens
ggatgtgcatctggccta

SEQ ID NO: 6319155 - DNA, 16 bp, Homo sapiens
ggatgtgctgcagtgc

SEQ ID NO: 6319156 - DNA, 18 bp, Homo sapiens
ggatgtggagctcctgct

SEQ ID NO: 6319157 - DNA, 13 bp, Homo sapiens
ggatgtggcactg

SEQ ID NO: 6319158 - DNA, 13 bp, Homo sapiens
ggatgtggcaggg

SEQ ID NO: 6319159 - DNA, 19 bp, Homo sapiens
ggatgtggcaggggcagtg

SEQ ID NO: 6319160 - DNA, 24 bp, Homo sapiens
ggatgtggcaggggcagtggcctg

SEQ ID NO: 6319161 - DNA, 16 bp, Homo sapiens
ggatgtggccaggggt

SEQ ID NO: 6319162 - DNA, 13 bp, Homo sapiens
ggatgtgggcagc

SEQ ID NO: 6319163 - DNA, 22 bp, Homo sapiens
ggatgtggggtccccatcatcc

SEQ ID NO: 6319164 - DNA, 16 bp, Homo sapiens
ggatgtgggtaagagg

SEQ ID NO: 6319165 - DNA, 22 bp, Homo sapiens
ggatgtgggtaagaggagcaga

SEQ ID NO: 6319166 - DNA, 17 bp, Homo sapiens
ggatgtgtgctttccca

SEQ ID NO: 6319167 - DNA, 14 bp, Homo sapiens
ggatgtgtgtgtgt

SEQ ID NO: 6319168 - DNA, 15 bp, Homo sapiens
ggatgttacaagttt

SEQ ID NO: 6319169 - DNA, 20 bp, Homo sapiens
ggatgttacaagtttgctaa

SEQ ID NO: 6319170 - DNA, 21 bp, Homo sapiens
ggatgttagacttgctccctc

SEQ ID NO: 6319171 - DNA, 22 bp, Homo sapiens
ggatgttagacttgctccctct

SEQ ID NO: 6319172 - DNA, 16 bp, Homo sapiens
ggatgttatgaacagc

SEQ ID NO: 6319173 - DNA, 18 bp, Homo sapiens
ggatgttatgaacagctg

SEQ ID NO: 6319174 - DNA, 21 bp, Homo sapiens
ggatgttcaacttaatgaaga

SEQ ID NO: 6319175 - DNA, 20 bp, Homo sapiens
ggatgttcagcactgtccct

SEQ ID NO: 6319176 - DNA, 14 bp, Homo sapiens
ggatgttccagtgg

SEQ ID NO: 6319177 - DNA, 15 bp, Homo sapiens
ggatgttctgggaca

SEQ ID NO: 6319178 - DNA, 22 bp, Homo sapiens
ggatgttgaaaaagttctgcag

SEQ ID NO: 6319179 - DNA, 13 bp, Homo sapiens
ggatgttgctata

SEQ ID NO: 6319180 - DNA, 23 bp, Homo sapiens
ggatgttggccaccaggtgcctt

SEQ ID NO: 6319181 - DNA, 14 bp, Homo sapiens
ggatgttgtaaata

SEQ ID NO: 6319182 - DNA, 20 bp, Homo sapiens
ggatgtttaatcaagagaga

SEQ ID NO: 6319183 - DNA, 17 bp, Homo sapiens
ggatgtttacctggtgc

SEQ ID NO: 6319184 - DNA, 19 bp, Homo sapiens
ggatgtttagcagtggctg

SEQ ID NO: 6319185 - DNA, 12 bp, Homo sapiens
ggatgtttgccc

SEQ ID NO: 6319186 - DNA, 21 bp, Homo sapiens
ggatgttttgtcccatttcct

SEQ ID NO: 6319187 - DNA, 13 bp, Homo sapiens
ggattaaaccttt

SEQ ID NO: 6319188 - DNA, 12 bp, Homo sapiens
ggattaaactta

SEQ ID NO: 6319189 - DNA, 23 bp, Homo sapiens
ggattaaacttaatctaaatgga

SEQ ID NO: 6319190 - DNA, 15 bp, Homo sapiens
ggattaactaaagaa

SEQ ID NO: 6319191 - DNA, 16 bp, Homo sapiens
ggattaactaaagaag

SEQ ID NO: 6319192 - DNA, 18 bp, Homo sapiens
ggattaagaaaccttgct

SEQ ID NO: 6319193 - DNA, 19 bp, Homo sapiens
ggattaagatacactcctg

SEQ ID NO: 6319194 - DNA, 22 bp, Homo sapiens
ggattaaggcgtgagccactgc

SEQ ID NO: 6319195 - DNA, 15 bp, Homo sapiens
ggattaatatgaaaa

SEQ ID NO: 6319196 - DNA, 13 bp, Homo sapiens
ggattaatgaaaa

SEQ ID NO: 6319197 - DNA, 13 bp, Homo sapiens
ggattacagaaac

SEQ ID NO: 6319198 - DNA, 14 bp, Homo sapiens
ggattacagaaact

SEQ ID NO: 6319199 - DNA, 14 bp, Homo sapiens
ggattacaggcgtg

SEQ ID NO: 6319200 - DNA, 19 bp, Homo sapiens
ggattacaggctcctgcca

SEQ ID NO: 6319201 - DNA, 22 bp, Homo sapiens
ggattactgacttttcttttta

SEQ ID NO: 6319202 - DNA, 18 bp, Homo sapiens
ggattacttctctataaa

SEQ ID NO: 6319203 - DNA, 16 bp, Homo sapiens
ggattagacagtaaga

SEQ ID NO: 6319204 - DNA, 13 bp, Homo sapiens
ggattagcttttc

SEQ ID NO: 6319205 - DNA, 14 bp, Homo sapiens
ggattagtttagaa

SEQ ID NO: 6319206 - DNA, 21 bp, Homo sapiens
ggattataaatgaaatttgca

SEQ ID NO: 6319207 - DNA, 15 bp, Homo sapiens
ggattataatcagaa

SEQ ID NO: 6319208 - DNA, 15 bp, Homo sapiens
ggattatatgtatta

SEQ ID NO: 6319209 - DNA, 19 bp, Homo sapiens
ggattattagaatcaaaca

SEQ ID NO: 6319210 - DNA, 19 bp, Homo sapiens
ggattattcatttaaaatg

SEQ ID NO: 6319211 - DNA, 22 bp, Homo sapiens
ggattattcatttaaaatgatt

SEQ ID NO: 6319212 - DNA, 18 bp, Homo sapiens
ggattatttagaatatgt

SEQ ID NO: 6319213 - DNA, 13 bp, Homo sapiens
ggattattttttc

SEQ ID NO: 6319214 - DNA, 14 bp, Homo sapiens
ggattcaaatgcat

SEQ ID NO: 6319215 - DNA, 15 bp, Homo sapiens
ggattcaaatgcatg

SEQ ID NO: 6319216 - DNA, 11 bp, Homo sapiens
ggattcaaatt

SEQ ID NO: 6319217 - DNA, 15 bp, Homo sapiens
ggattcaattcctgt

SEQ ID NO: 6319218 - DNA, 14 bp, Homo sapiens
ggattcaattttaa

SEQ ID NO: 6319219 - DNA, 21 bp, Homo sapiens
ggattcacccccctctgctgc

SEQ ID NO: 6319220 - DNA, 18 bp, Homo sapiens
ggattcaggcctctgagg

SEQ ID NO: 6319221 - DNA, 21 bp, Homo sapiens
ggattcaggcctctgaggagc

SEQ ID NO: 6319222 - DNA, 18 bp, Homo sapiens
ggattcaggggctggggg

SEQ ID NO: 6319223 - DNA, 20 bp, Homo sapiens
ggattcataatcacaaatat

SEQ ID NO: 6319224 - DNA, 22 bp, Homo sapiens
ggattcattctcataattccta

SEQ ID NO: 6319225 - DNA, 22 bp, Homo sapiens
ggattcattgtctctcacagat

SEQ ID NO: 6319226 - DNA, 18 bp, Homo sapiens
ggattcatttcctgccct

SEQ ID NO: 6319227 - DNA, 16 bp, Homo sapiens
ggattccaaagcattt

SEQ ID NO: 6319228 - DNA, 18 bp, Homo sapiens
ggattccaaccttccttt

SEQ ID NO: 6319229 - DNA, 22 bp, Homo sapiens
ggattccactcgtgtgtttcta

SEQ ID NO: 6319230 - DNA, 15 bp, Homo sapiens
ggattccagtgcatg

SEQ ID NO: 6319231 - DNA, 12 bp, Homo sapiens
ggattccatgct

SEQ ID NO: 6319232 - DNA, 13 bp, Homo sapiens
ggattcccagaga

SEQ ID NO: 6319233 - DNA, 22 bp, Homo sapiens
ggattcccccccctttcctaaa

SEQ ID NO: 6319234 - DNA, 21 bp, Homo sapiens
ggattccccctgccctgtgcc

SEQ ID NO: 6319235 - DNA, 23 bp, Homo sapiens
ggattcccctcaatgcagtcagt

SEQ ID NO: 6319236 - DNA, 16 bp, Homo sapiens
ggattcccctggacat

SEQ ID NO: 6319237 - DNA, 19 bp, Homo sapiens
ggattccggccctggctgg

SEQ ID NO: 6319238 - DNA, 12 bp, Homo sapiens
ggattcctcccc

SEQ ID NO: 6319239 - DNA, 16 bp, Homo sapiens
ggattcctccccaccc

SEQ ID NO: 6319240 - DNA, 17 bp, Homo sapiens
ggattcctccccaccct

SEQ ID NO: 6319241 - DNA, 14 bp, Homo sapiens
ggattcctcccctg

SEQ ID NO: 6319242 - DNA, 13 bp, Homo sapiens
ggattcctctttt

SEQ ID NO: 6319243 - DNA, 14 bp, Homo sapiens
ggattcctgaccca

SEQ ID NO: 6319244 - DNA, 16 bp, Homo sapiens
ggattcctgagctggc

SEQ ID NO: 6319245 - DNA, 17 bp, Homo sapiens
ggattcctgagctggcc

SEQ ID NO: 6319246 - DNA, 18 bp, Homo sapiens
ggattcctgggcaagaac

SEQ ID NO: 6319247 - DNA, 15 bp, Homo sapiens
ggattctaaattatg

SEQ ID NO: 6319248 - DNA, 23 bp, Homo sapiens
ggattctaccgtaattgctttgt

SEQ ID NO: 6319249 - DNA, 12 bp, Homo sapiens
ggattctccagg

SEQ ID NO: 6319250 - DNA, 16 bp, Homo sapiens
ggattctctaaccttt

SEQ ID NO: 6319251 - DNA, 11 bp, Homo sapiens
ggattctctac

SEQ ID NO: 6319252 - DNA, 16 bp, Homo sapiens
ggattctctactgcca

SEQ ID NO: 6319253 - DNA, 14 bp, Homo sapiens
ggattctgagcagt

SEQ ID NO: 6319254 - DNA, 17 bp, Homo sapiens
ggattctgatttgtatt

SEQ ID NO: 6319255 - DNA, 18 bp, Homo sapiens
ggattctgctggcctctg

SEQ ID NO: 6319256 - DNA, 21 bp, Homo sapiens
ggattctggcctagtcccttc

SEQ ID NO: 6319257 - DNA, 10 bp, Homo sapiens
ggattctggg

SEQ ID NO: 6319258 - DNA, 23 bp, Homo sapiens
ggattctgggaagcttgagcctc

SEQ ID NO: 6319259 - DNA, 12 bp, Homo sapiens
ggattctgggag

SEQ ID NO: 6319260 - DNA, 19 bp, Homo sapiens
ggattctgggaggaagcag

SEQ ID NO: 6319261 - DNA, 22 bp, Homo sapiens
ggattctgggaggcaagaaaag

SEQ ID NO: 6319262 - DNA, 22 bp, Homo sapiens
ggattctgtgcctccaggacca

SEQ ID NO: 6319263 - DNA, 13 bp, Homo sapiens
ggattctgtgttt

SEQ ID NO: 6319264 - DNA, 20 bp, Homo sapiens
ggattcttaaagttgaattt

SEQ ID NO: 6319265 - DNA, 16 bp, Homo sapiens
ggattcttccatctga

SEQ ID NO: 6319266 - DNA, 18 bp, Homo sapiens
ggattcttgttttgcttc

SEQ ID NO: 6319267 - DNA, 14 bp, Homo sapiens
ggattctttaaata

SEQ ID NO: 6319268 - DNA, 16 bp, Homo sapiens
gtcaaacaggctgtaa

SEQ ID NO: 6319269 - DNA, 14 bp, Homo sapiens
gtcaaacagtgcca

SEQ ID NO: 6319270 - DNA, 17 bp, Homo sapiens
gtcaaactaattctcac

SEQ ID NO: 6319271 - DNA, 19 bp, Homo sapiens
gtcaaactaattctcacat

SEQ ID NO: 6319272 - DNA, 23 bp, Homo sapiens
gtcaaactccctagtctccacct

SEQ ID NO: 6319273 - DNA, 16 bp, Homo sapiens
gtcaaactgtagaaat

SEQ ID NO: 6319274 - DNA, 23 bp, Homo sapiens
gtcaaacttgtcaagaatgagaa

SEQ ID NO: 6319275 - DNA, 13 bp, Homo sapiens
gtcaaacttgttt

SEQ ID NO: 6319276 - DNA, 12 bp, Homo sapiens
gtcaaagaagac

SEQ ID NO: 6319277 - DNA, 13 bp, Homo sapiens
gtcaaagaagctt

SEQ ID NO: 6319278 - DNA, 16 bp, Homo sapiens
gtcaaagcaaggatct

SEQ ID NO: 6319279 - DNA, 18 bp, Homo sapiens
gtcaaagcattgagatct

SEQ ID NO: 6319280 - DNA, 18 bp, Homo sapiens
gtcaaagctgcagtcagc

SEQ ID NO: 6319281 - DNA, 18 bp, Homo sapiens
gtcaaaggacggaagtgg

SEQ ID NO: 6319282 - DNA, 19 bp, Homo sapiens
gtcaaagtggtgagaggca

SEQ ID NO: 6319283 - DNA, 21 bp, Homo sapiens
gtcaaagtgttgctgtggctc

SEQ ID NO: 6319284 - DNA, 14 bp, Homo sapiens
gtcaaataaacact

SEQ ID NO: 6319285 - DNA, 15 bp, Homo sapiens
gtcaaataaacactg

SEQ ID NO: 6319286 - DNA, 14 bp, Homo sapiens
gtcaaataaagcaa

SEQ ID NO: 6319287 - DNA, 20 bp, Homo sapiens
gtcaaataaatgtttccccc

SEQ ID NO: 6319288 - DNA, 19 bp, Homo sapiens
gtcaaatacagcatttctt

SEQ ID NO: 6319289 - DNA, 18 bp, Homo sapiens
gtcaaatatcatttactc

SEQ ID NO: 6319290 - DNA, 24 bp, Homo sapiens
gtcaaatatgttctggacagctaa

SEQ ID NO: 6319291 - DNA, 22 bp, Homo sapiens
gtcaaatcatggccaaatcgca

SEQ ID NO: 6319292 - DNA, 12 bp, Homo sapiens
gtcaaatccagt

SEQ ID NO: 6319293 - DNA, 18 bp, Homo sapiens
gtcaaatccagtggtggg

SEQ ID NO: 6319294 - DNA, 22 bp, Homo sapiens
gtcaaatccagtggtgggtaat

SEQ ID NO: 6319295 - DNA, 18 bp, Homo sapiens
gtcaaatccatgtgtccc

SEQ ID NO: 6319296 - DNA, 16 bp, Homo sapiens
gtcaaatgctagaaaa

SEQ ID NO: 6319297 - DNA, 16 bp, Homo sapiens
gtcaaatgggaaaaaa

SEQ ID NO: 6319298 - DNA, 15 bp, Homo sapiens
gtcaaatgtttcctt

SEQ ID NO: 6319299 - DNA, 15 bp, Homo sapiens
gtcaaattatgtatt

SEQ ID NO: 6319300 - DNA, 17 bp, Homo sapiens
gtcaaattgtgcaaaat

SEQ ID NO: 6319301 - DNA, 20 bp, Homo sapiens
gtcaaattgtgcaaaatatt

SEQ ID NO: 6319302 - DNA, 14 bp, Homo sapiens
gtcaaatttacatt

SEQ ID NO: 6319303 - DNA, 22 bp, Homo sapiens
gtcaaatttactttaaaaagaa

SEQ ID NO: 6319304 - DNA, 17 bp, Homo sapiens
gtcaacaaaaagacatg

SEQ ID NO: 6319305 - DNA, 22 bp, Homo sapiens
gtcaacaaatctaggaaaatat

SEQ ID NO: 6319306 - DNA, 19 bp, Homo sapiens
gtcaacaaggggtcaatgt

SEQ ID NO: 6319307 - DNA, 22 bp, Homo sapiens
gtcaacaaggggtcaatgtcat

SEQ ID NO: 6319308 - DNA, 21 bp, Homo sapiens
gtcaacactatatattttatg

SEQ ID NO: 6319309 - DNA, 19 bp, Homo sapiens
gtcaacacttaagggtttt

SEQ ID NO: 6319310 - DNA, 17 bp, Homo sapiens
gtcaacagaatgaaaaa

SEQ ID NO: 6319311 - DNA, 18 bp, Homo sapiens
gtcaacagagaggggcag

SEQ ID NO: 6319312 - DNA, 18 bp, Homo sapiens
gtcaacagccataataat

SEQ ID NO: 6319313 - DNA, 14 bp, Homo sapiens
gtcaacagttttcc

SEQ ID NO: 6319314 - DNA, 22 bp, Homo sapiens
gtcaacagttttcctatgcttt

SEQ ID NO: 6319315 - DNA, 21 bp, Homo sapiens
gtcaacatatgtgattgttcc

SEQ ID NO: 6319316 - DNA, 20 bp, Homo sapiens
gtcaacatttctcatgttga

SEQ ID NO: 6319317 - DNA, 12 bp, Homo sapiens
gtcaaccagaca

SEQ ID NO: 6319318 - DNA, 17 bp, Homo sapiens
gtcaaccctcaggggaa

SEQ ID NO: 6319319 - DNA, 16 bp, Homo sapiens
gtcaacctcctggaca

SEQ ID NO: 6319320 - DNA, 12 bp, Homo sapiens
gtcaacctgaat

SEQ ID NO: 6319321 - DNA, 17 bp, Homo sapiens
gtcaacctgaattaaag

SEQ ID NO: 6319322 - DNA, 18 bp, Homo sapiens
gtcaacctgaattaaagt

SEQ ID NO: 6319323 - DNA, 20 bp, Homo sapiens
gtcaacctgaattaaagtct

SEQ ID NO: 6319324 - DNA, 19 bp, Homo sapiens
gtcaacctttgtaagaaaa

SEQ ID NO: 6319325 - DNA, 23 bp, Homo sapiens
gtcaacctttgtgtggctcctgg

SEQ ID NO: 6319326 - DNA, 16 bp, Homo sapiens
gtcaacgttgtactgt

SEQ ID NO: 6319327 - DNA, 21 bp, Homo sapiens
gtcaactaaatgagattatat

SEQ ID NO: 6319328 - DNA, 14 bp, Homo sapiens
gtcaactacacaaa

SEQ ID NO: 6319329 - DNA, 16 bp, Homo sapiens
gtcaactccaaggcaa

SEQ ID NO: 6319330 - DNA, 17 bp, Homo sapiens
gtcaactctttgttatt

SEQ ID NO: 6319331 - DNA, 23 bp, Homo sapiens
gtcaactgctgttttatgtcata

SEQ ID NO: 6319332 - DNA, 13 bp, Homo sapiens
gtcaactggagca

SEQ ID NO: 6319333 - DNA, 19 bp, Homo sapiens
gtcaactggctggccagtc

SEQ ID NO: 6319334 - DNA, 17 bp, Homo sapiens
gtcaacttcaacattta

SEQ ID NO: 6319335 - DNA, 15 bp, Homo sapiens
gtcaacttctggctc

SEQ ID NO: 6319336 - DNA, 17 bp, Homo sapiens
gtcaacttctggctcct

SEQ ID NO: 6319337 - DNA, 14 bp, Homo sapiens
gtcaagaaaggagg

SEQ ID NO: 6319338 - DNA, 18 bp, Homo sapiens
gtcaagaaaggaggggag

SEQ ID NO: 6319339 - DNA, 22 bp, Homo sapiens
gtcaagaaatgagtctgtttga

SEQ ID NO: 6319340 - DNA, 15 bp, Homo sapiens
gtcaagaagaaaaag

SEQ ID NO: 6319341 - DNA, 12 bp, Homo sapiens
gtcaagacattt

SEQ ID NO: 6319342 - DNA, 20 bp, Homo sapiens
gtcaagaggtttttctcccc

SEQ ID NO: 6319343 - DNA, 23 bp, Homo sapiens
gtcaagatgctacaatggaaacc

SEQ ID NO: 6319344 - DNA, 16 bp, Homo sapiens
gtcaagattcagctag

SEQ ID NO: 6319345 - DNA, 22 bp, Homo sapiens
gtcaagcaatggggaatacaag

SEQ ID NO: 6319346 - DNA, 13 bp, Homo sapiens
gtcaagcagaaaa

SEQ ID NO: 6319347 - DNA, 16 bp, Homo sapiens
gtcaagcatattggaa

SEQ ID NO: 6319348 - DNA, 16 bp, Homo sapiens
gtcaagcatgtatttt

SEQ ID NO: 6319349 - DNA, 18 bp, Homo sapiens
gtcaagccatttttacat

SEQ ID NO: 6319350 - DNA, 15 bp, Homo sapiens
gtcaagctgagctgg

SEQ ID NO: 6319351 - DNA, 20 bp, Homo sapiens
gtcaagctgctctgagccac

SEQ ID NO: 6319352 - DNA, 15 bp, Homo sapiens
gtcaaggaagctggg

SEQ ID NO: 6319353 - DNA, 15 bp, Homo sapiens
gtcaaggagtggctt

SEQ ID NO: 6319354 - DNA, 13 bp, Homo sapiens
gtcaaggccacct

SEQ ID NO: 6319355 - DNA, 15 bp, Homo sapiens
gtcaaggcctgctcc

SEQ ID NO: 6319356 - DNA, 18 bp, Homo sapiens
gtcaaggctgcttagaat

SEQ ID NO: 6319357 - DNA, 13 bp, Homo sapiens
gtcaaggcttaga

SEQ ID NO: 6319358 - DNA, 14 bp, Homo sapiens
gtcaaggcttagac

SEQ ID NO: 6319359 - DNA, 16 bp, Homo sapiens
gtcaaggcttagaccc

SEQ ID NO: 6319360 - DNA, 20 bp, Homo sapiens
gtcaagggggctgctctgca

SEQ ID NO: 6319361 - DNA, 15 bp, Homo sapiens
gtcaaggtggcatcc

SEQ ID NO: 6319362 - DNA, 21 bp, Homo sapiens
gtcaagtaatggaggtcccag

SEQ ID NO: 6319363 - DNA, 14 bp, Homo sapiens
gtcaagtcatgatg

SEQ ID NO: 6319364 - DNA, 20 bp, Homo sapiens
gtcaagtcctgactgggctg

SEQ ID NO: 6319365 - DNA, 14 bp, Homo sapiens
gtcaagtctctgct

SEQ ID NO: 6319366 - DNA, 17 bp, Homo sapiens
gtcaagtctctgctggc

SEQ ID NO: 6319367 - DNA, 21 bp, Homo sapiens
gtcaagtctctgctggcccag

SEQ ID NO: 6319368 - DNA, 20 bp, Homo sapiens
gtcaagtggcaaagctgttc

SEQ ID NO: 6319369 - DNA, 18 bp, Homo sapiens
gtcaagtgttaggtcaat

SEQ ID NO: 6319370 - DNA, 11 bp, Homo sapiens
gtcaagttatt

SEQ ID NO: 6319371 - DNA, 20 bp, Homo sapiens
gtcaagttattaatttcttc

SEQ ID NO: 6319372 - DNA, 12 bp, Homo sapiens
gtcaagttccca

SEQ ID NO: 6319373 - DNA, 18 bp, Homo sapiens
gtcaagttccctcctgca

SEQ ID NO: 6319374 - DNA, 17 bp, Homo sapiens
gtcaagttcctttgggt

SEQ ID NO: 6319375 - DNA, 16 bp, Homo sapiens
gtcaagttgtgcttgt

SEQ ID NO: 6319376 - DNA, 17 bp, Homo sapiens
gtcaagttgtgcttgtt

SEQ ID NO: 6319377 - DNA, 16 bp, Homo sapiens
gtcaataaaagagctg

SEQ ID NO: 6319378 - DNA, 23 bp, Homo sapiens
gtcaataaaatccatacatttgt

SEQ ID NO: 6319379 - DNA, 20 bp, Homo sapiens
gtcaataaacaacagctgaa

SEQ ID NO: 6319380 - DNA, 13 bp, Homo sapiens
gtcaataaacagc

SEQ ID NO: 6319381 - DNA, 20 bp, Homo sapiens
gtcaataaacagcttcatgc

SEQ ID NO: 6319382 - DNA, 14 bp, Homo sapiens
gtcaataaacttgt

SEQ ID NO: 6319383 - DNA, 16 bp, Homo sapiens
gtcaataaagcagagc

SEQ ID NO: 6319384 - DNA, 23 bp, Homo sapiens
gtcaataaatgacacccagacct

SEQ ID NO: 6319385 - DNA, 21 bp, Homo sapiens
gtcaataacactgtattttaa

SEQ ID NO: 6319386 - DNA, 19 bp, Homo sapiens
gtcaataattgtggagagg

SEQ ID NO: 6319387 - DNA, 20 bp, Homo sapiens
gtcaataattgtggagagga

SEQ ID NO: 6319388 - DNA, 22 bp, Homo sapiens
gtcaataattgtggagaggaga

SEQ ID NO: 6319389 - DNA, 17 bp, Homo sapiens
gtcaatacaaatagatt

SEQ ID NO: 6319390 - DNA, 22 bp, Homo sapiens
gtcaatagcattgtttttgtca

SEQ ID NO: 6319391 - DNA, 15 bp, Homo sapiens
gtcaatattaaatac

SEQ ID NO: 6319392 - DNA, 17 bp, Homo sapiens
gtcaatattaaatacag

SEQ ID NO: 6319393 - DNA, 18 bp, Homo sapiens
gtcaatattaaatacaga

SEQ ID NO: 6319394 - DNA, 18 bp, Homo sapiens
gtcaatattggtgtactg

SEQ ID NO: 6319395 - DNA, 22 bp, Homo sapiens
gtcaatcaagatgggtgattat

SEQ ID NO: 6319396 - DNA, 14 bp, Homo sapiens
gtcaatcagccttt

SEQ ID NO: 6319397 - DNA, 15 bp, Homo sapiens
gtcaatcagccttta

SEQ ID NO: 6319398 - DNA, 19 bp, Homo sapiens
gtcaatcatgtgtttaaat

SEQ ID NO: 6319399 - DNA, 16 bp, Homo sapiens
gtcaatcatttctcac

SEQ ID NO: 6319400 - DNA, 12 bp, Homo sapiens
gtcaatccaaga

SEQ ID NO: 6319401 - DNA, 22 bp, Homo sapiens
gtcaatccaagagtctgatgat

SEQ ID NO: 6319402 - DNA, 15 bp, Homo sapiens
gtcaatcctgtgggt

SEQ ID NO: 6319403 - DNA, 19 bp, Homo sapiens
gtcaatcctgtgggtgaag

SEQ ID NO: 6319404 - DNA, 17 bp, Homo sapiens
gtcaatctagttccaga

SEQ ID NO: 6319405 - DNA, 21 bp, Homo sapiens
gtcaatctagttccagagggt

SEQ ID NO: 6319406 - DNA, 21 bp, Homo sapiens
gtcaatgacacccctggcctg

SEQ ID NO: 6319407 - DNA, 20 bp, Homo sapiens
gtcaatgaggttatgagaaa

SEQ ID NO: 6319408 - DNA, 21 bp, Homo sapiens
gtcaatgaggttatgagaaaa

SEQ ID NO: 6319409 - DNA, 12 bp, Homo sapiens
gtcaatgatggt

SEQ ID NO: 6319410 - DNA, 17 bp, Homo sapiens
gtcaatggactgcacct

SEQ ID NO: 6319411 - DNA, 13 bp, Homo sapiens
gtcaatggcttgt

SEQ ID NO: 6319412 - DNA, 15 bp, Homo sapiens
gtcaatgtactagga

SEQ ID NO: 6319413 - DNA, 18 bp, Homo sapiens
gtcaatgtgaaataaaga

SEQ ID NO: 6319414 - DNA, 14 bp, Homo sapiens
gtcaatgtttgctt

SEQ ID NO: 6319415 - DNA, 20 bp, Homo sapiens
gtcaattaccagaaagataa

SEQ ID NO: 6319416 - DNA, 21 bp, Homo sapiens
gtcaattaccagaaagataac

SEQ ID NO: 6319417 - DNA, 20 bp, Homo sapiens
gtcaattcattaataaaata

SEQ ID NO: 6319418 - DNA, 20 bp, Homo sapiens
gtcaattccacccctcctcg

SEQ ID NO: 6319419 - DNA, 13 bp, Homo sapiens
gtcaattccttag

SEQ ID NO: 6319420 - DNA, 23 bp, Homo sapiens
gtcaattctgatgttactgagat

SEQ ID NO: 6319421 - DNA, 15 bp, Homo sapiens
gtcaattctgtgtgg

SEQ ID NO: 6319422 - DNA, 14 bp, Homo sapiens
gtcaattgtttaat

SEQ ID NO: 6319423 - DNA, 16 bp, Homo sapiens
gtcaattgtttaatgt

SEQ ID NO: 6319424 - DNA, 13 bp, Homo sapiens
gtcaatttataat

SEQ ID NO: 6319425 - DNA, 21 bp, Homo sapiens
gtcaattttgttatgtatatt

SEQ ID NO: 6319426 - DNA, 20 bp, Homo sapiens
gtcacaaaccagcctggggc

SEQ ID NO: 6319427 - DNA, 21 bp, Homo sapiens
gtcacaaaccagcctggggcc

SEQ ID NO: 6319428 - DNA, 14 bp, Homo sapiens
gtcacaaactgatc

SEQ ID NO: 6319429 - DNA, 20 bp, Homo sapiens
gtcacaaactgatctaaaat

SEQ ID NO: 6319430 - DNA, 11 bp, Homo sapiens
gtcacaaagag

SEQ ID NO: 6319431 - DNA, 15 bp, Homo sapiens
gtcacaaagagctga

SEQ ID NO: 6319432 - DNA, 16 bp, Homo sapiens
gtcacaaagctattta

SEQ ID NO: 6319433 - DNA, 21 bp, Homo sapiens
gtcacaaatcctaaaagaagc

SEQ ID NO: 6319434 - DNA, 17 bp, Homo sapiens
gtcacaacccttctctg

SEQ ID NO: 6319435 - DNA, 17 bp, Homo sapiens
gtcacaagtaggagaca

SEQ ID NO: 6319436 - DNA, 16 bp, Homo sapiens
gtcacaataaagtgta

SEQ ID NO: 6319437 - DNA, 15 bp, Homo sapiens
gtcacaataaagttt

SEQ ID NO: 6319438 - DNA, 13 bp, Homo sapiens
gtcacaataaatg

SEQ ID NO: 6319439 - DNA, 17 bp, Homo sapiens
gtcacaatgttctttat

SEQ ID NO: 6319440 - DNA, 21 bp, Homo sapiens
gtcacaatgttctttatatac

SEQ ID NO: 6319441 - DNA, 21 bp, Homo sapiens
gtcacacaaaggcatgctgga

SEQ ID NO: 6319442 - DNA, 19 bp, Homo sapiens
gtcacacaacactgatgtg

SEQ ID NO: 6319443 - DNA, 13 bp, Homo sapiens
gtcacacactgga

SEQ ID NO: 6319444 - DNA, 20 bp, Homo sapiens
gtcacacactggaccccact

SEQ ID NO: 6319445 - DNA, 22 bp, Homo sapiens
gtcacacactggaccccactgg

SEQ ID NO: 6319446 - DNA, 20 bp, Homo sapiens
ggattctttgacatttggtg

SEQ ID NO: 6319447 - DNA, 16 bp, Homo sapiens
ggattgaacacaggca

SEQ ID NO: 6319448 - DNA, 17 bp, Homo sapiens
ggattgaacacaggcaa

SEQ ID NO: 6319449 - DNA, 22 bp, Homo sapiens
ggattgaaggggcttctaatga

SEQ ID NO: 6319450 - DNA, 13 bp, Homo sapiens
ggattgacagtaa

SEQ ID NO: 6319451 - DNA, 14 bp, Homo sapiens
ggattgaggatgaa

SEQ ID NO: 6319452 - DNA, 13 bp, Homo sapiens
ggattgaggctta

SEQ ID NO: 6319453 - DNA, 22 bp, Homo sapiens
ggattgatcttcagggctgttt

SEQ ID NO: 6319454 - DNA, 17 bp, Homo sapiens
ggattgcacgtggcctc

SEQ ID NO: 6319455 - DNA, 13 bp, Homo sapiens
ggattgcagagtg

SEQ ID NO: 6319456 - DNA, 19 bp, Homo sapiens
ggattgcaggtgcctggct

SEQ ID NO: 6319457 - DNA, 16 bp, Homo sapiens
ggattgcatcctgctg

SEQ ID NO: 6319458 - DNA, 12 bp, Homo sapiens
ggattgccacag

SEQ ID NO: 6319459 - DNA, 15 bp, Homo sapiens
ggattgcccctggct

SEQ ID NO: 6319460 - DNA, 18 bp, Homo sapiens
ggattgcgagagatgtgt

SEQ ID NO: 6319461 - DNA, 13 bp, Homo sapiens
ggattgctgccag

SEQ ID NO: 6319462 - DNA, 16 bp, Homo sapiens
ggattgctgccagaga

SEQ ID NO: 6319463 - DNA, 22 bp, Homo sapiens
ggattgctggggccaggcccca

SEQ ID NO: 6319464 - DNA, 17 bp, Homo sapiens
ggattgcttgagcccag

SEQ ID NO: 6319465 - DNA, 23 bp, Homo sapiens
ggattggatgattgttcataata

SEQ ID NO: 6319466 - DNA, 21 bp, Homo sapiens
ggattggcaagtaacttctga

SEQ ID NO: 6319467 - DNA, 21 bp, Homo sapiens
ggattggcaggtgtgggctcc

SEQ ID NO: 6319468 - DNA, 22 bp, Homo sapiens
ggattggcaggtgtgggctccc

SEQ ID NO: 6319469 - DNA, 14 bp, Homo sapiens
ggattggccctgcc

SEQ ID NO: 6319470 - DNA, 19 bp, Homo sapiens
ggattggccctgcccctcc

SEQ ID NO: 6319471 - DNA, 22 bp, Homo sapiens
ggattggccctgcccctccccc

SEQ ID NO: 6319472 - DNA, 18 bp, Homo sapiens
ggattgggaaagaagttg

SEQ ID NO: 6319473 - DNA, 14 bp, Homo sapiens
ggattgggagggac

SEQ ID NO: 6319474 - DNA, 16 bp, Homo sapiens
ggattgggagggacag

SEQ ID NO: 6319475 - DNA, 18 bp, Homo sapiens
ggattgggagggacaggg

SEQ ID NO: 6319476 - DNA, 18 bp, Homo sapiens
ggattgggcccctgccag

SEQ ID NO: 6319477 - DNA, 19 bp, Homo sapiens
ggattggggaagactgtgg

SEQ ID NO: 6319478 - DNA, 18 bp, Homo sapiens
ggattgggggctggtgcc

SEQ ID NO: 6319479 - DNA, 19 bp, Homo sapiens
ggattggggggtgggcttt

SEQ ID NO: 6319480 - DNA, 20 bp, Homo sapiens
ggattggggggtgggctttg

SEQ ID NO: 6319481 - DNA, 16 bp, Homo sapiens
ggattggggtccctct

SEQ ID NO: 6319482 - DNA, 17 bp, Homo sapiens
ggattgggtcgtggtgg

SEQ ID NO: 6319483 - DNA, 15 bp, Homo sapiens
ggattggtaccagag

SEQ ID NO: 6319484 - DNA, 18 bp, Homo sapiens
ggattggtaccagagcct

SEQ ID NO: 6319485 - DNA, 22 bp, Homo sapiens
ggattgtaaaaaaaaatgcctt

SEQ ID NO: 6319486 - DNA, 23 bp, Homo sapiens
ggattgtaaaaaaaaatgccttt

SEQ ID NO: 6319487 - DNA, 18 bp, Homo sapiens
ggattgtacatattttta

SEQ ID NO: 6319488 - DNA, 18 bp, Homo sapiens
ggattgtacgtgggagag

SEQ ID NO: 6319489 - DNA, 18 bp, Homo sapiens
ggattgtccacaaatgtc

SEQ ID NO: 6319490 - DNA, 19 bp, Homo sapiens
ggattgtccacaaatgtcc

SEQ ID NO: 6319491 - DNA, 20 bp, Homo sapiens
ggattgtccacaaatgtcct

SEQ ID NO: 6319492 - DNA, 21 bp, Homo sapiens
ggattgtccaccttctgccaa

SEQ ID NO: 6319493 - DNA, 20 bp, Homo sapiens
ggattgtccccgacccttgc

SEQ ID NO: 6319494 - DNA, 20 bp, Homo sapiens
ggattgtccctgtgttgtcc

SEQ ID NO: 6319495 - DNA, 20 bp, Homo sapiens
ggattgtctgctgcctccaa

SEQ ID NO: 6319496 - DNA, 20 bp, Homo sapiens
ggattgtgctgatgtagtga

SEQ ID NO: 6319497 - DNA, 13 bp, Homo sapiens
ggattgtggaaaa

SEQ ID NO: 6319498 - DNA, 16 bp, Homo sapiens
ggattgttaatttcag

SEQ ID NO: 6319499 - DNA, 15 bp, Homo sapiens
ggattgttcctgtca

SEQ ID NO: 6319500 - DNA, 15 bp, Homo sapiens
ggattgttgacatga

SEQ ID NO: 6319501 - DNA, 16 bp, Homo sapiens
ggatttaaaagcctgc

SEQ ID NO: 6319502 - DNA, 19 bp, Homo sapiens
ggatttaaaagcctgctca

SEQ ID NO: 6319503 - DNA, 17 bp, Homo sapiens
ggatttaacagaaatgt

SEQ ID NO: 6319504 - DNA, 15 bp, Homo sapiens
ggatttaacagcatg

SEQ ID NO: 6319505 - DNA, 17 bp, Homo sapiens
ggatttaagcaaaggct

SEQ ID NO: 6319506 - DNA, 13 bp, Homo sapiens
ggatttaatttgt

SEQ ID NO: 6319507 - DNA, 17 bp, Homo sapiens
ggatttacgactgaaga

SEQ ID NO: 6319508 - DNA, 19 bp, Homo sapiens
ggatttacgactgaagaag

SEQ ID NO: 6319509 - DNA, 14 bp, Homo sapiens
ggatttagaagtgt

SEQ ID NO: 6319510 - DNA, 23 bp, Homo sapiens
ggatttagaagtgtcatgtttat

SEQ ID NO: 6319511 - DNA, 18 bp, Homo sapiens
ggatttataaatgctatt

SEQ ID NO: 6319512 - DNA, 19 bp, Homo sapiens
ggatttatatctatagtag

SEQ ID NO: 6319513 - DNA, 18 bp, Homo sapiens
ggatttattctcagaaca

SEQ ID NO: 6319514 - DNA, 20 bp, Homo sapiens
ggatttattttttgtaactc

SEQ ID NO: 6319515 - DNA, 13 bp, Homo sapiens
ggatttcagccat

SEQ ID NO: 6319516 - DNA, 20 bp, Homo sapiens
ggatttcatgatttcatttc

SEQ ID NO: 6319517 - DNA, 17 bp, Homo sapiens
ggatttcattgactgaa

SEQ ID NO: 6319518 - DNA, 19 bp, Homo sapiens
ggatttccctgaagctatg

SEQ ID NO: 6319519 - DNA, 23 bp, Homo sapiens
ggatttcctgctttgggaagccg

SEQ ID NO: 6319520 - DNA, 19 bp, Homo sapiens
ggatttcgaagtttgcaac

SEQ ID NO: 6319521 - DNA, 21 bp, Homo sapiens
ggatttctaacagtccttgct

SEQ ID NO: 6319522 - DNA, 22 bp, Homo sapiens
ggatttctaacagtccttgctt

SEQ ID NO: 6319523 - DNA, 15 bp, Homo sapiens
ggatttcttaaattt

SEQ ID NO: 6319524 - DNA, 17 bp, Homo sapiens
ggatttcttattttctt

SEQ ID NO: 6319525 - DNA, 14 bp, Homo sapiens
ggatttcttcctat

SEQ ID NO: 6319526 - DNA, 19 bp, Homo sapiens
ggatttcttcgctgctcta

SEQ ID NO: 6319527 - DNA, 17 bp, Homo sapiens
ggatttctttatataag

SEQ ID NO: 6319528 - DNA, 16 bp, Homo sapiens
ggatttgattcatttt

SEQ ID NO: 6319529 - DNA, 22 bp, Homo sapiens
ggatttgattcattttcctgtt

SEQ ID NO: 6319530 - DNA, 18 bp, Homo sapiens
ggatttgcctcaccttgg

SEQ ID NO: 6319531 - DNA, 18 bp, Homo sapiens
ggatttggagagaaatat

SEQ ID NO: 6319532 - DNA, 18 bp, Homo sapiens
ggatttggctcgctgtgg

SEQ ID NO: 6319533 - DNA, 22 bp, Homo sapiens
ggatttggggtgttacagtagc

SEQ ID NO: 6319534 - DNA, 15 bp, Homo sapiens
ggatttggttgttta

SEQ ID NO: 6319535 - DNA, 21 bp, Homo sapiens
ggatttgtagcataactgtag

SEQ ID NO: 6319536 - DNA, 15 bp, Homo sapiens
ggatttgttgccatg

SEQ ID NO: 6319537 - DNA, 22 bp, Homo sapiens
ggattttaaaaacatgagaaat

SEQ ID NO: 6319538 - DNA, 15 bp, Homo sapiens
ggattttaatttcag

SEQ ID NO: 6319539 - DNA, 15 bp, Homo sapiens
ggattttaccaaagc

SEQ ID NO: 6319540 - DNA, 17 bp, Homo sapiens
ggattttaccaaagcat

SEQ ID NO: 6319541 - DNA, 19 bp, Homo sapiens
ggattttagcctcttccct

SEQ ID NO: 6319542 - DNA, 18 bp, Homo sapiens
ggattttattaattataa

SEQ ID NO: 6319543 - DNA, 12 bp, Homo sapiens
ggattttcagcc

SEQ ID NO: 6319544 - DNA, 10 bp, Homo sapiens
ggattttcta

SEQ ID NO: 6319545 - DNA, 22 bp, Homo sapiens
ggattttctattgttactctgg

SEQ ID NO: 6319546 - DNA, 13 bp, Homo sapiens
ggattttcttttt

SEQ ID NO: 6319547 - DNA, 12 bp, Homo sapiens
ggatttttacca

SEQ ID NO: 6319548 - DNA, 16 bp, Homo sapiens
ggatttttagaattaa

SEQ ID NO: 6319549 - DNA, 18 bp, Homo sapiens
ggattttttatgtacaac

SEQ ID NO: 6319550 - DNA, 17 bp, Homo sapiens
ggcaaaaaaaaaaaagc

SEQ ID NO: 6319551 - DNA, 20 bp, Homo sapiens
ggcaaaaaagaacagtgttg

SEQ ID NO: 6319552 - DNA, 13 bp, Homo sapiens
ggcaaaaacaaag

SEQ ID NO: 6319553 - DNA, 22 bp, Homo sapiens
ggcaaaaagaatcccaatgttt

SEQ ID NO: 6319554 - DNA, 15 bp, Homo sapiens
ggcaaaaaggcagga

SEQ ID NO: 6319555 - DNA, 12 bp, Homo sapiens
ggcaaaaatatt

SEQ ID NO: 6319556 - DNA, 14 bp, Homo sapiens
ggcaaaaatatttt

SEQ ID NO: 6319557 - DNA, 13 bp, Homo sapiens
ggcaaaaatgcaa

SEQ ID NO: 6319558 - DNA, 12 bp, Homo sapiens
ggcaaaactcta

SEQ ID NO: 6319559 - DNA, 12 bp, Homo sapiens
ggcaaaagacat

SEQ ID NO: 6319560 - DNA, 21 bp, Homo sapiens
ggcaaaagcccattgaagaag

SEQ ID NO: 6319561 - DNA, 15 bp, Homo sapiens
ggcaaaagccttgtg

SEQ ID NO: 6319562 - DNA, 20 bp, Homo sapiens
ggcaaaagccttgtgtatat

SEQ ID NO: 6319563 - DNA, 11 bp, Homo sapiens
ggcaaaagctt

SEQ ID NO: 6319564 - DNA, 23 bp, Homo sapiens
ggcaaaaggatctttgtggccaa

SEQ ID NO: 6319565 - DNA, 18 bp, Homo sapiens
ggcaaaagggcagctgtg

SEQ ID NO: 6319566 - DNA, 21 bp, Homo sapiens
ggcaaaagtcattgctgacag

SEQ ID NO: 6319567 - DNA, 23 bp, Homo sapiens
ggcaaaatgagagggcagtgttt

SEQ ID NO: 6319568 - DNA, 18 bp, Homo sapiens
ggcaaaattgtgaagcta

SEQ ID NO: 6319569 - DNA, 22 bp, Homo sapiens
ggcaaacactttggccacagcc

SEQ ID NO: 6319570 - DNA, 11 bp, Homo sapiens
ggcaaacattt

SEQ ID NO: 6319571 - DNA, 12 bp, Homo sapiens
ggcaaacattta

SEQ ID NO: 6319572 - DNA, 21 bp, Homo sapiens
ggcaaacattttctcttagaa

SEQ ID NO: 6319573 - DNA, 13 bp, Homo sapiens
ggcaaaccaggct

SEQ ID NO: 6319574 - DNA, 19 bp, Homo sapiens
ggcaaaccaggctgcaggt

SEQ ID NO: 6319575 - DNA, 19 bp, Homo sapiens
ggcaaaccatttcaaatgg

SEQ ID NO: 6319576 - DNA, 13 bp, Homo sapiens
ggcaaacccatca

SEQ ID NO: 6319577 - DNA, 16 bp, Homo sapiens
ggcaaaccctcccaga

SEQ ID NO: 6319578 - DNA, 14 bp, Homo sapiens
ggcaaacctttccc

SEQ ID NO: 6319579 - DNA, 19 bp, Homo sapiens
ggcaaacgtttctcaaatc

SEQ ID NO: 6319580 - DNA, 20 bp, Homo sapiens
ggcaaagagacccagtcaat

SEQ ID NO: 6319581 - DNA, 15 bp, Homo sapiens
ggcaaagaggatccg

SEQ ID NO: 6319582 - DNA, 22 bp, Homo sapiens
ggcaaagaggcgaattgtagaa

SEQ ID NO: 6319583 - DNA, 22 bp, Homo sapiens
ggcaaagaggtgctgctttgct

SEQ ID NO: 6319584 - DNA, 16 bp, Homo sapiens
ggcaaagatggtggct

SEQ ID NO: 6319585 - DNA, 19 bp, Homo sapiens
ggcaaagatggtggctgtg

SEQ ID NO: 6319586 - DNA, 22 bp, Homo sapiens
ggcaaagcacgaaatgttattt

SEQ ID NO: 6319587 - DNA, 13 bp, Homo sapiens
ggcaaagcccctc

SEQ ID NO: 6319588 - DNA, 16 bp, Homo sapiens
ggcaaagcccctggaa

SEQ ID NO: 6319589 - DNA, 13 bp, Homo sapiens
ggcaaagctgctg

SEQ ID NO: 6319590 - DNA, 16 bp, Homo sapiens
ggcaaagctgctgggc

SEQ ID NO: 6319591 - DNA, 19 bp, Homo sapiens
ggcaaagctgctgggccag

SEQ ID NO: 6319592 - DNA, 13 bp, Homo sapiens
ggcaaagctgttc

SEQ ID NO: 6319593 - DNA, 15 bp, Homo sapiens
ggcaaaggcagagga

SEQ ID NO: 6319594 - DNA, 12 bp, Homo sapiens
ggcaaaggcagg

SEQ ID NO: 6319595 - DNA, 14 bp, Homo sapiens
ggcaaaggcagggc

SEQ ID NO: 6319596 - DNA, 13 bp, Homo sapiens
ggcaaaggcctgg

SEQ ID NO: 6319597 - DNA, 16 bp, Homo sapiens
ggcaaaggcctggaca

SEQ ID NO: 6319598 - DNA, 16 bp, Homo sapiens
ggcaaagggggaggag

SEQ ID NO: 6319599 - DNA, 16 bp, Homo sapiens
ggcaaaggtcaagact

SEQ ID NO: 6319600 - DNA, 20 bp, Homo sapiens
ggcaaaggtggctctccagt

SEQ ID NO: 6319601 - DNA, 19 bp, Homo sapiens
ggcaaagtacattgtaaaa

SEQ ID NO: 6319602 - DNA, 18 bp, Homo sapiens
ggcaaagtttaaatgtat

SEQ ID NO: 6319603 - DNA, 22 bp, Homo sapiens
ggcaaagtttaaatgtatttta

SEQ ID NO: 6319604 - DNA, 18 bp, Homo sapiens
ggcaaagttttacagaga

SEQ ID NO: 6319605 - DNA, 12 bp, Homo sapiens
ggcaaataaaag

SEQ ID NO: 6319606 - DNA, 13 bp, Homo sapiens
ggcaaataaaatt

SEQ ID NO: 6319607 - DNA, 17 bp, Homo sapiens
ggcaaataatggaaaaa

SEQ ID NO: 6319608 - DNA, 20 bp, Homo sapiens
ggcaaatagagagtctccaa

SEQ ID NO: 6319609 - DNA, 16 bp, Homo sapiens
ggcaaatatcttgaaa

SEQ ID NO: 6319610 - DNA, 15 bp, Homo sapiens
ggcaaatattgaagt

SEQ ID NO: 6319611 - DNA, 16 bp, Homo sapiens
ggcaaatattgaagtt

SEQ ID NO: 6319612 - DNA, 22 bp, Homo sapiens
ggcaaatattttgtcactgctg

SEQ ID NO: 6319613 - DNA, 18 bp, Homo sapiens
ggcaaatcacaacattct

SEQ ID NO: 6319614 - DNA, 14 bp, Homo sapiens
ggcaaatcaggggc

SEQ ID NO: 6319615 - DNA, 13 bp, Homo sapiens
ggcaaatccaggc

SEQ ID NO: 6319616 - DNA, 15 bp, Homo sapiens
ggcaaatctgacttt

SEQ ID NO: 6319617 - DNA, 18 bp, Homo sapiens
ggcaaatgacatgcactg

SEQ ID NO: 6319618 - DNA, 22 bp, Homo sapiens
ggcaaatgcacacacctcatgc

SEQ ID NO: 6319619 - DNA, 13 bp, Homo sapiens
ggcaaatggctga

SEQ ID NO: 6319620 - DNA, 16 bp, Homo sapiens
ggcaaatgtttattta

SEQ ID NO: 6319621 - DNA, 18 bp, Homo sapiens
ggcaaattcttttgaatt

SEQ ID NO: 6319622 - DNA, 15 bp, Homo sapiens
ggcaaatttgtgaac

SEQ ID NO: 6319623 - DNA, 17 bp, Homo sapiens
ggcaaattttaaaacat

SEQ ID NO: 6319624 - DNA, 18 bp, Homo sapiens
ggcaaatttttatttttt

SEQ ID NO: 6319625 - DNA, 16 bp, Homo sapiens
gtcacacactttggct

SEQ ID NO: 6319626 - DNA, 16 bp, Homo sapiens
gtcacacagacacaca

SEQ ID NO: 6319627 - DNA, 23 bp, Homo sapiens
gtcacacagagcgcctcacctgc

SEQ ID NO: 6319628 - DNA, 14 bp, Homo sapiens
gtcacacagggcag

SEQ ID NO: 6319629 - DNA, 21 bp, Homo sapiens
gtcacacagtattacttctgc

SEQ ID NO: 6319630 - DNA, 22 bp, Homo sapiens
gtcacacagtattacttctgct

SEQ ID NO: 6319631 - DNA, 23 bp, Homo sapiens
gtcacacccaccccctgcctggt

SEQ ID NO: 6319632 - DNA, 14 bp, Homo sapiens
gtcacacctcactg

SEQ ID NO: 6319633 - DNA, 21 bp, Homo sapiens
gtcacacctcactgtcatctg

SEQ ID NO: 6319634 - DNA, 17 bp, Homo sapiens
gtcacactaaaatttaa

SEQ ID NO: 6319635 - DNA, 13 bp, Homo sapiens
gtcacactctgtg

SEQ ID NO: 6319636 - DNA, 19 bp, Homo sapiens
gtcacactgagctgggcac

SEQ ID NO: 6319637 - DNA, 14 bp, Homo sapiens
gtcacactgctggg

SEQ ID NO: 6319638 - DNA, 15 bp, Homo sapiens
gtcacactgctggga

SEQ ID NO: 6319639 - DNA, 20 bp, Homo sapiens
gtcacagaatctccatttct

SEQ ID NO: 6319640 - DNA, 14 bp, Homo sapiens
gtcacagacccctg

SEQ ID NO: 6319641 - DNA, 20 bp, Homo sapiens
gtcacagacccctgggggag

SEQ ID NO: 6319642 - DNA, 17 bp, Homo sapiens
gtcacagacgtgaaagc

SEQ ID NO: 6319643 - DNA, 21 bp, Homo sapiens
gtcacagacgtgaaagccaga

SEQ ID NO: 6319644 - DNA, 14 bp, Homo sapiens
gtcacagaggcagt

SEQ ID NO: 6319645 - DNA, 19 bp, Homo sapiens
gtcacagaggcagtggcag

SEQ ID NO: 6319646 - DNA, 20 bp, Homo sapiens
gtcacagagtgagactccat

SEQ ID NO: 6319647 - DNA, 20 bp, Homo sapiens
gtcacagatatatttctcca

SEQ ID NO: 6319648 - DNA, 14 bp, Homo sapiens
gtcacagatgaggc

SEQ ID NO: 6319649 - DNA, 17 bp, Homo sapiens
gtcacagatgaggcccc

SEQ ID NO: 6319650 - DNA, 13 bp, Homo sapiens
gtcacagattctt

SEQ ID NO: 6319651 - DNA, 22 bp, Homo sapiens
gtcacagcagtacttgctcaat

SEQ ID NO: 6319652 - DNA, 22 bp, Homo sapiens
gtcacagcatggaggaggaggg

SEQ ID NO: 6319653 - DNA, 12 bp, Homo sapiens
gtcacagccagg

SEQ ID NO: 6319654 - DNA, 19 bp, Homo sapiens
gtcacagccgtttgaatat

SEQ ID NO: 6319655 - DNA, 14 bp, Homo sapiens
gtcacagcctcctc

SEQ ID NO: 6319656 - DNA, 21 bp, Homo sapiens
gtcacagcctcctctgtctgc

SEQ ID NO: 6319657 - DNA, 23 bp, Homo sapiens
gtcacagcctcctctgtctgccc

SEQ ID NO: 6319658 - DNA, 15 bp, Homo sapiens
gtcacagctcttgtt

SEQ ID NO: 6319659 - DNA, 17 bp, Homo sapiens
gtcacagctgcagctgg

SEQ ID NO: 6319660 - DNA, 20 bp, Homo sapiens
gtcacagctgcagctgggcc

SEQ ID NO: 6319661 - DNA, 21 bp, Homo sapiens
gtcacagctgcagctgggccc

SEQ ID NO: 6319662 - DNA, 17 bp, Homo sapiens
gtcacagctttcccagg

SEQ ID NO: 6319663 - DNA, 13 bp, Homo sapiens
gtcacaggaagaa

SEQ ID NO: 6319664 - DNA, 13 bp, Homo sapiens
gtcacaggaagta

SEQ ID NO: 6319665 - DNA, 15 bp, Homo sapiens
gtcacaggaagtaga

SEQ ID NO: 6319666 - DNA, 16 bp, Homo sapiens
gtcacaggcccagaag

SEQ ID NO: 6319667 - DNA, 22 bp, Homo sapiens
gtcacaggcccagaagggtagc

SEQ ID NO: 6319668 - DNA, 15 bp, Homo sapiens
gtcacaggcccagga

SEQ ID NO: 6319669 - DNA, 19 bp, Homo sapiens
gtcacaggcccaggaaggc

SEQ ID NO: 6319670 - DNA, 14 bp, Homo sapiens
gtcacaggctgtgc

SEQ ID NO: 6319671 - DNA, 16 bp, Homo sapiens
gtcacaggctgtgcct

SEQ ID NO: 6319672 - DNA, 12 bp, Homo sapiens
gtcacagggcag

SEQ ID NO: 6319673 - DNA, 20 bp, Homo sapiens
gtcacagggcatgccccggc

SEQ ID NO: 6319674 - DNA, 15 bp, Homo sapiens
gtcacagggccaact

SEQ ID NO: 6319675 - DNA, 16 bp, Homo sapiens
gtcacaggttttcaga

SEQ ID NO: 6319676 - DNA, 22 bp, Homo sapiens
gtcacagtaaagagtacactca

SEQ ID NO: 6319677 - DNA, 19 bp, Homo sapiens
gtcacagtcctatgtacag

SEQ ID NO: 6319678 - DNA, 16 bp, Homo sapiens
gtcacagtcttgtgaa

SEQ ID NO: 6319679 - DNA, 17 bp, Homo sapiens
gtcacagtcttgtgaac

SEQ ID NO: 6319680 - DNA, 18 bp, Homo sapiens
gtcacagtcttgtgaact

SEQ ID NO: 6319681 - DNA, 16 bp, Homo sapiens
gtcacagtttgttcag

SEQ ID NO: 6319682 - DNA, 20 bp, Homo sapiens
gtcacataaatggattaatt

SEQ ID NO: 6319683 - DNA, 14 bp, Homo sapiens
gtcacatacaatta

SEQ ID NO: 6319684 - DNA, 21 bp, Homo sapiens
gtcacatatacaaaagcaaga

SEQ ID NO: 6319685 - DNA, 13 bp, Homo sapiens
gtcacatatcaag

SEQ ID NO: 6319686 - DNA, 22 bp, Homo sapiens
gtcacatatcaagtcccgaggc

SEQ ID NO: 6319687 - DNA, 23 bp, Homo sapiens
gtcacatatcaagtcccgaggca

SEQ ID NO: 6319688 - DNA, 19 bp, Homo sapiens
gtcacatcacaatattcag

SEQ ID NO: 6319689 - DNA, 20 bp, Homo sapiens
gtcacatcacaatattcagt

SEQ ID NO: 6319690 - DNA, 17 bp, Homo sapiens
gtcacatcagtgaggag

SEQ ID NO: 6319691 - DNA, 23 bp, Homo sapiens
gtcacatcagtgaggagggatgt

SEQ ID NO: 6319692 - DNA, 15 bp, Homo sapiens
gtcacatccaactgg

SEQ ID NO: 6319693 - DNA, 22 bp, Homo sapiens
gtcacatcccaccccatcctcc

SEQ ID NO: 6319694 - DNA, 13 bp, Homo sapiens
gtcacatgaaaca

SEQ ID NO: 6319695 - DNA, 18 bp, Homo sapiens
gtcacatgacatccacat

SEQ ID NO: 6319696 - DNA, 19 bp, Homo sapiens
gtcacatgacatccacatg

SEQ ID NO: 6319697 - DNA, 20 bp, Homo sapiens
gtcacatgactctcatttta

SEQ ID NO: 6319698 - DNA, 12 bp, Homo sapiens
gtcacatgcttg

SEQ ID NO: 6319699 - DNA, 20 bp, Homo sapiens
gtcacattatttattaaaaa

SEQ ID NO: 6319700 - DNA, 13 bp, Homo sapiens
gtcacattctgct

SEQ ID NO: 6319701 - DNA, 13 bp, Homo sapiens
gtcacattgcatt

SEQ ID NO: 6319702 - DNA, 17 bp, Homo sapiens
gtcacattgcattctat

SEQ ID NO: 6319703 - DNA, 20 bp, Homo sapiens
gtcacatttgaattcttgat

SEQ ID NO: 6319704 - DNA, 22 bp, Homo sapiens
gtcaccaaatagtgtgaaatat

SEQ ID NO: 6319705 - DNA, 22 bp, Homo sapiens
gtcaccaaatcagctgctacta

SEQ ID NO: 6319706 - DNA, 16 bp, Homo sapiens
gtcaccaagaaggggc

SEQ ID NO: 6319707 - DNA, 13 bp, Homo sapiens
gtcaccaaggaaa

SEQ ID NO: 6319708 - DNA, 15 bp, Homo sapiens
gtcaccaaggcagtg

SEQ ID NO: 6319709 - DNA, 17 bp, Homo sapiens
gtcaccaaggcagtgca

SEQ ID NO: 6319710 - DNA, 19 bp, Homo sapiens
gtcaccaaggtggcttctc

SEQ ID NO: 6319711 - DNA, 22 bp, Homo sapiens
gtcaccaatgtacccaccgggc

SEQ ID NO: 6319712 - DNA, 14 bp, Homo sapiens
gtcaccaccacccc

SEQ ID NO: 6319713 - DNA, 21 bp, Homo sapiens
gtcaccaccacccgaaatgcc

SEQ ID NO: 6319714 - DNA, 22 bp, Homo sapiens
gtcaccaccacccgaaatgcca

SEQ ID NO: 6319715 - DNA, 12 bp, Homo sapiens
gtcaccacccag

SEQ ID NO: 6319716 - DNA, 17 bp, Homo sapiens
gtcaccaccctgctcat

SEQ ID NO: 6319717 - DNA, 13 bp, Homo sapiens
gtcaccacctctc

SEQ ID NO: 6319718 - DNA, 14 bp, Homo sapiens
gtcaccaccttccc

SEQ ID NO: 6319719 - DNA, 17 bp, Homo sapiens
gtcaccaccttcccagc

SEQ ID NO: 6319720 - DNA, 12 bp, Homo sapiens
gtcaccacgtgg

SEQ ID NO: 6319721 - DNA, 16 bp, Homo sapiens
gtcaccagagacttta

SEQ ID NO: 6319722 - DNA, 12 bp, Homo sapiens
gtcaccagagct

SEQ ID NO: 6319723 - DNA, 15 bp, Homo sapiens
gtcaccagcaacatc

SEQ ID NO: 6319724 - DNA, 12 bp, Homo sapiens
gtcaccagcctg

SEQ ID NO: 6319725 - DNA, 19 bp, Homo sapiens
gtcaccagctatctgtcat

SEQ ID NO: 6319726 - DNA, 14 bp, Homo sapiens
gtcaccagctcctc

SEQ ID NO: 6319727 - DNA, 13 bp, Homo sapiens
gtcaccagctgct

SEQ ID NO: 6319728 - DNA, 16 bp, Homo sapiens
gtcaccaggacttggg

SEQ ID NO: 6319729 - DNA, 23 bp, Homo sapiens
gtcaccaggacttggggtcagga

SEQ ID NO: 6319730 - DNA, 13 bp, Homo sapiens
gtcaccaggggag

SEQ ID NO: 6319731 - DNA, 16 bp, Homo sapiens
gtcaccaggggaggag

SEQ ID NO: 6319732 - DNA, 12 bp, Homo sapiens
gtcaccagtggc

SEQ ID NO: 6319733 - DNA, 14 bp, Homo sapiens
gtcaccatcctcag

SEQ ID NO: 6319734 - DNA, 16 bp, Homo sapiens
gtcaccatctcaggcc

SEQ ID NO: 6319735 - DNA, 15 bp, Homo sapiens
gtcaccatgcaaggg

SEQ ID NO: 6319736 - DNA, 15 bp, Homo sapiens
gtcaccattctgcat

SEQ ID NO: 6319737 - DNA, 16 bp, Homo sapiens
gtcaccattctgcatt

SEQ ID NO: 6319738 - DNA, 23 bp, Homo sapiens
gtcaccattggacagtctccctg

SEQ ID NO: 6319739 - DNA, 15 bp, Homo sapiens
gtcacccaaaagcac

SEQ ID NO: 6319740 - DNA, 13 bp, Homo sapiens
gtcacccaaacac

SEQ ID NO: 6319741 - DNA, 18 bp, Homo sapiens
gtcacccaacctggcata

SEQ ID NO: 6319742 - DNA, 16 bp, Homo sapiens
gtcacccactctgcac

SEQ ID NO: 6319743 - DNA, 20 bp, Homo sapiens
gtcacccagactggaatgca

SEQ ID NO: 6319744 - DNA, 17 bp, Homo sapiens
gtcacccagagcacagg

SEQ ID NO: 6319745 - DNA, 20 bp, Homo sapiens
gtcacccaggctggactgca

SEQ ID NO: 6319746 - DNA, 20 bp, Homo sapiens
gtcacccaggctggagtgcg

SEQ ID NO: 6319747 - DNA, 16 bp, Homo sapiens
gtcaccccaagtagtc

SEQ ID NO: 6319748 - DNA, 13 bp, Homo sapiens
gtcaccccagagc

SEQ ID NO: 6319749 - DNA, 17 bp, Homo sapiens
gtcaccccagagccaca

SEQ ID NO: 6319750 - DNA, 18 bp, Homo sapiens
gtcaccccagagccacac

SEQ ID NO: 6319751 - DNA, 20 bp, Homo sapiens
gtcaccccagttcccttggt

SEQ ID NO: 6319752 - DNA, 22 bp, Homo sapiens
gtcacccccacccccgggtgcc

SEQ ID NO: 6319753 - DNA, 13 bp, Homo sapiens
gtcacccccactt

SEQ ID NO: 6319754 - DNA, 15 bp, Homo sapiens
gtcacccccacttcc

SEQ ID NO: 6319755 - DNA, 19 bp, Homo sapiens
gtcacccccccaggcctcc

SEQ ID NO: 6319756 - DNA, 18 bp, Homo sapiens
gtcaccccgccagcctac

SEQ ID NO: 6319757 - DNA, 13 bp, Homo sapiens
gtcaccccggcca

SEQ ID NO: 6319758 - DNA, 15 bp, Homo sapiens
gtcacccctccctcc

SEQ ID NO: 6319759 - DNA, 13 bp, Homo sapiens
gtcacccctgtct

SEQ ID NO: 6319760 - DNA, 19 bp, Homo sapiens
gtcacccctttctgtccca

SEQ ID NO: 6319761 - DNA, 18 bp, Homo sapiens
gtcacccgactttggaat

SEQ ID NO: 6319762 - DNA, 21 bp, Homo sapiens
gtcacccgactttggaatttg

SEQ ID NO: 6319763 - DNA, 14 bp, Homo sapiens
gtcaccctagccct

SEQ ID NO: 6319764 - DNA, 20 bp, Homo sapiens
gtcaccctcctcacagacct

SEQ ID NO: 6319765 - DNA, 14 bp, Homo sapiens
gtcaccctcctgag

SEQ ID NO: 6319766 - DNA, 15 bp, Homo sapiens
gtcaccctcctgagc

SEQ ID NO: 6319767 - DNA, 18 bp, Homo sapiens
gtcaccctcctgagcctc

SEQ ID NO: 6319768 - DNA, 12 bp, Homo sapiens
gtcaccctgagg

SEQ ID NO: 6319769 - DNA, 13 bp, Homo sapiens
gtcaccctgaggt

SEQ ID NO: 6319770 - DNA, 15 bp, Homo sapiens
gtcaccctggccacc

SEQ ID NO: 6319771 - DNA, 14 bp, Homo sapiens
gtcaccctggcccc

SEQ ID NO: 6319772 - DNA, 18 bp, Homo sapiens
gtcaccctggccccaact

SEQ ID NO: 6319773 - DNA, 14 bp, Homo sapiens
gtcaccctggcctg

SEQ ID NO: 6319774 - DNA, 20 bp, Homo sapiens
gtcaccctggggctgcttag

SEQ ID NO: 6319775 - DNA, 20 bp, Homo sapiens
gtcaccctgtgaccctctca

SEQ ID NO: 6319776 - DNA, 14 bp, Homo sapiens
gtcaccctgtgggt

SEQ ID NO: 6319777 - DNA, 19 bp, Homo sapiens
gtcaccctgtgggtgtctc

SEQ ID NO: 6319778 - DNA, 23 bp, Homo sapiens
gtcaccctgtgggtgtctccctc

SEQ ID NO: 6319779 - DNA, 15 bp, Homo sapiens
gtcacccttctgggc

SEQ ID NO: 6319780 - DNA, 17 bp, Homo sapiens
gtcacccttggtagagt

SEQ ID NO: 6319781 - DNA, 20 bp, Homo sapiens
gtcacccttggtagagttta

SEQ ID NO: 6319782 - DNA, 15 bp, Homo sapiens
gtcaccgacagcggc

SEQ ID NO: 6319783 - DNA, 20 bp, Homo sapiens
gtcaccgagactcagcctct

SEQ ID NO: 6319784 - DNA, 21 bp, Homo sapiens
gtcaccgagactcagcctctg

SEQ ID NO: 6319785 - DNA, 17 bp, Homo sapiens
gtcaccgcggacgtgct

SEQ ID NO: 6319786 - DNA, 16 bp, Homo sapiens
gtcaccggatcctggg

SEQ ID NO: 6319787 - DNA, 19 bp, Homo sapiens
gtcaccggatcctgggtgg

SEQ ID NO: 6319788 - DNA, 17 bp, Homo sapiens
gtcaccggtcagtgcct

SEQ ID NO: 6319789 - DNA, 19 bp, Homo sapiens
gtcaccggtcagtgccttt

SEQ ID NO: 6319790 - DNA, 21 bp, Homo sapiens
gtcaccgtggaccttcctgcc

SEQ ID NO: 6319791 - DNA, 18 bp, Homo sapiens
gtcacctacaggactggg

SEQ ID NO: 6319792 - DNA, 22 bp, Homo sapiens
gtcacctagaacgtgcatcctt

SEQ ID NO: 6319793 - DNA, 15 bp, Homo sapiens
gtcacctagcaagct

SEQ ID NO: 6319794 - DNA, 19 bp, Homo sapiens
gtcacctagcaagctgccg

SEQ ID NO: 6319795 - DNA, 19 bp, Homo sapiens
gtcacctcactcagcacca

SEQ ID NO: 6319796 - DNA, 16 bp, Homo sapiens
gtcacctcagagacat

SEQ ID NO: 6319797 - DNA, 21 bp, Homo sapiens
gtcacctcagagacatacacc

SEQ ID NO: 6319798 - DNA, 13 bp, Homo sapiens
gtcacctccccac

SEQ ID NO: 6319799 - DNA, 15 bp, Homo sapiens
gtcacctccccacat

SEQ ID NO: 6319800 - DNA, 17 bp, Homo sapiens
gtcacctcctccactca

SEQ ID NO: 6319801 - DNA, 14 bp, Homo sapiens
gtcacctccttccc

SEQ ID NO: 6319802 - DNA, 15 bp, Homo sapiens
gtcacctccttcccc

SEQ ID NO: 6319803 - DNA, 19 bp, Homo sapiens
gtcacctccttccccagct

SEQ ID NO: 6319804 - DNA, 22 bp, Homo sapiens
gtcacctcgtctccctggtgcc

SEQ ID NO: 6319805 - DNA, 16 bp, Homo sapiens
ggcaacaaactgcaca

SEQ ID NO: 6319806 - DNA, 20 bp, Homo sapiens
ggcaacacagcgagactccg

SEQ ID NO: 6319807 - DNA, 21 bp, Homo sapiens
ggcaacacctccttgctttgc

SEQ ID NO: 6319808 - DNA, 23 bp, Homo sapiens
ggcaacactcactgcctgcagct

SEQ ID NO: 6319809 - DNA, 21 bp, Homo sapiens
ggcaacagaaaacaattgttc

SEQ ID NO: 6319810 - DNA, 20 bp, Homo sapiens
ggcaacagagcaagactccg

SEQ ID NO: 6319811 - DNA, 15 bp, Homo sapiens
ggcaacagatctgga

SEQ ID NO: 6319812 - DNA, 19 bp, Homo sapiens
ggcaacagatctggaacct

SEQ ID NO: 6319813 - DNA, 13 bp, Homo sapiens
ggcaacagatgaa

SEQ ID NO: 6319814 - DNA, 17 bp, Homo sapiens
ggcaacaggacagagtt

SEQ ID NO: 6319815 - DNA, 17 bp, Homo sapiens
ggcaacaggagagacag

SEQ ID NO: 6319816 - DNA, 12 bp, Homo sapiens
ggcaacaggatt

SEQ ID NO: 6319817 - DNA, 13 bp, Homo sapiens
ggcaacagggagc

SEQ ID NO: 6319818 - DNA, 18 bp, Homo sapiens
ggcaacagggcttctctt

SEQ ID NO: 6319819 - DNA, 16 bp, Homo sapiens
ggcaacagtgttctga

SEQ ID NO: 6319820 - DNA, 17 bp, Homo sapiens
ggcaacataataagact

SEQ ID NO: 6319821 - DNA, 16 bp, Homo sapiens
ggcaacatagtgagac

SEQ ID NO: 6319822 - DNA, 17 bp, Homo sapiens
ggcaacattacaaacaa

SEQ ID NO: 6319823 - DNA, 19 bp, Homo sapiens
ggcaacattgctggctgga

SEQ ID NO: 6319824 - DNA, 17 bp, Homo sapiens
ggcaaccaactgcccca

SEQ ID NO: 6319825 - DNA, 19 bp, Homo sapiens
ggcaaccaactgccccagg

SEQ ID NO: 6319826 - DNA, 20 bp, Homo sapiens
ggcaaccaataaaagccaga

SEQ ID NO: 6319827 - DNA, 17 bp, Homo sapiens
ggcaaccacatgtccca

SEQ ID NO: 6319828 - DNA, 17 bp, Homo sapiens
ggcaaccagccagcgtc

SEQ ID NO: 6319829 - DNA, 21 bp, Homo sapiens
ggcaaccccagttctgctcct

SEQ ID NO: 6319830 - DNA, 19 bp, Homo sapiens
ggcaacccccagcctgcta

SEQ ID NO: 6319831 - DNA, 19 bp, Homo sapiens
ggcaaccccctcggagcct

SEQ ID NO: 6319832 - DNA, 14 bp, Homo sapiens
ggcaacccctgcag

SEQ ID NO: 6319833 - DNA, 21 bp, Homo sapiens
ggcaacctcccatcccacccc

SEQ ID NO: 6319834 - DNA, 17 bp, Homo sapiens
ggcaacctgattgtaaa

SEQ ID NO: 6319835 - DNA, 18 bp, Homo sapiens
ggcaacctgcggaaggag

SEQ ID NO: 6319836 - DNA, 19 bp, Homo sapiens
ggcaacctggaggtctgaa

SEQ ID NO: 6319837 - DNA, 15 bp, Homo sapiens
ggcaaccttgtctct

SEQ ID NO: 6319838 - DNA, 16 bp, Homo sapiens
ggcaacgaagaaaaaa

SEQ ID NO: 6319839 - DNA, 17 bp, Homo sapiens
ggcaacgacggtttcaa

SEQ ID NO: 6319840 - DNA, 18 bp, Homo sapiens
ggcaacgattcacagcct

SEQ ID NO: 6319841 - DNA, 21 bp, Homo sapiens
ggcaacgtgtgaactgcaaca

SEQ ID NO: 6319842 - DNA, 16 bp, Homo sapiens
ggcaactattaataat

SEQ ID NO: 6319843 - DNA, 14 bp, Homo sapiens
ggcaactcagcagg

SEQ ID NO: 6319844 - DNA, 23 bp, Homo sapiens
ggcaactctggctccaggcagaa

SEQ ID NO: 6319845 - DNA, 23 bp, Homo sapiens
ggcaactgacattgctccaagat

SEQ ID NO: 6319846 - DNA, 19 bp, Homo sapiens
ggcaactgaggcagacagc

SEQ ID NO: 6319847 - DNA, 22 bp, Homo sapiens
ggcaactgctgatgctcatggt

SEQ ID NO: 6319848 - DNA, 21 bp, Homo sapiens
ggcaactgtattaaagaaaaa

SEQ ID NO: 6319849 - DNA, 17 bp, Homo sapiens
ggcaacttgaagaaacg

SEQ ID NO: 6319850 - DNA, 12 bp, Homo sapiens
ggcaagaaaagg

SEQ ID NO: 6319851 - DNA, 16 bp, Homo sapiens
ggcaagaacagtgggc

SEQ ID NO: 6319852 - DNA, 23 bp, Homo sapiens
ggcaagaaccagttgttttgtct

SEQ ID NO: 6319853 - DNA, 18 bp, Homo sapiens
ggcaagaagactgtattt

SEQ ID NO: 6319854 - DNA, 13 bp, Homo sapiens
ggcaagaagctgc

SEQ ID NO: 6319855 - DNA, 12 bp, Homo sapiens
ggcaagaaggca

SEQ ID NO: 6319856 - DNA, 20 bp, Homo sapiens
ggcaagaattcttatgctta

SEQ ID NO: 6319857 - DNA, 24 bp, Homo sapiens
ggcaagacagaaaagtgcctgagc

SEQ ID NO: 6319858 - DNA, 22 bp, Homo sapiens
ggcaagacctcttccctctggg

SEQ ID NO: 6319859 - DNA, 17 bp, Homo sapiens
ggcaagacttttctttg

SEQ ID NO: 6319860 - DNA, 16 bp, Homo sapiens
ggcaagagaaaataaa

SEQ ID NO: 6319861 - DNA, 19 bp, Homo sapiens
ggcaagagaaatgaggaag

SEQ ID NO: 6319862 - DNA, 20 bp, Homo sapiens
ggcaagagaaatgaggaaga

SEQ ID NO: 6319863 - DNA, 14 bp, Homo sapiens
ggcaagagactggg

SEQ ID NO: 6319864 - DNA, 16 bp, Homo sapiens
ggcaagagcagatact

SEQ ID NO: 6319865 - DNA, 22 bp, Homo sapiens
ggcaagagcccccttgacaccg

SEQ ID NO: 6319866 - DNA, 18 bp, Homo sapiens
ggcaagagctcaggagaa

SEQ ID NO: 6319867 - DNA, 21 bp, Homo sapiens
ggcaagagctcaggagaaggc

SEQ ID NO: 6319868 - DNA, 21 bp, Homo sapiens
ggcaagaggagttctaacaca

SEQ ID NO: 6319869 - DNA, 13 bp, Homo sapiens
ggcaagagggagg

SEQ ID NO: 6319870 - DNA, 16 bp, Homo sapiens
ggcaagagggagggga

SEQ ID NO: 6319871 - DNA, 20 bp, Homo sapiens
ggcaagagggaggggacaga

SEQ ID NO: 6319872 - DNA, 12 bp, Homo sapiens
ggcaagaggggt

SEQ ID NO: 6319873 - DNA, 14 bp, Homo sapiens
ggcaagaggggtgg

SEQ ID NO: 6319874 - DNA, 17 bp, Homo sapiens
ggcaagagggtgacagc

SEQ ID NO: 6319875 - DNA, 19 bp, Homo sapiens
ggcaagaggtgcctgggag

SEQ ID NO: 6319876 - DNA, 22 bp, Homo sapiens
ggcaagaggtgcctgggaggag

SEQ ID NO: 6319877 - DNA, 14 bp, Homo sapiens
ggcaagagtgagac

SEQ ID NO: 6319878 - DNA, 18 bp, Homo sapiens
ggcaagagtgagactccg

SEQ ID NO: 6319879 - DNA, 16 bp, Homo sapiens
ggcaagagtgttcttt

SEQ ID NO: 6319880 - DNA, 18 bp, Homo sapiens
ggcaagattgtgtcccat

SEQ ID NO: 6319881 - DNA, 19 bp, Homo sapiens
ggcaagcacctcctgcctc

SEQ ID NO: 6319882 - DNA, 15 bp, Homo sapiens
ggcaagcagaaaaat

SEQ ID NO: 6319883 - DNA, 20 bp, Homo sapiens
ggcaagcagaaaaattaaat

SEQ ID NO: 6319884 - DNA, 16 bp, Homo sapiens
ggcaagcagactgttc

SEQ ID NO: 6319885 - DNA, 17 bp, Homo sapiens
ggcaagcagctggtcag

SEQ ID NO: 6319886 - DNA, 15 bp, Homo sapiens
ggcaagcaggacctg

SEQ ID NO: 6319887 - DNA, 19 bp, Homo sapiens
ggcaagcaggacctggcat

SEQ ID NO: 6319888 - DNA, 14 bp, Homo sapiens
ggcaagcatgaata

SEQ ID NO: 6319889 - DNA, 16 bp, Homo sapiens
ggcaagcatgtaactt

SEQ ID NO: 6319890 - DNA, 13 bp, Homo sapiens
ggcaagccacagg

SEQ ID NO: 6319891 - DNA, 16 bp, Homo sapiens
ggcaagccacaggaag

SEQ ID NO: 6319892 - DNA, 12 bp, Homo sapiens
ggcaagccaggg

SEQ ID NO: 6319893 - DNA, 20 bp, Homo sapiens
ggcaagccagggcccagagc

SEQ ID NO: 6319894 - DNA, 15 bp, Homo sapiens
ggcaagcccctcagc

SEQ ID NO: 6319895 - DNA, 18 bp, Homo sapiens
ggcaagcccctcagccct

SEQ ID NO: 6319896 - DNA, 19 bp, Homo sapiens
ggcaagcccctcagccctt

SEQ ID NO: 6319897 - DNA, 15 bp, Homo sapiens
ggcaagcctctagtg

SEQ ID NO: 6319898 - DNA, 14 bp, Homo sapiens
ggcaagcctgagtg

SEQ ID NO: 6319899 - DNA, 19 bp, Homo sapiens
ggcaagcgaccgaggccct

SEQ ID NO: 6319900 - DNA, 19 bp, Homo sapiens
ggcaagctaggccccagag

SEQ ID NO: 6319901 - DNA, 21 bp, Homo sapiens
ggcaagctaggccccagaggc

SEQ ID NO: 6319902 - DNA, 18 bp, Homo sapiens
ggcaagctcatagcacat

SEQ ID NO: 6319903 - DNA, 19 bp, Homo sapiens
ggcaagctcatagcacatg

SEQ ID NO: 6319904 - DNA, 14 bp, Homo sapiens
ggcaagctccgcag

SEQ ID NO: 6319905 - DNA, 11 bp, Homo sapiens
ggcaagctgca

SEQ ID NO: 6319906 - DNA, 20 bp, Homo sapiens
ggcaagctgcaaaaggcctg

SEQ ID NO: 6319907 - DNA, 23 bp, Homo sapiens
ggcaagctgtgacttctccaggt

SEQ ID NO: 6319908 - DNA, 14 bp, Homo sapiens
ggcaagcttgaggc

SEQ ID NO: 6319909 - DNA, 20 bp, Homo sapiens
ggcaagcttgtgtgggccca

SEQ ID NO: 6319910 - DNA, 23 bp, Homo sapiens
ggcaagctttgctccttcagttc

SEQ ID NO: 6319911 - DNA, 19 bp, Homo sapiens
ggcaaggaaaaagaaaata

SEQ ID NO: 6319912 - DNA, 22 bp, Homo sapiens
ggcaaggaaacaggctccaaga

SEQ ID NO: 6319913 - DNA, 22 bp, Homo sapiens
ggcaaggaaaggggagaaggga

SEQ ID NO: 6319914 - DNA, 15 bp, Homo sapiens
ggcaaggaagctttg

SEQ ID NO: 6319915 - DNA, 20 bp, Homo sapiens
ggcaaggaatcctctgggag

SEQ ID NO: 6319916 - DNA, 22 bp, Homo sapiens
ggcaaggaatcctctgggagct

SEQ ID NO: 6319917 - DNA, 23 bp, Homo sapiens
ggcaaggacgcttcacaggacag

SEQ ID NO: 6319918 - DNA, 23 bp, Homo sapiens
ggcaaggagtttattacaatgta

SEQ ID NO: 6319919 - DNA, 18 bp, Homo sapiens
ggcaaggatgaaagacaa

SEQ ID NO: 6319920 - DNA, 21 bp, Homo sapiens
ggcaaggatgaaagacaaaga

SEQ ID NO: 6319921 - DNA, 12 bp, Homo sapiens
ggcaaggatggt

SEQ ID NO: 6319922 - DNA, 21 bp, Homo sapiens
ggcaaggatggtggggccccc

SEQ ID NO: 6319923 - DNA, 22 bp, Homo sapiens
ggcaaggcagctcccaggttta

SEQ ID NO: 6319924 - DNA, 12 bp, Homo sapiens
ggcaaggcaggt

SEQ ID NO: 6319925 - DNA, 22 bp, Homo sapiens
ggcaaggcaggtgcctccaggt

SEQ ID NO: 6319926 - DNA, 12 bp, Homo sapiens
ggcaaggcccag

SEQ ID NO: 6319927 - DNA, 16 bp, Homo sapiens
ggcaaggccccttcca

SEQ ID NO: 6319928 - DNA, 13 bp, Homo sapiens
ggcaaggctgtgc

SEQ ID NO: 6319929 - DNA, 14 bp, Homo sapiens
ggcaaggctgtgct

SEQ ID NO: 6319930 - DNA, 19 bp, Homo sapiens
ggcaagggccatgctgaag

SEQ ID NO: 6319931 - DNA, 16 bp, Homo sapiens
ggcaagggctcctatc

SEQ ID NO: 6319932 - DNA, 16 bp, Homo sapiens
ggcaaggggaatctgg

SEQ ID NO: 6319933 - DNA, 24 bp, Homo sapiens
ggcaaggggcagccagccctggct

SEQ ID NO: 6319934 - DNA, 16 bp, Homo sapiens
ggcaaggggccaggaa

SEQ ID NO: 6319935 - DNA, 17 bp, Homo sapiens
ggcaaggggccaggaag

SEQ ID NO: 6319936 - DNA, 22 bp, Homo sapiens
ggcaaggggcgcgcgcccccag

SEQ ID NO: 6319937 - DNA, 13 bp, Homo sapiens
ggcaagggggcgg

SEQ ID NO: 6319938 - DNA, 21 bp, Homo sapiens
ggcaaggggtgggactggtgg

SEQ ID NO: 6319939 - DNA, 16 bp, Homo sapiens
ggcaaggtctccttac

SEQ ID NO: 6319940 - DNA, 17 bp, Homo sapiens
ggcaaggtgggggagcc

SEQ ID NO: 6319941 - DNA, 18 bp, Homo sapiens
ggcaaggtgggtgattcc

SEQ ID NO: 6319942 - DNA, 23 bp, Homo sapiens
ggcaagtccctgactctctgtga

SEQ ID NO: 6319943 - DNA, 20 bp, Homo sapiens
ggcaagtcgagagggctgtt

SEQ ID NO: 6319944 - DNA, 19 bp, Homo sapiens
ggcaagtcggggcctggga

SEQ ID NO: 6319945 - DNA, 16 bp, Homo sapiens
ggcaagtgagagggga

SEQ ID NO: 6319946 - DNA, 18 bp, Homo sapiens
ggcaagtgagaggggagg

SEQ ID NO: 6319947 - DNA, 20 bp, Homo sapiens
ggcaagtgagaggggaggga

SEQ ID NO: 6319948 - DNA, 16 bp, Homo sapiens
ggcaagtggaatatct

SEQ ID NO: 6319949 - DNA, 19 bp, Homo sapiens
ggcaagtggatggcccagc

SEQ ID NO: 6319950 - DNA, 16 bp, Homo sapiens
ggcaagtgtaaaaaga

SEQ ID NO: 6319951 - DNA, 17 bp, Homo sapiens
ggcaataaaagcccagg

SEQ ID NO: 6319952 - DNA, 20 bp, Homo sapiens
ggcaataaaagcccaggagc

SEQ ID NO: 6319953 - DNA, 22 bp, Homo sapiens
ggcaataaaagcccaggagccc

SEQ ID NO: 6319954 - DNA, 10 bp, Homo sapiens
ggcaataaac

SEQ ID NO: 6319955 - DNA, 12 bp, Homo sapiens
ggcaataaactc

SEQ ID NO: 6319956 - DNA, 20 bp, Homo sapiens
ggcaataaataaagcttggg

SEQ ID NO: 6319957 - DNA, 21 bp, Homo sapiens
ggcaataaatgtcccaaataa

SEQ ID NO: 6319958 - DNA, 15 bp, Homo sapiens
ggcaataaattttga

SEQ ID NO: 6319959 - DNA, 20 bp, Homo sapiens
ggcaataagatacacagctc

SEQ ID NO: 6319960 - DNA, 23 bp, Homo sapiens
ggcaatagcgctcccttttcacc

SEQ ID NO: 6319961 - DNA, 20 bp, Homo sapiens
ggcaatagtgttgaggaggg

SEQ ID NO: 6319962 - DNA, 22 bp, Homo sapiens
ggcaatagtgttgaggagggga

SEQ ID NO: 6319963 - DNA, 21 bp, Homo sapiens
ggcaatataaccaatgtttaa

SEQ ID NO: 6319964 - DNA, 20 bp, Homo sapiens
ggcaatatcatattctaaaa

SEQ ID NO: 6319965 - DNA, 15 bp, Homo sapiens
ggcaatattctctgt

SEQ ID NO: 6319966 - DNA, 17 bp, Homo sapiens
ggcaatatttgttctgg

SEQ ID NO: 6319967 - DNA, 15 bp, Homo sapiens
ggcaatcaatgttca

SEQ ID NO: 6319968 - DNA, 15 bp, Homo sapiens
ggcaatcccaccaaa

SEQ ID NO: 6319969 - DNA, 19 bp, Homo sapiens
ggcaatcccaccaaatcat

SEQ ID NO: 6319970 - DNA, 23 bp, Homo sapiens
ggcaatcctaagcaaaaagaaca

SEQ ID NO: 6319971 - DNA, 18 bp, Homo sapiens
ggcaatcgttctgctggc

SEQ ID NO: 6319972 - DNA, 13 bp, Homo sapiens
ggcaatctctctc

SEQ ID NO: 6319973 - DNA, 14 bp, Homo sapiens
ggcaatctctctct

SEQ ID NO: 6319974 - DNA, 15 bp, Homo sapiens
ggcaatcttgccctt

SEQ ID NO: 6319975 - DNA, 13 bp, Homo sapiens
ggcaatgaaaatt

SEQ ID NO: 6319976 - DNA, 15 bp, Homo sapiens
ggcaatgaaaatttt

SEQ ID NO: 6319977 - DNA, 19 bp, Homo sapiens
ggcaatgactgcgcagagt

SEQ ID NO: 6319978 - DNA, 18 bp, Homo sapiens
ggcaatgagtgtgccaga

SEQ ID NO: 6319979 - DNA, 15 bp, Homo sapiens
ggcaatgatggcaat

SEQ ID NO: 6319980 - DNA, 18 bp, Homo sapiens
ggcaatgccacagccctg

SEQ ID NO: 6319981 - DNA, 17 bp, Homo sapiens
ggcaatgccatcagccc

SEQ ID NO: 6319982 - DNA, 24 bp, Homo sapiens
gtcacctctcagctgctggatgac

SEQ ID NO: 6319983 - DNA, 20 bp, Homo sapiens
gtcacctctccctcctcagc

SEQ ID NO: 6319984 - DNA, 17 bp, Homo sapiens
gtcacctctctcagagc

SEQ ID NO: 6319985 - DNA, 22 bp, Homo sapiens
gtcacctcttccgactctttct

SEQ ID NO: 6319986 - DNA, 19 bp, Homo sapiens
gtcacctgcaagccccagg

SEQ ID NO: 6319987 - DNA, 23 bp, Homo sapiens
gtcacctgcaagccccagggcct

SEQ ID NO: 6319988 - DNA, 21 bp, Homo sapiens
gtcacctgcacagggccctct

SEQ ID NO: 6319989 - DNA, 17 bp, Homo sapiens
gtcacctgccccagcac

SEQ ID NO: 6319990 - DNA, 17 bp, Homo sapiens
gtcacctgccgccctgt

SEQ ID NO: 6319991 - DNA, 20 bp, Homo sapiens
gtcacctgccgccctgtggg

SEQ ID NO: 6319992 - DNA, 21 bp, Homo sapiens
gtcacctgctcacagggatgc

SEQ ID NO: 6319993 - DNA, 23 bp, Homo sapiens
gtcacctgctcacagggatgctg

SEQ ID NO: 6319994 - DNA, 24 bp, Homo sapiens
gtcacctgctcacagggatgctgg

SEQ ID NO: 6319995 - DNA, 13 bp, Homo sapiens
gtcacctgctcca

SEQ ID NO: 6319996 - DNA, 14 bp, Homo sapiens
gtcacctgctccag

SEQ ID NO: 6319997 - DNA, 16 bp, Homo sapiens
gtcacctgctccagaa

SEQ ID NO: 6319998 - DNA, 23 bp, Homo sapiens
gtcacctgctggttgttgccagg

SEQ ID NO: 6319999 - DNA, 16 bp, Homo sapiens
gtcacctgcttctctg

SEQ ID NO: 6320000 - DNA, 19 bp, Homo sapiens
gtcacctgtgcagggccct

SEQ ID NO: 6320001 - DNA, 21 bp, Homo sapiens
gtcacctgtgcagggccctct

SEQ ID NO: 6320002 - DNA, 22 bp, Homo sapiens
gtcacctgtgcagggccctctg

SEQ ID NO: 6320003 - DNA, 13 bp, Homo sapiens
gtcacctgtgcta

SEQ ID NO: 6320004 - DNA, 21 bp, Homo sapiens
gtcacctgttggctacacaga

SEQ ID NO: 6320005 - DNA, 13 bp, Homo sapiens
gtcaccttcctgg

SEQ ID NO: 6320006 - DNA, 15 bp, Homo sapiens
gtcaccttcctgggc

SEQ ID NO: 6320007 - DNA, 24 bp, Homo sapiens
gtcaccttcctgggcagcccagag

SEQ ID NO: 6320008 - DNA, 14 bp, Homo sapiens
gtcaccttcgagta

SEQ ID NO: 6320009 - DNA, 11 bp, Homo sapiens
gtcaccttctg

SEQ ID NO: 6320010 - DNA, 17 bp, Homo sapiens
gtcacctttctgggctt

SEQ ID NO: 6320011 - DNA, 22 bp, Homo sapiens
gtcacctttctgggctttctcc

SEQ ID NO: 6320012 - DNA, 22 bp, Homo sapiens
gtcacgaggtccagacccactc

SEQ ID NO: 6320013 - DNA, 15 bp, Homo sapiens
gtcacgatcacaggc

SEQ ID NO: 6320014 - DNA, 17 bp, Homo sapiens
gtcacgatcacaggcct

SEQ ID NO: 6320015 - DNA, 16 bp, Homo sapiens
gtcacgcagccaccag

SEQ ID NO: 6320016 - DNA, 19 bp, Homo sapiens
gtcacgcggcagcttcagg

SEQ ID NO: 6320017 - DNA, 18 bp, Homo sapiens
gtcacgctcatgtcctgt

SEQ ID NO: 6320018 - DNA, 23 bp, Homo sapiens
gtcacgctccctgacttctcccc

SEQ ID NO: 6320019 - DNA, 18 bp, Homo sapiens
gtcacgctggggctctct

SEQ ID NO: 6320020 - DNA, 19 bp, Homo sapiens
gtcacgctggggctctctg

SEQ ID NO: 6320021 - DNA, 20 bp, Homo sapiens
gtcacgctggggctctctga

SEQ ID NO: 6320022 - DNA, 21 bp, Homo sapiens
gtcacgctggggctctctgag

SEQ ID NO: 6320023 - DNA, 22 bp, Homo sapiens
gtcacgcttgcctggtcaccct

SEQ ID NO: 6320024 - DNA, 13 bp, Homo sapiens
gtcacgtcttgaa

SEQ ID NO: 6320025 - DNA, 17 bp, Homo sapiens
gtcacgtgaccctgtgc

SEQ ID NO: 6320026 - DNA, 18 bp, Homo sapiens
gtcacgtgaggcccctgt

SEQ ID NO: 6320027 - DNA, 14 bp, Homo sapiens
gtcacgtgtaggag

SEQ ID NO: 6320028 - DNA, 19 bp, Homo sapiens
gtcacgtttggtgcttctc

SEQ ID NO: 6320029 - DNA, 20 bp, Homo sapiens
gtcactaaatggcagtgaga

SEQ ID NO: 6320030 - DNA, 19 bp, Homo sapiens
gtcactaaccaacaaggtt

SEQ ID NO: 6320031 - DNA, 14 bp, Homo sapiens
gtcactacctggct

SEQ ID NO: 6320032 - DNA, 14 bp, Homo sapiens
gtcactactcacag

SEQ ID NO: 6320033 - DNA, 15 bp, Homo sapiens
gtcactactggtctg

SEQ ID NO: 6320034 - DNA, 14 bp, Homo sapiens
gtcactagcagctg

SEQ ID NO: 6320035 - DNA, 16 bp, Homo sapiens
gtcactatgctatttc

SEQ ID NO: 6320036 - DNA, 18 bp, Homo sapiens
gtcactatgctatttctg

SEQ ID NO: 6320037 - DNA, 19 bp, Homo sapiens
gtcactatgctatttctgg

SEQ ID NO: 6320038 - DNA, 19 bp, Homo sapiens
gtcactatgggatgagaaa

SEQ ID NO: 6320039 - DNA, 20 bp, Homo sapiens
gtcactatgggatgagaaaa

SEQ ID NO: 6320040 - DNA, 23 bp, Homo sapiens
gtcactcagatggaaccgcagga

SEQ ID NO: 6320041 - DNA, 16 bp, Homo sapiens
gtcactcagctgagaa

SEQ ID NO: 6320042 - DNA, 20 bp, Homo sapiens
gtcactcaggcctctgcaga

SEQ ID NO: 6320043 - DNA, 22 bp, Homo sapiens
gtcactcaggcctctgcagaag

SEQ ID NO: 6320044 - DNA, 14 bp, Homo sapiens
gtcactcattgctg

SEQ ID NO: 6320045 - DNA, 24 bp, Homo sapiens
gtcactcattgctgagcctctgct

SEQ ID NO: 6320046 - DNA, 19 bp, Homo sapiens
gtcactccagtgctcagct

SEQ ID NO: 6320047 - DNA, 20 bp, Homo sapiens
gtcactccagtgctcagctg

SEQ ID NO: 6320048 - DNA, 14 bp, Homo sapiens
gtcactcccaagcc

SEQ ID NO: 6320049 - DNA, 11 bp, Homo sapiens
gtcactcccag

SEQ ID NO: 6320050 - DNA, 16 bp, Homo sapiens
gtcactcctctctagg

SEQ ID NO: 6320051 - DNA, 13 bp, Homo sapiens
gtcactcctgggg

SEQ ID NO: 6320052 - DNA, 17 bp, Homo sapiens
gtcactcgtaggggatg

SEQ ID NO: 6320053 - DNA, 13 bp, Homo sapiens
gtcactctccagc

SEQ ID NO: 6320054 - DNA, 15 bp, Homo sapiens
gtcactctgccctct

SEQ ID NO: 6320055 - DNA, 22 bp, Homo sapiens
gtcactctgccctctgctgctg

SEQ ID NO: 6320056 - DNA, 12 bp, Homo sapiens
gtcactctgcct

SEQ ID NO: 6320057 - DNA, 14 bp, Homo sapiens
gtcactctgcctct

SEQ ID NO: 6320058 - DNA, 15 bp, Homo sapiens
gtcactctgcctcta

SEQ ID NO: 6320059 - DNA, 12 bp, Homo sapiens
gtcactctggca

SEQ ID NO: 6320060 - DNA, 22 bp, Homo sapiens
gtcactctggcagctcagagag

SEQ ID NO: 6320061 - DNA, 23 bp, Homo sapiens
gtcactctggcagctcagagagg

SEQ ID NO: 6320062 - DNA, 17 bp, Homo sapiens
gtcactctgggcctggg

SEQ ID NO: 6320063 - DNA, 13 bp, Homo sapiens
gtcactgaacaaa

SEQ ID NO: 6320064 - DNA, 15 bp, Homo sapiens
gtcactgaacaaaac

SEQ ID NO: 6320065 - DNA, 23 bp, Homo sapiens
gtcactgaaccactgcttctctt

SEQ ID NO: 6320066 - DNA, 16 bp, Homo sapiens
gtcactgacacaaagg

SEQ ID NO: 6320067 - DNA, 18 bp, Homo sapiens
gtcactgcatttgcctgc

SEQ ID NO: 6320068 - DNA, 22 bp, Homo sapiens
gtcactgcatttgcctgcttct

SEQ ID NO: 6320069 - DNA, 12 bp, Homo sapiens
gtcactgcccac

SEQ ID NO: 6320070 - DNA, 16 bp, Homo sapiens
gtcactgcccaccaaa

SEQ ID NO: 6320071 - DNA, 15 bp, Homo sapiens
gtcactgcccacctg

SEQ ID NO: 6320072 - DNA, 18 bp, Homo sapiens
gtcactgcccacctgcca

SEQ ID NO: 6320073 - DNA, 21 bp, Homo sapiens
gtcactgcccacctgccaggc

SEQ ID NO: 6320074 - DNA, 21 bp, Homo sapiens
gtcactgccgacatccctccc

SEQ ID NO: 6320075 - DNA, 23 bp, Homo sapiens
gtcactgcctctccctggccctc

SEQ ID NO: 6320076 - DNA, 18 bp, Homo sapiens
gtcactgcctgcagaggt

SEQ ID NO: 6320077 - DNA, 23 bp, Homo sapiens
gtcactgcctgcagaggtctgtg

SEQ ID NO: 6320078 - DNA, 14 bp, Homo sapiens
gtcactgcctggag

SEQ ID NO: 6320079 - DNA, 17 bp, Homo sapiens
gtcactgctgtaaagca

SEQ ID NO: 6320080 - DNA, 15 bp, Homo sapiens
gtcactggaaagggg

SEQ ID NO: 6320081 - DNA, 19 bp, Homo sapiens
gtcactggcagcctgcacc

SEQ ID NO: 6320082 - DNA, 18 bp, Homo sapiens
gtcactggcctctcccca

SEQ ID NO: 6320083 - DNA, 15 bp, Homo sapiens
gtcactggctctcca

SEQ ID NO: 6320084 - DNA, 14 bp, Homo sapiens
gtcactggctgcct

SEQ ID NO: 6320085 - DNA, 13 bp, Homo sapiens
gtcactggctggc

SEQ ID NO: 6320086 - DNA, 19 bp, Homo sapiens
gtcactggctggctcctag

SEQ ID NO: 6320087 - DNA, 16 bp, Homo sapiens
gtcactggggctgcgc

SEQ ID NO: 6320088 - DNA, 22 bp, Homo sapiens
gtcactgggggacactgtggca

SEQ ID NO: 6320089 - DNA, 14 bp, Homo sapiens
gtcactggtcaggg

SEQ ID NO: 6320090 - DNA, 12 bp, Homo sapiens
gtcactgtacag

SEQ ID NO: 6320091 - DNA, 14 bp, Homo sapiens
gtcactgtcactgc

SEQ ID NO: 6320092 - DNA, 17 bp, Homo sapiens
gtcactgtccctcaaat

SEQ ID NO: 6320093 - DNA, 14 bp, Homo sapiens
gtcactgtccctcc

SEQ ID NO: 6320094 - DNA, 18 bp, Homo sapiens
gtcactgtccctcctggt

SEQ ID NO: 6320095 - DNA, 22 bp, Homo sapiens
gtcactgtctcaactactcagc

SEQ ID NO: 6320096 - DNA, 17 bp, Homo sapiens
gtcactgtgcactgccc

SEQ ID NO: 6320097 - DNA, 16 bp, Homo sapiens
gtcactgttataaatt

SEQ ID NO: 6320098 - DNA, 17 bp, Homo sapiens
gtcactgttataaattt

SEQ ID NO: 6320099 - DNA, 22 bp, Homo sapiens
gtcactgttataaattttgtac

SEQ ID NO: 6320100 - DNA, 19 bp, Homo sapiens
gtcactgtttattttttta

SEQ ID NO: 6320101 - DNA, 16 bp, Homo sapiens
gtcactgtttctctgc

SEQ ID NO: 6320102 - DNA, 17 bp, Homo sapiens
gtcacttatcctgacac

SEQ ID NO: 6320103 - DNA, 19 bp, Homo sapiens
gtcacttcaaacatgccct

SEQ ID NO: 6320104 - DNA, 17 bp, Homo sapiens
gtcacttcatttttatt

SEQ ID NO: 6320105 - DNA, 13 bp, Homo sapiens
gtcacttctccat

SEQ ID NO: 6320106 - DNA, 17 bp, Homo sapiens
gtcacttctcctgctgc

SEQ ID NO: 6320107 - DNA, 22 bp, Homo sapiens
gtcacttctcctgctgctcctg

SEQ ID NO: 6320108 - DNA, 17 bp, Homo sapiens
gtcacttcttcacctct

SEQ ID NO: 6320109 - DNA, 17 bp, Homo sapiens
gtcacttgactcttgaa

SEQ ID NO: 6320110 - DNA, 23 bp, Homo sapiens
gtcacttgatgtgccattttaaa

SEQ ID NO: 6320111 - DNA, 11 bp, Homo sapiens
gtcacttgcca

SEQ ID NO: 6320112 - DNA, 21 bp, Homo sapiens
gtcacttgctgctttttctgc

SEQ ID NO: 6320113 - DNA, 20 bp, Homo sapiens
gtcacttgctggctgtgaaa

SEQ ID NO: 6320114 - DNA, 22 bp, Homo sapiens
gtcacttgggaagaggacttcg

SEQ ID NO: 6320115 - DNA, 23 bp, Homo sapiens
gtcacttgggagctgctgggcta

SEQ ID NO: 6320116 - DNA, 22 bp, Homo sapiens
gtcacttgtaggtttctctgcc

SEQ ID NO: 6320117 - DNA, 24 bp, Homo sapiens
gtcacttgtgctttgctcttgtcc

SEQ ID NO: 6320118 - DNA, 14 bp, Homo sapiens
gtcactttctctct

SEQ ID NO: 6320119 - DNA, 17 bp, Homo sapiens
gtcactttgctctgggt

SEQ ID NO: 6320120 - DNA, 23 bp, Homo sapiens
gtcactttgctctgggtggaagt

SEQ ID NO: 6320121 - DNA, 13 bp, Homo sapiens
gtcacttttcctt

SEQ ID NO: 6320122 - DNA, 14 bp, Homo sapiens
gtcacttttccttt

SEQ ID NO: 6320123 - DNA, 17 bp, Homo sapiens
gtcacttttccttttct

SEQ ID NO: 6320124 - DNA, 19 bp, Homo sapiens
gtcacttttgttcccaggt

SEQ ID NO: 6320125 - DNA, 14 bp, Homo sapiens
gtcactttttatgc

SEQ ID NO: 6320126 - DNA, 15 bp, Homo sapiens
gtcactttttcccct

SEQ ID NO: 6320127 - DNA, 18 bp, Homo sapiens
gtcactttttcccctgca

SEQ ID NO: 6320128 - DNA, 20 bp, Homo sapiens
gtcactttttcccctgcaat

SEQ ID NO: 6320129 - DNA, 19 bp, Homo sapiens
gtcacttttttcctgtcaa

SEQ ID NO: 6320130 - DNA, 17 bp, Homo sapiens
gtcacttttttctgcct

SEQ ID NO: 6320131 - DNA, 22 bp, Homo sapiens
gtcactttttttttttttcccc

SEQ ID NO: 6320132 - DNA, 15 bp, Homo sapiens
gtcagaaaaaatatg

SEQ ID NO: 6320133 - DNA, 21 bp, Homo sapiens
gtcagaaaataacagatgctg

SEQ ID NO: 6320134 - DNA, 19 bp, Homo sapiens
gtcagaaacaatgacatcc

SEQ ID NO: 6320135 - DNA, 15 bp, Homo sapiens
gtcagaaacaggacc

SEQ ID NO: 6320136 - DNA, 19 bp, Homo sapiens
gtcagaaaccaaagtgacc

SEQ ID NO: 6320137 - DNA, 13 bp, Homo sapiens
gtcagaaagtgta

SEQ ID NO: 6320138 - DNA, 14 bp, Homo sapiens
gtcagaaatgattc

SEQ ID NO: 6320139 - DNA, 18 bp, Homo sapiens
gtcagaactgcagggcct

SEQ ID NO: 6320140 - DNA, 19 bp, Homo sapiens
gtcagaagaagtgggagca

SEQ ID NO: 6320141 - DNA, 20 bp, Homo sapiens
gtcagaagaagtgggagcag

SEQ ID NO: 6320142 - DNA, 14 bp, Homo sapiens
gtcagaagacacta

SEQ ID NO: 6320143 - DNA, 15 bp, Homo sapiens
gtcagaagacactaa

SEQ ID NO: 6320144 - DNA, 17 bp, Homo sapiens
gtcagaagcaggttctt

SEQ ID NO: 6320145 - DNA, 18 bp, Homo sapiens
gtcagaagcctccaagcc

SEQ ID NO: 6320146 - DNA, 21 bp, Homo sapiens
gtcagaagggggttgtggcaa

SEQ ID NO: 6320147 - DNA, 20 bp, Homo sapiens
gtcagaagtcaataggccta

SEQ ID NO: 6320148 - DNA, 20 bp, Homo sapiens
gtcagaataaagaacattct

SEQ ID NO: 6320149 - DNA, 20 bp, Homo sapiens
gtcagaataataagaggtgc

SEQ ID NO: 6320150 - DNA, 13 bp, Homo sapiens
gtcagaatcagaa

SEQ ID NO: 6320151 - DNA, 18 bp, Homo sapiens
gtcagaatcagaatcatg

SEQ ID NO: 6320152 - DNA, 23 bp, Homo sapiens
gtcagaatcagaatcatggagaa

SEQ ID NO: 6320153 - DNA, 19 bp, Homo sapiens
gtcagaatcatgctgttct

SEQ ID NO: 6320154 - DNA, 19 bp, Homo sapiens
gtcagaattagctgcttct

SEQ ID NO: 6320155 - DNA, 15 bp, Homo sapiens
gtcagaattcttcat

SEQ ID NO: 6320156 - DNA, 13 bp, Homo sapiens
gtcagacacagat

SEQ ID NO: 6320157 - DNA, 18 bp, Homo sapiens
gtcagacagatgtcagct

SEQ ID NO: 6320158 - DNA, 15 bp, Homo sapiens
gtcagacataaagcc

SEQ ID NO: 6320159 - DNA, 19 bp, Homo sapiens
ggcaatgccatcagcccct

SEQ ID NO: 6320160 - DNA, 22 bp, Homo sapiens
ggcaatgccatcagcccctggg

SEQ ID NO: 6320161 - DNA, 21 bp, Homo sapiens
ggcaatgccctgcggctctgg

SEQ ID NO: 6320162 - DNA, 22 bp, Homo sapiens
ggcaatgccctgcggctctgga

SEQ ID NO: 6320163 - DNA, 18 bp, Homo sapiens
ggcaatgcttaaactaaa

SEQ ID NO: 6320164 - DNA, 13 bp, Homo sapiens
ggcaatggggaga

SEQ ID NO: 6320165 - DNA, 17 bp, Homo sapiens
ggcaatggtagtttctg

SEQ ID NO: 6320166 - DNA, 22 bp, Homo sapiens
ggcaatgttaatttagtggaaa

SEQ ID NO: 6320167 - DNA, 16 bp, Homo sapiens
ggcaatgttttgcttt

SEQ ID NO: 6320168 - DNA, 17 bp, Homo sapiens
ggcaattaattccttca

SEQ ID NO: 6320169 - DNA, 14 bp, Homo sapiens
ggcaattagagaaa

SEQ ID NO: 6320170 - DNA, 19 bp, Homo sapiens
ggcaattccaatatttctg

SEQ ID NO: 6320171 - DNA, 19 bp, Homo sapiens
ggcaattctcctgcctttg

SEQ ID NO: 6320172 - DNA, 16 bp, Homo sapiens
ggcaattctggaagct

SEQ ID NO: 6320173 - DNA, 13 bp, Homo sapiens
ggcaattggaaca

SEQ ID NO: 6320174 - DNA, 16 bp, Homo sapiens
ggcaattggggcggag

SEQ ID NO: 6320175 - DNA, 18 bp, Homo sapiens
ggcaatttcctggccctc

SEQ ID NO: 6320176 - DNA, 11 bp, Homo sapiens
ggcaattttgt

SEQ ID NO: 6320177 - DNA, 14 bp, Homo sapiens
ggcaattttgtaac

SEQ ID NO: 6320178 - DNA, 19 bp, Homo sapiens
ggcacaaaagacagctggc

SEQ ID NO: 6320179 - DNA, 23 bp, Homo sapiens
ggcacaaaattctagaagcagaa

SEQ ID NO: 6320180 - DNA, 13 bp, Homo sapiens
ggcacaaacagaa

SEQ ID NO: 6320181 - DNA, 19 bp, Homo sapiens
ggcacaaagggcaggcctg

SEQ ID NO: 6320182 - DNA, 20 bp, Homo sapiens
ggcacaacacatcaggaaag

SEQ ID NO: 6320183 - DNA, 23 bp, Homo sapiens
ggcacaacgctctaccctgcagc

SEQ ID NO: 6320184 - DNA, 24 bp, Homo sapiens
ggcacaacgctctaccctgcagct

SEQ ID NO: 6320185 - DNA, 18 bp, Homo sapiens
ggcacaactggaagcttt

SEQ ID NO: 6320186 - DNA, 21 bp, Homo sapiens
ggcacaacttcagcaggggat

SEQ ID NO: 6320187 - DNA, 13 bp, Homo sapiens
ggcacaagactga

SEQ ID NO: 6320188 - DNA, 23 bp, Homo sapiens
ggcacaagctcaggtcctgctgc

SEQ ID NO: 6320189 - DNA, 16 bp, Homo sapiens
ggcacaagctccctgg

SEQ ID NO: 6320190 - DNA, 19 bp, Homo sapiens
ggcacaagctccctggtga

SEQ ID NO: 6320191 - DNA, 11 bp, Homo sapiens
ggcacaataaa

SEQ ID NO: 6320192 - DNA, 19 bp, Homo sapiens
ggcacaatctcacacagct

SEQ ID NO: 6320193 - DNA, 17 bp, Homo sapiens
ggcacaatctcagctca

SEQ ID NO: 6320194 - DNA, 22 bp, Homo sapiens
ggcacaatggctaattcccaga

SEQ ID NO: 6320195 - DNA, 17 bp, Homo sapiens
ggcacacaaggggccct

SEQ ID NO: 6320196 - DNA, 18 bp, Homo sapiens
ggcacacacgccttcatg

SEQ ID NO: 6320197 - DNA, 13 bp, Homo sapiens
ggcacacagagat

SEQ ID NO: 6320198 - DNA, 16 bp, Homo sapiens
ggcacacagcagcccc

SEQ ID NO: 6320199 - DNA, 23 bp, Homo sapiens
ggcacaccacccgaggggggccc

SEQ ID NO: 6320200 - DNA, 13 bp, Homo sapiens
ggcacaccactgc

SEQ ID NO: 6320201 - DNA, 18 bp, Homo sapiens
ggcacaccactgccctgc

SEQ ID NO: 6320202 - DNA, 19 bp, Homo sapiens
ggcacaccactgccctgcc

SEQ ID NO: 6320203 - DNA, 23 bp, Homo sapiens
ggcacaccactgccctgcctgcc

SEQ ID NO: 6320204 - DNA, 15 bp, Homo sapiens
ggcacaccgccatcc

SEQ ID NO: 6320205 - DNA, 17 bp, Homo sapiens
ggcacacctcctcccac

SEQ ID NO: 6320206 - DNA, 13 bp, Homo sapiens
ggcacaccttgca

SEQ ID NO: 6320207 - DNA, 21 bp, Homo sapiens
ggcacacgcacaaacacacac

SEQ ID NO: 6320208 - DNA, 19 bp, Homo sapiens
ggcacacgcctcccactgg

SEQ ID NO: 6320209 - DNA, 20 bp, Homo sapiens
ggcacacgctgctctgcccc

SEQ ID NO: 6320210 - DNA, 21 bp, Homo sapiens
ggcacacgctgctctgcccca

SEQ ID NO: 6320211 - DNA, 22 bp, Homo sapiens
ggcacacgctgctctgccccag

SEQ ID NO: 6320212 - DNA, 17 bp, Homo sapiens
ggcacactacagagcag

SEQ ID NO: 6320213 - DNA, 17 bp, Homo sapiens
ggcacactccctctcct

SEQ ID NO: 6320214 - DNA, 19 bp, Homo sapiens
ggcacagaaaatggaagac

SEQ ID NO: 6320215 - DNA, 21 bp, Homo sapiens
ggcacagaaacacaatatttt

SEQ ID NO: 6320216 - DNA, 16 bp, Homo sapiens
ggcacagaaacctcta

SEQ ID NO: 6320217 - DNA, 14 bp, Homo sapiens
ggcacagaccaggc

SEQ ID NO: 6320218 - DNA, 24 bp, Homo sapiens
ggcacagacccccgtcctgtcccc

SEQ ID NO: 6320219 - DNA, 18 bp, Homo sapiens
ggcacagacctctcccac

SEQ ID NO: 6320220 - DNA, 16 bp, Homo sapiens
ggcacagattgaagaa

SEQ ID NO: 6320221 - DNA, 20 bp, Homo sapiens
ggcacagcaactctaagact

SEQ ID NO: 6320222 - DNA, 15 bp, Homo sapiens
ggcacagcagctgca

SEQ ID NO: 6320223 - DNA, 16 bp, Homo sapiens
ggcacagcaggggagc

SEQ ID NO: 6320224 - DNA, 20 bp, Homo sapiens
ggcacagcaggggagccctg

SEQ ID NO: 6320225 - DNA, 22 bp, Homo sapiens
ggcacagcatctgtagtcagcc

SEQ ID NO: 6320226 - DNA, 13 bp, Homo sapiens
ggcacagccagaa

SEQ ID NO: 6320227 - DNA, 15 bp, Homo sapiens
ggcacagccagaaac

SEQ ID NO: 6320228 - DNA, 20 bp, Homo sapiens
ggcacagcccctggagcctc

SEQ ID NO: 6320229 - DNA, 23 bp, Homo sapiens
ggcacagccctcagcgtcagaca

SEQ ID NO: 6320230 - DNA, 17 bp, Homo sapiens
ggcacagccctgagtgt

SEQ ID NO: 6320231 - DNA, 19 bp, Homo sapiens
ggcacagccctgagtgtcc

SEQ ID NO: 6320232 - DNA, 23 bp, Homo sapiens
ggcacagccctgagtgtcccaag

SEQ ID NO: 6320233 - DNA, 22 bp, Homo sapiens
ggcacagccgcgggccaggagg

SEQ ID NO: 6320234 - DNA, 17 bp, Homo sapiens
ggcacagccggggcctg

SEQ ID NO: 6320235 - DNA, 20 bp, Homo sapiens
ggcacagccggggcctgcct

SEQ ID NO: 6320236 - DNA, 21 bp, Homo sapiens
ggcacagccggggcctgccta

SEQ ID NO: 6320237 - DNA, 13 bp, Homo sapiens
ggcacagcctgca

SEQ ID NO: 6320238 - DNA, 15 bp, Homo sapiens
ggcacagcctgcact

SEQ ID NO: 6320239 - DNA, 16 bp, Homo sapiens
ggcacagctaaccact

SEQ ID NO: 6320240 - DNA, 14 bp, Homo sapiens
ggcacagctgccct

SEQ ID NO: 6320241 - DNA, 15 bp, Homo sapiens
ggcacagctgctgtg

SEQ ID NO: 6320242 - DNA, 12 bp, Homo sapiens
ggcacagctggg

SEQ ID NO: 6320243 - DNA, 15 bp, Homo sapiens
ggcacagctgggagc

SEQ ID NO: 6320244 - DNA, 14 bp, Homo sapiens
ggcacagctgggat

SEQ ID NO: 6320245 - DNA, 15 bp, Homo sapiens
ggcacagctgtctgc

SEQ ID NO: 6320246 - DNA, 16 bp, Homo sapiens
ggcacaggaaacagca

SEQ ID NO: 6320247 - DNA, 17 bp, Homo sapiens
ggcacaggaaacagcaa

SEQ ID NO: 6320248 - DNA, 19 bp, Homo sapiens
ggcacaggagctacctgtg

SEQ ID NO: 6320249 - DNA, 20 bp, Homo sapiens
ggcacaggagtgtcctcttc

SEQ ID NO: 6320250 - DNA, 14 bp, Homo sapiens
ggcacaggcaggaa

SEQ ID NO: 6320251 - DNA, 19 bp, Homo sapiens
ggcacaggcaggaagagag

SEQ ID NO: 6320252 - DNA, 14 bp, Homo sapiens
ggcacaggcagggc

SEQ ID NO: 6320253 - DNA, 17 bp, Homo sapiens
ggcacaggccatggatg

SEQ ID NO: 6320254 - DNA, 20 bp, Homo sapiens
ggcacaggccgtcaccctgg

SEQ ID NO: 6320255 - DNA, 14 bp, Homo sapiens
ggcacagggcacca

SEQ ID NO: 6320256 - DNA, 17 bp, Homo sapiens
ggcacagggcaccagag

SEQ ID NO: 6320257 - DNA, 16 bp, Homo sapiens
ggcacagggcatgaaa

SEQ ID NO: 6320258 - DNA, 19 bp, Homo sapiens
ggcacagggcatgaaatga

SEQ ID NO: 6320259 - DNA, 13 bp, Homo sapiens
ggcacagggcccg

SEQ ID NO: 6320260 - DNA, 14 bp, Homo sapiens
ggcacagggcccgc

SEQ ID NO: 6320261 - DNA, 15 bp, Homo sapiens
ggcacagggcctggc

SEQ ID NO: 6320262 - DNA, 17 bp, Homo sapiens
ggcacagggtctgctct

SEQ ID NO: 6320263 - DNA, 16 bp, Homo sapiens
ggcacaggtgtaaata

SEQ ID NO: 6320264 - DNA, 18 bp, Homo sapiens
ggcacaggtgtaaatata

SEQ ID NO: 6320265 - DNA, 14 bp, Homo sapiens
ggcacagtccagga

SEQ ID NO: 6320266 - DNA, 20 bp, Homo sapiens
ggcacagtgctgccccttgc

SEQ ID NO: 6320267 - DNA, 13 bp, Homo sapiens
ggcacagtgggag

SEQ ID NO: 6320268 - DNA, 21 bp, Homo sapiens
ggcacagtgggcctgtgtgtg

SEQ ID NO: 6320269 - DNA, 18 bp, Homo sapiens
ggcacagtgtctgggctg

SEQ ID NO: 6320270 - DNA, 19 bp, Homo sapiens
ggcacagtgtctgggctga

SEQ ID NO: 6320271 - DNA, 12 bp, Homo sapiens
ggcacatagaga

SEQ ID NO: 6320272 - DNA, 15 bp, Homo sapiens
ggcacatagcatagg

SEQ ID NO: 6320273 - DNA, 22 bp, Homo sapiens
ggcacatagcataggctgggga

SEQ ID NO: 6320274 - DNA, 17 bp, Homo sapiens
ggcacatcagaaaggaa

SEQ ID NO: 6320275 - DNA, 14 bp, Homo sapiens
ggcacatcatttca

SEQ ID NO: 6320276 - DNA, 18 bp, Homo sapiens
ggcacatcctatgcaata

SEQ ID NO: 6320277 - DNA, 14 bp, Homo sapiens
ggcacatctccaga

SEQ ID NO: 6320278 - DNA, 14 bp, Homo sapiens
ggcacatctgtcct

SEQ ID NO: 6320279 - DNA, 17 bp, Homo sapiens
ggcacatgaaaaatttt

SEQ ID NO: 6320280 - DNA, 18 bp, Homo sapiens
ggcacatgaaaaatttta

SEQ ID NO: 6320281 - DNA, 14 bp, Homo sapiens
ggcacatggaggag

SEQ ID NO: 6320282 - DNA, 15 bp, Homo sapiens
ggcacatggctgggg

SEQ ID NO: 6320283 - DNA, 14 bp, Homo sapiens
ggcacatgtgttca

SEQ ID NO: 6320284 - DNA, 17 bp, Homo sapiens
ggcacattaactccctc

SEQ ID NO: 6320285 - DNA, 21 bp, Homo sapiens
ggcacattaactgttgcactt

SEQ ID NO: 6320286 - DNA, 22 bp, Homo sapiens
ggcacattaactgttgcacttt

SEQ ID NO: 6320287 - DNA, 18 bp, Homo sapiens
ggcacattgcccatggct

SEQ ID NO: 6320288 - DNA, 18 bp, Homo sapiens
ggcacatttcagggagaa

SEQ ID NO: 6320289 - DNA, 20 bp, Homo sapiens
ggcacatttcagggagaaac

SEQ ID NO: 6320290 - DNA, 15 bp, Homo sapiens
ggcacatttcatgag

SEQ ID NO: 6320291 - DNA, 18 bp, Homo sapiens
ggcacattttttttttta

SEQ ID NO: 6320292 - DNA, 15 bp, Homo sapiens
ggcaccaaagatgca

SEQ ID NO: 6320293 - DNA, 17 bp, Homo sapiens
ggcaccaaagatgcagc

SEQ ID NO: 6320294 - DNA, 20 bp, Homo sapiens
ggcaccaaagatgcagccgc

SEQ ID NO: 6320295 - DNA, 16 bp, Homo sapiens
ggcaccaaagccacca

SEQ ID NO: 6320296 - DNA, 16 bp, Homo sapiens
ggcaccaagcccacag

SEQ ID NO: 6320297 - DNA, 13 bp, Homo sapiens
ggcaccaataaag

SEQ ID NO: 6320298 - DNA, 20 bp, Homo sapiens
ggcaccaataaaggaggaat

SEQ ID NO: 6320299 - DNA, 16 bp, Homo sapiens
ggcaccacagcctcca

SEQ ID NO: 6320300 - DNA, 16 bp, Homo sapiens
ggcaccaccaggagca

SEQ ID NO: 6320301 - DNA, 18 bp, Homo sapiens
ggcaccaccaggagcagc

SEQ ID NO: 6320302 - DNA, 16 bp, Homo sapiens
ggcaccaccagggtgg

SEQ ID NO: 6320303 - DNA, 16 bp, Homo sapiens
ggcaccacccccagtc

SEQ ID NO: 6320304 - DNA, 21 bp, Homo sapiens
ggcaccacccccagtcccccc

SEQ ID NO: 6320305 - DNA, 17 bp, Homo sapiens
ggcaccagacacccagg

SEQ ID NO: 6320306 - DNA, 20 bp, Homo sapiens
ggcaccagacacccaggact

SEQ ID NO: 6320307 - DNA, 17 bp, Homo sapiens
ggcaccagatgcaacct

SEQ ID NO: 6320308 - DNA, 16 bp, Homo sapiens
ggcaccagcagcctgg

SEQ ID NO: 6320309 - DNA, 19 bp, Homo sapiens
ggcaccagcatccaccttg

SEQ ID NO: 6320310 - DNA, 13 bp, Homo sapiens
ggcaccagccagc

SEQ ID NO: 6320311 - DNA, 14 bp, Homo sapiens
ggcaccagccccct

SEQ ID NO: 6320312 - DNA, 13 bp, Homo sapiens
ggcaccagctctg

SEQ ID NO: 6320313 - DNA, 14 bp, Homo sapiens
ggcaccagctctgt

SEQ ID NO: 6320314 - DNA, 18 bp, Homo sapiens
ggcaccagcttctttctc

SEQ ID NO: 6320315 - DNA, 15 bp, Homo sapiens
ggcaccaggaagccg

SEQ ID NO: 6320316 - DNA, 17 bp, Homo sapiens
ggcaccaggggtttctc

SEQ ID NO: 6320317 - DNA, 19 bp, Homo sapiens
ggcaccagtagcaggcccg

SEQ ID NO: 6320318 - DNA, 14 bp, Homo sapiens
ggcaccagtccctg

SEQ ID NO: 6320319 - DNA, 15 bp, Homo sapiens
ggcaccatcagcctg

SEQ ID NO: 6320320 - DNA, 16 bp, Homo sapiens
ggcaccatcagcctgt

SEQ ID NO: 6320321 - DNA, 18 bp, Homo sapiens
ggcaccatccaccctgca

SEQ ID NO: 6320322 - DNA, 15 bp, Homo sapiens
ggcaccatctggacg

SEQ ID NO: 6320323 - DNA, 19 bp, Homo sapiens
ggcaccatgcaaatgtctt

SEQ ID NO: 6320324 - DNA, 16 bp, Homo sapiens
ggcaccatggtgactg

SEQ ID NO: 6320325 - DNA, 17 bp, Homo sapiens
ggcaccatggtgactgc

SEQ ID NO: 6320326 - DNA, 19 bp, Homo sapiens
ggcacccaaatcacatctc

SEQ ID NO: 6320327 - DNA, 22 bp, Homo sapiens
ggcacccaagacctcagggcac

SEQ ID NO: 6320328 - DNA, 23 bp, Homo sapiens
ggcacccacaagcccgtgacaga

SEQ ID NO: 6320329 - DNA, 14 bp, Homo sapiens
ggcacccaccactc

SEQ ID NO: 6320330 - DNA, 20 bp, Homo sapiens
ggcacccaccatcatgtctg

SEQ ID NO: 6320331 - DNA, 23 bp, Homo sapiens
ggcacccaccgtctcggccctga

SEQ ID NO: 6320332 - DNA, 20 bp, Homo sapiens
ggcacccaccgtggaggagg

SEQ ID NO: 6320333 - DNA, 12 bp, Homo sapiens
ggcacccaggca

SEQ ID NO: 6320334 - DNA, 13 bp, Homo sapiens
ggcacccaggcct

SEQ ID NO: 6320335 - DNA, 21 bp, Homo sapiens
ggcacccaggcctccctgcag

SEQ ID NO: 6320336 - DNA, 18 bp, Homo sapiens
ggcacccatcagaaaaag

SEQ ID NO: 6320337 - DNA, 14 bp, Homo sapiens
ggcacccatgtggg

SEQ ID NO: 6320338 - DNA, 16 bp, Homo sapiens
gtcagacataaagcca

SEQ ID NO: 6320339 - DNA, 20 bp, Homo sapiens
gtcagacataaagccatgtt

SEQ ID NO: 6320340 - DNA, 20 bp, Homo sapiens
gtcagacccatctctccctt

SEQ ID NO: 6320341 - DNA, 21 bp, Homo sapiens
gtcagaccctaggaagctgga

SEQ ID NO: 6320342 - DNA, 16 bp, Homo sapiens
gtcagaccctggaggc

SEQ ID NO: 6320343 - DNA, 21 bp, Homo sapiens
gtcagactgaaacgccttgca

SEQ ID NO: 6320344 - DNA, 23 bp, Homo sapiens
gtcagactggaggtcgaagcaat

SEQ ID NO: 6320345 - DNA, 14 bp, Homo sapiens
gtcagactggctgg

SEQ ID NO: 6320346 - DNA, 18 bp, Homo sapiens
gtcagactggctggctgc

SEQ ID NO: 6320347 - DNA, 13 bp, Homo sapiens
gtcagactttgct

SEQ ID NO: 6320348 - DNA, 22 bp, Homo sapiens
gtcagactttgtgttcatttca

SEQ ID NO: 6320349 - DNA, 14 bp, Homo sapiens
gtcagagaaaacac

SEQ ID NO: 6320350 - DNA, 16 bp, Homo sapiens
gtcagagaaaacactt

SEQ ID NO: 6320351 - DNA, 14 bp, Homo sapiens
gtcagagaagaaaa

SEQ ID NO: 6320352 - DNA, 12 bp, Homo sapiens
gtcagagagaat

SEQ ID NO: 6320353 - DNA, 12 bp, Homo sapiens
gtcagagccact

SEQ ID NO: 6320354 - DNA, 12 bp, Homo sapiens
gtcagagcccag

SEQ ID NO: 6320355 - DNA, 16 bp, Homo sapiens
gtcagagcccagccca

SEQ ID NO: 6320356 - DNA, 17 bp, Homo sapiens
gtcagagcccagcccag

SEQ ID NO: 6320357 - DNA, 14 bp, Homo sapiens
gtcagagcctacct

SEQ ID NO: 6320358 - DNA, 15 bp, Homo sapiens
gtcagagcctgcagt

SEQ ID NO: 6320359 - DNA, 10 bp, Homo sapiens
gtcagagcta

SEQ ID NO: 6320360 - DNA, 13 bp, Homo sapiens
gtcagagctcagg

SEQ ID NO: 6320361 - DNA, 14 bp, Homo sapiens
gtcagagctgggag

SEQ ID NO: 6320362 - DNA, 23 bp, Homo sapiens
gtcagaggaacaaaccaggggac

SEQ ID NO: 6320363 - DNA, 13 bp, Homo sapiens
gtcagaggacccc

SEQ ID NO: 6320364 - DNA, 21 bp, Homo sapiens
gtcagaggaccccagggtggt

SEQ ID NO: 6320365 - DNA, 16 bp, Homo sapiens
gtcagaggagagatag

SEQ ID NO: 6320366 - DNA, 23 bp, Homo sapiens
gtcagaggagagatagcctgtgg

SEQ ID NO: 6320367 - DNA, 20 bp, Homo sapiens
gtcagaggagcgcaggcagc

SEQ ID NO: 6320368 - DNA, 18 bp, Homo sapiens
gtcagaggagggcatggg

SEQ ID NO: 6320369 - DNA, 23 bp, Homo sapiens
gtcagaggagtgattgaaccagc

SEQ ID NO: 6320370 - DNA, 21 bp, Homo sapiens
gtcagaggcccaaaacagtta

SEQ ID NO: 6320371 - DNA, 15 bp, Homo sapiens
gtcagaggccctgga

SEQ ID NO: 6320372 - DNA, 23 bp, Homo sapiens
gtcagagggactgtcagctgagc

SEQ ID NO: 6320373 - DNA, 20 bp, Homo sapiens
gtcagagtataattttggtt

SEQ ID NO: 6320374 - DNA, 13 bp, Homo sapiens
gtcagagtgttgt

SEQ ID NO: 6320375 - DNA, 23 bp, Homo sapiens
gtcagagttgactttcctcccat

SEQ ID NO: 6320376 - DNA, 15 bp, Homo sapiens
gtcagatgagaacaa

SEQ ID NO: 6320377 - DNA, 12 bp, Homo sapiens
gtcagatgagca

SEQ ID NO: 6320378 - DNA, 23 bp, Homo sapiens
gtcagatgagcaaggacattgcc

SEQ ID NO: 6320379 - DNA, 15 bp, Homo sapiens
gtcagatgaggcaaa

SEQ ID NO: 6320380 - DNA, 22 bp, Homo sapiens
gtcagatggaggttctcagagc

SEQ ID NO: 6320381 - DNA, 22 bp, Homo sapiens
gtcagatggatgtagatacaga

SEQ ID NO: 6320382 - DNA, 13 bp, Homo sapiens
gtcagatgtttaa

SEQ ID NO: 6320383 - DNA, 17 bp, Homo sapiens
gtcagatgtttaaaaca

SEQ ID NO: 6320384 - DNA, 12 bp, Homo sapiens
gtcagattcctt

SEQ ID NO: 6320385 - DNA, 13 bp, Homo sapiens
gtcagattccttt

SEQ ID NO: 6320386 - DNA, 16 bp, Homo sapiens
gtcagattcctttccc

SEQ ID NO: 6320387 - DNA, 15 bp, Homo sapiens
gtcagattcttgcat

SEQ ID NO: 6320388 - DNA, 17 bp, Homo sapiens
gtcagattcttgcatcc

SEQ ID NO: 6320389 - DNA, 22 bp, Homo sapiens
gtcagatttatttgtttgattt

SEQ ID NO: 6320390 - DNA, 15 bp, Homo sapiens
gtcagatttctggtt

SEQ ID NO: 6320391 - DNA, 21 bp, Homo sapiens
gtcagatttctggttgatttg

SEQ ID NO: 6320392 - DNA, 17 bp, Homo sapiens
gtcagatttgaaaagaa

SEQ ID NO: 6320393 - DNA, 19 bp, Homo sapiens
gtcagatttttaaagtttt

SEQ ID NO: 6320394 - DNA, 16 bp, Homo sapiens
gtcagcaaaaagcaaa

SEQ ID NO: 6320395 - DNA, 13 bp, Homo sapiens
gtcagcaagagga

SEQ ID NO: 6320396 - DNA, 23 bp, Homo sapiens
gtcagcacccccaccaaacttta

SEQ ID NO: 6320397 - DNA, 21 bp, Homo sapiens
gtcagcaccttggcccaggag

SEQ ID NO: 6320398 - DNA, 23 bp, Homo sapiens
gtcagcaccttggcccaggagct

SEQ ID NO: 6320399 - DNA, 24 bp, Homo sapiens
gtcagcaccttggcccaggagctc

SEQ ID NO: 6320400 - DNA, 16 bp, Homo sapiens
gtcagcagacacacat

SEQ ID NO: 6320401 - DNA, 16 bp, Homo sapiens
gtcagcagatgccagt

SEQ ID NO: 6320402 - DNA, 19 bp, Homo sapiens
gtcagcagatgccagtgaa

SEQ ID NO: 6320403 - DNA, 15 bp, Homo sapiens
gtcagcagcagctct

SEQ ID NO: 6320404 - DNA, 22 bp, Homo sapiens
gtcagcagcagctctgagccag

SEQ ID NO: 6320405 - DNA, 14 bp, Homo sapiens
gtcagcaggcaggc

SEQ ID NO: 6320406 - DNA, 11 bp, Homo sapiens
gtcagcaggcc

SEQ ID NO: 6320407 - DNA, 16 bp, Homo sapiens
gtcagcaggcccagga

SEQ ID NO: 6320408 - DNA, 12 bp, Homo sapiens
gtcagcagtatt

SEQ ID NO: 6320409 - DNA, 20 bp, Homo sapiens
gtcagcatcactgatgggaa

SEQ ID NO: 6320410 - DNA, 21 bp, Homo sapiens
gtcagcatcactgatgggaat

SEQ ID NO: 6320411 - DNA, 11 bp, Homo sapiens
gtcagcatctg

SEQ ID NO: 6320412 - DNA, 16 bp, Homo sapiens
gtcagcatctgaccat

SEQ ID NO: 6320413 - DNA, 19 bp, Homo sapiens
gtcagcatctgaccatctg

SEQ ID NO: 6320414 - DNA, 21 bp, Homo sapiens
gtcagcatctgaccatctgtg

SEQ ID NO: 6320415 - DNA, 15 bp, Homo sapiens
gtcagcatctggctg

SEQ ID NO: 6320416 - DNA, 22 bp, Homo sapiens
gtcagcatctggctgtctagaa

SEQ ID NO: 6320417 - DNA, 20 bp, Homo sapiens
gtcagcatgaatttgtaatg

SEQ ID NO: 6320418 - DNA, 14 bp, Homo sapiens
gtcagcatttgatc

SEQ ID NO: 6320419 - DNA, 13 bp, Homo sapiens
gtcagcattttct

SEQ ID NO: 6320420 - DNA, 15 bp, Homo sapiens
gtcagccaaatgact

SEQ ID NO: 6320421 - DNA, 16 bp, Homo sapiens
gtcagccaagtgcaga

SEQ ID NO: 6320422 - DNA, 18 bp, Homo sapiens
gtcagccacacctgtcag

SEQ ID NO: 6320423 - DNA, 13 bp, Homo sapiens
gtcagccacactg

SEQ ID NO: 6320424 - DNA, 16 bp, Homo sapiens
gtcagccacactgggc

SEQ ID NO: 6320425 - DNA, 13 bp, Homo sapiens
gtcagccacctgg

SEQ ID NO: 6320426 - DNA, 16 bp, Homo sapiens
gtcagccacctgggaa

SEQ ID NO: 6320427 - DNA, 13 bp, Homo sapiens
gtcagccactgtt

SEQ ID NO: 6320428 - DNA, 19 bp, Homo sapiens
gtcagccagccctcttctg

SEQ ID NO: 6320429 - DNA, 15 bp, Homo sapiens
gtcagccaggagctg

SEQ ID NO: 6320430 - DNA, 12 bp, Homo sapiens
gtcagccagggc

SEQ ID NO: 6320431 - DNA, 20 bp, Homo sapiens
gtcagccatcgccaacttgt

SEQ ID NO: 6320432 - DNA, 19 bp, Homo sapiens
gtcagccatcgtcctggga

SEQ ID NO: 6320433 - DNA, 22 bp, Homo sapiens
gtcagccatgggaaatgagcca

SEQ ID NO: 6320434 - DNA, 12 bp, Homo sapiens
gtcagcccagca

SEQ ID NO: 6320435 - DNA, 13 bp, Homo sapiens
gtcagcccagcac

SEQ ID NO: 6320436 - DNA, 18 bp, Homo sapiens
gtcagcccatggaggcag

SEQ ID NO: 6320437 - DNA, 16 bp, Homo sapiens
gtcagcccatgtcaat

SEQ ID NO: 6320438 - DNA, 19 bp, Homo sapiens
gtcagcccatgtcaatcaa

SEQ ID NO: 6320439 - DNA, 17 bp, Homo sapiens
gtcagccccaagggctg

SEQ ID NO: 6320440 - DNA, 20 bp, Homo sapiens
gtcagcccctcatcagcctt

SEQ ID NO: 6320441 - DNA, 18 bp, Homo sapiens
gtcagcccctcttccctt

SEQ ID NO: 6320442 - DNA, 19 bp, Homo sapiens
gtcagcccgaatgcctgtc

SEQ ID NO: 6320443 - DNA, 16 bp, Homo sapiens
gtcagccgagccgggc

SEQ ID NO: 6320444 - DNA, 12 bp, Homo sapiens
gtcagcctccct

SEQ ID NO: 6320445 - DNA, 13 bp, Homo sapiens
gtcagcctccctg

SEQ ID NO: 6320446 - DNA, 23 bp, Homo sapiens
gtcagcctcgcaggcctccctgc

SEQ ID NO: 6320447 - DNA, 22 bp, Homo sapiens
gtcagcctcttaccttcccgcc

SEQ ID NO: 6320448 - DNA, 20 bp, Homo sapiens
gtcagcctgaagatcagagc

SEQ ID NO: 6320449 - DNA, 15 bp, Homo sapiens
gtcagcctggctggg

SEQ ID NO: 6320450 - DNA, 18 bp, Homo sapiens
gtcagcctggctgggctc

SEQ ID NO: 6320451 - DNA, 22 bp, Homo sapiens
gtcagcctgtgctgtggcatag

SEQ ID NO: 6320452 - DNA, 22 bp, Homo sapiens
gtcagccttgcatcaagggctt

SEQ ID NO: 6320453 - DNA, 20 bp, Homo sapiens
gtcagcctttgttaacctta

SEQ ID NO: 6320454 - DNA, 13 bp, Homo sapiens
gtcagcgactgga

SEQ ID NO: 6320455 - DNA, 19 bp, Homo sapiens
gtcagcgattcctgccaag

SEQ ID NO: 6320456 - DNA, 14 bp, Homo sapiens
gtcagcgcctcaag

SEQ ID NO: 6320457 - DNA, 22 bp, Homo sapiens
gtcagcggagaggaccccattc

SEQ ID NO: 6320458 - DNA, 18 bp, Homo sapiens
gtcagcgggcccaggcct

SEQ ID NO: 6320459 - DNA, 20 bp, Homo sapiens
gtcagcgggcgctgctggga

SEQ ID NO: 6320460 - DNA, 15 bp, Homo sapiens
gtcagcgttgcatgt

SEQ ID NO: 6320461 - DNA, 18 bp, Homo sapiens
gtcagcgttgcatgtcgt

SEQ ID NO: 6320462 - DNA, 13 bp, Homo sapiens
gtcagctaaagaa

SEQ ID NO: 6320463 - DNA, 14 bp, Homo sapiens
gtcagctactaatg

SEQ ID NO: 6320464 - DNA, 23 bp, Homo sapiens
gtcagctagatcatttgttctgg

SEQ ID NO: 6320465 - DNA, 18 bp, Homo sapiens
gtcagctcaggcagctcg

SEQ ID NO: 6320466 - DNA, 19 bp, Homo sapiens
gtcagctcccctcggagaa

SEQ ID NO: 6320467 - DNA, 16 bp, Homo sapiens
gtcagctcccttctct

SEQ ID NO: 6320468 - DNA, 15 bp, Homo sapiens
gtcagctccttgacc

SEQ ID NO: 6320469 - DNA, 13 bp, Homo sapiens
gtcagctctctgc

SEQ ID NO: 6320470 - DNA, 17 bp, Homo sapiens
gtcagctctctgccctg

SEQ ID NO: 6320471 - DNA, 16 bp, Homo sapiens
gtcagctctggccaca

SEQ ID NO: 6320472 - DNA, 16 bp, Homo sapiens
gtcagctgaccccctc

SEQ ID NO: 6320473 - DNA, 15 bp, Homo sapiens
gtcagctgtagaaag

SEQ ID NO: 6320474 - DNA, 17 bp, Homo sapiens
gtcagctgtagaaaggt

SEQ ID NO: 6320475 - DNA, 18 bp, Homo sapiens
gtcagcttcccaacaata

SEQ ID NO: 6320476 - DNA, 14 bp, Homo sapiens
gtcagcttcccagc

SEQ ID NO: 6320477 - DNA, 15 bp, Homo sapiens
gtcagcttcccagcc

SEQ ID NO: 6320478 - DNA, 16 bp, Homo sapiens
gtcagcttcccagcca

SEQ ID NO: 6320479 - DNA, 17 bp, Homo sapiens
gtcagcttcccagccat

SEQ ID NO: 6320480 - DNA, 14 bp, Homo sapiens
gtcagcttctccca

SEQ ID NO: 6320481 - DNA, 16 bp, Homo sapiens
gtcagcttgctgccct

SEQ ID NO: 6320482 - DNA, 17 bp, Homo sapiens
gtcagctttcagagcca

SEQ ID NO: 6320483 - DNA, 19 bp, Homo sapiens
gtcagctttgcttttcctg

SEQ ID NO: 6320484 - DNA, 22 bp, Homo sapiens
gtcagctttggattgctggggc

SEQ ID NO: 6320485 - DNA, 16 bp, Homo sapiens
gtcaggaacagtggct

SEQ ID NO: 6320486 - DNA, 19 bp, Homo sapiens
gtcaggacccaggccgcct

SEQ ID NO: 6320487 - DNA, 15 bp, Homo sapiens
gtcaggacggctcct

SEQ ID NO: 6320488 - DNA, 19 bp, Homo sapiens
gtcaggacggctcctcaga

SEQ ID NO: 6320489 - DNA, 23 bp, Homo sapiens
gtcaggacggctcctcagagcgc

SEQ ID NO: 6320490 - DNA, 14 bp, Homo sapiens
gtcaggagagcagc

SEQ ID NO: 6320491 - DNA, 17 bp, Homo sapiens
gtcaggagagtgcagat

SEQ ID NO: 6320492 - DNA, 21 bp, Homo sapiens
gtcaggagatcgagaccatcc

SEQ ID NO: 6320493 - DNA, 14 bp, Homo sapiens
gtcaggagccagca

SEQ ID NO: 6320494 - DNA, 17 bp, Homo sapiens
gtcaggaggtgcctgag

SEQ ID NO: 6320495 - DNA, 16 bp, Homo sapiens
gtcaggagtgtagttg

SEQ ID NO: 6320496 - DNA, 18 bp, Homo sapiens
gtcaggagtgtgtgtgag

SEQ ID NO: 6320497 - DNA, 22 bp, Homo sapiens
gtcaggagttagaggccagcct

SEQ ID NO: 6320498 - DNA, 13 bp, Homo sapiens
gtcaggagttcct

SEQ ID NO: 6320499 - DNA, 19 bp, Homo sapiens
gtcaggagttcgagaccaa

SEQ ID NO: 6320500 - DNA, 21 bp, Homo sapiens
gtcaggagttgtttctgaccc

SEQ ID NO: 6320501 - DNA, 19 bp, Homo sapiens
gtcaggagttttactgcct

SEQ ID NO: 6320502 - DNA, 17 bp, Homo sapiens
gtcaggatgaggccccg

SEQ ID NO: 6320503 - DNA, 20 bp, Homo sapiens
gtcaggatgttgctccatcc

SEQ ID NO: 6320504 - DNA, 19 bp, Homo sapiens
gtcaggattgcgagagatg

SEQ ID NO: 6320505 - DNA, 15 bp, Homo sapiens
gtcaggcaatgccct

SEQ ID NO: 6320506 - DNA, 17 bp, Homo sapiens
gtcaggcaatgccctgc

SEQ ID NO: 6320507 - DNA, 18 bp, Homo sapiens
gtcaggcaatgccctgcg

SEQ ID NO: 6320508 - DNA, 18 bp, Homo sapiens
gtcaggcacgtctcctgc

SEQ ID NO: 6320509 - DNA, 20 bp, Homo sapiens
gtcaggcacgtctcctgctg

SEQ ID NO: 6320510 - DNA, 16 bp, Homo sapiens
gtcaggcactgggcat

SEQ ID NO: 6320511 - DNA, 15 bp, Homo sapiens
gtcaggcagaggcaa

SEQ ID NO: 6320512 - DNA, 21 bp, Homo sapiens
gtcaggcaggtttgccagtga

SEQ ID NO: 6320513 - DNA, 14 bp, Homo sapiens
gtcaggccacggca

SEQ ID NO: 6320514 - DNA, 16 bp, Homo sapiens
gtcaggccacggcagc

SEQ ID NO: 6320515 - DNA, 14 bp, Homo sapiens
gtcaggccaggtgg

SEQ ID NO: 6320516 - DNA, 15 bp, Homo sapiens
gtcaggccaggtggg

SEQ ID NO: 6320517 - DNA, 14 bp, Homo sapiens
gtcaggcccagcct

SEQ ID NO: 6320518 - DNA, 23 bp, Homo sapiens
ggcacccatgtgggcgcccaccc

SEQ ID NO: 6320519 - DNA, 15 bp, Homo sapiens
ggcaccccaggcagc

SEQ ID NO: 6320520 - DNA, 16 bp, Homo sapiens
ggcaccccaggcagct

SEQ ID NO: 6320521 - DNA, 20 bp, Homo sapiens
ggcaccccaggcagctcctg

SEQ ID NO: 6320522 - DNA, 24 bp, Homo sapiens
ggcacccccacaagctgtccctgc

SEQ ID NO: 6320523 - DNA, 14 bp, Homo sapiens
ggcacccccagcct

SEQ ID NO: 6320524 - DNA, 15 bp, Homo sapiens
ggcacccccagcctg

SEQ ID NO: 6320525 - DNA, 14 bp, Homo sapiens
ggcacccccatgct

SEQ ID NO: 6320526 - DNA, 16 bp, Homo sapiens
ggcacccccatgctgc

SEQ ID NO: 6320527 - DNA, 17 bp, Homo sapiens
ggcacccccgtcaagag

SEQ ID NO: 6320528 - DNA, 15 bp, Homo sapiens
ggcaccccctgcagc

SEQ ID NO: 6320529 - DNA, 16 bp, Homo sapiens
ggcaccccctgcagct

SEQ ID NO: 6320530 - DNA, 18 bp, Homo sapiens
ggcaccccctggagagaa

SEQ ID NO: 6320531 - DNA, 21 bp, Homo sapiens
ggcaccccggatcgaggacaa

SEQ ID NO: 6320532 - DNA, 13 bp, Homo sapiens
ggcaccccttgtt

SEQ ID NO: 6320533 - DNA, 20 bp, Homo sapiens
ggcacccctttccccagcct

SEQ ID NO: 6320534 - DNA, 19 bp, Homo sapiens
ggcaccctcagggagcctc

SEQ ID NO: 6320535 - DNA, 12 bp, Homo sapiens
ggcaccctccca

SEQ ID NO: 6320536 - DNA, 12 bp, Homo sapiens
ggcaccctctgg

SEQ ID NO: 6320537 - DNA, 20 bp, Homo sapiens
ggcaccctctggccgcctag

SEQ ID NO: 6320538 - DNA, 16 bp, Homo sapiens
ggcaccctgcaggcag

SEQ ID NO: 6320539 - DNA, 19 bp, Homo sapiens
ggcaccctgcaggcaggca

SEQ ID NO: 6320540 - DNA, 12 bp, Homo sapiens
ggcacccttctt

SEQ ID NO: 6320541 - DNA, 20 bp, Homo sapiens
ggcacccttctttcctcttc

SEQ ID NO: 6320542 - DNA, 22 bp, Homo sapiens
ggcacccttctttcctcttccc

SEQ ID NO: 6320543 - DNA, 15 bp, Homo sapiens
ggcaccgagaatgtt

SEQ ID NO: 6320544 - DNA, 20 bp, Homo sapiens
ggcaccgccacgtcccagca

SEQ ID NO: 6320545 - DNA, 17 bp, Homo sapiens
ggcaccgcctgccccca

SEQ ID NO: 6320546 - DNA, 13 bp, Homo sapiens
ggcaccggcgctg

SEQ ID NO: 6320547 - DNA, 15 bp, Homo sapiens
ggcaccggcgctgca

SEQ ID NO: 6320548 - DNA, 15 bp, Homo sapiens
ggcaccgggctggct

SEQ ID NO: 6320549 - DNA, 16 bp, Homo sapiens
ggcaccgtccaggccc

SEQ ID NO: 6320550 - DNA, 18 bp, Homo sapiens
ggcaccgtccaggcccca

SEQ ID NO: 6320551 - DNA, 16 bp, Homo sapiens
ggcaccgtgtcctcct

SEQ ID NO: 6320552 - DNA, 18 bp, Homo sapiens
ggcaccgtgtcctcctct

SEQ ID NO: 6320553 - DNA, 15 bp, Homo sapiens
ggcacctaatccagg

SEQ ID NO: 6320554 - DNA, 17 bp, Homo sapiens
ggcacctaatccaggca

SEQ ID NO: 6320555 - DNA, 20 bp, Homo sapiens
ggcacctacatccccaggtc

SEQ ID NO: 6320556 - DNA, 18 bp, Homo sapiens
ggcacctatagtcccagc

SEQ ID NO: 6320557 - DNA, 19 bp, Homo sapiens
ggcacctatagtcccagct

SEQ ID NO: 6320558 - DNA, 16 bp, Homo sapiens
ggcacctcacaggccc

SEQ ID NO: 6320559 - DNA, 19 bp, Homo sapiens
ggcacctcacaggccccag

SEQ ID NO: 6320560 - DNA, 12 bp, Homo sapiens
ggcacctccagg

SEQ ID NO: 6320561 - DNA, 16 bp, Homo sapiens
ggcacctccaggcagg

SEQ ID NO: 6320562 - DNA, 18 bp, Homo sapiens
ggcacctccaggcaggcc

SEQ ID NO: 6320563 - DNA, 20 bp, Homo sapiens
ggcacctccaggcaggccag

SEQ ID NO: 6320564 - DNA, 17 bp, Homo sapiens
ggcacctccccgctctc

SEQ ID NO: 6320565 - DNA, 20 bp, Homo sapiens
ggcacctccccgctctccct

SEQ ID NO: 6320566 - DNA, 19 bp, Homo sapiens
ggcacctccggctgcctag

SEQ ID NO: 6320567 - DNA, 20 bp, Homo sapiens
ggcacctctaatcagacctt

SEQ ID NO: 6320568 - DNA, 15 bp, Homo sapiens
ggcacctctgccctt

SEQ ID NO: 6320569 - DNA, 14 bp, Homo sapiens
ggcacctctgtgct

SEQ ID NO: 6320570 - DNA, 12 bp, Homo sapiens
ggcacctcttcc

SEQ ID NO: 6320571 - DNA, 16 bp, Homo sapiens
ggcacctgaaattaat

SEQ ID NO: 6320572 - DNA, 22 bp, Homo sapiens
ggcacctgaaattaatttgtga

SEQ ID NO: 6320573 - DNA, 16 bp, Homo sapiens
ggcacctgacttggct

SEQ ID NO: 6320574 - DNA, 17 bp, Homo sapiens
ggcacctgcacactcca

SEQ ID NO: 6320575 - DNA, 19 bp, Homo sapiens
ggcacctgcagcggctgcc

SEQ ID NO: 6320576 - DNA, 16 bp, Homo sapiens
ggcacctgcaggttgg

SEQ ID NO: 6320577 - DNA, 20 bp, Homo sapiens
ggcacctgcaggttgggcca

SEQ ID NO: 6320578 - DNA, 22 bp, Homo sapiens
ggcacctgccaccctgggcctg

SEQ ID NO: 6320579 - DNA, 22 bp, Homo sapiens
ggcacctgccaccgccagagga

SEQ ID NO: 6320580 - DNA, 23 bp, Homo sapiens
ggcacctgccaccgccagaggac

SEQ ID NO: 6320581 - DNA, 18 bp, Homo sapiens
ggcacctgcccccacagc

SEQ ID NO: 6320582 - DNA, 19 bp, Homo sapiens
ggcacctgcccccacagct

SEQ ID NO: 6320583 - DNA, 22 bp, Homo sapiens
ggcacctgcccccacagctcct

SEQ ID NO: 6320584 - DNA, 15 bp, Homo sapiens
ggcacctgctcccac

SEQ ID NO: 6320585 - DNA, 18 bp, Homo sapiens
ggcacctggcctgctggg

SEQ ID NO: 6320586 - DNA, 22 bp, Homo sapiens
ggcacctggtggccatgctcct

SEQ ID NO: 6320587 - DNA, 11 bp, Homo sapiens
ggcacctgtat

SEQ ID NO: 6320588 - DNA, 21 bp, Homo sapiens
ggcacctgtctgctccagctc

SEQ ID NO: 6320589 - DNA, 17 bp, Homo sapiens
ggcacgaggggggccag

SEQ ID NO: 6320590 - DNA, 16 bp, Homo sapiens
ggcacgatctcagctc

SEQ ID NO: 6320591 - DNA, 14 bp, Homo sapiens
ggcacgcaccactg

SEQ ID NO: 6320592 - DNA, 14 bp, Homo sapiens
ggcacgcacctgta

SEQ ID NO: 6320593 - DNA, 14 bp, Homo sapiens
ggcacgcacttgcc

SEQ ID NO: 6320594 - DNA, 19 bp, Homo sapiens
ggcacgccaacagcccccc

SEQ ID NO: 6320595 - DNA, 18 bp, Homo sapiens
ggcacgcctgcccagcct

SEQ ID NO: 6320596 - DNA, 19 bp, Homo sapiens
ggcacgcctgcccagcctc

SEQ ID NO: 6320597 - DNA, 21 bp, Homo sapiens
ggcacgcttgcgtatgtctgt

SEQ ID NO: 6320598 - DNA, 17 bp, Homo sapiens
ggcacggactgtccacc

SEQ ID NO: 6320599 - DNA, 21 bp, Homo sapiens
ggcacggcaggcgtgtggcag

SEQ ID NO: 6320600 - DNA, 21 bp, Homo sapiens
ggcacggcgggatcctccaca

SEQ ID NO: 6320601 - DNA, 15 bp, Homo sapiens
ggcacggctccgagg

SEQ ID NO: 6320602 - DNA, 13 bp, Homo sapiens
ggcacgggagagc

SEQ ID NO: 6320603 - DNA, 18 bp, Homo sapiens
ggcacgggagagcgccac

SEQ ID NO: 6320604 - DNA, 22 bp, Homo sapiens
ggcacgggagagcgccacccgc

SEQ ID NO: 6320605 - DNA, 23 bp, Homo sapiens
ggcacgggagagcgccacccgcc

SEQ ID NO: 6320606 - DNA, 13 bp, Homo sapiens
ggcacgggtccct

SEQ ID NO: 6320607 - DNA, 19 bp, Homo sapiens
ggcacgggtgtcacggcca

SEQ ID NO: 6320608 - DNA, 21 bp, Homo sapiens
ggcacgggtgtcacggccagg

SEQ ID NO: 6320609 - DNA, 23 bp, Homo sapiens
ggcacggtcacacggccacccgc

SEQ ID NO: 6320610 - DNA, 16 bp, Homo sapiens
ggcacgtaaggtctca

SEQ ID NO: 6320611 - DNA, 13 bp, Homo sapiens
ggcacgtcctcca

SEQ ID NO: 6320612 - DNA, 15 bp, Homo sapiens
ggcacgtgacaggct

SEQ ID NO: 6320613 - DNA, 19 bp, Homo sapiens
ggcacgtggttgagtgggg

SEQ ID NO: 6320614 - DNA, 22 bp, Homo sapiens
ggcactaaaccacttctctgct

SEQ ID NO: 6320615 - DNA, 14 bp, Homo sapiens
ggcactaaccccat

SEQ ID NO: 6320616 - DNA, 18 bp, Homo sapiens
ggcactaagggtggagag

SEQ ID NO: 6320617 - DNA, 19 bp, Homo sapiens
ggcactaagtcatggtcct

SEQ ID NO: 6320618 - DNA, 23 bp, Homo sapiens
ggcactaagtcatggtcctggct

SEQ ID NO: 6320619 - DNA, 16 bp, Homo sapiens
ggcactagccaaagcg

SEQ ID NO: 6320620 - DNA, 14 bp, Homo sapiens
ggcactagcctttg

SEQ ID NO: 6320621 - DNA, 20 bp, Homo sapiens
ggcactagcctttggctctg

SEQ ID NO: 6320622 - DNA, 19 bp, Homo sapiens
ggcactattataagtgctt

SEQ ID NO: 6320623 - DNA, 19 bp, Homo sapiens
ggcactatttatttacaaa

SEQ ID NO: 6320624 - DNA, 19 bp, Homo sapiens
ggcactcaactctgagccc

SEQ ID NO: 6320625 - DNA, 23 bp, Homo sapiens
ggcactcaatgcagccagaccta

SEQ ID NO: 6320626 - DNA, 23 bp, Homo sapiens
ggcactcacagacctggagcccc

SEQ ID NO: 6320627 - DNA, 20 bp, Homo sapiens
ggcactcagtgagcctcctg

SEQ ID NO: 6320628 - DNA, 20 bp, Homo sapiens
ggcactccaaacctgtcttg

SEQ ID NO: 6320629 - DNA, 19 bp, Homo sapiens
ggcactccaacctaacctg

SEQ ID NO: 6320630 - DNA, 16 bp, Homo sapiens
ggcactcccaaccctg

SEQ ID NO: 6320631 - DNA, 16 bp, Homo sapiens
ggcactcccccaggat

SEQ ID NO: 6320632 - DNA, 13 bp, Homo sapiens
ggcactcccctga

SEQ ID NO: 6320633 - DNA, 13 bp, Homo sapiens
ggcactcccggga

SEQ ID NO: 6320634 - DNA, 22 bp, Homo sapiens
ggcactccctaagtccactcta

SEQ ID NO: 6320635 - DNA, 22 bp, Homo sapiens
ggcactctcatcaccccagagg

SEQ ID NO: 6320636 - DNA, 16 bp, Homo sapiens
ggcactctctgccagc

SEQ ID NO: 6320637 - DNA, 20 bp, Homo sapiens
ggcactctctgccagctcca

SEQ ID NO: 6320638 - DNA, 24 bp, Homo sapiens
ggcactctctgccagctccacagg

SEQ ID NO: 6320639 - DNA, 14 bp, Homo sapiens
ggcactctgttccc

SEQ ID NO: 6320640 - DNA, 18 bp, Homo sapiens
ggcactctgttcccctcc

SEQ ID NO: 6320641 - DNA, 17 bp, Homo sapiens
ggcactgaacaggctgg

SEQ ID NO: 6320642 - DNA, 22 bp, Homo sapiens
ggcactgaagtggccctccctc

SEQ ID NO: 6320643 - DNA, 19 bp, Homo sapiens
ggcactgagagagcgcagc

SEQ ID NO: 6320644 - DNA, 23 bp, Homo sapiens
ggcactgagcccccccaacactg

SEQ ID NO: 6320645 - DNA, 12 bp, Homo sapiens
ggcactgaggga

SEQ ID NO: 6320646 - DNA, 16 bp, Homo sapiens
ggcactgagggatctg

SEQ ID NO: 6320647 - DNA, 23 bp, Homo sapiens
ggcactgcacataatttgcataa

SEQ ID NO: 6320648 - DNA, 14 bp, Homo sapiens
ggcactgcaggggc

SEQ ID NO: 6320649 - DNA, 18 bp, Homo sapiens
ggcactgcaggtggcctc

SEQ ID NO: 6320650 - DNA, 22 bp, Homo sapiens
ggcactgcaggtggcctccctc

SEQ ID NO: 6320651 - DNA, 15 bp, Homo sapiens
ggcactgcatgttcc

SEQ ID NO: 6320652 - DNA, 21 bp, Homo sapiens
ggcactgccagcccaccccct

SEQ ID NO: 6320653 - DNA, 12 bp, Homo sapiens
ggcactgccctg

SEQ ID NO: 6320654 - DNA, 20 bp, Homo sapiens
ggcactgccctggtggccct

SEQ ID NO: 6320655 - DNA, 24 bp, Homo sapiens
ggcactgccctggtggccctctcc

SEQ ID NO: 6320656 - DNA, 21 bp, Homo sapiens
ggcactgccgccgctaggtag

SEQ ID NO: 6320657 - DNA, 12 bp, Homo sapiens
ggcactgcctga

SEQ ID NO: 6320658 - DNA, 20 bp, Homo sapiens
ggcactgccttctcctctct

SEQ ID NO: 6320659 - DNA, 23 bp, Homo sapiens
ggcactgccttctcctctctggg

SEQ ID NO: 6320660 - DNA, 18 bp, Homo sapiens
ggcactgcgatcaggaag

SEQ ID NO: 6320661 - DNA, 14 bp, Homo sapiens
ggcactgctaggct

SEQ ID NO: 6320662 - DNA, 11 bp, Homo sapiens
ggcactgctct

SEQ ID NO: 6320663 - DNA, 14 bp, Homo sapiens
ggcactgctgagga

SEQ ID NO: 6320664 - DNA, 12 bp, Homo sapiens
ggcactgctggg

SEQ ID NO: 6320665 - DNA, 14 bp, Homo sapiens
ggcactgctgggtg

SEQ ID NO: 6320666 - DNA, 20 bp, Homo sapiens
ggcactgctgggtggcccat

SEQ ID NO: 6320667 - DNA, 14 bp, Homo sapiens
ggcactgctgtgct

SEQ ID NO: 6320668 - DNA, 17 bp, Homo sapiens
ggcactgcttgaggagg

SEQ ID NO: 6320669 - DNA, 16 bp, Homo sapiens
ggcactggagctggga

SEQ ID NO: 6320670 - DNA, 17 bp, Homo sapiens
ggcactgggaggcaggg

SEQ ID NO: 6320671 - DNA, 19 bp, Homo sapiens
ggcactgggatgagccgct

SEQ ID NO: 6320672 - DNA, 20 bp, Homo sapiens
ggcactgggatgagccgctg

SEQ ID NO: 6320673 - DNA, 21 bp, Homo sapiens
ggcactgggatgagccgctgt

SEQ ID NO: 6320674 - DNA, 22 bp, Homo sapiens
ggcactgggctgttgttccatt

SEQ ID NO: 6320675 - DNA, 20 bp, Homo sapiens
ggcactgggtttgctccctg

SEQ ID NO: 6320676 - DNA, 19 bp, Homo sapiens
ggcactgtaaggtgcttgc

SEQ ID NO: 6320677 - DNA, 14 bp, Homo sapiens
ggcactgtccaggg

SEQ ID NO: 6320678 - DNA, 22 bp, Homo sapiens
ggcactgtctgcgtgactattt

SEQ ID NO: 6320679 - DNA, 19 bp, Homo sapiens
ggcactgtggaactgccac

SEQ ID NO: 6320680 - DNA, 20 bp, Homo sapiens
ggcactgtggaactgccacc

SEQ ID NO: 6320681 - DNA, 20 bp, Homo sapiens
ggcactgtggtcaggcccag

SEQ ID NO: 6320682 - DNA, 12 bp, Homo sapiens
ggcactgttaat

SEQ ID NO: 6320683 - DNA, 20 bp, Homo sapiens
ggcacttaagtgcacttttt

SEQ ID NO: 6320684 - DNA, 20 bp, Homo sapiens
ggcacttaatttgtaaactt

SEQ ID NO: 6320685 - DNA, 22 bp, Homo sapiens
ggcacttaatttgtaaacttct

SEQ ID NO: 6320686 - DNA, 23 bp, Homo sapiens
ggcacttactggtccttaccaga

SEQ ID NO: 6320687 - DNA, 17 bp, Homo sapiens
ggcacttagtaggtcct

SEQ ID NO: 6320688 - DNA, 14 bp, Homo sapiens
ggcacttcaggtcc

SEQ ID NO: 6320689 - DNA, 18 bp, Homo sapiens
ggcacttcaggtccgtgg

SEQ ID NO: 6320690 - DNA, 20 bp, Homo sapiens
ggcacttccacctccagcct

SEQ ID NO: 6320691 - DNA, 22 bp, Homo sapiens
ggcacttccacctccagcctct

SEQ ID NO: 6320692 - DNA, 15 bp, Homo sapiens
ggcacttcctccaca

SEQ ID NO: 6320693 - DNA, 13 bp, Homo sapiens
ggcacttctgcct

SEQ ID NO: 6320694 - DNA, 22 bp, Homo sapiens
ggcacttctgccttgagtcccc

SEQ ID NO: 6320695 - DNA, 18 bp, Homo sapiens
gtcaggcccgtcagcatc

SEQ ID NO: 6320696 - DNA, 20 bp, Homo sapiens
gtcaggcccgtcggagctgc

SEQ ID NO: 6320697 - DNA, 22 bp, Homo sapiens
gtcaggcccgtcggagctgcct

SEQ ID NO: 6320698 - DNA, 15 bp, Homo sapiens
gtcaggccctctgcc

SEQ ID NO: 6320699 - DNA, 18 bp, Homo sapiens
gtcaggccctctgcctgc

SEQ ID NO: 6320700 - DNA, 20 bp, Homo sapiens
gtcaggccctctgcctgcac

SEQ ID NO: 6320701 - DNA, 23 bp, Homo sapiens
gtcaggccctctgcctgcactcc

SEQ ID NO: 6320702 - DNA, 22 bp, Homo sapiens
gtcaggccctgactcctctggc

SEQ ID NO: 6320703 - DNA, 15 bp, Homo sapiens
gtcaggccctggaac

SEQ ID NO: 6320704 - DNA, 16 bp, Homo sapiens
gtcaggccgggcagag

SEQ ID NO: 6320705 - DNA, 17 bp, Homo sapiens
gtcaggccgggcagagc

SEQ ID NO: 6320706 - DNA, 15 bp, Homo sapiens
gtcaggcctggcctc

SEQ ID NO: 6320707 - DNA, 15 bp, Homo sapiens
gtcaggcctgggcag

SEQ ID NO: 6320708 - DNA, 23 bp, Homo sapiens
gtcaggcctgtgtgtgaaaggaa

SEQ ID NO: 6320709 - DNA, 20 bp, Homo sapiens
gtcaggctaatgttggcaga

SEQ ID NO: 6320710 - DNA, 20 bp, Homo sapiens
gtcaggctacaggtgcccca

SEQ ID NO: 6320711 - DNA, 17 bp, Homo sapiens
gtcaggctgaaaacaat

SEQ ID NO: 6320712 - DNA, 22 bp, Homo sapiens
gtcaggctgggcagccccagag

SEQ ID NO: 6320713 - DNA, 23 bp, Homo sapiens
gtcaggctgggcagccccagaga

SEQ ID NO: 6320714 - DNA, 11 bp, Homo sapiens
gtcaggctggt

SEQ ID NO: 6320715 - DNA, 23 bp, Homo sapiens
gtcaggctgttggcgtgtcccag

SEQ ID NO: 6320716 - DNA, 17 bp, Homo sapiens
gtcaggcttctcttgct

SEQ ID NO: 6320717 - DNA, 13 bp, Homo sapiens
gtcagggacagca

SEQ ID NO: 6320718 - DNA, 16 bp, Homo sapiens
gtcagggacagcagcc

SEQ ID NO: 6320719 - DNA, 19 bp, Homo sapiens
gtcagggacagcagcctcc

SEQ ID NO: 6320720 - DNA, 13 bp, Homo sapiens
gtcagggaccaag

SEQ ID NO: 6320721 - DNA, 14 bp, Homo sapiens
gtcagggaccaagg

SEQ ID NO: 6320722 - DNA, 21 bp, Homo sapiens
gtcagggaccaaggacccctc

SEQ ID NO: 6320723 - DNA, 14 bp, Homo sapiens
gtcagggacccctg

SEQ ID NO: 6320724 - DNA, 16 bp, Homo sapiens
gtcagggacctgctgc

SEQ ID NO: 6320725 - DNA, 16 bp, Homo sapiens
gtcagggacttggaca

SEQ ID NO: 6320726 - DNA, 16 bp, Homo sapiens
gtcagggagggccagg

SEQ ID NO: 6320727 - DNA, 14 bp, Homo sapiens
gtcagggagtgctg

SEQ ID NO: 6320728 - DNA, 22 bp, Homo sapiens
gtcagggagtgctggctcacag

SEQ ID NO: 6320729 - DNA, 12 bp, Homo sapiens
gtcagggcagta

SEQ ID NO: 6320730 - DNA, 14 bp, Homo sapiens
gtcagggccaggtg

SEQ ID NO: 6320731 - DNA, 12 bp, Homo sapiens
gtcagggcccaa

SEQ ID NO: 6320732 - DNA, 14 bp, Homo sapiens
gtcagggcccaagt

SEQ ID NO: 6320733 - DNA, 20 bp, Homo sapiens
gtcagggcccaagtccctgt

SEQ ID NO: 6320734 - DNA, 15 bp, Homo sapiens
gtcagggcccagagg

SEQ ID NO: 6320735 - DNA, 18 bp, Homo sapiens
gtcagggccttggcccag

SEQ ID NO: 6320736 - DNA, 17 bp, Homo sapiens
gtcagggcggggctggc

SEQ ID NO: 6320737 - DNA, 18 bp, Homo sapiens
gtcagggctgtgctttcc

SEQ ID NO: 6320738 - DNA, 15 bp, Homo sapiens
gtcaggggagaagct

SEQ ID NO: 6320739 - DNA, 17 bp, Homo sapiens
gtcaggggagaagctga

SEQ ID NO: 6320740 - DNA, 15 bp, Homo sapiens
gtcaggggctctgtg

SEQ ID NO: 6320741 - DNA, 14 bp, Homo sapiens
gtcaggggctgggc

SEQ ID NO: 6320742 - DNA, 14 bp, Homo sapiens
gtcaggggcttgga

SEQ ID NO: 6320743 - DNA, 17 bp, Homo sapiens
gtcaggggtcaggtgtc

SEQ ID NO: 6320744 - DNA, 15 bp, Homo sapiens
gtcagggtgggaaga

SEQ ID NO: 6320745 - DNA, 19 bp, Homo sapiens
gtcagggtgtgggatctga

SEQ ID NO: 6320746 - DNA, 17 bp, Homo sapiens
gtcagggttggtgtgct

SEQ ID NO: 6320747 - DNA, 22 bp, Homo sapiens
gtcagggtttgtcagaggaaca

SEQ ID NO: 6320748 - DNA, 18 bp, Homo sapiens
gtcaggtaggggggaaac

SEQ ID NO: 6320749 - DNA, 16 bp, Homo sapiens
gtcaggtcccagcgag

SEQ ID NO: 6320750 - DNA, 18 bp, Homo sapiens
gtcaggtcccagcgagcc

SEQ ID NO: 6320751 - DNA, 19 bp, Homo sapiens
gtcaggtcccagcgagcca

SEQ ID NO: 6320752 - DNA, 14 bp, Homo sapiens
gtcaggtgaccctg

SEQ ID NO: 6320753 - DNA, 19 bp, Homo sapiens
gtcaggtgcagtcccagtc

SEQ ID NO: 6320754 - DNA, 15 bp, Homo sapiens
gtcaggtggaccctg

SEQ ID NO: 6320755 - DNA, 18 bp, Homo sapiens
gtcaggtggggcagcttg

SEQ ID NO: 6320756 - DNA, 22 bp, Homo sapiens
gtcaggtggttaccaggcactg

SEQ ID NO: 6320757 - DNA, 15 bp, Homo sapiens
gtcaggtgtcaggcc

SEQ ID NO: 6320758 - DNA, 13 bp, Homo sapiens
gtcaggttcttgc

SEQ ID NO: 6320759 - DNA, 17 bp, Homo sapiens
gtcaggttcttgccttt

SEQ ID NO: 6320760 - DNA, 15 bp, Homo sapiens
gtcaggtttaacatt

SEQ ID NO: 6320761 - DNA, 15 bp, Homo sapiens
gtcagtaaatactcc

SEQ ID NO: 6320762 - DNA, 14 bp, Homo sapiens
gtcagtaatttata

SEQ ID NO: 6320763 - DNA, 20 bp, Homo sapiens
gtcagtacccacctgagctt

SEQ ID NO: 6320764 - DNA, 20 bp, Homo sapiens
gtcagtactttctttctgtg

SEQ ID NO: 6320765 - DNA, 14 bp, Homo sapiens
gtcagtagactgtg

SEQ ID NO: 6320766 - DNA, 17 bp, Homo sapiens
gtcagtagccagagttg

SEQ ID NO: 6320767 - DNA, 22 bp, Homo sapiens
gtcagtaggagaggatgcacag

SEQ ID NO: 6320768 - DNA, 19 bp, Homo sapiens
gtcagtagtgctaatgcat

SEQ ID NO: 6320769 - DNA, 16 bp, Homo sapiens
gtcagtatccaggctt

SEQ ID NO: 6320770 - DNA, 14 bp, Homo sapiens
gtcagtattatcta

SEQ ID NO: 6320771 - DNA, 21 bp, Homo sapiens
gtcagtcacaaaccagcctgg

SEQ ID NO: 6320772 - DNA, 22 bp, Homo sapiens
gtcagtcacaaaccagcctggg

SEQ ID NO: 6320773 - DNA, 13 bp, Homo sapiens
gtcagtcacagcc

SEQ ID NO: 6320774 - DNA, 14 bp, Homo sapiens
gtcagtcacagcca

SEQ ID NO: 6320775 - DNA, 14 bp, Homo sapiens
gtcagtcccactgc

SEQ ID NO: 6320776 - DNA, 17 bp, Homo sapiens
gtcagtcgatattccca

SEQ ID NO: 6320777 - DNA, 15 bp, Homo sapiens
gtcagtcgtgttgct

SEQ ID NO: 6320778 - DNA, 13 bp, Homo sapiens
gtcagtctgtcca

SEQ ID NO: 6320779 - DNA, 17 bp, Homo sapiens
gtcagtctttttctgtt

SEQ ID NO: 6320780 - DNA, 21 bp, Homo sapiens
gtcagtctttttctgttgtaa

SEQ ID NO: 6320781 - DNA, 23 bp, Homo sapiens
gtcagtgaagcccaggaggacct

SEQ ID NO: 6320782 - DNA, 18 bp, Homo sapiens
gtcagtgcaaatgtcaga

SEQ ID NO: 6320783 - DNA, 23 bp, Homo sapiens
gtcagtgcagcccgtgtggcccc

SEQ ID NO: 6320784 - DNA, 22 bp, Homo sapiens
gtcagtgctataaatgccagag

SEQ ID NO: 6320785 - DNA, 16 bp, Homo sapiens
gtcagtgctcagaaat

SEQ ID NO: 6320786 - DNA, 14 bp, Homo sapiens
gtcagtggccaggt

SEQ ID NO: 6320787 - DNA, 22 bp, Homo sapiens
gtcagtgggaacgtgactgccc

SEQ ID NO: 6320788 - DNA, 21 bp, Homo sapiens
gtcagtggtttctacttcccc

SEQ ID NO: 6320789 - DNA, 22 bp, Homo sapiens
gtcagtggtttctacttcccct

SEQ ID NO: 6320790 - DNA, 21 bp, Homo sapiens
gtcagtgtacacgtctggacc

SEQ ID NO: 6320791 - DNA, 19 bp, Homo sapiens
gtcagtgtactctgagtcc

SEQ ID NO: 6320792 - DNA, 22 bp, Homo sapiens
gtcagtgtactctgagtcctca

SEQ ID NO: 6320793 - DNA, 20 bp, Homo sapiens
gtcagtgtagacacaggtca

SEQ ID NO: 6320794 - DNA, 21 bp, Homo sapiens
gtcagtgtagacacaggtcac

SEQ ID NO: 6320795 - DNA, 15 bp, Homo sapiens
gtcagtgtgactgat

SEQ ID NO: 6320796 - DNA, 20 bp, Homo sapiens
gtcagtgtgcaaagaaaaga

SEQ ID NO: 6320797 - DNA, 22 bp, Homo sapiens
gtcagtgtgccaccctctgcag

SEQ ID NO: 6320798 - DNA, 15 bp, Homo sapiens
gtcagtgtggagagg

SEQ ID NO: 6320799 - DNA, 16 bp, Homo sapiens
gtcagtgtggagaggg

SEQ ID NO: 6320800 - DNA, 19 bp, Homo sapiens
gtcagtgtggagaggggtg

SEQ ID NO: 6320801 - DNA, 19 bp, Homo sapiens
gtcagtgttaaagattttg

SEQ ID NO: 6320802 - DNA, 10 bp, Homo sapiens
gtcagtgttt

SEQ ID NO: 6320803 - DNA, 18 bp, Homo sapiens
gtcagtgtttcttttaag

SEQ ID NO: 6320804 - DNA, 16 bp, Homo sapiens
gtcagtgtttttgaaa

SEQ ID NO: 6320805 - DNA, 16 bp, Homo sapiens
gtcagttcataatata

SEQ ID NO: 6320806 - DNA, 19 bp, Homo sapiens
gtcagttcccggagcacag

SEQ ID NO: 6320807 - DNA, 22 bp, Homo sapiens
gtcagttcccggagcacagccc

SEQ ID NO: 6320808 - DNA, 11 bp, Homo sapiens
gtcagttgaac

SEQ ID NO: 6320809 - DNA, 17 bp, Homo sapiens
gtcagttggagaaaatg

SEQ ID NO: 6320810 - DNA, 15 bp, Homo sapiens
gtcagttgggccccc

SEQ ID NO: 6320811 - DNA, 16 bp, Homo sapiens
gtcagttgggccccca

SEQ ID NO: 6320812 - DNA, 18 bp, Homo sapiens
gtcagttgggcccccatc

SEQ ID NO: 6320813 - DNA, 17 bp, Homo sapiens
gtcagttgtacttctgc

SEQ ID NO: 6320814 - DNA, 18 bp, Homo sapiens
gtcagtttcactccctct

SEQ ID NO: 6320815 - DNA, 13 bp, Homo sapiens
gtcagtttcccct

SEQ ID NO: 6320816 - DNA, 15 bp, Homo sapiens
gtcagtttcccctct

SEQ ID NO: 6320817 - DNA, 19 bp, Homo sapiens
gtcagtttgtgaagtgatt

SEQ ID NO: 6320818 - DNA, 11 bp, Homo sapiens
gtcagttttca

SEQ ID NO: 6320819 - DNA, 17 bp, Homo sapiens
gtcagttttcacagagg

SEQ ID NO: 6320820 - DNA, 14 bp, Homo sapiens
gtcagtttttcctc

SEQ ID NO: 6320821 - DNA, 13 bp, Homo sapiens
gtcataaaatgct

SEQ ID NO: 6320822 - DNA, 14 bp, Homo sapiens
gtcataaaatgcta

SEQ ID NO: 6320823 - DNA, 11 bp, Homo sapiens
gtcataaacac

SEQ ID NO: 6320824 - DNA, 21 bp, Homo sapiens
gtcataaagtgagaaaactgt

SEQ ID NO: 6320825 - DNA, 22 bp, Homo sapiens
gtcataaagtgagaaaactgtg

SEQ ID NO: 6320826 - DNA, 16 bp, Homo sapiens
gtcataaatactgtca

SEQ ID NO: 6320827 - DNA, 17 bp, Homo sapiens
gtcataactagaactga

SEQ ID NO: 6320828 - DNA, 22 bp, Homo sapiens
gtcataactagaactgaatttt

SEQ ID NO: 6320829 - DNA, 14 bp, Homo sapiens
gtcataaggcggcg

SEQ ID NO: 6320830 - DNA, 14 bp, Homo sapiens
gtcataagtgggga

SEQ ID NO: 6320831 - DNA, 15 bp, Homo sapiens
gtcataataaagttg

SEQ ID NO: 6320832 - DNA, 18 bp, Homo sapiens
gtcataataaagttgttt

SEQ ID NO: 6320833 - DNA, 14 bp, Homo sapiens
gtcataatgaataa

SEQ ID NO: 6320834 - DNA, 21 bp, Homo sapiens
gtcataatgtgttgtgaaaat

SEQ ID NO: 6320835 - DNA, 12 bp, Homo sapiens
gtcataattgca

SEQ ID NO: 6320836 - DNA, 12 bp, Homo sapiens
gtcatacagaga

SEQ ID NO: 6320837 - DNA, 13 bp, Homo sapiens
gtcatacagagaa

SEQ ID NO: 6320838 - DNA, 14 bp, Homo sapiens
gtcatacagtaaac

SEQ ID NO: 6320839 - DNA, 16 bp, Homo sapiens
gtcataccaggccgcc

SEQ ID NO: 6320840 - DNA, 12 bp, Homo sapiens
gtcataccatcc

SEQ ID NO: 6320841 - DNA, 20 bp, Homo sapiens
gtcatacctggaatgtgtca

SEQ ID NO: 6320842 - DNA, 21 bp, Homo sapiens
gtcatacgtctttagatgcta

SEQ ID NO: 6320843 - DNA, 21 bp, Homo sapiens
gtcatactatctactctcctc

SEQ ID NO: 6320844 - DNA, 22 bp, Homo sapiens
gtcatactatctactctcctca

SEQ ID NO: 6320845 - DNA, 13 bp, Homo sapiens
gtcatagaaatat

SEQ ID NO: 6320846 - DNA, 16 bp, Homo sapiens
gtcatagattcttgag

SEQ ID NO: 6320847 - DNA, 15 bp, Homo sapiens
gtcataggaagttag

SEQ ID NO: 6320848 - DNA, 19 bp, Homo sapiens
gtcataggcttctgcacgt

SEQ ID NO: 6320849 - DNA, 18 bp, Homo sapiens
gtcatagggattgtccct

SEQ ID NO: 6320850 - DNA, 21 bp, Homo sapiens
gtcatagggattgtccctgtg

SEQ ID NO: 6320851 - DNA, 15 bp, Homo sapiens
gtcataggttaatat

SEQ ID NO: 6320852 - DNA, 17 bp, Homo sapiens
gtcatagtcttgaaatg

SEQ ID NO: 6320853 - DNA, 21 bp, Homo sapiens
gtcatagtcttgaaatgaaag

SEQ ID NO: 6320854 - DNA, 13 bp, Homo sapiens
gtcatagtttttt

SEQ ID NO: 6320855 - DNA, 12 bp, Homo sapiens
gtcatataaacc

SEQ ID NO: 6320856 - DNA, 14 bp, Homo sapiens
gtcatataaacctg

SEQ ID NO: 6320857 - DNA, 14 bp, Homo sapiens
gtcatatagtaaac

SEQ ID NO: 6320858 - DNA, 15 bp, Homo sapiens
gtcatatattcatgt

SEQ ID NO: 6320859 - DNA, 20 bp, Homo sapiens
gtcatatcactaaataaaca

SEQ ID NO: 6320860 - DNA, 20 bp, Homo sapiens
gtcatatcatttcactgtct

SEQ ID NO: 6320861 - DNA, 21 bp, Homo sapiens
gtcatatggaaaaaatgtatg

SEQ ID NO: 6320862 - DNA, 12 bp, Homo sapiens
gtcatatgttgt

SEQ ID NO: 6320863 - DNA, 18 bp, Homo sapiens
gtcatatgtttattcaaa

SEQ ID NO: 6320864 - DNA, 17 bp, Homo sapiens
gtcatattaaacttctg

SEQ ID NO: 6320865 - DNA, 20 bp, Homo sapiens
gtcatattaaacttctgatt

SEQ ID NO: 6320866 - DNA, 18 bp, Homo sapiens
gtcatcaaacatttgcca

SEQ ID NO: 6320867 - DNA, 14 bp, Homo sapiens
gtcatcaacaaaag

SEQ ID NO: 6320868 - DNA, 20 bp, Homo sapiens
gtcatcaagtagtagtactt

SEQ ID NO: 6320869 - DNA, 20 bp, Homo sapiens
gtcatcaatttgtaatttta

SEQ ID NO: 6320870 - DNA, 14 bp, Homo sapiens
gtcatcactagtgg

SEQ ID NO: 6320871 - DNA, 20 bp, Homo sapiens
gtcatcagagctcctctgtc

SEQ ID NO: 6320872 - DNA, 16 bp, Homo sapiens
gtcatcagtcatcagg

SEQ ID NO: 6320873 - DNA, 15 bp, Homo sapiens
gtcatcataaaaggt

SEQ ID NO: 6320874 - DNA, 13 bp, Homo sapiens
gtcatcatacatg

SEQ ID NO: 6320875 - DNA, 15 bp, Homo sapiens
ggcacttgcctgggt

SEQ ID NO: 6320876 - DNA, 17 bp, Homo sapiens
ggcacttggcagccttg

SEQ ID NO: 6320877 - DNA, 14 bp, Homo sapiens
ggcacttgtattta

SEQ ID NO: 6320878 - DNA, 21 bp, Homo sapiens
ggcactttagtgattgctttt

SEQ ID NO: 6320879 - DNA, 22 bp, Homo sapiens
ggcactttgagatgtgttcctc

SEQ ID NO: 6320880 - DNA, 23 bp, Homo sapiens
ggcactttgagatgtgttcctcc

SEQ ID NO: 6320881 - DNA, 15 bp, Homo sapiens
ggcacttttgatgaa

SEQ ID NO: 6320882 - DNA, 15 bp, Homo sapiens
ggcactttttaacat

SEQ ID NO: 6320883 - DNA, 18 bp, Homo sapiens
ggcagaaaacagagcctg

SEQ ID NO: 6320884 - DNA, 21 bp, Homo sapiens
ggcagaaaacagagcctgcct

SEQ ID NO: 6320885 - DNA, 22 bp, Homo sapiens
ggcagaaaacagagcctgccta

SEQ ID NO: 6320886 - DNA, 15 bp, Homo sapiens
ggcagaaaagaggag

SEQ ID NO: 6320887 - DNA, 11 bp, Homo sapiens
ggcagaaaatt

SEQ ID NO: 6320888 - DNA, 23 bp, Homo sapiens
ggcagaaacacaaccactcacca

SEQ ID NO: 6320889 - DNA, 22 bp, Homo sapiens
ggcagaaaccttgtttgtttta

SEQ ID NO: 6320890 - DNA, 20 bp, Homo sapiens
ggcagaaagatttggaaaat

SEQ ID NO: 6320891 - DNA, 18 bp, Homo sapiens
ggcagaaagcagaggctg

SEQ ID NO: 6320892 - DNA, 14 bp, Homo sapiens
ggcagaaaggaaaa

SEQ ID NO: 6320893 - DNA, 17 bp, Homo sapiens
ggcagaaatacagtctt

SEQ ID NO: 6320894 - DNA, 22 bp, Homo sapiens
ggcagaaatagttgtctgtgct

SEQ ID NO: 6320895 - DNA, 19 bp, Homo sapiens
ggcagaaatcccagttcat

SEQ ID NO: 6320896 - DNA, 23 bp, Homo sapiens
ggcagaaatcccagttcatgttg

SEQ ID NO: 6320897 - DNA, 20 bp, Homo sapiens
ggcagaaatcgagagtgtgc

SEQ ID NO: 6320898 - DNA, 23 bp, Homo sapiens
ggcagaaatcgagagtgtgctct

SEQ ID NO: 6320899 - DNA, 22 bp, Homo sapiens
ggcagaaatgattaaaatgttt

SEQ ID NO: 6320900 - DNA, 20 bp, Homo sapiens
ggcagaacactaacctgacc

SEQ ID NO: 6320901 - DNA, 19 bp, Homo sapiens
ggcagaaccggtcccagcc

SEQ ID NO: 6320902 - DNA, 23 bp, Homo sapiens
ggcagaaccggtcccagcctggg

SEQ ID NO: 6320903 - DNA, 24 bp, Homo sapiens
ggcagaacctggtggctggaggca

SEQ ID NO: 6320904 - DNA, 18 bp, Homo sapiens
ggcagaacgatgcctgca

SEQ ID NO: 6320905 - DNA, 18 bp, Homo sapiens
ggcagaactcctacctga

SEQ ID NO: 6320906 - DNA, 15 bp, Homo sapiens
ggcagaactgctggg

SEQ ID NO: 6320907 - DNA, 17 bp, Homo sapiens
ggcagaactgctggggc

SEQ ID NO: 6320908 - DNA, 20 bp, Homo sapiens
ggcagaactgctggggctgg

SEQ ID NO: 6320909 - DNA, 17 bp, Homo sapiens
ggcagaagaagctggga

SEQ ID NO: 6320910 - DNA, 23 bp, Homo sapiens
ggcagaagaattgaacccaggag

SEQ ID NO: 6320911 - DNA, 16 bp, Homo sapiens
ggcagaagacaccaga

SEQ ID NO: 6320912 - DNA, 20 bp, Homo sapiens
ggcagaagacaccagagcag

SEQ ID NO: 6320913 - DNA, 21 bp, Homo sapiens
ggcagaagactagaggccagg

SEQ ID NO: 6320914 - DNA, 20 bp, Homo sapiens
ggcagaagcattgcctggac

SEQ ID NO: 6320915 - DNA, 20 bp, Homo sapiens
ggcagaagcgtctcccttgg

SEQ ID NO: 6320916 - DNA, 18 bp, Homo sapiens
ggcagaagcttggaggag

SEQ ID NO: 6320917 - DNA, 22 bp, Homo sapiens
ggcagaaggaggaagggactgg

SEQ ID NO: 6320918 - DNA, 13 bp, Homo sapiens
ggcagaaggggaa

SEQ ID NO: 6320919 - DNA, 15 bp, Homo sapiens
ggcagaagtcagccc

SEQ ID NO: 6320920 - DNA, 15 bp, Homo sapiens
ggcagaagtgctctt

SEQ ID NO: 6320921 - DNA, 20 bp, Homo sapiens
ggcagaagtgtcaccctgtg

SEQ ID NO: 6320922 - DNA, 18 bp, Homo sapiens
ggcagaatcctgggcccc

SEQ ID NO: 6320923 - DNA, 18 bp, Homo sapiens
ggcagaatgctagctctg

SEQ ID NO: 6320924 - DNA, 15 bp, Homo sapiens
ggcagacaaccttgt

SEQ ID NO: 6320925 - DNA, 18 bp, Homo sapiens
ggcagacaagagctgctg

SEQ ID NO: 6320926 - DNA, 12 bp, Homo sapiens
ggcagacacaac

SEQ ID NO: 6320927 - DNA, 20 bp, Homo sapiens
ggcagacacaccgcggccag

SEQ ID NO: 6320928 - DNA, 21 bp, Homo sapiens
ggcagacacaccgcggccagg

SEQ ID NO: 6320929 - DNA, 18 bp, Homo sapiens
ggcagacacatgctgttg

SEQ ID NO: 6320930 - DNA, 17 bp, Homo sapiens
ggcagacacggatctga

SEQ ID NO: 6320931 - DNA, 16 bp, Homo sapiens
ggcagacagcagctca

SEQ ID NO: 6320932 - DNA, 18 bp, Homo sapiens
ggcagacagcagctcagg

SEQ ID NO: 6320933 - DNA, 15 bp, Homo sapiens
ggcagacaggaagga

SEQ ID NO: 6320934 - DNA, 19 bp, Homo sapiens
ggcagacaggaaggaagca

SEQ ID NO: 6320935 - DNA, 23 bp, Homo sapiens
ggcagacaggcgctggacagagg

SEQ ID NO: 6320936 - DNA, 21 bp, Homo sapiens
ggcagacaggtgggagatgga

SEQ ID NO: 6320937 - DNA, 20 bp, Homo sapiens
ggcagacattgtgctagtgc

SEQ ID NO: 6320938 - DNA, 16 bp, Homo sapiens
ggcagaccgggccccc

SEQ ID NO: 6320939 - DNA, 18 bp, Homo sapiens
ggcagaccgggcccccct

SEQ ID NO: 6320940 - DNA, 17 bp, Homo sapiens
ggcagaccgggggccag

SEQ ID NO: 6320941 - DNA, 20 bp, Homo sapiens
ggcagaccgggggccagaca

SEQ ID NO: 6320942 - DNA, 16 bp, Homo sapiens
ggcagacgggagggga

SEQ ID NO: 6320943 - DNA, 17 bp, Homo sapiens
ggcagacgtctgtcagg

SEQ ID NO: 6320944 - DNA, 21 bp, Homo sapiens
ggcagacgtctgtcaggggct

SEQ ID NO: 6320945 - DNA, 19 bp, Homo sapiens
ggcagactcaaggggctgg

SEQ ID NO: 6320946 - DNA, 21 bp, Homo sapiens
ggcagactctttaataaattg

SEQ ID NO: 6320947 - DNA, 19 bp, Homo sapiens
ggcagactctttatgcttg

SEQ ID NO: 6320948 - DNA, 20 bp, Homo sapiens
ggcagactctttatgcttgc

SEQ ID NO: 6320949 - DNA, 19 bp, Homo sapiens
ggcagagaaaacacacgct

SEQ ID NO: 6320950 - DNA, 14 bp, Homo sapiens
ggcagagaaagaag

SEQ ID NO: 6320951 - DNA, 16 bp, Homo sapiens
ggcagagaagagacca

SEQ ID NO: 6320952 - DNA, 16 bp, Homo sapiens
ggcagagaaggcctct

SEQ ID NO: 6320953 - DNA, 20 bp, Homo sapiens
ggcagagaagtggagtgact

SEQ ID NO: 6320954 - DNA, 15 bp, Homo sapiens
ggcagagaagttctc

SEQ ID NO: 6320955 - DNA, 19 bp, Homo sapiens
ggcagagaatctcttggga

SEQ ID NO: 6320956 - DNA, 19 bp, Homo sapiens
ggcagagaccaccgcgccc

SEQ ID NO: 6320957 - DNA, 24 bp, Homo sapiens
ggcagagaccccaggatcccagag

SEQ ID NO: 6320958 - DNA, 16 bp, Homo sapiens
ggcagagacctcctga

SEQ ID NO: 6320959 - DNA, 17 bp, Homo sapiens
ggcagagagcgaccagc

SEQ ID NO: 6320960 - DNA, 15 bp, Homo sapiens
ggcagagaggagtga

SEQ ID NO: 6320961 - DNA, 18 bp, Homo sapiens
ggcagagatgcctccctg

SEQ ID NO: 6320962 - DNA, 23 bp, Homo sapiens
ggcagagattgggggggcttggg

SEQ ID NO: 6320963 - DNA, 13 bp, Homo sapiens
ggcagagcacagc

SEQ ID NO: 6320964 - DNA, 15 bp, Homo sapiens
ggcagagcacagccc

SEQ ID NO: 6320965 - DNA, 17 bp, Homo sapiens
ggcagagcacagcccac

SEQ ID NO: 6320966 - DNA, 20 bp, Homo sapiens
ggcagagcacagcccacggg

SEQ ID NO: 6320967 - DNA, 12 bp, Homo sapiens
ggcagagcattt

SEQ ID NO: 6320968 - DNA, 14 bp, Homo sapiens
ggcagagccaggaa

SEQ ID NO: 6320969 - DNA, 14 bp, Homo sapiens
ggcagagccaggat

SEQ ID NO: 6320970 - DNA, 16 bp, Homo sapiens
ggcagagccataatgg

SEQ ID NO: 6320971 - DNA, 14 bp, Homo sapiens
ggcagagccatggg

SEQ ID NO: 6320972 - DNA, 23 bp, Homo sapiens
ggcagagccatgggcctgggcct

SEQ ID NO: 6320973 - DNA, 16 bp, Homo sapiens
ggcagagcccaaggga

SEQ ID NO: 6320974 - DNA, 14 bp, Homo sapiens
ggcagagccctgct

SEQ ID NO: 6320975 - DNA, 16 bp, Homo sapiens
ggcagagccgggaagc

SEQ ID NO: 6320976 - DNA, 12 bp, Homo sapiens
ggcagagcctct

SEQ ID NO: 6320977 - DNA, 16 bp, Homo sapiens
ggcagagcctctgaga

SEQ ID NO: 6320978 - DNA, 12 bp, Homo sapiens
ggcagagcctgt

SEQ ID NO: 6320979 - DNA, 14 bp, Homo sapiens
ggcagagcctgtcc

SEQ ID NO: 6320980 - DNA, 18 bp, Homo sapiens
ggcagagcgggagggagt

SEQ ID NO: 6320981 - DNA, 18 bp, Homo sapiens
ggcagagcggggaggtgc

SEQ ID NO: 6320982 - DNA, 15 bp, Homo sapiens
ggcagagctcagagg

SEQ ID NO: 6320983 - DNA, 16 bp, Homo sapiens
ggcagagctctacagg

SEQ ID NO: 6320984 - DNA, 12 bp, Homo sapiens
ggcagagctgag

SEQ ID NO: 6320985 - DNA, 18 bp, Homo sapiens
ggcagagctgagggccct

SEQ ID NO: 6320986 - DNA, 18 bp, Homo sapiens
ggcagagctgctcccctc

SEQ ID NO: 6320987 - DNA, 24 bp, Homo sapiens
ggcagagctggagcccccagcaga

SEQ ID NO: 6320988 - DNA, 15 bp, Homo sapiens
ggcagagctggtgcg

SEQ ID NO: 6320989 - DNA, 17 bp, Homo sapiens
ggcagagctgtggcaca

SEQ ID NO: 6320990 - DNA, 20 bp, Homo sapiens
ggcagagcttctcctgacca

SEQ ID NO: 6320991 - DNA, 21 bp, Homo sapiens
ggcagaggagaacttgctgcc

SEQ ID NO: 6320992 - DNA, 14 bp, Homo sapiens
ggcagaggcagaca

SEQ ID NO: 6320993 - DNA, 14 bp, Homo sapiens
ggcagaggcccagg

SEQ ID NO: 6320994 - DNA, 19 bp, Homo sapiens
ggcagaggcccaggctgcc

SEQ ID NO: 6320995 - DNA, 22 bp, Homo sapiens
ggcagaggcccaggctgccgtc

SEQ ID NO: 6320996 - DNA, 17 bp, Homo sapiens
ggcagaggcctgggctg

SEQ ID NO: 6320997 - DNA, 22 bp, Homo sapiens
ggcagaggctggaggcagggcc

SEQ ID NO: 6320998 - DNA, 23 bp, Homo sapiens
ggcagaggctggaggcagggcct

SEQ ID NO: 6320999 - DNA, 15 bp, Homo sapiens
ggcagaggctggcac

SEQ ID NO: 6321000 - DNA, 14 bp, Homo sapiens
ggcagagggcagag

SEQ ID NO: 6321001 - DNA, 14 bp, Homo sapiens
ggcagagggctgga

SEQ ID NO: 6321002 - DNA, 13 bp, Homo sapiens
ggcagaggtggcg

SEQ ID NO: 6321003 - DNA, 21 bp, Homo sapiens
ggcagaggttgcagtgagccg

SEQ ID NO: 6321004 - DNA, 18 bp, Homo sapiens
ggcagaggttgtggtgag

SEQ ID NO: 6321005 - DNA, 21 bp, Homo sapiens
ggcagaggttttaatgtctgt

SEQ ID NO: 6321006 - DNA, 15 bp, Homo sapiens
ggcagagtcctgcct

SEQ ID NO: 6321007 - DNA, 22 bp, Homo sapiens
ggcagagtcgttggagactgaa

SEQ ID NO: 6321008 - DNA, 16 bp, Homo sapiens
ggcagagtgccccacc

SEQ ID NO: 6321009 - DNA, 22 bp, Homo sapiens
ggcagagtgccccacctgccac

SEQ ID NO: 6321010 - DNA, 16 bp, Homo sapiens
ggcagagtggagccca

SEQ ID NO: 6321011 - DNA, 17 bp, Homo sapiens
ggcagagtggagcccag

SEQ ID NO: 6321012 - DNA, 20 bp, Homo sapiens
ggcagagtggagcccagggt

SEQ ID NO: 6321013 - DNA, 23 bp, Homo sapiens
ggcagagtggagcccagggtgct

SEQ ID NO: 6321014 - DNA, 13 bp, Homo sapiens
ggcagagttacag

SEQ ID NO: 6321015 - DNA, 13 bp, Homo sapiens
ggcagagttctgt

SEQ ID NO: 6321016 - DNA, 19 bp, Homo sapiens
ggcagagttgaagacagag

SEQ ID NO: 6321017 - DNA, 15 bp, Homo sapiens
ggcagagttgtaaat

SEQ ID NO: 6321018 - DNA, 22 bp, Homo sapiens
ggcagagttgtaaatatataaa

SEQ ID NO: 6321019 - DNA, 23 bp, Homo sapiens
ggcagagttgtaaatatataaat

SEQ ID NO: 6321020 - DNA, 21 bp, Homo sapiens
ggcagagtttgtgtgttgtct

SEQ ID NO: 6321021 - DNA, 15 bp, Homo sapiens
ggcagataactgctg

SEQ ID NO: 6321022 - DNA, 16 bp, Homo sapiens
ggcagataactgctgt

SEQ ID NO: 6321023 - DNA, 20 bp, Homo sapiens
ggcagataatcagcctctta

SEQ ID NO: 6321024 - DNA, 16 bp, Homo sapiens
ggcagatcacaaggtc

SEQ ID NO: 6321025 - DNA, 20 bp, Homo sapiens
ggcagatctgtgccccatgc

SEQ ID NO: 6321026 - DNA, 14 bp, Homo sapiens
ggcagatgagggct

SEQ ID NO: 6321027 - DNA, 15 bp, Homo sapiens
ggcagatgagggctg

SEQ ID NO: 6321028 - DNA, 14 bp, Homo sapiens
ggcagatgcacatg

SEQ ID NO: 6321029 - DNA, 18 bp, Homo sapiens
ggcagatgcagctcttcc

SEQ ID NO: 6321030 - DNA, 13 bp, Homo sapiens
ggcagatgccctt

SEQ ID NO: 6321031 - DNA, 17 bp, Homo sapiens
ggcagatgcccttgctg

SEQ ID NO: 6321032 - DNA, 15 bp, Homo sapiens
ggcagatggacttct

SEQ ID NO: 6321033 - DNA, 16 bp, Homo sapiens
ggcagatggagcccat

SEQ ID NO: 6321034 - DNA, 19 bp, Homo sapiens
ggcagatggcagggctgag

SEQ ID NO: 6321035 - DNA, 19 bp, Homo sapiens
ggcagatgggcctgtgtgc

SEQ ID NO: 6321036 - DNA, 23 bp, Homo sapiens
ggcagatgggggcctctctggaa

SEQ ID NO: 6321037 - DNA, 16 bp, Homo sapiens
ggcagatgtaggaggg

SEQ ID NO: 6321038 - DNA, 17 bp, Homo sapiens
ggcagatgtaggaggga

SEQ ID NO: 6321039 - DNA, 21 bp, Homo sapiens
ggcagatgtctcccctgccac

SEQ ID NO: 6321040 - DNA, 22 bp, Homo sapiens
ggcagatgtcttccctgggctg

SEQ ID NO: 6321041 - DNA, 13 bp, Homo sapiens
ggcagattaataa

SEQ ID NO: 6321042 - DNA, 14 bp, Homo sapiens
ggcagattaataac

SEQ ID NO: 6321043 - DNA, 15 bp, Homo sapiens
ggcagattcccactg

SEQ ID NO: 6321044 - DNA, 23 bp, Homo sapiens
ggcagatttactgtcccaggagc

SEQ ID NO: 6321045 - DNA, 21 bp, Homo sapiens
ggcagattttacaaaagatgt

SEQ ID NO: 6321046 - DNA, 17 bp, Homo sapiens
ggcagattttcatgcaa

SEQ ID NO: 6321047 - DNA, 22 bp, Homo sapiens
ggcagattttggttggttttta

SEQ ID NO: 6321048 - DNA, 22 bp, Homo sapiens
ggcagcaaaacaagtgacatga

SEQ ID NO: 6321049 - DNA, 16 bp, Homo sapiens
ggcagcaaaggaagac

SEQ ID NO: 6321050 - DNA, 17 bp, Homo sapiens
ggcagcaacaataaata

SEQ ID NO: 6321051 - DNA, 15 bp, Homo sapiens
gtcatcatcagggcc

SEQ ID NO: 6321052 - DNA, 20 bp, Homo sapiens
gtcatcatcatggccagctg

SEQ ID NO: 6321053 - DNA, 16 bp, Homo sapiens
gtcatcatctccaaac

SEQ ID NO: 6321054 - DNA, 17 bp, Homo sapiens
gtcatcatgaactggct

SEQ ID NO: 6321055 - DNA, 19 bp, Homo sapiens
gtcatcatgaactggcttg

SEQ ID NO: 6321056 - DNA, 18 bp, Homo sapiens
gtcatcatttgtcctgtt

SEQ ID NO: 6321057 - DNA, 21 bp, Homo sapiens
gtcatccaaatggactggcca

SEQ ID NO: 6321058 - DNA, 22 bp, Homo sapiens
gtcatccaacaagaagaaatat

SEQ ID NO: 6321059 - DNA, 23 bp, Homo sapiens
gtcatccacacaacaccaggact

SEQ ID NO: 6321060 - DNA, 16 bp, Homo sapiens
gtcatccacctgtctt

SEQ ID NO: 6321061 - DNA, 20 bp, Homo sapiens
gtcatcccagcacctgccag

SEQ ID NO: 6321062 - DNA, 21 bp, Homo sapiens
gtcatcccctacactttggcc

SEQ ID NO: 6321063 - DNA, 15 bp, Homo sapiens
gtcatcccgctcctg

SEQ ID NO: 6321064 - DNA, 19 bp, Homo sapiens
gtcatcccgctcctgctga

SEQ ID NO: 6321065 - DNA, 19 bp, Homo sapiens
gtcatcccttcctcctctc

SEQ ID NO: 6321066 - DNA, 24 bp, Homo sapiens
gtcatcccttcctcctctcctgga

SEQ ID NO: 6321067 - DNA, 18 bp, Homo sapiens
gtcatcctcacagtgaac

SEQ ID NO: 6321068 - DNA, 17 bp, Homo sapiens
gtcatcctcaggaacca

SEQ ID NO: 6321069 - DNA, 13 bp, Homo sapiens
gtcatcctccctt

SEQ ID NO: 6321070 - DNA, 22 bp, Homo sapiens
gtcatcctcccttgccccaggc

SEQ ID NO: 6321071 - DNA, 16 bp, Homo sapiens
gtcatccttggtgctc

SEQ ID NO: 6321072 - DNA, 22 bp, Homo sapiens
gtcatcgattcaaactgctcca

SEQ ID NO: 6321073 - DNA, 18 bp, Homo sapiens
gtcatcggaggctgggcc

SEQ ID NO: 6321074 - DNA, 18 bp, Homo sapiens
gtcatcgttccccacccc

SEQ ID NO: 6321075 - DNA, 22 bp, Homo sapiens
gtcatctaaccattaagtcatg

SEQ ID NO: 6321076 - DNA, 13 bp, Homo sapiens
gtcatctagcatt

SEQ ID NO: 6321077 - DNA, 23 bp, Homo sapiens
gtcatctagcgcaattgaaggat

SEQ ID NO: 6321078 - DNA, 12 bp, Homo sapiens
gtcatctcaggg

SEQ ID NO: 6321079 - DNA, 17 bp, Homo sapiens
gtcatctccatcagctg

SEQ ID NO: 6321080 - DNA, 16 bp, Homo sapiens
gtcatctcccctcctg

SEQ ID NO: 6321081 - DNA, 21 bp, Homo sapiens
gtcatctgataatttcacaga

SEQ ID NO: 6321082 - DNA, 17 bp, Homo sapiens
gtcatctgattggacag

SEQ ID NO: 6321083 - DNA, 19 bp, Homo sapiens
gtcatctgattggacaggc

SEQ ID NO: 6321084 - DNA, 11 bp, Homo sapiens
gtcatctgcca

SEQ ID NO: 6321085 - DNA, 12 bp, Homo sapiens
gtcatctgccag

SEQ ID NO: 6321086 - DNA, 18 bp, Homo sapiens
gtcatctgcggggcttct

SEQ ID NO: 6321087 - DNA, 20 bp, Homo sapiens
gtcatctgcggggcttctgg

SEQ ID NO: 6321088 - DNA, 17 bp, Homo sapiens
gtcatctgctccttcct

SEQ ID NO: 6321089 - DNA, 19 bp, Homo sapiens
gtcatctgctccttcctgt

SEQ ID NO: 6321090 - DNA, 13 bp, Homo sapiens
gtcatctgctgcg

SEQ ID NO: 6321091 - DNA, 12 bp, Homo sapiens
gtcatctgtcag

SEQ ID NO: 6321092 - DNA, 17 bp, Homo sapiens
gtcatctgttagggcct

SEQ ID NO: 6321093 - DNA, 13 bp, Homo sapiens
gtcatctgtttaa

SEQ ID NO: 6321094 - DNA, 13 bp, Homo sapiens
gtcatcttccctg

SEQ ID NO: 6321095 - DNA, 19 bp, Homo sapiens
gtcatcttccctgcccctg

SEQ ID NO: 6321096 - DNA, 20 bp, Homo sapiens
gtcatcttgaccaagcagga

SEQ ID NO: 6321097 - DNA, 13 bp, Homo sapiens
gtcatcttgcaca

SEQ ID NO: 6321098 - DNA, 23 bp, Homo sapiens
gtcatctttcttttctttgagtc

SEQ ID NO: 6321099 - DNA, 13 bp, Homo sapiens
gtcatgaacatgg

SEQ ID NO: 6321100 - DNA, 14 bp, Homo sapiens
gtcatgaagcccaa

SEQ ID NO: 6321101 - DNA, 18 bp, Homo sapiens
gtcatgaaggacactctg

SEQ ID NO: 6321102 - DNA, 19 bp, Homo sapiens
gtcatgaaggacactctgc

SEQ ID NO: 6321103 - DNA, 22 bp, Homo sapiens
gtcatgaattcatactctgttg

SEQ ID NO: 6321104 - DNA, 20 bp, Homo sapiens
gtcatgaattcttatgctta

SEQ ID NO: 6321105 - DNA, 19 bp, Homo sapiens
gtcatgacaagatgggaca

SEQ ID NO: 6321106 - DNA, 16 bp, Homo sapiens
gtcatgacatttctca

SEQ ID NO: 6321107 - DNA, 18 bp, Homo sapiens
gtcatgacatttctcaaa

SEQ ID NO: 6321108 - DNA, 23 bp, Homo sapiens
gtcatgagagaatgggtttactc

SEQ ID NO: 6321109 - DNA, 20 bp, Homo sapiens
gtcatgagcgtcaaagaaaa

SEQ ID NO: 6321110 - DNA, 18 bp, Homo sapiens
gtcatgagctgagcaggg

SEQ ID NO: 6321111 - DNA, 13 bp, Homo sapiens
gtcatgaggaaac

SEQ ID NO: 6321112 - DNA, 20 bp, Homo sapiens
gtcatgaggagattctgcct

SEQ ID NO: 6321113 - DNA, 21 bp, Homo sapiens
gtcatgaggagattctgcctt

SEQ ID NO: 6321114 - DNA, 17 bp, Homo sapiens
gtcatgatctccctgcc

SEQ ID NO: 6321115 - DNA, 22 bp, Homo sapiens
gtcatgatctccctgccgcctc

SEQ ID NO: 6321116 - DNA, 14 bp, Homo sapiens
gtcatgatgaatca

SEQ ID NO: 6321117 - DNA, 15 bp, Homo sapiens
gtcatgatggagact

SEQ ID NO: 6321118 - DNA, 24 bp, Homo sapiens
gtcatgatggatggaaatatgttc

SEQ ID NO: 6321119 - DNA, 15 bp, Homo sapiens
gtcatgatgttttta

SEQ ID NO: 6321120 - DNA, 16 bp, Homo sapiens
gtcatgattaatgtgt

SEQ ID NO: 6321121 - DNA, 23 bp, Homo sapiens
gtcatgattctatgtaatgtaaa

SEQ ID NO: 6321122 - DNA, 16 bp, Homo sapiens
gtcatgatttctgtga

SEQ ID NO: 6321123 - DNA, 17 bp, Homo sapiens
gtcatgcaaaggctggg

SEQ ID NO: 6321124 - DNA, 16 bp, Homo sapiens
gtcatgcactgaggtc

SEQ ID NO: 6321125 - DNA, 13 bp, Homo sapiens
gtcatgcataaat

SEQ ID NO: 6321126 - DNA, 18 bp, Homo sapiens
gtcatgcataaatatgca

SEQ ID NO: 6321127 - DNA, 12 bp, Homo sapiens
gtcatgcatgaa

SEQ ID NO: 6321128 - DNA, 19 bp, Homo sapiens
gtcatgcattttgctttgg

SEQ ID NO: 6321129 - DNA, 15 bp, Homo sapiens
gtcatgcccagcttg

SEQ ID NO: 6321130 - DNA, 16 bp, Homo sapiens
gtcatgcccccctcaa

SEQ ID NO: 6321131 - DNA, 17 bp, Homo sapiens
gtcatgccctcctctcc

SEQ ID NO: 6321132 - DNA, 18 bp, Homo sapiens
gtcatgccctcctctccc

SEQ ID NO: 6321133 - DNA, 14 bp, Homo sapiens
gtcatgctcagcct

SEQ ID NO: 6321134 - DNA, 21 bp, Homo sapiens
gtcatgctcagccttgctgct

SEQ ID NO: 6321135 - DNA, 23 bp, Homo sapiens
gtcatgctcagccttgctgctct

SEQ ID NO: 6321136 - DNA, 20 bp, Homo sapiens
gtcatgctcccctgtgccag

SEQ ID NO: 6321137 - DNA, 23 bp, Homo sapiens
gtcatgctcccctgtgccagccc

SEQ ID NO: 6321138 - DNA, 21 bp, Homo sapiens
gtcatgctgtccgtgcttgct

SEQ ID NO: 6321139 - DNA, 16 bp, Homo sapiens
gtcatgctgtgcattt

SEQ ID NO: 6321140 - DNA, 15 bp, Homo sapiens
gtcatgcttgtgtta

SEQ ID NO: 6321141 - DNA, 19 bp, Homo sapiens
gtcatggaaaagcccagtg

SEQ ID NO: 6321142 - DNA, 20 bp, Homo sapiens
gtcatggaaaatgtcctgtg

SEQ ID NO: 6321143 - DNA, 13 bp, Homo sapiens
gtcatggacattc

SEQ ID NO: 6321144 - DNA, 22 bp, Homo sapiens
gtcatggagaaccacctacccc

SEQ ID NO: 6321145 - DNA, 21 bp, Homo sapiens
gtcatggatcgtgttggtatt

SEQ ID NO: 6321146 - DNA, 19 bp, Homo sapiens
gtcatggcagtgcctgaac

SEQ ID NO: 6321147 - DNA, 11 bp, Homo sapiens
gtcatggccaa

SEQ ID NO: 6321148 - DNA, 12 bp, Homo sapiens
gtcatggccaca

SEQ ID NO: 6321149 - DNA, 13 bp, Homo sapiens
gtcatggccacac

SEQ ID NO: 6321150 - DNA, 18 bp, Homo sapiens
gtcatggccacactgtga

SEQ ID NO: 6321151 - DNA, 21 bp, Homo sapiens
gtcatggccacactgtgacac

SEQ ID NO: 6321152 - DNA, 16 bp, Homo sapiens
gtcatggcctgagatg

SEQ ID NO: 6321153 - DNA, 15 bp, Homo sapiens
gtcatggctcaagga

SEQ ID NO: 6321154 - DNA, 17 bp, Homo sapiens
gtcatgggagaagaggg

SEQ ID NO: 6321155 - DNA, 23 bp, Homo sapiens
gtcatgggccactgcttttccct

SEQ ID NO: 6321156 - DNA, 14 bp, Homo sapiens
gtcatggtcctggc

SEQ ID NO: 6321157 - DNA, 13 bp, Homo sapiens
gtcatggtgaaat

SEQ ID NO: 6321158 - DNA, 22 bp, Homo sapiens
gtcatggtgaaattataactat

SEQ ID NO: 6321159 - DNA, 20 bp, Homo sapiens
gtcatggtgatgcaagtcac

SEQ ID NO: 6321160 - DNA, 15 bp, Homo sapiens
gtcatggtgcaattt

SEQ ID NO: 6321161 - DNA, 20 bp, Homo sapiens
gtcatggttacaaactacag

SEQ ID NO: 6321162 - DNA, 21 bp, Homo sapiens
gtcatggtttcttggagggcc

SEQ ID NO: 6321163 - DNA, 20 bp, Homo sapiens
gtcatgtaagctgaaaatat

SEQ ID NO: 6321164 - DNA, 13 bp, Homo sapiens
gtcatgtaatact

SEQ ID NO: 6321165 - DNA, 14 bp, Homo sapiens
gtcatgtaccatca

SEQ ID NO: 6321166 - DNA, 15 bp, Homo sapiens
gtcatgtacttcttt

SEQ ID NO: 6321167 - DNA, 14 bp, Homo sapiens
gtcatgtatgtttc

SEQ ID NO: 6321168 - DNA, 14 bp, Homo sapiens
gtcatgtattttat

SEQ ID NO: 6321169 - DNA, 14 bp, Homo sapiens
gtcatgtctctaaa

SEQ ID NO: 6321170 - DNA, 15 bp, Homo sapiens
gtcatgtctgcttgt

SEQ ID NO: 6321171 - DNA, 15 bp, Homo sapiens
gtcatgtgacaggta

SEQ ID NO: 6321172 - DNA, 18 bp, Homo sapiens
gtcatgtgagtctgggat

SEQ ID NO: 6321173 - DNA, 19 bp, Homo sapiens
gtcatgtgcatctggtgta

SEQ ID NO: 6321174 - DNA, 17 bp, Homo sapiens
gtcatgtgcgaacacag

SEQ ID NO: 6321175 - DNA, 21 bp, Homo sapiens
gtcatgtgggtcttccagggg

SEQ ID NO: 6321176 - DNA, 14 bp, Homo sapiens
gtcatgtgtataaa

SEQ ID NO: 6321177 - DNA, 20 bp, Homo sapiens
gtcatgtgtcagctgtagaa

SEQ ID NO: 6321178 - DNA, 14 bp, Homo sapiens
gtcatgtgtgaaca

SEQ ID NO: 6321179 - DNA, 16 bp, Homo sapiens
gtcatgtgtgaacaca

SEQ ID NO: 6321180 - DNA, 12 bp, Homo sapiens
gtcatgtgtgca

SEQ ID NO: 6321181 - DNA, 15 bp, Homo sapiens
gtcatgtgtgcatgt

SEQ ID NO: 6321182 - DNA, 22 bp, Homo sapiens
gtcatgtgtgtattttttcata

SEQ ID NO: 6321183 - DNA, 16 bp, Homo sapiens
gtcatgtgttcccttt

SEQ ID NO: 6321184 - DNA, 18 bp, Homo sapiens
gtcatgtgttccctttgt

SEQ ID NO: 6321185 - DNA, 23 bp, Homo sapiens
gtcatgtgttccctttgtctttc

SEQ ID NO: 6321186 - DNA, 17 bp, Homo sapiens
gtcatgttccttcaaga

SEQ ID NO: 6321187 - DNA, 16 bp, Homo sapiens
gtcatgttgaaggtgc

SEQ ID NO: 6321188 - DNA, 16 bp, Homo sapiens
gtcatgttggccaggc

SEQ ID NO: 6321189 - DNA, 15 bp, Homo sapiens
gtcatgtttaagaaa

SEQ ID NO: 6321190 - DNA, 14 bp, Homo sapiens
gtcatgtttatctg

SEQ ID NO: 6321191 - DNA, 15 bp, Homo sapiens
gtcatgtttgcaggg

SEQ ID NO: 6321192 - DNA, 21 bp, Homo sapiens
gtcatgttttaaatgtacagt

SEQ ID NO: 6321193 - DNA, 14 bp, Homo sapiens
gtcattaaaataaa

SEQ ID NO: 6321194 - DNA, 19 bp, Homo sapiens
gtcattaaaatggaagtgg

SEQ ID NO: 6321195 - DNA, 13 bp, Homo sapiens
gtcattaaaattg

SEQ ID NO: 6321196 - DNA, 15 bp, Homo sapiens
gtcattaaactggtt

SEQ ID NO: 6321197 - DNA, 17 bp, Homo sapiens
gtcattaaattactata

SEQ ID NO: 6321198 - DNA, 24 bp, Homo sapiens
gtcattaaattactatagcaaagt

SEQ ID NO: 6321199 - DNA, 19 bp, Homo sapiens
gtcattaagcgggatccca

SEQ ID NO: 6321200 - DNA, 15 bp, Homo sapiens
gtcattactaaccat

SEQ ID NO: 6321201 - DNA, 23 bp, Homo sapiens
gtcattacttctgagccccagcc

SEQ ID NO: 6321202 - DNA, 13 bp, Homo sapiens
gtcattagcctga

SEQ ID NO: 6321203 - DNA, 15 bp, Homo sapiens
gtcattagtcctttg

SEQ ID NO: 6321204 - DNA, 22 bp, Homo sapiens
gtcattatagatcccccagact

SEQ ID NO: 6321205 - DNA, 15 bp, Homo sapiens
gtcattatattctaa

SEQ ID NO: 6321206 - DNA, 21 bp, Homo sapiens
gtcattatgacatttcttaaa

SEQ ID NO: 6321207 - DNA, 17 bp, Homo sapiens
gtcattatgatttcatt

SEQ ID NO: 6321208 - DNA, 14 bp, Homo sapiens
gtcattatgtagaa

SEQ ID NO: 6321209 - DNA, 18 bp, Homo sapiens
gtcattattactggtatt

SEQ ID NO: 6321210 - DNA, 15 bp, Homo sapiens
gtcattattccatct

SEQ ID NO: 6321211 - DNA, 18 bp, Homo sapiens
gtcattcaagcctgtgaa

SEQ ID NO: 6321212 - DNA, 14 bp, Homo sapiens
gtcattcagagtca

SEQ ID NO: 6321213 - DNA, 21 bp, Homo sapiens
gtcattcaggtgacctcctgc

SEQ ID NO: 6321214 - DNA, 13 bp, Homo sapiens
gtcattcagttct

SEQ ID NO: 6321215 - DNA, 19 bp, Homo sapiens
gtcattcagttctaggcct

SEQ ID NO: 6321216 - DNA, 21 bp, Homo sapiens
gtcattcagttctaggccttt

SEQ ID NO: 6321217 - DNA, 21 bp, Homo sapiens
gtcattcctaaaacacccttc

SEQ ID NO: 6321218 - DNA, 18 bp, Homo sapiens
gtcattcctaatgcatta

SEQ ID NO: 6321219 - DNA, 18 bp, Homo sapiens
gtcattctaggatgtgga

SEQ ID NO: 6321220 - DNA, 19 bp, Homo sapiens
gtcattctaggatgtggag

SEQ ID NO: 6321221 - DNA, 14 bp, Homo sapiens
gtcattctcacctg

SEQ ID NO: 6321222 - DNA, 14 bp, Homo sapiens
gtcattctcatcca

SEQ ID NO: 6321223 - DNA, 17 bp, Homo sapiens
gtcattctgcctgccct

SEQ ID NO: 6321224 - DNA, 16 bp, Homo sapiens
gtcattctgcctgctc

SEQ ID NO: 6321225 - DNA, 20 bp, Homo sapiens
gtcattctgctaatttatga

SEQ ID NO: 6321226 - DNA, 23 bp, Homo sapiens
gtcattcttaagatttctcctga

SEQ ID NO: 6321227 - DNA, 15 bp, Homo sapiens
gtcattctttattct

SEQ ID NO: 6321228 - DNA, 17 bp, Homo sapiens
gtcattctttattcttt

SEQ ID NO: 6321229 - DNA, 23 bp, Homo sapiens
gtcattcttttgccacatcccta

SEQ ID NO: 6321230 - DNA, 22 bp, Homo sapiens
ggcagcaacaataaatagacac

SEQ ID NO: 6321231 - DNA, 21 bp, Homo sapiens
ggcagcaacaggaccaggagc

SEQ ID NO: 6321232 - DNA, 20 bp, Homo sapiens
ggcagcaaggcccgagcagc

SEQ ID NO: 6321233 - DNA, 21 bp, Homo sapiens
ggcagcaaggctgctgccgga

SEQ ID NO: 6321234 - DNA, 15 bp, Homo sapiens
ggcagcaaggtcatg

SEQ ID NO: 6321235 - DNA, 15 bp, Homo sapiens
ggcagcaatttaaat

SEQ ID NO: 6321236 - DNA, 16 bp, Homo sapiens
ggcagcaatttaaatg

SEQ ID NO: 6321237 - DNA, 22 bp, Homo sapiens
ggcagcacaagtgtaatgaata

SEQ ID NO: 6321238 - DNA, 14 bp, Homo sapiens
ggcagcacagccca

SEQ ID NO: 6321239 - DNA, 18 bp, Homo sapiens
ggcagcacagcccagggc

SEQ ID NO: 6321240 - DNA, 16 bp, Homo sapiens
ggcagcaccaccacac

SEQ ID NO: 6321241 - DNA, 17 bp, Homo sapiens
ggcagcacccactcagc

SEQ ID NO: 6321242 - DNA, 12 bp, Homo sapiens
ggcagcaccctc

SEQ ID NO: 6321243 - DNA, 13 bp, Homo sapiens
ggcagcaccctcc

SEQ ID NO: 6321244 - DNA, 20 bp, Homo sapiens
ggcagcaccctcccccgcag

SEQ ID NO: 6321245 - DNA, 17 bp, Homo sapiens
ggcagcacctggagccc

SEQ ID NO: 6321246 - DNA, 18 bp, Homo sapiens
ggcagcacgcaggcgggg

SEQ ID NO: 6321247 - DNA, 19 bp, Homo sapiens
ggcagcacgcaggcggggc

SEQ ID NO: 6321248 - DNA, 13 bp, Homo sapiens
ggcagcacggccc

SEQ ID NO: 6321249 - DNA, 14 bp, Homo sapiens
ggcagcactcagtg

SEQ ID NO: 6321250 - DNA, 20 bp, Homo sapiens
ggcagcactccccagagctg

SEQ ID NO: 6321251 - DNA, 23 bp, Homo sapiens
ggcagcactccccagagctgtgc

SEQ ID NO: 6321252 - DNA, 24 bp, Homo sapiens
ggcagcactccccagagctgtgcc

SEQ ID NO: 6321253 - DNA, 14 bp, Homo sapiens
ggcagcagagagag

SEQ ID NO: 6321254 - DNA, 24 bp, Homo sapiens
ggcagcagagagagagagagagaa

SEQ ID NO: 6321255 - DNA, 10 bp, Homo sapiens
ggcagcagat

SEQ ID NO: 6321256 - DNA, 14 bp, Homo sapiens
ggcagcagcagcag

SEQ ID NO: 6321257 - DNA, 15 bp, Homo sapiens
ggcagcagcagccct

SEQ ID NO: 6321258 - DNA, 17 bp, Homo sapiens
ggcagcagcagccctgc

SEQ ID NO: 6321259 - DNA, 13 bp, Homo sapiens
ggcagcagcaggt

SEQ ID NO: 6321260 - DNA, 19 bp, Homo sapiens
ggcagcagcatcccagcct

SEQ ID NO: 6321261 - DNA, 22 bp, Homo sapiens
ggcagcagcatcccagccttga

SEQ ID NO: 6321262 - DNA, 12 bp, Homo sapiens
ggcagcagccag

SEQ ID NO: 6321263 - DNA, 18 bp, Homo sapiens
ggcagcagccagccctgc

SEQ ID NO: 6321264 - DNA, 22 bp, Homo sapiens
ggcagcagccagccctgcctgg

SEQ ID NO: 6321265 - DNA, 13 bp, Homo sapiens
ggcagcagccagg

SEQ ID NO: 6321266 - DNA, 13 bp, Homo sapiens
ggcagcagccatc

SEQ ID NO: 6321267 - DNA, 22 bp, Homo sapiens
ggcagcagctcagcctcccccc

SEQ ID NO: 6321268 - DNA, 12 bp, Homo sapiens
ggcagcaggagc

SEQ ID NO: 6321269 - DNA, 14 bp, Homo sapiens
ggcagcaggagcca

SEQ ID NO: 6321270 - DNA, 14 bp, Homo sapiens
ggcagcaggaggag

SEQ ID NO: 6321271 - DNA, 13 bp, Homo sapiens
ggcagcaggaggg

SEQ ID NO: 6321272 - DNA, 16 bp, Homo sapiens
ggcagcaggagggact

SEQ ID NO: 6321273 - DNA, 13 bp, Homo sapiens
ggcagcaggccag

SEQ ID NO: 6321274 - DNA, 18 bp, Homo sapiens
ggcagcaggccagagaaa

SEQ ID NO: 6321275 - DNA, 19 bp, Homo sapiens
ggcagcaggccagagaaag

SEQ ID NO: 6321276 - DNA, 14 bp, Homo sapiens
ggcagcaggggctg

SEQ ID NO: 6321277 - DNA, 19 bp, Homo sapiens
ggcagcaggtgctgctacc

SEQ ID NO: 6321278 - DNA, 12 bp, Homo sapiens
ggcagcagtggg

SEQ ID NO: 6321279 - DNA, 15 bp, Homo sapiens
ggcagcagtggggtg

SEQ ID NO: 6321280 - DNA, 19 bp, Homo sapiens
ggcagcagttccatgaaga

SEQ ID NO: 6321281 - DNA, 19 bp, Homo sapiens
ggcagcatagcaagacaca

SEQ ID NO: 6321282 - DNA, 16 bp, Homo sapiens
ggcagcatctgctcca

SEQ ID NO: 6321283 - DNA, 18 bp, Homo sapiens
ggcagcatgcttgggctg

SEQ ID NO: 6321284 - DNA, 19 bp, Homo sapiens
ggcagcatgcttgggctga

SEQ ID NO: 6321285 - DNA, 18 bp, Homo sapiens
ggcagcatggagagaggc

SEQ ID NO: 6321286 - DNA, 17 bp, Homo sapiens
ggcagcatggagagcct

SEQ ID NO: 6321287 - DNA, 18 bp, Homo sapiens
ggcagccaaacccatgag

SEQ ID NO: 6321288 - DNA, 13 bp, Homo sapiens
ggcagccaaggaa

SEQ ID NO: 6321289 - DNA, 21 bp, Homo sapiens
ggcagccacacttctcaggac

SEQ ID NO: 6321290 - DNA, 17 bp, Homo sapiens
ggcagccacccaagcct

SEQ ID NO: 6321291 - DNA, 17 bp, Homo sapiens
ggcagccaccctgccat

SEQ ID NO: 6321292 - DNA, 18 bp, Homo sapiens
ggcagccaccctgccatg

SEQ ID NO: 6321293 - DNA, 13 bp, Homo sapiens
ggcagccacggcc

SEQ ID NO: 6321294 - DNA, 14 bp, Homo sapiens
ggcagccagaccag

SEQ ID NO: 6321295 - DNA, 14 bp, Homo sapiens
ggcagccagatccc

SEQ ID NO: 6321296 - DNA, 12 bp, Homo sapiens
ggcagccaggct

SEQ ID NO: 6321297 - DNA, 16 bp, Homo sapiens
ggcagccaggctgggc

SEQ ID NO: 6321298 - DNA, 12 bp, Homo sapiens
ggcagccaggga

SEQ ID NO: 6321299 - DNA, 18 bp, Homo sapiens
ggcagccagggagagccc

SEQ ID NO: 6321300 - DNA, 19 bp, Homo sapiens
ggcagccagggagagccca

SEQ ID NO: 6321301 - DNA, 20 bp, Homo sapiens
ggcagccagggagagcccag

SEQ ID NO: 6321302 - DNA, 15 bp, Homo sapiens
ggcagccaggggctg

SEQ ID NO: 6321303 - DNA, 17 bp, Homo sapiens
ggcagccagtgccctga

SEQ ID NO: 6321304 - DNA, 13 bp, Homo sapiens
ggcagccatgcct

SEQ ID NO: 6321305 - DNA, 17 bp, Homo sapiens
ggcagccattggcctct

SEQ ID NO: 6321306 - DNA, 18 bp, Homo sapiens
ggcagcccaaagctgcag

SEQ ID NO: 6321307 - DNA, 18 bp, Homo sapiens
ggcagcccaacagcactt

SEQ ID NO: 6321308 - DNA, 13 bp, Homo sapiens
ggcagcccactgc

SEQ ID NO: 6321309 - DNA, 16 bp, Homo sapiens
ggcagcccactgcacc

SEQ ID NO: 6321310 - DNA, 20 bp, Homo sapiens
ggcagcccagagagaccctg

SEQ ID NO: 6321311 - DNA, 11 bp, Homo sapiens
ggcagcccagc

SEQ ID NO: 6321312 - DNA, 12 bp, Homo sapiens
ggcagcccagcc

SEQ ID NO: 6321313 - DNA, 18 bp, Homo sapiens
ggcagcccagccagcgtc

SEQ ID NO: 6321314 - DNA, 15 bp, Homo sapiens
ggcagccccagagag

SEQ ID NO: 6321315 - DNA, 13 bp, Homo sapiens
ggcagccccagca

SEQ ID NO: 6321316 - DNA, 14 bp, Homo sapiens
ggcagccccagcct

SEQ ID NO: 6321317 - DNA, 16 bp, Homo sapiens
ggcagccccagcctgc

SEQ ID NO: 6321318 - DNA, 18 bp, Homo sapiens
ggcagccccagcctgcta

SEQ ID NO: 6321319 - DNA, 18 bp, Homo sapiens
ggcagccccaggccaaag

SEQ ID NO: 6321320 - DNA, 11 bp, Homo sapiens
ggcagccccat

SEQ ID NO: 6321321 - DNA, 19 bp, Homo sapiens
ggcagccccatccttcccg

SEQ ID NO: 6321322 - DNA, 20 bp, Homo sapiens
ggcagccccattctgcctgc

SEQ ID NO: 6321323 - DNA, 22 bp, Homo sapiens
ggcagcccccatgggctcctgc

SEQ ID NO: 6321324 - DNA, 15 bp, Homo sapiens
ggcagccccctccac

SEQ ID NO: 6321325 - DNA, 23 bp, Homo sapiens
ggcagccccgcgaccacccctgt

SEQ ID NO: 6321326 - DNA, 12 bp, Homo sapiens
ggcagcccctcc

SEQ ID NO: 6321327 - DNA, 11 bp, Homo sapiens
ggcagcccctg

SEQ ID NO: 6321328 - DNA, 21 bp, Homo sapiens
ggcagcccctgctggaccaag

SEQ ID NO: 6321329 - DNA, 18 bp, Homo sapiens
ggcagccccttctggccg

SEQ ID NO: 6321330 - DNA, 17 bp, Homo sapiens
ggcagcccgcatcagct

SEQ ID NO: 6321331 - DNA, 17 bp, Homo sapiens
ggcagcccgctaggctc

SEQ ID NO: 6321332 - DNA, 17 bp, Homo sapiens
ggcagcccggctgctgc

SEQ ID NO: 6321333 - DNA, 17 bp, Homo sapiens
ggcagccctcacctctg

SEQ ID NO: 6321334 - DNA, 21 bp, Homo sapiens
ggcagccctcacctctgagga

SEQ ID NO: 6321335 - DNA, 22 bp, Homo sapiens
ggcagccctccacttctggtat

SEQ ID NO: 6321336 - DNA, 15 bp, Homo sapiens
ggcagccctccatgg

SEQ ID NO: 6321337 - DNA, 16 bp, Homo sapiens
ggcagccctccatggt

SEQ ID NO: 6321338 - DNA, 21 bp, Homo sapiens
ggcagccctccatggtcctgt

SEQ ID NO: 6321339 - DNA, 11 bp, Homo sapiens
ggcagcccttg

SEQ ID NO: 6321340 - DNA, 16 bp, Homo sapiens
ggcagccgaggcctgg

SEQ ID NO: 6321341 - DNA, 17 bp, Homo sapiens
ggcagccgaggcctggc

SEQ ID NO: 6321342 - DNA, 19 bp, Homo sapiens
ggcagccgaggcctggcca

SEQ ID NO: 6321343 - DNA, 17 bp, Homo sapiens
ggcagccgtcccaggcc

SEQ ID NO: 6321344 - DNA, 20 bp, Homo sapiens
ggcagccgtcccaggccacc

SEQ ID NO: 6321345 - DNA, 22 bp, Homo sapiens
ggcagccgtccttctaatgaag

SEQ ID NO: 6321346 - DNA, 19 bp, Homo sapiens
ggcagccgtgccttcagct

SEQ ID NO: 6321347 - DNA, 22 bp, Homo sapiens
ggcagccgtgggccccaccctc

SEQ ID NO: 6321348 - DNA, 19 bp, Homo sapiens
ggcagcctactagggacct

SEQ ID NO: 6321349 - DNA, 21 bp, Homo sapiens
ggcagcctactagggacctgg

SEQ ID NO: 6321350 - DNA, 12 bp, Homo sapiens
ggcagcctcaga

SEQ ID NO: 6321351 - DNA, 13 bp, Homo sapiens
ggcagcctccaga

SEQ ID NO: 6321352 - DNA, 14 bp, Homo sapiens
ggcagcctccagag

SEQ ID NO: 6321353 - DNA, 19 bp, Homo sapiens
ggcagcctccagagccagc

SEQ ID NO: 6321354 - DNA, 16 bp, Homo sapiens
ggcagcctccagtctg

SEQ ID NO: 6321355 - DNA, 23 bp, Homo sapiens
ggcagcctccagtctgctctcag

SEQ ID NO: 6321356 - DNA, 22 bp, Homo sapiens
ggcagcctcccatccagggccc

SEQ ID NO: 6321357 - DNA, 19 bp, Homo sapiens
ggcagcctccttgcctgga

SEQ ID NO: 6321358 - DNA, 22 bp, Homo sapiens
ggcagcctccttgcctggaact

SEQ ID NO: 6321359 - DNA, 16 bp, Homo sapiens
ggcagcctctgggggg

SEQ ID NO: 6321360 - DNA, 17 bp, Homo sapiens
ggcagcctgagagctgg

SEQ ID NO: 6321361 - DNA, 14 bp, Homo sapiens
ggcagcctgagagt

SEQ ID NO: 6321362 - DNA, 10 bp, Homo sapiens
ggcagcctgc

SEQ ID NO: 6321363 - DNA, 23 bp, Homo sapiens
ggcagcctgccttgcccactcct

SEQ ID NO: 6321364 - DNA, 11 bp, Homo sapiens
ggcagcctgct

SEQ ID NO: 6321365 - DNA, 19 bp, Homo sapiens
ggcagcctggctcccagga

SEQ ID NO: 6321366 - DNA, 15 bp, Homo sapiens
ggcagcctgtgggag

SEQ ID NO: 6321367 - DNA, 17 bp, Homo sapiens
ggcagcctgtgggagaa

SEQ ID NO: 6321368 - DNA, 22 bp, Homo sapiens
ggcagccttgggggggctgcct

SEQ ID NO: 6321369 - DNA, 23 bp, Homo sapiens
ggcagccttgggggggctgcctt

SEQ ID NO: 6321370 - DNA, 18 bp, Homo sapiens
ggcagcctttccagcctc

SEQ ID NO: 6321371 - DNA, 19 bp, Homo sapiens
ggcagcgaccccaggacct

SEQ ID NO: 6321372 - DNA, 13 bp, Homo sapiens
ggcagcgcagggc

SEQ ID NO: 6321373 - DNA, 18 bp, Homo sapiens
ggcagcgcagggctggca

SEQ ID NO: 6321374 - DNA, 19 bp, Homo sapiens
ggcagcgcagggctggcac

SEQ ID NO: 6321375 - DNA, 15 bp, Homo sapiens
ggcagcgccaagcaa

SEQ ID NO: 6321376 - DNA, 22 bp, Homo sapiens
ggcagcgccaagtgcgtgccgt

SEQ ID NO: 6321377 - DNA, 21 bp, Homo sapiens
ggcagcgccaggctgaccaca

SEQ ID NO: 6321378 - DNA, 14 bp, Homo sapiens
ggcagcgccccacc

SEQ ID NO: 6321379 - DNA, 17 bp, Homo sapiens
ggcagcgcccttcctct

SEQ ID NO: 6321380 - DNA, 19 bp, Homo sapiens
ggcagcgcccttcctctcc

SEQ ID NO: 6321381 - DNA, 16 bp, Homo sapiens
ggcagcgcctgtcccc

SEQ ID NO: 6321382 - DNA, 20 bp, Homo sapiens
ggcagcgcctgtcccctcac

SEQ ID NO: 6321383 - DNA, 23 bp, Homo sapiens
ggcagcggccccgcacccctcct

SEQ ID NO: 6321384 - DNA, 14 bp, Homo sapiens
ggcagcgggccagg

SEQ ID NO: 6321385 - DNA, 15 bp, Homo sapiens
ggcagcggggctggc

SEQ ID NO: 6321386 - DNA, 17 bp, Homo sapiens
ggcagcgtgggctctgc

SEQ ID NO: 6321387 - DNA, 19 bp, Homo sapiens
ggcagcgtgggctctgcca

SEQ ID NO: 6321388 - DNA, 20 bp, Homo sapiens
ggcagctaagatagaaagct

SEQ ID NO: 6321389 - DNA, 14 bp, Homo sapiens
ggcagctagtgcct

SEQ ID NO: 6321390 - DNA, 21 bp, Homo sapiens
ggcagctatttcagcctcctg

SEQ ID NO: 6321391 - DNA, 15 bp, Homo sapiens
ggcagctcacccctg

SEQ ID NO: 6321392 - DNA, 18 bp, Homo sapiens
ggcagctcacccctgggc

SEQ ID NO: 6321393 - DNA, 14 bp, Homo sapiens
ggcagctcacctct

SEQ ID NO: 6321394 - DNA, 18 bp, Homo sapiens
ggcagctcacctctccct

SEQ ID NO: 6321395 - DNA, 13 bp, Homo sapiens
ggcagctcagaga

SEQ ID NO: 6321396 - DNA, 14 bp, Homo sapiens
ggcagctccaacag

SEQ ID NO: 6321397 - DNA, 13 bp, Homo sapiens
ggcagctccagct

SEQ ID NO: 6321398 - DNA, 16 bp, Homo sapiens
ggcagctcctctgtct

SEQ ID NO: 6321399 - DNA, 15 bp, Homo sapiens
ggcagctcctgacca

SEQ ID NO: 6321400 - DNA, 16 bp, Homo sapiens
ggcagctcctgaccaa

SEQ ID NO: 6321401 - DNA, 22 bp, Homo sapiens
ggcagctcggattcaactacct

SEQ ID NO: 6321402 - DNA, 16 bp, Homo sapiens
ggcagctctccagtca

SEQ ID NO: 6321403 - DNA, 13 bp, Homo sapiens
ggcagctctgagc

SEQ ID NO: 6321404 - DNA, 13 bp, Homo sapiens
ggcagctctgtcg

SEQ ID NO: 6321405 - DNA, 17 bp, Homo sapiens
ggcagctcttctgggca

SEQ ID NO: 6321406 - DNA, 22 bp, Homo sapiens
ggcagctcttctgggcagagcc

SEQ ID NO: 6321407 - DNA, 19 bp, Homo sapiens
ggcagctgagaccagggtc

SEQ ID NO: 6321408 - DNA, 16 bp, Homo sapiens
ggcagctgatccaggc

SEQ ID NO: 6321409 - DNA, 23 bp, Homo sapiens
ggcagctgcagttagcacagagg

SEQ ID NO: 6321410 - DNA, 12 bp, Homo sapiens
ggcagctgccac

SEQ ID NO: 6321411 - DNA, 19 bp, Homo sapiens
gtcattgacctctcagggc

SEQ ID NO: 6321412 - DNA, 16 bp, Homo sapiens
gtcattgacttcattt

SEQ ID NO: 6321413 - DNA, 21 bp, Homo sapiens
gtcattgacttcattttatat

SEQ ID NO: 6321414 - DNA, 14 bp, Homo sapiens
gtcattgagcctgg

SEQ ID NO: 6321415 - DNA, 17 bp, Homo sapiens
gtcattgagtgacttta

SEQ ID NO: 6321416 - DNA, 18 bp, Homo sapiens
gtcattgatggagcctga

SEQ ID NO: 6321417 - DNA, 18 bp, Homo sapiens
gtcattgcagtttaagag

SEQ ID NO: 6321418 - DNA, 14 bp, Homo sapiens
gtcattgcccactt

SEQ ID NO: 6321419 - DNA, 17 bp, Homo sapiens
gtcattgcccacttctg

SEQ ID NO: 6321420 - DNA, 15 bp, Homo sapiens
gtcattgctgtagga

SEQ ID NO: 6321421 - DNA, 13 bp, Homo sapiens
gtcattgcttctt

SEQ ID NO: 6321422 - DNA, 16 bp, Homo sapiens
gtcattgctttactgg

SEQ ID NO: 6321423 - DNA, 13 bp, Homo sapiens
gtcattggcaaag

SEQ ID NO: 6321424 - DNA, 14 bp, Homo sapiens
gtcattggctttat

SEQ ID NO: 6321425 - DNA, 20 bp, Homo sapiens
gtcattgtaaacaaactctt

SEQ ID NO: 6321426 - DNA, 23 bp, Homo sapiens
gtcattgtaatgttgtgaataat

SEQ ID NO: 6321427 - DNA, 15 bp, Homo sapiens
gtcattgtatgttat

SEQ ID NO: 6321428 - DNA, 13 bp, Homo sapiens
gtcattgtctact

SEQ ID NO: 6321429 - DNA, 11 bp, Homo sapiens
gtcatttaaaa

SEQ ID NO: 6321430 - DNA, 15 bp, Homo sapiens
gtcatttaaatgtgt

SEQ ID NO: 6321431 - DNA, 16 bp, Homo sapiens
gtcatttactaaacat

SEQ ID NO: 6321432 - DNA, 20 bp, Homo sapiens
gtcatttagagtttcacaga

SEQ ID NO: 6321433 - DNA, 18 bp, Homo sapiens
gtcatttataacttctgt

SEQ ID NO: 6321434 - DNA, 16 bp, Homo sapiens
gtcatttatgagcaga

SEQ ID NO: 6321435 - DNA, 23 bp, Homo sapiens
gtcatttcatacaaattttccca

SEQ ID NO: 6321436 - DNA, 14 bp, Homo sapiens
gtcatttcattcca

SEQ ID NO: 6321437 - DNA, 15 bp, Homo sapiens
gtcatttcatttcct

SEQ ID NO: 6321438 - DNA, 22 bp, Homo sapiens
gtcatttccatgtatgcataat

SEQ ID NO: 6321439 - DNA, 23 bp, Homo sapiens
gtcatttccgtccccccccaggc

SEQ ID NO: 6321440 - DNA, 22 bp, Homo sapiens
gtcatttcctttgttgtctaca

SEQ ID NO: 6321441 - DNA, 16 bp, Homo sapiens
gtcatttctactttga

SEQ ID NO: 6321442 - DNA, 23 bp, Homo sapiens
gtcatttctatattcctccagct

SEQ ID NO: 6321443 - DNA, 12 bp, Homo sapiens
gtcatttctctt

SEQ ID NO: 6321444 - DNA, 17 bp, Homo sapiens
gtcatttgaacctggat

SEQ ID NO: 6321445 - DNA, 21 bp, Homo sapiens
gtcatttgacaggggctcagg

SEQ ID NO: 6321446 - DNA, 22 bp, Homo sapiens
gtcatttgagcagggctcagcg

SEQ ID NO: 6321447 - DNA, 19 bp, Homo sapiens
gtcatttgctaatgaattt

SEQ ID NO: 6321448 - DNA, 19 bp, Homo sapiens
gtcatttggtggctctaac

SEQ ID NO: 6321449 - DNA, 19 bp, Homo sapiens
gtcatttgtagatatatat

SEQ ID NO: 6321450 - DNA, 19 bp, Homo sapiens
gtcatttgttaatatttct

SEQ ID NO: 6321451 - DNA, 20 bp, Homo sapiens
gtcatttgttaatatttctt

SEQ ID NO: 6321452 - DNA, 21 bp, Homo sapiens
gtcattttaactttatcacat

SEQ ID NO: 6321453 - DNA, 19 bp, Homo sapiens
gtcattttattttgtaata

SEQ ID NO: 6321454 - DNA, 16 bp, Homo sapiens
gtcattttcagtgact

SEQ ID NO: 6321455 - DNA, 12 bp, Homo sapiens
gtcattttcatt

SEQ ID NO: 6321456 - DNA, 16 bp, Homo sapiens
gtcattttctgttata

SEQ ID NO: 6321457 - DNA, 21 bp, Homo sapiens
gtcattttctgttatacacag

SEQ ID NO: 6321458 - DNA, 12 bp, Homo sapiens
gtcattttgaag

SEQ ID NO: 6321459 - DNA, 17 bp, Homo sapiens
gtcattttgaagctaat

SEQ ID NO: 6321460 - DNA, 13 bp, Homo sapiens
gtcattttgcact

SEQ ID NO: 6321461 - DNA, 15 bp, Homo sapiens
gtcattttgcactgt

SEQ ID NO: 6321462 - DNA, 16 bp, Homo sapiens
gtcattttgcactgta

SEQ ID NO: 6321463 - DNA, 18 bp, Homo sapiens
gtcattttggtactttgg

SEQ ID NO: 6321464 - DNA, 14 bp, Homo sapiens
gtcatttttaacta

SEQ ID NO: 6321465 - DNA, 16 bp, Homo sapiens
gtcatttttaatgtat

SEQ ID NO: 6321466 - DNA, 11 bp, Homo sapiens
gtcatttttgt

SEQ ID NO: 6321467 - DNA, 13 bp, Homo sapiens
gtcattttttact

SEQ ID NO: 6321468 - DNA, 19 bp, Homo sapiens
gtcattttttttaagaaaa

SEQ ID NO: 6321469 - DNA, 21 bp, Homo sapiens
gtcattttttttaagaaaaag

SEQ ID NO: 6321470 - DNA, 19 bp, Homo sapiens
gtccaaaaaaaggaaaaat

SEQ ID NO: 6321471 - DNA, 18 bp, Homo sapiens
gtccaaaaccgccagctc

SEQ ID NO: 6321472 - DNA, 22 bp, Homo sapiens
gtccaaaagatacccaaatttt

SEQ ID NO: 6321473 - DNA, 18 bp, Homo sapiens
gtccaaaatttatatttt

SEQ ID NO: 6321474 - DNA, 20 bp, Homo sapiens
gtccaaacatttcatccgtg

SEQ ID NO: 6321475 - DNA, 14 bp, Homo sapiens
gtccaaacccactc

SEQ ID NO: 6321476 - DNA, 23 bp, Homo sapiens
gtccaaacccttcaactcctggc

SEQ ID NO: 6321477 - DNA, 16 bp, Homo sapiens
gtccaaaccttctacc

SEQ ID NO: 6321478 - DNA, 14 bp, Homo sapiens
gtccaaaggaggct

SEQ ID NO: 6321479 - DNA, 20 bp, Homo sapiens
gtccaaaggaggctggcagg

SEQ ID NO: 6321480 - DNA, 19 bp, Homo sapiens
gtccaaaggagtgcatggc

SEQ ID NO: 6321481 - DNA, 19 bp, Homo sapiens
gtccaaagtgcgtgtgtgt

SEQ ID NO: 6321482 - DNA, 20 bp, Homo sapiens
gtccaaataaaaactaaatt

SEQ ID NO: 6321483 - DNA, 13 bp, Homo sapiens
gtccaaattcttt

SEQ ID NO: 6321484 - DNA, 22 bp, Homo sapiens
gtccaaattgtctgtctgctct

SEQ ID NO: 6321485 - DNA, 23 bp, Homo sapiens
gtccaacatggtgaaacccccat

SEQ ID NO: 6321486 - DNA, 16 bp, Homo sapiens
gtccaaccagacctgg

SEQ ID NO: 6321487 - DNA, 22 bp, Homo sapiens
gtccaaccccggggcatggaca

SEQ ID NO: 6321488 - DNA, 15 bp, Homo sapiens
gtccaacccctcccc

SEQ ID NO: 6321489 - DNA, 14 bp, Homo sapiens
gtccaactaaaaac

SEQ ID NO: 6321490 - DNA, 13 bp, Homo sapiens
gtccaactactaa

SEQ ID NO: 6321491 - DNA, 19 bp, Homo sapiens
gtccaactcacttccagtg

SEQ ID NO: 6321492 - DNA, 15 bp, Homo sapiens
gtccaactctgtatt

SEQ ID NO: 6321493 - DNA, 20 bp, Homo sapiens
gtccaagaagcccaggaaag

SEQ ID NO: 6321494 - DNA, 16 bp, Homo sapiens
gtccaagattccggat

SEQ ID NO: 6321495 - DNA, 24 bp, Homo sapiens
gtccaagcataccaacacgagcag

SEQ ID NO: 6321496 - DNA, 18 bp, Homo sapiens
gtccaagcatcagcaaga

SEQ ID NO: 6321497 - DNA, 21 bp, Homo sapiens
gtccaagcatttagatgtata

SEQ ID NO: 6321498 - DNA, 19 bp, Homo sapiens
gtccaagccgtaggaccca

SEQ ID NO: 6321499 - DNA, 17 bp, Homo sapiens
gtccaaggaaaccacag

SEQ ID NO: 6321500 - DNA, 19 bp, Homo sapiens
gtccaaggacaccctccct

SEQ ID NO: 6321501 - DNA, 18 bp, Homo sapiens
gtccaaggccagtcccca

SEQ ID NO: 6321502 - DNA, 13 bp, Homo sapiens
gtccaagggccat

SEQ ID NO: 6321503 - DNA, 22 bp, Homo sapiens
gtccaaggggtcccctccagga

SEQ ID NO: 6321504 - DNA, 21 bp, Homo sapiens
gtccaaggtttaaagagtcta

SEQ ID NO: 6321505 - DNA, 16 bp, Homo sapiens
gtccaagtggctgtga

SEQ ID NO: 6321506 - DNA, 19 bp, Homo sapiens
gtccaagtgtgtgtgcgtg

SEQ ID NO: 6321507 - DNA, 15 bp, Homo sapiens
gtccaagttcacagt

SEQ ID NO: 6321508 - DNA, 22 bp, Homo sapiens
gtccaagttcttcacctctatc

SEQ ID NO: 6321509 - DNA, 21 bp, Homo sapiens
gtccaagttgccacattgctt

SEQ ID NO: 6321510 - DNA, 15 bp, Homo sapiens
gtccaagttgtttca

SEQ ID NO: 6321511 - DNA, 19 bp, Homo sapiens
gtccaatcacccccaggac

SEQ ID NO: 6321512 - DNA, 22 bp, Homo sapiens
gtccaatcatgggccacaaggc

SEQ ID NO: 6321513 - DNA, 16 bp, Homo sapiens
gtccaatccagccttc

SEQ ID NO: 6321514 - DNA, 18 bp, Homo sapiens
gtccaatgaagataaatg

SEQ ID NO: 6321515 - DNA, 18 bp, Homo sapiens
gtccaatgagctttctga

SEQ ID NO: 6321516 - DNA, 23 bp, Homo sapiens
gtccaatgagctttctgaacagc

SEQ ID NO: 6321517 - DNA, 20 bp, Homo sapiens
gtccaatgccacctagactc

SEQ ID NO: 6321518 - DNA, 12 bp, Homo sapiens
gtccaatgtggc

SEQ ID NO: 6321519 - DNA, 20 bp, Homo sapiens
gtccaattatgcactggcca

SEQ ID NO: 6321520 - DNA, 18 bp, Homo sapiens
gtccaattccagagctgt

SEQ ID NO: 6321521 - DNA, 17 bp, Homo sapiens
gtccaattgtgtagacg

SEQ ID NO: 6321522 - DNA, 14 bp, Homo sapiens
gtccaatttctatt

SEQ ID NO: 6321523 - DNA, 12 bp, Homo sapiens
gtccaatttgta

SEQ ID NO: 6321524 - DNA, 23 bp, Homo sapiens
gtccaatttgtaagtaacacagt

SEQ ID NO: 6321525 - DNA, 12 bp, Homo sapiens
gtccaattttcc

SEQ ID NO: 6321526 - DNA, 14 bp, Homo sapiens
gtccacaaatgtcc

SEQ ID NO: 6321527 - DNA, 17 bp, Homo sapiens
gtccacaaatgtcctca

SEQ ID NO: 6321528 - DNA, 15 bp, Homo sapiens
gtccacaacacacag

SEQ ID NO: 6321529 - DNA, 20 bp, Homo sapiens
gtccacaagcttctgtcctg

SEQ ID NO: 6321530 - DNA, 22 bp, Homo sapiens
gtccacacaaagattttctaag

SEQ ID NO: 6321531 - DNA, 15 bp, Homo sapiens
gtccacacaccacag

SEQ ID NO: 6321532 - DNA, 13 bp, Homo sapiens
gtccacagcccct

SEQ ID NO: 6321533 - DNA, 13 bp, Homo sapiens
gtccacagcttcc

SEQ ID NO: 6321534 - DNA, 22 bp, Homo sapiens
gtccacaggcttctgagcagcg

SEQ ID NO: 6321535 - DNA, 13 bp, Homo sapiens
gtccacagggcac

SEQ ID NO: 6321536 - DNA, 13 bp, Homo sapiens
gtccacaggtcca

SEQ ID NO: 6321537 - DNA, 18 bp, Homo sapiens
gtccacaggtccaaggac

SEQ ID NO: 6321538 - DNA, 16 bp, Homo sapiens
gtccacagtggaacca

SEQ ID NO: 6321539 - DNA, 15 bp, Homo sapiens
gtccacatacactgc

SEQ ID NO: 6321540 - DNA, 16 bp, Homo sapiens
gtccacatacactgca

SEQ ID NO: 6321541 - DNA, 18 bp, Homo sapiens
gtccacatcaaaaatgca

SEQ ID NO: 6321542 - DNA, 23 bp, Homo sapiens
gtccacatccccagagcccagct

SEQ ID NO: 6321543 - DNA, 14 bp, Homo sapiens
gtccacatctgcct

SEQ ID NO: 6321544 - DNA, 22 bp, Homo sapiens
gtccacatgtggggacagggct

SEQ ID NO: 6321545 - DNA, 19 bp, Homo sapiens
gtccacattcgtcacagat

SEQ ID NO: 6321546 - DNA, 20 bp, Homo sapiens
gtccacattctacttcagct

SEQ ID NO: 6321547 - DNA, 20 bp, Homo sapiens
gtccacattttacaggcaag

SEQ ID NO: 6321548 - DNA, 17 bp, Homo sapiens
gtccaccaatagaatga

SEQ ID NO: 6321549 - DNA, 14 bp, Homo sapiens
gtccaccagaccca

SEQ ID NO: 6321550 - DNA, 24 bp, Homo sapiens
gtccaccatgctctctcacctgct

SEQ ID NO: 6321551 - DNA, 19 bp, Homo sapiens
gtccacccacttagtccac

SEQ ID NO: 6321552 - DNA, 14 bp, Homo sapiens
gtccacccagcaaa

SEQ ID NO: 6321553 - DNA, 21 bp, Homo sapiens
gtccaccccaattaactgaag

SEQ ID NO: 6321554 - DNA, 11 bp, Homo sapiens
gtccaccccat

SEQ ID NO: 6321555 - DNA, 19 bp, Homo sapiens
gtccacccccattgtgaat

SEQ ID NO: 6321556 - DNA, 21 bp, Homo sapiens
gtccacccccattgtgaatgt

SEQ ID NO: 6321557 - DNA, 15 bp, Homo sapiens
gtccaccccccacac

SEQ ID NO: 6321558 - DNA, 17 bp, Homo sapiens
gtccaccccgtcccggc

SEQ ID NO: 6321559 - DNA, 19 bp, Homo sapiens
gtccaccccgtcccggccc

SEQ ID NO: 6321560 - DNA, 11 bp, Homo sapiens
gtccacccgcc

SEQ ID NO: 6321561 - DNA, 17 bp, Homo sapiens
gtccacccgtttccaag

SEQ ID NO: 6321562 - DNA, 13 bp, Homo sapiens
gtccaccctgagc

SEQ ID NO: 6321563 - DNA, 22 bp, Homo sapiens
gtccaccctgagctcggggaca

SEQ ID NO: 6321564 - DNA, 11 bp, Homo sapiens
gtccaccctgc

SEQ ID NO: 6321565 - DNA, 19 bp, Homo sapiens
gtccaccctgcagccagga

SEQ ID NO: 6321566 - DNA, 14 bp, Homo sapiens
gtccacccttccat

SEQ ID NO: 6321567 - DNA, 23 bp, Homo sapiens
gtccaccctttcatagagaggcc

SEQ ID NO: 6321568 - DNA, 13 bp, Homo sapiens
gtccacctggaga

SEQ ID NO: 6321569 - DNA, 21 bp, Homo sapiens
gtccacctggccccatgtctc

SEQ ID NO: 6321570 - DNA, 15 bp, Homo sapiens
gtccacctgtgagaa

SEQ ID NO: 6321571 - DNA, 23 bp, Homo sapiens
gtccacctgtgagaaaggaaaaa

SEQ ID NO: 6321572 - DNA, 13 bp, Homo sapiens
gtccacctgtggg

SEQ ID NO: 6321573 - DNA, 15 bp, Homo sapiens
gtccaccttctgcca

SEQ ID NO: 6321574 - DNA, 18 bp, Homo sapiens
gtccaccttctgccaagg

SEQ ID NO: 6321575 - DNA, 20 bp, Homo sapiens
gtccaccttttaagttaatg

SEQ ID NO: 6321576 - DNA, 13 bp, Homo sapiens
gtccacgcccacc

SEQ ID NO: 6321577 - DNA, 21 bp, Homo sapiens
gtccacgcccaccagccttgc

SEQ ID NO: 6321578 - DNA, 17 bp, Homo sapiens
gtccacggacccccaga

SEQ ID NO: 6321579 - DNA, 19 bp, Homo sapiens
gtccacgtactagaaaaat

SEQ ID NO: 6321580 - DNA, 18 bp, Homo sapiens
gtccacgtttttggaaaa

SEQ ID NO: 6321581 - DNA, 22 bp, Homo sapiens
gtccactacgctcctgtctcca

SEQ ID NO: 6321582 - DNA, 16 bp, Homo sapiens
gtccactcccaagcca

SEQ ID NO: 6321583 - DNA, 21 bp, Homo sapiens
gtccactctcggggcccttgg

SEQ ID NO: 6321584 - DNA, 13 bp, Homo sapiens
gtccactctgagt

SEQ ID NO: 6321585 - DNA, 18 bp, Homo sapiens
gtccactctgagtcgatt

SEQ ID NO: 6321586 - DNA, 19 bp, Homo sapiens
gtccactctgctcagggcc

SEQ ID NO: 6321587 - DNA, 12 bp, Homo sapiens
gtccactgtcct

SEQ ID NO: 6321588 - DNA, 21 bp, Homo sapiens
gtccactgtggcactggccac

SEQ ID NO: 6321589 - DNA, 16 bp, Homo sapiens
ggcagctgccagagaa

SEQ ID NO: 6321590 - DNA, 11 bp, Homo sapiens
ggcagctgccc

SEQ ID NO: 6321591 - DNA, 11 bp, Homo sapiens
ggcagctgcct

SEQ ID NO: 6321592 - DNA, 18 bp, Homo sapiens
ggcagctgcctcccctcc

SEQ ID NO: 6321593 - DNA, 22 bp, Homo sapiens
ggcagctgcctcccctcctctg

SEQ ID NO: 6321594 - DNA, 20 bp, Homo sapiens
ggcagctgcctctgctccct

SEQ ID NO: 6321595 - DNA, 12 bp, Homo sapiens
ggcagctgcctg

SEQ ID NO: 6321596 - DNA, 18 bp, Homo sapiens
ggcagctgcctggccatg

SEQ ID NO: 6321597 - DNA, 19 bp, Homo sapiens
ggcagctgcctggccatgc

SEQ ID NO: 6321598 - DNA, 21 bp, Homo sapiens
ggcagctgcggtccacccagg

SEQ ID NO: 6321599 - DNA, 23 bp, Homo sapiens
ggcagctgcggtccacccaggag

SEQ ID NO: 6321600 - DNA, 13 bp, Homo sapiens
ggcagctgctctt

SEQ ID NO: 6321601 - DNA, 23 bp, Homo sapiens
ggcagctgctcttagtgcccgcc

SEQ ID NO: 6321602 - DNA, 16 bp, Homo sapiens
ggcagctgctggctgt

SEQ ID NO: 6321603 - DNA, 22 bp, Homo sapiens
ggcagctgcttttgtctatggg

SEQ ID NO: 6321604 - DNA, 17 bp, Homo sapiens
ggcagctggcaggagag

SEQ ID NO: 6321605 - DNA, 18 bp, Homo sapiens
ggcagctggcaggagtgg

SEQ ID NO: 6321606 - DNA, 22 bp, Homo sapiens
ggcagctggcccccagccctgg

SEQ ID NO: 6321607 - DNA, 11 bp, Homo sapiens
ggcagctgggc

SEQ ID NO: 6321608 - DNA, 22 bp, Homo sapiens
ggcagctgggcccaaccctgtc

SEQ ID NO: 6321609 - DNA, 22 bp, Homo sapiens
ggcagctggggggctgtcctga

SEQ ID NO: 6321610 - DNA, 14 bp, Homo sapiens
ggcagctgtcctga

SEQ ID NO: 6321611 - DNA, 17 bp, Homo sapiens
ggcagctgtcctgaacc

SEQ ID NO: 6321612 - DNA, 19 bp, Homo sapiens
ggcagctgtcctgtgatgt

SEQ ID NO: 6321613 - DNA, 12 bp, Homo sapiens
ggcagctgtgat

SEQ ID NO: 6321614 - DNA, 16 bp, Homo sapiens
ggcagctgtgtctgag

SEQ ID NO: 6321615 - DNA, 20 bp, Homo sapiens
ggcagctgtgtctgagccca

SEQ ID NO: 6321616 - DNA, 21 bp, Homo sapiens
ggcagctgtgtctgagcccaa

SEQ ID NO: 6321617 - DNA, 22 bp, Homo sapiens
ggcagctgtgtctgagcccaac

SEQ ID NO: 6321618 - DNA, 16 bp, Homo sapiens
ggcagcttagggccct

SEQ ID NO: 6321619 - DNA, 21 bp, Homo sapiens
ggcagcttagggccctggagg

SEQ ID NO: 6321620 - DNA, 13 bp, Homo sapiens
ggcagcttcaaaa

SEQ ID NO: 6321621 - DNA, 17 bp, Homo sapiens
ggcagcttcagtctctg

SEQ ID NO: 6321622 - DNA, 13 bp, Homo sapiens
ggcagcttccctg

SEQ ID NO: 6321623 - DNA, 19 bp, Homo sapiens
ggcagcttctactcctgcc

SEQ ID NO: 6321624 - DNA, 20 bp, Homo sapiens
ggcagcttctattagccagt

SEQ ID NO: 6321625 - DNA, 17 bp, Homo sapiens
ggcagcttctgccccct

SEQ ID NO: 6321626 - DNA, 20 bp, Homo sapiens
ggcagcttctgccccctgca

SEQ ID NO: 6321627 - DNA, 21 bp, Homo sapiens
ggcagcttctgccccctgcag

SEQ ID NO: 6321628 - DNA, 16 bp, Homo sapiens
ggcagcttgagcctgt

SEQ ID NO: 6321629 - DNA, 19 bp, Homo sapiens
ggcagcttgagcctgtcac

SEQ ID NO: 6321630 - DNA, 17 bp, Homo sapiens
ggcagcttgagggttgg

SEQ ID NO: 6321631 - DNA, 15 bp, Homo sapiens
ggcagcttgccccgg

SEQ ID NO: 6321632 - DNA, 14 bp, Homo sapiens
ggcagcttgctggg

SEQ ID NO: 6321633 - DNA, 13 bp, Homo sapiens
ggcagcttttaaa

SEQ ID NO: 6321634 - DNA, 21 bp, Homo sapiens
ggcaggaaaccccgagaagga

SEQ ID NO: 6321635 - DNA, 22 bp, Homo sapiens
ggcaggaaaccccgagaaggaa

SEQ ID NO: 6321636 - DNA, 15 bp, Homo sapiens
ggcaggaacaaacag

SEQ ID NO: 6321637 - DNA, 14 bp, Homo sapiens
ggcaggaaccatgg

SEQ ID NO: 6321638 - DNA, 12 bp, Homo sapiens
ggcaggaagaga

SEQ ID NO: 6321639 - DNA, 22 bp, Homo sapiens
ggcaggaagagagagagagagg

SEQ ID NO: 6321640 - DNA, 23 bp, Homo sapiens
ggcaggaagagagagagagaggt

SEQ ID NO: 6321641 - DNA, 16 bp, Homo sapiens
ggcaggaaggactgtc

SEQ ID NO: 6321642 - DNA, 19 bp, Homo sapiens
ggcaggaaggagcggcgcc

SEQ ID NO: 6321643 - DNA, 14 bp, Homo sapiens
ggcaggaaggctga

SEQ ID NO: 6321644 - DNA, 18 bp, Homo sapiens
ggcaggaagtcaggagcc

SEQ ID NO: 6321645 - DNA, 16 bp, Homo sapiens
ggcaggaagtccctga

SEQ ID NO: 6321646 - DNA, 17 bp, Homo sapiens
ggcaggaatcaaggagc

SEQ ID NO: 6321647 - DNA, 15 bp, Homo sapiens
ggcaggaatgggggt

SEQ ID NO: 6321648 - DNA, 19 bp, Homo sapiens
ggcaggaatgggggtcaga

SEQ ID NO: 6321649 - DNA, 22 bp, Homo sapiens
ggcaggacacatcccggcctct

SEQ ID NO: 6321650 - DNA, 15 bp, Homo sapiens
ggcaggaccgccatg

SEQ ID NO: 6321651 - DNA, 22 bp, Homo sapiens
ggcaggaccgccatggtgctgg

SEQ ID NO: 6321652 - DNA, 15 bp, Homo sapiens
ggcaggacctcagag

SEQ ID NO: 6321653 - DNA, 17 bp, Homo sapiens
ggcaggaccttccttcc

SEQ ID NO: 6321654 - DNA, 16 bp, Homo sapiens
ggcaggactcagctcc

SEQ ID NO: 6321655 - DNA, 15 bp, Homo sapiens
ggcaggactcctggc

SEQ ID NO: 6321656 - DNA, 20 bp, Homo sapiens
ggcaggactcctggcagggc

SEQ ID NO: 6321657 - DNA, 15 bp, Homo sapiens
ggcaggactgcagag

SEQ ID NO: 6321658 - DNA, 21 bp, Homo sapiens
ggcaggactgttgtggtactg

SEQ ID NO: 6321659 - DNA, 19 bp, Homo sapiens
ggcaggagaatcacttgaa

SEQ ID NO: 6321660 - DNA, 19 bp, Homo sapiens
ggcaggagaatcagcctgg

SEQ ID NO: 6321661 - DNA, 23 bp, Homo sapiens
ggcaggagactgtggagactgct

SEQ ID NO: 6321662 - DNA, 15 bp, Homo sapiens
ggcaggagaggctgg

SEQ ID NO: 6321663 - DNA, 17 bp, Homo sapiens
ggcaggagaggctgggc

SEQ ID NO: 6321664 - DNA, 22 bp, Homo sapiens
ggcaggagagtgtgtgggcagg

SEQ ID NO: 6321665 - DNA, 21 bp, Homo sapiens
ggcaggagctactgagaacat

SEQ ID NO: 6321666 - DNA, 17 bp, Homo sapiens
ggcaggagctcacaccg

SEQ ID NO: 6321667 - DNA, 13 bp, Homo sapiens
ggcaggagctcag

SEQ ID NO: 6321668 - DNA, 14 bp, Homo sapiens
ggcaggagctcaga

SEQ ID NO: 6321669 - DNA, 12 bp, Homo sapiens
ggcaggagctgc

SEQ ID NO: 6321670 - DNA, 21 bp, Homo sapiens
ggcaggaggaaaaggcttggt

SEQ ID NO: 6321671 - DNA, 18 bp, Homo sapiens
ggcaggaggatcacttga

SEQ ID NO: 6321672 - DNA, 19 bp, Homo sapiens
ggcaggaggccccaggctg

SEQ ID NO: 6321673 - DNA, 17 bp, Homo sapiens
ggcaggaggcctggcct

SEQ ID NO: 6321674 - DNA, 18 bp, Homo sapiens
ggcaggaggcctggcctt

SEQ ID NO: 6321675 - DNA, 14 bp, Homo sapiens
ggcaggaggctcca

SEQ ID NO: 6321676 - DNA, 17 bp, Homo sapiens
ggcaggagggcatgtgc

SEQ ID NO: 6321677 - DNA, 14 bp, Homo sapiens
ggcaggagggccct

SEQ ID NO: 6321678 - DNA, 14 bp, Homo sapiens
ggcaggagggtggc

SEQ ID NO: 6321679 - DNA, 14 bp, Homo sapiens
ggcaggagtagctg

SEQ ID NO: 6321680 - DNA, 18 bp, Homo sapiens
ggcaggagtagctgagct

SEQ ID NO: 6321681 - DNA, 14 bp, Homo sapiens
ggcaggagtcacca

SEQ ID NO: 6321682 - DNA, 23 bp, Homo sapiens
ggcaggagtcaccatgcaagggt

SEQ ID NO: 6321683 - DNA, 19 bp, Homo sapiens
ggcaggagtctctgccagt

SEQ ID NO: 6321684 - DNA, 20 bp, Homo sapiens
ggcaggagtgccaggaccag

SEQ ID NO: 6321685 - DNA, 21 bp, Homo sapiens
ggcaggagtgccaggaccagc

SEQ ID NO: 6321686 - DNA, 15 bp, Homo sapiens
ggcaggagtggcagc

SEQ ID NO: 6321687 - DNA, 16 bp, Homo sapiens
ggcaggatatccccag

SEQ ID NO: 6321688 - DNA, 23 bp, Homo sapiens
ggcaggatcggcttcctcagggg

SEQ ID NO: 6321689 - DNA, 20 bp, Homo sapiens
ggcaggatctcaagccagcc

SEQ ID NO: 6321690 - DNA, 21 bp, Homo sapiens
ggcaggatctcaagccagccc

SEQ ID NO: 6321691 - DNA, 16 bp, Homo sapiens
ggcaggatgctgagct

SEQ ID NO: 6321692 - DNA, 15 bp, Homo sapiens
ggcaggatggcctgg

SEQ ID NO: 6321693 - DNA, 19 bp, Homo sapiens
ggcaggattctgcagctgc

SEQ ID NO: 6321694 - DNA, 21 bp, Homo sapiens
ggcaggattctgcagctgctt

SEQ ID NO: 6321695 - DNA, 20 bp, Homo sapiens
ggcaggattcttcccgctcc

SEQ ID NO: 6321696 - DNA, 16 bp, Homo sapiens
ggcaggcaagcccttc

SEQ ID NO: 6321697 - DNA, 16 bp, Homo sapiens
ggcaggcacagcacag

SEQ ID NO: 6321698 - DNA, 21 bp, Homo sapiens
ggcaggcactgtggcccttct

SEQ ID NO: 6321699 - DNA, 13 bp, Homo sapiens
ggcaggcagacca

SEQ ID NO: 6321700 - DNA, 20 bp, Homo sapiens
ggcaggcagatcacaaggtc

SEQ ID NO: 6321701 - DNA, 13 bp, Homo sapiens
ggcaggcagcgcc

SEQ ID NO: 6321702 - DNA, 14 bp, Homo sapiens
ggcaggcagcgcca

SEQ ID NO: 6321703 - DNA, 17 bp, Homo sapiens
ggcaggcagttctagaa

SEQ ID NO: 6321704 - DNA, 15 bp, Homo sapiens
ggcaggccacctggc

SEQ ID NO: 6321705 - DNA, 19 bp, Homo sapiens
ggcaggccagatggcccct

SEQ ID NO: 6321706 - DNA, 19 bp, Homo sapiens
ggcaggccagcaataaaaa

SEQ ID NO: 6321707 - DNA, 14 bp, Homo sapiens
ggcaggccaggctg

SEQ ID NO: 6321708 - DNA, 12 bp, Homo sapiens
ggcaggccaggg

SEQ ID NO: 6321709 - DNA, 17 bp, Homo sapiens
ggcaggccagtgtctgg

SEQ ID NO: 6321710 - DNA, 12 bp, Homo sapiens
ggcaggccctgc

SEQ ID NO: 6321711 - DNA, 16 bp, Homo sapiens
ggcaggccctgcactg

SEQ ID NO: 6321712 - DNA, 21 bp, Homo sapiens
ggcaggccctgcactgtcctg

SEQ ID NO: 6321713 - DNA, 13 bp, Homo sapiens
ggcaggccctgcc

SEQ ID NO: 6321714 - DNA, 22 bp, Homo sapiens
ggcaggccctgcccagccagcc

SEQ ID NO: 6321715 - DNA, 15 bp, Homo sapiens
ggcaggccgggcctg

SEQ ID NO: 6321716 - DNA, 14 bp, Homo sapiens
ggcaggcctcccaa

SEQ ID NO: 6321717 - DNA, 17 bp, Homo sapiens
ggcaggcctcccaagct

SEQ ID NO: 6321718 - DNA, 22 bp, Homo sapiens
ggcaggcctccctttggggaga

SEQ ID NO: 6321719 - DNA, 20 bp, Homo sapiens
ggcaggcctccgtcttccca

SEQ ID NO: 6321720 - DNA, 11 bp, Homo sapiens
ggcaggcctga

SEQ ID NO: 6321721 - DNA, 15 bp, Homo sapiens
ggcaggcggctcctc

SEQ ID NO: 6321722 - DNA, 16 bp, Homo sapiens
ggcaggcggctcctcc

SEQ ID NO: 6321723 - DNA, 19 bp, Homo sapiens
ggcaggcggctcctcctca

SEQ ID NO: 6321724 - DNA, 17 bp, Homo sapiens
ggcaggcgggcccatga

SEQ ID NO: 6321725 - DNA, 19 bp, Homo sapiens
ggcaggcgggcccatgaag

SEQ ID NO: 6321726 - DNA, 16 bp, Homo sapiens
ggcaggcgtgtggcag

SEQ ID NO: 6321727 - DNA, 18 bp, Homo sapiens
ggcaggcgtgtggcagcc

SEQ ID NO: 6321728 - DNA, 19 bp, Homo sapiens
ggcaggctagaacctggca

SEQ ID NO: 6321729 - DNA, 13 bp, Homo sapiens
ggcaggctcactg

SEQ ID NO: 6321730 - DNA, 16 bp, Homo sapiens
ggcaggctgacatctg

SEQ ID NO: 6321731 - DNA, 17 bp, Homo sapiens
ggcaggctggccagtcc

SEQ ID NO: 6321732 - DNA, 16 bp, Homo sapiens
ggcaggctggctggcc

SEQ ID NO: 6321733 - DNA, 14 bp, Homo sapiens
ggcaggctgggacg

SEQ ID NO: 6321734 - DNA, 15 bp, Homo sapiens
ggcaggctgggccat

SEQ ID NO: 6321735 - DNA, 16 bp, Homo sapiens
ggcaggctgggtgacc

SEQ ID NO: 6321736 - DNA, 12 bp, Homo sapiens
ggcaggcttggg

SEQ ID NO: 6321737 - DNA, 14 bp, Homo sapiens
ggcagggaaactgg

SEQ ID NO: 6321738 - DNA, 20 bp, Homo sapiens
ggcagggaagaggggtgcag

SEQ ID NO: 6321739 - DNA, 12 bp, Homo sapiens
ggcagggaagct

SEQ ID NO: 6321740 - DNA, 13 bp, Homo sapiens
ggcagggaagctt

SEQ ID NO: 6321741 - DNA, 12 bp, Homo sapiens
ggcagggaagga

SEQ ID NO: 6321742 - DNA, 16 bp, Homo sapiens
ggcagggaaggacagg

SEQ ID NO: 6321743 - DNA, 21 bp, Homo sapiens
ggcagggaagggtgcctggct

SEQ ID NO: 6321744 - DNA, 19 bp, Homo sapiens
ggcagggaatgcctggagg

SEQ ID NO: 6321745 - DNA, 18 bp, Homo sapiens
ggcagggacctaaaggga

SEQ ID NO: 6321746 - DNA, 21 bp, Homo sapiens
ggcagggacttgcctccactc

SEQ ID NO: 6321747 - DNA, 16 bp, Homo sapiens
ggcagggagagcgcct

SEQ ID NO: 6321748 - DNA, 21 bp, Homo sapiens
ggcagggagagcgcctcttcc

SEQ ID NO: 6321749 - DNA, 11 bp, Homo sapiens
ggcagggaggg

SEQ ID NO: 6321750 - DNA, 22 bp, Homo sapiens
ggcagggagggaaacccgggga

SEQ ID NO: 6321751 - DNA, 14 bp, Homo sapiens
ggcagggagggctt

SEQ ID NO: 6321752 - DNA, 13 bp, Homo sapiens
ggcagggaggggc

SEQ ID NO: 6321753 - DNA, 14 bp, Homo sapiens
ggcagggaggggct

SEQ ID NO: 6321754 - DNA, 17 bp, Homo sapiens
ggcagggagggggctgg

SEQ ID NO: 6321755 - DNA, 14 bp, Homo sapiens
ggcagggagtgtct

SEQ ID NO: 6321756 - DNA, 19 bp, Homo sapiens
ggcagggagtgtctgcagt

SEQ ID NO: 6321757 - DNA, 15 bp, Homo sapiens
ggcagggcaaaggtc

SEQ ID NO: 6321758 - DNA, 22 bp, Homo sapiens
ggcagggcaaaggtcaagactg

SEQ ID NO: 6321759 - DNA, 15 bp, Homo sapiens
ggcagggcacagggc

SEQ ID NO: 6321760 - DNA, 18 bp, Homo sapiens
ggcagggcacagggcctg

SEQ ID NO: 6321761 - DNA, 12 bp, Homo sapiens
ggcagggcagca

SEQ ID NO: 6321762 - DNA, 18 bp, Homo sapiens
ggcagggcagcaggaggc

SEQ ID NO: 6321763 - DNA, 15 bp, Homo sapiens
ggcagggcatctcct

SEQ ID NO: 6321764 - DNA, 19 bp, Homo sapiens
ggcagggccaccccactct

SEQ ID NO: 6321765 - DNA, 23 bp, Homo sapiens
ggcagggccaccccactctacct

SEQ ID NO: 6321766 - DNA, 22 bp, Homo sapiens
ggcagggccacctgcaggaccc

SEQ ID NO: 6321767 - DNA, 13 bp, Homo sapiens
ggcagggccaggc

SEQ ID NO: 6321768 - DNA, 16 bp, Homo sapiens
ggcagggccaggcctc

SEQ ID NO: 6321769 - DNA, 14 bp, Homo sapiens
gtccactgtgtata

SEQ ID NO: 6321770 - DNA, 20 bp, Homo sapiens
gtccactgtgtttagttgca

SEQ ID NO: 6321771 - DNA, 19 bp, Homo sapiens
gtccactgttctgttctca

SEQ ID NO: 6321772 - DNA, 20 bp, Homo sapiens
gtccactgttgagccccagt

SEQ ID NO: 6321773 - DNA, 19 bp, Homo sapiens
gtccacttctgacagcctc

SEQ ID NO: 6321774 - DNA, 14 bp, Homo sapiens
gtccacttgccagg

SEQ ID NO: 6321775 - DNA, 22 bp, Homo sapiens
gtccacttttccagtattttag

SEQ ID NO: 6321776 - DNA, 17 bp, Homo sapiens
gtccagaaactcctgtt

SEQ ID NO: 6321777 - DNA, 18 bp, Homo sapiens
gtccagaaactcctgttt

SEQ ID NO: 6321778 - DNA, 21 bp, Homo sapiens
gtccagaaactcctgtttctc

SEQ ID NO: 6321779 - DNA, 12 bp, Homo sapiens
gtccagaaatgg

SEQ ID NO: 6321780 - DNA, 19 bp, Homo sapiens
gtccagaagaaattattta

SEQ ID NO: 6321781 - DNA, 19 bp, Homo sapiens
gtccagaagaatattcagg

SEQ ID NO: 6321782 - DNA, 12 bp, Homo sapiens
gtccagaaggag

SEQ ID NO: 6321783 - DNA, 14 bp, Homo sapiens
gtccagaaggagac

SEQ ID NO: 6321784 - DNA, 20 bp, Homo sapiens
gtccagaaggagacaggcag

SEQ ID NO: 6321785 - DNA, 19 bp, Homo sapiens
gtccagaaggagcaggccc

SEQ ID NO: 6321786 - DNA, 20 bp, Homo sapiens
gtccagaaggagcaggccct

SEQ ID NO: 6321787 - DNA, 16 bp, Homo sapiens
gtccagacaagccctg

SEQ ID NO: 6321788 - DNA, 16 bp, Homo sapiens
gtccagacagcctgta

SEQ ID NO: 6321789 - DNA, 18 bp, Homo sapiens
gtccagaccattgtcttc

SEQ ID NO: 6321790 - DNA, 12 bp, Homo sapiens
gtccagacctgg

SEQ ID NO: 6321791 - DNA, 17 bp, Homo sapiens
gtccagacctgggccct

SEQ ID NO: 6321792 - DNA, 18 bp, Homo sapiens
gtccagacctgggccctg

SEQ ID NO: 6321793 - DNA, 19 bp, Homo sapiens
gtccagacctgggccctgg

SEQ ID NO: 6321794 - DNA, 18 bp, Homo sapiens
gtccagactcagagggct

SEQ ID NO: 6321795 - DNA, 19 bp, Homo sapiens
gtccagagacccctcaatc

SEQ ID NO: 6321796 - DNA, 18 bp, Homo sapiens
gtccagagagcctccctg

SEQ ID NO: 6321797 - DNA, 12 bp, Homo sapiens
gtccagagccgg

SEQ ID NO: 6321798 - DNA, 21 bp, Homo sapiens
gtccagagcggaggctgtgtg

SEQ ID NO: 6321799 - DNA, 22 bp, Homo sapiens
gtccagagcttcagggctgggc

SEQ ID NO: 6321800 - DNA, 16 bp, Homo sapiens
gtccagagcttttcag

SEQ ID NO: 6321801 - DNA, 14 bp, Homo sapiens
gtccagaggctgca

SEQ ID NO: 6321802 - DNA, 21 bp, Homo sapiens
gtccagagtcaactgttccca

SEQ ID NO: 6321803 - DNA, 21 bp, Homo sapiens
gtccagatcttgcctccagag

SEQ ID NO: 6321804 - DNA, 15 bp, Homo sapiens
gtccagatgccttcc

SEQ ID NO: 6321805 - DNA, 18 bp, Homo sapiens
gtccagattattggctgc

SEQ ID NO: 6321806 - DNA, 20 bp, Homo sapiens
gtccagattattggctgctt

SEQ ID NO: 6321807 - DNA, 15 bp, Homo sapiens
gtccagatttacact

SEQ ID NO: 6321808 - DNA, 17 bp, Homo sapiens
gtccagatttacactgg

SEQ ID NO: 6321809 - DNA, 21 bp, Homo sapiens
gtccagcaaataaagcagtca

SEQ ID NO: 6321810 - DNA, 19 bp, Homo sapiens
gtccagcaccttgtgcctg

SEQ ID NO: 6321811 - DNA, 13 bp, Homo sapiens
gtccagcagctgc

SEQ ID NO: 6321812 - DNA, 17 bp, Homo sapiens
gtccagcagtttccagt

SEQ ID NO: 6321813 - DNA, 19 bp, Homo sapiens
gtccagcattgctggactc

SEQ ID NO: 6321814 - DNA, 13 bp, Homo sapiens
gtccagccacttg

SEQ ID NO: 6321815 - DNA, 18 bp, Homo sapiens
gtccagccagctcctgca

SEQ ID NO: 6321816 - DNA, 22 bp, Homo sapiens
gtccagccagctcctgggcagc

SEQ ID NO: 6321817 - DNA, 23 bp, Homo sapiens
gtccagccagctcctgggcagct

SEQ ID NO: 6321818 - DNA, 19 bp, Homo sapiens
gtccagcccatctcggagc

SEQ ID NO: 6321819 - DNA, 11 bp, Homo sapiens
gtccagccccc

SEQ ID NO: 6321820 - DNA, 13 bp, Homo sapiens
gtccagcccccag

SEQ ID NO: 6321821 - DNA, 22 bp, Homo sapiens
gtccagcccctcctccctcaga

SEQ ID NO: 6321822 - DNA, 10 bp, Homo sapiens
gtccagccct

SEQ ID NO: 6321823 - DNA, 11 bp, Homo sapiens
gtccagccctc

SEQ ID NO: 6321824 - DNA, 13 bp, Homo sapiens
gtccagccctccg

SEQ ID NO: 6321825 - DNA, 16 bp, Homo sapiens
gtccagccctggctga

SEQ ID NO: 6321826 - DNA, 20 bp, Homo sapiens
gtccagccctggctgaagga

SEQ ID NO: 6321827 - DNA, 23 bp, Homo sapiens
gtccagccctggctgaaggactg

SEQ ID NO: 6321828 - DNA, 16 bp, Homo sapiens
gtccagccgtgtgtgc

SEQ ID NO: 6321829 - DNA, 22 bp, Homo sapiens
gtccagccgtgtgtgcatgtgc

SEQ ID NO: 6321830 - DNA, 23 bp, Homo sapiens
gtccagcctgccccggagctgga

SEQ ID NO: 6321831 - DNA, 11 bp, Homo sapiens
gtccagcctgg

SEQ ID NO: 6321832 - DNA, 13 bp, Homo sapiens
gtccagcctgggc

SEQ ID NO: 6321833 - DNA, 21 bp, Homo sapiens
gtccagccttgatcagtgaca

SEQ ID NO: 6321834 - DNA, 16 bp, Homo sapiens
gtccagcgtcactcca

SEQ ID NO: 6321835 - DNA, 17 bp, Homo sapiens
gtccagcgtcactccag

SEQ ID NO: 6321836 - DNA, 14 bp, Homo sapiens
gtccagctcagccc

SEQ ID NO: 6321837 - DNA, 18 bp, Homo sapiens
gtccagctcagccctggc

SEQ ID NO: 6321838 - DNA, 14 bp, Homo sapiens
gtccagctccaacc

SEQ ID NO: 6321839 - DNA, 12 bp, Homo sapiens
gtccagctctcc

SEQ ID NO: 6321840 - DNA, 14 bp, Homo sapiens
gtccagctctgaca

SEQ ID NO: 6321841 - DNA, 19 bp, Homo sapiens
gtccagctctgacatccct

SEQ ID NO: 6321842 - DNA, 12 bp, Homo sapiens
gtccagctctgg

SEQ ID NO: 6321843 - DNA, 13 bp, Homo sapiens
gtccagctctgga

SEQ ID NO: 6321844 - DNA, 21 bp, Homo sapiens
gtccagctctggaggggaggg

SEQ ID NO: 6321845 - DNA, 14 bp, Homo sapiens
gtccagctctgtgg

SEQ ID NO: 6321846 - DNA, 17 bp, Homo sapiens
gtccagctctgtgggcc

SEQ ID NO: 6321847 - DNA, 13 bp, Homo sapiens
gtccagctcttgg

SEQ ID NO: 6321848 - DNA, 19 bp, Homo sapiens
gtccagctcttggcccctg

SEQ ID NO: 6321849 - DNA, 17 bp, Homo sapiens
gtccagctgagcgccag

SEQ ID NO: 6321850 - DNA, 21 bp, Homo sapiens
gtccagctgcccttccgcagt

SEQ ID NO: 6321851 - DNA, 22 bp, Homo sapiens
gtccagctgcccttccgcagtg

SEQ ID NO: 6321852 - DNA, 13 bp, Homo sapiens
gtccagctgggcc

SEQ ID NO: 6321853 - DNA, 20 bp, Homo sapiens
gtccagctgggcctcctgcc

SEQ ID NO: 6321854 - DNA, 13 bp, Homo sapiens
gtccagctggggc

SEQ ID NO: 6321855 - DNA, 14 bp, Homo sapiens
gtccagctggggcc

SEQ ID NO: 6321856 - DNA, 17 bp, Homo sapiens
gtccagcttgctcttca

SEQ ID NO: 6321857 - DNA, 20 bp, Homo sapiens
gtccagctttactgtggctg

SEQ ID NO: 6321858 - DNA, 18 bp, Homo sapiens
gtccagctttccttctgc

SEQ ID NO: 6321859 - DNA, 20 bp, Homo sapiens
gtccagctttccttctgccc

SEQ ID NO: 6321860 - DNA, 21 bp, Homo sapiens
gtccagctttccttctgccct

SEQ ID NO: 6321861 - DNA, 12 bp, Homo sapiens
gtccagctttct

SEQ ID NO: 6321862 - DNA, 17 bp, Homo sapiens
gtccaggaactgcctgg

SEQ ID NO: 6321863 - DNA, 19 bp, Homo sapiens
gtccaggaactgcctgggc

SEQ ID NO: 6321864 - DNA, 17 bp, Homo sapiens
gtccaggaaggcagctg

SEQ ID NO: 6321865 - DNA, 20 bp, Homo sapiens
gtccaggaaggcagctgctc

SEQ ID NO: 6321866 - DNA, 19 bp, Homo sapiens
gtccaggagaagtgctccc

SEQ ID NO: 6321867 - DNA, 20 bp, Homo sapiens
gtccaggagaagtgctccct

SEQ ID NO: 6321868 - DNA, 15 bp, Homo sapiens
gtccaggagccccag

SEQ ID NO: 6321869 - DNA, 19 bp, Homo sapiens
gtccaggagccccagccag

SEQ ID NO: 6321870 - DNA, 15 bp, Homo sapiens
gtccaggagctcagg

SEQ ID NO: 6321871 - DNA, 15 bp, Homo sapiens
gtccaggcacaggat

SEQ ID NO: 6321872 - DNA, 15 bp, Homo sapiens
gtccaggcactgaga

SEQ ID NO: 6321873 - DNA, 12 bp, Homo sapiens
gtccaggcagct

SEQ ID NO: 6321874 - DNA, 12 bp, Homo sapiens
gtccaggcagga

SEQ ID NO: 6321875 - DNA, 15 bp, Homo sapiens
gtccaggcaggagga

SEQ ID NO: 6321876 - DNA, 21 bp, Homo sapiens
gtccaggccagtgggcctggt

SEQ ID NO: 6321877 - DNA, 22 bp, Homo sapiens
gtccaggccagtgggcctggta

SEQ ID NO: 6321878 - DNA, 17 bp, Homo sapiens
gtccaggccccaaaacc

SEQ ID NO: 6321879 - DNA, 20 bp, Homo sapiens
gtccaggcccccaacccctc

SEQ ID NO: 6321880 - DNA, 18 bp, Homo sapiens
gtccaggcccgtgggcgc

SEQ ID NO: 6321881 - DNA, 15 bp, Homo sapiens
gtccaggccctgtgg

SEQ ID NO: 6321882 - DNA, 17 bp, Homo sapiens
gtccaggccctgtggca

SEQ ID NO: 6321883 - DNA, 17 bp, Homo sapiens
gtccaggcctctctctg

SEQ ID NO: 6321884 - DNA, 15 bp, Homo sapiens
gtccaggcctgggtc

SEQ ID NO: 6321885 - DNA, 15 bp, Homo sapiens
gtccaggcgggcaag

SEQ ID NO: 6321886 - DNA, 14 bp, Homo sapiens
gtccaggctctggg

SEQ ID NO: 6321887 - DNA, 17 bp, Homo sapiens
gtccaggctctgggcac

SEQ ID NO: 6321888 - DNA, 22 bp, Homo sapiens
gtccaggctctgggcacagtgc

SEQ ID NO: 6321889 - DNA, 13 bp, Homo sapiens
gtccaggctgccg

SEQ ID NO: 6321890 - DNA, 18 bp, Homo sapiens
gtccaggctggtctgaaa

SEQ ID NO: 6321891 - DNA, 18 bp, Homo sapiens
gtccagggaaacagcctc

SEQ ID NO: 6321892 - DNA, 19 bp, Homo sapiens
gtccagggaaacagcctct

SEQ ID NO: 6321893 - DNA, 15 bp, Homo sapiens
gtccagggaagctgg

SEQ ID NO: 6321894 - DNA, 21 bp, Homo sapiens
gtccagggagcattttcctcc

SEQ ID NO: 6321895 - DNA, 19 bp, Homo sapiens
gtccagggcgggagtgggg

SEQ ID NO: 6321896 - DNA, 21 bp, Homo sapiens
gtccagggcgggagtgggggc

SEQ ID NO: 6321897 - DNA, 18 bp, Homo sapiens
gtccagggctagtgactt

SEQ ID NO: 6321898 - DNA, 11 bp, Homo sapiens
gtccagggctg

SEQ ID NO: 6321899 - DNA, 14 bp, Homo sapiens
gtccagggctgttg

SEQ ID NO: 6321900 - DNA, 19 bp, Homo sapiens
gtccaggggagggaaaagc

SEQ ID NO: 6321901 - DNA, 20 bp, Homo sapiens
gtccaggggagggaaaagct

SEQ ID NO: 6321902 - DNA, 23 bp, Homo sapiens
gtccaggggcccctccagcttgt

SEQ ID NO: 6321903 - DNA, 17 bp, Homo sapiens
gtccagggtccagccct

SEQ ID NO: 6321904 - DNA, 20 bp, Homo sapiens
gtccagggtttctctgcaga

SEQ ID NO: 6321905 - DNA, 16 bp, Homo sapiens
gtccaggtcacaggca

SEQ ID NO: 6321906 - DNA, 16 bp, Homo sapiens
gtccaggtcccagccc

SEQ ID NO: 6321907 - DNA, 19 bp, Homo sapiens
gtccaggtcccagcccctc

SEQ ID NO: 6321908 - DNA, 23 bp, Homo sapiens
gtccaggtcccagcccctcctcc

SEQ ID NO: 6321909 - DNA, 15 bp, Homo sapiens
gtccaggtcctggtg

SEQ ID NO: 6321910 - DNA, 22 bp, Homo sapiens
gtccaggtcctggtggggcagc

SEQ ID NO: 6321911 - DNA, 23 bp, Homo sapiens
gtccaggtcctggtggggcagct

SEQ ID NO: 6321912 - DNA, 23 bp, Homo sapiens
gtccaggtcgggctcagctctgg

SEQ ID NO: 6321913 - DNA, 22 bp, Homo sapiens
gtccaggtctagaaggccaggc

SEQ ID NO: 6321914 - DNA, 16 bp, Homo sapiens
gtccaggtctcactgc

SEQ ID NO: 6321915 - DNA, 17 bp, Homo sapiens
gtccaggtctcactgct

SEQ ID NO: 6321916 - DNA, 20 bp, Homo sapiens
gtccaggtctcactgctttg

SEQ ID NO: 6321917 - DNA, 21 bp, Homo sapiens
gtccaggtctcactgctttgc

SEQ ID NO: 6321918 - DNA, 20 bp, Homo sapiens
gtccaggtggtgaattttcc

SEQ ID NO: 6321919 - DNA, 15 bp, Homo sapiens
gtccaggttgatctt

SEQ ID NO: 6321920 - DNA, 21 bp, Homo sapiens
gtccagtaagatcactgttta

SEQ ID NO: 6321921 - DNA, 15 bp, Homo sapiens
gtccagtcatcctgc

SEQ ID NO: 6321922 - DNA, 22 bp, Homo sapiens
gtccagtcatcctgccctgcag

SEQ ID NO: 6321923 - DNA, 13 bp, Homo sapiens
gtccagtccagtg

SEQ ID NO: 6321924 - DNA, 14 bp, Homo sapiens
gtccagtccagtga

SEQ ID NO: 6321925 - DNA, 17 bp, Homo sapiens
gtccagtcctatctggg

SEQ ID NO: 6321926 - DNA, 21 bp, Homo sapiens
gtccagtcctttgttgctgtt

SEQ ID NO: 6321927 - DNA, 14 bp, Homo sapiens
gtccagtcgggagg

SEQ ID NO: 6321928 - DNA, 16 bp, Homo sapiens
gtccagtctcttctgc

SEQ ID NO: 6321929 - DNA, 12 bp, Homo sapiens
gtccagtctgtg

SEQ ID NO: 6321930 - DNA, 16 bp, Homo sapiens
gtccagtctgtgatcc

SEQ ID NO: 6321931 - DNA, 15 bp, Homo sapiens
gtccagtgagaaatt

SEQ ID NO: 6321932 - DNA, 17 bp, Homo sapiens
gtccagtgagcagtgtt

SEQ ID NO: 6321933 - DNA, 20 bp, Homo sapiens
gtccagtgcaaccacacacc

SEQ ID NO: 6321934 - DNA, 20 bp, Homo sapiens
gtccagtgcattttgtttct

SEQ ID NO: 6321935 - DNA, 13 bp, Homo sapiens
gtccagtgcccat

SEQ ID NO: 6321936 - DNA, 12 bp, Homo sapiens
gtccagtgccta

SEQ ID NO: 6321937 - DNA, 19 bp, Homo sapiens
gtccagtgctctgcctcag

SEQ ID NO: 6321938 - DNA, 18 bp, Homo sapiens
gtccagtggagggctcat

SEQ ID NO: 6321939 - DNA, 17 bp, Homo sapiens
gtccagtgtcacctctc

SEQ ID NO: 6321940 - DNA, 23 bp, Homo sapiens
gtccagtgtcacctctctcagag

SEQ ID NO: 6321941 - DNA, 19 bp, Homo sapiens
gtccagttcccagaaggca

SEQ ID NO: 6321942 - DNA, 22 bp, Homo sapiens
gtccagttgattgtacgtagcc

SEQ ID NO: 6321943 - DNA, 15 bp, Homo sapiens
gtccataagagaaat

SEQ ID NO: 6321944 - DNA, 14 bp, Homo sapiens
gtccatagagagca

SEQ ID NO: 6321945 - DNA, 20 bp, Homo sapiens
gtccatagagatgagcccac

SEQ ID NO: 6321946 - DNA, 21 bp, Homo sapiens
gtccatagagatgagcccacc

SEQ ID NO: 6321947 - DNA, 21 bp, Homo sapiens
gtccatagatataaagccatt

SEQ ID NO: 6321948 - DNA, 21 bp, Homo sapiens
ggcagggccaggcctctgctg

SEQ ID NO: 6321949 - DNA, 17 bp, Homo sapiens
ggcagggccagggcaat

SEQ ID NO: 6321950 - DNA, 20 bp, Homo sapiens
ggcagggcccacgtgtatag

SEQ ID NO: 6321951 - DNA, 21 bp, Homo sapiens
ggcagggcccagggaggtggc

SEQ ID NO: 6321952 - DNA, 21 bp, Homo sapiens
ggcagggcccccaataaacca

SEQ ID NO: 6321953 - DNA, 18 bp, Homo sapiens
ggcagggcccctgaccct

SEQ ID NO: 6321954 - DNA, 11 bp, Homo sapiens
ggcagggccct

SEQ ID NO: 6321955 - DNA, 12 bp, Homo sapiens
ggcagggccctg

SEQ ID NO: 6321956 - DNA, 14 bp, Homo sapiens
ggcagggccctgaa

SEQ ID NO: 6321957 - DNA, 17 bp, Homo sapiens
ggcagggccctgaaatg

SEQ ID NO: 6321958 - DNA, 14 bp, Homo sapiens
ggcagggccctgtg

SEQ ID NO: 6321959 - DNA, 19 bp, Homo sapiens
ggcagggccctgtggctcc

SEQ ID NO: 6321960 - DNA, 19 bp, Homo sapiens
ggcagggcctagctgctac

SEQ ID NO: 6321961 - DNA, 18 bp, Homo sapiens
ggcagggcctggctccag

SEQ ID NO: 6321962 - DNA, 19 bp, Homo sapiens
ggcagggcctgggcctcat

SEQ ID NO: 6321963 - DNA, 18 bp, Homo sapiens
ggcagggccttgcccaga

SEQ ID NO: 6321964 - DNA, 19 bp, Homo sapiens
ggcagggccttgcccagag

SEQ ID NO: 6321965 - DNA, 20 bp, Homo sapiens
ggcagggccttgcccagaga

SEQ ID NO: 6321966 - DNA, 17 bp, Homo sapiens
ggcagggcgagctgcag

SEQ ID NO: 6321967 - DNA, 19 bp, Homo sapiens
ggcagggcgggcagagggc

SEQ ID NO: 6321968 - DNA, 21 bp, Homo sapiens
ggcagggctcacactcctggg

SEQ ID NO: 6321969 - DNA, 13 bp, Homo sapiens
ggcagggctcagg

SEQ ID NO: 6321970 - DNA, 15 bp, Homo sapiens
ggcagggctcaggat

SEQ ID NO: 6321971 - DNA, 18 bp, Homo sapiens
ggcagggctcctccctgg

SEQ ID NO: 6321972 - DNA, 22 bp, Homo sapiens
ggcagggctcctccctggagct

SEQ ID NO: 6321973 - DNA, 13 bp, Homo sapiens
ggcagggctctga

SEQ ID NO: 6321974 - DNA, 15 bp, Homo sapiens
ggcagggctgactct

SEQ ID NO: 6321975 - DNA, 14 bp, Homo sapiens
ggcagggctgagga

SEQ ID NO: 6321976 - DNA, 24 bp, Homo sapiens
ggcagggctgcagagggagacggc

SEQ ID NO: 6321977 - DNA, 11 bp, Homo sapiens
ggcagggctgg

SEQ ID NO: 6321978 - DNA, 13 bp, Homo sapiens
ggcagggctggga

SEQ ID NO: 6321979 - DNA, 17 bp, Homo sapiens
ggcaggggaaactctgg

SEQ ID NO: 6321980 - DNA, 20 bp, Homo sapiens
ggcaggggaaactctggtgc

SEQ ID NO: 6321981 - DNA, 21 bp, Homo sapiens
ggcaggggaattttctctcca

SEQ ID NO: 6321982 - DNA, 14 bp, Homo sapiens
ggcaggggacagga

SEQ ID NO: 6321983 - DNA, 23 bp, Homo sapiens
ggcaggggagacaggagcctagc

SEQ ID NO: 6321984 - DNA, 16 bp, Homo sapiens
ggcaggggagccaggg

SEQ ID NO: 6321985 - DNA, 19 bp, Homo sapiens
ggcaggggagtagtggaga

SEQ ID NO: 6321986 - DNA, 14 bp, Homo sapiens
ggcaggggagtctg

SEQ ID NO: 6321987 - DNA, 15 bp, Homo sapiens
ggcaggggagtctgc

SEQ ID NO: 6321988 - DNA, 23 bp, Homo sapiens
ggcaggggatccagctcaaggga

SEQ ID NO: 6321989 - DNA, 16 bp, Homo sapiens
ggcaggggcaggaggg

SEQ ID NO: 6321990 - DNA, 14 bp, Homo sapiens
ggcaggggcagtgg

SEQ ID NO: 6321991 - DNA, 17 bp, Homo sapiens
ggcaggggcagtggcct

SEQ ID NO: 6321992 - DNA, 20 bp, Homo sapiens
ggcaggggcccctcctctgt

SEQ ID NO: 6321993 - DNA, 20 bp, Homo sapiens
ggcaggggccctgcagctct

SEQ ID NO: 6321994 - DNA, 21 bp, Homo sapiens
ggcaggggccctgcagctctc

SEQ ID NO: 6321995 - DNA, 21 bp, Homo sapiens
ggcaggggccgtgcagggcca

SEQ ID NO: 6321996 - DNA, 16 bp, Homo sapiens
ggcaggggcctggaga

SEQ ID NO: 6321997 - DNA, 17 bp, Homo sapiens
ggcaggggcctggagat

SEQ ID NO: 6321998 - DNA, 16 bp, Homo sapiens
ggcaggggctgcatcc

SEQ ID NO: 6321999 - DNA, 16 bp, Homo sapiens
ggcaggggctggaggg

SEQ ID NO: 6322000 - DNA, 14 bp, Homo sapiens
ggcaggggctgggc

SEQ ID NO: 6322001 - DNA, 16 bp, Homo sapiens
ggcaggggctgggcag

SEQ ID NO: 6322002 - DNA, 19 bp, Homo sapiens
ggcaggggctgggcagagg

SEQ ID NO: 6322003 - DNA, 15 bp, Homo sapiens
ggcaggggcttcctg

SEQ ID NO: 6322004 - DNA, 18 bp, Homo sapiens
ggcagggggacagcaggg

SEQ ID NO: 6322005 - DNA, 23 bp, Homo sapiens
ggcagggggccccgccagggctg

SEQ ID NO: 6322006 - DNA, 17 bp, Homo sapiens
ggcagggggccctgccc

SEQ ID NO: 6322007 - DNA, 19 bp, Homo sapiens
ggcagggggccctgcccca

SEQ ID NO: 6322008 - DNA, 13 bp, Homo sapiens
ggcagggggctgc

SEQ ID NO: 6322009 - DNA, 14 bp, Homo sapiens
ggcagggggctgct

SEQ ID NO: 6322010 - DNA, 15 bp, Homo sapiens
ggcaggggggagagg

SEQ ID NO: 6322011 - DNA, 20 bp, Homo sapiens
ggcagggggtatgcagagct

SEQ ID NO: 6322012 - DNA, 22 bp, Homo sapiens
ggcagggggtatgcagagcttg

SEQ ID NO: 6322013 - DNA, 19 bp, Homo sapiens
ggcagggggtgaaggcagg

SEQ ID NO: 6322014 - DNA, 20 bp, Homo sapiens
ggcaggggtcctgcaggtcc

SEQ ID NO: 6322015 - DNA, 15 bp, Homo sapiens
ggcaggggtgagagc

SEQ ID NO: 6322016 - DNA, 23 bp, Homo sapiens
ggcaggggtggaggagagcctgg

SEQ ID NO: 6322017 - DNA, 16 bp, Homo sapiens
ggcaggggtgggagag

SEQ ID NO: 6322018 - DNA, 13 bp, Homo sapiens
ggcaggggtgggg

SEQ ID NO: 6322019 - DNA, 21 bp, Homo sapiens
ggcaggggtggtggagggggc

SEQ ID NO: 6322020 - DNA, 16 bp, Homo sapiens
ggcaggggtgtcctga

SEQ ID NO: 6322021 - DNA, 17 bp, Homo sapiens
ggcaggggttagagcag

SEQ ID NO: 6322022 - DNA, 17 bp, Homo sapiens
ggcagggtaggtggggc

SEQ ID NO: 6322023 - DNA, 17 bp, Homo sapiens
ggcagggtccacgcctc

SEQ ID NO: 6322024 - DNA, 14 bp, Homo sapiens
ggcagggtctcact

SEQ ID NO: 6322025 - DNA, 18 bp, Homo sapiens
ggcagggtctcactctgt

SEQ ID NO: 6322026 - DNA, 20 bp, Homo sapiens
ggcagggtctcactctgtcg

SEQ ID NO: 6322027 - DNA, 18 bp, Homo sapiens
ggcagggtctctgctcca

SEQ ID NO: 6322028 - DNA, 19 bp, Homo sapiens
ggcagggtctctgctccag

SEQ ID NO: 6322029 - DNA, 21 bp, Homo sapiens
ggcagggtctctgctccagca

SEQ ID NO: 6322030 - DNA, 15 bp, Homo sapiens
ggcagggtctgggct

SEQ ID NO: 6322031 - DNA, 16 bp, Homo sapiens
ggcagggtctgggctg

SEQ ID NO: 6322032 - DNA, 15 bp, Homo sapiens
ggcagggtgggagcc

SEQ ID NO: 6322033 - DNA, 16 bp, Homo sapiens
ggcagggtgggatgga

SEQ ID NO: 6322034 - DNA, 23 bp, Homo sapiens
ggcagggtgggatggaggagaag

SEQ ID NO: 6322035 - DNA, 23 bp, Homo sapiens
ggcaggtatgatcggcaggacac

SEQ ID NO: 6322036 - DNA, 18 bp, Homo sapiens
ggcaggtcaggaccagga

SEQ ID NO: 6322037 - DNA, 18 bp, Homo sapiens
ggcaggtcatggagcagc

SEQ ID NO: 6322038 - DNA, 19 bp, Homo sapiens
ggcaggtcatggagcagcc

SEQ ID NO: 6322039 - DNA, 15 bp, Homo sapiens
ggcaggtccagctct

SEQ ID NO: 6322040 - DNA, 18 bp, Homo sapiens
ggcaggtccagctctgtg

SEQ ID NO: 6322041 - DNA, 23 bp, Homo sapiens
ggcaggtcctagtcgggcagggc

SEQ ID NO: 6322042 - DNA, 18 bp, Homo sapiens
ggcaggtcctcccctctc

SEQ ID NO: 6322043 - DNA, 16 bp, Homo sapiens
ggcaggtcctgcccat

SEQ ID NO: 6322044 - DNA, 19 bp, Homo sapiens
ggcaggtcctgcccatgtg

SEQ ID NO: 6322045 - DNA, 15 bp, Homo sapiens
ggcaggtcctggcca

SEQ ID NO: 6322046 - DNA, 19 bp, Homo sapiens
ggcaggtcctggggaggct

SEQ ID NO: 6322047 - DNA, 21 bp, Homo sapiens
ggcaggtctagtgttcctgca

SEQ ID NO: 6322048 - DNA, 21 bp, Homo sapiens
ggcaggtgacagtgaggtcct

SEQ ID NO: 6322049 - DNA, 16 bp, Homo sapiens
ggcaggtgaccttctg

SEQ ID NO: 6322050 - DNA, 17 bp, Homo sapiens
ggcaggtgagaacccag

SEQ ID NO: 6322051 - DNA, 13 bp, Homo sapiens
ggcaggtgcagat

SEQ ID NO: 6322052 - DNA, 18 bp, Homo sapiens
ggcaggtgcagggaagtg

SEQ ID NO: 6322053 - DNA, 14 bp, Homo sapiens
ggcaggtgccccgt

SEQ ID NO: 6322054 - DNA, 23 bp, Homo sapiens
ggcaggtgccccgtggtacattc

SEQ ID NO: 6322055 - DNA, 20 bp, Homo sapiens
ggcaggtgctggagcactgg

SEQ ID NO: 6322056 - DNA, 22 bp, Homo sapiens
ggcaggtgcttttggcagagac

SEQ ID NO: 6322057 - DNA, 18 bp, Homo sapiens
ggcaggtggacgctgcag

SEQ ID NO: 6322058 - DNA, 13 bp, Homo sapiens
ggcaggtggactg

SEQ ID NO: 6322059 - DNA, 22 bp, Homo sapiens
ggcaggtggagagagtggtaaa

SEQ ID NO: 6322060 - DNA, 23 bp, Homo sapiens
ggcaggtggccgcccctgaggct

SEQ ID NO: 6322061 - DNA, 22 bp, Homo sapiens
ggcaggtggcctctgctggtct

SEQ ID NO: 6322062 - DNA, 17 bp, Homo sapiens
ggcaggtgggagctgaa

SEQ ID NO: 6322063 - DNA, 17 bp, Homo sapiens
ggcaggtggtggagggg

SEQ ID NO: 6322064 - DNA, 18 bp, Homo sapiens
ggcaggtggtggaggggc

SEQ ID NO: 6322065 - DNA, 19 bp, Homo sapiens
ggcaggtggtggaggggcg

SEQ ID NO: 6322066 - DNA, 22 bp, Homo sapiens
ggcaggtggtggcactgagccc

SEQ ID NO: 6322067 - DNA, 15 bp, Homo sapiens
ggcaggtgtcatatg

SEQ ID NO: 6322068 - DNA, 13 bp, Homo sapiens
ggcaggtgtggga

SEQ ID NO: 6322069 - DNA, 20 bp, Homo sapiens
ggcaggttagaacctagaag

SEQ ID NO: 6322070 - DNA, 15 bp, Homo sapiens
ggcaggttagaagaa

SEQ ID NO: 6322071 - DNA, 13 bp, Homo sapiens
ggcaggttcctgg

SEQ ID NO: 6322072 - DNA, 16 bp, Homo sapiens
ggcaggttcctggggc

SEQ ID NO: 6322073 - DNA, 19 bp, Homo sapiens
ggcaggttgatcagtgagc

SEQ ID NO: 6322074 - DNA, 20 bp, Homo sapiens
ggcaggttggatgggagtgg

SEQ ID NO: 6322075 - DNA, 15 bp, Homo sapiens
ggcaggttggtgggg

SEQ ID NO: 6322076 - DNA, 16 bp, Homo sapiens
ggcaggtttgccagtg

SEQ ID NO: 6322077 - DNA, 16 bp, Homo sapiens
ggcagtaaagagaaac

SEQ ID NO: 6322078 - DNA, 19 bp, Homo sapiens
ggcagtaaagagaaacttt

SEQ ID NO: 6322079 - DNA, 16 bp, Homo sapiens
ggcagtacctgagggt

SEQ ID NO: 6322080 - DNA, 20 bp, Homo sapiens
ggcagtacctgagggtctgt

SEQ ID NO: 6322081 - DNA, 23 bp, Homo sapiens
ggcagtacctgggaaaggaccca

SEQ ID NO: 6322082 - DNA, 22 bp, Homo sapiens
ggcagtactcctccctgggggc

SEQ ID NO: 6322083 - DNA, 16 bp, Homo sapiens
ggcagtagcagctgtg

SEQ ID NO: 6322084 - DNA, 23 bp, Homo sapiens
ggcagtagctgtggtgaggtggg

SEQ ID NO: 6322085 - DNA, 20 bp, Homo sapiens
ggcagtaggaacccagctct

SEQ ID NO: 6322086 - DNA, 23 bp, Homo sapiens
ggcagtatggcggaggccatggg

SEQ ID NO: 6322087 - DNA, 16 bp, Homo sapiens
ggcagtatgtgatgga

SEQ ID NO: 6322088 - DNA, 15 bp, Homo sapiens
ggcagtattcccttt

SEQ ID NO: 6322089 - DNA, 19 bp, Homo sapiens
ggcagtattttgtgtcctc

SEQ ID NO: 6322090 - DNA, 13 bp, Homo sapiens
ggcagtcaccacc

SEQ ID NO: 6322091 - DNA, 16 bp, Homo sapiens
ggcagtcaccacccag

SEQ ID NO: 6322092 - DNA, 19 bp, Homo sapiens
ggcagtcaccacccagccc

SEQ ID NO: 6322093 - DNA, 19 bp, Homo sapiens
ggcagtcagtggagggcga

SEQ ID NO: 6322094 - DNA, 11 bp, Homo sapiens
ggcagtccaga

SEQ ID NO: 6322095 - DNA, 19 bp, Homo sapiens
ggcagtccagccagctcct

SEQ ID NO: 6322096 - DNA, 13 bp, Homo sapiens
ggcagtccaggcc

SEQ ID NO: 6322097 - DNA, 20 bp, Homo sapiens
ggcagtccaggcctctctct

SEQ ID NO: 6322098 - DNA, 22 bp, Homo sapiens
ggcagtccaggcctctctctgc

SEQ ID NO: 6322099 - DNA, 11 bp, Homo sapiens
ggcagtccctt

SEQ ID NO: 6322100 - DNA, 15 bp, Homo sapiens
ggcagtccgtgggac

SEQ ID NO: 6322101 - DNA, 12 bp, Homo sapiens
ggcagtcctgga

SEQ ID NO: 6322102 - DNA, 17 bp, Homo sapiens
ggcagtcctggaggcag

SEQ ID NO: 6322103 - DNA, 18 bp, Homo sapiens
ggcagtcctggaggcagg

SEQ ID NO: 6322104 - DNA, 17 bp, Homo sapiens
ggcagtccttactcccc

SEQ ID NO: 6322105 - DNA, 18 bp, Homo sapiens
ggcagtccttactccccc

SEQ ID NO: 6322106 - DNA, 16 bp, Homo sapiens
ggcagtcgcacacaca

SEQ ID NO: 6322107 - DNA, 23 bp, Homo sapiens
ggcagtcgggggctggcctagga

SEQ ID NO: 6322108 - DNA, 22 bp, Homo sapiens
ggcagtctaagtgtaaatgtta

SEQ ID NO: 6322109 - DNA, 14 bp, Homo sapiens
ggcagtctcccctt

SEQ ID NO: 6322110 - DNA, 16 bp, Homo sapiens
ggcagtctccccttcc

SEQ ID NO: 6322111 - DNA, 20 bp, Homo sapiens
ggcagtctccccttcctggc

SEQ ID NO: 6322112 - DNA, 16 bp, Homo sapiens
ggcagtctggaggggc

SEQ ID NO: 6322113 - DNA, 20 bp, Homo sapiens
ggcagtcttttgtgtcagtg

SEQ ID NO: 6322114 - DNA, 17 bp, Homo sapiens
ggcagtgacaagtggag

SEQ ID NO: 6322115 - DNA, 18 bp, Homo sapiens
ggcagtgacaagtggagg

SEQ ID NO: 6322116 - DNA, 20 bp, Homo sapiens
ggcagtgactccccagccca

SEQ ID NO: 6322117 - DNA, 21 bp, Homo sapiens
ggcagtgactccccagcccag

SEQ ID NO: 6322118 - DNA, 23 bp, Homo sapiens
ggcagtgactcgacaaaggccac

SEQ ID NO: 6322119 - DNA, 20 bp, Homo sapiens
ggcagtgactggcaggtgca

SEQ ID NO: 6322120 - DNA, 15 bp, Homo sapiens
ggcagtgagtgagcc

SEQ ID NO: 6322121 - DNA, 18 bp, Homo sapiens
ggcagtgagtgagcctgg

SEQ ID NO: 6322122 - DNA, 19 bp, Homo sapiens
ggcagtgagtgccatgctt

SEQ ID NO: 6322123 - DNA, 23 bp, Homo sapiens
ggcagtgatgacttgctgtccag

SEQ ID NO: 6322124 - DNA, 18 bp, Homo sapiens
ggcagtgatgctggatgc

SEQ ID NO: 6322125 - DNA, 17 bp, Homo sapiens
gtccatatcagacctct

SEQ ID NO: 6322126 - DNA, 20 bp, Homo sapiens
gtccatatcagacctctgat

SEQ ID NO: 6322127 - DNA, 15 bp, Homo sapiens
gtccatatgagggaa

SEQ ID NO: 6322128 - DNA, 15 bp, Homo sapiens
gtccatcagcccctc

SEQ ID NO: 6322129 - DNA, 20 bp, Homo sapiens
gtccatcagggatctcagag

SEQ ID NO: 6322130 - DNA, 17 bp, Homo sapiens
gtccatccccagttggg

SEQ ID NO: 6322131 - DNA, 19 bp, Homo sapiens
gtccatccccttcccccat

SEQ ID NO: 6322132 - DNA, 18 bp, Homo sapiens
gtccatcccttttcctgt

SEQ ID NO: 6322133 - DNA, 21 bp, Homo sapiens
gtccatcccttttcctgtcag

SEQ ID NO: 6322134 - DNA, 17 bp, Homo sapiens
gtccatccgtctctgtc

SEQ ID NO: 6322135 - DNA, 18 bp, Homo sapiens
gtccatccgtctctgtcc

SEQ ID NO: 6322136 - DNA, 13 bp, Homo sapiens
gtccatcctcctc

SEQ ID NO: 6322137 - DNA, 14 bp, Homo sapiens
gtccatcctcctct

SEQ ID NO: 6322138 - DNA, 17 bp, Homo sapiens
gtccatcctcctctcca

SEQ ID NO: 6322139 - DNA, 21 bp, Homo sapiens
gtccatcctcctctccatgca

SEQ ID NO: 6322140 - DNA, 23 bp, Homo sapiens
gtccatcctcctctccatgcaag

SEQ ID NO: 6322141 - DNA, 16 bp, Homo sapiens
gtccatcctgacctgc

SEQ ID NO: 6322142 - DNA, 16 bp, Homo sapiens
gtccatcctgtgccag

SEQ ID NO: 6322143 - DNA, 13 bp, Homo sapiens
gtccatctctctc

SEQ ID NO: 6322144 - DNA, 14 bp, Homo sapiens
gtccatctctctcc

SEQ ID NO: 6322145 - DNA, 16 bp, Homo sapiens
gtccatctctctccct

SEQ ID NO: 6322146 - DNA, 18 bp, Homo sapiens
gtccatctctctccctta

SEQ ID NO: 6322147 - DNA, 14 bp, Homo sapiens
gtccatctctgaaa

SEQ ID NO: 6322148 - DNA, 16 bp, Homo sapiens
gtccatctgcccgcct

SEQ ID NO: 6322149 - DNA, 17 bp, Homo sapiens
gtccatctgcccgcctg

SEQ ID NO: 6322150 - DNA, 14 bp, Homo sapiens
gtccatctgtctgt

SEQ ID NO: 6322151 - DNA, 18 bp, Homo sapiens
gtccatctgtctgtccta

SEQ ID NO: 6322152 - DNA, 10 bp, Homo sapiens
gtccatcttg

SEQ ID NO: 6322153 - DNA, 12 bp, Homo sapiens
gtccatcttgtt

SEQ ID NO: 6322154 - DNA, 19 bp, Homo sapiens
gtccatcttgtttcatttg

SEQ ID NO: 6322155 - DNA, 16 bp, Homo sapiens
gtccatgatgtccttg

SEQ ID NO: 6322156 - DNA, 22 bp, Homo sapiens
gtccatgcagggggctcctggg

SEQ ID NO: 6322157 - DNA, 22 bp, Homo sapiens
gtccatgcatgacagcctctat

SEQ ID NO: 6322158 - DNA, 16 bp, Homo sapiens
gtccatgcccactgct

SEQ ID NO: 6322159 - DNA, 17 bp, Homo sapiens
gtccatgcccactgctg

SEQ ID NO: 6322160 - DNA, 15 bp, Homo sapiens
gtccatgcctacaga

SEQ ID NO: 6322161 - DNA, 18 bp, Homo sapiens
gtccatgcctacagataa

SEQ ID NO: 6322162 - DNA, 20 bp, Homo sapiens
gtccatgctccagggtcagg

SEQ ID NO: 6322163 - DNA, 14 bp, Homo sapiens
gtccatgcttctca

SEQ ID NO: 6322164 - DNA, 13 bp, Homo sapiens
gtccatggcacca

SEQ ID NO: 6322165 - DNA, 15 bp, Homo sapiens
gtccatggcaccagc

SEQ ID NO: 6322166 - DNA, 16 bp, Homo sapiens
gtccatggcaccagcc

SEQ ID NO: 6322167 - DNA, 21 bp, Homo sapiens
gtccatggcaccagccccctg

SEQ ID NO: 6322168 - DNA, 15 bp, Homo sapiens
gtccatggcctttct

SEQ ID NO: 6322169 - DNA, 19 bp, Homo sapiens
gtccatggcctttctaata

SEQ ID NO: 6322170 - DNA, 14 bp, Homo sapiens
gtccatgggcagag

SEQ ID NO: 6322171 - DNA, 17 bp, Homo sapiens
gtccatgggtctggcct

SEQ ID NO: 6322172 - DNA, 14 bp, Homo sapiens
gtccatggtgctaa

SEQ ID NO: 6322173 - DNA, 16 bp, Homo sapiens
gtccatgtaaatactt

SEQ ID NO: 6322174 - DNA, 23 bp, Homo sapiens
gtccatgtattcacacacccctc

SEQ ID NO: 6322175 - DNA, 19 bp, Homo sapiens
gtccatgtggttcttcaaa

SEQ ID NO: 6322176 - DNA, 14 bp, Homo sapiens
gtccatgtgtgtgc

SEQ ID NO: 6322177 - DNA, 16 bp, Homo sapiens
gtccattacttgccag

SEQ ID NO: 6322178 - DNA, 16 bp, Homo sapiens
gtccattatctgctgt

SEQ ID NO: 6322179 - DNA, 17 bp, Homo sapiens
gtccattatctgctgtt

SEQ ID NO: 6322180 - DNA, 17 bp, Homo sapiens
gtccattcactttcagg

SEQ ID NO: 6322181 - DNA, 15 bp, Homo sapiens
gtccattcagaaagc

SEQ ID NO: 6322182 - DNA, 13 bp, Homo sapiens
gtccattcagatg

SEQ ID NO: 6322183 - DNA, 16 bp, Homo sapiens
gtccattcatctcatg

SEQ ID NO: 6322184 - DNA, 13 bp, Homo sapiens
gtccattctcaag

SEQ ID NO: 6322185 - DNA, 14 bp, Homo sapiens
gtccattcttcagt

SEQ ID NO: 6322186 - DNA, 15 bp, Homo sapiens
gtccattgacatgta

SEQ ID NO: 6322187 - DNA, 17 bp, Homo sapiens
gtccattgacatgtaca

SEQ ID NO: 6322188 - DNA, 14 bp, Homo sapiens
gtccattgatgtca

SEQ ID NO: 6322189 - DNA, 13 bp, Homo sapiens
gtccattgcaaaa

SEQ ID NO: 6322190 - DNA, 16 bp, Homo sapiens
gtccattgcaaaaggt

SEQ ID NO: 6322191 - DNA, 19 bp, Homo sapiens
gtccattgcgttattttct

SEQ ID NO: 6322192 - DNA, 12 bp, Homo sapiens
gtccattgtaaa

SEQ ID NO: 6322193 - DNA, 21 bp, Homo sapiens
gtccattgtaaatctgaagaa

SEQ ID NO: 6322194 - DNA, 21 bp, Homo sapiens
gtccattgtccaatcctatgt

SEQ ID NO: 6322195 - DNA, 22 bp, Homo sapiens
gtccatttatatatgaaaacta

SEQ ID NO: 6322196 - DNA, 23 bp, Homo sapiens
gtccatttatatatgaaaactat

SEQ ID NO: 6322197 - DNA, 21 bp, Homo sapiens
gtccatttatccacaggaaag

SEQ ID NO: 6322198 - DNA, 19 bp, Homo sapiens
gtccatttcccacatcttt

SEQ ID NO: 6322199 - DNA, 13 bp, Homo sapiens
gtccatttcctaa

SEQ ID NO: 6322200 - DNA, 20 bp, Homo sapiens
gtccatttcttatttaatta

SEQ ID NO: 6322201 - DNA, 13 bp, Homo sapiens
gtccatttgtaaa

SEQ ID NO: 6322202 - DNA, 15 bp, Homo sapiens
gtccatttgtaaaac

SEQ ID NO: 6322203 - DNA, 16 bp, Homo sapiens
gtccattttgtgaagc

SEQ ID NO: 6322204 - DNA, 20 bp, Homo sapiens
gtccattttgtgaagccctg

SEQ ID NO: 6322205 - DNA, 19 bp, Homo sapiens
gtccatttttgagtaaaac

SEQ ID NO: 6322206 - DNA, 19 bp, Homo sapiens
gtcccaaacagctgcctct

SEQ ID NO: 6322207 - DNA, 13 bp, Homo sapiens
gtcccaaatccgc

SEQ ID NO: 6322208 - DNA, 21 bp, Homo sapiens
gtcccaaatgtagcaggtgta

SEQ ID NO: 6322209 - DNA, 21 bp, Homo sapiens
gtcccaacaggaggacaattc

SEQ ID NO: 6322210 - DNA, 15 bp, Homo sapiens
gtcccaacttgtaaa

SEQ ID NO: 6322211 - DNA, 13 bp, Homo sapiens
gtcccaagccggg

SEQ ID NO: 6322212 - DNA, 16 bp, Homo sapiens
gtcccaagctcccaag

SEQ ID NO: 6322213 - DNA, 15 bp, Homo sapiens
gtcccaagctgggcc

SEQ ID NO: 6322214 - DNA, 16 bp, Homo sapiens
gtcccaagctgggccc

SEQ ID NO: 6322215 - DNA, 23 bp, Homo sapiens
gtcccaagctgggccccagccca

SEQ ID NO: 6322216 - DNA, 21 bp, Homo sapiens
gtcccaagctttgaatacccc

SEQ ID NO: 6322217 - DNA, 16 bp, Homo sapiens
gtcccaaggaaagccc

SEQ ID NO: 6322218 - DNA, 20 bp, Homo sapiens
gtcccaaggaatcagcagga

SEQ ID NO: 6322219 - DNA, 14 bp, Homo sapiens
gtcccaaggagctg

SEQ ID NO: 6322220 - DNA, 22 bp, Homo sapiens
gtcccaaggcaaggggtgcctg

SEQ ID NO: 6322221 - DNA, 22 bp, Homo sapiens
gtcccaaggtgaaatgaagcaa

SEQ ID NO: 6322222 - DNA, 21 bp, Homo sapiens
gtcccaagtagtagtgtcttc

SEQ ID NO: 6322223 - DNA, 20 bp, Homo sapiens
gtcccaatagctctactgcc

SEQ ID NO: 6322224 - DNA, 17 bp, Homo sapiens
gtcccaattcggggcct

SEQ ID NO: 6322225 - DNA, 16 bp, Homo sapiens
gtcccacaaaatattt

SEQ ID NO: 6322226 - DNA, 19 bp, Homo sapiens
gtcccacaaaatatttcta

SEQ ID NO: 6322227 - DNA, 15 bp, Homo sapiens
gtcccacactttgaa

SEQ ID NO: 6322228 - DNA, 21 bp, Homo sapiens
gtcccacagccccttgcttct

SEQ ID NO: 6322229 - DNA, 14 bp, Homo sapiens
gtcccacagccctg

SEQ ID NO: 6322230 - DNA, 17 bp, Homo sapiens
gtcccacagccctgaga

SEQ ID NO: 6322231 - DNA, 11 bp, Homo sapiens
gtcccacagct

SEQ ID NO: 6322232 - DNA, 15 bp, Homo sapiens
gtcccacagcttggg

SEQ ID NO: 6322233 - DNA, 16 bp, Homo sapiens
gtcccacagggaccac

SEQ ID NO: 6322234 - DNA, 13 bp, Homo sapiens
gtcccacatccct

SEQ ID NO: 6322235 - DNA, 14 bp, Homo sapiens
gtcccacatccctg

SEQ ID NO: 6322236 - DNA, 17 bp, Homo sapiens
gtcccacatccctgggc

SEQ ID NO: 6322237 - DNA, 18 bp, Homo sapiens
gtcccacatccctgggcc

SEQ ID NO: 6322238 - DNA, 20 bp, Homo sapiens
gtcccacatccctgggcctg

SEQ ID NO: 6322239 - DNA, 21 bp, Homo sapiens
gtcccacatccctgggcctgc

SEQ ID NO: 6322240 - DNA, 22 bp, Homo sapiens
gtcccacatccctgggcctgct

SEQ ID NO: 6322241 - DNA, 23 bp, Homo sapiens
gtcccacatccctgggcctgctg

SEQ ID NO: 6322242 - DNA, 16 bp, Homo sapiens
gtcccaccaactctgc

SEQ ID NO: 6322243 - DNA, 20 bp, Homo sapiens
gtcccaccaactctgcactc

SEQ ID NO: 6322244 - DNA, 21 bp, Homo sapiens
gtcccaccacagtccctcacc

SEQ ID NO: 6322245 - DNA, 17 bp, Homo sapiens
gtcccacccacacagct

SEQ ID NO: 6322246 - DNA, 22 bp, Homo sapiens
gtcccacccacacagctgccct

SEQ ID NO: 6322247 - DNA, 12 bp, Homo sapiens
gtcccacccacc

SEQ ID NO: 6322248 - DNA, 14 bp, Homo sapiens
gtcccacccaggaa

SEQ ID NO: 6322249 - DNA, 13 bp, Homo sapiens
gtcccacccccaa

SEQ ID NO: 6322250 - DNA, 20 bp, Homo sapiens
gtcccacccccagcagctca

SEQ ID NO: 6322251 - DNA, 21 bp, Homo sapiens
gtcccacccccagcagctcac

SEQ ID NO: 6322252 - DNA, 18 bp, Homo sapiens
gtcccacccctagccacc

SEQ ID NO: 6322253 - DNA, 16 bp, Homo sapiens
gtcccacccggacagg

SEQ ID NO: 6322254 - DNA, 18 bp, Homo sapiens
gtcccaccctatggccac

SEQ ID NO: 6322255 - DNA, 19 bp, Homo sapiens
gtcccaccggttgcttctg

SEQ ID NO: 6322256 - DNA, 22 bp, Homo sapiens
gtcccaccggttgcttctggga

SEQ ID NO: 6322257 - DNA, 16 bp, Homo sapiens
gtcccacctccagccc

SEQ ID NO: 6322258 - DNA, 15 bp, Homo sapiens
gtcccacctggctcc

SEQ ID NO: 6322259 - DNA, 16 bp, Homo sapiens
gtcccacctggctccc

SEQ ID NO: 6322260 - DNA, 23 bp, Homo sapiens
gtcccaccttgaccaaaatcagc

SEQ ID NO: 6322261 - DNA, 15 bp, Homo sapiens
gtcccaccttggctg

SEQ ID NO: 6322262 - DNA, 22 bp, Homo sapiens
gtcccacgaatttgctggggaa

SEQ ID NO: 6322263 - DNA, 15 bp, Homo sapiens
gtcccacggctctgt

SEQ ID NO: 6322264 - DNA, 19 bp, Homo sapiens
gtcccacggctctgtgccc

SEQ ID NO: 6322265 - DNA, 20 bp, Homo sapiens
gtcccacggctctgtgcccg

SEQ ID NO: 6322266 - DNA, 17 bp, Homo sapiens
gtcccacgtctggccag

SEQ ID NO: 6322267 - DNA, 24 bp, Homo sapiens
gtcccactacttgtggggctaagg

SEQ ID NO: 6322268 - DNA, 21 bp, Homo sapiens
gtcccactcaagccaagcagc

SEQ ID NO: 6322269 - DNA, 22 bp, Homo sapiens
gtcccactgcacccccctgtgc

SEQ ID NO: 6322270 - DNA, 14 bp, Homo sapiens
gtcccactggctcc

SEQ ID NO: 6322271 - DNA, 12 bp, Homo sapiens
gtcccactgtgc

SEQ ID NO: 6322272 - DNA, 16 bp, Homo sapiens
gtcccacttcccctcc

SEQ ID NO: 6322273 - DNA, 18 bp, Homo sapiens
gtcccagacaaggagagc

SEQ ID NO: 6322274 - DNA, 22 bp, Homo sapiens
gtcccagactaaaggatccaga

SEQ ID NO: 6322275 - DNA, 13 bp, Homo sapiens
gtcccagagcccg

SEQ ID NO: 6322276 - DNA, 21 bp, Homo sapiens
gtcccagagcttattggccac

SEQ ID NO: 6322277 - DNA, 23 bp, Homo sapiens
gtcccagaggccgctgcccctga

SEQ ID NO: 6322278 - DNA, 17 bp, Homo sapiens
gtcccagatacttgggg

SEQ ID NO: 6322279 - DNA, 15 bp, Homo sapiens
gtcccagatgctgtc

SEQ ID NO: 6322280 - DNA, 16 bp, Homo sapiens
gtcccagcacctggca

SEQ ID NO: 6322281 - DNA, 14 bp, Homo sapiens
gtcccagcagccag

SEQ ID NO: 6322282 - DNA, 14 bp, Homo sapiens
gtcccagcagctgc

SEQ ID NO: 6322283 - DNA, 22 bp, Homo sapiens
gtcccagcatccctggagcagg

SEQ ID NO: 6322284 - DNA, 16 bp, Homo sapiens
gtcccagccaccccgg

SEQ ID NO: 6322285 - DNA, 17 bp, Homo sapiens
gtcccagccccaggcct

SEQ ID NO: 6322286 - DNA, 18 bp, Homo sapiens
gtcccagccccaggcctg

SEQ ID NO: 6322287 - DNA, 22 bp, Homo sapiens
gtcccagccccggcaagccaca

SEQ ID NO: 6322288 - DNA, 18 bp, Homo sapiens
gtcccagcccctcctccc

SEQ ID NO: 6322289 - DNA, 16 bp, Homo sapiens
gtcccagcctggggct

SEQ ID NO: 6322290 - DNA, 20 bp, Homo sapiens
gtcccagcctggggctccct

SEQ ID NO: 6322291 - DNA, 13 bp, Homo sapiens
gtcccagcctggt

SEQ ID NO: 6322292 - DNA, 19 bp, Homo sapiens
gtcccagcggcctcagggt

SEQ ID NO: 6322293 - DNA, 14 bp, Homo sapiens
gtcccagctactcg

SEQ ID NO: 6322294 - DNA, 22 bp, Homo sapiens
gtcccagctacttgggagcctg

SEQ ID NO: 6322295 - DNA, 15 bp, Homo sapiens
gtcccagctccctgg

SEQ ID NO: 6322296 - DNA, 16 bp, Homo sapiens
gtcccagctgaaggca

SEQ ID NO: 6322297 - DNA, 15 bp, Homo sapiens
gtcccaggaagccgg

SEQ ID NO: 6322298 - DNA, 23 bp, Homo sapiens
gtcccaggaagccggtgcctggg

SEQ ID NO: 6322299 - DNA, 19 bp, Homo sapiens
gtcccaggaagtccagctc

SEQ ID NO: 6322300 - DNA, 20 bp, Homo sapiens
gtcccaggacctgagcctgg

SEQ ID NO: 6322301 - DNA, 21 bp, Homo sapiens
gtcccaggagcaaatgctgga

SEQ ID NO: 6322302 - DNA, 10 bp, Homo sapiens
gtcccaggca

SEQ ID NO: 6322303 - DNA, 12 bp, Homo sapiens
gtcccaggcagc

SEQ ID NO: 6322304 - DNA, 17 bp, Homo sapiens
ggcagtgcaatgcttgt

SEQ ID NO: 6322305 - DNA, 15 bp, Homo sapiens
ggcagtgcaccccct

SEQ ID NO: 6322306 - DNA, 22 bp, Homo sapiens
ggcagtgcagcaaccagagcac

SEQ ID NO: 6322307 - DNA, 13 bp, Homo sapiens
ggcagtgcagtgc

SEQ ID NO: 6322308 - DNA, 16 bp, Homo sapiens
ggcagtgcatgcatgt

SEQ ID NO: 6322309 - DNA, 19 bp, Homo sapiens
ggcagtgccacccgcagat

SEQ ID NO: 6322310 - DNA, 13 bp, Homo sapiens
ggcagtgccagcc

SEQ ID NO: 6322311 - DNA, 14 bp, Homo sapiens
ggcagtgccagcca

SEQ ID NO: 6322312 - DNA, 14 bp, Homo sapiens
ggcagtgccagggc

SEQ ID NO: 6322313 - DNA, 20 bp, Homo sapiens
ggcagtgcccatgtgtacat

SEQ ID NO: 6322314 - DNA, 13 bp, Homo sapiens
ggcagtgccccag

SEQ ID NO: 6322315 - DNA, 17 bp, Homo sapiens
ggcagtgccccagggag

SEQ ID NO: 6322316 - DNA, 13 bp, Homo sapiens
ggcagtgcccttt

SEQ ID NO: 6322317 - DNA, 12 bp, Homo sapiens
ggcagtgcctcc

SEQ ID NO: 6322318 - DNA, 14 bp, Homo sapiens
ggcagtgcctcctg

SEQ ID NO: 6322319 - DNA, 17 bp, Homo sapiens
ggcagtgcctcctggga

SEQ ID NO: 6322320 - DNA, 24 bp, Homo sapiens
ggcagtgctagtgagctgggcatg

SEQ ID NO: 6322321 - DNA, 22 bp, Homo sapiens
ggcagtgctgatccggctgctc

SEQ ID NO: 6322322 - DNA, 15 bp, Homo sapiens
ggcagtgctggttct

SEQ ID NO: 6322323 - DNA, 22 bp, Homo sapiens
ggcagtggaaaaatcagaagca

SEQ ID NO: 6322324 - DNA, 11 bp, Homo sapiens
ggcagtggaga

SEQ ID NO: 6322325 - DNA, 13 bp, Homo sapiens
ggcagtggagagg

SEQ ID NO: 6322326 - DNA, 20 bp, Homo sapiens
ggcagtggaggctgctgtga

SEQ ID NO: 6322327 - DNA, 13 bp, Homo sapiens
ggcagtggccaag

SEQ ID NO: 6322328 - DNA, 19 bp, Homo sapiens
ggcagtggccaagcctgct

SEQ ID NO: 6322329 - DNA, 20 bp, Homo sapiens
ggcagtggccaagcctgctg

SEQ ID NO: 6322330 - DNA, 13 bp, Homo sapiens
ggcagtggccagg

SEQ ID NO: 6322331 - DNA, 15 bp, Homo sapiens
ggcagtggccaggca

SEQ ID NO: 6322332 - DNA, 16 bp, Homo sapiens
ggcagtggcccaggga

SEQ ID NO: 6322333 - DNA, 13 bp, Homo sapiens
ggcagtggctgtg

SEQ ID NO: 6322334 - DNA, 15 bp, Homo sapiens
ggcagtggctgtgaa

SEQ ID NO: 6322335 - DNA, 18 bp, Homo sapiens
ggcagtgggagctgcctg

SEQ ID NO: 6322336 - DNA, 16 bp, Homo sapiens
ggcagtgggcctgctg

SEQ ID NO: 6322337 - DNA, 19 bp, Homo sapiens
ggcagtgggcctgctgagg

SEQ ID NO: 6322338 - DNA, 21 bp, Homo sapiens
ggcagtggggctggaagcaga

SEQ ID NO: 6322339 - DNA, 18 bp, Homo sapiens
ggcagtggggctgggggt

SEQ ID NO: 6322340 - DNA, 14 bp, Homo sapiens
ggcagtgtggcctc

SEQ ID NO: 6322341 - DNA, 15 bp, Homo sapiens
ggcagtgtggtggga

SEQ ID NO: 6322342 - DNA, 16 bp, Homo sapiens
ggcagtgtttaaaatg

SEQ ID NO: 6322343 - DNA, 15 bp, Homo sapiens
ggcagtgtttgtata

SEQ ID NO: 6322344 - DNA, 15 bp, Homo sapiens
ggcagtgttttgaga

SEQ ID NO: 6322345 - DNA, 13 bp, Homo sapiens
ggcagtgttttgg

SEQ ID NO: 6322346 - DNA, 11 bp, Homo sapiens
ggcagttacat

SEQ ID NO: 6322347 - DNA, 24 bp, Homo sapiens
ggcagttaccattaaaccatctcc

SEQ ID NO: 6322348 - DNA, 23 bp, Homo sapiens
ggcagttagagcagcctcgtgga

SEQ ID NO: 6322349 - DNA, 16 bp, Homo sapiens
ggcagttatattttgc

SEQ ID NO: 6322350 - DNA, 12 bp, Homo sapiens
ggcagttcctgg

SEQ ID NO: 6322351 - DNA, 15 bp, Homo sapiens
ggcagttcgcagcca

SEQ ID NO: 6322352 - DNA, 14 bp, Homo sapiens
ggcagttctagaag

SEQ ID NO: 6322353 - DNA, 18 bp, Homo sapiens
ggcagttctcactcctag

SEQ ID NO: 6322354 - DNA, 14 bp, Homo sapiens
ggcagttctcccag

SEQ ID NO: 6322355 - DNA, 16 bp, Homo sapiens
ggcagttctcccaggg

SEQ ID NO: 6322356 - DNA, 19 bp, Homo sapiens
ggcagttctcccagggagt

SEQ ID NO: 6322357 - DNA, 17 bp, Homo sapiens
ggcagttgaacagaggg

SEQ ID NO: 6322358 - DNA, 13 bp, Homo sapiens
ggcagttgcatta

SEQ ID NO: 6322359 - DNA, 19 bp, Homo sapiens
ggcagttggccaaaactta

SEQ ID NO: 6322360 - DNA, 17 bp, Homo sapiens
ggcagttggccaggctc

SEQ ID NO: 6322361 - DNA, 14 bp, Homo sapiens
ggcagttgggagtg

SEQ ID NO: 6322362 - DNA, 24 bp, Homo sapiens
ggcagttggggcggcccacgccag

SEQ ID NO: 6322363 - DNA, 23 bp, Homo sapiens
ggcagtttcagagatggacagag

SEQ ID NO: 6322364 - DNA, 16 bp, Homo sapiens
ggcagttttagcagca

SEQ ID NO: 6322365 - DNA, 23 bp, Homo sapiens
ggcagttttgacatcagccagct

SEQ ID NO: 6322366 - DNA, 10 bp, Homo sapiens
ggcagttttt

SEQ ID NO: 6322367 - DNA, 14 bp, Homo sapiens
ggcagtttttgttc

SEQ ID NO: 6322368 - DNA, 13 bp, Homo sapiens
ggcataaaacagc

SEQ ID NO: 6322369 - DNA, 16 bp, Homo sapiens
ggcataaaacagcttt

SEQ ID NO: 6322370 - DNA, 13 bp, Homo sapiens
ggcataaattaca

SEQ ID NO: 6322371 - DNA, 13 bp, Homo sapiens
ggcatacaaaata

SEQ ID NO: 6322372 - DNA, 17 bp, Homo sapiens
ggcatactatgtggatg

SEQ ID NO: 6322373 - DNA, 15 bp, Homo sapiens
ggcatactctccagg

SEQ ID NO: 6322374 - DNA, 16 bp, Homo sapiens
ggcatactctccagga

SEQ ID NO: 6322375 - DNA, 16 bp, Homo sapiens
ggcatactttttaaaa

SEQ ID NO: 6322376 - DNA, 21 bp, Homo sapiens
ggcatagaaactgaggagtag

SEQ ID NO: 6322377 - DNA, 16 bp, Homo sapiens
ggcatagaggcttctc

SEQ ID NO: 6322378 - DNA, 13 bp, Homo sapiens
ggcatagagtagg

SEQ ID NO: 6322379 - DNA, 14 bp, Homo sapiens
ggcatagagtgacc

SEQ ID NO: 6322380 - DNA, 22 bp, Homo sapiens
ggcatagcacccgtggtgcatg

SEQ ID NO: 6322381 - DNA, 19 bp, Homo sapiens
ggcatagcccagacacaga

SEQ ID NO: 6322382 - DNA, 21 bp, Homo sapiens
ggcatagcccagacacagaag

SEQ ID NO: 6322383 - DNA, 13 bp, Homo sapiens
ggcatagctctgg

SEQ ID NO: 6322384 - DNA, 15 bp, Homo sapiens
ggcataggcctgggt

SEQ ID NO: 6322385 - DNA, 15 bp, Homo sapiens
ggcatagtccccaga

SEQ ID NO: 6322386 - DNA, 18 bp, Homo sapiens
ggcatagtccccagagct

SEQ ID NO: 6322387 - DNA, 19 bp, Homo sapiens
ggcatagtccccagagctc

SEQ ID NO: 6322388 - DNA, 19 bp, Homo sapiens
ggcatatacagtgaagagt

SEQ ID NO: 6322389 - DNA, 23 bp, Homo sapiens
ggcatatcttctatatctgaaga

SEQ ID NO: 6322390 - DNA, 16 bp, Homo sapiens
ggcatattattttctg

SEQ ID NO: 6322391 - DNA, 18 bp, Homo sapiens
ggcatcaaagatgagaag

SEQ ID NO: 6322392 - DNA, 13 bp, Homo sapiens
ggcatcaaccacc

SEQ ID NO: 6322393 - DNA, 17 bp, Homo sapiens
ggcatcaaccccccgac

SEQ ID NO: 6322394 - DNA, 20 bp, Homo sapiens
ggcatcaagggagacaccag

SEQ ID NO: 6322395 - DNA, 20 bp, Homo sapiens
ggcatcacagaccccagctg

SEQ ID NO: 6322396 - DNA, 14 bp, Homo sapiens
ggcatcacagggca

SEQ ID NO: 6322397 - DNA, 20 bp, Homo sapiens
ggcatcaccttaggcaggga

SEQ ID NO: 6322398 - DNA, 16 bp, Homo sapiens
ggcatcagcagcaggg

SEQ ID NO: 6322399 - DNA, 13 bp, Homo sapiens
ggcatcagctggc

SEQ ID NO: 6322400 - DNA, 16 bp, Homo sapiens
ggcatcagctggcgtc

SEQ ID NO: 6322401 - DNA, 19 bp, Homo sapiens
ggcatcagctttccctggc

SEQ ID NO: 6322402 - DNA, 21 bp, Homo sapiens
ggcatcagctttccctggctc

SEQ ID NO: 6322403 - DNA, 15 bp, Homo sapiens
ggcatcaggcactgg

SEQ ID NO: 6322404 - DNA, 20 bp, Homo sapiens
ggcatcaggcactggtggca

SEQ ID NO: 6322405 - DNA, 20 bp, Homo sapiens
ggcatcagtccccctgtgca

SEQ ID NO: 6322406 - DNA, 18 bp, Homo sapiens
ggcatcagtccctatgta

SEQ ID NO: 6322407 - DNA, 20 bp, Homo sapiens
ggcatcagtgtccttggcag

SEQ ID NO: 6322408 - DNA, 19 bp, Homo sapiens
ggcatcagtttaggccttg

SEQ ID NO: 6322409 - DNA, 19 bp, Homo sapiens
ggcatcatccattctctct

SEQ ID NO: 6322410 - DNA, 20 bp, Homo sapiens
ggcatcatccattctctctg

SEQ ID NO: 6322411 - DNA, 15 bp, Homo sapiens
ggcatcatgggcaac

SEQ ID NO: 6322412 - DNA, 18 bp, Homo sapiens
ggcatcatttcccctccc

SEQ ID NO: 6322413 - DNA, 20 bp, Homo sapiens
ggcatccaaaggctcctgag

SEQ ID NO: 6322414 - DNA, 15 bp, Homo sapiens
ggcatccacccagtg

SEQ ID NO: 6322415 - DNA, 23 bp, Homo sapiens
ggcatccacccagtgctgccatg

SEQ ID NO: 6322416 - DNA, 16 bp, Homo sapiens
ggcatccaccttcctg

SEQ ID NO: 6322417 - DNA, 21 bp, Homo sapiens
ggcatccacgtagggggcagg

SEQ ID NO: 6322418 - DNA, 15 bp, Homo sapiens
ggcatccaggccagg

SEQ ID NO: 6322419 - DNA, 21 bp, Homo sapiens
ggcatccaggccagggctcct

SEQ ID NO: 6322420 - DNA, 17 bp, Homo sapiens
ggcatccagggctgcca

SEQ ID NO: 6322421 - DNA, 15 bp, Homo sapiens
ggcatcccagcctgg

SEQ ID NO: 6322422 - DNA, 16 bp, Homo sapiens
ggcatcccagcctggg

SEQ ID NO: 6322423 - DNA, 12 bp, Homo sapiens
ggcatcccagct

SEQ ID NO: 6322424 - DNA, 19 bp, Homo sapiens
ggcatcccagcttgccccc

SEQ ID NO: 6322425 - DNA, 21 bp, Homo sapiens
ggcatcccagtggcctcaacc

SEQ ID NO: 6322426 - DNA, 15 bp, Homo sapiens
ggcatcccatccctt

SEQ ID NO: 6322427 - DNA, 16 bp, Homo sapiens
ggcatccccagccccc

SEQ ID NO: 6322428 - DNA, 14 bp, Homo sapiens
ggcatccctgcaga

SEQ ID NO: 6322429 - DNA, 13 bp, Homo sapiens
ggcatccctgggc

SEQ ID NO: 6322430 - DNA, 18 bp, Homo sapiens
ggcatccgaaggtgtctc

SEQ ID NO: 6322431 - DNA, 17 bp, Homo sapiens
ggcatccgcagcccagg

SEQ ID NO: 6322432 - DNA, 20 bp, Homo sapiens
ggcatcctcaggtggtcagg

SEQ ID NO: 6322433 - DNA, 14 bp, Homo sapiens
ggcatcctctgact

SEQ ID NO: 6322434 - DNA, 19 bp, Homo sapiens
ggcatcctgaaagccagca

SEQ ID NO: 6322435 - DNA, 13 bp, Homo sapiens
ggcatcctgcccc

SEQ ID NO: 6322436 - DNA, 17 bp, Homo sapiens
ggcatcctgcctgggtg

SEQ ID NO: 6322437 - DNA, 13 bp, Homo sapiens
ggcatcctgcttc

SEQ ID NO: 6322438 - DNA, 15 bp, Homo sapiens
ggcatcctgcttcct

SEQ ID NO: 6322439 - DNA, 17 bp, Homo sapiens
ggcatcctgcttcctga

SEQ ID NO: 6322440 - DNA, 14 bp, Homo sapiens
ggcatcctggctgg

SEQ ID NO: 6322441 - DNA, 18 bp, Homo sapiens
ggcatcctggctggctgt

SEQ ID NO: 6322442 - DNA, 18 bp, Homo sapiens
ggcatccttgaggacctc

SEQ ID NO: 6322443 - DNA, 19 bp, Homo sapiens
ggcatccttgaggacctcc

SEQ ID NO: 6322444 - DNA, 23 bp, Homo sapiens
ggcatccttgcctgtctaaagcc

SEQ ID NO: 6322445 - DNA, 20 bp, Homo sapiens
ggcatcgcaatgtaagactc

SEQ ID NO: 6322446 - DNA, 21 bp, Homo sapiens
ggcatcgcaccattctgactc

SEQ ID NO: 6322447 - DNA, 17 bp, Homo sapiens
ggcatcgcatccgtcct

SEQ ID NO: 6322448 - DNA, 18 bp, Homo sapiens
ggcatcgcatccgtcctg

SEQ ID NO: 6322449 - DNA, 21 bp, Homo sapiens
ggcatcgcatccgtcctgggc

SEQ ID NO: 6322450 - DNA, 14 bp, Homo sapiens
ggcatcggcagctg

SEQ ID NO: 6322451 - DNA, 23 bp, Homo sapiens
ggcatcggggagccgggagcctg

SEQ ID NO: 6322452 - DNA, 22 bp, Homo sapiens
ggcatcggtcagcggggcagcg

SEQ ID NO: 6322453 - DNA, 16 bp, Homo sapiens
ggcatcgtagaagaga

SEQ ID NO: 6322454 - DNA, 21 bp, Homo sapiens
ggcatctacacagcctggact

SEQ ID NO: 6322455 - DNA, 21 bp, Homo sapiens
ggcatctagagcttgatgcca

SEQ ID NO: 6322456 - DNA, 15 bp, Homo sapiens
ggcatctatctgtgc

SEQ ID NO: 6322457 - DNA, 17 bp, Homo sapiens
ggcatctcaatggcatg

SEQ ID NO: 6322458 - DNA, 12 bp, Homo sapiens
ggcatctccagg

SEQ ID NO: 6322459 - DNA, 13 bp, Homo sapiens
ggcatctccagga

SEQ ID NO: 6322460 - DNA, 23 bp, Homo sapiens
ggcatctccctgaccttctccag

SEQ ID NO: 6322461 - DNA, 12 bp, Homo sapiens
ggcatctcctct

SEQ ID NO: 6322462 - DNA, 19 bp, Homo sapiens
ggcatctctgagtgtctct

SEQ ID NO: 6322463 - DNA, 20 bp, Homo sapiens
ggcatctctgagtgtctctg

SEQ ID NO: 6322464 - DNA, 22 bp, Homo sapiens
ggcatctctggagtgtgtgggg

SEQ ID NO: 6322465 - DNA, 12 bp, Homo sapiens
ggcatctctggg

SEQ ID NO: 6322466 - DNA, 14 bp, Homo sapiens
ggcatctctgggct

SEQ ID NO: 6322467 - DNA, 14 bp, Homo sapiens
ggcatctctgtccc

SEQ ID NO: 6322468 - DNA, 21 bp, Homo sapiens
ggcatctctgtcccattccct

SEQ ID NO: 6322469 - DNA, 14 bp, Homo sapiens
ggcatctcttcccc

SEQ ID NO: 6322470 - DNA, 19 bp, Homo sapiens
ggcatctcttccccagaga

SEQ ID NO: 6322471 - DNA, 16 bp, Homo sapiens
ggcatctgaaaacaat

SEQ ID NO: 6322472 - DNA, 15 bp, Homo sapiens
ggcatctgacacaaa

SEQ ID NO: 6322473 - DNA, 22 bp, Homo sapiens
ggcatctgcaccctcgatgaag

SEQ ID NO: 6322474 - DNA, 13 bp, Homo sapiens
ggcatctgcatgg

SEQ ID NO: 6322475 - DNA, 14 bp, Homo sapiens
ggcatctgcccctc

SEQ ID NO: 6322476 - DNA, 16 bp, Homo sapiens
ggcatctggcctggcc

SEQ ID NO: 6322477 - DNA, 13 bp, Homo sapiens
ggcatctggcctt

SEQ ID NO: 6322478 - DNA, 21 bp, Homo sapiens
ggcatctgtctgtctgtgggc

SEQ ID NO: 6322479 - DNA, 22 bp, Homo sapiens
ggcatctgttagcagagtctgt

SEQ ID NO: 6322480 - DNA, 15 bp, Homo sapiens
ggcatcttgctggct

SEQ ID NO: 6322481 - DNA, 16 bp, Homo sapiens
ggcatcttgctggcta

SEQ ID NO: 6322482 - DNA, 21 bp, Homo sapiens
ggcatctttctgaatttcatt

SEQ ID NO: 6322483 - DNA, 17 bp, Homo sapiens
ggcatctttgccttggg

SEQ ID NO: 6322484 - DNA, 22 bp, Homo sapiens
ggcatctttgccttgggctgct

SEQ ID NO: 6322485 - DNA, 16 bp, Homo sapiens
gtcccaggcagcgcca

SEQ ID NO: 6322486 - DNA, 19 bp, Homo sapiens
gtcccaggcagcgccactg

SEQ ID NO: 6322487 - DNA, 22 bp, Homo sapiens
gtcccaggcagcgccactgtcc

SEQ ID NO: 6322488 - DNA, 23 bp, Homo sapiens
gtcccaggcatgcagctgcctgg

SEQ ID NO: 6322489 - DNA, 18 bp, Homo sapiens
gtcccaggctgagcctca

SEQ ID NO: 6322490 - DNA, 21 bp, Homo sapiens
gtcccaggctgagcctcagtc

SEQ ID NO: 6322491 - DNA, 12 bp, Homo sapiens
gtcccagggaag

SEQ ID NO: 6322492 - DNA, 15 bp, Homo sapiens
gtcccagggccctcc

SEQ ID NO: 6322493 - DNA, 21 bp, Homo sapiens
gtcccagggccctcccagccc

SEQ ID NO: 6322494 - DNA, 22 bp, Homo sapiens
gtcccagggctctgcaggccac

SEQ ID NO: 6322495 - DNA, 12 bp, Homo sapiens
gtcccagggctg

SEQ ID NO: 6322496 - DNA, 13 bp, Homo sapiens
gtcccagggctgc

SEQ ID NO: 6322497 - DNA, 14 bp, Homo sapiens
gtcccagggctgca

SEQ ID NO: 6322498 - DNA, 13 bp, Homo sapiens
gtcccagggctgg

SEQ ID NO: 6322499 - DNA, 20 bp, Homo sapiens
gtcccagggctggccctagg

SEQ ID NO: 6322500 - DNA, 22 bp, Homo sapiens
gtcccagggctggccctaggca

SEQ ID NO: 6322501 - DNA, 14 bp, Homo sapiens
gtcccaggggcagc

SEQ ID NO: 6322502 - DNA, 18 bp, Homo sapiens
gtcccaggggcagccaca

SEQ ID NO: 6322503 - DNA, 22 bp, Homo sapiens
gtcccaggggtctccctgagcc

SEQ ID NO: 6322504 - DNA, 17 bp, Homo sapiens
gtcccaggttatctggg

SEQ ID NO: 6322505 - DNA, 16 bp, Homo sapiens
gtcccaggttggctct

SEQ ID NO: 6322506 - DNA, 21 bp, Homo sapiens
gtcccaggttggctctgccag

SEQ ID NO: 6322507 - DNA, 19 bp, Homo sapiens
gtcccagtattctcagagc

SEQ ID NO: 6322508 - DNA, 16 bp, Homo sapiens
gtcccagtcagaaata

SEQ ID NO: 6322509 - DNA, 17 bp, Homo sapiens
gtcccagtcccagcctc

SEQ ID NO: 6322510 - DNA, 14 bp, Homo sapiens
gtcccagtccggtg

SEQ ID NO: 6322511 - DNA, 22 bp, Homo sapiens
gtcccagtccggtgccttccac

SEQ ID NO: 6322512 - DNA, 16 bp, Homo sapiens
gtcccagtgaactcgg

SEQ ID NO: 6322513 - DNA, 23 bp, Homo sapiens
gtcccagtgctcaccagccctgc

SEQ ID NO: 6322514 - DNA, 11 bp, Homo sapiens
gtcccagtggg

SEQ ID NO: 6322515 - DNA, 14 bp, Homo sapiens
gtcccagtgggagg

SEQ ID NO: 6322516 - DNA, 21 bp, Homo sapiens
gtcccagtgggaggggcaggc

SEQ ID NO: 6322517 - DNA, 23 bp, Homo sapiens
gtcccagtgggaggggcaggctg

SEQ ID NO: 6322518 - DNA, 19 bp, Homo sapiens
gtcccagtgtcagtattta

SEQ ID NO: 6322519 - DNA, 19 bp, Homo sapiens
gtcccagtttcccactctg

SEQ ID NO: 6322520 - DNA, 18 bp, Homo sapiens
gtcccataggcccagtga

SEQ ID NO: 6322521 - DNA, 22 bp, Homo sapiens
gtcccataggtcttgtgaaaag

SEQ ID NO: 6322522 - DNA, 16 bp, Homo sapiens
gtcccatatcctgcct

SEQ ID NO: 6322523 - DNA, 18 bp, Homo sapiens
gtcccatatcctgcctca

SEQ ID NO: 6322524 - DNA, 14 bp, Homo sapiens
gtcccatccaggca

SEQ ID NO: 6322525 - DNA, 22 bp, Homo sapiens
gtcccatccccaggtccccaaa

SEQ ID NO: 6322526 - DNA, 15 bp, Homo sapiens
gtcccatccctgcgt

SEQ ID NO: 6322527 - DNA, 23 bp, Homo sapiens
gtcccatcctctaaagcagaggc

SEQ ID NO: 6322528 - DNA, 17 bp, Homo sapiens
gtcccatctgccctccc

SEQ ID NO: 6322529 - DNA, 15 bp, Homo sapiens
gtcccatcttcactc

SEQ ID NO: 6322530 - DNA, 23 bp, Homo sapiens
gtcccatcttcactcttcacttg

SEQ ID NO: 6322531 - DNA, 16 bp, Homo sapiens
gtcccatgacccaccc

SEQ ID NO: 6322532 - DNA, 18 bp, Homo sapiens
gtcccatgacccacccct

SEQ ID NO: 6322533 - DNA, 20 bp, Homo sapiens
gtcccatgacccacccctgt

SEQ ID NO: 6322534 - DNA, 23 bp, Homo sapiens
gtcccatgacccacccctgtgct

SEQ ID NO: 6322535 - DNA, 14 bp, Homo sapiens
gtcccatgctccac

SEQ ID NO: 6322536 - DNA, 15 bp, Homo sapiens
gtcccatgctccacc

SEQ ID NO: 6322537 - DNA, 21 bp, Homo sapiens
gtcccatgctggctgaagagg

SEQ ID NO: 6322538 - DNA, 13 bp, Homo sapiens
gtcccatggcctg

SEQ ID NO: 6322539 - DNA, 16 bp, Homo sapiens
gtcccatggctgaagc

SEQ ID NO: 6322540 - DNA, 18 bp, Homo sapiens
gtcccatggctgaagctg

SEQ ID NO: 6322541 - DNA, 23 bp, Homo sapiens
gtcccatggggaaaccctggagc

SEQ ID NO: 6322542 - DNA, 18 bp, Homo sapiens
gtcccatgtgagctgctg

SEQ ID NO: 6322543 - DNA, 16 bp, Homo sapiens
gtcccatgtgcatgga

SEQ ID NO: 6322544 - DNA, 13 bp, Homo sapiens
gtcccatgtggtg

SEQ ID NO: 6322545 - DNA, 16 bp, Homo sapiens
gtcccattcagtggca

SEQ ID NO: 6322546 - DNA, 17 bp, Homo sapiens
gtcccattcagtggcaa

SEQ ID NO: 6322547 - DNA, 20 bp, Homo sapiens
gtcccattcatattaagaca

SEQ ID NO: 6322548 - DNA, 19 bp, Homo sapiens
gtcccattcccccagtgcg

SEQ ID NO: 6322549 - DNA, 16 bp, Homo sapiens
gtcccattccctggga

SEQ ID NO: 6322550 - DNA, 14 bp, Homo sapiens
gtcccattctagat

SEQ ID NO: 6322551 - DNA, 21 bp, Homo sapiens
gtcccattgttggcgctgagg

SEQ ID NO: 6322552 - DNA, 13 bp, Homo sapiens
gtcccatttcctt

SEQ ID NO: 6322553 - DNA, 20 bp, Homo sapiens
gtcccatttccttggaggcc

SEQ ID NO: 6322554 - DNA, 19 bp, Homo sapiens
gtcccattttccccttcct

SEQ ID NO: 6322555 - DNA, 16 bp, Homo sapiens
gtccccaaaacactgt

SEQ ID NO: 6322556 - DNA, 12 bp, Homo sapiens
gtccccaaactt

SEQ ID NO: 6322557 - DNA, 21 bp, Homo sapiens
gtccccaaagtaccacactga

SEQ ID NO: 6322558 - DNA, 15 bp, Homo sapiens
gtccccaacagcgcc

SEQ ID NO: 6322559 - DNA, 22 bp, Homo sapiens
gtccccaacccgtgcccctggg

SEQ ID NO: 6322560 - DNA, 22 bp, Homo sapiens
gtccccaagacacttccccttg

SEQ ID NO: 6322561 - DNA, 21 bp, Homo sapiens
gtccccaagattcacacctga

SEQ ID NO: 6322562 - DNA, 13 bp, Homo sapiens
gtccccaaggcct

SEQ ID NO: 6322563 - DNA, 15 bp, Homo sapiens
gtccccaaggcctct

SEQ ID NO: 6322564 - DNA, 16 bp, Homo sapiens
gtccccaaggcctctc

SEQ ID NO: 6322565 - DNA, 19 bp, Homo sapiens
gtccccaaggcctctctct

SEQ ID NO: 6322566 - DNA, 20 bp, Homo sapiens
gtccccaaggcctctctctg

SEQ ID NO: 6322567 - DNA, 22 bp, Homo sapiens
gtccccaatgctgtacctggct

SEQ ID NO: 6322568 - DNA, 11 bp, Homo sapiens
gtccccacact

SEQ ID NO: 6322569 - DNA, 24 bp, Homo sapiens
gtccccacagactgccccagccaa

SEQ ID NO: 6322570 - DNA, 15 bp, Homo sapiens
gtccccaccatctgc

SEQ ID NO: 6322571 - DNA, 17 bp, Homo sapiens
gtccccaccatctgctg

SEQ ID NO: 6322572 - DNA, 15 bp, Homo sapiens
gtccccacccatgcg

SEQ ID NO: 6322573 - DNA, 16 bp, Homo sapiens
gtccccaccctccact

SEQ ID NO: 6322574 - DNA, 18 bp, Homo sapiens
gtccccaccgcagacagg

SEQ ID NO: 6322575 - DNA, 23 bp, Homo sapiens
gtccccacgaggggacccatggg

SEQ ID NO: 6322576 - DNA, 14 bp, Homo sapiens
gtccccactcaccc

SEQ ID NO: 6322577 - DNA, 15 bp, Homo sapiens
gtccccactccctgt

SEQ ID NO: 6322578 - DNA, 19 bp, Homo sapiens
gtccccactgctgagctgg

SEQ ID NO: 6322579 - DNA, 20 bp, Homo sapiens
gtccccactgctgagctggc

SEQ ID NO: 6322580 - DNA, 23 bp, Homo sapiens
gtccccagaactctgcctgccct

SEQ ID NO: 6322581 - DNA, 17 bp, Homo sapiens
gtccccagaccaaccct

SEQ ID NO: 6322582 - DNA, 13 bp, Homo sapiens
gtccccagaccct

SEQ ID NO: 6322583 - DNA, 21 bp, Homo sapiens
gtccccagactcagctggaag

SEQ ID NO: 6322584 - DNA, 18 bp, Homo sapiens
gtccccagagaccaggct

SEQ ID NO: 6322585 - DNA, 13 bp, Homo sapiens
gtccccagagctc

SEQ ID NO: 6322586 - DNA, 16 bp, Homo sapiens
gtccccagagctcccc

SEQ ID NO: 6322587 - DNA, 12 bp, Homo sapiens
gtccccagcaga

SEQ ID NO: 6322588 - DNA, 14 bp, Homo sapiens
gtccccagcagaat

SEQ ID NO: 6322589 - DNA, 12 bp, Homo sapiens
gtccccagcccc

SEQ ID NO: 6322590 - DNA, 13 bp, Homo sapiens
gtccccagccctg

SEQ ID NO: 6322591 - DNA, 19 bp, Homo sapiens
gtccccagccctgggcttg

SEQ ID NO: 6322592 - DNA, 13 bp, Homo sapiens
gtccccagccctt

SEQ ID NO: 6322593 - DNA, 22 bp, Homo sapiens
gtccccagcccttcctctgctc

SEQ ID NO: 6322594 - DNA, 20 bp, Homo sapiens
gtccccagcccttctgcctt

SEQ ID NO: 6322595 - DNA, 11 bp, Homo sapiens
gtccccagcta

SEQ ID NO: 6322596 - DNA, 17 bp, Homo sapiens
gtccccagctagcgtct

SEQ ID NO: 6322597 - DNA, 16 bp, Homo sapiens
gtccccagctccccag

SEQ ID NO: 6322598 - DNA, 16 bp, Homo sapiens
gtccccagctgagtga

SEQ ID NO: 6322599 - DNA, 22 bp, Homo sapiens
gtccccagctgagtgagtggga

SEQ ID NO: 6322600 - DNA, 13 bp, Homo sapiens
gtccccagctggt

SEQ ID NO: 6322601 - DNA, 13 bp, Homo sapiens
gtccccaggccca

SEQ ID NO: 6322602 - DNA, 14 bp, Homo sapiens
gtccccaggcccag

SEQ ID NO: 6322603 - DNA, 12 bp, Homo sapiens
gtccccaggcct

SEQ ID NO: 6322604 - DNA, 17 bp, Homo sapiens
gtccccaggcctggctc

SEQ ID NO: 6322605 - DNA, 16 bp, Homo sapiens
gtccccagggcccctc

SEQ ID NO: 6322606 - DNA, 11 bp, Homo sapiens
gtccccagggt

SEQ ID NO: 6322607 - DNA, 19 bp, Homo sapiens
gtccccaggtcctgtctct

SEQ ID NO: 6322608 - DNA, 18 bp, Homo sapiens
gtccccagtccccagccc

SEQ ID NO: 6322609 - DNA, 19 bp, Homo sapiens
gtccccagtgtggactctg

SEQ ID NO: 6322610 - DNA, 23 bp, Homo sapiens
gtccccagtgtggactctggact

SEQ ID NO: 6322611 - DNA, 19 bp, Homo sapiens
gtccccagtttgcagaaaa

SEQ ID NO: 6322612 - DNA, 16 bp, Homo sapiens
gtccccatactcctat

SEQ ID NO: 6322613 - DNA, 17 bp, Homo sapiens
gtccccatactcctatg

SEQ ID NO: 6322614 - DNA, 20 bp, Homo sapiens
gtccccatccagcgagagag

SEQ ID NO: 6322615 - DNA, 19 bp, Homo sapiens
gtccccatctaggtcctgg

SEQ ID NO: 6322616 - DNA, 12 bp, Homo sapiens
gtccccatctgt

SEQ ID NO: 6322617 - DNA, 19 bp, Homo sapiens
gtccccatgattccctcct

SEQ ID NO: 6322618 - DNA, 16 bp, Homo sapiens
gtcccccacccacctc

SEQ ID NO: 6322619 - DNA, 13 bp, Homo sapiens
gtcccccacgtgg

SEQ ID NO: 6322620 - DNA, 22 bp, Homo sapiens
gtcccccacgtggactctgtgc

SEQ ID NO: 6322621 - DNA, 12 bp, Homo sapiens
gtcccccactct

SEQ ID NO: 6322622 - DNA, 13 bp, Homo sapiens
gtcccccactctc

SEQ ID NO: 6322623 - DNA, 17 bp, Homo sapiens
gtcccccactctctcac

SEQ ID NO: 6322624 - DNA, 20 bp, Homo sapiens
gtcccccactctctcaccca

SEQ ID NO: 6322625 - DNA, 22 bp, Homo sapiens
gtcccccactctctcacccacc

SEQ ID NO: 6322626 - DNA, 12 bp, Homo sapiens
gtcccccagagc

SEQ ID NO: 6322627 - DNA, 17 bp, Homo sapiens
gtcccccagagcatctg

SEQ ID NO: 6322628 - DNA, 22 bp, Homo sapiens
gtcccccagcagaaccagcctc

SEQ ID NO: 6322629 - DNA, 12 bp, Homo sapiens
gtcccccagccc

SEQ ID NO: 6322630 - DNA, 20 bp, Homo sapiens
gtcccccagccccatgctcc

SEQ ID NO: 6322631 - DNA, 13 bp, Homo sapiens
gtcccccagccct

SEQ ID NO: 6322632 - DNA, 15 bp, Homo sapiens
gtcccccagccctca

SEQ ID NO: 6322633 - DNA, 16 bp, Homo sapiens
gtcccccagccctcag

SEQ ID NO: 6322634 - DNA, 14 bp, Homo sapiens
gtcccccagctctg

SEQ ID NO: 6322635 - DNA, 19 bp, Homo sapiens
gtcccccatgccaccaccc

SEQ ID NO: 6322636 - DNA, 19 bp, Homo sapiens
gtccccccacccctcccca

SEQ ID NO: 6322637 - DNA, 19 bp, Homo sapiens
gtccccccaccgctcagtg

SEQ ID NO: 6322638 - DNA, 22 bp, Homo sapiens
gtccccccaccgctcagtgtca

SEQ ID NO: 6322639 - DNA, 16 bp, Homo sapiens
gtccccccaggtgctg

SEQ ID NO: 6322640 - DNA, 14 bp, Homo sapiens
gtccccccatcccg

SEQ ID NO: 6322641 - DNA, 23 bp, Homo sapiens
gtccccccatcccgtttccctcc

SEQ ID NO: 6322642 - DNA, 13 bp, Homo sapiens
gtccccccccagg

SEQ ID NO: 6322643 - DNA, 15 bp, Homo sapiens
gtccccccccaggcc

SEQ ID NO: 6322644 - DNA, 17 bp, Homo sapiens
gtccccccccaggccct

SEQ ID NO: 6322645 - DNA, 15 bp, Homo sapiens
gtcccccctcactcc

SEQ ID NO: 6322646 - DNA, 13 bp, Homo sapiens
gtcccccctccct

SEQ ID NO: 6322647 - DNA, 15 bp, Homo sapiens
gtcccccctgagtgg

SEQ ID NO: 6322648 - DNA, 19 bp, Homo sapiens
gtcccccctgagtgggctg

SEQ ID NO: 6322649 - DNA, 15 bp, Homo sapiens
gtcccccctgtggtc

SEQ ID NO: 6322650 - DNA, 17 bp, Homo sapiens
gtcccccctgtggtctg

SEQ ID NO: 6322651 - DNA, 13 bp, Homo sapiens
gtccccccttgaa

SEQ ID NO: 6322652 - DNA, 20 bp, Homo sapiens
gtcccccgaccaatccccag

SEQ ID NO: 6322653 - DNA, 17 bp, Homo sapiens
gtcccccgactgcctgt

SEQ ID NO: 6322654 - DNA, 22 bp, Homo sapiens
gtcccccgactgcctgtctcca

SEQ ID NO: 6322655 - DNA, 16 bp, Homo sapiens
gtccccctacccaccg

SEQ ID NO: 6322656 - DNA, 13 bp, Homo sapiens
gtccccctagaga

SEQ ID NO: 6322657 - DNA, 18 bp, Homo sapiens
gtccccctatccttggca

SEQ ID NO: 6322658 - DNA, 13 bp, Homo sapiens
gtccccctcagca

SEQ ID NO: 6322659 - DNA, 23 bp, Homo sapiens
gtccccctcccctcccagtcctc

SEQ ID NO: 6322660 - DNA, 15 bp, Homo sapiens
gtccccctccctgcc

SEQ ID NO: 6322661 - DNA, 23 bp, Homo sapiens
gtccccctccctgcccaaactcc

SEQ ID NO: 6322662 - DNA, 20 bp, Homo sapiens
gtccccctcctcagccagcc

SEQ ID NO: 6322663 - DNA, 21 bp, Homo sapiens
gtccccctcctcagccagcct

SEQ ID NO: 6322664 - DNA, 20 bp, Homo sapiens
ggcatctttgctatggggac

SEQ ID NO: 6322665 - DNA, 22 bp, Homo sapiens
ggcatcttttctagagacacat

SEQ ID NO: 6322666 - DNA, 11 bp, Homo sapiens
ggcatcttttg

SEQ ID NO: 6322667 - DNA, 18 bp, Homo sapiens
ggcatcttttggaggaaa

SEQ ID NO: 6322668 - DNA, 14 bp, Homo sapiens
ggcatcttttgtat

SEQ ID NO: 6322669 - DNA, 21 bp, Homo sapiens
ggcatcttttgtattaagaaa

SEQ ID NO: 6322670 - DNA, 19 bp, Homo sapiens
ggcatgaaatgaacacaaa

SEQ ID NO: 6322671 - DNA, 17 bp, Homo sapiens
ggcatgacacacctggg

SEQ ID NO: 6322672 - DNA, 18 bp, Homo sapiens
ggcatgacacgaatattg

SEQ ID NO: 6322673 - DNA, 17 bp, Homo sapiens
ggcatgaccatcctgtc

SEQ ID NO: 6322674 - DNA, 23 bp, Homo sapiens
ggcatgacccagtgaagatgcag

SEQ ID NO: 6322675 - DNA, 12 bp, Homo sapiens
ggcatgactgtc

SEQ ID NO: 6322676 - DNA, 13 bp, Homo sapiens
ggcatgagccact

SEQ ID NO: 6322677 - DNA, 23 bp, Homo sapiens
ggcatgagccactgagcctggcc

SEQ ID NO: 6322678 - DNA, 21 bp, Homo sapiens
ggcatgagccactgcacctga

SEQ ID NO: 6322679 - DNA, 13 bp, Homo sapiens
ggcatgagctctt

SEQ ID NO: 6322680 - DNA, 13 bp, Homo sapiens
ggcatgaggcccc

SEQ ID NO: 6322681 - DNA, 14 bp, Homo sapiens
ggcatgaggccccg

SEQ ID NO: 6322682 - DNA, 16 bp, Homo sapiens
ggcatgagggctgaga

SEQ ID NO: 6322683 - DNA, 20 bp, Homo sapiens
ggcatgagggctgagatgcg

SEQ ID NO: 6322684 - DNA, 20 bp, Homo sapiens
ggcatgaggggttcctcccc

SEQ ID NO: 6322685 - DNA, 14 bp, Homo sapiens
ggcatgagtctgtt

SEQ ID NO: 6322686 - DNA, 19 bp, Homo sapiens
ggcatgagtctgtttccca

SEQ ID NO: 6322687 - DNA, 12 bp, Homo sapiens
ggcatgatttat

SEQ ID NO: 6322688 - DNA, 21 bp, Homo sapiens
ggcatgcacacggctggtcac

SEQ ID NO: 6322689 - DNA, 22 bp, Homo sapiens
ggcatgcacatctggaattaag

SEQ ID NO: 6322690 - DNA, 14 bp, Homo sapiens
ggcatgcacctgca

SEQ ID NO: 6322691 - DNA, 14 bp, Homo sapiens
ggcatgcagctgcc

SEQ ID NO: 6322692 - DNA, 17 bp, Homo sapiens
ggcatgcagctgcctgg

SEQ ID NO: 6322693 - DNA, 14 bp, Homo sapiens
ggcatgccaccctc

SEQ ID NO: 6322694 - DNA, 14 bp, Homo sapiens
ggcatgccaggacc

SEQ ID NO: 6322695 - DNA, 23 bp, Homo sapiens
ggcatgccaggacccgccagccc

SEQ ID NO: 6322696 - DNA, 15 bp, Homo sapiens
ggcatgccccggcca

SEQ ID NO: 6322697 - DNA, 21 bp, Homo sapiens
ggcatgccccggccacctctg

SEQ ID NO: 6322698 - DNA, 22 bp, Homo sapiens
ggcatgccccggccacctctgc

SEQ ID NO: 6322699 - DNA, 19 bp, Homo sapiens
ggcatgccgagtgccccag

SEQ ID NO: 6322700 - DNA, 13 bp, Homo sapiens
ggcatgcctggcc

SEQ ID NO: 6322701 - DNA, 14 bp, Homo sapiens
ggcatgcctggcct

SEQ ID NO: 6322702 - DNA, 16 bp, Homo sapiens
ggcatgcctgggaatc

SEQ ID NO: 6322703 - DNA, 13 bp, Homo sapiens
ggcatgcctgtgt

SEQ ID NO: 6322704 - DNA, 14 bp, Homo sapiens
ggcatgccttgtgc

SEQ ID NO: 6322705 - DNA, 16 bp, Homo sapiens
ggcatgcgaatgagct

SEQ ID NO: 6322706 - DNA, 13 bp, Homo sapiens
ggcatgctggcct

SEQ ID NO: 6322707 - DNA, 17 bp, Homo sapiens
ggcatgctggcctgtgg

SEQ ID NO: 6322708 - DNA, 12 bp, Homo sapiens
ggcatgctgggg

SEQ ID NO: 6322709 - DNA, 16 bp, Homo sapiens
ggcatggaaagatggg

SEQ ID NO: 6322710 - DNA, 22 bp, Homo sapiens
ggcatggacagggccagggttg

SEQ ID NO: 6322711 - DNA, 15 bp, Homo sapiens
ggcatggacttctgg

SEQ ID NO: 6322712 - DNA, 13 bp, Homo sapiens
ggcatggagactc

SEQ ID NO: 6322713 - DNA, 18 bp, Homo sapiens
ggcatggagactctgaga

SEQ ID NO: 6322714 - DNA, 21 bp, Homo sapiens
ggcatggcaaatcaggggcca

SEQ ID NO: 6322715 - DNA, 20 bp, Homo sapiens
ggcatggcaattctggaagc

SEQ ID NO: 6322716 - DNA, 14 bp, Homo sapiens
ggcatggcaggagt

SEQ ID NO: 6322717 - DNA, 17 bp, Homo sapiens
ggcatggccaggtggcc

SEQ ID NO: 6322718 - DNA, 17 bp, Homo sapiens
ggcatggcccagcctgg

SEQ ID NO: 6322719 - DNA, 21 bp, Homo sapiens
ggcatggcccagcctggagcc

SEQ ID NO: 6322720 - DNA, 22 bp, Homo sapiens
ggcatggcccagcctggagccg

SEQ ID NO: 6322721 - DNA, 21 bp, Homo sapiens
ggcatgggaaagccacctctc

SEQ ID NO: 6322722 - DNA, 18 bp, Homo sapiens
ggcatgggcctctctggg

SEQ ID NO: 6322723 - DNA, 16 bp, Homo sapiens
ggcatgggcgcaggcc

SEQ ID NO: 6322724 - DNA, 17 bp, Homo sapiens
ggcatggggcatgtcct

SEQ ID NO: 6322725 - DNA, 15 bp, Homo sapiens
ggcatgggggaggct

SEQ ID NO: 6322726 - DNA, 18 bp, Homo sapiens
ggcatgggggaggctctg

SEQ ID NO: 6322727 - DNA, 19 bp, Homo sapiens
ggcatgggggaggctctga

SEQ ID NO: 6322728 - DNA, 14 bp, Homo sapiens
ggcatgggggccca

SEQ ID NO: 6322729 - DNA, 18 bp, Homo sapiens
ggcatggtaccagccctg

SEQ ID NO: 6322730 - DNA, 20 bp, Homo sapiens
ggcatggtaccagccctggg

SEQ ID NO: 6322731 - DNA, 19 bp, Homo sapiens
ggcatggtatttgagacat

SEQ ID NO: 6322732 - DNA, 13 bp, Homo sapiens
ggcatggtcctgt

SEQ ID NO: 6322733 - DNA, 17 bp, Homo sapiens
ggcatggtgcagggaga

SEQ ID NO: 6322734 - DNA, 14 bp, Homo sapiens
ggcatggtggcatg

SEQ ID NO: 6322735 - DNA, 22 bp, Homo sapiens
ggcatggtggcgcaagcctgta

SEQ ID NO: 6322736 - DNA, 19 bp, Homo sapiens
ggcatggtggctcccgcct

SEQ ID NO: 6322737 - DNA, 22 bp, Homo sapiens
ggcatggttccttccctgggaa

SEQ ID NO: 6322738 - DNA, 21 bp, Homo sapiens
ggcatgtaaatgtaaactcag

SEQ ID NO: 6322739 - DNA, 20 bp, Homo sapiens
ggcatgtattagccagtcat

SEQ ID NO: 6322740 - DNA, 17 bp, Homo sapiens
ggcatgtattggcctgg

SEQ ID NO: 6322741 - DNA, 15 bp, Homo sapiens
ggcatgtcagaggac

SEQ ID NO: 6322742 - DNA, 21 bp, Homo sapiens
ggcatgtcagaggaccccagg

SEQ ID NO: 6322743 - DNA, 13 bp, Homo sapiens
ggcatgtcatttg

SEQ ID NO: 6322744 - DNA, 20 bp, Homo sapiens
ggcatgtcccacccacccgc

SEQ ID NO: 6322745 - DNA, 23 bp, Homo sapiens
ggcatgtgaattctgtgaagaat

SEQ ID NO: 6322746 - DNA, 12 bp, Homo sapiens
ggcatgtgccac

SEQ ID NO: 6322747 - DNA, 21 bp, Homo sapiens
ggcatgtgcctatagtcccag

SEQ ID NO: 6322748 - DNA, 12 bp, Homo sapiens
ggcatgtgcctg

SEQ ID NO: 6322749 - DNA, 13 bp, Homo sapiens
ggcatgtgctggt

SEQ ID NO: 6322750 - DNA, 12 bp, Homo sapiens
ggcatgtggaga

SEQ ID NO: 6322751 - DNA, 14 bp, Homo sapiens
ggcatgtggagaca

SEQ ID NO: 6322752 - DNA, 15 bp, Homo sapiens
ggcatgtggcctgtg

SEQ ID NO: 6322753 - DNA, 18 bp, Homo sapiens
ggcatgtgggttgtgata

SEQ ID NO: 6322754 - DNA, 17 bp, Homo sapiens
ggcatgtgtgcctgtgg

SEQ ID NO: 6322755 - DNA, 21 bp, Homo sapiens
ggcatgtgtgcctgtggcaga

SEQ ID NO: 6322756 - DNA, 23 bp, Homo sapiens
ggcatgtgtttactttatgttac

SEQ ID NO: 6322757 - DNA, 16 bp, Homo sapiens
ggcatgttcagggatg

SEQ ID NO: 6322758 - DNA, 16 bp, Homo sapiens
ggcattaaatgcaaaa

SEQ ID NO: 6322759 - DNA, 18 bp, Homo sapiens
ggcattaacaataaagca

SEQ ID NO: 6322760 - DNA, 16 bp, Homo sapiens
ggcattaatgtttcta

SEQ ID NO: 6322761 - DNA, 20 bp, Homo sapiens
ggcattaccctctgcagaac

SEQ ID NO: 6322762 - DNA, 16 bp, Homo sapiens
ggcattactctgcact

SEQ ID NO: 6322763 - DNA, 22 bp, Homo sapiens
ggcattagcaaggcagagcctt

SEQ ID NO: 6322764 - DNA, 18 bp, Homo sapiens
ggcattagtttcaggcaa

SEQ ID NO: 6322765 - DNA, 14 bp, Homo sapiens
ggcattatgtaaca

SEQ ID NO: 6322766 - DNA, 19 bp, Homo sapiens
ggcattattaggtcttaaa

SEQ ID NO: 6322767 - DNA, 18 bp, Homo sapiens
ggcattatttaatgtttg

SEQ ID NO: 6322768 - DNA, 22 bp, Homo sapiens
ggcattcaaccacgcaggaagc

SEQ ID NO: 6322769 - DNA, 16 bp, Homo sapiens
ggcattcacacacagc

SEQ ID NO: 6322770 - DNA, 18 bp, Homo sapiens
ggcattcacacacagcct

SEQ ID NO: 6322771 - DNA, 19 bp, Homo sapiens
ggcattcacacacagcctg

SEQ ID NO: 6322772 - DNA, 23 bp, Homo sapiens
ggcattcacacacagcctggcct

SEQ ID NO: 6322773 - DNA, 19 bp, Homo sapiens
ggcattccacacctaagaa

SEQ ID NO: 6322774 - DNA, 13 bp, Homo sapiens
ggcattccacagg

SEQ ID NO: 6322775 - DNA, 13 bp, Homo sapiens
ggcattcccagag

SEQ ID NO: 6322776 - DNA, 18 bp, Homo sapiens
ggcattcccagaggtggg

SEQ ID NO: 6322777 - DNA, 22 bp, Homo sapiens
ggcattcccagaggtggggaag

SEQ ID NO: 6322778 - DNA, 15 bp, Homo sapiens
ggcattccccaggag

SEQ ID NO: 6322779 - DNA, 12 bp, Homo sapiens
ggcattccttct

SEQ ID NO: 6322780 - DNA, 17 bp, Homo sapiens
ggcattcgggccacagg

SEQ ID NO: 6322781 - DNA, 18 bp, Homo sapiens
ggcattcgggccacaggg

SEQ ID NO: 6322782 - DNA, 19 bp, Homo sapiens
ggcattcgggccacagggc

SEQ ID NO: 6322783 - DNA, 15 bp, Homo sapiens
ggcattctacacctg

SEQ ID NO: 6322784 - DNA, 19 bp, Homo sapiens
ggcattctctctgctcagt

SEQ ID NO: 6322785 - DNA, 20 bp, Homo sapiens
ggcattctggacctctgggt

SEQ ID NO: 6322786 - DNA, 20 bp, Homo sapiens
ggcattctttgcaatactgc

SEQ ID NO: 6322787 - DNA, 17 bp, Homo sapiens
ggcattgacaaatctgt

SEQ ID NO: 6322788 - DNA, 20 bp, Homo sapiens
ggcattgacaaatctgtgta

SEQ ID NO: 6322789 - DNA, 16 bp, Homo sapiens
ggcattgaccttcatg

SEQ ID NO: 6322790 - DNA, 14 bp, Homo sapiens
ggcattgagggctc

SEQ ID NO: 6322791 - DNA, 23 bp, Homo sapiens
ggcattgatggggaaggaggctg

SEQ ID NO: 6322792 - DNA, 15 bp, Homo sapiens
ggcattgccaagccc

SEQ ID NO: 6322793 - DNA, 19 bp, Homo sapiens
ggcattgcctcggctggct

SEQ ID NO: 6322794 - DNA, 20 bp, Homo sapiens
ggcattgcctgtgactgagg

SEQ ID NO: 6322795 - DNA, 16 bp, Homo sapiens
ggcattgctcagcccg

SEQ ID NO: 6322796 - DNA, 12 bp, Homo sapiens
ggcattgctttc

SEQ ID NO: 6322797 - DNA, 19 bp, Homo sapiens
ggcattggcagcaggtgct

SEQ ID NO: 6322798 - DNA, 14 bp, Homo sapiens
ggcattgggctgac

SEQ ID NO: 6322799 - DNA, 15 bp, Homo sapiens
ggcattgggctgaca

SEQ ID NO: 6322800 - DNA, 17 bp, Homo sapiens
ggcattgggctgacacc

SEQ ID NO: 6322801 - DNA, 16 bp, Homo sapiens
ggcattgtatctgtct

SEQ ID NO: 6322802 - DNA, 19 bp, Homo sapiens
ggcattgtatctgtctttc

SEQ ID NO: 6322803 - DNA, 12 bp, Homo sapiens
ggcattgtggga

SEQ ID NO: 6322804 - DNA, 15 bp, Homo sapiens
ggcattgttagttta

SEQ ID NO: 6322805 - DNA, 17 bp, Homo sapiens
ggcatttaacttacatt

SEQ ID NO: 6322806 - DNA, 15 bp, Homo sapiens
ggcatttaaggagca

SEQ ID NO: 6322807 - DNA, 15 bp, Homo sapiens
ggcatttatattcca

SEQ ID NO: 6322808 - DNA, 21 bp, Homo sapiens
ggcatttcaattcctggccct

SEQ ID NO: 6322809 - DNA, 18 bp, Homo sapiens
ggcatttcacgaactgtt

SEQ ID NO: 6322810 - DNA, 16 bp, Homo sapiens
ggcatttcctgctgaa

SEQ ID NO: 6322811 - DNA, 18 bp, Homo sapiens
ggcatttcctgggtggct

SEQ ID NO: 6322812 - DNA, 15 bp, Homo sapiens
ggcatttgcaataaa

SEQ ID NO: 6322813 - DNA, 18 bp, Homo sapiens
ggcatttgctaaggcagc

SEQ ID NO: 6322814 - DNA, 21 bp, Homo sapiens
ggcatttgctgaataacaaca

SEQ ID NO: 6322815 - DNA, 20 bp, Homo sapiens
ggcatttgctgatttctagt

SEQ ID NO: 6322816 - DNA, 19 bp, Homo sapiens
ggcatttgctggcctggca

SEQ ID NO: 6322817 - DNA, 21 bp, Homo sapiens
ggcatttgctggcctggcagg

SEQ ID NO: 6322818 - DNA, 14 bp, Homo sapiens
ggcatttggcttcc

SEQ ID NO: 6322819 - DNA, 16 bp, Homo sapiens
ggcatttggcttcctc

SEQ ID NO: 6322820 - DNA, 18 bp, Homo sapiens
ggcatttggcttcctctg

SEQ ID NO: 6322821 - DNA, 19 bp, Homo sapiens
ggcatttggcttcctctgc

SEQ ID NO: 6322822 - DNA, 20 bp, Homo sapiens
ggcatttggtctcaggcagc

SEQ ID NO: 6322823 - DNA, 22 bp, Homo sapiens
ggcatttggtgagagtcaaagc

SEQ ID NO: 6322824 - DNA, 11 bp, Homo sapiens
ggcatttgtaa

SEQ ID NO: 6322825 - DNA, 18 bp, Homo sapiens
ggcatttgttccacagga

SEQ ID NO: 6322826 - DNA, 21 bp, Homo sapiens
ggcattttaatctaagtggtt

SEQ ID NO: 6322827 - DNA, 19 bp, Homo sapiens
ggcattttacaagaagtac

SEQ ID NO: 6322828 - DNA, 15 bp, Homo sapiens
ggcattttcctcctc

SEQ ID NO: 6322829 - DNA, 20 bp, Homo sapiens
ggcattttcctcctctgcct

SEQ ID NO: 6322830 - DNA, 14 bp, Homo sapiens
ggcattttctgttc

SEQ ID NO: 6322831 - DNA, 20 bp, Homo sapiens
ggcattttgaatgtgatcat

SEQ ID NO: 6322832 - DNA, 15 bp, Homo sapiens
ggcattttgagaatg

SEQ ID NO: 6322833 - DNA, 21 bp, Homo sapiens
ggcatttttaccatcactgag

SEQ ID NO: 6322834 - DNA, 14 bp, Homo sapiens
ggcatttttttaaa

SEQ ID NO: 6322835 - DNA, 19 bp, Homo sapiens
ggccaaaaccaatgctgat

SEQ ID NO: 6322836 - DNA, 17 bp, Homo sapiens
ggccaaaagctagacag

SEQ ID NO: 6322837 - DNA, 17 bp, Homo sapiens
ggccaaaagggcagcca

SEQ ID NO: 6322838 - DNA, 19 bp, Homo sapiens
ggccaaaagggcagccagg

SEQ ID NO: 6322839 - DNA, 22 bp, Homo sapiens
ggccaaaagggcagccaggggc

SEQ ID NO: 6322840 - DNA, 19 bp, Homo sapiens
ggccaaaataccaaatgcc

SEQ ID NO: 6322841 - DNA, 23 bp, Homo sapiens
ggccaaaataccaaatgcctgtt

SEQ ID NO: 6322842 - DNA, 16 bp, Homo sapiens
ggccaaaatcaagagt

SEQ ID NO: 6322843 - DNA, 22 bp, Homo sapiens
gtccccctcctcccagggcctc

SEQ ID NO: 6322844 - DNA, 15 bp, Homo sapiens
gtccccctcctgcac

SEQ ID NO: 6322845 - DNA, 12 bp, Homo sapiens
gtccccctctgg

SEQ ID NO: 6322846 - DNA, 13 bp, Homo sapiens
gtccccctctgtc

SEQ ID NO: 6322847 - DNA, 22 bp, Homo sapiens
gtccccctggggcttctcctga

SEQ ID NO: 6322848 - DNA, 16 bp, Homo sapiens
gtcccccttccatgga

SEQ ID NO: 6322849 - DNA, 19 bp, Homo sapiens
gtccccgagtgcctaggtt

SEQ ID NO: 6322850 - DNA, 13 bp, Homo sapiens
gtccccgcagccc

SEQ ID NO: 6322851 - DNA, 14 bp, Homo sapiens
gtccccgccctctc

SEQ ID NO: 6322852 - DNA, 14 bp, Homo sapiens
gtccccgccttccc

SEQ ID NO: 6322853 - DNA, 18 bp, Homo sapiens
gtccccggacgctggctc

SEQ ID NO: 6322854 - DNA, 18 bp, Homo sapiens
gtccccggcccctgcccc

SEQ ID NO: 6322855 - DNA, 22 bp, Homo sapiens
gtccccggcggggtgcctgctg

SEQ ID NO: 6322856 - DNA, 16 bp, Homo sapiens
gtccccgggaaaggcc

SEQ ID NO: 6322857 - DNA, 22 bp, Homo sapiens
gtccccggttgctggtcaggtc

SEQ ID NO: 6322858 - DNA, 19 bp, Homo sapiens
gtccccgtgtgccccaaga

SEQ ID NO: 6322859 - DNA, 20 bp, Homo sapiens
gtccccgtgtgccccaagag

SEQ ID NO: 6322860 - DNA, 15 bp, Homo sapiens
gtcccctaaggaaat

SEQ ID NO: 6322861 - DNA, 21 bp, Homo sapiens
gtcccctagggactgtcctag

SEQ ID NO: 6322862 - DNA, 16 bp, Homo sapiens
gtcccctatcctcccc

SEQ ID NO: 6322863 - DNA, 13 bp, Homo sapiens
gtcccctcaagcc

SEQ ID NO: 6322864 - DNA, 15 bp, Homo sapiens
gtcccctcaagcccc

SEQ ID NO: 6322865 - DNA, 18 bp, Homo sapiens
gtcccctcaagccccttc

SEQ ID NO: 6322866 - DNA, 22 bp, Homo sapiens
gtcccctcaagccccttctctc

SEQ ID NO: 6322867 - DNA, 13 bp, Homo sapiens
gtcccctcacaga

SEQ ID NO: 6322868 - DNA, 12 bp, Homo sapiens
gtcccctcacct

SEQ ID NO: 6322869 - DNA, 15 bp, Homo sapiens
gtcccctcacctcca

SEQ ID NO: 6322870 - DNA, 23 bp, Homo sapiens
gtcccctcactctgtcagccagc

SEQ ID NO: 6322871 - DNA, 14 bp, Homo sapiens
gtcccctcagctcc

SEQ ID NO: 6322872 - DNA, 18 bp, Homo sapiens
gtcccctcagctccagac

SEQ ID NO: 6322873 - DNA, 16 bp, Homo sapiens
gtcccctccatctggg

SEQ ID NO: 6322874 - DNA, 17 bp, Homo sapiens
gtcccctcccatctggg

SEQ ID NO: 6322875 - DNA, 12 bp, Homo sapiens
gtcccctcccca

SEQ ID NO: 6322876 - DNA, 13 bp, Homo sapiens
gtcccctccccca

SEQ ID NO: 6322877 - DNA, 22 bp, Homo sapiens
gtcccctcccccacccctgctg

SEQ ID NO: 6322878 - DNA, 14 bp, Homo sapiens
gtcccctccctcgt

SEQ ID NO: 6322879 - DNA, 17 bp, Homo sapiens
gtcccctccttcccaag

SEQ ID NO: 6322880 - DNA, 15 bp, Homo sapiens
gtcccctccttccct

SEQ ID NO: 6322881 - DNA, 13 bp, Homo sapiens
gtcccctctcccc

SEQ ID NO: 6322882 - DNA, 22 bp, Homo sapiens
gtcccctctcccctcatggaga

SEQ ID NO: 6322883 - DNA, 20 bp, Homo sapiens
gtcccctctgtgcttcgact

SEQ ID NO: 6322884 - DNA, 13 bp, Homo sapiens
gtcccctcttgcc

SEQ ID NO: 6322885 - DNA, 17 bp, Homo sapiens
gtcccctgagttggagc

SEQ ID NO: 6322886 - DNA, 12 bp, Homo sapiens
gtcccctgcagc

SEQ ID NO: 6322887 - DNA, 18 bp, Homo sapiens
gtcccctgcagcctgggt

SEQ ID NO: 6322888 - DNA, 20 bp, Homo sapiens
gtcccctgcagcctgggtct

SEQ ID NO: 6322889 - DNA, 21 bp, Homo sapiens
gtcccctgcagcctgggtctg

SEQ ID NO: 6322890 - DNA, 13 bp, Homo sapiens
gtcccctgccacc

SEQ ID NO: 6322891 - DNA, 24 bp, Homo sapiens
gtcccctgccaccgactgcccagc

SEQ ID NO: 6322892 - DNA, 16 bp, Homo sapiens
gtcccctgccctgagg

SEQ ID NO: 6322893 - DNA, 12 bp, Homo sapiens
gtcccctgcctc

SEQ ID NO: 6322894 - DNA, 12 bp, Homo sapiens
gtcccctgcggg

SEQ ID NO: 6322895 - DNA, 20 bp, Homo sapiens
gtcccctgcgggcgcgggca

SEQ ID NO: 6322896 - DNA, 22 bp, Homo sapiens
gtcccctggcccttccttcacc

SEQ ID NO: 6322897 - DNA, 14 bp, Homo sapiens
gtcccctgggccac

SEQ ID NO: 6322898 - DNA, 19 bp, Homo sapiens
gtcccctgggccacccttc

SEQ ID NO: 6322899 - DNA, 13 bp, Homo sapiens
gtcccctggggct

SEQ ID NO: 6322900 - DNA, 20 bp, Homo sapiens
gtcccctgtcccaccaactc

SEQ ID NO: 6322901 - DNA, 19 bp, Homo sapiens
gtcccctgtggtgatgtgc

SEQ ID NO: 6322902 - DNA, 12 bp, Homo sapiens
gtcccctgttga

SEQ ID NO: 6322903 - DNA, 18 bp, Homo sapiens
gtcccctgtttgtttctg

SEQ ID NO: 6322904 - DNA, 22 bp, Homo sapiens
gtcccctgtttgtttctgaaag

SEQ ID NO: 6322905 - DNA, 13 bp, Homo sapiens
gtccccttccatc

SEQ ID NO: 6322906 - DNA, 15 bp, Homo sapiens
gtccccttcccaggg

SEQ ID NO: 6322907 - DNA, 12 bp, Homo sapiens
gtccccttcccc

SEQ ID NO: 6322908 - DNA, 23 bp, Homo sapiens
gtcccctttcatcggtgcctggt

SEQ ID NO: 6322909 - DNA, 14 bp, Homo sapiens
gtcccctttcctct

SEQ ID NO: 6322910 - DNA, 22 bp, Homo sapiens
gtcccctttgtattccttaaat

SEQ ID NO: 6322911 - DNA, 22 bp, Homo sapiens
gtccccttttcttttctaccct

SEQ ID NO: 6322912 - DNA, 21 bp, Homo sapiens
gtcccgagccctcacaccctg

SEQ ID NO: 6322913 - DNA, 23 bp, Homo sapiens
gtcccgagcttagattctgtatg

SEQ ID NO: 6322914 - DNA, 17 bp, Homo sapiens
gtcccgaggaagggcca

SEQ ID NO: 6322915 - DNA, 24 bp, Homo sapiens
gtcccgaggaagggccagagcctg

SEQ ID NO: 6322916 - DNA, 19 bp, Homo sapiens
gtcccgagggcgcctgggt

SEQ ID NO: 6322917 - DNA, 20 bp, Homo sapiens
gtcccgagggcgcctgggtc

SEQ ID NO: 6322918 - DNA, 15 bp, Homo sapiens
gtcccgatgcctccc

SEQ ID NO: 6322919 - DNA, 16 bp, Homo sapiens
gtcccgattgtaactc

SEQ ID NO: 6322920 - DNA, 17 bp, Homo sapiens
gtcccgcactctgcccc

SEQ ID NO: 6322921 - DNA, 21 bp, Homo sapiens
gtcccgccttcctcctccaca

SEQ ID NO: 6322922 - DNA, 15 bp, Homo sapiens
gtcccgcggtgctga

SEQ ID NO: 6322923 - DNA, 18 bp, Homo sapiens
gtcccgcggtgctgactg

SEQ ID NO: 6322924 - DNA, 17 bp, Homo sapiens
gtcccgctgcctcctgc

SEQ ID NO: 6322925 - DNA, 12 bp, Homo sapiens
gtcccgctgctg

SEQ ID NO: 6322926 - DNA, 22 bp, Homo sapiens
gtcccgcttagttcttgaattg

SEQ ID NO: 6322927 - DNA, 15 bp, Homo sapiens
gtcccggccgcgccg

SEQ ID NO: 6322928 - DNA, 21 bp, Homo sapiens
gtcccggcgtttacctcgtgg

SEQ ID NO: 6322929 - DNA, 14 bp, Homo sapiens
gtcccggctctgtg

SEQ ID NO: 6322930 - DNA, 16 bp, Homo sapiens
gtcccggctctgtggg

SEQ ID NO: 6322931 - DNA, 22 bp, Homo sapiens
gtcccgggacacctaggctagg

SEQ ID NO: 6322932 - DNA, 20 bp, Homo sapiens
gtcccggggtcctgtggcag

SEQ ID NO: 6322933 - DNA, 22 bp, Homo sapiens
gtcccgggtactcagtcagccc

SEQ ID NO: 6322934 - DNA, 18 bp, Homo sapiens
gtcccgggttagcctggt

SEQ ID NO: 6322935 - DNA, 23 bp, Homo sapiens
gtcccggttcagacccctgcctg

SEQ ID NO: 6322936 - DNA, 19 bp, Homo sapiens
gtcccgtcaggacgttgag

SEQ ID NO: 6322937 - DNA, 16 bp, Homo sapiens
gtcccgtcgtgcagtc

SEQ ID NO: 6322938 - DNA, 21 bp, Homo sapiens
gtcccgtgcagcttctgtcct

SEQ ID NO: 6322939 - DNA, 20 bp, Homo sapiens
gtcccgtggggccccggctc

SEQ ID NO: 6322940 - DNA, 23 bp, Homo sapiens
gtccctaagcatgtgtcccagga

SEQ ID NO: 6322941 - DNA, 20 bp, Homo sapiens
gtccctaataaagctgtgtg

SEQ ID NO: 6322942 - DNA, 19 bp, Homo sapiens
gtccctaattctcttcgct

SEQ ID NO: 6322943 - DNA, 22 bp, Homo sapiens
gtccctaattctcttcgctgtg

SEQ ID NO: 6322944 - DNA, 21 bp, Homo sapiens
gtccctacacccctcccctgc

SEQ ID NO: 6322945 - DNA, 14 bp, Homo sapiens
gtccctaggaggga

SEQ ID NO: 6322946 - DNA, 22 bp, Homo sapiens
gtccctattctgccatgggaga

SEQ ID NO: 6322947 - DNA, 20 bp, Homo sapiens
gtccctcaaatgacccaaag

SEQ ID NO: 6322948 - DNA, 14 bp, Homo sapiens
gtccctcaggttcc

SEQ ID NO: 6322949 - DNA, 17 bp, Homo sapiens
gtccctcatggagacct

SEQ ID NO: 6322950 - DNA, 14 bp, Homo sapiens
gtccctccaaggct

SEQ ID NO: 6322951 - DNA, 16 bp, Homo sapiens
gtccctccactaggag

SEQ ID NO: 6322952 - DNA, 16 bp, Homo sapiens
gtccctccatcccaga

SEQ ID NO: 6322953 - DNA, 14 bp, Homo sapiens
gtccctcccacctc

SEQ ID NO: 6322954 - DNA, 15 bp, Homo sapiens
gtccctcccacctct

SEQ ID NO: 6322955 - DNA, 18 bp, Homo sapiens
gtccctcccacctctgtg

SEQ ID NO: 6322956 - DNA, 13 bp, Homo sapiens
gtccctcccactc

SEQ ID NO: 6322957 - DNA, 16 bp, Homo sapiens
gtccctcccccttgtc

SEQ ID NO: 6322958 - DNA, 15 bp, Homo sapiens
gtccctccctcctgg

SEQ ID NO: 6322959 - DNA, 18 bp, Homo sapiens
gtccctccctcctggctc

SEQ ID NO: 6322960 - DNA, 24 bp, Homo sapiens
gtccctccctcctggctcacagcc

SEQ ID NO: 6322961 - DNA, 15 bp, Homo sapiens
gtccctccctgcctg

SEQ ID NO: 6322962 - DNA, 17 bp, Homo sapiens
gtccctccgagcttggg

SEQ ID NO: 6322963 - DNA, 21 bp, Homo sapiens
gtccctcctcccccacgcctc

SEQ ID NO: 6322964 - DNA, 18 bp, Homo sapiens
gtccctcctccccggagc

SEQ ID NO: 6322965 - DNA, 19 bp, Homo sapiens
gtccctcctccccggagcc

SEQ ID NO: 6322966 - DNA, 12 bp, Homo sapiens
gtccctcctggg

SEQ ID NO: 6322967 - DNA, 14 bp, Homo sapiens
gtccctcctgggat

SEQ ID NO: 6322968 - DNA, 12 bp, Homo sapiens
gtccctcctggt

SEQ ID NO: 6322969 - DNA, 11 bp, Homo sapiens
gtccctcctgt

SEQ ID NO: 6322970 - DNA, 15 bp, Homo sapiens
gtccctcctgttgcc

SEQ ID NO: 6322971 - DNA, 18 bp, Homo sapiens
gtccctcgagctctgtag

SEQ ID NO: 6322972 - DNA, 21 bp, Homo sapiens
gtccctcgagctctgtagcct

SEQ ID NO: 6322973 - DNA, 20 bp, Homo sapiens
gtccctcgccgtccctccca

SEQ ID NO: 6322974 - DNA, 16 bp, Homo sapiens
gtccctcgtccacagg

SEQ ID NO: 6322975 - DNA, 23 bp, Homo sapiens
gtccctcgtctcttgtgactcag

SEQ ID NO: 6322976 - DNA, 16 bp, Homo sapiens
gtccctctcactcccc

SEQ ID NO: 6322977 - DNA, 21 bp, Homo sapiens
gtccctctcactccccagccc

SEQ ID NO: 6322978 - DNA, 12 bp, Homo sapiens
gtccctctcaga

SEQ ID NO: 6322979 - DNA, 16 bp, Homo sapiens
gtccctctcaggcatg

SEQ ID NO: 6322980 - DNA, 18 bp, Homo sapiens
gtccctctcagtgccttc

SEQ ID NO: 6322981 - DNA, 20 bp, Homo sapiens
gtccctctcctatgtggcag

SEQ ID NO: 6322982 - DNA, 23 bp, Homo sapiens
gtccctctccttgcccccagtgc

SEQ ID NO: 6322983 - DNA, 21 bp, Homo sapiens
gtccctctcggaaggctggct

SEQ ID NO: 6322984 - DNA, 12 bp, Homo sapiens
gtccctctgagg

SEQ ID NO: 6322985 - DNA, 12 bp, Homo sapiens
gtccctctgcag

SEQ ID NO: 6322986 - DNA, 13 bp, Homo sapiens
gtccctctgcaga

SEQ ID NO: 6322987 - DNA, 11 bp, Homo sapiens
gtccctctgcc

SEQ ID NO: 6322988 - DNA, 12 bp, Homo sapiens
gtccctctgcct

SEQ ID NO: 6322989 - DNA, 18 bp, Homo sapiens
gtccctctgccttgcaca

SEQ ID NO: 6322990 - DNA, 19 bp, Homo sapiens
gtccctcttctctcctcag

SEQ ID NO: 6322991 - DNA, 21 bp, Homo sapiens
gtccctcttctctcctcagtt

SEQ ID NO: 6322992 - DNA, 20 bp, Homo sapiens
gtccctcttctggtttccct

SEQ ID NO: 6322993 - DNA, 18 bp, Homo sapiens
gtccctgaacgccctggt

SEQ ID NO: 6322994 - DNA, 16 bp, Homo sapiens
gtccctgaagagaagg

SEQ ID NO: 6322995 - DNA, 23 bp, Homo sapiens
gtccctgaagtcttgcattgaat

SEQ ID NO: 6322996 - DNA, 15 bp, Homo sapiens
gtccctgacttccca

SEQ ID NO: 6322997 - DNA, 19 bp, Homo sapiens
gtccctgacttcccagctg

SEQ ID NO: 6322998 - DNA, 18 bp, Homo sapiens
gtccctgaggcaggtccc

SEQ ID NO: 6322999 - DNA, 20 bp, Homo sapiens
gtccctgcaaaactccaggc

SEQ ID NO: 6323000 - DNA, 22 bp, Homo sapiens
gtccctgcaaaactccaggcag

SEQ ID NO: 6323001 - DNA, 21 bp, Homo sapiens
gtccctgcacagtgacttctg

SEQ ID NO: 6323002 - DNA, 17 bp, Homo sapiens
gtccctgcactgtgccc

SEQ ID NO: 6323003 - DNA, 21 bp, Homo sapiens
gtccctgcacttgcagactct

SEQ ID NO: 6323004 - DNA, 20 bp, Homo sapiens
gtccctgcagaagccagaag

SEQ ID NO: 6323005 - DNA, 12 bp, Homo sapiens
gtccctgcaggg

SEQ ID NO: 6323006 - DNA, 13 bp, Homo sapiens
gtccctgcagggc

SEQ ID NO: 6323007 - DNA, 23 bp, Homo sapiens
gtccctgccaatgctccagctgt

SEQ ID NO: 6323008 - DNA, 18 bp, Homo sapiens
gtccctgccacactcagt

SEQ ID NO: 6323009 - DNA, 18 bp, Homo sapiens
gtccctgccccagcaaga

SEQ ID NO: 6323010 - DNA, 14 bp, Homo sapiens
gtccctgccccctc

SEQ ID NO: 6323011 - DNA, 16 bp, Homo sapiens
gtccctgccccgaccc

SEQ ID NO: 6323012 - DNA, 18 bp, Homo sapiens
gtccctgccccgcccccc

SEQ ID NO: 6323013 - DNA, 22 bp, Homo sapiens
gtccctgccccgccccccagag

SEQ ID NO: 6323014 - DNA, 23 bp, Homo sapiens
gtccctgccccgccccccagagc

SEQ ID NO: 6323015 - DNA, 16 bp, Homo sapiens
gtccctgccctcccct

SEQ ID NO: 6323016 - DNA, 13 bp, Homo sapiens
gtccctgcctgga

SEQ ID NO: 6323017 - DNA, 16 bp, Homo sapiens
gtccctgcctggccct

SEQ ID NO: 6323018 - DNA, 17 bp, Homo sapiens
gtccctgcctggccctc

SEQ ID NO: 6323019 - DNA, 20 bp, Homo sapiens
gtccctgccttcactgtgct

SEQ ID NO: 6323020 - DNA, 15 bp, Homo sapiens
gtccctgctcagccc

SEQ ID NO: 6323021 - DNA, 17 bp, Homo sapiens
gtccctgctcagcccat

SEQ ID NO: 6323022 - DNA, 23 bp, Homo sapiens
ggccaaacaacagtcttcatttt

SEQ ID NO: 6323023 - DNA, 14 bp, Homo sapiens
ggccaaacaagtgt

SEQ ID NO: 6323024 - DNA, 14 bp, Homo sapiens
ggccaaacagacag

SEQ ID NO: 6323025 - DNA, 17 bp, Homo sapiens
ggccaaacatcagacct

SEQ ID NO: 6323026 - DNA, 21 bp, Homo sapiens
ggccaaacccacttctggcct

SEQ ID NO: 6323027 - DNA, 14 bp, Homo sapiens
ggccaaacccagac

SEQ ID NO: 6323028 - DNA, 19 bp, Homo sapiens
ggccaaacccttgctttcc

SEQ ID NO: 6323029 - DNA, 21 bp, Homo sapiens
ggccaaacggtgcaacagaag

SEQ ID NO: 6323030 - DNA, 21 bp, Homo sapiens
ggccaaactcacctgcccctc

SEQ ID NO: 6323031 - DNA, 11 bp, Homo sapiens
ggccaaagaac

SEQ ID NO: 6323032 - DNA, 17 bp, Homo sapiens
ggccaaagaaccaaaga

SEQ ID NO: 6323033 - DNA, 16 bp, Homo sapiens
ggccaaagagtctcca

SEQ ID NO: 6323034 - DNA, 19 bp, Homo sapiens
ggccaaagcacagctgggc

SEQ ID NO: 6323035 - DNA, 12 bp, Homo sapiens
ggccaaaggaag

SEQ ID NO: 6323036 - DNA, 14 bp, Homo sapiens
ggccaaaggaagca

SEQ ID NO: 6323037 - DNA, 21 bp, Homo sapiens
ggccaaaggaagcacatgcct

SEQ ID NO: 6323038 - DNA, 16 bp, Homo sapiens
ggccaaaggctggtgg

SEQ ID NO: 6323039 - DNA, 19 bp, Homo sapiens
ggccaaaggggacctggaa

SEQ ID NO: 6323040 - DNA, 13 bp, Homo sapiens
ggccaaataaagt

SEQ ID NO: 6323041 - DNA, 14 bp, Homo sapiens
ggccaaataaagtc

SEQ ID NO: 6323042 - DNA, 12 bp, Homo sapiens
ggccaaatatgc

SEQ ID NO: 6323043 - DNA, 19 bp, Homo sapiens
ggccaaatcacccttagaa

SEQ ID NO: 6323044 - DNA, 17 bp, Homo sapiens
ggccaaatctagaattt

SEQ ID NO: 6323045 - DNA, 12 bp, Homo sapiens
ggccaaatgcaa

SEQ ID NO: 6323046 - DNA, 22 bp, Homo sapiens
ggccaaatgcacaagctcagaa

SEQ ID NO: 6323047 - DNA, 13 bp, Homo sapiens
ggccaaattccct

SEQ ID NO: 6323048 - DNA, 16 bp, Homo sapiens
ggccaacaaagctgtt

SEQ ID NO: 6323049 - DNA, 15 bp, Homo sapiens
ggccaacaaggactc

SEQ ID NO: 6323050 - DNA, 23 bp, Homo sapiens
ggccaacaatcctttctgcccac

SEQ ID NO: 6323051 - DNA, 22 bp, Homo sapiens
ggccaacatggtgaaaccctgt

SEQ ID NO: 6323052 - DNA, 14 bp, Homo sapiens
ggccaaccagcccg

SEQ ID NO: 6323053 - DNA, 18 bp, Homo sapiens
ggccaaccaggacccagg

SEQ ID NO: 6323054 - DNA, 16 bp, Homo sapiens
ggccaacccttctcct

SEQ ID NO: 6323055 - DNA, 15 bp, Homo sapiens
ggccaacctcaggct

SEQ ID NO: 6323056 - DNA, 15 bp, Homo sapiens
ggccaactcaccctt

SEQ ID NO: 6323057 - DNA, 14 bp, Homo sapiens
ggccaagaaagaaa

SEQ ID NO: 6323058 - DNA, 22 bp, Homo sapiens
ggccaagaatattgcaaaatac

SEQ ID NO: 6323059 - DNA, 15 bp, Homo sapiens
ggccaagacttggca

SEQ ID NO: 6323060 - DNA, 19 bp, Homo sapiens
ggccaagagaaacttccta

SEQ ID NO: 6323061 - DNA, 23 bp, Homo sapiens
ggccaagagaaaggcctgcacac

SEQ ID NO: 6323062 - DNA, 13 bp, Homo sapiens
ggccaagagaagg

SEQ ID NO: 6323063 - DNA, 16 bp, Homo sapiens
ggccaagagatctgtg

SEQ ID NO: 6323064 - DNA, 23 bp, Homo sapiens
ggccaagaggtttggctcctgcc

SEQ ID NO: 6323065 - DNA, 14 bp, Homo sapiens
ggccaagagtggcc

SEQ ID NO: 6323066 - DNA, 17 bp, Homo sapiens
ggccaagagtggcccca

SEQ ID NO: 6323067 - DNA, 19 bp, Homo sapiens
ggccaagagtggccccacc

SEQ ID NO: 6323068 - DNA, 20 bp, Homo sapiens
ggccaagagtggccccacct

SEQ ID NO: 6323069 - DNA, 22 bp, Homo sapiens
ggccaagagtggccccacctgg

SEQ ID NO: 6323070 - DNA, 19 bp, Homo sapiens
ggccaagataggaccttgg

SEQ ID NO: 6323071 - DNA, 14 bp, Homo sapiens
ggccaagcagaaaa

SEQ ID NO: 6323072 - DNA, 14 bp, Homo sapiens
ggccaagcagggag

SEQ ID NO: 6323073 - DNA, 17 bp, Homo sapiens
ggccaagcagtgcctgc

SEQ ID NO: 6323074 - DNA, 19 bp, Homo sapiens
ggccaagcagtgcctgcct

SEQ ID NO: 6323075 - DNA, 13 bp, Homo sapiens
ggccaagccagct

SEQ ID NO: 6323076 - DNA, 17 bp, Homo sapiens
ggccaagccagctgcct

SEQ ID NO: 6323077 - DNA, 18 bp, Homo sapiens
ggccaagccagctgccta

SEQ ID NO: 6323078 - DNA, 19 bp, Homo sapiens
ggccaagccagctgcctag

SEQ ID NO: 6323079 - DNA, 22 bp, Homo sapiens
ggccaagccagggttccagaca

SEQ ID NO: 6323080 - DNA, 17 bp, Homo sapiens
ggccaagccggcccaac

SEQ ID NO: 6323081 - DNA, 23 bp, Homo sapiens
ggccaagccggcccaacccaacc

SEQ ID NO: 6323082 - DNA, 14 bp, Homo sapiens
ggccaagcctgcag

SEQ ID NO: 6323083 - DNA, 16 bp, Homo sapiens
ggccaagcctgccccg

SEQ ID NO: 6323084 - DNA, 22 bp, Homo sapiens
ggccaagctgaagtgaaggaga

SEQ ID NO: 6323085 - DNA, 23 bp, Homo sapiens
ggccaagctgaagtgaaggagaa

SEQ ID NO: 6323086 - DNA, 14 bp, Homo sapiens
ggccaaggacccag

SEQ ID NO: 6323087 - DNA, 15 bp, Homo sapiens
ggccaaggacccagg

SEQ ID NO: 6323088 - DNA, 17 bp, Homo sapiens
ggccaaggacccaggcg

SEQ ID NO: 6323089 - DNA, 11 bp, Homo sapiens
ggccaaggact

SEQ ID NO: 6323090 - DNA, 15 bp, Homo sapiens
ggccaaggagctgct

SEQ ID NO: 6323091 - DNA, 16 bp, Homo sapiens
ggccaaggagctgcta

SEQ ID NO: 6323092 - DNA, 13 bp, Homo sapiens
ggccaaggcctca

SEQ ID NO: 6323093 - DNA, 18 bp, Homo sapiens
ggccaaggccttctcctc

SEQ ID NO: 6323094 - DNA, 19 bp, Homo sapiens
ggccaaggccttctcctcc

SEQ ID NO: 6323095 - DNA, 13 bp, Homo sapiens
ggccaagggacca

SEQ ID NO: 6323096 - DNA, 16 bp, Homo sapiens
ggccaagggctccagg

SEQ ID NO: 6323097 - DNA, 16 bp, Homo sapiens
ggccaaggtcctgctc

SEQ ID NO: 6323098 - DNA, 14 bp, Homo sapiens
ggccaaggtgcata

SEQ ID NO: 6323099 - DNA, 16 bp, Homo sapiens
ggccaaggtgccacca

SEQ ID NO: 6323100 - DNA, 13 bp, Homo sapiens
ggccaaggtggga

SEQ ID NO: 6323101 - DNA, 18 bp, Homo sapiens
ggccaagtccactgtcct

SEQ ID NO: 6323102 - DNA, 19 bp, Homo sapiens
ggccaagtctaatgaagag

SEQ ID NO: 6323103 - DNA, 20 bp, Homo sapiens
ggccaagtctaatgaagaga

SEQ ID NO: 6323104 - DNA, 23 bp, Homo sapiens
ggccaagtctaatgaagagaaaa

SEQ ID NO: 6323105 - DNA, 12 bp, Homo sapiens
ggccaagttctt

SEQ ID NO: 6323106 - DNA, 17 bp, Homo sapiens
ggccaatggaaacctca

SEQ ID NO: 6323107 - DNA, 20 bp, Homo sapiens
ggccaatggtgcttccccca

SEQ ID NO: 6323108 - DNA, 16 bp, Homo sapiens
ggccaattaaaatata

SEQ ID NO: 6323109 - DNA, 17 bp, Homo sapiens
ggccaattaaaatatat

SEQ ID NO: 6323110 - DNA, 23 bp, Homo sapiens
ggccaattaaaatatatataaat

SEQ ID NO: 6323111 - DNA, 22 bp, Homo sapiens
ggccacaactgctgtggccccc

SEQ ID NO: 6323112 - DNA, 17 bp, Homo sapiens
ggccacaagacccttgt

SEQ ID NO: 6323113 - DNA, 22 bp, Homo sapiens
ggccacaaggacgctggctact

SEQ ID NO: 6323114 - DNA, 18 bp, Homo sapiens
ggccacaatcctccccac

SEQ ID NO: 6323115 - DNA, 17 bp, Homo sapiens
ggccacacaagtgcagt

SEQ ID NO: 6323116 - DNA, 17 bp, Homo sapiens
ggccacacaggcagggc

SEQ ID NO: 6323117 - DNA, 22 bp, Homo sapiens
ggccacacaggcagggcctggc

SEQ ID NO: 6323118 - DNA, 21 bp, Homo sapiens
ggccacacatcctgctgggcc

SEQ ID NO: 6323119 - DNA, 16 bp, Homo sapiens
ggccacacccagcggc

SEQ ID NO: 6323120 - DNA, 13 bp, Homo sapiens
ggccacacccagg

SEQ ID NO: 6323121 - DNA, 17 bp, Homo sapiens
ggccacacccaggaagg

SEQ ID NO: 6323122 - DNA, 18 bp, Homo sapiens
ggccacaccccagactcc

SEQ ID NO: 6323123 - DNA, 18 bp, Homo sapiens
ggccacacccctctgctg

SEQ ID NO: 6323124 - DNA, 20 bp, Homo sapiens
ggccacacccctctgctgca

SEQ ID NO: 6323125 - DNA, 18 bp, Homo sapiens
ggccacacctgagcgctg

SEQ ID NO: 6323126 - DNA, 23 bp, Homo sapiens
ggccacacgcactggtgccaaaa

SEQ ID NO: 6323127 - DNA, 16 bp, Homo sapiens
ggccacacgctgccca

SEQ ID NO: 6323128 - DNA, 17 bp, Homo sapiens
ggccacacgctgcccag

SEQ ID NO: 6323129 - DNA, 23 bp, Homo sapiens
ggccacacgctgcccaggctctg

SEQ ID NO: 6323130 - DNA, 22 bp, Homo sapiens
ggccacactattaccatgagaa

SEQ ID NO: 6323131 - DNA, 21 bp, Homo sapiens
ggccacactcagcacaaggcc

SEQ ID NO: 6323132 - DNA, 11 bp, Homo sapiens
ggccacactgg

SEQ ID NO: 6323133 - DNA, 18 bp, Homo sapiens
ggccacactggggctgac

SEQ ID NO: 6323134 - DNA, 19 bp, Homo sapiens
ggccacagaaggtgaactt

SEQ ID NO: 6323135 - DNA, 23 bp, Homo sapiens
ggccacagactgacccccatctg

SEQ ID NO: 6323136 - DNA, 15 bp, Homo sapiens
ggccacagagaacct

SEQ ID NO: 6323137 - DNA, 15 bp, Homo sapiens
ggccacagcaccccg

SEQ ID NO: 6323138 - DNA, 14 bp, Homo sapiens
ggccacagccacct

SEQ ID NO: 6323139 - DNA, 16 bp, Homo sapiens
ggccacagccacctcc

SEQ ID NO: 6323140 - DNA, 20 bp, Homo sapiens
ggccacagccacctccaccc

SEQ ID NO: 6323141 - DNA, 21 bp, Homo sapiens
ggccacagccactaatcagga

SEQ ID NO: 6323142 - DNA, 13 bp, Homo sapiens
ggccacagccaga

SEQ ID NO: 6323143 - DNA, 21 bp, Homo sapiens
ggccacagcccccttgccctc

SEQ ID NO: 6323144 - DNA, 17 bp, Homo sapiens
ggccacagcccctggca

SEQ ID NO: 6323145 - DNA, 16 bp, Homo sapiens
ggccacagccttccct

SEQ ID NO: 6323146 - DNA, 15 bp, Homo sapiens
ggccacagcgtgctg

SEQ ID NO: 6323147 - DNA, 14 bp, Homo sapiens
ggccacagctgctg

SEQ ID NO: 6323148 - DNA, 11 bp, Homo sapiens
ggccacaggca

SEQ ID NO: 6323149 - DNA, 21 bp, Homo sapiens
ggccacaggcagtccaggcct

SEQ ID NO: 6323150 - DNA, 12 bp, Homo sapiens
ggccacagggca

SEQ ID NO: 6323151 - DNA, 16 bp, Homo sapiens
ggccacatcaaagagg

SEQ ID NO: 6323152 - DNA, 16 bp, Homo sapiens
ggccacatcagcccca

SEQ ID NO: 6323153 - DNA, 19 bp, Homo sapiens
ggccacatcagccccacag

SEQ ID NO: 6323154 - DNA, 19 bp, Homo sapiens
ggccacatccccaccccag

SEQ ID NO: 6323155 - DNA, 19 bp, Homo sapiens
ggccacatggggctgggca

SEQ ID NO: 6323156 - DNA, 18 bp, Homo sapiens
ggccacattgctggctgc

SEQ ID NO: 6323157 - DNA, 17 bp, Homo sapiens
ggccaccacccaacctg

SEQ ID NO: 6323158 - DNA, 22 bp, Homo sapiens
ggccaccacccaacctgtcctt

SEQ ID NO: 6323159 - DNA, 14 bp, Homo sapiens
ggccaccacccccc

SEQ ID NO: 6323160 - DNA, 18 bp, Homo sapiens
ggccaccaccccccactc

SEQ ID NO: 6323161 - DNA, 20 bp, Homo sapiens
ggccaccacgcctagcctca

SEQ ID NO: 6323162 - DNA, 16 bp, Homo sapiens
ggccaccagatgctga

SEQ ID NO: 6323163 - DNA, 20 bp, Homo sapiens
ggccaccagccatcctccct

SEQ ID NO: 6323164 - DNA, 21 bp, Homo sapiens
ggccaccagcttccctctgcc

SEQ ID NO: 6323165 - DNA, 24 bp, Homo sapiens
ggccaccagcttccctctgcctga

SEQ ID NO: 6323166 - DNA, 15 bp, Homo sapiens
ggccaccaggaagca

SEQ ID NO: 6323167 - DNA, 15 bp, Homo sapiens
ggccaccaggctggc

SEQ ID NO: 6323168 - DNA, 19 bp, Homo sapiens
ggccaccaggctggcgcag

SEQ ID NO: 6323169 - DNA, 20 bp, Homo sapiens
ggccaccatctgtaccctgc

SEQ ID NO: 6323170 - DNA, 22 bp, Homo sapiens
ggccacccaccagggctcagct

SEQ ID NO: 6323171 - DNA, 15 bp, Homo sapiens
ggccacccacccttc

SEQ ID NO: 6323172 - DNA, 16 bp, Homo sapiens
ggccacccactgaccc

SEQ ID NO: 6323173 - DNA, 23 bp, Homo sapiens
ggccacccactgtggggcaagcc

SEQ ID NO: 6323174 - DNA, 20 bp, Homo sapiens
ggccaccccaaaccccagcc

SEQ ID NO: 6323175 - DNA, 21 bp, Homo sapiens
ggccaccccaaaccccagccc

SEQ ID NO: 6323176 - DNA, 14 bp, Homo sapiens
ggccaccccactct

SEQ ID NO: 6323177 - DNA, 19 bp, Homo sapiens
ggccaccccactctacctc

SEQ ID NO: 6323178 - DNA, 21 bp, Homo sapiens
ggccaccccactctacctcct

SEQ ID NO: 6323179 - DNA, 17 bp, Homo sapiens
ggccaccccagagtggg

SEQ ID NO: 6323180 - DNA, 22 bp, Homo sapiens
ggccaccccagagtgggagagg

SEQ ID NO: 6323181 - DNA, 19 bp, Homo sapiens
ggccaccccctatcctctg

SEQ ID NO: 6323182 - DNA, 20 bp, Homo sapiens
ggccaccccgtgccacccgt

SEQ ID NO: 6323183 - DNA, 16 bp, Homo sapiens
ggccaccccttgctct

SEQ ID NO: 6323184 - DNA, 19 bp, Homo sapiens
ggccacccgcctccctctc

SEQ ID NO: 6323185 - DNA, 15 bp, Homo sapiens
ggccacccgggctgc

SEQ ID NO: 6323186 - DNA, 16 bp, Homo sapiens
ggccacccgggctgcc

SEQ ID NO: 6323187 - DNA, 24 bp, Homo sapiens
ggccacccgttctgctggcctgga

SEQ ID NO: 6323188 - DNA, 12 bp, Homo sapiens
ggccaccctcct

SEQ ID NO: 6323189 - DNA, 19 bp, Homo sapiens
ggccaccctccttcccgcc

SEQ ID NO: 6323190 - DNA, 14 bp, Homo sapiens
ggccaccctgagca

SEQ ID NO: 6323191 - DNA, 15 bp, Homo sapiens
ggccaccctgagcag

SEQ ID NO: 6323192 - DNA, 13 bp, Homo sapiens
ggccaccctggcc

SEQ ID NO: 6323193 - DNA, 20 bp, Homo sapiens
ggccacccttcacgctggct

SEQ ID NO: 6323194 - DNA, 18 bp, Homo sapiens
ggccaccgccttgcccag

SEQ ID NO: 6323195 - DNA, 18 bp, Homo sapiens
ggccaccgggacagacct

SEQ ID NO: 6323196 - DNA, 21 bp, Homo sapiens
ggccaccgggacagacctgga

SEQ ID NO: 6323197 - DNA, 16 bp, Homo sapiens
ggccaccggtgggcag

SEQ ID NO: 6323198 - DNA, 14 bp, Homo sapiens
ggccaccgtgcctg

SEQ ID NO: 6323199 - DNA, 19 bp, Homo sapiens
ggccaccgtgcctggctga

SEQ ID NO: 6323200 - DNA, 18 bp, Homo sapiens
gtccctgctcagcccatc

SEQ ID NO: 6323201 - DNA, 20 bp, Homo sapiens
gtccctgctcagcccatccc

SEQ ID NO: 6323202 - DNA, 24 bp, Homo sapiens
gtccctgctcagcccatcccctgc

SEQ ID NO: 6323203 - DNA, 15 bp, Homo sapiens
gtccctgctcggccg

SEQ ID NO: 6323204 - DNA, 15 bp, Homo sapiens
gtccctgctgccagc

SEQ ID NO: 6323205 - DNA, 22 bp, Homo sapiens
gtccctgctgctgccagggctt

SEQ ID NO: 6323206 - DNA, 23 bp, Homo sapiens
gtccctgctgctgccagggcttc

SEQ ID NO: 6323207 - DNA, 15 bp, Homo sapiens
gtccctggaaaagga

SEQ ID NO: 6323208 - DNA, 14 bp, Homo sapiens
gtccctggaagctt

SEQ ID NO: 6323209 - DNA, 13 bp, Homo sapiens
gtccctggacaca

SEQ ID NO: 6323210 - DNA, 16 bp, Homo sapiens
gtccctggacacagct

SEQ ID NO: 6323211 - DNA, 19 bp, Homo sapiens
gtccctggacacagctctt

SEQ ID NO: 6323212 - DNA, 12 bp, Homo sapiens
gtccctggacca

SEQ ID NO: 6323213 - DNA, 22 bp, Homo sapiens
gtccctggagggcaagccctgc

SEQ ID NO: 6323214 - DNA, 14 bp, Homo sapiens
gtccctgggaaaga

SEQ ID NO: 6323215 - DNA, 19 bp, Homo sapiens
gtccctggggcactccccc

SEQ ID NO: 6323216 - DNA, 19 bp, Homo sapiens
gtccctgggggaagccctg

SEQ ID NO: 6323217 - DNA, 20 bp, Homo sapiens
gtccctgggggaagccctgg

SEQ ID NO: 6323218 - DNA, 17 bp, Homo sapiens
gtccctgggggtgcaga

SEQ ID NO: 6323219 - DNA, 20 bp, Homo sapiens
gtccctgggtagcgggggag

SEQ ID NO: 6323220 - DNA, 22 bp, Homo sapiens
gtccctggtccctcgtccacag

SEQ ID NO: 6323221 - DNA, 12 bp, Homo sapiens
gtccctggtcct

SEQ ID NO: 6323222 - DNA, 16 bp, Homo sapiens
gtccctggtggcagct

SEQ ID NO: 6323223 - DNA, 18 bp, Homo sapiens
gtccctggtggcagctca

SEQ ID NO: 6323224 - DNA, 19 bp, Homo sapiens
gtccctggtggcagctcac

SEQ ID NO: 6323225 - DNA, 11 bp, Homo sapiens
gtccctgtatg

SEQ ID NO: 6323226 - DNA, 16 bp, Homo sapiens
gtccctgtcaggacac

SEQ ID NO: 6323227 - DNA, 22 bp, Homo sapiens
gtccctgtcattcactcgggtg

SEQ ID NO: 6323228 - DNA, 19 bp, Homo sapiens
gtccctgtccccaggccca

SEQ ID NO: 6323229 - DNA, 13 bp, Homo sapiens
gtccctgtccccc

SEQ ID NO: 6323230 - DNA, 18 bp, Homo sapiens
gtccctgtcccccagcat

SEQ ID NO: 6323231 - DNA, 18 bp, Homo sapiens
gtccctgtccctctcgcc

SEQ ID NO: 6323232 - DNA, 19 bp, Homo sapiens
gtccctgtccctgccccgc

SEQ ID NO: 6323233 - DNA, 17 bp, Homo sapiens
gtccctgtgatggccag

SEQ ID NO: 6323234 - DNA, 15 bp, Homo sapiens
gtccctgtgcctaac

SEQ ID NO: 6323235 - DNA, 17 bp, Homo sapiens
gtccctgtgggctcaca

SEQ ID NO: 6323236 - DNA, 19 bp, Homo sapiens
gtccctgtgggctcacacc

SEQ ID NO: 6323237 - DNA, 20 bp, Homo sapiens
gtccctgtgtgtaggctggg

SEQ ID NO: 6323238 - DNA, 19 bp, Homo sapiens
gtccctgtgttgtcccatc

SEQ ID NO: 6323239 - DNA, 20 bp, Homo sapiens
gtccctgtgttgtcccatct

SEQ ID NO: 6323240 - DNA, 24 bp, Homo sapiens
gtccctgtgttgtcccatctgccc

SEQ ID NO: 6323241 - DNA, 12 bp, Homo sapiens
gtccctgttaga

SEQ ID NO: 6323242 - DNA, 16 bp, Homo sapiens
gtccctgttctcagct

SEQ ID NO: 6323243 - DNA, 18 bp, Homo sapiens
gtccctgttttctgagcc

SEQ ID NO: 6323244 - DNA, 21 bp, Homo sapiens
gtcccttagaagatctgcttc

SEQ ID NO: 6323245 - DNA, 18 bp, Homo sapiens
gtcccttcaaggcctccc

SEQ ID NO: 6323246 - DNA, 20 bp, Homo sapiens
gtcccttccaatgctgtggg

SEQ ID NO: 6323247 - DNA, 18 bp, Homo sapiens
gtcccttccacaccccca

SEQ ID NO: 6323248 - DNA, 22 bp, Homo sapiens
gtcccttccacacccccacccc

SEQ ID NO: 6323249 - DNA, 22 bp, Homo sapiens
gtcccttccacttctaactcca

SEQ ID NO: 6323250 - DNA, 20 bp, Homo sapiens
gtcccttccagtcatgtgtg

SEQ ID NO: 6323251 - DNA, 17 bp, Homo sapiens
gtcccttccatgccctg

SEQ ID NO: 6323252 - DNA, 19 bp, Homo sapiens
gtcccttccatgccctggg

SEQ ID NO: 6323253 - DNA, 20 bp, Homo sapiens
gtcccttccatttctactgt

SEQ ID NO: 6323254 - DNA, 17 bp, Homo sapiens
gtcccttcccctccctg

SEQ ID NO: 6323255 - DNA, 21 bp, Homo sapiens
gtcccttccccttcaccgctc

SEQ ID NO: 6323256 - DNA, 17 bp, Homo sapiens
gtcccttcccgacccag

SEQ ID NO: 6323257 - DNA, 22 bp, Homo sapiens
gtcccttcccgacccagccagc

SEQ ID NO: 6323258 - DNA, 23 bp, Homo sapiens
gtcccttcccgacccagccagct

SEQ ID NO: 6323259 - DNA, 19 bp, Homo sapiens
gtcccttcctattctcctg

SEQ ID NO: 6323260 - DNA, 23 bp, Homo sapiens
gtcccttcctattctcctgccat

SEQ ID NO: 6323261 - DNA, 23 bp, Homo sapiens
gtcccttcctgcttcctgttacc

SEQ ID NO: 6323262 - DNA, 12 bp, Homo sapiens
gtcccttccttt

SEQ ID NO: 6323263 - DNA, 21 bp, Homo sapiens
gtcccttctctttggggctcc

SEQ ID NO: 6323264 - DNA, 22 bp, Homo sapiens
gtcccttcttccctaatcagct

SEQ ID NO: 6323265 - DNA, 18 bp, Homo sapiens
gtcccttgagacctcagc

SEQ ID NO: 6323266 - DNA, 19 bp, Homo sapiens
gtcccttgagacctcagcc

SEQ ID NO: 6323267 - DNA, 17 bp, Homo sapiens
gtcccttgatgcacaga

SEQ ID NO: 6323268 - DNA, 13 bp, Homo sapiens
gtcccttgccccc

SEQ ID NO: 6323269 - DNA, 21 bp, Homo sapiens
gtcccttgcccccctggcctc

SEQ ID NO: 6323270 - DNA, 13 bp, Homo sapiens
gtcccttgcctca

SEQ ID NO: 6323271 - DNA, 14 bp, Homo sapiens
gtcccttgcctcaa

SEQ ID NO: 6323272 - DNA, 20 bp, Homo sapiens
gtcccttgcctctgccctgg

SEQ ID NO: 6323273 - DNA, 21 bp, Homo sapiens
gtcccttgcttagcctgtgct

SEQ ID NO: 6323274 - DNA, 21 bp, Homo sapiens
gtcccttggaaagttcagcca

SEQ ID NO: 6323275 - DNA, 22 bp, Homo sapiens
gtcccttggaaagttcagccag

SEQ ID NO: 6323276 - DNA, 20 bp, Homo sapiens
gtcccttgtatcccctgcag

SEQ ID NO: 6323277 - DNA, 14 bp, Homo sapiens
gtccctttccccta

SEQ ID NO: 6323278 - DNA, 16 bp, Homo sapiens
gtccctttcccctaga

SEQ ID NO: 6323279 - DNA, 21 bp, Homo sapiens
gtccctttcccctagatccag

SEQ ID NO: 6323280 - DNA, 13 bp, Homo sapiens
gtccctttcccta

SEQ ID NO: 6323281 - DNA, 16 bp, Homo sapiens
gtccctttccctacct

SEQ ID NO: 6323282 - DNA, 17 bp, Homo sapiens
gtccctttccctacctt

SEQ ID NO: 6323283 - DNA, 15 bp, Homo sapiens
gtccctttccctgca

SEQ ID NO: 6323284 - DNA, 20 bp, Homo sapiens
gtccctttcttctcccccat

SEQ ID NO: 6323285 - DNA, 23 bp, Homo sapiens
gtccctttgtttgaagttggttt

SEQ ID NO: 6323286 - DNA, 19 bp, Homo sapiens
gtcccttttcattctcctc

SEQ ID NO: 6323287 - DNA, 17 bp, Homo sapiens
gtccctttttctccaca

SEQ ID NO: 6323288 - DNA, 20 bp, Homo sapiens
gtccctttttgcaggggact

SEQ ID NO: 6323289 - DNA, 15 bp, Homo sapiens
gtccgatctttgact

SEQ ID NO: 6323290 - DNA, 14 bp, Homo sapiens
gtccgcaccagctg

SEQ ID NO: 6323291 - DNA, 15 bp, Homo sapiens
gtccgcaccagctgc

SEQ ID NO: 6323292 - DNA, 16 bp, Homo sapiens
gtccgcaccagctgct

SEQ ID NO: 6323293 - DNA, 17 bp, Homo sapiens
gtccgcaccagctgctc

SEQ ID NO: 6323294 - DNA, 20 bp, Homo sapiens
gtccgcagttgtagcagaaa

SEQ ID NO: 6323295 - DNA, 21 bp, Homo sapiens
gtccgcagttgtagcagaaac

SEQ ID NO: 6323296 - DNA, 17 bp, Homo sapiens
gtccgcataagaaaaag

SEQ ID NO: 6323297 - DNA, 18 bp, Homo sapiens
gtccgcatccctgcttct

SEQ ID NO: 6323298 - DNA, 13 bp, Homo sapiens
gtccgcccatccc

SEQ ID NO: 6323299 - DNA, 17 bp, Homo sapiens
gtccgcccgcccacccc

SEQ ID NO: 6323300 - DNA, 17 bp, Homo sapiens
gtccgcccgcttccctc

SEQ ID NO: 6323301 - DNA, 12 bp, Homo sapiens
gtccgccctctt

SEQ ID NO: 6323302 - DNA, 21 bp, Homo sapiens
gtccgccctgctcctccctgg

SEQ ID NO: 6323303 - DNA, 12 bp, Homo sapiens
gtccgcctctgc

SEQ ID NO: 6323304 - DNA, 21 bp, Homo sapiens
gtccgcctctgcccgcagagc

SEQ ID NO: 6323305 - DNA, 22 bp, Homo sapiens
gtccgcctctgcccgcagagcc

SEQ ID NO: 6323306 - DNA, 13 bp, Homo sapiens
gtccgctcagcca

SEQ ID NO: 6323307 - DNA, 16 bp, Homo sapiens
gtccgctctctcatgt

SEQ ID NO: 6323308 - DNA, 20 bp, Homo sapiens
gtccgctgaagatggagggg

SEQ ID NO: 6323309 - DNA, 21 bp, Homo sapiens
gtccgctgccccatgtgtcct

SEQ ID NO: 6323310 - DNA, 17 bp, Homo sapiens
gtccgctgtctccctcc

SEQ ID NO: 6323311 - DNA, 14 bp, Homo sapiens
gtccgctttcctgg

SEQ ID NO: 6323312 - DNA, 13 bp, Homo sapiens
gtccggaagggtg

SEQ ID NO: 6323313 - DNA, 18 bp, Homo sapiens
gtccggcagcttctgccc

SEQ ID NO: 6323314 - DNA, 19 bp, Homo sapiens
gtccggcccagtgccagct

SEQ ID NO: 6323315 - DNA, 17 bp, Homo sapiens
gtccggcctctccctgc

SEQ ID NO: 6323316 - DNA, 18 bp, Homo sapiens
gtccggcctctccctgcc

SEQ ID NO: 6323317 - DNA, 19 bp, Homo sapiens
gtccggcctctccctgcct

SEQ ID NO: 6323318 - DNA, 12 bp, Homo sapiens
gtccggcgcccc

SEQ ID NO: 6323319 - DNA, 15 bp, Homo sapiens
gtccggcgccccgca

SEQ ID NO: 6323320 - DNA, 22 bp, Homo sapiens
gtccggcgccccgcacccccgc

SEQ ID NO: 6323321 - DNA, 18 bp, Homo sapiens
gtccgggtgccagggctg

SEQ ID NO: 6323322 - DNA, 21 bp, Homo sapiens
gtccggtggaaggccttcttt

SEQ ID NO: 6323323 - DNA, 15 bp, Homo sapiens
gtccggtgttctaag

SEQ ID NO: 6323324 - DNA, 16 bp, Homo sapiens
gtccggtgttctaaga

SEQ ID NO: 6323325 - DNA, 13 bp, Homo sapiens
gtccgtagctccc

SEQ ID NO: 6323326 - DNA, 14 bp, Homo sapiens
gtccgtagctcccc

SEQ ID NO: 6323327 - DNA, 19 bp, Homo sapiens
gtccgtagctcccctggct

SEQ ID NO: 6323328 - DNA, 21 bp, Homo sapiens
gtccgtagctcccctggctgg

SEQ ID NO: 6323329 - DNA, 23 bp, Homo sapiens
gtccgtagctcccctggctggct

SEQ ID NO: 6323330 - DNA, 22 bp, Homo sapiens
gtccgtagtatcagagatgtcc

SEQ ID NO: 6323331 - DNA, 22 bp, Homo sapiens
gtccgtcctgctcgccctgtgc

SEQ ID NO: 6323332 - DNA, 21 bp, Homo sapiens
gtccgtcctggcacagaagag

SEQ ID NO: 6323333 - DNA, 12 bp, Homo sapiens
gtccgtctctct

SEQ ID NO: 6323334 - DNA, 14 bp, Homo sapiens
gtccgtctctcttg

SEQ ID NO: 6323335 - DNA, 20 bp, Homo sapiens
gtccgtctctcttgcttgag

SEQ ID NO: 6323336 - DNA, 13 bp, Homo sapiens
gtccgtctgtctg

SEQ ID NO: 6323337 - DNA, 15 bp, Homo sapiens
gtccgtgaagagaaa

SEQ ID NO: 6323338 - DNA, 15 bp, Homo sapiens
gtccgtgcccaggcc

SEQ ID NO: 6323339 - DNA, 17 bp, Homo sapiens
gtccgtgcccaggccct

SEQ ID NO: 6323340 - DNA, 19 bp, Homo sapiens
gtccgtgccccttccctgg

SEQ ID NO: 6323341 - DNA, 16 bp, Homo sapiens
gtccgtgctaaggact

SEQ ID NO: 6323342 - DNA, 17 bp, Homo sapiens
gtccgtgctaaggactt

SEQ ID NO: 6323343 - DNA, 15 bp, Homo sapiens
gtccgtgctgacagc

SEQ ID NO: 6323344 - DNA, 19 bp, Homo sapiens
gtccgtgctgacagctgct

SEQ ID NO: 6323345 - DNA, 22 bp, Homo sapiens
gtccgtgctgacagctgctcct

SEQ ID NO: 6323346 - DNA, 23 bp, Homo sapiens
gtccgtgcttgctggtgcctctt

SEQ ID NO: 6323347 - DNA, 17 bp, Homo sapiens
gtccgtggtagaggcct

SEQ ID NO: 6323348 - DNA, 14 bp, Homo sapiens
gtccgtgtgcctcc

SEQ ID NO: 6323349 - DNA, 17 bp, Homo sapiens
gtccgtgtgcctcctgt

SEQ ID NO: 6323350 - DNA, 18 bp, Homo sapiens
gtccgtgtgcctcctgtg

SEQ ID NO: 6323351 - DNA, 21 bp, Homo sapiens
gtccgtttgagtgtctgcgcc

SEQ ID NO: 6323352 - DNA, 15 bp, Homo sapiens
gtcctaaaagcaaaa

SEQ ID NO: 6323353 - DNA, 17 bp, Homo sapiens
gtcctaaaagttctcaa

SEQ ID NO: 6323354 - DNA, 19 bp, Homo sapiens
gtcctaaagaagacatttt

SEQ ID NO: 6323355 - DNA, 20 bp, Homo sapiens
gtcctaaagaagacattttc

SEQ ID NO: 6323356 - DNA, 21 bp, Homo sapiens
gtcctaaagaagacattttct

SEQ ID NO: 6323357 - DNA, 23 bp, Homo sapiens
gtcctaaagaagacattttctct

SEQ ID NO: 6323358 - DNA, 14 bp, Homo sapiens
gtcctaaatgcaaa

SEQ ID NO: 6323359 - DNA, 15 bp, Homo sapiens
gtcctaaatgcaaag

SEQ ID NO: 6323360 - DNA, 19 bp, Homo sapiens
gtcctaactttctgaatta

SEQ ID NO: 6323361 - DNA, 14 bp, Homo sapiens
gtcctaagaaagag

SEQ ID NO: 6323362 - DNA, 15 bp, Homo sapiens
gtcctaaggaacctt

SEQ ID NO: 6323363 - DNA, 15 bp, Homo sapiens
gtcctaagtgtcaag

SEQ ID NO: 6323364 - DNA, 22 bp, Homo sapiens
gtcctacaaaaataaaaggctt

SEQ ID NO: 6323365 - DNA, 23 bp, Homo sapiens
gtcctacaaaaataaaaggcttc

SEQ ID NO: 6323366 - DNA, 23 bp, Homo sapiens
gtcctacaatatcattttcctgg

SEQ ID NO: 6323367 - DNA, 20 bp, Homo sapiens
gtcctacagcctcagaggca

SEQ ID NO: 6323368 - DNA, 22 bp, Homo sapiens
gtcctacagtgactccctggga

SEQ ID NO: 6323369 - DNA, 13 bp, Homo sapiens
gtcctacagtgtc

SEQ ID NO: 6323370 - DNA, 18 bp, Homo sapiens
gtcctaccagttgcccta

SEQ ID NO: 6323371 - DNA, 19 bp, Homo sapiens
gtcctaccagttgccctag

SEQ ID NO: 6323372 - DNA, 16 bp, Homo sapiens
gtcctaccatcagctc

SEQ ID NO: 6323373 - DNA, 21 bp, Homo sapiens
gtcctaccatcagctctgcct

SEQ ID NO: 6323374 - DNA, 24 bp, Homo sapiens
gtcctacgtccaaggtggcagatg

SEQ ID NO: 6323375 - DNA, 20 bp, Homo sapiens
gtcctactatcactgaacaa

SEQ ID NO: 6323376 - DNA, 19 bp, Homo sapiens
ggccacctagaagtctccc

SEQ ID NO: 6323377 - DNA, 16 bp, Homo sapiens
ggccacctcaccctct

SEQ ID NO: 6323378 - DNA, 20 bp, Homo sapiens
ggccacctcagtctcacctg

SEQ ID NO: 6323379 - DNA, 15 bp, Homo sapiens
ggccacctcccactc

SEQ ID NO: 6323380 - DNA, 23 bp, Homo sapiens
ggccacctcccactcctgctgca

SEQ ID NO: 6323381 - DNA, 18 bp, Homo sapiens
ggccacctcctacccctt

SEQ ID NO: 6323382 - DNA, 14 bp, Homo sapiens
ggccacctcctccc

SEQ ID NO: 6323383 - DNA, 16 bp, Homo sapiens
ggccacctcctccccc

SEQ ID NO: 6323384 - DNA, 13 bp, Homo sapiens
ggccacctctcca

SEQ ID NO: 6323385 - DNA, 18 bp, Homo sapiens
ggccacctctccaagggc

SEQ ID NO: 6323386 - DNA, 20 bp, Homo sapiens
ggccacctctccaagggctt

SEQ ID NO: 6323387 - DNA, 14 bp, Homo sapiens
ggccacctctgcct

SEQ ID NO: 6323388 - DNA, 15 bp, Homo sapiens
ggccacctctgcctc

SEQ ID NO: 6323389 - DNA, 22 bp, Homo sapiens
ggccacctcttcctggccggtg

SEQ ID NO: 6323390 - DNA, 17 bp, Homo sapiens
ggccacctgaggtgggc

SEQ ID NO: 6323391 - DNA, 21 bp, Homo sapiens
ggccacctgaggtgggcccag

SEQ ID NO: 6323392 - DNA, 23 bp, Homo sapiens
ggccacctgaggtgggcccagga

SEQ ID NO: 6323393 - DNA, 10 bp, Homo sapiens
ggccacctgc

SEQ ID NO: 6323394 - DNA, 11 bp, Homo sapiens
ggccacctgca

SEQ ID NO: 6323395 - DNA, 12 bp, Homo sapiens
ggccacctgcag

SEQ ID NO: 6323396 - DNA, 14 bp, Homo sapiens
ggccacctgcagga

SEQ ID NO: 6323397 - DNA, 16 bp, Homo sapiens
ggccacctgcaggacc

SEQ ID NO: 6323398 - DNA, 23 bp, Homo sapiens
ggccacctgcccccttctcccac

SEQ ID NO: 6323399 - DNA, 13 bp, Homo sapiens
ggccacctgcctg

SEQ ID NO: 6323400 - DNA, 14 bp, Homo sapiens
ggccacctgtagcc

SEQ ID NO: 6323401 - DNA, 22 bp, Homo sapiens
ggccacctgtagccatctgcac

SEQ ID NO: 6323402 - DNA, 17 bp, Homo sapiens
ggccacgcactgggcca

SEQ ID NO: 6323403 - DNA, 24 bp, Homo sapiens
ggccacgcactgggccacggagga

SEQ ID NO: 6323404 - DNA, 14 bp, Homo sapiens
ggccacgcagccag

SEQ ID NO: 6323405 - DNA, 19 bp, Homo sapiens
ggccacgcagccaggacac

SEQ ID NO: 6323406 - DNA, 16 bp, Homo sapiens
ggccacgccccagccc

SEQ ID NO: 6323407 - DNA, 19 bp, Homo sapiens
ggccacgccggccacaccc

SEQ ID NO: 6323408 - DNA, 11 bp, Homo sapiens
ggccacgctcc

SEQ ID NO: 6323409 - DNA, 13 bp, Homo sapiens
ggccacggaggag

SEQ ID NO: 6323410 - DNA, 22 bp, Homo sapiens
ggccacggaggagggatgctgc

SEQ ID NO: 6323411 - DNA, 14 bp, Homo sapiens
ggccacggcccagg

SEQ ID NO: 6323412 - DNA, 16 bp, Homo sapiens
ggccacggcccaggga

SEQ ID NO: 6323413 - DNA, 18 bp, Homo sapiens
ggccacggcccagggagg

SEQ ID NO: 6323414 - DNA, 18 bp, Homo sapiens
ggccacggctgagccttc

SEQ ID NO: 6323415 - DNA, 19 bp, Homo sapiens
ggccacggctgagccttca

SEQ ID NO: 6323416 - DNA, 21 bp, Homo sapiens
ggccacgtatagtcctagctg

SEQ ID NO: 6323417 - DNA, 22 bp, Homo sapiens
ggccacgtatagtcctagctga

SEQ ID NO: 6323418 - DNA, 13 bp, Homo sapiens
ggccacgtccagg

SEQ ID NO: 6323419 - DNA, 21 bp, Homo sapiens
ggccacgtgtgctgtggccag

SEQ ID NO: 6323420 - DNA, 16 bp, Homo sapiens
ggccactaaagcttca

SEQ ID NO: 6323421 - DNA, 18 bp, Homo sapiens
ggccactaaagcttcaga

SEQ ID NO: 6323422 - DNA, 20 bp, Homo sapiens
ggccactaagcagaggaggg

SEQ ID NO: 6323423 - DNA, 18 bp, Homo sapiens
ggccactcagaggccccc

SEQ ID NO: 6323424 - DNA, 20 bp, Homo sapiens
ggccactcagaggcccccag

SEQ ID NO: 6323425 - DNA, 22 bp, Homo sapiens
ggccactccccagtgctcctgt

SEQ ID NO: 6323426 - DNA, 13 bp, Homo sapiens
ggccactccgaga

SEQ ID NO: 6323427 - DNA, 16 bp, Homo sapiens
ggccactcctcttcac

SEQ ID NO: 6323428 - DNA, 23 bp, Homo sapiens
ggccactctcagagactcccagg

SEQ ID NO: 6323429 - DNA, 22 bp, Homo sapiens
ggccactctgcctctgcctgca

SEQ ID NO: 6323430 - DNA, 12 bp, Homo sapiens
ggccactgaaga

SEQ ID NO: 6323431 - DNA, 14 bp, Homo sapiens
ggccactgaagagg

SEQ ID NO: 6323432 - DNA, 19 bp, Homo sapiens
ggccactgaagaggaggag

SEQ ID NO: 6323433 - DNA, 13 bp, Homo sapiens
ggccactgaccca

SEQ ID NO: 6323434 - DNA, 15 bp, Homo sapiens
ggccactgacccacc

SEQ ID NO: 6323435 - DNA, 12 bp, Homo sapiens
ggccactgagct

SEQ ID NO: 6323436 - DNA, 14 bp, Homo sapiens
ggccactgagctgg

SEQ ID NO: 6323437 - DNA, 23 bp, Homo sapiens
ggccactgcaaaccctgctgcct

SEQ ID NO: 6323438 - DNA, 18 bp, Homo sapiens
ggccactgcacagagctc

SEQ ID NO: 6323439 - DNA, 21 bp, Homo sapiens
ggccactgcgccactgccatc

SEQ ID NO: 6323440 - DNA, 19 bp, Homo sapiens
ggccactgcgctcttggga

SEQ ID NO: 6323441 - DNA, 22 bp, Homo sapiens
ggccactgctccctaagccagc

SEQ ID NO: 6323442 - DNA, 16 bp, Homo sapiens
ggccactggatcctgc

SEQ ID NO: 6323443 - DNA, 19 bp, Homo sapiens
ggccactggatcctgctgc

SEQ ID NO: 6323444 - DNA, 22 bp, Homo sapiens
ggccactggcatctctggagtg

SEQ ID NO: 6323445 - DNA, 18 bp, Homo sapiens
ggccactggccatctcca

SEQ ID NO: 6323446 - DNA, 14 bp, Homo sapiens
ggccactggccctg

SEQ ID NO: 6323447 - DNA, 17 bp, Homo sapiens
ggccactggccctgttt

SEQ ID NO: 6323448 - DNA, 20 bp, Homo sapiens
ggccactgggccccattctc

SEQ ID NO: 6323449 - DNA, 14 bp, Homo sapiens
ggccactggggact

SEQ ID NO: 6323450 - DNA, 22 bp, Homo sapiens
ggccactggggtgccttcactg

SEQ ID NO: 6323451 - DNA, 23 bp, Homo sapiens
ggccactggggtgccttcactgg

SEQ ID NO: 6323452 - DNA, 22 bp, Homo sapiens
ggccactgggtctcactcctga

SEQ ID NO: 6323453 - DNA, 15 bp, Homo sapiens
ggccactgtccctgt

SEQ ID NO: 6323454 - DNA, 13 bp, Homo sapiens
ggccactgtggcc

SEQ ID NO: 6323455 - DNA, 21 bp, Homo sapiens
ggccactgtgggtgaagcgcc

SEQ ID NO: 6323456 - DNA, 18 bp, Homo sapiens
ggccactgtgtctctgtt

SEQ ID NO: 6323457 - DNA, 16 bp, Homo sapiens
ggccactgtgtttctg

SEQ ID NO: 6323458 - DNA, 20 bp, Homo sapiens
ggccactgtgtttctgtgct

SEQ ID NO: 6323459 - DNA, 22 bp, Homo sapiens
ggccactgtgtttctgtgctcc

SEQ ID NO: 6323460 - DNA, 22 bp, Homo sapiens
ggccacttcattccagcagctg

SEQ ID NO: 6323461 - DNA, 15 bp, Homo sapiens
ggccacttctgtcca

SEQ ID NO: 6323462 - DNA, 21 bp, Homo sapiens
ggccactttaagagagaaatc

SEQ ID NO: 6323463 - DNA, 17 bp, Homo sapiens
ggccactttcagagccc

SEQ ID NO: 6323464 - DNA, 17 bp, Homo sapiens
ggccagaaaaagaagaa

SEQ ID NO: 6323465 - DNA, 18 bp, Homo sapiens
ggccagaaaaagaagaag

SEQ ID NO: 6323466 - DNA, 19 bp, Homo sapiens
ggccagaaaaagaagaagg

SEQ ID NO: 6323467 - DNA, 21 bp, Homo sapiens
ggccagaaaaagaagaaggag

SEQ ID NO: 6323468 - DNA, 15 bp, Homo sapiens
ggccagaaaaatttg

SEQ ID NO: 6323469 - DNA, 20 bp, Homo sapiens
ggccagaaaaggcagccaga

SEQ ID NO: 6323470 - DNA, 21 bp, Homo sapiens
ggccagaaaggtgtgaggaga

SEQ ID NO: 6323471 - DNA, 13 bp, Homo sapiens
ggccagaaggagg

SEQ ID NO: 6323472 - DNA, 16 bp, Homo sapiens
ggccagaaggagggca

SEQ ID NO: 6323473 - DNA, 20 bp, Homo sapiens
ggccagaaggagggcagagc

SEQ ID NO: 6323474 - DNA, 22 bp, Homo sapiens
ggccagaaggagggcagagcca

SEQ ID NO: 6323475 - DNA, 12 bp, Homo sapiens
ggccagaagtac

SEQ ID NO: 6323476 - DNA, 17 bp, Homo sapiens
ggccagaagtagctttg

SEQ ID NO: 6323477 - DNA, 13 bp, Homo sapiens
ggccagacacaga

SEQ ID NO: 6323478 - DNA, 17 bp, Homo sapiens
ggccagacacaggccct

SEQ ID NO: 6323479 - DNA, 18 bp, Homo sapiens
ggccagacacaggccctc

SEQ ID NO: 6323480 - DNA, 18 bp, Homo sapiens
ggccagacacaggccgtg

SEQ ID NO: 6323481 - DNA, 20 bp, Homo sapiens
ggccagacacaggccgtggg

SEQ ID NO: 6323482 - DNA, 22 bp, Homo sapiens
ggccagacacaggccgtgggac

SEQ ID NO: 6323483 - DNA, 19 bp, Homo sapiens
ggccagacagaccttcaca

SEQ ID NO: 6323484 - DNA, 18 bp, Homo sapiens
ggccagacatgccacaag

SEQ ID NO: 6323485 - DNA, 19 bp, Homo sapiens
ggccagaccacgcccctgc

SEQ ID NO: 6323486 - DNA, 18 bp, Homo sapiens
ggccagaccagagctctg

SEQ ID NO: 6323487 - DNA, 15 bp, Homo sapiens
ggccagacctgcaga

SEQ ID NO: 6323488 - DNA, 18 bp, Homo sapiens
ggccagacctgcagacgc

SEQ ID NO: 6323489 - DNA, 21 bp, Homo sapiens
ggccagactggctgcacagcc

SEQ ID NO: 6323490 - DNA, 22 bp, Homo sapiens
ggccagactggctgcacagccc

SEQ ID NO: 6323491 - DNA, 23 bp, Homo sapiens
ggccagagaaagcaaaggtgcac

SEQ ID NO: 6323492 - DNA, 17 bp, Homo sapiens
ggccagagacacaagcc

SEQ ID NO: 6323493 - DNA, 15 bp, Homo sapiens
ggccagagagcaggg

SEQ ID NO: 6323494 - DNA, 20 bp, Homo sapiens
ggccagagagcaggggagct

SEQ ID NO: 6323495 - DNA, 22 bp, Homo sapiens
ggccagagagcaggggagcttg

SEQ ID NO: 6323496 - DNA, 18 bp, Homo sapiens
ggccagagagcctggtgc

SEQ ID NO: 6323497 - DNA, 16 bp, Homo sapiens
ggccagagagggaaaa

SEQ ID NO: 6323498 - DNA, 19 bp, Homo sapiens
ggccagagagggcccagct

SEQ ID NO: 6323499 - DNA, 20 bp, Homo sapiens
ggccagagagggcccagctg

SEQ ID NO: 6323500 - DNA, 21 bp, Homo sapiens
ggccagagcaaacagaaaaag

SEQ ID NO: 6323501 - DNA, 19 bp, Homo sapiens
ggccagagcacctcaggac

SEQ ID NO: 6323502 - DNA, 15 bp, Homo sapiens
ggccagagcagctcc

SEQ ID NO: 6323503 - DNA, 22 bp, Homo sapiens
ggccagagcagctccaccactg

SEQ ID NO: 6323504 - DNA, 12 bp, Homo sapiens
ggccagagccag

SEQ ID NO: 6323505 - DNA, 15 bp, Homo sapiens
ggccagagcctctgg

SEQ ID NO: 6323506 - DNA, 17 bp, Homo sapiens
ggccagagcctctggcc

SEQ ID NO: 6323507 - DNA, 18 bp, Homo sapiens
ggccagagcctctggccc

SEQ ID NO: 6323508 - DNA, 12 bp, Homo sapiens
ggccagagcctg

SEQ ID NO: 6323509 - DNA, 17 bp, Homo sapiens
ggccagagctagggctg

SEQ ID NO: 6323510 - DNA, 20 bp, Homo sapiens
ggccagagctagggctgctg

SEQ ID NO: 6323511 - DNA, 22 bp, Homo sapiens
ggccagagctagggctgctgct

SEQ ID NO: 6323512 - DNA, 23 bp, Homo sapiens
ggccagagctagggctgctgctt

SEQ ID NO: 6323513 - DNA, 11 bp, Homo sapiens
ggccagagctc

SEQ ID NO: 6323514 - DNA, 16 bp, Homo sapiens
ggccagagctcccagg

SEQ ID NO: 6323515 - DNA, 13 bp, Homo sapiens
ggccagagctgaa

SEQ ID NO: 6323516 - DNA, 13 bp, Homo sapiens
ggccagagctgga

SEQ ID NO: 6323517 - DNA, 15 bp, Homo sapiens
ggccagagctggaag

SEQ ID NO: 6323518 - DNA, 13 bp, Homo sapiens
ggccagaggaagg

SEQ ID NO: 6323519 - DNA, 16 bp, Homo sapiens
ggccagaggaagggag

SEQ ID NO: 6323520 - DNA, 17 bp, Homo sapiens
ggccagaggcagaaccc

SEQ ID NO: 6323521 - DNA, 19 bp, Homo sapiens
ggccagaggcagaaccctg

SEQ ID NO: 6323522 - DNA, 21 bp, Homo sapiens
ggccagaggcccccagcccag

SEQ ID NO: 6323523 - DNA, 23 bp, Homo sapiens
ggccagaggctcgaggggctcag

SEQ ID NO: 6323524 - DNA, 12 bp, Homo sapiens
ggccagagggac

SEQ ID NO: 6323525 - DNA, 21 bp, Homo sapiens
ggccagagggactttgcctgc

SEQ ID NO: 6323526 - DNA, 13 bp, Homo sapiens
ggccagagggagc

SEQ ID NO: 6323527 - DNA, 17 bp, Homo sapiens
ggccagagggagtgaca

SEQ ID NO: 6323528 - DNA, 19 bp, Homo sapiens
ggccagagggagtgacaga

SEQ ID NO: 6323529 - DNA, 22 bp, Homo sapiens
ggccagagggagtgacagaggc

SEQ ID NO: 6323530 - DNA, 15 bp, Homo sapiens
ggccagagggcccct

SEQ ID NO: 6323531 - DNA, 15 bp, Homo sapiens
ggccagagtggcctg

SEQ ID NO: 6323532 - DNA, 21 bp, Homo sapiens
ggccagatctgttaagtggtt

SEQ ID NO: 6323533 - DNA, 23 bp, Homo sapiens
ggccagatgattttcctccctgg

SEQ ID NO: 6323534 - DNA, 20 bp, Homo sapiens
ggccagatgcaccagccctt

SEQ ID NO: 6323535 - DNA, 23 bp, Homo sapiens
ggccagatggcccggatgctgct

SEQ ID NO: 6323536 - DNA, 18 bp, Homo sapiens
ggccagattgtggggtgc

SEQ ID NO: 6323537 - DNA, 19 bp, Homo sapiens
ggccagattgtggggtgca

SEQ ID NO: 6323538 - DNA, 19 bp, Homo sapiens
ggccagcaaaaactgtggg

SEQ ID NO: 6323539 - DNA, 22 bp, Homo sapiens
ggccagcaaaaactgtgggaag

SEQ ID NO: 6323540 - DNA, 22 bp, Homo sapiens
ggccagcaaggtggagtggatg

SEQ ID NO: 6323541 - DNA, 23 bp, Homo sapiens
ggccagcaaggtggagtggatgc

SEQ ID NO: 6323542 - DNA, 16 bp, Homo sapiens
ggccagcacagctgag

SEQ ID NO: 6323543 - DNA, 20 bp, Homo sapiens
ggccagcacccaaagggtta

SEQ ID NO: 6323544 - DNA, 17 bp, Homo sapiens
ggccagcaccctctcct

SEQ ID NO: 6323545 - DNA, 12 bp, Homo sapiens
ggccagcagagg

SEQ ID NO: 6323546 - DNA, 14 bp, Homo sapiens
ggccagcagagggc

SEQ ID NO: 6323547 - DNA, 18 bp, Homo sapiens
ggccagcagcacctgccc

SEQ ID NO: 6323548 - DNA, 11 bp, Homo sapiens
ggccagcagcc

SEQ ID NO: 6323549 - DNA, 18 bp, Homo sapiens
ggccagcagctgatgctg

SEQ ID NO: 6323550 - DNA, 20 bp, Homo sapiens
ggccagcagctgatgctgta

SEQ ID NO: 6323551 - DNA, 14 bp, Homo sapiens
ggccagcaggcagc

SEQ ID NO: 6323552 - DNA, 17 bp, Homo sapiens
ggccagcaggcagcgcc

SEQ ID NO: 6323553 - DNA, 14 bp, Homo sapiens
gtcctactcctgga

SEQ ID NO: 6323554 - DNA, 15 bp, Homo sapiens
gtcctactctgtgtc

SEQ ID NO: 6323555 - DNA, 23 bp, Homo sapiens
gtcctactctgtgtcaggtgggg

SEQ ID NO: 6323556 - DNA, 17 bp, Homo sapiens
gtcctagacttcaggga

SEQ ID NO: 6323557 - DNA, 14 bp, Homo sapiens
gtcctagagctcct

SEQ ID NO: 6323558 - DNA, 19 bp, Homo sapiens
gtcctagagctcctgtccc

SEQ ID NO: 6323559 - DNA, 22 bp, Homo sapiens
gtcctagaggccctttgctgtc

SEQ ID NO: 6323560 - DNA, 21 bp, Homo sapiens
gtcctagcacagatggccagc

SEQ ID NO: 6323561 - DNA, 18 bp, Homo sapiens
gtcctagccactcaggag

SEQ ID NO: 6323562 - DNA, 19 bp, Homo sapiens
gtcctagccactcaggagg

SEQ ID NO: 6323563 - DNA, 15 bp, Homo sapiens
gtcctagcccttccc

SEQ ID NO: 6323564 - DNA, 16 bp, Homo sapiens
gtcctagctcttacac

SEQ ID NO: 6323565 - DNA, 20 bp, Homo sapiens
gtcctagctgcacagggcag

SEQ ID NO: 6323566 - DNA, 13 bp, Homo sapiens
gtcctagctgtta

SEQ ID NO: 6323567 - DNA, 19 bp, Homo sapiens
gtcctaggagtatcctcat

SEQ ID NO: 6323568 - DNA, 22 bp, Homo sapiens
gtcctaggccacaccatctcct

SEQ ID NO: 6323569 - DNA, 17 bp, Homo sapiens
gtcctaggctggaagga

SEQ ID NO: 6323570 - DNA, 13 bp, Homo sapiens
gtcctaggtcatg

SEQ ID NO: 6323571 - DNA, 17 bp, Homo sapiens
gtcctaggtcatgaagg

SEQ ID NO: 6323572 - DNA, 20 bp, Homo sapiens
gtcctaggtcctctgaggca

SEQ ID NO: 6323573 - DNA, 16 bp, Homo sapiens
gtcctagtcgggcagg

SEQ ID NO: 6323574 - DNA, 13 bp, Homo sapiens
gtcctagttgtcc

SEQ ID NO: 6323575 - DNA, 18 bp, Homo sapiens
gtcctatccaaaggaatc

SEQ ID NO: 6323576 - DNA, 19 bp, Homo sapiens
gtcctatccaaaggaatca

SEQ ID NO: 6323577 - DNA, 20 bp, Homo sapiens
gtcctatctgggcttcctgg

SEQ ID NO: 6323578 - DNA, 20 bp, Homo sapiens
gtcctatgaatgctttgcat

SEQ ID NO: 6323579 - DNA, 21 bp, Homo sapiens
gtcctatgtatatcttctaca

SEQ ID NO: 6323580 - DNA, 21 bp, Homo sapiens
gtcctattagtgttatatgaa

SEQ ID NO: 6323581 - DNA, 22 bp, Homo sapiens
gtcctattgtgactcttctaaa

SEQ ID NO: 6323582 - DNA, 15 bp, Homo sapiens
gtcctatttttgtga

SEQ ID NO: 6323583 - DNA, 20 bp, Homo sapiens
gtcctcaaagaagtggttct

SEQ ID NO: 6323584 - DNA, 20 bp, Homo sapiens
gtcctcaaggggccatcctg

SEQ ID NO: 6323585 - DNA, 20 bp, Homo sapiens
gtcctcacacacggaggcca

SEQ ID NO: 6323586 - DNA, 14 bp, Homo sapiens
gtcctcacagcagt

SEQ ID NO: 6323587 - DNA, 16 bp, Homo sapiens
gtcctcacagcagtca

SEQ ID NO: 6323588 - DNA, 21 bp, Homo sapiens
gtcctcacagcagtcacaggc

SEQ ID NO: 6323589 - DNA, 22 bp, Homo sapiens
gtcctcacagcagtcacaggcc

SEQ ID NO: 6323590 - DNA, 17 bp, Homo sapiens
gtcctcacagcctagga

SEQ ID NO: 6323591 - DNA, 16 bp, Homo sapiens
gtcctcacagcctctc

SEQ ID NO: 6323592 - DNA, 18 bp, Homo sapiens
gtcctcacatctttcaca

SEQ ID NO: 6323593 - DNA, 21 bp, Homo sapiens
gtcctcacccctgtcctcact

SEQ ID NO: 6323594 - DNA, 16 bp, Homo sapiens
gtcctcactcccagtc

SEQ ID NO: 6323595 - DNA, 17 bp, Homo sapiens
gtcctcactcccagtcc

SEQ ID NO: 6323596 - DNA, 20 bp, Homo sapiens
gtcctcactgctccctgaag

SEQ ID NO: 6323597 - DNA, 24 bp, Homo sapiens
gtcctcacttctagatctcagcca

SEQ ID NO: 6323598 - DNA, 16 bp, Homo sapiens
gtcctcacttggggga

SEQ ID NO: 6323599 - DNA, 16 bp, Homo sapiens
gtcctcagagctccat

SEQ ID NO: 6323600 - DNA, 12 bp, Homo sapiens
gtcctcagatgg

SEQ ID NO: 6323601 - DNA, 21 bp, Homo sapiens
gtcctcagatgggaattgcac

SEQ ID NO: 6323602 - DNA, 19 bp, Homo sapiens
gtcctcagcaccccactcc

SEQ ID NO: 6323603 - DNA, 13 bp, Homo sapiens
gtcctcagccagt

SEQ ID NO: 6323604 - DNA, 13 bp, Homo sapiens
gtcctcagcttct

SEQ ID NO: 6323605 - DNA, 17 bp, Homo sapiens
gtcctcagcttcttaat

SEQ ID NO: 6323606 - DNA, 15 bp, Homo sapiens
gtcctcagcttgggc

SEQ ID NO: 6323607 - DNA, 16 bp, Homo sapiens
gtcctcagcttgggct

SEQ ID NO: 6323608 - DNA, 13 bp, Homo sapiens
gtcctcagggagc

SEQ ID NO: 6323609 - DNA, 18 bp, Homo sapiens
gtcctcaggtcagctggg

SEQ ID NO: 6323610 - DNA, 21 bp, Homo sapiens
gtcctcaggtcagctgggagc

SEQ ID NO: 6323611 - DNA, 17 bp, Homo sapiens
gtcctcaggtgaataac

SEQ ID NO: 6323612 - DNA, 16 bp, Homo sapiens
gtcctcaggtggccat

SEQ ID NO: 6323613 - DNA, 23 bp, Homo sapiens
gtcctcatctataaaatgaggga

SEQ ID NO: 6323614 - DNA, 14 bp, Homo sapiens
gtcctcatgtgaga

SEQ ID NO: 6323615 - DNA, 17 bp, Homo sapiens
gtcctcattcaaaggga

SEQ ID NO: 6323616 - DNA, 14 bp, Homo sapiens
gtcctcattcttct

SEQ ID NO: 6323617 - DNA, 17 bp, Homo sapiens
gtcctcattgaatcctc

SEQ ID NO: 6323618 - DNA, 23 bp, Homo sapiens
gtcctcattgttcagaaaagcac

SEQ ID NO: 6323619 - DNA, 17 bp, Homo sapiens
gtcctcatttctccaga

SEQ ID NO: 6323620 - DNA, 20 bp, Homo sapiens
gtcctccaaagactgaagga

SEQ ID NO: 6323621 - DNA, 21 bp, Homo sapiens
gtcctccaaagactgaaggag

SEQ ID NO: 6323622 - DNA, 22 bp, Homo sapiens
gtcctccaacaccaagcacagc

SEQ ID NO: 6323623 - DNA, 14 bp, Homo sapiens
gtcctccacaataa

SEQ ID NO: 6323624 - DNA, 13 bp, Homo sapiens
gtcctccaccatg

SEQ ID NO: 6323625 - DNA, 16 bp, Homo sapiens
gtcctccaccggtgcc

SEQ ID NO: 6323626 - DNA, 21 bp, Homo sapiens
gtcctccactcgacccagaat

SEQ ID NO: 6323627 - DNA, 20 bp, Homo sapiens
gtcctccactttgctggttc

SEQ ID NO: 6323628 - DNA, 12 bp, Homo sapiens
gtcctccagaac

SEQ ID NO: 6323629 - DNA, 13 bp, Homo sapiens
gtcctccagaact

SEQ ID NO: 6323630 - DNA, 13 bp, Homo sapiens
gtcctccagaagc

SEQ ID NO: 6323631 - DNA, 22 bp, Homo sapiens
gtcctccagaagcctctggcta

SEQ ID NO: 6323632 - DNA, 15 bp, Homo sapiens
gtcctccagcttccc

SEQ ID NO: 6323633 - DNA, 15 bp, Homo sapiens
gtcctccaggagctt

SEQ ID NO: 6323634 - DNA, 13 bp, Homo sapiens
gtcctccagggcg

SEQ ID NO: 6323635 - DNA, 16 bp, Homo sapiens
gtcctccagggcgagc

SEQ ID NO: 6323636 - DNA, 19 bp, Homo sapiens
gtcctccatcacccctggt

SEQ ID NO: 6323637 - DNA, 12 bp, Homo sapiens
gtcctccatcca

SEQ ID NO: 6323638 - DNA, 22 bp, Homo sapiens
gtcctccatccacgtggcctct

SEQ ID NO: 6323639 - DNA, 13 bp, Homo sapiens
gtcctccatttca

SEQ ID NO: 6323640 - DNA, 20 bp, Homo sapiens
gtcctccatttcaactccag

SEQ ID NO: 6323641 - DNA, 14 bp, Homo sapiens
gtcctcccaagctg

SEQ ID NO: 6323642 - DNA, 17 bp, Homo sapiens
gtcctcccaagctgtgc

SEQ ID NO: 6323643 - DNA, 20 bp, Homo sapiens
gtcctcccaagctgtgctgg

SEQ ID NO: 6323644 - DNA, 18 bp, Homo sapiens
gtcctcccacagacctgc

SEQ ID NO: 6323645 - DNA, 19 bp, Homo sapiens
gtcctcccacagacctgca

SEQ ID NO: 6323646 - DNA, 21 bp, Homo sapiens
gtcctcccacccctccccact

SEQ ID NO: 6323647 - DNA, 14 bp, Homo sapiens
gtcctcccacccta

SEQ ID NO: 6323648 - DNA, 15 bp, Homo sapiens
gtcctcccagctcct

SEQ ID NO: 6323649 - DNA, 11 bp, Homo sapiens
gtcctcccagg

SEQ ID NO: 6323650 - DNA, 12 bp, Homo sapiens
gtcctcccagga

SEQ ID NO: 6323651 - DNA, 13 bp, Homo sapiens
gtcctcccatccc

SEQ ID NO: 6323652 - DNA, 17 bp, Homo sapiens
gtcctcccatcccctca

SEQ ID NO: 6323653 - DNA, 19 bp, Homo sapiens
gtcctcccatcccctggac

SEQ ID NO: 6323654 - DNA, 13 bp, Homo sapiens
gtcctcccatctc

SEQ ID NO: 6323655 - DNA, 23 bp, Homo sapiens
gtcctcccatctcacacatgagc

SEQ ID NO: 6323656 - DNA, 13 bp, Homo sapiens
gtcctcccatttc

SEQ ID NO: 6323657 - DNA, 16 bp, Homo sapiens
gtcctccccctgccag

SEQ ID NO: 6323658 - DNA, 20 bp, Homo sapiens
gtcctccccctgccagtgcc

SEQ ID NO: 6323659 - DNA, 21 bp, Homo sapiens
gtcctccccctgccagtgcct

SEQ ID NO: 6323660 - DNA, 16 bp, Homo sapiens
gtcctcccctcaagga

SEQ ID NO: 6323661 - DNA, 18 bp, Homo sapiens
gtcctcccctcacagcct

SEQ ID NO: 6323662 - DNA, 20 bp, Homo sapiens
gtcctcccctcacagcctct

SEQ ID NO: 6323663 - DNA, 21 bp, Homo sapiens
gtcctcccctcacagcctctg

SEQ ID NO: 6323664 - DNA, 14 bp, Homo sapiens
gtcctcccctctct

SEQ ID NO: 6323665 - DNA, 15 bp, Homo sapiens
gtcctccccttgggc

SEQ ID NO: 6323666 - DNA, 16 bp, Homo sapiens
gtcctcccgagctcct

SEQ ID NO: 6323667 - DNA, 13 bp, Homo sapiens
gtcctcccgggag

SEQ ID NO: 6323668 - DNA, 15 bp, Homo sapiens
gtcctcccgggccct

SEQ ID NO: 6323669 - DNA, 21 bp, Homo sapiens
gtcctcccgggccctcccttg

SEQ ID NO: 6323670 - DNA, 14 bp, Homo sapiens
gtcctccctagctc

SEQ ID NO: 6323671 - DNA, 11 bp, Homo sapiens
gtcctccctca

SEQ ID NO: 6323672 - DNA, 14 bp, Homo sapiens
gtcctccctcaccc

SEQ ID NO: 6323673 - DNA, 13 bp, Homo sapiens
gtcctccctcagc

SEQ ID NO: 6323674 - DNA, 16 bp, Homo sapiens
gtcctccctcagcctc

SEQ ID NO: 6323675 - DNA, 17 bp, Homo sapiens
gtcctccctcagcctcc

SEQ ID NO: 6323676 - DNA, 18 bp, Homo sapiens
gtcctccctcagcctccc

SEQ ID NO: 6323677 - DNA, 20 bp, Homo sapiens
gtcctccctcagcctcccct

SEQ ID NO: 6323678 - DNA, 22 bp, Homo sapiens
gtcctccctccctcccttcctt

SEQ ID NO: 6323679 - DNA, 20 bp, Homo sapiens
gtcctccctcctgcaggctg

SEQ ID NO: 6323680 - DNA, 19 bp, Homo sapiens
gtcctccctgatcccaccc

SEQ ID NO: 6323681 - DNA, 22 bp, Homo sapiens
gtcctccctgatcccaccccct

SEQ ID NO: 6323682 - DNA, 17 bp, Homo sapiens
gtcctccctgctcagct

SEQ ID NO: 6323683 - DNA, 16 bp, Homo sapiens
gtcctccgcctactgt

SEQ ID NO: 6323684 - DNA, 16 bp, Homo sapiens
gtcctccggggctcag

SEQ ID NO: 6323685 - DNA, 18 bp, Homo sapiens
gtcctccggggctcagcc

SEQ ID NO: 6323686 - DNA, 23 bp, Homo sapiens
gtcctccggggctcagccctgag

SEQ ID NO: 6323687 - DNA, 13 bp, Homo sapiens
gtcctcctaagtc

SEQ ID NO: 6323688 - DNA, 20 bp, Homo sapiens
gtcctcctagaactccagta

SEQ ID NO: 6323689 - DNA, 23 bp, Homo sapiens
gtcctcctatctccctggctcac

SEQ ID NO: 6323690 - DNA, 17 bp, Homo sapiens
gtcctcctcacctcatg

SEQ ID NO: 6323691 - DNA, 18 bp, Homo sapiens
gtcctcctccagggacag

SEQ ID NO: 6323692 - DNA, 17 bp, Homo sapiens
gtcctcctctacctctc

SEQ ID NO: 6323693 - DNA, 15 bp, Homo sapiens
gtcctcctctctcta

SEQ ID NO: 6323694 - DNA, 18 bp, Homo sapiens
gtcctcctctgaggaagc

SEQ ID NO: 6323695 - DNA, 12 bp, Homo sapiens
gtcctcctctgt

SEQ ID NO: 6323696 - DNA, 18 bp, Homo sapiens
gtcctcctgctctgcttc

SEQ ID NO: 6323697 - DNA, 19 bp, Homo sapiens
gtcctcctgctctgcttcc

SEQ ID NO: 6323698 - DNA, 13 bp, Homo sapiens
gtcctcctggcac

SEQ ID NO: 6323699 - DNA, 21 bp, Homo sapiens
gtcctcctggcacctgagtgt

SEQ ID NO: 6323700 - DNA, 14 bp, Homo sapiens
gtcctcctgggagc

SEQ ID NO: 6323701 - DNA, 17 bp, Homo sapiens
gtcctcctgtgctattt

SEQ ID NO: 6323702 - DNA, 19 bp, Homo sapiens
gtcctcctgtgctatttgt

SEQ ID NO: 6323703 - DNA, 22 bp, Homo sapiens
gtcctcctgttcatctgtgcac

SEQ ID NO: 6323704 - DNA, 13 bp, Homo sapiens
gtcctccttccca

SEQ ID NO: 6323705 - DNA, 16 bp, Homo sapiens
gtcctccttcccagct

SEQ ID NO: 6323706 - DNA, 17 bp, Homo sapiens
gtcctccttcccagctc

SEQ ID NO: 6323707 - DNA, 12 bp, Homo sapiens
gtcctccttcct

SEQ ID NO: 6323708 - DNA, 15 bp, Homo sapiens
gtcctccttcctggg

SEQ ID NO: 6323709 - DNA, 17 bp, Homo sapiens
gtcctcctttctgaggg

SEQ ID NO: 6323710 - DNA, 22 bp, Homo sapiens
gtcctcctttcttattctgtga

SEQ ID NO: 6323711 - DNA, 23 bp, Homo sapiens
gtcctcgaattttatctgtggag

SEQ ID NO: 6323712 - DNA, 20 bp, Homo sapiens
gtcctcgccccccgcccggc

SEQ ID NO: 6323713 - DNA, 23 bp, Homo sapiens
gtcctcgccccccgcccggcctc

SEQ ID NO: 6323714 - DNA, 13 bp, Homo sapiens
gtcctcggccctg

SEQ ID NO: 6323715 - DNA, 14 bp, Homo sapiens
gtcctcggccctgt

SEQ ID NO: 6323716 - DNA, 15 bp, Homo sapiens
gtcctcgggcccctg

SEQ ID NO: 6323717 - DNA, 17 bp, Homo sapiens
gtcctcgggcccctgag

SEQ ID NO: 6323718 - DNA, 22 bp, Homo sapiens
gtcctcgtggcggggcagcagg

SEQ ID NO: 6323719 - DNA, 23 bp, Homo sapiens
gtcctctagcccactccctgcct

SEQ ID NO: 6323720 - DNA, 20 bp, Homo sapiens
gtcctctcagttctctccct

SEQ ID NO: 6323721 - DNA, 23 bp, Homo sapiens
gtcctctcagttctctcccttcc

SEQ ID NO: 6323722 - DNA, 21 bp, Homo sapiens
gtcctctcatcccagtcctga

SEQ ID NO: 6323723 - DNA, 13 bp, Homo sapiens
gtcctctccacct

SEQ ID NO: 6323724 - DNA, 14 bp, Homo sapiens
gtcctctccaccta

SEQ ID NO: 6323725 - DNA, 12 bp, Homo sapiens
gtcctctccagc

SEQ ID NO: 6323726 - DNA, 11 bp, Homo sapiens
gtcctctcccc

SEQ ID NO: 6323727 - DNA, 17 bp, Homo sapiens
gtcctctccccagcctg

SEQ ID NO: 6323728 - DNA, 20 bp, Homo sapiens
gtcctctccccagcctggca

SEQ ID NO: 6323729 - DNA, 13 bp, Homo sapiens
gtcctctccccct

SEQ ID NO: 6323730 - DNA, 21 bp, Homo sapiens
gtcctctcccccttcagctcc

SEQ ID NO: 6323731 - DNA, 19 bp, Homo sapiens
gtcctctcccctccagcct

SEQ ID NO: 6323732 - DNA, 17 bp, Homo sapiens
ggccagcaggcgggctc

SEQ ID NO: 6323733 - DNA, 15 bp, Homo sapiens
ggccagcaggctcct

SEQ ID NO: 6323734 - DNA, 17 bp, Homo sapiens
ggccagcaggctcctgg

SEQ ID NO: 6323735 - DNA, 17 bp, Homo sapiens
ggccagcatagggggga

SEQ ID NO: 6323736 - DNA, 22 bp, Homo sapiens
ggccagcatccatgcggccggc

SEQ ID NO: 6323737 - DNA, 21 bp, Homo sapiens
ggccagccaatttcccggagc

SEQ ID NO: 6323738 - DNA, 14 bp, Homo sapiens
ggccagccacacca

SEQ ID NO: 6323739 - DNA, 15 bp, Homo sapiens
ggccagccagccact

SEQ ID NO: 6323740 - DNA, 11 bp, Homo sapiens
ggccagccagg

SEQ ID NO: 6323741 - DNA, 22 bp, Homo sapiens
ggccagccagtgccattccact

SEQ ID NO: 6323742 - DNA, 13 bp, Homo sapiens
ggccagcccactg

SEQ ID NO: 6323743 - DNA, 20 bp, Homo sapiens
ggccagcccactgggccctg

SEQ ID NO: 6323744 - DNA, 21 bp, Homo sapiens
ggccagcccactgggccctgg

SEQ ID NO: 6323745 - DNA, 23 bp, Homo sapiens
ggccagcccactgggccctgggg

SEQ ID NO: 6323746 - DNA, 14 bp, Homo sapiens
ggccagcccagatg

SEQ ID NO: 6323747 - DNA, 14 bp, Homo sapiens
ggccagcccagcca

SEQ ID NO: 6323748 - DNA, 17 bp, Homo sapiens
ggccagcccagccaggc

SEQ ID NO: 6323749 - DNA, 14 bp, Homo sapiens
ggccagcccaggat

SEQ ID NO: 6323750 - DNA, 15 bp, Homo sapiens
ggccagccccacagc

SEQ ID NO: 6323751 - DNA, 13 bp, Homo sapiens
ggccagccccacc

SEQ ID NO: 6323752 - DNA, 20 bp, Homo sapiens
ggccagccccacccccagcc

SEQ ID NO: 6323753 - DNA, 22 bp, Homo sapiens
ggccagccccacccccagccag

SEQ ID NO: 6323754 - DNA, 14 bp, Homo sapiens
ggccagccccatct

SEQ ID NO: 6323755 - DNA, 17 bp, Homo sapiens
ggccagcccccccaccc

SEQ ID NO: 6323756 - DNA, 12 bp, Homo sapiens
ggccagcccctc

SEQ ID NO: 6323757 - DNA, 13 bp, Homo sapiens
ggccagcccctcc

SEQ ID NO: 6323758 - DNA, 17 bp, Homo sapiens
ggccagcccctccatct

SEQ ID NO: 6323759 - DNA, 13 bp, Homo sapiens
ggccagcccttcc

SEQ ID NO: 6323760 - DNA, 15 bp, Homo sapiens
ggccagcccttcctc

SEQ ID NO: 6323761 - DNA, 13 bp, Homo sapiens
ggccagcccttgc

SEQ ID NO: 6323762 - DNA, 19 bp, Homo sapiens
ggccagccgattcctccag

SEQ ID NO: 6323763 - DNA, 22 bp, Homo sapiens
ggccagccgcgggactgacacc

SEQ ID NO: 6323764 - DNA, 21 bp, Homo sapiens
ggccagccgctctcctgccac

SEQ ID NO: 6323765 - DNA, 22 bp, Homo sapiens
ggccagcctagcccttgtccct

SEQ ID NO: 6323766 - DNA, 18 bp, Homo sapiens
ggccagcctcacccttgc

SEQ ID NO: 6323767 - DNA, 15 bp, Homo sapiens
ggccagcctcagctc

SEQ ID NO: 6323768 - DNA, 23 bp, Homo sapiens
ggccagcctcagctcagcctccc

SEQ ID NO: 6323769 - DNA, 16 bp, Homo sapiens
ggccagcctccgagag

SEQ ID NO: 6323770 - DNA, 19 bp, Homo sapiens
ggccagcctccgagaggga

SEQ ID NO: 6323771 - DNA, 11 bp, Homo sapiens
ggccagcctct

SEQ ID NO: 6323772 - DNA, 13 bp, Homo sapiens
ggccagcctggat

SEQ ID NO: 6323773 - DNA, 17 bp, Homo sapiens
ggccagcctggcatcag

SEQ ID NO: 6323774 - DNA, 15 bp, Homo sapiens
ggccagcctggcctc

SEQ ID NO: 6323775 - DNA, 16 bp, Homo sapiens
ggccagcctggcctcc

SEQ ID NO: 6323776 - DNA, 18 bp, Homo sapiens
ggccagcctggcctcctg

SEQ ID NO: 6323777 - DNA, 21 bp, Homo sapiens
ggccagcctggcctcctgcct

SEQ ID NO: 6323778 - DNA, 19 bp, Homo sapiens
ggccagcctggggcctggc

SEQ ID NO: 6323779 - DNA, 20 bp, Homo sapiens
ggccagcctggggcctggca

SEQ ID NO: 6323780 - DNA, 20 bp, Homo sapiens
ggccagccttgaccattctc

SEQ ID NO: 6323781 - DNA, 22 bp, Homo sapiens
ggccagccttgaccattctcca

SEQ ID NO: 6323782 - DNA, 22 bp, Homo sapiens
ggccagccttgtacagtctgct

SEQ ID NO: 6323783 - DNA, 22 bp, Homo sapiens
ggccagcgagcgcccagctcct

SEQ ID NO: 6323784 - DNA, 19 bp, Homo sapiens
ggccagcgagtggtcaagg

SEQ ID NO: 6323785 - DNA, 17 bp, Homo sapiens
ggccagcggccctccca

SEQ ID NO: 6323786 - DNA, 18 bp, Homo sapiens
ggccagcggccctcccag

SEQ ID NO: 6323787 - DNA, 19 bp, Homo sapiens
ggccagcggccctcccagg

SEQ ID NO: 6323788 - DNA, 20 bp, Homo sapiens
ggccagcggccctcccaggc

SEQ ID NO: 6323789 - DNA, 14 bp, Homo sapiens
ggccagcgggcaca

SEQ ID NO: 6323790 - DNA, 15 bp, Homo sapiens
ggccagcgggcacag

SEQ ID NO: 6323791 - DNA, 18 bp, Homo sapiens
ggccagcgggcacagggc

SEQ ID NO: 6323792 - DNA, 19 bp, Homo sapiens
ggccagcgggcacagggca

SEQ ID NO: 6323793 - DNA, 16 bp, Homo sapiens
ggccagcggggctgct

SEQ ID NO: 6323794 - DNA, 19 bp, Homo sapiens
ggccagcggggctgctcac

SEQ ID NO: 6323795 - DNA, 22 bp, Homo sapiens
ggccagcggggctgctcaccca

SEQ ID NO: 6323796 - DNA, 20 bp, Homo sapiens
ggccagcggtgaccagcctg

SEQ ID NO: 6323797 - DNA, 13 bp, Homo sapiens
ggccagcgtccca

SEQ ID NO: 6323798 - DNA, 14 bp, Homo sapiens
ggccagctagagct

SEQ ID NO: 6323799 - DNA, 19 bp, Homo sapiens
ggccagctatctgcctgac

SEQ ID NO: 6323800 - DNA, 22 bp, Homo sapiens
ggccagctatctgcctgacagg

SEQ ID NO: 6323801 - DNA, 23 bp, Homo sapiens
ggccagctatctgcctgacaggc

SEQ ID NO: 6323802 - DNA, 20 bp, Homo sapiens
ggccagctcacaagcccagg

SEQ ID NO: 6323803 - DNA, 13 bp, Homo sapiens
ggccagctcagga

SEQ ID NO: 6323804 - DNA, 14 bp, Homo sapiens
ggccagctccccct

SEQ ID NO: 6323805 - DNA, 13 bp, Homo sapiens
ggccagctcctta

SEQ ID NO: 6323806 - DNA, 14 bp, Homo sapiens
ggccagctcctttt

SEQ ID NO: 6323807 - DNA, 18 bp, Homo sapiens
ggccagctccttttctgt

SEQ ID NO: 6323808 - DNA, 19 bp, Homo sapiens
ggccagctgccccagccag

SEQ ID NO: 6323809 - DNA, 20 bp, Homo sapiens
ggccagctgcctgtgcctgc

SEQ ID NO: 6323810 - DNA, 11 bp, Homo sapiens
ggccagctgcg

SEQ ID NO: 6323811 - DNA, 17 bp, Homo sapiens
ggccagctgcttgggct

SEQ ID NO: 6323812 - DNA, 15 bp, Homo sapiens
ggccagctggaggca

SEQ ID NO: 6323813 - DNA, 18 bp, Homo sapiens
ggccagctggcagcagag

SEQ ID NO: 6323814 - DNA, 12 bp, Homo sapiens
ggccagctgggg

SEQ ID NO: 6323815 - DNA, 15 bp, Homo sapiens
ggccagctggggaga

SEQ ID NO: 6323816 - DNA, 16 bp, Homo sapiens
ggccagctggggagat

SEQ ID NO: 6323817 - DNA, 22 bp, Homo sapiens
ggccagctggggagatgggggc

SEQ ID NO: 6323818 - DNA, 13 bp, Homo sapiens
ggccagctgggtg

SEQ ID NO: 6323819 - DNA, 19 bp, Homo sapiens
ggccagctgggtgccccag

SEQ ID NO: 6323820 - DNA, 22 bp, Homo sapiens
ggccagctgggtgccccaggga

SEQ ID NO: 6323821 - DNA, 18 bp, Homo sapiens
ggccagctgtggttttct

SEQ ID NO: 6323822 - DNA, 16 bp, Homo sapiens
ggccagcttcccctca

SEQ ID NO: 6323823 - DNA, 19 bp, Homo sapiens
ggccagcttcccctcactt

SEQ ID NO: 6323824 - DNA, 21 bp, Homo sapiens
ggccagcttcgtgctggagga

SEQ ID NO: 6323825 - DNA, 17 bp, Homo sapiens
ggccaggaaggggacag

SEQ ID NO: 6323826 - DNA, 18 bp, Homo sapiens
ggccaggaagtagcacag

SEQ ID NO: 6323827 - DNA, 22 bp, Homo sapiens
ggccaggaagtagcacaggctg

SEQ ID NO: 6323828 - DNA, 18 bp, Homo sapiens
ggccaggaccacacagtc

SEQ ID NO: 6323829 - DNA, 21 bp, Homo sapiens
ggccaggaccacacagtcccc

SEQ ID NO: 6323830 - DNA, 22 bp, Homo sapiens
ggccaggaccacacagtcccca

SEQ ID NO: 6323831 - DNA, 16 bp, Homo sapiens
ggccaggacgggccac

SEQ ID NO: 6323832 - DNA, 21 bp, Homo sapiens
ggccaggactctgcagcctca

SEQ ID NO: 6323833 - DNA, 15 bp, Homo sapiens
ggccaggactgagcc

SEQ ID NO: 6323834 - DNA, 20 bp, Homo sapiens
ggccaggactgagccccgca

SEQ ID NO: 6323835 - DNA, 11 bp, Homo sapiens
ggccaggagag

SEQ ID NO: 6323836 - DNA, 13 bp, Homo sapiens
ggccaggagcagg

SEQ ID NO: 6323837 - DNA, 14 bp, Homo sapiens
ggccaggagccctg

SEQ ID NO: 6323838 - DNA, 13 bp, Homo sapiens
ggccaggaggtgc

SEQ ID NO: 6323839 - DNA, 21 bp, Homo sapiens
ggccaggagtaagcccaagct

SEQ ID NO: 6323840 - DNA, 22 bp, Homo sapiens
ggccaggagtaagcccaagcta

SEQ ID NO: 6323841 - DNA, 15 bp, Homo sapiens
ggccaggagtgggga

SEQ ID NO: 6323842 - DNA, 22 bp, Homo sapiens
ggccaggagtgggtttccctgc

SEQ ID NO: 6323843 - DNA, 19 bp, Homo sapiens
ggccaggagtttgagacca

SEQ ID NO: 6323844 - DNA, 22 bp, Homo sapiens
ggccaggatccccctctttgca

SEQ ID NO: 6323845 - DNA, 17 bp, Homo sapiens
ggccaggatgcctgagc

SEQ ID NO: 6323846 - DNA, 19 bp, Homo sapiens
ggccaggatgcctgagccc

SEQ ID NO: 6323847 - DNA, 16 bp, Homo sapiens
ggccaggatggagggg

SEQ ID NO: 6323848 - DNA, 22 bp, Homo sapiens
ggccaggatggcgtgtcccctg

SEQ ID NO: 6323849 - DNA, 17 bp, Homo sapiens
ggccaggattcaggcct

SEQ ID NO: 6323850 - DNA, 14 bp, Homo sapiens
ggccaggcacaggg

SEQ ID NO: 6323851 - DNA, 18 bp, Homo sapiens
ggccaggcacagggcccg

SEQ ID NO: 6323852 - DNA, 11 bp, Homo sapiens
ggccaggcaga

SEQ ID NO: 6323853 - DNA, 20 bp, Homo sapiens
ggccaggcagaatggctgca

SEQ ID NO: 6323854 - DNA, 22 bp, Homo sapiens
ggccaggcagatctgtgcccca

SEQ ID NO: 6323855 - DNA, 20 bp, Homo sapiens
ggccaggcaggagcccttct

SEQ ID NO: 6323856 - DNA, 12 bp, Homo sapiens
ggccaggcaggc

SEQ ID NO: 6323857 - DNA, 12 bp, Homo sapiens
ggccaggcaggt

SEQ ID NO: 6323858 - DNA, 16 bp, Homo sapiens
ggccaggccaccagga

SEQ ID NO: 6323859 - DNA, 21 bp, Homo sapiens
ggccaggccacctccagaaac

SEQ ID NO: 6323860 - DNA, 16 bp, Homo sapiens
ggccaggccagcttcc

SEQ ID NO: 6323861 - DNA, 16 bp, Homo sapiens
ggccaggccaggacca

SEQ ID NO: 6323862 - DNA, 15 bp, Homo sapiens
ggccaggcccaggca

SEQ ID NO: 6323863 - DNA, 16 bp, Homo sapiens
ggccaggcccaggcag

SEQ ID NO: 6323864 - DNA, 20 bp, Homo sapiens
ggccaggcccaggcctcacc

SEQ ID NO: 6323865 - DNA, 11 bp, Homo sapiens
ggccaggcccc

SEQ ID NO: 6323866 - DNA, 19 bp, Homo sapiens
ggccaggccctcctgctgg

SEQ ID NO: 6323867 - DNA, 21 bp, Homo sapiens
ggccaggccctcctgctggct

SEQ ID NO: 6323868 - DNA, 22 bp, Homo sapiens
ggccaggccctcctgctggctg

SEQ ID NO: 6323869 - DNA, 18 bp, Homo sapiens
ggccaggccctctgccca

SEQ ID NO: 6323870 - DNA, 22 bp, Homo sapiens
ggccaggccctgagagtctggt

SEQ ID NO: 6323871 - DNA, 18 bp, Homo sapiens
ggccaggccctggagggc

SEQ ID NO: 6323872 - DNA, 16 bp, Homo sapiens
ggccaggccctgggtc

SEQ ID NO: 6323873 - DNA, 23 bp, Homo sapiens
ggccaggccctgggtcttgccat

SEQ ID NO: 6323874 - DNA, 23 bp, Homo sapiens
ggccaggcctagtaaccaaggcc

SEQ ID NO: 6323875 - DNA, 14 bp, Homo sapiens
ggccaggcctctgc

SEQ ID NO: 6323876 - DNA, 18 bp, Homo sapiens
ggccaggcctctgctggc

SEQ ID NO: 6323877 - DNA, 20 bp, Homo sapiens
ggccaggcctctgctggctc

SEQ ID NO: 6323878 - DNA, 11 bp, Homo sapiens
ggccaggcctt

SEQ ID NO: 6323879 - DNA, 18 bp, Homo sapiens
ggccaggcgagcctgact

SEQ ID NO: 6323880 - DNA, 22 bp, Homo sapiens
ggccaggcggggcgccccaaga

SEQ ID NO: 6323881 - DNA, 19 bp, Homo sapiens
ggccaggctccctgaccac

SEQ ID NO: 6323882 - DNA, 13 bp, Homo sapiens
ggccaggctgcct

SEQ ID NO: 6323883 - DNA, 14 bp, Homo sapiens
ggccaggctgcctc

SEQ ID NO: 6323884 - DNA, 18 bp, Homo sapiens
ggccaggctgcctcggac

SEQ ID NO: 6323885 - DNA, 11 bp, Homo sapiens
ggccaggctgg

SEQ ID NO: 6323886 - DNA, 23 bp, Homo sapiens
ggccagggaaacaaagtttacat

SEQ ID NO: 6323887 - DNA, 18 bp, Homo sapiens
ggccagggaaagcccgtg

SEQ ID NO: 6323888 - DNA, 14 bp, Homo sapiens
ggccagggacccaa

SEQ ID NO: 6323889 - DNA, 23 bp, Homo sapiens
ggccagggacccccgaggccccc

SEQ ID NO: 6323890 - DNA, 15 bp, Homo sapiens
ggccagggagaagct

SEQ ID NO: 6323891 - DNA, 18 bp, Homo sapiens
ggccagggagaagctcct

SEQ ID NO: 6323892 - DNA, 15 bp, Homo sapiens
ggccagggaggagcc

SEQ ID NO: 6323893 - DNA, 15 bp, Homo sapiens
ggccagggaggcgca

SEQ ID NO: 6323894 - DNA, 16 bp, Homo sapiens
ggccagggatctctct

SEQ ID NO: 6323895 - DNA, 10 bp, Homo sapiens
ggccagggca

SEQ ID NO: 6323896 - DNA, 18 bp, Homo sapiens
ggccagggcaatgccatc

SEQ ID NO: 6323897 - DNA, 23 bp, Homo sapiens
ggccagggcaatgccatcagccc

SEQ ID NO: 6323898 - DNA, 18 bp, Homo sapiens
ggccagggcagcaaggga

SEQ ID NO: 6323899 - DNA, 15 bp, Homo sapiens
ggccagggcagggcc

SEQ ID NO: 6323900 - DNA, 16 bp, Homo sapiens
ggccagggcagggcca

SEQ ID NO: 6323901 - DNA, 17 bp, Homo sapiens
ggccagggcagggccac

SEQ ID NO: 6323902 - DNA, 16 bp, Homo sapiens
ggccagggcatgtgta

SEQ ID NO: 6323903 - DNA, 21 bp, Homo sapiens
ggccagggccacgctccagct

SEQ ID NO: 6323904 - DNA, 13 bp, Homo sapiens
ggccagggccctg

SEQ ID NO: 6323905 - DNA, 16 bp, Homo sapiens
ggccagggccctgcag

SEQ ID NO: 6323906 - DNA, 17 bp, Homo sapiens
ggccagggccctgcaga

SEQ ID NO: 6323907 - DNA, 22 bp, Homo sapiens
ggccagggcctctccaaccact

SEQ ID NO: 6323908 - DNA, 16 bp, Homo sapiens
ggccagggcctggtgt

SEQ ID NO: 6323909 - DNA, 18 bp, Homo sapiens
ggccagggcctggtgtga

SEQ ID NO: 6323910 - DNA, 15 bp, Homo sapiens
ggccagggcggccag

SEQ ID NO: 6323911 - DNA, 21 bp, Homo sapiens
gtcctctccctcctggccaga

SEQ ID NO: 6323912 - DNA, 13 bp, Homo sapiens
gtcctctcgagcc

SEQ ID NO: 6323913 - DNA, 16 bp, Homo sapiens
gtcctctcgagcccag

SEQ ID NO: 6323914 - DNA, 17 bp, Homo sapiens
gtcctctcgagcccaga

SEQ ID NO: 6323915 - DNA, 18 bp, Homo sapiens
gtcctctcggctgccagg

SEQ ID NO: 6323916 - DNA, 19 bp, Homo sapiens
gtcctctcggctgccaggg

SEQ ID NO: 6323917 - DNA, 21 bp, Homo sapiens
gtcctctcggctgccaggggc

SEQ ID NO: 6323918 - DNA, 14 bp, Homo sapiens
gtcctctctctgtg

SEQ ID NO: 6323919 - DNA, 18 bp, Homo sapiens
gtcctctctctgtggggc

SEQ ID NO: 6323920 - DNA, 19 bp, Homo sapiens
gtcctctctgagtcaaatc

SEQ ID NO: 6323921 - DNA, 22 bp, Homo sapiens
gtcctctctgagtcaaatccag

SEQ ID NO: 6323922 - DNA, 23 bp, Homo sapiens
gtcctctctgagtcaaatccagt

SEQ ID NO: 6323923 - DNA, 15 bp, Homo sapiens
gtcctctcttccaca

SEQ ID NO: 6323924 - DNA, 21 bp, Homo sapiens
gtcctctctttatgcttgctt

SEQ ID NO: 6323925 - DNA, 16 bp, Homo sapiens
gtcctctgctccagca

SEQ ID NO: 6323926 - DNA, 21 bp, Homo sapiens
gtcctctgctccagcaactgc

SEQ ID NO: 6323927 - DNA, 13 bp, Homo sapiens
gtcctctgctttg

SEQ ID NO: 6323928 - DNA, 18 bp, Homo sapiens
gtcctctggagccctaac

SEQ ID NO: 6323929 - DNA, 19 bp, Homo sapiens
gtcctctgtcagtcacagc

SEQ ID NO: 6323930 - DNA, 23 bp, Homo sapiens
gtcctctgtcagtcacagccacc

SEQ ID NO: 6323931 - DNA, 18 bp, Homo sapiens
gtcctctgtgcccacggt

SEQ ID NO: 6323932 - DNA, 18 bp, Homo sapiens
gtcctcttaggtcccggg

SEQ ID NO: 6323933 - DNA, 16 bp, Homo sapiens
gtcctcttagtccaca

SEQ ID NO: 6323934 - DNA, 18 bp, Homo sapiens
gtcctcttccctctctgc

SEQ ID NO: 6323935 - DNA, 12 bp, Homo sapiens
gtcctcttctgc

SEQ ID NO: 6323936 - DNA, 15 bp, Homo sapiens
gtcctcttctgctct

SEQ ID NO: 6323937 - DNA, 15 bp, Homo sapiens
gtcctctttcaaagg

SEQ ID NO: 6323938 - DNA, 15 bp, Homo sapiens
gtcctctttcagctc

SEQ ID NO: 6323939 - DNA, 20 bp, Homo sapiens
gtcctctttcagctcctgac

SEQ ID NO: 6323940 - DNA, 14 bp, Homo sapiens
gtcctcttttctga

SEQ ID NO: 6323941 - DNA, 14 bp, Homo sapiens
gtcctgaaagcggc

SEQ ID NO: 6323942 - DNA, 19 bp, Homo sapiens
gtcctgaaccgactgaccc

SEQ ID NO: 6323943 - DNA, 17 bp, Homo sapiens
gtcctgaagaggcgggc

SEQ ID NO: 6323944 - DNA, 17 bp, Homo sapiens
gtcctgaatggctttgt

SEQ ID NO: 6323945 - DNA, 14 bp, Homo sapiens
gtcctgacaccagg

SEQ ID NO: 6323946 - DNA, 16 bp, Homo sapiens
gtcctgacaccaggca

SEQ ID NO: 6323947 - DNA, 23 bp, Homo sapiens
gtcctgacaccaggcaagaaaag

SEQ ID NO: 6323948 - DNA, 23 bp, Homo sapiens
gtcctgaccaccctcccctctct

SEQ ID NO: 6323949 - DNA, 14 bp, Homo sapiens
gtcctgaccaggat

SEQ ID NO: 6323950 - DNA, 24 bp, Homo sapiens
gtcctgaccaggatggagcaagct

SEQ ID NO: 6323951 - DNA, 13 bp, Homo sapiens
gtcctgactcaac

SEQ ID NO: 6323952 - DNA, 15 bp, Homo sapiens
gtcctgactgggctg

SEQ ID NO: 6323953 - DNA, 17 bp, Homo sapiens
gtcctgactgggctggg

SEQ ID NO: 6323954 - DNA, 23 bp, Homo sapiens
gtcctgacttcaggggctgcccg

SEQ ID NO: 6323955 - DNA, 16 bp, Homo sapiens
gtcctgagaaagctca

SEQ ID NO: 6323956 - DNA, 17 bp, Homo sapiens
gtcctgagccccctgca

SEQ ID NO: 6323957 - DNA, 19 bp, Homo sapiens
gtcctgagccccctgcacc

SEQ ID NO: 6323958 - DNA, 14 bp, Homo sapiens
gtcctgagctcagc

SEQ ID NO: 6323959 - DNA, 11 bp, Homo sapiens
gtcctgaggaa

SEQ ID NO: 6323960 - DNA, 16 bp, Homo sapiens
gtcctgaggagaggag

SEQ ID NO: 6323961 - DNA, 15 bp, Homo sapiens
gtcctgaggagccct

SEQ ID NO: 6323962 - DNA, 16 bp, Homo sapiens
gtcctgaggagccctg

SEQ ID NO: 6323963 - DNA, 20 bp, Homo sapiens
gtcctgaggagtgtcctgtc

SEQ ID NO: 6323964 - DNA, 16 bp, Homo sapiens
gtcctgaggcagaacc

SEQ ID NO: 6323965 - DNA, 23 bp, Homo sapiens
gtcctgaggcagaacctggtggc

SEQ ID NO: 6323966 - DNA, 13 bp, Homo sapiens
gtcctgaggggga

SEQ ID NO: 6323967 - DNA, 17 bp, Homo sapiens
gtcctgatcagagccgt

SEQ ID NO: 6323968 - DNA, 15 bp, Homo sapiens
gtcctgatccctcca

SEQ ID NO: 6323969 - DNA, 21 bp, Homo sapiens
gtcctgatcctaaccctgggc

SEQ ID NO: 6323970 - DNA, 15 bp, Homo sapiens
gtcctgatggtcagc

SEQ ID NO: 6323971 - DNA, 22 bp, Homo sapiens
gtcctgattcgaggtcctcctg

SEQ ID NO: 6323972 - DNA, 15 bp, Homo sapiens
gtcctgattctccct

SEQ ID NO: 6323973 - DNA, 17 bp, Homo sapiens
gtcctgcacaccctggg

SEQ ID NO: 6323974 - DNA, 21 bp, Homo sapiens
gtcctgcacaccctgggccac

SEQ ID NO: 6323975 - DNA, 20 bp, Homo sapiens
gtcctgcacatgagtggaaa

SEQ ID NO: 6323976 - DNA, 19 bp, Homo sapiens
gtcctgcaccggggcctgg

SEQ ID NO: 6323977 - DNA, 20 bp, Homo sapiens
gtcctgcaccggggcctggg

SEQ ID NO: 6323978 - DNA, 16 bp, Homo sapiens
gtcctgcagaagaagc

SEQ ID NO: 6323979 - DNA, 13 bp, Homo sapiens
gtcctgcagagct

SEQ ID NO: 6323980 - DNA, 14 bp, Homo sapiens
gtcctgcagagctg

SEQ ID NO: 6323981 - DNA, 15 bp, Homo sapiens
gtcctgcagagctgg

SEQ ID NO: 6323982 - DNA, 16 bp, Homo sapiens
gtcctgcagagctggg

SEQ ID NO: 6323983 - DNA, 18 bp, Homo sapiens
gtcctgcagagctggggg

SEQ ID NO: 6323984 - DNA, 13 bp, Homo sapiens
gtcctgcagagga

SEQ ID NO: 6323985 - DNA, 21 bp, Homo sapiens
gtcctgcagcaaacactccac

SEQ ID NO: 6323986 - DNA, 23 bp, Homo sapiens
gtcctgcagcaaacactccaccc

SEQ ID NO: 6323987 - DNA, 10 bp, Homo sapiens
gtcctgcagg

SEQ ID NO: 6323988 - DNA, 14 bp, Homo sapiens
gtcctgcaggggga

SEQ ID NO: 6323989 - DNA, 17 bp, Homo sapiens
gtcctgcagtgtgagat

SEQ ID NO: 6323990 - DNA, 18 bp, Homo sapiens
gtcctgcagtgtgagatt

SEQ ID NO: 6323991 - DNA, 20 bp, Homo sapiens
gtcctgcatggggcagaggc

SEQ ID NO: 6323992 - DNA, 21 bp, Homo sapiens
gtcctgcatggggcagaggct

SEQ ID NO: 6323993 - DNA, 12 bp, Homo sapiens
gtcctgcatgta

SEQ ID NO: 6323994 - DNA, 24 bp, Homo sapiens
gtcctgccaccaccctgtcttcct

SEQ ID NO: 6323995 - DNA, 18 bp, Homo sapiens
gtcctgccacctggggca

SEQ ID NO: 6323996 - DNA, 21 bp, Homo sapiens
gtcctgccagctgccttcctc

SEQ ID NO: 6323997 - DNA, 22 bp, Homo sapiens
gtcctgccagctgccttcctca

SEQ ID NO: 6323998 - DNA, 15 bp, Homo sapiens
gtcctgccagctgga

SEQ ID NO: 6323999 - DNA, 16 bp, Homo sapiens
gtcctgccagctggat

SEQ ID NO: 6324000 - DNA, 19 bp, Homo sapiens
gtcctgcccaccctaccag

SEQ ID NO: 6324001 - DNA, 14 bp, Homo sapiens
gtcctgcccatgcc

SEQ ID NO: 6324002 - DNA, 14 bp, Homo sapiens
gtcctgcccatgtg

SEQ ID NO: 6324003 - DNA, 21 bp, Homo sapiens
gtcctgcccatgtgtcccctc

SEQ ID NO: 6324004 - DNA, 13 bp, Homo sapiens
gtcctgccctgcc

SEQ ID NO: 6324005 - DNA, 15 bp, Homo sapiens
gtcctgccctgcccc

SEQ ID NO: 6324006 - DNA, 22 bp, Homo sapiens
gtcctgcccttgctccagcctg

SEQ ID NO: 6324007 - DNA, 23 bp, Homo sapiens
gtcctgcccttgctccagcctga

SEQ ID NO: 6324008 - DNA, 19 bp, Homo sapiens
gtcctgccggtgggaccct

SEQ ID NO: 6324009 - DNA, 16 bp, Homo sapiens
gtcctgcctaaatttc

SEQ ID NO: 6324010 - DNA, 13 bp, Homo sapiens
gtcctgcctcctc

SEQ ID NO: 6324011 - DNA, 18 bp, Homo sapiens
gtcctgcctctctgctcc

SEQ ID NO: 6324012 - DNA, 20 bp, Homo sapiens
gtcctgcctctctgctccag

SEQ ID NO: 6324013 - DNA, 12 bp, Homo sapiens
gtcctgcctgaa

SEQ ID NO: 6324014 - DNA, 21 bp, Homo sapiens
gtcctgcctgaacagccctct

SEQ ID NO: 6324015 - DNA, 12 bp, Homo sapiens
gtcctgcctgca

SEQ ID NO: 6324016 - DNA, 11 bp, Homo sapiens
gtcctgcctgt

SEQ ID NO: 6324017 - DNA, 13 bp, Homo sapiens
gtcctgcctgtgg

SEQ ID NO: 6324018 - DNA, 22 bp, Homo sapiens
gtcctgcctgtggcgccgtctc

SEQ ID NO: 6324019 - DNA, 14 bp, Homo sapiens
gtcctgcctttggg

SEQ ID NO: 6324020 - DNA, 21 bp, Homo sapiens
gtcctgcgcctgcgcctcctc

SEQ ID NO: 6324021 - DNA, 22 bp, Homo sapiens
gtcctgcgttcagcccctgatc

SEQ ID NO: 6324022 - DNA, 21 bp, Homo sapiens
gtcctgctacctttgtctcac

SEQ ID NO: 6324023 - DNA, 15 bp, Homo sapiens
gtcctgctagctgtc

SEQ ID NO: 6324024 - DNA, 20 bp, Homo sapiens
gtcctgctagctgtctctct

SEQ ID NO: 6324025 - DNA, 13 bp, Homo sapiens
gtcctgctcagat

SEQ ID NO: 6324026 - DNA, 20 bp, Homo sapiens
gtcctgctcagatgctggtc

SEQ ID NO: 6324027 - DNA, 21 bp, Homo sapiens
gtcctgctcattatgccactt

SEQ ID NO: 6324028 - DNA, 15 bp, Homo sapiens
gtcctgctccgctgc

SEQ ID NO: 6324029 - DNA, 18 bp, Homo sapiens
gtcctgctccgctgcctg

SEQ ID NO: 6324030 - DNA, 15 bp, Homo sapiens
gtcctgctcgccctg

SEQ ID NO: 6324031 - DNA, 17 bp, Homo sapiens
gtcctgctcgccctgtg

SEQ ID NO: 6324032 - DNA, 17 bp, Homo sapiens
gtcctgctctcttcagg

SEQ ID NO: 6324033 - DNA, 20 bp, Homo sapiens
gtcctgctctcttcaggagg

SEQ ID NO: 6324034 - DNA, 21 bp, Homo sapiens
gtcctgctctcttcaggaggc

SEQ ID NO: 6324035 - DNA, 16 bp, Homo sapiens
gtcctgctgcagttgc

SEQ ID NO: 6324036 - DNA, 11 bp, Homo sapiens
gtcctgctgcc

SEQ ID NO: 6324037 - DNA, 18 bp, Homo sapiens
gtcctgctgcctggagtc

SEQ ID NO: 6324038 - DNA, 15 bp, Homo sapiens
gtcctgctggcacct

SEQ ID NO: 6324039 - DNA, 13 bp, Homo sapiens
gtcctgctggcct

SEQ ID NO: 6324040 - DNA, 15 bp, Homo sapiens
gtcctgctggcctgc

SEQ ID NO: 6324041 - DNA, 15 bp, Homo sapiens
gtcctgctggcttcc

SEQ ID NO: 6324042 - DNA, 15 bp, Homo sapiens
gtcctgcttgaactg

SEQ ID NO: 6324043 - DNA, 15 bp, Homo sapiens
gtcctgctttcctat

SEQ ID NO: 6324044 - DNA, 20 bp, Homo sapiens
gtcctggacaccgggccagt

SEQ ID NO: 6324045 - DNA, 16 bp, Homo sapiens
gtcctggacacctccc

SEQ ID NO: 6324046 - DNA, 17 bp, Homo sapiens
gtcctggacacctccca

SEQ ID NO: 6324047 - DNA, 22 bp, Homo sapiens
gtcctggacacctcccagggga

SEQ ID NO: 6324048 - DNA, 22 bp, Homo sapiens
gtcctggactcctgccaccagc

SEQ ID NO: 6324049 - DNA, 14 bp, Homo sapiens
gtcctggaggcagg

SEQ ID NO: 6324050 - DNA, 21 bp, Homo sapiens
gtcctggaggcagggggtgag

SEQ ID NO: 6324051 - DNA, 13 bp, Homo sapiens
gtcctggaggggc

SEQ ID NO: 6324052 - DNA, 18 bp, Homo sapiens
gtcctggaggttccccag

SEQ ID NO: 6324053 - DNA, 16 bp, Homo sapiens
gtcctggcacagaaga

SEQ ID NO: 6324054 - DNA, 14 bp, Homo sapiens
gtcctggcagggca

SEQ ID NO: 6324055 - DNA, 20 bp, Homo sapiens
gtcctggcagggcaggcaga

SEQ ID NO: 6324056 - DNA, 17 bp, Homo sapiens
gtcctggcatgggaatg

SEQ ID NO: 6324057 - DNA, 14 bp, Homo sapiens
gtcctggcctggct

SEQ ID NO: 6324058 - DNA, 22 bp, Homo sapiens
gtcctggccttgtgtcactggc

SEQ ID NO: 6324059 - DNA, 20 bp, Homo sapiens
gtcctggctacatcccagcc

SEQ ID NO: 6324060 - DNA, 21 bp, Homo sapiens
gtcctggctacatcccagcct

SEQ ID NO: 6324061 - DNA, 19 bp, Homo sapiens
gtcctggctcctgaggggc

SEQ ID NO: 6324062 - DNA, 15 bp, Homo sapiens
gtcctggctgcactc

SEQ ID NO: 6324063 - DNA, 16 bp, Homo sapiens
gtcctggctggccgca

SEQ ID NO: 6324064 - DNA, 17 bp, Homo sapiens
gtcctgggagacccatg

SEQ ID NO: 6324065 - DNA, 12 bp, Homo sapiens
gtcctgggagcc

SEQ ID NO: 6324066 - DNA, 16 bp, Homo sapiens
gtcctgggaggagaga

SEQ ID NO: 6324067 - DNA, 16 bp, Homo sapiens
gtcctgggaggctgca

SEQ ID NO: 6324068 - DNA, 19 bp, Homo sapiens
gtcctgggaggctgcagcc

SEQ ID NO: 6324069 - DNA, 21 bp, Homo sapiens
gtcctgggaggctgcagccag

SEQ ID NO: 6324070 - DNA, 23 bp, Homo sapiens
gtcctgggaggctgcagccaggc

SEQ ID NO: 6324071 - DNA, 19 bp, Homo sapiens
gtcctgggagtgagctggt

SEQ ID NO: 6324072 - DNA, 11 bp, Homo sapiens
gtcctgggcag

SEQ ID NO: 6324073 - DNA, 15 bp, Homo sapiens
gtcctgggcaggtgg

SEQ ID NO: 6324074 - DNA, 13 bp, Homo sapiens
gtcctgggcctgc

SEQ ID NO: 6324075 - DNA, 17 bp, Homo sapiens
gtcctgggcctgcagaa

SEQ ID NO: 6324076 - DNA, 14 bp, Homo sapiens
gtcctgggcgccct

SEQ ID NO: 6324077 - DNA, 20 bp, Homo sapiens
gtcctgggcgccctggaagc

SEQ ID NO: 6324078 - DNA, 23 bp, Homo sapiens
gtcctgggcgccctggaagccgg

SEQ ID NO: 6324079 - DNA, 17 bp, Homo sapiens
gtcctgggctcaaatga

SEQ ID NO: 6324080 - DNA, 18 bp, Homo sapiens
gtcctgggctggggccac

SEQ ID NO: 6324081 - DNA, 23 bp, Homo sapiens
gtcctggggaggctgagactgca

SEQ ID NO: 6324082 - DNA, 22 bp, Homo sapiens
gtcctggggcctcggagcctca

SEQ ID NO: 6324083 - DNA, 17 bp, Homo sapiens
gtcctggggctctgtgc

SEQ ID NO: 6324084 - DNA, 18 bp, Homo sapiens
gtcctgggggcctgacct

SEQ ID NO: 6324085 - DNA, 15 bp, Homo sapiens
gtcctgggggctgct

SEQ ID NO: 6324086 - DNA, 20 bp, Homo sapiens
gtcctgggggctgctgcact

SEQ ID NO: 6324087 - DNA, 21 bp, Homo sapiens
gtcctgggtaaatgtggtgag

SEQ ID NO: 6324088 - DNA, 10 bp, Homo sapiens
gtcctgggtg

SEQ ID NO: 6324089 - DNA, 18 bp, Homo sapiens
gtcctgggttctggggca

SEQ ID NO: 6324090 - DNA, 18 bp, Homo sapiens
ggccagggcggccaggga

SEQ ID NO: 6324091 - DNA, 19 bp, Homo sapiens
ggccagggcggccagggac

SEQ ID NO: 6324092 - DNA, 16 bp, Homo sapiens
ggccagggctctggca

SEQ ID NO: 6324093 - DNA, 19 bp, Homo sapiens
ggccagggctgccctgaga

SEQ ID NO: 6324094 - DNA, 14 bp, Homo sapiens
ggccagggctgggt

SEQ ID NO: 6324095 - DNA, 18 bp, Homo sapiens
ggccagggcttccccatc

SEQ ID NO: 6324096 - DNA, 20 bp, Homo sapiens
ggccagggcttccccatcag

SEQ ID NO: 6324097 - DNA, 21 bp, Homo sapiens
ggccagggcttccccatcagc

SEQ ID NO: 6324098 - DNA, 20 bp, Homo sapiens
ggccaggggtgctcctgtgc

SEQ ID NO: 6324099 - DNA, 21 bp, Homo sapiens
ggccagggtagacttggagct

SEQ ID NO: 6324100 - DNA, 23 bp, Homo sapiens
ggccagggtctgtgtgaatgtgg

SEQ ID NO: 6324101 - DNA, 16 bp, Homo sapiens
ggccagggtgagagct

SEQ ID NO: 6324102 - DNA, 16 bp, Homo sapiens
ggccagggtgggaaga

SEQ ID NO: 6324103 - DNA, 21 bp, Homo sapiens
ggccaggtcccagcttgagct

SEQ ID NO: 6324104 - DNA, 16 bp, Homo sapiens
ggccaggtcctcacag

SEQ ID NO: 6324105 - DNA, 20 bp, Homo sapiens
ggccaggtcctcacagcagt

SEQ ID NO: 6324106 - DNA, 17 bp, Homo sapiens
ggccaggtctccgggga

SEQ ID NO: 6324107 - DNA, 15 bp, Homo sapiens
ggccaggtctggcgc

SEQ ID NO: 6324108 - DNA, 20 bp, Homo sapiens
ggccaggtctggcgccaggg

SEQ ID NO: 6324109 - DNA, 15 bp, Homo sapiens
ggccaggtgcccagg

SEQ ID NO: 6324110 - DNA, 23 bp, Homo sapiens
ggccaggtgcggcctggggggaa

SEQ ID NO: 6324111 - DNA, 22 bp, Homo sapiens
ggccaggtgcttttccctatcc

SEQ ID NO: 6324112 - DNA, 14 bp, Homo sapiens
ggccagtaaaagta

SEQ ID NO: 6324113 - DNA, 20 bp, Homo sapiens
ggccagtaagggaaatagaa

SEQ ID NO: 6324114 - DNA, 21 bp, Homo sapiens
ggccagtaatcccagtgactt

SEQ ID NO: 6324115 - DNA, 15 bp, Homo sapiens
ggccagtcagacgcc

SEQ ID NO: 6324116 - DNA, 20 bp, Homo sapiens
ggccagtccaccctgcctgc

SEQ ID NO: 6324117 - DNA, 12 bp, Homo sapiens
ggccagtcccca

SEQ ID NO: 6324118 - DNA, 21 bp, Homo sapiens
ggccagtccccatttctgcct

SEQ ID NO: 6324119 - DNA, 22 bp, Homo sapiens
ggccagtccccatttctgcctc

SEQ ID NO: 6324120 - DNA, 23 bp, Homo sapiens
ggccagtccccgaggagctgggc

SEQ ID NO: 6324121 - DNA, 14 bp, Homo sapiens
ggccagtcctagag

SEQ ID NO: 6324122 - DNA, 17 bp, Homo sapiens
ggccagtcctagagctc

SEQ ID NO: 6324123 - DNA, 18 bp, Homo sapiens
ggccagtcctagagctcc

SEQ ID NO: 6324124 - DNA, 22 bp, Homo sapiens
ggccagtcctagagctcctgtc

SEQ ID NO: 6324125 - DNA, 24 bp, Homo sapiens
ggccagtcctagagctcctgtccc

SEQ ID NO: 6324126 - DNA, 18 bp, Homo sapiens
ggccagtcctgcctggcc

SEQ ID NO: 6324127 - DNA, 15 bp, Homo sapiens
ggccagtcctggtcc

SEQ ID NO: 6324128 - DNA, 17 bp, Homo sapiens
ggccagtcctggtcctg

SEQ ID NO: 6324129 - DNA, 18 bp, Homo sapiens
ggccagtctgaacctgag

SEQ ID NO: 6324130 - DNA, 17 bp, Homo sapiens
ggccagtctgggctgcc

SEQ ID NO: 6324131 - DNA, 22 bp, Homo sapiens
ggccagtcttcctcttagcctc

SEQ ID NO: 6324132 - DNA, 20 bp, Homo sapiens
ggccagtgatgatgttttga

SEQ ID NO: 6324133 - DNA, 20 bp, Homo sapiens
ggccagtgccaggacagctg

SEQ ID NO: 6324134 - DNA, 21 bp, Homo sapiens
ggccagtgccaggacagctgg

SEQ ID NO: 6324135 - DNA, 20 bp, Homo sapiens
ggccagtgccctgatcccag

SEQ ID NO: 6324136 - DNA, 21 bp, Homo sapiens
ggccagtgccctgatcccaga

SEQ ID NO: 6324137 - DNA, 13 bp, Homo sapiens
ggccagtgctcca

SEQ ID NO: 6324138 - DNA, 13 bp, Homo sapiens
ggccagtgctgct

SEQ ID NO: 6324139 - DNA, 14 bp, Homo sapiens
ggccagtgctgctt

SEQ ID NO: 6324140 - DNA, 15 bp, Homo sapiens
ggccagtgctgcttc

SEQ ID NO: 6324141 - DNA, 16 bp, Homo sapiens
ggccagtgctgtgagc

SEQ ID NO: 6324142 - DNA, 16 bp, Homo sapiens
ggccagtggaagaaac

SEQ ID NO: 6324143 - DNA, 14 bp, Homo sapiens
ggccagtggacaga

SEQ ID NO: 6324144 - DNA, 20 bp, Homo sapiens
ggccagtggattcccacagc

SEQ ID NO: 6324145 - DNA, 12 bp, Homo sapiens
ggccagtggcac

SEQ ID NO: 6324146 - DNA, 16 bp, Homo sapiens
ggccagtggcccccgg

SEQ ID NO: 6324147 - DNA, 21 bp, Homo sapiens
ggccagtggcccccgggcctg

SEQ ID NO: 6324148 - DNA, 23 bp, Homo sapiens
ggccagtgtctgtcccggggtcc

SEQ ID NO: 6324149 - DNA, 18 bp, Homo sapiens
ggccagttgcccagagca

SEQ ID NO: 6324150 - DNA, 14 bp, Homo sapiens
ggccagttggtccc

SEQ ID NO: 6324151 - DNA, 15 bp, Homo sapiens
ggccagtttctctgc

SEQ ID NO: 6324152 - DNA, 21 bp, Homo sapiens
ggccagtttctctgccttctt

SEQ ID NO: 6324153 - DNA, 19 bp, Homo sapiens
ggccagtttgaagcctgtg

SEQ ID NO: 6324154 - DNA, 19 bp, Homo sapiens
ggccataaacggttcctgg

SEQ ID NO: 6324155 - DNA, 21 bp, Homo sapiens
ggccataaacggttcctggtg

SEQ ID NO: 6324156 - DNA, 13 bp, Homo sapiens
ggccataagcaac

SEQ ID NO: 6324157 - DNA, 13 bp, Homo sapiens
ggccatactgcct

SEQ ID NO: 6324158 - DNA, 17 bp, Homo sapiens
ggccatagaggcccagg

SEQ ID NO: 6324159 - DNA, 18 bp, Homo sapiens
ggccatagaggcccaggc

SEQ ID NO: 6324160 - DNA, 20 bp, Homo sapiens
ggccatagaggcccaggcac

SEQ ID NO: 6324161 - DNA, 22 bp, Homo sapiens
ggccatagaggcccaggcacca

SEQ ID NO: 6324162 - DNA, 15 bp, Homo sapiens
ggccatatatgctgt

SEQ ID NO: 6324163 - DNA, 19 bp, Homo sapiens
ggccatatatgctgtattt

SEQ ID NO: 6324164 - DNA, 22 bp, Homo sapiens
ggccatatatgctgtatttctt

SEQ ID NO: 6324165 - DNA, 22 bp, Homo sapiens
ggccatatgtgctatggagagg

SEQ ID NO: 6324166 - DNA, 19 bp, Homo sapiens
ggccatatttacctcagcc

SEQ ID NO: 6324167 - DNA, 21 bp, Homo sapiens
ggccatatttacctcagcctg

SEQ ID NO: 6324168 - DNA, 21 bp, Homo sapiens
ggccatcacagccccatggac

SEQ ID NO: 6324169 - DNA, 21 bp, Homo sapiens
ggccatcacaggatgccagcc

SEQ ID NO: 6324170 - DNA, 15 bp, Homo sapiens
ggccatcactcagcc

SEQ ID NO: 6324171 - DNA, 16 bp, Homo sapiens
ggccatcactcagccc

SEQ ID NO: 6324172 - DNA, 18 bp, Homo sapiens
ggccatcactcagcccct

SEQ ID NO: 6324173 - DNA, 19 bp, Homo sapiens
ggccatcagggccctgccc

SEQ ID NO: 6324174 - DNA, 23 bp, Homo sapiens
ggccatcagggccctgccccagg

SEQ ID NO: 6324175 - DNA, 15 bp, Homo sapiens
ggccatccactgtga

SEQ ID NO: 6324176 - DNA, 14 bp, Homo sapiens
ggccatcccacaag

SEQ ID NO: 6324177 - DNA, 15 bp, Homo sapiens
ggccatccccgtgtt

SEQ ID NO: 6324178 - DNA, 20 bp, Homo sapiens
ggccatccctgggcccctcc

SEQ ID NO: 6324179 - DNA, 17 bp, Homo sapiens
ggccatcctacccagcg

SEQ ID NO: 6324180 - DNA, 22 bp, Homo sapiens
ggccatcgcaagtcacagaaaa

SEQ ID NO: 6324181 - DNA, 18 bp, Homo sapiens
ggccatctccacccccag

SEQ ID NO: 6324182 - DNA, 16 bp, Homo sapiens
ggccatctgctcctgg

SEQ ID NO: 6324183 - DNA, 17 bp, Homo sapiens
ggccatctgctcctgga

SEQ ID NO: 6324184 - DNA, 21 bp, Homo sapiens
ggccatctggttaggatggca

SEQ ID NO: 6324185 - DNA, 22 bp, Homo sapiens
ggccatctggttaggatggcag

SEQ ID NO: 6324186 - DNA, 19 bp, Homo sapiens
ggccatctgtaaatatccc

SEQ ID NO: 6324187 - DNA, 22 bp, Homo sapiens
ggccatgaccctgcctctccca

SEQ ID NO: 6324188 - DNA, 21 bp, Homo sapiens
ggccatgagctccagaccccc

SEQ ID NO: 6324189 - DNA, 21 bp, Homo sapiens
ggccatgaggcctcagtggac

SEQ ID NO: 6324190 - DNA, 22 bp, Homo sapiens
ggccatgagggacagggtcttt

SEQ ID NO: 6324191 - DNA, 14 bp, Homo sapiens
ggccatgagggctg

SEQ ID NO: 6324192 - DNA, 21 bp, Homo sapiens
ggccatgatgtcgttcatttt

SEQ ID NO: 6324193 - DNA, 12 bp, Homo sapiens
ggccatgcagac

SEQ ID NO: 6324194 - DNA, 13 bp, Homo sapiens
ggccatgcagacc

SEQ ID NO: 6324195 - DNA, 14 bp, Homo sapiens
ggccatgcagacct

SEQ ID NO: 6324196 - DNA, 11 bp, Homo sapiens
ggccatgcagg

SEQ ID NO: 6324197 - DNA, 18 bp, Homo sapiens
ggccatgcaggaggtgga

SEQ ID NO: 6324198 - DNA, 13 bp, Homo sapiens
ggccatgcctgcc

SEQ ID NO: 6324199 - DNA, 14 bp, Homo sapiens
ggccatgcctgccc

SEQ ID NO: 6324200 - DNA, 21 bp, Homo sapiens
ggccatgcgaggggccagcag

SEQ ID NO: 6324201 - DNA, 11 bp, Homo sapiens
ggccatgctca

SEQ ID NO: 6324202 - DNA, 16 bp, Homo sapiens
ggccatgctcaacccc

SEQ ID NO: 6324203 - DNA, 18 bp, Homo sapiens
ggccatgctcctcttccc

SEQ ID NO: 6324204 - DNA, 21 bp, Homo sapiens
ggccatgctcctcttccccag

SEQ ID NO: 6324205 - DNA, 17 bp, Homo sapiens
ggccatgctgaagggac

SEQ ID NO: 6324206 - DNA, 13 bp, Homo sapiens
ggccatgctgagg

SEQ ID NO: 6324207 - DNA, 20 bp, Homo sapiens
ggccatgctgtccctgcact

SEQ ID NO: 6324208 - DNA, 18 bp, Homo sapiens
ggccatggaagctggcag

SEQ ID NO: 6324209 - DNA, 14 bp, Homo sapiens
ggccatggactctg

SEQ ID NO: 6324210 - DNA, 17 bp, Homo sapiens
ggccatggactctgtcc

SEQ ID NO: 6324211 - DNA, 18 bp, Homo sapiens
ggccatggagaaagctga

SEQ ID NO: 6324212 - DNA, 17 bp, Homo sapiens
ggccatggagagctgga

SEQ ID NO: 6324213 - DNA, 21 bp, Homo sapiens
ggccatggagagctggagcct

SEQ ID NO: 6324214 - DNA, 15 bp, Homo sapiens
ggccatggaggcagt

SEQ ID NO: 6324215 - DNA, 19 bp, Homo sapiens
ggccatggccaaggggcca

SEQ ID NO: 6324216 - DNA, 19 bp, Homo sapiens
ggccatggggcagcctcca

SEQ ID NO: 6324217 - DNA, 20 bp, Homo sapiens
ggccatggggcagcctccag

SEQ ID NO: 6324218 - DNA, 20 bp, Homo sapiens
ggccatgggggcccctcggc

SEQ ID NO: 6324219 - DNA, 21 bp, Homo sapiens
ggccatgggggcccctcggca

SEQ ID NO: 6324220 - DNA, 22 bp, Homo sapiens
ggccatgtattatgaaaaagat

SEQ ID NO: 6324221 - DNA, 19 bp, Homo sapiens
ggccatgtcacctggctgc

SEQ ID NO: 6324222 - DNA, 16 bp, Homo sapiens
ggccatgtcagacaca

SEQ ID NO: 6324223 - DNA, 14 bp, Homo sapiens
ggccatgtgagcca

SEQ ID NO: 6324224 - DNA, 21 bp, Homo sapiens
ggccatgtgagccaccgctgc

SEQ ID NO: 6324225 - DNA, 17 bp, Homo sapiens
ggccatgtgctgccctg

SEQ ID NO: 6324226 - DNA, 13 bp, Homo sapiens
ggccatgtggcct

SEQ ID NO: 6324227 - DNA, 18 bp, Homo sapiens
ggccatgtggcctgccca

SEQ ID NO: 6324228 - DNA, 19 bp, Homo sapiens
ggccatgtggcctgcccag

SEQ ID NO: 6324229 - DNA, 17 bp, Homo sapiens
ggccattaggaaactgt

SEQ ID NO: 6324230 - DNA, 20 bp, Homo sapiens
ggccattctattgtggcaag

SEQ ID NO: 6324231 - DNA, 20 bp, Homo sapiens
ggccattctccacagcaacc

SEQ ID NO: 6324232 - DNA, 21 bp, Homo sapiens
ggccattcttatgttccagat

SEQ ID NO: 6324233 - DNA, 13 bp, Homo sapiens
ggccattgggttt

SEQ ID NO: 6324234 - DNA, 23 bp, Homo sapiens
ggccattgggtttggggccatgg

SEQ ID NO: 6324235 - DNA, 19 bp, Homo sapiens
ggccatttaataccctgca

SEQ ID NO: 6324236 - DNA, 20 bp, Homo sapiens
ggccatttagattaggaagg

SEQ ID NO: 6324237 - DNA, 16 bp, Homo sapiens
ggccatttccttttct

SEQ ID NO: 6324238 - DNA, 20 bp, Homo sapiens
ggccatttccttttctctgc

SEQ ID NO: 6324239 - DNA, 21 bp, Homo sapiens
ggccatttccttttctctgcc

SEQ ID NO: 6324240 - DNA, 14 bp, Homo sapiens
ggccatttgcaata

SEQ ID NO: 6324241 - DNA, 22 bp, Homo sapiens
ggccatttgcaataacagctgc

SEQ ID NO: 6324242 - DNA, 16 bp, Homo sapiens
ggccatttgctgccct

SEQ ID NO: 6324243 - DNA, 17 bp, Homo sapiens
ggccatttgctgccctg

SEQ ID NO: 6324244 - DNA, 21 bp, Homo sapiens
ggccatttggccggctctggt

SEQ ID NO: 6324245 - DNA, 16 bp, Homo sapiens
ggccattttcttgcct

SEQ ID NO: 6324246 - DNA, 17 bp, Homo sapiens
ggccattttcttgcctg

SEQ ID NO: 6324247 - DNA, 15 bp, Homo sapiens
ggccatttttctggg

SEQ ID NO: 6324248 - DNA, 19 bp, Homo sapiens
ggcccaaagcttgtaaata

SEQ ID NO: 6324249 - DNA, 20 bp, Homo sapiens
ggcccaaaggcccagggagg

SEQ ID NO: 6324250 - DNA, 19 bp, Homo sapiens
ggcccaaaggtgatggtca

SEQ ID NO: 6324251 - DNA, 23 bp, Homo sapiens
ggcccaaatccagtgtgcacccc

SEQ ID NO: 6324252 - DNA, 23 bp, Homo sapiens
ggcccaacacaattcttcttcca

SEQ ID NO: 6324253 - DNA, 20 bp, Homo sapiens
ggcccaaccaccagatgaga

SEQ ID NO: 6324254 - DNA, 17 bp, Homo sapiens
ggcccaacccaaccact

SEQ ID NO: 6324255 - DNA, 16 bp, Homo sapiens
ggcccaacctcgccct

SEQ ID NO: 6324256 - DNA, 19 bp, Homo sapiens
ggcccaacctcgccctctc

SEQ ID NO: 6324257 - DNA, 21 bp, Homo sapiens
ggcccaacctcgccctctctc

SEQ ID NO: 6324258 - DNA, 20 bp, Homo sapiens
ggcccaactggttcaggctc

SEQ ID NO: 6324259 - DNA, 17 bp, Homo sapiens
ggcccaagagagacagc

SEQ ID NO: 6324260 - DNA, 19 bp, Homo sapiens
ggcccaagagatgaagagt

SEQ ID NO: 6324261 - DNA, 13 bp, Homo sapiens
ggcccaagagccc

SEQ ID NO: 6324262 - DNA, 16 bp, Homo sapiens
ggcccaagcatgcccc

SEQ ID NO: 6324263 - DNA, 19 bp, Homo sapiens
ggcccaagcatgccccacc

SEQ ID NO: 6324264 - DNA, 18 bp, Homo sapiens
ggcccaagctgggctccc

SEQ ID NO: 6324265 - DNA, 21 bp, Homo sapiens
ggcccaagctgggctcccttt

SEQ ID NO: 6324266 - DNA, 21 bp, Homo sapiens
gtcctggtaattcctctccag

SEQ ID NO: 6324267 - DNA, 24 bp, Homo sapiens
gtcctggtaattcctctccaggcc

SEQ ID NO: 6324268 - DNA, 16 bp, Homo sapiens
gtcctggtacagcagg

SEQ ID NO: 6324269 - DNA, 16 bp, Homo sapiens
gtcctggtccctctga

SEQ ID NO: 6324270 - DNA, 17 bp, Homo sapiens
gtcctggtccctctgag

SEQ ID NO: 6324271 - DNA, 16 bp, Homo sapiens
gtcctggtcctggctg

SEQ ID NO: 6324272 - DNA, 18 bp, Homo sapiens
gtcctggtctgctcagga

SEQ ID NO: 6324273 - DNA, 19 bp, Homo sapiens
gtcctggtctgctcaggaa

SEQ ID NO: 6324274 - DNA, 21 bp, Homo sapiens
gtcctggtctgctcaggaatt

SEQ ID NO: 6324275 - DNA, 15 bp, Homo sapiens
gtcctggtgaggaca

SEQ ID NO: 6324276 - DNA, 11 bp, Homo sapiens
gtcctggtgct

SEQ ID NO: 6324277 - DNA, 14 bp, Homo sapiens
gtcctggtgctctc

SEQ ID NO: 6324278 - DNA, 14 bp, Homo sapiens
gtcctggtgctgcc

SEQ ID NO: 6324279 - DNA, 18 bp, Homo sapiens
gtcctggtggggcagctc

SEQ ID NO: 6324280 - DNA, 20 bp, Homo sapiens
gtcctggtggggcagctcct

SEQ ID NO: 6324281 - DNA, 16 bp, Homo sapiens
gtcctggtggggctga

SEQ ID NO: 6324282 - DNA, 21 bp, Homo sapiens
gtcctggtggggctgagcctg

SEQ ID NO: 6324283 - DNA, 23 bp, Homo sapiens
gtcctggtgggtcagcccagcac

SEQ ID NO: 6324284 - DNA, 23 bp, Homo sapiens
gtcctggtggtattttcaatagc

SEQ ID NO: 6324285 - DNA, 14 bp, Homo sapiens
gtcctggttgtctg

SEQ ID NO: 6324286 - DNA, 22 bp, Homo sapiens
gtcctggttgtctgaacccagg

SEQ ID NO: 6324287 - DNA, 19 bp, Homo sapiens
gtcctggtttcctggcagc

SEQ ID NO: 6324288 - DNA, 14 bp, Homo sapiens
gtcctgtaaacact

SEQ ID NO: 6324289 - DNA, 18 bp, Homo sapiens
gtcctgtagagagagacc

SEQ ID NO: 6324290 - DNA, 20 bp, Homo sapiens
gtcctgtagcacgctgcctg

SEQ ID NO: 6324291 - DNA, 18 bp, Homo sapiens
gtcctgtaggagttctat

SEQ ID NO: 6324292 - DNA, 21 bp, Homo sapiens
gtcctgtagttgcgtggactc

SEQ ID NO: 6324293 - DNA, 23 bp, Homo sapiens
gtcctgtagttgcgtggactctg

SEQ ID NO: 6324294 - DNA, 15 bp, Homo sapiens
gtcctgtcaccctgg

SEQ ID NO: 6324295 - DNA, 19 bp, Homo sapiens
gtcctgtcagcttccccag

SEQ ID NO: 6324296 - DNA, 13 bp, Homo sapiens
gtcctgtcagtgc

SEQ ID NO: 6324297 - DNA, 15 bp, Homo sapiens
gtcctgtcagtgccg

SEQ ID NO: 6324298 - DNA, 21 bp, Homo sapiens
gtcctgtcagtgccgccgcct

SEQ ID NO: 6324299 - DNA, 20 bp, Homo sapiens
gtcctgtcatcatcatggcc

SEQ ID NO: 6324300 - DNA, 23 bp, Homo sapiens
gtcctgtcatcatcatggccagc

SEQ ID NO: 6324301 - DNA, 23 bp, Homo sapiens
gtcctgtccggagcgaccctggc

SEQ ID NO: 6324302 - DNA, 14 bp, Homo sapiens
gtcctgtcctgctc

SEQ ID NO: 6324303 - DNA, 16 bp, Homo sapiens
gtcctgtcctttcttg

SEQ ID NO: 6324304 - DNA, 17 bp, Homo sapiens
gtcctgtcctttcttgc

SEQ ID NO: 6324305 - DNA, 23 bp, Homo sapiens
gtcctgtcgaaggggaggcacac

SEQ ID NO: 6324306 - DNA, 18 bp, Homo sapiens
gtcctgtcggagccctgt

SEQ ID NO: 6324307 - DNA, 14 bp, Homo sapiens
gtcctgtctctgca

SEQ ID NO: 6324308 - DNA, 15 bp, Homo sapiens
gtcctgtctgtcctt

SEQ ID NO: 6324309 - DNA, 14 bp, Homo sapiens
gtcctgtctttgat

SEQ ID NO: 6324310 - DNA, 22 bp, Homo sapiens
gtcctgtgaagtaacccctcct

SEQ ID NO: 6324311 - DNA, 17 bp, Homo sapiens
gtcctgtgaatggaagc

SEQ ID NO: 6324312 - DNA, 19 bp, Homo sapiens
gtcctgtgaggtttcccaa

SEQ ID NO: 6324313 - DNA, 15 bp, Homo sapiens
gtcctgtgatcttat

SEQ ID NO: 6324314 - DNA, 16 bp, Homo sapiens
gtcctgtgatgtcagc

SEQ ID NO: 6324315 - DNA, 11 bp, Homo sapiens
gtcctgtgccc

SEQ ID NO: 6324316 - DNA, 15 bp, Homo sapiens
gtcctgtgccccgac

SEQ ID NO: 6324317 - DNA, 18 bp, Homo sapiens
gtcctgtgctttctgcat

SEQ ID NO: 6324318 - DNA, 20 bp, Homo sapiens
gtcctgtgtaaattagtgta

SEQ ID NO: 6324319 - DNA, 16 bp, Homo sapiens
gtcctgtgtcagttta

SEQ ID NO: 6324320 - DNA, 22 bp, Homo sapiens
gtcctgtgtcagtttatgtttt

SEQ ID NO: 6324321 - DNA, 18 bp, Homo sapiens
gtcctgtgtcatctgtca

SEQ ID NO: 6324322 - DNA, 21 bp, Homo sapiens
gtcctgtgttttttctgccac

SEQ ID NO: 6324323 - DNA, 23 bp, Homo sapiens
gtcctgttaacgtcatctcaggg

SEQ ID NO: 6324324 - DNA, 15 bp, Homo sapiens
gtcctgttccctacc

SEQ ID NO: 6324325 - DNA, 14 bp, Homo sapiens
gtcctgttcttcct

SEQ ID NO: 6324326 - DNA, 14 bp, Homo sapiens
gtcctgttgaagac

SEQ ID NO: 6324327 - DNA, 17 bp, Homo sapiens
gtcctgttgatcccagt

SEQ ID NO: 6324328 - DNA, 17 bp, Homo sapiens
gtcctgtttctgtcaag

SEQ ID NO: 6324329 - DNA, 12 bp, Homo sapiens
gtcctgtttctt

SEQ ID NO: 6324330 - DNA, 15 bp, Homo sapiens
gtccttaaagccatt

SEQ ID NO: 6324331 - DNA, 19 bp, Homo sapiens
gtccttaacccacctctcc

SEQ ID NO: 6324332 - DNA, 17 bp, Homo sapiens
gtccttaagcagaggaa

SEQ ID NO: 6324333 - DNA, 21 bp, Homo sapiens
gtccttaatgaagagccagcc

SEQ ID NO: 6324334 - DNA, 23 bp, Homo sapiens
gtccttaatgctgaaaacacaga

SEQ ID NO: 6324335 - DNA, 16 bp, Homo sapiens
gtccttacctcgggga

SEQ ID NO: 6324336 - DNA, 14 bp, Homo sapiens
gtccttactcagag

SEQ ID NO: 6324337 - DNA, 17 bp, Homo sapiens
gtccttactcccccacc

SEQ ID NO: 6324338 - DNA, 17 bp, Homo sapiens
gtccttagaacatttta

SEQ ID NO: 6324339 - DNA, 23 bp, Homo sapiens
gtccttagactccttctccccaa

SEQ ID NO: 6324340 - DNA, 18 bp, Homo sapiens
gtccttagcaaggggctc

SEQ ID NO: 6324341 - DNA, 13 bp, Homo sapiens
gtccttagcctgg

SEQ ID NO: 6324342 - DNA, 15 bp, Homo sapiens
gtccttagcctgggc

SEQ ID NO: 6324343 - DNA, 20 bp, Homo sapiens
gtccttagcctgggcctcct

SEQ ID NO: 6324344 - DNA, 19 bp, Homo sapiens
gtccttaggagacgctgca

SEQ ID NO: 6324345 - DNA, 18 bp, Homo sapiens
gtccttaggcctctgaga

SEQ ID NO: 6324346 - DNA, 18 bp, Homo sapiens
gtccttagtatcagtcat

SEQ ID NO: 6324347 - DNA, 15 bp, Homo sapiens
gtccttatgttaagc

SEQ ID NO: 6324348 - DNA, 18 bp, Homo sapiens
gtccttattatcccagct

SEQ ID NO: 6324349 - DNA, 16 bp, Homo sapiens
gtccttattcttgtgg

SEQ ID NO: 6324350 - DNA, 21 bp, Homo sapiens
gtccttcactggcgccttctc

SEQ ID NO: 6324351 - DNA, 20 bp, Homo sapiens
gtccttcagtgagcccctcc

SEQ ID NO: 6324352 - DNA, 11 bp, Homo sapiens
gtccttcagtt

SEQ ID NO: 6324353 - DNA, 16 bp, Homo sapiens
gtccttcagtttagaa

SEQ ID NO: 6324354 - DNA, 21 bp, Homo sapiens
gtccttcattccgttaggaat

SEQ ID NO: 6324355 - DNA, 13 bp, Homo sapiens
gtccttcccccag

SEQ ID NO: 6324356 - DNA, 18 bp, Homo sapiens
gtccttcccctcttcttc

SEQ ID NO: 6324357 - DNA, 14 bp, Homo sapiens
gtccttccccttcc

SEQ ID NO: 6324358 - DNA, 16 bp, Homo sapiens
gtccttccctgcccca

SEQ ID NO: 6324359 - DNA, 19 bp, Homo sapiens
gtccttccctgttctccct

SEQ ID NO: 6324360 - DNA, 16 bp, Homo sapiens
gtccttcctccacaag

SEQ ID NO: 6324361 - DNA, 23 bp, Homo sapiens
gtccttcctttaggtctggttgt

SEQ ID NO: 6324362 - DNA, 18 bp, Homo sapiens
gtccttctaatgaagaca

SEQ ID NO: 6324363 - DNA, 21 bp, Homo sapiens
gtccttctacagaacctgagg

SEQ ID NO: 6324364 - DNA, 16 bp, Homo sapiens
gtccttctcctcttgt

SEQ ID NO: 6324365 - DNA, 19 bp, Homo sapiens
gtccttctctcacctccta

SEQ ID NO: 6324366 - DNA, 13 bp, Homo sapiens
gtccttcttcctc

SEQ ID NO: 6324367 - DNA, 15 bp, Homo sapiens
gtccttctttcctct

SEQ ID NO: 6324368 - DNA, 11 bp, Homo sapiens
gtccttgaaaa

SEQ ID NO: 6324369 - DNA, 14 bp, Homo sapiens
gtccttgaaaatat

SEQ ID NO: 6324370 - DNA, 15 bp, Homo sapiens
gtccttgaacccaac

SEQ ID NO: 6324371 - DNA, 16 bp, Homo sapiens
gtccttgaactgaggc

SEQ ID NO: 6324372 - DNA, 16 bp, Homo sapiens
gtccttgaatgccata

SEQ ID NO: 6324373 - DNA, 19 bp, Homo sapiens
gtccttgatgccagagggc

SEQ ID NO: 6324374 - DNA, 23 bp, Homo sapiens
gtccttgatgccagagggccagc

SEQ ID NO: 6324375 - DNA, 19 bp, Homo sapiens
gtccttgatttcaaagttt

SEQ ID NO: 6324376 - DNA, 12 bp, Homo sapiens
gtccttgcacac

SEQ ID NO: 6324377 - DNA, 18 bp, Homo sapiens
gtccttgcacctgagcct

SEQ ID NO: 6324378 - DNA, 19 bp, Homo sapiens
gtccttgcacctgagcctg

SEQ ID NO: 6324379 - DNA, 18 bp, Homo sapiens
gtccttgcacctgcatcc

SEQ ID NO: 6324380 - DNA, 17 bp, Homo sapiens
gtccttgcctcctggaa

SEQ ID NO: 6324381 - DNA, 19 bp, Homo sapiens
gtccttgcctgaactccag

SEQ ID NO: 6324382 - DNA, 22 bp, Homo sapiens
gtccttgcgtcccatgaggtct

SEQ ID NO: 6324383 - DNA, 15 bp, Homo sapiens
gtccttgctcctgga

SEQ ID NO: 6324384 - DNA, 23 bp, Homo sapiens
gtccttggccccctttcccgggc

SEQ ID NO: 6324385 - DNA, 20 bp, Homo sapiens
gtccttggctggactgtaga

SEQ ID NO: 6324386 - DNA, 22 bp, Homo sapiens
gtccttggtggccgggggtggg

SEQ ID NO: 6324387 - DNA, 15 bp, Homo sapiens
gtccttgtccccgcc

SEQ ID NO: 6324388 - DNA, 20 bp, Homo sapiens
gtccttgttcccctaatcta

SEQ ID NO: 6324389 - DNA, 15 bp, Homo sapiens
gtcctttaggcagcc

SEQ ID NO: 6324390 - DNA, 17 bp, Homo sapiens
gtcctttaggcagcctg

SEQ ID NO: 6324391 - DNA, 13 bp, Homo sapiens
gtcctttatgtat

SEQ ID NO: 6324392 - DNA, 17 bp, Homo sapiens
gtcctttatgtattctc

SEQ ID NO: 6324393 - DNA, 16 bp, Homo sapiens
gtcctttatgtggaaa

SEQ ID NO: 6324394 - DNA, 21 bp, Homo sapiens
gtcctttattgtccattccaa

SEQ ID NO: 6324395 - DNA, 18 bp, Homo sapiens
gtcctttccaaggcttct

SEQ ID NO: 6324396 - DNA, 20 bp, Homo sapiens
gtcctttccaaggcttctcc

SEQ ID NO: 6324397 - DNA, 14 bp, Homo sapiens
gtcctttcccacca

SEQ ID NO: 6324398 - DNA, 21 bp, Homo sapiens
gtcctttcccaccattcctgc

SEQ ID NO: 6324399 - DNA, 12 bp, Homo sapiens
gtcctttcccct

SEQ ID NO: 6324400 - DNA, 15 bp, Homo sapiens
gtcctttcccctctc

SEQ ID NO: 6324401 - DNA, 18 bp, Homo sapiens
gtcctttcccctctctgc

SEQ ID NO: 6324402 - DNA, 24 bp, Homo sapiens
gtcctttcccctctctgcccctga

SEQ ID NO: 6324403 - DNA, 12 bp, Homo sapiens
gtcctttccctg

SEQ ID NO: 6324404 - DNA, 22 bp, Homo sapiens
gtcctttccctggagtcagttt

SEQ ID NO: 6324405 - DNA, 15 bp, Homo sapiens
gtcctttcctctcct

SEQ ID NO: 6324406 - DNA, 22 bp, Homo sapiens
gtcctttcctctcctctctgga

SEQ ID NO: 6324407 - DNA, 14 bp, Homo sapiens
gtcctttccttctc

SEQ ID NO: 6324408 - DNA, 14 bp, Homo sapiens
gtcctttctcagag

SEQ ID NO: 6324409 - DNA, 11 bp, Homo sapiens
gtcctttctcc

SEQ ID NO: 6324410 - DNA, 13 bp, Homo sapiens
gtcctttctccag

SEQ ID NO: 6324411 - DNA, 18 bp, Homo sapiens
gtcctttctgccttggcc

SEQ ID NO: 6324412 - DNA, 18 bp, Homo sapiens
gtcctttctgtgaagcta

SEQ ID NO: 6324413 - DNA, 20 bp, Homo sapiens
gtcctttcttccggcccctc

SEQ ID NO: 6324414 - DNA, 21 bp, Homo sapiens
gtcctttgagaaagaaataat

SEQ ID NO: 6324415 - DNA, 15 bp, Homo sapiens
gtcctttgaggcccc

SEQ ID NO: 6324416 - DNA, 22 bp, Homo sapiens
gtcctttgagtgtcaggctctg

SEQ ID NO: 6324417 - DNA, 16 bp, Homo sapiens
gtcctttgggtgactc

SEQ ID NO: 6324418 - DNA, 17 bp, Homo sapiens
gtccttttagcacatca

SEQ ID NO: 6324419 - DNA, 19 bp, Homo sapiens
gtccttttagcacatcact

SEQ ID NO: 6324420 - DNA, 20 bp, Homo sapiens
gtccttttagcacatcactg

SEQ ID NO: 6324421 - DNA, 19 bp, Homo sapiens
gtcctttttcactttgaaa

SEQ ID NO: 6324422 - DNA, 16 bp, Homo sapiens
gtcctttttttccatc

SEQ ID NO: 6324423 - DNA, 18 bp, Homo sapiens
gtcgaaaggtgcagctgc

SEQ ID NO: 6324424 - DNA, 13 bp, Homo sapiens
gtcgaaagttagt

SEQ ID NO: 6324425 - DNA, 18 bp, Homo sapiens
gtcgaagcaatcagcaaa

SEQ ID NO: 6324426 - DNA, 20 bp, Homo sapiens
gtcgaaggatgctctttccc

SEQ ID NO: 6324427 - DNA, 19 bp, Homo sapiens
gtcgaaggggaggcacact

SEQ ID NO: 6324428 - DNA, 21 bp, Homo sapiens
gtcgaatgggtaaaggagcat

SEQ ID NO: 6324429 - DNA, 17 bp, Homo sapiens
gtcgaattaatagcttt

SEQ ID NO: 6324430 - DNA, 15 bp, Homo sapiens
gtcgacactaagaat

SEQ ID NO: 6324431 - DNA, 16 bp, Homo sapiens
gtcgactttgagctgg

SEQ ID NO: 6324432 - DNA, 12 bp, Homo sapiens
gtcgagacactt

SEQ ID NO: 6324433 - DNA, 14 bp, Homo sapiens
gtcgagagctggcc

SEQ ID NO: 6324434 - DNA, 16 bp, Homo sapiens
gtcgagagctggccaa

SEQ ID NO: 6324435 - DNA, 13 bp, Homo sapiens
gtcgagcactcta

SEQ ID NO: 6324436 - DNA, 20 bp, Homo sapiens
gtcgagcactctaattagag

SEQ ID NO: 6324437 - DNA, 19 bp, Homo sapiens
gtcgagctgggaaggttcc

SEQ ID NO: 6324438 - DNA, 14 bp, Homo sapiens
gtcgagctgtgctc

SEQ ID NO: 6324439 - DNA, 23 bp, Homo sapiens
gtcgagctgtgctcgggtgctgc

SEQ ID NO: 6324440 - DNA, 12 bp, Homo sapiens
gtcgaggcagga

SEQ ID NO: 6324441 - DNA, 23 bp, Homo sapiens
gtcgaggccacattgctggctgc

SEQ ID NO: 6324442 - DNA, 18 bp, Homo sapiens
gtcgaggctggtaaggga

SEQ ID NO: 6324443 - DNA, 12 bp, Homo sapiens
gtcgagtccagt

SEQ ID NO: 6324444 - DNA, 21 bp, Homo sapiens
ggcccaaggagcttacccaag

SEQ ID NO: 6324445 - DNA, 11 bp, Homo sapiens
ggcccaaggcc

SEQ ID NO: 6324446 - DNA, 20 bp, Homo sapiens
ggcccaagggatggcaccac

SEQ ID NO: 6324447 - DNA, 21 bp, Homo sapiens
ggcccaagggatggcaccact

SEQ ID NO: 6324448 - DNA, 17 bp, Homo sapiens
ggcccaaggtcccctcc

SEQ ID NO: 6324449 - DNA, 15 bp, Homo sapiens
ggcccaagtcattgt

SEQ ID NO: 6324450 - DNA, 15 bp, Homo sapiens
ggcccaagtccctgt

SEQ ID NO: 6324451 - DNA, 22 bp, Homo sapiens
ggcccaagtccctgttttctga

SEQ ID NO: 6324452 - DNA, 21 bp, Homo sapiens
ggcccaatccaaggtggggtg

SEQ ID NO: 6324453 - DNA, 19 bp, Homo sapiens
ggcccaatgaggtggctca

SEQ ID NO: 6324454 - DNA, 14 bp, Homo sapiens
ggcccaatgctgct

SEQ ID NO: 6324455 - DNA, 15 bp, Homo sapiens
ggcccaatgctgctt

SEQ ID NO: 6324456 - DNA, 16 bp, Homo sapiens
ggcccacaaaggggag

SEQ ID NO: 6324457 - DNA, 19 bp, Homo sapiens
ggcccacaaaggggagaag

SEQ ID NO: 6324458 - DNA, 12 bp, Homo sapiens
ggcccacacaca

SEQ ID NO: 6324459 - DNA, 13 bp, Homo sapiens
ggcccacacctgg

SEQ ID NO: 6324460 - DNA, 20 bp, Homo sapiens
ggcccacacgtgcatagagg

SEQ ID NO: 6324461 - DNA, 13 bp, Homo sapiens
ggcccacagagcc

SEQ ID NO: 6324462 - DNA, 17 bp, Homo sapiens
ggcccacagagcctggc

SEQ ID NO: 6324463 - DNA, 18 bp, Homo sapiens
ggcccacagagcctggct

SEQ ID NO: 6324464 - DNA, 23 bp, Homo sapiens
ggcccacagcaggtgctgagcaa

SEQ ID NO: 6324465 - DNA, 12 bp, Homo sapiens
ggcccacagccc

SEQ ID NO: 6324466 - DNA, 13 bp, Homo sapiens
ggcccacagcccc

SEQ ID NO: 6324467 - DNA, 15 bp, Homo sapiens
ggcccacagccccca

SEQ ID NO: 6324468 - DNA, 20 bp, Homo sapiens
ggcccacagctcccacccca

SEQ ID NO: 6324469 - DNA, 15 bp, Homo sapiens
ggcccacagctctgc

SEQ ID NO: 6324470 - DNA, 17 bp, Homo sapiens
ggcccacagctctgctg

SEQ ID NO: 6324471 - DNA, 21 bp, Homo sapiens
ggcccacaggaagctcagcct

SEQ ID NO: 6324472 - DNA, 23 bp, Homo sapiens
ggcccacaggaggcaagcaagct

SEQ ID NO: 6324473 - DNA, 20 bp, Homo sapiens
ggcccacagggaaccctgct

SEQ ID NO: 6324474 - DNA, 17 bp, Homo sapiens
ggcccacagggtaccag

SEQ ID NO: 6324475 - DNA, 21 bp, Homo sapiens
ggcccacattgcccacacctg

SEQ ID NO: 6324476 - DNA, 16 bp, Homo sapiens
ggcccacattggaaga

SEQ ID NO: 6324477 - DNA, 19 bp, Homo sapiens
ggcccaccagagcctccct

SEQ ID NO: 6324478 - DNA, 20 bp, Homo sapiens
ggcccaccagggactgcagc

SEQ ID NO: 6324479 - DNA, 21 bp, Homo sapiens
ggcccaccagggactgcagct

SEQ ID NO: 6324480 - DNA, 14 bp, Homo sapiens
ggcccaccagggtc

SEQ ID NO: 6324481 - DNA, 15 bp, Homo sapiens
ggcccaccagggtcc

SEQ ID NO: 6324482 - DNA, 15 bp, Homo sapiens
ggcccaccccagcct

SEQ ID NO: 6324483 - DNA, 17 bp, Homo sapiens
ggcccaccccccagcct

SEQ ID NO: 6324484 - DNA, 12 bp, Homo sapiens
ggcccacccctc

SEQ ID NO: 6324485 - DNA, 20 bp, Homo sapiens
ggcccacccggtgggacccc

SEQ ID NO: 6324486 - DNA, 14 bp, Homo sapiens
ggcccaccctctgc

SEQ ID NO: 6324487 - DNA, 20 bp, Homo sapiens
ggcccaccggatgctgtgcc

SEQ ID NO: 6324488 - DNA, 22 bp, Homo sapiens
ggcccacctaccttcaaagctg

SEQ ID NO: 6324489 - DNA, 15 bp, Homo sapiens
ggcccacctggccac

SEQ ID NO: 6324490 - DNA, 19 bp, Homo sapiens
ggcccacctggccacctga

SEQ ID NO: 6324491 - DNA, 21 bp, Homo sapiens
ggcccaccttccccagaacca

SEQ ID NO: 6324492 - DNA, 17 bp, Homo sapiens
ggcccaccttggaccct

SEQ ID NO: 6324493 - DNA, 15 bp, Homo sapiens
ggcccacgcagagcc

SEQ ID NO: 6324494 - DNA, 21 bp, Homo sapiens
ggcccacgcagagccccggag

SEQ ID NO: 6324495 - DNA, 17 bp, Homo sapiens
ggcccacgccagctggc

SEQ ID NO: 6324496 - DNA, 18 bp, Homo sapiens
ggcccactagagggccca

SEQ ID NO: 6324497 - DNA, 23 bp, Homo sapiens
ggcccactcaggggtcactgagg

SEQ ID NO: 6324498 - DNA, 13 bp, Homo sapiens
ggcccactcccca

SEQ ID NO: 6324499 - DNA, 17 bp, Homo sapiens
ggcccactccccagccc

SEQ ID NO: 6324500 - DNA, 15 bp, Homo sapiens
ggcccactgcagaga

SEQ ID NO: 6324501 - DNA, 19 bp, Homo sapiens
ggcccactttcctgagctg

SEQ ID NO: 6324502 - DNA, 16 bp, Homo sapiens
ggcccagaaagcctct

SEQ ID NO: 6324503 - DNA, 12 bp, Homo sapiens
ggcccagaactg

SEQ ID NO: 6324504 - DNA, 16 bp, Homo sapiens
ggcccagaactgcccc

SEQ ID NO: 6324505 - DNA, 17 bp, Homo sapiens
ggcccagaactgccccc

SEQ ID NO: 6324506 - DNA, 17 bp, Homo sapiens
ggcccagaccactgtct

SEQ ID NO: 6324507 - DNA, 17 bp, Homo sapiens
ggcccagacccagcccg

SEQ ID NO: 6324508 - DNA, 23 bp, Homo sapiens
ggcccagacccagcccgcggcct

SEQ ID NO: 6324509 - DNA, 15 bp, Homo sapiens
ggcccagaccctggg

SEQ ID NO: 6324510 - DNA, 18 bp, Homo sapiens
ggcccagaccctgggcaa

SEQ ID NO: 6324511 - DNA, 12 bp, Homo sapiens
ggcccagacctg

SEQ ID NO: 6324512 - DNA, 15 bp, Homo sapiens
ggcccagacctggcc

SEQ ID NO: 6324513 - DNA, 22 bp, Homo sapiens
ggcccagacctggcctctgcca

SEQ ID NO: 6324514 - DNA, 23 bp, Homo sapiens
ggcccagacctggcctctgccat

SEQ ID NO: 6324515 - DNA, 15 bp, Homo sapiens
ggcccagagaagcaa

SEQ ID NO: 6324516 - DNA, 18 bp, Homo sapiens
ggcccagagaccccttcc

SEQ ID NO: 6324517 - DNA, 13 bp, Homo sapiens
ggcccagagaggt

SEQ ID NO: 6324518 - DNA, 16 bp, Homo sapiens
ggcccagagcaggaag

SEQ ID NO: 6324519 - DNA, 11 bp, Homo sapiens
ggcccagagcc

SEQ ID NO: 6324520 - DNA, 13 bp, Homo sapiens
ggcccagagccca

SEQ ID NO: 6324521 - DNA, 15 bp, Homo sapiens
ggcccagagcccagc

SEQ ID NO: 6324522 - DNA, 13 bp, Homo sapiens
ggcccagagccct

SEQ ID NO: 6324523 - DNA, 15 bp, Homo sapiens
ggcccagagcccttg

SEQ ID NO: 6324524 - DNA, 20 bp, Homo sapiens
ggcccagagcgaggaaagga

SEQ ID NO: 6324525 - DNA, 15 bp, Homo sapiens
ggcccagaggagagg

SEQ ID NO: 6324526 - DNA, 22 bp, Homo sapiens
ggcccagaggagaggagacaga

SEQ ID NO: 6324527 - DNA, 12 bp, Homo sapiens
ggcccagaggca

SEQ ID NO: 6324528 - DNA, 14 bp, Homo sapiens
ggcccagaggcaca

SEQ ID NO: 6324529 - DNA, 13 bp, Homo sapiens
ggcccagaggctg

SEQ ID NO: 6324530 - DNA, 23 bp, Homo sapiens
ggcccagaggggcggggccagga

SEQ ID NO: 6324531 - DNA, 20 bp, Homo sapiens
ggcccagagtgaaccgtcct

SEQ ID NO: 6324532 - DNA, 15 bp, Homo sapiens
ggcccagcaccccct

SEQ ID NO: 6324533 - DNA, 22 bp, Homo sapiens
ggcccagcaccccctctcctgg

SEQ ID NO: 6324534 - DNA, 16 bp, Homo sapiens
ggcccagcacgagcct

SEQ ID NO: 6324535 - DNA, 16 bp, Homo sapiens
ggcccagcactgccca

SEQ ID NO: 6324536 - DNA, 15 bp, Homo sapiens
ggcccagcagagccg

SEQ ID NO: 6324537 - DNA, 17 bp, Homo sapiens
ggcccagcagcggccca

SEQ ID NO: 6324538 - DNA, 12 bp, Homo sapiens
ggcccagcagct

SEQ ID NO: 6324539 - DNA, 13 bp, Homo sapiens
ggcccagcagctt

SEQ ID NO: 6324540 - DNA, 19 bp, Homo sapiens
ggcccagcagcttggctga

SEQ ID NO: 6324541 - DNA, 20 bp, Homo sapiens
ggcccagcataattcctcca

SEQ ID NO: 6324542 - DNA, 18 bp, Homo sapiens
ggcccagccactgcagca

SEQ ID NO: 6324543 - DNA, 13 bp, Homo sapiens
ggcccagccagca

SEQ ID NO: 6324544 - DNA, 16 bp, Homo sapiens
ggcccagccagccagg

SEQ ID NO: 6324545 - DNA, 15 bp, Homo sapiens
ggcccagcccagagc

SEQ ID NO: 6324546 - DNA, 16 bp, Homo sapiens
ggcccagcccagagcc

SEQ ID NO: 6324547 - DNA, 22 bp, Homo sapiens
ggcccagcccagagccacctgg

SEQ ID NO: 6324548 - DNA, 19 bp, Homo sapiens
ggcccagcccccacagtgc

SEQ ID NO: 6324549 - DNA, 21 bp, Homo sapiens
ggcccagcccccacagtgctg

SEQ ID NO: 6324550 - DNA, 22 bp, Homo sapiens
ggcccagccctgctggccgcct

SEQ ID NO: 6324551 - DNA, 14 bp, Homo sapiens
ggcccagccctggg

SEQ ID NO: 6324552 - DNA, 15 bp, Homo sapiens
ggcccagccctgggc

SEQ ID NO: 6324553 - DNA, 16 bp, Homo sapiens
ggcccagccgaccccc

SEQ ID NO: 6324554 - DNA, 19 bp, Homo sapiens
ggcccagccgaccccctct

SEQ ID NO: 6324555 - DNA, 20 bp, Homo sapiens
ggcccagccggcctctctgg

SEQ ID NO: 6324556 - DNA, 19 bp, Homo sapiens
ggcccagccggggtggggt

SEQ ID NO: 6324557 - DNA, 12 bp, Homo sapiens
ggcccagcctct

SEQ ID NO: 6324558 - DNA, 17 bp, Homo sapiens
ggcccagcctctctggc

SEQ ID NO: 6324559 - DNA, 20 bp, Homo sapiens
ggcccagcctctctggctca

SEQ ID NO: 6324560 - DNA, 15 bp, Homo sapiens
ggcccagcctctgcc

SEQ ID NO: 6324561 - DNA, 15 bp, Homo sapiens
ggcccagcctggagc

SEQ ID NO: 6324562 - DNA, 17 bp, Homo sapiens
ggcccagcctggcccca

SEQ ID NO: 6324563 - DNA, 23 bp, Homo sapiens
ggcccagcctggccccaaatgtt

SEQ ID NO: 6324564 - DNA, 17 bp, Homo sapiens
ggcccagcctgtcctgg

SEQ ID NO: 6324565 - DNA, 22 bp, Homo sapiens
ggcccagcctgtcctggtacag

SEQ ID NO: 6324566 - DNA, 16 bp, Homo sapiens
ggcccagcctgtggcc

SEQ ID NO: 6324567 - DNA, 19 bp, Homo sapiens
ggcccagcctgtggcctca

SEQ ID NO: 6324568 - DNA, 22 bp, Homo sapiens
ggcccagcctgtggcctcagca

SEQ ID NO: 6324569 - DNA, 19 bp, Homo sapiens
ggcccagcctttgttcccc

SEQ ID NO: 6324570 - DNA, 16 bp, Homo sapiens
ggcccagcgcggccag

SEQ ID NO: 6324571 - DNA, 18 bp, Homo sapiens
ggcccagcgcggccagcg

SEQ ID NO: 6324572 - DNA, 15 bp, Homo sapiens
ggcccagcgctctcc

SEQ ID NO: 6324573 - DNA, 18 bp, Homo sapiens
ggcccagcgctctcctgg

SEQ ID NO: 6324574 - DNA, 23 bp, Homo sapiens
ggcccagcggcccctcccacaca

SEQ ID NO: 6324575 - DNA, 18 bp, Homo sapiens
ggcccagcggtccctgca

SEQ ID NO: 6324576 - DNA, 23 bp, Homo sapiens
ggcccagctattaccacacttgg

SEQ ID NO: 6324577 - DNA, 14 bp, Homo sapiens
ggcccagctccccc

SEQ ID NO: 6324578 - DNA, 11 bp, Homo sapiens
ggcccagctga

SEQ ID NO: 6324579 - DNA, 14 bp, Homo sapiens
ggcccagctgccag

SEQ ID NO: 6324580 - DNA, 17 bp, Homo sapiens
ggcccagctgccaggga

SEQ ID NO: 6324581 - DNA, 14 bp, Homo sapiens
ggcccagctgctcc

SEQ ID NO: 6324582 - DNA, 14 bp, Homo sapiens
ggcccagctgggct

SEQ ID NO: 6324583 - DNA, 14 bp, Homo sapiens
ggcccagctgtagc

SEQ ID NO: 6324584 - DNA, 18 bp, Homo sapiens
ggcccagctgtagccatg

SEQ ID NO: 6324585 - DNA, 19 bp, Homo sapiens
ggcccagctgtagccatgg

SEQ ID NO: 6324586 - DNA, 17 bp, Homo sapiens
ggcccaggaagcccaca

SEQ ID NO: 6324587 - DNA, 23 bp, Homo sapiens
ggcccaggaaggcggcaggcaga

SEQ ID NO: 6324588 - DNA, 15 bp, Homo sapiens
ggcccaggaccagct

SEQ ID NO: 6324589 - DNA, 17 bp, Homo sapiens
ggcccaggagaccacgg

SEQ ID NO: 6324590 - DNA, 12 bp, Homo sapiens
ggcccaggagcg

SEQ ID NO: 6324591 - DNA, 15 bp, Homo sapiens
ggcccaggagcgcag

SEQ ID NO: 6324592 - DNA, 15 bp, Homo sapiens
ggcccaggagctctg

SEQ ID NO: 6324593 - DNA, 11 bp, Homo sapiens
ggcccaggagg

SEQ ID NO: 6324594 - DNA, 19 bp, Homo sapiens
ggcccaggagtttggccag

SEQ ID NO: 6324595 - DNA, 21 bp, Homo sapiens
ggcccaggagtttggccagaa

SEQ ID NO: 6324596 - DNA, 11 bp, Homo sapiens
ggcccaggcag

SEQ ID NO: 6324597 - DNA, 23 bp, Homo sapiens
ggcccaggcagacaaccttgtcc

SEQ ID NO: 6324598 - DNA, 12 bp, Homo sapiens
ggcccaggcagc

SEQ ID NO: 6324599 - DNA, 21 bp, Homo sapiens
ggcccaggcagcacctggagc

SEQ ID NO: 6324600 - DNA, 15 bp, Homo sapiens
ggcccaggcaggcca

SEQ ID NO: 6324601 - DNA, 17 bp, Homo sapiens
ggcccaggcaggcccag

SEQ ID NO: 6324602 - DNA, 21 bp, Homo sapiens
ggcccaggcaggtctgcaagg

SEQ ID NO: 6324603 - DNA, 12 bp, Homo sapiens
ggcccaggccag

SEQ ID NO: 6324604 - DNA, 13 bp, Homo sapiens
ggcccaggccagc

SEQ ID NO: 6324605 - DNA, 16 bp, Homo sapiens
ggcccaggccagcccc

SEQ ID NO: 6324606 - DNA, 16 bp, Homo sapiens
ggcccaggccaggtgc

SEQ ID NO: 6324607 - DNA, 22 bp, Homo sapiens
ggcccaggccatgtggcctgcc

SEQ ID NO: 6324608 - DNA, 20 bp, Homo sapiens
ggcccaggcccagcctcttg

SEQ ID NO: 6324609 - DNA, 19 bp, Homo sapiens
ggcccaggccgggaagagc

SEQ ID NO: 6324610 - DNA, 12 bp, Homo sapiens
ggcccaggccta

SEQ ID NO: 6324611 - DNA, 18 bp, Homo sapiens
ggcccaggcctacctcac

SEQ ID NO: 6324612 - DNA, 12 bp, Homo sapiens
ggcccaggcctc

SEQ ID NO: 6324613 - DNA, 15 bp, Homo sapiens
ggcccaggcctcacc

SEQ ID NO: 6324614 - DNA, 16 bp, Homo sapiens
ggcccaggcctcacca

SEQ ID NO: 6324615 - DNA, 15 bp, Homo sapiens
ggcccaggcctggag

SEQ ID NO: 6324616 - DNA, 13 bp, Homo sapiens
ggcccaggctgcc

SEQ ID NO: 6324617 - DNA, 13 bp, Homo sapiens
ggcccaggctggc

SEQ ID NO: 6324618 - DNA, 16 bp, Homo sapiens
ggcccaggctggcccc

SEQ ID NO: 6324619 - DNA, 21 bp, Homo sapiens
ggcccagggaatcagggagca

SEQ ID NO: 6324620 - DNA, 17 bp, Homo sapiens
ggcccagggacaccagc

SEQ ID NO: 6324621 - DNA, 20 bp, Homo sapiens
ggcccagggacaccagccag

SEQ ID NO: 6324622 - DNA, 20 bp, Homo sapiens
ggcccagggagaggccatga

SEQ ID NO: 6324623 - DNA, 12 bp, Homo sapiens
ggcccagggagg

SEQ ID NO: 6324624 - DNA, 13 bp, Homo sapiens
ggcccagggaggt

SEQ ID NO: 6324625 - DNA, 16 bp, Homo sapiens
gtcgagtctttgtgtg

SEQ ID NO: 6324626 - DNA, 18 bp, Homo sapiens
gtcgatcaagagaatcaa

SEQ ID NO: 6324627 - DNA, 14 bp, Homo sapiens
gtcgatgaactatt

SEQ ID NO: 6324628 - DNA, 13 bp, Homo sapiens
gtcgatgcacagt

SEQ ID NO: 6324629 - DNA, 13 bp, Homo sapiens
gtcgatgctcaat

SEQ ID NO: 6324630 - DNA, 23 bp, Homo sapiens
gtcgattaacctgcatgcagcaa

SEQ ID NO: 6324631 - DNA, 19 bp, Homo sapiens
gtcgcagctaccctcagcc

SEQ ID NO: 6324632 - DNA, 22 bp, Homo sapiens
gtcgccaacacttgtgttgctt

SEQ ID NO: 6324633 - DNA, 13 bp, Homo sapiens
gtcgccaggctag

SEQ ID NO: 6324634 - DNA, 19 bp, Homo sapiens
gtcgccagtcactgctgca

SEQ ID NO: 6324635 - DNA, 22 bp, Homo sapiens
gtcgccagtcactgctgcaagg

SEQ ID NO: 6324636 - DNA, 18 bp, Homo sapiens
gtcgcccacccagctggt

SEQ ID NO: 6324637 - DNA, 20 bp, Homo sapiens
gtcgcccacccagctggtcc

SEQ ID NO: 6324638 - DNA, 13 bp, Homo sapiens
gtcgcccaggctg

SEQ ID NO: 6324639 - DNA, 20 bp, Homo sapiens
gtcgcccaggctggagtgca

SEQ ID NO: 6324640 - DNA, 13 bp, Homo sapiens
gtcgccccaggcc

SEQ ID NO: 6324641 - DNA, 14 bp, Homo sapiens
gtcgcccctcagag

SEQ ID NO: 6324642 - DNA, 17 bp, Homo sapiens
gtcgcccctcagagcat

SEQ ID NO: 6324643 - DNA, 23 bp, Homo sapiens
gtcgcccctccttttggcctggg

SEQ ID NO: 6324644 - DNA, 21 bp, Homo sapiens
gtcgcccgctgagctgagtgg

SEQ ID NO: 6324645 - DNA, 13 bp, Homo sapiens
gtcgccctctgtg

SEQ ID NO: 6324646 - DNA, 15 bp, Homo sapiens
gtcgccgtccctctg

SEQ ID NO: 6324647 - DNA, 16 bp, Homo sapiens
gtcgccgtccctctgc

SEQ ID NO: 6324648 - DNA, 17 bp, Homo sapiens
gtcgccgtccctctgcc

SEQ ID NO: 6324649 - DNA, 19 bp, Homo sapiens
gtcgcctctcactctggca

SEQ ID NO: 6324650 - DNA, 12 bp, Homo sapiens
gtcgcctctgca

SEQ ID NO: 6324651 - DNA, 18 bp, Homo sapiens
gtcgcctgcggactccat

SEQ ID NO: 6324652 - DNA, 18 bp, Homo sapiens
gtcgccttagcatgtttg

SEQ ID NO: 6324653 - DNA, 18 bp, Homo sapiens
gtcgcgcaccgaaaaact

SEQ ID NO: 6324654 - DNA, 15 bp, Homo sapiens
gtcgcgcgtctccca

SEQ ID NO: 6324655 - DNA, 13 bp, Homo sapiens
gtcgcgctcagca

SEQ ID NO: 6324656 - DNA, 12 bp, Homo sapiens
gtcgcgctgcct

SEQ ID NO: 6324657 - DNA, 16 bp, Homo sapiens
gtcgcgctgcctgtgt

SEQ ID NO: 6324658 - DNA, 18 bp, Homo sapiens
gtcgcgctgcctgtgtgg

SEQ ID NO: 6324659 - DNA, 15 bp, Homo sapiens
gtcgcgctggacagc

SEQ ID NO: 6324660 - DNA, 14 bp, Homo sapiens
gtcgcggctgcagg

SEQ ID NO: 6324661 - DNA, 14 bp, Homo sapiens
gtcgctcaggctgg

SEQ ID NO: 6324662 - DNA, 16 bp, Homo sapiens
gtcgctcaggctggag

SEQ ID NO: 6324663 - DNA, 17 bp, Homo sapiens
gtcgcttgccaaagcag

SEQ ID NO: 6324664 - DNA, 23 bp, Homo sapiens
gtcggaaaagcgtctttaagaga

SEQ ID NO: 6324665 - DNA, 12 bp, Homo sapiens
gtcggaatggta

SEQ ID NO: 6324666 - DNA, 22 bp, Homo sapiens
gtcggagaggcgtttggagaag

SEQ ID NO: 6324667 - DNA, 14 bp, Homo sapiens
gtcggaggcttggg

SEQ ID NO: 6324668 - DNA, 13 bp, Homo sapiens
gtcggagggctgg

SEQ ID NO: 6324669 - DNA, 15 bp, Homo sapiens
gtcggagggctggac

SEQ ID NO: 6324670 - DNA, 16 bp, Homo sapiens
gtcggagtgcctggag

SEQ ID NO: 6324671 - DNA, 17 bp, Homo sapiens
gtcggagtgcctggagt

SEQ ID NO: 6324672 - DNA, 17 bp, Homo sapiens
gtcggcatgccaggacc

SEQ ID NO: 6324673 - DNA, 19 bp, Homo sapiens
gtcggccacaccccagact

SEQ ID NO: 6324674 - DNA, 16 bp, Homo sapiens
gtcggccagaggggct

SEQ ID NO: 6324675 - DNA, 17 bp, Homo sapiens
gtcggccagaggggctg

SEQ ID NO: 6324676 - DNA, 17 bp, Homo sapiens
gtcggccccaccagtgc

SEQ ID NO: 6324677 - DNA, 22 bp, Homo sapiens
gtcggccccaccagtgcctctc

SEQ ID NO: 6324678 - DNA, 21 bp, Homo sapiens
gtcggcctctaaccccaggcc

SEQ ID NO: 6324679 - DNA, 12 bp, Homo sapiens
gtcggctccagt

SEQ ID NO: 6324680 - DNA, 14 bp, Homo sapiens
gtcggctgaccatg

SEQ ID NO: 6324681 - DNA, 17 bp, Homo sapiens
gtcggctgaccatgctc

SEQ ID NO: 6324682 - DNA, 16 bp, Homo sapiens
gtcggctgggcagggc

SEQ ID NO: 6324683 - DNA, 17 bp, Homo sapiens
gtcggctgggcagggcc

SEQ ID NO: 6324684 - DNA, 18 bp, Homo sapiens
gtcggctgggcagggccg

SEQ ID NO: 6324685 - DNA, 17 bp, Homo sapiens
gtcgggaaattctgctg

SEQ ID NO: 6324686 - DNA, 20 bp, Homo sapiens
gtcgggaaattctgctgctt

SEQ ID NO: 6324687 - DNA, 14 bp, Homo sapiens
gtcgggacagacca

SEQ ID NO: 6324688 - DNA, 11 bp, Homo sapiens
gtcgggagagg

SEQ ID NO: 6324689 - DNA, 22 bp, Homo sapiens
gtcgggagaggggacgcaggcc

SEQ ID NO: 6324690 - DNA, 18 bp, Homo sapiens
gtcgggataacgtggggc

SEQ ID NO: 6324691 - DNA, 20 bp, Homo sapiens
gtcgggatgtcagcagacac

SEQ ID NO: 6324692 - DNA, 13 bp, Homo sapiens
gtcgggcagtcct

SEQ ID NO: 6324693 - DNA, 21 bp, Homo sapiens
gtcgggcagtggaggctgctg

SEQ ID NO: 6324694 - DNA, 16 bp, Homo sapiens
gtcgggcccctgcctg

SEQ ID NO: 6324695 - DNA, 22 bp, Homo sapiens
gtcgggcccttcttgctgccct

SEQ ID NO: 6324696 - DNA, 23 bp, Homo sapiens
gtcgggcccttcttgctgccctg

SEQ ID NO: 6324697 - DNA, 19 bp, Homo sapiens
gtcgggcttccctggcctc

SEQ ID NO: 6324698 - DNA, 16 bp, Homo sapiens
gtcgggcttgcggtgg

SEQ ID NO: 6324699 - DNA, 16 bp, Homo sapiens
gtcgggctttgtgtga

SEQ ID NO: 6324700 - DNA, 20 bp, Homo sapiens
gtcggggatcggggcaagag

SEQ ID NO: 6324701 - DNA, 17 bp, Homo sapiens
gtcgggggaggagcacc

SEQ ID NO: 6324702 - DNA, 22 bp, Homo sapiens
gtcgggggaggagcacccccag

SEQ ID NO: 6324703 - DNA, 18 bp, Homo sapiens
gtcgggggctgaggggca

SEQ ID NO: 6324704 - DNA, 18 bp, Homo sapiens
gtcggggggcgagggagg

SEQ ID NO: 6324705 - DNA, 19 bp, Homo sapiens
gtcggggggcgagggaggg

SEQ ID NO: 6324706 - DNA, 19 bp, Homo sapiens
gtcggggtgggggtgggaa

SEQ ID NO: 6324707 - DNA, 22 bp, Homo sapiens
gtcggggttggggtgggagggc

SEQ ID NO: 6324708 - DNA, 23 bp, Homo sapiens
gtcgggtgggggagggaaaggga

SEQ ID NO: 6324709 - DNA, 14 bp, Homo sapiens
gtcggtctgtgccc

SEQ ID NO: 6324710 - DNA, 13 bp, Homo sapiens
gtcggtcttgcaa

SEQ ID NO: 6324711 - DNA, 17 bp, Homo sapiens
gtcggtgaccccatcac

SEQ ID NO: 6324712 - DNA, 13 bp, Homo sapiens
gtcggtggctgtc

SEQ ID NO: 6324713 - DNA, 15 bp, Homo sapiens
gtcgtagaattcctt

SEQ ID NO: 6324714 - DNA, 18 bp, Homo sapiens
gtcgtcaaagctgaaatg

SEQ ID NO: 6324715 - DNA, 13 bp, Homo sapiens
gtcgtcccaggct

SEQ ID NO: 6324716 - DNA, 13 bp, Homo sapiens
gtcgtccccagac

SEQ ID NO: 6324717 - DNA, 14 bp, Homo sapiens
gtcgtccccagacc

SEQ ID NO: 6324718 - DNA, 19 bp, Homo sapiens
gtcgtccccagaccagtag

SEQ ID NO: 6324719 - DNA, 18 bp, Homo sapiens
gtcgtccccctccagtgc

SEQ ID NO: 6324720 - DNA, 17 bp, Homo sapiens
gtcgtcgcacagtctct

SEQ ID NO: 6324721 - DNA, 17 bp, Homo sapiens
gtcgtctgtgaatgcta

SEQ ID NO: 6324722 - DNA, 19 bp, Homo sapiens
gtcgtcttgaacgagcagc

SEQ ID NO: 6324723 - DNA, 18 bp, Homo sapiens
gtcgtgcctgtgtccatg

SEQ ID NO: 6324724 - DNA, 18 bp, Homo sapiens
gtcgtggagagctaggag

SEQ ID NO: 6324725 - DNA, 19 bp, Homo sapiens
gtcgtggagagctaggagc

SEQ ID NO: 6324726 - DNA, 13 bp, Homo sapiens
gtcgtggagccat

SEQ ID NO: 6324727 - DNA, 15 bp, Homo sapiens
gtcgtgggaaggagg

SEQ ID NO: 6324728 - DNA, 19 bp, Homo sapiens
gtcgtgggccagtccccga

SEQ ID NO: 6324729 - DNA, 23 bp, Homo sapiens
gtcgtggtggagaatctgagggc

SEQ ID NO: 6324730 - DNA, 15 bp, Homo sapiens
gtcgtggttcttaaa

SEQ ID NO: 6324731 - DNA, 21 bp, Homo sapiens
gtcgtgtcaccagctggtata

SEQ ID NO: 6324732 - DNA, 16 bp, Homo sapiens
gtcgtgtctgctgttg

SEQ ID NO: 6324733 - DNA, 12 bp, Homo sapiens
gtcgttcatttt

SEQ ID NO: 6324734 - DNA, 14 bp, Homo sapiens
gtcgttcattttct

SEQ ID NO: 6324735 - DNA, 15 bp, Homo sapiens
gtcgttcccagtgtg

SEQ ID NO: 6324736 - DNA, 21 bp, Homo sapiens
gtcgttgttgtggaagcatgt

SEQ ID NO: 6324737 - DNA, 21 bp, Homo sapiens
gtcgtttatattgtagcagtt

SEQ ID NO: 6324738 - DNA, 19 bp, Homo sapiens
gtctaaaaagacctggcct

SEQ ID NO: 6324739 - DNA, 22 bp, Homo sapiens
gtctaaaaataaaatgcattta

SEQ ID NO: 6324740 - DNA, 13 bp, Homo sapiens
gtctaaaacaata

SEQ ID NO: 6324741 - DNA, 11 bp, Homo sapiens
gtctaaaactc

SEQ ID NO: 6324742 - DNA, 22 bp, Homo sapiens
gtctaaaacttcaaaaactaaa

SEQ ID NO: 6324743 - DNA, 20 bp, Homo sapiens
gtctaaaatacttgagaaat

SEQ ID NO: 6324744 - DNA, 13 bp, Homo sapiens
gtctaaacaatga

SEQ ID NO: 6324745 - DNA, 23 bp, Homo sapiens
gtctaaacaatgaattcttcaac

SEQ ID NO: 6324746 - DNA, 16 bp, Homo sapiens
gtctaaacaatgctga

SEQ ID NO: 6324747 - DNA, 21 bp, Homo sapiens
gtctaaacaatgctgatttgg

SEQ ID NO: 6324748 - DNA, 21 bp, Homo sapiens
gtctaaactgagctcgcagcc

SEQ ID NO: 6324749 - DNA, 21 bp, Homo sapiens
gtctaaactgtttactcacat

SEQ ID NO: 6324750 - DNA, 16 bp, Homo sapiens
gtctaaagagaacaag

SEQ ID NO: 6324751 - DNA, 18 bp, Homo sapiens
gtctaaagagaacaagag

SEQ ID NO: 6324752 - DNA, 20 bp, Homo sapiens
gtctaaagatggagtttcta

SEQ ID NO: 6324753 - DNA, 23 bp, Homo sapiens
gtctaaagatggagtttctaagg

SEQ ID NO: 6324754 - DNA, 23 bp, Homo sapiens
gtctaaagccttaactaagactc

SEQ ID NO: 6324755 - DNA, 18 bp, Homo sapiens
gtctaaagttagggcatt

SEQ ID NO: 6324756 - DNA, 16 bp, Homo sapiens
gtctaaagtttacagt

SEQ ID NO: 6324757 - DNA, 17 bp, Homo sapiens
gtctaaagtttacagta

SEQ ID NO: 6324758 - DNA, 13 bp, Homo sapiens
gtctaaatttctt

SEQ ID NO: 6324759 - DNA, 22 bp, Homo sapiens
gtctaacagtttgcctgctgta

SEQ ID NO: 6324760 - DNA, 16 bp, Homo sapiens
gtctaaccaaatgcat

SEQ ID NO: 6324761 - DNA, 17 bp, Homo sapiens
gtctaaccaaatgcatc

SEQ ID NO: 6324762 - DNA, 13 bp, Homo sapiens
gtctaaccccagg

SEQ ID NO: 6324763 - DNA, 13 bp, Homo sapiens
gtctaacccccag

SEQ ID NO: 6324764 - DNA, 17 bp, Homo sapiens
gtctaacccccagctgg

SEQ ID NO: 6324765 - DNA, 16 bp, Homo sapiens
gtctaactcagaatta

SEQ ID NO: 6324766 - DNA, 20 bp, Homo sapiens
gtctaactgtggaatataaa

SEQ ID NO: 6324767 - DNA, 23 bp, Homo sapiens
gtctaacttggggaaggggcctg

SEQ ID NO: 6324768 - DNA, 22 bp, Homo sapiens
gtctaactttagaagtgcattt

SEQ ID NO: 6324769 - DNA, 21 bp, Homo sapiens
gtctaactttggttttcttgt

SEQ ID NO: 6324770 - DNA, 14 bp, Homo sapiens
gtctaagaaacatt

SEQ ID NO: 6324771 - DNA, 18 bp, Homo sapiens
gtctaagaaacattggaa

SEQ ID NO: 6324772 - DNA, 15 bp, Homo sapiens
gtctaagacccccat

SEQ ID NO: 6324773 - DNA, 20 bp, Homo sapiens
gtctaagcagttttgtaaat

SEQ ID NO: 6324774 - DNA, 23 bp, Homo sapiens
gtctaaggagcgctagtgccttg

SEQ ID NO: 6324775 - DNA, 20 bp, Homo sapiens
gtctaatcctagtttgctgt

SEQ ID NO: 6324776 - DNA, 14 bp, Homo sapiens
gtctaatcctccca

SEQ ID NO: 6324777 - DNA, 19 bp, Homo sapiens
gtctaatgatattttatgc

SEQ ID NO: 6324778 - DNA, 21 bp, Homo sapiens
gtctaatgggggcagtctccc

SEQ ID NO: 6324779 - DNA, 17 bp, Homo sapiens
gtctaatgtttaagcag

SEQ ID NO: 6324780 - DNA, 23 bp, Homo sapiens
gtctacactaagagagaatgaga

SEQ ID NO: 6324781 - DNA, 16 bp, Homo sapiens
gtctacactgcaatca

SEQ ID NO: 6324782 - DNA, 13 bp, Homo sapiens
gtctacagaaaat

SEQ ID NO: 6324783 - DNA, 17 bp, Homo sapiens
gtctacagctcccccag

SEQ ID NO: 6324784 - DNA, 15 bp, Homo sapiens
gtctacaggcctttc

SEQ ID NO: 6324785 - DNA, 23 bp, Homo sapiens
gtctacattcttggttgttaatt

SEQ ID NO: 6324786 - DNA, 12 bp, Homo sapiens
gtctacatttct

SEQ ID NO: 6324787 - DNA, 15 bp, Homo sapiens
gtctaccaatacaaa

SEQ ID NO: 6324788 - DNA, 21 bp, Homo sapiens
gtctaccaccgaatccctagt

SEQ ID NO: 6324789 - DNA, 21 bp, Homo sapiens
gtctacccctctcctttcact

SEQ ID NO: 6324790 - DNA, 17 bp, Homo sapiens
gtctaccctgatcacct

SEQ ID NO: 6324791 - DNA, 13 bp, Homo sapiens
gtctaccctggga

SEQ ID NO: 6324792 - DNA, 17 bp, Homo sapiens
gtctacctcatctctga

SEQ ID NO: 6324793 - DNA, 18 bp, Homo sapiens
gtctacctcatctctgaa

SEQ ID NO: 6324794 - DNA, 13 bp, Homo sapiens
gtctacctctgac

SEQ ID NO: 6324795 - DNA, 18 bp, Homo sapiens
gtctacctgaaaattcaa

SEQ ID NO: 6324796 - DNA, 13 bp, Homo sapiens
gtctacctgaggg

SEQ ID NO: 6324797 - DNA, 14 bp, Homo sapiens
gtctacctgagggg

SEQ ID NO: 6324798 - DNA, 15 bp, Homo sapiens
gtctacctgaggggc

SEQ ID NO: 6324799 - DNA, 16 bp, Homo sapiens
gtctacctgaggggcc

SEQ ID NO: 6324800 - DNA, 21 bp, Homo sapiens
gtctacctgctggacagcctc

SEQ ID NO: 6324801 - DNA, 21 bp, Homo sapiens
gtctacgtatgcatgctaaat

SEQ ID NO: 6324802 - DNA, 20 bp, Homo sapiens
gtctactcattccccggggc

SEQ ID NO: 6324803 - DNA, 14 bp, Homo sapiens
gtctactctagaag

SEQ ID NO: 6324804 - DNA, 21 bp, Homo sapiens
ggcccagggaggtggcaggga

SEQ ID NO: 6324805 - DNA, 19 bp, Homo sapiens
ggcccagggcaagctccgc

SEQ ID NO: 6324806 - DNA, 22 bp, Homo sapiens
ggcccagggcaagctccgcagg

SEQ ID NO: 6324807 - DNA, 14 bp, Homo sapiens
ggcccagggcccag

SEQ ID NO: 6324808 - DNA, 16 bp, Homo sapiens
ggcccagggcccagag

SEQ ID NO: 6324809 - DNA, 17 bp, Homo sapiens
ggcccagggcccagagc

SEQ ID NO: 6324810 - DNA, 19 bp, Homo sapiens
ggcccagggcccagagccc

SEQ ID NO: 6324811 - DNA, 12 bp, Homo sapiens
ggcccagggccg

SEQ ID NO: 6324812 - DNA, 13 bp, Homo sapiens
ggcccagggcctc

SEQ ID NO: 6324813 - DNA, 14 bp, Homo sapiens
ggcccagggcctct

SEQ ID NO: 6324814 - DNA, 16 bp, Homo sapiens
ggcccagggcctctgg

SEQ ID NO: 6324815 - DNA, 17 bp, Homo sapiens
ggcccagggcctctggc

SEQ ID NO: 6324816 - DNA, 18 bp, Homo sapiens
ggcccaggggaggcggca

SEQ ID NO: 6324817 - DNA, 13 bp, Homo sapiens
ggcccagggggcc

SEQ ID NO: 6324818 - DNA, 17 bp, Homo sapiens
ggcccagggggcctgga

SEQ ID NO: 6324819 - DNA, 19 bp, Homo sapiens
ggcccagggggcttcctga

SEQ ID NO: 6324820 - DNA, 22 bp, Homo sapiens
ggcccagggggcttcctgaggg

SEQ ID NO: 6324821 - DNA, 18 bp, Homo sapiens
ggcccaggtcagccactg

SEQ ID NO: 6324822 - DNA, 20 bp, Homo sapiens
ggcccaggttcgagacccaa

SEQ ID NO: 6324823 - DNA, 22 bp, Homo sapiens
ggcccagtacctagctggctct

SEQ ID NO: 6324824 - DNA, 17 bp, Homo sapiens
ggcccagtatgagccct

SEQ ID NO: 6324825 - DNA, 22 bp, Homo sapiens
ggcccagtcgtccgctcagcca

SEQ ID NO: 6324826 - DNA, 20 bp, Homo sapiens
ggcccagtgacaaagactcc

SEQ ID NO: 6324827 - DNA, 22 bp, Homo sapiens
ggcccagtgacaaagactcctc

SEQ ID NO: 6324828 - DNA, 17 bp, Homo sapiens
ggcccagtgagagtgag

SEQ ID NO: 6324829 - DNA, 19 bp, Homo sapiens
ggcccagtgcaatctgtcc

SEQ ID NO: 6324830 - DNA, 20 bp, Homo sapiens
ggcccagtgcaatctgtcca

SEQ ID NO: 6324831 - DNA, 18 bp, Homo sapiens
ggcccagtgcatggtggc

SEQ ID NO: 6324832 - DNA, 14 bp, Homo sapiens
ggcccagtgccact

SEQ ID NO: 6324833 - DNA, 15 bp, Homo sapiens
ggcccagtgccagca

SEQ ID NO: 6324834 - DNA, 15 bp, Homo sapiens
ggcccagtgccagct

SEQ ID NO: 6324835 - DNA, 16 bp, Homo sapiens
ggcccagttaaatatg

SEQ ID NO: 6324836 - DNA, 21 bp, Homo sapiens
ggcccataatagttagccctc

SEQ ID NO: 6324837 - DNA, 23 bp, Homo sapiens
ggcccataatagttagccctcag

SEQ ID NO: 6324838 - DNA, 24 bp, Homo sapiens
ggcccatatctgtgaaatgctggc

SEQ ID NO: 6324839 - DNA, 14 bp, Homo sapiens
ggcccatcaggggc

SEQ ID NO: 6324840 - DNA, 16 bp, Homo sapiens
ggcccatcaggggcag

SEQ ID NO: 6324841 - DNA, 16 bp, Homo sapiens
ggcccatcagtgtacc

SEQ ID NO: 6324842 - DNA, 13 bp, Homo sapiens
ggcccatcccccc

SEQ ID NO: 6324843 - DNA, 18 bp, Homo sapiens
ggcccatcccccctcacc

SEQ ID NO: 6324844 - DNA, 21 bp, Homo sapiens
ggcccatcccgccttctccag

SEQ ID NO: 6324845 - DNA, 22 bp, Homo sapiens
ggcccatcccgccttctccagg

SEQ ID NO: 6324846 - DNA, 20 bp, Homo sapiens
ggcccatctcaggtgccact

SEQ ID NO: 6324847 - DNA, 21 bp, Homo sapiens
ggcccatctcaggtgccactc

SEQ ID NO: 6324848 - DNA, 22 bp, Homo sapiens
ggcccatctcaggtgccactcc

SEQ ID NO: 6324849 - DNA, 15 bp, Homo sapiens
ggcccatctccctgc

SEQ ID NO: 6324850 - DNA, 18 bp, Homo sapiens
ggcccatctccctgcttt

SEQ ID NO: 6324851 - DNA, 13 bp, Homo sapiens
ggcccatctgtcc

SEQ ID NO: 6324852 - DNA, 14 bp, Homo sapiens
ggcccatctgtcca

SEQ ID NO: 6324853 - DNA, 22 bp, Homo sapiens
ggcccatctgtccatcctcctc

SEQ ID NO: 6324854 - DNA, 21 bp, Homo sapiens
ggcccatgaagaaagcccctc

SEQ ID NO: 6324855 - DNA, 14 bp, Homo sapiens
ggcccatgccccct

SEQ ID NO: 6324856 - DNA, 21 bp, Homo sapiens
ggcccatgcccccttcgctcc

SEQ ID NO: 6324857 - DNA, 11 bp, Homo sapiens
ggcccatggcc

SEQ ID NO: 6324858 - DNA, 15 bp, Homo sapiens
ggcccatggccacat

SEQ ID NO: 6324859 - DNA, 13 bp, Homo sapiens
ggcccatggcccc

SEQ ID NO: 6324860 - DNA, 19 bp, Homo sapiens
ggcccatggccccagctgg

SEQ ID NO: 6324861 - DNA, 20 bp, Homo sapiens
ggcccatggccccagctggc

SEQ ID NO: 6324862 - DNA, 16 bp, Homo sapiens
ggcccatgggcagaag

SEQ ID NO: 6324863 - DNA, 17 bp, Homo sapiens
ggcccatgtagctggca

SEQ ID NO: 6324864 - DNA, 19 bp, Homo sapiens
ggcccatgtagctggcaag

SEQ ID NO: 6324865 - DNA, 22 bp, Homo sapiens
ggcccatgtagctggcaagctg

SEQ ID NO: 6324866 - DNA, 17 bp, Homo sapiens
ggcccatgttgagccat

SEQ ID NO: 6324867 - DNA, 16 bp, Homo sapiens
ggcccattcagcctcg

SEQ ID NO: 6324868 - DNA, 19 bp, Homo sapiens
ggcccattcagcctcgtct

SEQ ID NO: 6324869 - DNA, 14 bp, Homo sapiens
ggcccattctactt

SEQ ID NO: 6324870 - DNA, 17 bp, Homo sapiens
ggcccattctgcatgcc

SEQ ID NO: 6324871 - DNA, 20 bp, Homo sapiens
ggcccattggagcacctggg

SEQ ID NO: 6324872 - DNA, 16 bp, Homo sapiens
ggccccaaaaccacag

SEQ ID NO: 6324873 - DNA, 20 bp, Homo sapiens
ggccccaaaaccacagccct

SEQ ID NO: 6324874 - DNA, 20 bp, Homo sapiens
ggccccaaagcccagcccgg

SEQ ID NO: 6324875 - DNA, 18 bp, Homo sapiens
ggccccaacaagcacccc

SEQ ID NO: 6324876 - DNA, 20 bp, Homo sapiens
ggccccaacaagcaccccgc

SEQ ID NO: 6324877 - DNA, 18 bp, Homo sapiens
ggccccaaccctgtcctc

SEQ ID NO: 6324878 - DNA, 22 bp, Homo sapiens
ggccccaactattaaagtgcca

SEQ ID NO: 6324879 - DNA, 23 bp, Homo sapiens
ggccccaagaggggcgggctcag

SEQ ID NO: 6324880 - DNA, 17 bp, Homo sapiens
ggccccaagatgttggg

SEQ ID NO: 6324881 - DNA, 23 bp, Homo sapiens
ggccccacaaggcctggtctggg

SEQ ID NO: 6324882 - DNA, 17 bp, Homo sapiens
ggccccaccagtgcctc

SEQ ID NO: 6324883 - DNA, 18 bp, Homo sapiens
ggccccacccaccctctg

SEQ ID NO: 6324884 - DNA, 19 bp, Homo sapiens
ggccccacccaccctctgg

SEQ ID NO: 6324885 - DNA, 23 bp, Homo sapiens
ggccccacccaccctctggtcct

SEQ ID NO: 6324886 - DNA, 20 bp, Homo sapiens
ggccccaccccctgggcaga

SEQ ID NO: 6324887 - DNA, 16 bp, Homo sapiens
ggccccacccctgtaa

SEQ ID NO: 6324888 - DNA, 15 bp, Homo sapiens
ggccccacctccctg

SEQ ID NO: 6324889 - DNA, 12 bp, Homo sapiens
ggccccacctga

SEQ ID NO: 6324890 - DNA, 20 bp, Homo sapiens
ggccccacctgaagggtgga

SEQ ID NO: 6324891 - DNA, 15 bp, Homo sapiens
ggccccacgtccctg

SEQ ID NO: 6324892 - DNA, 23 bp, Homo sapiens
ggccccactcccttgctggcccc

SEQ ID NO: 6324893 - DNA, 13 bp, Homo sapiens
ggccccactgatg

SEQ ID NO: 6324894 - DNA, 19 bp, Homo sapiens
ggccccactggacaacact

SEQ ID NO: 6324895 - DNA, 17 bp, Homo sapiens
ggccccactggctggag

SEQ ID NO: 6324896 - DNA, 12 bp, Homo sapiens
ggccccactggg

SEQ ID NO: 6324897 - DNA, 16 bp, Homo sapiens
ggccccagaaagcctc

SEQ ID NO: 6324898 - DNA, 19 bp, Homo sapiens
ggccccagaaagcctcaga

SEQ ID NO: 6324899 - DNA, 13 bp, Homo sapiens
ggccccagagact

SEQ ID NO: 6324900 - DNA, 18 bp, Homo sapiens
ggccccagagactcagag

SEQ ID NO: 6324901 - DNA, 23 bp, Homo sapiens
ggccccagagactcagagggagg

SEQ ID NO: 6324902 - DNA, 13 bp, Homo sapiens
ggccccagagaga

SEQ ID NO: 6324903 - DNA, 14 bp, Homo sapiens
ggccccagagaggg

SEQ ID NO: 6324904 - DNA, 14 bp, Homo sapiens
ggccccagaggacc

SEQ ID NO: 6324905 - DNA, 13 bp, Homo sapiens
ggccccagaggcc

SEQ ID NO: 6324906 - DNA, 15 bp, Homo sapiens
ggccccagaggccct

SEQ ID NO: 6324907 - DNA, 13 bp, Homo sapiens
ggccccagatctg

SEQ ID NO: 6324908 - DNA, 18 bp, Homo sapiens
ggccccagatctgcctgg

SEQ ID NO: 6324909 - DNA, 12 bp, Homo sapiens
ggccccagccaa

SEQ ID NO: 6324910 - DNA, 13 bp, Homo sapiens
ggccccagccaag

SEQ ID NO: 6324911 - DNA, 21 bp, Homo sapiens
ggccccagccagagttcctgc

SEQ ID NO: 6324912 - DNA, 14 bp, Homo sapiens
ggccccagcccacc

SEQ ID NO: 6324913 - DNA, 15 bp, Homo sapiens
ggccccagcccaccc

SEQ ID NO: 6324914 - DNA, 16 bp, Homo sapiens
ggccccagcccaccct

SEQ ID NO: 6324915 - DNA, 19 bp, Homo sapiens
ggccccagcccaccctcct

SEQ ID NO: 6324916 - DNA, 14 bp, Homo sapiens
ggccccagccctgc

SEQ ID NO: 6324917 - DNA, 18 bp, Homo sapiens
ggccccagccctgctggg

SEQ ID NO: 6324918 - DNA, 22 bp, Homo sapiens
ggccccagccctgctggggatc

SEQ ID NO: 6324919 - DNA, 13 bp, Homo sapiens
ggccccagccgtg

SEQ ID NO: 6324920 - DNA, 21 bp, Homo sapiens
ggccccagcctaggtggaggc

SEQ ID NO: 6324921 - DNA, 15 bp, Homo sapiens
ggccccagcctggcc

SEQ ID NO: 6324922 - DNA, 21 bp, Homo sapiens
ggccccagcctggcccagctc

SEQ ID NO: 6324923 - DNA, 23 bp, Homo sapiens
ggccccagcctggcccagctccc

SEQ ID NO: 6324924 - DNA, 22 bp, Homo sapiens
ggccccagcctgggccatctct

SEQ ID NO: 6324925 - DNA, 19 bp, Homo sapiens
ggccccagcgtctgcaggg

SEQ ID NO: 6324926 - DNA, 12 bp, Homo sapiens
ggccccagctcc

SEQ ID NO: 6324927 - DNA, 12 bp, Homo sapiens
ggccccagctgg

SEQ ID NO: 6324928 - DNA, 13 bp, Homo sapiens
ggccccagctggc

SEQ ID NO: 6324929 - DNA, 18 bp, Homo sapiens
ggccccaggaaaggccca

SEQ ID NO: 6324930 - DNA, 15 bp, Homo sapiens
ggccccaggaagccg

SEQ ID NO: 6324931 - DNA, 12 bp, Homo sapiens
ggccccaggagg

SEQ ID NO: 6324932 - DNA, 22 bp, Homo sapiens
ggccccaggcattgccaagggc

SEQ ID NO: 6324933 - DNA, 12 bp, Homo sapiens
ggccccaggccc

SEQ ID NO: 6324934 - DNA, 13 bp, Homo sapiens
ggccccaggcccc

SEQ ID NO: 6324935 - DNA, 17 bp, Homo sapiens
ggccccaggctcccctg

SEQ ID NO: 6324936 - DNA, 19 bp, Homo sapiens
ggccccaggctcccctggt

SEQ ID NO: 6324937 - DNA, 14 bp, Homo sapiens
ggccccaggctgga

SEQ ID NO: 6324938 - DNA, 19 bp, Homo sapiens
ggccccaggctggatgctg

SEQ ID NO: 6324939 - DNA, 21 bp, Homo sapiens
ggccccaggctggatgctggg

SEQ ID NO: 6324940 - DNA, 13 bp, Homo sapiens
ggccccagggaac

SEQ ID NO: 6324941 - DNA, 15 bp, Homo sapiens
ggccccagggaacta

SEQ ID NO: 6324942 - DNA, 13 bp, Homo sapiens
ggccccagggaca

SEQ ID NO: 6324943 - DNA, 14 bp, Homo sapiens
ggccccagggacag

SEQ ID NO: 6324944 - DNA, 19 bp, Homo sapiens
ggccccagggacagaggcc

SEQ ID NO: 6324945 - DNA, 11 bp, Homo sapiens
ggccccagggg

SEQ ID NO: 6324946 - DNA, 20 bp, Homo sapiens
ggccccaggggcagcaaggc

SEQ ID NO: 6324947 - DNA, 22 bp, Homo sapiens
ggccccaggggcagcaaggcct

SEQ ID NO: 6324948 - DNA, 14 bp, Homo sapiens
ggccccaggtgcca

SEQ ID NO: 6324949 - DNA, 20 bp, Homo sapiens
ggccccaggtgccaccaata

SEQ ID NO: 6324950 - DNA, 15 bp, Homo sapiens
ggccccagtcagcct

SEQ ID NO: 6324951 - DNA, 23 bp, Homo sapiens
ggccccatcagaggctgggggag

SEQ ID NO: 6324952 - DNA, 15 bp, Homo sapiens
ggccccatcagctgc

SEQ ID NO: 6324953 - DNA, 16 bp, Homo sapiens
ggccccatccagcatg

SEQ ID NO: 6324954 - DNA, 18 bp, Homo sapiens
ggccccatcctggcccag

SEQ ID NO: 6324955 - DNA, 14 bp, Homo sapiens
ggccccatgacctc

SEQ ID NO: 6324956 - DNA, 13 bp, Homo sapiens
ggccccatgctct

SEQ ID NO: 6324957 - DNA, 14 bp, Homo sapiens
ggccccatgctctg

SEQ ID NO: 6324958 - DNA, 15 bp, Homo sapiens
ggccccatgctctgc

SEQ ID NO: 6324959 - DNA, 17 bp, Homo sapiens
ggccccatgctctgccc

SEQ ID NO: 6324960 - DNA, 21 bp, Homo sapiens
ggccccatggcagctcctgac

SEQ ID NO: 6324961 - DNA, 15 bp, Homo sapiens
ggcccccaacccctc

SEQ ID NO: 6324962 - DNA, 19 bp, Homo sapiens
ggcccccaacccctcctcc

SEQ ID NO: 6324963 - DNA, 23 bp, Homo sapiens
ggcccccaacccctcctccctca

SEQ ID NO: 6324964 - DNA, 16 bp, Homo sapiens
ggcccccaacctcagg

SEQ ID NO: 6324965 - DNA, 20 bp, Homo sapiens
ggcccccaagttttttaatt

SEQ ID NO: 6324966 - DNA, 14 bp, Homo sapiens
ggcccccaataaag

SEQ ID NO: 6324967 - DNA, 24 bp, Homo sapiens
ggcccccacatttgtgccgacact

SEQ ID NO: 6324968 - DNA, 14 bp, Homo sapiens
ggcccccacccacc

SEQ ID NO: 6324969 - DNA, 15 bp, Homo sapiens
ggcccccacccacct

SEQ ID NO: 6324970 - DNA, 22 bp, Homo sapiens
ggcccccacccaccttccttgc

SEQ ID NO: 6324971 - DNA, 20 bp, Homo sapiens
ggcccccactcacagggagc

SEQ ID NO: 6324972 - DNA, 17 bp, Homo sapiens
ggcccccactggctgtg

SEQ ID NO: 6324973 - DNA, 16 bp, Homo sapiens
ggcccccacttgcctc

SEQ ID NO: 6324974 - DNA, 17 bp, Homo sapiens
ggcccccagagcgcccc

SEQ ID NO: 6324975 - DNA, 19 bp, Homo sapiens
ggcccccagagcgcccctc

SEQ ID NO: 6324976 - DNA, 20 bp, Homo sapiens
ggcccccagcccctcctccc

SEQ ID NO: 6324977 - DNA, 23 bp, Homo sapiens
ggcccccagcccctcctccctca

SEQ ID NO: 6324978 - DNA, 14 bp, Homo sapiens
ggcccccagccctg

SEQ ID NO: 6324979 - DNA, 15 bp, Homo sapiens
ggcccccagccctgg

SEQ ID NO: 6324980 - DNA, 14 bp, Homo sapiens
ggcccccagctggt

SEQ ID NO: 6324981 - DNA, 22 bp, Homo sapiens
ggcccccagcttcacctctggg

SEQ ID NO: 6324982 - DNA, 22 bp, Homo sapiens
ggcccccaggattcccccagcc

SEQ ID NO: 6324983 - DNA, 19 bp, Homo sapiens
gtctactcttaagccatct

SEQ ID NO: 6324984 - DNA, 19 bp, Homo sapiens
gtctactgtggtgatctgt

SEQ ID NO: 6324985 - DNA, 14 bp, Homo sapiens
gtctacttctgtgt

SEQ ID NO: 6324986 - DNA, 14 bp, Homo sapiens
gtctacttcttaaa

SEQ ID NO: 6324987 - DNA, 17 bp, Homo sapiens
gtctacttcttaaaatt

SEQ ID NO: 6324988 - DNA, 19 bp, Homo sapiens
gtctacttcttaaaattca

SEQ ID NO: 6324989 - DNA, 20 bp, Homo sapiens
gtctactttctcttgtttaa

SEQ ID NO: 6324990 - DNA, 16 bp, Homo sapiens
gtctagaaccagttat

SEQ ID NO: 6324991 - DNA, 14 bp, Homo sapiens
gtctagaagaacaa

SEQ ID NO: 6324992 - DNA, 15 bp, Homo sapiens
gtctagaaggccagg

SEQ ID NO: 6324993 - DNA, 18 bp, Homo sapiens
gtctagaaggccaggcct

SEQ ID NO: 6324994 - DNA, 17 bp, Homo sapiens
gtctagaagttgtttgt

SEQ ID NO: 6324995 - DNA, 17 bp, Homo sapiens
gtctagaatcctgcttt

SEQ ID NO: 6324996 - DNA, 20 bp, Homo sapiens
gtctagaatcctgctttaca

SEQ ID NO: 6324997 - DNA, 13 bp, Homo sapiens
gtctagaatgtgg

SEQ ID NO: 6324998 - DNA, 16 bp, Homo sapiens
gtctagaatgtggatt

SEQ ID NO: 6324999 - DNA, 16 bp, Homo sapiens
gtctagaccagggctg

SEQ ID NO: 6325000 - DNA, 21 bp, Homo sapiens
gtctagactgtttgctgatcc

SEQ ID NO: 6325001 - DNA, 15 bp, Homo sapiens
gtctagagaacactg

SEQ ID NO: 6325002 - DNA, 15 bp, Homo sapiens
gtctagagagggagg

SEQ ID NO: 6325003 - DNA, 17 bp, Homo sapiens
gtctagagcctcttggg

SEQ ID NO: 6325004 - DNA, 22 bp, Homo sapiens
gtctagagtcatgtgagcctcg

SEQ ID NO: 6325005 - DNA, 14 bp, Homo sapiens
gtctagataacatt

SEQ ID NO: 6325006 - DNA, 18 bp, Homo sapiens
gtctagatggatgaatta

SEQ ID NO: 6325007 - DNA, 19 bp, Homo sapiens
gtctagatggctcctctca

SEQ ID NO: 6325008 - DNA, 19 bp, Homo sapiens
gtctagattcaaaggttct

SEQ ID NO: 6325009 - DNA, 15 bp, Homo sapiens
gtctagattttgaaa

SEQ ID NO: 6325010 - DNA, 15 bp, Homo sapiens
gtctagcaaagccac

SEQ ID NO: 6325011 - DNA, 15 bp, Homo sapiens
gtctagccactccct

SEQ ID NO: 6325012 - DNA, 18 bp, Homo sapiens
gtctagccactccctccc

SEQ ID NO: 6325013 - DNA, 17 bp, Homo sapiens
gtctagccgctgccctg

SEQ ID NO: 6325014 - DNA, 21 bp, Homo sapiens
gtctaggagctgggaggaaaa

SEQ ID NO: 6325015 - DNA, 16 bp, Homo sapiens
gtctaggcactgagca

SEQ ID NO: 6325016 - DNA, 12 bp, Homo sapiens
gtctagggagag

SEQ ID NO: 6325017 - DNA, 16 bp, Homo sapiens
gtctagggcacaaaga

SEQ ID NO: 6325018 - DNA, 15 bp, Homo sapiens
gtctagggcagagta

SEQ ID NO: 6325019 - DNA, 17 bp, Homo sapiens
gtctagggcagagtatg

SEQ ID NO: 6325020 - DNA, 16 bp, Homo sapiens
gtctaggtctcctcag

SEQ ID NO: 6325021 - DNA, 20 bp, Homo sapiens
gtctagtaattgggaaaaaa

SEQ ID NO: 6325022 - DNA, 22 bp, Homo sapiens
gtctagtcacgcatgcagtgtt

SEQ ID NO: 6325023 - DNA, 14 bp, Homo sapiens
gtctagtcagtgta

SEQ ID NO: 6325024 - DNA, 18 bp, Homo sapiens
gtctagtccgtcctggca

SEQ ID NO: 6325025 - DNA, 18 bp, Homo sapiens
gtctagtctctcctgtaa

SEQ ID NO: 6325026 - DNA, 21 bp, Homo sapiens
gtctagtcttctggttttcta

SEQ ID NO: 6325027 - DNA, 21 bp, Homo sapiens
gtctagtgacacggtagcacc

SEQ ID NO: 6325028 - DNA, 20 bp, Homo sapiens
gtctagtggaaagattgtgt

SEQ ID NO: 6325029 - DNA, 13 bp, Homo sapiens
gtctagtgtctgg

SEQ ID NO: 6325030 - DNA, 14 bp, Homo sapiens
gtctagtttcccac

SEQ ID NO: 6325031 - DNA, 18 bp, Homo sapiens
gtctagtttcccacattc

SEQ ID NO: 6325032 - DNA, 14 bp, Homo sapiens
gtctagtttcctgg

SEQ ID NO: 6325033 - DNA, 15 bp, Homo sapiens
gtctagtttctagtg

SEQ ID NO: 6325034 - DNA, 16 bp, Homo sapiens
gtctataaaataaact

SEQ ID NO: 6325035 - DNA, 15 bp, Homo sapiens
gtctataagtatata

SEQ ID NO: 6325036 - DNA, 19 bp, Homo sapiens
gtctataatggaaacattt

SEQ ID NO: 6325037 - DNA, 21 bp, Homo sapiens
gtctataattccttaaaattt

SEQ ID NO: 6325038 - DNA, 15 bp, Homo sapiens
gtctatacattcctg

SEQ ID NO: 6325039 - DNA, 22 bp, Homo sapiens
gtctataccttaagaatgccaa

SEQ ID NO: 6325040 - DNA, 22 bp, Homo sapiens
gtctataggacttaatttagca

SEQ ID NO: 6325041 - DNA, 15 bp, Homo sapiens
gtctatatacacaga

SEQ ID NO: 6325042 - DNA, 19 bp, Homo sapiens
gtctatatacacagacatg

SEQ ID NO: 6325043 - DNA, 17 bp, Homo sapiens
gtctatatgaaaaacaa

SEQ ID NO: 6325044 - DNA, 14 bp, Homo sapiens
gtctatatgtttgt

SEQ ID NO: 6325045 - DNA, 21 bp, Homo sapiens
gtctatcaaccccagacactg

SEQ ID NO: 6325046 - DNA, 14 bp, Homo sapiens
gtctatcattgttg

SEQ ID NO: 6325047 - DNA, 13 bp, Homo sapiens
gtctatccacaga

SEQ ID NO: 6325048 - DNA, 14 bp, Homo sapiens
gtctatccacagag

SEQ ID NO: 6325049 - DNA, 16 bp, Homo sapiens
gtctatctgtgaacgt

SEQ ID NO: 6325050 - DNA, 12 bp, Homo sapiens
gtctatcttgta

SEQ ID NO: 6325051 - DNA, 9 bp, Homo sapiens
gtctatgaa

SEQ ID NO: 6325052 - DNA, 12 bp, Homo sapiens
gtctatgaagtt

SEQ ID NO: 6325053 - DNA, 15 bp, Homo sapiens
gtctatgaagttgct

SEQ ID NO: 6325054 - DNA, 20 bp, Homo sapiens
gtctatgaagttgctgttta

SEQ ID NO: 6325055 - DNA, 17 bp, Homo sapiens
gtctatgcagcctgctc

SEQ ID NO: 6325056 - DNA, 16 bp, Homo sapiens
gtctatgctgtgtgca

SEQ ID NO: 6325057 - DNA, 22 bp, Homo sapiens
gtctatgggactcaatgcactg

SEQ ID NO: 6325058 - DNA, 18 bp, Homo sapiens
gtctatggggatacatga

SEQ ID NO: 6325059 - DNA, 22 bp, Homo sapiens
gtctatgtcgagagctggccaa

SEQ ID NO: 6325060 - DNA, 16 bp, Homo sapiens
gtctatgtgtatatat

SEQ ID NO: 6325061 - DNA, 15 bp, Homo sapiens
gtctatgttcaaaga

SEQ ID NO: 6325062 - DNA, 23 bp, Homo sapiens
gtctattaaaattctgatgtttc

SEQ ID NO: 6325063 - DNA, 18 bp, Homo sapiens
gtctattatagtgaaaca

SEQ ID NO: 6325064 - DNA, 17 bp, Homo sapiens
gtctattatcacattaa

SEQ ID NO: 6325065 - DNA, 14 bp, Homo sapiens
gtctattccagctc

SEQ ID NO: 6325066 - DNA, 16 bp, Homo sapiens
gtctattccattccct

SEQ ID NO: 6325067 - DNA, 14 bp, Homo sapiens
gtctattccctgga

SEQ ID NO: 6325068 - DNA, 13 bp, Homo sapiens
gtctattctagtc

SEQ ID NO: 6325069 - DNA, 15 bp, Homo sapiens
gtctattctgagcct

SEQ ID NO: 6325070 - DNA, 17 bp, Homo sapiens
gtctatttccaagaacc

SEQ ID NO: 6325071 - DNA, 21 bp, Homo sapiens
gtctatttccactgaacaaaa

SEQ ID NO: 6325072 - DNA, 12 bp, Homo sapiens
gtctatttgaga

SEQ ID NO: 6325073 - DNA, 11 bp, Homo sapiens
gtctattttaa

SEQ ID NO: 6325074 - DNA, 16 bp, Homo sapiens
gtctattttaaaataa

SEQ ID NO: 6325075 - DNA, 18 bp, Homo sapiens
gtctattttatatctgtt

SEQ ID NO: 6325076 - DNA, 23 bp, Homo sapiens
gtctattttattatgagctttct

SEQ ID NO: 6325077 - DNA, 14 bp, Homo sapiens
gtctcaaaaaaaca

SEQ ID NO: 6325078 - DNA, 20 bp, Homo sapiens
gtctcaaaataaaaccagaa

SEQ ID NO: 6325079 - DNA, 16 bp, Homo sapiens
gtctcaaactcctggg

SEQ ID NO: 6325080 - DNA, 20 bp, Homo sapiens
gtctcaaactcctgggctca

SEQ ID NO: 6325081 - DNA, 22 bp, Homo sapiens
gtctcaaactcttgacctcagg

SEQ ID NO: 6325082 - DNA, 22 bp, Homo sapiens
gtctcaaacttgtggcctcaag

SEQ ID NO: 6325083 - DNA, 14 bp, Homo sapiens
gtctcaaaggccag

SEQ ID NO: 6325084 - DNA, 15 bp, Homo sapiens
gtctcaaataataat

SEQ ID NO: 6325085 - DNA, 17 bp, Homo sapiens
gtctcaactactcagct

SEQ ID NO: 6325086 - DNA, 20 bp, Homo sapiens
gtctcaaggttctcatttct

SEQ ID NO: 6325087 - DNA, 19 bp, Homo sapiens
gtctcaagtgcaatgcccc

SEQ ID NO: 6325088 - DNA, 22 bp, Homo sapiens
gtctcaatagctccaagctgtt

SEQ ID NO: 6325089 - DNA, 17 bp, Homo sapiens
gtctcaatgctcataac

SEQ ID NO: 6325090 - DNA, 16 bp, Homo sapiens
gtctcaattttgtatt

SEQ ID NO: 6325091 - DNA, 17 bp, Homo sapiens
gtctcaattttgtattt

SEQ ID NO: 6325092 - DNA, 18 bp, Homo sapiens
gtctcaattttgtattta

SEQ ID NO: 6325093 - DNA, 19 bp, Homo sapiens
gtctcaattttgtatttaa

SEQ ID NO: 6325094 - DNA, 16 bp, Homo sapiens
gtctcacactcctcct

SEQ ID NO: 6325095 - DNA, 18 bp, Homo sapiens
gtctcacactcctcctgc

SEQ ID NO: 6325096 - DNA, 19 bp, Homo sapiens
gtctcacactcctcctgcc

SEQ ID NO: 6325097 - DNA, 23 bp, Homo sapiens
gtctcacactcctcctgccagct

SEQ ID NO: 6325098 - DNA, 19 bp, Homo sapiens
gtctcacactgtttttcat

SEQ ID NO: 6325099 - DNA, 15 bp, Homo sapiens
gtctcacagagaagc

SEQ ID NO: 6325100 - DNA, 22 bp, Homo sapiens
gtctcacagagaagctcctgct

SEQ ID NO: 6325101 - DNA, 21 bp, Homo sapiens
gtctcacagaggcagtaggaa

SEQ ID NO: 6325102 - DNA, 13 bp, Homo sapiens
gtctcacagccct

SEQ ID NO: 6325103 - DNA, 19 bp, Homo sapiens
gtctcacagtgttgcccag

SEQ ID NO: 6325104 - DNA, 23 bp, Homo sapiens
gtctcacatgattccagccatca

SEQ ID NO: 6325105 - DNA, 20 bp, Homo sapiens
gtctcacctgccggctctgg

SEQ ID NO: 6325106 - DNA, 19 bp, Homo sapiens
gtctcacctggacttaagc

SEQ ID NO: 6325107 - DNA, 22 bp, Homo sapiens
gtctcacctggaggcaagaggg

SEQ ID NO: 6325108 - DNA, 20 bp, Homo sapiens
gtctcaccttcgcctttgct

SEQ ID NO: 6325109 - DNA, 18 bp, Homo sapiens
gtctcacgattccagtgc

SEQ ID NO: 6325110 - DNA, 19 bp, Homo sapiens
gtctcacgattccagtgca

SEQ ID NO: 6325111 - DNA, 23 bp, Homo sapiens
gtctcacgggcatgggcactccc

SEQ ID NO: 6325112 - DNA, 21 bp, Homo sapiens
gtctcactacttgaccattct

SEQ ID NO: 6325113 - DNA, 22 bp, Homo sapiens
gtctcactagtttttcctgtgc

SEQ ID NO: 6325114 - DNA, 19 bp, Homo sapiens
gtctcactatgttgcccag

SEQ ID NO: 6325115 - DNA, 22 bp, Homo sapiens
gtctcactatgttgcccaggct

SEQ ID NO: 6325116 - DNA, 17 bp, Homo sapiens
gtctcactcctgagtgg

SEQ ID NO: 6325117 - DNA, 16 bp, Homo sapiens
gtctcactctgtcacc

SEQ ID NO: 6325118 - DNA, 15 bp, Homo sapiens
gtctcactctgtcgc

SEQ ID NO: 6325119 - DNA, 19 bp, Homo sapiens
gtctcactctgtcgcccag

SEQ ID NO: 6325120 - DNA, 23 bp, Homo sapiens
gtctcactctgtcgctcaggctg

SEQ ID NO: 6325121 - DNA, 20 bp, Homo sapiens
gtctcactctgttgaccagg

SEQ ID NO: 6325122 - DNA, 22 bp, Homo sapiens
gtctcactcttctgtcttgtcc

SEQ ID NO: 6325123 - DNA, 15 bp, Homo sapiens
gtctcactctttctt

SEQ ID NO: 6325124 - DNA, 16 bp, Homo sapiens
gtctcactgagcactg

SEQ ID NO: 6325125 - DNA, 22 bp, Homo sapiens
gtctcactgagcactgttttct

SEQ ID NO: 6325126 - DNA, 20 bp, Homo sapiens
gtctcactgtctgctggcaa

SEQ ID NO: 6325127 - DNA, 15 bp, Homo sapiens
gtctcactgtgtgtc

SEQ ID NO: 6325128 - DNA, 18 bp, Homo sapiens
gtctcactgttgcccagg

SEQ ID NO: 6325129 - DNA, 19 bp, Homo sapiens
gtctcactgttgcccaggc

SEQ ID NO: 6325130 - DNA, 20 bp, Homo sapiens
gtctcactgttgcccaggct

SEQ ID NO: 6325131 - DNA, 23 bp, Homo sapiens
gtctcactttggactgggacagt

SEQ ID NO: 6325132 - DNA, 13 bp, Homo sapiens
gtctcacttttca

SEQ ID NO: 6325133 - DNA, 18 bp, Homo sapiens
gtctcagacgactagccc

SEQ ID NO: 6325134 - DNA, 21 bp, Homo sapiens
gtctcagacgactagcccagg

SEQ ID NO: 6325135 - DNA, 23 bp, Homo sapiens
gtctcagacgactagcccaggac

SEQ ID NO: 6325136 - DNA, 18 bp, Homo sapiens
gtctcagacttttgtaca

SEQ ID NO: 6325137 - DNA, 14 bp, Homo sapiens
gtctcagagaccag

SEQ ID NO: 6325138 - DNA, 15 bp, Homo sapiens
gtctcagagaccagc

SEQ ID NO: 6325139 - DNA, 18 bp, Homo sapiens
gtctcagagaccagcact

SEQ ID NO: 6325140 - DNA, 16 bp, Homo sapiens
gtctcagagccttcca

SEQ ID NO: 6325141 - DNA, 18 bp, Homo sapiens
gtctcagagccttccatg

SEQ ID NO: 6325142 - DNA, 23 bp, Homo sapiens
gtctcagcaaattcttgaataaa

SEQ ID NO: 6325143 - DNA, 22 bp, Homo sapiens
gtctcagcagcgaccacccctg

SEQ ID NO: 6325144 - DNA, 19 bp, Homo sapiens
gtctcagcccctttccctt

SEQ ID NO: 6325145 - DNA, 22 bp, Homo sapiens
gtctcagcccgggacagggtct

SEQ ID NO: 6325146 - DNA, 22 bp, Homo sapiens
gtctcagccgagcccaggggag

SEQ ID NO: 6325147 - DNA, 12 bp, Homo sapiens
gtctcagcctgg

SEQ ID NO: 6325148 - DNA, 14 bp, Homo sapiens
gtctcagccttccg

SEQ ID NO: 6325149 - DNA, 12 bp, Homo sapiens
gtctcagcttca

SEQ ID NO: 6325150 - DNA, 20 bp, Homo sapiens
gtctcagcttcatttccgtg

SEQ ID NO: 6325151 - DNA, 23 bp, Homo sapiens
gtctcagcttcatttccgtgaag

SEQ ID NO: 6325152 - DNA, 13 bp, Homo sapiens
gtctcaggaggag

SEQ ID NO: 6325153 - DNA, 13 bp, Homo sapiens
gtctcaggcagca

SEQ ID NO: 6325154 - DNA, 17 bp, Homo sapiens
gtctcaggctcaagttt

SEQ ID NO: 6325155 - DNA, 13 bp, Homo sapiens
gtctcaggctgcc

SEQ ID NO: 6325156 - DNA, 15 bp, Homo sapiens
gtctcaggctgcctg

SEQ ID NO: 6325157 - DNA, 16 bp, Homo sapiens
gtctcaggctgcctga

SEQ ID NO: 6325158 - DNA, 18 bp, Homo sapiens
gtctcaggctgcctgagt

SEQ ID NO: 6325159 - DNA, 17 bp, Homo sapiens
gtctcaggctggtggga

SEQ ID NO: 6325160 - DNA, 22 bp, Homo sapiens
gtctcaggctggtgggaggggc

SEQ ID NO: 6325161 - DNA, 20 bp, Homo sapiens
ggcccccaggggcaggactg

SEQ ID NO: 6325162 - DNA, 11 bp, Homo sapiens
ggcccccagtg

SEQ ID NO: 6325163 - DNA, 12 bp, Homo sapiens
ggcccccagtgg

SEQ ID NO: 6325164 - DNA, 24 bp, Homo sapiens
ggcccccagtggggacagggaggg

SEQ ID NO: 6325165 - DNA, 20 bp, Homo sapiens
ggcccccatcagccctgcta

SEQ ID NO: 6325166 - DNA, 14 bp, Homo sapiens
ggcccccatcttgg

SEQ ID NO: 6325167 - DNA, 19 bp, Homo sapiens
ggccccccaaatcccaggg

SEQ ID NO: 6325168 - DNA, 19 bp, Homo sapiens
ggcccccccagccccacac

SEQ ID NO: 6325169 - DNA, 14 bp, Homo sapiens
ggcccccccagctg

SEQ ID NO: 6325170 - DNA, 19 bp, Homo sapiens
ggccccccgcacagccacc

SEQ ID NO: 6325171 - DNA, 17 bp, Homo sapiens
ggccccccgcagcaccc

SEQ ID NO: 6325172 - DNA, 22 bp, Homo sapiens
ggccccccgcgctcgcccagca

SEQ ID NO: 6325173 - DNA, 18 bp, Homo sapiens
ggcccccctccaggcatg

SEQ ID NO: 6325174 - DNA, 19 bp, Homo sapiens
ggcccccctccccccactt

SEQ ID NO: 6325175 - DNA, 17 bp, Homo sapiens
ggcccccctccttgctc

SEQ ID NO: 6325176 - DNA, 21 bp, Homo sapiens
ggcccccctggtcccctcctt

SEQ ID NO: 6325177 - DNA, 19 bp, Homo sapiens
ggcccccgccccctcccta

SEQ ID NO: 6325178 - DNA, 14 bp, Homo sapiens
ggcccccgccccgc

SEQ ID NO: 6325179 - DNA, 15 bp, Homo sapiens
ggcccccgccctctg

SEQ ID NO: 6325180 - DNA, 16 bp, Homo sapiens
ggcccccgccctctgc

SEQ ID NO: 6325181 - DNA, 19 bp, Homo sapiens
ggcccccgctggctcctcc

SEQ ID NO: 6325182 - DNA, 18 bp, Homo sapiens
ggcccccggaggcgccca

SEQ ID NO: 6325183 - DNA, 20 bp, Homo sapiens
ggcccccggaggcgcccacc

SEQ ID NO: 6325184 - DNA, 16 bp, Homo sapiens
ggcccccggccaagga

SEQ ID NO: 6325185 - DNA, 20 bp, Homo sapiens
ggcccccggccaaggaccca

SEQ ID NO: 6325186 - DNA, 21 bp, Homo sapiens
ggcccccggccaaggacccag

SEQ ID NO: 6325187 - DNA, 17 bp, Homo sapiens
ggccccctcaccccagc

SEQ ID NO: 6325188 - DNA, 19 bp, Homo sapiens
ggccccctcaccccagctc

SEQ ID NO: 6325189 - DNA, 16 bp, Homo sapiens
ggccccctcagctctg

SEQ ID NO: 6325190 - DNA, 21 bp, Homo sapiens
ggccccctcattcagagactg

SEQ ID NO: 6325191 - DNA, 13 bp, Homo sapiens
ggccccctccctg

SEQ ID NO: 6325192 - DNA, 14 bp, Homo sapiens
ggccccctcctcac

SEQ ID NO: 6325193 - DNA, 13 bp, Homo sapiens
ggccccctctcct

SEQ ID NO: 6325194 - DNA, 16 bp, Homo sapiens
ggccccctgtgccagc

SEQ ID NO: 6325195 - DNA, 21 bp, Homo sapiens
ggccccctgtgccagctcagg

SEQ ID NO: 6325196 - DNA, 13 bp, Homo sapiens
ggcccccttcagg

SEQ ID NO: 6325197 - DNA, 14 bp, Homo sapiens
ggcccccttcagga

SEQ ID NO: 6325198 - DNA, 17 bp, Homo sapiens
ggcccccttcaggagcc

SEQ ID NO: 6325199 - DNA, 17 bp, Homo sapiens
ggcccccttcctggccc

SEQ ID NO: 6325200 - DNA, 19 bp, Homo sapiens
ggccccgacgtttgcggca

SEQ ID NO: 6325201 - DNA, 18 bp, Homo sapiens
ggccccgaggacccagac

SEQ ID NO: 6325202 - DNA, 20 bp, Homo sapiens
ggccccgatggactcctgac

SEQ ID NO: 6325203 - DNA, 21 bp, Homo sapiens
ggccccgatggactcctgacc

SEQ ID NO: 6325204 - DNA, 13 bp, Homo sapiens
ggccccgcacccc

SEQ ID NO: 6325205 - DNA, 18 bp, Homo sapiens
ggccccgcacccctcctc

SEQ ID NO: 6325206 - DNA, 22 bp, Homo sapiens
ggccccgcacccctcctccttg

SEQ ID NO: 6325207 - DNA, 17 bp, Homo sapiens
ggccccgcagtgccctg

SEQ ID NO: 6325208 - DNA, 14 bp, Homo sapiens
ggccccgccagggc

SEQ ID NO: 6325209 - DNA, 20 bp, Homo sapiens
ggccccgccagggctgggga

SEQ ID NO: 6325210 - DNA, 22 bp, Homo sapiens
ggccccgcccgagcccctgccc

SEQ ID NO: 6325211 - DNA, 23 bp, Homo sapiens
ggccccgcccgtagatcatcccc

SEQ ID NO: 6325212 - DNA, 14 bp, Homo sapiens
ggccccgcggagcc

SEQ ID NO: 6325213 - DNA, 19 bp, Homo sapiens
ggccccgcttgtccagcgc

SEQ ID NO: 6325214 - DNA, 13 bp, Homo sapiens
ggccccggcccca

SEQ ID NO: 6325215 - DNA, 18 bp, Homo sapiens
ggccccggccccagccag

SEQ ID NO: 6325216 - DNA, 19 bp, Homo sapiens
ggccccgggctctggccac

SEQ ID NO: 6325217 - DNA, 23 bp, Homo sapiens
ggccccgggctctggccaccctg

SEQ ID NO: 6325218 - DNA, 14 bp, Homo sapiens
ggccccgggctgga

SEQ ID NO: 6325219 - DNA, 16 bp, Homo sapiens
ggccccggggctggca

SEQ ID NO: 6325220 - DNA, 18 bp, Homo sapiens
ggccccggggctggcaag

SEQ ID NO: 6325221 - DNA, 14 bp, Homo sapiens
ggccccgggttcag

SEQ ID NO: 6325222 - DNA, 21 bp, Homo sapiens
ggccccgggttcagcctggcc

SEQ ID NO: 6325223 - DNA, 22 bp, Homo sapiens
ggccccgggttcagcctggcct

SEQ ID NO: 6325224 - DNA, 23 bp, Homo sapiens
ggccccggtcctggccccagccc

SEQ ID NO: 6325225 - DNA, 20 bp, Homo sapiens
ggccccgtcagccacacctg

SEQ ID NO: 6325226 - DNA, 19 bp, Homo sapiens
ggccccgtctcaggtctga

SEQ ID NO: 6325227 - DNA, 16 bp, Homo sapiens
ggccccgtctcctgag

SEQ ID NO: 6325228 - DNA, 17 bp, Homo sapiens
ggccccgtctcctgagg

SEQ ID NO: 6325229 - DNA, 23 bp, Homo sapiens
ggccccgtctcctgagggtcctg

SEQ ID NO: 6325230 - DNA, 20 bp, Homo sapiens
ggcccctaggtgcccagggc

SEQ ID NO: 6325231 - DNA, 20 bp, Homo sapiens
ggcccctcacatcctctcca

SEQ ID NO: 6325232 - DNA, 23 bp, Homo sapiens
ggcccctcacatcctctccagga

SEQ ID NO: 6325233 - DNA, 18 bp, Homo sapiens
ggcccctcaccctctgtc

SEQ ID NO: 6325234 - DNA, 22 bp, Homo sapiens
ggcccctcaccctgccttatct

SEQ ID NO: 6325235 - DNA, 14 bp, Homo sapiens
ggcccctcacctgg

SEQ ID NO: 6325236 - DNA, 17 bp, Homo sapiens
ggcccctcacctggtac

SEQ ID NO: 6325237 - DNA, 14 bp, Homo sapiens
ggcccctcagcctg

SEQ ID NO: 6325238 - DNA, 19 bp, Homo sapiens
ggcccctcagcctgcctga

SEQ ID NO: 6325239 - DNA, 23 bp, Homo sapiens
ggcccctcatctgctcagcagct

SEQ ID NO: 6325240 - DNA, 23 bp, Homo sapiens
ggcccctcatggcgggactggag

SEQ ID NO: 6325241 - DNA, 19 bp, Homo sapiens
ggcccctccagaccctgcc

SEQ ID NO: 6325242 - DNA, 13 bp, Homo sapiens
ggcccctccagca

SEQ ID NO: 6325243 - DNA, 13 bp, Homo sapiens
ggcccctccatcc

SEQ ID NO: 6325244 - DNA, 16 bp, Homo sapiens
ggcccctcccacatcc

SEQ ID NO: 6325245 - DNA, 22 bp, Homo sapiens
ggcccctcccagtaagggcgtg

SEQ ID NO: 6325246 - DNA, 13 bp, Homo sapiens
ggcccctcccctg

SEQ ID NO: 6325247 - DNA, 16 bp, Homo sapiens
ggcccctcccctgcag

SEQ ID NO: 6325248 - DNA, 17 bp, Homo sapiens
ggcccctcccctgcaga

SEQ ID NO: 6325249 - DNA, 17 bp, Homo sapiens
ggcccctccctacctca

SEQ ID NO: 6325250 - DNA, 16 bp, Homo sapiens
ggcccctccctctgcc

SEQ ID NO: 6325251 - DNA, 21 bp, Homo sapiens
ggcccctccctctgccccaag

SEQ ID NO: 6325252 - DNA, 22 bp, Homo sapiens
ggcccctccgcgagggctactc

SEQ ID NO: 6325253 - DNA, 19 bp, Homo sapiens
ggcccctcctagacccagg

SEQ ID NO: 6325254 - DNA, 11 bp, Homo sapiens
ggcccctcctc

SEQ ID NO: 6325255 - DNA, 14 bp, Homo sapiens
ggcccctcctccag

SEQ ID NO: 6325256 - DNA, 16 bp, Homo sapiens
ggcccctcctctgtgc

SEQ ID NO: 6325257 - DNA, 11 bp, Homo sapiens
ggcccctcctt

SEQ ID NO: 6325258 - DNA, 19 bp, Homo sapiens
ggcccctcgaccctgtgca

SEQ ID NO: 6325259 - DNA, 21 bp, Homo sapiens
ggcccctcggcattcacacac

SEQ ID NO: 6325260 - DNA, 13 bp, Homo sapiens
ggcccctctcagc

SEQ ID NO: 6325261 - DNA, 14 bp, Homo sapiens
ggcccctctcagcc

SEQ ID NO: 6325262 - DNA, 22 bp, Homo sapiens
ggcccctctccaagcgcctggc

SEQ ID NO: 6325263 - DNA, 22 bp, Homo sapiens
ggcccctctcctccgtggcaca

SEQ ID NO: 6325264 - DNA, 23 bp, Homo sapiens
ggcccctctcctccgtggcacat

SEQ ID NO: 6325265 - DNA, 17 bp, Homo sapiens
ggcccctctgcccagct

SEQ ID NO: 6325266 - DNA, 21 bp, Homo sapiens
ggcccctctgttctggtggcc

SEQ ID NO: 6325267 - DNA, 15 bp, Homo sapiens
ggcccctgagcctgt

SEQ ID NO: 6325268 - DNA, 16 bp, Homo sapiens
ggcccctgaggactgg

SEQ ID NO: 6325269 - DNA, 17 bp, Homo sapiens
ggcccctgcatcccctt

SEQ ID NO: 6325270 - DNA, 13 bp, Homo sapiens
ggcccctgccacc

SEQ ID NO: 6325271 - DNA, 17 bp, Homo sapiens
ggcccctgccaccctgg

SEQ ID NO: 6325272 - DNA, 20 bp, Homo sapiens
ggcccctgccacctcctgcc

SEQ ID NO: 6325273 - DNA, 20 bp, Homo sapiens
ggcccctgccagaccccctg

SEQ ID NO: 6325274 - DNA, 16 bp, Homo sapiens
ggcccctgccccgccc

SEQ ID NO: 6325275 - DNA, 12 bp, Homo sapiens
ggcccctgccct

SEQ ID NO: 6325276 - DNA, 13 bp, Homo sapiens
ggcccctgcctcc

SEQ ID NO: 6325277 - DNA, 13 bp, Homo sapiens
ggcccctgcctct

SEQ ID NO: 6325278 - DNA, 13 bp, Homo sapiens
ggcccctgcctgc

SEQ ID NO: 6325279 - DNA, 14 bp, Homo sapiens
ggcccctgcctgcc

SEQ ID NO: 6325280 - DNA, 14 bp, Homo sapiens
ggcccctgccttgg

SEQ ID NO: 6325281 - DNA, 17 bp, Homo sapiens
ggcccctgcgtgggggc

SEQ ID NO: 6325282 - DNA, 18 bp, Homo sapiens
ggcccctgctgtctctct

SEQ ID NO: 6325283 - DNA, 19 bp, Homo sapiens
ggcccctgcttctccagcc

SEQ ID NO: 6325284 - DNA, 14 bp, Homo sapiens
ggcccctggatctc

SEQ ID NO: 6325285 - DNA, 20 bp, Homo sapiens
ggcccctggcacgtcctcca

SEQ ID NO: 6325286 - DNA, 16 bp, Homo sapiens
ggcccctggcagcaca

SEQ ID NO: 6325287 - DNA, 23 bp, Homo sapiens
ggcccctggcagcacagcccagg

SEQ ID NO: 6325288 - DNA, 20 bp, Homo sapiens
ggcccctggcccagcggccc

SEQ ID NO: 6325289 - DNA, 13 bp, Homo sapiens
ggcccctggcccc

SEQ ID NO: 6325290 - DNA, 13 bp, Homo sapiens
ggcccctgggatg

SEQ ID NO: 6325291 - DNA, 15 bp, Homo sapiens
ggcccctgggctctc

SEQ ID NO: 6325292 - DNA, 19 bp, Homo sapiens
ggcccctgggctctcaccc

SEQ ID NO: 6325293 - DNA, 21 bp, Homo sapiens
ggcccctgggctctcacccag

SEQ ID NO: 6325294 - DNA, 22 bp, Homo sapiens
ggcccctgggcttggcctgctg

SEQ ID NO: 6325295 - DNA, 15 bp, Homo sapiens
ggcccctggggacag

SEQ ID NO: 6325296 - DNA, 20 bp, Homo sapiens
ggcccctggggacagagcca

SEQ ID NO: 6325297 - DNA, 22 bp, Homo sapiens
ggcccctggggacagagccacc

SEQ ID NO: 6325298 - DNA, 23 bp, Homo sapiens
ggcccctggggacagagccaccc

SEQ ID NO: 6325299 - DNA, 23 bp, Homo sapiens
ggcccctgggtcagtctggtggg

SEQ ID NO: 6325300 - DNA, 23 bp, Homo sapiens
ggcccctgtccccagtccccagc

SEQ ID NO: 6325301 - DNA, 23 bp, Homo sapiens
ggcccctgtctgttcccagcccc

SEQ ID NO: 6325302 - DNA, 18 bp, Homo sapiens
ggcccctgtggggaacag

SEQ ID NO: 6325303 - DNA, 15 bp, Homo sapiens
ggccccttcccagcc

SEQ ID NO: 6325304 - DNA, 20 bp, Homo sapiens
ggccccttccctggcaggtg

SEQ ID NO: 6325305 - DNA, 21 bp, Homo sapiens
ggccccttctatgcccagctg

SEQ ID NO: 6325306 - DNA, 21 bp, Homo sapiens
ggccccttgctgatgctcctc

SEQ ID NO: 6325307 - DNA, 20 bp, Homo sapiens
ggccccttgctgctggctcc

SEQ ID NO: 6325308 - DNA, 19 bp, Homo sapiens
ggccccttggcgggcagcc

SEQ ID NO: 6325309 - DNA, 17 bp, Homo sapiens
ggcccctttgggccctg

SEQ ID NO: 6325310 - DNA, 17 bp, Homo sapiens
ggcccgacagcctggca

SEQ ID NO: 6325311 - DNA, 15 bp, Homo sapiens
ggcccgacaggtggg

SEQ ID NO: 6325312 - DNA, 22 bp, Homo sapiens
ggcccgagagctgggactcagt

SEQ ID NO: 6325313 - DNA, 21 bp, Homo sapiens
ggcccgagatgtgacccacca

SEQ ID NO: 6325314 - DNA, 15 bp, Homo sapiens
ggcccgagcagctga

SEQ ID NO: 6325315 - DNA, 16 bp, Homo sapiens
ggcccgagcagctgag

SEQ ID NO: 6325316 - DNA, 18 bp, Homo sapiens
ggcccgagcagctgagca

SEQ ID NO: 6325317 - DNA, 24 bp, Homo sapiens
ggcccgagcctgaactgagcccca

SEQ ID NO: 6325318 - DNA, 21 bp, Homo sapiens
ggcccgagcgcgtgccttccc

SEQ ID NO: 6325319 - DNA, 16 bp, Homo sapiens
ggcccgaggcaccgga

SEQ ID NO: 6325320 - DNA, 22 bp, Homo sapiens
ggcccgcaccccggcctcaggg

SEQ ID NO: 6325321 - DNA, 17 bp, Homo sapiens
ggcccgcactcaggagc

SEQ ID NO: 6325322 - DNA, 21 bp, Homo sapiens
ggcccgcagcctggcatctgt

SEQ ID NO: 6325323 - DNA, 21 bp, Homo sapiens
ggcccgcatgtgcattctttt

SEQ ID NO: 6325324 - DNA, 14 bp, Homo sapiens
ggcccgccaccttg

SEQ ID NO: 6325325 - DNA, 14 bp, Homo sapiens
ggcccgccccaggc

SEQ ID NO: 6325326 - DNA, 16 bp, Homo sapiens
ggcccgccctcacctc

SEQ ID NO: 6325327 - DNA, 17 bp, Homo sapiens
ggcccgccctctgcctc

SEQ ID NO: 6325328 - DNA, 13 bp, Homo sapiens
ggcccgccctgcc

SEQ ID NO: 6325329 - DNA, 15 bp, Homo sapiens
ggcccgccctgcccg

SEQ ID NO: 6325330 - DNA, 19 bp, Homo sapiens
ggcccgccctgcccgcgcc

SEQ ID NO: 6325331 - DNA, 21 bp, Homo sapiens
ggcccgccctgcccgggctcc

SEQ ID NO: 6325332 - DNA, 19 bp, Homo sapiens
ggcccgccgtgcctgcatt

SEQ ID NO: 6325333 - DNA, 19 bp, Homo sapiens
ggcccgcctctcctcggtt

SEQ ID NO: 6325334 - DNA, 13 bp, Homo sapiens
ggcccgcctgcca

SEQ ID NO: 6325335 - DNA, 15 bp, Homo sapiens
ggcccgcctgccacc

SEQ ID NO: 6325336 - DNA, 23 bp, Homo sapiens
ggcccgcctgccacctctcccag

SEQ ID NO: 6325337 - DNA, 14 bp, Homo sapiens
ggcccgcctgccca

SEQ ID NO: 6325338 - DNA, 12 bp, Homo sapiens
gtctcagggccg

SEQ ID NO: 6325339 - DNA, 23 bp, Homo sapiens
gtctcaggtccagctttactgtg

SEQ ID NO: 6325340 - DNA, 16 bp, Homo sapiens
gtctcagtccacctga

SEQ ID NO: 6325341 - DNA, 16 bp, Homo sapiens
gtctcagtccagatgc

SEQ ID NO: 6325342 - DNA, 20 bp, Homo sapiens
gtctcagtccagatgccttc

SEQ ID NO: 6325343 - DNA, 16 bp, Homo sapiens
gtctcagtctgtcacc

SEQ ID NO: 6325344 - DNA, 18 bp, Homo sapiens
gtctcagtggcttcatct

SEQ ID NO: 6325345 - DNA, 12 bp, Homo sapiens
gtctcagtgtcc

SEQ ID NO: 6325346 - DNA, 22 bp, Homo sapiens
gtctcagtgtcctcatctgtaa

SEQ ID NO: 6325347 - DNA, 19 bp, Homo sapiens
gtctcagttcgtgtttgat

SEQ ID NO: 6325348 - DNA, 14 bp, Homo sapiens
gtctcagtttcttg

SEQ ID NO: 6325349 - DNA, 16 bp, Homo sapiens
gtctcataattgtcaa

SEQ ID NO: 6325350 - DNA, 19 bp, Homo sapiens
gtctcataggttgagcaat

SEQ ID NO: 6325351 - DNA, 15 bp, Homo sapiens
gtctcatatttttac

SEQ ID NO: 6325352 - DNA, 15 bp, Homo sapiens
gtctcatccatcatc

SEQ ID NO: 6325353 - DNA, 13 bp, Homo sapiens
gtctcatccccag

SEQ ID NO: 6325354 - DNA, 15 bp, Homo sapiens
gtctcatccccaggg

SEQ ID NO: 6325355 - DNA, 16 bp, Homo sapiens
gtctcatccccagggg

SEQ ID NO: 6325356 - DNA, 14 bp, Homo sapiens
gtctcatcctccca

SEQ ID NO: 6325357 - DNA, 18 bp, Homo sapiens
gtctcatcctcccattgc

SEQ ID NO: 6325358 - DNA, 22 bp, Homo sapiens
gtctcatcctcccattgcccag

SEQ ID NO: 6325359 - DNA, 16 bp, Homo sapiens
gtctcatctcccaggc

SEQ ID NO: 6325360 - DNA, 16 bp, Homo sapiens
gtctcatctcctgacc

SEQ ID NO: 6325361 - DNA, 12 bp, Homo sapiens
gtctcatctctt

SEQ ID NO: 6325362 - DNA, 22 bp, Homo sapiens
gtctcatgccagtaacaggctc

SEQ ID NO: 6325363 - DNA, 15 bp, Homo sapiens
gtctcatgcccactc

SEQ ID NO: 6325364 - DNA, 22 bp, Homo sapiens
gtctcatgcccactcccccagg

SEQ ID NO: 6325365 - DNA, 12 bp, Homo sapiens
gtctcatgcctg

SEQ ID NO: 6325366 - DNA, 22 bp, Homo sapiens
gtctcatggtcccacttcccca

SEQ ID NO: 6325367 - DNA, 15 bp, Homo sapiens
gtctcatgtaaaata

SEQ ID NO: 6325368 - DNA, 18 bp, Homo sapiens
gtctcatgtaaaataaga

SEQ ID NO: 6325369 - DNA, 20 bp, Homo sapiens
gtctcattccgttgtctgtg

SEQ ID NO: 6325370 - DNA, 21 bp, Homo sapiens
gtctcattcgcctttgtcttg

SEQ ID NO: 6325371 - DNA, 14 bp, Homo sapiens
gtctcattctcaga

SEQ ID NO: 6325372 - DNA, 23 bp, Homo sapiens
gtctcattctgttgcccaggctg

SEQ ID NO: 6325373 - DNA, 16 bp, Homo sapiens
gtctcattgcttctga

SEQ ID NO: 6325374 - DNA, 15 bp, Homo sapiens
gtctcattgtcacct

SEQ ID NO: 6325375 - DNA, 22 bp, Homo sapiens
gtctcatttaggactgggttcc

SEQ ID NO: 6325376 - DNA, 19 bp, Homo sapiens
gtctcatttgatattgtgt

SEQ ID NO: 6325377 - DNA, 15 bp, Homo sapiens
gtctcatttgccagg

SEQ ID NO: 6325378 - DNA, 15 bp, Homo sapiens
gtctcatttgggcta

SEQ ID NO: 6325379 - DNA, 15 bp, Homo sapiens
gtctcattttaatgt

SEQ ID NO: 6325380 - DNA, 20 bp, Homo sapiens
gtctcattttaatgtaaaga

SEQ ID NO: 6325381 - DNA, 14 bp, Homo sapiens
gtctccaaagaaga

SEQ ID NO: 6325382 - DNA, 15 bp, Homo sapiens
gtctccaaagaagat

SEQ ID NO: 6325383 - DNA, 16 bp, Homo sapiens
gtctccaaagaagata

SEQ ID NO: 6325384 - DNA, 16 bp, Homo sapiens
gtctccaaccccccag

SEQ ID NO: 6325385 - DNA, 20 bp, Homo sapiens
gtctccaaccccccagcact

SEQ ID NO: 6325386 - DNA, 22 bp, Homo sapiens
gtctccaaccccccagcactga

SEQ ID NO: 6325387 - DNA, 14 bp, Homo sapiens
gtctccaagaatac

SEQ ID NO: 6325388 - DNA, 15 bp, Homo sapiens
gtctccaagaatgtt

SEQ ID NO: 6325389 - DNA, 18 bp, Homo sapiens
gtctccaagaatgttttg

SEQ ID NO: 6325390 - DNA, 14 bp, Homo sapiens
gtctccaagggagg

SEQ ID NO: 6325391 - DNA, 17 bp, Homo sapiens
gtctccacatccccagc

SEQ ID NO: 6325392 - DNA, 15 bp, Homo sapiens
gtctccaccaggaac

SEQ ID NO: 6325393 - DNA, 21 bp, Homo sapiens
gtctccaccaggaacctcttc

SEQ ID NO: 6325394 - DNA, 16 bp, Homo sapiens
gtctccaccccagggt

SEQ ID NO: 6325395 - DNA, 15 bp, Homo sapiens
gtctccacccctcaa

SEQ ID NO: 6325396 - DNA, 21 bp, Homo sapiens
gtctccacctcaggggagact

SEQ ID NO: 6325397 - DNA, 12 bp, Homo sapiens
gtctccacctgc

SEQ ID NO: 6325398 - DNA, 13 bp, Homo sapiens
gtctccacctgca

SEQ ID NO: 6325399 - DNA, 18 bp, Homo sapiens
gtctccacctgcacattg

SEQ ID NO: 6325400 - DNA, 21 bp, Homo sapiens
gtctccactaaatgagctcct

SEQ ID NO: 6325401 - DNA, 17 bp, Homo sapiens
gtctccagaagaaaatt

SEQ ID NO: 6325402 - DNA, 15 bp, Homo sapiens
gtctccagaccccca

SEQ ID NO: 6325403 - DNA, 19 bp, Homo sapiens
gtctccagagagaaatcag

SEQ ID NO: 6325404 - DNA, 11 bp, Homo sapiens
gtctccagccc

SEQ ID NO: 6325405 - DNA, 14 bp, Homo sapiens
gtctccagctgcct

SEQ ID NO: 6325406 - DNA, 17 bp, Homo sapiens
gtctccagctgcctggg

SEQ ID NO: 6325407 - DNA, 13 bp, Homo sapiens
gtctccagctgct

SEQ ID NO: 6325408 - DNA, 15 bp, Homo sapiens
gtctccaggccatga

SEQ ID NO: 6325409 - DNA, 14 bp, Homo sapiens
gtctccagggaggg

SEQ ID NO: 6325410 - DNA, 20 bp, Homo sapiens
gtctccagggcccccaccga

SEQ ID NO: 6325411 - DNA, 23 bp, Homo sapiens
gtctccagtgttccccccataga

SEQ ID NO: 6325412 - DNA, 23 bp, Homo sapiens
gtctccataaaagtcctgtcacc

SEQ ID NO: 6325413 - DNA, 14 bp, Homo sapiens
gtctccataatgcc

SEQ ID NO: 6325414 - DNA, 16 bp, Homo sapiens
gtctccataatgccac

SEQ ID NO: 6325415 - DNA, 18 bp, Homo sapiens
gtctccataatgccactg

SEQ ID NO: 6325416 - DNA, 18 bp, Homo sapiens
gtctccatgaagagcttg

SEQ ID NO: 6325417 - DNA, 21 bp, Homo sapiens
gtctccatgctggatactgga

SEQ ID NO: 6325418 - DNA, 24 bp, Homo sapiens
gtctccatgctggatactggacac

SEQ ID NO: 6325419 - DNA, 19 bp, Homo sapiens
gtctccatgtgtgtgccaa

SEQ ID NO: 6325420 - DNA, 21 bp, Homo sapiens
gtctccattctgtgtggcacc

SEQ ID NO: 6325421 - DNA, 16 bp, Homo sapiens
gtctccattgtgtgat

SEQ ID NO: 6325422 - DNA, 20 bp, Homo sapiens
gtctccatttttcccaggac

SEQ ID NO: 6325423 - DNA, 15 bp, Homo sapiens
gtctcccaaagtgct

SEQ ID NO: 6325424 - DNA, 21 bp, Homo sapiens
gtctcccaaagtgctgggatt

SEQ ID NO: 6325425 - DNA, 16 bp, Homo sapiens
gtctcccaacatggga

SEQ ID NO: 6325426 - DNA, 22 bp, Homo sapiens
gtctcccaccctttctgccagg

SEQ ID NO: 6325427 - DNA, 22 bp, Homo sapiens
gtctcccagatcgctcccttgg

SEQ ID NO: 6325428 - DNA, 14 bp, Homo sapiens
gtctcccaggctgg

SEQ ID NO: 6325429 - DNA, 19 bp, Homo sapiens
gtctcccagtcgaggctgg

SEQ ID NO: 6325430 - DNA, 13 bp, Homo sapiens
gtctcccatcctg

SEQ ID NO: 6325431 - DNA, 14 bp, Homo sapiens
gtctccccaaagct

SEQ ID NO: 6325432 - DNA, 17 bp, Homo sapiens
gtctccccagttccaca

SEQ ID NO: 6325433 - DNA, 22 bp, Homo sapiens
gtctccccatgctgggctcact

SEQ ID NO: 6325434 - DNA, 20 bp, Homo sapiens
gtctcccccaacagctggac

SEQ ID NO: 6325435 - DNA, 13 bp, Homo sapiens
gtctcccccagag

SEQ ID NO: 6325436 - DNA, 15 bp, Homo sapiens
gtctcccccagagtg

SEQ ID NO: 6325437 - DNA, 14 bp, Homo sapiens
gtctcccctcctgc

SEQ ID NO: 6325438 - DNA, 12 bp, Homo sapiens
gtctcccctcgt

SEQ ID NO: 6325439 - DNA, 17 bp, Homo sapiens
gtctcccctctgctggc

SEQ ID NO: 6325440 - DNA, 12 bp, Homo sapiens
gtctccccttcc

SEQ ID NO: 6325441 - DNA, 16 bp, Homo sapiens
gtctccccttcctggc

SEQ ID NO: 6325442 - DNA, 19 bp, Homo sapiens
gtctcccgccccccacact

SEQ ID NO: 6325443 - DNA, 18 bp, Homo sapiens
gtctccctcccctctcag

SEQ ID NO: 6325444 - DNA, 20 bp, Homo sapiens
gtctccctcccctctcagaa

SEQ ID NO: 6325445 - DNA, 22 bp, Homo sapiens
gtctccctcccctctcagaaca

SEQ ID NO: 6325446 - DNA, 16 bp, Homo sapiens
gtctccctcctctgcc

SEQ ID NO: 6325447 - DNA, 17 bp, Homo sapiens
gtctccctcgacagcgc

SEQ ID NO: 6325448 - DNA, 23 bp, Homo sapiens
gtctccctcgacagcgcccctgc

SEQ ID NO: 6325449 - DNA, 15 bp, Homo sapiens
gtctccctctcctgc

SEQ ID NO: 6325450 - DNA, 16 bp, Homo sapiens
gtctccctctcctgcc

SEQ ID NO: 6325451 - DNA, 17 bp, Homo sapiens
gtctccctctcctgcct

SEQ ID NO: 6325452 - DNA, 19 bp, Homo sapiens
gtctccctctcctgcctac

SEQ ID NO: 6325453 - DNA, 12 bp, Homo sapiens
gtctccctctga

SEQ ID NO: 6325454 - DNA, 14 bp, Homo sapiens
gtctccctgaagag

SEQ ID NO: 6325455 - DNA, 16 bp, Homo sapiens
gtctccctgcacagcc

SEQ ID NO: 6325456 - DNA, 17 bp, Homo sapiens
gtctccctgcacagcct

SEQ ID NO: 6325457 - DNA, 18 bp, Homo sapiens
gtctccctgcacagcctc

SEQ ID NO: 6325458 - DNA, 15 bp, Homo sapiens
gtctccctggccctc

SEQ ID NO: 6325459 - DNA, 15 bp, Homo sapiens
gtctccctggctccc

SEQ ID NO: 6325460 - DNA, 13 bp, Homo sapiens
gtctccctgggca

SEQ ID NO: 6325461 - DNA, 20 bp, Homo sapiens
gtctccctgtgttacccagg

SEQ ID NO: 6325462 - DNA, 19 bp, Homo sapiens
gtctcccttccgtccatcc

SEQ ID NO: 6325463 - DNA, 20 bp, Homo sapiens
gtctcccttccgtccatccc

SEQ ID NO: 6325464 - DNA, 14 bp, Homo sapiens
gtctcccttctctc

SEQ ID NO: 6325465 - DNA, 14 bp, Homo sapiens
gtctcccttggcca

SEQ ID NO: 6325466 - DNA, 21 bp, Homo sapiens
gtctcccttggccacggcctg

SEQ ID NO: 6325467 - DNA, 19 bp, Homo sapiens
gtctcccttggcccagaga

SEQ ID NO: 6325468 - DNA, 19 bp, Homo sapiens
gtctccctttccatggcaa

SEQ ID NO: 6325469 - DNA, 14 bp, Homo sapiens
gtctccggcctctc

SEQ ID NO: 6325470 - DNA, 17 bp, Homo sapiens
gtctcctactcctgact

SEQ ID NO: 6325471 - DNA, 22 bp, Homo sapiens
gtctcctaggctaaatgagaat

SEQ ID NO: 6325472 - DNA, 17 bp, Homo sapiens
gtctcctaggggcttgg

SEQ ID NO: 6325473 - DNA, 19 bp, Homo sapiens
gtctcctatacccagcaga

SEQ ID NO: 6325474 - DNA, 22 bp, Homo sapiens
gtctcctatatatttctattat

SEQ ID NO: 6325475 - DNA, 23 bp, Homo sapiens
gtctcctcaatttttgtctcaga

SEQ ID NO: 6325476 - DNA, 17 bp, Homo sapiens
gtctcctcagcctcctc

SEQ ID NO: 6325477 - DNA, 23 bp, Homo sapiens
gtctcctcagcctcctcatctgg

SEQ ID NO: 6325478 - DNA, 15 bp, Homo sapiens
gtctcctcaggacca

SEQ ID NO: 6325479 - DNA, 14 bp, Homo sapiens
gtctcctccaccgc

SEQ ID NO: 6325480 - DNA, 13 bp, Homo sapiens
gtctcctcccagc

SEQ ID NO: 6325481 - DNA, 16 bp, Homo sapiens
gtctcctccccttccc

SEQ ID NO: 6325482 - DNA, 21 bp, Homo sapiens
gtctcctccctgggctaagca

SEQ ID NO: 6325483 - DNA, 19 bp, Homo sapiens
gtctcctcctcgaagccat

SEQ ID NO: 6325484 - DNA, 15 bp, Homo sapiens
gtctcctctccagcc

SEQ ID NO: 6325485 - DNA, 16 bp, Homo sapiens
gtctcctctccagccc

SEQ ID NO: 6325486 - DNA, 17 bp, Homo sapiens
gtctcctctccagccct

SEQ ID NO: 6325487 - DNA, 13 bp, Homo sapiens
gtctcctctgtca

SEQ ID NO: 6325488 - DNA, 17 bp, Homo sapiens
gtctcctcttccagagt

SEQ ID NO: 6325489 - DNA, 20 bp, Homo sapiens
gtctcctgactggtgctgca

SEQ ID NO: 6325490 - DNA, 12 bp, Homo sapiens
gtctcctgaggg

SEQ ID NO: 6325491 - DNA, 16 bp, Homo sapiens
gtctcctgagggtcct

SEQ ID NO: 6325492 - DNA, 14 bp, Homo sapiens
gtctcctgcatgca

SEQ ID NO: 6325493 - DNA, 23 bp, Homo sapiens
gtctcctgcccccacacctggcc

SEQ ID NO: 6325494 - DNA, 12 bp, Homo sapiens
gtctcctgggaa

SEQ ID NO: 6325495 - DNA, 22 bp, Homo sapiens
gtctcctgggcatctggccctg

SEQ ID NO: 6325496 - DNA, 23 bp, Homo sapiens
gtctcctgggcatctggccctgc

SEQ ID NO: 6325497 - DNA, 15 bp, Homo sapiens
gtctcctgtccccgg

SEQ ID NO: 6325498 - DNA, 12 bp, Homo sapiens
gtctcctgtctt

SEQ ID NO: 6325499 - DNA, 23 bp, Homo sapiens
gtctcctgtcttatggtccagaa

SEQ ID NO: 6325500 - DNA, 22 bp, Homo sapiens
gtctcctgtgcccacatcccag

SEQ ID NO: 6325501 - DNA, 22 bp, Homo sapiens
gtctccttaacactgagctgtc

SEQ ID NO: 6325502 - DNA, 19 bp, Homo sapiens
gtctccttactctgagccc

SEQ ID NO: 6325503 - DNA, 20 bp, Homo sapiens
gtctccttactctgagccca

SEQ ID NO: 6325504 - DNA, 15 bp, Homo sapiens
gtctccttcagcacg

SEQ ID NO: 6325505 - DNA, 13 bp, Homo sapiens
gtctccttcccac

SEQ ID NO: 6325506 - DNA, 17 bp, Homo sapiens
gtctccttcccactgtc

SEQ ID NO: 6325507 - DNA, 23 bp, Homo sapiens
gtctccttcccactgtcctttct

SEQ ID NO: 6325508 - DNA, 14 bp, Homo sapiens
gtctccttctcttc

SEQ ID NO: 6325509 - DNA, 15 bp, Homo sapiens
gtctccttctcttct

SEQ ID NO: 6325510 - DNA, 17 bp, Homo sapiens
gtctccttctcttctct

SEQ ID NO: 6325511 - DNA, 11 bp, Homo sapiens
gtctccttggc

SEQ ID NO: 6325512 - DNA, 21 bp, Homo sapiens
gtctcctttctgactgtccct

SEQ ID NO: 6325513 - DNA, 20 bp, Homo sapiens
gtctcctttgcactgagggc

SEQ ID NO: 6325514 - DNA, 22 bp, Homo sapiens
gtctcctttgcactgagggcca

SEQ ID NO: 6325515 - DNA, 18 bp, Homo sapiens
gtctcctttgcaggctca

SEQ ID NO: 6325516 - DNA, 14 bp, Homo sapiens
gtctcctttgctct

SEQ ID NO: 6325517 - DNA, 15 bp, Homo sapiens
ggcccgcgcagctgc

SEQ ID NO: 6325518 - DNA, 13 bp, Homo sapiens
ggcccgcgggcac

SEQ ID NO: 6325519 - DNA, 16 bp, Homo sapiens
ggcccgcgggcacagc

SEQ ID NO: 6325520 - DNA, 14 bp, Homo sapiens
ggcccgctgcctct

SEQ ID NO: 6325521 - DNA, 15 bp, Homo sapiens
ggcccgctgcctctt

SEQ ID NO: 6325522 - DNA, 13 bp, Homo sapiens
ggcccgcttgcct

SEQ ID NO: 6325523 - DNA, 14 bp, Homo sapiens
ggcccgcttgcctc

SEQ ID NO: 6325524 - DNA, 19 bp, Homo sapiens
ggcccggagaaacctgatg

SEQ ID NO: 6325525 - DNA, 17 bp, Homo sapiens
ggcccggagaaactgag

SEQ ID NO: 6325526 - DNA, 24 bp, Homo sapiens
ggcccggagatgcatctgtggcct

SEQ ID NO: 6325527 - DNA, 15 bp, Homo sapiens
ggcccggagcagcag

SEQ ID NO: 6325528 - DNA, 22 bp, Homo sapiens
ggcccggagtaatcaggcagcc

SEQ ID NO: 6325529 - DNA, 15 bp, Homo sapiens
ggcccggatgctgct

SEQ ID NO: 6325530 - DNA, 12 bp, Homo sapiens
ggcccggcaggg

SEQ ID NO: 6325531 - DNA, 13 bp, Homo sapiens
ggcccggcagggc

SEQ ID NO: 6325532 - DNA, 18 bp, Homo sapiens
ggcccggcagggcgggca

SEQ ID NO: 6325533 - DNA, 18 bp, Homo sapiens
ggcccggcatgaggcccc

SEQ ID NO: 6325534 - DNA, 12 bp, Homo sapiens
ggcccggccagc

SEQ ID NO: 6325535 - DNA, 16 bp, Homo sapiens
ggcccggccagcgggc

SEQ ID NO: 6325536 - DNA, 23 bp, Homo sapiens
ggcccggccagcgggcacagggc

SEQ ID NO: 6325537 - DNA, 19 bp, Homo sapiens
ggcccggcccctcaccctc

SEQ ID NO: 6325538 - DNA, 14 bp, Homo sapiens
ggcccggcccctcc

SEQ ID NO: 6325539 - DNA, 23 bp, Homo sapiens
ggcccggcgcggtggctcacgcc

SEQ ID NO: 6325540 - DNA, 18 bp, Homo sapiens
ggcccggctgagcccccc

SEQ ID NO: 6325541 - DNA, 16 bp, Homo sapiens
ggcccggctgagccct

SEQ ID NO: 6325542 - DNA, 18 bp, Homo sapiens
ggcccgggaactcctgcc

SEQ ID NO: 6325543 - DNA, 15 bp, Homo sapiens
ggcccgggcaggcca

SEQ ID NO: 6325544 - DNA, 21 bp, Homo sapiens
ggcccgggcccccgccccgcc

SEQ ID NO: 6325545 - DNA, 17 bp, Homo sapiens
ggcccgggccgaccctg

SEQ ID NO: 6325546 - DNA, 22 bp, Homo sapiens
ggcccgggccgaccctgcggcc

SEQ ID NO: 6325547 - DNA, 18 bp, Homo sapiens
ggcccggggcccttcctc

SEQ ID NO: 6325548 - DNA, 18 bp, Homo sapiens
ggcccggtggcggcaggg

SEQ ID NO: 6325549 - DNA, 16 bp, Homo sapiens
ggcccgtcggagctgc

SEQ ID NO: 6325550 - DNA, 18 bp, Homo sapiens
ggcccgtcggagctgcct

SEQ ID NO: 6325551 - DNA, 23 bp, Homo sapiens
ggcccgtcggagctgcctgcagc

SEQ ID NO: 6325552 - DNA, 18 bp, Homo sapiens
ggcccgtgcgcagccgcg

SEQ ID NO: 6325553 - DNA, 21 bp, Homo sapiens
ggcccgtggcctggcatctgt

SEQ ID NO: 6325554 - DNA, 16 bp, Homo sapiens
ggcccgttgaggatga

SEQ ID NO: 6325555 - DNA, 17 bp, Homo sapiens
ggcccgttgtctccctg

SEQ ID NO: 6325556 - DNA, 18 bp, Homo sapiens
ggcccgttgtctccctgg

SEQ ID NO: 6325557 - DNA, 22 bp, Homo sapiens
ggcccgttgtctccctggccct

SEQ ID NO: 6325558 - DNA, 16 bp, Homo sapiens
ggccctaattcagcca

SEQ ID NO: 6325559 - DNA, 18 bp, Homo sapiens
ggccctacaatgctcatg

SEQ ID NO: 6325560 - DNA, 13 bp, Homo sapiens
ggccctacagccc

SEQ ID NO: 6325561 - DNA, 15 bp, Homo sapiens
ggccctacagccctg

SEQ ID NO: 6325562 - DNA, 16 bp, Homo sapiens
ggccctacagtacccc

SEQ ID NO: 6325563 - DNA, 22 bp, Homo sapiens
ggccctaccagcgcccgctggg

SEQ ID NO: 6325564 - DNA, 18 bp, Homo sapiens
ggccctaccctcctgctg

SEQ ID NO: 6325565 - DNA, 11 bp, Homo sapiens
ggccctacctg

SEQ ID NO: 6325566 - DNA, 13 bp, Homo sapiens
ggccctagcattg

SEQ ID NO: 6325567 - DNA, 21 bp, Homo sapiens
ggccctagcccagcgctctgc

SEQ ID NO: 6325568 - DNA, 14 bp, Homo sapiens
ggccctaggcatac

SEQ ID NO: 6325569 - DNA, 22 bp, Homo sapiens
ggccctaggcatactctccagg

SEQ ID NO: 6325570 - DNA, 18 bp, Homo sapiens
ggccctagtgacaggttt

SEQ ID NO: 6325571 - DNA, 18 bp, Homo sapiens
ggccctcaaggcctccca

SEQ ID NO: 6325572 - DNA, 19 bp, Homo sapiens
ggccctcaagtctttctct

SEQ ID NO: 6325573 - DNA, 20 bp, Homo sapiens
ggccctcacccctgccctgg

SEQ ID NO: 6325574 - DNA, 10 bp, Homo sapiens
ggccctcact

SEQ ID NO: 6325575 - DNA, 15 bp, Homo sapiens
ggccctcactcagga

SEQ ID NO: 6325576 - DNA, 22 bp, Homo sapiens
ggccctcactcaggaaccctgg

SEQ ID NO: 6325577 - DNA, 16 bp, Homo sapiens
ggccctcactgagcct

SEQ ID NO: 6325578 - DNA, 17 bp, Homo sapiens
ggccctcagctccctga

SEQ ID NO: 6325579 - DNA, 18 bp, Homo sapiens
ggccctcagctccctgac

SEQ ID NO: 6325580 - DNA, 13 bp, Homo sapiens
ggccctcaggcca

SEQ ID NO: 6325581 - DNA, 14 bp, Homo sapiens
ggccctcaggccat

SEQ ID NO: 6325582 - DNA, 14 bp, Homo sapiens
ggccctcaggccca

SEQ ID NO: 6325583 - DNA, 16 bp, Homo sapiens
ggccctcagtgcatcc

SEQ ID NO: 6325584 - DNA, 20 bp, Homo sapiens
ggccctcagtgggctccctg

SEQ ID NO: 6325585 - DNA, 20 bp, Homo sapiens
ggccctcattaatgacactt

SEQ ID NO: 6325586 - DNA, 17 bp, Homo sapiens
ggccctcattctcattt

SEQ ID NO: 6325587 - DNA, 17 bp, Homo sapiens
ggccctccacacctgcg

SEQ ID NO: 6325588 - DNA, 19 bp, Homo sapiens
ggccctccacacctgcggc

SEQ ID NO: 6325589 - DNA, 22 bp, Homo sapiens
ggccctccagtgggctgatgct

SEQ ID NO: 6325590 - DNA, 16 bp, Homo sapiens
ggccctccatgggcta

SEQ ID NO: 6325591 - DNA, 14 bp, Homo sapiens
ggccctcccaaaga

SEQ ID NO: 6325592 - DNA, 16 bp, Homo sapiens
ggccctcccaccaccc

SEQ ID NO: 6325593 - DNA, 16 bp, Homo sapiens
ggccctcccagaacct

SEQ ID NO: 6325594 - DNA, 12 bp, Homo sapiens
ggccctcccagg

SEQ ID NO: 6325595 - DNA, 14 bp, Homo sapiens
ggccctcccaggcg

SEQ ID NO: 6325596 - DNA, 14 bp, Homo sapiens
ggccctcccaggct

SEQ ID NO: 6325597 - DNA, 15 bp, Homo sapiens
ggccctcccccagct

SEQ ID NO: 6325598 - DNA, 13 bp, Homo sapiens
ggccctccctcag

SEQ ID NO: 6325599 - DNA, 13 bp, Homo sapiens
ggccctccctccc

SEQ ID NO: 6325600 - DNA, 16 bp, Homo sapiens
ggccctccctcccagc

SEQ ID NO: 6325601 - DNA, 22 bp, Homo sapiens
ggccctccctccctagcccttc

SEQ ID NO: 6325602 - DNA, 13 bp, Homo sapiens
ggccctccctgac

SEQ ID NO: 6325603 - DNA, 21 bp, Homo sapiens
ggccctccctgactccctgtg

SEQ ID NO: 6325604 - DNA, 15 bp, Homo sapiens
ggccctccctgcgct

SEQ ID NO: 6325605 - DNA, 19 bp, Homo sapiens
ggccctccctgcgcttcct

SEQ ID NO: 6325606 - DNA, 22 bp, Homo sapiens
ggccctccctgtctccagggcc

SEQ ID NO: 6325607 - DNA, 23 bp, Homo sapiens
ggccctccctgtctccagggccc

SEQ ID NO: 6325608 - DNA, 19 bp, Homo sapiens
ggccctccctgttccccag

SEQ ID NO: 6325609 - DNA, 21 bp, Homo sapiens
ggccctcccttgcaggtcggt

SEQ ID NO: 6325610 - DNA, 17 bp, Homo sapiens
ggccctcctaccctgcg

SEQ ID NO: 6325611 - DNA, 20 bp, Homo sapiens
ggccctcctaccctgcgccc

SEQ ID NO: 6325612 - DNA, 15 bp, Homo sapiens
ggccctcctcagctc

SEQ ID NO: 6325613 - DNA, 19 bp, Homo sapiens
ggccctcctcagctccctg

SEQ ID NO: 6325614 - DNA, 16 bp, Homo sapiens
ggccctcctctggtca

SEQ ID NO: 6325615 - DNA, 18 bp, Homo sapiens
ggccctcctgctggctga

SEQ ID NO: 6325616 - DNA, 12 bp, Homo sapiens
ggccctcctggg

SEQ ID NO: 6325617 - DNA, 14 bp, Homo sapiens
ggccctcctgtgct

SEQ ID NO: 6325618 - DNA, 19 bp, Homo sapiens
ggccctccttccctcctgt

SEQ ID NO: 6325619 - DNA, 19 bp, Homo sapiens
ggccctcgctgccagctct

SEQ ID NO: 6325620 - DNA, 23 bp, Homo sapiens
ggccctcgctgccagctctgtat

SEQ ID NO: 6325621 - DNA, 15 bp, Homo sapiens
ggccctcggagctgg

SEQ ID NO: 6325622 - DNA, 20 bp, Homo sapiens
ggccctcggaggtccagctg

SEQ ID NO: 6325623 - DNA, 15 bp, Homo sapiens
ggccctcgggcccag

SEQ ID NO: 6325624 - DNA, 17 bp, Homo sapiens
ggccctcgggcccagcc

SEQ ID NO: 6325625 - DNA, 19 bp, Homo sapiens
ggccctcgggcccagcccc

SEQ ID NO: 6325626 - DNA, 20 bp, Homo sapiens
ggccctcgggcccagccccc

SEQ ID NO: 6325627 - DNA, 14 bp, Homo sapiens
ggccctcgggccct

SEQ ID NO: 6325628 - DNA, 16 bp, Homo sapiens
ggccctctatgctggc

SEQ ID NO: 6325629 - DNA, 15 bp, Homo sapiens
ggccctctcccctgc

SEQ ID NO: 6325630 - DNA, 23 bp, Homo sapiens
ggccctctcccctgccccctgca

SEQ ID NO: 6325631 - DNA, 16 bp, Homo sapiens
ggccctctctctgggc

SEQ ID NO: 6325632 - DNA, 20 bp, Homo sapiens
ggccctctctgaaggaggcc

SEQ ID NO: 6325633 - DNA, 21 bp, Homo sapiens
ggccctctctgaaggaggcca

SEQ ID NO: 6325634 - DNA, 15 bp, Homo sapiens
ggccctctctgcagt

SEQ ID NO: 6325635 - DNA, 14 bp, Homo sapiens
ggccctctctgctc

SEQ ID NO: 6325636 - DNA, 23 bp, Homo sapiens
ggccctctgaggctcagccctga

SEQ ID NO: 6325637 - DNA, 17 bp, Homo sapiens
ggccctctgcccactcc

SEQ ID NO: 6325638 - DNA, 19 bp, Homo sapiens
ggccctctgcccactccct

SEQ ID NO: 6325639 - DNA, 21 bp, Homo sapiens
ggccctctgcccactccctgc

SEQ ID NO: 6325640 - DNA, 23 bp, Homo sapiens
ggccctctgccgaccgcctgctt

SEQ ID NO: 6325641 - DNA, 23 bp, Homo sapiens
ggccctctggggctcagccctga

SEQ ID NO: 6325642 - DNA, 15 bp, Homo sapiens
ggccctctgtccaca

SEQ ID NO: 6325643 - DNA, 16 bp, Homo sapiens
ggccctctgtccacat

SEQ ID NO: 6325644 - DNA, 13 bp, Homo sapiens
ggccctcttgcca

SEQ ID NO: 6325645 - DNA, 14 bp, Homo sapiens
ggccctcttgccag

SEQ ID NO: 6325646 - DNA, 20 bp, Homo sapiens
ggccctcttgccagcctcct

SEQ ID NO: 6325647 - DNA, 14 bp, Homo sapiens
ggccctctttccct

SEQ ID NO: 6325648 - DNA, 15 bp, Homo sapiens
ggccctctttccctg

SEQ ID NO: 6325649 - DNA, 17 bp, Homo sapiens
ggccctctttccctgcg

SEQ ID NO: 6325650 - DNA, 19 bp, Homo sapiens
ggccctctttccctgcgag

SEQ ID NO: 6325651 - DNA, 19 bp, Homo sapiens
ggccctgaaatggcctgtc

SEQ ID NO: 6325652 - DNA, 19 bp, Homo sapiens
ggccctgacattggagcct

SEQ ID NO: 6325653 - DNA, 20 bp, Homo sapiens
ggccctgactgtcagggagg

SEQ ID NO: 6325654 - DNA, 18 bp, Homo sapiens
ggccctgacttctggaga

SEQ ID NO: 6325655 - DNA, 14 bp, Homo sapiens
ggccctgagccaga

SEQ ID NO: 6325656 - DNA, 23 bp, Homo sapiens
ggccctgagcgagtggagtctgc

SEQ ID NO: 6325657 - DNA, 14 bp, Homo sapiens
ggccctgagctcgg

SEQ ID NO: 6325658 - DNA, 13 bp, Homo sapiens
ggccctgagctga

SEQ ID NO: 6325659 - DNA, 13 bp, Homo sapiens
ggccctgaggaat

SEQ ID NO: 6325660 - DNA, 14 bp, Homo sapiens
ggccctgaggaata

SEQ ID NO: 6325661 - DNA, 17 bp, Homo sapiens
ggccctgatccaggaaa

SEQ ID NO: 6325662 - DNA, 17 bp, Homo sapiens
ggccctgcaagggcgtg

SEQ ID NO: 6325663 - DNA, 22 bp, Homo sapiens
ggccctgcaatgtatcccttct

SEQ ID NO: 6325664 - DNA, 11 bp, Homo sapiens
ggccctgcacc

SEQ ID NO: 6325665 - DNA, 17 bp, Homo sapiens
ggccctgcaccttcccc

SEQ ID NO: 6325666 - DNA, 22 bp, Homo sapiens
ggccctgcactgtcctgctcca

SEQ ID NO: 6325667 - DNA, 16 bp, Homo sapiens
ggccctgcagccagct

SEQ ID NO: 6325668 - DNA, 12 bp, Homo sapiens
ggccctgcagct

SEQ ID NO: 6325669 - DNA, 18 bp, Homo sapiens
ggccctgcaggagcaggg

SEQ ID NO: 6325670 - DNA, 15 bp, Homo sapiens
ggccctgcaggctgc

SEQ ID NO: 6325671 - DNA, 18 bp, Homo sapiens
ggccctgcatctgtctgc

SEQ ID NO: 6325672 - DNA, 22 bp, Homo sapiens
ggccctgcatctgtctgctctg

SEQ ID NO: 6325673 - DNA, 11 bp, Homo sapiens
ggccctgcatg

SEQ ID NO: 6325674 - DNA, 18 bp, Homo sapiens
ggccctgcattggcctgg

SEQ ID NO: 6325675 - DNA, 19 bp, Homo sapiens
ggccctgcattggcctggc

SEQ ID NO: 6325676 - DNA, 21 bp, Homo sapiens
ggccctgcattggcctggcct

SEQ ID NO: 6325677 - DNA, 16 bp, Homo sapiens
ggccctgccacgtccc

SEQ ID NO: 6325678 - DNA, 23 bp, Homo sapiens
ggccctgccacgtcccgctgcct

SEQ ID NO: 6325679 - DNA, 18 bp, Homo sapiens
ggccctgccatcttccca

SEQ ID NO: 6325680 - DNA, 11 bp, Homo sapiens
ggccctgccca

SEQ ID NO: 6325681 - DNA, 15 bp, Homo sapiens
ggccctgcccagcca

SEQ ID NO: 6325682 - DNA, 11 bp, Homo sapiens
ggccctgcccc

SEQ ID NO: 6325683 - DNA, 17 bp, Homo sapiens
ggccctgccccacacag

SEQ ID NO: 6325684 - DNA, 17 bp, Homo sapiens
ggccctgccccaggcct

SEQ ID NO: 6325685 - DNA, 18 bp, Homo sapiens
ggccctgccccaggcctg

SEQ ID NO: 6325686 - DNA, 16 bp, Homo sapiens
ggccctgccccatcct

SEQ ID NO: 6325687 - DNA, 20 bp, Homo sapiens
ggccctgccccatcctgggc

SEQ ID NO: 6325688 - DNA, 23 bp, Homo sapiens
ggccctgccccatcctgggcctt

SEQ ID NO: 6325689 - DNA, 13 bp, Homo sapiens
ggccctgcccccc

SEQ ID NO: 6325690 - DNA, 23 bp, Homo sapiens
ggccctgccccccacattctggc

SEQ ID NO: 6325691 - DNA, 19 bp, Homo sapiens
ggccctgccccctcccact

SEQ ID NO: 6325692 - DNA, 21 bp, Homo sapiens
ggccctgccccctcccactct

SEQ ID NO: 6325693 - DNA, 22 bp, Homo sapiens
ggccctgcccctaggatgctgc

SEQ ID NO: 6325694 - DNA, 21 bp, Homo sapiens
ggccctgcccctccccctacc

SEQ ID NO: 6325695 - DNA, 17 bp, Homo sapiens
ggccctgcccctcccta

SEQ ID NO: 6325696 - DNA, 18 bp, Homo sapiens
gtctcctttgctcttgcc

SEQ ID NO: 6325697 - DNA, 22 bp, Homo sapiens
gtctcgaactcctgacctcaag

SEQ ID NO: 6325698 - DNA, 16 bp, Homo sapiens
gtctcgaactcctggc

SEQ ID NO: 6325699 - DNA, 17 bp, Homo sapiens
gtctcgaactcctggcc

SEQ ID NO: 6325700 - DNA, 15 bp, Homo sapiens
gtctcgaatgtaatt

SEQ ID NO: 6325701 - DNA, 16 bp, Homo sapiens
gtctcgaatgtaattg

SEQ ID NO: 6325702 - DNA, 17 bp, Homo sapiens
gtctcgagcgccctgca

SEQ ID NO: 6325703 - DNA, 19 bp, Homo sapiens
gtctcgagcgccctgcaga

SEQ ID NO: 6325704 - DNA, 15 bp, Homo sapiens
gtctcgatctcctga

SEQ ID NO: 6325705 - DNA, 16 bp, Homo sapiens
gtctcgatgctgctgg

SEQ ID NO: 6325706 - DNA, 23 bp, Homo sapiens
gtctcgcagcctgaagcctggat

SEQ ID NO: 6325707 - DNA, 21 bp, Homo sapiens
gtctcgccagaagactcctag

SEQ ID NO: 6325708 - DNA, 16 bp, Homo sapiens
gtctcgcgcgactgag

SEQ ID NO: 6325709 - DNA, 14 bp, Homo sapiens
gtctcgctctgtcg

SEQ ID NO: 6325710 - DNA, 22 bp, Homo sapiens
gtctcgctctgtcgcccaggct

SEQ ID NO: 6325711 - DNA, 13 bp, Homo sapiens
gtctcgctgcatc

SEQ ID NO: 6325712 - DNA, 22 bp, Homo sapiens
gtctcgctgcatcacccaggct

SEQ ID NO: 6325713 - DNA, 23 bp, Homo sapiens
gtctcggaacctgtgagctgcac

SEQ ID NO: 6325714 - DNA, 22 bp, Homo sapiens
gtctcggatgacaccctggcct

SEQ ID NO: 6325715 - DNA, 15 bp, Homo sapiens
gtctcggcccctctg

SEQ ID NO: 6325716 - DNA, 19 bp, Homo sapiens
gtctcggcccctctgattg

SEQ ID NO: 6325717 - DNA, 16 bp, Homo sapiens
gtctcggctctgcatg

SEQ ID NO: 6325718 - DNA, 13 bp, Homo sapiens
gtctcgtcaggag

SEQ ID NO: 6325719 - DNA, 15 bp, Homo sapiens
gtctcgtcaggaggt

SEQ ID NO: 6325720 - DNA, 20 bp, Homo sapiens
gtctcgtcaggaggtgcctg

SEQ ID NO: 6325721 - DNA, 21 bp, Homo sapiens
gtctcgtcttccgtctccccc

SEQ ID NO: 6325722 - DNA, 19 bp, Homo sapiens
gtctcgtgtcagtaattta

SEQ ID NO: 6325723 - DNA, 18 bp, Homo sapiens
gtctcgtgttcgctggct

SEQ ID NO: 6325724 - DNA, 20 bp, Homo sapiens
gtctcgtgttcgctggctga

SEQ ID NO: 6325725 - DNA, 14 bp, Homo sapiens
gtctcgttcctgtt

SEQ ID NO: 6325726 - DNA, 16 bp, Homo sapiens
gtctcgtttgtgattc

SEQ ID NO: 6325727 - DNA, 21 bp, Homo sapiens
gtctctaaaaagaagccacag

SEQ ID NO: 6325728 - DNA, 22 bp, Homo sapiens
gtctctaagttatgactgtgaa

SEQ ID NO: 6325729 - DNA, 22 bp, Homo sapiens
gtctctaatctgtgctgtttca

SEQ ID NO: 6325730 - DNA, 20 bp, Homo sapiens
gtctctaatgtctgcagctc

SEQ ID NO: 6325731 - DNA, 21 bp, Homo sapiens
gtctctaattctattaaagtg

SEQ ID NO: 6325732 - DNA, 17 bp, Homo sapiens
gtctctacaaaaaataa

SEQ ID NO: 6325733 - DNA, 22 bp, Homo sapiens
gtctctaccaaaaaaaggaagg

SEQ ID NO: 6325734 - DNA, 17 bp, Homo sapiens
gtctctacccctttctg

SEQ ID NO: 6325735 - DNA, 12 bp, Homo sapiens
gtctctagagca

SEQ ID NO: 6325736 - DNA, 18 bp, Homo sapiens
gtctctagagcagggatt

SEQ ID NO: 6325737 - DNA, 14 bp, Homo sapiens
gtctctagccgggc

SEQ ID NO: 6325738 - DNA, 17 bp, Homo sapiens
gtctctataccaataaa

SEQ ID NO: 6325739 - DNA, 18 bp, Homo sapiens
gtctctataccaataaag

SEQ ID NO: 6325740 - DNA, 19 bp, Homo sapiens
gtctctataccaataaagt

SEQ ID NO: 6325741 - DNA, 21 bp, Homo sapiens
gtctctataccaataaagtga

SEQ ID NO: 6325742 - DNA, 21 bp, Homo sapiens
gtctctatattatgtcttctt

SEQ ID NO: 6325743 - DNA, 17 bp, Homo sapiens
gtctctatcattaaagt

SEQ ID NO: 6325744 - DNA, 20 bp, Homo sapiens
gtctctatcattaaagttct

SEQ ID NO: 6325745 - DNA, 17 bp, Homo sapiens
gtctctatgccagctca

SEQ ID NO: 6325746 - DNA, 15 bp, Homo sapiens
gtctctattagctgg

SEQ ID NO: 6325747 - DNA, 11 bp, Homo sapiens
gtctctattta

SEQ ID NO: 6325748 - DNA, 13 bp, Homo sapiens
gtctctatttaaa

SEQ ID NO: 6325749 - DNA, 19 bp, Homo sapiens
gtctctatttaaattcttt

SEQ ID NO: 6325750 - DNA, 20 bp, Homo sapiens
gtctctatttaaattctttt

SEQ ID NO: 6325751 - DNA, 16 bp, Homo sapiens
gtctctcacagacagg

SEQ ID NO: 6325752 - DNA, 19 bp, Homo sapiens
gtctctcacagacaggacc

SEQ ID NO: 6325753 - DNA, 13 bp, Homo sapiens
gtctctccagcct

SEQ ID NO: 6325754 - DNA, 15 bp, Homo sapiens
gtctctccagcctca

SEQ ID NO: 6325755 - DNA, 16 bp, Homo sapiens
gtctctccagcctcac

SEQ ID NO: 6325756 - DNA, 24 bp, Homo sapiens
gtctctccagcctcacagatgctg

SEQ ID NO: 6325757 - DNA, 13 bp, Homo sapiens
gtctctcccaccc

SEQ ID NO: 6325758 - DNA, 21 bp, Homo sapiens
gtctctcccaccccctcccca

SEQ ID NO: 6325759 - DNA, 20 bp, Homo sapiens
gtctctcccaccccggcctc

SEQ ID NO: 6325760 - DNA, 16 bp, Homo sapiens
gtctctcccagctctg

SEQ ID NO: 6325761 - DNA, 17 bp, Homo sapiens
gtctctcccagctctgg

SEQ ID NO: 6325762 - DNA, 23 bp, Homo sapiens
gtctctcccagctctgggggact

SEQ ID NO: 6325763 - DNA, 16 bp, Homo sapiens
gtctctccccctctgt

SEQ ID NO: 6325764 - DNA, 22 bp, Homo sapiens
gtctctccccctctgtcttctc

SEQ ID NO: 6325765 - DNA, 20 bp, Homo sapiens
gtctctccccggtaatgtca

SEQ ID NO: 6325766 - DNA, 14 bp, Homo sapiens
gtctctccctcagg

SEQ ID NO: 6325767 - DNA, 14 bp, Homo sapiens
gtctctcctagccc

SEQ ID NO: 6325768 - DNA, 20 bp, Homo sapiens
gtctctcctagcccctctct

SEQ ID NO: 6325769 - DNA, 20 bp, Homo sapiens
gtctctcctggctgggccat

SEQ ID NO: 6325770 - DNA, 12 bp, Homo sapiens
gtctctcctttt

SEQ ID NO: 6325771 - DNA, 14 bp, Homo sapiens
gtctctccttttct

SEQ ID NO: 6325772 - DNA, 15 bp, Homo sapiens
gtctctccttttctt

SEQ ID NO: 6325773 - DNA, 15 bp, Homo sapiens
gtctctctcacatta

SEQ ID NO: 6325774 - DNA, 16 bp, Homo sapiens
gtctctctccaggtca

SEQ ID NO: 6325775 - DNA, 17 bp, Homo sapiens
gtctctctccaggtcag

SEQ ID NO: 6325776 - DNA, 12 bp, Homo sapiens
gtctctctccat

SEQ ID NO: 6325777 - DNA, 12 bp, Homo sapiens
gtctctctccct

SEQ ID NO: 6325778 - DNA, 21 bp, Homo sapiens
gtctctctccctacctccctc

SEQ ID NO: 6325779 - DNA, 15 bp, Homo sapiens
gtctctctctctcta

SEQ ID NO: 6325780 - DNA, 19 bp, Homo sapiens
gtctctctctctctacaaa

SEQ ID NO: 6325781 - DNA, 15 bp, Homo sapiens
gtctctctgcctgct

SEQ ID NO: 6325782 - DNA, 19 bp, Homo sapiens
gtctctctgcctgctgggc

SEQ ID NO: 6325783 - DNA, 20 bp, Homo sapiens
gtctctctgcctgctgggct

SEQ ID NO: 6325784 - DNA, 21 bp, Homo sapiens
gtctctctgcctgctgggctc

SEQ ID NO: 6325785 - DNA, 18 bp, Homo sapiens
gtctctctgggccttagg

SEQ ID NO: 6325786 - DNA, 13 bp, Homo sapiens
gtctctctgtgaa

SEQ ID NO: 6325787 - DNA, 18 bp, Homo sapiens
gtctctcttcggtggcct

SEQ ID NO: 6325788 - DNA, 20 bp, Homo sapiens
gtctctcttcggtggccttg

SEQ ID NO: 6325789 - DNA, 20 bp, Homo sapiens
gtctctcttgcttgaggaat

SEQ ID NO: 6325790 - DNA, 16 bp, Homo sapiens
gtctctcttggaccca

SEQ ID NO: 6325791 - DNA, 18 bp, Homo sapiens
gtctctcttggacccacc

SEQ ID NO: 6325792 - DNA, 19 bp, Homo sapiens
gtctctcttggacccacct

SEQ ID NO: 6325793 - DNA, 16 bp, Homo sapiens
gtctctcttgtcacat

SEQ ID NO: 6325794 - DNA, 12 bp, Homo sapiens
gtctctctttct

SEQ ID NO: 6325795 - DNA, 17 bp, Homo sapiens
gtctctcttttgctctc

SEQ ID NO: 6325796 - DNA, 15 bp, Homo sapiens
gtctctgaacatcct

SEQ ID NO: 6325797 - DNA, 10 bp, Homo sapiens
gtctctgaag

SEQ ID NO: 6325798 - DNA, 12 bp, Homo sapiens
gtctctgagaac

SEQ ID NO: 6325799 - DNA, 13 bp, Homo sapiens
gtctctgagcagt

SEQ ID NO: 6325800 - DNA, 17 bp, Homo sapiens
gtctctgagcagtgggg

SEQ ID NO: 6325801 - DNA, 23 bp, Homo sapiens
gtctctgagccccctgtgcccac

SEQ ID NO: 6325802 - DNA, 14 bp, Homo sapiens
gtctctgaggctct

SEQ ID NO: 6325803 - DNA, 19 bp, Homo sapiens
gtctctgaggggctaccag

SEQ ID NO: 6325804 - DNA, 22 bp, Homo sapiens
gtctctgaggggtgggggtgcc

SEQ ID NO: 6325805 - DNA, 13 bp, Homo sapiens
gtctctgagtcct

SEQ ID NO: 6325806 - DNA, 23 bp, Homo sapiens
gtctctgatacacagtaattgtg

SEQ ID NO: 6325807 - DNA, 19 bp, Homo sapiens
gtctctgatgcagcttata

SEQ ID NO: 6325808 - DNA, 16 bp, Homo sapiens
gtctctgcagtgtcca

SEQ ID NO: 6325809 - DNA, 14 bp, Homo sapiens
gtctctgcatctga

SEQ ID NO: 6325810 - DNA, 21 bp, Homo sapiens
gtctctgccagttacttgggc

SEQ ID NO: 6325811 - DNA, 11 bp, Homo sapiens
gtctctgccat

SEQ ID NO: 6325812 - DNA, 21 bp, Homo sapiens
gtctctgccatgaactggagg

SEQ ID NO: 6325813 - DNA, 22 bp, Homo sapiens
gtctctgccatgaactggaggc

SEQ ID NO: 6325814 - DNA, 13 bp, Homo sapiens
gtctctgccatgt

SEQ ID NO: 6325815 - DNA, 16 bp, Homo sapiens
gtctctgccccagcct

SEQ ID NO: 6325816 - DNA, 18 bp, Homo sapiens
gtctctgccccagcctgt

SEQ ID NO: 6325817 - DNA, 17 bp, Homo sapiens
gtctctgccggctcttt

SEQ ID NO: 6325818 - DNA, 12 bp, Homo sapiens
gtctctgcctgg

SEQ ID NO: 6325819 - DNA, 16 bp, Homo sapiens
gtctctgcctggagca

SEQ ID NO: 6325820 - DNA, 18 bp, Homo sapiens
gtctctgcctggagcagg

SEQ ID NO: 6325821 - DNA, 15 bp, Homo sapiens
gtctctgccttaggg

SEQ ID NO: 6325822 - DNA, 12 bp, Homo sapiens
gtctctgctgaa

SEQ ID NO: 6325823 - DNA, 14 bp, Homo sapiens
gtctctgctgcatt

SEQ ID NO: 6325824 - DNA, 22 bp, Homo sapiens
gtctctgctgcatttgtgtcat

SEQ ID NO: 6325825 - DNA, 13 bp, Homo sapiens
gtctctgctgccg

SEQ ID NO: 6325826 - DNA, 13 bp, Homo sapiens
gtctctgctggcc

SEQ ID NO: 6325827 - DNA, 12 bp, Homo sapiens
gtctctgcttcc

SEQ ID NO: 6325828 - DNA, 12 bp, Homo sapiens
gtctctgctttc

SEQ ID NO: 6325829 - DNA, 16 bp, Homo sapiens
gtctctggaacccagg

SEQ ID NO: 6325830 - DNA, 21 bp, Homo sapiens
gtctctggaacccaggacctc

SEQ ID NO: 6325831 - DNA, 17 bp, Homo sapiens
gtctctggaatttgaaa

SEQ ID NO: 6325832 - DNA, 21 bp, Homo sapiens
gtctctggattatattatgaa

SEQ ID NO: 6325833 - DNA, 12 bp, Homo sapiens
gtctctggcccc

SEQ ID NO: 6325834 - DNA, 13 bp, Homo sapiens
gtctctggcctgt

SEQ ID NO: 6325835 - DNA, 18 bp, Homo sapiens
gtctctggctcagctgtg

SEQ ID NO: 6325836 - DNA, 20 bp, Homo sapiens
gtctctggctcagctgtggt

SEQ ID NO: 6325837 - DNA, 17 bp, Homo sapiens
gtctctgggccccaggc

SEQ ID NO: 6325838 - DNA, 14 bp, Homo sapiens
gtctctgggcctgt

SEQ ID NO: 6325839 - DNA, 12 bp, Homo sapiens
gtctctggggac

SEQ ID NO: 6325840 - DNA, 11 bp, Homo sapiens
gtctctggggc

SEQ ID NO: 6325841 - DNA, 23 bp, Homo sapiens
gtctctgggtttacaacaaacac

SEQ ID NO: 6325842 - DNA, 17 bp, Homo sapiens
gtctctggtcttccagc

SEQ ID NO: 6325843 - DNA, 16 bp, Homo sapiens
gtctctggttcttgaa

SEQ ID NO: 6325844 - DNA, 22 bp, Homo sapiens
gtctctgtctctcctagcccct

SEQ ID NO: 6325845 - DNA, 12 bp, Homo sapiens
gtctctgtgagg

SEQ ID NO: 6325846 - DNA, 20 bp, Homo sapiens
gtctctgtggaaaagccatc

SEQ ID NO: 6325847 - DNA, 22 bp, Homo sapiens
gtctctgttattgttagtttta

SEQ ID NO: 6325848 - DNA, 16 bp, Homo sapiens
gtctctgttcagatgt

SEQ ID NO: 6325849 - DNA, 20 bp, Homo sapiens
gtctctgttgactggctgtg

SEQ ID NO: 6325850 - DNA, 20 bp, Homo sapiens
gtctctgttggtccactgtg

SEQ ID NO: 6325851 - DNA, 19 bp, Homo sapiens
gtctctgtttagtaaatac

SEQ ID NO: 6325852 - DNA, 21 bp, Homo sapiens
gtctctgtttagtaaatacat

SEQ ID NO: 6325853 - DNA, 14 bp, Homo sapiens
gtctctgtttcctg

SEQ ID NO: 6325854 - DNA, 15 bp, Homo sapiens
gtctcttatggatgt

SEQ ID NO: 6325855 - DNA, 15 bp, Homo sapiens
gtctcttcaaacagt

SEQ ID NO: 6325856 - DNA, 11 bp, Homo sapiens
gtctcttcaga

SEQ ID NO: 6325857 - DNA, 11 bp, Homo sapiens
gtctcttcctg

SEQ ID NO: 6325858 - DNA, 12 bp, Homo sapiens
gtctcttccttc

SEQ ID NO: 6325859 - DNA, 21 bp, Homo sapiens
gtctcttcctttgctctgagg

SEQ ID NO: 6325860 - DNA, 13 bp, Homo sapiens
gtctcttctcaga

SEQ ID NO: 6325861 - DNA, 14 bp, Homo sapiens
gtctcttctccact

SEQ ID NO: 6325862 - DNA, 17 bp, Homo sapiens
gtctcttctccactgga

SEQ ID NO: 6325863 - DNA, 22 bp, Homo sapiens
gtctcttctcccagaatcccag

SEQ ID NO: 6325864 - DNA, 23 bp, Homo sapiens
gtctcttctcccagaatcccagc

SEQ ID NO: 6325865 - DNA, 13 bp, Homo sapiens
gtctcttctcctt

SEQ ID NO: 6325866 - DNA, 14 bp, Homo sapiens
gtctcttctcctta

SEQ ID NO: 6325867 - DNA, 19 bp, Homo sapiens
gtctcttctgaataaagca

SEQ ID NO: 6325868 - DNA, 23 bp, Homo sapiens
gtctcttctgaataaagcaatta

SEQ ID NO: 6325869 - DNA, 21 bp, Homo sapiens
gtctcttcttggggcccagtg

SEQ ID NO: 6325870 - DNA, 22 bp, Homo sapiens
gtctcttcttggggcccagtgc

SEQ ID NO: 6325871 - DNA, 22 bp, Homo sapiens
gtctcttctttcatctggggat

SEQ ID NO: 6325872 - DNA, 17 bp, Homo sapiens
gtctcttgactggctca

SEQ ID NO: 6325873 - DNA, 21 bp, Homo sapiens
gtctcttgactggctcaagaa

SEQ ID NO: 6325874 - DNA, 15 bp, Homo sapiens
gtctcttgagcatca

SEQ ID NO: 6325875 - DNA, 22 bp, Homo sapiens
gtctcttgagcatcaatcttgt

SEQ ID NO: 6325876 - DNA, 19 bp, Homo sapiens
ggccctgcccctcttcccg

SEQ ID NO: 6325877 - DNA, 17 bp, Homo sapiens
ggccctgcccggggagc

SEQ ID NO: 6325878 - DNA, 19 bp, Homo sapiens
ggccctgcccggggagctg

SEQ ID NO: 6325879 - DNA, 11 bp, Homo sapiens
ggccctgccct

SEQ ID NO: 6325880 - DNA, 16 bp, Homo sapiens
ggccctgccctccccc

SEQ ID NO: 6325881 - DNA, 19 bp, Homo sapiens
ggccctgccctcccccacg

SEQ ID NO: 6325882 - DNA, 23 bp, Homo sapiens
ggccctgccctcccccacggccg

SEQ ID NO: 6325883 - DNA, 17 bp, Homo sapiens
ggccctgccctggcagg

SEQ ID NO: 6325884 - DNA, 20 bp, Homo sapiens
ggccctgccctggtttcctg

SEQ ID NO: 6325885 - DNA, 17 bp, Homo sapiens
ggccctgcccttggcac

SEQ ID NO: 6325886 - DNA, 10 bp, Homo sapiens
ggccctgcct

SEQ ID NO: 6325887 - DNA, 15 bp, Homo sapiens
ggccctgcctcactg

SEQ ID NO: 6325888 - DNA, 12 bp, Homo sapiens
ggccctgcctcc

SEQ ID NO: 6325889 - DNA, 13 bp, Homo sapiens
ggccctgcctcct

SEQ ID NO: 6325890 - DNA, 15 bp, Homo sapiens
ggccctgcctccttt

SEQ ID NO: 6325891 - DNA, 22 bp, Homo sapiens
ggccctgcctgacccatccctt

SEQ ID NO: 6325892 - DNA, 12 bp, Homo sapiens
ggccctgcctgc

SEQ ID NO: 6325893 - DNA, 20 bp, Homo sapiens
ggccctgcctgcagccaggg

SEQ ID NO: 6325894 - DNA, 16 bp, Homo sapiens
ggccctgctcaggcct

SEQ ID NO: 6325895 - DNA, 17 bp, Homo sapiens
ggccctgctcctgcagc

SEQ ID NO: 6325896 - DNA, 19 bp, Homo sapiens
ggccctgctgccccctacc

SEQ ID NO: 6325897 - DNA, 16 bp, Homo sapiens
ggccctgctgcccctc

SEQ ID NO: 6325898 - DNA, 17 bp, Homo sapiens
ggccctgctgcccctcc

SEQ ID NO: 6325899 - DNA, 17 bp, Homo sapiens
ggccctgctttttttct

SEQ ID NO: 6325900 - DNA, 22 bp, Homo sapiens
ggccctggacacagcccaccct

SEQ ID NO: 6325901 - DNA, 14 bp, Homo sapiens
ggccctggacagca

SEQ ID NO: 6325902 - DNA, 16 bp, Homo sapiens
ggccctggagcagcca

SEQ ID NO: 6325903 - DNA, 14 bp, Homo sapiens
ggccctggagccag

SEQ ID NO: 6325904 - DNA, 15 bp, Homo sapiens
ggccctggagctcag

SEQ ID NO: 6325905 - DNA, 22 bp, Homo sapiens
ggccctggaggaattcagctca

SEQ ID NO: 6325906 - DNA, 17 bp, Homo sapiens
ggccctggagggcagag

SEQ ID NO: 6325907 - DNA, 20 bp, Homo sapiens
ggccctggagggcagagaca

SEQ ID NO: 6325908 - DNA, 23 bp, Homo sapiens
ggccctggatcagcgtggccttg

SEQ ID NO: 6325909 - DNA, 22 bp, Homo sapiens
ggccctggatgtgcccacaggg

SEQ ID NO: 6325910 - DNA, 15 bp, Homo sapiens
ggccctggcaccccc

SEQ ID NO: 6325911 - DNA, 16 bp, Homo sapiens
ggccctggcaccccca

SEQ ID NO: 6325912 - DNA, 14 bp, Homo sapiens
ggccctggcagccc

SEQ ID NO: 6325913 - DNA, 12 bp, Homo sapiens
ggccctggccag

SEQ ID NO: 6325914 - DNA, 14 bp, Homo sapiens
ggccctggccagcc

SEQ ID NO: 6325915 - DNA, 16 bp, Homo sapiens
ggccctggccagccgg

SEQ ID NO: 6325916 - DNA, 15 bp, Homo sapiens
ggccctggccaggac

SEQ ID NO: 6325917 - DNA, 13 bp, Homo sapiens
ggccctggcctcc

SEQ ID NO: 6325918 - DNA, 17 bp, Homo sapiens
ggccctggcctcccctg

SEQ ID NO: 6325919 - DNA, 16 bp, Homo sapiens
ggccctggcctgctgg

SEQ ID NO: 6325920 - DNA, 22 bp, Homo sapiens
ggccctggcctgctgggctctc

SEQ ID NO: 6325921 - DNA, 19 bp, Homo sapiens
ggccctggctgagggcagc

SEQ ID NO: 6325922 - DNA, 13 bp, Homo sapiens
ggccctggctgcc

SEQ ID NO: 6325923 - DNA, 13 bp, Homo sapiens
ggccctggctggg

SEQ ID NO: 6325924 - DNA, 21 bp, Homo sapiens
ggccctggctggggacttggc

SEQ ID NO: 6325925 - DNA, 18 bp, Homo sapiens
ggccctgggcctccacct

SEQ ID NO: 6325926 - DNA, 18 bp, Homo sapiens
ggccctgggcctgcctca

SEQ ID NO: 6325927 - DNA, 23 bp, Homo sapiens
ggccctgggcctgcctcaccacg

SEQ ID NO: 6325928 - DNA, 11 bp, Homo sapiens
ggccctgggct

SEQ ID NO: 6325929 - DNA, 18 bp, Homo sapiens
ggccctgggctcggaggc

SEQ ID NO: 6325930 - DNA, 13 bp, Homo sapiens
ggccctgggctga

SEQ ID NO: 6325931 - DNA, 22 bp, Homo sapiens
ggccctgggctgggtgctggga

SEQ ID NO: 6325932 - DNA, 12 bp, Homo sapiens
ggccctggggaa

SEQ ID NO: 6325933 - DNA, 21 bp, Homo sapiens
ggccctggggaagaggccttg

SEQ ID NO: 6325934 - DNA, 20 bp, Homo sapiens
ggccctggggatcttcccac

SEQ ID NO: 6325935 - DNA, 17 bp, Homo sapiens
ggccctggggcctgtac

SEQ ID NO: 6325936 - DNA, 16 bp, Homo sapiens
ggccctggggctgccc

SEQ ID NO: 6325937 - DNA, 14 bp, Homo sapiens
ggccctgggggacc

SEQ ID NO: 6325938 - DNA, 19 bp, Homo sapiens
ggccctggggtccccactc

SEQ ID NO: 6325939 - DNA, 16 bp, Homo sapiens
ggccctggggtctctg

SEQ ID NO: 6325940 - DNA, 22 bp, Homo sapiens
ggccctggggtgtgtctcggtg

SEQ ID NO: 6325941 - DNA, 21 bp, Homo sapiens
ggccctgggtaagaagggtgg

SEQ ID NO: 6325942 - DNA, 12 bp, Homo sapiens
ggccctggtcct

SEQ ID NO: 6325943 - DNA, 18 bp, Homo sapiens
ggccctggtcctggcctc

SEQ ID NO: 6325944 - DNA, 17 bp, Homo sapiens
ggccctggtccttccag

SEQ ID NO: 6325945 - DNA, 22 bp, Homo sapiens
ggccctggtgcgaatggacttt

SEQ ID NO: 6325946 - DNA, 18 bp, Homo sapiens
ggccctggtgtcaggcag

SEQ ID NO: 6325947 - DNA, 19 bp, Homo sapiens
ggccctggtgtttctagca

SEQ ID NO: 6325948 - DNA, 15 bp, Homo sapiens
ggccctggttccccc

SEQ ID NO: 6325949 - DNA, 17 bp, Homo sapiens
ggccctgtagccctggc

SEQ ID NO: 6325950 - DNA, 19 bp, Homo sapiens
ggccctgtagccctggccc

SEQ ID NO: 6325951 - DNA, 20 bp, Homo sapiens
ggccctgtagttaggcctgg

SEQ ID NO: 6325952 - DNA, 16 bp, Homo sapiens
ggccctgtcactgtcc

SEQ ID NO: 6325953 - DNA, 15 bp, Homo sapiens
ggccctgtcagagcc

SEQ ID NO: 6325954 - DNA, 19 bp, Homo sapiens
ggccctgtcatccagctca

SEQ ID NO: 6325955 - DNA, 14 bp, Homo sapiens
ggccctgtccagcc

SEQ ID NO: 6325956 - DNA, 19 bp, Homo sapiens
ggccctgtccagcccccag

SEQ ID NO: 6325957 - DNA, 18 bp, Homo sapiens
ggccctgtccaggtagaa

SEQ ID NO: 6325958 - DNA, 12 bp, Homo sapiens
ggccctgtccca

SEQ ID NO: 6325959 - DNA, 19 bp, Homo sapiens
ggccctgtcccaggccggc

SEQ ID NO: 6325960 - DNA, 12 bp, Homo sapiens
ggccctgtcccc

SEQ ID NO: 6325961 - DNA, 15 bp, Homo sapiens
ggccctgtcccctgg

SEQ ID NO: 6325962 - DNA, 21 bp, Homo sapiens
ggccctgtccctcccacctct

SEQ ID NO: 6325963 - DNA, 16 bp, Homo sapiens
ggccctgtcgcccctc

SEQ ID NO: 6325964 - DNA, 16 bp, Homo sapiens
ggccctgtctctggct

SEQ ID NO: 6325965 - DNA, 18 bp, Homo sapiens
ggccctgtctctggctac

SEQ ID NO: 6325966 - DNA, 20 bp, Homo sapiens
ggccctgtggagtccagctc

SEQ ID NO: 6325967 - DNA, 21 bp, Homo sapiens
ggccctgtggagtccagctct

SEQ ID NO: 6325968 - DNA, 17 bp, Homo sapiens
ggccctgtggctccagg

SEQ ID NO: 6325969 - DNA, 12 bp, Homo sapiens
ggccctgtggga

SEQ ID NO: 6325970 - DNA, 17 bp, Homo sapiens
ggccctgtggtgctggg

SEQ ID NO: 6325971 - DNA, 11 bp, Homo sapiens
ggccctgtgta

SEQ ID NO: 6325972 - DNA, 15 bp, Homo sapiens
ggccctgttccctgg

SEQ ID NO: 6325973 - DNA, 14 bp, Homo sapiens
ggccctgttctcct

SEQ ID NO: 6325974 - DNA, 15 bp, Homo sapiens
ggccctgttgtgggg

SEQ ID NO: 6325975 - DNA, 21 bp, Homo sapiens
ggcccttcactgcctttgctc

SEQ ID NO: 6325976 - DNA, 19 bp, Homo sapiens
ggcccttcagtctgctcca

SEQ ID NO: 6325977 - DNA, 20 bp, Homo sapiens
ggcccttcagtctgctccac

SEQ ID NO: 6325978 - DNA, 20 bp, Homo sapiens
ggcccttcccaacctcccct

SEQ ID NO: 6325979 - DNA, 22 bp, Homo sapiens
ggcccttcccattctgccccag

SEQ ID NO: 6325980 - DNA, 16 bp, Homo sapiens
ggcccttcctcctcca

SEQ ID NO: 6325981 - DNA, 13 bp, Homo sapiens
ggcccttcctctc

SEQ ID NO: 6325982 - DNA, 17 bp, Homo sapiens
ggcccttcctggacagc

SEQ ID NO: 6325983 - DNA, 19 bp, Homo sapiens
ggcccttcctggacagctg

SEQ ID NO: 6325984 - DNA, 22 bp, Homo sapiens
ggcccttcctggacagctgtgc

SEQ ID NO: 6325985 - DNA, 13 bp, Homo sapiens
ggcccttcctggc

SEQ ID NO: 6325986 - DNA, 18 bp, Homo sapiens
ggcccttcctggctagga

SEQ ID NO: 6325987 - DNA, 13 bp, Homo sapiens
ggcccttccttca

SEQ ID NO: 6325988 - DNA, 17 bp, Homo sapiens
ggcccttccttcaccca

SEQ ID NO: 6325989 - DNA, 14 bp, Homo sapiens
ggcccttccttcca

SEQ ID NO: 6325990 - DNA, 20 bp, Homo sapiens
ggcccttctctccagcccct

SEQ ID NO: 6325991 - DNA, 21 bp, Homo sapiens
ggcccttctctccagcccctg

SEQ ID NO: 6325992 - DNA, 23 bp, Homo sapiens
ggcccttctctccagcccctgga

SEQ ID NO: 6325993 - DNA, 12 bp, Homo sapiens
ggcccttgccca

SEQ ID NO: 6325994 - DNA, 16 bp, Homo sapiens
ggcccttgcccaactc

SEQ ID NO: 6325995 - DNA, 20 bp, Homo sapiens
ggcccttgcccaactcccag

SEQ ID NO: 6325996 - DNA, 14 bp, Homo sapiens
ggcccttggaataa

SEQ ID NO: 6325997 - DNA, 14 bp, Homo sapiens
ggcccttgggacag

SEQ ID NO: 6325998 - DNA, 13 bp, Homo sapiens
ggcccttggggtg

SEQ ID NO: 6325999 - DNA, 16 bp, Homo sapiens
ggcccttggggtggcg

SEQ ID NO: 6326000 - DNA, 16 bp, Homo sapiens
ggcccttgtcctgcca

SEQ ID NO: 6326001 - DNA, 22 bp, Homo sapiens
ggcccttgtcctgccagctgcc

SEQ ID NO: 6326002 - DNA, 23 bp, Homo sapiens
ggcccttgtcctgccagctgcct

SEQ ID NO: 6326003 - DNA, 18 bp, Homo sapiens
ggcccttgtcttttcaag

SEQ ID NO: 6326004 - DNA, 14 bp, Homo sapiens
ggccctttccacga

SEQ ID NO: 6326005 - DNA, 17 bp, Homo sapiens
ggccctttccccttccc

SEQ ID NO: 6326006 - DNA, 22 bp, Homo sapiens
ggccctttcttgcactgtccag

SEQ ID NO: 6326007 - DNA, 18 bp, Homo sapiens
ggccctttgaagcctcag

SEQ ID NO: 6326008 - DNA, 18 bp, Homo sapiens
ggcccttttctggctcct

SEQ ID NO: 6326009 - DNA, 19 bp, Homo sapiens
ggcccttttctggctcctg

SEQ ID NO: 6326010 - DNA, 22 bp, Homo sapiens
ggccctttttcccttccctcct

SEQ ID NO: 6326011 - DNA, 14 bp, Homo sapiens
ggccgaacccccca

SEQ ID NO: 6326012 - DNA, 17 bp, Homo sapiens
ggccgaagccccttgga

SEQ ID NO: 6326013 - DNA, 18 bp, Homo sapiens
ggccgaagctaacaggga

SEQ ID NO: 6326014 - DNA, 17 bp, Homo sapiens
ggccgaaggtgcctcag

SEQ ID NO: 6326015 - DNA, 19 bp, Homo sapiens
ggccgaaggtgcctcagac

SEQ ID NO: 6326016 - DNA, 14 bp, Homo sapiens
ggccgaatccccca

SEQ ID NO: 6326017 - DNA, 16 bp, Homo sapiens
ggccgaatcccccagg

SEQ ID NO: 6326018 - DNA, 18 bp, Homo sapiens
ggccgaatcccccaggga

SEQ ID NO: 6326019 - DNA, 21 bp, Homo sapiens
ggccgacaccactcctgccag

SEQ ID NO: 6326020 - DNA, 14 bp, Homo sapiens
ggccgacaggaggc

SEQ ID NO: 6326021 - DNA, 17 bp, Homo sapiens
ggccgaccaggctggac

SEQ ID NO: 6326022 - DNA, 23 bp, Homo sapiens
ggccgaccaggctggacaccctc

SEQ ID NO: 6326023 - DNA, 17 bp, Homo sapiens
ggccgacccactgaccc

SEQ ID NO: 6326024 - DNA, 16 bp, Homo sapiens
ggccgacggagccggg

SEQ ID NO: 6326025 - DNA, 18 bp, Homo sapiens
ggccgacgttccacctgg

SEQ ID NO: 6326026 - DNA, 17 bp, Homo sapiens
ggccgactgggctgctg

SEQ ID NO: 6326027 - DNA, 20 bp, Homo sapiens
ggccgactgggctgctgggg

SEQ ID NO: 6326028 - DNA, 15 bp, Homo sapiens
ggccgagaagcaaga

SEQ ID NO: 6326029 - DNA, 13 bp, Homo sapiens
ggccgagccacct

SEQ ID NO: 6326030 - DNA, 13 bp, Homo sapiens
ggccgagcccaca

SEQ ID NO: 6326031 - DNA, 18 bp, Homo sapiens
ggccgagcggtggccccg

SEQ ID NO: 6326032 - DNA, 20 bp, Homo sapiens
ggccgagcgttcccagcagg

SEQ ID NO: 6326033 - DNA, 15 bp, Homo sapiens
ggccgagctgtggac

SEQ ID NO: 6326034 - DNA, 13 bp, Homo sapiens
ggccgaggacttt

SEQ ID NO: 6326035 - DNA, 15 bp, Homo sapiens
ggccgaggcacgaga

SEQ ID NO: 6326036 - DNA, 17 bp, Homo sapiens
ggccgaggcaggggctg

SEQ ID NO: 6326037 - DNA, 22 bp, Homo sapiens
ggccgaggcgcgtttgtgcata

SEQ ID NO: 6326038 - DNA, 14 bp, Homo sapiens
ggccgagggccagg

SEQ ID NO: 6326039 - DNA, 17 bp, Homo sapiens
ggccgaggggccagggt

SEQ ID NO: 6326040 - DNA, 16 bp, Homo sapiens
ggccgagggtcctggc

SEQ ID NO: 6326041 - DNA, 17 bp, Homo sapiens
ggccgaggtcccattgt

SEQ ID NO: 6326042 - DNA, 15 bp, Homo sapiens
ggccgaggtgggcag

SEQ ID NO: 6326043 - DNA, 13 bp, Homo sapiens
ggccgagtctgtc

SEQ ID NO: 6326044 - DNA, 14 bp, Homo sapiens
ggccgatgagctgg

SEQ ID NO: 6326045 - DNA, 14 bp, Homo sapiens
ggccgatggagaca

SEQ ID NO: 6326046 - DNA, 20 bp, Homo sapiens
ggccgatgggagtctccctc

SEQ ID NO: 6326047 - DNA, 21 bp, Homo sapiens
ggccgatgtgggtccctctct

SEQ ID NO: 6326048 - DNA, 17 bp, Homo sapiens
ggccgattgggagaaag

SEQ ID NO: 6326049 - DNA, 22 bp, Homo sapiens
ggccgatttgggaaccaagcta

SEQ ID NO: 6326050 - DNA, 20 bp, Homo sapiens
ggccgcaagcgcagggagga

SEQ ID NO: 6326051 - DNA, 19 bp, Homo sapiens
ggccgcaaggggaccgccc

SEQ ID NO: 6326052 - DNA, 17 bp, Homo sapiens
ggccgcaagtccccagc

SEQ ID NO: 6326053 - DNA, 20 bp, Homo sapiens
ggccgcaagtccccagcccc

SEQ ID NO: 6326054 - DNA, 17 bp, Homo sapiens
ggccgcacgcctctccc

SEQ ID NO: 6326055 - DNA, 13 bp, Homo sapiens
ggccgcagaggat

SEQ ID NO: 6326056 - DNA, 13 bp, Homo sapiens
gtctcttgaggga

SEQ ID NO: 6326057 - DNA, 14 bp, Homo sapiens
gtctcttgcctgcc

SEQ ID NO: 6326058 - DNA, 16 bp, Homo sapiens
gtctcttgcctgccac

SEQ ID NO: 6326059 - DNA, 18 bp, Homo sapiens
gtctcttgcctgccactg

SEQ ID NO: 6326060 - DNA, 19 bp, Homo sapiens
gtctcttgcctgccactgt

SEQ ID NO: 6326061 - DNA, 20 bp, Homo sapiens
gtctcttgcctgccactgtg

SEQ ID NO: 6326062 - DNA, 18 bp, Homo sapiens
gtctcttgggaagcagtt

SEQ ID NO: 6326063 - DNA, 18 bp, Homo sapiens
gtctcttggtcctgctgc

SEQ ID NO: 6326064 - DNA, 20 bp, Homo sapiens
gtctcttggtcctgctgcag

SEQ ID NO: 6326065 - DNA, 13 bp, Homo sapiens
gtctcttgtaatc

SEQ ID NO: 6326066 - DNA, 14 bp, Homo sapiens
gtctcttgtagaag

SEQ ID NO: 6326067 - DNA, 16 bp, Homo sapiens
gtctcttgtattaaac

SEQ ID NO: 6326068 - DNA, 19 bp, Homo sapiens
gtctctttaatgtcacagg

SEQ ID NO: 6326069 - DNA, 22 bp, Homo sapiens
gtctctttattcctagttggtg

SEQ ID NO: 6326070 - DNA, 22 bp, Homo sapiens
gtctctttcatgagtttttccc

SEQ ID NO: 6326071 - DNA, 13 bp, Homo sapiens
gtctctttccact

SEQ ID NO: 6326072 - DNA, 17 bp, Homo sapiens
gtctctttccactttgt

SEQ ID NO: 6326073 - DNA, 19 bp, Homo sapiens
gtctctttctttccaaagg

SEQ ID NO: 6326074 - DNA, 21 bp, Homo sapiens
gtctctttgctttctggtggt

SEQ ID NO: 6326075 - DNA, 18 bp, Homo sapiens
gtctctttggggagagct

SEQ ID NO: 6326076 - DNA, 12 bp, Homo sapiens
gtctcttttctc

SEQ ID NO: 6326077 - DNA, 11 bp, Homo sapiens
gtctcttttgt

SEQ ID NO: 6326078 - DNA, 18 bp, Homo sapiens
gtctcttttgtaaattaa

SEQ ID NO: 6326079 - DNA, 19 bp, Homo sapiens
gtctcttttgtaaattaaa

SEQ ID NO: 6326080 - DNA, 20 bp, Homo sapiens
gtctctttttttggcccagg

SEQ ID NO: 6326081 - DNA, 17 bp, Homo sapiens
gtctgaaaaagtgtttt

SEQ ID NO: 6326082 - DNA, 23 bp, Homo sapiens
gtctgaaaaagtgtttttacata

SEQ ID NO: 6326083 - DNA, 15 bp, Homo sapiens
gtctgaaacagagaa

SEQ ID NO: 6326084 - DNA, 23 bp, Homo sapiens
gtctgaaagacagaatgtcacca

SEQ ID NO: 6326085 - DNA, 13 bp, Homo sapiens
gtctgaaattttt

SEQ ID NO: 6326086 - DNA, 17 bp, Homo sapiens
gtctgaacaaaaactgt

SEQ ID NO: 6326087 - DNA, 12 bp, Homo sapiens
gtctgaacaaag

SEQ ID NO: 6326088 - DNA, 15 bp, Homo sapiens
gtctgaacagctgta

SEQ ID NO: 6326089 - DNA, 16 bp, Homo sapiens
gtctgaacccaggcag

SEQ ID NO: 6326090 - DNA, 20 bp, Homo sapiens
gtctgaacccaggcagctgg

SEQ ID NO: 6326091 - DNA, 13 bp, Homo sapiens
gtctgaactgctt

SEQ ID NO: 6326092 - DNA, 20 bp, Homo sapiens
gtctgaaggaatagccagag

SEQ ID NO: 6326093 - DNA, 22 bp, Homo sapiens
gtctgaaggaatagccagagag

SEQ ID NO: 6326094 - DNA, 23 bp, Homo sapiens
gtctgaaggaatagccagagagg

SEQ ID NO: 6326095 - DNA, 19 bp, Homo sapiens
gtctgaaggacacttcctg

SEQ ID NO: 6326096 - DNA, 22 bp, Homo sapiens
gtctgaaggacacttcctgcct

SEQ ID NO: 6326097 - DNA, 14 bp, Homo sapiens
gtctgaaggagagg

SEQ ID NO: 6326098 - DNA, 23 bp, Homo sapiens
gtctgaaggattttaaatgctgt

SEQ ID NO: 6326099 - DNA, 16 bp, Homo sapiens
gtctgaaggcctccat

SEQ ID NO: 6326100 - DNA, 14 bp, Homo sapiens
gtctgaagtacaaa

SEQ ID NO: 6326101 - DNA, 21 bp, Homo sapiens
gtctgaagtgcctactggggg

SEQ ID NO: 6326102 - DNA, 18 bp, Homo sapiens
gtctgaatattctagaac

SEQ ID NO: 6326103 - DNA, 16 bp, Homo sapiens
gtctgaatctcccaag

SEQ ID NO: 6326104 - DNA, 13 bp, Homo sapiens
gtctgaatgttct

SEQ ID NO: 6326105 - DNA, 17 bp, Homo sapiens
gtctgaatgttctgaca

SEQ ID NO: 6326106 - DNA, 20 bp, Homo sapiens
gtctgaatgttctgacatta

SEQ ID NO: 6326107 - DNA, 15 bp, Homo sapiens
gtctgaattgagaaa

SEQ ID NO: 6326108 - DNA, 13 bp, Homo sapiens
gtctgaattttag

SEQ ID NO: 6326109 - DNA, 23 bp, Homo sapiens
gtctgacaaggtggtcaacaaca

SEQ ID NO: 6326110 - DNA, 16 bp, Homo sapiens
gtctgacacatgctct

SEQ ID NO: 6326111 - DNA, 17 bp, Homo sapiens
gtctgacacatgctctc

SEQ ID NO: 6326112 - DNA, 23 bp, Homo sapiens
gtctgacacgcaagtgtgtgagt

SEQ ID NO: 6326113 - DNA, 13 bp, Homo sapiens
gtctgacaggaag

SEQ ID NO: 6326114 - DNA, 15 bp, Homo sapiens
gtctgacaggaagac

SEQ ID NO: 6326115 - DNA, 22 bp, Homo sapiens
gtctgacaggaagactggagac

SEQ ID NO: 6326116 - DNA, 23 bp, Homo sapiens
gtctgacaggaagactggagact

SEQ ID NO: 6326117 - DNA, 19 bp, Homo sapiens
gtctgaccaaaaccagagg

SEQ ID NO: 6326118 - DNA, 21 bp, Homo sapiens
gtctgaccaaaaccagagggc

SEQ ID NO: 6326119 - DNA, 22 bp, Homo sapiens
gtctgaccaaaaccagagggca

SEQ ID NO: 6326120 - DNA, 23 bp, Homo sapiens
gtctgaccaaaaccagagggcag

SEQ ID NO: 6326121 - DNA, 15 bp, Homo sapiens
gtctgacccactgct

SEQ ID NO: 6326122 - DNA, 16 bp, Homo sapiens
gtctgaccccagccca

SEQ ID NO: 6326123 - DNA, 15 bp, Homo sapiens
gtctgaccctctgcg

SEQ ID NO: 6326124 - DNA, 12 bp, Homo sapiens
gtctgacctggt

SEQ ID NO: 6326125 - DNA, 13 bp, Homo sapiens
gtctgacctggtg

SEQ ID NO: 6326126 - DNA, 18 bp, Homo sapiens
gtctgacctggtgggagc

SEQ ID NO: 6326127 - DNA, 16 bp, Homo sapiens
gtctgactcaggcgcc

SEQ ID NO: 6326128 - DNA, 23 bp, Homo sapiens
gtctgactcaggcgcctggcaca

SEQ ID NO: 6326129 - DNA, 17 bp, Homo sapiens
gtctgactccagagtct

SEQ ID NO: 6326130 - DNA, 21 bp, Homo sapiens
gtctgactccagagtctgagc

SEQ ID NO: 6326131 - DNA, 19 bp, Homo sapiens
gtctgactccctccccacc

SEQ ID NO: 6326132 - DNA, 20 bp, Homo sapiens
gtctgactccctccccaccc

SEQ ID NO: 6326133 - DNA, 13 bp, Homo sapiens
gtctgactgtttc

SEQ ID NO: 6326134 - DNA, 11 bp, Homo sapiens
gtctgagaaat

SEQ ID NO: 6326135 - DNA, 13 bp, Homo sapiens
gtctgagaaatag

SEQ ID NO: 6326136 - DNA, 10 bp, Homo sapiens
gtctgagact

SEQ ID NO: 6326137 - DNA, 21 bp, Homo sapiens
gtctgagactcacaggaagga

SEQ ID NO: 6326138 - DNA, 15 bp, Homo sapiens
gtctgagagaggcca

SEQ ID NO: 6326139 - DNA, 19 bp, Homo sapiens
gtctgagagcaaagtgacc

SEQ ID NO: 6326140 - DNA, 20 bp, Homo sapiens
gtctgagagcaaagtgacct

SEQ ID NO: 6326141 - DNA, 10 bp, Homo sapiens
gtctgagccc

SEQ ID NO: 6326142 - DNA, 16 bp, Homo sapiens
gtctgagcccaaccct

SEQ ID NO: 6326143 - DNA, 19 bp, Homo sapiens
gtctgagcccatttctggg

SEQ ID NO: 6326144 - DNA, 16 bp, Homo sapiens
gtctgagcccccggct

SEQ ID NO: 6326145 - DNA, 20 bp, Homo sapiens
gtctgagccctgccctcact

SEQ ID NO: 6326146 - DNA, 24 bp, Homo sapiens
gtctgagccctgccctcactccac

SEQ ID NO: 6326147 - DNA, 13 bp, Homo sapiens
gtctgagccctgg

SEQ ID NO: 6326148 - DNA, 21 bp, Homo sapiens
gtctgagcggccgcctgtcct

SEQ ID NO: 6326149 - DNA, 22 bp, Homo sapiens
gtctgagcggccgcctgtcctt

SEQ ID NO: 6326150 - DNA, 20 bp, Homo sapiens
gtctgagctagctagcgcac

SEQ ID NO: 6326151 - DNA, 13 bp, Homo sapiens
gtctgagctgctg

SEQ ID NO: 6326152 - DNA, 12 bp, Homo sapiens
gtctgagctggg

SEQ ID NO: 6326153 - DNA, 15 bp, Homo sapiens
gtctgagctggggtg

SEQ ID NO: 6326154 - DNA, 21 bp, Homo sapiens
gtctgagctggggtgggagct

SEQ ID NO: 6326155 - DNA, 17 bp, Homo sapiens
gtctgagctgtcccaag

SEQ ID NO: 6326156 - DNA, 18 bp, Homo sapiens
gtctgagctgtcccaagt

SEQ ID NO: 6326157 - DNA, 15 bp, Homo sapiens
gtctgaggactgtcc

SEQ ID NO: 6326158 - DNA, 16 bp, Homo sapiens
gtctgaggactgtcct

SEQ ID NO: 6326159 - DNA, 22 bp, Homo sapiens
gtctgaggagtaagtgtacaat

SEQ ID NO: 6326160 - DNA, 18 bp, Homo sapiens
gtctgaggcccctgcctc

SEQ ID NO: 6326161 - DNA, 19 bp, Homo sapiens
gtctgaggcccctgcctcc

SEQ ID NO: 6326162 - DNA, 19 bp, Homo sapiens
gtctgaggcctcatccctc

SEQ ID NO: 6326163 - DNA, 19 bp, Homo sapiens
gtctgaggcctgccccctg

SEQ ID NO: 6326164 - DNA, 22 bp, Homo sapiens
gtctgaggcctgccccctgggc

SEQ ID NO: 6326165 - DNA, 20 bp, Homo sapiens
gtctgagggcttgtagttct

SEQ ID NO: 6326166 - DNA, 21 bp, Homo sapiens
gtctgagggcttgtagttctt

SEQ ID NO: 6326167 - DNA, 22 bp, Homo sapiens
gtctgaggggcaactgagtctg

SEQ ID NO: 6326168 - DNA, 15 bp, Homo sapiens
gtctgaggttctttc

SEQ ID NO: 6326169 - DNA, 20 bp, Homo sapiens
gtctgagtagtggccactgg

SEQ ID NO: 6326170 - DNA, 21 bp, Homo sapiens
gtctgagtcatggccgggtgg

SEQ ID NO: 6326171 - DNA, 15 bp, Homo sapiens
gtctgagtctatgtt

SEQ ID NO: 6326172 - DNA, 18 bp, Homo sapiens
gtctgagtctgagtcctg

SEQ ID NO: 6326173 - DNA, 13 bp, Homo sapiens
gtctgagtgggcg

SEQ ID NO: 6326174 - DNA, 22 bp, Homo sapiens
gtctgagtggggcttcctgggc

SEQ ID NO: 6326175 - DNA, 19 bp, Homo sapiens
gtctgagttcttgtgtcct

SEQ ID NO: 6326176 - DNA, 15 bp, Homo sapiens
gtctgatcgacgtgg

SEQ ID NO: 6326177 - DNA, 21 bp, Homo sapiens
gtctgatcgacgtggtgacgc

SEQ ID NO: 6326178 - DNA, 19 bp, Homo sapiens
gtctgatcgtgacgctgaa

SEQ ID NO: 6326179 - DNA, 14 bp, Homo sapiens
gtctgatctgggtt

SEQ ID NO: 6326180 - DNA, 21 bp, Homo sapiens
gtctgatctgtgctttccagc

SEQ ID NO: 6326181 - DNA, 23 bp, Homo sapiens
gtctgatctgtgctttccagctc

SEQ ID NO: 6326182 - DNA, 16 bp, Homo sapiens
gtctgatgccaaagct

SEQ ID NO: 6326183 - DNA, 19 bp, Homo sapiens
gtctgatgttctttccatg

SEQ ID NO: 6326184 - DNA, 18 bp, Homo sapiens
gtctgattcccaagctct

SEQ ID NO: 6326185 - DNA, 19 bp, Homo sapiens
gtctgattcccaagctctg

SEQ ID NO: 6326186 - DNA, 20 bp, Homo sapiens
gtctgattcccaagctctgc

SEQ ID NO: 6326187 - DNA, 13 bp, Homo sapiens
gtctgattctatg

SEQ ID NO: 6326188 - DNA, 18 bp, Homo sapiens
gtctgattggctgcttaa

SEQ ID NO: 6326189 - DNA, 14 bp, Homo sapiens
gtctgattggcttg

SEQ ID NO: 6326190 - DNA, 20 bp, Homo sapiens
gtctgattggttttaattga

SEQ ID NO: 6326191 - DNA, 19 bp, Homo sapiens
gtctgatttgcaggatttt

SEQ ID NO: 6326192 - DNA, 23 bp, Homo sapiens
gtctgattttaatgaaatcaaat

SEQ ID NO: 6326193 - DNA, 23 bp, Homo sapiens
gtctgattttctcactgaactcc

SEQ ID NO: 6326194 - DNA, 18 bp, Homo sapiens
gtctgcaaaggagggcct

SEQ ID NO: 6326195 - DNA, 15 bp, Homo sapiens
gtctgcaactttaag

SEQ ID NO: 6326196 - DNA, 15 bp, Homo sapiens
gtctgcaagaacctg

SEQ ID NO: 6326197 - DNA, 20 bp, Homo sapiens
gtctgcaagggcccagagtg

SEQ ID NO: 6326198 - DNA, 13 bp, Homo sapiens
gtctgcaagtcag

SEQ ID NO: 6326199 - DNA, 14 bp, Homo sapiens
gtctgcaagtcaga

SEQ ID NO: 6326200 - DNA, 15 bp, Homo sapiens
gtctgcaagtcagag

SEQ ID NO: 6326201 - DNA, 16 bp, Homo sapiens
gtctgcaagtcagagg

SEQ ID NO: 6326202 - DNA, 19 bp, Homo sapiens
gtctgcaagtcagaggatg

SEQ ID NO: 6326203 - DNA, 21 bp, Homo sapiens
gtctgcaagtcagaggatggc

SEQ ID NO: 6326204 - DNA, 14 bp, Homo sapiens
gtctgcaatggtga

SEQ ID NO: 6326205 - DNA, 20 bp, Homo sapiens
gtctgcacacataacacaca

SEQ ID NO: 6326206 - DNA, 16 bp, Homo sapiens
gtctgcacagggtcct

SEQ ID NO: 6326207 - DNA, 13 bp, Homo sapiens
gtctgcacccagg

SEQ ID NO: 6326208 - DNA, 17 bp, Homo sapiens
gtctgcacccaggggtg

SEQ ID NO: 6326209 - DNA, 14 bp, Homo sapiens
gtctgcacctccgc

SEQ ID NO: 6326210 - DNA, 21 bp, Homo sapiens
gtctgcacctccgcttgccag

SEQ ID NO: 6326211 - DNA, 20 bp, Homo sapiens
gtctgcactcctttatctgt

SEQ ID NO: 6326212 - DNA, 19 bp, Homo sapiens
gtctgcacttctgttccag

SEQ ID NO: 6326213 - DNA, 11 bp, Homo sapiens
gtctgcagccc

SEQ ID NO: 6326214 - DNA, 18 bp, Homo sapiens
gtctgcagcccggcgcca

SEQ ID NO: 6326215 - DNA, 14 bp, Homo sapiens
gtctgcagcctgct

SEQ ID NO: 6326216 - DNA, 17 bp, Homo sapiens
gtctgcagcctgctggg

SEQ ID NO: 6326217 - DNA, 20 bp, Homo sapiens
gtctgcagcctgctggggct

SEQ ID NO: 6326218 - DNA, 21 bp, Homo sapiens
gtctgcagctattcacacaca

SEQ ID NO: 6326219 - DNA, 16 bp, Homo sapiens
gtctgcagctggtgtg

SEQ ID NO: 6326220 - DNA, 13 bp, Homo sapiens
gtctgcaggcagg

SEQ ID NO: 6326221 - DNA, 16 bp, Homo sapiens
gtctgcaggccaccag

SEQ ID NO: 6326222 - DNA, 13 bp, Homo sapiens
gtctgcaggggcc

SEQ ID NO: 6326223 - DNA, 17 bp, Homo sapiens
gtctgcaggggcctgga

SEQ ID NO: 6326224 - DNA, 19 bp, Homo sapiens
gtctgcaggggcctggagg

SEQ ID NO: 6326225 - DNA, 19 bp, Homo sapiens
gtctgcaggtgagcagaca

SEQ ID NO: 6326226 - DNA, 16 bp, Homo sapiens
gtctgcaggtgcacca

SEQ ID NO: 6326227 - DNA, 19 bp, Homo sapiens
gtctgcaggtgtctgacac

SEQ ID NO: 6326228 - DNA, 18 bp, Homo sapiens
gtctgcagtcctggtggg

SEQ ID NO: 6326229 - DNA, 22 bp, Homo sapiens
gtctgcagtcctggtggggctg

SEQ ID NO: 6326230 - DNA, 18 bp, Homo sapiens
gtctgcatcagctttttg

SEQ ID NO: 6326231 - DNA, 19 bp, Homo sapiens
gtctgcatcagctttttgt

SEQ ID NO: 6326232 - DNA, 14 bp, Homo sapiens
gtctgcatggcaga

SEQ ID NO: 6326233 - DNA, 22 bp, Homo sapiens
gtctgcattgttattgtggaag

SEQ ID NO: 6326234 - DNA, 21 bp, Homo sapiens
ggccgcagccacaccgctggc

SEQ ID NO: 6326235 - DNA, 13 bp, Homo sapiens
ggccgcaggaggg

SEQ ID NO: 6326236 - DNA, 12 bp, Homo sapiens
ggccgcagggcc

SEQ ID NO: 6326237 - DNA, 13 bp, Homo sapiens
ggccgcagggccc

SEQ ID NO: 6326238 - DNA, 14 bp, Homo sapiens
ggccgcagggccca

SEQ ID NO: 6326239 - DNA, 16 bp, Homo sapiens
ggccgcagggcccacc

SEQ ID NO: 6326240 - DNA, 16 bp, Homo sapiens
ggccgcagggcgctcc

SEQ ID NO: 6326241 - DNA, 22 bp, Homo sapiens
ggccgcagggcgctccggcaga

SEQ ID NO: 6326242 - DNA, 14 bp, Homo sapiens
ggccgcagggcggg

SEQ ID NO: 6326243 - DNA, 19 bp, Homo sapiens
ggccgcatgtctgcatggc

SEQ ID NO: 6326244 - DNA, 21 bp, Homo sapiens
ggccgcatgtctgcatggcag

SEQ ID NO: 6326245 - DNA, 15 bp, Homo sapiens
ggccgcattccctga

SEQ ID NO: 6326246 - DNA, 15 bp, Homo sapiens
ggccgccacggcctg

SEQ ID NO: 6326247 - DNA, 22 bp, Homo sapiens
ggccgccacggcctggctggtg

SEQ ID NO: 6326248 - DNA, 21 bp, Homo sapiens
ggccgccagcgtgtggagcag

SEQ ID NO: 6326249 - DNA, 23 bp, Homo sapiens
ggccgccagcgtgtggagcagag

SEQ ID NO: 6326250 - DNA, 15 bp, Homo sapiens
ggccgccatccggga

SEQ ID NO: 6326251 - DNA, 13 bp, Homo sapiens
ggccgccatctgc

SEQ ID NO: 6326252 - DNA, 20 bp, Homo sapiens
ggccgccatctgcgcagggt

SEQ ID NO: 6326253 - DNA, 21 bp, Homo sapiens
ggccgccatctgcgcagggtg

SEQ ID NO: 6326254 - DNA, 22 bp, Homo sapiens
ggccgcccacatcgggctcacc

SEQ ID NO: 6326255 - DNA, 22 bp, Homo sapiens
ggccgcccacccgcccgaggga

SEQ ID NO: 6326256 - DNA, 15 bp, Homo sapiens
ggccgcccacctgca

SEQ ID NO: 6326257 - DNA, 19 bp, Homo sapiens
ggccgccccccgcccctcg

SEQ ID NO: 6326258 - DNA, 14 bp, Homo sapiens
ggccgcccctgagg

SEQ ID NO: 6326259 - DNA, 16 bp, Homo sapiens
ggccgcccggcagtgc

SEQ ID NO: 6326260 - DNA, 21 bp, Homo sapiens
ggccgcccgggcccagaggag

SEQ ID NO: 6326261 - DNA, 21 bp, Homo sapiens
ggccgccgaagggcagccccg

SEQ ID NO: 6326262 - DNA, 22 bp, Homo sapiens
ggccgccgaagggcagccccgc

SEQ ID NO: 6326263 - DNA, 23 bp, Homo sapiens
ggccgccgaagggcagccccgcg

SEQ ID NO: 6326264 - DNA, 16 bp, Homo sapiens
ggccgccgccaggact

SEQ ID NO: 6326265 - DNA, 17 bp, Homo sapiens
ggccgccgccaggactg

SEQ ID NO: 6326266 - DNA, 18 bp, Homo sapiens
ggccgccgccaggactgt

SEQ ID NO: 6326267 - DNA, 14 bp, Homo sapiens
ggccgccgcctctt

SEQ ID NO: 6326268 - DNA, 22 bp, Homo sapiens
ggccgccgctgaccctgggcct

SEQ ID NO: 6326269 - DNA, 22 bp, Homo sapiens
ggccgccggcaataaaagccca

SEQ ID NO: 6326270 - DNA, 13 bp, Homo sapiens
ggccgcctcaccc

SEQ ID NO: 6326271 - DNA, 15 bp, Homo sapiens
ggccgcctccaggag

SEQ ID NO: 6326272 - DNA, 14 bp, Homo sapiens
ggccgcctcctcca

SEQ ID NO: 6326273 - DNA, 16 bp, Homo sapiens
ggccgcctcctccaga

SEQ ID NO: 6326274 - DNA, 16 bp, Homo sapiens
ggccgcctgccctgcc

SEQ ID NO: 6326275 - DNA, 19 bp, Homo sapiens
ggccgcctgccctgccttg

SEQ ID NO: 6326276 - DNA, 14 bp, Homo sapiens
ggccgcctgcctta

SEQ ID NO: 6326277 - DNA, 15 bp, Homo sapiens
ggccgcctggcaggt

SEQ ID NO: 6326278 - DNA, 16 bp, Homo sapiens
ggccgcctggcaggtg

SEQ ID NO: 6326279 - DNA, 18 bp, Homo sapiens
ggccgcctggcaggtgga

SEQ ID NO: 6326280 - DNA, 14 bp, Homo sapiens
ggccgcctgtcctt

SEQ ID NO: 6326281 - DNA, 20 bp, Homo sapiens
ggccgcgcaccgccatgcat

SEQ ID NO: 6326282 - DNA, 18 bp, Homo sapiens
ggccgcgccacccgggca

SEQ ID NO: 6326283 - DNA, 21 bp, Homo sapiens
ggccgcgccacccgggcaagg

SEQ ID NO: 6326284 - DNA, 16 bp, Homo sapiens
ggccgcgcccagcaga

SEQ ID NO: 6326285 - DNA, 13 bp, Homo sapiens
ggccgcggcccag

SEQ ID NO: 6326286 - DNA, 16 bp, Homo sapiens
ggccgcgtgccgggcc

SEQ ID NO: 6326287 - DNA, 17 bp, Homo sapiens
ggccgcgtgccgggccc

SEQ ID NO: 6326288 - DNA, 23 bp, Homo sapiens
ggccgcgtgccgggcccccaccg

SEQ ID NO: 6326289 - DNA, 13 bp, Homo sapiens
ggccgctagaggc

SEQ ID NO: 6326290 - DNA, 13 bp, Homo sapiens
ggccgctccaggg

SEQ ID NO: 6326291 - DNA, 16 bp, Homo sapiens
ggccgctctccccctg

SEQ ID NO: 6326292 - DNA, 22 bp, Homo sapiens
ggccgctctccccctgcagccg

SEQ ID NO: 6326293 - DNA, 23 bp, Homo sapiens
ggccgctctccccctgcagccgt

SEQ ID NO: 6326294 - DNA, 18 bp, Homo sapiens
ggccgctctccgcccccc

SEQ ID NO: 6326295 - DNA, 21 bp, Homo sapiens
ggccgctctccgccccccggc

SEQ ID NO: 6326296 - DNA, 21 bp, Homo sapiens
ggccgctcttcccccatgtgc

SEQ ID NO: 6326297 - DNA, 15 bp, Homo sapiens
ggccgctgagcgccc

SEQ ID NO: 6326298 - DNA, 17 bp, Homo sapiens
ggccgctgcagtcagca

SEQ ID NO: 6326299 - DNA, 23 bp, Homo sapiens
ggccgctgcagtcagcacagaga

SEQ ID NO: 6326300 - DNA, 12 bp, Homo sapiens
ggccgctgccac

SEQ ID NO: 6326301 - DNA, 22 bp, Homo sapiens
ggccgctgccacccacctccct

SEQ ID NO: 6326302 - DNA, 15 bp, Homo sapiens
ggccgctgcccctga

SEQ ID NO: 6326303 - DNA, 21 bp, Homo sapiens
ggccgctgctgaccagcactg

SEQ ID NO: 6326304 - DNA, 12 bp, Homo sapiens
ggccgctggccc

SEQ ID NO: 6326305 - DNA, 14 bp, Homo sapiens
ggccgctggcccag

SEQ ID NO: 6326306 - DNA, 22 bp, Homo sapiens
ggccgctgggagaaaagccaga

SEQ ID NO: 6326307 - DNA, 13 bp, Homo sapiens
ggccgctggggtc

SEQ ID NO: 6326308 - DNA, 14 bp, Homo sapiens
ggccgctgtgccag

SEQ ID NO: 6326309 - DNA, 15 bp, Homo sapiens
ggccgcttcgccatg

SEQ ID NO: 6326310 - DNA, 16 bp, Homo sapiens
ggccgcttcgccatgt

SEQ ID NO: 6326311 - DNA, 17 bp, Homo sapiens
ggccgcttcgccatgtg

SEQ ID NO: 6326312 - DNA, 20 bp, Homo sapiens
ggccgcttcgccatgtgctg

SEQ ID NO: 6326313 - DNA, 21 bp, Homo sapiens
ggccgcttctagagcctcgac

SEQ ID NO: 6326314 - DNA, 16 bp, Homo sapiens
ggccgcttctccccag

SEQ ID NO: 6326315 - DNA, 19 bp, Homo sapiens
ggccgcttctccccagagc

SEQ ID NO: 6326316 - DNA, 15 bp, Homo sapiens
ggccgcttctcctgc

SEQ ID NO: 6326317 - DNA, 17 bp, Homo sapiens
ggccggaaccacagggc

SEQ ID NO: 6326318 - DNA, 18 bp, Homo sapiens
ggccggaaccacagggcc

SEQ ID NO: 6326319 - DNA, 23 bp, Homo sapiens
ggccggaaggaatgtcagggcca

SEQ ID NO: 6326320 - DNA, 20 bp, Homo sapiens
ggccggacgcaggtgctgcg

SEQ ID NO: 6326321 - DNA, 16 bp, Homo sapiens
ggccggacgcatctca

SEQ ID NO: 6326322 - DNA, 22 bp, Homo sapiens
ggccggagacccacagccctga

SEQ ID NO: 6326323 - DNA, 15 bp, Homo sapiens
ggccggagcccagat

SEQ ID NO: 6326324 - DNA, 14 bp, Homo sapiens
ggccggagggcagg

SEQ ID NO: 6326325 - DNA, 18 bp, Homo sapiens
ggccggccagctgggtgc

SEQ ID NO: 6326326 - DNA, 19 bp, Homo sapiens
ggccggcccacgtcctggg

SEQ ID NO: 6326327 - DNA, 21 bp, Homo sapiens
ggccggcccacgtcctgggtg

SEQ ID NO: 6326328 - DNA, 14 bp, Homo sapiens
ggccggccccaggc

SEQ ID NO: 6326329 - DNA, 15 bp, Homo sapiens
ggccggccccaggct

SEQ ID NO: 6326330 - DNA, 15 bp, Homo sapiens
ggccggccctgcccc

SEQ ID NO: 6326331 - DNA, 12 bp, Homo sapiens
ggccggccctgt

SEQ ID NO: 6326332 - DNA, 17 bp, Homo sapiens
ggccggcctcctcctca

SEQ ID NO: 6326333 - DNA, 15 bp, Homo sapiens
ggccggcgagccctg

SEQ ID NO: 6326334 - DNA, 15 bp, Homo sapiens
ggccggcggctctga

SEQ ID NO: 6326335 - DNA, 16 bp, Homo sapiens
ggccggctgagtggca

SEQ ID NO: 6326336 - DNA, 21 bp, Homo sapiens
ggccggctggcctggaggctc

SEQ ID NO: 6326337 - DNA, 19 bp, Homo sapiens
ggccggcttgccacacccc

SEQ ID NO: 6326338 - DNA, 18 bp, Homo sapiens
ggccggctttcaggagct

SEQ ID NO: 6326339 - DNA, 19 bp, Homo sapiens
ggccggctttcaggagctc

SEQ ID NO: 6326340 - DNA, 22 bp, Homo sapiens
ggccgggaccccgagcctggct

SEQ ID NO: 6326341 - DNA, 15 bp, Homo sapiens
ggccgggaggcagtg

SEQ ID NO: 6326342 - DNA, 14 bp, Homo sapiens
ggccgggcacagct

SEQ ID NO: 6326343 - DNA, 15 bp, Homo sapiens
ggccgggcacagctg

SEQ ID NO: 6326344 - DNA, 22 bp, Homo sapiens
ggccgggcaccacccccagtcc

SEQ ID NO: 6326345 - DNA, 12 bp, Homo sapiens
ggccgggcagag

SEQ ID NO: 6326346 - DNA, 16 bp, Homo sapiens
ggccgggcagaggggc

SEQ ID NO: 6326347 - DNA, 12 bp, Homo sapiens
ggccgggcaggg

SEQ ID NO: 6326348 - DNA, 19 bp, Homo sapiens
ggccgggcaggtcctgccc

SEQ ID NO: 6326349 - DNA, 20 bp, Homo sapiens
ggccgggcaggtcctgccca

SEQ ID NO: 6326350 - DNA, 20 bp, Homo sapiens
ggccgggcccagggcctctg

SEQ ID NO: 6326351 - DNA, 20 bp, Homo sapiens
ggccgggccctctgtagctc

SEQ ID NO: 6326352 - DNA, 18 bp, Homo sapiens
ggccggggaactggccaa

SEQ ID NO: 6326353 - DNA, 15 bp, Homo sapiens
ggccggggcccctca

SEQ ID NO: 6326354 - DNA, 14 bp, Homo sapiens
ggccggggggaggg

SEQ ID NO: 6326355 - DNA, 18 bp, Homo sapiens
ggccggggggaggggaca

SEQ ID NO: 6326356 - DNA, 14 bp, Homo sapiens
ggccggggtccagg

SEQ ID NO: 6326357 - DNA, 19 bp, Homo sapiens
ggccgggtcaccctgtgac

SEQ ID NO: 6326358 - DNA, 18 bp, Homo sapiens
ggccgggttggaggcctc

SEQ ID NO: 6326359 - DNA, 21 bp, Homo sapiens
ggccggtagaggctccccagg

SEQ ID NO: 6326360 - DNA, 23 bp, Homo sapiens
ggccggtagaggctccccagggc

SEQ ID NO: 6326361 - DNA, 14 bp, Homo sapiens
ggccggtaggctgc

SEQ ID NO: 6326362 - DNA, 17 bp, Homo sapiens
ggccggtaggctgctgg

SEQ ID NO: 6326363 - DNA, 14 bp, Homo sapiens
ggccggtgagggga

SEQ ID NO: 6326364 - DNA, 16 bp, Homo sapiens
ggccggtgaggggagg

SEQ ID NO: 6326365 - DNA, 16 bp, Homo sapiens
ggccggtgccagctgc

SEQ ID NO: 6326366 - DNA, 18 bp, Homo sapiens
ggccggtgccagctgccc

SEQ ID NO: 6326367 - DNA, 13 bp, Homo sapiens
ggccggtgctggg

SEQ ID NO: 6326368 - DNA, 14 bp, Homo sapiens
ggccggtgctgggt

SEQ ID NO: 6326369 - DNA, 19 bp, Homo sapiens
ggccggttttcctcagctc

SEQ ID NO: 6326370 - DNA, 23 bp, Homo sapiens
ggccggttttcctcagctctagg

SEQ ID NO: 6326371 - DNA, 21 bp, Homo sapiens
ggccgtatctccggctcccag

SEQ ID NO: 6326372 - DNA, 18 bp, Homo sapiens
ggccgtatctgagggctg

SEQ ID NO: 6326373 - DNA, 15 bp, Homo sapiens
ggccgtatctgtcac

SEQ ID NO: 6326374 - DNA, 16 bp, Homo sapiens
ggccgtatctgtcaca

SEQ ID NO: 6326375 - DNA, 16 bp, Homo sapiens
ggccgtcaccccgcca

SEQ ID NO: 6326376 - DNA, 17 bp, Homo sapiens
ggccgtcacgctttcat

SEQ ID NO: 6326377 - DNA, 14 bp, Homo sapiens
ggccgtcctcccgg

SEQ ID NO: 6326378 - DNA, 15 bp, Homo sapiens
ggccgtcctcccggg

SEQ ID NO: 6326379 - DNA, 21 bp, Homo sapiens
ggccgtcctcccgggccctcc

SEQ ID NO: 6326380 - DNA, 13 bp, Homo sapiens
ggccgtctcctcc

SEQ ID NO: 6326381 - DNA, 21 bp, Homo sapiens
ggccgtgacgtctgggtggcc

SEQ ID NO: 6326382 - DNA, 18 bp, Homo sapiens
ggccgtggagtcgagctg

SEQ ID NO: 6326383 - DNA, 20 bp, Homo sapiens
ggccgtggagtcgagctggc

SEQ ID NO: 6326384 - DNA, 21 bp, Homo sapiens
ggccgtggagtcggagtggac

SEQ ID NO: 6326385 - DNA, 18 bp, Homo sapiens
ggccgtggcacagctggg

SEQ ID NO: 6326386 - DNA, 15 bp, Homo sapiens
ggccgtggctccaga

SEQ ID NO: 6326387 - DNA, 16 bp, Homo sapiens
ggccgtggcttgggct

SEQ ID NO: 6326388 - DNA, 20 bp, Homo sapiens
ggccgtgggacccaggctcc

SEQ ID NO: 6326389 - DNA, 24 bp, Homo sapiens
ggccgtgtcccgcggtgctgactg

SEQ ID NO: 6326390 - DNA, 16 bp, Homo sapiens
ggccgttccccttggc

SEQ ID NO: 6326391 - DNA, 22 bp, Homo sapiens
ggccgttccccttggcttcctc

SEQ ID NO: 6326392 - DNA, 18 bp, Homo sapiens
ggcctaaaactggcctga

SEQ ID NO: 6326393 - DNA, 22 bp, Homo sapiens
ggcctaacctgccgagagtcca

SEQ ID NO: 6326394 - DNA, 15 bp, Homo sapiens
ggcctaagaggctgc

SEQ ID NO: 6326395 - DNA, 19 bp, Homo sapiens
ggcctaagagttgagctct

SEQ ID NO: 6326396 - DNA, 17 bp, Homo sapiens
ggcctaaggaagccagt

SEQ ID NO: 6326397 - DNA, 20 bp, Homo sapiens
ggcctaaggagggtctccac

SEQ ID NO: 6326398 - DNA, 13 bp, Homo sapiens
ggcctaataaaac

SEQ ID NO: 6326399 - DNA, 17 bp, Homo sapiens
ggcctaatcactctgag

SEQ ID NO: 6326400 - DNA, 20 bp, Homo sapiens
ggcctaatcactctgagtca

SEQ ID NO: 6326401 - DNA, 14 bp, Homo sapiens
ggcctaatttttta

SEQ ID NO: 6326402 - DNA, 23 bp, Homo sapiens
ggcctacagccacatccccaagc

SEQ ID NO: 6326403 - DNA, 17 bp, Homo sapiens
ggcctacatgctttgtg

SEQ ID NO: 6326404 - DNA, 23 bp, Homo sapiens
ggcctacatgctttgtgaacaag

SEQ ID NO: 6326405 - DNA, 16 bp, Homo sapiens
ggcctacattctttat

SEQ ID NO: 6326406 - DNA, 20 bp, Homo sapiens
ggcctaccacagctgcctcc

SEQ ID NO: 6326407 - DNA, 16 bp, Homo sapiens
ggcctaccccgcagac

SEQ ID NO: 6326408 - DNA, 20 bp, Homo sapiens
ggcctacccctttctccagc

SEQ ID NO: 6326409 - DNA, 19 bp, Homo sapiens
ggcctacctcaagttcttg

SEQ ID NO: 6326410 - DNA, 21 bp, Homo sapiens
ggcctacctcaagttcttgga

SEQ ID NO: 6326411 - DNA, 23 bp, Homo sapiens
ggcctacctcaagttcttggacc

SEQ ID NO: 6326412 - DNA, 16 bp, Homo sapiens
gtctgcatttcatatt

SEQ ID NO: 6326413 - DNA, 17 bp, Homo sapiens
gtctgcattttctcagg

SEQ ID NO: 6326414 - DNA, 17 bp, Homo sapiens
gtctgccacacaaacgt

SEQ ID NO: 6326415 - DNA, 15 bp, Homo sapiens
gtctgccacagagag

SEQ ID NO: 6326416 - DNA, 20 bp, Homo sapiens
gtctgccaccagcgccccca

SEQ ID NO: 6326417 - DNA, 14 bp, Homo sapiens
gtctgccacccagg

SEQ ID NO: 6326418 - DNA, 16 bp, Homo sapiens
gtctgccagccagcag

SEQ ID NO: 6326419 - DNA, 11 bp, Homo sapiens
gtctgccaggc

SEQ ID NO: 6326420 - DNA, 14 bp, Homo sapiens
gtctgccaggcact

SEQ ID NO: 6326421 - DNA, 16 bp, Homo sapiens
gtctgccaggcactct

SEQ ID NO: 6326422 - DNA, 14 bp, Homo sapiens
gtctgccaggccca

SEQ ID NO: 6326423 - DNA, 17 bp, Homo sapiens
gtctgccaggcccatct

SEQ ID NO: 6326424 - DNA, 22 bp, Homo sapiens
gtctgccaggcccatctcaggt

SEQ ID NO: 6326425 - DNA, 14 bp, Homo sapiens
gtctgccatgctct

SEQ ID NO: 6326426 - DNA, 18 bp, Homo sapiens
gtctgcccacgcagagga

SEQ ID NO: 6326427 - DNA, 20 bp, Homo sapiens
gtctgcccacgcagaggacg

SEQ ID NO: 6326428 - DNA, 17 bp, Homo sapiens
gtctgccctctgcatcc

SEQ ID NO: 6326429 - DNA, 21 bp, Homo sapiens
gtctgccctctgcatcctctg

SEQ ID NO: 6326430 - DNA, 14 bp, Homo sapiens
gtctgccctgccca

SEQ ID NO: 6326431 - DNA, 10 bp, Homo sapiens
gtctgccctt

SEQ ID NO: 6326432 - DNA, 18 bp, Homo sapiens
gtctgccgcccacctcgc

SEQ ID NO: 6326433 - DNA, 22 bp, Homo sapiens
gtctgcctatgcactgaagagc

SEQ ID NO: 6326434 - DNA, 21 bp, Homo sapiens
gtctgcctggagtgctgtgct

SEQ ID NO: 6326435 - DNA, 11 bp, Homo sapiens
gtctgcctggg

SEQ ID NO: 6326436 - DNA, 21 bp, Homo sapiens
gtctgcctggttccctcccca

SEQ ID NO: 6326437 - DNA, 14 bp, Homo sapiens
gtctgcctgtattt

SEQ ID NO: 6326438 - DNA, 18 bp, Homo sapiens
gtctgccttaggctgctg

SEQ ID NO: 6326439 - DNA, 20 bp, Homo sapiens
gtctgccttaggctgctggg

SEQ ID NO: 6326440 - DNA, 14 bp, Homo sapiens
gtctgccttctgct

SEQ ID NO: 6326441 - DNA, 17 bp, Homo sapiens
gtctgcgccgctgtgct

SEQ ID NO: 6326442 - DNA, 18 bp, Homo sapiens
gtctgcgcctgaaaaggg

SEQ ID NO: 6326443 - DNA, 14 bp, Homo sapiens
gtctgcgccttggg

SEQ ID NO: 6326444 - DNA, 17 bp, Homo sapiens
gtctgcggagccagcgc

SEQ ID NO: 6326445 - DNA, 18 bp, Homo sapiens
gtctgcggagccagcgcc

SEQ ID NO: 6326446 - DNA, 22 bp, Homo sapiens
gtctgcggggggtgtcttccct

SEQ ID NO: 6326447 - DNA, 17 bp, Homo sapiens
gtctgctatattttcat

SEQ ID NO: 6326448 - DNA, 18 bp, Homo sapiens
gtctgctatattttcatg

SEQ ID NO: 6326449 - DNA, 14 bp, Homo sapiens
gtctgctccaccaa

SEQ ID NO: 6326450 - DNA, 21 bp, Homo sapiens
gtctgctcccaaggggcctga

SEQ ID NO: 6326451 - DNA, 16 bp, Homo sapiens
gtctgctccccaggaa

SEQ ID NO: 6326452 - DNA, 16 bp, Homo sapiens
gtctgctcctccctcc

SEQ ID NO: 6326453 - DNA, 14 bp, Homo sapiens
gtctgctcctgtgg

SEQ ID NO: 6326454 - DNA, 17 bp, Homo sapiens
gtctgctcctttcccct

SEQ ID NO: 6326455 - DNA, 17 bp, Homo sapiens
gtctgctcgggcccagg

SEQ ID NO: 6326456 - DNA, 19 bp, Homo sapiens
gtctgctcgggcccaggcc

SEQ ID NO: 6326457 - DNA, 20 bp, Homo sapiens
gtctgctctgctgctctgac

SEQ ID NO: 6326458 - DNA, 14 bp, Homo sapiens
gtctgctctggtgg

SEQ ID NO: 6326459 - DNA, 16 bp, Homo sapiens
gtctgctctggtggct

SEQ ID NO: 6326460 - DNA, 17 bp, Homo sapiens
gtctgctctgtgcctgg

SEQ ID NO: 6326461 - DNA, 19 bp, Homo sapiens
gtctgctctgtgcctggga

SEQ ID NO: 6326462 - DNA, 20 bp, Homo sapiens
gtctgctctttctctgccag

SEQ ID NO: 6326463 - DNA, 22 bp, Homo sapiens
gtctgctctttctctgccagtg

SEQ ID NO: 6326464 - DNA, 22 bp, Homo sapiens
gtctgctgactgtttcattcac

SEQ ID NO: 6326465 - DNA, 20 bp, Homo sapiens
gtctgctgatcaaaagcatt

SEQ ID NO: 6326466 - DNA, 15 bp, Homo sapiens
gtctgctgatgcagc

SEQ ID NO: 6326467 - DNA, 15 bp, Homo sapiens
gtctgctgccagcac

SEQ ID NO: 6326468 - DNA, 17 bp, Homo sapiens
gtctgctgccagcacag

SEQ ID NO: 6326469 - DNA, 16 bp, Homo sapiens
gtctgctgccctccat

SEQ ID NO: 6326470 - DNA, 18 bp, Homo sapiens
gtctgctgccctccatcc

SEQ ID NO: 6326471 - DNA, 19 bp, Homo sapiens
gtctgctgccctccatccc

SEQ ID NO: 6326472 - DNA, 18 bp, Homo sapiens
gtctgctgccgcaggagc

SEQ ID NO: 6326473 - DNA, 16 bp, Homo sapiens
gtctgctgctgcctcc

SEQ ID NO: 6326474 - DNA, 21 bp, Homo sapiens
gtctgctgctgcctccctggg

SEQ ID NO: 6326475 - DNA, 18 bp, Homo sapiens
gtctgctggtatttctaa

SEQ ID NO: 6326476 - DNA, 20 bp, Homo sapiens
gtctgctggtcacttcttct

SEQ ID NO: 6326477 - DNA, 17 bp, Homo sapiens
gtctgctgtctcatcac

SEQ ID NO: 6326478 - DNA, 16 bp, Homo sapiens
gtctgctgttccagtg

SEQ ID NO: 6326479 - DNA, 19 bp, Homo sapiens
gtctgcttaaagcttccct

SEQ ID NO: 6326480 - DNA, 20 bp, Homo sapiens
gtctgcttctctctctctca

SEQ ID NO: 6326481 - DNA, 11 bp, Homo sapiens
gtctgcttctg

SEQ ID NO: 6326482 - DNA, 17 bp, Homo sapiens
gtctgcttctgtccagg

SEQ ID NO: 6326483 - DNA, 22 bp, Homo sapiens
gtctgctttaaagggcctgcct

SEQ ID NO: 6326484 - DNA, 23 bp, Homo sapiens
gtctgctttaaagggcctgcctg

SEQ ID NO: 6326485 - DNA, 17 bp, Homo sapiens
gtctggaaaacagaaac

SEQ ID NO: 6326486 - DNA, 15 bp, Homo sapiens
gtctggaactgctgc

SEQ ID NO: 6326487 - DNA, 10 bp, Homo sapiens
gtctggaaga

SEQ ID NO: 6326488 - DNA, 17 bp, Homo sapiens
gtctggaagaagcagcg

SEQ ID NO: 6326489 - DNA, 14 bp, Homo sapiens
gtctggaagatggg

SEQ ID NO: 6326490 - DNA, 19 bp, Homo sapiens
gtctggaaggtcacgctga

SEQ ID NO: 6326491 - DNA, 20 bp, Homo sapiens
gtctggaatcccagctccgc

SEQ ID NO: 6326492 - DNA, 16 bp, Homo sapiens
gtctggacctccatcc

SEQ ID NO: 6326493 - DNA, 20 bp, Homo sapiens
gtctggacgccgagggcagc

SEQ ID NO: 6326494 - DNA, 14 bp, Homo sapiens
gtctggactgacag

SEQ ID NO: 6326495 - DNA, 18 bp, Homo sapiens
gtctggactgacagcatg

SEQ ID NO: 6326496 - DNA, 15 bp, Homo sapiens
gtctggactgttctg

SEQ ID NO: 6326497 - DNA, 10 bp, Homo sapiens
gtctggagac

SEQ ID NO: 6326498 - DNA, 14 bp, Homo sapiens
gtctggagaccagg

SEQ ID NO: 6326499 - DNA, 15 bp, Homo sapiens
gtctggagcccctat

SEQ ID NO: 6326500 - DNA, 14 bp, Homo sapiens
gtctggagcggctg

SEQ ID NO: 6326501 - DNA, 18 bp, Homo sapiens
gtctggagcggctgctcg

SEQ ID NO: 6326502 - DNA, 18 bp, Homo sapiens
gtctggaggacctgcccg

SEQ ID NO: 6326503 - DNA, 12 bp, Homo sapiens
gtctggagtggg

SEQ ID NO: 6326504 - DNA, 19 bp, Homo sapiens
gtctggagtgggcagagcc

SEQ ID NO: 6326505 - DNA, 16 bp, Homo sapiens
gtctggagtggtaaca

SEQ ID NO: 6326506 - DNA, 19 bp, Homo sapiens
gtctggagtggtaacagct

SEQ ID NO: 6326507 - DNA, 19 bp, Homo sapiens
gtctggatcagtaaaatta

SEQ ID NO: 6326508 - DNA, 12 bp, Homo sapiens
gtctggatgcac

SEQ ID NO: 6326509 - DNA, 20 bp, Homo sapiens
gtctggatgcacagatgcca

SEQ ID NO: 6326510 - DNA, 22 bp, Homo sapiens
gtctggatgggaggagagccac

SEQ ID NO: 6326511 - DNA, 22 bp, Homo sapiens
gtctggattcccgtggctttgt

SEQ ID NO: 6326512 - DNA, 19 bp, Homo sapiens
gtctggcaaacatgtgcaa

SEQ ID NO: 6326513 - DNA, 17 bp, Homo sapiens
gtctggcacagcctgca

SEQ ID NO: 6326514 - DNA, 17 bp, Homo sapiens
gtctggcacagcctggc

SEQ ID NO: 6326515 - DNA, 15 bp, Homo sapiens
gtctggcagagcctc

SEQ ID NO: 6326516 - DNA, 17 bp, Homo sapiens
gtctggcagagcctctg

SEQ ID NO: 6326517 - DNA, 22 bp, Homo sapiens
gtctggcagcctcccatccagg

SEQ ID NO: 6326518 - DNA, 22 bp, Homo sapiens
gtctggcaggctactctgccca

SEQ ID NO: 6326519 - DNA, 15 bp, Homo sapiens
gtctggcagggcagc

SEQ ID NO: 6326520 - DNA, 22 bp, Homo sapiens
gtctggcagggcagcaggaggc

SEQ ID NO: 6326521 - DNA, 17 bp, Homo sapiens
gtctggccactgtcaag

SEQ ID NO: 6326522 - DNA, 14 bp, Homo sapiens
gtctggccaggcac

SEQ ID NO: 6326523 - DNA, 14 bp, Homo sapiens
gtctggccagggag

SEQ ID NO: 6326524 - DNA, 17 bp, Homo sapiens
gtctggccagggaggag

SEQ ID NO: 6326525 - DNA, 22 bp, Homo sapiens
gtctggccagggaggagcccca

SEQ ID NO: 6326526 - DNA, 12 bp, Homo sapiens
gtctggcccagc

SEQ ID NO: 6326527 - DNA, 13 bp, Homo sapiens
gtctggcccagcc

SEQ ID NO: 6326528 - DNA, 16 bp, Homo sapiens
gtctggcccagccatg

SEQ ID NO: 6326529 - DNA, 18 bp, Homo sapiens
gtctggcccagccatggc

SEQ ID NO: 6326530 - DNA, 22 bp, Homo sapiens
gtctggccctaactcctataaa

SEQ ID NO: 6326531 - DNA, 11 bp, Homo sapiens
gtctggcctca

SEQ ID NO: 6326532 - DNA, 20 bp, Homo sapiens
gtctggccttgggaagaagt

SEQ ID NO: 6326533 - DNA, 15 bp, Homo sapiens
gtctggcgagccctt

SEQ ID NO: 6326534 - DNA, 16 bp, Homo sapiens
gtctggcgagccctta

SEQ ID NO: 6326535 - DNA, 14 bp, Homo sapiens
gtctggcgccaggg

SEQ ID NO: 6326536 - DNA, 17 bp, Homo sapiens
gtctggcgttgtgggga

SEQ ID NO: 6326537 - DNA, 20 bp, Homo sapiens
gtctggctcaaagcagcagg

SEQ ID NO: 6326538 - DNA, 14 bp, Homo sapiens
gtctggctccagcc

SEQ ID NO: 6326539 - DNA, 23 bp, Homo sapiens
gtctggctccctgccccttaacc

SEQ ID NO: 6326540 - DNA, 21 bp, Homo sapiens
gtctggctcggacccacccca

SEQ ID NO: 6326541 - DNA, 13 bp, Homo sapiens
gtctggctgagcc

SEQ ID NO: 6326542 - DNA, 17 bp, Homo sapiens
gtctggctgagcccctg

SEQ ID NO: 6326543 - DNA, 20 bp, Homo sapiens
gtctggctgagcccctgggg

SEQ ID NO: 6326544 - DNA, 15 bp, Homo sapiens
gtctggctgagctga

SEQ ID NO: 6326545 - DNA, 21 bp, Homo sapiens
gtctggctttggaaagacctg

SEQ ID NO: 6326546 - DNA, 16 bp, Homo sapiens
gtctggctttggcact

SEQ ID NO: 6326547 - DNA, 21 bp, Homo sapiens
gtctggctttggtgaactgtt

SEQ ID NO: 6326548 - DNA, 18 bp, Homo sapiens
gtctggctttttcctctg

SEQ ID NO: 6326549 - DNA, 21 bp, Homo sapiens
gtctggctttttcctctgagc

SEQ ID NO: 6326550 - DNA, 24 bp, Homo sapiens
gtctggctttttcctctgagccca

SEQ ID NO: 6326551 - DNA, 22 bp, Homo sapiens
gtctgggaaatgagcagggatg

SEQ ID NO: 6326552 - DNA, 13 bp, Homo sapiens
gtctgggaagggg

SEQ ID NO: 6326553 - DNA, 19 bp, Homo sapiens
gtctgggaatcctggacag

SEQ ID NO: 6326554 - DNA, 14 bp, Homo sapiens
gtctgggacacaaa

SEQ ID NO: 6326555 - DNA, 16 bp, Homo sapiens
gtctgggacagggagg

SEQ ID NO: 6326556 - DNA, 18 bp, Homo sapiens
gtctgggacttccttgct

SEQ ID NO: 6326557 - DNA, 16 bp, Homo sapiens
gtctgggagaaattga

SEQ ID NO: 6326558 - DNA, 14 bp, Homo sapiens
gtctgggagagcct

SEQ ID NO: 6326559 - DNA, 15 bp, Homo sapiens
gtctgggagagcctg

SEQ ID NO: 6326560 - DNA, 16 bp, Homo sapiens
gtctgggagagcctgg

SEQ ID NO: 6326561 - DNA, 19 bp, Homo sapiens
gtctgggagagcctggcaa

SEQ ID NO: 6326562 - DNA, 14 bp, Homo sapiens
gtctgggaggcagg

SEQ ID NO: 6326563 - DNA, 20 bp, Homo sapiens
gtctgggagtatacggaaac

SEQ ID NO: 6326564 - DNA, 17 bp, Homo sapiens
gtctgggagtcaggccc

SEQ ID NO: 6326565 - DNA, 21 bp, Homo sapiens
gtctgggagtgttctgtttcc

SEQ ID NO: 6326566 - DNA, 18 bp, Homo sapiens
gtctgggatatggctgcc

SEQ ID NO: 6326567 - DNA, 17 bp, Homo sapiens
gtctgggatattcttta

SEQ ID NO: 6326568 - DNA, 13 bp, Homo sapiens
gtctgggatggac

SEQ ID NO: 6326569 - DNA, 16 bp, Homo sapiens
gtctgggatgtagaac

SEQ ID NO: 6326570 - DNA, 21 bp, Homo sapiens
gtctgggcaagtagcaggact

SEQ ID NO: 6326571 - DNA, 23 bp, Homo sapiens
gtctgggcaagtagcaggactag

SEQ ID NO: 6326572 - DNA, 22 bp, Homo sapiens
gtctgggcagctgtcccttgct

SEQ ID NO: 6326573 - DNA, 14 bp, Homo sapiens
gtctgggcagtgcc

SEQ ID NO: 6326574 - DNA, 11 bp, Homo sapiens
gtctgggcctc

SEQ ID NO: 6326575 - DNA, 18 bp, Homo sapiens
gtctgggctcaagctttc

SEQ ID NO: 6326576 - DNA, 14 bp, Homo sapiens
gtctggggacaggc

SEQ ID NO: 6326577 - DNA, 15 bp, Homo sapiens
gtctggggacaggcc

SEQ ID NO: 6326578 - DNA, 16 bp, Homo sapiens
gtctggggacaggcct

SEQ ID NO: 6326579 - DNA, 23 bp, Homo sapiens
gtctggggagcgggtctgctccc

SEQ ID NO: 6326580 - DNA, 20 bp, Homo sapiens
gtctgggggcacaagactga

SEQ ID NO: 6326581 - DNA, 13 bp, Homo sapiens
gtctgggggcagc

SEQ ID NO: 6326582 - DNA, 14 bp, Homo sapiens
gtctgggggcagct

SEQ ID NO: 6326583 - DNA, 16 bp, Homo sapiens
gtctgggggcagctgt

SEQ ID NO: 6326584 - DNA, 16 bp, Homo sapiens
gtctggggtaaaattg

SEQ ID NO: 6326585 - DNA, 15 bp, Homo sapiens
gtctggggtgaggga

SEQ ID NO: 6326586 - DNA, 19 bp, Homo sapiens
gtctggggtgagggagtta

SEQ ID NO: 6326587 - DNA, 16 bp, Homo sapiens
gtctggggttcagccc

SEQ ID NO: 6326588 - DNA, 23 bp, Homo sapiens
gtctggggttcagcccctcctct

SEQ ID NO: 6326589 - DNA, 16 bp, Homo sapiens
gtctgggtgcagctgg

SEQ ID NO: 6326590 - DNA, 17 bp, Homo sapiens
gtctgggtgcagctggg

SEQ ID NO: 6326591 - DNA, 14 bp, Homo sapiens
gtctgggtgctact

SEQ ID NO: 6326592 - DNA, 12 bp, Homo sapiens
ggcctacctctc

SEQ ID NO: 6326593 - DNA, 23 bp, Homo sapiens
ggcctacctctcgtttctgccca

SEQ ID NO: 6326594 - DNA, 16 bp, Homo sapiens
ggcctacctgctcccc

SEQ ID NO: 6326595 - DNA, 13 bp, Homo sapiens
ggcctagaccagc

SEQ ID NO: 6326596 - DNA, 13 bp, Homo sapiens
ggcctagactctg

SEQ ID NO: 6326597 - DNA, 18 bp, Homo sapiens
ggcctagactctgtctac

SEQ ID NO: 6326598 - DNA, 14 bp, Homo sapiens
ggcctagaggcctg

SEQ ID NO: 6326599 - DNA, 17 bp, Homo sapiens
ggcctagatccacacac

SEQ ID NO: 6326600 - DNA, 23 bp, Homo sapiens
ggcctagcatacgtacacatttt

SEQ ID NO: 6326601 - DNA, 21 bp, Homo sapiens
ggcctagcgatctctcctggc

SEQ ID NO: 6326602 - DNA, 23 bp, Homo sapiens
ggcctagcgatctctcctggcct

SEQ ID NO: 6326603 - DNA, 16 bp, Homo sapiens
ggcctagctgctacaa

SEQ ID NO: 6326604 - DNA, 21 bp, Homo sapiens
ggcctagctgctacaaagaag

SEQ ID NO: 6326605 - DNA, 19 bp, Homo sapiens
ggcctaggagggtcctctg

SEQ ID NO: 6326606 - DNA, 13 bp, Homo sapiens
ggcctaggattct

SEQ ID NO: 6326607 - DNA, 14 bp, Homo sapiens
ggcctaggccagga

SEQ ID NO: 6326608 - DNA, 13 bp, Homo sapiens
ggcctaggctgca

SEQ ID NO: 6326609 - DNA, 16 bp, Homo sapiens
ggcctaggggtggcgc

SEQ ID NO: 6326610 - DNA, 19 bp, Homo sapiens
ggcctaggggtggcgctca

SEQ ID NO: 6326611 - DNA, 16 bp, Homo sapiens
ggcctaggtgcagctc

SEQ ID NO: 6326612 - DNA, 22 bp, Homo sapiens
ggcctaggtgcagctcctcagc

SEQ ID NO: 6326613 - DNA, 19 bp, Homo sapiens
ggcctagtaaccaaggccc

SEQ ID NO: 6326614 - DNA, 23 bp, Homo sapiens
ggcctagtggcttcagcccctgg

SEQ ID NO: 6326615 - DNA, 21 bp, Homo sapiens
ggcctagtggggaggggcctg

SEQ ID NO: 6326616 - DNA, 16 bp, Homo sapiens
ggcctatctaaactgg

SEQ ID NO: 6326617 - DNA, 10 bp, Homo sapiens
ggcctatgaa

SEQ ID NO: 6326618 - DNA, 14 bp, Homo sapiens
ggcctatgaccctg

SEQ ID NO: 6326619 - DNA, 15 bp, Homo sapiens
ggcctatgaccctgt

SEQ ID NO: 6326620 - DNA, 19 bp, Homo sapiens
ggcctatgaccctgtgcct

SEQ ID NO: 6326621 - DNA, 20 bp, Homo sapiens
ggcctatgcacatatggact

SEQ ID NO: 6326622 - DNA, 21 bp, Homo sapiens
ggcctatggagagccctggga

SEQ ID NO: 6326623 - DNA, 16 bp, Homo sapiens
ggcctattccaggaat

SEQ ID NO: 6326624 - DNA, 23 bp, Homo sapiens
ggcctattgcttgggtctctctc

SEQ ID NO: 6326625 - DNA, 14 bp, Homo sapiens
ggcctatttaacaa

SEQ ID NO: 6326626 - DNA, 19 bp, Homo sapiens
ggcctatttcagctgcttt

SEQ ID NO: 6326627 - DNA, 19 bp, Homo sapiens
ggcctcaaaggcccgctct

SEQ ID NO: 6326628 - DNA, 22 bp, Homo sapiens
ggcctcaaagttggggcaggct

SEQ ID NO: 6326629 - DNA, 22 bp, Homo sapiens
ggcctcaacaaggatcaggctg

SEQ ID NO: 6326630 - DNA, 15 bp, Homo sapiens
ggcctcaaccctccc

SEQ ID NO: 6326631 - DNA, 20 bp, Homo sapiens
ggcctcaactcctcccatag

SEQ ID NO: 6326632 - DNA, 21 bp, Homo sapiens
ggcctcaactgagaagccaag

SEQ ID NO: 6326633 - DNA, 22 bp, Homo sapiens
ggcctcaagaacaaacactgca

SEQ ID NO: 6326634 - DNA, 18 bp, Homo sapiens
ggcctcaagatcaatgaa

SEQ ID NO: 6326635 - DNA, 21 bp, Homo sapiens
ggcctcaagcaaggaagcaga

SEQ ID NO: 6326636 - DNA, 21 bp, Homo sapiens
ggcctcaatctaaggccttcc

SEQ ID NO: 6326637 - DNA, 20 bp, Homo sapiens
ggcctcacacccagagggta

SEQ ID NO: 6326638 - DNA, 12 bp, Homo sapiens
ggcctcaccacc

SEQ ID NO: 6326639 - DNA, 17 bp, Homo sapiens
ggcctcacccacccctg

SEQ ID NO: 6326640 - DNA, 12 bp, Homo sapiens
ggcctcacccag

SEQ ID NO: 6326641 - DNA, 13 bp, Homo sapiens
ggcctcacccaga

SEQ ID NO: 6326642 - DNA, 14 bp, Homo sapiens
ggcctcacccagaa

SEQ ID NO: 6326643 - DNA, 15 bp, Homo sapiens
ggcctcacccagaag

SEQ ID NO: 6326644 - DNA, 16 bp, Homo sapiens
ggcctcacccagaagg

SEQ ID NO: 6326645 - DNA, 17 bp, Homo sapiens
ggcctcacccagaagga

SEQ ID NO: 6326646 - DNA, 22 bp, Homo sapiens
ggcctcacccctcccctgggac

SEQ ID NO: 6326647 - DNA, 23 bp, Homo sapiens
ggcctcacccctcccctgggact

SEQ ID NO: 6326648 - DNA, 16 bp, Homo sapiens
ggcctcacctcccagg

SEQ ID NO: 6326649 - DNA, 20 bp, Homo sapiens
ggcctcacctcccagggcta

SEQ ID NO: 6326650 - DNA, 20 bp, Homo sapiens
ggcctcacctgcccctctgt

SEQ ID NO: 6326651 - DNA, 21 bp, Homo sapiens
ggcctcacctgcccctctgtt

SEQ ID NO: 6326652 - DNA, 23 bp, Homo sapiens
ggcctcacctgcccctctgttct

SEQ ID NO: 6326653 - DNA, 15 bp, Homo sapiens
ggcctcacctggctt

SEQ ID NO: 6326654 - DNA, 16 bp, Homo sapiens
ggcctcacctggcttc

SEQ ID NO: 6326655 - DNA, 22 bp, Homo sapiens
ggcctcacctgggttccccacc

SEQ ID NO: 6326656 - DNA, 17 bp, Homo sapiens
ggcctcacgcccagcct

SEQ ID NO: 6326657 - DNA, 18 bp, Homo sapiens
ggcctcacgcccagcctc

SEQ ID NO: 6326658 - DNA, 20 bp, Homo sapiens
ggcctcacgcccagcctcct

SEQ ID NO: 6326659 - DNA, 16 bp, Homo sapiens
ggcctcactcaagcct

SEQ ID NO: 6326660 - DNA, 18 bp, Homo sapiens
ggcctcactcaagcctga

SEQ ID NO: 6326661 - DNA, 15 bp, Homo sapiens
ggcctcactccagga

SEQ ID NO: 6326662 - DNA, 18 bp, Homo sapiens
ggcctcactccaggaagg

SEQ ID NO: 6326663 - DNA, 15 bp, Homo sapiens
ggcctcactggctca

SEQ ID NO: 6326664 - DNA, 22 bp, Homo sapiens
ggcctcactggctcatgcccct

SEQ ID NO: 6326665 - DNA, 17 bp, Homo sapiens
ggcctcacttccctggg

SEQ ID NO: 6326666 - DNA, 19 bp, Homo sapiens
ggcctcacttccctgggaa

SEQ ID NO: 6326667 - DNA, 22 bp, Homo sapiens
ggcctcacttgattcatctctg

SEQ ID NO: 6326668 - DNA, 23 bp, Homo sapiens
ggcctcacttgattcatctctgg

SEQ ID NO: 6326669 - DNA, 11 bp, Homo sapiens
ggcctcagact

SEQ ID NO: 6326670 - DNA, 20 bp, Homo sapiens
ggcctcagactgcacccagg

SEQ ID NO: 6326671 - DNA, 21 bp, Homo sapiens
ggcctcagactgcacccagga

SEQ ID NO: 6326672 - DNA, 22 bp, Homo sapiens
ggcctcagactgcacccaggag

SEQ ID NO: 6326673 - DNA, 13 bp, Homo sapiens
ggcctcagagaca

SEQ ID NO: 6326674 - DNA, 19 bp, Homo sapiens
ggcctcagatagacctgtg

SEQ ID NO: 6326675 - DNA, 21 bp, Homo sapiens
ggcctcagatagacctgtgac

SEQ ID NO: 6326676 - DNA, 22 bp, Homo sapiens
ggcctcagcagaaggccttgcc

SEQ ID NO: 6326677 - DNA, 10 bp, Homo sapiens
ggcctcagcc

SEQ ID NO: 6326678 - DNA, 15 bp, Homo sapiens
ggcctcagccagctg

SEQ ID NO: 6326679 - DNA, 17 bp, Homo sapiens
ggcctcagccagctgcc

SEQ ID NO: 6326680 - DNA, 15 bp, Homo sapiens
ggcctcagccctcag

SEQ ID NO: 6326681 - DNA, 17 bp, Homo sapiens
ggcctcagccctgctcc

SEQ ID NO: 6326682 - DNA, 19 bp, Homo sapiens
ggcctcagccctgctccct

SEQ ID NO: 6326683 - DNA, 13 bp, Homo sapiens
ggcctcagcctgg

SEQ ID NO: 6326684 - DNA, 14 bp, Homo sapiens
ggcctcagcctggg

SEQ ID NO: 6326685 - DNA, 15 bp, Homo sapiens
ggcctcagcctgggg

SEQ ID NO: 6326686 - DNA, 16 bp, Homo sapiens
ggcctcagcctggggc

SEQ ID NO: 6326687 - DNA, 17 bp, Homo sapiens
ggcctcagctgaatgcc

SEQ ID NO: 6326688 - DNA, 13 bp, Homo sapiens
ggcctcagctgcc

SEQ ID NO: 6326689 - DNA, 15 bp, Homo sapiens
ggcctcagctgcctc

SEQ ID NO: 6326690 - DNA, 16 bp, Homo sapiens
ggcctcagctgcctca

SEQ ID NO: 6326691 - DNA, 15 bp, Homo sapiens
ggcctcagctggctg

SEQ ID NO: 6326692 - DNA, 22 bp, Homo sapiens
ggcctcaggcgtttctgaagtg

SEQ ID NO: 6326693 - DNA, 15 bp, Homo sapiens
ggcctcaggctctgc

SEQ ID NO: 6326694 - DNA, 17 bp, Homo sapiens
ggcctcaggctctgcac

SEQ ID NO: 6326695 - DNA, 10 bp, Homo sapiens
ggcctcaggg

SEQ ID NO: 6326696 - DNA, 16 bp, Homo sapiens
ggcctcagggaccaag

SEQ ID NO: 6326697 - DNA, 16 bp, Homo sapiens
ggcctcagggccagga

SEQ ID NO: 6326698 - DNA, 16 bp, Homo sapiens
ggcctcagggcgctca

SEQ ID NO: 6326699 - DNA, 18 bp, Homo sapiens
ggcctcagggcgctcaga

SEQ ID NO: 6326700 - DNA, 11 bp, Homo sapiens
ggcctcagggt

SEQ ID NO: 6326701 - DNA, 12 bp, Homo sapiens
ggcctcagggtc

SEQ ID NO: 6326702 - DNA, 16 bp, Homo sapiens
ggcctcaggtgctgtc

SEQ ID NO: 6326703 - DNA, 20 bp, Homo sapiens
ggcctcagtctcccttctcc

SEQ ID NO: 6326704 - DNA, 13 bp, Homo sapiens
ggcctcagtgccc

SEQ ID NO: 6326705 - DNA, 14 bp, Homo sapiens
ggcctcagtgcccc

SEQ ID NO: 6326706 - DNA, 18 bp, Homo sapiens
ggcctcagtgtcctcatc

SEQ ID NO: 6326707 - DNA, 14 bp, Homo sapiens
ggcctcagttccca

SEQ ID NO: 6326708 - DNA, 17 bp, Homo sapiens
ggcctcagttcccagct

SEQ ID NO: 6326709 - DNA, 23 bp, Homo sapiens
ggcctcagttcccagctcccccc

SEQ ID NO: 6326710 - DNA, 11 bp, Homo sapiens
ggcctcagttt

SEQ ID NO: 6326711 - DNA, 13 bp, Homo sapiens
ggcctcagtttcc

SEQ ID NO: 6326712 - DNA, 19 bp, Homo sapiens
ggcctcagtttctccatca

SEQ ID NO: 6326713 - DNA, 12 bp, Homo sapiens
ggcctcatccag

SEQ ID NO: 6326714 - DNA, 16 bp, Homo sapiens
ggcctcatccagggcc

SEQ ID NO: 6326715 - DNA, 13 bp, Homo sapiens
ggcctcatccctc

SEQ ID NO: 6326716 - DNA, 19 bp, Homo sapiens
ggcctcatctctgcctgac

SEQ ID NO: 6326717 - DNA, 22 bp, Homo sapiens
ggcctcatcttccccagccctc

SEQ ID NO: 6326718 - DNA, 19 bp, Homo sapiens
ggcctcatgcctgctgaga

SEQ ID NO: 6326719 - DNA, 18 bp, Homo sapiens
ggcctcatgctggaggga

SEQ ID NO: 6326720 - DNA, 14 bp, Homo sapiens
ggcctcatgtggct

SEQ ID NO: 6326721 - DNA, 17 bp, Homo sapiens
ggcctcattactttacc

SEQ ID NO: 6326722 - DNA, 19 bp, Homo sapiens
ggcctccaaccttctgccc

SEQ ID NO: 6326723 - DNA, 19 bp, Homo sapiens
ggcctccaacgcccctgtg

SEQ ID NO: 6326724 - DNA, 20 bp, Homo sapiens
ggcctccaacgcccctgtgg

SEQ ID NO: 6326725 - DNA, 24 bp, Homo sapiens
ggcctccaccaaccccgcggccca

SEQ ID NO: 6326726 - DNA, 15 bp, Homo sapiens
ggcctccacctctgt

SEQ ID NO: 6326727 - DNA, 14 bp, Homo sapiens
ggcctccactcccc

SEQ ID NO: 6326728 - DNA, 21 bp, Homo sapiens
ggcctccactcccccacctga

SEQ ID NO: 6326729 - DNA, 17 bp, Homo sapiens
ggcctccactccttcca

SEQ ID NO: 6326730 - DNA, 20 bp, Homo sapiens
ggcctccagaactcactggg

SEQ ID NO: 6326731 - DNA, 14 bp, Homo sapiens
ggcctccagaagct

SEQ ID NO: 6326732 - DNA, 16 bp, Homo sapiens
ggcctccagaagctgc

SEQ ID NO: 6326733 - DNA, 18 bp, Homo sapiens
ggcctccagaagctgctc

SEQ ID NO: 6326734 - DNA, 14 bp, Homo sapiens
ggcctccagactgc

SEQ ID NO: 6326735 - DNA, 17 bp, Homo sapiens
ggcctccagcctttgct

SEQ ID NO: 6326736 - DNA, 13 bp, Homo sapiens
ggcctccagctca

SEQ ID NO: 6326737 - DNA, 15 bp, Homo sapiens
ggcctccagctcagc

SEQ ID NO: 6326738 - DNA, 18 bp, Homo sapiens
ggcctccagctcccactc

SEQ ID NO: 6326739 - DNA, 13 bp, Homo sapiens
ggcctccagctgt

SEQ ID NO: 6326740 - DNA, 14 bp, Homo sapiens
ggcctccaggaggg

SEQ ID NO: 6326741 - DNA, 13 bp, Homo sapiens
ggcctccaggccc

SEQ ID NO: 6326742 - DNA, 22 bp, Homo sapiens
ggcctccaggcccgtctgtcca

SEQ ID NO: 6326743 - DNA, 17 bp, Homo sapiens
ggcctccaggctggggc

SEQ ID NO: 6326744 - DNA, 14 bp, Homo sapiens
ggcctccatcctca

SEQ ID NO: 6326745 - DNA, 20 bp, Homo sapiens
ggcctccatgccccagctct

SEQ ID NO: 6326746 - DNA, 21 bp, Homo sapiens
ggcctccatgccccagctctg

SEQ ID NO: 6326747 - DNA, 19 bp, Homo sapiens
ggcctccatgggccccagg

SEQ ID NO: 6326748 - DNA, 21 bp, Homo sapiens
ggcctccattcctggagcccg

SEQ ID NO: 6326749 - DNA, 23 bp, Homo sapiens
ggcctccattcctggagcccgag

SEQ ID NO: 6326750 - DNA, 16 bp, Homo sapiens
ggcctcccaaagtgct

SEQ ID NO: 6326751 - DNA, 19 bp, Homo sapiens
ggcctcccaaagtgctggg

SEQ ID NO: 6326752 - DNA, 17 bp, Homo sapiens
ggcctcccaataaagct

SEQ ID NO: 6326753 - DNA, 14 bp, Homo sapiens
ggcctcccacagac

SEQ ID NO: 6326754 - DNA, 18 bp, Homo sapiens
ggcctcccacagtgctgg

SEQ ID NO: 6326755 - DNA, 11 bp, Homo sapiens
ggcctcccacc

SEQ ID NO: 6326756 - DNA, 13 bp, Homo sapiens
ggcctcccacccg

SEQ ID NO: 6326757 - DNA, 20 bp, Homo sapiens
ggcctcccactcccatggct

SEQ ID NO: 6326758 - DNA, 22 bp, Homo sapiens
ggcctcccactcccatggctct

SEQ ID NO: 6326759 - DNA, 15 bp, Homo sapiens
ggcctcccagcccaa

SEQ ID NO: 6326760 - DNA, 15 bp, Homo sapiens
ggcctcccagccccc

SEQ ID NO: 6326761 - DNA, 18 bp, Homo sapiens
ggcctcccagcccccaac

SEQ ID NO: 6326762 - DNA, 18 bp, Homo sapiens
ggcctcccatagtgctgg

SEQ ID NO: 6326763 - DNA, 20 bp, Homo sapiens
ggcctccccaatccaggcca

SEQ ID NO: 6326764 - DNA, 13 bp, Homo sapiens
ggcctcccccact

SEQ ID NO: 6326765 - DNA, 16 bp, Homo sapiens
ggcctccccccagccc

SEQ ID NO: 6326766 - DNA, 18 bp, Homo sapiens
ggcctccccccagcccct

SEQ ID NO: 6326767 - DNA, 10 bp, Homo sapiens
ggcctccccg

SEQ ID NO: 6326768 - DNA, 23 bp, Homo sapiens
ggcctccccgaggttgtggggag

SEQ ID NO: 6326769 - DNA, 11 bp, Homo sapiens
ggcctcccctg

SEQ ID NO: 6326770 - DNA, 12 bp, Homo sapiens
ggcctcccctgc

SEQ ID NO: 6326771 - DNA, 19 bp, Homo sapiens
ggcctcccctgccaccagg

SEQ ID NO: 6326772 - DNA, 15 bp, Homo sapiens
gtctgggtgctactg

SEQ ID NO: 6326773 - DNA, 20 bp, Homo sapiens
gtctgggtgctactggggaa

SEQ ID NO: 6326774 - DNA, 16 bp, Homo sapiens
gtctgggtgtccgcca

SEQ ID NO: 6326775 - DNA, 20 bp, Homo sapiens
gtctggtcacacacaggtgt

SEQ ID NO: 6326776 - DNA, 17 bp, Homo sapiens
gtctggtcagagccaca

SEQ ID NO: 6326777 - DNA, 20 bp, Homo sapiens
gtctggtcagagccacaggg

SEQ ID NO: 6326778 - DNA, 22 bp, Homo sapiens
gtctggtcaggcaatgccctgc

SEQ ID NO: 6326779 - DNA, 14 bp, Homo sapiens
gtctggtctatgtt

SEQ ID NO: 6326780 - DNA, 19 bp, Homo sapiens
gtctggtgaggtggcccag

SEQ ID NO: 6326781 - DNA, 14 bp, Homo sapiens
gtctggtgcagaat

SEQ ID NO: 6326782 - DNA, 22 bp, Homo sapiens
gtctggtgcagaatatgacaat

SEQ ID NO: 6326783 - DNA, 14 bp, Homo sapiens
gtctggtgctgagg

SEQ ID NO: 6326784 - DNA, 20 bp, Homo sapiens
gtctggtggccccgtttctg

SEQ ID NO: 6326785 - DNA, 14 bp, Homo sapiens
gtctggtggtgctg

SEQ ID NO: 6326786 - DNA, 15 bp, Homo sapiens
gtctggtggtgctgg

SEQ ID NO: 6326787 - DNA, 23 bp, Homo sapiens
gtctggtgtagctcctctgctgc

SEQ ID NO: 6326788 - DNA, 13 bp, Homo sapiens
gtctggtgttcca

SEQ ID NO: 6326789 - DNA, 14 bp, Homo sapiens
gtctggtgtttgtc

SEQ ID NO: 6326790 - DNA, 17 bp, Homo sapiens
gtctggtgtttgtcatg

SEQ ID NO: 6326791 - DNA, 18 bp, Homo sapiens
gtctggttctcaattcca

SEQ ID NO: 6326792 - DNA, 20 bp, Homo sapiens
gtctggttgctaatgacagc

SEQ ID NO: 6326793 - DNA, 17 bp, Homo sapiens
gtctggtttcaccgagg

SEQ ID NO: 6326794 - DNA, 22 bp, Homo sapiens
gtctggtttcaccgaggacatg

SEQ ID NO: 6326795 - DNA, 19 bp, Homo sapiens
gtctgtaaaaaatggagct

SEQ ID NO: 6326796 - DNA, 13 bp, Homo sapiens
gtctgtaaaatct

SEQ ID NO: 6326797 - DNA, 14 bp, Homo sapiens
gtctgtaaaatctt

SEQ ID NO: 6326798 - DNA, 13 bp, Homo sapiens
gtctgtaaagaaa

SEQ ID NO: 6326799 - DNA, 14 bp, Homo sapiens
gtctgtaaagaaaa

SEQ ID NO: 6326800 - DNA, 19 bp, Homo sapiens
gtctgtaaagaaaaataat

SEQ ID NO: 6326801 - DNA, 16 bp, Homo sapiens
gtctgtaactgcccag

SEQ ID NO: 6326802 - DNA, 20 bp, Homo sapiens
gtctgtaactgcccagcccc

SEQ ID NO: 6326803 - DNA, 14 bp, Homo sapiens
gtctgtaagagaat

SEQ ID NO: 6326804 - DNA, 14 bp, Homo sapiens
gtctgtaagctgaa

SEQ ID NO: 6326805 - DNA, 14 bp, Homo sapiens
gtctgtaatcatgt

SEQ ID NO: 6326806 - DNA, 11 bp, Homo sapiens
gtctgtacata

SEQ ID NO: 6326807 - DNA, 17 bp, Homo sapiens
gtctgtacatactggcc

SEQ ID NO: 6326808 - DNA, 21 bp, Homo sapiens
gtctgtacatactggcctctg

SEQ ID NO: 6326809 - DNA, 13 bp, Homo sapiens
gtctgtacctaaa

SEQ ID NO: 6326810 - DNA, 23 bp, Homo sapiens
gtctgtactccttggatttgcat

SEQ ID NO: 6326811 - DNA, 16 bp, Homo sapiens
gtctgtactgattcaa

SEQ ID NO: 6326812 - DNA, 11 bp, Homo sapiens
gtctgtacttc

SEQ ID NO: 6326813 - DNA, 14 bp, Homo sapiens
gtctgtagagggcc

SEQ ID NO: 6326814 - DNA, 21 bp, Homo sapiens
gtctgtagggagtgaagccac

SEQ ID NO: 6326815 - DNA, 20 bp, Homo sapiens
gtctgtaggtgaaagaacaa

SEQ ID NO: 6326816 - DNA, 19 bp, Homo sapiens
gtctgtaggtggagaggtg

SEQ ID NO: 6326817 - DNA, 16 bp, Homo sapiens
gtctgtaggttgcaca

SEQ ID NO: 6326818 - DNA, 22 bp, Homo sapiens
gtctgtagtgtcactcaaggcg

SEQ ID NO: 6326819 - DNA, 14 bp, Homo sapiens
gtctgtagtgtttt

SEQ ID NO: 6326820 - DNA, 23 bp, Homo sapiens
gtctgtatagtctagactttaaa

SEQ ID NO: 6326821 - DNA, 15 bp, Homo sapiens
gtctgtatatacatt

SEQ ID NO: 6326822 - DNA, 22 bp, Homo sapiens
gtctgtatcagtggatttccca

SEQ ID NO: 6326823 - DNA, 19 bp, Homo sapiens
gtctgtatccccagtgccc

SEQ ID NO: 6326824 - DNA, 12 bp, Homo sapiens
gtctgtatgtca

SEQ ID NO: 6326825 - DNA, 13 bp, Homo sapiens
gtctgtatgtcat

SEQ ID NO: 6326826 - DNA, 19 bp, Homo sapiens
gtctgtatttatgtgtgag

SEQ ID NO: 6326827 - DNA, 23 bp, Homo sapiens
gtctgtatttatgtgtgaggagc

SEQ ID NO: 6326828 - DNA, 18 bp, Homo sapiens
gtctgtatttcatgtggc

SEQ ID NO: 6326829 - DNA, 15 bp, Homo sapiens
gtctgtcacaggctg

SEQ ID NO: 6326830 - DNA, 13 bp, Homo sapiens
gtctgtcacccag

SEQ ID NO: 6326831 - DNA, 21 bp, Homo sapiens
gtctgtcacccaggctggagt

SEQ ID NO: 6326832 - DNA, 16 bp, Homo sapiens
gtctgtcagaagacac

SEQ ID NO: 6326833 - DNA, 13 bp, Homo sapiens
gtctgtcaggggc

SEQ ID NO: 6326834 - DNA, 22 bp, Homo sapiens
gtctgtcaggggcttggatttc

SEQ ID NO: 6326835 - DNA, 19 bp, Homo sapiens
gtctgtcatcctctggaag

SEQ ID NO: 6326836 - DNA, 14 bp, Homo sapiens
gtctgtcatttctc

SEQ ID NO: 6326837 - DNA, 21 bp, Homo sapiens
gtctgtccaaatttaaaatgt

SEQ ID NO: 6326838 - DNA, 22 bp, Homo sapiens
gtctgtccatctgcccgcctgc

SEQ ID NO: 6326839 - DNA, 22 bp, Homo sapiens
gtctgtccatctgtctgtccta

SEQ ID NO: 6326840 - DNA, 16 bp, Homo sapiens
gtctgtcccggggtcc

SEQ ID NO: 6326841 - DNA, 23 bp, Homo sapiens
gtctgtcccggggtcctgtggca

SEQ ID NO: 6326842 - DNA, 19 bp, Homo sapiens
gtctgtccctaaacatagt

SEQ ID NO: 6326843 - DNA, 22 bp, Homo sapiens
gtctgtccctgaactcccagaa

SEQ ID NO: 6326844 - DNA, 18 bp, Homo sapiens
gtctgtcccttccccttc

SEQ ID NO: 6326845 - DNA, 17 bp, Homo sapiens
gtctgtccgtgttattt

SEQ ID NO: 6326846 - DNA, 13 bp, Homo sapiens
gtctgtcctaccc

SEQ ID NO: 6326847 - DNA, 15 bp, Homo sapiens
gtctgtcctgcgcct

SEQ ID NO: 6326848 - DNA, 18 bp, Homo sapiens
gtctgtcctttgccccct

SEQ ID NO: 6326849 - DNA, 17 bp, Homo sapiens
gtctgtctactgtggtg

SEQ ID NO: 6326850 - DNA, 21 bp, Homo sapiens
gtctgtctccatcgtctcatc

SEQ ID NO: 6326851 - DNA, 24 bp, Homo sapiens
gtctgtctccctcccctctcagaa

SEQ ID NO: 6326852 - DNA, 22 bp, Homo sapiens
gtctgtctctcttttgctctct

SEQ ID NO: 6326853 - DNA, 16 bp, Homo sapiens
gtctgtctgctcttat

SEQ ID NO: 6326854 - DNA, 23 bp, Homo sapiens
gtctgtctgctcttatttttgta

SEQ ID NO: 6326855 - DNA, 18 bp, Homo sapiens
gtctgtctgtcgcccttc

SEQ ID NO: 6326856 - DNA, 13 bp, Homo sapiens
gtctgtctgtggg

SEQ ID NO: 6326857 - DNA, 23 bp, Homo sapiens
gtctgtcttctgtatataaatgg

SEQ ID NO: 6326858 - DNA, 16 bp, Homo sapiens
gtctgtctttcctgaa

SEQ ID NO: 6326859 - DNA, 20 bp, Homo sapiens
gtctgtctttgcaaaggact

SEQ ID NO: 6326860 - DNA, 15 bp, Homo sapiens
gtctgtctttgtggg

SEQ ID NO: 6326861 - DNA, 17 bp, Homo sapiens
gtctgtcttttaaactc

SEQ ID NO: 6326862 - DNA, 21 bp, Homo sapiens
gtctgtgaaagtctcctgtat

SEQ ID NO: 6326863 - DNA, 21 bp, Homo sapiens
gtctgtgaacagagagaccct

SEQ ID NO: 6326864 - DNA, 23 bp, Homo sapiens
gtctgtgaattgtggctgttcac

SEQ ID NO: 6326865 - DNA, 17 bp, Homo sapiens
gtctgtgactggatctt

SEQ ID NO: 6326866 - DNA, 17 bp, Homo sapiens
gtctgtgagaggcagct

SEQ ID NO: 6326867 - DNA, 15 bp, Homo sapiens
gtctgtgagatgcta

SEQ ID NO: 6326868 - DNA, 16 bp, Homo sapiens
gtctgtgagatgctag

SEQ ID NO: 6326869 - DNA, 21 bp, Homo sapiens
gtctgtgagatgctagaactc

SEQ ID NO: 6326870 - DNA, 16 bp, Homo sapiens
gtctgtgatctctgct

SEQ ID NO: 6326871 - DNA, 17 bp, Homo sapiens
gtctgtgatctctgctg

SEQ ID NO: 6326872 - DNA, 17 bp, Homo sapiens
gtctgtgatgctcccaa

SEQ ID NO: 6326873 - DNA, 20 bp, Homo sapiens
gtctgtgatgtcagtagtgc

SEQ ID NO: 6326874 - DNA, 14 bp, Homo sapiens
gtctgtgattgcca

SEQ ID NO: 6326875 - DNA, 15 bp, Homo sapiens
gtctgtgcacatgcc

SEQ ID NO: 6326876 - DNA, 18 bp, Homo sapiens
gtctgtgcagatgctttg

SEQ ID NO: 6326877 - DNA, 19 bp, Homo sapiens
gtctgtgcagatgctttgc

SEQ ID NO: 6326878 - DNA, 11 bp, Homo sapiens
gtctgtgcagc

SEQ ID NO: 6326879 - DNA, 12 bp, Homo sapiens
gtctgtgcagct

SEQ ID NO: 6326880 - DNA, 15 bp, Homo sapiens
gtctgtgcattgtgg

SEQ ID NO: 6326881 - DNA, 16 bp, Homo sapiens
gtctgtgcattgtggc

SEQ ID NO: 6326882 - DNA, 19 bp, Homo sapiens
gtctgtgcattgtggctgt

SEQ ID NO: 6326883 - DNA, 23 bp, Homo sapiens
gtctgtgccatttctcagggaag

SEQ ID NO: 6326884 - DNA, 20 bp, Homo sapiens
gtctgtgccccttccgccac

SEQ ID NO: 6326885 - DNA, 22 bp, Homo sapiens
gtctgtgccccttccgccactg

SEQ ID NO: 6326886 - DNA, 19 bp, Homo sapiens
gtctgtgccctccaaagag

SEQ ID NO: 6326887 - DNA, 15 bp, Homo sapiens
gtctgtgctgtgcct

SEQ ID NO: 6326888 - DNA, 18 bp, Homo sapiens
gtctgtgctgtgcctgct

SEQ ID NO: 6326889 - DNA, 15 bp, Homo sapiens
gtctgtggacactgt

SEQ ID NO: 6326890 - DNA, 22 bp, Homo sapiens
gtctgtggagatggactcagga

SEQ ID NO: 6326891 - DNA, 16 bp, Homo sapiens
gtctgtggagcgtcct

SEQ ID NO: 6326892 - DNA, 16 bp, Homo sapiens
gtctgtggattttttc

SEQ ID NO: 6326893 - DNA, 18 bp, Homo sapiens
gtctgtggccagttgaca

SEQ ID NO: 6326894 - DNA, 20 bp, Homo sapiens
gtctgtggctttcagcctct

SEQ ID NO: 6326895 - DNA, 19 bp, Homo sapiens
gtctgtgggagctcagctc

SEQ ID NO: 6326896 - DNA, 15 bp, Homo sapiens
gtctgtgggcttcag

SEQ ID NO: 6326897 - DNA, 18 bp, Homo sapiens
gtctgtgggcttcagcac

SEQ ID NO: 6326898 - DNA, 23 bp, Homo sapiens
gtctgtggggaggggttgttttg

SEQ ID NO: 6326899 - DNA, 22 bp, Homo sapiens
gtctgtggggtggttccgggct

SEQ ID NO: 6326900 - DNA, 15 bp, Homo sapiens
gtctgtggtgcagtg

SEQ ID NO: 6326901 - DNA, 17 bp, Homo sapiens
gtctgtggtgcagtgtg

SEQ ID NO: 6326902 - DNA, 21 bp, Homo sapiens
gtctgtgtaacatccaagcca

SEQ ID NO: 6326903 - DNA, 20 bp, Homo sapiens
gtctgtgtaactttaaacat

SEQ ID NO: 6326904 - DNA, 15 bp, Homo sapiens
gtctgtgtcatttct

SEQ ID NO: 6326905 - DNA, 18 bp, Homo sapiens
gtctgtgtcatttcttca

SEQ ID NO: 6326906 - DNA, 13 bp, Homo sapiens
gtctgtgtcccag

SEQ ID NO: 6326907 - DNA, 14 bp, Homo sapiens
gtctgtgtcccagc

SEQ ID NO: 6326908 - DNA, 20 bp, Homo sapiens
gtctgtgtcccagccacgca

SEQ ID NO: 6326909 - DNA, 20 bp, Homo sapiens
gtctgtgtgcgctctgtgga

SEQ ID NO: 6326910 - DNA, 11 bp, Homo sapiens
gtctgtgtgct

SEQ ID NO: 6326911 - DNA, 12 bp, Homo sapiens
gtctgtgtgcta

SEQ ID NO: 6326912 - DNA, 17 bp, Homo sapiens
gtctgtgtgctactaac

SEQ ID NO: 6326913 - DNA, 15 bp, Homo sapiens
gtctgtgtgctgttt

SEQ ID NO: 6326914 - DNA, 19 bp, Homo sapiens
gtctgtgtggcaaattaaa

SEQ ID NO: 6326915 - DNA, 21 bp, Homo sapiens
gtctgtgtggcaaattaaaca

SEQ ID NO: 6326916 - DNA, 18 bp, Homo sapiens
gtctgtgtgggactgtac

SEQ ID NO: 6326917 - DNA, 20 bp, Homo sapiens
gtctgtgtgggactgtacac

SEQ ID NO: 6326918 - DNA, 12 bp, Homo sapiens
gtctgtgtgggg

SEQ ID NO: 6326919 - DNA, 16 bp, Homo sapiens
gtctgtgtgtagccag

SEQ ID NO: 6326920 - DNA, 11 bp, Homo sapiens
gtctgtgtgtg

SEQ ID NO: 6326921 - DNA, 16 bp, Homo sapiens
gtctgtgtgtgacacc

SEQ ID NO: 6326922 - DNA, 22 bp, Homo sapiens
gtctgtgtgtgacccctcctgg

SEQ ID NO: 6326923 - DNA, 23 bp, Homo sapiens
gtctgtgtgtgacccctcctggg

SEQ ID NO: 6326924 - DNA, 21 bp, Homo sapiens
gtctgtgtgtgtgtgtgtgcg

SEQ ID NO: 6326925 - DNA, 11 bp, Homo sapiens
gtctgtgtgtt

SEQ ID NO: 6326926 - DNA, 15 bp, Homo sapiens
gtctgtgttctcaac

SEQ ID NO: 6326927 - DNA, 19 bp, Homo sapiens
gtctgtgttgctgtttaga

SEQ ID NO: 6326928 - DNA, 22 bp, Homo sapiens
gtctgtgttgtgtcctgacacc

SEQ ID NO: 6326929 - DNA, 16 bp, Homo sapiens
gtctgtgtttaaagtg

SEQ ID NO: 6326930 - DNA, 12 bp, Homo sapiens
gtctgtgtttac

SEQ ID NO: 6326931 - DNA, 20 bp, Homo sapiens
gtctgtgtttttttggcagt

SEQ ID NO: 6326932 - DNA, 23 bp, Homo sapiens
gtctgttaggtgtacatcctgca

SEQ ID NO: 6326933 - DNA, 16 bp, Homo sapiens
gtctgttatgcactgt

SEQ ID NO: 6326934 - DNA, 16 bp, Homo sapiens
gtctgttattgttttg

SEQ ID NO: 6326935 - DNA, 21 bp, Homo sapiens
gtctgttattgttttgttaac

SEQ ID NO: 6326936 - DNA, 16 bp, Homo sapiens
gtctgttatttattat

SEQ ID NO: 6326937 - DNA, 17 bp, Homo sapiens
gtctgttcactgcattc

SEQ ID NO: 6326938 - DNA, 15 bp, Homo sapiens
gtctgttcccagccc

SEQ ID NO: 6326939 - DNA, 19 bp, Homo sapiens
gtctgttcccagcccctgc

SEQ ID NO: 6326940 - DNA, 21 bp, Homo sapiens
gtctgttccccatggccactt

SEQ ID NO: 6326941 - DNA, 12 bp, Homo sapiens
gtctgttctcac

SEQ ID NO: 6326942 - DNA, 13 bp, Homo sapiens
gtctgttcttcat

SEQ ID NO: 6326943 - DNA, 22 bp, Homo sapiens
gtctgttcttcatttctatagc

SEQ ID NO: 6326944 - DNA, 14 bp, Homo sapiens
gtctgttcttgaat

SEQ ID NO: 6326945 - DNA, 14 bp, Homo sapiens
gtctgttctttcca

SEQ ID NO: 6326946 - DNA, 16 bp, Homo sapiens
gtctgttgattaaaga

SEQ ID NO: 6326947 - DNA, 19 bp, Homo sapiens
gtctgttgattaaagatga

SEQ ID NO: 6326948 - DNA, 23 bp, Homo sapiens
gtctgttggcaaatttgtgaact

SEQ ID NO: 6326949 - DNA, 24 bp, Homo sapiens
gtctgttggcaaatttgtgaactg

SEQ ID NO: 6326950 - DNA, 14 bp, Homo sapiens
ggcctcccctgggc

SEQ ID NO: 6326951 - DNA, 15 bp, Homo sapiens
ggcctcccctgggca

SEQ ID NO: 6326952 - DNA, 23 bp, Homo sapiens
ggcctccctcaggctctgtggag

SEQ ID NO: 6326953 - DNA, 14 bp, Homo sapiens
ggcctccctccaga

SEQ ID NO: 6326954 - DNA, 16 bp, Homo sapiens
ggcctccctccgtccc

SEQ ID NO: 6326955 - DNA, 12 bp, Homo sapiens
ggcctccctcct

SEQ ID NO: 6326956 - DNA, 18 bp, Homo sapiens
ggcctccctgcagactcc

SEQ ID NO: 6326957 - DNA, 13 bp, Homo sapiens
ggcctccctgctg

SEQ ID NO: 6326958 - DNA, 22 bp, Homo sapiens
ggcctccctgctgtgccatgct

SEQ ID NO: 6326959 - DNA, 10 bp, Homo sapiens
ggcctccctt

SEQ ID NO: 6326960 - DNA, 13 bp, Homo sapiens
ggcctcccttgag

SEQ ID NO: 6326961 - DNA, 16 bp, Homo sapiens
ggcctccgaggctccc

SEQ ID NO: 6326962 - DNA, 20 bp, Homo sapiens
ggcctccggcgtcagcctcc

SEQ ID NO: 6326963 - DNA, 21 bp, Homo sapiens
ggcctccggcgtcagcctcca

SEQ ID NO: 6326964 - DNA, 22 bp, Homo sapiens
ggcctccggcgtcagcctccag

SEQ ID NO: 6326965 - DNA, 20 bp, Homo sapiens
ggcctccggcgtcttgccca

SEQ ID NO: 6326966 - DNA, 21 bp, Homo sapiens
ggcctccgtcttcccagcggt

SEQ ID NO: 6326967 - DNA, 23 bp, Homo sapiens
ggcctcctaaggctccccacccc

SEQ ID NO: 6326968 - DNA, 12 bp, Homo sapiens
ggcctcctagcc

SEQ ID NO: 6326969 - DNA, 18 bp, Homo sapiens
ggcctcctaggggaaggg

SEQ ID NO: 6326970 - DNA, 12 bp, Homo sapiens
ggcctcctcagc

SEQ ID NO: 6326971 - DNA, 18 bp, Homo sapiens
ggcctcctcagcctctgc

SEQ ID NO: 6326972 - DNA, 14 bp, Homo sapiens
ggcctcctccccca

SEQ ID NO: 6326973 - DNA, 17 bp, Homo sapiens
ggcctcctcccttagct

SEQ ID NO: 6326974 - DNA, 14 bp, Homo sapiens
ggcctcctcctagc

SEQ ID NO: 6326975 - DNA, 16 bp, Homo sapiens
ggcctcctcctagctg

SEQ ID NO: 6326976 - DNA, 19 bp, Homo sapiens
ggcctcctcctagctggag

SEQ ID NO: 6326977 - DNA, 15 bp, Homo sapiens
ggcctcctcctcacc

SEQ ID NO: 6326978 - DNA, 20 bp, Homo sapiens
ggcctcctcggagagcagca

SEQ ID NO: 6326979 - DNA, 20 bp, Homo sapiens
ggcctcctctctgccaccac

SEQ ID NO: 6326980 - DNA, 21 bp, Homo sapiens
ggcctcctcttcaccccggca

SEQ ID NO: 6326981 - DNA, 24 bp, Homo sapiens
ggcctcctgcctccgggcaggcaa

SEQ ID NO: 6326982 - DNA, 19 bp, Homo sapiens
ggcctcctggcccgccctc

SEQ ID NO: 6326983 - DNA, 22 bp, Homo sapiens
ggcctccttcccatgcctgtct

SEQ ID NO: 6326984 - DNA, 22 bp, Homo sapiens
ggcctccttctgagctcctgtc

SEQ ID NO: 6326985 - DNA, 17 bp, Homo sapiens
ggcctccttcttccact

SEQ ID NO: 6326986 - DNA, 19 bp, Homo sapiens
ggcctccttgtccaggtct

SEQ ID NO: 6326987 - DNA, 21 bp, Homo sapiens
ggcctcgcacttgcagaggag

SEQ ID NO: 6326988 - DNA, 13 bp, Homo sapiens
ggcctcgcctgcc

SEQ ID NO: 6326989 - DNA, 17 bp, Homo sapiens
ggcctcgcctgccctcc

SEQ ID NO: 6326990 - DNA, 18 bp, Homo sapiens
ggcctcgcctgcctttct

SEQ ID NO: 6326991 - DNA, 15 bp, Homo sapiens
ggcctcgcctggcct

SEQ ID NO: 6326992 - DNA, 18 bp, Homo sapiens
ggcctcgcctggcctgag

SEQ ID NO: 6326993 - DNA, 13 bp, Homo sapiens
ggcctcgcctggg

SEQ ID NO: 6326994 - DNA, 18 bp, Homo sapiens
ggcctcgcctgggcccag

SEQ ID NO: 6326995 - DNA, 22 bp, Homo sapiens
ggcctcggagcctcatccgagg

SEQ ID NO: 6326996 - DNA, 18 bp, Homo sapiens
ggcctcggaggctcctcc

SEQ ID NO: 6326997 - DNA, 22 bp, Homo sapiens
ggcctcggaggctcctccctct

SEQ ID NO: 6326998 - DNA, 13 bp, Homo sapiens
ggcctcggcagaa

SEQ ID NO: 6326999 - DNA, 12 bp, Homo sapiens
ggcctcggcctg

SEQ ID NO: 6327000 - DNA, 16 bp, Homo sapiens
ggcctcgggacacctg

SEQ ID NO: 6327001 - DNA, 18 bp, Homo sapiens
ggcctcgtaccagccagg

SEQ ID NO: 6327002 - DNA, 17 bp, Homo sapiens
ggcctcgtgaggggcaa

SEQ ID NO: 6327003 - DNA, 16 bp, Homo sapiens
ggcctctaaccccagg

SEQ ID NO: 6327004 - DNA, 18 bp, Homo sapiens
ggcctctaaccccaggcc

SEQ ID NO: 6327005 - DNA, 22 bp, Homo sapiens
ggcctctaaccccaggccccga

SEQ ID NO: 6327006 - DNA, 14 bp, Homo sapiens
ggcctctaattgaa

SEQ ID NO: 6327007 - DNA, 17 bp, Homo sapiens
ggcctctagaacaccca

SEQ ID NO: 6327008 - DNA, 20 bp, Homo sapiens
ggcctctcattccagaggaa

SEQ ID NO: 6327009 - DNA, 15 bp, Homo sapiens
ggcctctccagcctc

SEQ ID NO: 6327010 - DNA, 15 bp, Homo sapiens
ggcctctccatttgc

SEQ ID NO: 6327011 - DNA, 15 bp, Homo sapiens
ggcctctccccagga

SEQ ID NO: 6327012 - DNA, 17 bp, Homo sapiens
ggcctctccctgcctgt

SEQ ID NO: 6327013 - DNA, 19 bp, Homo sapiens
ggcctctccctgcctgtgg

SEQ ID NO: 6327014 - DNA, 21 bp, Homo sapiens
ggcctctccctgcctgtggcc

SEQ ID NO: 6327015 - DNA, 17 bp, Homo sapiens
ggcctctcctgccctct

SEQ ID NO: 6327016 - DNA, 18 bp, Homo sapiens
ggcctctcctgccctctg

SEQ ID NO: 6327017 - DNA, 13 bp, Homo sapiens
ggcctctctatcc

SEQ ID NO: 6327018 - DNA, 23 bp, Homo sapiens
ggcctctctatcctctcttcctc

SEQ ID NO: 6327019 - DNA, 16 bp, Homo sapiens
ggcctctctccactac

SEQ ID NO: 6327020 - DNA, 14 bp, Homo sapiens
ggcctctctcctgc

SEQ ID NO: 6327021 - DNA, 20 bp, Homo sapiens
ggcctctctcctgcctgccc

SEQ ID NO: 6327022 - DNA, 11 bp, Homo sapiens
ggcctctctct

SEQ ID NO: 6327023 - DNA, 13 bp, Homo sapiens
ggcctctctctgc

SEQ ID NO: 6327024 - DNA, 15 bp, Homo sapiens
ggcctctctctgctc

SEQ ID NO: 6327025 - DNA, 16 bp, Homo sapiens
ggcctctctctgctcc

SEQ ID NO: 6327026 - DNA, 18 bp, Homo sapiens
ggcctctctcttcccagc

SEQ ID NO: 6327027 - DNA, 18 bp, Homo sapiens
ggcctctctgccccaccc

SEQ ID NO: 6327028 - DNA, 19 bp, Homo sapiens
ggcctctctgccccaccca

SEQ ID NO: 6327029 - DNA, 17 bp, Homo sapiens
ggcctctctggcctccc

SEQ ID NO: 6327030 - DNA, 21 bp, Homo sapiens
ggcctctctggcctcccaccc

SEQ ID NO: 6327031 - DNA, 12 bp, Homo sapiens
ggcctctctggg

SEQ ID NO: 6327032 - DNA, 13 bp, Homo sapiens
ggcctctcttgga

SEQ ID NO: 6327033 - DNA, 20 bp, Homo sapiens
ggcctctcttggaactgcac

SEQ ID NO: 6327034 - DNA, 15 bp, Homo sapiens
ggcctctgaggagcc

SEQ ID NO: 6327035 - DNA, 19 bp, Homo sapiens
ggcctctgcactcccctgc

SEQ ID NO: 6327036 - DNA, 20 bp, Homo sapiens
ggcctctgccatcctccctg

SEQ ID NO: 6327037 - DNA, 11 bp, Homo sapiens
ggcctctgccc

SEQ ID NO: 6327038 - DNA, 16 bp, Homo sapiens
ggcctctgccccaaga

SEQ ID NO: 6327039 - DNA, 20 bp, Homo sapiens
ggcctctgcccctcttccct

SEQ ID NO: 6327040 - DNA, 13 bp, Homo sapiens
ggcctctgcctcc

SEQ ID NO: 6327041 - DNA, 20 bp, Homo sapiens
ggcctctgcctccaccctcc

SEQ ID NO: 6327042 - DNA, 20 bp, Homo sapiens
ggcctctgcctgctggggat

SEQ ID NO: 6327043 - DNA, 13 bp, Homo sapiens
ggcctctgcctgg

SEQ ID NO: 6327044 - DNA, 14 bp, Homo sapiens
ggcctctgcctggg

SEQ ID NO: 6327045 - DNA, 16 bp, Homo sapiens
ggcctctgcctggggc

SEQ ID NO: 6327046 - DNA, 20 bp, Homo sapiens
ggcctctgcggagcacactg

SEQ ID NO: 6327047 - DNA, 14 bp, Homo sapiens
ggcctctgctgaat

SEQ ID NO: 6327048 - DNA, 18 bp, Homo sapiens
ggcctctgctggctcagg

SEQ ID NO: 6327049 - DNA, 21 bp, Homo sapiens
ggcctctgcttgccagccagg

SEQ ID NO: 6327050 - DNA, 21 bp, Homo sapiens
ggcctctggaaagcaaagggc

SEQ ID NO: 6327051 - DNA, 13 bp, Homo sapiens
ggcctctggccct

SEQ ID NO: 6327052 - DNA, 19 bp, Homo sapiens
ggcctctggcttccctgcc

SEQ ID NO: 6327053 - DNA, 20 bp, Homo sapiens
ggcctctggcttccctgccc

SEQ ID NO: 6327054 - DNA, 21 bp, Homo sapiens
ggcctctggcttccctgccca

SEQ ID NO: 6327055 - DNA, 16 bp, Homo sapiens
ggcctctgggacccac

SEQ ID NO: 6327056 - DNA, 17 bp, Homo sapiens
ggcctctgtgcagacag

SEQ ID NO: 6327057 - DNA, 18 bp, Homo sapiens
ggcctctgtgcagacagt

SEQ ID NO: 6327058 - DNA, 14 bp, Homo sapiens
ggcctctgtgtcct

SEQ ID NO: 6327059 - DNA, 15 bp, Homo sapiens
ggcctcttcaggcct

SEQ ID NO: 6327060 - DNA, 15 bp, Homo sapiens
ggcctcttccaccca

SEQ ID NO: 6327061 - DNA, 16 bp, Homo sapiens
ggcctcttccacccat

SEQ ID NO: 6327062 - DNA, 23 bp, Homo sapiens
ggcctcttcctccctccctgcag

SEQ ID NO: 6327063 - DNA, 22 bp, Homo sapiens
ggcctcttcgcctttcccaccc

SEQ ID NO: 6327064 - DNA, 22 bp, Homo sapiens
ggcctcttctcaacttttttcc

SEQ ID NO: 6327065 - DNA, 17 bp, Homo sapiens
ggcctcttgaagagaaa

SEQ ID NO: 6327066 - DNA, 16 bp, Homo sapiens
ggcctcttgagcagtg

SEQ ID NO: 6327067 - DNA, 22 bp, Homo sapiens
ggcctcttgagcagtggctggt

SEQ ID NO: 6327068 - DNA, 16 bp, Homo sapiens
ggcctcttgctggtgc

SEQ ID NO: 6327069 - DNA, 22 bp, Homo sapiens
ggcctcttggacctctgctctg

SEQ ID NO: 6327070 - DNA, 13 bp, Homo sapiens
ggcctcttggcag

SEQ ID NO: 6327071 - DNA, 12 bp, Homo sapiens
ggcctcttggct

SEQ ID NO: 6327072 - DNA, 21 bp, Homo sapiens
ggcctcttggctatttctgtg

SEQ ID NO: 6327073 - DNA, 14 bp, Homo sapiens
ggcctcttgtccct

SEQ ID NO: 6327074 - DNA, 20 bp, Homo sapiens
ggcctctttctgtgcttctc

SEQ ID NO: 6327075 - DNA, 19 bp, Homo sapiens
ggcctctttttgcccttta

SEQ ID NO: 6327076 - DNA, 16 bp, Homo sapiens
ggcctgaaagcaacag

SEQ ID NO: 6327077 - DNA, 17 bp, Homo sapiens
ggcctgaaagcaacagc

SEQ ID NO: 6327078 - DNA, 18 bp, Homo sapiens
ggcctgaaagcaacagct

SEQ ID NO: 6327079 - DNA, 16 bp, Homo sapiens
ggcctgaaaggagccc

SEQ ID NO: 6327080 - DNA, 20 bp, Homo sapiens
ggcctgaacagatgtaaatc

SEQ ID NO: 6327081 - DNA, 24 bp, Homo sapiens
ggcctgaactaggtgctggcatgt

SEQ ID NO: 6327082 - DNA, 16 bp, Homo sapiens
ggcctgaactgaggag

SEQ ID NO: 6327083 - DNA, 15 bp, Homo sapiens
ggcctgaagccagct

SEQ ID NO: 6327084 - DNA, 16 bp, Homo sapiens
ggcctgaatccaaaag

SEQ ID NO: 6327085 - DNA, 14 bp, Homo sapiens
ggcctgacagctct

SEQ ID NO: 6327086 - DNA, 15 bp, Homo sapiens
ggcctgacagctctg

SEQ ID NO: 6327087 - DNA, 20 bp, Homo sapiens
ggcctgaccaaacagccaac

SEQ ID NO: 6327088 - DNA, 15 bp, Homo sapiens
ggcctgaccaggggg

SEQ ID NO: 6327089 - DNA, 14 bp, Homo sapiens
ggcctgacctccag

SEQ ID NO: 6327090 - DNA, 20 bp, Homo sapiens
ggcctgacctccagtcctgc

SEQ ID NO: 6327091 - DNA, 23 bp, Homo sapiens
ggcctgacctccagtcctgctgg

SEQ ID NO: 6327092 - DNA, 19 bp, Homo sapiens
ggcctgacctccccctcct

SEQ ID NO: 6327093 - DNA, 20 bp, Homo sapiens
ggcctgacctccccctcctt

SEQ ID NO: 6327094 - DNA, 15 bp, Homo sapiens
ggcctgactgctcag

SEQ ID NO: 6327095 - DNA, 11 bp, Homo sapiens
ggcctgactgt

SEQ ID NO: 6327096 - DNA, 22 bp, Homo sapiens
ggcctgacttgagccactcctt

SEQ ID NO: 6327097 - DNA, 23 bp, Homo sapiens
ggcctgagaaacactatttgtga

SEQ ID NO: 6327098 - DNA, 14 bp, Homo sapiens
ggcctgagaatgag

SEQ ID NO: 6327099 - DNA, 23 bp, Homo sapiens
ggcctgagaattgaggggaggtg

SEQ ID NO: 6327100 - DNA, 21 bp, Homo sapiens
ggcctgagagaattggctcaa

SEQ ID NO: 6327101 - DNA, 14 bp, Homo sapiens
ggcctgagaggttg

SEQ ID NO: 6327102 - DNA, 22 bp, Homo sapiens
ggcctgagatttcatctgctct

SEQ ID NO: 6327103 - DNA, 20 bp, Homo sapiens
ggcctgagcaacaaagcgag

SEQ ID NO: 6327104 - DNA, 18 bp, Homo sapiens
ggcctgagcatccagacc

SEQ ID NO: 6327105 - DNA, 22 bp, Homo sapiens
ggcctgagcccctttgcctgtc

SEQ ID NO: 6327106 - DNA, 13 bp, Homo sapiens
ggcctgaggatga

SEQ ID NO: 6327107 - DNA, 19 bp, Homo sapiens
ggcctgaggatgagctgga

SEQ ID NO: 6327108 - DNA, 19 bp, Homo sapiens
ggcctgagggaagcccacc

SEQ ID NO: 6327109 - DNA, 20 bp, Homo sapiens
ggcctgagggaagcccaccc

SEQ ID NO: 6327110 - DNA, 11 bp, Homo sapiens
ggcctgagggg

SEQ ID NO: 6327111 - DNA, 13 bp, Homo sapiens
ggcctgaggggca

SEQ ID NO: 6327112 - DNA, 19 bp, Homo sapiens
ggcctgagggtccacctgg

SEQ ID NO: 6327113 - DNA, 23 bp, Homo sapiens
ggcctgagggtccacctggagag

SEQ ID NO: 6327114 - DNA, 15 bp, Homo sapiens
ggcctgagtcctggt

SEQ ID NO: 6327115 - DNA, 22 bp, Homo sapiens
ggcctgagtgacctccttctgc

SEQ ID NO: 6327116 - DNA, 19 bp, Homo sapiens
ggcctgatatccaacagaa

SEQ ID NO: 6327117 - DNA, 18 bp, Homo sapiens
ggcctgatcagaccacgg

SEQ ID NO: 6327118 - DNA, 14 bp, Homo sapiens
ggcctgatctctgc

SEQ ID NO: 6327119 - DNA, 16 bp, Homo sapiens
ggcctgatcttgcctg

SEQ ID NO: 6327120 - DNA, 20 bp, Homo sapiens
ggcctgatgagactccactc

SEQ ID NO: 6327121 - DNA, 14 bp, Homo sapiens
ggcctgatgctccc

SEQ ID NO: 6327122 - DNA, 15 bp, Homo sapiens
ggcctgatgctccct

SEQ ID NO: 6327123 - DNA, 18 bp, Homo sapiens
ggcctgatgctccctccc

SEQ ID NO: 6327124 - DNA, 22 bp, Homo sapiens
ggcctgatgctccctcccctgc

SEQ ID NO: 6327125 - DNA, 14 bp, Homo sapiens
ggcctgatggagag

SEQ ID NO: 6327126 - DNA, 16 bp, Homo sapiens
ggcctgatggagagga

SEQ ID NO: 6327127 - DNA, 20 bp, Homo sapiens
ggcctgatggagaggagaac

SEQ ID NO: 6327128 - DNA, 14 bp, Homo sapiens
ggcctgatggccag

SEQ ID NO: 6327129 - DNA, 19 bp, Homo sapiens
gtctgttggcaggctggcc

SEQ ID NO: 6327130 - DNA, 20 bp, Homo sapiens
gtctgttggcaggctggcca

SEQ ID NO: 6327131 - DNA, 18 bp, Homo sapiens
gtctgttgtgtgtcatgc

SEQ ID NO: 6327132 - DNA, 14 bp, Homo sapiens
gtctgtttaagaaa

SEQ ID NO: 6327133 - DNA, 18 bp, Homo sapiens
gtctgtttaagaaaagta

SEQ ID NO: 6327134 - DNA, 12 bp, Homo sapiens
gtctgtttactg

SEQ ID NO: 6327135 - DNA, 22 bp, Homo sapiens
gtctgtttattaactactgaat

SEQ ID NO: 6327136 - DNA, 16 bp, Homo sapiens
gtctgtttcccaagct

SEQ ID NO: 6327137 - DNA, 13 bp, Homo sapiens
gtctgtttggact

SEQ ID NO: 6327138 - DNA, 17 bp, Homo sapiens
gtctgtttgtctgaaca

SEQ ID NO: 6327139 - DNA, 17 bp, Homo sapiens
gtctgtttgtttcaaga

SEQ ID NO: 6327140 - DNA, 21 bp, Homo sapiens
gtctgttttcctttctcaccg

SEQ ID NO: 6327141 - DNA, 20 bp, Homo sapiens
gtctgttttggtcccctccc

SEQ ID NO: 6327142 - DNA, 15 bp, Homo sapiens
gtctgttttgtaaag

SEQ ID NO: 6327143 - DNA, 14 bp, Homo sapiens
gtctgttttgtgta

SEQ ID NO: 6327144 - DNA, 20 bp, Homo sapiens
gtctgttttgtgtactttta

SEQ ID NO: 6327145 - DNA, 15 bp, Homo sapiens
gtctgttttgtgtct

SEQ ID NO: 6327146 - DNA, 17 bp, Homo sapiens
gtctgttttgtgtctgg

SEQ ID NO: 6327147 - DNA, 14 bp, Homo sapiens
gtcttaaaaccaga

SEQ ID NO: 6327148 - DNA, 14 bp, Homo sapiens
gtcttaaaacctgc

SEQ ID NO: 6327149 - DNA, 20 bp, Homo sapiens
gtcttaaaacctgcttttca

SEQ ID NO: 6327150 - DNA, 12 bp, Homo sapiens
gtcttaaaataa

SEQ ID NO: 6327151 - DNA, 15 bp, Homo sapiens
gtcttaaaataactt

SEQ ID NO: 6327152 - DNA, 18 bp, Homo sapiens
gtcttaaagaatttgaaa

SEQ ID NO: 6327153 - DNA, 18 bp, Homo sapiens
gtcttaaagggaatcatt

SEQ ID NO: 6327154 - DNA, 18 bp, Homo sapiens
gtcttaaataaaactatt

SEQ ID NO: 6327155 - DNA, 22 bp, Homo sapiens
gtcttaaataaaactatttaaa

SEQ ID NO: 6327156 - DNA, 23 bp, Homo sapiens
gtcttaaataaaactatttaaaa

SEQ ID NO: 6327157 - DNA, 18 bp, Homo sapiens
gtcttaaattttcttcct

SEQ ID NO: 6327158 - DNA, 23 bp, Homo sapiens
gtcttaacaaaccaacatctttg

SEQ ID NO: 6327159 - DNA, 17 bp, Homo sapiens
gtcttaacctcagggag

SEQ ID NO: 6327160 - DNA, 16 bp, Homo sapiens
gtcttaacgaataaag

SEQ ID NO: 6327161 - DNA, 16 bp, Homo sapiens
gtcttaactgtatttc

SEQ ID NO: 6327162 - DNA, 19 bp, Homo sapiens
gtcttaactgtatttcagt

SEQ ID NO: 6327163 - DNA, 19 bp, Homo sapiens
gtcttaaggacaaagtgcc

SEQ ID NO: 6327164 - DNA, 23 bp, Homo sapiens
gtcttaagggtcactggcctctc

SEQ ID NO: 6327165 - DNA, 14 bp, Homo sapiens
gtcttaagtgtttc

SEQ ID NO: 6327166 - DNA, 17 bp, Homo sapiens
gtcttaagtgtttctca

SEQ ID NO: 6327167 - DNA, 21 bp, Homo sapiens
gtcttaataaaataaactaga

SEQ ID NO: 6327168 - DNA, 16 bp, Homo sapiens
gtcttaatgaagtttg

SEQ ID NO: 6327169 - DNA, 18 bp, Homo sapiens
gtcttaatgaagtttgaa

SEQ ID NO: 6327170 - DNA, 20 bp, Homo sapiens
gtcttaatgaagtttgaatg

SEQ ID NO: 6327171 - DNA, 22 bp, Homo sapiens
gtcttaatgaagtttgaatgtt

SEQ ID NO: 6327172 - DNA, 15 bp, Homo sapiens
gtcttaatgttgaat

SEQ ID NO: 6327173 - DNA, 21 bp, Homo sapiens
gtcttaattaaaagaatattt

SEQ ID NO: 6327174 - DNA, 20 bp, Homo sapiens
gtcttaattaagtaaactaa

SEQ ID NO: 6327175 - DNA, 13 bp, Homo sapiens
gtcttaattatta

SEQ ID NO: 6327176 - DNA, 21 bp, Homo sapiens
gtcttaattattatttgtgtt

SEQ ID NO: 6327177 - DNA, 16 bp, Homo sapiens
gtcttaatttatttct

SEQ ID NO: 6327178 - DNA, 16 bp, Homo sapiens
gtcttaattttctaaa

SEQ ID NO: 6327179 - DNA, 22 bp, Homo sapiens
gtcttaatttttgaaaaaagta

SEQ ID NO: 6327180 - DNA, 21 bp, Homo sapiens
gtcttacaactgactgactta

SEQ ID NO: 6327181 - DNA, 20 bp, Homo sapiens
gtcttacaatcaaatctcct

SEQ ID NO: 6327182 - DNA, 14 bp, Homo sapiens
gtcttacaggaagc

SEQ ID NO: 6327183 - DNA, 22 bp, Homo sapiens
gtcttaccagtgacgctgctga

SEQ ID NO: 6327184 - DNA, 19 bp, Homo sapiens
gtcttacgtttttctggtg

SEQ ID NO: 6327185 - DNA, 14 bp, Homo sapiens
gtcttactacttta

SEQ ID NO: 6327186 - DNA, 17 bp, Homo sapiens
gtcttactactttaaat

SEQ ID NO: 6327187 - DNA, 20 bp, Homo sapiens
gtcttactactttaaatcct

SEQ ID NO: 6327188 - DNA, 23 bp, Homo sapiens
gtcttactctgtctcccaggctg

SEQ ID NO: 6327189 - DNA, 13 bp, Homo sapiens
gtcttactttgtg

SEQ ID NO: 6327190 - DNA, 21 bp, Homo sapiens
gtcttactttgttaatttatc

SEQ ID NO: 6327191 - DNA, 19 bp, Homo sapiens
gtcttagaagtggaccagg

SEQ ID NO: 6327192 - DNA, 22 bp, Homo sapiens
gtcttagaagtggaccaggaca

SEQ ID NO: 6327193 - DNA, 23 bp, Homo sapiens
gtcttagaagtggaccaggacag

SEQ ID NO: 6327194 - DNA, 23 bp, Homo sapiens
gtcttagacttgaaatactactt

SEQ ID NO: 6327195 - DNA, 20 bp, Homo sapiens
gtcttagagccttttatctg

SEQ ID NO: 6327196 - DNA, 21 bp, Homo sapiens
gtcttagctctggacgtgaaa

SEQ ID NO: 6327197 - DNA, 16 bp, Homo sapiens
gtcttagctctttctc

SEQ ID NO: 6327198 - DNA, 14 bp, Homo sapiens
gtcttagctttaca

SEQ ID NO: 6327199 - DNA, 22 bp, Homo sapiens
gtcttaggaattgaattaataa

SEQ ID NO: 6327200 - DNA, 15 bp, Homo sapiens
gtcttaggatgtctg

SEQ ID NO: 6327201 - DNA, 20 bp, Homo sapiens
gtcttagggtacagcccagg

SEQ ID NO: 6327202 - DNA, 14 bp, Homo sapiens
gtcttaggtcagga

SEQ ID NO: 6327203 - DNA, 23 bp, Homo sapiens
gtcttaggtcttcctgtggctcc

SEQ ID NO: 6327204 - DNA, 13 bp, Homo sapiens
gtcttaggtggca

SEQ ID NO: 6327205 - DNA, 18 bp, Homo sapiens
gtcttataagtaaagaca

SEQ ID NO: 6327206 - DNA, 15 bp, Homo sapiens
gtcttatagaaagca

SEQ ID NO: 6327207 - DNA, 17 bp, Homo sapiens
gtcttatcccccccagc

SEQ ID NO: 6327208 - DNA, 23 bp, Homo sapiens
gtcttatctgagctgagccaggc

SEQ ID NO: 6327209 - DNA, 16 bp, Homo sapiens
gtcttatgattttatt

SEQ ID NO: 6327210 - DNA, 14 bp, Homo sapiens
gtcttatggtccag

SEQ ID NO: 6327211 - DNA, 19 bp, Homo sapiens
gtcttatggtccagaaact

SEQ ID NO: 6327212 - DNA, 14 bp, Homo sapiens
gtcttatgtaaagt

SEQ ID NO: 6327213 - DNA, 18 bp, Homo sapiens
gtcttatgtgaaaaatta

SEQ ID NO: 6327214 - DNA, 16 bp, Homo sapiens
gtcttattcccttcct

SEQ ID NO: 6327215 - DNA, 17 bp, Homo sapiens
gtcttattcctaattcc

SEQ ID NO: 6327216 - DNA, 14 bp, Homo sapiens
gtcttatttcctca

SEQ ID NO: 6327217 - DNA, 17 bp, Homo sapiens
gtcttcaaactgtgaag

SEQ ID NO: 6327218 - DNA, 11 bp, Homo sapiens
gtcttcaaatt

SEQ ID NO: 6327219 - DNA, 13 bp, Homo sapiens
gtcttcaaattaa

SEQ ID NO: 6327220 - DNA, 14 bp, Homo sapiens
gtcttcaaattaaa

SEQ ID NO: 6327221 - DNA, 17 bp, Homo sapiens
gtcttcaaattgtcttt

SEQ ID NO: 6327222 - DNA, 14 bp, Homo sapiens
gtcttcaaatttga

SEQ ID NO: 6327223 - DNA, 16 bp, Homo sapiens
gtcttcaacagctccc

SEQ ID NO: 6327224 - DNA, 18 bp, Homo sapiens
gtcttcaacatcctgcca

SEQ ID NO: 6327225 - DNA, 20 bp, Homo sapiens
gtcttcaacatcctgccagc

SEQ ID NO: 6327226 - DNA, 21 bp, Homo sapiens
gtcttcaacatcctgccagcc

SEQ ID NO: 6327227 - DNA, 17 bp, Homo sapiens
gtcttcaaccctgccct

SEQ ID NO: 6327228 - DNA, 23 bp, Homo sapiens
gtcttcaaccctgccctgcacct

SEQ ID NO: 6327229 - DNA, 13 bp, Homo sapiens
gtcttcaagcctg

SEQ ID NO: 6327230 - DNA, 15 bp, Homo sapiens
gtcttcaagcctggc

SEQ ID NO: 6327231 - DNA, 16 bp, Homo sapiens
gtcttcaagcctggcc

SEQ ID NO: 6327232 - DNA, 14 bp, Homo sapiens
gtcttcaagggctt

SEQ ID NO: 6327233 - DNA, 18 bp, Homo sapiens
gtcttcaatctctgttct

SEQ ID NO: 6327234 - DNA, 22 bp, Homo sapiens
gtcttcacactgcgcaggtctc

SEQ ID NO: 6327235 - DNA, 20 bp, Homo sapiens
gtcttcacctgattcaacta

SEQ ID NO: 6327236 - DNA, 16 bp, Homo sapiens
gtcttcacctgccacc

SEQ ID NO: 6327237 - DNA, 17 bp, Homo sapiens
gtcttcactgccatgcc

SEQ ID NO: 6327238 - DNA, 13 bp, Homo sapiens
gtcttcactgtgt

SEQ ID NO: 6327239 - DNA, 18 bp, Homo sapiens
gtcttcacttgcactggg

SEQ ID NO: 6327240 - DNA, 17 bp, Homo sapiens
gtcttcactttcctcag

SEQ ID NO: 6327241 - DNA, 19 bp, Homo sapiens
gtcttcactttcctcagtt

SEQ ID NO: 6327242 - DNA, 14 bp, Homo sapiens
gtcttcagacccag

SEQ ID NO: 6327243 - DNA, 16 bp, Homo sapiens
gtcttcagacccagag

SEQ ID NO: 6327244 - DNA, 22 bp, Homo sapiens
gtcttcagacccagagaaggac

SEQ ID NO: 6327245 - DNA, 19 bp, Homo sapiens
gtcttcagatcctgctgcc

SEQ ID NO: 6327246 - DNA, 20 bp, Homo sapiens
gtcttcagatcctgctgccg

SEQ ID NO: 6327247 - DNA, 18 bp, Homo sapiens
gtcttcagcattccctcc

SEQ ID NO: 6327248 - DNA, 12 bp, Homo sapiens
gtcttcagccta

SEQ ID NO: 6327249 - DNA, 13 bp, Homo sapiens
gtcttcagcctag

SEQ ID NO: 6327250 - DNA, 15 bp, Homo sapiens
gtcttcagcctagcc

SEQ ID NO: 6327251 - DNA, 23 bp, Homo sapiens
gtcttcagcctagccgacctcag

SEQ ID NO: 6327252 - DNA, 15 bp, Homo sapiens
gtcttcagcctccct

SEQ ID NO: 6327253 - DNA, 17 bp, Homo sapiens
gtcttcagcgagaccct

SEQ ID NO: 6327254 - DNA, 18 bp, Homo sapiens
gtcttcagggggccaggt

SEQ ID NO: 6327255 - DNA, 22 bp, Homo sapiens
gtcttcagtggaacacaaatga

SEQ ID NO: 6327256 - DNA, 11 bp, Homo sapiens
gtcttcataaa

SEQ ID NO: 6327257 - DNA, 20 bp, Homo sapiens
gtcttcataccccagaaatt

SEQ ID NO: 6327258 - DNA, 23 bp, Homo sapiens
gtcttcatacctacatgtatttg

SEQ ID NO: 6327259 - DNA, 19 bp, Homo sapiens
gtcttcatcacttcttcca

SEQ ID NO: 6327260 - DNA, 21 bp, Homo sapiens
gtcttcatccttagcaacagc

SEQ ID NO: 6327261 - DNA, 15 bp, Homo sapiens
gtcttcatggtctct

SEQ ID NO: 6327262 - DNA, 22 bp, Homo sapiens
gtcttcattaagccctcttcca

SEQ ID NO: 6327263 - DNA, 19 bp, Homo sapiens
gtcttcattttttaatgtg

SEQ ID NO: 6327264 - DNA, 15 bp, Homo sapiens
gtcttccaaccccag

SEQ ID NO: 6327265 - DNA, 17 bp, Homo sapiens
gtcttccaaccccagct

SEQ ID NO: 6327266 - DNA, 18 bp, Homo sapiens
gtcttccaaccccagctg

SEQ ID NO: 6327267 - DNA, 23 bp, Homo sapiens
gtcttccaaccccagctggcctc

SEQ ID NO: 6327268 - DNA, 20 bp, Homo sapiens
gtcttccaaggccagaagga

SEQ ID NO: 6327269 - DNA, 17 bp, Homo sapiens
gtcttccagagaacctg

SEQ ID NO: 6327270 - DNA, 18 bp, Homo sapiens
gtcttccaggcccagtcc

SEQ ID NO: 6327271 - DNA, 23 bp, Homo sapiens
gtcttccagggggaaggccaagg

SEQ ID NO: 6327272 - DNA, 22 bp, Homo sapiens
gtcttccaggtgcctggccctt

SEQ ID NO: 6327273 - DNA, 13 bp, Homo sapiens
gtcttccatcagc

SEQ ID NO: 6327274 - DNA, 14 bp, Homo sapiens
gtcttccatcagca

SEQ ID NO: 6327275 - DNA, 12 bp, Homo sapiens
gtcttcccaggg

SEQ ID NO: 6327276 - DNA, 15 bp, Homo sapiens
gtcttcccccctctc

SEQ ID NO: 6327277 - DNA, 22 bp, Homo sapiens
gtcttcccccctctcctcccag

SEQ ID NO: 6327278 - DNA, 23 bp, Homo sapiens
gtcttcccccctctcctcccagc

SEQ ID NO: 6327279 - DNA, 18 bp, Homo sapiens
gtcttcccgcaaggcctc

SEQ ID NO: 6327280 - DNA, 20 bp, Homo sapiens
gtcttccctagggctgggtg

SEQ ID NO: 6327281 - DNA, 14 bp, Homo sapiens
gtcttccctctcta

SEQ ID NO: 6327282 - DNA, 18 bp, Homo sapiens
gtcttccctgggctgcca

SEQ ID NO: 6327283 - DNA, 17 bp, Homo sapiens
gtcttcccttacctcaa

SEQ ID NO: 6327284 - DNA, 14 bp, Homo sapiens
gtcttcccttcttt

SEQ ID NO: 6327285 - DNA, 15 bp, Homo sapiens
gtcttcccttctttg

SEQ ID NO: 6327286 - DNA, 16 bp, Homo sapiens
gtcttcccttctttgc

SEQ ID NO: 6327287 - DNA, 19 bp, Homo sapiens
gtcttcctactcttctctc

SEQ ID NO: 6327288 - DNA, 22 bp, Homo sapiens
gtcttcctactcttctctctgc

SEQ ID NO: 6327289 - DNA, 16 bp, Homo sapiens
gtcttcctattgtact

SEQ ID NO: 6327290 - DNA, 16 bp, Homo sapiens
gtcttcctatttcaga

SEQ ID NO: 6327291 - DNA, 23 bp, Homo sapiens
gtcttcctatttcagaagtttaa

SEQ ID NO: 6327292 - DNA, 23 bp, Homo sapiens
gtcttcctcaaaataaagaagta

SEQ ID NO: 6327293 - DNA, 10 bp, Homo sapiens
gtcttcctcc

SEQ ID NO: 6327294 - DNA, 15 bp, Homo sapiens
gtcttcctcctcccc

SEQ ID NO: 6327295 - DNA, 20 bp, Homo sapiens
gtcttcctcctcccctggca

SEQ ID NO: 6327296 - DNA, 12 bp, Homo sapiens
gtcttcctctgc

SEQ ID NO: 6327297 - DNA, 22 bp, Homo sapiens
gtcttcctctgcaagtgctcag

SEQ ID NO: 6327298 - DNA, 19 bp, Homo sapiens
gtcttcctgacactttaat

SEQ ID NO: 6327299 - DNA, 14 bp, Homo sapiens
gtcttcctgtggct

SEQ ID NO: 6327300 - DNA, 19 bp, Homo sapiens
gtcttcctgtggctccctc

SEQ ID NO: 6327301 - DNA, 20 bp, Homo sapiens
gtcttcctgtggctccctct

SEQ ID NO: 6327302 - DNA, 21 bp, Homo sapiens
gtcttcctgtggctccctctc

SEQ ID NO: 6327303 - DNA, 24 bp, Homo sapiens
gtcttcctgtggctccctctctcc

SEQ ID NO: 6327304 - DNA, 17 bp, Homo sapiens
gtcttccttacctggaa

SEQ ID NO: 6327305 - DNA, 19 bp, Homo sapiens
gtcttccttacctggaaaa

SEQ ID NO: 6327306 - DNA, 17 bp, Homo sapiens
ggcctgattcactggcc

SEQ ID NO: 6327307 - DNA, 24 bp, Homo sapiens
ggcctgcaaaccttcctgggagga

SEQ ID NO: 6327308 - DNA, 16 bp, Homo sapiens
ggcctgcaagggagtg

SEQ ID NO: 6327309 - DNA, 14 bp, Homo sapiens
ggcctgcacacaag

SEQ ID NO: 6327310 - DNA, 12 bp, Homo sapiens
ggcctgcaccct

SEQ ID NO: 6327311 - DNA, 19 bp, Homo sapiens
ggcctgcaccgaccccggg

SEQ ID NO: 6327312 - DNA, 17 bp, Homo sapiens
ggcctgcacggtgggcc

SEQ ID NO: 6327313 - DNA, 19 bp, Homo sapiens
ggcctgcacggtgggcctt

SEQ ID NO: 6327314 - DNA, 19 bp, Homo sapiens
ggcctgcagaccctgccag

SEQ ID NO: 6327315 - DNA, 21 bp, Homo sapiens
ggcctgcagaccctgccaggg

SEQ ID NO: 6327316 - DNA, 20 bp, Homo sapiens
ggcctgcagcaggagtggtg

SEQ ID NO: 6327317 - DNA, 15 bp, Homo sapiens
ggcctgcagcccaga

SEQ ID NO: 6327318 - DNA, 15 bp, Homo sapiens
ggcctgcagccccta

SEQ ID NO: 6327319 - DNA, 17 bp, Homo sapiens
ggcctgcaggacctgcc

SEQ ID NO: 6327320 - DNA, 15 bp, Homo sapiens
ggcctgcaggcccca

SEQ ID NO: 6327321 - DNA, 16 bp, Homo sapiens
ggcctgcaggccccag

SEQ ID NO: 6327322 - DNA, 17 bp, Homo sapiens
ggcctgcaggccccagc

SEQ ID NO: 6327323 - DNA, 18 bp, Homo sapiens
ggcctgcaggccccagcc

SEQ ID NO: 6327324 - DNA, 19 bp, Homo sapiens
ggcctgcaggccccagcca

SEQ ID NO: 6327325 - DNA, 14 bp, Homo sapiens
ggcctgcaggggcc

SEQ ID NO: 6327326 - DNA, 21 bp, Homo sapiens
ggcctgcaggtgagcaggcag

SEQ ID NO: 6327327 - DNA, 21 bp, Homo sapiens
ggcctgcataggctccttcct

SEQ ID NO: 6327328 - DNA, 22 bp, Homo sapiens
ggcctgccaatgccacagccaa

SEQ ID NO: 6327329 - DNA, 17 bp, Homo sapiens
ggcctgccaccctcctg

SEQ ID NO: 6327330 - DNA, 18 bp, Homo sapiens
ggcctgccacctggaccc

SEQ ID NO: 6327331 - DNA, 19 bp, Homo sapiens
ggcctgccacctggacccc

SEQ ID NO: 6327332 - DNA, 12 bp, Homo sapiens
ggcctgccagga

SEQ ID NO: 6327333 - DNA, 13 bp, Homo sapiens
ggcctgccaggag

SEQ ID NO: 6327334 - DNA, 14 bp, Homo sapiens
ggcctgccaggagg

SEQ ID NO: 6327335 - DNA, 18 bp, Homo sapiens
ggcctgcccagcctcaat

SEQ ID NO: 6327336 - DNA, 18 bp, Homo sapiens
ggcctgcccagtcgaccc

SEQ ID NO: 6327337 - DNA, 17 bp, Homo sapiens
ggcctgcccagtgcact

SEQ ID NO: 6327338 - DNA, 12 bp, Homo sapiens
ggcctgcccccc

SEQ ID NO: 6327339 - DNA, 21 bp, Homo sapiens
ggcctgccccccttcccaccc

SEQ ID NO: 6327340 - DNA, 16 bp, Homo sapiens
ggcctgccccctgggc

SEQ ID NO: 6327341 - DNA, 13 bp, Homo sapiens
ggcctgcccctgt

SEQ ID NO: 6327342 - DNA, 17 bp, Homo sapiens
ggcctgccctcagggat

SEQ ID NO: 6327343 - DNA, 16 bp, Homo sapiens
ggcctgccctctgccc

SEQ ID NO: 6327344 - DNA, 13 bp, Homo sapiens
ggcctgccctgct

SEQ ID NO: 6327345 - DNA, 15 bp, Homo sapiens
ggcctgccctgctat

SEQ ID NO: 6327346 - DNA, 22 bp, Homo sapiens
ggcctgccctgttagctttcca

SEQ ID NO: 6327347 - DNA, 15 bp, Homo sapiens
ggcctgcctcccagc

SEQ ID NO: 6327348 - DNA, 16 bp, Homo sapiens
ggcctgcctgcctcca

SEQ ID NO: 6327349 - DNA, 17 bp, Homo sapiens
ggcctgcctgcctccac

SEQ ID NO: 6327350 - DNA, 14 bp, Homo sapiens
ggcctgcctggccc

SEQ ID NO: 6327351 - DNA, 11 bp, Homo sapiens
ggcctgcctgt

SEQ ID NO: 6327352 - DNA, 16 bp, Homo sapiens
ggcctgccttctcagg

SEQ ID NO: 6327353 - DNA, 18 bp, Homo sapiens
ggcctgccttctcaggga

SEQ ID NO: 6327354 - DNA, 13 bp, Homo sapiens
ggcctgcgcaggc

SEQ ID NO: 6327355 - DNA, 18 bp, Homo sapiens
ggcctgcgccagtcctgc

SEQ ID NO: 6327356 - DNA, 12 bp, Homo sapiens
ggcctgcgccca

SEQ ID NO: 6327357 - DNA, 22 bp, Homo sapiens
ggcctgcgcccagagctggcct

SEQ ID NO: 6327358 - DNA, 19 bp, Homo sapiens
ggcctgcggccgggctgcc

SEQ ID NO: 6327359 - DNA, 15 bp, Homo sapiens
ggcctgcgtgcgctg

SEQ ID NO: 6327360 - DNA, 20 bp, Homo sapiens
ggcctgcgtgtgtctgtgtt

SEQ ID NO: 6327361 - DNA, 21 bp, Homo sapiens
ggcctgctaaggctcctcctt

SEQ ID NO: 6327362 - DNA, 15 bp, Homo sapiens
ggcctgctaaggtct

SEQ ID NO: 6327363 - DNA, 17 bp, Homo sapiens
ggcctgctagcggctga

SEQ ID NO: 6327364 - DNA, 13 bp, Homo sapiens
ggcctgctattgc

SEQ ID NO: 6327365 - DNA, 15 bp, Homo sapiens
ggcctgctccagacc

SEQ ID NO: 6327366 - DNA, 17 bp, Homo sapiens
ggcctgctccagacctg

SEQ ID NO: 6327367 - DNA, 18 bp, Homo sapiens
ggcctgctccagacctga

SEQ ID NO: 6327368 - DNA, 18 bp, Homo sapiens
ggcctgctcccagcagcc

SEQ ID NO: 6327369 - DNA, 11 bp, Homo sapiens
ggcctgctctg

SEQ ID NO: 6327370 - DNA, 17 bp, Homo sapiens
ggcctgctgccagtgca

SEQ ID NO: 6327371 - DNA, 11 bp, Homo sapiens
ggcctgctgcg

SEQ ID NO: 6327372 - DNA, 14 bp, Homo sapiens
ggcctgctgctgag

SEQ ID NO: 6327373 - DNA, 19 bp, Homo sapiens
ggcctgctgctgagaacct

SEQ ID NO: 6327374 - DNA, 20 bp, Homo sapiens
ggcctgctgctgagaacctg

SEQ ID NO: 6327375 - DNA, 22 bp, Homo sapiens
ggcctgctgctgagaacctggc

SEQ ID NO: 6327376 - DNA, 23 bp, Homo sapiens
ggcctgctgctgagaacctggcc

SEQ ID NO: 6327377 - DNA, 15 bp, Homo sapiens
ggcctgctggaggcc

SEQ ID NO: 6327378 - DNA, 17 bp, Homo sapiens
ggcctgctggaggcctc

SEQ ID NO: 6327379 - DNA, 18 bp, Homo sapiens
ggcctgctggaggcctca

SEQ ID NO: 6327380 - DNA, 21 bp, Homo sapiens
ggcctgctggaggcctcaggt

SEQ ID NO: 6327381 - DNA, 16 bp, Homo sapiens
ggcctgctggcatcag

SEQ ID NO: 6327382 - DNA, 22 bp, Homo sapiens
ggcctgctgggaaccccgcagc

SEQ ID NO: 6327383 - DNA, 19 bp, Homo sapiens
ggcctgctgggctctccac

SEQ ID NO: 6327384 - DNA, 20 bp, Homo sapiens
ggcctgctgggctctccacc

SEQ ID NO: 6327385 - DNA, 21 bp, Homo sapiens
ggcctgctgggctctccacct

SEQ ID NO: 6327386 - DNA, 15 bp, Homo sapiens
ggcctgctgggcttg

SEQ ID NO: 6327387 - DNA, 15 bp, Homo sapiens
ggcctgctgtgggtc

SEQ ID NO: 6327388 - DNA, 17 bp, Homo sapiens
ggcctgcttcctgtctt

SEQ ID NO: 6327389 - DNA, 19 bp, Homo sapiens
ggcctgcttgactttccag

SEQ ID NO: 6327390 - DNA, 19 bp, Homo sapiens
ggcctgcttttccaggatc

SEQ ID NO: 6327391 - DNA, 20 bp, Homo sapiens
ggcctgcttttccaggatcc

SEQ ID NO: 6327392 - DNA, 16 bp, Homo sapiens
ggcctggaagacagag

SEQ ID NO: 6327393 - DNA, 19 bp, Homo sapiens
ggcctggaatttgggcaga

SEQ ID NO: 6327394 - DNA, 21 bp, Homo sapiens
ggcctggactgcacaggcagc

SEQ ID NO: 6327395 - DNA, 21 bp, Homo sapiens
ggcctggagaggacggccctg

SEQ ID NO: 6327396 - DNA, 13 bp, Homo sapiens
ggcctggagaggg

SEQ ID NO: 6327397 - DNA, 20 bp, Homo sapiens
ggcctggagatcctcctgca

SEQ ID NO: 6327398 - DNA, 22 bp, Homo sapiens
ggcctggagcacaaagaccctg

SEQ ID NO: 6327399 - DNA, 15 bp, Homo sapiens
ggcctggagcaggcc

SEQ ID NO: 6327400 - DNA, 24 bp, Homo sapiens
ggcctggagcgtttgctgtgccag

SEQ ID NO: 6327401 - DNA, 12 bp, Homo sapiens
ggcctggatcca

SEQ ID NO: 6327402 - DNA, 21 bp, Homo sapiens
ggcctggatctccccactcta

SEQ ID NO: 6327403 - DNA, 16 bp, Homo sapiens
ggcctggatgcacagt

SEQ ID NO: 6327404 - DNA, 22 bp, Homo sapiens
ggcctggatgcacagtgcctga

SEQ ID NO: 6327405 - DNA, 20 bp, Homo sapiens
ggcctggattcatttcctgc

SEQ ID NO: 6327406 - DNA, 20 bp, Homo sapiens
ggcctggcaaaataaaacat

SEQ ID NO: 6327407 - DNA, 13 bp, Homo sapiens
ggcctggcaggcc

SEQ ID NO: 6327408 - DNA, 17 bp, Homo sapiens
ggcctggcaggccagtg

SEQ ID NO: 6327409 - DNA, 21 bp, Homo sapiens
ggcctggcagggaggtcaggc

SEQ ID NO: 6327410 - DNA, 13 bp, Homo sapiens
ggcctggcagggg

SEQ ID NO: 6327411 - DNA, 14 bp, Homo sapiens
ggcctggcaggggg

SEQ ID NO: 6327412 - DNA, 19 bp, Homo sapiens
ggcctggcatctgtgcgcg

SEQ ID NO: 6327413 - DNA, 16 bp, Homo sapiens
ggcctggcatctgtgt

SEQ ID NO: 6327414 - DNA, 18 bp, Homo sapiens
ggcctggcatctgtgtgt

SEQ ID NO: 6327415 - DNA, 14 bp, Homo sapiens
ggcctggcatgcag

SEQ ID NO: 6327416 - DNA, 16 bp, Homo sapiens
ggcctggccacctctc

SEQ ID NO: 6327417 - DNA, 17 bp, Homo sapiens
ggcctggccacctctct

SEQ ID NO: 6327418 - DNA, 12 bp, Homo sapiens
ggcctggccaga

SEQ ID NO: 6327419 - DNA, 15 bp, Homo sapiens
ggcctggccagatgc

SEQ ID NO: 6327420 - DNA, 21 bp, Homo sapiens
ggcctggccagatgcaccagc

SEQ ID NO: 6327421 - DNA, 16 bp, Homo sapiens
ggcctggccaggagct

SEQ ID NO: 6327422 - DNA, 17 bp, Homo sapiens
ggcctggccaggagctc

SEQ ID NO: 6327423 - DNA, 22 bp, Homo sapiens
ggcctggccagggcctggaaga

SEQ ID NO: 6327424 - DNA, 15 bp, Homo sapiens
ggcctggccagtctt

SEQ ID NO: 6327425 - DNA, 23 bp, Homo sapiens
ggcctggcccacagcaggtgctg

SEQ ID NO: 6327426 - DNA, 13 bp, Homo sapiens
ggcctggcccagc

SEQ ID NO: 6327427 - DNA, 16 bp, Homo sapiens
ggcctggcccagccag

SEQ ID NO: 6327428 - DNA, 17 bp, Homo sapiens
ggcctggcccagccagc

SEQ ID NO: 6327429 - DNA, 19 bp, Homo sapiens
ggcctggcccagccagcag

SEQ ID NO: 6327430 - DNA, 15 bp, Homo sapiens
ggcctggcccatgta

SEQ ID NO: 6327431 - DNA, 11 bp, Homo sapiens
ggcctggcccc

SEQ ID NO: 6327432 - DNA, 23 bp, Homo sapiens
ggcctggccccctcgcgcccctg

SEQ ID NO: 6327433 - DNA, 18 bp, Homo sapiens
ggcctggcccctcagggt

SEQ ID NO: 6327434 - DNA, 13 bp, Homo sapiens
ggcctggccctca

SEQ ID NO: 6327435 - DNA, 15 bp, Homo sapiens
ggcctggccctcctg

SEQ ID NO: 6327436 - DNA, 13 bp, Homo sapiens
ggcctggccctgc

SEQ ID NO: 6327437 - DNA, 18 bp, Homo sapiens
ggcctggccctgccctga

SEQ ID NO: 6327438 - DNA, 19 bp, Homo sapiens
ggcctggccctttcacccc

SEQ ID NO: 6327439 - DNA, 20 bp, Homo sapiens
ggcctggccgttcagcctgt

SEQ ID NO: 6327440 - DNA, 21 bp, Homo sapiens
ggcctggccgttcagcctgtc

SEQ ID NO: 6327441 - DNA, 10 bp, Homo sapiens
ggcctggcct

SEQ ID NO: 6327442 - DNA, 16 bp, Homo sapiens
ggcctggcctatttaa

SEQ ID NO: 6327443 - DNA, 22 bp, Homo sapiens
ggcctggcctatttaagccccc

SEQ ID NO: 6327444 - DNA, 11 bp, Homo sapiens
ggcctggcctc

SEQ ID NO: 6327445 - DNA, 15 bp, Homo sapiens
ggcctggcctcatct

SEQ ID NO: 6327446 - DNA, 12 bp, Homo sapiens
ggcctggcctcc

SEQ ID NO: 6327447 - DNA, 14 bp, Homo sapiens
ggcctggcctccag

SEQ ID NO: 6327448 - DNA, 16 bp, Homo sapiens
ggcctggcctccagct

SEQ ID NO: 6327449 - DNA, 21 bp, Homo sapiens
ggcctggcctcggggcagggc

SEQ ID NO: 6327450 - DNA, 12 bp, Homo sapiens
ggcctggcctct

SEQ ID NO: 6327451 - DNA, 13 bp, Homo sapiens
ggcctggcctctg

SEQ ID NO: 6327452 - DNA, 15 bp, Homo sapiens
ggcctggcctgagct

SEQ ID NO: 6327453 - DNA, 13 bp, Homo sapiens
ggcctggcctggc

SEQ ID NO: 6327454 - DNA, 17 bp, Homo sapiens
ggcctggcctggccctg

SEQ ID NO: 6327455 - DNA, 18 bp, Homo sapiens
ggcctggcctggccctgc

SEQ ID NO: 6327456 - DNA, 14 bp, Homo sapiens
ggcctggccttgtc

SEQ ID NO: 6327457 - DNA, 14 bp, Homo sapiens
ggcctggcggcctg

SEQ ID NO: 6327458 - DNA, 16 bp, Homo sapiens
ggcctggcggcctgtg

SEQ ID NO: 6327459 - DNA, 23 bp, Homo sapiens
ggcctggcgggatgggccaccgc

SEQ ID NO: 6327460 - DNA, 17 bp, Homo sapiens
ggcctggcgtcggccag

SEQ ID NO: 6327461 - DNA, 20 bp, Homo sapiens
ggcctggctcattctgcacc

SEQ ID NO: 6327462 - DNA, 12 bp, Homo sapiens
ggcctggctccg

SEQ ID NO: 6327463 - DNA, 18 bp, Homo sapiens
ggcctggctccgctgtgt

SEQ ID NO: 6327464 - DNA, 14 bp, Homo sapiens
ggcctggctctgga

SEQ ID NO: 6327465 - DNA, 14 bp, Homo sapiens
ggcctggctgcagc

SEQ ID NO: 6327466 - DNA, 20 bp, Homo sapiens
ggcctggctgcagctgggca

SEQ ID NO: 6327467 - DNA, 11 bp, Homo sapiens
ggcctggctgg

SEQ ID NO: 6327468 - DNA, 12 bp, Homo sapiens
ggcctggctgga

SEQ ID NO: 6327469 - DNA, 15 bp, Homo sapiens
ggcctggctggccag

SEQ ID NO: 6327470 - DNA, 14 bp, Homo sapiens
ggcctggctggctg

SEQ ID NO: 6327471 - DNA, 17 bp, Homo sapiens
ggcctggctggctgagg

SEQ ID NO: 6327472 - DNA, 16 bp, Homo sapiens
ggcctggctggtggga

SEQ ID NO: 6327473 - DNA, 15 bp, Homo sapiens
ggcctggcttctcct

SEQ ID NO: 6327474 - DNA, 19 bp, Homo sapiens
ggcctggcttgctccaggg

SEQ ID NO: 6327475 - DNA, 14 bp, Homo sapiens
ggcctggcttgtct

SEQ ID NO: 6327476 - DNA, 20 bp, Homo sapiens
ggcctgggaaaagggcagga

SEQ ID NO: 6327477 - DNA, 15 bp, Homo sapiens
ggcctgggaaaggaa

SEQ ID NO: 6327478 - DNA, 16 bp, Homo sapiens
ggcctgggaaaggaaa

SEQ ID NO: 6327479 - DNA, 22 bp, Homo sapiens
ggcctgggacacttccctgggc

SEQ ID NO: 6327480 - DNA, 23 bp, Homo sapiens
ggcctgggacacttccctgggcc

SEQ ID NO: 6327481 - DNA, 20 bp, Homo sapiens
ggcctgggacccagctactc

SEQ ID NO: 6327482 - DNA, 20 bp, Homo sapiens
ggcctgggagggttcccctg

SEQ ID NO: 6327483 - DNA, 21 bp, Homo sapiens
ggcctgggagggttcccctgg

SEQ ID NO: 6327484 - DNA, 22 bp, Homo sapiens
ggcctgggatctggcacactcc

SEQ ID NO: 6327485 - DNA, 13 bp, Homo sapiens
ggcctgggcagga

SEQ ID NO: 6327486 - DNA, 18 bp, Homo sapiens
ggcctgggcaggaccctg

SEQ ID NO: 6327487 - DNA, 22 bp, Homo sapiens
gtcttccttctcattgctgccc

SEQ ID NO: 6327488 - DNA, 23 bp, Homo sapiens
gtcttccttctcattgctgcccg

SEQ ID NO: 6327489 - DNA, 15 bp, Homo sapiens
gtcttccttgtctct

SEQ ID NO: 6327490 - DNA, 17 bp, Homo sapiens
gtcttcgccctctgaaa

SEQ ID NO: 6327491 - DNA, 21 bp, Homo sapiens
gtcttcgccctctgaaattaa

SEQ ID NO: 6327492 - DNA, 23 bp, Homo sapiens
gtcttcgccctctgaaattaaag

SEQ ID NO: 6327493 - DNA, 17 bp, Homo sapiens
gtcttcggaaaccttgg

SEQ ID NO: 6327494 - DNA, 14 bp, Homo sapiens
gtcttcgtccttga

SEQ ID NO: 6327495 - DNA, 14 bp, Homo sapiens
gtcttctaaacttc

SEQ ID NO: 6327496 - DNA, 17 bp, Homo sapiens
gtcttctaatgtaaatt

SEQ ID NO: 6327497 - DNA, 17 bp, Homo sapiens
gtcttctactgccttga

SEQ ID NO: 6327498 - DNA, 21 bp, Homo sapiens
gtcttctagagagcttagtgt

SEQ ID NO: 6327499 - DNA, 15 bp, Homo sapiens
gtcttctcaggctct

SEQ ID NO: 6327500 - DNA, 19 bp, Homo sapiens
gtcttctcaggctctgccc

SEQ ID NO: 6327501 - DNA, 11 bp, Homo sapiens
gtcttctccca

SEQ ID NO: 6327502 - DNA, 12 bp, Homo sapiens
gtcttctcccca

SEQ ID NO: 6327503 - DNA, 12 bp, Homo sapiens
gtcttctccctg

SEQ ID NO: 6327504 - DNA, 23 bp, Homo sapiens
gtcttctccctgtcccctcatgg

SEQ ID NO: 6327505 - DNA, 13 bp, Homo sapiens
gtcttctctccat

SEQ ID NO: 6327506 - DNA, 16 bp, Homo sapiens
gtcttctctgtctcag

SEQ ID NO: 6327507 - DNA, 14 bp, Homo sapiens
gtcttctgcctgtt

SEQ ID NO: 6327508 - DNA, 14 bp, Homo sapiens
gtcttctgctgttc

SEQ ID NO: 6327509 - DNA, 14 bp, Homo sapiens
gtcttctgctttgt

SEQ ID NO: 6327510 - DNA, 18 bp, Homo sapiens
gtcttctggacaggctct

SEQ ID NO: 6327511 - DNA, 23 bp, Homo sapiens
gtcttctggacaggctctgcttc

SEQ ID NO: 6327512 - DNA, 23 bp, Homo sapiens
gtcttctggtctgtgtgtgttct

SEQ ID NO: 6327513 - DNA, 17 bp, Homo sapiens
gtcttctggttttctag

SEQ ID NO: 6327514 - DNA, 21 bp, Homo sapiens
gtcttctgtaattcattgagc

SEQ ID NO: 6327515 - DNA, 16 bp, Homo sapiens
gtcttctgttcccaag

SEQ ID NO: 6327516 - DNA, 21 bp, Homo sapiens
gtcttcttcacccgctgcagc

SEQ ID NO: 6327517 - DNA, 14 bp, Homo sapiens
gtcttcttcagggt

SEQ ID NO: 6327518 - DNA, 12 bp, Homo sapiens
gtcttcttggcc

SEQ ID NO: 6327519 - DNA, 13 bp, Homo sapiens
gtcttctttctcc

SEQ ID NO: 6327520 - DNA, 23 bp, Homo sapiens
gtcttgaaaaaaaatagatgttt

SEQ ID NO: 6327521 - DNA, 22 bp, Homo sapiens
gtcttgaaacatgttcatctgg

SEQ ID NO: 6327522 - DNA, 19 bp, Homo sapiens
gtcttgaaacctttctact

SEQ ID NO: 6327523 - DNA, 13 bp, Homo sapiens
gtcttgaaatgaa

SEQ ID NO: 6327524 - DNA, 16 bp, Homo sapiens
gtcttgaaatgaaagg

SEQ ID NO: 6327525 - DNA, 17 bp, Homo sapiens
gtcttgaaatgaaaggg

SEQ ID NO: 6327526 - DNA, 18 bp, Homo sapiens
gtcttgaaatgaaaggga

SEQ ID NO: 6327527 - DNA, 17 bp, Homo sapiens
gtcttgaacgagcagcc

SEQ ID NO: 6327528 - DNA, 18 bp, Homo sapiens
gtcttgaactcctggcct

SEQ ID NO: 6327529 - DNA, 21 bp, Homo sapiens
gtcttgaactcctggcctcaa

SEQ ID NO: 6327530 - DNA, 17 bp, Homo sapiens
gtcttgaagtctgtaca

SEQ ID NO: 6327531 - DNA, 21 bp, Homo sapiens
gtcttgaatagattttctctg

SEQ ID NO: 6327532 - DNA, 19 bp, Homo sapiens
gtcttgaatgtcttttgaa

SEQ ID NO: 6327533 - DNA, 18 bp, Homo sapiens
gtcttgaattagtatttc

SEQ ID NO: 6327534 - DNA, 22 bp, Homo sapiens
gtcttgaattagtatttcagtg

SEQ ID NO: 6327535 - DNA, 18 bp, Homo sapiens
gtcttgacctctccagca

SEQ ID NO: 6327536 - DNA, 17 bp, Homo sapiens
gtcttgacctgaactct

SEQ ID NO: 6327537 - DNA, 22 bp, Homo sapiens
gtcttgactgttagttgtccac

SEQ ID NO: 6327538 - DNA, 16 bp, Homo sapiens
gtcttgagaaaacaga

SEQ ID NO: 6327539 - DNA, 21 bp, Homo sapiens
gtcttgagaccagcctgccag

SEQ ID NO: 6327540 - DNA, 18 bp, Homo sapiens
gtcttgagagcgctggcc

SEQ ID NO: 6327541 - DNA, 23 bp, Homo sapiens
gtcttgagaggagacttgtgaat

SEQ ID NO: 6327542 - DNA, 16 bp, Homo sapiens
gtcttgagctctatta

SEQ ID NO: 6327543 - DNA, 17 bp, Homo sapiens
gtcttgaggggaagctg

SEQ ID NO: 6327544 - DNA, 17 bp, Homo sapiens
gtcttgagtttcatttt

SEQ ID NO: 6327545 - DNA, 14 bp, Homo sapiens
gtcttgatctcctg

SEQ ID NO: 6327546 - DNA, 18 bp, Homo sapiens
gtcttgatgaccaaagtc

SEQ ID NO: 6327547 - DNA, 19 bp, Homo sapiens
gtcttgcaaagcgacagat

SEQ ID NO: 6327548 - DNA, 18 bp, Homo sapiens
gtcttgcaatggcagcct

SEQ ID NO: 6327549 - DNA, 19 bp, Homo sapiens
gtcttgcagtgattaaggt

SEQ ID NO: 6327550 - DNA, 21 bp, Homo sapiens
gtcttgcagtgattaaggtct

SEQ ID NO: 6327551 - DNA, 16 bp, Homo sapiens
gtcttgcccagcagct

SEQ ID NO: 6327552 - DNA, 21 bp, Homo sapiens
gtcttgcccagcagctcaaga

SEQ ID NO: 6327553 - DNA, 12 bp, Homo sapiens
gtcttgccccag

SEQ ID NO: 6327554 - DNA, 22 bp, Homo sapiens
gtcttgccccatcactgcgcca

SEQ ID NO: 6327555 - DNA, 16 bp, Homo sapiens
gtcttgcctttttcat

SEQ ID NO: 6327556 - DNA, 17 bp, Homo sapiens
gtcttgcctttttcatt

SEQ ID NO: 6327557 - DNA, 18 bp, Homo sapiens
gtcttgcctttttcatta

SEQ ID NO: 6327558 - DNA, 20 bp, Homo sapiens
gtcttgctatgttgcccaag

SEQ ID NO: 6327559 - DNA, 19 bp, Homo sapiens
gtcttgctatttgagcatg

SEQ ID NO: 6327560 - DNA, 16 bp, Homo sapiens
gtcttgctctgtctcc

SEQ ID NO: 6327561 - DNA, 19 bp, Homo sapiens
gtcttgctctgtctcccag

SEQ ID NO: 6327562 - DNA, 20 bp, Homo sapiens
gtcttgctggaagacagaga

SEQ ID NO: 6327563 - DNA, 12 bp, Homo sapiens
gtcttgctgtgg

SEQ ID NO: 6327564 - DNA, 17 bp, Homo sapiens
gtcttgctttgctgtct

SEQ ID NO: 6327565 - DNA, 15 bp, Homo sapiens
gtcttggacactgta

SEQ ID NO: 6327566 - DNA, 14 bp, Homo sapiens
gtcttggagaggag

SEQ ID NO: 6327567 - DNA, 20 bp, Homo sapiens
gtcttggagaggaggtgtgg

SEQ ID NO: 6327568 - DNA, 18 bp, Homo sapiens
gtcttggagctgagcctc

SEQ ID NO: 6327569 - DNA, 15 bp, Homo sapiens
gtcttggatatatag

SEQ ID NO: 6327570 - DNA, 20 bp, Homo sapiens
gtcttggcattaaaccacat

SEQ ID NO: 6327571 - DNA, 21 bp, Homo sapiens
gtcttggccgactcagggacc

SEQ ID NO: 6327572 - DNA, 13 bp, Homo sapiens
gtcttggcctccc

SEQ ID NO: 6327573 - DNA, 18 bp, Homo sapiens
gtcttggcggcagcagcc

SEQ ID NO: 6327574 - DNA, 23 bp, Homo sapiens
gtcttggcggcagcagccatcat

SEQ ID NO: 6327575 - DNA, 16 bp, Homo sapiens
gtcttgggaaatatga

SEQ ID NO: 6327576 - DNA, 21 bp, Homo sapiens
gtcttgggaaatatgaatgcc

SEQ ID NO: 6327577 - DNA, 16 bp, Homo sapiens
gtcttgggcagagctg

SEQ ID NO: 6327578 - DNA, 12 bp, Homo sapiens
gtcttgggcctg

SEQ ID NO: 6327579 - DNA, 18 bp, Homo sapiens
gtcttgggctactggcag

SEQ ID NO: 6327580 - DNA, 15 bp, Homo sapiens
gtcttggggccactt

SEQ ID NO: 6327581 - DNA, 20 bp, Homo sapiens
gtcttggggccactttcaga

SEQ ID NO: 6327582 - DNA, 19 bp, Homo sapiens
gtcttgggggtcagggggg

SEQ ID NO: 6327583 - DNA, 15 bp, Homo sapiens
gtcttggtattctta

SEQ ID NO: 6327584 - DNA, 23 bp, Homo sapiens
gtcttggtggatgggccctgcaa

SEQ ID NO: 6327585 - DNA, 16 bp, Homo sapiens
gtcttggttccagcct

SEQ ID NO: 6327586 - DNA, 23 bp, Homo sapiens
gtcttggtttccatcaaagccct

SEQ ID NO: 6327587 - DNA, 16 bp, Homo sapiens
gtcttggtttggttca

SEQ ID NO: 6327588 - DNA, 21 bp, Homo sapiens
gtcttgtaaaaaggggaggag

SEQ ID NO: 6327589 - DNA, 16 bp, Homo sapiens
gtcttgtaatattttg

SEQ ID NO: 6327590 - DNA, 19 bp, Homo sapiens
gtcttgtaatattttgtat

SEQ ID NO: 6327591 - DNA, 14 bp, Homo sapiens
gtcttgtactgtga

SEQ ID NO: 6327592 - DNA, 15 bp, Homo sapiens
gtcttgtactgtgac

SEQ ID NO: 6327593 - DNA, 15 bp, Homo sapiens
gtcttgtacttctgt

SEQ ID NO: 6327594 - DNA, 23 bp, Homo sapiens
gtcttgtagctagaacttctcta

SEQ ID NO: 6327595 - DNA, 18 bp, Homo sapiens
gtcttgtattatcataag

SEQ ID NO: 6327596 - DNA, 19 bp, Homo sapiens
gtcttgtcccaattaaaat

SEQ ID NO: 6327597 - DNA, 20 bp, Homo sapiens
gtcttgtctcagattttatt

SEQ ID NO: 6327598 - DNA, 22 bp, Homo sapiens
gtcttgtctcatttaggactgg

SEQ ID NO: 6327599 - DNA, 13 bp, Homo sapiens
gtcttgtgaaatt

SEQ ID NO: 6327600 - DNA, 14 bp, Homo sapiens
gtcttgtgaaattg

SEQ ID NO: 6327601 - DNA, 16 bp, Homo sapiens
gtcttgtgaaattgtg

SEQ ID NO: 6327602 - DNA, 11 bp, Homo sapiens
gtcttgtgaac

SEQ ID NO: 6327603 - DNA, 13 bp, Homo sapiens
gtcttgtgactag

SEQ ID NO: 6327604 - DNA, 16 bp, Homo sapiens
gtcttgtggttgtgtg

SEQ ID NO: 6327605 - DNA, 22 bp, Homo sapiens
gtcttgtggttgtgtgtgttct

SEQ ID NO: 6327606 - DNA, 17 bp, Homo sapiens
gtcttgtgtatttctct

SEQ ID NO: 6327607 - DNA, 21 bp, Homo sapiens
gtcttgtgtatttctctgtga

SEQ ID NO: 6327608 - DNA, 23 bp, Homo sapiens
gtcttgtgtatttctctgtgaat

SEQ ID NO: 6327609 - DNA, 20 bp, Homo sapiens
gtcttgtgtttctttagttt

SEQ ID NO: 6327610 - DNA, 17 bp, Homo sapiens
gtcttgtgtttgctgca

SEQ ID NO: 6327611 - DNA, 21 bp, Homo sapiens
gtcttgttctgtcactcaggc

SEQ ID NO: 6327612 - DNA, 14 bp, Homo sapiens
gtcttgttgttcat

SEQ ID NO: 6327613 - DNA, 16 bp, Homo sapiens
gtctttaaaggcccag

SEQ ID NO: 6327614 - DNA, 20 bp, Homo sapiens
gtctttaaaggcccagcccc

SEQ ID NO: 6327615 - DNA, 23 bp, Homo sapiens
gtctttaagatcttggcttaatt

SEQ ID NO: 6327616 - DNA, 13 bp, Homo sapiens
gtctttaatcatt

SEQ ID NO: 6327617 - DNA, 15 bp, Homo sapiens
gtctttaatcccagt

SEQ ID NO: 6327618 - DNA, 16 bp, Homo sapiens
gtctttaatcccagtt

SEQ ID NO: 6327619 - DNA, 17 bp, Homo sapiens
gtctttacccctgctga

SEQ ID NO: 6327620 - DNA, 15 bp, Homo sapiens
gtctttactggacct

SEQ ID NO: 6327621 - DNA, 23 bp, Homo sapiens
gtctttagggagacccaataaag

SEQ ID NO: 6327622 - DNA, 20 bp, Homo sapiens
gtctttagtgatgcaataaa

SEQ ID NO: 6327623 - DNA, 14 bp, Homo sapiens
gtctttataaagct

SEQ ID NO: 6327624 - DNA, 24 bp, Homo sapiens
gtctttataaagctgttcttgaaa

SEQ ID NO: 6327625 - DNA, 21 bp, Homo sapiens
gtctttataacccatattttc

SEQ ID NO: 6327626 - DNA, 12 bp, Homo sapiens
gtctttatgaat

SEQ ID NO: 6327627 - DNA, 13 bp, Homo sapiens
gtctttatgattt

SEQ ID NO: 6327628 - DNA, 15 bp, Homo sapiens
gtctttatgatttca

SEQ ID NO: 6327629 - DNA, 17 bp, Homo sapiens
gtctttatgatttcatg

SEQ ID NO: 6327630 - DNA, 21 bp, Homo sapiens
gtctttatgtaagaagaaact

SEQ ID NO: 6327631 - DNA, 22 bp, Homo sapiens
gtctttatgtaagaagaaactg

SEQ ID NO: 6327632 - DNA, 19 bp, Homo sapiens
gtctttattagattttcct

SEQ ID NO: 6327633 - DNA, 18 bp, Homo sapiens
gtctttattcttattact

SEQ ID NO: 6327634 - DNA, 21 bp, Homo sapiens
gtctttatttttttcccatga

SEQ ID NO: 6327635 - DNA, 13 bp, Homo sapiens
gtctttcaagtga

SEQ ID NO: 6327636 - DNA, 19 bp, Homo sapiens
gtctttcacagtaccatct

SEQ ID NO: 6327637 - DNA, 12 bp, Homo sapiens
gtctttcagaag

SEQ ID NO: 6327638 - DNA, 23 bp, Homo sapiens
gtctttcagcaagataaacatta

SEQ ID NO: 6327639 - DNA, 21 bp, Homo sapiens
gtctttcaggaccttttgaag

SEQ ID NO: 6327640 - DNA, 19 bp, Homo sapiens
gtctttcatggaatgcaat

SEQ ID NO: 6327641 - DNA, 13 bp, Homo sapiens
gtctttcatggct

SEQ ID NO: 6327642 - DNA, 16 bp, Homo sapiens
gtctttcatggctgct

SEQ ID NO: 6327643 - DNA, 23 bp, Homo sapiens
gtctttcatggctgctgttgctt

SEQ ID NO: 6327644 - DNA, 18 bp, Homo sapiens
gtctttccacggagccac

SEQ ID NO: 6327645 - DNA, 13 bp, Homo sapiens
gtctttccactct

SEQ ID NO: 6327646 - DNA, 18 bp, Homo sapiens
gtctttccacttctctgg

SEQ ID NO: 6327647 - DNA, 14 bp, Homo sapiens
gtctttcccccagg

SEQ ID NO: 6327648 - DNA, 18 bp, Homo sapiens
gtctttcccccaggaaaa

SEQ ID NO: 6327649 - DNA, 21 bp, Homo sapiens
gtctttcctcctaccttttgt

SEQ ID NO: 6327650 - DNA, 20 bp, Homo sapiens
gtctttcctgctacaagtgt

SEQ ID NO: 6327651 - DNA, 21 bp, Homo sapiens
gtctttcggaatttttaaaat

SEQ ID NO: 6327652 - DNA, 18 bp, Homo sapiens
gtctttctaatgtagcta

SEQ ID NO: 6327653 - DNA, 14 bp, Homo sapiens
gtctttctattcat

SEQ ID NO: 6327654 - DNA, 23 bp, Homo sapiens
gtctttctattcataataaacta

SEQ ID NO: 6327655 - DNA, 16 bp, Homo sapiens
gtctttctccaaagtt

SEQ ID NO: 6327656 - DNA, 19 bp, Homo sapiens
gtctttctcctctttgaga

SEQ ID NO: 6327657 - DNA, 18 bp, Homo sapiens
gtctttctctaaatatga

SEQ ID NO: 6327658 - DNA, 11 bp, Homo sapiens
gtctttctctc

SEQ ID NO: 6327659 - DNA, 14 bp, Homo sapiens
gtctttctctctca

SEQ ID NO: 6327660 - DNA, 21 bp, Homo sapiens
gtctttctctttccctggtcc

SEQ ID NO: 6327661 - DNA, 22 bp, Homo sapiens
gtctttcttcactctggcttca

SEQ ID NO: 6327662 - DNA, 12 bp, Homo sapiens
gtctttcttctt

SEQ ID NO: 6327663 - DNA, 15 bp, Homo sapiens
gtctttcttcttttt

SEQ ID NO: 6327664 - DNA, 12 bp, Homo sapiens
ggcctgggcctc

SEQ ID NO: 6327665 - DNA, 16 bp, Homo sapiens
ggcctgggcctcatgg

SEQ ID NO: 6327666 - DNA, 18 bp, Homo sapiens
ggcctgggcctcctggga

SEQ ID NO: 6327667 - DNA, 17 bp, Homo sapiens
ggcctgggcctctgccc

SEQ ID NO: 6327668 - DNA, 14 bp, Homo sapiens
ggcctgggcctgct

SEQ ID NO: 6327669 - DNA, 17 bp, Homo sapiens
ggcctgggctaggggac

SEQ ID NO: 6327670 - DNA, 15 bp, Homo sapiens
ggcctgggctggcct

SEQ ID NO: 6327671 - DNA, 14 bp, Homo sapiens
ggcctgggctgttg

SEQ ID NO: 6327672 - DNA, 19 bp, Homo sapiens
ggcctggggacccaaaccc

SEQ ID NO: 6327673 - DNA, 15 bp, Homo sapiens
ggcctggggacggag

SEQ ID NO: 6327674 - DNA, 17 bp, Homo sapiens
ggcctggggacggagca

SEQ ID NO: 6327675 - DNA, 17 bp, Homo sapiens
ggcctggggagcccact

SEQ ID NO: 6327676 - DNA, 18 bp, Homo sapiens
ggcctggggagcccactg

SEQ ID NO: 6327677 - DNA, 15 bp, Homo sapiens
ggcctggggaggccc

SEQ ID NO: 6327678 - DNA, 21 bp, Homo sapiens
ggcctggggccggtagaggct

SEQ ID NO: 6327679 - DNA, 14 bp, Homo sapiens
ggcctggggcctga

SEQ ID NO: 6327680 - DNA, 14 bp, Homo sapiens
ggcctggggctcct

SEQ ID NO: 6327681 - DNA, 18 bp, Homo sapiens
ggcctgggggcagggaga

SEQ ID NO: 6327682 - DNA, 15 bp, Homo sapiens
ggcctgggggcagtg

SEQ ID NO: 6327683 - DNA, 14 bp, Homo sapiens
ggcctgggggctgg

SEQ ID NO: 6327684 - DNA, 22 bp, Homo sapiens
ggcctgggggctgggcagagga

SEQ ID NO: 6327685 - DNA, 22 bp, Homo sapiens
ggcctgggggttttccaagccc

SEQ ID NO: 6327686 - DNA, 20 bp, Homo sapiens
ggcctggggtaggaggaaca

SEQ ID NO: 6327687 - DNA, 19 bp, Homo sapiens
ggcctggggtccctctgaa

SEQ ID NO: 6327688 - DNA, 15 bp, Homo sapiens
ggcctggggtgaccc

SEQ ID NO: 6327689 - DNA, 20 bp, Homo sapiens
ggcctggggtgcatctcctc

SEQ ID NO: 6327690 - DNA, 24 bp, Homo sapiens
ggcctgggtcccagggctggccct

SEQ ID NO: 6327691 - DNA, 16 bp, Homo sapiens
ggcctgggtccccctc

SEQ ID NO: 6327692 - DNA, 16 bp, Homo sapiens
ggcctgggtcctcggc

SEQ ID NO: 6327693 - DNA, 21 bp, Homo sapiens
ggcctgggtcctcggccctgt

SEQ ID NO: 6327694 - DNA, 14 bp, Homo sapiens
ggcctgggtctgtg

SEQ ID NO: 6327695 - DNA, 20 bp, Homo sapiens
ggcctgggtgatctgctgct

SEQ ID NO: 6327696 - DNA, 22 bp, Homo sapiens
ggcctgggtggggcagggcctg

SEQ ID NO: 6327697 - DNA, 11 bp, Homo sapiens
ggcctgggttt

SEQ ID NO: 6327698 - DNA, 14 bp, Homo sapiens
ggcctggtagcaca

SEQ ID NO: 6327699 - DNA, 15 bp, Homo sapiens
ggcctggtaggtctg

SEQ ID NO: 6327700 - DNA, 14 bp, Homo sapiens
ggcctggtcagcag

SEQ ID NO: 6327701 - DNA, 17 bp, Homo sapiens
ggcctggtcagcagagc

SEQ ID NO: 6327702 - DNA, 16 bp, Homo sapiens
ggcctggtccctggtc

SEQ ID NO: 6327703 - DNA, 14 bp, Homo sapiens
ggcctggtccctgt

SEQ ID NO: 6327704 - DNA, 14 bp, Homo sapiens
ggcctggtctggga

SEQ ID NO: 6327705 - DNA, 15 bp, Homo sapiens
ggcctggtgccctgg

SEQ ID NO: 6327706 - DNA, 17 bp, Homo sapiens
ggcctggtgccctggcc

SEQ ID NO: 6327707 - DNA, 18 bp, Homo sapiens
ggcctggtgggtcagggg

SEQ ID NO: 6327708 - DNA, 23 bp, Homo sapiens
ggcctggtttcctcgagaggcac

SEQ ID NO: 6327709 - DNA, 15 bp, Homo sapiens
ggcctgtaatcagct

SEQ ID NO: 6327710 - DNA, 21 bp, Homo sapiens
ggcctgtaatcagctctcctg

SEQ ID NO: 6327711 - DNA, 23 bp, Homo sapiens
ggcctgtaatcagctctcctggc

SEQ ID NO: 6327712 - DNA, 19 bp, Homo sapiens
ggcctgtacaaaagggaca

SEQ ID NO: 6327713 - DNA, 15 bp, Homo sapiens
ggcctgtactgcctg

SEQ ID NO: 6327714 - DNA, 15 bp, Homo sapiens
ggcctgtatgaggct

SEQ ID NO: 6327715 - DNA, 15 bp, Homo sapiens
ggcctgtcagagctt

SEQ ID NO: 6327716 - DNA, 18 bp, Homo sapiens
ggcctgtccaacacatct

SEQ ID NO: 6327717 - DNA, 23 bp, Homo sapiens
ggcctgtccacctgtgctgctgc

SEQ ID NO: 6327718 - DNA, 17 bp, Homo sapiens
ggcctgtcccccaaggt

SEQ ID NO: 6327719 - DNA, 20 bp, Homo sapiens
ggcctgtcccttgcctctgc

SEQ ID NO: 6327720 - DNA, 13 bp, Homo sapiens
ggcctgtctcaga

SEQ ID NO: 6327721 - DNA, 14 bp, Homo sapiens
ggcctgtctcagtg

SEQ ID NO: 6327722 - DNA, 22 bp, Homo sapiens
ggcctgtctctattagctgggt

SEQ ID NO: 6327723 - DNA, 20 bp, Homo sapiens
ggcctgtgagcaagagccag

SEQ ID NO: 6327724 - DNA, 22 bp, Homo sapiens
ggcctgtgagcaagagccaggg

SEQ ID NO: 6327725 - DNA, 11 bp, Homo sapiens
ggcctgtgagg

SEQ ID NO: 6327726 - DNA, 15 bp, Homo sapiens
ggcctgtgaggggcc

SEQ ID NO: 6327727 - DNA, 15 bp, Homo sapiens
ggcctgtgatccagg

SEQ ID NO: 6327728 - DNA, 18 bp, Homo sapiens
ggcctgtgcactgggcag

SEQ ID NO: 6327729 - DNA, 21 bp, Homo sapiens
ggcctgtgcactgggcaggtt

SEQ ID NO: 6327730 - DNA, 23 bp, Homo sapiens
ggcctgtgcactgggcaggttcc

SEQ ID NO: 6327731 - DNA, 15 bp, Homo sapiens
ggcctgtgcagcagc

SEQ ID NO: 6327732 - DNA, 16 bp, Homo sapiens
ggcctgtgcagcagcc

SEQ ID NO: 6327733 - DNA, 18 bp, Homo sapiens
ggcctgtgcagcagccca

SEQ ID NO: 6327734 - DNA, 20 bp, Homo sapiens
ggcctgtgcagcagcccagc

SEQ ID NO: 6327735 - DNA, 21 bp, Homo sapiens
ggcctgtgccagcaccacagc

SEQ ID NO: 6327736 - DNA, 23 bp, Homo sapiens
ggcctgtgccagcaccacagccg

SEQ ID NO: 6327737 - DNA, 13 bp, Homo sapiens
ggcctgtgctctg

SEQ ID NO: 6327738 - DNA, 17 bp, Homo sapiens
ggcctgtgctgcatgcg

SEQ ID NO: 6327739 - DNA, 15 bp, Homo sapiens
ggcctgtgctgggcc

SEQ ID NO: 6327740 - DNA, 17 bp, Homo sapiens
ggcctgtgctgggccag

SEQ ID NO: 6327741 - DNA, 16 bp, Homo sapiens
ggcctgtggaatgagt

SEQ ID NO: 6327742 - DNA, 16 bp, Homo sapiens
ggcctgtggctccctt

SEQ ID NO: 6327743 - DNA, 19 bp, Homo sapiens
ggcctgtgggcctcacctg

SEQ ID NO: 6327744 - DNA, 14 bp, Homo sapiens
ggcctgtggggagc

SEQ ID NO: 6327745 - DNA, 20 bp, Homo sapiens
ggcctgtgggtctctgaagg

SEQ ID NO: 6327746 - DNA, 22 bp, Homo sapiens
ggcctgtgggtttgggtgcctc

SEQ ID NO: 6327747 - DNA, 18 bp, Homo sapiens
ggcctgtggtggctcccc

SEQ ID NO: 6327748 - DNA, 20 bp, Homo sapiens
ggcctgtggtggctccccct

SEQ ID NO: 6327749 - DNA, 20 bp, Homo sapiens
ggcctgtgtagctgtgacct

SEQ ID NO: 6327750 - DNA, 23 bp, Homo sapiens
ggcctgtgtagctgtgacctgct

SEQ ID NO: 6327751 - DNA, 15 bp, Homo sapiens
ggcctgtgtccagca

SEQ ID NO: 6327752 - DNA, 18 bp, Homo sapiens
ggcctgtgtccagcagct

SEQ ID NO: 6327753 - DNA, 19 bp, Homo sapiens
ggcctgtgtccagcagctg

SEQ ID NO: 6327754 - DNA, 22 bp, Homo sapiens
ggcctgtgtccagcagctgcgg

SEQ ID NO: 6327755 - DNA, 21 bp, Homo sapiens
ggcctgtgtcccatgacccac

SEQ ID NO: 6327756 - DNA, 23 bp, Homo sapiens
ggcctgtgtggaggcctcaggga

SEQ ID NO: 6327757 - DNA, 18 bp, Homo sapiens
ggcctgtgtggccacttc

SEQ ID NO: 6327758 - DNA, 18 bp, Homo sapiens
ggcctgtgtgtgggtggg

SEQ ID NO: 6327759 - DNA, 22 bp, Homo sapiens
ggcctgtgtgttgccaggcagg

SEQ ID NO: 6327760 - DNA, 23 bp, Homo sapiens
ggcctgtgtgttgccaggcaggc

SEQ ID NO: 6327761 - DNA, 18 bp, Homo sapiens
ggcctgttatgattctga

SEQ ID NO: 6327762 - DNA, 15 bp, Homo sapiens
ggcctgttccctaga

SEQ ID NO: 6327763 - DNA, 14 bp, Homo sapiens
ggcctgttccctga

SEQ ID NO: 6327764 - DNA, 18 bp, Homo sapiens
ggcctgttccctgaggac

SEQ ID NO: 6327765 - DNA, 20 bp, Homo sapiens
ggcctgttccctgaggacct

SEQ ID NO: 6327766 - DNA, 22 bp, Homo sapiens
ggcctgttctgtaggagagact

SEQ ID NO: 6327767 - DNA, 15 bp, Homo sapiens
ggcctgttgctatag

SEQ ID NO: 6327768 - DNA, 19 bp, Homo sapiens
ggcctgttgggcagagctg

SEQ ID NO: 6327769 - DNA, 20 bp, Homo sapiens
ggcctgtttctgcagccctt

SEQ ID NO: 6327770 - DNA, 17 bp, Homo sapiens
ggcctgtttgaaagtaa

SEQ ID NO: 6327771 - DNA, 20 bp, Homo sapiens
ggcctgtttgaaagtaaaaa

SEQ ID NO: 6327772 - DNA, 12 bp, Homo sapiens
ggcctgtttgat

SEQ ID NO: 6327773 - DNA, 20 bp, Homo sapiens
ggcctgtttggtgaggacct

SEQ ID NO: 6327774 - DNA, 22 bp, Homo sapiens
ggccttaaaaggggcccaagcc

SEQ ID NO: 6327775 - DNA, 21 bp, Homo sapiens
ggccttaaaattacttggctt

SEQ ID NO: 6327776 - DNA, 22 bp, Homo sapiens
ggccttaaaattacttggcttt

SEQ ID NO: 6327777 - DNA, 16 bp, Homo sapiens
ggccttaaagagggac

SEQ ID NO: 6327778 - DNA, 19 bp, Homo sapiens
ggccttaacacactggcca

SEQ ID NO: 6327779 - DNA, 16 bp, Homo sapiens
ggccttaactggccct

SEQ ID NO: 6327780 - DNA, 17 bp, Homo sapiens
ggccttaactggccctc

SEQ ID NO: 6327781 - DNA, 18 bp, Homo sapiens
ggccttaactggccctcg

SEQ ID NO: 6327782 - DNA, 22 bp, Homo sapiens
ggccttaactggccctcgggcc

SEQ ID NO: 6327783 - DNA, 16 bp, Homo sapiens
ggccttaatttccttt

SEQ ID NO: 6327784 - DNA, 18 bp, Homo sapiens
ggccttacacctcgttag

SEQ ID NO: 6327785 - DNA, 14 bp, Homo sapiens
ggccttacccctgc

SEQ ID NO: 6327786 - DNA, 14 bp, Homo sapiens
ggccttacctcccc

SEQ ID NO: 6327787 - DNA, 21 bp, Homo sapiens
ggccttagtacggctgctgca

SEQ ID NO: 6327788 - DNA, 22 bp, Homo sapiens
ggccttagtagtcaaaaacaaa

SEQ ID NO: 6327789 - DNA, 16 bp, Homo sapiens
ggccttagtgggccag

SEQ ID NO: 6327790 - DNA, 17 bp, Homo sapiens
ggccttattgcatccca

SEQ ID NO: 6327791 - DNA, 20 bp, Homo sapiens
ggccttcacaatctgtcagt

SEQ ID NO: 6327792 - DNA, 13 bp, Homo sapiens
ggccttcaccaag

SEQ ID NO: 6327793 - DNA, 13 bp, Homo sapiens
ggccttccccagc

SEQ ID NO: 6327794 - DNA, 15 bp, Homo sapiens
ggccttccccagcct

SEQ ID NO: 6327795 - DNA, 20 bp, Homo sapiens
ggccttcccctcccagccct

SEQ ID NO: 6327796 - DNA, 14 bp, Homo sapiens
ggccttcccctggc

SEQ ID NO: 6327797 - DNA, 20 bp, Homo sapiens
ggccttcccctggcactggc

SEQ ID NO: 6327798 - DNA, 21 bp, Homo sapiens
ggccttcccgccggaggccag

SEQ ID NO: 6327799 - DNA, 13 bp, Homo sapiens
ggccttcctgccc

SEQ ID NO: 6327800 - DNA, 16 bp, Homo sapiens
ggccttcctggctttg

SEQ ID NO: 6327801 - DNA, 18 bp, Homo sapiens
ggccttcgtctccatctc

SEQ ID NO: 6327802 - DNA, 17 bp, Homo sapiens
ggccttctaggaatgga

SEQ ID NO: 6327803 - DNA, 21 bp, Homo sapiens
ggccttctaggaatggaggag

SEQ ID NO: 6327804 - DNA, 15 bp, Homo sapiens
ggccttctcagctct

SEQ ID NO: 6327805 - DNA, 18 bp, Homo sapiens
ggccttctcccctcttct

SEQ ID NO: 6327806 - DNA, 20 bp, Homo sapiens
ggccttctcccctcttctga

SEQ ID NO: 6327807 - DNA, 14 bp, Homo sapiens
ggccttctgcctgc

SEQ ID NO: 6327808 - DNA, 16 bp, Homo sapiens
ggccttctgcctgctg

SEQ ID NO: 6327809 - DNA, 15 bp, Homo sapiens
ggccttctgctgccc

SEQ ID NO: 6327810 - DNA, 20 bp, Homo sapiens
ggccttctgctgcccaggcc

SEQ ID NO: 6327811 - DNA, 11 bp, Homo sapiens
ggccttctgtg

SEQ ID NO: 6327812 - DNA, 17 bp, Homo sapiens
ggccttctgtggggctg

SEQ ID NO: 6327813 - DNA, 19 bp, Homo sapiens
ggccttctgtggggctggg

SEQ ID NO: 6327814 - DNA, 22 bp, Homo sapiens
ggccttctttctagagagggaa

SEQ ID NO: 6327815 - DNA, 19 bp, Homo sapiens
ggccttgacttatggctcg

SEQ ID NO: 6327816 - DNA, 15 bp, Homo sapiens
ggccttgagcatctg

SEQ ID NO: 6327817 - DNA, 16 bp, Homo sapiens
ggccttgagcatctgg

SEQ ID NO: 6327818 - DNA, 15 bp, Homo sapiens
ggccttgagtctctg

SEQ ID NO: 6327819 - DNA, 19 bp, Homo sapiens
ggccttgcagctggcccac

SEQ ID NO: 6327820 - DNA, 17 bp, Homo sapiens
ggccttgccagcgagca

SEQ ID NO: 6327821 - DNA, 16 bp, Homo sapiens
ggccttgcccagagat

SEQ ID NO: 6327822 - DNA, 22 bp, Homo sapiens
ggccttgcccgccagcctcagt

SEQ ID NO: 6327823 - DNA, 13 bp, Homo sapiens
ggccttgcccgtc

SEQ ID NO: 6327824 - DNA, 16 bp, Homo sapiens
ggccttgcggaagcca

SEQ ID NO: 6327825 - DNA, 19 bp, Homo sapiens
ggccttgcggaagccatag

SEQ ID NO: 6327826 - DNA, 18 bp, Homo sapiens
ggccttgcggctcctcag

SEQ ID NO: 6327827 - DNA, 14 bp, Homo sapiens
ggccttgctctgag

SEQ ID NO: 6327828 - DNA, 23 bp, Homo sapiens
ggccttgctctgagcacaggtga

SEQ ID NO: 6327829 - DNA, 15 bp, Homo sapiens
ggccttgctgactct

SEQ ID NO: 6327830 - DNA, 21 bp, Homo sapiens
ggccttgctgactctctgagc

SEQ ID NO: 6327831 - DNA, 15 bp, Homo sapiens
ggccttgctgctgct

SEQ ID NO: 6327832 - DNA, 18 bp, Homo sapiens
ggccttgctgctgctgca

SEQ ID NO: 6327833 - DNA, 19 bp, Homo sapiens
ggccttgctgctgctgcac

SEQ ID NO: 6327834 - DNA, 21 bp, Homo sapiens
ggccttgctgctgctgcaccc

SEQ ID NO: 6327835 - DNA, 23 bp, Homo sapiens
ggccttgctgctgctgcacccaa

SEQ ID NO: 6327836 - DNA, 19 bp, Homo sapiens
ggccttgctggatgctgct

SEQ ID NO: 6327837 - DNA, 14 bp, Homo sapiens
ggccttgctggggt

SEQ ID NO: 6327838 - DNA, 20 bp, Homo sapiens
ggccttgctggggtccaggg

SEQ ID NO: 6327839 - DNA, 23 bp, Homo sapiens
ggccttgctggggtccagggctg

SEQ ID NO: 6327840 - DNA, 14 bp, Homo sapiens
ggccttgctgtcat

SEQ ID NO: 6327841 - DNA, 17 bp, Homo sapiens
gtctttcttgaaattga

SEQ ID NO: 6327842 - DNA, 19 bp, Homo sapiens
gtctttctttgctgctgtg

SEQ ID NO: 6327843 - DNA, 21 bp, Homo sapiens
gtctttctttgctgctgtgga

SEQ ID NO: 6327844 - DNA, 19 bp, Homo sapiens
gtctttctttgtcattcag

SEQ ID NO: 6327845 - DNA, 20 bp, Homo sapiens
gtctttctttgtcattcagt

SEQ ID NO: 6327846 - DNA, 22 bp, Homo sapiens
gtctttctttgtcattcagttc

SEQ ID NO: 6327847 - DNA, 19 bp, Homo sapiens
gtctttgaaatatgcatgt

SEQ ID NO: 6327848 - DNA, 12 bp, Homo sapiens
gtctttgaataa

SEQ ID NO: 6327849 - DNA, 13 bp, Homo sapiens
gtctttgaataaa

SEQ ID NO: 6327850 - DNA, 16 bp, Homo sapiens
gtctttgaataaagtc

SEQ ID NO: 6327851 - DNA, 21 bp, Homo sapiens
gtctttgaataaagtctgagt

SEQ ID NO: 6327852 - DNA, 16 bp, Homo sapiens
gtctttgcacatgtga

SEQ ID NO: 6327853 - DNA, 15 bp, Homo sapiens
gtctttgccttctct

SEQ ID NO: 6327854 - DNA, 17 bp, Homo sapiens
gtctttgctcagtggat

SEQ ID NO: 6327855 - DNA, 18 bp, Homo sapiens
gtctttgctgctgctctc

SEQ ID NO: 6327856 - DNA, 18 bp, Homo sapiens
gtctttgctgtttatata

SEQ ID NO: 6327857 - DNA, 19 bp, Homo sapiens
gtctttgctgtttatatat

SEQ ID NO: 6327858 - DNA, 16 bp, Homo sapiens
gtctttggaaaattca

SEQ ID NO: 6327859 - DNA, 18 bp, Homo sapiens
gtctttggagaaatgctt

SEQ ID NO: 6327860 - DNA, 17 bp, Homo sapiens
gtctttggagagctcag

SEQ ID NO: 6327861 - DNA, 17 bp, Homo sapiens
gtctttggaggaacagc

SEQ ID NO: 6327862 - DNA, 22 bp, Homo sapiens
gtctttgggggattcaaatgca

SEQ ID NO: 6327863 - DNA, 22 bp, Homo sapiens
gtctttggggtctacactgcaa

SEQ ID NO: 6327864 - DNA, 16 bp, Homo sapiens
gtctttggttcctcat

SEQ ID NO: 6327865 - DNA, 19 bp, Homo sapiens
gtctttggttcctcatggc

SEQ ID NO: 6327866 - DNA, 12 bp, Homo sapiens
gtctttgtaaga

SEQ ID NO: 6327867 - DNA, 14 bp, Homo sapiens
gtctttgtaagagt

SEQ ID NO: 6327868 - DNA, 15 bp, Homo sapiens
gtctttgtaagagtg

SEQ ID NO: 6327869 - DNA, 22 bp, Homo sapiens
gtctttgtaagagtgtagaagc

SEQ ID NO: 6327870 - DNA, 21 bp, Homo sapiens
gtctttgtaagtcagtgttga

SEQ ID NO: 6327871 - DNA, 16 bp, Homo sapiens
gtctttgtaatgtcac

SEQ ID NO: 6327872 - DNA, 22 bp, Homo sapiens
gtctttgtaatgtcaccacctt

SEQ ID NO: 6327873 - DNA, 15 bp, Homo sapiens
gtctttgtacagaca

SEQ ID NO: 6327874 - DNA, 17 bp, Homo sapiens
gtctttgtatcttccat

SEQ ID NO: 6327875 - DNA, 15 bp, Homo sapiens
gtctttgtccctgtt

SEQ ID NO: 6327876 - DNA, 13 bp, Homo sapiens
gtctttgtgggag

SEQ ID NO: 6327877 - DNA, 23 bp, Homo sapiens
gtctttgtgggagggtaagacaa

SEQ ID NO: 6327878 - DNA, 16 bp, Homo sapiens
gtctttgtgtgctgtg

SEQ ID NO: 6327879 - DNA, 14 bp, Homo sapiens
gtctttgtgtgtta

SEQ ID NO: 6327880 - DNA, 20 bp, Homo sapiens
gtctttgtgtgttatattcc

SEQ ID NO: 6327881 - DNA, 12 bp, Homo sapiens
gtctttgtgttt

SEQ ID NO: 6327882 - DNA, 19 bp, Homo sapiens
gtcttttaaaaactcctgt

SEQ ID NO: 6327883 - DNA, 14 bp, Homo sapiens
gtcttttaccctgt

SEQ ID NO: 6327884 - DNA, 20 bp, Homo sapiens
gtcttttaccctgtgtcaga

SEQ ID NO: 6327885 - DNA, 24 bp, Homo sapiens
gtcttttaggacccttcccttgag

SEQ ID NO: 6327886 - DNA, 22 bp, Homo sapiens
gtcttttagttccaacaaagaa

SEQ ID NO: 6327887 - DNA, 23 bp, Homo sapiens
gtcttttataggaaaaaaactgg

SEQ ID NO: 6327888 - DNA, 18 bp, Homo sapiens
gtcttttatatttgtatc

SEQ ID NO: 6327889 - DNA, 16 bp, Homo sapiens
gtcttttcaaaaggat

SEQ ID NO: 6327890 - DNA, 12 bp, Homo sapiens
gtcttttcaatc

SEQ ID NO: 6327891 - DNA, 23 bp, Homo sapiens
gtcttttcagaagcaagccagac

SEQ ID NO: 6327892 - DNA, 14 bp, Homo sapiens
gtcttttcatctgg

SEQ ID NO: 6327893 - DNA, 20 bp, Homo sapiens
gtcttttccactcctatgga

SEQ ID NO: 6327894 - DNA, 22 bp, Homo sapiens
gtcttttcccctcattgcattt

SEQ ID NO: 6327895 - DNA, 12 bp, Homo sapiens
gtcttttctgct

SEQ ID NO: 6327896 - DNA, 16 bp, Homo sapiens
gtcttttctgggatgt

SEQ ID NO: 6327897 - DNA, 19 bp, Homo sapiens
gtcttttcttgcatgaggc

SEQ ID NO: 6327898 - DNA, 16 bp, Homo sapiens
gtcttttgacatgtgg

SEQ ID NO: 6327899 - DNA, 23 bp, Homo sapiens
gtcttttgagctattcacctcag

SEQ ID NO: 6327900 - DNA, 13 bp, Homo sapiens
gtcttttgcatga

SEQ ID NO: 6327901 - DNA, 22 bp, Homo sapiens
gtcttttgcttttgcccatttt

SEQ ID NO: 6327902 - DNA, 14 bp, Homo sapiens
gtcttttggaggac

SEQ ID NO: 6327903 - DNA, 19 bp, Homo sapiens
gtcttttgtgtcagtgtct

SEQ ID NO: 6327904 - DNA, 15 bp, Homo sapiens
gtcttttgttcgcat

SEQ ID NO: 6327905 - DNA, 13 bp, Homo sapiens
gtcttttgttctc

SEQ ID NO: 6327906 - DNA, 16 bp, Homo sapiens
gtcttttgttctctga

SEQ ID NO: 6327907 - DNA, 18 bp, Homo sapiens
gtctttttaacctcagaa

SEQ ID NO: 6327908 - DNA, 15 bp, Homo sapiens
gtctttttaagctta

SEQ ID NO: 6327909 - DNA, 16 bp, Homo sapiens
gtctttttacattgtg

SEQ ID NO: 6327910 - DNA, 15 bp, Homo sapiens
gtctttttccaaaca

SEQ ID NO: 6327911 - DNA, 14 bp, Homo sapiens
gtctttttcctatg

SEQ ID NO: 6327912 - DNA, 15 bp, Homo sapiens
gtctttttccttcct

SEQ ID NO: 6327913 - DNA, 18 bp, Homo sapiens
gtctttttccttcctgag

SEQ ID NO: 6327914 - DNA, 20 bp, Homo sapiens
gtctttttcgccaaactgtc

SEQ ID NO: 6327915 - DNA, 13 bp, Homo sapiens
gtctttttctagg

SEQ ID NO: 6327916 - DNA, 20 bp, Homo sapiens
gtctttttctgttgtaactt

SEQ ID NO: 6327917 - DNA, 22 bp, Homo sapiens
gtctttttctgttgtaacttat

SEQ ID NO: 6327918 - DNA, 22 bp, Homo sapiens
gtctttttctttttttggtaaa

SEQ ID NO: 6327919 - DNA, 11 bp, Homo sapiens
gtctttttgta

SEQ ID NO: 6327920 - DNA, 14 bp, Homo sapiens
gtctttttgtatct

SEQ ID NO: 6327921 - DNA, 13 bp, Homo sapiens
gtctttttgtttg

SEQ ID NO: 6327922 - DNA, 18 bp, Homo sapiens
gtcttttttaaggctctg

SEQ ID NO: 6327923 - DNA, 13 bp, Homo sapiens
gtcttttttctct

SEQ ID NO: 6327924 - DNA, 17 bp, Homo sapiens
gtcttttttctcttccc

SEQ ID NO: 6327925 - DNA, 16 bp, Homo sapiens
gtcttttttctgggtc

SEQ ID NO: 6327926 - DNA, 13 bp, Homo sapiens
gtctttttttact

SEQ ID NO: 6327927 - DNA, 16 bp, Homo sapiens
gtctttttttgtatag

SEQ ID NO: 6327928 - DNA, 16 bp, Homo sapiens
gtcttttttttaatgt

SEQ ID NO: 6327929 - DNA, 22 bp, Homo sapiens
gtcttttttttaatgtgctgtg

SEQ ID NO: 6327930 - DNA, 18 bp, Homo sapiens
gtcttttttttcatcctt

SEQ ID NO: 6327931 - DNA, 15 bp, Homo sapiens
gtcttttttttcctg

SEQ ID NO: 6327932 - DNA, 19 bp, Homo sapiens
gtcttttttttcctttgaa

SEQ ID NO: 6327933 - DNA, 21 bp, Homo sapiens
gtcttttttttcttcacctca

SEQ ID NO: 6327934 - DNA, 16 bp, Homo sapiens
gtgaaaaaaatgaaat

SEQ ID NO: 6327935 - DNA, 16 bp, Homo sapiens
gtgaaaacagaaaaaa

SEQ ID NO: 6327936 - DNA, 20 bp, Homo sapiens
gtgaaaaccaaccctgtggg

SEQ ID NO: 6327937 - DNA, 13 bp, Homo sapiens
gtgaaaagagcaa

SEQ ID NO: 6327938 - DNA, 14 bp, Homo sapiens
gtgaaaagctccat

SEQ ID NO: 6327939 - DNA, 14 bp, Homo sapiens
gtgaaaataaagca

SEQ ID NO: 6327940 - DNA, 17 bp, Homo sapiens
gtgaaaataaagcagaa

SEQ ID NO: 6327941 - DNA, 23 bp, Homo sapiens
gtgaaaataagaaagaattgcag

SEQ ID NO: 6327942 - DNA, 17 bp, Homo sapiens
gtgaaaataagacaaaa

SEQ ID NO: 6327943 - DNA, 19 bp, Homo sapiens
gtgaaaataggtatacagt

SEQ ID NO: 6327944 - DNA, 15 bp, Homo sapiens
gtgaaaatagtgtaa

SEQ ID NO: 6327945 - DNA, 20 bp, Homo sapiens
gtgaaaatagtgtaagaact

SEQ ID NO: 6327946 - DNA, 13 bp, Homo sapiens
gtgaaaatgcttt

SEQ ID NO: 6327947 - DNA, 21 bp, Homo sapiens
gtgaaaatgctttgaaaatgt

SEQ ID NO: 6327948 - DNA, 17 bp, Homo sapiens
gtgaaaatggtccagga

SEQ ID NO: 6327949 - DNA, 14 bp, Homo sapiens
gtgaaaatgtactg

SEQ ID NO: 6327950 - DNA, 16 bp, Homo sapiens
gtgaaaatgttttatt

SEQ ID NO: 6327951 - DNA, 13 bp, Homo sapiens
gtgaaacacacac

SEQ ID NO: 6327952 - DNA, 17 bp, Homo sapiens
gtgaaacacaccaggct

SEQ ID NO: 6327953 - DNA, 23 bp, Homo sapiens
gtgaaacacaccaggctgtgggc

SEQ ID NO: 6327954 - DNA, 14 bp, Homo sapiens
gtgaaacacagctg

SEQ ID NO: 6327955 - DNA, 16 bp, Homo sapiens
gtgaaacacatgccag

SEQ ID NO: 6327956 - DNA, 23 bp, Homo sapiens
gtgaaacagagaaagaaaaggca

SEQ ID NO: 6327957 - DNA, 21 bp, Homo sapiens
gtgaaacagggcttgtccctc

SEQ ID NO: 6327958 - DNA, 12 bp, Homo sapiens
gtgaaacagtgt

SEQ ID NO: 6327959 - DNA, 18 bp, Homo sapiens
gtgaaacagttgctgtga

SEQ ID NO: 6327960 - DNA, 18 bp, Homo sapiens
gtgaaacattttctccct

SEQ ID NO: 6327961 - DNA, 20 bp, Homo sapiens
gtgaaaccccatctctacta

SEQ ID NO: 6327962 - DNA, 17 bp, Homo sapiens
gtgaaacccccatctct

SEQ ID NO: 6327963 - DNA, 16 bp, Homo sapiens
gtgaaaccctgtctct

SEQ ID NO: 6327964 - DNA, 17 bp, Homo sapiens
gtgaaacctgtgaagct

SEQ ID NO: 6327965 - DNA, 18 bp, Homo sapiens
gtgaaaccttttttaaga

SEQ ID NO: 6327966 - DNA, 22 bp, Homo sapiens
gtgaaaccttttttaagatttt

SEQ ID NO: 6327967 - DNA, 20 bp, Homo sapiens
gtgaaacgactcaaaatgac

SEQ ID NO: 6327968 - DNA, 23 bp, Homo sapiens
gtgaaacgactcaaaatgacagt

SEQ ID NO: 6327969 - DNA, 17 bp, Homo sapiens
gtgaaacgccacaaaaa

SEQ ID NO: 6327970 - DNA, 15 bp, Homo sapiens
gtgaaacggatgagg

SEQ ID NO: 6327971 - DNA, 19 bp, Homo sapiens
gtgaaacgtcccacacttt

SEQ ID NO: 6327972 - DNA, 13 bp, Homo sapiens
gtgaaactcccac

SEQ ID NO: 6327973 - DNA, 12 bp, Homo sapiens
gtgaaactgaga

SEQ ID NO: 6327974 - DNA, 15 bp, Homo sapiens
gtgaaactgagacca

SEQ ID NO: 6327975 - DNA, 16 bp, Homo sapiens
gtgaaacttcctaagt

SEQ ID NO: 6327976 - DNA, 14 bp, Homo sapiens
gtgaaactttcatt

SEQ ID NO: 6327977 - DNA, 21 bp, Homo sapiens
gtgaaacttttctagaattat

SEQ ID NO: 6327978 - DNA, 19 bp, Homo sapiens
gtgaaagaaaataacaata

SEQ ID NO: 6327979 - DNA, 12 bp, Homo sapiens
gtgaaagaaagc

SEQ ID NO: 6327980 - DNA, 22 bp, Homo sapiens
gtgaaagaattatttttgtgtt

SEQ ID NO: 6327981 - DNA, 16 bp, Homo sapiens
gtgaaagataaatgat

SEQ ID NO: 6327982 - DNA, 19 bp, Homo sapiens
gtgaaagatgcaagcacct

SEQ ID NO: 6327983 - DNA, 17 bp, Homo sapiens
gtgaaagctgagaactc

SEQ ID NO: 6327984 - DNA, 21 bp, Homo sapiens
gtgaaagctgagaactcctga

SEQ ID NO: 6327985 - DNA, 13 bp, Homo sapiens
gtgaaagctgcac

SEQ ID NO: 6327986 - DNA, 19 bp, Homo sapiens
gtgaaaggatatgaatctg

SEQ ID NO: 6327987 - DNA, 13 bp, Homo sapiens
gtgaaagggtact

SEQ ID NO: 6327988 - DNA, 17 bp, Homo sapiens
gtgaaagtgccaaaata

SEQ ID NO: 6327989 - DNA, 17 bp, Homo sapiens
gtgaaagtggcaagctc

SEQ ID NO: 6327990 - DNA, 15 bp, Homo sapiens
gtgaaagtgtaaaat

SEQ ID NO: 6327991 - DNA, 14 bp, Homo sapiens
gtgaaataaaatgc

SEQ ID NO: 6327992 - DNA, 19 bp, Homo sapiens
gtgaaataaattctgattc

SEQ ID NO: 6327993 - DNA, 18 bp, Homo sapiens
gtgaaataataaaatgca

SEQ ID NO: 6327994 - DNA, 19 bp, Homo sapiens
gtgaaataataaaatgcaa

SEQ ID NO: 6327995 - DNA, 21 bp, Homo sapiens
gtgaaataataaaatgcaaat

SEQ ID NO: 6327996 - DNA, 21 bp, Homo sapiens
gtgaaataattaaaaaccact

SEQ ID NO: 6327997 - DNA, 20 bp, Homo sapiens
gtgaaataatttttaacttt

SEQ ID NO: 6327998 - DNA, 15 bp, Homo sapiens
gtgaaatacatcctt

SEQ ID NO: 6327999 - DNA, 17 bp, Homo sapiens
gtgaaatagttcaaagc

SEQ ID NO: 6328000 - DNA, 21 bp, Homo sapiens
gtgaaatagttcaaagccaag

SEQ ID NO: 6328001 - DNA, 20 bp, Homo sapiens
gtgaaatccatactgtagac

SEQ ID NO: 6328002 - DNA, 15 bp, Homo sapiens
gtgaaatctgtcttt

SEQ ID NO: 6328003 - DNA, 20 bp, Homo sapiens
gtgaaatctgtgcaataaaa

SEQ ID NO: 6328004 - DNA, 22 bp, Homo sapiens
gtgaaatcttgtttgttactgt

SEQ ID NO: 6328005 - DNA, 20 bp, Homo sapiens
gtgaaatcttttatgtttct

SEQ ID NO: 6328006 - DNA, 15 bp, Homo sapiens
gtgaaatggatacta

SEQ ID NO: 6328007 - DNA, 14 bp, Homo sapiens
gtgaaatggctggg

SEQ ID NO: 6328008 - DNA, 18 bp, Homo sapiens
gtgaaatgtaacatgaag

SEQ ID NO: 6328009 - DNA, 14 bp, Homo sapiens
gtgaaatgtaactg

SEQ ID NO: 6328010 - DNA, 17 bp, Homo sapiens
gtgaaatgtgaaggaaa

SEQ ID NO: 6328011 - DNA, 13 bp, Homo sapiens
gtgaaatgtgcaa

SEQ ID NO: 6328012 - DNA, 18 bp, Homo sapiens
gtgaaattagtattttga

SEQ ID NO: 6328013 - DNA, 17 bp, Homo sapiens
gtgaaattataactatt

SEQ ID NO: 6328014 - DNA, 18 bp, Homo sapiens
gtgaaattataactatta

SEQ ID NO: 6328015 - DNA, 11 bp, Homo sapiens
gtgaaattatg

SEQ ID NO: 6328016 - DNA, 18 bp, Homo sapiens
gtgaaattattcataatt

SEQ ID NO: 6328017 - DNA, 13 bp, Homo sapiens
gtgaaattatttt

SEQ ID NO: 6328018 - DNA, 12 bp, Homo sapiens
gtgaaattccca

SEQ ID NO: 6328019 - DNA, 15 bp, Homo sapiens
gtgaaattctcagag

SEQ ID NO: 6328020 - DNA, 18 bp, Homo sapiens
gtgaaattgatgccagtg

SEQ ID NO: 6328021 - DNA, 13 bp, Homo sapiens
ggccttgcttctc

SEQ ID NO: 6328022 - DNA, 21 bp, Homo sapiens
ggccttgctttgtctggcctc

SEQ ID NO: 6328023 - DNA, 17 bp, Homo sapiens
ggccttggcctggagca

SEQ ID NO: 6328024 - DNA, 18 bp, Homo sapiens
ggccttggcctggagcac

SEQ ID NO: 6328025 - DNA, 20 bp, Homo sapiens
ggccttggccttggggccag

SEQ ID NO: 6328026 - DNA, 15 bp, Homo sapiens
ggccttggctgggcc

SEQ ID NO: 6328027 - DNA, 19 bp, Homo sapiens
ggccttggctgggcctctg

SEQ ID NO: 6328028 - DNA, 14 bp, Homo sapiens
ggccttgggaggac

SEQ ID NO: 6328029 - DNA, 19 bp, Homo sapiens
ggccttgggccctctggtt

SEQ ID NO: 6328030 - DNA, 20 bp, Homo sapiens
ggccttggggccagactggc

SEQ ID NO: 6328031 - DNA, 16 bp, Homo sapiens
ggccttggggtggggg

SEQ ID NO: 6328032 - DNA, 24 bp, Homo sapiens
ggccttggggtgggggccaggcct

SEQ ID NO: 6328033 - DNA, 19 bp, Homo sapiens
ggccttggtggagcagcca

SEQ ID NO: 6328034 - DNA, 21 bp, Homo sapiens
ggccttggtggagcagccaga

SEQ ID NO: 6328035 - DNA, 23 bp, Homo sapiens
ggccttggtggagcagccagagc

SEQ ID NO: 6328036 - DNA, 22 bp, Homo sapiens
ggccttgtcaggacccaggccg

SEQ ID NO: 6328037 - DNA, 18 bp, Homo sapiens
ggccttgtcatcctccct

SEQ ID NO: 6328038 - DNA, 19 bp, Homo sapiens
ggccttgtcatcctccctt

SEQ ID NO: 6328039 - DNA, 22 bp, Homo sapiens
ggccttgtcctacgtccaaggt

SEQ ID NO: 6328040 - DNA, 19 bp, Homo sapiens
ggccttgtcctcagccagt

SEQ ID NO: 6328041 - DNA, 15 bp, Homo sapiens
ggccttgtctgggtg

SEQ ID NO: 6328042 - DNA, 14 bp, Homo sapiens
ggccttgtggtcca

SEQ ID NO: 6328043 - DNA, 20 bp, Homo sapiens
ggccttgtgtgctggcttcc

SEQ ID NO: 6328044 - DNA, 19 bp, Homo sapiens
ggccttgtgtgtcaggccc

SEQ ID NO: 6328045 - DNA, 16 bp, Homo sapiens
ggccttgttctgtcac

SEQ ID NO: 6328046 - DNA, 23 bp, Homo sapiens
ggcctttaaaacgcgtctgcctg

SEQ ID NO: 6328047 - DNA, 14 bp, Homo sapiens
ggcctttcactttt

SEQ ID NO: 6328048 - DNA, 20 bp, Homo sapiens
ggcctttcaggtccaggcca

SEQ ID NO: 6328049 - DNA, 13 bp, Homo sapiens
ggcctttccctgc

SEQ ID NO: 6328050 - DNA, 12 bp, Homo sapiens
ggcctttcctct

SEQ ID NO: 6328051 - DNA, 13 bp, Homo sapiens
ggcctttcctctc

SEQ ID NO: 6328052 - DNA, 14 bp, Homo sapiens
ggcctttcctctct

SEQ ID NO: 6328053 - DNA, 20 bp, Homo sapiens
ggcctttccttccctctctg

SEQ ID NO: 6328054 - DNA, 21 bp, Homo sapiens
ggcctttccttccctctctga

SEQ ID NO: 6328055 - DNA, 17 bp, Homo sapiens
ggcctttctaataaact

SEQ ID NO: 6328056 - DNA, 15 bp, Homo sapiens
ggcctttctcctccc

SEQ ID NO: 6328057 - DNA, 22 bp, Homo sapiens
ggcctttctcctccccacctgt

SEQ ID NO: 6328058 - DNA, 16 bp, Homo sapiens
ggcctttctgtgtgtg

SEQ ID NO: 6328059 - DNA, 15 bp, Homo sapiens
ggcctttgagcctga

SEQ ID NO: 6328060 - DNA, 19 bp, Homo sapiens
ggcctttgcaagatgcttg

SEQ ID NO: 6328061 - DNA, 16 bp, Homo sapiens
ggcctttgccagcaga

SEQ ID NO: 6328062 - DNA, 23 bp, Homo sapiens
ggcctttgcgctcctggcccagc

SEQ ID NO: 6328063 - DNA, 16 bp, Homo sapiens
ggcctttggaggggaa

SEQ ID NO: 6328064 - DNA, 18 bp, Homo sapiens
ggcctttgtgctgcgcct

SEQ ID NO: 6328065 - DNA, 23 bp, Homo sapiens
ggcctttgtgctgcgcctgcagg

SEQ ID NO: 6328066 - DNA, 17 bp, Homo sapiens
ggccttttaacattttg

SEQ ID NO: 6328067 - DNA, 21 bp, Homo sapiens
ggccttttaacattttgttct

SEQ ID NO: 6328068 - DNA, 16 bp, Homo sapiens
ggccttttatgtaatt

SEQ ID NO: 6328069 - DNA, 12 bp, Homo sapiens
ggccttttccta

SEQ ID NO: 6328070 - DNA, 17 bp, Homo sapiens
ggccttttctggcaccg

SEQ ID NO: 6328071 - DNA, 21 bp, Homo sapiens
ggccttttgacggccttcttg

SEQ ID NO: 6328072 - DNA, 18 bp, Homo sapiens
ggccttttgcccggaggc

SEQ ID NO: 6328073 - DNA, 18 bp, Homo sapiens
ggcgaaatccctgctcac

SEQ ID NO: 6328074 - DNA, 22 bp, Homo sapiens
ggcgaaatccctgctcactgca

SEQ ID NO: 6328075 - DNA, 22 bp, Homo sapiens
ggcgaagcctgagcaggcaggg

SEQ ID NO: 6328076 - DNA, 15 bp, Homo sapiens
ggcgaatcatttgtt

SEQ ID NO: 6328077 - DNA, 17 bp, Homo sapiens
ggcgaatctacagaaca

SEQ ID NO: 6328078 - DNA, 21 bp, Homo sapiens
ggcgacaaaatctcctggctt

SEQ ID NO: 6328079 - DNA, 13 bp, Homo sapiens
ggcgacactcagg

SEQ ID NO: 6328080 - DNA, 20 bp, Homo sapiens
ggcgacagagcgagactccg

SEQ ID NO: 6328081 - DNA, 15 bp, Homo sapiens
ggcgaccaccaaagt

SEQ ID NO: 6328082 - DNA, 17 bp, Homo sapiens
ggcgaccaccgcccctg

SEQ ID NO: 6328083 - DNA, 21 bp, Homo sapiens
ggcgaccaccgcccctggccg

SEQ ID NO: 6328084 - DNA, 18 bp, Homo sapiens
ggcgacccctcagtgctc

SEQ ID NO: 6328085 - DNA, 15 bp, Homo sapiens
ggcgactctgcagag

SEQ ID NO: 6328086 - DNA, 13 bp, Homo sapiens
ggcgactggaggc

SEQ ID NO: 6328087 - DNA, 13 bp, Homo sapiens
ggcgactgtcatg

SEQ ID NO: 6328088 - DNA, 12 bp, Homo sapiens
ggcgacttcctc

SEQ ID NO: 6328089 - DNA, 14 bp, Homo sapiens
ggcgagaaaggcct

SEQ ID NO: 6328090 - DNA, 18 bp, Homo sapiens
ggcgagaagggctgcttc

SEQ ID NO: 6328091 - DNA, 19 bp, Homo sapiens
ggcgagacaagcatggaaa

SEQ ID NO: 6328092 - DNA, 15 bp, Homo sapiens
ggcgagaggtgagct

SEQ ID NO: 6328093 - DNA, 15 bp, Homo sapiens
ggcgagcagggcagg

SEQ ID NO: 6328094 - DNA, 21 bp, Homo sapiens
ggcgagccagattaggcctgg

SEQ ID NO: 6328095 - DNA, 23 bp, Homo sapiens
ggcgagccagattaggcctggag

SEQ ID NO: 6328096 - DNA, 15 bp, Homo sapiens
ggcgagcctgactct

SEQ ID NO: 6328097 - DNA, 12 bp, Homo sapiens
ggcgagcctggc

SEQ ID NO: 6328098 - DNA, 12 bp, Homo sapiens
ggcgagctgcag

SEQ ID NO: 6328099 - DNA, 12 bp, Homo sapiens
ggcgaggcagag

SEQ ID NO: 6328100 - DNA, 13 bp, Homo sapiens
ggcgaggcagagg

SEQ ID NO: 6328101 - DNA, 18 bp, Homo sapiens
ggcgaggcccttcctctt

SEQ ID NO: 6328102 - DNA, 20 bp, Homo sapiens
ggcgaggccggagagctggt

SEQ ID NO: 6328103 - DNA, 15 bp, Homo sapiens
ggcgaggcgaagctg

SEQ ID NO: 6328104 - DNA, 13 bp, Homo sapiens
ggcgaggctgccc

SEQ ID NO: 6328105 - DNA, 20 bp, Homo sapiens
ggcgagggaggggaggtggc

SEQ ID NO: 6328106 - DNA, 19 bp, Homo sapiens
ggcgagtcccggagcccca

SEQ ID NO: 6328107 - DNA, 23 bp, Homo sapiens
ggcgagtctggggacctggcact

SEQ ID NO: 6328108 - DNA, 22 bp, Homo sapiens
ggcgagtggtttcggaaaaaaa

SEQ ID NO: 6328109 - DNA, 19 bp, Homo sapiens
ggcgatcaagtccagagcc

SEQ ID NO: 6328110 - DNA, 18 bp, Homo sapiens
ggcgatcacaacgtgcat

SEQ ID NO: 6328111 - DNA, 20 bp, Homo sapiens
ggcgatcacaacgtgcattg

SEQ ID NO: 6328112 - DNA, 22 bp, Homo sapiens
ggcgatccacctgtctcagcct

SEQ ID NO: 6328113 - DNA, 20 bp, Homo sapiens
ggcgatccccgcttcccctt

SEQ ID NO: 6328114 - DNA, 21 bp, Homo sapiens
ggcgatcgcggcggagctggc

SEQ ID NO: 6328115 - DNA, 16 bp, Homo sapiens
ggcgatctcccagggc

SEQ ID NO: 6328116 - DNA, 24 bp, Homo sapiens
ggcgatctcccagggctctctgga

SEQ ID NO: 6328117 - DNA, 23 bp, Homo sapiens
ggcgatgcactcgcactgcaaat

SEQ ID NO: 6328118 - DNA, 18 bp, Homo sapiens
ggcgatgccagccaagct

SEQ ID NO: 6328119 - DNA, 22 bp, Homo sapiens
ggcgcaagcctgtaatcccagc

SEQ ID NO: 6328120 - DNA, 22 bp, Homo sapiens
ggcgcaagcgacacaggctgcc

SEQ ID NO: 6328121 - DNA, 17 bp, Homo sapiens
ggcgcaatctcggctca

SEQ ID NO: 6328122 - DNA, 13 bp, Homo sapiens
ggcgcaccccaca

SEQ ID NO: 6328123 - DNA, 19 bp, Homo sapiens
ggcgcaccccacagctggg

SEQ ID NO: 6328124 - DNA, 18 bp, Homo sapiens
ggcgcacccggcagcccc

SEQ ID NO: 6328125 - DNA, 16 bp, Homo sapiens
ggcgcaccctcccctc

SEQ ID NO: 6328126 - DNA, 18 bp, Homo sapiens
ggcgcaccctcccctccc

SEQ ID NO: 6328127 - DNA, 14 bp, Homo sapiens
ggcgcactgcctct

SEQ ID NO: 6328128 - DNA, 22 bp, Homo sapiens
ggcgcactttcctcctggcaga

SEQ ID NO: 6328129 - DNA, 14 bp, Homo sapiens
ggcgcagagccctc

SEQ ID NO: 6328130 - DNA, 21 bp, Homo sapiens
ggcgcagaggtcccagcccca

SEQ ID NO: 6328131 - DNA, 13 bp, Homo sapiens
ggcgcagcccctg

SEQ ID NO: 6328132 - DNA, 19 bp, Homo sapiens
ggcgcagcccgaagcccag

SEQ ID NO: 6328133 - DNA, 18 bp, Homo sapiens
ggcgcagccctagtggga

SEQ ID NO: 6328134 - DNA, 19 bp, Homo sapiens
ggcgcagccctagtgggag

SEQ ID NO: 6328135 - DNA, 16 bp, Homo sapiens
ggcgcagctgaagcct

SEQ ID NO: 6328136 - DNA, 17 bp, Homo sapiens
ggcgcaggcccagtgac

SEQ ID NO: 6328137 - DNA, 20 bp, Homo sapiens
ggcgcaggcgaccgggcctc

SEQ ID NO: 6328138 - DNA, 21 bp, Homo sapiens
ggcgcagggacatggggcaag

SEQ ID NO: 6328139 - DNA, 23 bp, Homo sapiens
ggcgcagggacatggggcaagcc

SEQ ID NO: 6328140 - DNA, 14 bp, Homo sapiens
ggcgcaggtgggct

SEQ ID NO: 6328141 - DNA, 18 bp, Homo sapiens
ggcgcatgagtatctgtg

SEQ ID NO: 6328142 - DNA, 18 bp, Homo sapiens
ggcgcatgcctcccaggc

SEQ ID NO: 6328143 - DNA, 11 bp, Homo sapiens
ggcgcatgtct

SEQ ID NO: 6328144 - DNA, 13 bp, Homo sapiens
ggcgcatgtctgc

SEQ ID NO: 6328145 - DNA, 15 bp, Homo sapiens
ggcgcatgtctgcac

SEQ ID NO: 6328146 - DNA, 21 bp, Homo sapiens
ggcgcatgtctgcacctccgc

SEQ ID NO: 6328147 - DNA, 21 bp, Homo sapiens
ggcgcatgtgtgtatcaccct

SEQ ID NO: 6328148 - DNA, 23 bp, Homo sapiens
ggcgccaacgttcgatttctacc

SEQ ID NO: 6328149 - DNA, 13 bp, Homo sapiens
ggcgccaggacag

SEQ ID NO: 6328150 - DNA, 17 bp, Homo sapiens
ggcgccaggacagcagc

SEQ ID NO: 6328151 - DNA, 22 bp, Homo sapiens
ggcgccaggggcgggggaccta

SEQ ID NO: 6328152 - DNA, 18 bp, Homo sapiens
ggcgccagggtgctgtcg

SEQ ID NO: 6328153 - DNA, 22 bp, Homo sapiens
ggcgcccaccaccccctcaagc

SEQ ID NO: 6328154 - DNA, 13 bp, Homo sapiens
ggcgcccaccctg

SEQ ID NO: 6328155 - DNA, 16 bp, Homo sapiens
ggcgcccaccctgggc

SEQ ID NO: 6328156 - DNA, 12 bp, Homo sapiens
ggcgcccagcag

SEQ ID NO: 6328157 - DNA, 19 bp, Homo sapiens
ggcgcccagcagcctgcca

SEQ ID NO: 6328158 - DNA, 20 bp, Homo sapiens
ggcgcccagcagcctgccag

SEQ ID NO: 6328159 - DNA, 14 bp, Homo sapiens
ggcgcccagcccag

SEQ ID NO: 6328160 - DNA, 17 bp, Homo sapiens
ggcgcccagcccaggcc

SEQ ID NO: 6328161 - DNA, 20 bp, Homo sapiens
ggcgcccagcccaggcctgg

SEQ ID NO: 6328162 - DNA, 23 bp, Homo sapiens
ggcgcccagcccaggcctggtgg

SEQ ID NO: 6328163 - DNA, 12 bp, Homo sapiens
ggcgcccagggt

SEQ ID NO: 6328164 - DNA, 16 bp, Homo sapiens
ggcgccccaacccgtg

SEQ ID NO: 6328165 - DNA, 15 bp, Homo sapiens
ggcgcccccgcccca

SEQ ID NO: 6328166 - DNA, 18 bp, Homo sapiens
ggcgcccctgcctgtgcc

SEQ ID NO: 6328167 - DNA, 13 bp, Homo sapiens
ggcgccctctgtc

SEQ ID NO: 6328168 - DNA, 14 bp, Homo sapiens
ggcgccctctgtcc

SEQ ID NO: 6328169 - DNA, 11 bp, Homo sapiens
ggcgccctgcg

SEQ ID NO: 6328170 - DNA, 16 bp, Homo sapiens
ggcgccctggaagccg

SEQ ID NO: 6328171 - DNA, 20 bp, Homo sapiens
ggcgccgcaaaccacactgg

SEQ ID NO: 6328172 - DNA, 14 bp, Homo sapiens
ggcgccgcctcgcc

SEQ ID NO: 6328173 - DNA, 21 bp, Homo sapiens
ggcgccgtctccaggggctgc

SEQ ID NO: 6328174 - DNA, 20 bp, Homo sapiens
ggcgccgtgctgggcagccc

SEQ ID NO: 6328175 - DNA, 23 bp, Homo sapiens
ggcgcctcaactctgctgagggt

SEQ ID NO: 6328176 - DNA, 13 bp, Homo sapiens
ggcgcctctgcaa

SEQ ID NO: 6328177 - DNA, 17 bp, Homo sapiens
ggcgcctctgtcctggc

SEQ ID NO: 6328178 - DNA, 19 bp, Homo sapiens
ggcgcctgccctgcccaag

SEQ ID NO: 6328179 - DNA, 23 bp, Homo sapiens
ggcgcctgcgctcctctgcagcc

SEQ ID NO: 6328180 - DNA, 14 bp, Homo sapiens
ggcgcctggaggga

SEQ ID NO: 6328181 - DNA, 17 bp, Homo sapiens
ggcgcctggagggatgc

SEQ ID NO: 6328182 - DNA, 21 bp, Homo sapiens
ggcgcctggagggatgccccc

SEQ ID NO: 6328183 - DNA, 23 bp, Homo sapiens
ggcgcctggagggatgcccccag

SEQ ID NO: 6328184 - DNA, 18 bp, Homo sapiens
ggcgcctgggtcctccca

SEQ ID NO: 6328185 - DNA, 15 bp, Homo sapiens
ggcgcctgtcgggcc

SEQ ID NO: 6328186 - DNA, 17 bp, Homo sapiens
ggcgccttctcggagct

SEQ ID NO: 6328187 - DNA, 13 bp, Homo sapiens
ggcgccttttcag

SEQ ID NO: 6328188 - DNA, 14 bp, Homo sapiens
ggcgccttttcagc

SEQ ID NO: 6328189 - DNA, 18 bp, Homo sapiens
ggcgccttttcagccctt

SEQ ID NO: 6328190 - DNA, 17 bp, Homo sapiens
ggcgcctttttggcctg

SEQ ID NO: 6328191 - DNA, 18 bp, Homo sapiens
ggcgcctttttggcctgt

SEQ ID NO: 6328192 - DNA, 22 bp, Homo sapiens
ggcgcgatctcggctcactgca

SEQ ID NO: 6328193 - DNA, 15 bp, Homo sapiens
ggcgcgcaccgccca

SEQ ID NO: 6328194 - DNA, 20 bp, Homo sapiens
ggcgcgcaccgcccaacccc

SEQ ID NO: 6328195 - DNA, 22 bp, Homo sapiens
ggcgcgcacctgtaatcccagc

SEQ ID NO: 6328196 - DNA, 18 bp, Homo sapiens
ggcgcgcaggcagggaga

SEQ ID NO: 6328197 - DNA, 14 bp, Homo sapiens
ggcgcgcgccccca

SEQ ID NO: 6328198 - DNA, 22 bp, Homo sapiens
gtgaaatttacatcatttcttt

SEQ ID NO: 6328199 - DNA, 13 bp, Homo sapiens
gtgaaatttcatg

SEQ ID NO: 6328200 - DNA, 21 bp, Homo sapiens
gtgaaatttcatgaaaacttt

SEQ ID NO: 6328201 - DNA, 17 bp, Homo sapiens
gtgaaatttgcctctgt

SEQ ID NO: 6328202 - DNA, 18 bp, Homo sapiens
gtgaaatttgcctctgtc

SEQ ID NO: 6328203 - DNA, 13 bp, Homo sapiens
gtgaaattttcag

SEQ ID NO: 6328204 - DNA, 15 bp, Homo sapiens
gtgaaattttcttaa

SEQ ID NO: 6328205 - DNA, 14 bp, Homo sapiens
gtgaaattttggtg

SEQ ID NO: 6328206 - DNA, 13 bp, Homo sapiens
gtgaaatttttca

SEQ ID NO: 6328207 - DNA, 19 bp, Homo sapiens
gtgaacaaaagatgctctt

SEQ ID NO: 6328208 - DNA, 19 bp, Homo sapiens
gtgaacaaatcaaattgct

SEQ ID NO: 6328209 - DNA, 13 bp, Homo sapiens
gtgaacacacaca

SEQ ID NO: 6328210 - DNA, 12 bp, Homo sapiens
gtgaacagccaa

SEQ ID NO: 6328211 - DNA, 15 bp, Homo sapiens
gtgaacagcttgctg

SEQ ID NO: 6328212 - DNA, 16 bp, Homo sapiens
gtgaacatcccttatt

SEQ ID NO: 6328213 - DNA, 20 bp, Homo sapiens
gtgaacattcccagcccagc

SEQ ID NO: 6328214 - DNA, 12 bp, Homo sapiens
gtgaaccaaaga

SEQ ID NO: 6328215 - DNA, 13 bp, Homo sapiens
gtgaaccaactgc

SEQ ID NO: 6328216 - DNA, 13 bp, Homo sapiens
gtgaaccagaggg

SEQ ID NO: 6328217 - DNA, 19 bp, Homo sapiens
gtgaaccatctcagacctt

SEQ ID NO: 6328218 - DNA, 15 bp, Homo sapiens
gtgaaccatgtcagc

SEQ ID NO: 6328219 - DNA, 17 bp, Homo sapiens
gtgaacccaggacaagc

SEQ ID NO: 6328220 - DNA, 20 bp, Homo sapiens
gtgaacccgggaggtggagc

SEQ ID NO: 6328221 - DNA, 14 bp, Homo sapiens
gtgaaccctggggc

SEQ ID NO: 6328222 - DNA, 18 bp, Homo sapiens
gtgaaccctggggcctga

SEQ ID NO: 6328223 - DNA, 13 bp, Homo sapiens
gtgaacgctgtga

SEQ ID NO: 6328224 - DNA, 17 bp, Homo sapiens
gtgaacgctgtgatgct

SEQ ID NO: 6328225 - DNA, 20 bp, Homo sapiens
gtgaacgctgtgatgctgtg

SEQ ID NO: 6328226 - DNA, 15 bp, Homo sapiens
gtgaacgtggactcc

SEQ ID NO: 6328227 - DNA, 21 bp, Homo sapiens
gtgaactatatcagtagtgta

SEQ ID NO: 6328228 - DNA, 22 bp, Homo sapiens
gtgaactcaccctgggagccag

SEQ ID NO: 6328229 - DNA, 17 bp, Homo sapiens
gtgaactcagccaagca

SEQ ID NO: 6328230 - DNA, 19 bp, Homo sapiens
gtgaactcagccaagcaca

SEQ ID NO: 6328231 - DNA, 12 bp, Homo sapiens
gtgaactccagg

SEQ ID NO: 6328232 - DNA, 14 bp, Homo sapiens
gtgaactccaggca

SEQ ID NO: 6328233 - DNA, 15 bp, Homo sapiens
gtgaactccatcatt

SEQ ID NO: 6328234 - DNA, 15 bp, Homo sapiens
gtgaactgaagcaga

SEQ ID NO: 6328235 - DNA, 13 bp, Homo sapiens
gtgaactgacagg

SEQ ID NO: 6328236 - DNA, 13 bp, Homo sapiens
gtgaactgagact

SEQ ID NO: 6328237 - DNA, 18 bp, Homo sapiens
gtgaactgataatttttg

SEQ ID NO: 6328238 - DNA, 17 bp, Homo sapiens
gtgaactgatcatgttt

SEQ ID NO: 6328239 - DNA, 15 bp, Homo sapiens
gtgaactgcaaagct

SEQ ID NO: 6328240 - DNA, 18 bp, Homo sapiens
gtgaactgcgtgccagtg

SEQ ID NO: 6328241 - DNA, 13 bp, Homo sapiens
gtgaactggaaga

SEQ ID NO: 6328242 - DNA, 15 bp, Homo sapiens
gtgaactggaagaaa

SEQ ID NO: 6328243 - DNA, 18 bp, Homo sapiens
gtgaactggaagaaagca

SEQ ID NO: 6328244 - DNA, 13 bp, Homo sapiens
gtgaactgggcat

SEQ ID NO: 6328245 - DNA, 21 bp, Homo sapiens
gtgaactgtgagggtaaaggc

SEQ ID NO: 6328246 - DNA, 22 bp, Homo sapiens
gtgaactgtgtgtgaatctgct

SEQ ID NO: 6328247 - DNA, 18 bp, Homo sapiens
gtgaacttcttgaatcta

SEQ ID NO: 6328248 - DNA, 16 bp, Homo sapiens
gtgaacttgactgggt

SEQ ID NO: 6328249 - DNA, 23 bp, Homo sapiens
gtgaacttgatgttcctgggatg

SEQ ID NO: 6328250 - DNA, 16 bp, Homo sapiens
gtgaacttgattttaa

SEQ ID NO: 6328251 - DNA, 17 bp, Homo sapiens
gtgaacttgggccactg

SEQ ID NO: 6328252 - DNA, 20 bp, Homo sapiens
gtgaacttggggaacaaggg

SEQ ID NO: 6328253 - DNA, 21 bp, Homo sapiens
gtgaacttggtgcctaatgtt

SEQ ID NO: 6328254 - DNA, 21 bp, Homo sapiens
gtgaacttgtagctgtaaaac

SEQ ID NO: 6328255 - DNA, 15 bp, Homo sapiens
gtgaactttattaaa

SEQ ID NO: 6328256 - DNA, 19 bp, Homo sapiens
gtgaactttctcagcatat

SEQ ID NO: 6328257 - DNA, 12 bp, Homo sapiens
gtgaacttttct

SEQ ID NO: 6328258 - DNA, 16 bp, Homo sapiens
gtgaacttttgtaatt

SEQ ID NO: 6328259 - DNA, 23 bp, Homo sapiens
gtgaagaaaagtgaatgctcaag

SEQ ID NO: 6328260 - DNA, 12 bp, Homo sapiens
gtgaagaaataa

SEQ ID NO: 6328261 - DNA, 15 bp, Homo sapiens
gtgaagaaataagta

SEQ ID NO: 6328262 - DNA, 15 bp, Homo sapiens
gtgaagaaatggaat

SEQ ID NO: 6328263 - DNA, 14 bp, Homo sapiens
gtgaagaatacttc

SEQ ID NO: 6328264 - DNA, 23 bp, Homo sapiens
gtgaagaatccttttgtagaatg

SEQ ID NO: 6328265 - DNA, 21 bp, Homo sapiens
gtgaagaatttatctgtgaat

SEQ ID NO: 6328266 - DNA, 23 bp, Homo sapiens
gtgaagacaatgacttactgtac

SEQ ID NO: 6328267 - DNA, 23 bp, Homo sapiens
gtgaagacactacagaggattct

SEQ ID NO: 6328268 - DNA, 19 bp, Homo sapiens
gtgaagacagagcagatca

SEQ ID NO: 6328269 - DNA, 19 bp, Homo sapiens
gtgaagaccagagcagttt

SEQ ID NO: 6328270 - DNA, 14 bp, Homo sapiens
gtgaagactccaga

SEQ ID NO: 6328271 - DNA, 21 bp, Homo sapiens
gtgaagagaatgtattctgta

SEQ ID NO: 6328272 - DNA, 14 bp, Homo sapiens
gtgaagaggggcag

SEQ ID NO: 6328273 - DNA, 19 bp, Homo sapiens
gtgaagaggggcagccctt

SEQ ID NO: 6328274 - DNA, 13 bp, Homo sapiens
gtgaagaggtctg

SEQ ID NO: 6328275 - DNA, 15 bp, Homo sapiens
gtgaagaggtctgat

SEQ ID NO: 6328276 - DNA, 18 bp, Homo sapiens
gtgaagaggtctgattgg

SEQ ID NO: 6328277 - DNA, 22 bp, Homo sapiens
gtgaagaggtctgattggctgc

SEQ ID NO: 6328278 - DNA, 16 bp, Homo sapiens
gtgaagagtttcacaa

SEQ ID NO: 6328279 - DNA, 17 bp, Homo sapiens
gtgaagataatttgcat

SEQ ID NO: 6328280 - DNA, 19 bp, Homo sapiens
gtgaagatctcactctgcc

SEQ ID NO: 6328281 - DNA, 14 bp, Homo sapiens
gtgaagatgctgta

SEQ ID NO: 6328282 - DNA, 18 bp, Homo sapiens
gtgaagcaccaagctcaa

SEQ ID NO: 6328283 - DNA, 17 bp, Homo sapiens
gtgaagcagcactgtga

SEQ ID NO: 6328284 - DNA, 16 bp, Homo sapiens
gtgaagcagtgcctcg

SEQ ID NO: 6328285 - DNA, 22 bp, Homo sapiens
gtgaagcagtgcctcgaggcac

SEQ ID NO: 6328286 - DNA, 23 bp, Homo sapiens
gtgaagcagtgcctcgaggcacc

SEQ ID NO: 6328287 - DNA, 20 bp, Homo sapiens
gtgaagcctggagctttcct

SEQ ID NO: 6328288 - DNA, 16 bp, Homo sapiens
gtgaagctcacactga

SEQ ID NO: 6328289 - DNA, 22 bp, Homo sapiens
gtgaagctgaaccccctccaga

SEQ ID NO: 6328290 - DNA, 12 bp, Homo sapiens
gtgaagctgggg

SEQ ID NO: 6328291 - DNA, 23 bp, Homo sapiens
gtgaagctggggacagctttcct

SEQ ID NO: 6328292 - DNA, 18 bp, Homo sapiens
gtgaaggaaaaacatgct

SEQ ID NO: 6328293 - DNA, 13 bp, Homo sapiens
gtgaaggacatga

SEQ ID NO: 6328294 - DNA, 15 bp, Homo sapiens
gtgaaggacatgaga

SEQ ID NO: 6328295 - DNA, 12 bp, Homo sapiens
gtgaaggaccct

SEQ ID NO: 6328296 - DNA, 17 bp, Homo sapiens
gtgaaggaccctggctc

SEQ ID NO: 6328297 - DNA, 12 bp, Homo sapiens
gtgaaggactta

SEQ ID NO: 6328298 - DNA, 16 bp, Homo sapiens
gtgaaggaggctccag

SEQ ID NO: 6328299 - DNA, 21 bp, Homo sapiens
gtgaaggaggctccaggcagc

SEQ ID NO: 6328300 - DNA, 23 bp, Homo sapiens
gtgaaggatccaggaatatgaca

SEQ ID NO: 6328301 - DNA, 17 bp, Homo sapiens
gtgaaggatctgtccga

SEQ ID NO: 6328302 - DNA, 13 bp, Homo sapiens
gtgaaggctggca

SEQ ID NO: 6328303 - DNA, 14 bp, Homo sapiens
gtgaaggctggcat

SEQ ID NO: 6328304 - DNA, 14 bp, Homo sapiens
gtgaaggcttctct

SEQ ID NO: 6328305 - DNA, 18 bp, Homo sapiens
gtgaaggcttctctgttc

SEQ ID NO: 6328306 - DNA, 16 bp, Homo sapiens
gtgaagggaaagataa

SEQ ID NO: 6328307 - DNA, 14 bp, Homo sapiens
gtgaagggaagtgg

SEQ ID NO: 6328308 - DNA, 15 bp, Homo sapiens
gtgaagggagaaagg

SEQ ID NO: 6328309 - DNA, 12 bp, Homo sapiens
gtgaagggatgg

SEQ ID NO: 6328310 - DNA, 17 bp, Homo sapiens
gtgaagggatgggggaa

SEQ ID NO: 6328311 - DNA, 13 bp, Homo sapiens
gtgaagggcaccg

SEQ ID NO: 6328312 - DNA, 11 bp, Homo sapiens
gtgaaggggct

SEQ ID NO: 6328313 - DNA, 14 bp, Homo sapiens
gtgaagggtggggt

SEQ ID NO: 6328314 - DNA, 18 bp, Homo sapiens
gtgaagtaacccctcctg

SEQ ID NO: 6328315 - DNA, 19 bp, Homo sapiens
gtgaagtacaataattcat

SEQ ID NO: 6328316 - DNA, 20 bp, Homo sapiens
gtgaagtagcctcttgtgta

SEQ ID NO: 6328317 - DNA, 17 bp, Homo sapiens
gtgaagtatactgtatt

SEQ ID NO: 6328318 - DNA, 17 bp, Homo sapiens
gtgaagtatgcactaat

SEQ ID NO: 6328319 - DNA, 16 bp, Homo sapiens
gtgaagtgaatgaaac

SEQ ID NO: 6328320 - DNA, 13 bp, Homo sapiens
gtgaagtgaggac

SEQ ID NO: 6328321 - DNA, 23 bp, Homo sapiens
gtgaagtgcctgctgggtgccag

SEQ ID NO: 6328322 - DNA, 14 bp, Homo sapiens
gtgaagtgtatatg

SEQ ID NO: 6328323 - DNA, 14 bp, Homo sapiens
gtgaagtgtggctg

SEQ ID NO: 6328324 - DNA, 22 bp, Homo sapiens
gtgaagtgtggctggtgtcccc

SEQ ID NO: 6328325 - DNA, 23 bp, Homo sapiens
gtgaagtgtggctggtgtcccct

SEQ ID NO: 6328326 - DNA, 17 bp, Homo sapiens
gtgaagttacacaatta

SEQ ID NO: 6328327 - DNA, 22 bp, Homo sapiens
gtgaagttacatgcataaaagg

SEQ ID NO: 6328328 - DNA, 21 bp, Homo sapiens
gtgaagttacctcttacattt

SEQ ID NO: 6328329 - DNA, 16 bp, Homo sapiens
gtgaagttaggttctt

SEQ ID NO: 6328330 - DNA, 18 bp, Homo sapiens
gtgaagttttactgtcta

SEQ ID NO: 6328331 - DNA, 18 bp, Homo sapiens
gtgaagttttcttttact

SEQ ID NO: 6328332 - DNA, 18 bp, Homo sapiens
gtgaataaaaattgatga

SEQ ID NO: 6328333 - DNA, 20 bp, Homo sapiens
gtgaataaacttcagcacca

SEQ ID NO: 6328334 - DNA, 16 bp, Homo sapiens
gtgaataaagccacat

SEQ ID NO: 6328335 - DNA, 13 bp, Homo sapiens
gtgaataaagtgc

SEQ ID NO: 6328336 - DNA, 13 bp, Homo sapiens
gtgaataaatgtc

SEQ ID NO: 6328337 - DNA, 16 bp, Homo sapiens
gtgaataaatgtcttg

SEQ ID NO: 6328338 - DNA, 16 bp, Homo sapiens
gtgaataacagactat

SEQ ID NO: 6328339 - DNA, 23 bp, Homo sapiens
gtgaataatacagtatctcaggg

SEQ ID NO: 6328340 - DNA, 17 bp, Homo sapiens
gtgaatacaattaaagg

SEQ ID NO: 6328341 - DNA, 12 bp, Homo sapiens
gtgaatacatgg

SEQ ID NO: 6328342 - DNA, 13 bp, Homo sapiens
gtgaatacatggt

SEQ ID NO: 6328343 - DNA, 17 bp, Homo sapiens
gtgaatacattctttgc

SEQ ID NO: 6328344 - DNA, 18 bp, Homo sapiens
gtgaatacattttgcaca

SEQ ID NO: 6328345 - DNA, 23 bp, Homo sapiens
gtgaataccccaagactcccatg

SEQ ID NO: 6328346 - DNA, 19 bp, Homo sapiens
gtgaatactgctacagcaa

SEQ ID NO: 6328347 - DNA, 21 bp, Homo sapiens
gtgaatactgctacagcaatt

SEQ ID NO: 6328348 - DNA, 14 bp, Homo sapiens
gtgaatagcctggc

SEQ ID NO: 6328349 - DNA, 17 bp, Homo sapiens
gtgaatataaatgtgtg

SEQ ID NO: 6328350 - DNA, 16 bp, Homo sapiens
gtgaatatgagaaata

SEQ ID NO: 6328351 - DNA, 22 bp, Homo sapiens
gtgaatatgcctgtaattcagt

SEQ ID NO: 6328352 - DNA, 15 bp, Homo sapiens
gtgaatatgtgtaac

SEQ ID NO: 6328353 - DNA, 18 bp, Homo sapiens
gtgaatattgtggctccc

SEQ ID NO: 6328354 - DNA, 20 bp, Homo sapiens
gtgaatattgtggctccctg

SEQ ID NO: 6328355 - DNA, 13 bp, Homo sapiens
gtgaatattttca

SEQ ID NO: 6328356 - DNA, 15 bp, Homo sapiens
gtgaatatttttgta

SEQ ID NO: 6328357 - DNA, 17 bp, Homo sapiens
gtgaatcaagggtcagg

SEQ ID NO: 6328358 - DNA, 21 bp, Homo sapiens
gtgaatcaagggtcaggcctt

SEQ ID NO: 6328359 - DNA, 19 bp, Homo sapiens
gtgaatccaggaggcagtg

SEQ ID NO: 6328360 - DNA, 22 bp, Homo sapiens
gtgaatcgcaaggcctgtgctg

SEQ ID NO: 6328361 - DNA, 17 bp, Homo sapiens
gtgaatcgcagctgtgg

SEQ ID NO: 6328362 - DNA, 23 bp, Homo sapiens
gtgaatctgcattttctgggttc

SEQ ID NO: 6328363 - DNA, 18 bp, Homo sapiens
gtgaatctgtctatctgt

SEQ ID NO: 6328364 - DNA, 15 bp, Homo sapiens
gtgaatcttaacatt

SEQ ID NO: 6328365 - DNA, 13 bp, Homo sapiens
gtgaatcttgtct

SEQ ID NO: 6328366 - DNA, 13 bp, Homo sapiens
gtgaatctttctc

SEQ ID NO: 6328367 - DNA, 12 bp, Homo sapiens
gtgaatgaaaga

SEQ ID NO: 6328368 - DNA, 17 bp, Homo sapiens
gtgaatgaaagattaaa

SEQ ID NO: 6328369 - DNA, 19 bp, Homo sapiens
gtgaatgaaagattaaaca

SEQ ID NO: 6328370 - DNA, 23 bp, Homo sapiens
gtgaatgattcatgttatattta

SEQ ID NO: 6328371 - DNA, 17 bp, Homo sapiens
gtgaatgccaaagccat

SEQ ID NO: 6328372 - DNA, 21 bp, Homo sapiens
gtgaatgccaaagccattctc

SEQ ID NO: 6328373 - DNA, 15 bp, Homo sapiens
gtgaatgccagtgtg

SEQ ID NO: 6328374 - DNA, 19 bp, Homo sapiens
gtgaatgccagtgtgctga

SEQ ID NO: 6328375 - DNA, 21 bp, Homo sapiens
gtgaatgctaagtccatcacc

SEQ ID NO: 6328376 - DNA, 22 bp, Homo sapiens
gtgaatgctgggcccctgctca

SEQ ID NO: 6328377 - DNA, 18 bp, Homo sapiens
gtgaatgcttctgattta

SEQ ID NO: 6328378 - DNA, 21 bp, Homo sapiens
ggcgcgcgcccccaggacccc

SEQ ID NO: 6328379 - DNA, 18 bp, Homo sapiens
ggcgcggcctcccgagga

SEQ ID NO: 6328380 - DNA, 19 bp, Homo sapiens
ggcgcggcctcccgaggag

SEQ ID NO: 6328381 - DNA, 17 bp, Homo sapiens
ggcgcggcggctctgcc

SEQ ID NO: 6328382 - DNA, 16 bp, Homo sapiens
ggcgcggctgggagga

SEQ ID NO: 6328383 - DNA, 19 bp, Homo sapiens
ggcgcgggacaggacttgt

SEQ ID NO: 6328384 - DNA, 19 bp, Homo sapiens
ggcgcgggaggcaccagct

SEQ ID NO: 6328385 - DNA, 12 bp, Homo sapiens
ggcgcggttcag

SEQ ID NO: 6328386 - DNA, 20 bp, Homo sapiens
ggcgcgtctgccccaccctc

SEQ ID NO: 6328387 - DNA, 14 bp, Homo sapiens
ggcgcgtgaggccc

SEQ ID NO: 6328388 - DNA, 12 bp, Homo sapiens
ggcgctaacttg

SEQ ID NO: 6328389 - DNA, 21 bp, Homo sapiens
ggcgctaggggacttggggat

SEQ ID NO: 6328390 - DNA, 16 bp, Homo sapiens
ggcgctattacaaata

SEQ ID NO: 6328391 - DNA, 22 bp, Homo sapiens
ggcgctattgcactccagtctg

SEQ ID NO: 6328392 - DNA, 21 bp, Homo sapiens
ggcgctcagacggcggccagg

SEQ ID NO: 6328393 - DNA, 13 bp, Homo sapiens
ggcgctcagaggc

SEQ ID NO: 6328394 - DNA, 14 bp, Homo sapiens
ggcgctcaggaccc

SEQ ID NO: 6328395 - DNA, 13 bp, Homo sapiens
ggcgctcctccca

SEQ ID NO: 6328396 - DNA, 17 bp, Homo sapiens
ggcgctcctcccagctg

SEQ ID NO: 6328397 - DNA, 18 bp, Homo sapiens
ggcgctcctcccagctgt

SEQ ID NO: 6328398 - DNA, 23 bp, Homo sapiens
ggcgctcgaagttgatctcccca

SEQ ID NO: 6328399 - DNA, 14 bp, Homo sapiens
ggcgctcgctcagg

SEQ ID NO: 6328400 - DNA, 17 bp, Homo sapiens
ggcgctcggtctccacc

SEQ ID NO: 6328401 - DNA, 21 bp, Homo sapiens
ggcgctcggtctccaccccag

SEQ ID NO: 6328402 - DNA, 23 bp, Homo sapiens
ggcgctcggtctccaccccaggg

SEQ ID NO: 6328403 - DNA, 20 bp, Homo sapiens
ggcgctctgccctccctggc

SEQ ID NO: 6328404 - DNA, 21 bp, Homo sapiens
ggcgctctgccctccctggcc

SEQ ID NO: 6328405 - DNA, 23 bp, Homo sapiens
ggcgctctgccctccctggcctc

SEQ ID NO: 6328406 - DNA, 20 bp, Homo sapiens
ggcgctgaggtgtctggcct

SEQ ID NO: 6328407 - DNA, 15 bp, Homo sapiens
ggcgctgcagcctcc

SEQ ID NO: 6328408 - DNA, 12 bp, Homo sapiens
ggcgctgcaggt

SEQ ID NO: 6328409 - DNA, 19 bp, Homo sapiens
ggcgctgcccctggcagcc

SEQ ID NO: 6328410 - DNA, 15 bp, Homo sapiens
ggcgctgcctcaggc

SEQ ID NO: 6328411 - DNA, 14 bp, Homo sapiens
ggcgctgctgggag

SEQ ID NO: 6328412 - DNA, 14 bp, Homo sapiens
ggcgctgcttccag

SEQ ID NO: 6328413 - DNA, 15 bp, Homo sapiens
ggcgctgcttccagg

SEQ ID NO: 6328414 - DNA, 12 bp, Homo sapiens
ggcgctggacac

SEQ ID NO: 6328415 - DNA, 19 bp, Homo sapiens
ggcgctggacacctacagc

SEQ ID NO: 6328416 - DNA, 22 bp, Homo sapiens
ggcgctggacacctacagcagc

SEQ ID NO: 6328417 - DNA, 23 bp, Homo sapiens
ggcgctggacacctacagcagca

SEQ ID NO: 6328418 - DNA, 16 bp, Homo sapiens
ggcgctggagagtcaa

SEQ ID NO: 6328419 - DNA, 19 bp, Homo sapiens
ggcgctggcccagccggcc

SEQ ID NO: 6328420 - DNA, 12 bp, Homo sapiens
ggcgctgtcctg

SEQ ID NO: 6328421 - DNA, 16 bp, Homo sapiens
ggcgcttcccacctgc

SEQ ID NO: 6328422 - DNA, 15 bp, Homo sapiens
ggcgcttggatctgg

SEQ ID NO: 6328423 - DNA, 19 bp, Homo sapiens
ggcgcttggatctggggtg

SEQ ID NO: 6328424 - DNA, 15 bp, Homo sapiens
ggcggaaaccttgca

SEQ ID NO: 6328425 - DNA, 17 bp, Homo sapiens
ggcggaaaccttgcagc

SEQ ID NO: 6328426 - DNA, 19 bp, Homo sapiens
ggcggaaaccttgcagcat

SEQ ID NO: 6328427 - DNA, 15 bp, Homo sapiens
ggcggaacctggctg

SEQ ID NO: 6328428 - DNA, 19 bp, Homo sapiens
ggcggacaaaagggccagg

SEQ ID NO: 6328429 - DNA, 21 bp, Homo sapiens
ggcggagagtacagtgagcca

SEQ ID NO: 6328430 - DNA, 13 bp, Homo sapiens
ggcggagccggcc

SEQ ID NO: 6328431 - DNA, 14 bp, Homo sapiens
ggcggagctccagg

SEQ ID NO: 6328432 - DNA, 14 bp, Homo sapiens
ggcggagctggccc

SEQ ID NO: 6328433 - DNA, 17 bp, Homo sapiens
ggcggagctggccccgc

SEQ ID NO: 6328434 - DNA, 20 bp, Homo sapiens
ggcggagctggccccgccgc

SEQ ID NO: 6328435 - DNA, 14 bp, Homo sapiens
ggcggaggccatgg

SEQ ID NO: 6328436 - DNA, 23 bp, Homo sapiens
ggcggagggatgcaggtgggccg

SEQ ID NO: 6328437 - DNA, 16 bp, Homo sapiens
ggcggaggggatccag

SEQ ID NO: 6328438 - DNA, 20 bp, Homo sapiens
ggcggaggggatccagccac

SEQ ID NO: 6328439 - DNA, 16 bp, Homo sapiens
ggcggaggggcttgga

SEQ ID NO: 6328440 - DNA, 21 bp, Homo sapiens
ggcggaggggcttggagcaga

SEQ ID NO: 6328441 - DNA, 19 bp, Homo sapiens
ggcggagggtctccctggg

SEQ ID NO: 6328442 - DNA, 20 bp, Homo sapiens
ggcggaggtctctgggagcc

SEQ ID NO: 6328443 - DNA, 20 bp, Homo sapiens
ggcggaggttccagtgagcc

SEQ ID NO: 6328444 - DNA, 21 bp, Homo sapiens
ggcggaggttgcagtgagccg

SEQ ID NO: 6328445 - DNA, 16 bp, Homo sapiens
ggcggatcacaaggtc

SEQ ID NO: 6328446 - DNA, 16 bp, Homo sapiens
ggcggatccgcgggga

SEQ ID NO: 6328447 - DNA, 14 bp, Homo sapiens
ggcggcacagcctt

SEQ ID NO: 6328448 - DNA, 13 bp, Homo sapiens
ggcggcagacaca

SEQ ID NO: 6328449 - DNA, 16 bp, Homo sapiens
ggcggcagcagccatc

SEQ ID NO: 6328450 - DNA, 15 bp, Homo sapiens
ggcggcagccccact

SEQ ID NO: 6328451 - DNA, 12 bp, Homo sapiens
ggcggcagctgg

SEQ ID NO: 6328452 - DNA, 13 bp, Homo sapiens
ggcggcagctggg

SEQ ID NO: 6328453 - DNA, 12 bp, Homo sapiens
ggcggcaggcag

SEQ ID NO: 6328454 - DNA, 15 bp, Homo sapiens
ggcggcaggcagaga

SEQ ID NO: 6328455 - DNA, 17 bp, Homo sapiens
ggcggcaggcagagaag

SEQ ID NO: 6328456 - DNA, 15 bp, Homo sapiens
ggcggcagggccagg

SEQ ID NO: 6328457 - DNA, 17 bp, Homo sapiens
ggcggcaggggttggca

SEQ ID NO: 6328458 - DNA, 20 bp, Homo sapiens
ggcggcaggggttggcagcg

SEQ ID NO: 6328459 - DNA, 21 bp, Homo sapiens
ggcggcaggggttggcagcgc

SEQ ID NO: 6328460 - DNA, 16 bp, Homo sapiens
ggcggcatccgagccc

SEQ ID NO: 6328461 - DNA, 19 bp, Homo sapiens
ggcggcatccgagcccctg

SEQ ID NO: 6328462 - DNA, 15 bp, Homo sapiens
ggcggcatgaaccct

SEQ ID NO: 6328463 - DNA, 19 bp, Homo sapiens
ggcggccacgcactgggcc

SEQ ID NO: 6328464 - DNA, 19 bp, Homo sapiens
ggcggccagccctcccagc

SEQ ID NO: 6328465 - DNA, 23 bp, Homo sapiens
ggcggccagggacccccgaggcc

SEQ ID NO: 6328466 - DNA, 14 bp, Homo sapiens
ggcggccagggcgg

SEQ ID NO: 6328467 - DNA, 18 bp, Homo sapiens
ggcggccagggcggccag

SEQ ID NO: 6328468 - DNA, 18 bp, Homo sapiens
ggcggcccaagcccgact

SEQ ID NO: 6328469 - DNA, 20 bp, Homo sapiens
ggcggcccacgccagctggc

SEQ ID NO: 6328470 - DNA, 18 bp, Homo sapiens
ggcggccccaactcgggc

SEQ ID NO: 6328471 - DNA, 13 bp, Homo sapiens
ggcggccccagca

SEQ ID NO: 6328472 - DNA, 14 bp, Homo sapiens
ggcggcccctcagc

SEQ ID NO: 6328473 - DNA, 16 bp, Homo sapiens
ggcggcccctcagcct

SEQ ID NO: 6328474 - DNA, 18 bp, Homo sapiens
ggcggcccctctgttctg

SEQ ID NO: 6328475 - DNA, 15 bp, Homo sapiens
ggcggcccggccagc

SEQ ID NO: 6328476 - DNA, 19 bp, Homo sapiens
ggcggcccggccggagggc

SEQ ID NO: 6328477 - DNA, 19 bp, Homo sapiens
ggcggcccgtggacacccc

SEQ ID NO: 6328478 - DNA, 17 bp, Homo sapiens
ggcggccctaagccact

SEQ ID NO: 6328479 - DNA, 15 bp, Homo sapiens
ggcggccctggggag

SEQ ID NO: 6328480 - DNA, 23 bp, Homo sapiens
ggcggccctggggaggggtggtg

SEQ ID NO: 6328481 - DNA, 17 bp, Homo sapiens
ggcggcccttctgactg

SEQ ID NO: 6328482 - DNA, 21 bp, Homo sapiens
ggcggcccttctgactgttta

SEQ ID NO: 6328483 - DNA, 22 bp, Homo sapiens
ggcggcctatgacttgggcacc

SEQ ID NO: 6328484 - DNA, 12 bp, Homo sapiens
ggcggcctccat

SEQ ID NO: 6328485 - DNA, 14 bp, Homo sapiens
ggcggcctgcagac

SEQ ID NO: 6328486 - DNA, 14 bp, Homo sapiens
ggcggcctgcagtg

SEQ ID NO: 6328487 - DNA, 20 bp, Homo sapiens
ggcggcgttttggacccgcg

SEQ ID NO: 6328488 - DNA, 20 bp, Homo sapiens
ggcggctactcagcagccct

SEQ ID NO: 6328489 - DNA, 22 bp, Homo sapiens
ggcggctactcagcagccctcc

SEQ ID NO: 6328490 - DNA, 14 bp, Homo sapiens
ggcggctactctgg

SEQ ID NO: 6328491 - DNA, 13 bp, Homo sapiens
ggcggctcctcct

SEQ ID NO: 6328492 - DNA, 19 bp, Homo sapiens
ggcggctctagccccagcg

SEQ ID NO: 6328493 - DNA, 12 bp, Homo sapiens
ggcggctctgcc

SEQ ID NO: 6328494 - DNA, 18 bp, Homo sapiens
ggcggctgagagccccag

SEQ ID NO: 6328495 - DNA, 15 bp, Homo sapiens
ggcggctgcacaaca

SEQ ID NO: 6328496 - DNA, 17 bp, Homo sapiens
ggcggctgccgactccc

SEQ ID NO: 6328497 - DNA, 20 bp, Homo sapiens
ggcggctggggtcccagcag

SEQ ID NO: 6328498 - DNA, 19 bp, Homo sapiens
ggcgggaaccctctggggc

SEQ ID NO: 6328499 - DNA, 22 bp, Homo sapiens
ggcgggaaccctctggggccct

SEQ ID NO: 6328500 - DNA, 19 bp, Homo sapiens
ggcgggaagggtgggccct

SEQ ID NO: 6328501 - DNA, 20 bp, Homo sapiens
ggcgggaagggtgggccctg

SEQ ID NO: 6328502 - DNA, 19 bp, Homo sapiens
ggcgggacacaggctccaa

SEQ ID NO: 6328503 - DNA, 18 bp, Homo sapiens
ggcgggacagtgctgcag

SEQ ID NO: 6328504 - DNA, 16 bp, Homo sapiens
ggcgggacccaggcac

SEQ ID NO: 6328505 - DNA, 19 bp, Homo sapiens
ggcgggacccaggcacctg

SEQ ID NO: 6328506 - DNA, 16 bp, Homo sapiens
ggcgggagatggaccc

SEQ ID NO: 6328507 - DNA, 15 bp, Homo sapiens
ggcgggagtgggggc

SEQ ID NO: 6328508 - DNA, 17 bp, Homo sapiens
ggcgggagtgggggctg

SEQ ID NO: 6328509 - DNA, 20 bp, Homo sapiens
ggcgggcacacctcctccca

SEQ ID NO: 6328510 - DNA, 13 bp, Homo sapiens
ggcgggcacctgt

SEQ ID NO: 6328511 - DNA, 17 bp, Homo sapiens
ggcgggcagagggctgg

SEQ ID NO: 6328512 - DNA, 11 bp, Homo sapiens
ggcgggcagcc

SEQ ID NO: 6328513 - DNA, 12 bp, Homo sapiens
ggcgggcagccc

SEQ ID NO: 6328514 - DNA, 16 bp, Homo sapiens
ggcgggcagcccagcc

SEQ ID NO: 6328515 - DNA, 14 bp, Homo sapiens
ggcgggcagcccct

SEQ ID NO: 6328516 - DNA, 15 bp, Homo sapiens
ggcgggcagcccctg

SEQ ID NO: 6328517 - DNA, 15 bp, Homo sapiens
ggcgggccagggtgg

SEQ ID NO: 6328518 - DNA, 22 bp, Homo sapiens
ggcgggccagggtgggaagaga

SEQ ID NO: 6328519 - DNA, 12 bp, Homo sapiens
ggcgggcccact

SEQ ID NO: 6328520 - DNA, 16 bp, Homo sapiens
ggcgggccctggagct

SEQ ID NO: 6328521 - DNA, 13 bp, Homo sapiens
ggcgggctcagag

SEQ ID NO: 6328522 - DNA, 15 bp, Homo sapiens
ggcgggctgatgtct

SEQ ID NO: 6328523 - DNA, 22 bp, Homo sapiens
ggcggggaggaggaacgggcag

SEQ ID NO: 6328524 - DNA, 12 bp, Homo sapiens
ggcggggcacta

SEQ ID NO: 6328525 - DNA, 13 bp, Homo sapiens
ggcggggcaggag

SEQ ID NO: 6328526 - DNA, 13 bp, Homo sapiens
ggcggggcagtat

SEQ ID NO: 6328527 - DNA, 17 bp, Homo sapiens
ggcggggccgggactgg

SEQ ID NO: 6328528 - DNA, 14 bp, Homo sapiens
ggcggggctatgcc

SEQ ID NO: 6328529 - DNA, 14 bp, Homo sapiens
ggcggggctcctcc

SEQ ID NO: 6328530 - DNA, 15 bp, Homo sapiens
ggcggggctgtcacc

SEQ ID NO: 6328531 - DNA, 14 bp, Homo sapiens
ggcgggggagcctg

SEQ ID NO: 6328532 - DNA, 17 bp, Homo sapiens
ggcgggggagcctggag

SEQ ID NO: 6328533 - DNA, 17 bp, Homo sapiens
ggcgggggatcctggag

SEQ ID NO: 6328534 - DNA, 23 bp, Homo sapiens
ggcgggggatcctggagcccctg

SEQ ID NO: 6328535 - DNA, 12 bp, Homo sapiens
ggcgggggtggc

SEQ ID NO: 6328536 - DNA, 19 bp, Homo sapiens
ggcgggggtggcggcggcc

SEQ ID NO: 6328537 - DNA, 16 bp, Homo sapiens
ggcggggtgcctgctg

SEQ ID NO: 6328538 - DNA, 22 bp, Homo sapiens
ggcgggtatgaagtgtggggcg

SEQ ID NO: 6328539 - DNA, 10 bp, Homo sapiens
ggcgggtgac

SEQ ID NO: 6328540 - DNA, 15 bp, Homo sapiens
ggcgggtgacgccca

SEQ ID NO: 6328541 - DNA, 16 bp, Homo sapiens
ggcgggtgatggccag

SEQ ID NO: 6328542 - DNA, 20 bp, Homo sapiens
ggcgggtggatcacgaggtc

SEQ ID NO: 6328543 - DNA, 20 bp, Homo sapiens
ggcgggtggatcatgaggtc

SEQ ID NO: 6328544 - DNA, 22 bp, Homo sapiens
ggcgggtggatcatgaggtcag

SEQ ID NO: 6328545 - DNA, 24 bp, Homo sapiens
ggcgggtgtggagaccaggctcct

SEQ ID NO: 6328546 - DNA, 15 bp, Homo sapiens
ggcggtatccagagg

SEQ ID NO: 6328547 - DNA, 17 bp, Homo sapiens
ggcggtatccagaggtg

SEQ ID NO: 6328548 - DNA, 21 bp, Homo sapiens
ggcggtatccagaggtgaggg

SEQ ID NO: 6328549 - DNA, 22 bp, Homo sapiens
ggcggtcaataattgtggagag

SEQ ID NO: 6328550 - DNA, 23 bp, Homo sapiens
ggcggtcacagcatggaggagga

SEQ ID NO: 6328551 - DNA, 16 bp, Homo sapiens
ggcggtcactgcccac

SEQ ID NO: 6328552 - DNA, 18 bp, Homo sapiens
ggcggtccagaaggagca

SEQ ID NO: 6328553 - DNA, 21 bp, Homo sapiens
ggcggtccccatccccaccag

SEQ ID NO: 6328554 - DNA, 16 bp, Homo sapiens
ggcggtcctgcacaga

SEQ ID NO: 6328555 - DNA, 17 bp, Homo sapiens
ggcggtcctgcacagat

SEQ ID NO: 6328556 - DNA, 19 bp, Homo sapiens
ggcggtcggatctacagaa

SEQ ID NO: 6328557 - DNA, 20 bp, Homo sapiens
ggcggtcttcaacatcctgc

SEQ ID NO: 6328558 - DNA, 16 bp, Homo sapiens
gtgaatggaagcaaag

SEQ ID NO: 6328559 - DNA, 19 bp, Homo sapiens
gtgaatggaagcaaagtgc

SEQ ID NO: 6328560 - DNA, 12 bp, Homo sapiens
gtgaatggaggc

SEQ ID NO: 6328561 - DNA, 13 bp, Homo sapiens
gtgaatggaggca

SEQ ID NO: 6328562 - DNA, 14 bp, Homo sapiens
gtgaatggaggcag

SEQ ID NO: 6328563 - DNA, 20 bp, Homo sapiens
gtgaatggattggattattt

SEQ ID NO: 6328564 - DNA, 16 bp, Homo sapiens
gtgaatggctgtgccc

SEQ ID NO: 6328565 - DNA, 19 bp, Homo sapiens
gtgaatggctttgtataga

SEQ ID NO: 6328566 - DNA, 15 bp, Homo sapiens
gtgaatgggaaaaga

SEQ ID NO: 6328567 - DNA, 16 bp, Homo sapiens
gtgaatggtctctgtc

SEQ ID NO: 6328568 - DNA, 22 bp, Homo sapiens
gtgaatgtagcttccacctcat

SEQ ID NO: 6328569 - DNA, 11 bp, Homo sapiens
gtgaatgtgag

SEQ ID NO: 6328570 - DNA, 17 bp, Homo sapiens
gtgaatgttgtcctgtg

SEQ ID NO: 6328571 - DNA, 23 bp, Homo sapiens
gtgaatgtttagtgtgctgctgt

SEQ ID NO: 6328572 - DNA, 19 bp, Homo sapiens
gtgaattaatgatgaggat

SEQ ID NO: 6328573 - DNA, 22 bp, Homo sapiens
gtgaattacactcaaggaaaag

SEQ ID NO: 6328574 - DNA, 18 bp, Homo sapiens
gtgaattaggctgtaact

SEQ ID NO: 6328575 - DNA, 21 bp, Homo sapiens
gtgaattaggctgtaactact

SEQ ID NO: 6328576 - DNA, 17 bp, Homo sapiens
gtgaattattgacactg

SEQ ID NO: 6328577 - DNA, 19 bp, Homo sapiens
gtgaattattgacactgaa

SEQ ID NO: 6328578 - DNA, 20 bp, Homo sapiens
gtgaattcctgcatttgata

SEQ ID NO: 6328579 - DNA, 22 bp, Homo sapiens
gtgaattcttgaaggaaaatga

SEQ ID NO: 6328580 - DNA, 17 bp, Homo sapiens
gtgaattgataataaac

SEQ ID NO: 6328581 - DNA, 12 bp, Homo sapiens
gtgaattgcttt

SEQ ID NO: 6328582 - DNA, 18 bp, Homo sapiens
gtgaattggcttccttga

SEQ ID NO: 6328583 - DNA, 17 bp, Homo sapiens
gtgaatttaagcatgag

SEQ ID NO: 6328584 - DNA, 15 bp, Homo sapiens
gtgaatttgaatctc

SEQ ID NO: 6328585 - DNA, 13 bp, Homo sapiens
gtgaatttgaatg

SEQ ID NO: 6328586 - DNA, 14 bp, Homo sapiens
gtgaattttaaaat

SEQ ID NO: 6328587 - DNA, 20 bp, Homo sapiens
gtgaattttaaaatgcaaat

SEQ ID NO: 6328588 - DNA, 12 bp, Homo sapiens
gtgaatttttat

SEQ ID NO: 6328589 - DNA, 13 bp, Homo sapiens
gtgaatttttatt

SEQ ID NO: 6328590 - DNA, 19 bp, Homo sapiens
gtgaatttttattgttgta

SEQ ID NO: 6328591 - DNA, 14 bp, Homo sapiens
gtgaatttttctct

SEQ ID NO: 6328592 - DNA, 16 bp, Homo sapiens
gtgaatttttctctaa

SEQ ID NO: 6328593 - DNA, 11 bp, Homo sapiens
gtgaatttttg

SEQ ID NO: 6328594 - DNA, 16 bp, Homo sapiens
gtgaatttttgcaata

SEQ ID NO: 6328595 - DNA, 17 bp, Homo sapiens
gtgaatttttgcaataa

SEQ ID NO: 6328596 - DNA, 13 bp, Homo sapiens
gtgacaaaaaatt

SEQ ID NO: 6328597 - DNA, 19 bp, Homo sapiens
gtgacaaaatgggaggagg

SEQ ID NO: 6328598 - DNA, 20 bp, Homo sapiens
gtgacaaaatgggaggagga

SEQ ID NO: 6328599 - DNA, 17 bp, Homo sapiens
gtgacaaaattcatttg

SEQ ID NO: 6328600 - DNA, 20 bp, Homo sapiens
gtgacaaaattttataagca

SEQ ID NO: 6328601 - DNA, 12 bp, Homo sapiens
gtgacaaaccat

SEQ ID NO: 6328602 - DNA, 18 bp, Homo sapiens
gtgacaaagactcctctg

SEQ ID NO: 6328603 - DNA, 20 bp, Homo sapiens
gtgacaaagactcctctggg

SEQ ID NO: 6328604 - DNA, 19 bp, Homo sapiens
gtgacaaagccagaggaga

SEQ ID NO: 6328605 - DNA, 21 bp, Homo sapiens
gtgacaaattgtaactacact

SEQ ID NO: 6328606 - DNA, 16 bp, Homo sapiens
gtgacaacacttgtgt

SEQ ID NO: 6328607 - DNA, 17 bp, Homo sapiens
gtgacaaccctggcctc

SEQ ID NO: 6328608 - DNA, 18 bp, Homo sapiens
gtgacaacctttgtgtaa

SEQ ID NO: 6328609 - DNA, 21 bp, Homo sapiens
gtgacaacctttgtgtaataa

SEQ ID NO: 6328610 - DNA, 21 bp, Homo sapiens
gtgacaagcagatactgctgt

SEQ ID NO: 6328611 - DNA, 16 bp, Homo sapiens
gtgacaagctcacaga

SEQ ID NO: 6328612 - DNA, 20 bp, Homo sapiens
gtgacaaggattgctactgt

SEQ ID NO: 6328613 - DNA, 13 bp, Homo sapiens
gtgacaaggcccc

SEQ ID NO: 6328614 - DNA, 18 bp, Homo sapiens
gtgacaaggccccagaga

SEQ ID NO: 6328615 - DNA, 19 bp, Homo sapiens
gtgacaaggccccagagac

SEQ ID NO: 6328616 - DNA, 14 bp, Homo sapiens
gtgacaaggcctgc

SEQ ID NO: 6328617 - DNA, 15 bp, Homo sapiens
gtgacaagtgaagaa

SEQ ID NO: 6328618 - DNA, 19 bp, Homo sapiens
gtgacaagtggagggggtg

SEQ ID NO: 6328619 - DNA, 14 bp, Homo sapiens
gtgacaataaaaca

SEQ ID NO: 6328620 - DNA, 14 bp, Homo sapiens
gtgacacaaacaca

SEQ ID NO: 6328621 - DNA, 21 bp, Homo sapiens
gtgacacaaacacacacaaaa

SEQ ID NO: 6328622 - DNA, 11 bp, Homo sapiens
gtgacacacag

SEQ ID NO: 6328623 - DNA, 22 bp, Homo sapiens
gtgacacactacaccacacaca

SEQ ID NO: 6328624 - DNA, 23 bp, Homo sapiens
gtgacacactacaccacacacaa

SEQ ID NO: 6328625 - DNA, 13 bp, Homo sapiens
gtgacacagacat

SEQ ID NO: 6328626 - DNA, 14 bp, Homo sapiens
gtgacacagacatt

SEQ ID NO: 6328627 - DNA, 15 bp, Homo sapiens
gtgacacagacattt

SEQ ID NO: 6328628 - DNA, 12 bp, Homo sapiens
gtgacacagact

SEQ ID NO: 6328629 - DNA, 20 bp, Homo sapiens
gtgacacagctgagctggcc

SEQ ID NO: 6328630 - DNA, 20 bp, Homo sapiens
gtgacacaggtcagggctca

SEQ ID NO: 6328631 - DNA, 21 bp, Homo sapiens
gtgacacaggtcagggctcag

SEQ ID NO: 6328632 - DNA, 19 bp, Homo sapiens
gtgacaccaataaatgttt

SEQ ID NO: 6328633 - DNA, 17 bp, Homo sapiens
gtgacaccaccactgtg

SEQ ID NO: 6328634 - DNA, 23 bp, Homo sapiens
gtgacacccagagggagtagaat

SEQ ID NO: 6328635 - DNA, 23 bp, Homo sapiens
gtgacaccccccttctgaatgaa

SEQ ID NO: 6328636 - DNA, 14 bp, Homo sapiens
gtgacacctccccc

SEQ ID NO: 6328637 - DNA, 18 bp, Homo sapiens
gtgacacgcttctgagca

SEQ ID NO: 6328638 - DNA, 16 bp, Homo sapiens
gtgacactctccttgc

SEQ ID NO: 6328639 - DNA, 20 bp, Homo sapiens
gtgacactctccttgcagtt

SEQ ID NO: 6328640 - DNA, 19 bp, Homo sapiens
gtgacactctcgtggtatg

SEQ ID NO: 6328641 - DNA, 15 bp, Homo sapiens
gtgacagaaggcccg

SEQ ID NO: 6328642 - DNA, 21 bp, Homo sapiens
gtgacagaaggcccgaggagg

SEQ ID NO: 6328643 - DNA, 22 bp, Homo sapiens
gtgacagaaggcccgaggaggc

SEQ ID NO: 6328644 - DNA, 15 bp, Homo sapiens
gtgacagacaggctc

SEQ ID NO: 6328645 - DNA, 15 bp, Homo sapiens
gtgacagactcctga

SEQ ID NO: 6328646 - DNA, 20 bp, Homo sapiens
gtgacagactcctgaggaca

SEQ ID NO: 6328647 - DNA, 12 bp, Homo sapiens
gtgacagagacc

SEQ ID NO: 6328648 - DNA, 18 bp, Homo sapiens
gtgacagagcgagactcc

SEQ ID NO: 6328649 - DNA, 22 bp, Homo sapiens
gtgacagagcgagactctgtct

SEQ ID NO: 6328650 - DNA, 14 bp, Homo sapiens
gtgacagaggcagc

SEQ ID NO: 6328651 - DNA, 15 bp, Homo sapiens
gtgacagaggcagcc

SEQ ID NO: 6328652 - DNA, 14 bp, Homo sapiens
gtgacagcctctga

SEQ ID NO: 6328653 - DNA, 13 bp, Homo sapiens
gtgacagctgcaa

SEQ ID NO: 6328654 - DNA, 14 bp, Homo sapiens
gtgacaggcagcag

SEQ ID NO: 6328655 - DNA, 23 bp, Homo sapiens
gtgacaggcagtgttcttggggg

SEQ ID NO: 6328656 - DNA, 20 bp, Homo sapiens
gtgacaggctcgtcagccac

SEQ ID NO: 6328657 - DNA, 20 bp, Homo sapiens
gtgacagggaaacctttttt

SEQ ID NO: 6328658 - DNA, 23 bp, Homo sapiens
gtgacagggaaacctttttttga

SEQ ID NO: 6328659 - DNA, 20 bp, Homo sapiens
gtgacagggaagctacaggt

SEQ ID NO: 6328660 - DNA, 19 bp, Homo sapiens
gtgacagggcaagaccctg

SEQ ID NO: 6328661 - DNA, 20 bp, Homo sapiens
gtgacagggccagtggggcc

SEQ ID NO: 6328662 - DNA, 11 bp, Homo sapiens
gtgacagtcat

SEQ ID NO: 6328663 - DNA, 21 bp, Homo sapiens
gtgacagtcatcatcagggcc

SEQ ID NO: 6328664 - DNA, 18 bp, Homo sapiens
gtgacagtgcctcttcca

SEQ ID NO: 6328665 - DNA, 15 bp, Homo sapiens
gtgacagtgcctggg

SEQ ID NO: 6328666 - DNA, 17 bp, Homo sapiens
gtgacagtgcctgggaa

SEQ ID NO: 6328667 - DNA, 17 bp, Homo sapiens
gtgacagtgccttctct

SEQ ID NO: 6328668 - DNA, 18 bp, Homo sapiens
gtgacagtggctgctctg

SEQ ID NO: 6328669 - DNA, 20 bp, Homo sapiens
gtgacagtggctgctctggg

SEQ ID NO: 6328670 - DNA, 22 bp, Homo sapiens
gtgacagtggctgctctgggaa

SEQ ID NO: 6328671 - DNA, 14 bp, Homo sapiens
gtgacagtttccaa

SEQ ID NO: 6328672 - DNA, 16 bp, Homo sapiens
gtgacagtttccaaat

SEQ ID NO: 6328673 - DNA, 23 bp, Homo sapiens
gtgacataatatattctattttt

SEQ ID NO: 6328674 - DNA, 15 bp, Homo sapiens
gtgacatcagtggca

SEQ ID NO: 6328675 - DNA, 17 bp, Homo sapiens
gtgacatcccaggaggg

SEQ ID NO: 6328676 - DNA, 18 bp, Homo sapiens
gtgacatctacctcccga

SEQ ID NO: 6328677 - DNA, 20 bp, Homo sapiens
gtgacatctctattccccac

SEQ ID NO: 6328678 - DNA, 13 bp, Homo sapiens
gtgacatgcggct

SEQ ID NO: 6328679 - DNA, 21 bp, Homo sapiens
gtgacatgcgggctgggcagc

SEQ ID NO: 6328680 - DNA, 17 bp, Homo sapiens
gtgacatggggaaggca

SEQ ID NO: 6328681 - DNA, 22 bp, Homo sapiens
gtgacatggtgcctgagaggca

SEQ ID NO: 6328682 - DNA, 22 bp, Homo sapiens
gtgacatgtctactttttaatt

SEQ ID NO: 6328683 - DNA, 14 bp, Homo sapiens
gtgacatgtctttt

SEQ ID NO: 6328684 - DNA, 20 bp, Homo sapiens
gtgacatgtgcagtgctgta

SEQ ID NO: 6328685 - DNA, 13 bp, Homo sapiens
gtgacattcactg

SEQ ID NO: 6328686 - DNA, 16 bp, Homo sapiens
gtgacatttctcttcc

SEQ ID NO: 6328687 - DNA, 20 bp, Homo sapiens
gtgacatttgtcattttcat

SEQ ID NO: 6328688 - DNA, 23 bp, Homo sapiens
gtgacatttgtcattttcattag

SEQ ID NO: 6328689 - DNA, 19 bp, Homo sapiens
gtgacattttacattaaat

SEQ ID NO: 6328690 - DNA, 19 bp, Homo sapiens
gtgaccaactagacattct

SEQ ID NO: 6328691 - DNA, 14 bp, Homo sapiens
gtgaccaaggagga

SEQ ID NO: 6328692 - DNA, 16 bp, Homo sapiens
gtgaccaccttctgtc

SEQ ID NO: 6328693 - DNA, 19 bp, Homo sapiens
gtgaccaccttctgtcccc

SEQ ID NO: 6328694 - DNA, 17 bp, Homo sapiens
gtgaccactctgtcttg

SEQ ID NO: 6328695 - DNA, 13 bp, Homo sapiens
gtgaccactgaat

SEQ ID NO: 6328696 - DNA, 18 bp, Homo sapiens
gtgaccactgaattcact

SEQ ID NO: 6328697 - DNA, 13 bp, Homo sapiens
gtgaccagaatga

SEQ ID NO: 6328698 - DNA, 21 bp, Homo sapiens
gtgaccagcaccatctctcct

SEQ ID NO: 6328699 - DNA, 16 bp, Homo sapiens
gtgaccagcataccag

SEQ ID NO: 6328700 - DNA, 22 bp, Homo sapiens
gtgaccagcataccagttcttg

SEQ ID NO: 6328701 - DNA, 12 bp, Homo sapiens
gtgaccagccac

SEQ ID NO: 6328702 - DNA, 13 bp, Homo sapiens
gtgaccagccccg

SEQ ID NO: 6328703 - DNA, 14 bp, Homo sapiens
gtgaccaggggtga

SEQ ID NO: 6328704 - DNA, 14 bp, Homo sapiens
gtgaccatctgttt

SEQ ID NO: 6328705 - DNA, 22 bp, Homo sapiens
gtgaccatctgtttgagaatat

SEQ ID NO: 6328706 - DNA, 14 bp, Homo sapiens
gtgaccatgaaaaa

SEQ ID NO: 6328707 - DNA, 11 bp, Homo sapiens
gtgaccatgtt

SEQ ID NO: 6328708 - DNA, 12 bp, Homo sapiens
gtgaccatgttc

SEQ ID NO: 6328709 - DNA, 16 bp, Homo sapiens
gtgaccattattcaca

SEQ ID NO: 6328710 - DNA, 13 bp, Homo sapiens
gtgaccattctgc

SEQ ID NO: 6328711 - DNA, 19 bp, Homo sapiens
gtgacccaagaactcctga

SEQ ID NO: 6328712 - DNA, 22 bp, Homo sapiens
gtgacccaagaactcctgaaat

SEQ ID NO: 6328713 - DNA, 19 bp, Homo sapiens
gtgacccaatgctcctgga

SEQ ID NO: 6328714 - DNA, 16 bp, Homo sapiens
gtgacccacagctctg

SEQ ID NO: 6328715 - DNA, 15 bp, Homo sapiens
gtgacccacttctca

SEQ ID NO: 6328716 - DNA, 12 bp, Homo sapiens
gtgacccagcta

SEQ ID NO: 6328717 - DNA, 23 bp, Homo sapiens
gtgacccagctactgaaccagcc

SEQ ID NO: 6328718 - DNA, 12 bp, Homo sapiens
gtgacccagtgg

SEQ ID NO: 6328719 - DNA, 13 bp, Homo sapiens
gtgaccccagctc

SEQ ID NO: 6328720 - DNA, 14 bp, Homo sapiens
gtgaccccagctcc

SEQ ID NO: 6328721 - DNA, 17 bp, Homo sapiens
gtgaccccagctccagg

SEQ ID NO: 6328722 - DNA, 15 bp, Homo sapiens
gtgaccccagggcac

SEQ ID NO: 6328723 - DNA, 17 bp, Homo sapiens
gtgaccccagggcctgt

SEQ ID NO: 6328724 - DNA, 12 bp, Homo sapiens
gtgaccccaggt

SEQ ID NO: 6328725 - DNA, 17 bp, Homo sapiens
gtgaccccatctctgct

SEQ ID NO: 6328726 - DNA, 20 bp, Homo sapiens
gtgaccccatctctgctgct

SEQ ID NO: 6328727 - DNA, 21 bp, Homo sapiens
gtgaccccatctctgctgctt

SEQ ID NO: 6328728 - DNA, 23 bp, Homo sapiens
gtgacccccactgccgcctcctt

SEQ ID NO: 6328729 - DNA, 17 bp, Homo sapiens
gtgacccccagctccgg

SEQ ID NO: 6328730 - DNA, 13 bp, Homo sapiens
gtgacccctcctg

SEQ ID NO: 6328731 - DNA, 18 bp, Homo sapiens
gtgacccctcctggggcc

SEQ ID NO: 6328732 - DNA, 21 bp, Homo sapiens
gtgacccctcctggggccagg

SEQ ID NO: 6328733 - DNA, 23 bp, Homo sapiens
gtgacccctcctggggccaggcc

SEQ ID NO: 6328734 - DNA, 20 bp, Homo sapiens
gtgaccccttttcagcttct

SEQ ID NO: 6328735 - DNA, 15 bp, Homo sapiens
gtgacccggaggcca

SEQ ID NO: 6328736 - DNA, 18 bp, Homo sapiens
gtgacccggcaccccctg

SEQ ID NO: 6328737 - DNA, 13 bp, Homo sapiens
ggcggtggctgcc

SEQ ID NO: 6328738 - DNA, 17 bp, Homo sapiens
ggcggtttccaggaaga

SEQ ID NO: 6328739 - DNA, 19 bp, Homo sapiens
ggcgtaagtacagagaagc

SEQ ID NO: 6328740 - DNA, 20 bp, Homo sapiens
ggcgtaagtacagagaagcc

SEQ ID NO: 6328741 - DNA, 19 bp, Homo sapiens
ggcgtaatgggcctgccca

SEQ ID NO: 6328742 - DNA, 20 bp, Homo sapiens
ggcgtactacccagctctgt

SEQ ID NO: 6328743 - DNA, 22 bp, Homo sapiens
ggcgtactatttttattgagcc

SEQ ID NO: 6328744 - DNA, 15 bp, Homo sapiens
ggcgtaggctacaga

SEQ ID NO: 6328745 - DNA, 17 bp, Homo sapiens
ggcgtaggctacagaga

SEQ ID NO: 6328746 - DNA, 19 bp, Homo sapiens
ggcgtaggctacagagaag

SEQ ID NO: 6328747 - DNA, 19 bp, Homo sapiens
ggcgtagggccagggctct

SEQ ID NO: 6328748 - DNA, 21 bp, Homo sapiens
ggcgtagggccagggctctgg

SEQ ID NO: 6328749 - DNA, 13 bp, Homo sapiens
ggcgtcagagaga

SEQ ID NO: 6328750 - DNA, 17 bp, Homo sapiens
ggcgtcagagagacccg

SEQ ID NO: 6328751 - DNA, 20 bp, Homo sapiens
ggcgtcagcctccagcctct

SEQ ID NO: 6328752 - DNA, 16 bp, Homo sapiens
ggcgtcaggcagaggc

SEQ ID NO: 6328753 - DNA, 16 bp, Homo sapiens
ggcgtcaggggtgcac

SEQ ID NO: 6328754 - DNA, 18 bp, Homo sapiens
ggcgtcaggggtgcacag

SEQ ID NO: 6328755 - DNA, 24 bp, Homo sapiens
ggcgtcaggggtgcacagtccaca

SEQ ID NO: 6328756 - DNA, 18 bp, Homo sapiens
ggcgtcctctccctcctg

SEQ ID NO: 6328757 - DNA, 22 bp, Homo sapiens
ggcgtcctctccctcctggcca

SEQ ID NO: 6328758 - DNA, 23 bp, Homo sapiens
ggcgtcctctccctcctggccag

SEQ ID NO: 6328759 - DNA, 18 bp, Homo sapiens
ggcgtcctggtgaggaca

SEQ ID NO: 6328760 - DNA, 12 bp, Homo sapiens
ggcgtctccccc

SEQ ID NO: 6328761 - DNA, 17 bp, Homo sapiens
ggcgtctcccccagagt

SEQ ID NO: 6328762 - DNA, 21 bp, Homo sapiens
ggcgtctcccccagagtgctg

SEQ ID NO: 6328763 - DNA, 12 bp, Homo sapiens
ggcgtctccctc

SEQ ID NO: 6328764 - DNA, 21 bp, Homo sapiens
ggcgtcttcatctccctgcca

SEQ ID NO: 6328765 - DNA, 22 bp, Homo sapiens
ggcgtcttcatctccctgccat

SEQ ID NO: 6328766 - DNA, 20 bp, Homo sapiens
ggcgtgaacccgggaggtgg

SEQ ID NO: 6328767 - DNA, 14 bp, Homo sapiens
ggcgtgacccgtcc

SEQ ID NO: 6328768 - DNA, 17 bp, Homo sapiens
ggcgtgagacctgcccc

SEQ ID NO: 6328769 - DNA, 18 bp, Homo sapiens
ggcgtgagccaccaaacc

SEQ ID NO: 6328770 - DNA, 20 bp, Homo sapiens
ggcgtgatctcggctcactg

SEQ ID NO: 6328771 - DNA, 14 bp, Homo sapiens
ggcgtgcagtggtg

SEQ ID NO: 6328772 - DNA, 15 bp, Homo sapiens
ggcgtgctacctgca

SEQ ID NO: 6328773 - DNA, 14 bp, Homo sapiens
ggcgtgctcagacc

SEQ ID NO: 6328774 - DNA, 21 bp, Homo sapiens
ggcgtgctggtcccctcctca

SEQ ID NO: 6328775 - DNA, 15 bp, Homo sapiens
ggcgtggagactggc

SEQ ID NO: 6328776 - DNA, 17 bp, Homo sapiens
ggcgtggagactggcag

SEQ ID NO: 6328777 - DNA, 20 bp, Homo sapiens
ggcgtggagactggcaggcg

SEQ ID NO: 6328778 - DNA, 14 bp, Homo sapiens
ggcgtggaggagag

SEQ ID NO: 6328779 - DNA, 13 bp, Homo sapiens
ggcgtggcctgca

SEQ ID NO: 6328780 - DNA, 22 bp, Homo sapiens
ggcgtggcctgcataggctcct

SEQ ID NO: 6328781 - DNA, 16 bp, Homo sapiens
ggcgtggctctgggtg

SEQ ID NO: 6328782 - DNA, 16 bp, Homo sapiens
ggcgtgggacgtggtc

SEQ ID NO: 6328783 - DNA, 18 bp, Homo sapiens
ggcgtgggagccagcctc

SEQ ID NO: 6328784 - DNA, 17 bp, Homo sapiens
ggcgtgggatccagaga

SEQ ID NO: 6328785 - DNA, 19 bp, Homo sapiens
ggcgtgggatccagagaga

SEQ ID NO: 6328786 - DNA, 22 bp, Homo sapiens
ggcgtgggatccagagagaagc

SEQ ID NO: 6328787 - DNA, 20 bp, Homo sapiens
ggcgtgggcgaggcctgaca

SEQ ID NO: 6328788 - DNA, 21 bp, Homo sapiens
ggcgtgggggcactgaccagg

SEQ ID NO: 6328789 - DNA, 19 bp, Homo sapiens
ggcgtgggtctctggggac

SEQ ID NO: 6328790 - DNA, 17 bp, Homo sapiens
ggcgtggtcactgctgt

SEQ ID NO: 6328791 - DNA, 18 bp, Homo sapiens
ggcgtggtcactgctgtc

SEQ ID NO: 6328792 - DNA, 22 bp, Homo sapiens
ggcgtggtgtgtccctggacac

SEQ ID NO: 6328793 - DNA, 23 bp, Homo sapiens
ggcgtggtgtgtccctggacaca

SEQ ID NO: 6328794 - DNA, 23 bp, Homo sapiens
ggcgtgtccctcctcttcctgta

SEQ ID NO: 6328795 - DNA, 20 bp, Homo sapiens
ggcgtgtgcatagcgtcctg

SEQ ID NO: 6328796 - DNA, 17 bp, Homo sapiens
ggcgtgtggtttccctg

SEQ ID NO: 6328797 - DNA, 14 bp, Homo sapiens
ggcgtgtgtgacac

SEQ ID NO: 6328798 - DNA, 20 bp, Homo sapiens
ggcgtgtgttccccagctga

SEQ ID NO: 6328799 - DNA, 17 bp, Homo sapiens
ggcgttcacctccctgc

SEQ ID NO: 6328800 - DNA, 17 bp, Homo sapiens
ggcgttctcccaaagat

SEQ ID NO: 6328801 - DNA, 18 bp, Homo sapiens
ggcgttctgctgcccctg

SEQ ID NO: 6328802 - DNA, 23 bp, Homo sapiens
ggcgttctgctgcccctgcagtt

SEQ ID NO: 6328803 - DNA, 16 bp, Homo sapiens
ggctaaaaacatttta

SEQ ID NO: 6328804 - DNA, 21 bp, Homo sapiens
ggctaaaagacatgcattttt

SEQ ID NO: 6328805 - DNA, 18 bp, Homo sapiens
ggctaaaatgttttcagc

SEQ ID NO: 6328806 - DNA, 19 bp, Homo sapiens
ggctaaagaagacacacag

SEQ ID NO: 6328807 - DNA, 16 bp, Homo sapiens
ggctaaagtgattcct

SEQ ID NO: 6328808 - DNA, 17 bp, Homo sapiens
ggctaaataaagaggag

SEQ ID NO: 6328809 - DNA, 24 bp, Homo sapiens
ggctaaccagttctctttgtaagg

SEQ ID NO: 6328810 - DNA, 21 bp, Homo sapiens
ggctaaccatcgaaaagaaca

SEQ ID NO: 6328811 - DNA, 20 bp, Homo sapiens
ggctaacctggacctggaac

SEQ ID NO: 6328812 - DNA, 18 bp, Homo sapiens
ggctaacgggaggctggg

SEQ ID NO: 6328813 - DNA, 19 bp, Homo sapiens
ggctaacgggaggctgggc

SEQ ID NO: 6328814 - DNA, 19 bp, Homo sapiens
ggctaacgtttatttaaaa

SEQ ID NO: 6328815 - DNA, 17 bp, Homo sapiens
ggctaactggccccagg

SEQ ID NO: 6328816 - DNA, 19 bp, Homo sapiens
ggctaactggccccaggcg

SEQ ID NO: 6328817 - DNA, 13 bp, Homo sapiens
ggctaagaaaaag

SEQ ID NO: 6328818 - DNA, 20 bp, Homo sapiens
ggctaagagctagcgctgcc

SEQ ID NO: 6328819 - DNA, 16 bp, Homo sapiens
ggctaagaggctgctg

SEQ ID NO: 6328820 - DNA, 14 bp, Homo sapiens
ggctaagcctggac

SEQ ID NO: 6328821 - DNA, 14 bp, Homo sapiens
ggctaaggataggg

SEQ ID NO: 6328822 - DNA, 22 bp, Homo sapiens
ggctaaggcgtggagctgcctg

SEQ ID NO: 6328823 - DNA, 23 bp, Homo sapiens
ggctaagggggaccatggggagg

SEQ ID NO: 6328824 - DNA, 18 bp, Homo sapiens
ggctaagtccagctctcc

SEQ ID NO: 6328825 - DNA, 20 bp, Homo sapiens
ggctaagtgatcctcccacc

SEQ ID NO: 6328826 - DNA, 18 bp, Homo sapiens
ggctaataaactgtatta

SEQ ID NO: 6328827 - DNA, 12 bp, Homo sapiens
ggctaatgtttg

SEQ ID NO: 6328828 - DNA, 14 bp, Homo sapiens
ggctaatgtttgta

SEQ ID NO: 6328829 - DNA, 22 bp, Homo sapiens
ggctaattagaggatgtggcag

SEQ ID NO: 6328830 - DNA, 23 bp, Homo sapiens
ggctaattcccagagtgtgaaac

SEQ ID NO: 6328831 - DNA, 13 bp, Homo sapiens
ggctaatttaaca

SEQ ID NO: 6328832 - DNA, 17 bp, Homo sapiens
ggctacaaaccaggagc

SEQ ID NO: 6328833 - DNA, 18 bp, Homo sapiens
ggctacaaaccaggagca

SEQ ID NO: 6328834 - DNA, 16 bp, Homo sapiens
ggctacaaagcagaga

SEQ ID NO: 6328835 - DNA, 20 bp, Homo sapiens
ggctacacagaccctgccca

SEQ ID NO: 6328836 - DNA, 23 bp, Homo sapiens
ggctacaccttagcctgccctcc

SEQ ID NO: 6328837 - DNA, 11 bp, Homo sapiens
ggctacagaga

SEQ ID NO: 6328838 - DNA, 12 bp, Homo sapiens
ggctacagagaa

SEQ ID NO: 6328839 - DNA, 19 bp, Homo sapiens
ggctacagagaagccttca

SEQ ID NO: 6328840 - DNA, 14 bp, Homo sapiens
ggctacagctccac

SEQ ID NO: 6328841 - DNA, 15 bp, Homo sapiens
ggctacagctccaca

SEQ ID NO: 6328842 - DNA, 19 bp, Homo sapiens
ggctacagctccacacgcc

SEQ ID NO: 6328843 - DNA, 19 bp, Homo sapiens
ggctacagtaaccaaaaca

SEQ ID NO: 6328844 - DNA, 22 bp, Homo sapiens
ggctacagttgaacagaactgc

SEQ ID NO: 6328845 - DNA, 12 bp, Homo sapiens
ggctacatcagc

SEQ ID NO: 6328846 - DNA, 13 bp, Homo sapiens
ggctacatcccag

SEQ ID NO: 6328847 - DNA, 17 bp, Homo sapiens
ggctacatctccaaata

SEQ ID NO: 6328848 - DNA, 21 bp, Homo sapiens
ggctaccagaagaggggcagc

SEQ ID NO: 6328849 - DNA, 14 bp, Homo sapiens
ggctaccatctgca

SEQ ID NO: 6328850 - DNA, 18 bp, Homo sapiens
ggctaccatctgcatggg

SEQ ID NO: 6328851 - DNA, 20 bp, Homo sapiens
ggctacccctcgactcagca

SEQ ID NO: 6328852 - DNA, 21 bp, Homo sapiens
ggctacccctcgactcagcac

SEQ ID NO: 6328853 - DNA, 15 bp, Homo sapiens
ggctacccgctgtgg

SEQ ID NO: 6328854 - DNA, 19 bp, Homo sapiens
ggctacccgctgtggccgg

SEQ ID NO: 6328855 - DNA, 12 bp, Homo sapiens
ggctaccctccc

SEQ ID NO: 6328856 - DNA, 23 bp, Homo sapiens
ggctaccctcctctagaaggctg

SEQ ID NO: 6328857 - DNA, 21 bp, Homo sapiens
ggctacgctgacaatcagtta

SEQ ID NO: 6328858 - DNA, 18 bp, Homo sapiens
ggctactcagcagccctc

SEQ ID NO: 6328859 - DNA, 20 bp, Homo sapiens
ggctactcagcagccctcct

SEQ ID NO: 6328860 - DNA, 19 bp, Homo sapiens
ggctactcagcagtaagca

SEQ ID NO: 6328861 - DNA, 14 bp, Homo sapiens
ggctactctgccca

SEQ ID NO: 6328862 - DNA, 13 bp, Homo sapiens
ggctactctgtgc

SEQ ID NO: 6328863 - DNA, 18 bp, Homo sapiens
ggctactctgtgccagag

SEQ ID NO: 6328864 - DNA, 19 bp, Homo sapiens
ggctactctgtgccagagc

SEQ ID NO: 6328865 - DNA, 23 bp, Homo sapiens
ggctactctgtgccagagcctgg

SEQ ID NO: 6328866 - DNA, 13 bp, Homo sapiens
ggctactggcagc

SEQ ID NO: 6328867 - DNA, 14 bp, Homo sapiens
ggctactggcagct

SEQ ID NO: 6328868 - DNA, 15 bp, Homo sapiens
ggctactggcagctc

SEQ ID NO: 6328869 - DNA, 16 bp, Homo sapiens
ggctactggcagctcc

SEQ ID NO: 6328870 - DNA, 16 bp, Homo sapiens
ggctactgtaatgctg

SEQ ID NO: 6328871 - DNA, 14 bp, Homo sapiens
ggctacttcccttc

SEQ ID NO: 6328872 - DNA, 21 bp, Homo sapiens
ggctagaaccaagaagggcta

SEQ ID NO: 6328873 - DNA, 21 bp, Homo sapiens
ggctagaacctagaagggcta

SEQ ID NO: 6328874 - DNA, 22 bp, Homo sapiens
ggctagaacctggagagctaga

SEQ ID NO: 6328875 - DNA, 14 bp, Homo sapiens
ggctagaacctggc

SEQ ID NO: 6328876 - DNA, 21 bp, Homo sapiens
ggctagaagaaagtaaaaaga

SEQ ID NO: 6328877 - DNA, 15 bp, Homo sapiens
ggctagaatggaaaa

SEQ ID NO: 6328878 - DNA, 17 bp, Homo sapiens
ggctagactagtctcaa

SEQ ID NO: 6328879 - DNA, 16 bp, Homo sapiens
ggctagactgggctgg

SEQ ID NO: 6328880 - DNA, 17 bp, Homo sapiens
ggctagactgggctggc

SEQ ID NO: 6328881 - DNA, 14 bp, Homo sapiens
ggctagagccgagg

SEQ ID NO: 6328882 - DNA, 19 bp, Homo sapiens
ggctagagccgaggggaga

SEQ ID NO: 6328883 - DNA, 16 bp, Homo sapiens
ggctagaggccagccc

SEQ ID NO: 6328884 - DNA, 17 bp, Homo sapiens
ggctagagggcccaaag

SEQ ID NO: 6328885 - DNA, 18 bp, Homo sapiens
ggctagcattcctcagga

SEQ ID NO: 6328886 - DNA, 12 bp, Homo sapiens
ggctagccccag

SEQ ID NO: 6328887 - DNA, 15 bp, Homo sapiens
ggctagccccagggt

SEQ ID NO: 6328888 - DNA, 17 bp, Homo sapiens
ggctagccccagggtga

SEQ ID NO: 6328889 - DNA, 15 bp, Homo sapiens
ggctagccctgagcc

SEQ ID NO: 6328890 - DNA, 15 bp, Homo sapiens
ggctagctaagccaa

SEQ ID NO: 6328891 - DNA, 17 bp, Homo sapiens
ggctagctgtgctggta

SEQ ID NO: 6328892 - DNA, 16 bp, Homo sapiens
ggctaggaaagggaag

SEQ ID NO: 6328893 - DNA, 20 bp, Homo sapiens
ggctaggacgttggcctcag

SEQ ID NO: 6328894 - DNA, 20 bp, Homo sapiens
ggctaggactgtggagggga

SEQ ID NO: 6328895 - DNA, 13 bp, Homo sapiens
ggctaggccagca

SEQ ID NO: 6328896 - DNA, 19 bp, Homo sapiens
ggctaggccagcaggggct

SEQ ID NO: 6328897 - DNA, 21 bp, Homo sapiens
ggctaggccggccagctcccc

SEQ ID NO: 6328898 - DNA, 12 bp, Homo sapiens
ggctaggcctcc

SEQ ID NO: 6328899 - DNA, 15 bp, Homo sapiens
ggctagggaggacca

SEQ ID NO: 6328900 - DNA, 24 bp, Homo sapiens
ggctaggggaggggggagccagag

SEQ ID NO: 6328901 - DNA, 14 bp, Homo sapiens
ggctaggggctggg

SEQ ID NO: 6328902 - DNA, 15 bp, Homo sapiens
ggctaggtagaaaaa

SEQ ID NO: 6328903 - DNA, 19 bp, Homo sapiens
ggctaggtgggttgaaagc

SEQ ID NO: 6328904 - DNA, 13 bp, Homo sapiens
ggctagtactgta

SEQ ID NO: 6328905 - DNA, 17 bp, Homo sapiens
ggctagtcaagctcctc

SEQ ID NO: 6328906 - DNA, 23 bp, Homo sapiens
ggctagtcaagctcctcctccct

SEQ ID NO: 6328907 - DNA, 14 bp, Homo sapiens
ggctagtcagagag

SEQ ID NO: 6328908 - DNA, 18 bp, Homo sapiens
ggctagtcagagagagtg

SEQ ID NO: 6328909 - DNA, 19 bp, Homo sapiens
ggctagtggggtgaacagc

SEQ ID NO: 6328910 - DNA, 17 bp, Homo sapiens
ggctagttaaggtgtgc

SEQ ID NO: 6328911 - DNA, 18 bp, Homo sapiens
ggctagttctaattccct

SEQ ID NO: 6328912 - DNA, 15 bp, Homo sapiens
ggctagttgggcttc

SEQ ID NO: 6328913 - DNA, 20 bp, Homo sapiens
ggctatacctggggacttga

SEQ ID NO: 6328914 - DNA, 21 bp, Homo sapiens
gtgacccggcaccccctgcag

SEQ ID NO: 6328915 - DNA, 16 bp, Homo sapiens
gtgaccctcagctgtc

SEQ ID NO: 6328916 - DNA, 20 bp, Homo sapiens
gtgaccctgggcaagtcact

SEQ ID NO: 6328917 - DNA, 13 bp, Homo sapiens
gtgaccctgtgcc

SEQ ID NO: 6328918 - DNA, 16 bp, Homo sapiens
gtgaccctgtgccccg

SEQ ID NO: 6328919 - DNA, 17 bp, Homo sapiens
gtgacccttgtcatctc

SEQ ID NO: 6328920 - DNA, 21 bp, Homo sapiens
gtgaccgccctccgtcgggcc

SEQ ID NO: 6328921 - DNA, 19 bp, Homo sapiens
gtgaccggacttttctgca

SEQ ID NO: 6328922 - DNA, 19 bp, Homo sapiens
gtgaccggcccgccacctt

SEQ ID NO: 6328923 - DNA, 21 bp, Homo sapiens
gtgaccggcccgccaccttgt

SEQ ID NO: 6328924 - DNA, 20 bp, Homo sapiens
gtgaccgggggctgctgggc

SEQ ID NO: 6328925 - DNA, 13 bp, Homo sapiens
gtgaccggggtcc

SEQ ID NO: 6328926 - DNA, 14 bp, Homo sapiens
gtgacctataattt

SEQ ID NO: 6328927 - DNA, 19 bp, Homo sapiens
gtgacctattcaccctcca

SEQ ID NO: 6328928 - DNA, 16 bp, Homo sapiens
gtgacctcagctttga

SEQ ID NO: 6328929 - DNA, 15 bp, Homo sapiens
gtgacctccatactg

SEQ ID NO: 6328930 - DNA, 18 bp, Homo sapiens
gtgacctccgtcctctcc

SEQ ID NO: 6328931 - DNA, 14 bp, Homo sapiens
gtgacctcctgtca

SEQ ID NO: 6328932 - DNA, 18 bp, Homo sapiens
gtgacctccttctgcaaa

SEQ ID NO: 6328933 - DNA, 23 bp, Homo sapiens
gtgacctcggacagagcccccct

SEQ ID NO: 6328934 - DNA, 19 bp, Homo sapiens
gtgacctctagccctgccc

SEQ ID NO: 6328935 - DNA, 13 bp, Homo sapiens
gtgacctctgcct

SEQ ID NO: 6328936 - DNA, 19 bp, Homo sapiens
gtgacctgaagttcaccat

SEQ ID NO: 6328937 - DNA, 16 bp, Homo sapiens
gtgacctgaggaagcg

SEQ ID NO: 6328938 - DNA, 23 bp, Homo sapiens
gtgacctgatttcagaagagact

SEQ ID NO: 6328939 - DNA, 12 bp, Homo sapiens
gtgacctgctga

SEQ ID NO: 6328940 - DNA, 17 bp, Homo sapiens
gtgacctggtctggtca

SEQ ID NO: 6328941 - DNA, 15 bp, Homo sapiens
gtgaccttagtgttt

SEQ ID NO: 6328942 - DNA, 20 bp, Homo sapiens
gtgaccttccaagagcctga

SEQ ID NO: 6328943 - DNA, 21 bp, Homo sapiens
gtgaccttccaagagcctgag

SEQ ID NO: 6328944 - DNA, 22 bp, Homo sapiens
gtgaccttccaagagcctgaga

SEQ ID NO: 6328945 - DNA, 15 bp, Homo sapiens
gtgaccttctgggaa

SEQ ID NO: 6328946 - DNA, 20 bp, Homo sapiens
gtgaccttgacttgccatga

SEQ ID NO: 6328947 - DNA, 19 bp, Homo sapiens
gtgaccttgggaccaaagg

SEQ ID NO: 6328948 - DNA, 16 bp, Homo sapiens
gtgacctttgacctcg

SEQ ID NO: 6328949 - DNA, 16 bp, Homo sapiens
gtgaccttttcttcat

SEQ ID NO: 6328950 - DNA, 19 bp, Homo sapiens
gtgacctttttaatccagg

SEQ ID NO: 6328951 - DNA, 20 bp, Homo sapiens
gtgacgatgggtgttgctgt

SEQ ID NO: 6328952 - DNA, 20 bp, Homo sapiens
gtgacgattatttatttctg

SEQ ID NO: 6328953 - DNA, 19 bp, Homo sapiens
gtgacgcccaccttcgggc

SEQ ID NO: 6328954 - DNA, 14 bp, Homo sapiens
gtgacgcccagctc

SEQ ID NO: 6328955 - DNA, 16 bp, Homo sapiens
gtgacgcccagctccg

SEQ ID NO: 6328956 - DNA, 17 bp, Homo sapiens
gtgacgcctgagacagc

SEQ ID NO: 6328957 - DNA, 17 bp, Homo sapiens
gtgacgcctgccctccc

SEQ ID NO: 6328958 - DNA, 15 bp, Homo sapiens
gtgacgctgaataaa

SEQ ID NO: 6328959 - DNA, 20 bp, Homo sapiens
gtgacggactcagactcctg

SEQ ID NO: 6328960 - DNA, 19 bp, Homo sapiens
gtgacgggagcctcctctg

SEQ ID NO: 6328961 - DNA, 20 bp, Homo sapiens
gtgacggtcctttaggcagc

SEQ ID NO: 6328962 - DNA, 24 bp, Homo sapiens
gtgacggttcctacacaggacagg

SEQ ID NO: 6328963 - DNA, 21 bp, Homo sapiens
gtgactaattgtataacaggt

SEQ ID NO: 6328964 - DNA, 22 bp, Homo sapiens
gtgactaattgtataacaggtt

SEQ ID NO: 6328965 - DNA, 16 bp, Homo sapiens
gtgactaccacttatt

SEQ ID NO: 6328966 - DNA, 19 bp, Homo sapiens
gtgactaccacttatttct

SEQ ID NO: 6328967 - DNA, 17 bp, Homo sapiens
gtgactaccgtgccagc

SEQ ID NO: 6328968 - DNA, 21 bp, Homo sapiens
gtgactaccgtgccagcagcg

SEQ ID NO: 6328969 - DNA, 17 bp, Homo sapiens
gtgactagcgcctggcc

SEQ ID NO: 6328970 - DNA, 17 bp, Homo sapiens
gtgactaggcatacact

SEQ ID NO: 6328971 - DNA, 13 bp, Homo sapiens
gtgactagtgctg

SEQ ID NO: 6328972 - DNA, 15 bp, Homo sapiens
gtgactagtgctgaa

SEQ ID NO: 6328973 - DNA, 22 bp, Homo sapiens
gtgactagtgctgaagcttatt

SEQ ID NO: 6328974 - DNA, 20 bp, Homo sapiens
gtgactatatagagatgttt

SEQ ID NO: 6328975 - DNA, 21 bp, Homo sapiens
gtgactatggagctgagcagg

SEQ ID NO: 6328976 - DNA, 13 bp, Homo sapiens
gtgactattctca

SEQ ID NO: 6328977 - DNA, 14 bp, Homo sapiens
gtgactattgttta

SEQ ID NO: 6328978 - DNA, 20 bp, Homo sapiens
gtgactattttttaataaaa

SEQ ID NO: 6328979 - DNA, 22 bp, Homo sapiens
gtgactcacacttgtaatccca

SEQ ID NO: 6328980 - DNA, 17 bp, Homo sapiens
gtgactcacttcaatgt

SEQ ID NO: 6328981 - DNA, 13 bp, Homo sapiens
gtgactcagaaga

SEQ ID NO: 6328982 - DNA, 18 bp, Homo sapiens
gtgactcatcctcttgaa

SEQ ID NO: 6328983 - DNA, 12 bp, Homo sapiens
gtgactccaggg

SEQ ID NO: 6328984 - DNA, 13 bp, Homo sapiens
gtgactccagggt

SEQ ID NO: 6328985 - DNA, 14 bp, Homo sapiens
gtgactccatatcc

SEQ ID NO: 6328986 - DNA, 21 bp, Homo sapiens
gtgactccccagcccagcacc

SEQ ID NO: 6328987 - DNA, 14 bp, Homo sapiens
gtgactccctggga

SEQ ID NO: 6328988 - DNA, 10 bp, Homo sapiens
gtgactcctc

SEQ ID NO: 6328989 - DNA, 13 bp, Homo sapiens
gtgactcctccct

SEQ ID NO: 6328990 - DNA, 18 bp, Homo sapiens
gtgactcctcccttcccc

SEQ ID NO: 6328991 - DNA, 23 bp, Homo sapiens
gtgactcctcccttccccactct

SEQ ID NO: 6328992 - DNA, 12 bp, Homo sapiens
gtgactcctgct

SEQ ID NO: 6328993 - DNA, 17 bp, Homo sapiens
gtgactccttatctctt

SEQ ID NO: 6328994 - DNA, 18 bp, Homo sapiens
gtgactccttatctcttt

SEQ ID NO: 6328995 - DNA, 21 bp, Homo sapiens
gtgactccttatctctttcca

SEQ ID NO: 6328996 - DNA, 23 bp, Homo sapiens
gtgactcgacaaaggccacaggc

SEQ ID NO: 6328997 - DNA, 20 bp, Homo sapiens
gtgactcgagtcacactcaa

SEQ ID NO: 6328998 - DNA, 15 bp, Homo sapiens
gtgactcgggagctg

SEQ ID NO: 6328999 - DNA, 16 bp, Homo sapiens
gtgactcgggagctgc

SEQ ID NO: 6329000 - DNA, 19 bp, Homo sapiens
gtgactcgggagctgcaca

SEQ ID NO: 6329001 - DNA, 21 bp, Homo sapiens
gtgactcgggagctgcacaca

SEQ ID NO: 6329002 - DNA, 20 bp, Homo sapiens
gtgactcgggctcctgtgcc

SEQ ID NO: 6329003 - DNA, 22 bp, Homo sapiens
gtgactctaagctcagtgctct

SEQ ID NO: 6329004 - DNA, 14 bp, Homo sapiens
gtgactctacctgc

SEQ ID NO: 6329005 - DNA, 17 bp, Homo sapiens
gtgactctaggcttcag

SEQ ID NO: 6329006 - DNA, 21 bp, Homo sapiens
gtgactctcctgcctcagcct

SEQ ID NO: 6329007 - DNA, 14 bp, Homo sapiens
gtgactctgaagct

SEQ ID NO: 6329008 - DNA, 13 bp, Homo sapiens
gtgactctggctg

SEQ ID NO: 6329009 - DNA, 13 bp, Homo sapiens
gtgactctgggca

SEQ ID NO: 6329010 - DNA, 16 bp, Homo sapiens
gtgactctgtccagct

SEQ ID NO: 6329011 - DNA, 15 bp, Homo sapiens
gtgactcttctctca

SEQ ID NO: 6329012 - DNA, 16 bp, Homo sapiens
gtgactctttttaggg

SEQ ID NO: 6329013 - DNA, 19 bp, Homo sapiens
gtgactgaaaccattttcc

SEQ ID NO: 6329014 - DNA, 18 bp, Homo sapiens
gtgactgaaggggcacac

SEQ ID NO: 6329015 - DNA, 16 bp, Homo sapiens
gtgactgaatttcttt

SEQ ID NO: 6329016 - DNA, 19 bp, Homo sapiens
gtgactgaatttgggcctc

SEQ ID NO: 6329017 - DNA, 22 bp, Homo sapiens
gtgactgaatttgggcctcttg

SEQ ID NO: 6329018 - DNA, 17 bp, Homo sapiens
gtgactgatctctcgtg

SEQ ID NO: 6329019 - DNA, 21 bp, Homo sapiens
gtgactgatgttacatcacag

SEQ ID NO: 6329020 - DNA, 16 bp, Homo sapiens
gtgactgccaaggtgt

SEQ ID NO: 6329021 - DNA, 21 bp, Homo sapiens
gtgactgccccaactcctgga

SEQ ID NO: 6329022 - DNA, 21 bp, Homo sapiens
gtgactgctgcgctgtgctgg

SEQ ID NO: 6329023 - DNA, 19 bp, Homo sapiens
gtgactggaagttgtggat

SEQ ID NO: 6329024 - DNA, 23 bp, Homo sapiens
gtgactggagcccgagggcctga

SEQ ID NO: 6329025 - DNA, 14 bp, Homo sapiens
gtgactggatcttc

SEQ ID NO: 6329026 - DNA, 19 bp, Homo sapiens
gtgactggcaagaggcctc

SEQ ID NO: 6329027 - DNA, 15 bp, Homo sapiens
gtgactggcaggtgc

SEQ ID NO: 6329028 - DNA, 17 bp, Homo sapiens
gtgactgggccctgtcc

SEQ ID NO: 6329029 - DNA, 20 bp, Homo sapiens
gtgactggttatcacaccat

SEQ ID NO: 6329030 - DNA, 19 bp, Homo sapiens
gtgactgtatctgtgtaga

SEQ ID NO: 6329031 - DNA, 22 bp, Homo sapiens
gtgactgtcccaccgggagcct

SEQ ID NO: 6329032 - DNA, 23 bp, Homo sapiens
gtgactgtcccaccgggagcctc

SEQ ID NO: 6329033 - DNA, 20 bp, Homo sapiens
gtgactgtcgtgtttacaaa

SEQ ID NO: 6329034 - DNA, 13 bp, Homo sapiens
gtgactgtgctgt

SEQ ID NO: 6329035 - DNA, 22 bp, Homo sapiens
gtgactgtgctgtgcagctctc

SEQ ID NO: 6329036 - DNA, 18 bp, Homo sapiens
gtgactgtggcacacgcc

SEQ ID NO: 6329037 - DNA, 14 bp, Homo sapiens
gtgactgtggcatt

SEQ ID NO: 6329038 - DNA, 22 bp, Homo sapiens
gtgactgtgtttgcattgtcta

SEQ ID NO: 6329039 - DNA, 18 bp, Homo sapiens
gtgactgttgtagcattt

SEQ ID NO: 6329040 - DNA, 15 bp, Homo sapiens
gtgactgtttttgtt

SEQ ID NO: 6329041 - DNA, 19 bp, Homo sapiens
gtgactgtttttgttttgt

SEQ ID NO: 6329042 - DNA, 16 bp, Homo sapiens
gtgacttaaggagaaa

SEQ ID NO: 6329043 - DNA, 17 bp, Homo sapiens
gtgacttaggaggctga

SEQ ID NO: 6329044 - DNA, 23 bp, Homo sapiens
gtgacttatttgctcataagtaa

SEQ ID NO: 6329045 - DNA, 20 bp, Homo sapiens
gtgacttcagactctctcct

SEQ ID NO: 6329046 - DNA, 15 bp, Homo sapiens
gtgacttcctggtga

SEQ ID NO: 6329047 - DNA, 17 bp, Homo sapiens
gtgacttctagcagaga

SEQ ID NO: 6329048 - DNA, 14 bp, Homo sapiens
gtgacttctgctgc

SEQ ID NO: 6329049 - DNA, 17 bp, Homo sapiens
gtgacttctgctgctgg

SEQ ID NO: 6329050 - DNA, 17 bp, Homo sapiens
gtgacttcttcttcttt

SEQ ID NO: 6329051 - DNA, 16 bp, Homo sapiens
gtgacttgcctggggc

SEQ ID NO: 6329052 - DNA, 14 bp, Homo sapiens
gtgacttggagata

SEQ ID NO: 6329053 - DNA, 13 bp, Homo sapiens
gtgacttgggctc

SEQ ID NO: 6329054 - DNA, 20 bp, Homo sapiens
gtgacttgggctccgctgtg

SEQ ID NO: 6329055 - DNA, 15 bp, Homo sapiens
gtgacttgtctgcct

SEQ ID NO: 6329056 - DNA, 17 bp, Homo sapiens
gtgacttgtctgcctcc

SEQ ID NO: 6329057 - DNA, 14 bp, Homo sapiens
gtgacttgttctga

SEQ ID NO: 6329058 - DNA, 14 bp, Homo sapiens
gtgactttctgaaa

SEQ ID NO: 6329059 - DNA, 20 bp, Homo sapiens
gtgactttggctgcatgcga

SEQ ID NO: 6329060 - DNA, 19 bp, Homo sapiens
gtgactttgtctctcctgg

SEQ ID NO: 6329061 - DNA, 22 bp, Homo sapiens
gtgactttgtctctcctggctg

SEQ ID NO: 6329062 - DNA, 14 bp, Homo sapiens
gtgacttttgaaga

SEQ ID NO: 6329063 - DNA, 17 bp, Homo sapiens
gtgagaaaaagctcctg

SEQ ID NO: 6329064 - DNA, 22 bp, Homo sapiens
gtgagaaaaagctcctgtcctc

SEQ ID NO: 6329065 - DNA, 17 bp, Homo sapiens
gtgagaaaatgcctcaa

SEQ ID NO: 6329066 - DNA, 13 bp, Homo sapiens
gtgagaaagaaag

SEQ ID NO: 6329067 - DNA, 23 bp, Homo sapiens
gtgagaaagaaagtaaaaaaggt

SEQ ID NO: 6329068 - DNA, 14 bp, Homo sapiens
gtgagaaaggaaaa

SEQ ID NO: 6329069 - DNA, 19 bp, Homo sapiens
gtgagaaagggattgctga

SEQ ID NO: 6329070 - DNA, 14 bp, Homo sapiens
gtgagaaagttaga

SEQ ID NO: 6329071 - DNA, 15 bp, Homo sapiens
gtgagaactactcag

SEQ ID NO: 6329072 - DNA, 19 bp, Homo sapiens
gtgagaactcagaagagaa

SEQ ID NO: 6329073 - DNA, 13 bp, Homo sapiens
gtgagaactgtga

SEQ ID NO: 6329074 - DNA, 14 bp, Homo sapiens
gtgagaacttttca

SEQ ID NO: 6329075 - DNA, 16 bp, Homo sapiens
gtgagaagaaagaaac

SEQ ID NO: 6329076 - DNA, 15 bp, Homo sapiens
gtgagaagctgaggc

SEQ ID NO: 6329077 - DNA, 17 bp, Homo sapiens
gtgagaagggcctgctc

SEQ ID NO: 6329078 - DNA, 19 bp, Homo sapiens
gtgagaagggcctgctctg

SEQ ID NO: 6329079 - DNA, 13 bp, Homo sapiens
gtgagaagggctc

SEQ ID NO: 6329080 - DNA, 23 bp, Homo sapiens
gtgagaagggctcagagaggaca

SEQ ID NO: 6329081 - DNA, 21 bp, Homo sapiens
gtgagaagtacagggcagaac

SEQ ID NO: 6329082 - DNA, 17 bp, Homo sapiens
gtgagaagtgccttctc

SEQ ID NO: 6329083 - DNA, 11 bp, Homo sapiens
gtgagaagttt

SEQ ID NO: 6329084 - DNA, 19 bp, Homo sapiens
gtgagaatcgacctcactg

SEQ ID NO: 6329085 - DNA, 11 bp, Homo sapiens
gtgagaatggc

SEQ ID NO: 6329086 - DNA, 17 bp, Homo sapiens
gtgagaatggcctggag

SEQ ID NO: 6329087 - DNA, 20 bp, Homo sapiens
gtgagaatggcctggagcag

SEQ ID NO: 6329088 - DNA, 21 bp, Homo sapiens
gtgagaatggcctggagcagg

SEQ ID NO: 6329089 - DNA, 16 bp, Homo sapiens
gtgagaattactgttt

SEQ ID NO: 6329090 - DNA, 21 bp, Homo sapiens
gtgagaattactgtttgaaac

SEQ ID NO: 6329091 - DNA, 16 bp, Homo sapiens
gtgagaattgggactc

SEQ ID NO: 6329092 - DNA, 15 bp, Homo sapiens
ggctatatgcctata

SEQ ID NO: 6329093 - DNA, 16 bp, Homo sapiens
ggctatcaaaagaaat

SEQ ID NO: 6329094 - DNA, 21 bp, Homo sapiens
ggctatcaaaagaaatagaaa

SEQ ID NO: 6329095 - DNA, 17 bp, Homo sapiens
ggctatcccttctcaga

SEQ ID NO: 6329096 - DNA, 18 bp, Homo sapiens
ggctatgaaaatgagccc

SEQ ID NO: 6329097 - DNA, 20 bp, Homo sapiens
ggctatgaaaatgagccctg

SEQ ID NO: 6329098 - DNA, 13 bp, Homo sapiens
ggctatgaacaga

SEQ ID NO: 6329099 - DNA, 21 bp, Homo sapiens
ggctatgaagggacagctgct

SEQ ID NO: 6329100 - DNA, 12 bp, Homo sapiens
ggctatgcattt

SEQ ID NO: 6329101 - DNA, 15 bp, Homo sapiens
ggctatgcatttgaa

SEQ ID NO: 6329102 - DNA, 22 bp, Homo sapiens
ggctatgccactaggccctggt

SEQ ID NO: 6329103 - DNA, 18 bp, Homo sapiens
ggctatgcctccatttca

SEQ ID NO: 6329104 - DNA, 15 bp, Homo sapiens
ggctatgccttgtct

SEQ ID NO: 6329105 - DNA, 17 bp, Homo sapiens
ggctatggacacagggt

SEQ ID NO: 6329106 - DNA, 21 bp, Homo sapiens
ggctatggggatagatgtgtg

SEQ ID NO: 6329107 - DNA, 18 bp, Homo sapiens
ggctatgtagtcataata

SEQ ID NO: 6329108 - DNA, 15 bp, Homo sapiens
ggctattataatata

SEQ ID NO: 6329109 - DNA, 22 bp, Homo sapiens
ggctattataatatagaaagaa

SEQ ID NO: 6329110 - DNA, 19 bp, Homo sapiens
ggctattcctaggcctcag

SEQ ID NO: 6329111 - DNA, 19 bp, Homo sapiens
ggctattgaagatgctgcc

SEQ ID NO: 6329112 - DNA, 21 bp, Homo sapiens
ggctattgaagatgctgcctg

SEQ ID NO: 6329113 - DNA, 14 bp, Homo sapiens
ggctattgtccttg

SEQ ID NO: 6329114 - DNA, 15 bp, Homo sapiens
ggctatttctgtgtc

SEQ ID NO: 6329115 - DNA, 16 bp, Homo sapiens
ggctatttctgtgtcc

SEQ ID NO: 6329116 - DNA, 16 bp, Homo sapiens
ggctatttgtaaatct

SEQ ID NO: 6329117 - DNA, 21 bp, Homo sapiens
ggctattttgtttgcttcatg

SEQ ID NO: 6329118 - DNA, 17 bp, Homo sapiens
ggctatttttgaagcaa

SEQ ID NO: 6329119 - DNA, 12 bp, Homo sapiens
ggctcaaatttt

SEQ ID NO: 6329120 - DNA, 23 bp, Homo sapiens
ggctcaaccttccaacttcctgt

SEQ ID NO: 6329121 - DNA, 14 bp, Homo sapiens
ggctcaagaggccc

SEQ ID NO: 6329122 - DNA, 16 bp, Homo sapiens
ggctcaagaggcccag

SEQ ID NO: 6329123 - DNA, 18 bp, Homo sapiens
ggctcaagaggcccaggg

SEQ ID NO: 6329124 - DNA, 20 bp, Homo sapiens
ggctcaagaggcccagggag

SEQ ID NO: 6329125 - DNA, 16 bp, Homo sapiens
ggctcaagctttcccg

SEQ ID NO: 6329126 - DNA, 14 bp, Homo sapiens
ggctcaaggattca

SEQ ID NO: 6329127 - DNA, 21 bp, Homo sapiens
ggctcaaggcaccgcagcctg

SEQ ID NO: 6329128 - DNA, 22 bp, Homo sapiens
ggctcaaggcaccgcagcctgt

SEQ ID NO: 6329129 - DNA, 16 bp, Homo sapiens
ggctcaagtagaaaag

SEQ ID NO: 6329130 - DNA, 16 bp, Homo sapiens
ggctcaagtgatcctc

SEQ ID NO: 6329131 - DNA, 21 bp, Homo sapiens
ggctcaatgcaacctctgccc

SEQ ID NO: 6329132 - DNA, 15 bp, Homo sapiens
ggctcacaaggccca

SEQ ID NO: 6329133 - DNA, 16 bp, Homo sapiens
ggctcacaccagccct

SEQ ID NO: 6329134 - DNA, 15 bp, Homo sapiens
ggctcacacctgcaa

SEQ ID NO: 6329135 - DNA, 17 bp, Homo sapiens
ggctcacactcctgggc

SEQ ID NO: 6329136 - DNA, 18 bp, Homo sapiens
ggctcacactcctgggct

SEQ ID NO: 6329137 - DNA, 21 bp, Homo sapiens
ggctcacacttggctctgagg

SEQ ID NO: 6329138 - DNA, 13 bp, Homo sapiens
ggctcacagccac

SEQ ID NO: 6329139 - DNA, 15 bp, Homo sapiens
ggctcacagccacca

SEQ ID NO: 6329140 - DNA, 19 bp, Homo sapiens
ggctcacagccaccacctg

SEQ ID NO: 6329141 - DNA, 20 bp, Homo sapiens
ggctcacagccaccacctgg

SEQ ID NO: 6329142 - DNA, 21 bp, Homo sapiens
ggctcacagccaccacctgga

SEQ ID NO: 6329143 - DNA, 18 bp, Homo sapiens
ggctcacaggcctctctt

SEQ ID NO: 6329144 - DNA, 15 bp, Homo sapiens
ggctcacagggcagg

SEQ ID NO: 6329145 - DNA, 18 bp, Homo sapiens
ggctcacagggcaggcct

SEQ ID NO: 6329146 - DNA, 19 bp, Homo sapiens
ggctcacatgctccttgcc

SEQ ID NO: 6329147 - DNA, 14 bp, Homo sapiens
ggctcaccagctgg

SEQ ID NO: 6329148 - DNA, 19 bp, Homo sapiens
ggctcacccaagcaaggcc

SEQ ID NO: 6329149 - DNA, 14 bp, Homo sapiens
ggctcacccactgc

SEQ ID NO: 6329150 - DNA, 13 bp, Homo sapiens
ggctcacccagtc

SEQ ID NO: 6329151 - DNA, 16 bp, Homo sapiens
ggctcacccagtcctg

SEQ ID NO: 6329152 - DNA, 17 bp, Homo sapiens
ggctcacccccttctcc

SEQ ID NO: 6329153 - DNA, 22 bp, Homo sapiens
ggctcacccccttctccatcca

SEQ ID NO: 6329154 - DNA, 18 bp, Homo sapiens
ggctcaccttaaaggtca

SEQ ID NO: 6329155 - DNA, 19 bp, Homo sapiens
ggctcacctttagaacagg

SEQ ID NO: 6329156 - DNA, 22 bp, Homo sapiens
ggctcacgccccgctgtgtcct

SEQ ID NO: 6329157 - DNA, 21 bp, Homo sapiens
ggctcacgcctatgatcccag

SEQ ID NO: 6329158 - DNA, 23 bp, Homo sapiens
ggctcacgcctatgatcccagca

SEQ ID NO: 6329159 - DNA, 13 bp, Homo sapiens
ggctcacgcctgt

SEQ ID NO: 6329160 - DNA, 22 bp, Homo sapiens
ggctcacgcctgtaatcccagc

SEQ ID NO: 6329161 - DNA, 20 bp, Homo sapiens
ggctcacggggcctccaacc

SEQ ID NO: 6329162 - DNA, 13 bp, Homo sapiens
ggctcactactga

SEQ ID NO: 6329163 - DNA, 16 bp, Homo sapiens
ggctcactactgaaca

SEQ ID NO: 6329164 - DNA, 17 bp, Homo sapiens
ggctcactatggtgcca

SEQ ID NO: 6329165 - DNA, 22 bp, Homo sapiens
ggctcactcagcacttggccct

SEQ ID NO: 6329166 - DNA, 14 bp, Homo sapiens
ggctcactctggcc

SEQ ID NO: 6329167 - DNA, 21 bp, Homo sapiens
ggctcactgaaacctctgcct

SEQ ID NO: 6329168 - DNA, 15 bp, Homo sapiens
ggctcactgcaacct

SEQ ID NO: 6329169 - DNA, 19 bp, Homo sapiens
ggctcactgcaacctccgc

SEQ ID NO: 6329170 - DNA, 22 bp, Homo sapiens
ggctcactgcaacctcttcctc

SEQ ID NO: 6329171 - DNA, 19 bp, Homo sapiens
ggctcactgcaagctctgc

SEQ ID NO: 6329172 - DNA, 19 bp, Homo sapiens
ggctcactgcagcctccgc

SEQ ID NO: 6329173 - DNA, 18 bp, Homo sapiens
ggctcactgcagcctcga

SEQ ID NO: 6329174 - DNA, 19 bp, Homo sapiens
ggctcactgcatcctccgc

SEQ ID NO: 6329175 - DNA, 13 bp, Homo sapiens
ggctcactgccag

SEQ ID NO: 6329176 - DNA, 16 bp, Homo sapiens
ggctcactgccaggcc

SEQ ID NO: 6329177 - DNA, 19 bp, Homo sapiens
ggctcactgccaggccagc

SEQ ID NO: 6329178 - DNA, 20 bp, Homo sapiens
ggctcactgccaggccagcc

SEQ ID NO: 6329179 - DNA, 13 bp, Homo sapiens
ggctcactgtgct

SEQ ID NO: 6329180 - DNA, 17 bp, Homo sapiens
ggctcagaagaatttaa

SEQ ID NO: 6329181 - DNA, 15 bp, Homo sapiens
ggctcagaagagcag

SEQ ID NO: 6329182 - DNA, 16 bp, Homo sapiens
ggctcagaagagcagc

SEQ ID NO: 6329183 - DNA, 13 bp, Homo sapiens
ggctcagaaggaa

SEQ ID NO: 6329184 - DNA, 22 bp, Homo sapiens
ggctcagacccctcagccccag

SEQ ID NO: 6329185 - DNA, 16 bp, Homo sapiens
ggctcagagaggacaa

SEQ ID NO: 6329186 - DNA, 18 bp, Homo sapiens
ggctcagagaggtagcac

SEQ ID NO: 6329187 - DNA, 23 bp, Homo sapiens
ggctcagagagtacactgtgtct

SEQ ID NO: 6329188 - DNA, 18 bp, Homo sapiens
ggctcagagccggggtgg

SEQ ID NO: 6329189 - DNA, 11 bp, Homo sapiens
ggctcagagct

SEQ ID NO: 6329190 - DNA, 17 bp, Homo sapiens
ggctcagagctgctgag

SEQ ID NO: 6329191 - DNA, 18 bp, Homo sapiens
ggctcagagctgctgagc

SEQ ID NO: 6329192 - DNA, 16 bp, Homo sapiens
ggctcagagctttgtc

SEQ ID NO: 6329193 - DNA, 23 bp, Homo sapiens
ggctcagagctttgtcacttgcc

SEQ ID NO: 6329194 - DNA, 12 bp, Homo sapiens
ggctcagagggg

SEQ ID NO: 6329195 - DNA, 15 bp, Homo sapiens
ggctcagatggactg

SEQ ID NO: 6329196 - DNA, 18 bp, Homo sapiens
ggctcagatggactggga

SEQ ID NO: 6329197 - DNA, 19 bp, Homo sapiens
ggctcagatggactgggag

SEQ ID NO: 6329198 - DNA, 23 bp, Homo sapiens
ggctcagatggggcctgggctgt

SEQ ID NO: 6329199 - DNA, 23 bp, Homo sapiens
ggctcagcaaaagatgcttctca

SEQ ID NO: 6329200 - DNA, 17 bp, Homo sapiens
ggctcagcaaggccacc

SEQ ID NO: 6329201 - DNA, 13 bp, Homo sapiens
ggctcagcagggc

SEQ ID NO: 6329202 - DNA, 19 bp, Homo sapiens
ggctcagcagggctggtca

SEQ ID NO: 6329203 - DNA, 18 bp, Homo sapiens
ggctcagcatcctccacg

SEQ ID NO: 6329204 - DNA, 16 bp, Homo sapiens
ggctcagcccaccctc

SEQ ID NO: 6329205 - DNA, 23 bp, Homo sapiens
ggctcagccccaccccagggcag

SEQ ID NO: 6329206 - DNA, 14 bp, Homo sapiens
ggctcagcccgctg

SEQ ID NO: 6329207 - DNA, 22 bp, Homo sapiens
ggctcagccctagccctcagcc

SEQ ID NO: 6329208 - DNA, 12 bp, Homo sapiens
ggctcagcctgg

SEQ ID NO: 6329209 - DNA, 23 bp, Homo sapiens
ggctcagcctggtttctgggtgc

SEQ ID NO: 6329210 - DNA, 12 bp, Homo sapiens
ggctcagcctgt

SEQ ID NO: 6329211 - DNA, 14 bp, Homo sapiens
ggctcagcctgtct

SEQ ID NO: 6329212 - DNA, 23 bp, Homo sapiens
ggctcagcctgtctcgggctgac

SEQ ID NO: 6329213 - DNA, 14 bp, Homo sapiens
ggctcagccttgca

SEQ ID NO: 6329214 - DNA, 15 bp, Homo sapiens
ggctcagccttgcac

SEQ ID NO: 6329215 - DNA, 17 bp, Homo sapiens
ggctcagccttgcacac

SEQ ID NO: 6329216 - DNA, 22 bp, Homo sapiens
ggctcagccttgcacacccact

SEQ ID NO: 6329217 - DNA, 20 bp, Homo sapiens
ggctcagcggggacagctcc

SEQ ID NO: 6329218 - DNA, 14 bp, Homo sapiens
ggctcagctgtggt

SEQ ID NO: 6329219 - DNA, 20 bp, Homo sapiens
ggctcagctgtggtcccacc

SEQ ID NO: 6329220 - DNA, 16 bp, Homo sapiens
ggctcaggagagggcc

SEQ ID NO: 6329221 - DNA, 20 bp, Homo sapiens
ggctcaggaggaggggtgag

SEQ ID NO: 6329222 - DNA, 14 bp, Homo sapiens
ggctcaggcccagc

SEQ ID NO: 6329223 - DNA, 13 bp, Homo sapiens
ggctcaggctgcc

SEQ ID NO: 6329224 - DNA, 16 bp, Homo sapiens
ggctcaggctgcccag

SEQ ID NO: 6329225 - DNA, 16 bp, Homo sapiens
ggctcagggaccacag

SEQ ID NO: 6329226 - DNA, 17 bp, Homo sapiens
ggctcagggaccacagc

SEQ ID NO: 6329227 - DNA, 18 bp, Homo sapiens
ggctcagggaccacagca

SEQ ID NO: 6329228 - DNA, 17 bp, Homo sapiens
ggctcagggcccacctc

SEQ ID NO: 6329229 - DNA, 16 bp, Homo sapiens
ggctcagggctggagt

SEQ ID NO: 6329230 - DNA, 21 bp, Homo sapiens
ggctcaggggagcaagcttac

SEQ ID NO: 6329231 - DNA, 22 bp, Homo sapiens
ggctcagggttggccatttgct

SEQ ID NO: 6329232 - DNA, 16 bp, Homo sapiens
ggctcaggtcacataa

SEQ ID NO: 6329233 - DNA, 15 bp, Homo sapiens
ggctcagtctcagga

SEQ ID NO: 6329234 - DNA, 18 bp, Homo sapiens
ggctcagtgcaacctctg

SEQ ID NO: 6329235 - DNA, 19 bp, Homo sapiens
ggctcagtgtaggtcccaa

SEQ ID NO: 6329236 - DNA, 15 bp, Homo sapiens
ggctcagttctgcct

SEQ ID NO: 6329237 - DNA, 21 bp, Homo sapiens
ggctcataaaacatgaatcaa

SEQ ID NO: 6329238 - DNA, 20 bp, Homo sapiens
ggctcatagggaagacctgc

SEQ ID NO: 6329239 - DNA, 17 bp, Homo sapiens
ggctcatattcctgcag

SEQ ID NO: 6329240 - DNA, 21 bp, Homo sapiens
ggctcatattcctgcagcctg

SEQ ID NO: 6329241 - DNA, 23 bp, Homo sapiens
ggctcatgcctgtaatcccagca

SEQ ID NO: 6329242 - DNA, 22 bp, Homo sapiens
ggctcattctgcaccttgccag

SEQ ID NO: 6329243 - DNA, 13 bp, Homo sapiens
ggctcattttcta

SEQ ID NO: 6329244 - DNA, 16 bp, Homo sapiens
ggctcatttttgcact

SEQ ID NO: 6329245 - DNA, 23 bp, Homo sapiens
ggctccaacccgttgggtccctt

SEQ ID NO: 6329246 - DNA, 23 bp, Homo sapiens
ggctccaactcctttcagccaca

SEQ ID NO: 6329247 - DNA, 18 bp, Homo sapiens
ggctccaagacctaggct

SEQ ID NO: 6329248 - DNA, 17 bp, Homo sapiens
ggctccaatggggcggg

SEQ ID NO: 6329249 - DNA, 15 bp, Homo sapiens
ggctccacacagcag

SEQ ID NO: 6329250 - DNA, 16 bp, Homo sapiens
ggctccacgccctggg

SEQ ID NO: 6329251 - DNA, 15 bp, Homo sapiens
ggctccacgggggcc

SEQ ID NO: 6329252 - DNA, 22 bp, Homo sapiens
ggctccacgggggcctagtggc

SEQ ID NO: 6329253 - DNA, 9 bp, Homo sapiens
ggctccaga

SEQ ID NO: 6329254 - DNA, 17 bp, Homo sapiens
ggctccagaatgtgctg

SEQ ID NO: 6329255 - DNA, 18 bp, Homo sapiens
ggctccagaatgtgctgc

SEQ ID NO: 6329256 - DNA, 15 bp, Homo sapiens
ggctccagaggacct

SEQ ID NO: 6329257 - DNA, 19 bp, Homo sapiens
ggctccagatgcagggcag

SEQ ID NO: 6329258 - DNA, 14 bp, Homo sapiens
ggctccagcatcca

SEQ ID NO: 6329259 - DNA, 20 bp, Homo sapiens
ggctccagcatccagcctgt

SEQ ID NO: 6329260 - DNA, 15 bp, Homo sapiens
ggctccagccatctc

SEQ ID NO: 6329261 - DNA, 15 bp, Homo sapiens
ggctccagcccctct

SEQ ID NO: 6329262 - DNA, 18 bp, Homo sapiens
ggctccagctctggcaca

SEQ ID NO: 6329263 - DNA, 19 bp, Homo sapiens
ggctccagctctggcacag

SEQ ID NO: 6329264 - DNA, 12 bp, Homo sapiens
ggctccaggact

SEQ ID NO: 6329265 - DNA, 13 bp, Homo sapiens
ggctccaggactc

SEQ ID NO: 6329266 - DNA, 13 bp, Homo sapiens
ggctccaggagca

SEQ ID NO: 6329267 - DNA, 18 bp, Homo sapiens
ggctccaggagcagccac

SEQ ID NO: 6329268 - DNA, 13 bp, Homo sapiens
ggctccaggcagc

SEQ ID NO: 6329269 - DNA, 14 bp, Homo sapiens
ggctccaggccagg

SEQ ID NO: 6329270 - DNA, 16 bp, Homo sapiens
ggctccaggccagggg

SEQ ID NO: 6329271 - DNA, 20 bp, Homo sapiens
gtgagaattgggactctgtt

SEQ ID NO: 6329272 - DNA, 12 bp, Homo sapiens
gtgagacagact

SEQ ID NO: 6329273 - DNA, 12 bp, Homo sapiens
gtgagacagcaa

SEQ ID NO: 6329274 - DNA, 14 bp, Homo sapiens
gtgagacagcaagt

SEQ ID NO: 6329275 - DNA, 18 bp, Homo sapiens
gtgagacagtccagcctg

SEQ ID NO: 6329276 - DNA, 15 bp, Homo sapiens
gtgagacagtggggg

SEQ ID NO: 6329277 - DNA, 17 bp, Homo sapiens
gtgagaccaaattgagc

SEQ ID NO: 6329278 - DNA, 15 bp, Homo sapiens
gtgagacccccacac

SEQ ID NO: 6329279 - DNA, 16 bp, Homo sapiens
gtgagaccccgcactg

SEQ ID NO: 6329280 - DNA, 20 bp, Homo sapiens
gtgagaccccgcactgcaga

SEQ ID NO: 6329281 - DNA, 13 bp, Homo sapiens
gtgagacctgccc

SEQ ID NO: 6329282 - DNA, 23 bp, Homo sapiens
gtgagacctgcccctcctctctg

SEQ ID NO: 6329283 - DNA, 16 bp, Homo sapiens
gtgagacgaggcaggg

SEQ ID NO: 6329284 - DNA, 18 bp, Homo sapiens
gtgagacgaggcaggggc

SEQ ID NO: 6329285 - DNA, 19 bp, Homo sapiens
gtgagacgccaccattcct

SEQ ID NO: 6329286 - DNA, 15 bp, Homo sapiens
gtgagactccatctc

SEQ ID NO: 6329287 - DNA, 16 bp, Homo sapiens
gtgagactccatctca

SEQ ID NO: 6329288 - DNA, 19 bp, Homo sapiens
gtgagactgcaggtgggct

SEQ ID NO: 6329289 - DNA, 23 bp, Homo sapiens
gtgagactgggaaggcttgggat

SEQ ID NO: 6329290 - DNA, 13 bp, Homo sapiens
gtgagagaaagag

SEQ ID NO: 6329291 - DNA, 14 bp, Homo sapiens
gtgagagaaagaga

SEQ ID NO: 6329292 - DNA, 18 bp, Homo sapiens
gtgagagaaagagaaatc

SEQ ID NO: 6329293 - DNA, 20 bp, Homo sapiens
gtgagagaaagagagaagcc

SEQ ID NO: 6329294 - DNA, 21 bp, Homo sapiens
gtgagagaataatttctgttg

SEQ ID NO: 6329295 - DNA, 15 bp, Homo sapiens
gtgagagaatgtatt

SEQ ID NO: 6329296 - DNA, 13 bp, Homo sapiens
gtgagagaattta

SEQ ID NO: 6329297 - DNA, 16 bp, Homo sapiens
gtgagagaatttatca

SEQ ID NO: 6329298 - DNA, 19 bp, Homo sapiens
gtgagagacctgctcaggc

SEQ ID NO: 6329299 - DNA, 17 bp, Homo sapiens
gtgagagagatgggagc

SEQ ID NO: 6329300 - DNA, 14 bp, Homo sapiens
gtgagagaggacct

SEQ ID NO: 6329301 - DNA, 15 bp, Homo sapiens
gtgagagaggacctc

SEQ ID NO: 6329302 - DNA, 18 bp, Homo sapiens
gtgagagaggaggcctgg

SEQ ID NO: 6329303 - DNA, 20 bp, Homo sapiens
gtgagagaggaggcctggac

SEQ ID NO: 6329304 - DNA, 21 bp, Homo sapiens
gtgagagaggaggcctggacc

SEQ ID NO: 6329305 - DNA, 15 bp, Homo sapiens
gtgagagagtggctg

SEQ ID NO: 6329306 - DNA, 18 bp, Homo sapiens
gtgagagagtggctgggg

SEQ ID NO: 6329307 - DNA, 15 bp, Homo sapiens
gtgagagcacaaaga

SEQ ID NO: 6329308 - DNA, 16 bp, Homo sapiens
gtgagagcacaaagat

SEQ ID NO: 6329309 - DNA, 12 bp, Homo sapiens
gtgagagcccat

SEQ ID NO: 6329310 - DNA, 12 bp, Homo sapiens
gtgagagctggt

SEQ ID NO: 6329311 - DNA, 12 bp, Homo sapiens
gtgagaggcagc

SEQ ID NO: 6329312 - DNA, 15 bp, Homo sapiens
gtgagaggcccccac

SEQ ID NO: 6329313 - DNA, 17 bp, Homo sapiens
gtgagagggctgttaac

SEQ ID NO: 6329314 - DNA, 16 bp, Homo sapiens
gtgagagtcaaagctg

SEQ ID NO: 6329315 - DNA, 13 bp, Homo sapiens
gtgagagtgagct

SEQ ID NO: 6329316 - DNA, 18 bp, Homo sapiens
gtgagagtgtgagcaggg

SEQ ID NO: 6329317 - DNA, 14 bp, Homo sapiens
gtgagagttgtctc

SEQ ID NO: 6329318 - DNA, 15 bp, Homo sapiens
gtgagagttgtctct

SEQ ID NO: 6329319 - DNA, 15 bp, Homo sapiens
gtgagagtttggtga

SEQ ID NO: 6329320 - DNA, 16 bp, Homo sapiens
gtgagatacccagaga

SEQ ID NO: 6329321 - DNA, 20 bp, Homo sapiens
gtgagatacccagagagaaa

SEQ ID NO: 6329322 - DNA, 22 bp, Homo sapiens
gtgagatacccagagagaaaaa

SEQ ID NO: 6329323 - DNA, 21 bp, Homo sapiens
gtgagatataggataaaataa

SEQ ID NO: 6329324 - DNA, 20 bp, Homo sapiens
gtgagatcacagcctccagg

SEQ ID NO: 6329325 - DNA, 23 bp, Homo sapiens
gtgagatcctctttactctgggc

SEQ ID NO: 6329326 - DNA, 16 bp, Homo sapiens
gtgagatgcagctgga

SEQ ID NO: 6329327 - DNA, 15 bp, Homo sapiens
gtgagatgctggaga

SEQ ID NO: 6329328 - DNA, 17 bp, Homo sapiens
gtgagatgctggagaag

SEQ ID NO: 6329329 - DNA, 12 bp, Homo sapiens
gtgagatggaat

SEQ ID NO: 6329330 - DNA, 20 bp, Homo sapiens
gtgagatggacttggggcct

SEQ ID NO: 6329331 - DNA, 15 bp, Homo sapiens
gtgagatgggaaggg

SEQ ID NO: 6329332 - DNA, 21 bp, Homo sapiens
gtgagatggtgccccctgggg

SEQ ID NO: 6329333 - DNA, 20 bp, Homo sapiens
gtgagatttagggttctata

SEQ ID NO: 6329334 - DNA, 23 bp, Homo sapiens
gtgagatttagggttctatattt

SEQ ID NO: 6329335 - DNA, 18 bp, Homo sapiens
gtgagattttttattgct

SEQ ID NO: 6329336 - DNA, 21 bp, Homo sapiens
gtgagcaaaatatgccccttc

SEQ ID NO: 6329337 - DNA, 18 bp, Homo sapiens
gtgagcaaacctgcccca

SEQ ID NO: 6329338 - DNA, 21 bp, Homo sapiens
gtgagcaacatttattattta

SEQ ID NO: 6329339 - DNA, 13 bp, Homo sapiens
gtgagcaaccagc

SEQ ID NO: 6329340 - DNA, 18 bp, Homo sapiens
gtgagcaaccagctggaa

SEQ ID NO: 6329341 - DNA, 21 bp, Homo sapiens
gtgagcaagaagtcaaagtaa

SEQ ID NO: 6329342 - DNA, 17 bp, Homo sapiens
gtgagcaagagccaggg

SEQ ID NO: 6329343 - DNA, 17 bp, Homo sapiens
gtgagcacaaagaagaa

SEQ ID NO: 6329344 - DNA, 18 bp, Homo sapiens
gtgagcaccaccagggct

SEQ ID NO: 6329345 - DNA, 16 bp, Homo sapiens
gtgagcactcccaagt

SEQ ID NO: 6329346 - DNA, 16 bp, Homo sapiens
gtgagcactctggggt

SEQ ID NO: 6329347 - DNA, 17 bp, Homo sapiens
gtgagcactctggggtg

SEQ ID NO: 6329348 - DNA, 12 bp, Homo sapiens
gtgagcagaaca

SEQ ID NO: 6329349 - DNA, 14 bp, Homo sapiens
gtgagcagaacagg

SEQ ID NO: 6329350 - DNA, 20 bp, Homo sapiens
gtgagcagaagtggagctgg

SEQ ID NO: 6329351 - DNA, 15 bp, Homo sapiens
gtgagcagagcggga

SEQ ID NO: 6329352 - DNA, 21 bp, Homo sapiens
gtgagcagatctgaaaggcac

SEQ ID NO: 6329353 - DNA, 15 bp, Homo sapiens
gtgagcagcctccac

SEQ ID NO: 6329354 - DNA, 21 bp, Homo sapiens
gtgagcagcctggagccctgg

SEQ ID NO: 6329355 - DNA, 18 bp, Homo sapiens
gtgagcaggaaggcctgg

SEQ ID NO: 6329356 - DNA, 19 bp, Homo sapiens
gtgagcaggaaggcctggg

SEQ ID NO: 6329357 - DNA, 15 bp, Homo sapiens
gtgagcaggctgtga

SEQ ID NO: 6329358 - DNA, 17 bp, Homo sapiens
gtgagcaggctgtgagt

SEQ ID NO: 6329359 - DNA, 20 bp, Homo sapiens
gtgagcagggccctcagagg

SEQ ID NO: 6329360 - DNA, 20 bp, Homo sapiens
gtgagcagggtcaagcctct

SEQ ID NO: 6329361 - DNA, 13 bp, Homo sapiens
gtgagcagggtga

SEQ ID NO: 6329362 - DNA, 18 bp, Homo sapiens
gtgagcagggtggggtct

SEQ ID NO: 6329363 - DNA, 22 bp, Homo sapiens
gtgagcagggtggggtctggga

SEQ ID NO: 6329364 - DNA, 16 bp, Homo sapiens
gtgagcatcagagggc

SEQ ID NO: 6329365 - DNA, 19 bp, Homo sapiens
gtgagcatgggtgtgccct

SEQ ID NO: 6329366 - DNA, 23 bp, Homo sapiens
gtgagcatgtaagtgttaagttt

SEQ ID NO: 6329367 - DNA, 19 bp, Homo sapiens
gtgagcatgtttggaaggg

SEQ ID NO: 6329368 - DNA, 16 bp, Homo sapiens
gtgagccaaaatcatg

SEQ ID NO: 6329369 - DNA, 16 bp, Homo sapiens
gtgagccaagaaacac

SEQ ID NO: 6329370 - DNA, 16 bp, Homo sapiens
gtgagccacagaccac

SEQ ID NO: 6329371 - DNA, 20 bp, Homo sapiens
gtgagccacagaccacctgc

SEQ ID NO: 6329372 - DNA, 21 bp, Homo sapiens
gtgagccacagaccacctgct

SEQ ID NO: 6329373 - DNA, 20 bp, Homo sapiens
gtgagccacagcactcggcc

SEQ ID NO: 6329374 - DNA, 15 bp, Homo sapiens
gtgagccaccacgcc

SEQ ID NO: 6329375 - DNA, 14 bp, Homo sapiens
gtgagccaccgctg

SEQ ID NO: 6329376 - DNA, 19 bp, Homo sapiens
gtgagccaccgtgcctggc

SEQ ID NO: 6329377 - DNA, 19 bp, Homo sapiens
gtgagccactcagtctctt

SEQ ID NO: 6329378 - DNA, 20 bp, Homo sapiens
gtgagccactgcaccgggcc

SEQ ID NO: 6329379 - DNA, 18 bp, Homo sapiens
gtgagccactgcgcccag

SEQ ID NO: 6329380 - DNA, 14 bp, Homo sapiens
gtgagccactgtgc

SEQ ID NO: 6329381 - DNA, 20 bp, Homo sapiens
gtgagccaggtaatgaggga

SEQ ID NO: 6329382 - DNA, 20 bp, Homo sapiens
gtgagcccagctgggtcagg

SEQ ID NO: 6329383 - DNA, 14 bp, Homo sapiens
gtgagccccacagc

SEQ ID NO: 6329384 - DNA, 17 bp, Homo sapiens
gtgagccccaggggggc

SEQ ID NO: 6329385 - DNA, 21 bp, Homo sapiens
gtgagccccaggggggcctcc

SEQ ID NO: 6329386 - DNA, 23 bp, Homo sapiens
gtgagccccaggggggcctcctc

SEQ ID NO: 6329387 - DNA, 19 bp, Homo sapiens
gtgagcccccacgctggcc

SEQ ID NO: 6329388 - DNA, 17 bp, Homo sapiens
gtgagcccctggtcctg

SEQ ID NO: 6329389 - DNA, 22 bp, Homo sapiens
gtgagccctctagggcagggtg

SEQ ID NO: 6329390 - DNA, 15 bp, Homo sapiens
gtgagccctgctctt

SEQ ID NO: 6329391 - DNA, 19 bp, Homo sapiens
gtgagccctgctcttctct

SEQ ID NO: 6329392 - DNA, 24 bp, Homo sapiens
gtgagccctgctcttctctcccca

SEQ ID NO: 6329393 - DNA, 19 bp, Homo sapiens
gtgagccgagatcacgcca

SEQ ID NO: 6329394 - DNA, 17 bp, Homo sapiens
gtgagccgccaggaacc

SEQ ID NO: 6329395 - DNA, 15 bp, Homo sapiens
gtgagccgcctcgga

SEQ ID NO: 6329396 - DNA, 17 bp, Homo sapiens
gtgagcctagccctggg

SEQ ID NO: 6329397 - DNA, 17 bp, Homo sapiens
gtgagcctcctgtgcct

SEQ ID NO: 6329398 - DNA, 12 bp, Homo sapiens
gtgagcctctgc

SEQ ID NO: 6329399 - DNA, 17 bp, Homo sapiens
gtgagcctctgcgcctc

SEQ ID NO: 6329400 - DNA, 14 bp, Homo sapiens
gtgagcctggctct

SEQ ID NO: 6329401 - DNA, 23 bp, Homo sapiens
gtgagccttgcatgacatcatga

SEQ ID NO: 6329402 - DNA, 23 bp, Homo sapiens
gtgagccttttgcaggaaaaggc

SEQ ID NO: 6329403 - DNA, 13 bp, Homo sapiens
gtgagcgaagccc

SEQ ID NO: 6329404 - DNA, 22 bp, Homo sapiens
gtgagcgagtggatgctgtgct

SEQ ID NO: 6329405 - DNA, 19 bp, Homo sapiens
gtgagcgatcatttatttc

SEQ ID NO: 6329406 - DNA, 17 bp, Homo sapiens
gtgagcgccccgccccc

SEQ ID NO: 6329407 - DNA, 14 bp, Homo sapiens
gtgagcggccgctg

SEQ ID NO: 6329408 - DNA, 14 bp, Homo sapiens
gtgagcgggtgggg

SEQ ID NO: 6329409 - DNA, 16 bp, Homo sapiens
gtgagcgtggccttgg

SEQ ID NO: 6329410 - DNA, 17 bp, Homo sapiens
gtgagcgtggccttggg

SEQ ID NO: 6329411 - DNA, 14 bp, Homo sapiens
gtgagctacaaatg

SEQ ID NO: 6329412 - DNA, 15 bp, Homo sapiens
gtgagctacagagcc

SEQ ID NO: 6329413 - DNA, 15 bp, Homo sapiens
gtgagctaccaggaa

SEQ ID NO: 6329414 - DNA, 21 bp, Homo sapiens
gtgagctaggagaagggctga

SEQ ID NO: 6329415 - DNA, 15 bp, Homo sapiens
gtgagctatgagccc

SEQ ID NO: 6329416 - DNA, 16 bp, Homo sapiens
gtgagctcaggagaga

SEQ ID NO: 6329417 - DNA, 16 bp, Homo sapiens
gtgagctctcaggccg

SEQ ID NO: 6329418 - DNA, 15 bp, Homo sapiens
gtgagctctggtgga

SEQ ID NO: 6329419 - DNA, 18 bp, Homo sapiens
gtgagctctggtggagac

SEQ ID NO: 6329420 - DNA, 23 bp, Homo sapiens
gtgagctcttcctatccctctcc

SEQ ID NO: 6329421 - DNA, 14 bp, Homo sapiens
gtgagctgagatca

SEQ ID NO: 6329422 - DNA, 19 bp, Homo sapiens
gtgagctgagatcacgcca

SEQ ID NO: 6329423 - DNA, 16 bp, Homo sapiens
gtgagctgagcaggcc

SEQ ID NO: 6329424 - DNA, 13 bp, Homo sapiens
gtgagctgcacca

SEQ ID NO: 6329425 - DNA, 22 bp, Homo sapiens
gtgagctgcccggcgcctgccc

SEQ ID NO: 6329426 - DNA, 14 bp, Homo sapiens
gtgagctgggaagc

SEQ ID NO: 6329427 - DNA, 16 bp, Homo sapiens
gtgagctgggaagctg

SEQ ID NO: 6329428 - DNA, 23 bp, Homo sapiens
gtgagctggggactcagggaccg

SEQ ID NO: 6329429 - DNA, 15 bp, Homo sapiens
gtgagctggtagagg

SEQ ID NO: 6329430 - DNA, 21 bp, Homo sapiens
gtgaggaaagtgcgttctccc

SEQ ID NO: 6329431 - DNA, 14 bp, Homo sapiens
gtgaggaaatcaaa

SEQ ID NO: 6329432 - DNA, 22 bp, Homo sapiens
gtgaggaaatccattgtttaaa

SEQ ID NO: 6329433 - DNA, 21 bp, Homo sapiens
gtgaggacaaattgagacagt

SEQ ID NO: 6329434 - DNA, 23 bp, Homo sapiens
gtgaggacaaggtacaggcaagg

SEQ ID NO: 6329435 - DNA, 18 bp, Homo sapiens
gtgaggacagggccccca

SEQ ID NO: 6329436 - DNA, 17 bp, Homo sapiens
gtgaggacctgcggcct

SEQ ID NO: 6329437 - DNA, 23 bp, Homo sapiens
gtgaggactcggccactgtgtct

SEQ ID NO: 6329438 - DNA, 15 bp, Homo sapiens
gtgaggagctgctgg

SEQ ID NO: 6329439 - DNA, 18 bp, Homo sapiens
gtgaggagctgctggctt

SEQ ID NO: 6329440 - DNA, 18 bp, Homo sapiens
gtgaggagcttgaaaccc

SEQ ID NO: 6329441 - DNA, 13 bp, Homo sapiens
gtgaggaggaaaa

SEQ ID NO: 6329442 - DNA, 16 bp, Homo sapiens
gtgaggaggaggcaga

SEQ ID NO: 6329443 - DNA, 22 bp, Homo sapiens
gtgaggaggaggcagaaccagc

SEQ ID NO: 6329444 - DNA, 12 bp, Homo sapiens
gtgaggagggat

SEQ ID NO: 6329445 - DNA, 12 bp, Homo sapiens
gtgaggagggtg

SEQ ID NO: 6329446 - DNA, 21 bp, Homo sapiens
gtgaggagtccagcacaacct

SEQ ID NO: 6329447 - DNA, 20 bp, Homo sapiens
gtgaggatagagacttgcag

SEQ ID NO: 6329448 - DNA, 16 bp, Homo sapiens
gtgaggataggacaga

SEQ ID NO: 6329449 - DNA, 18 bp, Homo sapiens
gtgaggatgtcactcaga

SEQ ID NO: 6329450 - DNA, 18 bp, Homo sapiens
ggctccaggccagggggc

SEQ ID NO: 6329451 - DNA, 13 bp, Homo sapiens
ggctccaggctcc

SEQ ID NO: 6329452 - DNA, 17 bp, Homo sapiens
ggctccaggctccaggc

SEQ ID NO: 6329453 - DNA, 19 bp, Homo sapiens
ggctccaggctccaggctg

SEQ ID NO: 6329454 - DNA, 16 bp, Homo sapiens
ggctccaggctccttt

SEQ ID NO: 6329455 - DNA, 12 bp, Homo sapiens
ggctccaggctg

SEQ ID NO: 6329456 - DNA, 13 bp, Homo sapiens
ggctccaggctgg

SEQ ID NO: 6329457 - DNA, 22 bp, Homo sapiens
ggctccagggggtgccctccca

SEQ ID NO: 6329458 - DNA, 19 bp, Homo sapiens
ggctccaggtccggagggg

SEQ ID NO: 6329459 - DNA, 22 bp, Homo sapiens
ggctccagtctgctgccctcca

SEQ ID NO: 6329460 - DNA, 20 bp, Homo sapiens
ggctccatatcatttgagtt

SEQ ID NO: 6329461 - DNA, 19 bp, Homo sapiens
ggctccatgattctctgag

SEQ ID NO: 6329462 - DNA, 20 bp, Homo sapiens
ggctccatgattctctgagt

SEQ ID NO: 6329463 - DNA, 13 bp, Homo sapiens
ggctccatgcacc

SEQ ID NO: 6329464 - DNA, 17 bp, Homo sapiens
ggctccatgcacctccc

SEQ ID NO: 6329465 - DNA, 13 bp, Homo sapiens
ggctccatgccag

SEQ ID NO: 6329466 - DNA, 21 bp, Homo sapiens
ggctccatgcctctggaggcc

SEQ ID NO: 6329467 - DNA, 20 bp, Homo sapiens
ggctccatgctgggtctgag

SEQ ID NO: 6329468 - DNA, 17 bp, Homo sapiens
ggctccatggaggaggt

SEQ ID NO: 6329469 - DNA, 18 bp, Homo sapiens
ggctccatggaggaggtg

SEQ ID NO: 6329470 - DNA, 22 bp, Homo sapiens
ggctcccaaaacacctgacagc

SEQ ID NO: 6329471 - DNA, 17 bp, Homo sapiens
ggctcccaatcagcttt

SEQ ID NO: 6329472 - DNA, 18 bp, Homo sapiens
ggctcccacaggcccttc

SEQ ID NO: 6329473 - DNA, 20 bp, Homo sapiens
ggctcccacaggcccttcct

SEQ ID NO: 6329474 - DNA, 13 bp, Homo sapiens
ggctcccacaggt

SEQ ID NO: 6329475 - DNA, 15 bp, Homo sapiens
ggctcccacgccctc

SEQ ID NO: 6329476 - DNA, 21 bp, Homo sapiens
ggctcccacgccctcctccct

SEQ ID NO: 6329477 - DNA, 17 bp, Homo sapiens
ggctcccagccaggccc

SEQ ID NO: 6329478 - DNA, 20 bp, Homo sapiens
ggctcccaggagcctgccca

SEQ ID NO: 6329479 - DNA, 22 bp, Homo sapiens
ggctcccaggagcctgcccagc

SEQ ID NO: 6329480 - DNA, 17 bp, Homo sapiens
ggctcccagggacacct

SEQ ID NO: 6329481 - DNA, 12 bp, Homo sapiens
ggctcccagggg

SEQ ID NO: 6329482 - DNA, 22 bp, Homo sapiens
ggctcccaggggctccctccgc

SEQ ID NO: 6329483 - DNA, 20 bp, Homo sapiens
ggctcccaggggtctccctg

SEQ ID NO: 6329484 - DNA, 23 bp, Homo sapiens
ggctcccaggggtctccctggct

SEQ ID NO: 6329485 - DNA, 12 bp, Homo sapiens
ggctcccagggt

SEQ ID NO: 6329486 - DNA, 21 bp, Homo sapiens
ggctcccagggtccctgccca

SEQ ID NO: 6329487 - DNA, 17 bp, Homo sapiens
ggctcccatgtcaagag

SEQ ID NO: 6329488 - DNA, 11 bp, Homo sapiens
ggctccccaag

SEQ ID NO: 6329489 - DNA, 18 bp, Homo sapiens
ggctccccaagacttgac

SEQ ID NO: 6329490 - DNA, 14 bp, Homo sapiens
ggctccccaccccg

SEQ ID NO: 6329491 - DNA, 15 bp, Homo sapiens
ggctccccacctgga

SEQ ID NO: 6329492 - DNA, 23 bp, Homo sapiens
ggctccccagaactggctgggcc

SEQ ID NO: 6329493 - DNA, 11 bp, Homo sapiens
ggctccccagg

SEQ ID NO: 6329494 - DNA, 21 bp, Homo sapiens
ggctccccaggaagcccactg

SEQ ID NO: 6329495 - DNA, 21 bp, Homo sapiens
ggctccccagtgctcctggcc

SEQ ID NO: 6329496 - DNA, 17 bp, Homo sapiens
ggctccccatgtgtcct

SEQ ID NO: 6329497 - DNA, 19 bp, Homo sapiens
ggctccccctccagccaga

SEQ ID NO: 6329498 - DNA, 21 bp, Homo sapiens
ggctccccctccagccagaga

SEQ ID NO: 6329499 - DNA, 16 bp, Homo sapiens
ggctccccctccccag

SEQ ID NO: 6329500 - DNA, 20 bp, Homo sapiens
ggctccccctccccaggctg

SEQ ID NO: 6329501 - DNA, 23 bp, Homo sapiens
ggctccccctccccaggctggag

SEQ ID NO: 6329502 - DNA, 16 bp, Homo sapiens
ggctccccctgccagc

SEQ ID NO: 6329503 - DNA, 19 bp, Homo sapiens
ggctccccctgccagcaac

SEQ ID NO: 6329504 - DNA, 22 bp, Homo sapiens
ggctccccctggacggggcggg

SEQ ID NO: 6329505 - DNA, 13 bp, Homo sapiens
ggctccccgcctc

SEQ ID NO: 6329506 - DNA, 16 bp, Homo sapiens
ggctccccgcctccac

SEQ ID NO: 6329507 - DNA, 21 bp, Homo sapiens
ggctccccgggggcagacacc

SEQ ID NO: 6329508 - DNA, 18 bp, Homo sapiens
ggctcccctcccagggga

SEQ ID NO: 6329509 - DNA, 20 bp, Homo sapiens
ggctcccctcgacagctctc

SEQ ID NO: 6329510 - DNA, 13 bp, Homo sapiens
ggctcccctctgc

SEQ ID NO: 6329511 - DNA, 15 bp, Homo sapiens
ggctcccctgcagcc

SEQ ID NO: 6329512 - DNA, 23 bp, Homo sapiens
ggctcccctgcagccctggccca

SEQ ID NO: 6329513 - DNA, 14 bp, Homo sapiens
ggctcccgaagaat

SEQ ID NO: 6329514 - DNA, 14 bp, Homo sapiens
ggctcccgcttgct

SEQ ID NO: 6329515 - DNA, 15 bp, Homo sapiens
ggctcccgcttgctc

SEQ ID NO: 6329516 - DNA, 23 bp, Homo sapiens
ggctcccgcttgctctcctggag

SEQ ID NO: 6329517 - DNA, 16 bp, Homo sapiens
ggctcccggggcctgg

SEQ ID NO: 6329518 - DNA, 20 bp, Homo sapiens
ggctcccggggcctggacag

SEQ ID NO: 6329519 - DNA, 21 bp, Homo sapiens
ggctccctacattccccagag

SEQ ID NO: 6329520 - DNA, 11 bp, Homo sapiens
ggctccctccc

SEQ ID NO: 6329521 - DNA, 13 bp, Homo sapiens
ggctccctccgcc

SEQ ID NO: 6329522 - DNA, 11 bp, Homo sapiens
ggctccctcct

SEQ ID NO: 6329523 - DNA, 15 bp, Homo sapiens
ggctccctcctctgg

SEQ ID NO: 6329524 - DNA, 19 bp, Homo sapiens
ggctccctcctctggcagg

SEQ ID NO: 6329525 - DNA, 13 bp, Homo sapiens
ggctccctgacca

SEQ ID NO: 6329526 - DNA, 17 bp, Homo sapiens
ggctccctgactgggag

SEQ ID NO: 6329527 - DNA, 17 bp, Homo sapiens
ggctccctgatggggga

SEQ ID NO: 6329528 - DNA, 18 bp, Homo sapiens
ggctccctgctccctccc

SEQ ID NO: 6329529 - DNA, 15 bp, Homo sapiens
ggctccctggaggac

SEQ ID NO: 6329530 - DNA, 14 bp, Homo sapiens
ggctccctggcagg

SEQ ID NO: 6329531 - DNA, 13 bp, Homo sapiens
ggctccctgggct

SEQ ID NO: 6329532 - DNA, 17 bp, Homo sapiens
ggctccctgggctggca

SEQ ID NO: 6329533 - DNA, 20 bp, Homo sapiens
ggctccctgtaacctcttca

SEQ ID NO: 6329534 - DNA, 21 bp, Homo sapiens
ggctccctgtaacctcttcag

SEQ ID NO: 6329535 - DNA, 21 bp, Homo sapiens
ggctcccttcatctccaggga

SEQ ID NO: 6329536 - DNA, 20 bp, Homo sapiens
ggctcccttcccacctctct

SEQ ID NO: 6329537 - DNA, 16 bp, Homo sapiens
ggctcccttcctccca

SEQ ID NO: 6329538 - DNA, 19 bp, Homo sapiens
ggctccgagggcggccagg

SEQ ID NO: 6329539 - DNA, 22 bp, Homo sapiens
ggctccgagggcggccagggac

SEQ ID NO: 6329540 - DNA, 16 bp, Homo sapiens
ggctccgggtcactgc

SEQ ID NO: 6329541 - DNA, 18 bp, Homo sapiens
ggctccgggtcactgctg

SEQ ID NO: 6329542 - DNA, 14 bp, Homo sapiens
ggctccgtgagccc

SEQ ID NO: 6329543 - DNA, 17 bp, Homo sapiens
ggctccgtgagcccttg

SEQ ID NO: 6329544 - DNA, 19 bp, Homo sapiens
ggctcctaccactggacag

SEQ ID NO: 6329545 - DNA, 20 bp, Homo sapiens
ggctcctacctgtctgctgc

SEQ ID NO: 6329546 - DNA, 17 bp, Homo sapiens
ggctcctattcaacaca

SEQ ID NO: 6329547 - DNA, 14 bp, Homo sapiens
ggctcctcacatag

SEQ ID NO: 6329548 - DNA, 13 bp, Homo sapiens
ggctcctcagagc

SEQ ID NO: 6329549 - DNA, 22 bp, Homo sapiens
ggctcctcagagcgccaggaag

SEQ ID NO: 6329550 - DNA, 13 bp, Homo sapiens
ggctcctcagccc

SEQ ID NO: 6329551 - DNA, 18 bp, Homo sapiens
ggctcctcagccctctct

SEQ ID NO: 6329552 - DNA, 13 bp, Homo sapiens
ggctcctccagca

SEQ ID NO: 6329553 - DNA, 20 bp, Homo sapiens
ggctcctccatctagagatt

SEQ ID NO: 6329554 - DNA, 13 bp, Homo sapiens
ggctcctcccagc

SEQ ID NO: 6329555 - DNA, 14 bp, Homo sapiens
ggctcctcccagca

SEQ ID NO: 6329556 - DNA, 23 bp, Homo sapiens
ggctcctcccagcacaggcacct

SEQ ID NO: 6329557 - DNA, 16 bp, Homo sapiens
ggctcctccctccctc

SEQ ID NO: 6329558 - DNA, 21 bp, Homo sapiens
ggctcctccctctgcctcatc

SEQ ID NO: 6329559 - DNA, 23 bp, Homo sapiens
ggctcctccctctgcctcatcct

SEQ ID NO: 6329560 - DNA, 16 bp, Homo sapiens
ggctcctccctggagc

SEQ ID NO: 6329561 - DNA, 20 bp, Homo sapiens
ggctcctccgtctgaccctc

SEQ ID NO: 6329562 - DNA, 16 bp, Homo sapiens
ggctcctcctcaccca

SEQ ID NO: 6329563 - DNA, 19 bp, Homo sapiens
ggctcctcctcacccacct

SEQ ID NO: 6329564 - DNA, 18 bp, Homo sapiens
ggctcctcctgaaggagg

SEQ ID NO: 6329565 - DNA, 17 bp, Homo sapiens
ggctcctcgcccccacc

SEQ ID NO: 6329566 - DNA, 11 bp, Homo sapiens
ggctcctctta

SEQ ID NO: 6329567 - DNA, 20 bp, Homo sapiens
ggctcctcttagctcagctg

SEQ ID NO: 6329568 - DNA, 16 bp, Homo sapiens
ggctcctgacctacct

SEQ ID NO: 6329569 - DNA, 9 bp, Homo sapiens
ggctcctgc

SEQ ID NO: 6329570 - DNA, 16 bp, Homo sapiens
ggctcctgccactgac

SEQ ID NO: 6329571 - DNA, 12 bp, Homo sapiens
ggctcctgccag

SEQ ID NO: 6329572 - DNA, 21 bp, Homo sapiens
ggctcctgcccaggccacaga

SEQ ID NO: 6329573 - DNA, 12 bp, Homo sapiens
ggctcctgcccc

SEQ ID NO: 6329574 - DNA, 22 bp, Homo sapiens
ggctcctgcccctttcaggcct

SEQ ID NO: 6329575 - DNA, 17 bp, Homo sapiens
ggctcctgccttctgtc

SEQ ID NO: 6329576 - DNA, 14 bp, Homo sapiens
ggctcctgccttga

SEQ ID NO: 6329577 - DNA, 22 bp, Homo sapiens
ggctcctgccttgatgaagccc

SEQ ID NO: 6329578 - DNA, 11 bp, Homo sapiens
ggctcctgctg

SEQ ID NO: 6329579 - DNA, 16 bp, Homo sapiens
ggctcctgctgcacca

SEQ ID NO: 6329580 - DNA, 21 bp, Homo sapiens
ggctcctgctgcaccaaccca

SEQ ID NO: 6329581 - DNA, 22 bp, Homo sapiens
ggctcctgctgcaccaacccag

SEQ ID NO: 6329582 - DNA, 13 bp, Homo sapiens
ggctcctggagcc

SEQ ID NO: 6329583 - DNA, 18 bp, Homo sapiens
ggctcctggctgccaggc

SEQ ID NO: 6329584 - DNA, 15 bp, Homo sapiens
ggctcctggctgtgc

SEQ ID NO: 6329585 - DNA, 17 bp, Homo sapiens
ggctcctggctgtgccc

SEQ ID NO: 6329586 - DNA, 19 bp, Homo sapiens
ggctcctgggaggccctgg

SEQ ID NO: 6329587 - DNA, 11 bp, Homo sapiens
ggctcctgggg

SEQ ID NO: 6329588 - DNA, 19 bp, Homo sapiens
ggctcctgggttggaggga

SEQ ID NO: 6329589 - DNA, 23 bp, Homo sapiens
ggctcctggtcacctaggaagcc

SEQ ID NO: 6329590 - DNA, 12 bp, Homo sapiens
ggctcctgtgct

SEQ ID NO: 6329591 - DNA, 23 bp, Homo sapiens
ggctcctgtgctactttgccttt

SEQ ID NO: 6329592 - DNA, 18 bp, Homo sapiens
ggctcctgtggcagctgc

SEQ ID NO: 6329593 - DNA, 12 bp, Homo sapiens
ggctcctgtggt

SEQ ID NO: 6329594 - DNA, 13 bp, Homo sapiens
ggctcctgtggta

SEQ ID NO: 6329595 - DNA, 16 bp, Homo sapiens
ggctcctgtggtagtc

SEQ ID NO: 6329596 - DNA, 16 bp, Homo sapiens
ggctcctgtgtggagt

SEQ ID NO: 6329597 - DNA, 18 bp, Homo sapiens
ggctcctgttagctcctc

SEQ ID NO: 6329598 - DNA, 21 bp, Homo sapiens
ggctcctgttagctcctcact

SEQ ID NO: 6329599 - DNA, 14 bp, Homo sapiens
ggctccttcccctg

SEQ ID NO: 6329600 - DNA, 12 bp, Homo sapiens
ggctccttgcag

SEQ ID NO: 6329601 - DNA, 17 bp, Homo sapiens
ggctccttgtgggcctg

SEQ ID NO: 6329602 - DNA, 22 bp, Homo sapiens
ggctccttgtgggcctgggctc

SEQ ID NO: 6329603 - DNA, 11 bp, Homo sapiens
ggctcctttcc

SEQ ID NO: 6329604 - DNA, 14 bp, Homo sapiens
ggctcctttcccac

SEQ ID NO: 6329605 - DNA, 22 bp, Homo sapiens
ggctcgaagaaaataattctct

SEQ ID NO: 6329606 - DNA, 13 bp, Homo sapiens
ggctcgaatctct

SEQ ID NO: 6329607 - DNA, 17 bp, Homo sapiens
ggctcgaatctctgtgc

SEQ ID NO: 6329608 - DNA, 19 bp, Homo sapiens
ggctcgaatctctgtgcct

SEQ ID NO: 6329609 - DNA, 13 bp, Homo sapiens
ggctcgagctcgg

SEQ ID NO: 6329610 - DNA, 23 bp, Homo sapiens
ggctcgagctcggggctgggggc

SEQ ID NO: 6329611 - DNA, 18 bp, Homo sapiens
ggctcgaggctggtgcca

SEQ ID NO: 6329612 - DNA, 18 bp, Homo sapiens
ggctcgagtgcccctgca

SEQ ID NO: 6329613 - DNA, 19 bp, Homo sapiens
ggctcgatgtttgccatga

SEQ ID NO: 6329614 - DNA, 21 bp, Homo sapiens
ggctcgatgtttgccatgagt

SEQ ID NO: 6329615 - DNA, 20 bp, Homo sapiens
ggctcgattttgtatctgca

SEQ ID NO: 6329616 - DNA, 15 bp, Homo sapiens
ggctcgcactgccca

SEQ ID NO: 6329617 - DNA, 13 bp, Homo sapiens
ggctcgccaaggc

SEQ ID NO: 6329618 - DNA, 15 bp, Homo sapiens
ggctcgccaaggcct

SEQ ID NO: 6329619 - DNA, 16 bp, Homo sapiens
ggctcgccaaggccta

SEQ ID NO: 6329620 - DNA, 13 bp, Homo sapiens
ggctcgccaggcc

SEQ ID NO: 6329621 - DNA, 17 bp, Homo sapiens
ggctcgccatgccgggg

SEQ ID NO: 6329622 - DNA, 14 bp, Homo sapiens
ggctcgccccaccc

SEQ ID NO: 6329623 - DNA, 22 bp, Homo sapiens
ggctcgcctcaggaatgggctg

SEQ ID NO: 6329624 - DNA, 22 bp, Homo sapiens
ggctcgctccctgtagctctgc

SEQ ID NO: 6329625 - DNA, 14 bp, Homo sapiens
ggctcggcctgccc

SEQ ID NO: 6329626 - DNA, 20 bp, Homo sapiens
ggctcgggcgctgtggctcc

SEQ ID NO: 6329627 - DNA, 18 bp, Homo sapiens
ggctcggggaggcagaga

SEQ ID NO: 6329628 - DNA, 22 bp, Homo sapiens
ggctcggggtaaaaagtggctg

SEQ ID NO: 6329629 - DNA, 20 bp, Homo sapiens
gtgaggattatgggtcctgc

SEQ ID NO: 6329630 - DNA, 20 bp, Homo sapiens
gtgaggattccaaaaacatt

SEQ ID NO: 6329631 - DNA, 19 bp, Homo sapiens
gtgaggcagccgaggtccc

SEQ ID NO: 6329632 - DNA, 21 bp, Homo sapiens
gtgaggcagggacaagtcttt

SEQ ID NO: 6329633 - DNA, 18 bp, Homo sapiens
gtgaggcaggggagtctg

SEQ ID NO: 6329634 - DNA, 20 bp, Homo sapiens
gtgaggcaggggagtctgct

SEQ ID NO: 6329635 - DNA, 17 bp, Homo sapiens
gtgaggcaggggcggag

SEQ ID NO: 6329636 - DNA, 22 bp, Homo sapiens
gtgaggcattcggggaagctgc

SEQ ID NO: 6329637 - DNA, 12 bp, Homo sapiens
gtgaggccacac

SEQ ID NO: 6329638 - DNA, 21 bp, Homo sapiens
gtgaggccactgaagaggagg

SEQ ID NO: 6329639 - DNA, 17 bp, Homo sapiens
gtgaggccagggcagag

SEQ ID NO: 6329640 - DNA, 11 bp, Homo sapiens
gtgaggcccaa

SEQ ID NO: 6329641 - DNA, 14 bp, Homo sapiens
gtgaggcccaagga

SEQ ID NO: 6329642 - DNA, 15 bp, Homo sapiens
gtgaggcccccggag

SEQ ID NO: 6329643 - DNA, 17 bp, Homo sapiens
gtgaggccggagaggag

SEQ ID NO: 6329644 - DNA, 16 bp, Homo sapiens
gtgaggccggccctgc

SEQ ID NO: 6329645 - DNA, 11 bp, Homo sapiens
gtgaggcctgg

SEQ ID NO: 6329646 - DNA, 13 bp, Homo sapiens
gtgaggcctggcc

SEQ ID NO: 6329647 - DNA, 16 bp, Homo sapiens
gtgaggcctggccagg

SEQ ID NO: 6329648 - DNA, 19 bp, Homo sapiens
gtgaggcggcagctggggc

SEQ ID NO: 6329649 - DNA, 21 bp, Homo sapiens
gtgaggctccctccctccctg

SEQ ID NO: 6329650 - DNA, 22 bp, Homo sapiens
gtgaggctctattgagccaaga

SEQ ID NO: 6329651 - DNA, 13 bp, Homo sapiens
gtgaggctctgcc

SEQ ID NO: 6329652 - DNA, 16 bp, Homo sapiens
gtgaggctctgccctt

SEQ ID NO: 6329653 - DNA, 18 bp, Homo sapiens
gtgaggctctgcccttgg

SEQ ID NO: 6329654 - DNA, 14 bp, Homo sapiens
gtgaggctgctgcc

SEQ ID NO: 6329655 - DNA, 15 bp, Homo sapiens
gtgaggctgggcagg

SEQ ID NO: 6329656 - DNA, 19 bp, Homo sapiens
gtgaggctgggcagggcct

SEQ ID NO: 6329657 - DNA, 15 bp, Homo sapiens
gtgaggctgggccag

SEQ ID NO: 6329658 - DNA, 17 bp, Homo sapiens
gtgaggcttctaataaa

SEQ ID NO: 6329659 - DNA, 16 bp, Homo sapiens
gtgaggcttgcccagg

SEQ ID NO: 6329660 - DNA, 13 bp, Homo sapiens
gtgagggaaggag

SEQ ID NO: 6329661 - DNA, 13 bp, Homo sapiens
gtgagggagggga

SEQ ID NO: 6329662 - DNA, 12 bp, Homo sapiens
gtgagggagtgc

SEQ ID NO: 6329663 - DNA, 21 bp, Homo sapiens
gtgagggagttagggagagag

SEQ ID NO: 6329664 - DNA, 12 bp, Homo sapiens
gtgagggcaaga

SEQ ID NO: 6329665 - DNA, 16 bp, Homo sapiens
gtgagggcctcagagc

SEQ ID NO: 6329666 - DNA, 14 bp, Homo sapiens
gtgagggccttctt

SEQ ID NO: 6329667 - DNA, 12 bp, Homo sapiens
gtgagggctggg

SEQ ID NO: 6329668 - DNA, 19 bp, Homo sapiens
gtgaggggaacagggtgca

SEQ ID NO: 6329669 - DNA, 11 bp, Homo sapiens
gtgaggggaag

SEQ ID NO: 6329670 - DNA, 14 bp, Homo sapiens
gtgaggggaaggcc

SEQ ID NO: 6329671 - DNA, 15 bp, Homo sapiens
gtgaggggcccctgg

SEQ ID NO: 6329672 - DNA, 21 bp, Homo sapiens
gtgaggggcccctggcccagg

SEQ ID NO: 6329673 - DNA, 15 bp, Homo sapiens
gtgaggggctttctc

SEQ ID NO: 6329674 - DNA, 19 bp, Homo sapiens
gtgaggggctttctcttcc

SEQ ID NO: 6329675 - DNA, 16 bp, Homo sapiens
gtgagggggagctgaa

SEQ ID NO: 6329676 - DNA, 14 bp, Homo sapiens
gtgaggggggctgg

SEQ ID NO: 6329677 - DNA, 17 bp, Homo sapiens
gtgagggggggctccct

SEQ ID NO: 6329678 - DNA, 19 bp, Homo sapiens
gtgaggggtaaaagctgat

SEQ ID NO: 6329679 - DNA, 14 bp, Homo sapiens
gtgagggtcctgca

SEQ ID NO: 6329680 - DNA, 17 bp, Homo sapiens
gtgagggtgacagaggg

SEQ ID NO: 6329681 - DNA, 18 bp, Homo sapiens
gtgagggtgacagaggga

SEQ ID NO: 6329682 - DNA, 12 bp, Homo sapiens
gtgagggtgcag

SEQ ID NO: 6329683 - DNA, 23 bp, Homo sapiens
gtgagggtgccccgcctgagtca

SEQ ID NO: 6329684 - DNA, 11 bp, Homo sapiens
gtgagggtgcg

SEQ ID NO: 6329685 - DNA, 19 bp, Homo sapiens
gtgagggtggggtgcccca

SEQ ID NO: 6329686 - DNA, 22 bp, Homo sapiens
gtgagggtggggtgccccagct

SEQ ID NO: 6329687 - DNA, 18 bp, Homo sapiens
gtgagggtgggtgtgggt

SEQ ID NO: 6329688 - DNA, 24 bp, Homo sapiens
gtgaggtcatcccggggccatgga

SEQ ID NO: 6329689 - DNA, 13 bp, Homo sapiens
gtgaggtcctggg

SEQ ID NO: 6329690 - DNA, 19 bp, Homo sapiens
gtgaggtcctgggggcctg

SEQ ID NO: 6329691 - DNA, 17 bp, Homo sapiens
gtgaggtgaactccagg

SEQ ID NO: 6329692 - DNA, 19 bp, Homo sapiens
gtgaggtgcagagtgccca

SEQ ID NO: 6329693 - DNA, 14 bp, Homo sapiens
gtgaggtgcccagc

SEQ ID NO: 6329694 - DNA, 15 bp, Homo sapiens
gtgaggtggcccagg

SEQ ID NO: 6329695 - DNA, 16 bp, Homo sapiens
gtgaggtggcccaggc

SEQ ID NO: 6329696 - DNA, 19 bp, Homo sapiens
gtgaggtggcccaggcccc

SEQ ID NO: 6329697 - DNA, 17 bp, Homo sapiens
gtgaggtgggcctttga

SEQ ID NO: 6329698 - DNA, 22 bp, Homo sapiens
gtgaggtgggggtctggcctag

SEQ ID NO: 6329699 - DNA, 16 bp, Homo sapiens
gtgaggtgtgcctggc

SEQ ID NO: 6329700 - DNA, 17 bp, Homo sapiens
gtgaggttgtgctgcct

SEQ ID NO: 6329701 - DNA, 16 bp, Homo sapiens
gtgagtaagagctggt

SEQ ID NO: 6329702 - DNA, 18 bp, Homo sapiens
gtgagtaatcaatacaga

SEQ ID NO: 6329703 - DNA, 18 bp, Homo sapiens
gtgagtaattttggattt

SEQ ID NO: 6329704 - DNA, 19 bp, Homo sapiens
gtgagtactacagtcctcc

SEQ ID NO: 6329705 - DNA, 21 bp, Homo sapiens
gtgagtactacagtcctccca

SEQ ID NO: 6329706 - DNA, 13 bp, Homo sapiens
gtgagtactgtta

SEQ ID NO: 6329707 - DNA, 21 bp, Homo sapiens
gtgagtactgttaagaataat

SEQ ID NO: 6329708 - DNA, 21 bp, Homo sapiens
gtgagtagtcttatgtaaagt

SEQ ID NO: 6329709 - DNA, 12 bp, Homo sapiens
gtgagtatgtgt

SEQ ID NO: 6329710 - DNA, 13 bp, Homo sapiens
gtgagtatgtgtg

SEQ ID NO: 6329711 - DNA, 19 bp, Homo sapiens
gtgagtcacctgctccaga

SEQ ID NO: 6329712 - DNA, 20 bp, Homo sapiens
gtgagtcacctgctccagaa

SEQ ID NO: 6329713 - DNA, 23 bp, Homo sapiens
gtgagtcacctgctccagaagat

SEQ ID NO: 6329714 - DNA, 13 bp, Homo sapiens
gtgagtcattatg

SEQ ID NO: 6329715 - DNA, 16 bp, Homo sapiens
gtgagtcccctactcc

SEQ ID NO: 6329716 - DNA, 19 bp, Homo sapiens
gtgagtcctagagctacag

SEQ ID NO: 6329717 - DNA, 17 bp, Homo sapiens
gtgagtcctggcatggg

SEQ ID NO: 6329718 - DNA, 18 bp, Homo sapiens
gtgagtcctgttgaagac

SEQ ID NO: 6329719 - DNA, 22 bp, Homo sapiens
gtgagtcgaggacagggaggtg

SEQ ID NO: 6329720 - DNA, 22 bp, Homo sapiens
gtgagtctctctgggccttagg

SEQ ID NO: 6329721 - DNA, 22 bp, Homo sapiens
gtgagtctggtggaggagctga

SEQ ID NO: 6329722 - DNA, 18 bp, Homo sapiens
gtgagtctgtcctttccc

SEQ ID NO: 6329723 - DNA, 21 bp, Homo sapiens
gtgagtcttggcggcagcagc

SEQ ID NO: 6329724 - DNA, 17 bp, Homo sapiens
gtgagtctttggttcta

SEQ ID NO: 6329725 - DNA, 19 bp, Homo sapiens
gtgagtctttggttctaag

SEQ ID NO: 6329726 - DNA, 17 bp, Homo sapiens
gtgagtgaaactcccac

SEQ ID NO: 6329727 - DNA, 13 bp, Homo sapiens
gtgagtgaaagtt

SEQ ID NO: 6329728 - DNA, 18 bp, Homo sapiens
gtgagtgacgatgatgta

SEQ ID NO: 6329729 - DNA, 13 bp, Homo sapiens
gtgagtgagcctg

SEQ ID NO: 6329730 - DNA, 16 bp, Homo sapiens
gtgagtgcaagagcct

SEQ ID NO: 6329731 - DNA, 20 bp, Homo sapiens
gtgagtgccatgctttttgg

SEQ ID NO: 6329732 - DNA, 13 bp, Homo sapiens
gtgagtgcctttt

SEQ ID NO: 6329733 - DNA, 17 bp, Homo sapiens
gtgagtgccttttgcag

SEQ ID NO: 6329734 - DNA, 22 bp, Homo sapiens
gtgagtgcttgtcatggaaaat

SEQ ID NO: 6329735 - DNA, 11 bp, Homo sapiens
gtgagtggagt

SEQ ID NO: 6329736 - DNA, 17 bp, Homo sapiens
gtgagtggagttgaggt

SEQ ID NO: 6329737 - DNA, 12 bp, Homo sapiens
gtgagtggcagc

SEQ ID NO: 6329738 - DNA, 13 bp, Homo sapiens
gtgagtggcagcc

SEQ ID NO: 6329739 - DNA, 17 bp, Homo sapiens
gtgagtggcagccatgc

SEQ ID NO: 6329740 - DNA, 21 bp, Homo sapiens
gtgagtgggaggagagggcag

SEQ ID NO: 6329741 - DNA, 15 bp, Homo sapiens
gtgagtgtatgtata

SEQ ID NO: 6329742 - DNA, 18 bp, Homo sapiens
gtgagtgtatgtgtgtgt

SEQ ID NO: 6329743 - DNA, 16 bp, Homo sapiens
gtgagtgtctggtgcc

SEQ ID NO: 6329744 - DNA, 15 bp, Homo sapiens
gtgagtgtgagtgtg

SEQ ID NO: 6329745 - DNA, 15 bp, Homo sapiens
gtgagtgtggctccc

SEQ ID NO: 6329746 - DNA, 23 bp, Homo sapiens
gtgagtgtgtccaagtgtgtgtg

SEQ ID NO: 6329747 - DNA, 14 bp, Homo sapiens
gtgagtgtgtgaag

SEQ ID NO: 6329748 - DNA, 18 bp, Homo sapiens
gtgagtgtgtgaagccgc

SEQ ID NO: 6329749 - DNA, 16 bp, Homo sapiens
gtgagtgtgtgcacag

SEQ ID NO: 6329750 - DNA, 15 bp, Homo sapiens
gtgagtgtgtgtgct

SEQ ID NO: 6329751 - DNA, 23 bp, Homo sapiens
gtgagtgtttctatgagtggaaa

SEQ ID NO: 6329752 - DNA, 13 bp, Homo sapiens
gtgagttctcact

SEQ ID NO: 6329753 - DNA, 15 bp, Homo sapiens
gtgagttctcactat

SEQ ID NO: 6329754 - DNA, 22 bp, Homo sapiens
gtgagttctttttcactctgtg

SEQ ID NO: 6329755 - DNA, 19 bp, Homo sapiens
gtgagttgcatgtttttga

SEQ ID NO: 6329756 - DNA, 12 bp, Homo sapiens
gtgagttggctt

SEQ ID NO: 6329757 - DNA, 15 bp, Homo sapiens
gtgagttggggcgac

SEQ ID NO: 6329758 - DNA, 15 bp, Homo sapiens
gtgagtttgtttctt

SEQ ID NO: 6329759 - DNA, 17 bp, Homo sapiens
gtgagtttgtttctttg

SEQ ID NO: 6329760 - DNA, 17 bp, Homo sapiens
gtgataaatcagtcaag

SEQ ID NO: 6329761 - DNA, 19 bp, Homo sapiens
gtgataaccagtaaggaaa

SEQ ID NO: 6329762 - DNA, 20 bp, Homo sapiens
gtgataactacttagcactg

SEQ ID NO: 6329763 - DNA, 21 bp, Homo sapiens
gtgataaggacatgatgcttt

SEQ ID NO: 6329764 - DNA, 20 bp, Homo sapiens
gtgataaggggccttgctct

SEQ ID NO: 6329765 - DNA, 11 bp, Homo sapiens
gtgataagtgg

SEQ ID NO: 6329766 - DNA, 15 bp, Homo sapiens
gtgataagtggaaaa

SEQ ID NO: 6329767 - DNA, 23 bp, Homo sapiens
gtgataatacagatttgtaacat

SEQ ID NO: 6329768 - DNA, 19 bp, Homo sapiens
gtgataatattgtttccct

SEQ ID NO: 6329769 - DNA, 20 bp, Homo sapiens
gtgataatgccccaaggaca

SEQ ID NO: 6329770 - DNA, 15 bp, Homo sapiens
gtgataattttgaat

SEQ ID NO: 6329771 - DNA, 20 bp, Homo sapiens
gtgatacatgtactccagag

SEQ ID NO: 6329772 - DNA, 20 bp, Homo sapiens
gtgatacccatagcttccat

SEQ ID NO: 6329773 - DNA, 12 bp, Homo sapiens
gtgatagcattg

SEQ ID NO: 6329774 - DNA, 19 bp, Homo sapiens
gtgatagcattgctttcgt

SEQ ID NO: 6329775 - DNA, 19 bp, Homo sapiens
gtgatagctactgtagaaa

SEQ ID NO: 6329776 - DNA, 22 bp, Homo sapiens
gtgatagctactgtagaaagga

SEQ ID NO: 6329777 - DNA, 23 bp, Homo sapiens
gtgataggcccaaggtcccctcc

SEQ ID NO: 6329778 - DNA, 17 bp, Homo sapiens
gtgatagttcaccccct

SEQ ID NO: 6329779 - DNA, 16 bp, Homo sapiens
gtgatataaacagctt

SEQ ID NO: 6329780 - DNA, 19 bp, Homo sapiens
gtgatataagtgtgtgttt

SEQ ID NO: 6329781 - DNA, 18 bp, Homo sapiens
gtgatatacaaagtgtac

SEQ ID NO: 6329782 - DNA, 21 bp, Homo sapiens
gtgatatataagtgtacatat

SEQ ID NO: 6329783 - DNA, 23 bp, Homo sapiens
gtgatatataagtgtacatatgt

SEQ ID NO: 6329784 - DNA, 12 bp, Homo sapiens
gtgatatataat

SEQ ID NO: 6329785 - DNA, 20 bp, Homo sapiens
gtgatatattcctaaactat

SEQ ID NO: 6329786 - DNA, 19 bp, Homo sapiens
gtgatatcacctctcttca

SEQ ID NO: 6329787 - DNA, 16 bp, Homo sapiens
gtgatatcctgaaaaa

SEQ ID NO: 6329788 - DNA, 15 bp, Homo sapiens
gtgatatctttctca

SEQ ID NO: 6329789 - DNA, 13 bp, Homo sapiens
gtgatatggagcc

SEQ ID NO: 6329790 - DNA, 22 bp, Homo sapiens
gtgatatggcggcctgcagtgg

SEQ ID NO: 6329791 - DNA, 21 bp, Homo sapiens
gtgatatggtactaaggagaa

SEQ ID NO: 6329792 - DNA, 16 bp, Homo sapiens
gtgatatgtgtaatat

SEQ ID NO: 6329793 - DNA, 18 bp, Homo sapiens
gtgatatgtgtaatatca

SEQ ID NO: 6329794 - DNA, 14 bp, Homo sapiens
gtgatatgttttaa

SEQ ID NO: 6329795 - DNA, 19 bp, Homo sapiens
gtgatattgaccatgtgat

SEQ ID NO: 6329796 - DNA, 13 bp, Homo sapiens
gtgatatttcaga

SEQ ID NO: 6329797 - DNA, 17 bp, Homo sapiens
gtgatatttcagaaata

SEQ ID NO: 6329798 - DNA, 15 bp, Homo sapiens
gtgatatttgacaga

SEQ ID NO: 6329799 - DNA, 15 bp, Homo sapiens
gtgatattttacttg

SEQ ID NO: 6329800 - DNA, 20 bp, Homo sapiens
gtgatatttttatgtgcagc

SEQ ID NO: 6329801 - DNA, 17 bp, Homo sapiens
gtgatcaataaaatgtg

SEQ ID NO: 6329802 - DNA, 18 bp, Homo sapiens
gtgatcaataaaatgtga

SEQ ID NO: 6329803 - DNA, 17 bp, Homo sapiens
gtgatcaattaaatgta

SEQ ID NO: 6329804 - DNA, 17 bp, Homo sapiens
gtgatcacagcagcttc

SEQ ID NO: 6329805 - DNA, 15 bp, Homo sapiens
gtgatcactgagcca

SEQ ID NO: 6329806 - DNA, 13 bp, Homo sapiens
gtgatcagcagag

SEQ ID NO: 6329807 - DNA, 15 bp, Homo sapiens
gtgatcagcattgtg

SEQ ID NO: 6329808 - DNA, 20 bp, Homo sapiens
gtgatcagtatgctgtttta

SEQ ID NO: 6329809 - DNA, 18 bp, Homo sapiens
ggctcgtaggcctgccgc

SEQ ID NO: 6329810 - DNA, 17 bp, Homo sapiens
ggctcgtcagccacctg

SEQ ID NO: 6329811 - DNA, 19 bp, Homo sapiens
ggctcgtggactgagtggg

SEQ ID NO: 6329812 - DNA, 13 bp, Homo sapiens
ggctcgtggcctt

SEQ ID NO: 6329813 - DNA, 14 bp, Homo sapiens
ggctcgtggccttc

SEQ ID NO: 6329814 - DNA, 16 bp, Homo sapiens
ggctcgtgggctctgg

SEQ ID NO: 6329815 - DNA, 17 bp, Homo sapiens
ggctcgtgggctctggc

SEQ ID NO: 6329816 - DNA, 20 bp, Homo sapiens
ggctcgtgtttcacagtggg

SEQ ID NO: 6329817 - DNA, 23 bp, Homo sapiens
ggctctaaacctcaggccacatc

SEQ ID NO: 6329818 - DNA, 17 bp, Homo sapiens
ggctctaacgcctgagc

SEQ ID NO: 6329819 - DNA, 22 bp, Homo sapiens
ggctctaacgcctgagcccagg

SEQ ID NO: 6329820 - DNA, 23 bp, Homo sapiens
ggctctaacgcctgagcccaggg

SEQ ID NO: 6329821 - DNA, 13 bp, Homo sapiens
ggctctaatttcc

SEQ ID NO: 6329822 - DNA, 13 bp, Homo sapiens
ggctctacctctc

SEQ ID NO: 6329823 - DNA, 14 bp, Homo sapiens
ggctctacctctct

SEQ ID NO: 6329824 - DNA, 14 bp, Homo sapiens
ggctctaccttcct

SEQ ID NO: 6329825 - DNA, 15 bp, Homo sapiens
ggctctaccttcctg

SEQ ID NO: 6329826 - DNA, 23 bp, Homo sapiens
ggctctaccttcctgtccctgag

SEQ ID NO: 6329827 - DNA, 17 bp, Homo sapiens
ggctctacttccccatg

SEQ ID NO: 6329828 - DNA, 23 bp, Homo sapiens
ggctctagaaatgcccttcactt

SEQ ID NO: 6329829 - DNA, 20 bp, Homo sapiens
ggctctagagagagggagaa

SEQ ID NO: 6329830 - DNA, 18 bp, Homo sapiens
ggctctataaggcagcct

SEQ ID NO: 6329831 - DNA, 15 bp, Homo sapiens
ggctctatctgctgg

SEQ ID NO: 6329832 - DNA, 23 bp, Homo sapiens
ggctctatgagtctagatgttta

SEQ ID NO: 6329833 - DNA, 18 bp, Homo sapiens
ggctctatgcctgcactg

SEQ ID NO: 6329834 - DNA, 20 bp, Homo sapiens
ggctctatttcttcttcaca

SEQ ID NO: 6329835 - DNA, 17 bp, Homo sapiens
ggctctcaatgctgttt

SEQ ID NO: 6329836 - DNA, 14 bp, Homo sapiens
ggctctcacccagt

SEQ ID NO: 6329837 - DNA, 18 bp, Homo sapiens
ggctctcagagcagcaga

SEQ ID NO: 6329838 - DNA, 13 bp, Homo sapiens
ggctctcaggcca

SEQ ID NO: 6329839 - DNA, 14 bp, Homo sapiens
ggctctcaggccag

SEQ ID NO: 6329840 - DNA, 16 bp, Homo sapiens
ggctctcaggccagct

SEQ ID NO: 6329841 - DNA, 17 bp, Homo sapiens
ggctctcaggccagctg

SEQ ID NO: 6329842 - DNA, 19 bp, Homo sapiens
ggctctccaaaggggctgc

SEQ ID NO: 6329843 - DNA, 20 bp, Homo sapiens
ggctctccaaaggggctgct

SEQ ID NO: 6329844 - DNA, 17 bp, Homo sapiens
ggctctccaagtgccag

SEQ ID NO: 6329845 - DNA, 19 bp, Homo sapiens
ggctctccaagtgccagag

SEQ ID NO: 6329846 - DNA, 20 bp, Homo sapiens
ggctctccaagtgccagagg

SEQ ID NO: 6329847 - DNA, 23 bp, Homo sapiens
ggctctccaagtgccagaggtgg

SEQ ID NO: 6329848 - DNA, 16 bp, Homo sapiens
ggctctccacctcagc

SEQ ID NO: 6329849 - DNA, 17 bp, Homo sapiens
ggctctccacctcagcc

SEQ ID NO: 6329850 - DNA, 21 bp, Homo sapiens
ggctctccacctcagccttgg

SEQ ID NO: 6329851 - DNA, 15 bp, Homo sapiens
ggctctccagacctg

SEQ ID NO: 6329852 - DNA, 13 bp, Homo sapiens
ggctctccagtta

SEQ ID NO: 6329853 - DNA, 16 bp, Homo sapiens
ggctctccctctctgc

SEQ ID NO: 6329854 - DNA, 12 bp, Homo sapiens
ggctctccgggc

SEQ ID NO: 6329855 - DNA, 13 bp, Homo sapiens
ggctctcctgccc

SEQ ID NO: 6329856 - DNA, 23 bp, Homo sapiens
ggctctcctgccctgccctcctg

SEQ ID NO: 6329857 - DNA, 21 bp, Homo sapiens
ggctctcgcggcctcttctct

SEQ ID NO: 6329858 - DNA, 23 bp, Homo sapiens
ggctctcgctgccctgtggacag

SEQ ID NO: 6329859 - DNA, 19 bp, Homo sapiens
ggctctctaagaaaagaga

SEQ ID NO: 6329860 - DNA, 21 bp, Homo sapiens
ggctctctattccctcagcct

SEQ ID NO: 6329861 - DNA, 20 bp, Homo sapiens
ggctctctcacccagcctgg

SEQ ID NO: 6329862 - DNA, 12 bp, Homo sapiens
ggctctctgacc

SEQ ID NO: 6329863 - DNA, 12 bp, Homo sapiens
ggctctctgagt

SEQ ID NO: 6329864 - DNA, 15 bp, Homo sapiens
ggctctctggacctg

SEQ ID NO: 6329865 - DNA, 23 bp, Homo sapiens
ggctctctttccttcttgccttc

SEQ ID NO: 6329866 - DNA, 16 bp, Homo sapiens
ggctctgaaagctgct

SEQ ID NO: 6329867 - DNA, 21 bp, Homo sapiens
ggctctgaaagctgcttctgg

SEQ ID NO: 6329868 - DNA, 13 bp, Homo sapiens
ggctctgaacaca

SEQ ID NO: 6329869 - DNA, 15 bp, Homo sapiens
ggctctgaagccaag

SEQ ID NO: 6329870 - DNA, 19 bp, Homo sapiens
ggctctgacaaagcttccc

SEQ ID NO: 6329871 - DNA, 20 bp, Homo sapiens
ggctctgactctgccagggt

SEQ ID NO: 6329872 - DNA, 19 bp, Homo sapiens
ggctctgagactaaatgag

SEQ ID NO: 6329873 - DNA, 20 bp, Homo sapiens
ggctctgagagtctagattc

SEQ ID NO: 6329874 - DNA, 15 bp, Homo sapiens
ggctctgagcagggg

SEQ ID NO: 6329875 - DNA, 20 bp, Homo sapiens
ggctctgagcaggggcaggc

SEQ ID NO: 6329876 - DNA, 14 bp, Homo sapiens
ggctctgagcgcct

SEQ ID NO: 6329877 - DNA, 14 bp, Homo sapiens
ggctctgaggcgcc

SEQ ID NO: 6329878 - DNA, 15 bp, Homo sapiens
ggctctgaggggcac

SEQ ID NO: 6329879 - DNA, 19 bp, Homo sapiens
ggctctgaggtgcctgtcc

SEQ ID NO: 6329880 - DNA, 19 bp, Homo sapiens
ggctctgatctaacaaaat

SEQ ID NO: 6329881 - DNA, 20 bp, Homo sapiens
ggctctgatctaacaaaata

SEQ ID NO: 6329882 - DNA, 20 bp, Homo sapiens
ggctctgattggaatttctg

SEQ ID NO: 6329883 - DNA, 20 bp, Homo sapiens
ggctctgcaatgggcactgg

SEQ ID NO: 6329884 - DNA, 13 bp, Homo sapiens
ggctctgcaccca

SEQ ID NO: 6329885 - DNA, 13 bp, Homo sapiens
ggctctgcagcac

SEQ ID NO: 6329886 - DNA, 16 bp, Homo sapiens
ggctctgcagcacctc

SEQ ID NO: 6329887 - DNA, 12 bp, Homo sapiens
ggctctgcagtc

SEQ ID NO: 6329888 - DNA, 11 bp, Homo sapiens
ggctctgccca

SEQ ID NO: 6329889 - DNA, 14 bp, Homo sapiens
ggctctgcccacct

SEQ ID NO: 6329890 - DNA, 13 bp, Homo sapiens
ggctctgccccag

SEQ ID NO: 6329891 - DNA, 16 bp, Homo sapiens
ggctctgccccagagg

SEQ ID NO: 6329892 - DNA, 20 bp, Homo sapiens
ggctctgccccagctctggc

SEQ ID NO: 6329893 - DNA, 21 bp, Homo sapiens
ggctctgccccagctctggct

SEQ ID NO: 6329894 - DNA, 14 bp, Homo sapiens
ggctctgccccctc

SEQ ID NO: 6329895 - DNA, 16 bp, Homo sapiens
ggctctgccccctccc

SEQ ID NO: 6329896 - DNA, 13 bp, Homo sapiens
ggctctgcccctc

SEQ ID NO: 6329897 - DNA, 18 bp, Homo sapiens
ggctctgcccctcagggg

SEQ ID NO: 6329898 - DNA, 21 bp, Homo sapiens
ggctctgccctccctccttcc

SEQ ID NO: 6329899 - DNA, 15 bp, Homo sapiens
ggctctgccctggaa

SEQ ID NO: 6329900 - DNA, 16 bp, Homo sapiens
ggctctgccctggaaa

SEQ ID NO: 6329901 - DNA, 16 bp, Homo sapiens
ggctctgcctcaggag

SEQ ID NO: 6329902 - DNA, 13 bp, Homo sapiens
ggctctgcctccc

SEQ ID NO: 6329903 - DNA, 15 bp, Homo sapiens
ggctctgcctcccat

SEQ ID NO: 6329904 - DNA, 14 bp, Homo sapiens
ggctctgccttctc

SEQ ID NO: 6329905 - DNA, 18 bp, Homo sapiens
ggctctgcgtcccactga

SEQ ID NO: 6329906 - DNA, 16 bp, Homo sapiens
ggctctgctgacttct

SEQ ID NO: 6329907 - DNA, 19 bp, Homo sapiens
ggctctgctggccggagca

SEQ ID NO: 6329908 - DNA, 11 bp, Homo sapiens
ggctctggaag

SEQ ID NO: 6329909 - DNA, 12 bp, Homo sapiens
ggctctggacct

SEQ ID NO: 6329910 - DNA, 22 bp, Homo sapiens
ggctctggacctcaggagggca

SEQ ID NO: 6329911 - DNA, 18 bp, Homo sapiens
ggctctggactctaaaga

SEQ ID NO: 6329912 - DNA, 15 bp, Homo sapiens
ggctctggagacagc

SEQ ID NO: 6329913 - DNA, 16 bp, Homo sapiens
ggctctggagacagcc

SEQ ID NO: 6329914 - DNA, 19 bp, Homo sapiens
ggctctggagacagcccca

SEQ ID NO: 6329915 - DNA, 14 bp, Homo sapiens
ggctctggagagaa

SEQ ID NO: 6329916 - DNA, 15 bp, Homo sapiens
ggctctggagagaaa

SEQ ID NO: 6329917 - DNA, 13 bp, Homo sapiens
ggctctggccaag

SEQ ID NO: 6329918 - DNA, 20 bp, Homo sapiens
ggctctggccaagggccaga

SEQ ID NO: 6329919 - DNA, 14 bp, Homo sapiens
ggctctggccaccc

SEQ ID NO: 6329920 - DNA, 15 bp, Homo sapiens
ggctctggccaccct

SEQ ID NO: 6329921 - DNA, 12 bp, Homo sapiens
ggctctggccct

SEQ ID NO: 6329922 - DNA, 17 bp, Homo sapiens
ggctctggcccttgcct

SEQ ID NO: 6329923 - DNA, 16 bp, Homo sapiens
ggctctggctccctgg

SEQ ID NO: 6329924 - DNA, 15 bp, Homo sapiens
ggctctgggaatggg

SEQ ID NO: 6329925 - DNA, 14 bp, Homo sapiens
ggctctgggcacag

SEQ ID NO: 6329926 - DNA, 17 bp, Homo sapiens
ggctctgggctggctgc

SEQ ID NO: 6329927 - DNA, 16 bp, Homo sapiens
ggctctggggtatgtg

SEQ ID NO: 6329928 - DNA, 17 bp, Homo sapiens
ggctctggtggccactg

SEQ ID NO: 6329929 - DNA, 21 bp, Homo sapiens
ggctctggttcctccagccac

SEQ ID NO: 6329930 - DNA, 15 bp, Homo sapiens
ggctctgtcaccgcc

SEQ ID NO: 6329931 - DNA, 12 bp, Homo sapiens
ggctctgtcact

SEQ ID NO: 6329932 - DNA, 17 bp, Homo sapiens
ggctctgtcactgagca

SEQ ID NO: 6329933 - DNA, 14 bp, Homo sapiens
ggctctgtccccag

SEQ ID NO: 6329934 - DNA, 18 bp, Homo sapiens
ggctctgtccccagcctg

SEQ ID NO: 6329935 - DNA, 23 bp, Homo sapiens
ggctctgtccccagcctgggaaa

SEQ ID NO: 6329936 - DNA, 14 bp, Homo sapiens
ggctctgtcttcct

SEQ ID NO: 6329937 - DNA, 20 bp, Homo sapiens
ggctctgtgaaaacatattt

SEQ ID NO: 6329938 - DNA, 15 bp, Homo sapiens
ggctctgtgcaggga

SEQ ID NO: 6329939 - DNA, 13 bp, Homo sapiens
ggctctgtgcccg

SEQ ID NO: 6329940 - DNA, 19 bp, Homo sapiens
ggctctgtgctgaccctcc

SEQ ID NO: 6329941 - DNA, 20 bp, Homo sapiens
ggctctgtgctgaccctcct

SEQ ID NO: 6329942 - DNA, 14 bp, Homo sapiens
ggctctgtggcaaa

SEQ ID NO: 6329943 - DNA, 15 bp, Homo sapiens
ggctctgtggcaaaa

SEQ ID NO: 6329944 - DNA, 18 bp, Homo sapiens
ggctctgtggcttgctag

SEQ ID NO: 6329945 - DNA, 12 bp, Homo sapiens
ggctctgtgggc

SEQ ID NO: 6329946 - DNA, 15 bp, Homo sapiens
ggctctgtgggctgc

SEQ ID NO: 6329947 - DNA, 14 bp, Homo sapiens
ggctctgttgctgt

SEQ ID NO: 6329948 - DNA, 18 bp, Homo sapiens
ggctcttaactgttgctc

SEQ ID NO: 6329949 - DNA, 19 bp, Homo sapiens
ggctcttagcagcttccag

SEQ ID NO: 6329950 - DNA, 20 bp, Homo sapiens
ggctcttagcagcttccaga

SEQ ID NO: 6329951 - DNA, 21 bp, Homo sapiens
ggctcttagcagcttccagat

SEQ ID NO: 6329952 - DNA, 22 bp, Homo sapiens
ggctcttatagaagcttcagca

SEQ ID NO: 6329953 - DNA, 14 bp, Homo sapiens
ggctcttcaaagac

SEQ ID NO: 6329954 - DNA, 15 bp, Homo sapiens
ggctcttcatctgcc

SEQ ID NO: 6329955 - DNA, 16 bp, Homo sapiens
ggctcttcatctgcct

SEQ ID NO: 6329956 - DNA, 19 bp, Homo sapiens
ggctcttcatctgcctgcg

SEQ ID NO: 6329957 - DNA, 24 bp, Homo sapiens
ggctcttccaggctgggagagcct

SEQ ID NO: 6329958 - DNA, 13 bp, Homo sapiens
ggctcttctcatt

SEQ ID NO: 6329959 - DNA, 20 bp, Homo sapiens
ggctcttctcatttcacccc

SEQ ID NO: 6329960 - DNA, 22 bp, Homo sapiens
ggctcttctcatttcacccctc

SEQ ID NO: 6329961 - DNA, 12 bp, Homo sapiens
ggctcttctcct

SEQ ID NO: 6329962 - DNA, 21 bp, Homo sapiens
ggctcttctccttggaggaca

SEQ ID NO: 6329963 - DNA, 23 bp, Homo sapiens
ggctcttctccttggaggacagt

SEQ ID NO: 6329964 - DNA, 14 bp, Homo sapiens
ggctcttctctcgg

SEQ ID NO: 6329965 - DNA, 19 bp, Homo sapiens
ggctcttgaactgagcttg

SEQ ID NO: 6329966 - DNA, 15 bp, Homo sapiens
ggctcttgactactt

SEQ ID NO: 6329967 - DNA, 15 bp, Homo sapiens
ggctcttggcttcca

SEQ ID NO: 6329968 - DNA, 16 bp, Homo sapiens
ggctcttggcttccag

SEQ ID NO: 6329969 - DNA, 21 bp, Homo sapiens
ggctcttggcttccagaaggc

SEQ ID NO: 6329970 - DNA, 23 bp, Homo sapiens
ggctcttggcttccagaaggcag

SEQ ID NO: 6329971 - DNA, 12 bp, Homo sapiens
ggctctttcaga

SEQ ID NO: 6329972 - DNA, 14 bp, Homo sapiens
ggctctttccttgc

SEQ ID NO: 6329973 - DNA, 17 bp, Homo sapiens
ggctctttccttgctca

SEQ ID NO: 6329974 - DNA, 16 bp, Homo sapiens
ggctctttctctctgc

SEQ ID NO: 6329975 - DNA, 15 bp, Homo sapiens
ggctctttgggctgg

SEQ ID NO: 6329976 - DNA, 22 bp, Homo sapiens
ggctctttggggtcagccaggg

SEQ ID NO: 6329977 - DNA, 13 bp, Homo sapiens
ggctgaaaagtgc

SEQ ID NO: 6329978 - DNA, 11 bp, Homo sapiens
ggctgaaagcc

SEQ ID NO: 6329979 - DNA, 19 bp, Homo sapiens
ggctgaaataaaagcctct

SEQ ID NO: 6329980 - DNA, 22 bp, Homo sapiens
ggctgaaataaaagcctctggt

SEQ ID NO: 6329981 - DNA, 18 bp, Homo sapiens
ggctgaaattctcctgga

SEQ ID NO: 6329982 - DNA, 19 bp, Homo sapiens
ggctgaaattctcctggag

SEQ ID NO: 6329983 - DNA, 17 bp, Homo sapiens
ggctgaacagtgctctg

SEQ ID NO: 6329984 - DNA, 20 bp, Homo sapiens
ggctgaacagtgctctgcct

SEQ ID NO: 6329985 - DNA, 19 bp, Homo sapiens
ggctgaacatgcctgccaa

SEQ ID NO: 6329986 - DNA, 14 bp, Homo sapiens
ggctgaaccctgtg

SEQ ID NO: 6329987 - DNA, 19 bp, Homo sapiens
ggctgaaccctgtgctggt

SEQ ID NO: 6329988 - DNA, 20 bp, Homo sapiens
ggctgaaccctgtgctggtg

SEQ ID NO: 6329989 - DNA, 21 bp, Homo sapiens
gtgatcatagctcactgcacc

SEQ ID NO: 6329990 - DNA, 14 bp, Homo sapiens
gtgatcatatgagg

SEQ ID NO: 6329991 - DNA, 17 bp, Homo sapiens
gtgatcatgtgtggaag

SEQ ID NO: 6329992 - DNA, 18 bp, Homo sapiens
gtgatccacccacctcag

SEQ ID NO: 6329993 - DNA, 22 bp, Homo sapiens
gtgatccacccacctgggcctc

SEQ ID NO: 6329994 - DNA, 16 bp, Homo sapiens
gtgatccacctgcctc

SEQ ID NO: 6329995 - DNA, 12 bp, Homo sapiens
gtgatccagccc

SEQ ID NO: 6329996 - DNA, 16 bp, Homo sapiens
gtgatccagccctggt

SEQ ID NO: 6329997 - DNA, 13 bp, Homo sapiens
gtgatccatccat

SEQ ID NO: 6329998 - DNA, 24 bp, Homo sapiens
gtgatcccagctcactgcagcctc

SEQ ID NO: 6329999 - DNA, 22 bp, Homo sapiens
gtgatcccccaaacagcatgtg

SEQ ID NO: 6330000 - DNA, 21 bp, Homo sapiens
gtgatccgcccacctcagcct

SEQ ID NO: 6330001 - DNA, 23 bp, Homo sapiens
gtgatccgcccacctcagcctcc

SEQ ID NO: 6330002 - DNA, 20 bp, Homo sapiens
gtgatccgcccgcctcggcc

SEQ ID NO: 6330003 - DNA, 21 bp, Homo sapiens
gtgatccgcccgcctctgcct

SEQ ID NO: 6330004 - DNA, 23 bp, Homo sapiens
gtgatccgcccgcctctgcctcc

SEQ ID NO: 6330005 - DNA, 17 bp, Homo sapiens
gtgatcctaaatatgac

SEQ ID NO: 6330006 - DNA, 19 bp, Homo sapiens
gtgatcctcaaacacacaa

SEQ ID NO: 6330007 - DNA, 15 bp, Homo sapiens
gtgatcctcccacct

SEQ ID NO: 6330008 - DNA, 18 bp, Homo sapiens
gtgatcctcccacctcag

SEQ ID NO: 6330009 - DNA, 22 bp, Homo sapiens
gtgatcctcccacctcagcctc

SEQ ID NO: 6330010 - DNA, 23 bp, Homo sapiens
gtgatcctcccacctcagcctcc

SEQ ID NO: 6330011 - DNA, 20 bp, Homo sapiens
gtgatcctcccgccccagcc

SEQ ID NO: 6330012 - DNA, 22 bp, Homo sapiens
gtgatcctcctgtcttggcctc

SEQ ID NO: 6330013 - DNA, 14 bp, Homo sapiens
gtgatcctctattt

SEQ ID NO: 6330014 - DNA, 19 bp, Homo sapiens
gtgatccttccacctcagt

SEQ ID NO: 6330015 - DNA, 18 bp, Homo sapiens
gtgatccttggtgctgtg

SEQ ID NO: 6330016 - DNA, 21 bp, Homo sapiens
gtgatcctttggggcttctgt

SEQ ID NO: 6330017 - DNA, 23 bp, Homo sapiens
gtgatcctttggggcttctgtga

SEQ ID NO: 6330018 - DNA, 14 bp, Homo sapiens
gtgatccttttatg

SEQ ID NO: 6330019 - DNA, 14 bp, Homo sapiens
gtgatctaagcagt

SEQ ID NO: 6330020 - DNA, 18 bp, Homo sapiens
gtgatctagtccttgtct

SEQ ID NO: 6330021 - DNA, 18 bp, Homo sapiens
gtgatctatgtttgtgtg

SEQ ID NO: 6330022 - DNA, 17 bp, Homo sapiens
gtgatctcaaatccact

SEQ ID NO: 6330023 - DNA, 14 bp, Homo sapiens
gtgatctcacttaa

SEQ ID NO: 6330024 - DNA, 12 bp, Homo sapiens
gtgatctccata

SEQ ID NO: 6330025 - DNA, 23 bp, Homo sapiens
gtgatctcccctcacactttgcc

SEQ ID NO: 6330026 - DNA, 17 bp, Homo sapiens
gtgatctcgactccccc

SEQ ID NO: 6330027 - DNA, 14 bp, Homo sapiens
gtgatctctgctgg

SEQ ID NO: 6330028 - DNA, 20 bp, Homo sapiens
gtgatctctgttacaaaaga

SEQ ID NO: 6330029 - DNA, 15 bp, Homo sapiens
gtgatctgctgctga

SEQ ID NO: 6330030 - DNA, 18 bp, Homo sapiens
gtgatctgtagacttctg

SEQ ID NO: 6330031 - DNA, 13 bp, Homo sapiens
gtgatctgtcctt

SEQ ID NO: 6330032 - DNA, 14 bp, Homo sapiens
gtgatctgttgtaa

SEQ ID NO: 6330033 - DNA, 19 bp, Homo sapiens
gtgatctgtttgaggagag

SEQ ID NO: 6330034 - DNA, 22 bp, Homo sapiens
gtgatcttggcttactgcagcc

SEQ ID NO: 6330035 - DNA, 16 bp, Homo sapiens
gtgatgaaatatgaaa

SEQ ID NO: 6330036 - DNA, 13 bp, Homo sapiens
gtgatgaaattat

SEQ ID NO: 6330037 - DNA, 17 bp, Homo sapiens
gtgatgaagctgaggct

SEQ ID NO: 6330038 - DNA, 18 bp, Homo sapiens
gtgatgaagctgaggctg

SEQ ID NO: 6330039 - DNA, 20 bp, Homo sapiens
gtgatgaatctacatttgtt

SEQ ID NO: 6330040 - DNA, 16 bp, Homo sapiens
gtgatgactgcttgta

SEQ ID NO: 6330041 - DNA, 16 bp, Homo sapiens
gtgatgacttgctgtc

SEQ ID NO: 6330042 - DNA, 19 bp, Homo sapiens
gtgatgagctgaaaagtga

SEQ ID NO: 6330043 - DNA, 17 bp, Homo sapiens
gtgatgagggcagcagc

SEQ ID NO: 6330044 - DNA, 11 bp, Homo sapiens
gtgatgatggg

SEQ ID NO: 6330045 - DNA, 13 bp, Homo sapiens
gtgatgcaatctt

SEQ ID NO: 6330046 - DNA, 19 bp, Homo sapiens
gtgatgcaatcttggctca

SEQ ID NO: 6330047 - DNA, 14 bp, Homo sapiens
gtgatgcattttat

SEQ ID NO: 6330048 - DNA, 15 bp, Homo sapiens
gtgatgcattttata

SEQ ID NO: 6330049 - DNA, 15 bp, Homo sapiens
gtgatgccaaagatg

SEQ ID NO: 6330050 - DNA, 20 bp, Homo sapiens
gtgatgccaaagatgtttga

SEQ ID NO: 6330051 - DNA, 22 bp, Homo sapiens
gtgatgccaaagatgtttgaaa

SEQ ID NO: 6330052 - DNA, 17 bp, Homo sapiens
gtgatgccacacagagt

SEQ ID NO: 6330053 - DNA, 19 bp, Homo sapiens
gtgatgccacacagagtgg

SEQ ID NO: 6330054 - DNA, 23 bp, Homo sapiens
gtgatgccaggttctatttggaa

SEQ ID NO: 6330055 - DNA, 16 bp, Homo sapiens
gtgatgccctgccctt

SEQ ID NO: 6330056 - DNA, 18 bp, Homo sapiens
gtgatgccgggcgccagg

SEQ ID NO: 6330057 - DNA, 20 bp, Homo sapiens
gtgatgccgggcgccaggac

SEQ ID NO: 6330058 - DNA, 23 bp, Homo sapiens
gtgatgccgtcctgctggagtga

SEQ ID NO: 6330059 - DNA, 19 bp, Homo sapiens
gtgatgcctaattatgaat

SEQ ID NO: 6330060 - DNA, 12 bp, Homo sapiens
gtgatgccttcc

SEQ ID NO: 6330061 - DNA, 15 bp, Homo sapiens
gtgatgcgcagttgc

SEQ ID NO: 6330062 - DNA, 22 bp, Homo sapiens
gtgatgcgcatgtcacggaggg

SEQ ID NO: 6330063 - DNA, 15 bp, Homo sapiens
gtgatgcttttgctg

SEQ ID NO: 6330064 - DNA, 17 bp, Homo sapiens
gtgatgcttttgctgct

SEQ ID NO: 6330065 - DNA, 16 bp, Homo sapiens
gtgatggaacacacac

SEQ ID NO: 6330066 - DNA, 19 bp, Homo sapiens
gtgatggagaggacagagc

SEQ ID NO: 6330067 - DNA, 15 bp, Homo sapiens
gtgatggagagggat

SEQ ID NO: 6330068 - DNA, 15 bp, Homo sapiens
gtgatggagggaagg

SEQ ID NO: 6330069 - DNA, 12 bp, Homo sapiens
gtgatggagggg

SEQ ID NO: 6330070 - DNA, 14 bp, Homo sapiens
gtgatggaggggag

SEQ ID NO: 6330071 - DNA, 22 bp, Homo sapiens
gtgatggaggggagaggggtca

SEQ ID NO: 6330072 - DNA, 23 bp, Homo sapiens
gtgatggagtttctctagaagct

SEQ ID NO: 6330073 - DNA, 18 bp, Homo sapiens
gtgatggatggcacaatg

SEQ ID NO: 6330074 - DNA, 19 bp, Homo sapiens
gtgatggcattactctgca

SEQ ID NO: 6330075 - DNA, 16 bp, Homo sapiens
gtgatggccagcccct

SEQ ID NO: 6330076 - DNA, 17 bp, Homo sapiens
gtgatggccaggccagg

SEQ ID NO: 6330077 - DNA, 22 bp, Homo sapiens
gtgatgggactcattgtagaaa

SEQ ID NO: 6330078 - DNA, 14 bp, Homo sapiens
gtgatgggatctgt

SEQ ID NO: 6330079 - DNA, 20 bp, Homo sapiens
gtgatgggcaaggggccagg

SEQ ID NO: 6330080 - DNA, 18 bp, Homo sapiens
gtgatgggctaggcctcc

SEQ ID NO: 6330081 - DNA, 17 bp, Homo sapiens
gtgatggggccctgcct

SEQ ID NO: 6330082 - DNA, 18 bp, Homo sapiens
gtgatggggccctgcctc

SEQ ID NO: 6330083 - DNA, 17 bp, Homo sapiens
gtgatgggggagagggt

SEQ ID NO: 6330084 - DNA, 16 bp, Homo sapiens
gtgatggggtgggcag

SEQ ID NO: 6330085 - DNA, 22 bp, Homo sapiens
gtgatggggtgggcagggctgg

SEQ ID NO: 6330086 - DNA, 15 bp, Homo sapiens
gtgatgggtgcagga

SEQ ID NO: 6330087 - DNA, 15 bp, Homo sapiens
gtgatggtcattcat

SEQ ID NO: 6330088 - DNA, 14 bp, Homo sapiens
gtgatggtctctgg

SEQ ID NO: 6330089 - DNA, 16 bp, Homo sapiens
gtgatggtgtccttcc

SEQ ID NO: 6330090 - DNA, 14 bp, Homo sapiens
gtgatggttcccct

SEQ ID NO: 6330091 - DNA, 16 bp, Homo sapiens
gtgatggttcccctgt

SEQ ID NO: 6330092 - DNA, 23 bp, Homo sapiens
gtgatggttcccctgttcactct

SEQ ID NO: 6330093 - DNA, 15 bp, Homo sapiens
gtgatgtaaaaatgc

SEQ ID NO: 6330094 - DNA, 15 bp, Homo sapiens
gtgatgtaaaacaga

SEQ ID NO: 6330095 - DNA, 13 bp, Homo sapiens
gtgatgtatacat

SEQ ID NO: 6330096 - DNA, 11 bp, Homo sapiens
gtgatgtatgt

SEQ ID NO: 6330097 - DNA, 21 bp, Homo sapiens
gtgatgtattcttttatgaaa

SEQ ID NO: 6330098 - DNA, 16 bp, Homo sapiens
gtgatgtcacagtttg

SEQ ID NO: 6330099 - DNA, 17 bp, Homo sapiens
gtgatgtcacagtttgt

SEQ ID NO: 6330100 - DNA, 17 bp, Homo sapiens
gtgatgtcatacagaga

SEQ ID NO: 6330101 - DNA, 19 bp, Homo sapiens
gtgatgtcatacagagaag

SEQ ID NO: 6330102 - DNA, 22 bp, Homo sapiens
gtgatgtcatacagagaagtca

SEQ ID NO: 6330103 - DNA, 16 bp, Homo sapiens
gtgatgtccaaaagat

SEQ ID NO: 6330104 - DNA, 21 bp, Homo sapiens
gtgatgtcctgtaaacactca

SEQ ID NO: 6330105 - DNA, 18 bp, Homo sapiens
gtgatgtcttttcttggc

SEQ ID NO: 6330106 - DNA, 15 bp, Homo sapiens
gtgatgtgaagccaa

SEQ ID NO: 6330107 - DNA, 16 bp, Homo sapiens
gtgatgtgacatttgt

SEQ ID NO: 6330108 - DNA, 18 bp, Homo sapiens
gtgatgtgacatttgtca

SEQ ID NO: 6330109 - DNA, 14 bp, Homo sapiens
gtgatgtgatttat

SEQ ID NO: 6330110 - DNA, 20 bp, Homo sapiens
gtgatgtgatttatgcattt

SEQ ID NO: 6330111 - DNA, 13 bp, Homo sapiens
gtgatgtgctgga

SEQ ID NO: 6330112 - DNA, 21 bp, Homo sapiens
gtgatgtggaggaagagccac

SEQ ID NO: 6330113 - DNA, 15 bp, Homo sapiens
gtgatgtggtggccg

SEQ ID NO: 6330114 - DNA, 18 bp, Homo sapiens
gtgatgttctaaggctct

SEQ ID NO: 6330115 - DNA, 22 bp, Homo sapiens
gtgatgtttaacaggaagatct

SEQ ID NO: 6330116 - DNA, 12 bp, Homo sapiens
gtgatgttttgt

SEQ ID NO: 6330117 - DNA, 15 bp, Homo sapiens
gtgatgtttttatga

SEQ ID NO: 6330118 - DNA, 15 bp, Homo sapiens
gtgattaaagcaaga

SEQ ID NO: 6330119 - DNA, 17 bp, Homo sapiens
gtgattaaagctaagga

SEQ ID NO: 6330120 - DNA, 19 bp, Homo sapiens
gtgattaaagctaaggacc

SEQ ID NO: 6330121 - DNA, 15 bp, Homo sapiens
gtgattaactgtgaa

SEQ ID NO: 6330122 - DNA, 18 bp, Homo sapiens
gtgattaactgtgaataa

SEQ ID NO: 6330123 - DNA, 11 bp, Homo sapiens
gtgattaccag

SEQ ID NO: 6330124 - DNA, 23 bp, Homo sapiens
gtgattaccggcattttattaaa

SEQ ID NO: 6330125 - DNA, 17 bp, Homo sapiens
gtgattacctgctgcat

SEQ ID NO: 6330126 - DNA, 21 bp, Homo sapiens
gtgattacgtgtatgtttctt

SEQ ID NO: 6330127 - DNA, 23 bp, Homo sapiens
gtgattactctttgctttgtagt

SEQ ID NO: 6330128 - DNA, 13 bp, Homo sapiens
gtgattatcattt

SEQ ID NO: 6330129 - DNA, 15 bp, Homo sapiens
gtgattatcatttat

SEQ ID NO: 6330130 - DNA, 22 bp, Homo sapiens
gtgattatggacatcgatatga

SEQ ID NO: 6330131 - DNA, 19 bp, Homo sapiens
gtgattatttgttatttgt

SEQ ID NO: 6330132 - DNA, 16 bp, Homo sapiens
gtgattcaatctgtaa

SEQ ID NO: 6330133 - DNA, 14 bp, Homo sapiens
gtgattcagcaggc

SEQ ID NO: 6330134 - DNA, 18 bp, Homo sapiens
gtgattccccggagctgg

SEQ ID NO: 6330135 - DNA, 18 bp, Homo sapiens
gtgattcctacccctctt

SEQ ID NO: 6330136 - DNA, 15 bp, Homo sapiens
gtgattcctcccagg

SEQ ID NO: 6330137 - DNA, 20 bp, Homo sapiens
gtgattccttcaattcaaaa

SEQ ID NO: 6330138 - DNA, 19 bp, Homo sapiens
gtgattcctttgaagagga

SEQ ID NO: 6330139 - DNA, 21 bp, Homo sapiens
gtgattcctttgaagaggaaa

SEQ ID NO: 6330140 - DNA, 23 bp, Homo sapiens
gtgattccttttgatggggagaa

SEQ ID NO: 6330141 - DNA, 19 bp, Homo sapiens
gtgattcgggggctgacct

SEQ ID NO: 6330142 - DNA, 12 bp, Homo sapiens
gtgattctagag

SEQ ID NO: 6330143 - DNA, 18 bp, Homo sapiens
gtgattctcagggctgga

SEQ ID NO: 6330144 - DNA, 15 bp, Homo sapiens
gtgattctcctgcct

SEQ ID NO: 6330145 - DNA, 19 bp, Homo sapiens
gtgattctcctgcctcagc

SEQ ID NO: 6330146 - DNA, 20 bp, Homo sapiens
gtgattctcctgcctcagcc

SEQ ID NO: 6330147 - DNA, 17 bp, Homo sapiens
gtgattctctcttctct

SEQ ID NO: 6330148 - DNA, 23 bp, Homo sapiens
gtgattctctcttctctcccctt

SEQ ID NO: 6330149 - DNA, 14 bp, Homo sapiens
gtgattctgggatg

SEQ ID NO: 6330150 - DNA, 18 bp, Homo sapiens
gtgattctgtttattctt

SEQ ID NO: 6330151 - DNA, 17 bp, Homo sapiens
gtgattctttttttgtg

SEQ ID NO: 6330152 - DNA, 13 bp, Homo sapiens
gtgattgaaagaa

SEQ ID NO: 6330153 - DNA, 20 bp, Homo sapiens
gtgattgacacacagcactc

SEQ ID NO: 6330154 - DNA, 17 bp, Homo sapiens
gtgattgacagctttgc

SEQ ID NO: 6330155 - DNA, 13 bp, Homo sapiens
gtgattgcagctt

SEQ ID NO: 6330156 - DNA, 18 bp, Homo sapiens
gtgattgcagctttatgt

SEQ ID NO: 6330157 - DNA, 12 bp, Homo sapiens
gtgattgctttt

SEQ ID NO: 6330158 - DNA, 20 bp, Homo sapiens
gtgattggcaggaggcagga

SEQ ID NO: 6330159 - DNA, 12 bp, Homo sapiens
gtgattggctgc

SEQ ID NO: 6330160 - DNA, 14 bp, Homo sapiens
gtgattggctgcag

SEQ ID NO: 6330161 - DNA, 16 bp, Homo sapiens
gtgattgggacagagg

SEQ ID NO: 6330162 - DNA, 15 bp, Homo sapiens
gtgattggtaactag

SEQ ID NO: 6330163 - DNA, 23 bp, Homo sapiens
gtgattgtaacaaattgatctgt

SEQ ID NO: 6330164 - DNA, 23 bp, Homo sapiens
gtgattgtggaatggagattcag

SEQ ID NO: 6330165 - DNA, 14 bp, Homo sapiens
gtgattgtggcatt

SEQ ID NO: 6330166 - DNA, 19 bp, Homo sapiens
gtgatttaagacacttttt

SEQ ID NO: 6330167 - DNA, 19 bp, Homo sapiens
ggctgaactgagaaggcag

SEQ ID NO: 6330168 - DNA, 23 bp, Homo sapiens
ggctgaactgagaaggcaggcct

SEQ ID NO: 6330169 - DNA, 18 bp, Homo sapiens
ggctgaactttgtggtcg

SEQ ID NO: 6330170 - DNA, 11 bp, Homo sapiens
ggctgaagacg

SEQ ID NO: 6330171 - DNA, 13 bp, Homo sapiens
ggctgaagagagg

SEQ ID NO: 6330172 - DNA, 14 bp, Homo sapiens
ggctgaagaggacc

SEQ ID NO: 6330173 - DNA, 17 bp, Homo sapiens
ggctgaagaggaccaga

SEQ ID NO: 6330174 - DNA, 18 bp, Homo sapiens
ggctgaagaggaccagag

SEQ ID NO: 6330175 - DNA, 19 bp, Homo sapiens
ggctgaagaggaccagagg

SEQ ID NO: 6330176 - DNA, 16 bp, Homo sapiens
ggctgaagccacacag

SEQ ID NO: 6330177 - DNA, 18 bp, Homo sapiens
ggctgaagccacacagcc

SEQ ID NO: 6330178 - DNA, 20 bp, Homo sapiens
ggctgaagccacacagccca

SEQ ID NO: 6330179 - DNA, 19 bp, Homo sapiens
ggctgaagctggagcagcg

SEQ ID NO: 6330180 - DNA, 22 bp, Homo sapiens
ggctgaaggatgggggctcctg

SEQ ID NO: 6330181 - DNA, 21 bp, Homo sapiens
ggctgaagggaagcccagcct

SEQ ID NO: 6330182 - DNA, 18 bp, Homo sapiens
ggctgaagtgttctctag

SEQ ID NO: 6330183 - DNA, 14 bp, Homo sapiens
ggctgaataaagcc

SEQ ID NO: 6330184 - DNA, 21 bp, Homo sapiens
ggctgaatccgtggtggcacc

SEQ ID NO: 6330185 - DNA, 19 bp, Homo sapiens
ggctgaatgtatgtaaata

SEQ ID NO: 6330186 - DNA, 22 bp, Homo sapiens
ggctgaatgtatgtcagtgcta

SEQ ID NO: 6330187 - DNA, 18 bp, Homo sapiens
ggctgaattaaaatggtt

SEQ ID NO: 6330188 - DNA, 14 bp, Homo sapiens
ggctgacacccagg

SEQ ID NO: 6330189 - DNA, 18 bp, Homo sapiens
ggctgacacccaggcccg

SEQ ID NO: 6330190 - DNA, 14 bp, Homo sapiens
ggctgacagagcag

SEQ ID NO: 6330191 - DNA, 14 bp, Homo sapiens
ggctgacatctgtg

SEQ ID NO: 6330192 - DNA, 22 bp, Homo sapiens
ggctgacatgaagctgttgtgt

SEQ ID NO: 6330193 - DNA, 15 bp, Homo sapiens
ggctgaccaggcttc

SEQ ID NO: 6330194 - DNA, 23 bp, Homo sapiens
ggctgacccagcatctcccagca

SEQ ID NO: 6330195 - DNA, 17 bp, Homo sapiens
ggctgacccagtccctg

SEQ ID NO: 6330196 - DNA, 23 bp, Homo sapiens
ggctgacccagtgtgtgctcagc

SEQ ID NO: 6330197 - DNA, 19 bp, Homo sapiens
ggctgaccccaaagagcct

SEQ ID NO: 6330198 - DNA, 22 bp, Homo sapiens
ggctgaccccaaagagcctgga

SEQ ID NO: 6330199 - DNA, 13 bp, Homo sapiens
ggctgacccccct

SEQ ID NO: 6330200 - DNA, 12 bp, Homo sapiens
ggctgacccctc

SEQ ID NO: 6330201 - DNA, 15 bp, Homo sapiens
ggctgacccctctgg

SEQ ID NO: 6330202 - DNA, 22 bp, Homo sapiens
ggctgacccctctggtgtgtgg

SEQ ID NO: 6330203 - DNA, 13 bp, Homo sapiens
ggctgacctctca

SEQ ID NO: 6330204 - DNA, 23 bp, Homo sapiens
ggctgacctgggcccacagagcc

SEQ ID NO: 6330205 - DNA, 23 bp, Homo sapiens
ggctgaccttcctcgcagagagg

SEQ ID NO: 6330206 - DNA, 20 bp, Homo sapiens
ggctgactaagccccgtctg

SEQ ID NO: 6330207 - DNA, 12 bp, Homo sapiens
ggctgactggcc

SEQ ID NO: 6330208 - DNA, 13 bp, Homo sapiens
ggctgactggcca

SEQ ID NO: 6330209 - DNA, 18 bp, Homo sapiens
ggctgactggggctgggg

SEQ ID NO: 6330210 - DNA, 14 bp, Homo sapiens
ggctgactgggggc

SEQ ID NO: 6330211 - DNA, 16 bp, Homo sapiens
ggctgacttcatctgg

SEQ ID NO: 6330212 - DNA, 18 bp, Homo sapiens
ggctgacttctccaggac

SEQ ID NO: 6330213 - DNA, 17 bp, Homo sapiens
ggctgagaaccctgcgt

SEQ ID NO: 6330214 - DNA, 17 bp, Homo sapiens
ggctgagactgcagagg

SEQ ID NO: 6330215 - DNA, 20 bp, Homo sapiens
ggctgagactgcagaggagc

SEQ ID NO: 6330216 - DNA, 21 bp, Homo sapiens
ggctgagactggatactgccc

SEQ ID NO: 6330217 - DNA, 17 bp, Homo sapiens
ggctgagagccccagct

SEQ ID NO: 6330218 - DNA, 20 bp, Homo sapiens
ggctgagagccccagctgac

SEQ ID NO: 6330219 - DNA, 18 bp, Homo sapiens
ggctgagagggctgtggc

SEQ ID NO: 6330220 - DNA, 19 bp, Homo sapiens
ggctgagagggctgtggct

SEQ ID NO: 6330221 - DNA, 21 bp, Homo sapiens
ggctgagagggctgtggctgg

SEQ ID NO: 6330222 - DNA, 20 bp, Homo sapiens
ggctgagagggtgtgggtgc

SEQ ID NO: 6330223 - DNA, 15 bp, Homo sapiens
ggctgagatatgaac

SEQ ID NO: 6330224 - DNA, 21 bp, Homo sapiens
ggctgagccaaagccagagtg

SEQ ID NO: 6330225 - DNA, 14 bp, Homo sapiens
ggctgagcccagcc

SEQ ID NO: 6330226 - DNA, 17 bp, Homo sapiens
ggctgagcccagccacc

SEQ ID NO: 6330227 - DNA, 19 bp, Homo sapiens
ggctgagcccagccacctc

SEQ ID NO: 6330228 - DNA, 20 bp, Homo sapiens
ggctgagcccagccacctcc

SEQ ID NO: 6330229 - DNA, 21 bp, Homo sapiens
ggctgagcccagccacctccc

SEQ ID NO: 6330230 - DNA, 13 bp, Homo sapiens
ggctgagcccctg

SEQ ID NO: 6330231 - DNA, 16 bp, Homo sapiens
ggctgagcccctgggg

SEQ ID NO: 6330232 - DNA, 18 bp, Homo sapiens
ggctgagcccctggtctt

SEQ ID NO: 6330233 - DNA, 15 bp, Homo sapiens
ggctgagccctcctg

SEQ ID NO: 6330234 - DNA, 17 bp, Homo sapiens
ggctgagccctcctgag

SEQ ID NO: 6330235 - DNA, 13 bp, Homo sapiens
ggctgagccctgc

SEQ ID NO: 6330236 - DNA, 14 bp, Homo sapiens
ggctgagccctggc

SEQ ID NO: 6330237 - DNA, 13 bp, Homo sapiens
ggctgagccctgt

SEQ ID NO: 6330238 - DNA, 22 bp, Homo sapiens
ggctgagccctgtacccacccc

SEQ ID NO: 6330239 - DNA, 20 bp, Homo sapiens
ggctgagccgatctggtctc

SEQ ID NO: 6330240 - DNA, 20 bp, Homo sapiens
ggctgagcctactgtctcct

SEQ ID NO: 6330241 - DNA, 23 bp, Homo sapiens
ggctgagcctactgtctccttcc

SEQ ID NO: 6330242 - DNA, 11 bp, Homo sapiens
ggctgagcctg

SEQ ID NO: 6330243 - DNA, 19 bp, Homo sapiens
ggctgagcggatgcatctg

SEQ ID NO: 6330244 - DNA, 14 bp, Homo sapiens
ggctgagctgccca

SEQ ID NO: 6330245 - DNA, 20 bp, Homo sapiens
ggctgagctgcccacagcag

SEQ ID NO: 6330246 - DNA, 22 bp, Homo sapiens
ggctgagctgtgccagctgctt

SEQ ID NO: 6330247 - DNA, 15 bp, Homo sapiens
ggctgagcttggccc

SEQ ID NO: 6330248 - DNA, 16 bp, Homo sapiens
ggctgagcttggccct

SEQ ID NO: 6330249 - DNA, 18 bp, Homo sapiens
ggctgagctttctagcct

SEQ ID NO: 6330250 - DNA, 16 bp, Homo sapiens
ggctgaggacgagacc

SEQ ID NO: 6330251 - DNA, 19 bp, Homo sapiens
ggctgaggacggggcagag

SEQ ID NO: 6330252 - DNA, 21 bp, Homo sapiens
ggctgaggacggggcagagct

SEQ ID NO: 6330253 - DNA, 16 bp, Homo sapiens
ggctgaggagcagcca

SEQ ID NO: 6330254 - DNA, 19 bp, Homo sapiens
ggctgaggagcagccagga

SEQ ID NO: 6330255 - DNA, 15 bp, Homo sapiens
ggctgaggaggcctc

SEQ ID NO: 6330256 - DNA, 16 bp, Homo sapiens
ggctgaggaggcctcc

SEQ ID NO: 6330257 - DNA, 19 bp, Homo sapiens
ggctgaggaggcctccatc

SEQ ID NO: 6330258 - DNA, 21 bp, Homo sapiens
ggctgaggataccccaaagtc

SEQ ID NO: 6330259 - DNA, 14 bp, Homo sapiens
ggctgaggcagaag

SEQ ID NO: 6330260 - DNA, 23 bp, Homo sapiens
ggctgaggcaggagaatggtgtg

SEQ ID NO: 6330261 - DNA, 17 bp, Homo sapiens
ggctgaggcagtgctag

SEQ ID NO: 6330262 - DNA, 13 bp, Homo sapiens
ggctgaggccacc

SEQ ID NO: 6330263 - DNA, 17 bp, Homo sapiens
ggctgaggctggcacag

SEQ ID NO: 6330264 - DNA, 12 bp, Homo sapiens
ggctgagggagg

SEQ ID NO: 6330265 - DNA, 15 bp, Homo sapiens
ggctgagggaggcag

SEQ ID NO: 6330266 - DNA, 23 bp, Homo sapiens
ggctgagggatggactgatgctt

SEQ ID NO: 6330267 - DNA, 22 bp, Homo sapiens
ggctgagggcagttcgcagcca

SEQ ID NO: 6330268 - DNA, 14 bp, Homo sapiens
ggctgagggcatct

SEQ ID NO: 6330269 - DNA, 12 bp, Homo sapiens
ggctgagggcct

SEQ ID NO: 6330270 - DNA, 13 bp, Homo sapiens
ggctgagggcctg

SEQ ID NO: 6330271 - DNA, 21 bp, Homo sapiens
ggctgaggggcctgcgcccag

SEQ ID NO: 6330272 - DNA, 15 bp, Homo sapiens
ggctgaggggcttgg

SEQ ID NO: 6330273 - DNA, 15 bp, Homo sapiens
ggctgagggtcgtgg

SEQ ID NO: 6330274 - DNA, 16 bp, Homo sapiens
ggctgagggtgccctt

SEQ ID NO: 6330275 - DNA, 16 bp, Homo sapiens
ggctgaggtggggaag

SEQ ID NO: 6330276 - DNA, 16 bp, Homo sapiens
ggctgaggttcctctg

SEQ ID NO: 6330277 - DNA, 18 bp, Homo sapiens
ggctgaggttcctctgcc

SEQ ID NO: 6330278 - DNA, 22 bp, Homo sapiens
ggctgaggttcctctgcctgcc

SEQ ID NO: 6330279 - DNA, 17 bp, Homo sapiens
ggctgagtagctctgcc

SEQ ID NO: 6330280 - DNA, 22 bp, Homo sapiens
ggctgagtcatgatctccctgc

SEQ ID NO: 6330281 - DNA, 16 bp, Homo sapiens
ggctgagtctccaggg

SEQ ID NO: 6330282 - DNA, 16 bp, Homo sapiens
ggctgagtctggctag

SEQ ID NO: 6330283 - DNA, 16 bp, Homo sapiens
ggctgagtgcagaggc

SEQ ID NO: 6330284 - DNA, 13 bp, Homo sapiens
ggctgagtgcagc

SEQ ID NO: 6330285 - DNA, 15 bp, Homo sapiens
ggctgagtgcagcca

SEQ ID NO: 6330286 - DNA, 17 bp, Homo sapiens
ggctgagtgcagccaaa

SEQ ID NO: 6330287 - DNA, 17 bp, Homo sapiens
ggctgagtgcaggccca

SEQ ID NO: 6330288 - DNA, 18 bp, Homo sapiens
ggctgagtgcaggcccac

SEQ ID NO: 6330289 - DNA, 21 bp, Homo sapiens
ggctgagtgcaggcccaccct

SEQ ID NO: 6330290 - DNA, 16 bp, Homo sapiens
ggctgagtggcagcag

SEQ ID NO: 6330291 - DNA, 17 bp, Homo sapiens
ggctgagttctggttca

SEQ ID NO: 6330292 - DNA, 19 bp, Homo sapiens
ggctgataattccagtggt

SEQ ID NO: 6330293 - DNA, 19 bp, Homo sapiens
ggctgatcattaattagaa

SEQ ID NO: 6330294 - DNA, 13 bp, Homo sapiens
ggctgatctcagg

SEQ ID NO: 6330295 - DNA, 19 bp, Homo sapiens
ggctgatctcagggaagcc

SEQ ID NO: 6330296 - DNA, 13 bp, Homo sapiens
ggctgatgaagaa

SEQ ID NO: 6330297 - DNA, 14 bp, Homo sapiens
ggctgatgaagaag

SEQ ID NO: 6330298 - DNA, 17 bp, Homo sapiens
ggctgatgaagaagggg

SEQ ID NO: 6330299 - DNA, 16 bp, Homo sapiens
ggctgatggaggaaaa

SEQ ID NO: 6330300 - DNA, 15 bp, Homo sapiens
ggctgatggagtaaa

SEQ ID NO: 6330301 - DNA, 21 bp, Homo sapiens
ggctgatggattccaaaccag

SEQ ID NO: 6330302 - DNA, 18 bp, Homo sapiens
ggctgatgggtggacctg

SEQ ID NO: 6330303 - DNA, 17 bp, Homo sapiens
ggctgatgtggactgtc

SEQ ID NO: 6330304 - DNA, 15 bp, Homo sapiens
ggctgattcagcatt

SEQ ID NO: 6330305 - DNA, 14 bp, Homo sapiens
ggctgatttctagg

SEQ ID NO: 6330306 - DNA, 19 bp, Homo sapiens
ggctgatttggagtgagcc

SEQ ID NO: 6330307 - DNA, 13 bp, Homo sapiens
ggctgcaaaatta

SEQ ID NO: 6330308 - DNA, 22 bp, Homo sapiens
ggctgcaaataaggacagcagc

SEQ ID NO: 6330309 - DNA, 23 bp, Homo sapiens
ggctgcaaataaggacagcagct

SEQ ID NO: 6330310 - DNA, 24 bp, Homo sapiens
ggctgcaaataaggacagcagctg

SEQ ID NO: 6330311 - DNA, 18 bp, Homo sapiens
ggctgcacaacagccctg

SEQ ID NO: 6330312 - DNA, 19 bp, Homo sapiens
ggctgcacagcccaaccag

SEQ ID NO: 6330313 - DNA, 17 bp, Homo sapiens
ggctgcaccggctggcc

SEQ ID NO: 6330314 - DNA, 22 bp, Homo sapiens
ggctgcacgtcaccctcctgag

SEQ ID NO: 6330315 - DNA, 23 bp, Homo sapiens
ggctgcacgtcaccctcctgagc

SEQ ID NO: 6330316 - DNA, 21 bp, Homo sapiens
ggctgcactcaagaccctcga

SEQ ID NO: 6330317 - DNA, 15 bp, Homo sapiens
ggctgcactctgtgc

SEQ ID NO: 6330318 - DNA, 15 bp, Homo sapiens
ggctgcactggagcc

SEQ ID NO: 6330319 - DNA, 17 bp, Homo sapiens
ggctgcactggagccac

SEQ ID NO: 6330320 - DNA, 12 bp, Homo sapiens
ggctgcagaaga

SEQ ID NO: 6330321 - DNA, 23 bp, Homo sapiens
ggctgcagaagatttagatgttt

SEQ ID NO: 6330322 - DNA, 12 bp, Homo sapiens
ggctgcagagcc

SEQ ID NO: 6330323 - DNA, 13 bp, Homo sapiens
ggctgcagaggcc

SEQ ID NO: 6330324 - DNA, 18 bp, Homo sapiens
ggctgcagaggccagagg

SEQ ID NO: 6330325 - DNA, 19 bp, Homo sapiens
ggctgcagaggccagaggc

SEQ ID NO: 6330326 - DNA, 20 bp, Homo sapiens
ggctgcagagtctgccccac

SEQ ID NO: 6330327 - DNA, 16 bp, Homo sapiens
ggctgcagcagaggcc

SEQ ID NO: 6330328 - DNA, 13 bp, Homo sapiens
ggctgcagcagcc

SEQ ID NO: 6330329 - DNA, 22 bp, Homo sapiens
ggctgcagcagcggtggcctct

SEQ ID NO: 6330330 - DNA, 18 bp, Homo sapiens
ggctgcagcaggcagagg

SEQ ID NO: 6330331 - DNA, 20 bp, Homo sapiens
ggctgcagcaggtgctgggc

SEQ ID NO: 6330332 - DNA, 22 bp, Homo sapiens
ggctgcagcaggtgctgggctg

SEQ ID NO: 6330333 - DNA, 15 bp, Homo sapiens
ggctgcagccaggcc

SEQ ID NO: 6330334 - DNA, 16 bp, Homo sapiens
ggctgcagccaggcca

SEQ ID NO: 6330335 - DNA, 17 bp, Homo sapiens
ggctgcagccccctgct

SEQ ID NO: 6330336 - DNA, 20 bp, Homo sapiens
ggctgcagcctcaggactgg

SEQ ID NO: 6330337 - DNA, 22 bp, Homo sapiens
ggctgcagcgcccggtgctctg

SEQ ID NO: 6330338 - DNA, 15 bp, Homo sapiens
ggctgcagctggaca

SEQ ID NO: 6330339 - DNA, 18 bp, Homo sapiens
ggctgcagctggacagag

SEQ ID NO: 6330340 - DNA, 13 bp, Homo sapiens
ggctgcaggaggg

SEQ ID NO: 6330341 - DNA, 16 bp, Homo sapiens
ggctgcaggagggcac

SEQ ID NO: 6330342 - DNA, 18 bp, Homo sapiens
ggctgcaggagggcactg

SEQ ID NO: 6330343 - DNA, 13 bp, Homo sapiens
ggctgcaggcagg

SEQ ID NO: 6330344 - DNA, 14 bp, Homo sapiens
ggctgcaggcaggc

SEQ ID NO: 6330345 - DNA, 22 bp, Homo sapiens
gtgatttaagggcccaggtcag

SEQ ID NO: 6330346 - DNA, 18 bp, Homo sapiens
gtgatttaatagtgttaa

SEQ ID NO: 6330347 - DNA, 19 bp, Homo sapiens
gtgatttaatagtgttaat

SEQ ID NO: 6330348 - DNA, 15 bp, Homo sapiens
gtgatttacacaggt

SEQ ID NO: 6330349 - DNA, 21 bp, Homo sapiens
gtgatttagaactgtatgtca

SEQ ID NO: 6330350 - DNA, 21 bp, Homo sapiens
gtgatttatttggagtggagg

SEQ ID NO: 6330351 - DNA, 23 bp, Homo sapiens
gtgatttcagactgcagagggga

SEQ ID NO: 6330352 - DNA, 15 bp, Homo sapiens
gtgatttccatctct

SEQ ID NO: 6330353 - DNA, 12 bp, Homo sapiens
gtgatttccatt

SEQ ID NO: 6330354 - DNA, 17 bp, Homo sapiens
gtgatttccatttctga

SEQ ID NO: 6330355 - DNA, 23 bp, Homo sapiens
gtgatttctcagtgatttcctac

SEQ ID NO: 6330356 - DNA, 17 bp, Homo sapiens
gtgatttgaaaaatata

SEQ ID NO: 6330357 - DNA, 14 bp, Homo sapiens
gtgatttgactgtt

SEQ ID NO: 6330358 - DNA, 22 bp, Homo sapiens
gtgatttgactgtttttaccca

SEQ ID NO: 6330359 - DNA, 16 bp, Homo sapiens
gtgatttgtcttccct

SEQ ID NO: 6330360 - DNA, 15 bp, Homo sapiens
gtgatttgtgaaata

SEQ ID NO: 6330361 - DNA, 16 bp, Homo sapiens
gtgattttaaatgtgt

SEQ ID NO: 6330362 - DNA, 21 bp, Homo sapiens
gtgattttatgatcagtgttg

SEQ ID NO: 6330363 - DNA, 17 bp, Homo sapiens
gtgattttatgtttaaa

SEQ ID NO: 6330364 - DNA, 18 bp, Homo sapiens
gtgattttatgtttaaaa

SEQ ID NO: 6330365 - DNA, 18 bp, Homo sapiens
gtgattttatttttgcaa

SEQ ID NO: 6330366 - DNA, 19 bp, Homo sapiens
gtgattttatttttgcaaa

SEQ ID NO: 6330367 - DNA, 23 bp, Homo sapiens
gtgattttatttttgcaaaataa

SEQ ID NO: 6330368 - DNA, 12 bp, Homo sapiens
gtgattttcaaa

SEQ ID NO: 6330369 - DNA, 21 bp, Homo sapiens
gtgattttcaaatatgtaaac

SEQ ID NO: 6330370 - DNA, 21 bp, Homo sapiens
gtgattttgccctcctgccca

SEQ ID NO: 6330371 - DNA, 13 bp, Homo sapiens
gtgattttgtaca

SEQ ID NO: 6330372 - DNA, 14 bp, Homo sapiens
gtgattttgtacag

SEQ ID NO: 6330373 - DNA, 22 bp, Homo sapiens
gtgattttgtaggttattttat

SEQ ID NO: 6330374 - DNA, 16 bp, Homo sapiens
gtgatttttaaattaa

SEQ ID NO: 6330375 - DNA, 15 bp, Homo sapiens
gtgatttttttttag

SEQ ID NO: 6330376 - DNA, 23 bp, Homo sapiens
gtgatttttttttttttcctgtc

SEQ ID NO: 6330377 - DNA, 13 bp, Homo sapiens
gtgcaaaaaacat

SEQ ID NO: 6330378 - DNA, 13 bp, Homo sapiens
gtgcaaaaataaa

SEQ ID NO: 6330379 - DNA, 23 bp, Homo sapiens
gtgcaaaaataaaaggaaaacca

SEQ ID NO: 6330380 - DNA, 13 bp, Homo sapiens
gtgcaaaactgtg

SEQ ID NO: 6330381 - DNA, 16 bp, Homo sapiens
gtgcaaaactgtgtca

SEQ ID NO: 6330382 - DNA, 19 bp, Homo sapiens
gtgcaaaatatttgactat

SEQ ID NO: 6330383 - DNA, 17 bp, Homo sapiens
gtgcaaaatgtcttgtg

SEQ ID NO: 6330384 - DNA, 21 bp, Homo sapiens
gtgcaaacagtaacgtgtgcg

SEQ ID NO: 6330385 - DNA, 18 bp, Homo sapiens
gtgcaaacccactcagag

SEQ ID NO: 6330386 - DNA, 15 bp, Homo sapiens
gtgcaaagaaaagaa

SEQ ID NO: 6330387 - DNA, 15 bp, Homo sapiens
gtgcaaagactctga

SEQ ID NO: 6330388 - DNA, 16 bp, Homo sapiens
gtgcaaagactctgag

SEQ ID NO: 6330389 - DNA, 18 bp, Homo sapiens
gtgcaaagactctgagcc

SEQ ID NO: 6330390 - DNA, 15 bp, Homo sapiens
gtgcaaagcagtatg

SEQ ID NO: 6330391 - DNA, 23 bp, Homo sapiens
gtgcaaatggtttatagccctgt

SEQ ID NO: 6330392 - DNA, 19 bp, Homo sapiens
gtgcaaatgtcagatacaa

SEQ ID NO: 6330393 - DNA, 18 bp, Homo sapiens
gtgcaaattgtatcttat

SEQ ID NO: 6330394 - DNA, 13 bp, Homo sapiens
gtgcaaattttgc

SEQ ID NO: 6330395 - DNA, 22 bp, Homo sapiens
gtgcaacaaggtcctctgtcag

SEQ ID NO: 6330396 - DNA, 13 bp, Homo sapiens
gtgcaacactggt

SEQ ID NO: 6330397 - DNA, 14 bp, Homo sapiens
gtgcaacagacaag

SEQ ID NO: 6330398 - DNA, 15 bp, Homo sapiens
gtgcaacagacaagt

SEQ ID NO: 6330399 - DNA, 14 bp, Homo sapiens
gtgcaacatctctg

SEQ ID NO: 6330400 - DNA, 17 bp, Homo sapiens
gtgcaacggccagggtt

SEQ ID NO: 6330401 - DNA, 13 bp, Homo sapiens
gtgcaactgacac

SEQ ID NO: 6330402 - DNA, 18 bp, Homo sapiens
gtgcaactggccagccaa

SEQ ID NO: 6330403 - DNA, 12 bp, Homo sapiens
gtgcaagagaca

SEQ ID NO: 6330404 - DNA, 16 bp, Homo sapiens
gtgcaagagacagagc

SEQ ID NO: 6330405 - DNA, 18 bp, Homo sapiens
gtgcaagagacagagccc

SEQ ID NO: 6330406 - DNA, 18 bp, Homo sapiens
gtgcaagagactctggcc

SEQ ID NO: 6330407 - DNA, 19 bp, Homo sapiens
gtgcaagagactctggcct

SEQ ID NO: 6330408 - DNA, 14 bp, Homo sapiens
gtgcaagagacttt

SEQ ID NO: 6330409 - DNA, 14 bp, Homo sapiens
gtgcaagcaaagca

SEQ ID NO: 6330410 - DNA, 19 bp, Homo sapiens
gtgcaagcgacgacagatg

SEQ ID NO: 6330411 - DNA, 13 bp, Homo sapiens
gtgcaaggaccaa

SEQ ID NO: 6330412 - DNA, 15 bp, Homo sapiens
gtgcaaggacctaaa

SEQ ID NO: 6330413 - DNA, 21 bp, Homo sapiens
gtgcaaggagtgtaaaatgta

SEQ ID NO: 6330414 - DNA, 12 bp, Homo sapiens
gtgcaaggcagc

SEQ ID NO: 6330415 - DNA, 17 bp, Homo sapiens
gtgcaaggtggcctttg

SEQ ID NO: 6330416 - DNA, 20 bp, Homo sapiens
gtgcaagtagcacatggttt

SEQ ID NO: 6330417 - DNA, 14 bp, Homo sapiens
gtgcaagtgtgtgc

SEQ ID NO: 6330418 - DNA, 23 bp, Homo sapiens
gtgcaagttcatgtgtggaaatg

SEQ ID NO: 6330419 - DNA, 17 bp, Homo sapiens
gtgcaagttgtactgta

SEQ ID NO: 6330420 - DNA, 19 bp, Homo sapiens
gtgcaataaatctgaccca

SEQ ID NO: 6330421 - DNA, 22 bp, Homo sapiens
gtgcaataaatctgacccagtg

SEQ ID NO: 6330422 - DNA, 15 bp, Homo sapiens
gtgcaatacattttt

SEQ ID NO: 6330423 - DNA, 15 bp, Homo sapiens
gtgcaataggtgaga

SEQ ID NO: 6330424 - DNA, 13 bp, Homo sapiens
gtgcaatatattt

SEQ ID NO: 6330425 - DNA, 20 bp, Homo sapiens
gtgcaatatattttgtatgc

SEQ ID NO: 6330426 - DNA, 24 bp, Homo sapiens
gtgcaatatgaggggactgcatgc

SEQ ID NO: 6330427 - DNA, 21 bp, Homo sapiens
gtgcaatatgggcgggcagtc

SEQ ID NO: 6330428 - DNA, 17 bp, Homo sapiens
gtgcaatcacagctcac

SEQ ID NO: 6330429 - DNA, 20 bp, Homo sapiens
gtgcaatgccccctcccctc

SEQ ID NO: 6330430 - DNA, 19 bp, Homo sapiens
gtgcaatgggtaagggagg

SEQ ID NO: 6330431 - DNA, 21 bp, Homo sapiens
gtgcaatgtctgagtgaacct

SEQ ID NO: 6330432 - DNA, 23 bp, Homo sapiens
gtgcaatgtgtataaacaagaaa

SEQ ID NO: 6330433 - DNA, 20 bp, Homo sapiens
gtgcaatgtgtgtatatgga

SEQ ID NO: 6330434 - DNA, 18 bp, Homo sapiens
gtgcaattccaagaaaat

SEQ ID NO: 6330435 - DNA, 19 bp, Homo sapiens
gtgcaattccaagaaaata

SEQ ID NO: 6330436 - DNA, 23 bp, Homo sapiens
gtgcaattgtcttttttttcctt

SEQ ID NO: 6330437 - DNA, 23 bp, Homo sapiens
gtgcaatttctgtacatttgcaa

SEQ ID NO: 6330438 - DNA, 23 bp, Homo sapiens
gtgcaatttcttctgtagctatt

SEQ ID NO: 6330439 - DNA, 13 bp, Homo sapiens
gtgcaatttgtct

SEQ ID NO: 6330440 - DNA, 16 bp, Homo sapiens
gtgcaatttgtctttg

SEQ ID NO: 6330441 - DNA, 21 bp, Homo sapiens
gtgcaatttgtttgtgcttct

SEQ ID NO: 6330442 - DNA, 18 bp, Homo sapiens
gtgcacaaaacccagacc

SEQ ID NO: 6330443 - DNA, 15 bp, Homo sapiens
gtgcacaaatattta

SEQ ID NO: 6330444 - DNA, 23 bp, Homo sapiens
gtgcacaacccaccacccccttt

SEQ ID NO: 6330445 - DNA, 21 bp, Homo sapiens
gtgcacaagctccaagctccc

SEQ ID NO: 6330446 - DNA, 19 bp, Homo sapiens
gtgcacaataaagggggtt

SEQ ID NO: 6330447 - DNA, 12 bp, Homo sapiens
gtgcacacacac

SEQ ID NO: 6330448 - DNA, 12 bp, Homo sapiens
gtgcacacacct

SEQ ID NO: 6330449 - DNA, 14 bp, Homo sapiens
gtgcacacacctgc

SEQ ID NO: 6330450 - DNA, 20 bp, Homo sapiens
gtgcacaccccactcccaca

SEQ ID NO: 6330451 - DNA, 19 bp, Homo sapiens
gtgcacacgtgtgtatgag

SEQ ID NO: 6330452 - DNA, 14 bp, Homo sapiens
gtgcacagaaaacc

SEQ ID NO: 6330453 - DNA, 20 bp, Homo sapiens
gtgcacagacgtccctccac

SEQ ID NO: 6330454 - DNA, 13 bp, Homo sapiens
gtgcacagccact

SEQ ID NO: 6330455 - DNA, 11 bp, Homo sapiens
gtgcacagccc

SEQ ID NO: 6330456 - DNA, 15 bp, Homo sapiens
gtgcacaggagccaa

SEQ ID NO: 6330457 - DNA, 12 bp, Homo sapiens
gtgcacaggagg

SEQ ID NO: 6330458 - DNA, 12 bp, Homo sapiens
gtgcacaggcag

SEQ ID NO: 6330459 - DNA, 13 bp, Homo sapiens
gtgcacaggcaga

SEQ ID NO: 6330460 - DNA, 17 bp, Homo sapiens
gtgcacaggcctctgcc

SEQ ID NO: 6330461 - DNA, 18 bp, Homo sapiens
gtgcacaggcctctgcct

SEQ ID NO: 6330462 - DNA, 19 bp, Homo sapiens
gtgcacaggcctctgcctg

SEQ ID NO: 6330463 - DNA, 20 bp, Homo sapiens
gtgcacaggcctctgcctgc

SEQ ID NO: 6330464 - DNA, 22 bp, Homo sapiens
gtgcacaggtttgttttttcaa

SEQ ID NO: 6330465 - DNA, 16 bp, Homo sapiens
gtgcacagtccacagc

SEQ ID NO: 6330466 - DNA, 13 bp, Homo sapiens
gtgcacagtgatt

SEQ ID NO: 6330467 - DNA, 22 bp, Homo sapiens
gtgcacatatccaggcaccagg

SEQ ID NO: 6330468 - DNA, 22 bp, Homo sapiens
gtgcacatctacatgccatgcc

SEQ ID NO: 6330469 - DNA, 17 bp, Homo sapiens
gtgcacatctgttttgt

SEQ ID NO: 6330470 - DNA, 22 bp, Homo sapiens
gtgcacatgtacatatggaaat

SEQ ID NO: 6330471 - DNA, 14 bp, Homo sapiens
gtgcacatgtgtct

SEQ ID NO: 6330472 - DNA, 15 bp, Homo sapiens
gtgcacatgtgtctg

SEQ ID NO: 6330473 - DNA, 16 bp, Homo sapiens
gtgcacatgtgtctgt

SEQ ID NO: 6330474 - DNA, 14 bp, Homo sapiens
gtgcacattctccc

SEQ ID NO: 6330475 - DNA, 13 bp, Homo sapiens
gtgcacatttctt

SEQ ID NO: 6330476 - DNA, 18 bp, Homo sapiens
gtgcaccaccacacccgg

SEQ ID NO: 6330477 - DNA, 21 bp, Homo sapiens
gtgcaccaccatgccaggcta

SEQ ID NO: 6330478 - DNA, 23 bp, Homo sapiens
gtgcaccatccctttttgaagtg

SEQ ID NO: 6330479 - DNA, 22 bp, Homo sapiens
gtgcacccacctgttttctgaa

SEQ ID NO: 6330480 - DNA, 18 bp, Homo sapiens
gtgcacccactcaccagg

SEQ ID NO: 6330481 - DNA, 19 bp, Homo sapiens
gtgcacccactcaccaggg

SEQ ID NO: 6330482 - DNA, 21 bp, Homo sapiens
gtgcacccactcaccagggtc

SEQ ID NO: 6330483 - DNA, 22 bp, Homo sapiens
gtgcacccactcaccagggtcc

SEQ ID NO: 6330484 - DNA, 14 bp, Homo sapiens
gtgcacccggcctg

SEQ ID NO: 6330485 - DNA, 21 bp, Homo sapiens
gtgcaccgttgggaccaatgc

SEQ ID NO: 6330486 - DNA, 22 bp, Homo sapiens
gtgcacctccctccccagctcc

SEQ ID NO: 6330487 - DNA, 18 bp, Homo sapiens
gtgcacctgccccaggct

SEQ ID NO: 6330488 - DNA, 15 bp, Homo sapiens
gtgcacctgcctcca

SEQ ID NO: 6330489 - DNA, 16 bp, Homo sapiens
gtgcacctgcctccac

SEQ ID NO: 6330490 - DNA, 18 bp, Homo sapiens
gtgcacgcaggcacagca

SEQ ID NO: 6330491 - DNA, 22 bp, Homo sapiens
gtgcacgcaggcacagcagctg

SEQ ID NO: 6330492 - DNA, 18 bp, Homo sapiens
gtgcacgcagtggccttc

SEQ ID NO: 6330493 - DNA, 15 bp, Homo sapiens
gtgcacgcctgagcg

SEQ ID NO: 6330494 - DNA, 21 bp, Homo sapiens
gtgcacgcctgagcgtcctcc

SEQ ID NO: 6330495 - DNA, 15 bp, Homo sapiens
gtgcacggcagcttg

SEQ ID NO: 6330496 - DNA, 15 bp, Homo sapiens
gtgcacggttcaatg

SEQ ID NO: 6330497 - DNA, 15 bp, Homo sapiens
gtgcacgtggagagc

SEQ ID NO: 6330498 - DNA, 21 bp, Homo sapiens
gtgcacgtggagagctggtgc

SEQ ID NO: 6330499 - DNA, 19 bp, Homo sapiens
gtgcactaaccccagctgc

SEQ ID NO: 6330500 - DNA, 13 bp, Homo sapiens
gtgcactcagagc

SEQ ID NO: 6330501 - DNA, 15 bp, Homo sapiens
gtgcactccagactc

SEQ ID NO: 6330502 - DNA, 13 bp, Homo sapiens
gtgcactccagct

SEQ ID NO: 6330503 - DNA, 13 bp, Homo sapiens
gtgcactcgccat

SEQ ID NO: 6330504 - DNA, 19 bp, Homo sapiens
gtgcactctactctgcgac

SEQ ID NO: 6330505 - DNA, 20 bp, Homo sapiens
gtgcactctgctaatcatgt

SEQ ID NO: 6330506 - DNA, 14 bp, Homo sapiens
gtgcactgaatcgt

SEQ ID NO: 6330507 - DNA, 20 bp, Homo sapiens
gtgcactgcccatggacagg

SEQ ID NO: 6330508 - DNA, 13 bp, Homo sapiens
gtgcactgggagg

SEQ ID NO: 6330509 - DNA, 15 bp, Homo sapiens
gtgcactgggaggct

SEQ ID NO: 6330510 - DNA, 20 bp, Homo sapiens
gtgcactgggaggctcccct

SEQ ID NO: 6330511 - DNA, 13 bp, Homo sapiens
gtgcactgggcag

SEQ ID NO: 6330512 - DNA, 13 bp, Homo sapiens
gtgcactgtcact

SEQ ID NO: 6330513 - DNA, 15 bp, Homo sapiens
gtgcactgtcacttt

SEQ ID NO: 6330514 - DNA, 22 bp, Homo sapiens
gtgcacttacacttataaaata

SEQ ID NO: 6330515 - DNA, 15 bp, Homo sapiens
gtgcacttagccatg

SEQ ID NO: 6330516 - DNA, 23 bp, Homo sapiens
gtgcacttggtgctgcgcccagg

SEQ ID NO: 6330517 - DNA, 13 bp, Homo sapiens
gtgcactttgtaa

SEQ ID NO: 6330518 - DNA, 14 bp, Homo sapiens
gtgcagaaaacatt

SEQ ID NO: 6330519 - DNA, 15 bp, Homo sapiens
gtgcagaaaacattg

SEQ ID NO: 6330520 - DNA, 16 bp, Homo sapiens
gtgcagaaaacattgt

SEQ ID NO: 6330521 - DNA, 15 bp, Homo sapiens
gtgcagaaaatattt

SEQ ID NO: 6330522 - DNA, 18 bp, Homo sapiens
gtgcagaaaatatttaat

SEQ ID NO: 6330523 - DNA, 15 bp, Homo sapiens
gtgcagaaccagcac

SEQ ID NO: 6330524 - DNA, 12 bp, Homo sapiens
ggctgcagggag

SEQ ID NO: 6330525 - DNA, 21 bp, Homo sapiens
ggctgcagggctgggtcaggg

SEQ ID NO: 6330526 - DNA, 14 bp, Homo sapiens
ggctgcaggtgctg

SEQ ID NO: 6330527 - DNA, 17 bp, Homo sapiens
ggctgcaggtgctgctg

SEQ ID NO: 6330528 - DNA, 17 bp, Homo sapiens
ggctgcagtagccatgt

SEQ ID NO: 6330529 - DNA, 17 bp, Homo sapiens
ggctgcagtcagccctg

SEQ ID NO: 6330530 - DNA, 22 bp, Homo sapiens
ggctgcagtcctccggttgcat

SEQ ID NO: 6330531 - DNA, 22 bp, Homo sapiens
ggctgcagtgacgtgcacctgt

SEQ ID NO: 6330532 - DNA, 14 bp, Homo sapiens
ggctgcagtgagcc

SEQ ID NO: 6330533 - DNA, 19 bp, Homo sapiens
ggctgcatagaaggaggag

SEQ ID NO: 6330534 - DNA, 15 bp, Homo sapiens
ggctgcatcctcagc

SEQ ID NO: 6330535 - DNA, 22 bp, Homo sapiens
ggctgcatgatgtttgcccaaa

SEQ ID NO: 6330536 - DNA, 21 bp, Homo sapiens
ggctgcatgatttttgccctg

SEQ ID NO: 6330537 - DNA, 20 bp, Homo sapiens
ggctgcatgctctggaagcc

SEQ ID NO: 6330538 - DNA, 20 bp, Homo sapiens
ggctgcattgaaaagagctg

SEQ ID NO: 6330539 - DNA, 22 bp, Homo sapiens
ggctgccaagagtccaagccat

SEQ ID NO: 6330540 - DNA, 19 bp, Homo sapiens
ggctgccaatgggagctca

SEQ ID NO: 6330541 - DNA, 20 bp, Homo sapiens
ggctgccaatgggagctcat

SEQ ID NO: 6330542 - DNA, 18 bp, Homo sapiens
ggctgccagacatggacc

SEQ ID NO: 6330543 - DNA, 23 bp, Homo sapiens
ggctgccagcccactgcctcctg

SEQ ID NO: 6330544 - DNA, 17 bp, Homo sapiens
ggctgccaggcaccatc

SEQ ID NO: 6330545 - DNA, 14 bp, Homo sapiens
ggctgccaggggct

SEQ ID NO: 6330546 - DNA, 19 bp, Homo sapiens
ggctgccaggggctctgtg

SEQ ID NO: 6330547 - DNA, 20 bp, Homo sapiens
ggctgccaggggctctgtgg

SEQ ID NO: 6330548 - DNA, 22 bp, Homo sapiens
ggctgccagggggcaaggagaa

SEQ ID NO: 6330549 - DNA, 17 bp, Homo sapiens
ggctgccagtgcctggg

SEQ ID NO: 6330550 - DNA, 22 bp, Homo sapiens
ggctgccatctcacctcctgct

SEQ ID NO: 6330551 - DNA, 17 bp, Homo sapiens
ggctgccattggtccac

SEQ ID NO: 6330552 - DNA, 20 bp, Homo sapiens
ggctgccattggtccaccct

SEQ ID NO: 6330553 - DNA, 17 bp, Homo sapiens
ggctgcccacacacccc

SEQ ID NO: 6330554 - DNA, 20 bp, Homo sapiens
ggctgcccacacaccccaat

SEQ ID NO: 6330555 - DNA, 17 bp, Homo sapiens
ggctgcccacctggctg

SEQ ID NO: 6330556 - DNA, 15 bp, Homo sapiens
ggctgcccactctgg

SEQ ID NO: 6330557 - DNA, 16 bp, Homo sapiens
ggctgcccactctggg

SEQ ID NO: 6330558 - DNA, 20 bp, Homo sapiens
ggctgcccagccccgctcag

SEQ ID NO: 6330559 - DNA, 23 bp, Homo sapiens
ggctgcccagccccgctcaggcc

SEQ ID NO: 6330560 - DNA, 16 bp, Homo sapiens
ggctgcccagctgctc

SEQ ID NO: 6330561 - DNA, 17 bp, Homo sapiens
ggctgcccagctgctcc

SEQ ID NO: 6330562 - DNA, 21 bp, Homo sapiens
ggctgcccagctgctcccctg

SEQ ID NO: 6330563 - DNA, 21 bp, Homo sapiens
ggctgccccacatccccacct

SEQ ID NO: 6330564 - DNA, 15 bp, Homo sapiens
ggctgccccacccct

SEQ ID NO: 6330565 - DNA, 18 bp, Homo sapiens
ggctgccccattccagct

SEQ ID NO: 6330566 - DNA, 21 bp, Homo sapiens
ggctgcccccaacactccagg

SEQ ID NO: 6330567 - DNA, 23 bp, Homo sapiens
ggctgcccccatcacctctactg

SEQ ID NO: 6330568 - DNA, 17 bp, Homo sapiens
ggctgccccggcctcct

SEQ ID NO: 6330569 - DNA, 19 bp, Homo sapiens
ggctgccccgggtccccag

SEQ ID NO: 6330570 - DNA, 22 bp, Homo sapiens
ggctgcccctaatctctgtagg

SEQ ID NO: 6330571 - DNA, 12 bp, Homo sapiens
ggctgcccctca

SEQ ID NO: 6330572 - DNA, 13 bp, Homo sapiens
ggctgcccctcac

SEQ ID NO: 6330573 - DNA, 23 bp, Homo sapiens
ggctgcccctcgcacacagggct

SEQ ID NO: 6330574 - DNA, 13 bp, Homo sapiens
ggctgcccctctc

SEQ ID NO: 6330575 - DNA, 20 bp, Homo sapiens
ggctgcccctgcgtggcctg

SEQ ID NO: 6330576 - DNA, 13 bp, Homo sapiens
ggctgcccgctcc

SEQ ID NO: 6330577 - DNA, 17 bp, Homo sapiens
ggctgcccgctcccagt

SEQ ID NO: 6330578 - DNA, 21 bp, Homo sapiens
ggctgcccgctcccagtgtct

SEQ ID NO: 6330579 - DNA, 20 bp, Homo sapiens
ggctgccctggccctgaggt

SEQ ID NO: 6330580 - DNA, 22 bp, Homo sapiens
ggctgccctggccctgaggtgt

SEQ ID NO: 6330581 - DNA, 15 bp, Homo sapiens
ggctgccctggtgct

SEQ ID NO: 6330582 - DNA, 16 bp, Homo sapiens
ggctgccctggtgctg

SEQ ID NO: 6330583 - DNA, 19 bp, Homo sapiens
ggctgccctgtctggaaca

SEQ ID NO: 6330584 - DNA, 10 bp, Homo sapiens
ggctgccctt

SEQ ID NO: 6330585 - DNA, 18 bp, Homo sapiens
ggctgcccttcgctgcca

SEQ ID NO: 6330586 - DNA, 23 bp, Homo sapiens
ggctgcccttcgctgccaggaca

SEQ ID NO: 6330587 - DNA, 16 bp, Homo sapiens
ggctgcccttgggcca

SEQ ID NO: 6330588 - DNA, 17 bp, Homo sapiens
ggctgcccttgttgcct

SEQ ID NO: 6330589 - DNA, 20 bp, Homo sapiens
ggctgccgactcccccaacc

SEQ ID NO: 6330590 - DNA, 22 bp, Homo sapiens
ggctgccgagacagaccctctg

SEQ ID NO: 6330591 - DNA, 15 bp, Homo sapiens
ggctgccgagccacc

SEQ ID NO: 6330592 - DNA, 21 bp, Homo sapiens
ggctgccgcatctgcctggag

SEQ ID NO: 6330593 - DNA, 14 bp, Homo sapiens
ggctgccggaggga

SEQ ID NO: 6330594 - DNA, 19 bp, Homo sapiens
ggctgccggatctgggctg

SEQ ID NO: 6330595 - DNA, 20 bp, Homo sapiens
ggctgccgtgcacggggcca

SEQ ID NO: 6330596 - DNA, 17 bp, Homo sapiens
ggctgccgttttctggg

SEQ ID NO: 6330597 - DNA, 17 bp, Homo sapiens
ggctgcctagccctccc

SEQ ID NO: 6330598 - DNA, 20 bp, Homo sapiens
ggctgcctccactcccactt

SEQ ID NO: 6330599 - DNA, 17 bp, Homo sapiens
ggctgcctccattatcc

SEQ ID NO: 6330600 - DNA, 12 bp, Homo sapiens
ggctgcctccca

SEQ ID NO: 6330601 - DNA, 18 bp, Homo sapiens
ggctgcctcctgccctta

SEQ ID NO: 6330602 - DNA, 19 bp, Homo sapiens
ggctgcctcggactccatg

SEQ ID NO: 6330603 - DNA, 17 bp, Homo sapiens
ggctgcctctgggtgag

SEQ ID NO: 6330604 - DNA, 22 bp, Homo sapiens
ggctgcctctgggtgagtggct

SEQ ID NO: 6330605 - DNA, 11 bp, Homo sapiens
ggctgcctgcc

SEQ ID NO: 6330606 - DNA, 14 bp, Homo sapiens
ggctgcctggagaa

SEQ ID NO: 6330607 - DNA, 19 bp, Homo sapiens
ggctgcctggagaaaggat

SEQ ID NO: 6330608 - DNA, 15 bp, Homo sapiens
ggctgcctggcccag

SEQ ID NO: 6330609 - DNA, 16 bp, Homo sapiens
ggctgcctggccccca

SEQ ID NO: 6330610 - DNA, 13 bp, Homo sapiens
ggctgccttcttt

SEQ ID NO: 6330611 - DNA, 21 bp, Homo sapiens
ggctgcctttgatcacaggag

SEQ ID NO: 6330612 - DNA, 17 bp, Homo sapiens
ggctgcctttgtggtgg

SEQ ID NO: 6330613 - DNA, 21 bp, Homo sapiens
ggctgcctttgtggtgggcgc

SEQ ID NO: 6330614 - DNA, 22 bp, Homo sapiens
ggctgcctttgtggtgggcgct

SEQ ID NO: 6330615 - DNA, 17 bp, Homo sapiens
ggctgcgcctgcccgcc

SEQ ID NO: 6330616 - DNA, 19 bp, Homo sapiens
ggctgcgcctgcccgcccg

SEQ ID NO: 6330617 - DNA, 23 bp, Homo sapiens
ggctgcgctagcagcccttgtgt

SEQ ID NO: 6330618 - DNA, 23 bp, Homo sapiens
ggctgcgcttcctatttctaggg

SEQ ID NO: 6330619 - DNA, 18 bp, Homo sapiens
ggctgcggcccctccccc

SEQ ID NO: 6330620 - DNA, 22 bp, Homo sapiens
ggctgcggcgtacaggctggcg

SEQ ID NO: 6330621 - DNA, 19 bp, Homo sapiens
ggctgcgggaggccctggc

SEQ ID NO: 6330622 - DNA, 18 bp, Homo sapiens
ggctgcggtgggcagcca

SEQ ID NO: 6330623 - DNA, 23 bp, Homo sapiens
ggctgcgtactccactggtctgt

SEQ ID NO: 6330624 - DNA, 19 bp, Homo sapiens
ggctgcgtccctccgagct

SEQ ID NO: 6330625 - DNA, 15 bp, Homo sapiens
ggctgctaagtggaa

SEQ ID NO: 6330626 - DNA, 17 bp, Homo sapiens
ggctgctacccagaacc

SEQ ID NO: 6330627 - DNA, 13 bp, Homo sapiens
ggctgctaggcca

SEQ ID NO: 6330628 - DNA, 21 bp, Homo sapiens
ggctgctcaagccgcaagctc

SEQ ID NO: 6330629 - DNA, 13 bp, Homo sapiens
ggctgctcagagg

SEQ ID NO: 6330630 - DNA, 15 bp, Homo sapiens
ggctgctcagggctg

SEQ ID NO: 6330631 - DNA, 16 bp, Homo sapiens
ggctgctcatcaccca

SEQ ID NO: 6330632 - DNA, 24 bp, Homo sapiens
ggctgctcattccttctggaggac

SEQ ID NO: 6330633 - DNA, 19 bp, Homo sapiens
ggctgctccagtgggcagg

SEQ ID NO: 6330634 - DNA, 15 bp, Homo sapiens
ggctgctcccacctg

SEQ ID NO: 6330635 - DNA, 19 bp, Homo sapiens
ggctgctcccacctggctc

SEQ ID NO: 6330636 - DNA, 13 bp, Homo sapiens
ggctgctcccctt

SEQ ID NO: 6330637 - DNA, 15 bp, Homo sapiens
ggctgctccctgagg

SEQ ID NO: 6330638 - DNA, 14 bp, Homo sapiens
ggctgctccctgct

SEQ ID NO: 6330639 - DNA, 17 bp, Homo sapiens
ggctgctccctgctccc

SEQ ID NO: 6330640 - DNA, 18 bp, Homo sapiens
ggctgctccctgctccca

SEQ ID NO: 6330641 - DNA, 14 bp, Homo sapiens
ggctgctcctccag

SEQ ID NO: 6330642 - DNA, 19 bp, Homo sapiens
ggctgctcctccagccctt

SEQ ID NO: 6330643 - DNA, 18 bp, Homo sapiens
ggctgctcctccagggcc

SEQ ID NO: 6330644 - DNA, 13 bp, Homo sapiens
ggctgctcctgaa

SEQ ID NO: 6330645 - DNA, 20 bp, Homo sapiens
ggctgctcgcccaggaaggc

SEQ ID NO: 6330646 - DNA, 21 bp, Homo sapiens
ggctgctcgcccaggaaggcc

SEQ ID NO: 6330647 - DNA, 22 bp, Homo sapiens
ggctgctcgcccaggaaggcct

SEQ ID NO: 6330648 - DNA, 21 bp, Homo sapiens
ggctgctctcatgcctgcctg

SEQ ID NO: 6330649 - DNA, 13 bp, Homo sapiens
ggctgctctggga

SEQ ID NO: 6330650 - DNA, 14 bp, Homo sapiens
ggctgctctttcca

SEQ ID NO: 6330651 - DNA, 22 bp, Homo sapiens
ggctgctctttccacttgccct

SEQ ID NO: 6330652 - DNA, 23 bp, Homo sapiens
ggctgctctttccacttgccctg

SEQ ID NO: 6330653 - DNA, 19 bp, Homo sapiens
ggctgctgaaaaccatctg

SEQ ID NO: 6330654 - DNA, 13 bp, Homo sapiens
ggctgctgaaggc

SEQ ID NO: 6330655 - DNA, 14 bp, Homo sapiens
ggctgctgaaggct

SEQ ID NO: 6330656 - DNA, 17 bp, Homo sapiens
ggctgctgaaggctcga

SEQ ID NO: 6330657 - DNA, 13 bp, Homo sapiens
ggctgctgacagg

SEQ ID NO: 6330658 - DNA, 16 bp, Homo sapiens
ggctgctgacctccac

SEQ ID NO: 6330659 - DNA, 15 bp, Homo sapiens
ggctgctgacgtttg

SEQ ID NO: 6330660 - DNA, 17 bp, Homo sapiens
ggctgctgcacaccaag

SEQ ID NO: 6330661 - DNA, 17 bp, Homo sapiens
ggctgctgcagtcagca

SEQ ID NO: 6330662 - DNA, 23 bp, Homo sapiens
ggctgctgcagtcagcacagaga

SEQ ID NO: 6330663 - DNA, 12 bp, Homo sapiens
ggctgctgccac

SEQ ID NO: 6330664 - DNA, 15 bp, Homo sapiens
ggctgctgccaggcc

SEQ ID NO: 6330665 - DNA, 11 bp, Homo sapiens
ggctgctgccc

SEQ ID NO: 6330666 - DNA, 12 bp, Homo sapiens
ggctgctgccca

SEQ ID NO: 6330667 - DNA, 19 bp, Homo sapiens
ggctgctgccccctggctt

SEQ ID NO: 6330668 - DNA, 14 bp, Homo sapiens
ggctgctgcctgct

SEQ ID NO: 6330669 - DNA, 13 bp, Homo sapiens
ggctgctgctcac

SEQ ID NO: 6330670 - DNA, 14 bp, Homo sapiens
ggctgctgctcacc

SEQ ID NO: 6330671 - DNA, 16 bp, Homo sapiens
ggctgctgctcctctc

SEQ ID NO: 6330672 - DNA, 11 bp, Homo sapiens
ggctgctgctg

SEQ ID NO: 6330673 - DNA, 18 bp, Homo sapiens
ggctgctgctgggctcag

SEQ ID NO: 6330674 - DNA, 19 bp, Homo sapiens
ggctgctgcttctccctgg

SEQ ID NO: 6330675 - DNA, 20 bp, Homo sapiens
ggctgctgcttctccctggg

SEQ ID NO: 6330676 - DNA, 15 bp, Homo sapiens
ggctgctgcttctgc

SEQ ID NO: 6330677 - DNA, 20 bp, Homo sapiens
ggctgctgcttctgctccag

SEQ ID NO: 6330678 - DNA, 22 bp, Homo sapiens
ggctgctgcttggatgcgagct

SEQ ID NO: 6330679 - DNA, 20 bp, Homo sapiens
ggctgctggaaaggcccgga

SEQ ID NO: 6330680 - DNA, 22 bp, Homo sapiens
ggctgctggcccacagctctgc

SEQ ID NO: 6330681 - DNA, 12 bp, Homo sapiens
ggctgctggcct

SEQ ID NO: 6330682 - DNA, 13 bp, Homo sapiens
ggctgctggcctg

SEQ ID NO: 6330683 - DNA, 15 bp, Homo sapiens
ggctgctggcctggc

SEQ ID NO: 6330684 - DNA, 18 bp, Homo sapiens
ggctgctggcctggccct

SEQ ID NO: 6330685 - DNA, 12 bp, Homo sapiens
ggctgctggctt

SEQ ID NO: 6330686 - DNA, 15 bp, Homo sapiens
ggctgctgggcgtct

SEQ ID NO: 6330687 - DNA, 11 bp, Homo sapiens
ggctgctgggg

SEQ ID NO: 6330688 - DNA, 21 bp, Homo sapiens
ggctgctggggcagggcccag

SEQ ID NO: 6330689 - DNA, 20 bp, Homo sapiens
ggctgctgggggctcccctt

SEQ ID NO: 6330690 - DNA, 23 bp, Homo sapiens
ggctgctgggggctccccttgcc

SEQ ID NO: 6330691 - DNA, 14 bp, Homo sapiens
ggctgctgtgaagc

SEQ ID NO: 6330692 - DNA, 12 bp, Homo sapiens
ggctgctgtggc

SEQ ID NO: 6330693 - DNA, 16 bp, Homo sapiens
ggctgctgtggcccag

SEQ ID NO: 6330694 - DNA, 18 bp, Homo sapiens
ggctgctgtggcccagtc

SEQ ID NO: 6330695 - DNA, 18 bp, Homo sapiens
ggctgctgtgtagctctg

SEQ ID NO: 6330696 - DNA, 19 bp, Homo sapiens
ggctgctgtgtagctctgt

SEQ ID NO: 6330697 - DNA, 17 bp, Homo sapiens
ggctgctgtgtgccttc

SEQ ID NO: 6330698 - DNA, 15 bp, Homo sapiens
ggctgctgtgtggac

SEQ ID NO: 6330699 - DNA, 14 bp, Homo sapiens
ggctgcttagaatc

SEQ ID NO: 6330700 - DNA, 14 bp, Homo sapiens
ggctgcttcaagga

SEQ ID NO: 6330701 - DNA, 21 bp, Homo sapiens
ggctgcttcaaggatcctgag

SEQ ID NO: 6330702 - DNA, 20 bp, Homo sapiens
gtgcagaataatggaaacat

SEQ ID NO: 6330703 - DNA, 16 bp, Homo sapiens
gtgcagacaattctcc

SEQ ID NO: 6330704 - DNA, 21 bp, Homo sapiens
gtgcagacacctaaccccagg

SEQ ID NO: 6330705 - DNA, 16 bp, Homo sapiens
gtgcagacactcaaga

SEQ ID NO: 6330706 - DNA, 18 bp, Homo sapiens
gtgcagacactcaagagc

SEQ ID NO: 6330707 - DNA, 19 bp, Homo sapiens
gtgcagacactcaagagcc

SEQ ID NO: 6330708 - DNA, 16 bp, Homo sapiens
gtgcagacagaagtct

SEQ ID NO: 6330709 - DNA, 18 bp, Homo sapiens
gtgcagacagtgtcagag

SEQ ID NO: 6330710 - DNA, 17 bp, Homo sapiens
gtgcagacccagtccca

SEQ ID NO: 6330711 - DNA, 14 bp, Homo sapiens
gtgcagacgccaca

SEQ ID NO: 6330712 - DNA, 14 bp, Homo sapiens
gtgcagactggagg

SEQ ID NO: 6330713 - DNA, 15 bp, Homo sapiens
gtgcagagaagctgg

SEQ ID NO: 6330714 - DNA, 13 bp, Homo sapiens
gtgcagagctggg

SEQ ID NO: 6330715 - DNA, 12 bp, Homo sapiens
gtgcagaggctg

SEQ ID NO: 6330716 - DNA, 14 bp, Homo sapiens
gtgcagaggctgtg

SEQ ID NO: 6330717 - DNA, 22 bp, Homo sapiens
gtgcagaggctgtggctggtga

SEQ ID NO: 6330718 - DNA, 19 bp, Homo sapiens
gtgcagaggtaccctgggt

SEQ ID NO: 6330719 - DNA, 17 bp, Homo sapiens
gtgcagaggtgagcaga

SEQ ID NO: 6330720 - DNA, 17 bp, Homo sapiens
gtgcagaggtttcttga

SEQ ID NO: 6330721 - DNA, 16 bp, Homo sapiens
gtgcagatcacttttt

SEQ ID NO: 6330722 - DNA, 19 bp, Homo sapiens
gtgcagatgcaattgtttg

SEQ ID NO: 6330723 - DNA, 22 bp, Homo sapiens
gtgcagatgctgctgaagagag

SEQ ID NO: 6330724 - DNA, 15 bp, Homo sapiens
gtgcagatggagaga

SEQ ID NO: 6330725 - DNA, 15 bp, Homo sapiens
gtgcagatgggctgt

SEQ ID NO: 6330726 - DNA, 20 bp, Homo sapiens
gtgcagatggtactgctgag

SEQ ID NO: 6330727 - DNA, 21 bp, Homo sapiens
gtgcagcagattggaaggaga

SEQ ID NO: 6330728 - DNA, 15 bp, Homo sapiens
gtgcagcagcccagc

SEQ ID NO: 6330729 - DNA, 18 bp, Homo sapiens
gtgcagcagcccagcttc

SEQ ID NO: 6330730 - DNA, 16 bp, Homo sapiens
gtgcagcagggaaggc

SEQ ID NO: 6330731 - DNA, 15 bp, Homo sapiens
gtgcagcatatgagg

SEQ ID NO: 6330732 - DNA, 19 bp, Homo sapiens
gtgcagcccgccatggccg

SEQ ID NO: 6330733 - DNA, 19 bp, Homo sapiens
gtgcagcccgtgtggcccc

SEQ ID NO: 6330734 - DNA, 20 bp, Homo sapiens
gtgcagcccgtgtggcccct

SEQ ID NO: 6330735 - DNA, 21 bp, Homo sapiens
gtgcagcccgtgtggcccctt

SEQ ID NO: 6330736 - DNA, 18 bp, Homo sapiens
gtgcagccgctgagcgag

SEQ ID NO: 6330737 - DNA, 23 bp, Homo sapiens
gtgcagccggggagctgaggggc

SEQ ID NO: 6330738 - DNA, 21 bp, Homo sapiens
gtgcagcctgtcctgggctgg

SEQ ID NO: 6330739 - DNA, 17 bp, Homo sapiens
gtgcagccttcccctcc

SEQ ID NO: 6330740 - DNA, 14 bp, Homo sapiens
gtgcagccttctcc

SEQ ID NO: 6330741 - DNA, 20 bp, Homo sapiens
gtgcagcggtggaaggagcc

SEQ ID NO: 6330742 - DNA, 12 bp, Homo sapiens
gtgcagctgatt

SEQ ID NO: 6330743 - DNA, 17 bp, Homo sapiens
gtgcagctgggtggggc

SEQ ID NO: 6330744 - DNA, 18 bp, Homo sapiens
gtgcagcttcacccacca

SEQ ID NO: 6330745 - DNA, 15 bp, Homo sapiens
gtgcaggacagctct

SEQ ID NO: 6330746 - DNA, 17 bp, Homo sapiens
gtgcaggagcctccctg

SEQ ID NO: 6330747 - DNA, 11 bp, Homo sapiens
gtgcaggcagg

SEQ ID NO: 6330748 - DNA, 12 bp, Homo sapiens
gtgcaggcccac

SEQ ID NO: 6330749 - DNA, 13 bp, Homo sapiens
gtgcaggcccacc

SEQ ID NO: 6330750 - DNA, 12 bp, Homo sapiens
gtgcaggcccag

SEQ ID NO: 6330751 - DNA, 16 bp, Homo sapiens
gtgcaggcccaggcag

SEQ ID NO: 6330752 - DNA, 19 bp, Homo sapiens
gtgcaggcccaggcaggcc

SEQ ID NO: 6330753 - DNA, 21 bp, Homo sapiens
gtgcaggcctgtccctgggag

SEQ ID NO: 6330754 - DNA, 23 bp, Homo sapiens
gtgcaggcgactggaggcaggac

SEQ ID NO: 6330755 - DNA, 18 bp, Homo sapiens
gtgcaggcgcgcaccgcc

SEQ ID NO: 6330756 - DNA, 19 bp, Homo sapiens
gtgcaggcgcgcaccgccc

SEQ ID NO: 6330757 - DNA, 22 bp, Homo sapiens
gtgcaggctcccaaactcaggc

SEQ ID NO: 6330758 - DNA, 13 bp, Homo sapiens
gtgcaggctgcag

SEQ ID NO: 6330759 - DNA, 20 bp, Homo sapiens
gtgcaggctgcagtggctcc

SEQ ID NO: 6330760 - DNA, 15 bp, Homo sapiens
gtgcaggctggcacc

SEQ ID NO: 6330761 - DNA, 20 bp, Homo sapiens
gtgcaggctggccagccgct

SEQ ID NO: 6330762 - DNA, 23 bp, Homo sapiens
gtgcagggaggaggtggcagccc

SEQ ID NO: 6330763 - DNA, 14 bp, Homo sapiens
gtgcagggatgtgg

SEQ ID NO: 6330764 - DNA, 11 bp, Homo sapiens
gtgcagggcac

SEQ ID NO: 6330765 - DNA, 21 bp, Homo sapiens
gtgcagggcacagaaggctgg

SEQ ID NO: 6330766 - DNA, 23 bp, Homo sapiens
gtgcagggcctgtaatcccagca

SEQ ID NO: 6330767 - DNA, 16 bp, Homo sapiens
gtgcagggctggtttg

SEQ ID NO: 6330768 - DNA, 21 bp, Homo sapiens
gtgcagggctggtttgttctg

SEQ ID NO: 6330769 - DNA, 15 bp, Homo sapiens
gtgcaggtctccacc

SEQ ID NO: 6330770 - DNA, 19 bp, Homo sapiens
gtgcaggtctccacctgca

SEQ ID NO: 6330771 - DNA, 20 bp, Homo sapiens
gtgcagtatagaataggcac

SEQ ID NO: 6330772 - DNA, 17 bp, Homo sapiens
gtgcagtgatacatgta

SEQ ID NO: 6330773 - DNA, 16 bp, Homo sapiens
gtgcagtggagctggc

SEQ ID NO: 6330774 - DNA, 20 bp, Homo sapiens
gtgcagtggtgcgatctggg

SEQ ID NO: 6330775 - DNA, 22 bp, Homo sapiens
gtgcagtgtgagtgtgatgggc

SEQ ID NO: 6330776 - DNA, 17 bp, Homo sapiens
gtgcagtgtgtgaaaat

SEQ ID NO: 6330777 - DNA, 22 bp, Homo sapiens
gtgcagttacgttgcatccaca

SEQ ID NO: 6330778 - DNA, 19 bp, Homo sapiens
gtgcagttctagtttgcat

SEQ ID NO: 6330779 - DNA, 20 bp, Homo sapiens
gtgcagttgacagcaggtgg

SEQ ID NO: 6330780 - DNA, 15 bp, Homo sapiens
gtgcagttgctcatt

SEQ ID NO: 6330781 - DNA, 17 bp, Homo sapiens
gtgcagttgctgtttac

SEQ ID NO: 6330782 - DNA, 17 bp, Homo sapiens
gtgcagttgtgatttct

SEQ ID NO: 6330783 - DNA, 19 bp, Homo sapiens
gtgcagtttggtatgaaac

SEQ ID NO: 6330784 - DNA, 19 bp, Homo sapiens
gtgcataaaaactggttct

SEQ ID NO: 6330785 - DNA, 14 bp, Homo sapiens
gtgcataatgataa

SEQ ID NO: 6330786 - DNA, 19 bp, Homo sapiens
gtgcatactggcattggcc

SEQ ID NO: 6330787 - DNA, 15 bp, Homo sapiens
gtgcatagcgtcctg

SEQ ID NO: 6330788 - DNA, 20 bp, Homo sapiens
gtgcatagcgtcctgccctg

SEQ ID NO: 6330789 - DNA, 22 bp, Homo sapiens
gtgcatagttgtagacaaagta

SEQ ID NO: 6330790 - DNA, 21 bp, Homo sapiens
gtgcatataaaggttatgaaa

SEQ ID NO: 6330791 - DNA, 22 bp, Homo sapiens
gtgcatatagaaaacaaaggag

SEQ ID NO: 6330792 - DNA, 17 bp, Homo sapiens
gtgcatatatactacat

SEQ ID NO: 6330793 - DNA, 16 bp, Homo sapiens
gtgcatatctgcctcc

SEQ ID NO: 6330794 - DNA, 19 bp, Homo sapiens
gtgcatatctgcctcccct

SEQ ID NO: 6330795 - DNA, 20 bp, Homo sapiens
gtgcatatgcatgtgtgtgt

SEQ ID NO: 6330796 - DNA, 20 bp, Homo sapiens
gtgcatatggcaacgttcat

SEQ ID NO: 6330797 - DNA, 15 bp, Homo sapiens
gtgcatatgtgtgtg

SEQ ID NO: 6330798 - DNA, 18 bp, Homo sapiens
gtgcatattgtacacttt

SEQ ID NO: 6330799 - DNA, 11 bp, Homo sapiens
gtgcatcaggc

SEQ ID NO: 6330800 - DNA, 19 bp, Homo sapiens
gtgcatccacgcacacatg

SEQ ID NO: 6330801 - DNA, 18 bp, Homo sapiens
gtgcatccgcctgaaagt

SEQ ID NO: 6330802 - DNA, 23 bp, Homo sapiens
gtgcatcctcctcagcccccagg

SEQ ID NO: 6330803 - DNA, 16 bp, Homo sapiens
gtgcatccttgtaata

SEQ ID NO: 6330804 - DNA, 19 bp, Homo sapiens
gtgcatcgaaatgtattca

SEQ ID NO: 6330805 - DNA, 14 bp, Homo sapiens
gtgcatctcagccc

SEQ ID NO: 6330806 - DNA, 15 bp, Homo sapiens
gtgcatctcagccca

SEQ ID NO: 6330807 - DNA, 13 bp, Homo sapiens
gtgcatctggcct

SEQ ID NO: 6330808 - DNA, 21 bp, Homo sapiens
gtgcatctggcctatgaccct

SEQ ID NO: 6330809 - DNA, 23 bp, Homo sapiens
gtgcatctggcctatgaccctgt

SEQ ID NO: 6330810 - DNA, 17 bp, Homo sapiens
gtgcatctggcctgggg

SEQ ID NO: 6330811 - DNA, 14 bp, Homo sapiens
gtgcatctggtgta

SEQ ID NO: 6330812 - DNA, 17 bp, Homo sapiens
gtgcatgagaatgtcat

SEQ ID NO: 6330813 - DNA, 18 bp, Homo sapiens
gtgcatgagaatgtcatt

SEQ ID NO: 6330814 - DNA, 22 bp, Homo sapiens
gtgcatgagaatgtcatttgct

SEQ ID NO: 6330815 - DNA, 23 bp, Homo sapiens
gtgcatgagaatgtcatttgcta

SEQ ID NO: 6330816 - DNA, 18 bp, Homo sapiens
gtgcatgatcttgagcaa

SEQ ID NO: 6330817 - DNA, 18 bp, Homo sapiens
gtgcatgcaaaaatgaat

SEQ ID NO: 6330818 - DNA, 15 bp, Homo sapiens
gtgcatgcaggtctc

SEQ ID NO: 6330819 - DNA, 11 bp, Homo sapiens
gtgcatgcatg

SEQ ID NO: 6330820 - DNA, 22 bp, Homo sapiens
gtgcatgcatgccctctctgag

SEQ ID NO: 6330821 - DNA, 20 bp, Homo sapiens
gtgcatgccttcataaatta

SEQ ID NO: 6330822 - DNA, 19 bp, Homo sapiens
gtgcatgcgcctactcgct

SEQ ID NO: 6330823 - DNA, 19 bp, Homo sapiens
gtgcatgctctctgcagcc

SEQ ID NO: 6330824 - DNA, 16 bp, Homo sapiens
gtgcatgctgtagctg

SEQ ID NO: 6330825 - DNA, 22 bp, Homo sapiens
gtgcatgctgtcccttacgtga

SEQ ID NO: 6330826 - DNA, 22 bp, Homo sapiens
gtgcatggaactaaaatgttat

SEQ ID NO: 6330827 - DNA, 21 bp, Homo sapiens
gtgcatggaggccctcctgtg

SEQ ID NO: 6330828 - DNA, 18 bp, Homo sapiens
gtgcatggcttggggagc

SEQ ID NO: 6330829 - DNA, 22 bp, Homo sapiens
gtgcatggcttggggagcagag

SEQ ID NO: 6330830 - DNA, 12 bp, Homo sapiens
gtgcatgggctc

SEQ ID NO: 6330831 - DNA, 13 bp, Homo sapiens
gtgcatgggtgaa

SEQ ID NO: 6330832 - DNA, 13 bp, Homo sapiens
gtgcatgtcacat

SEQ ID NO: 6330833 - DNA, 18 bp, Homo sapiens
gtgcatgtcacatgacat

SEQ ID NO: 6330834 - DNA, 18 bp, Homo sapiens
gtgcatgtgaagcatgct

SEQ ID NO: 6330835 - DNA, 15 bp, Homo sapiens
gtgcatgtgcatgca

SEQ ID NO: 6330836 - DNA, 16 bp, Homo sapiens
gtgcatgtgcatgcat

SEQ ID NO: 6330837 - DNA, 12 bp, Homo sapiens
gtgcatgtgccg

SEQ ID NO: 6330838 - DNA, 15 bp, Homo sapiens
gtgcatgtgccgagg

SEQ ID NO: 6330839 - DNA, 14 bp, Homo sapiens
gtgcatgtgtgtat

SEQ ID NO: 6330840 - DNA, 15 bp, Homo sapiens
gtgcatgtgtgtgct

SEQ ID NO: 6330841 - DNA, 15 bp, Homo sapiens
gtgcatgttaaaata

SEQ ID NO: 6330842 - DNA, 19 bp, Homo sapiens
gtgcatgttaaaataatta

SEQ ID NO: 6330843 - DNA, 22 bp, Homo sapiens
gtgcatgttgccatgaggcctt

SEQ ID NO: 6330844 - DNA, 14 bp, Homo sapiens
gtgcattaaaatta

SEQ ID NO: 6330845 - DNA, 16 bp, Homo sapiens
gtgcattacagagagg

SEQ ID NO: 6330846 - DNA, 18 bp, Homo sapiens
gtgcattagcacagattt

SEQ ID NO: 6330847 - DNA, 21 bp, Homo sapiens
gtgcattagcacagattttaa

SEQ ID NO: 6330848 - DNA, 23 bp, Homo sapiens
gtgcattagcacagattttaatt

SEQ ID NO: 6330849 - DNA, 16 bp, Homo sapiens
gtgcattataattttt

SEQ ID NO: 6330850 - DNA, 13 bp, Homo sapiens
gtgcattcctgaa

SEQ ID NO: 6330851 - DNA, 19 bp, Homo sapiens
gtgcattctgtttcctctt

SEQ ID NO: 6330852 - DNA, 20 bp, Homo sapiens
gtgcattctgtttcctcttg

SEQ ID NO: 6330853 - DNA, 15 bp, Homo sapiens
gtgcattctttggta

SEQ ID NO: 6330854 - DNA, 19 bp, Homo sapiens
gtgcattcttttaaaagac

SEQ ID NO: 6330855 - DNA, 22 bp, Homo sapiens
gtgcattgatacatttttaaat

SEQ ID NO: 6330856 - DNA, 18 bp, Homo sapiens
gtgcattggataacacca

SEQ ID NO: 6330857 - DNA, 17 bp, Homo sapiens
gtgcattgggattttag

SEQ ID NO: 6330858 - DNA, 19 bp, Homo sapiens
gtgcattgggattttagaa

SEQ ID NO: 6330859 - DNA, 18 bp, Homo sapiens
gtgcattgtaaacataaa

SEQ ID NO: 6330860 - DNA, 22 bp, Homo sapiens
gtgcattgtatagatataatga

SEQ ID NO: 6330861 - DNA, 11 bp, Homo sapiens
gtgcattgtgt

SEQ ID NO: 6330862 - DNA, 18 bp, Homo sapiens
gtgcattgttatttaata

SEQ ID NO: 6330863 - DNA, 15 bp, Homo sapiens
gtgcattgtttctgt

SEQ ID NO: 6330864 - DNA, 12 bp, Homo sapiens
gtgcatttaaaa

SEQ ID NO: 6330865 - DNA, 17 bp, Homo sapiens
gtgcatttctgggcctt

SEQ ID NO: 6330866 - DNA, 18 bp, Homo sapiens
gtgcatttgagagaagcc

SEQ ID NO: 6330867 - DNA, 19 bp, Homo sapiens
gtgcatttgttcagctccc

SEQ ID NO: 6330868 - DNA, 15 bp, Homo sapiens
gtgcattttgtgtga

SEQ ID NO: 6330869 - DNA, 19 bp, Homo sapiens
gtgcattttgtgtgatgca

SEQ ID NO: 6330870 - DNA, 21 bp, Homo sapiens
gtgcattttgtgtgatgcatg

SEQ ID NO: 6330871 - DNA, 23 bp, Homo sapiens
gtgcatttttaaacttgaaatat

SEQ ID NO: 6330872 - DNA, 15 bp, Homo sapiens
gtgcatttttgtaaa

SEQ ID NO: 6330873 - DNA, 18 bp, Homo sapiens
gtgcatttttgtgaaatg

SEQ ID NO: 6330874 - DNA, 22 bp, Homo sapiens
gtgcatttttgtgaaatgaaaa

SEQ ID NO: 6330875 - DNA, 23 bp, Homo sapiens
gtgccaaaaacaacaacaaaatg

SEQ ID NO: 6330876 - DNA, 17 bp, Homo sapiens
gtgccaaaaccaggcct

SEQ ID NO: 6330877 - DNA, 20 bp, Homo sapiens
gtgccaaaaggccccttccc

SEQ ID NO: 6330878 - DNA, 21 bp, Homo sapiens
gtgccaaacccagcccctgcg

SEQ ID NO: 6330879 - DNA, 13 bp, Homo sapiens
ggctgcttcctcc

SEQ ID NO: 6330880 - DNA, 15 bp, Homo sapiens
ggctgcttcctcctg

SEQ ID NO: 6330881 - DNA, 18 bp, Homo sapiens
ggctgcttcctcctggaa

SEQ ID NO: 6330882 - DNA, 19 bp, Homo sapiens
ggctgcttcctcctggaaa

SEQ ID NO: 6330883 - DNA, 22 bp, Homo sapiens
ggctgcttccttctgcacccag

SEQ ID NO: 6330884 - DNA, 12 bp, Homo sapiens
ggctgcttctcc

SEQ ID NO: 6330885 - DNA, 17 bp, Homo sapiens
ggctgcttctctacaga

SEQ ID NO: 6330886 - DNA, 17 bp, Homo sapiens
ggctgcttctggggctc

SEQ ID NO: 6330887 - DNA, 17 bp, Homo sapiens
ggctgcttgcagccagg

SEQ ID NO: 6330888 - DNA, 23 bp, Homo sapiens
ggctgcttgcagccaggagaagg

SEQ ID NO: 6330889 - DNA, 17 bp, Homo sapiens
ggctgctttctcctttc

SEQ ID NO: 6330890 - DNA, 14 bp, Homo sapiens
ggctgctttctgcc

SEQ ID NO: 6330891 - DNA, 23 bp, Homo sapiens
ggctgctttgtagtttgcccaga

SEQ ID NO: 6330892 - DNA, 22 bp, Homo sapiens
ggctgcttttcttaagtgccca

SEQ ID NO: 6330893 - DNA, 13 bp, Homo sapiens
ggctggaaagagg

SEQ ID NO: 6330894 - DNA, 14 bp, Homo sapiens
ggctggaaagagga

SEQ ID NO: 6330895 - DNA, 17 bp, Homo sapiens
ggctggaaagaggagaa

SEQ ID NO: 6330896 - DNA, 22 bp, Homo sapiens
ggctggaacagattcacactgt

SEQ ID NO: 6330897 - DNA, 23 bp, Homo sapiens
ggctggaacagattcacactgtc

SEQ ID NO: 6330898 - DNA, 10 bp, Homo sapiens
ggctggaaga

SEQ ID NO: 6330899 - DNA, 15 bp, Homo sapiens
ggctggaagagggtg

SEQ ID NO: 6330900 - DNA, 18 bp, Homo sapiens
ggctggaagatagctgtg

SEQ ID NO: 6330901 - DNA, 15 bp, Homo sapiens
ggctggaagatcctg

SEQ ID NO: 6330902 - DNA, 14 bp, Homo sapiens
ggctggaagcagaa

SEQ ID NO: 6330903 - DNA, 15 bp, Homo sapiens
ggctggaagcagaaa

SEQ ID NO: 6330904 - DNA, 21 bp, Homo sapiens
ggctggaagcagaaacaaaat

SEQ ID NO: 6330905 - DNA, 23 bp, Homo sapiens
ggctggaaggacctgctcccaca

SEQ ID NO: 6330906 - DNA, 16 bp, Homo sapiens
ggctggaaggaggaag

SEQ ID NO: 6330907 - DNA, 16 bp, Homo sapiens
ggctggaaggcagcag

SEQ ID NO: 6330908 - DNA, 19 bp, Homo sapiens
ggctggaagtacttggccc

SEQ ID NO: 6330909 - DNA, 14 bp, Homo sapiens
ggctggaatctgga

SEQ ID NO: 6330910 - DNA, 14 bp, Homo sapiens
ggctggaatgaggg

SEQ ID NO: 6330911 - DNA, 15 bp, Homo sapiens
ggctggaatgaggga

SEQ ID NO: 6330912 - DNA, 17 bp, Homo sapiens
ggctggaatgagggagg

SEQ ID NO: 6330913 - DNA, 17 bp, Homo sapiens
ggctggaatgcagtggt

SEQ ID NO: 6330914 - DNA, 20 bp, Homo sapiens
ggctggaatgcagtggtgcg

SEQ ID NO: 6330915 - DNA, 22 bp, Homo sapiens
ggctggaatgggagacctgttg

SEQ ID NO: 6330916 - DNA, 19 bp, Homo sapiens
ggctggacatttgtggcag

SEQ ID NO: 6330917 - DNA, 22 bp, Homo sapiens
ggctggaccacgtctccctggc

SEQ ID NO: 6330918 - DNA, 15 bp, Homo sapiens
ggctggacccagcca

SEQ ID NO: 6330919 - DNA, 21 bp, Homo sapiens
ggctggacccagccaggccca

SEQ ID NO: 6330920 - DNA, 22 bp, Homo sapiens
ggctggacctatgtcctaagga

SEQ ID NO: 6330921 - DNA, 15 bp, Homo sapiens
ggctggactccagat

SEQ ID NO: 6330922 - DNA, 19 bp, Homo sapiens
ggctggactccagatctgc

SEQ ID NO: 6330923 - DNA, 18 bp, Homo sapiens
ggctggactgaggcctga

SEQ ID NO: 6330924 - DNA, 15 bp, Homo sapiens
ggctggactgcagtg

SEQ ID NO: 6330925 - DNA, 13 bp, Homo sapiens
ggctggactggag

SEQ ID NO: 6330926 - DNA, 14 bp, Homo sapiens
ggctggactggagg

SEQ ID NO: 6330927 - DNA, 15 bp, Homo sapiens
ggctggactggaggc

SEQ ID NO: 6330928 - DNA, 21 bp, Homo sapiens
ggctggacttctacctgccct

SEQ ID NO: 6330929 - DNA, 17 bp, Homo sapiens
ggctggagaaagatgca

SEQ ID NO: 6330930 - DNA, 24 bp, Homo sapiens
ggctggagaccagaacagcatggc

SEQ ID NO: 6330931 - DNA, 19 bp, Homo sapiens
ggctggagacgggtgggcg

SEQ ID NO: 6330932 - DNA, 20 bp, Homo sapiens
ggctggagataacagcctct

SEQ ID NO: 6330933 - DNA, 22 bp, Homo sapiens
ggctggagatggctgctgctca

SEQ ID NO: 6330934 - DNA, 23 bp, Homo sapiens
ggctggagatggctgctgctcac

SEQ ID NO: 6330935 - DNA, 23 bp, Homo sapiens
ggctggagcccagggagcggaaa

SEQ ID NO: 6330936 - DNA, 18 bp, Homo sapiens
ggctggagcggggatctg

SEQ ID NO: 6330937 - DNA, 16 bp, Homo sapiens
ggctggagctcctccc

SEQ ID NO: 6330938 - DNA, 18 bp, Homo sapiens
ggctggagctcctccctc

SEQ ID NO: 6330939 - DNA, 19 bp, Homo sapiens
ggctggagctcctccctcc

SEQ ID NO: 6330940 - DNA, 14 bp, Homo sapiens
ggctggaggaagga

SEQ ID NO: 6330941 - DNA, 17 bp, Homo sapiens
ggctggaggaaggaaac

SEQ ID NO: 6330942 - DNA, 18 bp, Homo sapiens
ggctggaggaagtggggt

SEQ ID NO: 6330943 - DNA, 11 bp, Homo sapiens
ggctggaggag

SEQ ID NO: 6330944 - DNA, 16 bp, Homo sapiens
ggctggaggagcccag

SEQ ID NO: 6330945 - DNA, 19 bp, Homo sapiens
ggctggaggagctggcctg

SEQ ID NO: 6330946 - DNA, 23 bp, Homo sapiens
ggctggaggcagggccttgccca

SEQ ID NO: 6330947 - DNA, 19 bp, Homo sapiens
ggctggaggcccaggctgg

SEQ ID NO: 6330948 - DNA, 21 bp, Homo sapiens
ggctggagggctgggcagggc

SEQ ID NO: 6330949 - DNA, 23 bp, Homo sapiens
ggctggagggctgggcagggccc

SEQ ID NO: 6330950 - DNA, 16 bp, Homo sapiens
ggctggagtcctctcc

SEQ ID NO: 6330951 - DNA, 20 bp, Homo sapiens
ggctggagtgaagtggtgtg

SEQ ID NO: 6330952 - DNA, 16 bp, Homo sapiens
ggctggagtgaggaaa

SEQ ID NO: 6330953 - DNA, 14 bp, Homo sapiens
ggctggagtgcagt

SEQ ID NO: 6330954 - DNA, 21 bp, Homo sapiens
ggctggagtgcagtggcacaa

SEQ ID NO: 6330955 - DNA, 21 bp, Homo sapiens
ggctggagtgcagtggcgcaa

SEQ ID NO: 6330956 - DNA, 20 bp, Homo sapiens
ggctggagtgcagtggtgcg

SEQ ID NO: 6330957 - DNA, 19 bp, Homo sapiens
ggctggagtggagtggcgt

SEQ ID NO: 6330958 - DNA, 20 bp, Homo sapiens
ggctggagtgtagtggcaca

SEQ ID NO: 6330959 - DNA, 23 bp, Homo sapiens
ggctggagttattgaagcagagt

SEQ ID NO: 6330960 - DNA, 17 bp, Homo sapiens
ggctggagttggggcag

SEQ ID NO: 6330961 - DNA, 22 bp, Homo sapiens
ggctggagttggggcagaggag

SEQ ID NO: 6330962 - DNA, 14 bp, Homo sapiens
ggctggataggaga

SEQ ID NO: 6330963 - DNA, 19 bp, Homo sapiens
ggctggatgagctcccaca

SEQ ID NO: 6330964 - DNA, 23 bp, Homo sapiens
ggctggatgagctcccacaagcc

SEQ ID NO: 6330965 - DNA, 16 bp, Homo sapiens
ggctggatggacagac

SEQ ID NO: 6330966 - DNA, 20 bp, Homo sapiens
ggctggatggacagacacct

SEQ ID NO: 6330967 - DNA, 15 bp, Homo sapiens
ggctggatgggggct

SEQ ID NO: 6330968 - DNA, 18 bp, Homo sapiens
ggctggatgggggctctg

SEQ ID NO: 6330969 - DNA, 21 bp, Homo sapiens
ggctggatgggggctctgcac

SEQ ID NO: 6330970 - DNA, 22 bp, Homo sapiens
ggctggatgggggctctgcacc

SEQ ID NO: 6330971 - DNA, 14 bp, Homo sapiens
ggctggatgtgcat

SEQ ID NO: 6330972 - DNA, 19 bp, Homo sapiens
ggctggatgtgcatctggc

SEQ ID NO: 6330973 - DNA, 16 bp, Homo sapiens
ggctggatgtgctttc

SEQ ID NO: 6330974 - DNA, 19 bp, Homo sapiens
ggctggatgtggtggcata

SEQ ID NO: 6330975 - DNA, 16 bp, Homo sapiens
ggctggattggcaggt

SEQ ID NO: 6330976 - DNA, 17 bp, Homo sapiens
ggctggattggcaggtg

SEQ ID NO: 6330977 - DNA, 20 bp, Homo sapiens
ggctggattggcaggtgtgg

SEQ ID NO: 6330978 - DNA, 21 bp, Homo sapiens
ggctggattttgaattttctt

SEQ ID NO: 6330979 - DNA, 14 bp, Homo sapiens
ggctggcaagcagg

SEQ ID NO: 6330980 - DNA, 16 bp, Homo sapiens
ggctggcaagcaggga

SEQ ID NO: 6330981 - DNA, 17 bp, Homo sapiens
ggctggcaagcagggaa

SEQ ID NO: 6330982 - DNA, 13 bp, Homo sapiens
ggctggcacagga

SEQ ID NO: 6330983 - DNA, 18 bp, Homo sapiens
ggctggcaccagcaggca

SEQ ID NO: 6330984 - DNA, 19 bp, Homo sapiens
ggctggcacccactggagg

SEQ ID NO: 6330985 - DNA, 16 bp, Homo sapiens
ggctggcagctctcca

SEQ ID NO: 6330986 - DNA, 20 bp, Homo sapiens
ggctggcagctctccagtca

SEQ ID NO: 6330987 - DNA, 15 bp, Homo sapiens
ggctggcatcctggc

SEQ ID NO: 6330988 - DNA, 17 bp, Homo sapiens
ggctggcatctccccca

SEQ ID NO: 6330989 - DNA, 22 bp, Homo sapiens
ggctggcatctcccccaccctg

SEQ ID NO: 6330990 - DNA, 22 bp, Homo sapiens
ggctggcatgatccaagcaaga

SEQ ID NO: 6330991 - DNA, 13 bp, Homo sapiens
ggctggccaaggt

SEQ ID NO: 6330992 - DNA, 13 bp, Homo sapiens
ggctggccactgc

SEQ ID NO: 6330993 - DNA, 21 bp, Homo sapiens
ggctggccactgcacagagct

SEQ ID NO: 6330994 - DNA, 23 bp, Homo sapiens
ggctggccactgcacagagctct

SEQ ID NO: 6330995 - DNA, 18 bp, Homo sapiens
ggctggccagccccacag

SEQ ID NO: 6330996 - DNA, 12 bp, Homo sapiens
ggctggccagga

SEQ ID NO: 6330997 - DNA, 15 bp, Homo sapiens
ggctggccatggggc

SEQ ID NO: 6330998 - DNA, 13 bp, Homo sapiens
ggctggcccagcc

SEQ ID NO: 6330999 - DNA, 11 bp, Homo sapiens
ggctggcccca

SEQ ID NO: 6331000 - DNA, 17 bp, Homo sapiens
ggctggccccagggcac

SEQ ID NO: 6331001 - DNA, 19 bp, Homo sapiens
ggctggccccatcctggcc

SEQ ID NO: 6331002 - DNA, 14 bp, Homo sapiens
ggctggcccccacc

SEQ ID NO: 6331003 - DNA, 11 bp, Homo sapiens
ggctggcccta

SEQ ID NO: 6331004 - DNA, 12 bp, Homo sapiens
ggctggccctgc

SEQ ID NO: 6331005 - DNA, 18 bp, Homo sapiens
ggctggccctgccctccc

SEQ ID NO: 6331006 - DNA, 13 bp, Homo sapiens
ggctggccctgtg

SEQ ID NO: 6331007 - DNA, 16 bp, Homo sapiens
ggctggccctgtgcag

SEQ ID NO: 6331008 - DNA, 19 bp, Homo sapiens
ggctggccctgtgcagacc

SEQ ID NO: 6331009 - DNA, 21 bp, Homo sapiens
ggctggcctaggagatatctg

SEQ ID NO: 6331010 - DNA, 13 bp, Homo sapiens
ggctggcctgaca

SEQ ID NO: 6331011 - DNA, 14 bp, Homo sapiens
ggctggcctgagca

SEQ ID NO: 6331012 - DNA, 17 bp, Homo sapiens
ggctggcctggcccctc

SEQ ID NO: 6331013 - DNA, 22 bp, Homo sapiens
ggctggcctggcccctcagggt

SEQ ID NO: 6331014 - DNA, 13 bp, Homo sapiens
ggctggcctggta

SEQ ID NO: 6331015 - DNA, 13 bp, Homo sapiens
ggctggccttcct

SEQ ID NO: 6331016 - DNA, 14 bp, Homo sapiens
ggctggcgcagcca

SEQ ID NO: 6331017 - DNA, 19 bp, Homo sapiens
ggctggcgcagccaaggcc

SEQ ID NO: 6331018 - DNA, 19 bp, Homo sapiens
ggctggcgcttggatctgg

SEQ ID NO: 6331019 - DNA, 20 bp, Homo sapiens
ggctggcggctactcagcag

SEQ ID NO: 6331020 - DNA, 23 bp, Homo sapiens
ggctggcgggccctggagctcaa

SEQ ID NO: 6331021 - DNA, 20 bp, Homo sapiens
ggctggcggggtcccccctc

SEQ ID NO: 6331022 - DNA, 16 bp, Homo sapiens
ggctggcgtgcagtgg

SEQ ID NO: 6331023 - DNA, 11 bp, Homo sapiens
ggctggctccc

SEQ ID NO: 6331024 - DNA, 12 bp, Homo sapiens
ggctggctccca

SEQ ID NO: 6331025 - DNA, 14 bp, Homo sapiens
ggctggctcccagg

SEQ ID NO: 6331026 - DNA, 17 bp, Homo sapiens
ggctggctcccagggtg

SEQ ID NO: 6331027 - DNA, 18 bp, Homo sapiens
ggctggctcccagggtgg

SEQ ID NO: 6331028 - DNA, 16 bp, Homo sapiens
ggctggctcccctgca

SEQ ID NO: 6331029 - DNA, 17 bp, Homo sapiens
ggctggctcctagggga

SEQ ID NO: 6331030 - DNA, 13 bp, Homo sapiens
ggctggctcctct

SEQ ID NO: 6331031 - DNA, 24 bp, Homo sapiens
ggctggctcctggggatggccagg

SEQ ID NO: 6331032 - DNA, 23 bp, Homo sapiens
ggctggctctaccttcctgtccc

SEQ ID NO: 6331033 - DNA, 11 bp, Homo sapiens
ggctggctctg

SEQ ID NO: 6331034 - DNA, 20 bp, Homo sapiens
ggctggctctgtggaggggc

SEQ ID NO: 6331035 - DNA, 13 bp, Homo sapiens
ggctggctgaaga

SEQ ID NO: 6331036 - DNA, 12 bp, Homo sapiens
ggctggctgagg

SEQ ID NO: 6331037 - DNA, 14 bp, Homo sapiens
ggctggctgcagac

SEQ ID NO: 6331038 - DNA, 15 bp, Homo sapiens
ggctggctgcagtga

SEQ ID NO: 6331039 - DNA, 14 bp, Homo sapiens
ggctggctgctcct

SEQ ID NO: 6331040 - DNA, 10 bp, Homo sapiens
ggctggctgg

SEQ ID NO: 6331041 - DNA, 13 bp, Homo sapiens
ggctggctgggca

SEQ ID NO: 6331042 - DNA, 14 bp, Homo sapiens
ggctggcttttctg

SEQ ID NO: 6331043 - DNA, 22 bp, Homo sapiens
ggctgggaaacactccttgcat

SEQ ID NO: 6331044 - DNA, 11 bp, Homo sapiens
ggctgggaaat

SEQ ID NO: 6331045 - DNA, 21 bp, Homo sapiens
ggctgggaacatgacccagcc

SEQ ID NO: 6331046 - DNA, 23 bp, Homo sapiens
ggctgggaactgcagacctgtcc

SEQ ID NO: 6331047 - DNA, 20 bp, Homo sapiens
ggctgggaactgggccagca

SEQ ID NO: 6331048 - DNA, 23 bp, Homo sapiens
ggctgggaaggggaacacagacc

SEQ ID NO: 6331049 - DNA, 15 bp, Homo sapiens
ggctgggacttctta

SEQ ID NO: 6331050 - DNA, 17 bp, Homo sapiens
ggctgggacttcttacc

SEQ ID NO: 6331051 - DNA, 13 bp, Homo sapiens
ggctgggagaagg

SEQ ID NO: 6331052 - DNA, 23 bp, Homo sapiens
ggctgggaggagcccctggacat

SEQ ID NO: 6331053 - DNA, 17 bp, Homo sapiens
ggctgggaggaggaaga

SEQ ID NO: 6331054 - DNA, 15 bp, Homo sapiens
ggctgggaggctcgg

SEQ ID NO: 6331055 - DNA, 11 bp, Homo sapiens
ggctgggaggg

SEQ ID NO: 6331056 - DNA, 16 bp, Homo sapiens
ggctgggagggggccc

SEQ ID NO: 6331057 - DNA, 15 bp, Homo sapiens
ggctgggagtggcat

SEQ ID NO: 6331058 - DNA, 22 bp, Homo sapiens
gtgccaaactaccgttcccaaa

SEQ ID NO: 6331059 - DNA, 17 bp, Homo sapiens
gtgccaaagcaggtcag

SEQ ID NO: 6331060 - DNA, 21 bp, Homo sapiens
gtgccaaatagccccagactg

SEQ ID NO: 6331061 - DNA, 15 bp, Homo sapiens
gtgccaaatgctctc

SEQ ID NO: 6331062 - DNA, 16 bp, Homo sapiens
gtgccaaatgctgggg

SEQ ID NO: 6331063 - DNA, 20 bp, Homo sapiens
gtgccaacaatcctagtgct

SEQ ID NO: 6331064 - DNA, 23 bp, Homo sapiens
gtgccaacactcaagaagcaggc

SEQ ID NO: 6331065 - DNA, 18 bp, Homo sapiens
gtgccaaccacctctggc

SEQ ID NO: 6331066 - DNA, 14 bp, Homo sapiens
gtgccaaccccacc

SEQ ID NO: 6331067 - DNA, 14 bp, Homo sapiens
gtgccaacctcttt

SEQ ID NO: 6331068 - DNA, 13 bp, Homo sapiens
gtgccaagagcta

SEQ ID NO: 6331069 - DNA, 17 bp, Homo sapiens
gtgccaagagctactcc

SEQ ID NO: 6331070 - DNA, 19 bp, Homo sapiens
gtgccaagatttaaaatta

SEQ ID NO: 6331071 - DNA, 16 bp, Homo sapiens
gtgccaagcacagtgc

SEQ ID NO: 6331072 - DNA, 19 bp, Homo sapiens
gtgccaagcacagtgcctg

SEQ ID NO: 6331073 - DNA, 13 bp, Homo sapiens
gtgccaagccctg

SEQ ID NO: 6331074 - DNA, 15 bp, Homo sapiens
gtgccaagccctggc

SEQ ID NO: 6331075 - DNA, 12 bp, Homo sapiens
gtgccaagcctt

SEQ ID NO: 6331076 - DNA, 14 bp, Homo sapiens
gtgccaagccttct

SEQ ID NO: 6331077 - DNA, 20 bp, Homo sapiens
gtgccaaggacctcctcttc

SEQ ID NO: 6331078 - DNA, 15 bp, Homo sapiens
gtgccaagggcccca

SEQ ID NO: 6331079 - DNA, 16 bp, Homo sapiens
gtgccaagggccccag

SEQ ID NO: 6331080 - DNA, 18 bp, Homo sapiens
gtgccaagtccaggtcct

SEQ ID NO: 6331081 - DNA, 20 bp, Homo sapiens
gtgccaagtccaggtcctgg

SEQ ID NO: 6331082 - DNA, 21 bp, Homo sapiens
gtgccaagtccaggtcctggt

SEQ ID NO: 6331083 - DNA, 22 bp, Homo sapiens
gtgccaagtccaggtcctggtg

SEQ ID NO: 6331084 - DNA, 16 bp, Homo sapiens
gtgccaagtggacagt

SEQ ID NO: 6331085 - DNA, 15 bp, Homo sapiens
gtgccaatatgtatt

SEQ ID NO: 6331086 - DNA, 17 bp, Homo sapiens
gtgccaatatgtattgt

SEQ ID NO: 6331087 - DNA, 14 bp, Homo sapiens
gtgccaatttcaag

SEQ ID NO: 6331088 - DNA, 22 bp, Homo sapiens
gtgccacacagtgacttggccc

SEQ ID NO: 6331089 - DNA, 21 bp, Homo sapiens
gtgccacacgcatgggcattg

SEQ ID NO: 6331090 - DNA, 13 bp, Homo sapiens
gtgccacagagaa

SEQ ID NO: 6331091 - DNA, 12 bp, Homo sapiens
gtgccacagagg

SEQ ID NO: 6331092 - DNA, 20 bp, Homo sapiens
gtgccacagaggccccacct

SEQ ID NO: 6331093 - DNA, 21 bp, Homo sapiens
gtgccacagaggccccacctg

SEQ ID NO: 6331094 - DNA, 19 bp, Homo sapiens
gtgccacagagtgtagcca

SEQ ID NO: 6331095 - DNA, 15 bp, Homo sapiens
gtgccacagcctgct

SEQ ID NO: 6331096 - DNA, 16 bp, Homo sapiens
gtgccacagcctgctg

SEQ ID NO: 6331097 - DNA, 16 bp, Homo sapiens
gtgccaccaaaagtgc

SEQ ID NO: 6331098 - DNA, 15 bp, Homo sapiens
gtgccaccaataaaa

SEQ ID NO: 6331099 - DNA, 12 bp, Homo sapiens
gtgccaccaccc

SEQ ID NO: 6331100 - DNA, 15 bp, Homo sapiens
gtgccaccaccctgc

SEQ ID NO: 6331101 - DNA, 22 bp, Homo sapiens
gtgccacccacctttgccacaa

SEQ ID NO: 6331102 - DNA, 18 bp, Homo sapiens
gtgccaccccgagggctg

SEQ ID NO: 6331103 - DNA, 15 bp, Homo sapiens
gtgccaccccttcct

SEQ ID NO: 6331104 - DNA, 20 bp, Homo sapiens
gtgccacccgtaggcagcct

SEQ ID NO: 6331105 - DNA, 19 bp, Homo sapiens
gtgccaccctctgcagggc

SEQ ID NO: 6331106 - DNA, 15 bp, Homo sapiens
gtgccaccctgggct

SEQ ID NO: 6331107 - DNA, 16 bp, Homo sapiens
gtgccaccctgggctc

SEQ ID NO: 6331108 - DNA, 20 bp, Homo sapiens
gtgccaccctgggctctgtg

SEQ ID NO: 6331109 - DNA, 22 bp, Homo sapiens
gtgccaccctgggctctgtggg

SEQ ID NO: 6331110 - DNA, 22 bp, Homo sapiens
gtgccacctatgcctgtggtga

SEQ ID NO: 6331111 - DNA, 14 bp, Homo sapiens
gtgccacctgcaag

SEQ ID NO: 6331112 - DNA, 18 bp, Homo sapiens
gtgccacctgtccggccc

SEQ ID NO: 6331113 - DNA, 20 bp, Homo sapiens
gtgccacctgtccggcccag

SEQ ID NO: 6331114 - DNA, 15 bp, Homo sapiens
gtgccacgcgctctg

SEQ ID NO: 6331115 - DNA, 17 bp, Homo sapiens
gtgccacgcgctctgca

SEQ ID NO: 6331116 - DNA, 18 bp, Homo sapiens
gtgccacgcgctctgcat

SEQ ID NO: 6331117 - DNA, 16 bp, Homo sapiens
gtgccacgctcctctg

SEQ ID NO: 6331118 - DNA, 21 bp, Homo sapiens
gtgccacgtggccgctgccca

SEQ ID NO: 6331119 - DNA, 18 bp, Homo sapiens
gtgccactccctgagctt

SEQ ID NO: 6331120 - DNA, 12 bp, Homo sapiens
gtgccactgacc

SEQ ID NO: 6331121 - DNA, 14 bp, Homo sapiens
gtgccactgacttg

SEQ ID NO: 6331122 - DNA, 17 bp, Homo sapiens
gtgccactgacttgctg

SEQ ID NO: 6331123 - DNA, 18 bp, Homo sapiens
gtgccactgacttgctgt

SEQ ID NO: 6331124 - DNA, 19 bp, Homo sapiens
gtgccactgcactccaggc

SEQ ID NO: 6331125 - DNA, 23 bp, Homo sapiens
gtgccactgccccccgaggctgc

SEQ ID NO: 6331126 - DNA, 18 bp, Homo sapiens
gtgccactgcccgagctg

SEQ ID NO: 6331127 - DNA, 22 bp, Homo sapiens
gtgccactgcccgagctggtgc

SEQ ID NO: 6331128 - DNA, 18 bp, Homo sapiens
gtgccacttaatgtatgt

SEQ ID NO: 6331129 - DNA, 21 bp, Homo sapiens
gtgccacttcttaaaggcctg

SEQ ID NO: 6331130 - DNA, 23 bp, Homo sapiens
gtgccacttcttaaaggcctgga

SEQ ID NO: 6331131 - DNA, 19 bp, Homo sapiens
gtgccacttgacattcctt

SEQ ID NO: 6331132 - DNA, 19 bp, Homo sapiens
gtgccagaaagagagaacc

SEQ ID NO: 6331133 - DNA, 14 bp, Homo sapiens
gtgccagaagctac

SEQ ID NO: 6331134 - DNA, 14 bp, Homo sapiens
gtgccagaaggaag

SEQ ID NO: 6331135 - DNA, 22 bp, Homo sapiens
gtgccagacaaataggagtgag

SEQ ID NO: 6331136 - DNA, 23 bp, Homo sapiens
gtgccagacattgctctcagtgc

SEQ ID NO: 6331137 - DNA, 15 bp, Homo sapiens
gtgccagacgtgctc

SEQ ID NO: 6331138 - DNA, 16 bp, Homo sapiens
gtgccagagaacccag

SEQ ID NO: 6331139 - DNA, 18 bp, Homo sapiens
gtgccagagaacccagcc

SEQ ID NO: 6331140 - DNA, 15 bp, Homo sapiens
gtgccagagaggggc

SEQ ID NO: 6331141 - DNA, 16 bp, Homo sapiens
gtgccagagcctgggg

SEQ ID NO: 6331142 - DNA, 18 bp, Homo sapiens
gtgccagagcctggggct

SEQ ID NO: 6331143 - DNA, 15 bp, Homo sapiens
gtgccagaggtgggc

SEQ ID NO: 6331144 - DNA, 20 bp, Homo sapiens
gtgccagaggtgggcaggtg

SEQ ID NO: 6331145 - DNA, 18 bp, Homo sapiens
gtgccagatataactgtc

SEQ ID NO: 6331146 - DNA, 14 bp, Homo sapiens
gtgccagcaaagcc

SEQ ID NO: 6331147 - DNA, 19 bp, Homo sapiens
gtgccagcaaagccccatg

SEQ ID NO: 6331148 - DNA, 18 bp, Homo sapiens
gtgccagcaactgaataa

SEQ ID NO: 6331149 - DNA, 21 bp, Homo sapiens
gtgccagcaactgaataaata

SEQ ID NO: 6331150 - DNA, 21 bp, Homo sapiens
gtgccagcaagtccttaggct

SEQ ID NO: 6331151 - DNA, 23 bp, Homo sapiens
gtgccagcacccagtcctctgcc

SEQ ID NO: 6331152 - DNA, 15 bp, Homo sapiens
gtgccagcattccag

SEQ ID NO: 6331153 - DNA, 13 bp, Homo sapiens
gtgccagcccctg

SEQ ID NO: 6331154 - DNA, 15 bp, Homo sapiens
gtgccagcctgaggc

SEQ ID NO: 6331155 - DNA, 12 bp, Homo sapiens
gtgccagctcca

SEQ ID NO: 6331156 - DNA, 13 bp, Homo sapiens
gtgccagctccag

SEQ ID NO: 6331157 - DNA, 20 bp, Homo sapiens
gtgccagctgcttctgccca

SEQ ID NO: 6331158 - DNA, 21 bp, Homo sapiens
gtgccagctgcttctgcccac

SEQ ID NO: 6331159 - DNA, 19 bp, Homo sapiens
gtgccagctggtgaatcca

SEQ ID NO: 6331160 - DNA, 18 bp, Homo sapiens
gtgccagcttctttgcag

SEQ ID NO: 6331161 - DNA, 18 bp, Homo sapiens
gtgccaggaaactcttgc

SEQ ID NO: 6331162 - DNA, 13 bp, Homo sapiens
gtgccaggacagc

SEQ ID NO: 6331163 - DNA, 18 bp, Homo sapiens
gtgccaggacagctggct

SEQ ID NO: 6331164 - DNA, 19 bp, Homo sapiens
gtgccaggacagctggctg

SEQ ID NO: 6331165 - DNA, 23 bp, Homo sapiens
gtgccaggacagctggctgctga

SEQ ID NO: 6331166 - DNA, 12 bp, Homo sapiens
gtgccaggacca

SEQ ID NO: 6331167 - DNA, 14 bp, Homo sapiens
gtgccaggaccagc

SEQ ID NO: 6331168 - DNA, 15 bp, Homo sapiens
gtgccaggaccagcc

SEQ ID NO: 6331169 - DNA, 17 bp, Homo sapiens
gtgccaggactgtgact

SEQ ID NO: 6331170 - DNA, 21 bp, Homo sapiens
gtgccaggagcaatgggactg

SEQ ID NO: 6331171 - DNA, 18 bp, Homo sapiens
gtgccaggagcctggagg

SEQ ID NO: 6331172 - DNA, 17 bp, Homo sapiens
gtgccaggcccggggct

SEQ ID NO: 6331173 - DNA, 13 bp, Homo sapiens
gtgccaggctggg

SEQ ID NO: 6331174 - DNA, 16 bp, Homo sapiens
gtgccaggctgggagg

SEQ ID NO: 6331175 - DNA, 20 bp, Homo sapiens
gtgccaggctgggaggctcg

SEQ ID NO: 6331176 - DNA, 17 bp, Homo sapiens
gtgccaggcttgcctgg

SEQ ID NO: 6331177 - DNA, 18 bp, Homo sapiens
gtgccaggcttgcctggg

SEQ ID NO: 6331178 - DNA, 19 bp, Homo sapiens
gtgccaggcttgcctgggc

SEQ ID NO: 6331179 - DNA, 14 bp, Homo sapiens
gtgccagggcagca

SEQ ID NO: 6331180 - DNA, 19 bp, Homo sapiens
gtgccagggcccaccccag

SEQ ID NO: 6331181 - DNA, 16 bp, Homo sapiens
gtgccagggctgcagg

SEQ ID NO: 6331182 - DNA, 23 bp, Homo sapiens
gtgccagggctgggccccttcca

SEQ ID NO: 6331183 - DNA, 17 bp, Homo sapiens
gtgccagggtgggctgg

SEQ ID NO: 6331184 - DNA, 19 bp, Homo sapiens
gtgccagggtgggctgggg

SEQ ID NO: 6331185 - DNA, 16 bp, Homo sapiens
gtgccaggtgaggtca

SEQ ID NO: 6331186 - DNA, 13 bp, Homo sapiens
gtgccaggtgctg

SEQ ID NO: 6331187 - DNA, 22 bp, Homo sapiens
gtgccaggtggctcagtgccac

SEQ ID NO: 6331188 - DNA, 20 bp, Homo sapiens
gtgccaggttttctgggtgt

SEQ ID NO: 6331189 - DNA, 18 bp, Homo sapiens
gtgccagtattttaaaat

SEQ ID NO: 6331190 - DNA, 17 bp, Homo sapiens
gtgccagtcaagaagaa

SEQ ID NO: 6331191 - DNA, 15 bp, Homo sapiens
gtgccagtcgcgctg

SEQ ID NO: 6331192 - DNA, 21 bp, Homo sapiens
gtgccagtcgcgctgcctgtg

SEQ ID NO: 6331193 - DNA, 14 bp, Homo sapiens
gtgccagttcctgt

SEQ ID NO: 6331194 - DNA, 14 bp, Homo sapiens
gtgccagttgggct

SEQ ID NO: 6331195 - DNA, 22 bp, Homo sapiens
gtgccatacatgttattgtttt

SEQ ID NO: 6331196 - DNA, 20 bp, Homo sapiens
gtgccataccttctcccagg

SEQ ID NO: 6331197 - DNA, 22 bp, Homo sapiens
gtgccataccttctcccaggcc

SEQ ID NO: 6331198 - DNA, 23 bp, Homo sapiens
gtgccatattctggttcttgaaa

SEQ ID NO: 6331199 - DNA, 14 bp, Homo sapiens
gtgccatcagtgcc

SEQ ID NO: 6331200 - DNA, 23 bp, Homo sapiens
gtgccatctgtacatattactgt

SEQ ID NO: 6331201 - DNA, 18 bp, Homo sapiens
gtgccatcttccatatcc

SEQ ID NO: 6331202 - DNA, 13 bp, Homo sapiens
gtgccatgcccaa

SEQ ID NO: 6331203 - DNA, 17 bp, Homo sapiens
gtgccatgcctgctccc

SEQ ID NO: 6331204 - DNA, 23 bp, Homo sapiens
gtgccatgcctgctccctgtctg

SEQ ID NO: 6331205 - DNA, 13 bp, Homo sapiens
gtgccatgctggg

SEQ ID NO: 6331206 - DNA, 15 bp, Homo sapiens
gtgccatgctgggcc

SEQ ID NO: 6331207 - DNA, 19 bp, Homo sapiens
gtgccatggatttccactg

SEQ ID NO: 6331208 - DNA, 13 bp, Homo sapiens
gtgccatggcccc

SEQ ID NO: 6331209 - DNA, 19 bp, Homo sapiens
gtgccatggccccccactc

SEQ ID NO: 6331210 - DNA, 18 bp, Homo sapiens
gtgccatgtataattttt

SEQ ID NO: 6331211 - DNA, 18 bp, Homo sapiens
gtgccatgtggagtggac

SEQ ID NO: 6331212 - DNA, 16 bp, Homo sapiens
gtgccatgttattcag

SEQ ID NO: 6331213 - DNA, 15 bp, Homo sapiens
gtgccatgttcaaaa

SEQ ID NO: 6331214 - DNA, 23 bp, Homo sapiens
gtgccattacactccagcctggg

SEQ ID NO: 6331215 - DNA, 16 bp, Homo sapiens
gtgccattactactgt

SEQ ID NO: 6331216 - DNA, 18 bp, Homo sapiens
gtgccattactactgtac

SEQ ID NO: 6331217 - DNA, 16 bp, Homo sapiens
gtgccattatatttgc

SEQ ID NO: 6331218 - DNA, 20 bp, Homo sapiens
gtgccattatatttgcatta

SEQ ID NO: 6331219 - DNA, 23 bp, Homo sapiens
gtgccattccactccactcaggt

SEQ ID NO: 6331220 - DNA, 13 bp, Homo sapiens
gtgccattcccag

SEQ ID NO: 6331221 - DNA, 22 bp, Homo sapiens
gtgccattgtactccagcctgg

SEQ ID NO: 6331222 - DNA, 23 bp, Homo sapiens
gtgccattgtctttcctcccttc

SEQ ID NO: 6331223 - DNA, 14 bp, Homo sapiens
gtgccatttctcag

SEQ ID NO: 6331224 - DNA, 17 bp, Homo sapiens
gtgccattttcgaagga

SEQ ID NO: 6331225 - DNA, 15 bp, Homo sapiens
gtgcccaaaagccat

SEQ ID NO: 6331226 - DNA, 23 bp, Homo sapiens
gtgcccaagaatagatgctgact

SEQ ID NO: 6331227 - DNA, 12 bp, Homo sapiens
gtgcccaagcca

SEQ ID NO: 6331228 - DNA, 20 bp, Homo sapiens
gtgcccaagccagaggctgg

SEQ ID NO: 6331229 - DNA, 20 bp, Homo sapiens
gtgcccaagctcagaaggct

SEQ ID NO: 6331230 - DNA, 12 bp, Homo sapiens
gtgcccacagcc

SEQ ID NO: 6331231 - DNA, 14 bp, Homo sapiens
gtgcccacagcccg

SEQ ID NO: 6331232 - DNA, 19 bp, Homo sapiens
gtgcccacagcccgcatgc

SEQ ID NO: 6331233 - DNA, 22 bp, Homo sapiens
gtgcccacagcccgcatgcagc

SEQ ID NO: 6331234 - DNA, 20 bp, Homo sapiens
gtgcccacaggatcagtctg

SEQ ID NO: 6331235 - DNA, 13 bp, Homo sapiens
gtgcccacaggga

SEQ ID NO: 6331236 - DNA, 14 bp, Homo sapiens
ggctgggagtggtg

SEQ ID NO: 6331237 - DNA, 19 bp, Homo sapiens
ggctgggatcagagcagga

SEQ ID NO: 6331238 - DNA, 21 bp, Homo sapiens
ggctgggatcagagcaggagc

SEQ ID NO: 6331239 - DNA, 16 bp, Homo sapiens
ggctgggatgggcctg

SEQ ID NO: 6331240 - DNA, 19 bp, Homo sapiens
ggctgggcaaggaaaaaga

SEQ ID NO: 6331241 - DNA, 17 bp, Homo sapiens
ggctgggcaaggaggcc

SEQ ID NO: 6331242 - DNA, 23 bp, Homo sapiens
ggctgggcaccgtgtcctcctct

SEQ ID NO: 6331243 - DNA, 14 bp, Homo sapiens
ggctgggcactgct

SEQ ID NO: 6331244 - DNA, 12 bp, Homo sapiens
ggctgggcagag

SEQ ID NO: 6331245 - DNA, 13 bp, Homo sapiens
ggctgggcagagg

SEQ ID NO: 6331246 - DNA, 16 bp, Homo sapiens
ggctgggcagagggga

SEQ ID NO: 6331247 - DNA, 18 bp, Homo sapiens
ggctgggcagccccagag

SEQ ID NO: 6331248 - DNA, 13 bp, Homo sapiens
ggctgggcagcct

SEQ ID NO: 6331249 - DNA, 12 bp, Homo sapiens
ggctgggcagct

SEQ ID NO: 6331250 - DNA, 13 bp, Homo sapiens
ggctgggcagctg

SEQ ID NO: 6331251 - DNA, 12 bp, Homo sapiens
ggctgggcaggg

SEQ ID NO: 6331252 - DNA, 14 bp, Homo sapiens
ggctgggcagggcc

SEQ ID NO: 6331253 - DNA, 15 bp, Homo sapiens
ggctgggcagggccc

SEQ ID NO: 6331254 - DNA, 21 bp, Homo sapiens
ggctgggcaggtcctggggag

SEQ ID NO: 6331255 - DNA, 23 bp, Homo sapiens
ggctgggcaggtcctggggaggc

SEQ ID NO: 6331256 - DNA, 13 bp, Homo sapiens
ggctgggcatccc

SEQ ID NO: 6331257 - DNA, 17 bp, Homo sapiens
ggctgggcatcccagct

SEQ ID NO: 6331258 - DNA, 18 bp, Homo sapiens
ggctgggccaagccaggg

SEQ ID NO: 6331259 - DNA, 17 bp, Homo sapiens
ggctgggccaccaggga

SEQ ID NO: 6331260 - DNA, 14 bp, Homo sapiens
ggctgggccaggtc

SEQ ID NO: 6331261 - DNA, 11 bp, Homo sapiens
ggctgggccat

SEQ ID NO: 6331262 - DNA, 17 bp, Homo sapiens
ggctgggccatgtccaa

SEQ ID NO: 6331263 - DNA, 20 bp, Homo sapiens
ggctgggccatgtccaaaga

SEQ ID NO: 6331264 - DNA, 18 bp, Homo sapiens
ggctgggcccacccaggg

SEQ ID NO: 6331265 - DNA, 21 bp, Homo sapiens
ggctgggcccacccagggagc

SEQ ID NO: 6331266 - DNA, 14 bp, Homo sapiens
ggctgggcccagaa

SEQ ID NO: 6331267 - DNA, 15 bp, Homo sapiens
ggctgggcccagagg

SEQ ID NO: 6331268 - DNA, 16 bp, Homo sapiens
ggctgggcccagaggc

SEQ ID NO: 6331269 - DNA, 13 bp, Homo sapiens
ggctgggcccagc

SEQ ID NO: 6331270 - DNA, 13 bp, Homo sapiens
ggctgggcccccc

SEQ ID NO: 6331271 - DNA, 21 bp, Homo sapiens
ggctgggccccccagctcagg

SEQ ID NO: 6331272 - DNA, 22 bp, Homo sapiens
ggctgggccccccagctcaggg

SEQ ID NO: 6331273 - DNA, 13 bp, Homo sapiens
ggctgggcccctc

SEQ ID NO: 6331274 - DNA, 17 bp, Homo sapiens
ggctgggcccctccagg

SEQ ID NO: 6331275 - DNA, 18 bp, Homo sapiens
ggctgggcccctggggac

SEQ ID NO: 6331276 - DNA, 22 bp, Homo sapiens
ggctgggcccctggggacagag

SEQ ID NO: 6331277 - DNA, 13 bp, Homo sapiens
ggctgggcccgag

SEQ ID NO: 6331278 - DNA, 17 bp, Homo sapiens
ggctgggcccgagggtc

SEQ ID NO: 6331279 - DNA, 18 bp, Homo sapiens
ggctgggcccgagggtcc

SEQ ID NO: 6331280 - DNA, 21 bp, Homo sapiens
ggctgggcccttcctggctag

SEQ ID NO: 6331281 - DNA, 22 bp, Homo sapiens
ggctgggcccttcctggctagg

SEQ ID NO: 6331282 - DNA, 18 bp, Homo sapiens
ggctgggccgcaagggcc

SEQ ID NO: 6331283 - DNA, 13 bp, Homo sapiens
ggctgggcctcct

SEQ ID NO: 6331284 - DNA, 22 bp, Homo sapiens
ggctgggcctccttcttccact

SEQ ID NO: 6331285 - DNA, 17 bp, Homo sapiens
ggctgggcgcctctgtc

SEQ ID NO: 6331286 - DNA, 11 bp, Homo sapiens
ggctgggctac

SEQ ID NO: 6331287 - DNA, 21 bp, Homo sapiens
ggctgggctagaaagaccact

SEQ ID NO: 6331288 - DNA, 19 bp, Homo sapiens
ggctgggctcacaggcctc

SEQ ID NO: 6331289 - DNA, 21 bp, Homo sapiens
ggctgggctcacaggcctctc

SEQ ID NO: 6331290 - DNA, 18 bp, Homo sapiens
ggctgggctgagcccctg

SEQ ID NO: 6331291 - DNA, 14 bp, Homo sapiens
ggctgggctggcca

SEQ ID NO: 6331292 - DNA, 15 bp, Homo sapiens
ggctgggctgggcac

SEQ ID NO: 6331293 - DNA, 16 bp, Homo sapiens
ggctgggctgggctga

SEQ ID NO: 6331294 - DNA, 13 bp, Homo sapiens
ggctgggcttcag

SEQ ID NO: 6331295 - DNA, 18 bp, Homo sapiens
ggctgggcttcagtggca

SEQ ID NO: 6331296 - DNA, 22 bp, Homo sapiens
ggctgggctttggggctggtgg

SEQ ID NO: 6331297 - DNA, 17 bp, Homo sapiens
ggctggggaagtcctct

SEQ ID NO: 6331298 - DNA, 16 bp, Homo sapiens
ggctggggacccaccc

SEQ ID NO: 6331299 - DNA, 16 bp, Homo sapiens
ggctggggactctggc

SEQ ID NO: 6331300 - DNA, 18 bp, Homo sapiens
ggctggggactctggcac

SEQ ID NO: 6331301 - DNA, 15 bp, Homo sapiens
ggctggggaggacca

SEQ ID NO: 6331302 - DNA, 15 bp, Homo sapiens
ggctggggaggtgct

SEQ ID NO: 6331303 - DNA, 16 bp, Homo sapiens
ggctggggatggccga

SEQ ID NO: 6331304 - DNA, 14 bp, Homo sapiens
ggctggggcagagg

SEQ ID NO: 6331305 - DNA, 23 bp, Homo sapiens
ggctggggcagcctctgggccca

SEQ ID NO: 6331306 - DNA, 14 bp, Homo sapiens
ggctggggcagggg

SEQ ID NO: 6331307 - DNA, 16 bp, Homo sapiens
ggctggggcaggggcc

SEQ ID NO: 6331308 - DNA, 20 bp, Homo sapiens
ggctggggcaggggcctggg

SEQ ID NO: 6331309 - DNA, 22 bp, Homo sapiens
ggctggggcaggggcctgggcc

SEQ ID NO: 6331310 - DNA, 14 bp, Homo sapiens
ggctggggccaaga

SEQ ID NO: 6331311 - DNA, 15 bp, Homo sapiens
ggctggggccacctt

SEQ ID NO: 6331312 - DNA, 15 bp, Homo sapiens
ggctggggcccagca

SEQ ID NO: 6331313 - DNA, 21 bp, Homo sapiens
ggctggggccccatcttgatc

SEQ ID NO: 6331314 - DNA, 15 bp, Homo sapiens
ggctggggccgctgg

SEQ ID NO: 6331315 - DNA, 13 bp, Homo sapiens
ggctggggcctgg

SEQ ID NO: 6331316 - DNA, 18 bp, Homo sapiens
ggctggggcctggaggcc

SEQ ID NO: 6331317 - DNA, 16 bp, Homo sapiens
ggctggggcctggcct

SEQ ID NO: 6331318 - DNA, 20 bp, Homo sapiens
ggctggggcggggctggagg

SEQ ID NO: 6331319 - DNA, 17 bp, Homo sapiens
ggctggggctgctcccc

SEQ ID NO: 6331320 - DNA, 19 bp, Homo sapiens
ggctggggcttttgtgcca

SEQ ID NO: 6331321 - DNA, 16 bp, Homo sapiens
ggctgggggaagaagc

SEQ ID NO: 6331322 - DNA, 16 bp, Homo sapiens
ggctgggggactgggg

SEQ ID NO: 6331323 - DNA, 21 bp, Homo sapiens
ggctgggggactggggggcca

SEQ ID NO: 6331324 - DNA, 18 bp, Homo sapiens
ggctgggggagagccgtg

SEQ ID NO: 6331325 - DNA, 16 bp, Homo sapiens
ggctgggggagggact

SEQ ID NO: 6331326 - DNA, 19 bp, Homo sapiens
ggctgggggaggtccaagc

SEQ ID NO: 6331327 - DNA, 21 bp, Homo sapiens
ggctgggggccagggctggat

SEQ ID NO: 6331328 - DNA, 16 bp, Homo sapiens
ggctgggggcctcagt

SEQ ID NO: 6331329 - DNA, 18 bp, Homo sapiens
ggctgggggcgggggagc

SEQ ID NO: 6331330 - DNA, 16 bp, Homo sapiens
ggctgggggctgcagg

SEQ ID NO: 6331331 - DNA, 22 bp, Homo sapiens
ggctggggggatgacggccagg

SEQ ID NO: 6331332 - DNA, 23 bp, Homo sapiens
ggctggggggatgacggccaggc

SEQ ID NO: 6331333 - DNA, 19 bp, Homo sapiens
ggctgggggtgaggggcca

SEQ ID NO: 6331334 - DNA, 16 bp, Homo sapiens
ggctggggtcccagca

SEQ ID NO: 6331335 - DNA, 17 bp, Homo sapiens
ggctggggtcctcctgt

SEQ ID NO: 6331336 - DNA, 19 bp, Homo sapiens
ggctggggtgagcctgact

SEQ ID NO: 6331337 - DNA, 23 bp, Homo sapiens
ggctggggtggagtgggaaggga

SEQ ID NO: 6331338 - DNA, 16 bp, Homo sapiens
ggctggggtggcctgt

SEQ ID NO: 6331339 - DNA, 20 bp, Homo sapiens
ggctgggtaatgtgaaggcc

SEQ ID NO: 6331340 - DNA, 22 bp, Homo sapiens
ggctgggtaatgtgaaggccca

SEQ ID NO: 6331341 - DNA, 15 bp, Homo sapiens
ggctgggtcacagga

SEQ ID NO: 6331342 - DNA, 18 bp, Homo sapiens
ggctgggtcagggccaga

SEQ ID NO: 6331343 - DNA, 19 bp, Homo sapiens
ggctgggtccgtctgagtg

SEQ ID NO: 6331344 - DNA, 12 bp, Homo sapiens
ggctgggtcctg

SEQ ID NO: 6331345 - DNA, 18 bp, Homo sapiens
ggctgggtcctgccagct

SEQ ID NO: 6331346 - DNA, 15 bp, Homo sapiens
ggctgggtccttggg

SEQ ID NO: 6331347 - DNA, 19 bp, Homo sapiens
ggctgggtccttgggcctg

SEQ ID NO: 6331348 - DNA, 21 bp, Homo sapiens
ggctgggtccttgggcctggc

SEQ ID NO: 6331349 - DNA, 17 bp, Homo sapiens
ggctgggtcgcccctcc

SEQ ID NO: 6331350 - DNA, 20 bp, Homo sapiens
ggctgggtcgccctggactg

SEQ ID NO: 6331351 - DNA, 18 bp, Homo sapiens
ggctgggtcggccctgcc

SEQ ID NO: 6331352 - DNA, 22 bp, Homo sapiens
ggctgggtgaccgactacccca

SEQ ID NO: 6331353 - DNA, 14 bp, Homo sapiens
ggctgggtgcgacc

SEQ ID NO: 6331354 - DNA, 15 bp, Homo sapiens
ggctgggtgctggga

SEQ ID NO: 6331355 - DNA, 19 bp, Homo sapiens
ggctgggtggcaccagcag

SEQ ID NO: 6331356 - DNA, 21 bp, Homo sapiens
ggctgggtggccggccctgcc

SEQ ID NO: 6331357 - DNA, 22 bp, Homo sapiens
ggctgggtggccggccctgccc

SEQ ID NO: 6331358 - DNA, 18 bp, Homo sapiens
ggctgggtgggcccagaa

SEQ ID NO: 6331359 - DNA, 18 bp, Homo sapiens
ggctgggtttgctgtctt

SEQ ID NO: 6331360 - DNA, 18 bp, Homo sapiens
ggctgggttttcaggggc

SEQ ID NO: 6331361 - DNA, 23 bp, Homo sapiens
ggctgggttttcaggggctttgg

SEQ ID NO: 6331362 - DNA, 21 bp, Homo sapiens
ggctggtaagggaccttcagg

SEQ ID NO: 6331363 - DNA, 20 bp, Homo sapiens
ggctggtacaacggaggcct

SEQ ID NO: 6331364 - DNA, 20 bp, Homo sapiens
ggctggtagaaaaaggggcc

SEQ ID NO: 6331365 - DNA, 21 bp, Homo sapiens
ggctggtagaaaaaggggcct

SEQ ID NO: 6331366 - DNA, 13 bp, Homo sapiens
ggctggtagcagc

SEQ ID NO: 6331367 - DNA, 20 bp, Homo sapiens
ggctggtagcagcaggctca

SEQ ID NO: 6331368 - DNA, 23 bp, Homo sapiens
ggctggtagcagcaggctcaggc

SEQ ID NO: 6331369 - DNA, 15 bp, Homo sapiens
ggctggtagctcagg

SEQ ID NO: 6331370 - DNA, 16 bp, Homo sapiens
ggctggtagctcaggt

SEQ ID NO: 6331371 - DNA, 22 bp, Homo sapiens
ggctggtattctctctatgcaa

SEQ ID NO: 6331372 - DNA, 17 bp, Homo sapiens
ggctggtcacctcccat

SEQ ID NO: 6331373 - DNA, 14 bp, Homo sapiens
ggctggtcactctg

SEQ ID NO: 6331374 - DNA, 13 bp, Homo sapiens
ggctggtccaggg

SEQ ID NO: 6331375 - DNA, 20 bp, Homo sapiens
ggctggtctggagtcccacc

SEQ ID NO: 6331376 - DNA, 21 bp, Homo sapiens
ggctggtctggagtcccaccc

SEQ ID NO: 6331377 - DNA, 17 bp, Homo sapiens
ggctggtcttgaactcc

SEQ ID NO: 6331378 - DNA, 20 bp, Homo sapiens
ggctggtcttgaactcctga

SEQ ID NO: 6331379 - DNA, 23 bp, Homo sapiens
ggctggtcttgaactcttggcct

SEQ ID NO: 6331380 - DNA, 18 bp, Homo sapiens
ggctggtgccagccttcc

SEQ ID NO: 6331381 - DNA, 17 bp, Homo sapiens
ggctggtgcccatgaag

SEQ ID NO: 6331382 - DNA, 16 bp, Homo sapiens
ggctggtgccccacag

SEQ ID NO: 6331383 - DNA, 18 bp, Homo sapiens
ggctggtgccccacagct

SEQ ID NO: 6331384 - DNA, 23 bp, Homo sapiens
ggctggtgcctgaagaccccaga

SEQ ID NO: 6331385 - DNA, 17 bp, Homo sapiens
ggctggtgcctgagccc

SEQ ID NO: 6331386 - DNA, 19 bp, Homo sapiens
ggctggtggattgggcaga

SEQ ID NO: 6331387 - DNA, 16 bp, Homo sapiens
ggctggtggcccagga

SEQ ID NO: 6331388 - DNA, 16 bp, Homo sapiens
ggctggtgggaaggcc

SEQ ID NO: 6331389 - DNA, 17 bp, Homo sapiens
ggctggtgggaggggcg

SEQ ID NO: 6331390 - DNA, 23 bp, Homo sapiens
ggctggtgggataggagggtgcc

SEQ ID NO: 6331391 - DNA, 13 bp, Homo sapiens
ggctggtgggccc

SEQ ID NO: 6331392 - DNA, 20 bp, Homo sapiens
ggctggtgggtctgcagctg

SEQ ID NO: 6331393 - DNA, 17 bp, Homo sapiens
ggctggtggtcatgaat

SEQ ID NO: 6331394 - DNA, 22 bp, Homo sapiens
ggctggtggttttcagagcagg

SEQ ID NO: 6331395 - DNA, 14 bp, Homo sapiens
ggctggtgtcccct

SEQ ID NO: 6331396 - DNA, 18 bp, Homo sapiens
ggctggtgtccccttccc

SEQ ID NO: 6331397 - DNA, 15 bp, Homo sapiens
ggctggtgtggtaca

SEQ ID NO: 6331398 - DNA, 20 bp, Homo sapiens
ggctggtgtggtacagagaa

SEQ ID NO: 6331399 - DNA, 21 bp, Homo sapiens
ggctggtgtggtacagagaag

SEQ ID NO: 6331400 - DNA, 23 bp, Homo sapiens
ggctggtgtggtacagagaagcc

SEQ ID NO: 6331401 - DNA, 22 bp, Homo sapiens
ggctggttcggatttggggtgg

SEQ ID NO: 6331402 - DNA, 23 bp, Homo sapiens
ggctggttggcatttgctggcct

SEQ ID NO: 6331403 - DNA, 22 bp, Homo sapiens
ggctggtttaaccattggaatg

SEQ ID NO: 6331404 - DNA, 21 bp, Homo sapiens
ggctggtttcaaactcctgac

SEQ ID NO: 6331405 - DNA, 16 bp, Homo sapiens
ggctggtttctgccct

SEQ ID NO: 6331406 - DNA, 17 bp, Homo sapiens
ggctggtttgcccagag

SEQ ID NO: 6331407 - DNA, 21 bp, Homo sapiens
ggctggtttggtggccaggct

SEQ ID NO: 6331408 - DNA, 14 bp, Homo sapiens
ggctggtttgttct

SEQ ID NO: 6331409 - DNA, 13 bp, Homo sapiens
ggctggttttgta

SEQ ID NO: 6331410 - DNA, 14 bp, Homo sapiens
ggctgtaaaactta

SEQ ID NO: 6331411 - DNA, 19 bp, Homo sapiens
ggctgtaaacagctctgtg

SEQ ID NO: 6331412 - DNA, 18 bp, Homo sapiens
ggctgtaaattgaacttc

SEQ ID NO: 6331413 - DNA, 15 bp, Homo sapiens
ggctgtaacctgctg

SEQ ID NO: 6331414 - DNA, 23 bp, Homo sapiens
gtgcccacatgtgtccatcccag

SEQ ID NO: 6331415 - DNA, 19 bp, Homo sapiens
gtgcccacccgtgttctcc

SEQ ID NO: 6331416 - DNA, 12 bp, Homo sapiens
gtgcccaccctt

SEQ ID NO: 6331417 - DNA, 15 bp, Homo sapiens
gtgcccaccgccctc

SEQ ID NO: 6331418 - DNA, 17 bp, Homo sapiens
gtgcccacgagggtctc

SEQ ID NO: 6331419 - DNA, 18 bp, Homo sapiens
gtgcccacggtctgagct

SEQ ID NO: 6331420 - DNA, 23 bp, Homo sapiens
gtgcccactccgccagccacagg

SEQ ID NO: 6331421 - DNA, 21 bp, Homo sapiens
gtgcccacttaccctgggctg

SEQ ID NO: 6331422 - DNA, 23 bp, Homo sapiens
gtgcccacttaccctgggctgga

SEQ ID NO: 6331423 - DNA, 16 bp, Homo sapiens
gtgcccagaataagtt

SEQ ID NO: 6331424 - DNA, 18 bp, Homo sapiens
gtgcccagagtagcccag

SEQ ID NO: 6331425 - DNA, 21 bp, Homo sapiens
gtgcccagatcgttctgccac

SEQ ID NO: 6331426 - DNA, 14 bp, Homo sapiens
gtgcccagcaggcc

SEQ ID NO: 6331427 - DNA, 16 bp, Homo sapiens
gtgcccagcaggccca

SEQ ID NO: 6331428 - DNA, 15 bp, Homo sapiens
gtgcccagcccctgc

SEQ ID NO: 6331429 - DNA, 17 bp, Homo sapiens
gtgcccagcccctgccc

SEQ ID NO: 6331430 - DNA, 18 bp, Homo sapiens
gtgcccagcccggacctt

SEQ ID NO: 6331431 - DNA, 23 bp, Homo sapiens
gtgcccagctagctgcagagcca

SEQ ID NO: 6331432 - DNA, 12 bp, Homo sapiens
gtgcccagctca

SEQ ID NO: 6331433 - DNA, 21 bp, Homo sapiens
gtgcccaggacggtctgtgcc

SEQ ID NO: 6331434 - DNA, 21 bp, Homo sapiens
gtgcccagggccagtgggacc

SEQ ID NO: 6331435 - DNA, 19 bp, Homo sapiens
gtgcccaggggcccacagg

SEQ ID NO: 6331436 - DNA, 13 bp, Homo sapiens
gtgcccagggttt

SEQ ID NO: 6331437 - DNA, 13 bp, Homo sapiens
gtgcccagtgatg

SEQ ID NO: 6331438 - DNA, 18 bp, Homo sapiens
gtgcccagtggagcctgc

SEQ ID NO: 6331439 - DNA, 20 bp, Homo sapiens
gtgcccagtggagcctgccg

SEQ ID NO: 6331440 - DNA, 15 bp, Homo sapiens
gtgcccatcctgcca

SEQ ID NO: 6331441 - DNA, 14 bp, Homo sapiens
gtgcccatgggcac

SEQ ID NO: 6331442 - DNA, 20 bp, Homo sapiens
gtgcccatgggcactgctgg

SEQ ID NO: 6331443 - DNA, 17 bp, Homo sapiens
gtgcccatgtgtatgga

SEQ ID NO: 6331444 - DNA, 16 bp, Homo sapiens
gtgcccatttcacaca

SEQ ID NO: 6331445 - DNA, 19 bp, Homo sapiens
gtgccccacaaggcccagc

SEQ ID NO: 6331446 - DNA, 14 bp, Homo sapiens
gtgccccacagcta

SEQ ID NO: 6331447 - DNA, 22 bp, Homo sapiens
gtgccccacagctacctgagac

SEQ ID NO: 6331448 - DNA, 13 bp, Homo sapiens
gtgccccacctcc

SEQ ID NO: 6331449 - DNA, 18 bp, Homo sapiens
gtgccccacctcccgccc

SEQ ID NO: 6331450 - DNA, 21 bp, Homo sapiens
gtgccccacctcccgccctca

SEQ ID NO: 6331451 - DNA, 14 bp, Homo sapiens
gtgccccacctgcc

SEQ ID NO: 6331452 - DNA, 15 bp, Homo sapiens
gtgccccacctgcca

SEQ ID NO: 6331453 - DNA, 21 bp, Homo sapiens
gtgccccacctgcctggtgca

SEQ ID NO: 6331454 - DNA, 16 bp, Homo sapiens
gtgccccacctgttgt

SEQ ID NO: 6331455 - DNA, 17 bp, Homo sapiens
gtgccccactccagcct

SEQ ID NO: 6331456 - DNA, 18 bp, Homo sapiens
gtgccccactccagcctg

SEQ ID NO: 6331457 - DNA, 23 bp, Homo sapiens
gtgccccactccagcctggggac

SEQ ID NO: 6331458 - DNA, 19 bp, Homo sapiens
gtgccccacttctggccac

SEQ ID NO: 6331459 - DNA, 13 bp, Homo sapiens
gtgccccagactg

SEQ ID NO: 6331460 - DNA, 12 bp, Homo sapiens
gtgccccaggga

SEQ ID NO: 6331461 - DNA, 13 bp, Homo sapiens
gtgccccagggag

SEQ ID NO: 6331462 - DNA, 20 bp, Homo sapiens
gtgccccagtggtgcgggcc

SEQ ID NO: 6331463 - DNA, 23 bp, Homo sapiens
gtgccccagtggtgcgggccagg

SEQ ID NO: 6331464 - DNA, 22 bp, Homo sapiens
gtgcccccaaccatttcctcag

SEQ ID NO: 6331465 - DNA, 15 bp, Homo sapiens
gtgcccccaccccca

SEQ ID NO: 6331466 - DNA, 12 bp, Homo sapiens
gtgcccccagac

SEQ ID NO: 6331467 - DNA, 13 bp, Homo sapiens
gtgcccccagagt

SEQ ID NO: 6331468 - DNA, 22 bp, Homo sapiens
gtgcccccagagtgtagggggc

SEQ ID NO: 6331469 - DNA, 15 bp, Homo sapiens
gtgcccccagcctca

SEQ ID NO: 6331470 - DNA, 16 bp, Homo sapiens
gtgcccccagcctcag

SEQ ID NO: 6331471 - DNA, 17 bp, Homo sapiens
gtgcccccagcctcagc

SEQ ID NO: 6331472 - DNA, 23 bp, Homo sapiens
gtgcccccagcctcagcccaact

SEQ ID NO: 6331473 - DNA, 12 bp, Homo sapiens
gtgcccccagcg

SEQ ID NO: 6331474 - DNA, 13 bp, Homo sapiens
gtgcccccaggtg

SEQ ID NO: 6331475 - DNA, 19 bp, Homo sapiens
gtgccccccatcctggccc

SEQ ID NO: 6331476 - DNA, 13 bp, Homo sapiens
gtgcccccctcct

SEQ ID NO: 6331477 - DNA, 14 bp, Homo sapiens
gtgcccccctcctc

SEQ ID NO: 6331478 - DNA, 19 bp, Homo sapiens
gtgcccccctcctccagta

SEQ ID NO: 6331479 - DNA, 16 bp, Homo sapiens
gtgcccccctcctccc

SEQ ID NO: 6331480 - DNA, 13 bp, Homo sapiens
gtgccccccttgc

SEQ ID NO: 6331481 - DNA, 14 bp, Homo sapiens
gtgccccctcacct

SEQ ID NO: 6331482 - DNA, 17 bp, Homo sapiens
gtgccccctcctctccc

SEQ ID NO: 6331483 - DNA, 15 bp, Homo sapiens
gtgccccctggtgga

SEQ ID NO: 6331484 - DNA, 18 bp, Homo sapiens
gtgccccgaccccacctg

SEQ ID NO: 6331485 - DNA, 17 bp, Homo sapiens
gtgcccctaaagagcat

SEQ ID NO: 6331486 - DNA, 21 bp, Homo sapiens
gtgcccctaaagagcatcctg

SEQ ID NO: 6331487 - DNA, 22 bp, Homo sapiens
gtgcccctaaagagcatcctga

SEQ ID NO: 6331488 - DNA, 15 bp, Homo sapiens
gtgcccctccaagtc

SEQ ID NO: 6331489 - DNA, 15 bp, Homo sapiens
gtgcccctcccatgg

SEQ ID NO: 6331490 - DNA, 16 bp, Homo sapiens
gtgcccctcccatggc

SEQ ID NO: 6331491 - DNA, 22 bp, Homo sapiens
gtgcccctcgccagcttctcct

SEQ ID NO: 6331492 - DNA, 23 bp, Homo sapiens
gtgcccctcttccaaaggcagcg

SEQ ID NO: 6331493 - DNA, 23 bp, Homo sapiens
gtgcccctgatgcagcctgtggc

SEQ ID NO: 6331494 - DNA, 16 bp, Homo sapiens
gtgcccctgcagggga

SEQ ID NO: 6331495 - DNA, 13 bp, Homo sapiens
gtgcccctgctca

SEQ ID NO: 6331496 - DNA, 22 bp, Homo sapiens
gtgcccctgctcactgggcccg

SEQ ID NO: 6331497 - DNA, 13 bp, Homo sapiens
gtgcccctgctgc

SEQ ID NO: 6331498 - DNA, 13 bp, Homo sapiens
gtgcccctgggat

SEQ ID NO: 6331499 - DNA, 21 bp, Homo sapiens
gtgcccctgtgctgcggggcc

SEQ ID NO: 6331500 - DNA, 12 bp, Homo sapiens
gtgccccttcac

SEQ ID NO: 6331501 - DNA, 16 bp, Homo sapiens
gtgccccttccctggg

SEQ ID NO: 6331502 - DNA, 22 bp, Homo sapiens
gtgccccttccgccactggggc

SEQ ID NO: 6331503 - DNA, 21 bp, Homo sapiens
gtgcccctttccttcactgcc

SEQ ID NO: 6331504 - DNA, 23 bp, Homo sapiens
gtgcccctttccttcactgcccc

SEQ ID NO: 6331505 - DNA, 19 bp, Homo sapiens
gtgcccgaggttcctgtca

SEQ ID NO: 6331506 - DNA, 17 bp, Homo sapiens
gtgcccgcatgtgtgcc

SEQ ID NO: 6331507 - DNA, 20 bp, Homo sapiens
gtgcccgccctgcccctgcc

SEQ ID NO: 6331508 - DNA, 15 bp, Homo sapiens
gtgcccgccctgggc

SEQ ID NO: 6331509 - DNA, 18 bp, Homo sapiens
gtgcccgcgccaggccct

SEQ ID NO: 6331510 - DNA, 19 bp, Homo sapiens
gtgcccgctgcgctgccct

SEQ ID NO: 6331511 - DNA, 23 bp, Homo sapiens
gtgcccgctgcgctgccctgcaa

SEQ ID NO: 6331512 - DNA, 18 bp, Homo sapiens
gtgcccggctaatgtttg

SEQ ID NO: 6331513 - DNA, 16 bp, Homo sapiens
gtgcccgggcaggggc

SEQ ID NO: 6331514 - DNA, 20 bp, Homo sapiens
gtgcccggtgcagggcctgg

SEQ ID NO: 6331515 - DNA, 20 bp, Homo sapiens
gtgcccggtgccatcttcca

SEQ ID NO: 6331516 - DNA, 15 bp, Homo sapiens
gtgcccgtaatccca

SEQ ID NO: 6331517 - DNA, 16 bp, Homo sapiens
gtgcccgtgtggcctg

SEQ ID NO: 6331518 - DNA, 19 bp, Homo sapiens
gtgcccgtgtggcctgggt

SEQ ID NO: 6331519 - DNA, 21 bp, Homo sapiens
gtgcccgtgtggcctgggtcc

SEQ ID NO: 6331520 - DNA, 23 bp, Homo sapiens
gtgcccgttttaccaataaactg

SEQ ID NO: 6331521 - DNA, 16 bp, Homo sapiens
gtgccctagaagggga

SEQ ID NO: 6331522 - DNA, 18 bp, Homo sapiens
gtgccctagggctcagag

SEQ ID NO: 6331523 - DNA, 15 bp, Homo sapiens
gtgccctcaccacca

SEQ ID NO: 6331524 - DNA, 14 bp, Homo sapiens
gtgccctccaaaga

SEQ ID NO: 6331525 - DNA, 20 bp, Homo sapiens
gtgccctccactgccctctg

SEQ ID NO: 6331526 - DNA, 21 bp, Homo sapiens
gtgccctcctgagggaggacc

SEQ ID NO: 6331527 - DNA, 14 bp, Homo sapiens
gtgccctccttccc

SEQ ID NO: 6331528 - DNA, 17 bp, Homo sapiens
gtgccctccttcccaat

SEQ ID NO: 6331529 - DNA, 16 bp, Homo sapiens
gtgccctcgcctcctc

SEQ ID NO: 6331530 - DNA, 22 bp, Homo sapiens
gtgccctctcactgacttctcc

SEQ ID NO: 6331531 - DNA, 12 bp, Homo sapiens
gtgccctctcca

SEQ ID NO: 6331532 - DNA, 17 bp, Homo sapiens
gtgccctctgggctctg

SEQ ID NO: 6331533 - DNA, 13 bp, Homo sapiens
gtgccctgatccc

SEQ ID NO: 6331534 - DNA, 13 bp, Homo sapiens
gtgccctgcattc

SEQ ID NO: 6331535 - DNA, 11 bp, Homo sapiens
gtgccctgccc

SEQ ID NO: 6331536 - DNA, 13 bp, Homo sapiens
gtgccctgccccc

SEQ ID NO: 6331537 - DNA, 18 bp, Homo sapiens
gtgccctgcccccatctc

SEQ ID NO: 6331538 - DNA, 19 bp, Homo sapiens
gtgccctgcccccatctcc

SEQ ID NO: 6331539 - DNA, 22 bp, Homo sapiens
gtgccctgcccccatctcccca

SEQ ID NO: 6331540 - DNA, 16 bp, Homo sapiens
gtgccctgccccctgg

SEQ ID NO: 6331541 - DNA, 18 bp, Homo sapiens
gtgccctgccccctggct

SEQ ID NO: 6331542 - DNA, 21 bp, Homo sapiens
gtgccctgccccctggctgac

SEQ ID NO: 6331543 - DNA, 23 bp, Homo sapiens
gtgccctgccccctggctgactg

SEQ ID NO: 6331544 - DNA, 21 bp, Homo sapiens
gtgccctggaggctgacacag

SEQ ID NO: 6331545 - DNA, 18 bp, Homo sapiens
gtgccctggatgcccagg

SEQ ID NO: 6331546 - DNA, 18 bp, Homo sapiens
gtgccctggcccagcctg

SEQ ID NO: 6331547 - DNA, 23 bp, Homo sapiens
gtgccctggcccagcctgtggcc

SEQ ID NO: 6331548 - DNA, 23 bp, Homo sapiens
gtgccctggctcccaagggaggc

SEQ ID NO: 6331549 - DNA, 21 bp, Homo sapiens
gtgccctgggccaggcaggcg

SEQ ID NO: 6331550 - DNA, 21 bp, Homo sapiens
gtgccctggtgaatcacctgg

SEQ ID NO: 6331551 - DNA, 15 bp, Homo sapiens
gtgccctggtggaga

SEQ ID NO: 6331552 - DNA, 23 bp, Homo sapiens
gtgccctggtggagaaagcactg

SEQ ID NO: 6331553 - DNA, 15 bp, Homo sapiens
gtgccctgtgggaga

SEQ ID NO: 6331554 - DNA, 14 bp, Homo sapiens
gtgccctgtgtgtg

SEQ ID NO: 6331555 - DNA, 13 bp, Homo sapiens
gtgccctgtttcc

SEQ ID NO: 6331556 - DNA, 17 bp, Homo sapiens
gtgcccttccctggagg

SEQ ID NO: 6331557 - DNA, 22 bp, Homo sapiens
gtgcccttcctcacagagttaa

SEQ ID NO: 6331558 - DNA, 14 bp, Homo sapiens
gtgcccttgatttt

SEQ ID NO: 6331559 - DNA, 22 bp, Homo sapiens
gtgcccttgcccttggagctgc

SEQ ID NO: 6331560 - DNA, 20 bp, Homo sapiens
gtgcccttgctgggtccagg

SEQ ID NO: 6331561 - DNA, 16 bp, Homo sapiens
gtgcccttggaggcca

SEQ ID NO: 6331562 - DNA, 17 bp, Homo sapiens
gtgccctttcctggcag

SEQ ID NO: 6331563 - DNA, 23 bp, Homo sapiens
gtgccctttggggttgcccagcc

SEQ ID NO: 6331564 - DNA, 14 bp, Homo sapiens
gtgccgaagtgttt

SEQ ID NO: 6331565 - DNA, 21 bp, Homo sapiens
gtgccgaatgactatgtccag

SEQ ID NO: 6331566 - DNA, 15 bp, Homo sapiens
gtgccgccagctgcc

SEQ ID NO: 6331567 - DNA, 23 bp, Homo sapiens
gtgccgccgcctcgcccaccgca

SEQ ID NO: 6331568 - DNA, 21 bp, Homo sapiens
gtgccgcctgcactcctcagg

SEQ ID NO: 6331569 - DNA, 14 bp, Homo sapiens
gtgccgcctgcccg

SEQ ID NO: 6331570 - DNA, 14 bp, Homo sapiens
gtgccgcctgctcc

SEQ ID NO: 6331571 - DNA, 17 bp, Homo sapiens
gtgccgcctgctcctca

SEQ ID NO: 6331572 - DNA, 15 bp, Homo sapiens
gtgccgcctgtgccc

SEQ ID NO: 6331573 - DNA, 16 bp, Homo sapiens
gtgccgctcctgcttc

SEQ ID NO: 6331574 - DNA, 19 bp, Homo sapiens
gtgccgctcctgcttcccc

SEQ ID NO: 6331575 - DNA, 15 bp, Homo sapiens
gtgccgctgtctctg

SEQ ID NO: 6331576 - DNA, 23 bp, Homo sapiens
gtgccgcttaaacatttccctgc

SEQ ID NO: 6331577 - DNA, 20 bp, Homo sapiens
gtgccggaaagagagctgga

SEQ ID NO: 6331578 - DNA, 19 bp, Homo sapiens
gtgccggcatctcccctag

SEQ ID NO: 6331579 - DNA, 23 bp, Homo sapiens
gtgccggcatctcccctagctca

SEQ ID NO: 6331580 - DNA, 13 bp, Homo sapiens
gtgccggctgtgg

SEQ ID NO: 6331581 - DNA, 15 bp, Homo sapiens
gtgccgggaggcagc

SEQ ID NO: 6331582 - DNA, 15 bp, Homo sapiens
gtgccgggcccccac

SEQ ID NO: 6331583 - DNA, 18 bp, Homo sapiens
gtgccggggaggggcaga

SEQ ID NO: 6331584 - DNA, 15 bp, Homo sapiens
gtgccgtgagcaggc

SEQ ID NO: 6331585 - DNA, 16 bp, Homo sapiens
gtgccgtgagcaggct

SEQ ID NO: 6331586 - DNA, 16 bp, Homo sapiens
gtgccgtggagcttgg

SEQ ID NO: 6331587 - DNA, 21 bp, Homo sapiens
gtgccgtggagcttggagccc

SEQ ID NO: 6331588 - DNA, 22 bp, Homo sapiens
gtgccgtgtcccctgacagggc

SEQ ID NO: 6331589 - DNA, 20 bp, Homo sapiens
gtgccgtgtgagtgtgacag

SEQ ID NO: 6331590 - DNA, 15 bp, Homo sapiens
gtgcctaaaattgta

SEQ ID NO: 6331591 - DNA, 16 bp, Homo sapiens
gtgcctaaataagtta

SEQ ID NO: 6331592 - DNA, 15 bp, Homo sapiens
ggctgtaaggctcta

SEQ ID NO: 6331593 - DNA, 18 bp, Homo sapiens
ggctgtaatgacaaaaga

SEQ ID NO: 6331594 - DNA, 19 bp, Homo sapiens
ggctgtaatgacaaaagat

SEQ ID NO: 6331595 - DNA, 19 bp, Homo sapiens
ggctgtacacaccctccag

SEQ ID NO: 6331596 - DNA, 15 bp, Homo sapiens
ggctgtacccaggaa

SEQ ID NO: 6331597 - DNA, 21 bp, Homo sapiens
ggctgtactgctcaggctgca

SEQ ID NO: 6331598 - DNA, 15 bp, Homo sapiens
ggctgtagaaggaga

SEQ ID NO: 6331599 - DNA, 19 bp, Homo sapiens
ggctgtagatggtgacctg

SEQ ID NO: 6331600 - DNA, 16 bp, Homo sapiens
ggctgtagccaggaaa

SEQ ID NO: 6331601 - DNA, 19 bp, Homo sapiens
ggctgtatcccatgagcct

SEQ ID NO: 6331602 - DNA, 23 bp, Homo sapiens
ggctgtatcccatgagcctcagc

SEQ ID NO: 6331603 - DNA, 17 bp, Homo sapiens
ggctgtatttttagaga

SEQ ID NO: 6331604 - DNA, 22 bp, Homo sapiens
ggctgtatttttgaaatactct

SEQ ID NO: 6331605 - DNA, 22 bp, Homo sapiens
ggctgtcaaatccatgtgtccc

SEQ ID NO: 6331606 - DNA, 23 bp, Homo sapiens
ggctgtcaatgggacctgtggct

SEQ ID NO: 6331607 - DNA, 15 bp, Homo sapiens
ggctgtcaattacag

SEQ ID NO: 6331608 - DNA, 16 bp, Homo sapiens
ggctgtcagcaggaag

SEQ ID NO: 6331609 - DNA, 15 bp, Homo sapiens
ggctgtccaaccaga

SEQ ID NO: 6331610 - DNA, 13 bp, Homo sapiens
ggctgtccagcct

SEQ ID NO: 6331611 - DNA, 11 bp, Homo sapiens
ggctgtccagt

SEQ ID NO: 6331612 - DNA, 16 bp, Homo sapiens
ggctgtccagtgccca

SEQ ID NO: 6331613 - DNA, 23 bp, Homo sapiens
ggctgtcccaagctcccaagagc

SEQ ID NO: 6331614 - DNA, 17 bp, Homo sapiens
ggctgtcccggaggcgg

SEQ ID NO: 6331615 - DNA, 22 bp, Homo sapiens
ggctgtccctcatggagacctc

SEQ ID NO: 6331616 - DNA, 16 bp, Homo sapiens
ggctgtccgtgtgcct

SEQ ID NO: 6331617 - DNA, 20 bp, Homo sapiens
ggctgtcctaccatcagctc

SEQ ID NO: 6331618 - DNA, 19 bp, Homo sapiens
ggctgtcctccttcctggg

SEQ ID NO: 6331619 - DNA, 12 bp, Homo sapiens
ggctgtcctgct

SEQ ID NO: 6331620 - DNA, 14 bp, Homo sapiens
ggctgtcctgctca

SEQ ID NO: 6331621 - DNA, 13 bp, Homo sapiens
ggctgtcctgtac

SEQ ID NO: 6331622 - DNA, 15 bp, Homo sapiens
ggctgtccttcccct

SEQ ID NO: 6331623 - DNA, 22 bp, Homo sapiens
ggctgtccttgtcgtagagccc

SEQ ID NO: 6331624 - DNA, 13 bp, Homo sapiens
ggctgtcctttcc

SEQ ID NO: 6331625 - DNA, 15 bp, Homo sapiens
ggctgtcggcgctgc

SEQ ID NO: 6331626 - DNA, 16 bp, Homo sapiens
ggctgtcggtgggacc

SEQ ID NO: 6331627 - DNA, 19 bp, Homo sapiens
ggctgtcggtgtgctgtca

SEQ ID NO: 6331628 - DNA, 13 bp, Homo sapiens
ggctgtctcctgt

SEQ ID NO: 6331629 - DNA, 15 bp, Homo sapiens
ggctgtctcctgtcc

SEQ ID NO: 6331630 - DNA, 10 bp, Homo sapiens
ggctgtctga

SEQ ID NO: 6331631 - DNA, 14 bp, Homo sapiens
ggctgtctgaggct

SEQ ID NO: 6331632 - DNA, 12 bp, Homo sapiens
ggctgtctgcga

SEQ ID NO: 6331633 - DNA, 13 bp, Homo sapiens
ggctgtctggatc

SEQ ID NO: 6331634 - DNA, 13 bp, Homo sapiens
ggctgtctgtcac

SEQ ID NO: 6331635 - DNA, 16 bp, Homo sapiens
ggctgtctgtgccatg

SEQ ID NO: 6331636 - DNA, 21 bp, Homo sapiens
ggctgtctgtgccatggcccc

SEQ ID NO: 6331637 - DNA, 18 bp, Homo sapiens
ggctgtcttaaaagatat

SEQ ID NO: 6331638 - DNA, 18 bp, Homo sapiens
ggctgtcttctcaggctc

SEQ ID NO: 6331639 - DNA, 21 bp, Homo sapiens
ggctgtcttctcccagagcac

SEQ ID NO: 6331640 - DNA, 23 bp, Homo sapiens
ggctgtcttggtggatgggccct

SEQ ID NO: 6331641 - DNA, 17 bp, Homo sapiens
ggctgtctttgcagggc

SEQ ID NO: 6331642 - DNA, 22 bp, Homo sapiens
ggctgtctttgcagggcacaga

SEQ ID NO: 6331643 - DNA, 10 bp, Homo sapiens
ggctgtgaaa

SEQ ID NO: 6331644 - DNA, 13 bp, Homo sapiens
ggctgtgaaggag

SEQ ID NO: 6331645 - DNA, 20 bp, Homo sapiens
ggctgtgaatgccaaagcca

SEQ ID NO: 6331646 - DNA, 20 bp, Homo sapiens
ggctgtgacaaccctggcct

SEQ ID NO: 6331647 - DNA, 15 bp, Homo sapiens
ggctgtgactcttct

SEQ ID NO: 6331648 - DNA, 12 bp, Homo sapiens
ggctgtgaggac

SEQ ID NO: 6331649 - DNA, 17 bp, Homo sapiens
ggctgtgaggacagggc

SEQ ID NO: 6331650 - DNA, 20 bp, Homo sapiens
ggctgtgaggcgggtggctg

SEQ ID NO: 6331651 - DNA, 21 bp, Homo sapiens
ggctgtgaggcgggtggctgg

SEQ ID NO: 6331652 - DNA, 14 bp, Homo sapiens
ggctgtgattgctg

SEQ ID NO: 6331653 - DNA, 17 bp, Homo sapiens
ggctgtgattgctgcca

SEQ ID NO: 6331654 - DNA, 21 bp, Homo sapiens
ggctgtgcacattctcccttg

SEQ ID NO: 6331655 - DNA, 22 bp, Homo sapiens
ggctgtgcacattctcccttga

SEQ ID NO: 6331656 - DNA, 13 bp, Homo sapiens
ggctgtgccaggc

SEQ ID NO: 6331657 - DNA, 15 bp, Homo sapiens
ggctgtgccaggctg

SEQ ID NO: 6331658 - DNA, 17 bp, Homo sapiens
ggctgtgccaggctggg

SEQ ID NO: 6331659 - DNA, 17 bp, Homo sapiens
ggctgtgcccagcaggc

SEQ ID NO: 6331660 - DNA, 22 bp, Homo sapiens
ggctgtgcccagcaggcccagc

SEQ ID NO: 6331661 - DNA, 13 bp, Homo sapiens
ggctgtgccccac

SEQ ID NO: 6331662 - DNA, 14 bp, Homo sapiens
ggctgtgcccggcc

SEQ ID NO: 6331663 - DNA, 12 bp, Homo sapiens
ggctgtgcctcc

SEQ ID NO: 6331664 - DNA, 13 bp, Homo sapiens
ggctgtgcctctg

SEQ ID NO: 6331665 - DNA, 21 bp, Homo sapiens
ggctgtgcctgcttctgtgta

SEQ ID NO: 6331666 - DNA, 16 bp, Homo sapiens
ggctgtgcgggcgccc

SEQ ID NO: 6331667 - DNA, 19 bp, Homo sapiens
ggctgtgctacctgagcca

SEQ ID NO: 6331668 - DNA, 15 bp, Homo sapiens
ggctgtgctcagaga

SEQ ID NO: 6331669 - DNA, 14 bp, Homo sapiens
ggctgtgctgccct

SEQ ID NO: 6331670 - DNA, 15 bp, Homo sapiens
ggctgtgctgccctg

SEQ ID NO: 6331671 - DNA, 16 bp, Homo sapiens
ggctgtgctgccctga

SEQ ID NO: 6331672 - DNA, 16 bp, Homo sapiens
ggctgtgctgggagaa

SEQ ID NO: 6331673 - DNA, 19 bp, Homo sapiens
ggctgtgcttgaaggccct

SEQ ID NO: 6331674 - DNA, 23 bp, Homo sapiens
ggctgtgcttgaaggccctgctg

SEQ ID NO: 6331675 - DNA, 12 bp, Homo sapiens
ggctgtggaagg

SEQ ID NO: 6331676 - DNA, 19 bp, Homo sapiens
ggctgtggaccgtggacag

SEQ ID NO: 6331677 - DNA, 21 bp, Homo sapiens
ggctgtggaccgtggacaggc

SEQ ID NO: 6331678 - DNA, 21 bp, Homo sapiens
ggctgtggagacaatgtctgc

SEQ ID NO: 6331679 - DNA, 13 bp, Homo sapiens
ggctgtggaggcc

SEQ ID NO: 6331680 - DNA, 22 bp, Homo sapiens
ggctgtggaggcctgatgctgc

SEQ ID NO: 6331681 - DNA, 19 bp, Homo sapiens
ggctgtggcatttccaaac

SEQ ID NO: 6331682 - DNA, 12 bp, Homo sapiens
ggctgtggcccc

SEQ ID NO: 6331683 - DNA, 14 bp, Homo sapiens
ggctgtggcccctc

SEQ ID NO: 6331684 - DNA, 15 bp, Homo sapiens
ggctgtggcccctcc

SEQ ID NO: 6331685 - DNA, 21 bp, Homo sapiens
ggctgtggccgtctcctccct

SEQ ID NO: 6331686 - DNA, 22 bp, Homo sapiens
ggctgtggccgtctcctccctc

SEQ ID NO: 6331687 - DNA, 21 bp, Homo sapiens
ggctgtggcctccctgctcta

SEQ ID NO: 6331688 - DNA, 16 bp, Homo sapiens
ggctgtggctggtgag

SEQ ID NO: 6331689 - DNA, 16 bp, Homo sapiens
ggctgtgggactccag

SEQ ID NO: 6331690 - DNA, 22 bp, Homo sapiens
ggctgtgggcctcaaggacttg

SEQ ID NO: 6331691 - DNA, 14 bp, Homo sapiens
ggctgtgggctccc

SEQ ID NO: 6331692 - DNA, 15 bp, Homo sapiens
ggctgtgggctccct

SEQ ID NO: 6331693 - DNA, 15 bp, Homo sapiens
ggctgtggggtctgg

SEQ ID NO: 6331694 - DNA, 20 bp, Homo sapiens
ggctgtggggtggagcactg

SEQ ID NO: 6331695 - DNA, 24 bp, Homo sapiens
ggctgtggggtggagcactggact

SEQ ID NO: 6331696 - DNA, 15 bp, Homo sapiens
ggctgtgggtgggga

SEQ ID NO: 6331697 - DNA, 22 bp, Homo sapiens
ggctgtgtaagatttgttttta

SEQ ID NO: 6331698 - DNA, 15 bp, Homo sapiens
ggctgtgtatttctg

SEQ ID NO: 6331699 - DNA, 18 bp, Homo sapiens
ggctgtgtatttctgtag

SEQ ID NO: 6331700 - DNA, 14 bp, Homo sapiens
ggctgtgtcccaga

SEQ ID NO: 6331701 - DNA, 12 bp, Homo sapiens
ggctgtgtcctc

SEQ ID NO: 6331702 - DNA, 18 bp, Homo sapiens
ggctgtgtcctctccagc

SEQ ID NO: 6331703 - DNA, 19 bp, Homo sapiens
ggctgtgtcctctccagct

SEQ ID NO: 6331704 - DNA, 15 bp, Homo sapiens
ggctgtgtctaaact

SEQ ID NO: 6331705 - DNA, 17 bp, Homo sapiens
ggctgtgtggccaacca

SEQ ID NO: 6331706 - DNA, 11 bp, Homo sapiens
ggctgtgtgtg

SEQ ID NO: 6331707 - DNA, 20 bp, Homo sapiens
ggctgtgttctggtgaggcc

SEQ ID NO: 6331708 - DNA, 20 bp, Homo sapiens
ggctgttaaccacccgcccc

SEQ ID NO: 6331709 - DNA, 15 bp, Homo sapiens
ggctgttagctcaga

SEQ ID NO: 6331710 - DNA, 16 bp, Homo sapiens
ggctgttaggacagca

SEQ ID NO: 6331711 - DNA, 22 bp, Homo sapiens
ggctgttccagactcaggttcc

SEQ ID NO: 6331712 - DNA, 18 bp, Homo sapiens
ggctgttccctccaggca

SEQ ID NO: 6331713 - DNA, 18 bp, Homo sapiens
ggctgttccctttgcctt

SEQ ID NO: 6331714 - DNA, 15 bp, Homo sapiens
ggctgttcctcccct

SEQ ID NO: 6331715 - DNA, 20 bp, Homo sapiens
ggctgttctcgaactcctga

SEQ ID NO: 6331716 - DNA, 15 bp, Homo sapiens
ggctgttctgcactg

SEQ ID NO: 6331717 - DNA, 19 bp, Homo sapiens
ggctgttctgcactgaaaa

SEQ ID NO: 6331718 - DNA, 18 bp, Homo sapiens
ggctgttctgtggttcct

SEQ ID NO: 6331719 - DNA, 23 bp, Homo sapiens
ggctgttctgtttcctgtgtctc

SEQ ID NO: 6331720 - DNA, 11 bp, Homo sapiens
ggctgttcttc

SEQ ID NO: 6331721 - DNA, 17 bp, Homo sapiens
ggctgttgaagtcacct

SEQ ID NO: 6331722 - DNA, 21 bp, Homo sapiens
ggctgttgagggccacttttt

SEQ ID NO: 6331723 - DNA, 15 bp, Homo sapiens
ggctgttgcattttt

SEQ ID NO: 6331724 - DNA, 18 bp, Homo sapiens
ggctgttgctagggagag

SEQ ID NO: 6331725 - DNA, 18 bp, Homo sapiens
ggctgttggacagctgct

SEQ ID NO: 6331726 - DNA, 17 bp, Homo sapiens
ggctgttggcactcaca

SEQ ID NO: 6331727 - DNA, 23 bp, Homo sapiens
ggctgttggcactcacagacctg

SEQ ID NO: 6331728 - DNA, 14 bp, Homo sapiens
ggctgttggctggg

SEQ ID NO: 6331729 - DNA, 15 bp, Homo sapiens
ggctgttggctgggg

SEQ ID NO: 6331730 - DNA, 13 bp, Homo sapiens
ggctgttggggac

SEQ ID NO: 6331731 - DNA, 22 bp, Homo sapiens
ggctgttgtgtctggagcctgc

SEQ ID NO: 6331732 - DNA, 12 bp, Homo sapiens
ggctgtttactg

SEQ ID NO: 6331733 - DNA, 16 bp, Homo sapiens
ggctgtttagcagaac

SEQ ID NO: 6331734 - DNA, 14 bp, Homo sapiens
ggctgtttcatcag

SEQ ID NO: 6331735 - DNA, 12 bp, Homo sapiens
ggctgtttctgc

SEQ ID NO: 6331736 - DNA, 20 bp, Homo sapiens
ggctgtttctgcttatttca

SEQ ID NO: 6331737 - DNA, 18 bp, Homo sapiens
ggctgtttgatagcagaa

SEQ ID NO: 6331738 - DNA, 22 bp, Homo sapiens
ggctgttttaacggcctgcatc

SEQ ID NO: 6331739 - DNA, 21 bp, Homo sapiens
ggctgttttagtgccaggctg

SEQ ID NO: 6331740 - DNA, 18 bp, Homo sapiens
ggctgttttccctctgct

SEQ ID NO: 6331741 - DNA, 20 bp, Homo sapiens
ggctgttttccctctgctgc

SEQ ID NO: 6331742 - DNA, 18 bp, Homo sapiens
ggctgtttttggctgttt

SEQ ID NO: 6331743 - DNA, 22 bp, Homo sapiens
ggctgtttttgggtgcaagagg

SEQ ID NO: 6331744 - DNA, 21 bp, Homo sapiens
ggcttaaaaatacttaataaa

SEQ ID NO: 6331745 - DNA, 15 bp, Homo sapiens
ggcttaaaacaacac

SEQ ID NO: 6331746 - DNA, 18 bp, Homo sapiens
ggcttaaagtgaaggaaa

SEQ ID NO: 6331747 - DNA, 21 bp, Homo sapiens
ggcttaagtgagcagaacagg

SEQ ID NO: 6331748 - DNA, 13 bp, Homo sapiens
ggcttaataaaaa

SEQ ID NO: 6331749 - DNA, 14 bp, Homo sapiens
ggcttaatgtttat

SEQ ID NO: 6331750 - DNA, 16 bp, Homo sapiens
ggcttaatgtttattc

SEQ ID NO: 6331751 - DNA, 21 bp, Homo sapiens
ggcttaattattgatgttttc

SEQ ID NO: 6331752 - DNA, 13 bp, Homo sapiens
ggcttaattgaaa

SEQ ID NO: 6331753 - DNA, 14 bp, Homo sapiens
ggcttaattgaaac

SEQ ID NO: 6331754 - DNA, 14 bp, Homo sapiens
ggcttacaaagcct

SEQ ID NO: 6331755 - DNA, 17 bp, Homo sapiens
ggcttacacgtggagga

SEQ ID NO: 6331756 - DNA, 19 bp, Homo sapiens
ggcttacctgacctcttgc

SEQ ID NO: 6331757 - DNA, 20 bp, Homo sapiens
ggcttacctggcccatcagg

SEQ ID NO: 6331758 - DNA, 17 bp, Homo sapiens
ggcttacctgttctcta

SEQ ID NO: 6331759 - DNA, 19 bp, Homo sapiens
ggcttacttacaaaagcag

SEQ ID NO: 6331760 - DNA, 22 bp, Homo sapiens
ggcttagacaccacctggagtg

SEQ ID NO: 6331761 - DNA, 15 bp, Homo sapiens
ggcttagccaagccc

SEQ ID NO: 6331762 - DNA, 20 bp, Homo sapiens
ggcttagcgttctgtttcac

SEQ ID NO: 6331763 - DNA, 14 bp, Homo sapiens
ggcttagctgccat

SEQ ID NO: 6331764 - DNA, 22 bp, Homo sapiens
ggcttagggacaggaccccagc

SEQ ID NO: 6331765 - DNA, 16 bp, Homo sapiens
ggcttagtatttctca

SEQ ID NO: 6331766 - DNA, 13 bp, Homo sapiens
ggcttagtgccac

SEQ ID NO: 6331767 - DNA, 19 bp, Homo sapiens
ggcttagtgccacccacct

SEQ ID NO: 6331768 - DNA, 14 bp, Homo sapiens
ggcttataaaacag

SEQ ID NO: 6331769 - DNA, 13 bp, Homo sapiens
ggcttataaatgt

SEQ ID NO: 6331770 - DNA, 22 bp, Homo sapiens
ggcttataaatgtgtattctgg

SEQ ID NO: 6331771 - DNA, 17 bp, Homo sapiens
ggcttataagttaaaac

SEQ ID NO: 6331772 - DNA, 11 bp, Homo sapiens
gtgcctaataa

SEQ ID NO: 6331773 - DNA, 12 bp, Homo sapiens
gtgcctaataaa

SEQ ID NO: 6331774 - DNA, 16 bp, Homo sapiens
gtgcctaatggagaag

SEQ ID NO: 6331775 - DNA, 20 bp, Homo sapiens
gtgcctaatggagaagaccc

SEQ ID NO: 6331776 - DNA, 23 bp, Homo sapiens
gtgcctacatcccgggcctcagt

SEQ ID NO: 6331777 - DNA, 17 bp, Homo sapiens
gtgcctacctggccgca

SEQ ID NO: 6331778 - DNA, 16 bp, Homo sapiens
gtgcctagactgttac

SEQ ID NO: 6331779 - DNA, 20 bp, Homo sapiens
gtgcctaggcctgggcagtg

SEQ ID NO: 6331780 - DNA, 24 bp, Homo sapiens
gtgcctaggttggtttcccctgca

SEQ ID NO: 6331781 - DNA, 18 bp, Homo sapiens
gtgcctagtattgacaaa

SEQ ID NO: 6331782 - DNA, 19 bp, Homo sapiens
gtgcctagttcctgtggcc

SEQ ID NO: 6331783 - DNA, 13 bp, Homo sapiens
gtgcctataacca

SEQ ID NO: 6331784 - DNA, 14 bp, Homo sapiens
gtgcctatagaaaa

SEQ ID NO: 6331785 - DNA, 13 bp, Homo sapiens
gtgcctatatctg

SEQ ID NO: 6331786 - DNA, 23 bp, Homo sapiens
gtgcctatatctgagagacctgt

SEQ ID NO: 6331787 - DNA, 18 bp, Homo sapiens
gtgcctattgctagagct

SEQ ID NO: 6331788 - DNA, 19 bp, Homo sapiens
gtgcctattgctagagctc

SEQ ID NO: 6331789 - DNA, 20 bp, Homo sapiens
gtgcctatttattcattcag

SEQ ID NO: 6331790 - DNA, 15 bp, Homo sapiens
gtgcctcaagaggaa

SEQ ID NO: 6331791 - DNA, 12 bp, Homo sapiens
gtgcctcagact

SEQ ID NO: 6331792 - DNA, 13 bp, Homo sapiens
gtgcctcagagac

SEQ ID NO: 6331793 - DNA, 14 bp, Homo sapiens
gtgcctcagagcag

SEQ ID NO: 6331794 - DNA, 10 bp, Homo sapiens
gtgcctcagc

SEQ ID NO: 6331795 - DNA, 17 bp, Homo sapiens
gtgcctcagcgctgccc

SEQ ID NO: 6331796 - DNA, 13 bp, Homo sapiens
gtgcctcaggacc

SEQ ID NO: 6331797 - DNA, 14 bp, Homo sapiens
gtgcctcagtgaga

SEQ ID NO: 6331798 - DNA, 14 bp, Homo sapiens
gtgcctcagtgctg

SEQ ID NO: 6331799 - DNA, 18 bp, Homo sapiens
gtgcctcagtgctgcaat

SEQ ID NO: 6331800 - DNA, 19 bp, Homo sapiens
gtgcctccaagcggccctg

SEQ ID NO: 6331801 - DNA, 20 bp, Homo sapiens
gtgcctccaccaccactggc

SEQ ID NO: 6331802 - DNA, 21 bp, Homo sapiens
gtgcctccaccaccactggcc

SEQ ID NO: 6331803 - DNA, 23 bp, Homo sapiens
gtgcctccagaggggctcaggtc

SEQ ID NO: 6331804 - DNA, 20 bp, Homo sapiens
gtgcctccaggaccaggggc

SEQ ID NO: 6331805 - DNA, 15 bp, Homo sapiens
gtgcctccaggtgtg

SEQ ID NO: 6331806 - DNA, 22 bp, Homo sapiens
gtgcctcccaagctcagagcag

SEQ ID NO: 6331807 - DNA, 19 bp, Homo sapiens
gtgcctcccagccctgccc

SEQ ID NO: 6331808 - DNA, 15 bp, Homo sapiens
gtgcctccctggtga

SEQ ID NO: 6331809 - DNA, 13 bp, Homo sapiens
gtgcctcccttcc

SEQ ID NO: 6331810 - DNA, 23 bp, Homo sapiens
gtgcctcccttcccagtgggctg

SEQ ID NO: 6331811 - DNA, 16 bp, Homo sapiens
gtgcctcccttccgct

SEQ ID NO: 6331812 - DNA, 13 bp, Homo sapiens
gtgcctcctagag

SEQ ID NO: 6331813 - DNA, 15 bp, Homo sapiens
gtgcctcctccccag

SEQ ID NO: 6331814 - DNA, 13 bp, Homo sapiens
gtgcctcctccct

SEQ ID NO: 6331815 - DNA, 14 bp, Homo sapiens
gtgcctcctccctc

SEQ ID NO: 6331816 - DNA, 13 bp, Homo sapiens
gtgcctcctctgg

SEQ ID NO: 6331817 - DNA, 15 bp, Homo sapiens
gtgcctcctctgggg

SEQ ID NO: 6331818 - DNA, 13 bp, Homo sapiens
gtgcctcctgcag

SEQ ID NO: 6331819 - DNA, 22 bp, Homo sapiens
gtgcctcctgcagtttgggaga

SEQ ID NO: 6331820 - DNA, 12 bp, Homo sapiens
gtgcctcctgtc

SEQ ID NO: 6331821 - DNA, 20 bp, Homo sapiens
gtgcctcctgtgtgtctgca

SEQ ID NO: 6331822 - DNA, 21 bp, Homo sapiens
gtgcctccttccacctccctc

SEQ ID NO: 6331823 - DNA, 14 bp, Homo sapiens
gtgcctcgaggcac

SEQ ID NO: 6331824 - DNA, 16 bp, Homo sapiens
gtgcctcgaggcaccg

SEQ ID NO: 6331825 - DNA, 21 bp, Homo sapiens
gtgcctcgcatcctatgctta

SEQ ID NO: 6331826 - DNA, 19 bp, Homo sapiens
gtgcctcggcctccctagt

SEQ ID NO: 6331827 - DNA, 14 bp, Homo sapiens
gtgcctctagctga

SEQ ID NO: 6331828 - DNA, 16 bp, Homo sapiens
gtgcctctccctgctg

SEQ ID NO: 6331829 - DNA, 16 bp, Homo sapiens
gtgcctctgattctat

SEQ ID NO: 6331830 - DNA, 22 bp, Homo sapiens
gtgcctctgcccaagcagcctg

SEQ ID NO: 6331831 - DNA, 21 bp, Homo sapiens
gtgcctctggaggcctctggg

SEQ ID NO: 6331832 - DNA, 22 bp, Homo sapiens
gtgcctctggaggcctctgggc

SEQ ID NO: 6331833 - DNA, 14 bp, Homo sapiens
gtgcctctgggact

SEQ ID NO: 6331834 - DNA, 15 bp, Homo sapiens
gtgcctctgtcctta

SEQ ID NO: 6331835 - DNA, 24 bp, Homo sapiens
gtgcctcttatcaagtgttacaga

SEQ ID NO: 6331836 - DNA, 19 bp, Homo sapiens
gtgcctcttccagtgaaca

SEQ ID NO: 6331837 - DNA, 16 bp, Homo sapiens
gtgcctcttgggagac

SEQ ID NO: 6331838 - DNA, 15 bp, Homo sapiens
gtgcctcttgttgca

SEQ ID NO: 6331839 - DNA, 17 bp, Homo sapiens
gtgcctgaaagctggga

SEQ ID NO: 6331840 - DNA, 17 bp, Homo sapiens
gtgcctgaacattcttg

SEQ ID NO: 6331841 - DNA, 18 bp, Homo sapiens
gtgcctgaagaccccaga

SEQ ID NO: 6331842 - DNA, 17 bp, Homo sapiens
gtgcctgagaatttaat

SEQ ID NO: 6331843 - DNA, 18 bp, Homo sapiens
gtgcctgagaccagggtg

SEQ ID NO: 6331844 - DNA, 16 bp, Homo sapiens
gtgcctgagaggcagg

SEQ ID NO: 6331845 - DNA, 16 bp, Homo sapiens
gtgcctgagcccctca

SEQ ID NO: 6331846 - DNA, 18 bp, Homo sapiens
gtgcctgagcccctcaga

SEQ ID NO: 6331847 - DNA, 14 bp, Homo sapiens
gtgcctgagctggg

SEQ ID NO: 6331848 - DNA, 15 bp, Homo sapiens
gtgcctgagctgggg

SEQ ID NO: 6331849 - DNA, 18 bp, Homo sapiens
gtgcctgaggctggctgg

SEQ ID NO: 6331850 - DNA, 19 bp, Homo sapiens
gtgcctgaggctggctggg

SEQ ID NO: 6331851 - DNA, 24 bp, Homo sapiens
gtgcctgatgggagtaggctccag

SEQ ID NO: 6331852 - DNA, 15 bp, Homo sapiens
gtgcctgattatttt

SEQ ID NO: 6331853 - DNA, 22 bp, Homo sapiens
gtgcctgattcggctgtctcag

SEQ ID NO: 6331854 - DNA, 15 bp, Homo sapiens
gtgcctgcacacaga

SEQ ID NO: 6331855 - DNA, 19 bp, Homo sapiens
gtgcctgcacatcatgagc

SEQ ID NO: 6331856 - DNA, 19 bp, Homo sapiens
gtgcctgcaccaggagaca

SEQ ID NO: 6331857 - DNA, 16 bp, Homo sapiens
gtgcctgcactgagag

SEQ ID NO: 6331858 - DNA, 16 bp, Homo sapiens
gtgcctgcaggggagc

SEQ ID NO: 6331859 - DNA, 15 bp, Homo sapiens
gtgcctgccactctc

SEQ ID NO: 6331860 - DNA, 19 bp, Homo sapiens
gtgcctgccatagccagga

SEQ ID NO: 6331861 - DNA, 22 bp, Homo sapiens
gtgcctgccatagccaggagcg

SEQ ID NO: 6331862 - DNA, 23 bp, Homo sapiens
gtgcctgccatagccaggagcgc

SEQ ID NO: 6331863 - DNA, 15 bp, Homo sapiens
gtgcctgccatgggc

SEQ ID NO: 6331864 - DNA, 17 bp, Homo sapiens
gtgcctgccatgggcca

SEQ ID NO: 6331865 - DNA, 22 bp, Homo sapiens
gtgcctgccatgggccagccta

SEQ ID NO: 6331866 - DNA, 23 bp, Homo sapiens
gtgcctgccatgggccagcctag

SEQ ID NO: 6331867 - DNA, 18 bp, Homo sapiens
gtgcctgccctggaggga

SEQ ID NO: 6331868 - DNA, 23 bp, Homo sapiens
gtgcctgcctgggagacttcctt

SEQ ID NO: 6331869 - DNA, 23 bp, Homo sapiens
gtgcctgcctgggagttttgtat

SEQ ID NO: 6331870 - DNA, 16 bp, Homo sapiens
gtgcctgctagagcaa

SEQ ID NO: 6331871 - DNA, 17 bp, Homo sapiens
gtgcctgctagagcaac

SEQ ID NO: 6331872 - DNA, 18 bp, Homo sapiens
gtgcctgctagagcaacc

SEQ ID NO: 6331873 - DNA, 18 bp, Homo sapiens
gtgcctgctatccagccg

SEQ ID NO: 6331874 - DNA, 19 bp, Homo sapiens
gtgcctgctttgacgggcc

SEQ ID NO: 6331875 - DNA, 22 bp, Homo sapiens
gtgcctggacatttgccttgct

SEQ ID NO: 6331876 - DNA, 17 bp, Homo sapiens
gtgcctggagctcctgg

SEQ ID NO: 6331877 - DNA, 11 bp, Homo sapiens
gtgcctggagt

SEQ ID NO: 6331878 - DNA, 19 bp, Homo sapiens
gtgcctggagtcaggtgtc

SEQ ID NO: 6331879 - DNA, 14 bp, Homo sapiens
gtgcctggcaaggc

SEQ ID NO: 6331880 - DNA, 16 bp, Homo sapiens
gtgcctggccacgccc

SEQ ID NO: 6331881 - DNA, 19 bp, Homo sapiens
gtgcctggcccattcttga

SEQ ID NO: 6331882 - DNA, 17 bp, Homo sapiens
gtgcctggcccttggct

SEQ ID NO: 6331883 - DNA, 22 bp, Homo sapiens
gtgcctggccgcagggcggggc

SEQ ID NO: 6331884 - DNA, 12 bp, Homo sapiens
gtgcctggcctg

SEQ ID NO: 6331885 - DNA, 14 bp, Homo sapiens
gtgcctggctcaga

SEQ ID NO: 6331886 - DNA, 13 bp, Homo sapiens
gtgcctggctggg

SEQ ID NO: 6331887 - DNA, 14 bp, Homo sapiens
gtgcctggcttgct

SEQ ID NO: 6331888 - DNA, 15 bp, Homo sapiens
gtgcctggcttgctg

SEQ ID NO: 6331889 - DNA, 23 bp, Homo sapiens
gtgcctggcttgctgtggctatg

SEQ ID NO: 6331890 - DNA, 20 bp, Homo sapiens
gtgcctgggatcagtggggc

SEQ ID NO: 6331891 - DNA, 15 bp, Homo sapiens
gtgcctgggcccctc

SEQ ID NO: 6331892 - DNA, 19 bp, Homo sapiens
gtgcctgggcccctcccct

SEQ ID NO: 6331893 - DNA, 21 bp, Homo sapiens
gtgcctgggcccctcccctca

SEQ ID NO: 6331894 - DNA, 16 bp, Homo sapiens
gtgcctgggccctggg

SEQ ID NO: 6331895 - DNA, 11 bp, Homo sapiens
gtgcctgggct

SEQ ID NO: 6331896 - DNA, 20 bp, Homo sapiens
gtgcctgggctcagcctggt

SEQ ID NO: 6331897 - DNA, 11 bp, Homo sapiens
gtgcctggggt

SEQ ID NO: 6331898 - DNA, 22 bp, Homo sapiens
gtgcctgggtggacatggcccc

SEQ ID NO: 6331899 - DNA, 17 bp, Homo sapiens
gtgcctgggtggccatc

SEQ ID NO: 6331900 - DNA, 13 bp, Homo sapiens
gtgcctggtttga

SEQ ID NO: 6331901 - DNA, 19 bp, Homo sapiens
gtgcctgtacaagctgatg

SEQ ID NO: 6331902 - DNA, 19 bp, Homo sapiens
gtgcctgtatgcaacaggc

SEQ ID NO: 6331903 - DNA, 19 bp, Homo sapiens
gtgcctgtattcccagcta

SEQ ID NO: 6331904 - DNA, 15 bp, Homo sapiens
gtgcctgtctgtcca

SEQ ID NO: 6331905 - DNA, 20 bp, Homo sapiens
gtgcctgtgaccggggtcct

SEQ ID NO: 6331906 - DNA, 22 bp, Homo sapiens
gtgcctgtgaccggggtcctga

SEQ ID NO: 6331907 - DNA, 16 bp, Homo sapiens
gtgcctgtgaggcagg

SEQ ID NO: 6331908 - DNA, 14 bp, Homo sapiens
gtgcctgtgctcct

SEQ ID NO: 6331909 - DNA, 21 bp, Homo sapiens
gtgcctgtgctcctgcccagg

SEQ ID NO: 6331910 - DNA, 13 bp, Homo sapiens
gtgcctgtgtcca

SEQ ID NO: 6331911 - DNA, 15 bp, Homo sapiens
gtgcctgtgtttcat

SEQ ID NO: 6331912 - DNA, 19 bp, Homo sapiens
gtgcctgtgtttcatgttc

SEQ ID NO: 6331913 - DNA, 15 bp, Homo sapiens
gtgccttaaaaataa

SEQ ID NO: 6331914 - DNA, 15 bp, Homo sapiens
gtgccttaagtttta

SEQ ID NO: 6331915 - DNA, 14 bp, Homo sapiens
gtgccttacctcct

SEQ ID NO: 6331916 - DNA, 17 bp, Homo sapiens
gtgccttacctcctgcc

SEQ ID NO: 6331917 - DNA, 18 bp, Homo sapiens
gtgccttacctcctgccc

SEQ ID NO: 6331918 - DNA, 21 bp, Homo sapiens
gtgccttacctcctgcccagg

SEQ ID NO: 6331919 - DNA, 17 bp, Homo sapiens
gtgccttaggaatactg

SEQ ID NO: 6331920 - DNA, 11 bp, Homo sapiens
gtgccttatgg

SEQ ID NO: 6331921 - DNA, 23 bp, Homo sapiens
gtgccttatggaacactctgaga

SEQ ID NO: 6331922 - DNA, 18 bp, Homo sapiens
gtgccttatgttgaaaaa

SEQ ID NO: 6331923 - DNA, 18 bp, Homo sapiens
gtgccttcactgggccag

SEQ ID NO: 6331924 - DNA, 19 bp, Homo sapiens
gtgccttcagccaagacca

SEQ ID NO: 6331925 - DNA, 20 bp, Homo sapiens
gtgccttcagccaagaccat

SEQ ID NO: 6331926 - DNA, 14 bp, Homo sapiens
gtgccttcatttgg

SEQ ID NO: 6331927 - DNA, 15 bp, Homo sapiens
gtgccttccaccctg

SEQ ID NO: 6331928 - DNA, 22 bp, Homo sapiens
gtgccttccaccctgccctggc

SEQ ID NO: 6331929 - DNA, 23 bp, Homo sapiens
gtgccttccagatcctctctggg

SEQ ID NO: 6331930 - DNA, 13 bp, Homo sapiens
gtgccttcccttt

SEQ ID NO: 6331931 - DNA, 20 bp, Homo sapiens
gtgccttctccttccccagg

SEQ ID NO: 6331932 - DNA, 23 bp, Homo sapiens
gtgccttctctcagctcccaggc

SEQ ID NO: 6331933 - DNA, 14 bp, Homo sapiens
gtgccttctgtggg

SEQ ID NO: 6331934 - DNA, 23 bp, Homo sapiens
gtgccttcttattctcactccac

SEQ ID NO: 6331935 - DNA, 20 bp, Homo sapiens
gtgccttcttcagggcctgg

SEQ ID NO: 6331936 - DNA, 21 bp, Homo sapiens
gtgccttcttcagggcctggt

SEQ ID NO: 6331937 - DNA, 13 bp, Homo sapiens
gtgccttgcccac

SEQ ID NO: 6331938 - DNA, 13 bp, Homo sapiens
gtgccttggagca

SEQ ID NO: 6331939 - DNA, 11 bp, Homo sapiens
gtgccttgggc

SEQ ID NO: 6331940 - DNA, 17 bp, Homo sapiens
gtgccttggggaaatgt

SEQ ID NO: 6331941 - DNA, 21 bp, Homo sapiens
gtgccttggggacaagagcag

SEQ ID NO: 6331942 - DNA, 23 bp, Homo sapiens
gtgccttggtctctccttcctct

SEQ ID NO: 6331943 - DNA, 16 bp, Homo sapiens
gtgcctttatctcagc

SEQ ID NO: 6331944 - DNA, 17 bp, Homo sapiens
gtgcctttatctcagcc

SEQ ID NO: 6331945 - DNA, 22 bp, Homo sapiens
gtgcctttcccgggccctcagc

SEQ ID NO: 6331946 - DNA, 17 bp, Homo sapiens
gtgcctttcctgttcag

SEQ ID NO: 6331947 - DNA, 18 bp, Homo sapiens
gtgcctttcctgttcagc

SEQ ID NO: 6331948 - DNA, 16 bp, Homo sapiens
gtgcctttctctggct

SEQ ID NO: 6331949 - DNA, 22 bp, Homo sapiens
gtgcctttctctggctccagaa

SEQ ID NO: 6331950 - DNA, 13 bp, Homo sapiens
gtgcctttggcct

SEQ ID NO: 6331951 - DNA, 14 bp, Homo sapiens
ggcttatattcaac

SEQ ID NO: 6331952 - DNA, 20 bp, Homo sapiens
ggcttatattcaaccatgga

SEQ ID NO: 6331953 - DNA, 21 bp, Homo sapiens
ggcttatattcaaccatggac

SEQ ID NO: 6331954 - DNA, 23 bp, Homo sapiens
ggcttatattcaaccatggactt

SEQ ID NO: 6331955 - DNA, 13 bp, Homo sapiens
ggcttatattcta

SEQ ID NO: 6331956 - DNA, 14 bp, Homo sapiens
ggcttatgtcatca

SEQ ID NO: 6331957 - DNA, 21 bp, Homo sapiens
ggcttatgtcatcagtaaagt

SEQ ID NO: 6331958 - DNA, 23 bp, Homo sapiens
ggcttattcccaactgctctgcc

SEQ ID NO: 6331959 - DNA, 18 bp, Homo sapiens
ggcttattttaatgtgat

SEQ ID NO: 6331960 - DNA, 23 bp, Homo sapiens
ggcttattttgggttcaggcctg

SEQ ID NO: 6331961 - DNA, 21 bp, Homo sapiens
ggcttatttttaaaataaaaa

SEQ ID NO: 6331962 - DNA, 20 bp, Homo sapiens
ggcttattttttaaaataat

SEQ ID NO: 6331963 - DNA, 18 bp, Homo sapiens
ggcttcaaaaagccacag

SEQ ID NO: 6331964 - DNA, 20 bp, Homo sapiens
ggcttcaaaaagccacagca

SEQ ID NO: 6331965 - DNA, 22 bp, Homo sapiens
ggcttcaaaaagccacagcaga

SEQ ID NO: 6331966 - DNA, 18 bp, Homo sapiens
ggcttcaaggatggagat

SEQ ID NO: 6331967 - DNA, 20 bp, Homo sapiens
ggcttcaatcactgtaacct

SEQ ID NO: 6331968 - DNA, 22 bp, Homo sapiens
ggcttcaattggtggaattcct

SEQ ID NO: 6331969 - DNA, 16 bp, Homo sapiens
ggcttcacagccacac

SEQ ID NO: 6331970 - DNA, 13 bp, Homo sapiens
ggcttcaccaggg

SEQ ID NO: 6331971 - DNA, 17 bp, Homo sapiens
ggcttcacccatgaaat

SEQ ID NO: 6331972 - DNA, 20 bp, Homo sapiens
ggcttcacggaagagccttg

SEQ ID NO: 6331973 - DNA, 18 bp, Homo sapiens
ggcttcactgtataaata

SEQ ID NO: 6331974 - DNA, 11 bp, Homo sapiens
ggcttcagcct

SEQ ID NO: 6331975 - DNA, 19 bp, Homo sapiens
ggcttcaggcaattctcct

SEQ ID NO: 6331976 - DNA, 13 bp, Homo sapiens
ggcttcaggtcca

SEQ ID NO: 6331977 - DNA, 15 bp, Homo sapiens
ggcttcagtggcagc

SEQ ID NO: 6331978 - DNA, 16 bp, Homo sapiens
ggcttcagtggcagct

SEQ ID NO: 6331979 - DNA, 12 bp, Homo sapiens
ggcttcatacac

SEQ ID NO: 6331980 - DNA, 16 bp, Homo sapiens
ggcttcatctctttag

SEQ ID NO: 6331981 - DNA, 19 bp, Homo sapiens
ggcttcatctctttagaga

SEQ ID NO: 6331982 - DNA, 15 bp, Homo sapiens
ggcttcatgccagct

SEQ ID NO: 6331983 - DNA, 21 bp, Homo sapiens
ggcttcattccggactggcag

SEQ ID NO: 6331984 - DNA, 21 bp, Homo sapiens
ggcttccagaaaaccccagca

SEQ ID NO: 6331985 - DNA, 21 bp, Homo sapiens
ggcttccagaaggcagcaaag

SEQ ID NO: 6331986 - DNA, 13 bp, Homo sapiens
ggcttccagagag

SEQ ID NO: 6331987 - DNA, 15 bp, Homo sapiens
ggcttccagcttcag

SEQ ID NO: 6331988 - DNA, 13 bp, Homo sapiens
ggcttccaggctc

SEQ ID NO: 6331989 - DNA, 14 bp, Homo sapiens
ggcttccaggctct

SEQ ID NO: 6331990 - DNA, 18 bp, Homo sapiens
ggcttccaggctcttcct

SEQ ID NO: 6331991 - DNA, 21 bp, Homo sapiens
ggcttccaggtatctccagga

SEQ ID NO: 6331992 - DNA, 14 bp, Homo sapiens
ggcttccatggtgg

SEQ ID NO: 6331993 - DNA, 17 bp, Homo sapiens
ggcttccatttgtgtgt

SEQ ID NO: 6331994 - DNA, 15 bp, Homo sapiens
ggcttcccaggaccc

SEQ ID NO: 6331995 - DNA, 20 bp, Homo sapiens
ggcttcccagtggctgctgc

SEQ ID NO: 6331996 - DNA, 21 bp, Homo sapiens
ggcttcccagtggctgctgcc

SEQ ID NO: 6331997 - DNA, 20 bp, Homo sapiens
ggcttcccatagtggggcct

SEQ ID NO: 6331998 - DNA, 23 bp, Homo sapiens
ggcttccccactcccccgtttct

SEQ ID NO: 6331999 - DNA, 21 bp, Homo sapiens
ggcttccccatcagctcccaa

SEQ ID NO: 6332000 - DNA, 15 bp, Homo sapiens
ggcttccccttcaga

SEQ ID NO: 6332001 - DNA, 18 bp, Homo sapiens
ggcttcccgctcagccct

SEQ ID NO: 6332002 - DNA, 19 bp, Homo sapiens
ggcttcccgctcagccctc

SEQ ID NO: 6332003 - DNA, 16 bp, Homo sapiens
ggcttccctacacagg

SEQ ID NO: 6332004 - DNA, 14 bp, Homo sapiens
ggcttccctctgct

SEQ ID NO: 6332005 - DNA, 20 bp, Homo sapiens
ggcttccctgacttgcttta

SEQ ID NO: 6332006 - DNA, 15 bp, Homo sapiens
ggcttccctgcccaa

SEQ ID NO: 6332007 - DNA, 12 bp, Homo sapiens
ggcttccctgga

SEQ ID NO: 6332008 - DNA, 13 bp, Homo sapiens
ggcttccctggaa

SEQ ID NO: 6332009 - DNA, 20 bp, Homo sapiens
ggcttccctggaagctctcc

SEQ ID NO: 6332010 - DNA, 22 bp, Homo sapiens
ggcttccctggaagctctccga

SEQ ID NO: 6332011 - DNA, 20 bp, Homo sapiens
ggcttccctggcatgatgga

SEQ ID NO: 6332012 - DNA, 22 bp, Homo sapiens
ggcttccctggcatgatggaca

SEQ ID NO: 6332013 - DNA, 15 bp, Homo sapiens
ggcttccctggcctc

SEQ ID NO: 6332014 - DNA, 15 bp, Homo sapiens
ggcttccctgggcct

SEQ ID NO: 6332015 - DNA, 21 bp, Homo sapiens
ggcttcccttctccccagcca

SEQ ID NO: 6332016 - DNA, 22 bp, Homo sapiens
ggcttcccttctccccagccag

SEQ ID NO: 6332017 - DNA, 23 bp, Homo sapiens
ggcttcccttctccccagccaga

SEQ ID NO: 6332018 - DNA, 22 bp, Homo sapiens
ggcttccggctgagctgtgcca

SEQ ID NO: 6332019 - DNA, 22 bp, Homo sapiens
ggcttcctataacttcttcctg

SEQ ID NO: 6332020 - DNA, 22 bp, Homo sapiens
ggcttcctcaaatacatgcaca

SEQ ID NO: 6332021 - DNA, 14 bp, Homo sapiens
ggcttcctcagggg

SEQ ID NO: 6332022 - DNA, 23 bp, Homo sapiens
ggcttcctccagcggctgggtgg

SEQ ID NO: 6332023 - DNA, 19 bp, Homo sapiens
ggcttcctccctccacgct

SEQ ID NO: 6332024 - DNA, 22 bp, Homo sapiens
ggcttcctccttccagatgccc

SEQ ID NO: 6332025 - DNA, 14 bp, Homo sapiens
ggcttcctctgctg

SEQ ID NO: 6332026 - DNA, 15 bp, Homo sapiens
ggcttcctctgctgc

SEQ ID NO: 6332027 - DNA, 17 bp, Homo sapiens
ggcttcctcttcttgtt

SEQ ID NO: 6332028 - DNA, 23 bp, Homo sapiens
ggcttcctgagaaagcccacctg

SEQ ID NO: 6332029 - DNA, 17 bp, Homo sapiens
ggcttcctgaggggaga

SEQ ID NO: 6332030 - DNA, 14 bp, Homo sapiens
ggcttcctgcccta

SEQ ID NO: 6332031 - DNA, 13 bp, Homo sapiens
ggcttcctggagc

SEQ ID NO: 6332032 - DNA, 11 bp, Homo sapiens
ggcttcctggc

SEQ ID NO: 6332033 - DNA, 14 bp, Homo sapiens
ggcttcctggcgcc

SEQ ID NO: 6332034 - DNA, 11 bp, Homo sapiens
ggcttcctggt

SEQ ID NO: 6332035 - DNA, 20 bp, Homo sapiens
ggcttcctggtgagaactga

SEQ ID NO: 6332036 - DNA, 14 bp, Homo sapiens
ggcttcctggtgct

SEQ ID NO: 6332037 - DNA, 18 bp, Homo sapiens
ggcttcctggtgctggag

SEQ ID NO: 6332038 - DNA, 15 bp, Homo sapiens
ggcttcctgtggctt

SEQ ID NO: 6332039 - DNA, 16 bp, Homo sapiens
ggcttcctgtggcttt

SEQ ID NO: 6332040 - DNA, 12 bp, Homo sapiens
ggcttcctttct

SEQ ID NO: 6332041 - DNA, 17 bp, Homo sapiens
ggcttcggacaaaatat

SEQ ID NO: 6332042 - DNA, 18 bp, Homo sapiens
ggcttcggagtgaatgtg

SEQ ID NO: 6332043 - DNA, 15 bp, Homo sapiens
ggcttcggcctgctt

SEQ ID NO: 6332044 - DNA, 18 bp, Homo sapiens
ggcttcgtctcagaaggc

SEQ ID NO: 6332045 - DNA, 19 bp, Homo sapiens
ggcttcgttagaccgctct

SEQ ID NO: 6332046 - DNA, 12 bp, Homo sapiens
ggcttctaatga

SEQ ID NO: 6332047 - DNA, 14 bp, Homo sapiens
ggcttctaatgacc

SEQ ID NO: 6332048 - DNA, 18 bp, Homo sapiens
ggcttctatgatcagaac

SEQ ID NO: 6332049 - DNA, 23 bp, Homo sapiens
ggcttctcacgctttgtttactc

SEQ ID NO: 6332050 - DNA, 15 bp, Homo sapiens
ggcttctcagcccct

SEQ ID NO: 6332051 - DNA, 20 bp, Homo sapiens
ggcttctcatacgtccacca

SEQ ID NO: 6332052 - DNA, 14 bp, Homo sapiens
ggcttctcccaaca

SEQ ID NO: 6332053 - DNA, 17 bp, Homo sapiens
ggcttctccctggggac

SEQ ID NO: 6332054 - DNA, 18 bp, Homo sapiens
ggcttctccctggggacg

SEQ ID NO: 6332055 - DNA, 17 bp, Homo sapiens
ggcttctccgccagcct

SEQ ID NO: 6332056 - DNA, 18 bp, Homo sapiens
ggcttctccgccagcctc

SEQ ID NO: 6332057 - DNA, 21 bp, Homo sapiens
ggcttctccgccagcctcctc

SEQ ID NO: 6332058 - DNA, 12 bp, Homo sapiens
ggcttctcctga

SEQ ID NO: 6332059 - DNA, 15 bp, Homo sapiens
ggcttctcctgaccc

SEQ ID NO: 6332060 - DNA, 18 bp, Homo sapiens
ggcttctcctttggcatg

SEQ ID NO: 6332061 - DNA, 22 bp, Homo sapiens
ggcttctcctttggcatgttta

SEQ ID NO: 6332062 - DNA, 22 bp, Homo sapiens
ggcttctctccgcgggtgggac

SEQ ID NO: 6332063 - DNA, 11 bp, Homo sapiens
ggcttctctct

SEQ ID NO: 6332064 - DNA, 12 bp, Homo sapiens
ggcttctctctc

SEQ ID NO: 6332065 - DNA, 12 bp, Homo sapiens
ggcttctctctt

SEQ ID NO: 6332066 - DNA, 20 bp, Homo sapiens
ggcttctctgccctgccctg

SEQ ID NO: 6332067 - DNA, 14 bp, Homo sapiens
ggcttctctgggac

SEQ ID NO: 6332068 - DNA, 16 bp, Homo sapiens
ggcttctctgtctctg

SEQ ID NO: 6332069 - DNA, 20 bp, Homo sapiens
ggcttctctgtgaattgcct

SEQ ID NO: 6332070 - DNA, 16 bp, Homo sapiens
ggcttctgaagagcct

SEQ ID NO: 6332071 - DNA, 13 bp, Homo sapiens
ggcttctgagcag

SEQ ID NO: 6332072 - DNA, 18 bp, Homo sapiens
ggcttctgatgaatcttg

SEQ ID NO: 6332073 - DNA, 20 bp, Homo sapiens
ggcttctgcaccctccaccc

SEQ ID NO: 6332074 - DNA, 19 bp, Homo sapiens
ggcttctgcggggctgaga

SEQ ID NO: 6332075 - DNA, 12 bp, Homo sapiens
ggcttctgctgg

SEQ ID NO: 6332076 - DNA, 15 bp, Homo sapiens
ggcttctgctggggc

SEQ ID NO: 6332077 - DNA, 21 bp, Homo sapiens
ggcttctgctggggcctggga

SEQ ID NO: 6332078 - DNA, 13 bp, Homo sapiens
ggcttctggagcc

SEQ ID NO: 6332079 - DNA, 16 bp, Homo sapiens
ggcttctggagccctt

SEQ ID NO: 6332080 - DNA, 20 bp, Homo sapiens
ggcttctggagcccttgggt

SEQ ID NO: 6332081 - DNA, 16 bp, Homo sapiens
ggcttctgggacaggc

SEQ ID NO: 6332082 - DNA, 15 bp, Homo sapiens
ggcttctgggacctg

SEQ ID NO: 6332083 - DNA, 18 bp, Homo sapiens
ggcttctgggtggctcct

SEQ ID NO: 6332084 - DNA, 22 bp, Homo sapiens
ggcttctgggtggctcctgcca

SEQ ID NO: 6332085 - DNA, 13 bp, Homo sapiens
ggcttctgtgaaa

SEQ ID NO: 6332086 - DNA, 18 bp, Homo sapiens
ggcttctgtgatgagctg

SEQ ID NO: 6332087 - DNA, 21 bp, Homo sapiens
ggcttctgtgatgagctgatc

SEQ ID NO: 6332088 - DNA, 12 bp, Homo sapiens
ggcttctgtgca

SEQ ID NO: 6332089 - DNA, 13 bp, Homo sapiens
ggcttctgtgcac

SEQ ID NO: 6332090 - DNA, 19 bp, Homo sapiens
ggcttctgtgcacctgggc

SEQ ID NO: 6332091 - DNA, 13 bp, Homo sapiens
ggcttctgtgggg

SEQ ID NO: 6332092 - DNA, 17 bp, Homo sapiens
ggcttctgttctctgct

SEQ ID NO: 6332093 - DNA, 17 bp, Homo sapiens
ggcttctgttgcgccac

SEQ ID NO: 6332094 - DNA, 19 bp, Homo sapiens
ggcttctgttgcgccactg

SEQ ID NO: 6332095 - DNA, 15 bp, Homo sapiens
ggcttcttaaaaact

SEQ ID NO: 6332096 - DNA, 17 bp, Homo sapiens
ggcttcttaaaaactgt

SEQ ID NO: 6332097 - DNA, 17 bp, Homo sapiens
ggcttcttatccttaat

SEQ ID NO: 6332098 - DNA, 13 bp, Homo sapiens
ggcttcttcaact

SEQ ID NO: 6332099 - DNA, 20 bp, Homo sapiens
ggcttcttcagatcagtgct

SEQ ID NO: 6332100 - DNA, 22 bp, Homo sapiens
ggcttcttcctcacactgctgt

SEQ ID NO: 6332101 - DNA, 15 bp, Homo sapiens
ggcttctttctccct

SEQ ID NO: 6332102 - DNA, 13 bp, Homo sapiens
ggcttctttctgc

SEQ ID NO: 6332103 - DNA, 15 bp, Homo sapiens
ggcttctttctgctg

SEQ ID NO: 6332104 - DNA, 20 bp, Homo sapiens
ggcttctttctgctggctga

SEQ ID NO: 6332105 - DNA, 16 bp, Homo sapiens
ggcttgaagccaaaga

SEQ ID NO: 6332106 - DNA, 13 bp, Homo sapiens
ggcttgaagctgt

SEQ ID NO: 6332107 - DNA, 14 bp, Homo sapiens
ggcttgaagctgtg

SEQ ID NO: 6332108 - DNA, 21 bp, Homo sapiens
ggcttgaaggactgcagacag

SEQ ID NO: 6332109 - DNA, 19 bp, Homo sapiens
ggcttgacacctgtcttga

SEQ ID NO: 6332110 - DNA, 20 bp, Homo sapiens
ggcttgacagcatgaggtgt

SEQ ID NO: 6332111 - DNA, 14 bp, Homo sapiens
ggcttgacatgtgc

SEQ ID NO: 6332112 - DNA, 14 bp, Homo sapiens
ggcttgactggatg

SEQ ID NO: 6332113 - DNA, 16 bp, Homo sapiens
ggcttgagctagagat

SEQ ID NO: 6332114 - DNA, 15 bp, Homo sapiens
ggcttgagggagggc

SEQ ID NO: 6332115 - DNA, 16 bp, Homo sapiens
ggcttgagggagggct

SEQ ID NO: 6332116 - DNA, 20 bp, Homo sapiens
ggcttgagttcaccatctct

SEQ ID NO: 6332117 - DNA, 21 bp, Homo sapiens
ggcttgatggtgacagctgca

SEQ ID NO: 6332118 - DNA, 23 bp, Homo sapiens
ggcttgcaagtatgttttagcat

SEQ ID NO: 6332119 - DNA, 14 bp, Homo sapiens
ggcttgcatgccaa

SEQ ID NO: 6332120 - DNA, 16 bp, Homo sapiens
ggcttgcccaggagca

SEQ ID NO: 6332121 - DNA, 15 bp, Homo sapiens
ggcttgccccaggac

SEQ ID NO: 6332122 - DNA, 17 bp, Homo sapiens
ggcttgccccaggactc

SEQ ID NO: 6332123 - DNA, 23 bp, Homo sapiens
ggcttgccccaggactctggcac

SEQ ID NO: 6332124 - DNA, 19 bp, Homo sapiens
ggcttgcccgcgctctttc

SEQ ID NO: 6332125 - DNA, 15 bp, Homo sapiens
ggcttgcctgcaggc

SEQ ID NO: 6332126 - DNA, 22 bp, Homo sapiens
ggcttgcctgggctgggcagcc

SEQ ID NO: 6332127 - DNA, 23 bp, Homo sapiens
ggcttgcctgggctgggcagcct

SEQ ID NO: 6332128 - DNA, 15 bp, Homo sapiens
ggcttgctattctgt

SEQ ID NO: 6332129 - DNA, 23 bp, Homo sapiens
ggcttgctcccgccccagggtct

SEQ ID NO: 6332130 - DNA, 14 bp, Homo sapiens
gtgcctttggcctg

SEQ ID NO: 6332131 - DNA, 17 bp, Homo sapiens
gtgccttttgcacccct

SEQ ID NO: 6332132 - DNA, 18 bp, Homo sapiens
gtgccttttgcagaagag

SEQ ID NO: 6332133 - DNA, 19 bp, Homo sapiens
gtgccttttgctgcgcacc

SEQ ID NO: 6332134 - DNA, 19 bp, Homo sapiens
gtgccttttgtaggctgtt

SEQ ID NO: 6332135 - DNA, 21 bp, Homo sapiens
gtgccttttgtaggctgttcc

SEQ ID NO: 6332136 - DNA, 16 bp, Homo sapiens
gtgcctttttcctaga

SEQ ID NO: 6332137 - DNA, 17 bp, Homo sapiens
gtgcctttttcctagaa

SEQ ID NO: 6332138 - DNA, 18 bp, Homo sapiens
gtgccttttttcacggaa

SEQ ID NO: 6332139 - DNA, 18 bp, Homo sapiens
gtgcgaagcaagaagaat

SEQ ID NO: 6332140 - DNA, 12 bp, Homo sapiens
gtgcgaaggcag

SEQ ID NO: 6332141 - DNA, 12 bp, Homo sapiens
gtgcgacagaga

SEQ ID NO: 6332142 - DNA, 16 bp, Homo sapiens
gtgcgaccccccaccc

SEQ ID NO: 6332143 - DNA, 22 bp, Homo sapiens
gtgcgacttcacaaaatgcaag

SEQ ID NO: 6332144 - DNA, 22 bp, Homo sapiens
gtgcgagggggccttgctggat

SEQ ID NO: 6332145 - DNA, 23 bp, Homo sapiens
gtgcgatcatggctcactgcagc

SEQ ID NO: 6332146 - DNA, 15 bp, Homo sapiens
gtgcgattctggata

SEQ ID NO: 6332147 - DNA, 15 bp, Homo sapiens
gtgcgcactgcatgg

SEQ ID NO: 6332148 - DNA, 18 bp, Homo sapiens
gtgcgcacttacctgctt

SEQ ID NO: 6332149 - DNA, 20 bp, Homo sapiens
gtgcgcacttacctgcttga

SEQ ID NO: 6332150 - DNA, 21 bp, Homo sapiens
gtgcgcagatctgtgcctggg

SEQ ID NO: 6332151 - DNA, 13 bp, Homo sapiens
gtgcgcccagggc

SEQ ID NO: 6332152 - DNA, 14 bp, Homo sapiens
gtgcgcccagggct

SEQ ID NO: 6332153 - DNA, 15 bp, Homo sapiens
gtgcgcccagggctg

SEQ ID NO: 6332154 - DNA, 16 bp, Homo sapiens
gtgcgccggcgccccg

SEQ ID NO: 6332155 - DNA, 18 bp, Homo sapiens
gtgcgccggcgccccgga

SEQ ID NO: 6332156 - DNA, 16 bp, Homo sapiens
gtgcgcgcccaggcca

SEQ ID NO: 6332157 - DNA, 19 bp, Homo sapiens
gtgcgcgtggcgtggcccg

SEQ ID NO: 6332158 - DNA, 21 bp, Homo sapiens
gtgcgctaaacttttctgata

SEQ ID NO: 6332159 - DNA, 21 bp, Homo sapiens
gtgcgctcacctgcagcccct

SEQ ID NO: 6332160 - DNA, 20 bp, Homo sapiens
gtgcgctcattttaggcctc

SEQ ID NO: 6332161 - DNA, 15 bp, Homo sapiens
gtgcgctctgtggat

SEQ ID NO: 6332162 - DNA, 22 bp, Homo sapiens
gtgcgctgacaaccaccgctcc

SEQ ID NO: 6332163 - DNA, 15 bp, Homo sapiens
gtgcgctgcctggcc

SEQ ID NO: 6332164 - DNA, 14 bp, Homo sapiens
gtgcggcaggagca

SEQ ID NO: 6332165 - DNA, 14 bp, Homo sapiens
gtgcggccaccacc

SEQ ID NO: 6332166 - DNA, 11 bp, Homo sapiens
gtgcggcccgt

SEQ ID NO: 6332167 - DNA, 17 bp, Homo sapiens
gtgcggcccgtgcgcag

SEQ ID NO: 6332168 - DNA, 18 bp, Homo sapiens
gtgcggcccgtgcgcagc

SEQ ID NO: 6332169 - DNA, 21 bp, Homo sapiens
gtgcggcccgtgcgcagccgc

SEQ ID NO: 6332170 - DNA, 12 bp, Homo sapiens
gtgcggcctggg

SEQ ID NO: 6332171 - DNA, 13 bp, Homo sapiens
gtgcggcctgggg

SEQ ID NO: 6332172 - DNA, 18 bp, Homo sapiens
gtgcggcggtcccagctc

SEQ ID NO: 6332173 - DNA, 19 bp, Homo sapiens
gtgcggcggtcccagctcc

SEQ ID NO: 6332174 - DNA, 18 bp, Homo sapiens
gtgcggcgtggagactgg

SEQ ID NO: 6332175 - DNA, 19 bp, Homo sapiens
gtgcggcgtggagactggc

SEQ ID NO: 6332176 - DNA, 19 bp, Homo sapiens
gtgcggcgtgggggcactg

SEQ ID NO: 6332177 - DNA, 14 bp, Homo sapiens
gtgcggctgtgcag

SEQ ID NO: 6332178 - DNA, 16 bp, Homo sapiens
gtgcggggcctgcagg

SEQ ID NO: 6332179 - DNA, 19 bp, Homo sapiens
gtgcggggcctgcaggcca

SEQ ID NO: 6332180 - DNA, 23 bp, Homo sapiens
gtgcggtgcactggtccgaggag

SEQ ID NO: 6332181 - DNA, 23 bp, Homo sapiens
gtgcgtctctctttctccctcac

SEQ ID NO: 6332182 - DNA, 13 bp, Homo sapiens
gtgcgtctgaggg

SEQ ID NO: 6332183 - DNA, 13 bp, Homo sapiens
gtgcgtgaatatt

SEQ ID NO: 6332184 - DNA, 22 bp, Homo sapiens
gtgcgtgccgtgtgagtgtgac

SEQ ID NO: 6332185 - DNA, 16 bp, Homo sapiens
gtgcgtgcgtgtgtgt

SEQ ID NO: 6332186 - DNA, 22 bp, Homo sapiens
gtgcgtggaagtgttcctgtct

SEQ ID NO: 6332187 - DNA, 16 bp, Homo sapiens
gtgcgtggctgtggca

SEQ ID NO: 6332188 - DNA, 22 bp, Homo sapiens
gtgcgtggtatacatgtgtaca

SEQ ID NO: 6332189 - DNA, 23 bp, Homo sapiens
gtgcgtggtatacatgtgtacat

SEQ ID NO: 6332190 - DNA, 16 bp, Homo sapiens
gtgcgtggtccgtgtg

SEQ ID NO: 6332191 - DNA, 13 bp, Homo sapiens
gtgcgtggtgcga

SEQ ID NO: 6332192 - DNA, 19 bp, Homo sapiens
gtgcgtggtggtccctggg

SEQ ID NO: 6332193 - DNA, 15 bp, Homo sapiens
gtgcgtgtgtagagt

SEQ ID NO: 6332194 - DNA, 13 bp, Homo sapiens
gtgcgtgtgtgtg

SEQ ID NO: 6332195 - DNA, 17 bp, Homo sapiens
gtgcgtgttagtgtgtg

SEQ ID NO: 6332196 - DNA, 13 bp, Homo sapiens
gtgcgttctccca

SEQ ID NO: 6332197 - DNA, 15 bp, Homo sapiens
gtgcgttggaatcac

SEQ ID NO: 6332198 - DNA, 15 bp, Homo sapiens
gtgctaaacctatct

SEQ ID NO: 6332199 - DNA, 14 bp, Homo sapiens
gtgctaaaggaggc

SEQ ID NO: 6332200 - DNA, 16 bp, Homo sapiens
gtgctaaatcctagca

SEQ ID NO: 6332201 - DNA, 14 bp, Homo sapiens
gtgctaaattgtct

SEQ ID NO: 6332202 - DNA, 16 bp, Homo sapiens
gtgctaagagcctctg

SEQ ID NO: 6332203 - DNA, 13 bp, Homo sapiens
gtgctaaggactt

SEQ ID NO: 6332204 - DNA, 20 bp, Homo sapiens
gtgctaaggacttgttagat

SEQ ID NO: 6332205 - DNA, 14 bp, Homo sapiens
gtgctaagtgtgaa

SEQ ID NO: 6332206 - DNA, 16 bp, Homo sapiens
gtgctaagtgtgaact

SEQ ID NO: 6332207 - DNA, 14 bp, Homo sapiens
gtgctaagttgtct

SEQ ID NO: 6332208 - DNA, 17 bp, Homo sapiens
gtgctaataacagtgca

SEQ ID NO: 6332209 - DNA, 13 bp, Homo sapiens
gtgctaatgtgtc

SEQ ID NO: 6332210 - DNA, 14 bp, Homo sapiens
gtgctaatgtgtct

SEQ ID NO: 6332211 - DNA, 21 bp, Homo sapiens
gtgctacaaaaacacagcaag

SEQ ID NO: 6332212 - DNA, 21 bp, Homo sapiens
gtgctacacccttttccagct

SEQ ID NO: 6332213 - DNA, 15 bp, Homo sapiens
gtgctacagaaagca

SEQ ID NO: 6332214 - DNA, 20 bp, Homo sapiens
gtgctacaggggccagaaga

SEQ ID NO: 6332215 - DNA, 13 bp, Homo sapiens
gtgctacattttg

SEQ ID NO: 6332216 - DNA, 22 bp, Homo sapiens
gtgctaccagagttaaagcata

SEQ ID NO: 6332217 - DNA, 19 bp, Homo sapiens
gtgctacctgcacctctgg

SEQ ID NO: 6332218 - DNA, 22 bp, Homo sapiens
gtgctacgtgtgaaatctgtct

SEQ ID NO: 6332219 - DNA, 12 bp, Homo sapiens
gtgctactaaca

SEQ ID NO: 6332220 - DNA, 15 bp, Homo sapiens
gtgctactaacagat

SEQ ID NO: 6332221 - DNA, 16 bp, Homo sapiens
gtgctactgattgttt

SEQ ID NO: 6332222 - DNA, 18 bp, Homo sapiens
gtgctactggggaaactg

SEQ ID NO: 6332223 - DNA, 24 bp, Homo sapiens
gtgctagaagcctactggtagaaa

SEQ ID NO: 6332224 - DNA, 19 bp, Homo sapiens
gtgctagagttaaaagtta

SEQ ID NO: 6332225 - DNA, 17 bp, Homo sapiens
gtgctagcaacacccaa

SEQ ID NO: 6332226 - DNA, 13 bp, Homo sapiens
gtgctagctctta

SEQ ID NO: 6332227 - DNA, 21 bp, Homo sapiens
gtgctagcttgacacagtcag

SEQ ID NO: 6332228 - DNA, 22 bp, Homo sapiens
gtgctaggaacactccttcaca

SEQ ID NO: 6332229 - DNA, 16 bp, Homo sapiens
gtgctaggggatgagg

SEQ ID NO: 6332230 - DNA, 14 bp, Homo sapiens
gtgctagtaaattt

SEQ ID NO: 6332231 - DNA, 21 bp, Homo sapiens
gtgctagtcactggcagcctg

SEQ ID NO: 6332232 - DNA, 14 bp, Homo sapiens
gtgctagtgagctg

SEQ ID NO: 6332233 - DNA, 21 bp, Homo sapiens
gtgctataaatgccagagcca

SEQ ID NO: 6332234 - DNA, 23 bp, Homo sapiens
gtgctataaatgccagagccaac

SEQ ID NO: 6332235 - DNA, 23 bp, Homo sapiens
gtgctataatctgtttttacgta

SEQ ID NO: 6332236 - DNA, 15 bp, Homo sapiens
gtgctatagtatttg

SEQ ID NO: 6332237 - DNA, 13 bp, Homo sapiens
gtgctatcacatg

SEQ ID NO: 6332238 - DNA, 21 bp, Homo sapiens
gtgctatctcccccagcccca

SEQ ID NO: 6332239 - DNA, 22 bp, Homo sapiens
gtgctatctcccccagccccat

SEQ ID NO: 6332240 - DNA, 15 bp, Homo sapiens
gtgctatgaaacaat

SEQ ID NO: 6332241 - DNA, 17 bp, Homo sapiens
gtgctatgaagccaact

SEQ ID NO: 6332242 - DNA, 21 bp, Homo sapiens
gtgctatgacatggaggcact

SEQ ID NO: 6332243 - DNA, 17 bp, Homo sapiens
gtgctatgcaaaataga

SEQ ID NO: 6332244 - DNA, 14 bp, Homo sapiens
gtgctattaatatt

SEQ ID NO: 6332245 - DNA, 20 bp, Homo sapiens
gtgctattcgtaagttctgt

SEQ ID NO: 6332246 - DNA, 21 bp, Homo sapiens
gtgctattcgtaagttctgtg

SEQ ID NO: 6332247 - DNA, 21 bp, Homo sapiens
gtgctattctgtgaaactaat

SEQ ID NO: 6332248 - DNA, 14 bp, Homo sapiens
gtgctattctgtgt

SEQ ID NO: 6332249 - DNA, 17 bp, Homo sapiens
gtgctattctgtgttga

SEQ ID NO: 6332250 - DNA, 23 bp, Homo sapiens
gtgctattgtagagccagaggtc

SEQ ID NO: 6332251 - DNA, 20 bp, Homo sapiens
gtgctatttaacattttaca

SEQ ID NO: 6332252 - DNA, 19 bp, Homo sapiens
gtgctatttctattcctta

SEQ ID NO: 6332253 - DNA, 19 bp, Homo sapiens
gtgctatttgaagaaaaaa

SEQ ID NO: 6332254 - DNA, 11 bp, Homo sapiens
gtgctatttgt

SEQ ID NO: 6332255 - DNA, 17 bp, Homo sapiens
gtgctatttgtacaaat

SEQ ID NO: 6332256 - DNA, 24 bp, Homo sapiens
gtgctatttgtacaaataaacctg

SEQ ID NO: 6332257 - DNA, 21 bp, Homo sapiens
gtgctattttgtttgttttgt

SEQ ID NO: 6332258 - DNA, 13 bp, Homo sapiens
gtgctatttttga

SEQ ID NO: 6332259 - DNA, 19 bp, Homo sapiens
gtgctcaaagatgtactga

SEQ ID NO: 6332260 - DNA, 21 bp, Homo sapiens
gtgctcaaagatgtactgaga

SEQ ID NO: 6332261 - DNA, 16 bp, Homo sapiens
gtgctcaaccagacag

SEQ ID NO: 6332262 - DNA, 17 bp, Homo sapiens
gtgctcaagcagcaaaa

SEQ ID NO: 6332263 - DNA, 18 bp, Homo sapiens
gtgctcaagcagcaaaat

SEQ ID NO: 6332264 - DNA, 20 bp, Homo sapiens
gtgctcaagcagcaaaatcc

SEQ ID NO: 6332265 - DNA, 22 bp, Homo sapiens
gtgctcaaggttactgggagtg

SEQ ID NO: 6332266 - DNA, 14 bp, Homo sapiens
gtgctcaataaact

SEQ ID NO: 6332267 - DNA, 15 bp, Homo sapiens
gtgctcaataaactt

SEQ ID NO: 6332268 - DNA, 18 bp, Homo sapiens
gtgctcaataaacttgtg

SEQ ID NO: 6332269 - DNA, 20 bp, Homo sapiens
gtgctcaataaacttgtgcc

SEQ ID NO: 6332270 - DNA, 21 bp, Homo sapiens
gtgctcaataaacttgtgcct

SEQ ID NO: 6332271 - DNA, 22 bp, Homo sapiens
gtgctcaataaacttgtgcctc

SEQ ID NO: 6332272 - DNA, 18 bp, Homo sapiens
gtgctcaatggagaatat

SEQ ID NO: 6332273 - DNA, 15 bp, Homo sapiens
gtgctcacaatgttc

SEQ ID NO: 6332274 - DNA, 18 bp, Homo sapiens
gtgctcaccagccctgca

SEQ ID NO: 6332275 - DNA, 17 bp, Homo sapiens
gtgctcacccattgtct

SEQ ID NO: 6332276 - DNA, 20 bp, Homo sapiens
gtgctcacccattgtctcat

SEQ ID NO: 6332277 - DNA, 16 bp, Homo sapiens
gtgctcagaagggcta

SEQ ID NO: 6332278 - DNA, 22 bp, Homo sapiens
gtgctcagaataaggcaggcat

SEQ ID NO: 6332279 - DNA, 13 bp, Homo sapiens
gtgctcagccaaa

SEQ ID NO: 6332280 - DNA, 23 bp, Homo sapiens
gtgctcagccaccatctggagtt

SEQ ID NO: 6332281 - DNA, 14 bp, Homo sapiens
gtgctcagcccagg

SEQ ID NO: 6332282 - DNA, 12 bp, Homo sapiens
gtgctcagccct

SEQ ID NO: 6332283 - DNA, 13 bp, Homo sapiens
gtgctcagctgtg

SEQ ID NO: 6332284 - DNA, 15 bp, Homo sapiens
gtgctcagctgtggc

SEQ ID NO: 6332285 - DNA, 17 bp, Homo sapiens
gtgctcagctgtggctg

SEQ ID NO: 6332286 - DNA, 20 bp, Homo sapiens
gtgctcagggaaatggcctt

SEQ ID NO: 6332287 - DNA, 13 bp, Homo sapiens
gtgctcagggcta

SEQ ID NO: 6332288 - DNA, 22 bp, Homo sapiens
gtgctcagtattgacgacctac

SEQ ID NO: 6332289 - DNA, 17 bp, Homo sapiens
gtgctcagtcgccctgt

SEQ ID NO: 6332290 - DNA, 14 bp, Homo sapiens
gtgctcagttccaa

SEQ ID NO: 6332291 - DNA, 18 bp, Homo sapiens
gtgctcagttgtactttt

SEQ ID NO: 6332292 - DNA, 15 bp, Homo sapiens
gtgctcatcagaaac

SEQ ID NO: 6332293 - DNA, 23 bp, Homo sapiens
gtgctcatgtctgttaataaaga

SEQ ID NO: 6332294 - DNA, 14 bp, Homo sapiens
gtgctcatgtgtgt

SEQ ID NO: 6332295 - DNA, 16 bp, Homo sapiens
gtgctcatgtgtgtgg

SEQ ID NO: 6332296 - DNA, 16 bp, Homo sapiens
gtgctcatttcaggat

SEQ ID NO: 6332297 - DNA, 18 bp, Homo sapiens
gtgctccaaatgtctact

SEQ ID NO: 6332298 - DNA, 13 bp, Homo sapiens
gtgctccaacctg

SEQ ID NO: 6332299 - DNA, 17 bp, Homo sapiens
gtgctccagcagtgctg

SEQ ID NO: 6332300 - DNA, 20 bp, Homo sapiens
gtgctccagcagtgctgggc

SEQ ID NO: 6332301 - DNA, 22 bp, Homo sapiens
gtgctccaggcttcctgcccta

SEQ ID NO: 6332302 - DNA, 17 bp, Homo sapiens
gtgctccatagagcagt

SEQ ID NO: 6332303 - DNA, 22 bp, Homo sapiens
gtgctccatatttgatttctaa

SEQ ID NO: 6332304 - DNA, 22 bp, Homo sapiens
gtgctccatggctgccatctca

SEQ ID NO: 6332305 - DNA, 16 bp, Homo sapiens
gtgctcccaccaggca

SEQ ID NO: 6332306 - DNA, 12 bp, Homo sapiens
gtgctccccaaa

SEQ ID NO: 6332307 - DNA, 23 bp, Homo sapiens
gtgctcccctgctcggcaccgcc

SEQ ID NO: 6332308 - DNA, 13 bp, Homo sapiens
ggcttgctgagag

SEQ ID NO: 6332309 - DNA, 19 bp, Homo sapiens
ggcttgctgatggctgctg

SEQ ID NO: 6332310 - DNA, 23 bp, Homo sapiens
ggcttgctgtatgacccctggcc

SEQ ID NO: 6332311 - DNA, 23 bp, Homo sapiens
ggcttgctgtggctatgggaatc

SEQ ID NO: 6332312 - DNA, 21 bp, Homo sapiens
ggcttgctgtttactcccttc

SEQ ID NO: 6332313 - DNA, 15 bp, Homo sapiens
ggcttgcttatgtgt

SEQ ID NO: 6332314 - DNA, 18 bp, Homo sapiens
ggcttgcttgccgagcct

SEQ ID NO: 6332315 - DNA, 16 bp, Homo sapiens
ggcttggaagggcgct

SEQ ID NO: 6332316 - DNA, 16 bp, Homo sapiens
ggcttggaggcttggc

SEQ ID NO: 6332317 - DNA, 15 bp, Homo sapiens
ggcttggatcctggg

SEQ ID NO: 6332318 - DNA, 17 bp, Homo sapiens
ggcttggatcctgggct

SEQ ID NO: 6332319 - DNA, 19 bp, Homo sapiens
ggcttggatcctgggctgg

SEQ ID NO: 6332320 - DNA, 17 bp, Homo sapiens
ggcttggatttcgtgtg

SEQ ID NO: 6332321 - DNA, 18 bp, Homo sapiens
ggcttggcatctgtgtgc

SEQ ID NO: 6332322 - DNA, 19 bp, Homo sapiens
ggcttggcatctgtgtgcg

SEQ ID NO: 6332323 - DNA, 22 bp, Homo sapiens
ggcttggccacaacctgaaaga

SEQ ID NO: 6332324 - DNA, 17 bp, Homo sapiens
ggcttggccacagccag

SEQ ID NO: 6332325 - DNA, 19 bp, Homo sapiens
ggcttggccacagccaggg

SEQ ID NO: 6332326 - DNA, 18 bp, Homo sapiens
ggcttggcccgcggcctg

SEQ ID NO: 6332327 - DNA, 13 bp, Homo sapiens
ggcttggccgcca

SEQ ID NO: 6332328 - DNA, 15 bp, Homo sapiens
ggcttggccttggca

SEQ ID NO: 6332329 - DNA, 14 bp, Homo sapiens
ggcttggccttgtg

SEQ ID NO: 6332330 - DNA, 18 bp, Homo sapiens
ggcttggcgtggagcagg

SEQ ID NO: 6332331 - DNA, 17 bp, Homo sapiens
ggcttggctcgcacccc

SEQ ID NO: 6332332 - DNA, 13 bp, Homo sapiens
ggcttggctgccc

SEQ ID NO: 6332333 - DNA, 16 bp, Homo sapiens
ggcttggctgccctgt

SEQ ID NO: 6332334 - DNA, 15 bp, Homo sapiens
ggcttgggaaaaaaa

SEQ ID NO: 6332335 - DNA, 22 bp, Homo sapiens
ggcttgggacatggcacaggcc

SEQ ID NO: 6332336 - DNA, 15 bp, Homo sapiens
ggcttgggccctgca

SEQ ID NO: 6332337 - DNA, 16 bp, Homo sapiens
ggcttgggcctaggct

SEQ ID NO: 6332338 - DNA, 17 bp, Homo sapiens
ggcttgggcctaggctg

SEQ ID NO: 6332339 - DNA, 17 bp, Homo sapiens
ggcttgggcctgcaccc

SEQ ID NO: 6332340 - DNA, 18 bp, Homo sapiens
ggcttggggagcaggtct

SEQ ID NO: 6332341 - DNA, 19 bp, Homo sapiens
ggcttggggagcaggtctc

SEQ ID NO: 6332342 - DNA, 19 bp, Homo sapiens
ggcttggggattgtacacg

SEQ ID NO: 6332343 - DNA, 17 bp, Homo sapiens
ggcttgggggaaaagag

SEQ ID NO: 6332344 - DNA, 14 bp, Homo sapiens
ggcttggtcacttc

SEQ ID NO: 6332345 - DNA, 16 bp, Homo sapiens
ggcttggtgtctgcgg

SEQ ID NO: 6332346 - DNA, 18 bp, Homo sapiens
ggcttgtaactccaccaa

SEQ ID NO: 6332347 - DNA, 20 bp, Homo sapiens
ggcttgtacatttttaaatt

SEQ ID NO: 6332348 - DNA, 23 bp, Homo sapiens
ggcttgtacatttttaaattctt

SEQ ID NO: 6332349 - DNA, 16 bp, Homo sapiens
ggcttgtagaattgtt

SEQ ID NO: 6332350 - DNA, 19 bp, Homo sapiens
ggcttgtagaattgttata

SEQ ID NO: 6332351 - DNA, 17 bp, Homo sapiens
ggcttgtagaattttta

SEQ ID NO: 6332352 - DNA, 17 bp, Homo sapiens
ggcttgtcagagctggg

SEQ ID NO: 6332353 - DNA, 20 bp, Homo sapiens
ggcttgtcctgtgcttgctt

SEQ ID NO: 6332354 - DNA, 14 bp, Homo sapiens
ggcttgtgaactgc

SEQ ID NO: 6332355 - DNA, 22 bp, Homo sapiens
ggcttgtgaactgctggagtct

SEQ ID NO: 6332356 - DNA, 18 bp, Homo sapiens
ggcttgtgacattcgtga

SEQ ID NO: 6332357 - DNA, 15 bp, Homo sapiens
ggcttgtgattctgg

SEQ ID NO: 6332358 - DNA, 22 bp, Homo sapiens
ggcttgtgatttccatttctga

SEQ ID NO: 6332359 - DNA, 20 bp, Homo sapiens
ggcttgtggactctctgcct

SEQ ID NO: 6332360 - DNA, 23 bp, Homo sapiens
ggcttgtggactctctgcctgct

SEQ ID NO: 6332361 - DNA, 14 bp, Homo sapiens
ggcttgtgggctgg

SEQ ID NO: 6332362 - DNA, 17 bp, Homo sapiens
ggcttgttctctggaac

SEQ ID NO: 6332363 - DNA, 20 bp, Homo sapiens
ggcttgttctctggaacctg

SEQ ID NO: 6332364 - DNA, 14 bp, Homo sapiens
ggcttgttttccaa

SEQ ID NO: 6332365 - DNA, 19 bp, Homo sapiens
ggcttgtttttcttcagca

SEQ ID NO: 6332366 - DNA, 17 bp, Homo sapiens
ggctttaaaagaaaaaa

SEQ ID NO: 6332367 - DNA, 14 bp, Homo sapiens
ggctttaaaattct

SEQ ID NO: 6332368 - DNA, 23 bp, Homo sapiens
ggctttaaactaccctccagagt

SEQ ID NO: 6332369 - DNA, 15 bp, Homo sapiens
ggctttaaagctgag

SEQ ID NO: 6332370 - DNA, 12 bp, Homo sapiens
ggctttaaataa

SEQ ID NO: 6332371 - DNA, 18 bp, Homo sapiens
ggctttaaataaattaag

SEQ ID NO: 6332372 - DNA, 17 bp, Homo sapiens
ggctttaattgtataag

SEQ ID NO: 6332373 - DNA, 20 bp, Homo sapiens
ggctttacatactttatcaa

SEQ ID NO: 6332374 - DNA, 16 bp, Homo sapiens
ggctttacattttatt

SEQ ID NO: 6332375 - DNA, 14 bp, Homo sapiens
ggctttagaagaga

SEQ ID NO: 6332376 - DNA, 13 bp, Homo sapiens
ggctttagacact

SEQ ID NO: 6332377 - DNA, 18 bp, Homo sapiens
ggctttatcctctttaga

SEQ ID NO: 6332378 - DNA, 20 bp, Homo sapiens
ggctttatcctctttagagt

SEQ ID NO: 6332379 - DNA, 21 bp, Homo sapiens
ggctttatcctctttagagtt

SEQ ID NO: 6332380 - DNA, 20 bp, Homo sapiens
ggctttatgataatagattc

SEQ ID NO: 6332381 - DNA, 15 bp, Homo sapiens
ggctttatgctgtgt

SEQ ID NO: 6332382 - DNA, 22 bp, Homo sapiens
ggctttatttttttgaactctt

SEQ ID NO: 6332383 - DNA, 18 bp, Homo sapiens
ggctttcaaggctggggc

SEQ ID NO: 6332384 - DNA, 19 bp, Homo sapiens
ggctttcaaggctggggca

SEQ ID NO: 6332385 - DNA, 18 bp, Homo sapiens
ggctttcaattgtatttt

SEQ ID NO: 6332386 - DNA, 16 bp, Homo sapiens
ggctttcactgctgag

SEQ ID NO: 6332387 - DNA, 19 bp, Homo sapiens
ggctttcagaaaacgggaa

SEQ ID NO: 6332388 - DNA, 13 bp, Homo sapiens
ggctttcagctta

SEQ ID NO: 6332389 - DNA, 22 bp, Homo sapiens
ggctttcagtgatatctttctc

SEQ ID NO: 6332390 - DNA, 23 bp, Homo sapiens
ggctttcatcctgtgtcccctga

SEQ ID NO: 6332391 - DNA, 24 bp, Homo sapiens
ggctttccagaaggccacaggcca

SEQ ID NO: 6332392 - DNA, 14 bp, Homo sapiens
ggctttcccaggag

SEQ ID NO: 6332393 - DNA, 21 bp, Homo sapiens
ggctttcgtccacagcttcct

SEQ ID NO: 6332394 - DNA, 22 bp, Homo sapiens
ggctttcgtccacagcttcctg

SEQ ID NO: 6332395 - DNA, 23 bp, Homo sapiens
ggctttcgtccacagcttcctgt

SEQ ID NO: 6332396 - DNA, 13 bp, Homo sapiens
ggctttctcctgg

SEQ ID NO: 6332397 - DNA, 16 bp, Homo sapiens
ggctttctcctggaga

SEQ ID NO: 6332398 - DNA, 12 bp, Homo sapiens
ggctttctctct

SEQ ID NO: 6332399 - DNA, 14 bp, Homo sapiens
ggctttctctgcct

SEQ ID NO: 6332400 - DNA, 18 bp, Homo sapiens
ggctttctctgcctctgg

SEQ ID NO: 6332401 - DNA, 16 bp, Homo sapiens
ggctttctcttcccct

SEQ ID NO: 6332402 - DNA, 21 bp, Homo sapiens
ggctttctcttccccttcctg

SEQ ID NO: 6332403 - DNA, 17 bp, Homo sapiens
ggctttctgggctctgg

SEQ ID NO: 6332404 - DNA, 15 bp, Homo sapiens
ggctttgcagggaga

SEQ ID NO: 6332405 - DNA, 19 bp, Homo sapiens
ggctttgcagggagaccag

SEQ ID NO: 6332406 - DNA, 14 bp, Homo sapiens
ggctttgcatttct

SEQ ID NO: 6332407 - DNA, 18 bp, Homo sapiens
ggctttgccatgggcctg

SEQ ID NO: 6332408 - DNA, 18 bp, Homo sapiens
ggctttgcccacccctca

SEQ ID NO: 6332409 - DNA, 12 bp, Homo sapiens
ggctttgcctct

SEQ ID NO: 6332410 - DNA, 13 bp, Homo sapiens
ggctttgcctctt

SEQ ID NO: 6332411 - DNA, 19 bp, Homo sapiens
ggctttgcctcttctttgt

SEQ ID NO: 6332412 - DNA, 22 bp, Homo sapiens
ggctttgccttgcagccacatg

SEQ ID NO: 6332413 - DNA, 19 bp, Homo sapiens
ggctttgggaaagcccaga

SEQ ID NO: 6332414 - DNA, 14 bp, Homo sapiens
ggctttgggtagtg

SEQ ID NO: 6332415 - DNA, 21 bp, Homo sapiens
ggctttgggtggctcactact

SEQ ID NO: 6332416 - DNA, 18 bp, Homo sapiens
ggctttggttccttctct

SEQ ID NO: 6332417 - DNA, 18 bp, Homo sapiens
ggctttgtcccacagctt

SEQ ID NO: 6332418 - DNA, 14 bp, Homo sapiens
ggctttgtcttgaa

SEQ ID NO: 6332419 - DNA, 14 bp, Homo sapiens
ggctttgtgagaga

SEQ ID NO: 6332420 - DNA, 16 bp, Homo sapiens
ggctttgtgagagagg

SEQ ID NO: 6332421 - DNA, 17 bp, Homo sapiens
ggctttgtgagagagga

SEQ ID NO: 6332422 - DNA, 18 bp, Homo sapiens
ggctttgtgagagaggac

SEQ ID NO: 6332423 - DNA, 22 bp, Homo sapiens
ggctttgtgagagaggacctcc

SEQ ID NO: 6332424 - DNA, 20 bp, Homo sapiens
ggctttgtggcatgtgcctg

SEQ ID NO: 6332425 - DNA, 17 bp, Homo sapiens
ggctttgtgtctggcca

SEQ ID NO: 6332426 - DNA, 14 bp, Homo sapiens
ggctttgttgctgg

SEQ ID NO: 6332427 - DNA, 23 bp, Homo sapiens
ggcttttaccattagcataattt

SEQ ID NO: 6332428 - DNA, 19 bp, Homo sapiens
ggcttttattaatgcactt

SEQ ID NO: 6332429 - DNA, 22 bp, Homo sapiens
ggcttttattttttaagttcaa

SEQ ID NO: 6332430 - DNA, 23 bp, Homo sapiens
ggcttttattttttaagttcaat

SEQ ID NO: 6332431 - DNA, 19 bp, Homo sapiens
ggcttttcaccccagagga

SEQ ID NO: 6332432 - DNA, 13 bp, Homo sapiens
ggcttttcactgc

SEQ ID NO: 6332433 - DNA, 22 bp, Homo sapiens
ggcttttcactgcctgtagaga

SEQ ID NO: 6332434 - DNA, 15 bp, Homo sapiens
ggcttttcactgctg

SEQ ID NO: 6332435 - DNA, 13 bp, Homo sapiens
ggcttttccagtg

SEQ ID NO: 6332436 - DNA, 17 bp, Homo sapiens
ggcttttcccaccagct

SEQ ID NO: 6332437 - DNA, 21 bp, Homo sapiens
ggcttttcccaccagctccca

SEQ ID NO: 6332438 - DNA, 20 bp, Homo sapiens
ggcttttcgcttgcttctgc

SEQ ID NO: 6332439 - DNA, 21 bp, Homo sapiens
ggcttttcgcttgcttctgca

SEQ ID NO: 6332440 - DNA, 22 bp, Homo sapiens
ggcttttcgcttgcttctgcag

SEQ ID NO: 6332441 - DNA, 19 bp, Homo sapiens
ggcttttctctttcctcta

SEQ ID NO: 6332442 - DNA, 17 bp, Homo sapiens
ggcttttctgatccagt

SEQ ID NO: 6332443 - DNA, 20 bp, Homo sapiens
ggcttttcttggccaacaga

SEQ ID NO: 6332444 - DNA, 19 bp, Homo sapiens
ggcttttgcttggcagaga

SEQ ID NO: 6332445 - DNA, 16 bp, Homo sapiens
ggcttttggtggtccc

SEQ ID NO: 6332446 - DNA, 17 bp, Homo sapiens
ggcttttgtgccaggag

SEQ ID NO: 6332447 - DNA, 17 bp, Homo sapiens
ggcttttgttttgcttt

SEQ ID NO: 6332448 - DNA, 20 bp, Homo sapiens
ggctttttaatggaaaccaa

SEQ ID NO: 6332449 - DNA, 22 bp, Homo sapiens
ggctttttactattaacatgat

SEQ ID NO: 6332450 - DNA, 12 bp, Homo sapiens
ggctttttccaa

SEQ ID NO: 6332451 - DNA, 20 bp, Homo sapiens
ggctttttcctctgagccca

SEQ ID NO: 6332452 - DNA, 23 bp, Homo sapiens
ggctttttgtcaaataaaatgaa

SEQ ID NO: 6332453 - DNA, 19 bp, Homo sapiens
gggaaaaaaaagaaaaaat

SEQ ID NO: 6332454 - DNA, 21 bp, Homo sapiens
gggaaaaaaaatgtagcgaca

SEQ ID NO: 6332455 - DNA, 20 bp, Homo sapiens
gggaaaaaaacttggcactt

SEQ ID NO: 6332456 - DNA, 16 bp, Homo sapiens
gggaaaaaaagaaaaa

SEQ ID NO: 6332457 - DNA, 20 bp, Homo sapiens
gggaaaaaacttaaaaatta

SEQ ID NO: 6332458 - DNA, 21 bp, Homo sapiens
gggaaaaaagttttgatgaaa

SEQ ID NO: 6332459 - DNA, 16 bp, Homo sapiens
gggaaaaactggcttt

SEQ ID NO: 6332460 - DNA, 12 bp, Homo sapiens
gggaaaaaggct

SEQ ID NO: 6332461 - DNA, 20 bp, Homo sapiens
gggaaaaagttgatgtcaat

SEQ ID NO: 6332462 - DNA, 22 bp, Homo sapiens
gggaaaaatgcaaaaaagaaac

SEQ ID NO: 6332463 - DNA, 15 bp, Homo sapiens
gggaaaacacagatg

SEQ ID NO: 6332464 - DNA, 21 bp, Homo sapiens
gggaaaacacggccctcctgg

SEQ ID NO: 6332465 - DNA, 16 bp, Homo sapiens
gggaaaacagaggaat

SEQ ID NO: 6332466 - DNA, 16 bp, Homo sapiens
gggaaaacataatatc

SEQ ID NO: 6332467 - DNA, 16 bp, Homo sapiens
gggaaaagaagctgtc

SEQ ID NO: 6332468 - DNA, 17 bp, Homo sapiens
gggaaaagaccagggct

SEQ ID NO: 6332469 - DNA, 23 bp, Homo sapiens
gggaaaagggaacaggaaaagaa

SEQ ID NO: 6332470 - DNA, 13 bp, Homo sapiens
gggaaaagggcag

SEQ ID NO: 6332471 - DNA, 13 bp, Homo sapiens
gggaaaatatttc

SEQ ID NO: 6332472 - DNA, 13 bp, Homo sapiens
gggaaaatcagcc

SEQ ID NO: 6332473 - DNA, 23 bp, Homo sapiens
gggaaaatcagcctgctccagct

SEQ ID NO: 6332474 - DNA, 20 bp, Homo sapiens
gggaaaatggccatgcagga

SEQ ID NO: 6332475 - DNA, 16 bp, Homo sapiens
gggaaaatgtgaagct

SEQ ID NO: 6332476 - DNA, 13 bp, Homo sapiens
gggaaaattagct

SEQ ID NO: 6332477 - DNA, 19 bp, Homo sapiens
gggaaacaatgaaaacaaa

SEQ ID NO: 6332478 - DNA, 16 bp, Homo sapiens
gggaaacactccttgc

SEQ ID NO: 6332479 - DNA, 22 bp, Homo sapiens
gggaaacagcatctccaagcag

SEQ ID NO: 6332480 - DNA, 14 bp, Homo sapiens
gggaaacagcctct

SEQ ID NO: 6332481 - DNA, 15 bp, Homo sapiens
gggaaacagcctctc

SEQ ID NO: 6332482 - DNA, 14 bp, Homo sapiens
gggaaacagggagc

SEQ ID NO: 6332483 - DNA, 21 bp, Homo sapiens
gggaaaccctggagccatccc

SEQ ID NO: 6332484 - DNA, 22 bp, Homo sapiens
gggaaacctgcctttgtatgtg

SEQ ID NO: 6332485 - DNA, 15 bp, Homo sapiens
gtgctccctaccacc

SEQ ID NO: 6332486 - DNA, 13 bp, Homo sapiens
gtgctccctccca

SEQ ID NO: 6332487 - DNA, 13 bp, Homo sapiens
gtgctccctctgt

SEQ ID NO: 6332488 - DNA, 14 bp, Homo sapiens
gtgctccctggagg

SEQ ID NO: 6332489 - DNA, 18 bp, Homo sapiens
gtgctccctggaggcacg

SEQ ID NO: 6332490 - DNA, 17 bp, Homo sapiens
gtgctccgtagctctgc

SEQ ID NO: 6332491 - DNA, 22 bp, Homo sapiens
gtgctccgtagctctgctgctg

SEQ ID NO: 6332492 - DNA, 13 bp, Homo sapiens
gtgctcctctgcc

SEQ ID NO: 6332493 - DNA, 21 bp, Homo sapiens
gtgctcctcttgattcctggt

SEQ ID NO: 6332494 - DNA, 13 bp, Homo sapiens
gtgctcctgccca

SEQ ID NO: 6332495 - DNA, 16 bp, Homo sapiens
gtgctcctgcccagcc

SEQ ID NO: 6332496 - DNA, 16 bp, Homo sapiens
gtgctccttttctctt

SEQ ID NO: 6332497 - DNA, 16 bp, Homo sapiens
gtgctcgcagcctggc

SEQ ID NO: 6332498 - DNA, 14 bp, Homo sapiens
gtgctcgccccagc

SEQ ID NO: 6332499 - DNA, 16 bp, Homo sapiens
gtgctcgccccagcag

SEQ ID NO: 6332500 - DNA, 14 bp, Homo sapiens
gtgctcgccctgcg

SEQ ID NO: 6332501 - DNA, 14 bp, Homo sapiens
gtgctcgcctctgc

SEQ ID NO: 6332502 - DNA, 22 bp, Homo sapiens
gtgctcggacacagttttgtct

SEQ ID NO: 6332503 - DNA, 15 bp, Homo sapiens
gtgctcgggatcaaa

SEQ ID NO: 6332504 - DNA, 13 bp, Homo sapiens
gtgctctccattc

SEQ ID NO: 6332505 - DNA, 13 bp, Homo sapiens
gtgctctctgcca

SEQ ID NO: 6332506 - DNA, 16 bp, Homo sapiens
gtgctctgatcatcca

SEQ ID NO: 6332507 - DNA, 16 bp, Homo sapiens
gtgctctggacaggca

SEQ ID NO: 6332508 - DNA, 18 bp, Homo sapiens
gtgctctggacaggcatg

SEQ ID NO: 6332509 - DNA, 11 bp, Homo sapiens
gtgctctggcg

SEQ ID NO: 6332510 - DNA, 19 bp, Homo sapiens
gtgctctggcggcttcctg

SEQ ID NO: 6332511 - DNA, 22 bp, Homo sapiens
gtgctctggggatttctgggat

SEQ ID NO: 6332512 - DNA, 16 bp, Homo sapiens
gtgctctgtaaaacac

SEQ ID NO: 6332513 - DNA, 14 bp, Homo sapiens
gtgctctgtaacat

SEQ ID NO: 6332514 - DNA, 15 bp, Homo sapiens
gtgctctgtccttgt

SEQ ID NO: 6332515 - DNA, 13 bp, Homo sapiens
gtgctctgtgtca

SEQ ID NO: 6332516 - DNA, 17 bp, Homo sapiens
gtgctcttatccccagc

SEQ ID NO: 6332517 - DNA, 19 bp, Homo sapiens
gtgctcttcccactccagc

SEQ ID NO: 6332518 - DNA, 15 bp, Homo sapiens
gtgctcttcctctgg

SEQ ID NO: 6332519 - DNA, 17 bp, Homo sapiens
gtgctcttcctctggtt

SEQ ID NO: 6332520 - DNA, 17 bp, Homo sapiens
gtgctcttctgttctca

SEQ ID NO: 6332521 - DNA, 15 bp, Homo sapiens
gtgctctttcctgcc

SEQ ID NO: 6332522 - DNA, 16 bp, Homo sapiens
gtgctctttgtagcta

SEQ ID NO: 6332523 - DNA, 18 bp, Homo sapiens
gtgctctttgttcatcat

SEQ ID NO: 6332524 - DNA, 16 bp, Homo sapiens
gtgctctttgttttgt

SEQ ID NO: 6332525 - DNA, 20 bp, Homo sapiens
gtgctcttttctcctcactg

SEQ ID NO: 6332526 - DNA, 21 bp, Homo sapiens
gtgctgaacagtggaggaaga

SEQ ID NO: 6332527 - DNA, 16 bp, Homo sapiens
gtgctgaacgacagtc

SEQ ID NO: 6332528 - DNA, 21 bp, Homo sapiens
gtgctgaagcttattaatgct

SEQ ID NO: 6332529 - DNA, 18 bp, Homo sapiens
gtgctgacaacttagctc

SEQ ID NO: 6332530 - DNA, 21 bp, Homo sapiens
gtgctgacaacttagctcagg

SEQ ID NO: 6332531 - DNA, 13 bp, Homo sapiens
gtgctgaccccag

SEQ ID NO: 6332532 - DNA, 15 bp, Homo sapiens
gtgctgacggaagcc

SEQ ID NO: 6332533 - DNA, 21 bp, Homo sapiens
gtgctgactaactataagcat

SEQ ID NO: 6332534 - DNA, 14 bp, Homo sapiens
gtgctgactgaaca

SEQ ID NO: 6332535 - DNA, 15 bp, Homo sapiens
gtgctgactgaacat

SEQ ID NO: 6332536 - DNA, 18 bp, Homo sapiens
gtgctgactgaggcctgc

SEQ ID NO: 6332537 - DNA, 11 bp, Homo sapiens
gtgctgagaag

SEQ ID NO: 6332538 - DNA, 14 bp, Homo sapiens
gtgctgagaagctt

SEQ ID NO: 6332539 - DNA, 21 bp, Homo sapiens
gtgctgagcacacaacaggct

SEQ ID NO: 6332540 - DNA, 15 bp, Homo sapiens
gtgctgagcctgccc

SEQ ID NO: 6332541 - DNA, 16 bp, Homo sapiens
gtgctgagcctgccca

SEQ ID NO: 6332542 - DNA, 13 bp, Homo sapiens
gtgctgagctgac

SEQ ID NO: 6332543 - DNA, 18 bp, Homo sapiens
gtgctgagcttagccttg

SEQ ID NO: 6332544 - DNA, 15 bp, Homo sapiens
gtgctgaggtgggcc

SEQ ID NO: 6332545 - DNA, 19 bp, Homo sapiens
gtgctgaggtgggccttcc

SEQ ID NO: 6332546 - DNA, 18 bp, Homo sapiens
gtgctgagtctgaaggct

SEQ ID NO: 6332547 - DNA, 19 bp, Homo sapiens
gtgctgagtctgaaggctg

SEQ ID NO: 6332548 - DNA, 21 bp, Homo sapiens
gtgctgagtgtacagagtgga

SEQ ID NO: 6332549 - DNA, 23 bp, Homo sapiens
gtgctgagttggtgttgacatgt

SEQ ID NO: 6332550 - DNA, 15 bp, Homo sapiens
gtgctgatccggctg

SEQ ID NO: 6332551 - DNA, 20 bp, Homo sapiens
gtgctgatccggctgctcct

SEQ ID NO: 6332552 - DNA, 21 bp, Homo sapiens
gtgctgatcctaagaattttt

SEQ ID NO: 6332553 - DNA, 14 bp, Homo sapiens
gtgctgatcctgct

SEQ ID NO: 6332554 - DNA, 15 bp, Homo sapiens
gtgctgatcctgctg

SEQ ID NO: 6332555 - DNA, 20 bp, Homo sapiens
gtgctgatcgtgctaaattt

SEQ ID NO: 6332556 - DNA, 11 bp, Homo sapiens
gtgctgatgga

SEQ ID NO: 6332557 - DNA, 12 bp, Homo sapiens
gtgctgatggcc

SEQ ID NO: 6332558 - DNA, 17 bp, Homo sapiens
gtgctgatgggaaggag

SEQ ID NO: 6332559 - DNA, 23 bp, Homo sapiens
gtgctgatgggaaggaggggagc

SEQ ID NO: 6332560 - DNA, 22 bp, Homo sapiens
gtgctgattcaaaccaaagctg

SEQ ID NO: 6332561 - DNA, 18 bp, Homo sapiens
gtgctgcaattgagggct

SEQ ID NO: 6332562 - DNA, 19 bp, Homo sapiens
gtgctgcacaaaagcagat

SEQ ID NO: 6332563 - DNA, 18 bp, Homo sapiens
gtgctgcacccctggtgt

SEQ ID NO: 6332564 - DNA, 15 bp, Homo sapiens
gtgctgcagatttga

SEQ ID NO: 6332565 - DNA, 22 bp, Homo sapiens
gtgctgcagatttgatatttgc

SEQ ID NO: 6332566 - DNA, 22 bp, Homo sapiens
gtgctgcagcaccgaggggcct

SEQ ID NO: 6332567 - DNA, 16 bp, Homo sapiens
gtgctgcagccaaaga

SEQ ID NO: 6332568 - DNA, 18 bp, Homo sapiens
gtgctgcagctccctggc

SEQ ID NO: 6332569 - DNA, 23 bp, Homo sapiens
gtgctgcaggagtgtcctgccca

SEQ ID NO: 6332570 - DNA, 20 bp, Homo sapiens
gtgctgcatccctgtgtcca

SEQ ID NO: 6332571 - DNA, 21 bp, Homo sapiens
gtgctgcattgagtccagctt

SEQ ID NO: 6332572 - DNA, 16 bp, Homo sapiens
gtgctgccaacttgat

SEQ ID NO: 6332573 - DNA, 21 bp, Homo sapiens
gtgctgccacacttcaggctc

SEQ ID NO: 6332574 - DNA, 22 bp, Homo sapiens
gtgctgccaccccttggcactg

SEQ ID NO: 6332575 - DNA, 17 bp, Homo sapiens
gtgctgccacctgcccc

SEQ ID NO: 6332576 - DNA, 13 bp, Homo sapiens
gtgctgccagtca

SEQ ID NO: 6332577 - DNA, 16 bp, Homo sapiens
gtgctgccatgccact

SEQ ID NO: 6332578 - DNA, 21 bp, Homo sapiens
gtgctgccatgccactgccag

SEQ ID NO: 6332579 - DNA, 21 bp, Homo sapiens
gtgctgccatttgatttttct

SEQ ID NO: 6332580 - DNA, 14 bp, Homo sapiens
gtgctgccccttgc

SEQ ID NO: 6332581 - DNA, 17 bp, Homo sapiens
gtgctgccccttgcaag

SEQ ID NO: 6332582 - DNA, 19 bp, Homo sapiens
gtgctgccccttgcaagcc

SEQ ID NO: 6332583 - DNA, 21 bp, Homo sapiens
gtgctgcccgtcttcagccta

SEQ ID NO: 6332584 - DNA, 11 bp, Homo sapiens
gtgctgccctg

SEQ ID NO: 6332585 - DNA, 23 bp, Homo sapiens
gtgctgccctgcccacctggcct

SEQ ID NO: 6332586 - DNA, 14 bp, Homo sapiens
gtgctgccctgctc

SEQ ID NO: 6332587 - DNA, 19 bp, Homo sapiens
gtgctgccctgctctgggg

SEQ ID NO: 6332588 - DNA, 13 bp, Homo sapiens
gtgctgccctgtg

SEQ ID NO: 6332589 - DNA, 14 bp, Homo sapiens
gtgctgccctgtgt

SEQ ID NO: 6332590 - DNA, 15 bp, Homo sapiens
gtgctgccctgtgta

SEQ ID NO: 6332591 - DNA, 23 bp, Homo sapiens
gtgctgccctgttgccgagccca

SEQ ID NO: 6332592 - DNA, 15 bp, Homo sapiens
gtgctgccgagggct

SEQ ID NO: 6332593 - DNA, 19 bp, Homo sapiens
gtgctgccgagggctggcc

SEQ ID NO: 6332594 - DNA, 21 bp, Homo sapiens
gtgctgccgagggctggccgg

SEQ ID NO: 6332595 - DNA, 21 bp, Homo sapiens
gtgctgcctggccctccccac

SEQ ID NO: 6332596 - DNA, 22 bp, Homo sapiens
gtgctgcctggccctccccaca

SEQ ID NO: 6332597 - DNA, 23 bp, Homo sapiens
gtgctgccttgtagatggagcaa

SEQ ID NO: 6332598 - DNA, 20 bp, Homo sapiens
gtgctgcgatgggggatcag

SEQ ID NO: 6332599 - DNA, 22 bp, Homo sapiens
gtgctgcggtcactcaggcctc

SEQ ID NO: 6332600 - DNA, 15 bp, Homo sapiens
gtgctgctaattctt

SEQ ID NO: 6332601 - DNA, 18 bp, Homo sapiens
gtgctgctaattctttgc

SEQ ID NO: 6332602 - DNA, 19 bp, Homo sapiens
gtgctgctaattctttgca

SEQ ID NO: 6332603 - DNA, 22 bp, Homo sapiens
gtgctgctaccctccctgctgt

SEQ ID NO: 6332604 - DNA, 11 bp, Homo sapiens
gtgctgctcaa

SEQ ID NO: 6332605 - DNA, 17 bp, Homo sapiens
gtgctgctctagggcag

SEQ ID NO: 6332606 - DNA, 12 bp, Homo sapiens
gtgctgctgagt

SEQ ID NO: 6332607 - DNA, 16 bp, Homo sapiens
gtgctgctgctgctat

SEQ ID NO: 6332608 - DNA, 15 bp, Homo sapiens
gtgctgctgttctgt

SEQ ID NO: 6332609 - DNA, 17 bp, Homo sapiens
gtgctgcttacactcca

SEQ ID NO: 6332610 - DNA, 19 bp, Homo sapiens
gtgctgcttacactccagg

SEQ ID NO: 6332611 - DNA, 16 bp, Homo sapiens
gtgctgcttccctctg

SEQ ID NO: 6332612 - DNA, 12 bp, Homo sapiens
gtgctgctttga

SEQ ID NO: 6332613 - DNA, 20 bp, Homo sapiens
gtgctgcttttgagcctcag

SEQ ID NO: 6332614 - DNA, 19 bp, Homo sapiens
gtgctggaaggacaaataa

SEQ ID NO: 6332615 - DNA, 15 bp, Homo sapiens
gtgctggaagggagg

SEQ ID NO: 6332616 - DNA, 21 bp, Homo sapiens
gtgctggaagtctccatgaag

SEQ ID NO: 6332617 - DNA, 19 bp, Homo sapiens
gtgctggaattccacaggg

SEQ ID NO: 6332618 - DNA, 22 bp, Homo sapiens
gtgctggagcactgggctcccg

SEQ ID NO: 6332619 - DNA, 18 bp, Homo sapiens
gtgctggagccactaact

SEQ ID NO: 6332620 - DNA, 16 bp, Homo sapiens
gtgctggagctggctt

SEQ ID NO: 6332621 - DNA, 20 bp, Homo sapiens
gtgctggaggattttccagt

SEQ ID NO: 6332622 - DNA, 23 bp, Homo sapiens
gtgctggaggggtggcccagagc

SEQ ID NO: 6332623 - DNA, 21 bp, Homo sapiens
gtgctggaggtgggagcagga

SEQ ID NO: 6332624 - DNA, 24 bp, Homo sapiens
gtgctggaggtgggagcaggagat

SEQ ID NO: 6332625 - DNA, 20 bp, Homo sapiens
gtgctggatggagcccaggc

SEQ ID NO: 6332626 - DNA, 15 bp, Homo sapiens
gtgctggcaaccact

SEQ ID NO: 6332627 - DNA, 18 bp, Homo sapiens
gtgctggcaccaccaggc

SEQ ID NO: 6332628 - DNA, 15 bp, Homo sapiens
gtgctggccagcgag

SEQ ID NO: 6332629 - DNA, 14 bp, Homo sapiens
gtgctggcccagca

SEQ ID NO: 6332630 - DNA, 14 bp, Homo sapiens
gtgctggcccccag

SEQ ID NO: 6332631 - DNA, 14 bp, Homo sapiens
gtgctggccttggt

SEQ ID NO: 6332632 - DNA, 17 bp, Homo sapiens
gtgctggcgacactcag

SEQ ID NO: 6332633 - DNA, 16 bp, Homo sapiens
gtgctggcggacgcag

SEQ ID NO: 6332634 - DNA, 14 bp, Homo sapiens
gtgctggctcacag

SEQ ID NO: 6332635 - DNA, 20 bp, Homo sapiens
gtgctggctcacagtacagc

SEQ ID NO: 6332636 - DNA, 14 bp, Homo sapiens
gtgctggctgctgg

SEQ ID NO: 6332637 - DNA, 20 bp, Homo sapiens
gtgctggcttccgctgtcac

SEQ ID NO: 6332638 - DNA, 20 bp, Homo sapiens
gtgctgggaacctcagggta

SEQ ID NO: 6332639 - DNA, 17 bp, Homo sapiens
gtgctgggaagcccgga

SEQ ID NO: 6332640 - DNA, 19 bp, Homo sapiens
gtgctgggaagcccggact

SEQ ID NO: 6332641 - DNA, 17 bp, Homo sapiens
gtgctgggacagctagg

SEQ ID NO: 6332642 - DNA, 12 bp, Homo sapiens
gtgctgggacca

SEQ ID NO: 6332643 - DNA, 17 bp, Homo sapiens
gtgctgggaccagagcc

SEQ ID NO: 6332644 - DNA, 20 bp, Homo sapiens
gtgctgggaccagagccaga

SEQ ID NO: 6332645 - DNA, 18 bp, Homo sapiens
gtgctgggactgagccag

SEQ ID NO: 6332646 - DNA, 19 bp, Homo sapiens
gtgctgggactgagccagt

SEQ ID NO: 6332647 - DNA, 17 bp, Homo sapiens
gtgctgggagaaatact

SEQ ID NO: 6332648 - DNA, 14 bp, Homo sapiens
gtgctgggagatgc

SEQ ID NO: 6332649 - DNA, 22 bp, Homo sapiens
gtgctgggagatgctctctgag

SEQ ID NO: 6332650 - DNA, 22 bp, Homo sapiens
gtgctgggagctccactctgct

SEQ ID NO: 6332651 - DNA, 18 bp, Homo sapiens
gtgctgggaggagggaga

SEQ ID NO: 6332652 - DNA, 15 bp, Homo sapiens
gtgctgggagggata

SEQ ID NO: 6332653 - DNA, 16 bp, Homo sapiens
gtgctgggaggtccca

SEQ ID NO: 6332654 - DNA, 22 bp, Homo sapiens
gtgctgggattacaagcgtgag

SEQ ID NO: 6332655 - DNA, 16 bp, Homo sapiens
gtgctgggattacagg

SEQ ID NO: 6332656 - DNA, 20 bp, Homo sapiens
gtgctgggattacaggtgtg

SEQ ID NO: 6332657 - DNA, 21 bp, Homo sapiens
gtgctgggattacaggtgtga

SEQ ID NO: 6332658 - DNA, 15 bp, Homo sapiens
gtgctgggcactgct

SEQ ID NO: 6332659 - DNA, 18 bp, Homo sapiens
gtgctgggcactgctcca

SEQ ID NO: 6332660 - DNA, 12 bp, Homo sapiens
gtgctgggcaga

SEQ ID NO: 6332661 - DNA, 11 bp, Homo sapiens
gtgctgggccc

SEQ ID NO: 6332662 - DNA, 15 bp, Homo sapiens
gtgctgggcccagcc

SEQ ID NO: 6332663 - DNA, 16 bp, Homo sapiens
gtgctgggcccagccg

SEQ ID NO: 6332664 - DNA, 19 bp, Homo sapiens
gggaaaccttggagaggag

SEQ ID NO: 6332665 - DNA, 21 bp, Homo sapiens
gggaaactaaggtcagaaggg

SEQ ID NO: 6332666 - DNA, 18 bp, Homo sapiens
gggaaactctggagagcc

SEQ ID NO: 6332667 - DNA, 17 bp, Homo sapiens
gggaaactgagggcaga

SEQ ID NO: 6332668 - DNA, 12 bp, Homo sapiens
gggaaactggct

SEQ ID NO: 6332669 - DNA, 16 bp, Homo sapiens
gggaaactgggaaact

SEQ ID NO: 6332670 - DNA, 14 bp, Homo sapiens
gggaaactgtgaat

SEQ ID NO: 6332671 - DNA, 22 bp, Homo sapiens
gggaaactgtgaatgcttctga

SEQ ID NO: 6332672 - DNA, 13 bp, Homo sapiens
gggaaagaagaaa

SEQ ID NO: 6332673 - DNA, 15 bp, Homo sapiens
gggaaagaagggatc

SEQ ID NO: 6332674 - DNA, 17 bp, Homo sapiens
gggaaagacactgcctg

SEQ ID NO: 6332675 - DNA, 18 bp, Homo sapiens
gggaaagacactgcctgg

SEQ ID NO: 6332676 - DNA, 13 bp, Homo sapiens
gggaaagagaaag

SEQ ID NO: 6332677 - DNA, 14 bp, Homo sapiens
gggaaagcaaagca

SEQ ID NO: 6332678 - DNA, 16 bp, Homo sapiens
gggaaagccagcctgg

SEQ ID NO: 6332679 - DNA, 17 bp, Homo sapiens
gggaaagccagcctggg

SEQ ID NO: 6332680 - DNA, 21 bp, Homo sapiens
gggaaagccagcctgggggct

SEQ ID NO: 6332681 - DNA, 19 bp, Homo sapiens
gggaaagccagtgactcca

SEQ ID NO: 6332682 - DNA, 16 bp, Homo sapiens
gggaaagcccctgccc

SEQ ID NO: 6332683 - DNA, 14 bp, Homo sapiens
gggaaagcctctgg

SEQ ID NO: 6332684 - DNA, 17 bp, Homo sapiens
gggaaagcctctggccg

SEQ ID NO: 6332685 - DNA, 18 bp, Homo sapiens
gggaaagcgggcagcccc

SEQ ID NO: 6332686 - DNA, 13 bp, Homo sapiens
gggaaagctccac

SEQ ID NO: 6332687 - DNA, 19 bp, Homo sapiens
gggaaaggaaaaccaggga

SEQ ID NO: 6332688 - DNA, 22 bp, Homo sapiens
gggaaaggaaaaccagggatag

SEQ ID NO: 6332689 - DNA, 19 bp, Homo sapiens
gggaaaggaatcaattatt

SEQ ID NO: 6332690 - DNA, 16 bp, Homo sapiens
gggaaaggacccaccc

SEQ ID NO: 6332691 - DNA, 15 bp, Homo sapiens
gggaaaggatatttt

SEQ ID NO: 6332692 - DNA, 16 bp, Homo sapiens
gggaaaggcagggccc

SEQ ID NO: 6332693 - DNA, 12 bp, Homo sapiens
gggaaaggccgg

SEQ ID NO: 6332694 - DNA, 18 bp, Homo sapiens
gggaaagggaggaagata

SEQ ID NO: 6332695 - DNA, 16 bp, Homo sapiens
gggaaagggctggctg

SEQ ID NO: 6332696 - DNA, 17 bp, Homo sapiens
gggaaagggctggctgc

SEQ ID NO: 6332697 - DNA, 21 bp, Homo sapiens
gggaaagggctggctgcaatt

SEQ ID NO: 6332698 - DNA, 20 bp, Homo sapiens
gggaaaggggttggggtgac

SEQ ID NO: 6332699 - DNA, 20 bp, Homo sapiens
gggaaagggtcctgctttct

SEQ ID NO: 6332700 - DNA, 16 bp, Homo sapiens
gggaaaggtgctcaaa

SEQ ID NO: 6332701 - DNA, 18 bp, Homo sapiens
gggaaaggtgctcaaaga

SEQ ID NO: 6332702 - DNA, 19 bp, Homo sapiens
gggaaaggtgctcaaagat

SEQ ID NO: 6332703 - DNA, 21 bp, Homo sapiens
gggaaagtattctcttttcaa

SEQ ID NO: 6332704 - DNA, 13 bp, Homo sapiens
gggaaagtatttt

SEQ ID NO: 6332705 - DNA, 20 bp, Homo sapiens
gggaaagtatttttgaaaga

SEQ ID NO: 6332706 - DNA, 20 bp, Homo sapiens
gggaaagtgcatatgaaatc

SEQ ID NO: 6332707 - DNA, 15 bp, Homo sapiens
gggaaatagcggccc

SEQ ID NO: 6332708 - DNA, 16 bp, Homo sapiens
gggaaatagcggccct

SEQ ID NO: 6332709 - DNA, 18 bp, Homo sapiens
gggaaatagcggccctgg

SEQ ID NO: 6332710 - DNA, 23 bp, Homo sapiens
gggaaatatatacaaaaagaaaa

SEQ ID NO: 6332711 - DNA, 21 bp, Homo sapiens
gggaaatatgccactgaccga

SEQ ID NO: 6332712 - DNA, 22 bp, Homo sapiens
gggaaatcaaaagggccaaaga

SEQ ID NO: 6332713 - DNA, 23 bp, Homo sapiens
gggaaatcgagtgccgcatctca

SEQ ID NO: 6332714 - DNA, 11 bp, Homo sapiens
gggaaatgtgg

SEQ ID NO: 6332715 - DNA, 19 bp, Homo sapiens
gggaaattattatgactca

SEQ ID NO: 6332716 - DNA, 12 bp, Homo sapiens
gggaaattcagt

SEQ ID NO: 6332717 - DNA, 17 bp, Homo sapiens
gggaaattgaagtgtct

SEQ ID NO: 6332718 - DNA, 11 bp, Homo sapiens
gggaaattttt

SEQ ID NO: 6332719 - DNA, 21 bp, Homo sapiens
gggaacaaatcacacctctgg

SEQ ID NO: 6332720 - DNA, 22 bp, Homo sapiens
gggaacaaatcacacctctggg

SEQ ID NO: 6332721 - DNA, 14 bp, Homo sapiens
gggaacaaggaagg

SEQ ID NO: 6332722 - DNA, 17 bp, Homo sapiens
gggaacaagtgtacaga

SEQ ID NO: 6332723 - DNA, 21 bp, Homo sapiens
gggaacaatttggcaattttg

SEQ ID NO: 6332724 - DNA, 17 bp, Homo sapiens
gggaacacagtgcccca

SEQ ID NO: 6332725 - DNA, 13 bp, Homo sapiens
gggaacacctgct

SEQ ID NO: 6332726 - DNA, 21 bp, Homo sapiens
gggaacactgagaaagaggca

SEQ ID NO: 6332727 - DNA, 15 bp, Homo sapiens
gggaacactggcctg

SEQ ID NO: 6332728 - DNA, 14 bp, Homo sapiens
gggaacagacagga

SEQ ID NO: 6332729 - DNA, 15 bp, Homo sapiens
gggaacagacaggag

SEQ ID NO: 6332730 - DNA, 13 bp, Homo sapiens
gggaacagaccag

SEQ ID NO: 6332731 - DNA, 14 bp, Homo sapiens
gggaacagactgga

SEQ ID NO: 6332732 - DNA, 15 bp, Homo sapiens
gggaacagcctgagc

SEQ ID NO: 6332733 - DNA, 16 bp, Homo sapiens
gggaacagcctgagcc

SEQ ID NO: 6332734 - DNA, 12 bp, Homo sapiens
gggaacaggccc

SEQ ID NO: 6332735 - DNA, 13 bp, Homo sapiens
gggaacaggcccc

SEQ ID NO: 6332736 - DNA, 23 bp, Homo sapiens
gggaacagtaaagaaagcagaat

SEQ ID NO: 6332737 - DNA, 20 bp, Homo sapiens
gggaacagtgcatgtgcatg

SEQ ID NO: 6332738 - DNA, 20 bp, Homo sapiens
gggaacagtgtgcaaggcag

SEQ ID NO: 6332739 - DNA, 15 bp, Homo sapiens
gggaacatgaagcca

SEQ ID NO: 6332740 - DNA, 18 bp, Homo sapiens
gggaacatggctggcctg

SEQ ID NO: 6332741 - DNA, 20 bp, Homo sapiens
gggaacatggctggcctggt

SEQ ID NO: 6332742 - DNA, 10 bp, Homo sapiens
gggaacattt

SEQ ID NO: 6332743 - DNA, 22 bp, Homo sapiens
gggaacatttctgtaaatacca

SEQ ID NO: 6332744 - DNA, 15 bp, Homo sapiens
gggaaccactcccac

SEQ ID NO: 6332745 - DNA, 20 bp, Homo sapiens
gggaaccagccctccagagc

SEQ ID NO: 6332746 - DNA, 15 bp, Homo sapiens
gggaacccagccctg

SEQ ID NO: 6332747 - DNA, 17 bp, Homo sapiens
gggaaccccgcagcccg

SEQ ID NO: 6332748 - DNA, 20 bp, Homo sapiens
gggaacccgactgtgaaagt

SEQ ID NO: 6332749 - DNA, 20 bp, Homo sapiens
gggaacctagtactctctgc

SEQ ID NO: 6332750 - DNA, 12 bp, Homo sapiens
gggaacctcact

SEQ ID NO: 6332751 - DNA, 11 bp, Homo sapiens
gggaacctccc

SEQ ID NO: 6332752 - DNA, 14 bp, Homo sapiens
gggaacctcccaga

SEQ ID NO: 6332753 - DNA, 17 bp, Homo sapiens
gggaacctcccagaggt

SEQ ID NO: 6332754 - DNA, 18 bp, Homo sapiens
gggaacctccccagcctg

SEQ ID NO: 6332755 - DNA, 20 bp, Homo sapiens
gggaacctccccagcctgcg

SEQ ID NO: 6332756 - DNA, 13 bp, Homo sapiens
gggaacctgaccc

SEQ ID NO: 6332757 - DNA, 13 bp, Homo sapiens
gggaacctggaac

SEQ ID NO: 6332758 - DNA, 22 bp, Homo sapiens
gggaacgcaagaggcatcccaa

SEQ ID NO: 6332759 - DNA, 12 bp, Homo sapiens
gggaacgcccac

SEQ ID NO: 6332760 - DNA, 17 bp, Homo sapiens
gggaacgtgtgtccagg

SEQ ID NO: 6332761 - DNA, 15 bp, Homo sapiens
gggaactccactctc

SEQ ID NO: 6332762 - DNA, 18 bp, Homo sapiens
gggaactccactctcctt

SEQ ID NO: 6332763 - DNA, 16 bp, Homo sapiens
gggaactcccccagag

SEQ ID NO: 6332764 - DNA, 18 bp, Homo sapiens
gggaactcccccagaggt

SEQ ID NO: 6332765 - DNA, 20 bp, Homo sapiens
gggaactcccccagaggtgg

SEQ ID NO: 6332766 - DNA, 13 bp, Homo sapiens
gggaactcctgga

SEQ ID NO: 6332767 - DNA, 14 bp, Homo sapiens
gggaactctgacaa

SEQ ID NO: 6332768 - DNA, 17 bp, Homo sapiens
gggaactgagggcaagg

SEQ ID NO: 6332769 - DNA, 14 bp, Homo sapiens
gggaactgagtcac

SEQ ID NO: 6332770 - DNA, 21 bp, Homo sapiens
gggaactgcatatcggaggtg

SEQ ID NO: 6332771 - DNA, 12 bp, Homo sapiens
gggaactggcca

SEQ ID NO: 6332772 - DNA, 18 bp, Homo sapiens
gggaactggccaagctga

SEQ ID NO: 6332773 - DNA, 20 bp, Homo sapiens
gggaactggccaagctgagg

SEQ ID NO: 6332774 - DNA, 13 bp, Homo sapiens
gggaactggcctg

SEQ ID NO: 6332775 - DNA, 16 bp, Homo sapiens
gggaactgggccagca

SEQ ID NO: 6332776 - DNA, 17 bp, Homo sapiens
gggaactttctggactc

SEQ ID NO: 6332777 - DNA, 15 bp, Homo sapiens
gggaactttgataca

SEQ ID NO: 6332778 - DNA, 10 bp, Homo sapiens
gggaagaaaa

SEQ ID NO: 6332779 - DNA, 12 bp, Homo sapiens
gggaagaaaaag

SEQ ID NO: 6332780 - DNA, 15 bp, Homo sapiens
gggaagaaaaagcaa

SEQ ID NO: 6332781 - DNA, 17 bp, Homo sapiens
gggaagaagcagagaga

SEQ ID NO: 6332782 - DNA, 19 bp, Homo sapiens
gggaagacagagcaggctt

SEQ ID NO: 6332783 - DNA, 22 bp, Homo sapiens
gggaagaccagaattcccttga

SEQ ID NO: 6332784 - DNA, 15 bp, Homo sapiens
gggaagacctgaaag

SEQ ID NO: 6332785 - DNA, 17 bp, Homo sapiens
gggaagacgcctgagct

SEQ ID NO: 6332786 - DNA, 14 bp, Homo sapiens
gggaagagaaacag

SEQ ID NO: 6332787 - DNA, 21 bp, Homo sapiens
gggaagagacaaagtgggtgt

SEQ ID NO: 6332788 - DNA, 21 bp, Homo sapiens
gggaagagagaggcctgggtg

SEQ ID NO: 6332789 - DNA, 17 bp, Homo sapiens
gggaagagatccaaaga

SEQ ID NO: 6332790 - DNA, 12 bp, Homo sapiens
gggaagagctgg

SEQ ID NO: 6332791 - DNA, 22 bp, Homo sapiens
gggaagagctgggttttcctag

SEQ ID NO: 6332792 - DNA, 14 bp, Homo sapiens
gggaagaggccttg

SEQ ID NO: 6332793 - DNA, 20 bp, Homo sapiens
gggaagagggaaatgtacac

SEQ ID NO: 6332794 - DNA, 15 bp, Homo sapiens
gggaagagggcagta

SEQ ID NO: 6332795 - DNA, 23 bp, Homo sapiens
gggaagagggttaggagggtttc

SEQ ID NO: 6332796 - DNA, 14 bp, Homo sapiens
gggaagagtagctg

SEQ ID NO: 6332797 - DNA, 23 bp, Homo sapiens
gggaagatcctccttccaggccc

SEQ ID NO: 6332798 - DNA, 18 bp, Homo sapiens
gggaagatgaactttgtc

SEQ ID NO: 6332799 - DNA, 17 bp, Homo sapiens
gggaagatgacctgccc

SEQ ID NO: 6332800 - DNA, 22 bp, Homo sapiens
gggaagcaaaaacgaaagctgg

SEQ ID NO: 6332801 - DNA, 19 bp, Homo sapiens
gggaagcaaaggggggagg

SEQ ID NO: 6332802 - DNA, 16 bp, Homo sapiens
gggaagcaccagcctc

SEQ ID NO: 6332803 - DNA, 22 bp, Homo sapiens
gggaagcagaatagcaaggtgc

SEQ ID NO: 6332804 - DNA, 16 bp, Homo sapiens
gggaagcagagcctgg

SEQ ID NO: 6332805 - DNA, 17 bp, Homo sapiens
gggaagcagcagcctcg

SEQ ID NO: 6332806 - DNA, 14 bp, Homo sapiens
gggaagcaggcaga

SEQ ID NO: 6332807 - DNA, 15 bp, Homo sapiens
gggaagcagtttcag

SEQ ID NO: 6332808 - DNA, 15 bp, Homo sapiens
gggaagccagtcagg

SEQ ID NO: 6332809 - DNA, 17 bp, Homo sapiens
gggaagccagtcagggc

SEQ ID NO: 6332810 - DNA, 15 bp, Homo sapiens
gggaagccagtgaca

SEQ ID NO: 6332811 - DNA, 23 bp, Homo sapiens
gggaagccattttccagtgactt

SEQ ID NO: 6332812 - DNA, 20 bp, Homo sapiens
gggaagcccacccgccccag

SEQ ID NO: 6332813 - DNA, 14 bp, Homo sapiens
gggaagcccagctc

SEQ ID NO: 6332814 - DNA, 24 bp, Homo sapiens
gggaagccctcggcctccagactg

SEQ ID NO: 6332815 - DNA, 21 bp, Homo sapiens
gggaagcctccgtcaggagag

SEQ ID NO: 6332816 - DNA, 22 bp, Homo sapiens
gggaagctcacacatcctgtca

SEQ ID NO: 6332817 - DNA, 19 bp, Homo sapiens
gggaagctgagcccctccc

SEQ ID NO: 6332818 - DNA, 20 bp, Homo sapiens
gggaagctgagcccctccct

SEQ ID NO: 6332819 - DNA, 17 bp, Homo sapiens
gggaagctgaggcccat

SEQ ID NO: 6332820 - DNA, 14 bp, Homo sapiens
gggaagctgccagc

SEQ ID NO: 6332821 - DNA, 20 bp, Homo sapiens
gggaagctgccgtagcttca

SEQ ID NO: 6332822 - DNA, 12 bp, Homo sapiens
gggaagctgcta

SEQ ID NO: 6332823 - DNA, 16 bp, Homo sapiens
gggaagctggcagcac

SEQ ID NO: 6332824 - DNA, 19 bp, Homo sapiens
gggaagctgtagaggacca

SEQ ID NO: 6332825 - DNA, 20 bp, Homo sapiens
gggaagcttctgtctccagc

SEQ ID NO: 6332826 - DNA, 18 bp, Homo sapiens
gggaagcttgagcctccc

SEQ ID NO: 6332827 - DNA, 20 bp, Homo sapiens
gggaagcttgagcctccccc

SEQ ID NO: 6332828 - DNA, 23 bp, Homo sapiens
gggaagctttgtacctttagagt

SEQ ID NO: 6332829 - DNA, 14 bp, Homo sapiens
gggaaggaaacaaa

SEQ ID NO: 6332830 - DNA, 15 bp, Homo sapiens
gggaaggaaacaaat

SEQ ID NO: 6332831 - DNA, 20 bp, Homo sapiens
gggaaggaagggacacacac

SEQ ID NO: 6332832 - DNA, 15 bp, Homo sapiens
gggaaggacacagca

SEQ ID NO: 6332833 - DNA, 20 bp, Homo sapiens
gggaaggagacaggatgagg

SEQ ID NO: 6332834 - DNA, 23 bp, Homo sapiens
gggaaggagagaatgattttgct

SEQ ID NO: 6332835 - DNA, 13 bp, Homo sapiens
gggaaggagccca

SEQ ID NO: 6332836 - DNA, 15 bp, Homo sapiens
gggaaggatcccatg

SEQ ID NO: 6332837 - DNA, 13 bp, Homo sapiens
gggaaggatttaa

SEQ ID NO: 6332838 - DNA, 19 bp, Homo sapiens
gggaaggcagaggctggca

SEQ ID NO: 6332839 - DNA, 15 bp, Homo sapiens
gggaaggcaggcagg

SEQ ID NO: 6332840 - DNA, 22 bp, Homo sapiens
gggaaggcatgacacacctggg

SEQ ID NO: 6332841 - DNA, 18 bp, Homo sapiens
gggaaggccacctgcagg

SEQ ID NO: 6332842 - DNA, 16 bp, Homo sapiens
gggaaggccagccttg

SEQ ID NO: 6332843 - DNA, 18 bp, Homo sapiens
gggaaggccctgaggcgg

SEQ ID NO: 6332844 - DNA, 18 bp, Homo sapiens
gtgctgggcggctgtgct

SEQ ID NO: 6332845 - DNA, 15 bp, Homo sapiens
gtgctgggctggact

SEQ ID NO: 6332846 - DNA, 19 bp, Homo sapiens
gtgctggggagccaaaggc

SEQ ID NO: 6332847 - DNA, 15 bp, Homo sapiens
gtgctggggcacggc

SEQ ID NO: 6332848 - DNA, 14 bp, Homo sapiens
gtgctggggcagag

SEQ ID NO: 6332849 - DNA, 16 bp, Homo sapiens
gtgctggggcagagtg

SEQ ID NO: 6332850 - DNA, 24 bp, Homo sapiens
gtgctggggcagagtggagcccag

SEQ ID NO: 6332851 - DNA, 16 bp, Homo sapiens
gtgctggggccagggc

SEQ ID NO: 6332852 - DNA, 14 bp, Homo sapiens
gtgctggggctgca

SEQ ID NO: 6332853 - DNA, 16 bp, Homo sapiens
gtgctgggggcacagc

SEQ ID NO: 6332854 - DNA, 17 bp, Homo sapiens
gtgctgggtgagctctt

SEQ ID NO: 6332855 - DNA, 20 bp, Homo sapiens
gtgctgggtgagctcttcca

SEQ ID NO: 6332856 - DNA, 20 bp, Homo sapiens
gtgctgggttcccactcccg

SEQ ID NO: 6332857 - DNA, 17 bp, Homo sapiens
gtgctggtatccacagt

SEQ ID NO: 6332858 - DNA, 20 bp, Homo sapiens
gtgctggtcccggggccagc

SEQ ID NO: 6332859 - DNA, 18 bp, Homo sapiens
gtgctggtcctaggtcct

SEQ ID NO: 6332860 - DNA, 19 bp, Homo sapiens
gtgctggtcctaggtcctc

SEQ ID NO: 6332861 - DNA, 20 bp, Homo sapiens
gtgctggtctctaggcctga

SEQ ID NO: 6332862 - DNA, 19 bp, Homo sapiens
gtgctggtgaacactgtga

SEQ ID NO: 6332863 - DNA, 19 bp, Homo sapiens
gtgctggtgggtctgagct

SEQ ID NO: 6332864 - DNA, 23 bp, Homo sapiens
gtgctggtgggtctgagctggac

SEQ ID NO: 6332865 - DNA, 13 bp, Homo sapiens
gtgctggtgtcct

SEQ ID NO: 6332866 - DNA, 16 bp, Homo sapiens
gtgctggtgtcctgac

SEQ ID NO: 6332867 - DNA, 20 bp, Homo sapiens
gtgctggtgtcctgaccacc

SEQ ID NO: 6332868 - DNA, 18 bp, Homo sapiens
gtgctgtaatattgtaaa

SEQ ID NO: 6332869 - DNA, 19 bp, Homo sapiens
gtgctgtaatcggctcccg

SEQ ID NO: 6332870 - DNA, 15 bp, Homo sapiens
gtgctgtatggccca

SEQ ID NO: 6332871 - DNA, 17 bp, Homo sapiens
gtgctgtcatgcccagc

SEQ ID NO: 6332872 - DNA, 14 bp, Homo sapiens
gtgctgtctgtcct

SEQ ID NO: 6332873 - DNA, 17 bp, Homo sapiens
gtgctgtcttttgttct

SEQ ID NO: 6332874 - DNA, 15 bp, Homo sapiens
gtgctgtgcccaagt

SEQ ID NO: 6332875 - DNA, 16 bp, Homo sapiens
gtgctgtgcccaagtt

SEQ ID NO: 6332876 - DNA, 12 bp, Homo sapiens
gtgctgtgcctg

SEQ ID NO: 6332877 - DNA, 20 bp, Homo sapiens
gtgctgtgcctgctagagca

SEQ ID NO: 6332878 - DNA, 15 bp, Homo sapiens
gtgctgtgctctggc

SEQ ID NO: 6332879 - DNA, 13 bp, Homo sapiens
gtgctgtggccag

SEQ ID NO: 6332880 - DNA, 15 bp, Homo sapiens
gtgctgtggccaggc

SEQ ID NO: 6332881 - DNA, 17 bp, Homo sapiens
gtgctgtggccaggcct

SEQ ID NO: 6332882 - DNA, 12 bp, Homo sapiens
gtgctgtgggca

SEQ ID NO: 6332883 - DNA, 14 bp, Homo sapiens
gtgctgtgggcctc

SEQ ID NO: 6332884 - DNA, 17 bp, Homo sapiens
gtgctgtgggcctcagg

SEQ ID NO: 6332885 - DNA, 12 bp, Homo sapiens
gtgctgtgtaaa

SEQ ID NO: 6332886 - DNA, 13 bp, Homo sapiens
gtgctgtgtaaag

SEQ ID NO: 6332887 - DNA, 14 bp, Homo sapiens
gtgctgtgtaaagt

SEQ ID NO: 6332888 - DNA, 19 bp, Homo sapiens
gtgctgtgtgacattggga

SEQ ID NO: 6332889 - DNA, 17 bp, Homo sapiens
gtgctgttggtggcagt

SEQ ID NO: 6332890 - DNA, 20 bp, Homo sapiens
gtgctgttgtcattgcttta

SEQ ID NO: 6332891 - DNA, 22 bp, Homo sapiens
gtgctgttgttatgatgtgctt

SEQ ID NO: 6332892 - DNA, 14 bp, Homo sapiens
gtgctgtttaagct

SEQ ID NO: 6332893 - DNA, 15 bp, Homo sapiens
gtgctgtttcaaagt

SEQ ID NO: 6332894 - DNA, 12 bp, Homo sapiens
gtgctgtttgag

SEQ ID NO: 6332895 - DNA, 19 bp, Homo sapiens
gtgctgttttattactgtt

SEQ ID NO: 6332896 - DNA, 19 bp, Homo sapiens
gtgcttaaattatttttat

SEQ ID NO: 6332897 - DNA, 12 bp, Homo sapiens
gtgcttaataat

SEQ ID NO: 6332898 - DNA, 18 bp, Homo sapiens
gtgcttacagtgactgtc

SEQ ID NO: 6332899 - DNA, 13 bp, Homo sapiens
gtgcttacctgtg

SEQ ID NO: 6332900 - DNA, 17 bp, Homo sapiens
gtgcttagaaacctcac

SEQ ID NO: 6332901 - DNA, 14 bp, Homo sapiens
gtgcttagaaagtt

SEQ ID NO: 6332902 - DNA, 21 bp, Homo sapiens
gtgcttatgtcatttcttctc

SEQ ID NO: 6332903 - DNA, 19 bp, Homo sapiens
gtgcttattaagaccaaag

SEQ ID NO: 6332904 - DNA, 15 bp, Homo sapiens
gtgcttcaattaata

SEQ ID NO: 6332905 - DNA, 14 bp, Homo sapiens
gtgcttcacacaaa

SEQ ID NO: 6332906 - DNA, 23 bp, Homo sapiens
gtgcttcacacaaagtgaaatta

SEQ ID NO: 6332907 - DNA, 22 bp, Homo sapiens
gtgcttcacagtagagccagct

SEQ ID NO: 6332908 - DNA, 14 bp, Homo sapiens
gtgcttcagagttt

SEQ ID NO: 6332909 - DNA, 17 bp, Homo sapiens
gtgcttcagagtttgtg

SEQ ID NO: 6332910 - DNA, 15 bp, Homo sapiens
gtgcttcagccctgg

SEQ ID NO: 6332911 - DNA, 19 bp, Homo sapiens
gtgcttcccccacccctcc

SEQ ID NO: 6332912 - DNA, 19 bp, Homo sapiens
gtgcttccctaggctgagc

SEQ ID NO: 6332913 - DNA, 15 bp, Homo sapiens
gtgcttcctgctgta

SEQ ID NO: 6332914 - DNA, 13 bp, Homo sapiens
gtgcttccttgta

SEQ ID NO: 6332915 - DNA, 23 bp, Homo sapiens
gtgcttccttttcagcatggttt

SEQ ID NO: 6332916 - DNA, 16 bp, Homo sapiens
gtgcttcgactactgc

SEQ ID NO: 6332917 - DNA, 14 bp, Homo sapiens
gtgcttcgggccct

SEQ ID NO: 6332918 - DNA, 21 bp, Homo sapiens
gtgcttctagttctgccagga

SEQ ID NO: 6332919 - DNA, 22 bp, Homo sapiens
gtgcttctagttctgccaggag

SEQ ID NO: 6332920 - DNA, 19 bp, Homo sapiens
gtgcttctccaacactgaa

SEQ ID NO: 6332921 - DNA, 17 bp, Homo sapiens
gtgcttctccccagaat

SEQ ID NO: 6332922 - DNA, 21 bp, Homo sapiens
gtgcttctccccagaattcac

SEQ ID NO: 6332923 - DNA, 19 bp, Homo sapiens
gtgcttctctttgtcccca

SEQ ID NO: 6332924 - DNA, 21 bp, Homo sapiens
gtgcttctgccaccctgctga

SEQ ID NO: 6332925 - DNA, 13 bp, Homo sapiens
gtgcttctgctca

SEQ ID NO: 6332926 - DNA, 13 bp, Homo sapiens
gtgcttcttgtaa

SEQ ID NO: 6332927 - DNA, 14 bp, Homo sapiens
gtgcttctttcttt

SEQ ID NO: 6332928 - DNA, 13 bp, Homo sapiens
gtgcttgaaggcc

SEQ ID NO: 6332929 - DNA, 18 bp, Homo sapiens
gtgcttgaaggccctgct

SEQ ID NO: 6332930 - DNA, 15 bp, Homo sapiens
gtgcttgactctcac

SEQ ID NO: 6332931 - DNA, 16 bp, Homo sapiens
gtgcttgactctcact

SEQ ID NO: 6332932 - DNA, 20 bp, Homo sapiens
gtgcttgaggccaaatgagt

SEQ ID NO: 6332933 - DNA, 18 bp, Homo sapiens
gtgcttgatagaaatgcc

SEQ ID NO: 6332934 - DNA, 12 bp, Homo sapiens
gtgcttgatcta

SEQ ID NO: 6332935 - DNA, 14 bp, Homo sapiens
gtgcttgctcccca

SEQ ID NO: 6332936 - DNA, 19 bp, Homo sapiens
gtgcttgctggccacaagg

SEQ ID NO: 6332937 - DNA, 18 bp, Homo sapiens
gtgcttgctggtgcctct

SEQ ID NO: 6332938 - DNA, 23 bp, Homo sapiens
gtgcttgctggtgcctgccacct

SEQ ID NO: 6332939 - DNA, 18 bp, Homo sapiens
gtgcttggagggggaaga

SEQ ID NO: 6332940 - DNA, 13 bp, Homo sapiens
gtgcttggcccag

SEQ ID NO: 6332941 - DNA, 19 bp, Homo sapiens
gtgcttggcccaggagttt

SEQ ID NO: 6332942 - DNA, 20 bp, Homo sapiens
gtgcttgggagagtcaggca

SEQ ID NO: 6332943 - DNA, 15 bp, Homo sapiens
gtgcttgggctccac

SEQ ID NO: 6332944 - DNA, 20 bp, Homo sapiens
gtgcttgggggtttttgaag

SEQ ID NO: 6332945 - DNA, 21 bp, Homo sapiens
gtgcttgggtggtgggtgctg

SEQ ID NO: 6332946 - DNA, 16 bp, Homo sapiens
gtgcttgttagagaga

SEQ ID NO: 6332947 - DNA, 21 bp, Homo sapiens
gtgcttgtttgctcacctggg

SEQ ID NO: 6332948 - DNA, 10 bp, Homo sapiens
gtgctttata

SEQ ID NO: 6332949 - DNA, 12 bp, Homo sapiens
gtgctttataaa

SEQ ID NO: 6332950 - DNA, 15 bp, Homo sapiens
gtgctttatccacat

SEQ ID NO: 6332951 - DNA, 15 bp, Homo sapiens
gtgctttatttatgg

SEQ ID NO: 6332952 - DNA, 16 bp, Homo sapiens
gtgctttatttatggc

SEQ ID NO: 6332953 - DNA, 18 bp, Homo sapiens
gtgctttatttatggctt

SEQ ID NO: 6332954 - DNA, 20 bp, Homo sapiens
gtgctttcaggtctggggct

SEQ ID NO: 6332955 - DNA, 14 bp, Homo sapiens
gtgctttccagctc

SEQ ID NO: 6332956 - DNA, 15 bp, Homo sapiens
gtgctttccagctca

SEQ ID NO: 6332957 - DNA, 22 bp, Homo sapiens
gtgctttccgtggcactgcata

SEQ ID NO: 6332958 - DNA, 11 bp, Homo sapiens
gtgctttcctg

SEQ ID NO: 6332959 - DNA, 17 bp, Homo sapiens
gtgctttctattgtaca

SEQ ID NO: 6332960 - DNA, 12 bp, Homo sapiens
gtgctttctcca

SEQ ID NO: 6332961 - DNA, 14 bp, Homo sapiens
gtgctttctgtgaa

SEQ ID NO: 6332962 - DNA, 21 bp, Homo sapiens
gtgctttctgtgaaagcctta

SEQ ID NO: 6332963 - DNA, 12 bp, Homo sapiens
gtgctttgaaaa

SEQ ID NO: 6332964 - DNA, 14 bp, Homo sapiens
gtgctttgcccttg

SEQ ID NO: 6332965 - DNA, 15 bp, Homo sapiens
gtgctttgcccttga

SEQ ID NO: 6332966 - DNA, 21 bp, Homo sapiens
gtgctttgctggagtcctgtt

SEQ ID NO: 6332967 - DNA, 15 bp, Homo sapiens
gtgctttgtaatatt

SEQ ID NO: 6332968 - DNA, 11 bp, Homo sapiens
gtgctttgtag

SEQ ID NO: 6332969 - DNA, 15 bp, Homo sapiens
gtgctttgtagctta

SEQ ID NO: 6332970 - DNA, 14 bp, Homo sapiens
gtgctttgtctaat

SEQ ID NO: 6332971 - DNA, 13 bp, Homo sapiens
gtgctttgtgtct

SEQ ID NO: 6332972 - DNA, 19 bp, Homo sapiens
gtgctttgtgtctagggca

SEQ ID NO: 6332973 - DNA, 18 bp, Homo sapiens
gtgctttgtgttcagttt

SEQ ID NO: 6332974 - DNA, 22 bp, Homo sapiens
gtgcttttaggcttgaaatctc

SEQ ID NO: 6332975 - DNA, 18 bp, Homo sapiens
gtgctttttataaaaaga

SEQ ID NO: 6332976 - DNA, 15 bp, Homo sapiens
gtgctttttcactgc

SEQ ID NO: 6332977 - DNA, 18 bp, Homo sapiens
gtgctttttccttttcat

SEQ ID NO: 6332978 - DNA, 22 bp, Homo sapiens
gtgctttttccttttcatctgt

SEQ ID NO: 6332979 - DNA, 20 bp, Homo sapiens
gtgctttttctcccctcctc

SEQ ID NO: 6332980 - DNA, 16 bp, Homo sapiens
gtgctttttttgtgtg

SEQ ID NO: 6332981 - DNA, 16 bp, Homo sapiens
gtggaaaaaacatttt

SEQ ID NO: 6332982 - DNA, 19 bp, Homo sapiens
gtggaaaaaagagaaaaac

SEQ ID NO: 6332983 - DNA, 18 bp, Homo sapiens
gtggaaaaactgagacag

SEQ ID NO: 6332984 - DNA, 19 bp, Homo sapiens
gtggaaaaactgagacagg

SEQ ID NO: 6332985 - DNA, 14 bp, Homo sapiens
gtggaaaaagaaat

SEQ ID NO: 6332986 - DNA, 21 bp, Homo sapiens
gtggaaaaagaaattctgtta

SEQ ID NO: 6332987 - DNA, 21 bp, Homo sapiens
gtggaaaaagacgatgtttat

SEQ ID NO: 6332988 - DNA, 13 bp, Homo sapiens
gtggaaaaagtaa

SEQ ID NO: 6332989 - DNA, 13 bp, Homo sapiens
gtggaaaaatatt

SEQ ID NO: 6332990 - DNA, 15 bp, Homo sapiens
gtggaaaaatattta

SEQ ID NO: 6332991 - DNA, 18 bp, Homo sapiens
gtggaaaaatcagaagca

SEQ ID NO: 6332992 - DNA, 16 bp, Homo sapiens
gtggaaaacagggtgc

SEQ ID NO: 6332993 - DNA, 16 bp, Homo sapiens
gtggaaaactcacaga

SEQ ID NO: 6332994 - DNA, 20 bp, Homo sapiens
gtggaaaagaatccctgcag

SEQ ID NO: 6332995 - DNA, 12 bp, Homo sapiens
gtggaaaaggaa

SEQ ID NO: 6332996 - DNA, 15 bp, Homo sapiens
gtggaaaaggaaaac

SEQ ID NO: 6332997 - DNA, 13 bp, Homo sapiens
gtggaaacagctg

SEQ ID NO: 6332998 - DNA, 14 bp, Homo sapiens
gtggaaactcagcc

SEQ ID NO: 6332999 - DNA, 20 bp, Homo sapiens
gtggaaagaaaagacaaatg

SEQ ID NO: 6333000 - DNA, 16 bp, Homo sapiens
gtggaaagagaaatga

SEQ ID NO: 6333001 - DNA, 13 bp, Homo sapiens
gtggaaagggtgc

SEQ ID NO: 6333002 - DNA, 13 bp, Homo sapiens
gtggaaagtgtaa

SEQ ID NO: 6333003 - DNA, 18 bp, Homo sapiens
gtggaaagtgtaaagcat

SEQ ID NO: 6333004 - DNA, 20 bp, Homo sapiens
gtggaaataatttgaatgta

SEQ ID NO: 6333005 - DNA, 20 bp, Homo sapiens
gtggaaatcaaccctctcct

SEQ ID NO: 6333006 - DNA, 19 bp, Homo sapiens
gtggaaattaagaagaaac

SEQ ID NO: 6333007 - DNA, 15 bp, Homo sapiens
gtggaaccaggaacc

SEQ ID NO: 6333008 - DNA, 13 bp, Homo sapiens
gtggaacccagca

SEQ ID NO: 6333009 - DNA, 14 bp, Homo sapiens
gtggaacctctgtc

SEQ ID NO: 6333010 - DNA, 17 bp, Homo sapiens
gtggaacctctgtctca

SEQ ID NO: 6333011 - DNA, 22 bp, Homo sapiens
gtggaacgtttttcctgttctt

SEQ ID NO: 6333012 - DNA, 16 bp, Homo sapiens
gtggaactaataaata

SEQ ID NO: 6333013 - DNA, 23 bp, Homo sapiens
gtggaactctcctgctcctcagg

SEQ ID NO: 6333014 - DNA, 16 bp, Homo sapiens
gtggaactgctgccac

SEQ ID NO: 6333015 - DNA, 20 bp, Homo sapiens
gtggaagaactgtgataaaa

SEQ ID NO: 6333016 - DNA, 17 bp, Homo sapiens
gtggaagaagggaagcc

SEQ ID NO: 6333017 - DNA, 16 bp, Homo sapiens
gtggaagaagggccac

SEQ ID NO: 6333018 - DNA, 17 bp, Homo sapiens
gtggaagacacttgctg

SEQ ID NO: 6333019 - DNA, 16 bp, Homo sapiens
gtggaagagcagcctg

SEQ ID NO: 6333020 - DNA, 14 bp, Homo sapiens
gtggaagagggctg

SEQ ID NO: 6333021 - DNA, 15 bp, Homo sapiens
gtggaagagtgtgtg

SEQ ID NO: 6333022 - DNA, 12 bp, Homo sapiens
gtggaagcaacc

SEQ ID NO: 6333023 - DNA, 14 bp, Homo sapiens
gtggaagcagaggc

SEQ ID NO: 6333024 - DNA, 15 bp, Homo sapiens
gtggaagcagaggcc

SEQ ID NO: 6333025 - DNA, 18 bp, Homo sapiens
gtggaagcagaggccctg

SEQ ID NO: 6333026 - DNA, 13 bp, Homo sapiens
gggaaggcctgac

SEQ ID NO: 6333027 - DNA, 21 bp, Homo sapiens
gggaaggcctgagggaagccc

SEQ ID NO: 6333028 - DNA, 20 bp, Homo sapiens
gggaaggcgctgggtgcctg

SEQ ID NO: 6333029 - DNA, 17 bp, Homo sapiens
gggaagggaaccagccc

SEQ ID NO: 6333030 - DNA, 22 bp, Homo sapiens
gggaagggagcaccagatgaca

SEQ ID NO: 6333031 - DNA, 18 bp, Homo sapiens
gggaagggagtctctctt

SEQ ID NO: 6333032 - DNA, 13 bp, Homo sapiens
gggaagggcaggc

SEQ ID NO: 6333033 - DNA, 14 bp, Homo sapiens
gggaagggccaccc

SEQ ID NO: 6333034 - DNA, 17 bp, Homo sapiens
gggaagggccaccctgc

SEQ ID NO: 6333035 - DNA, 16 bp, Homo sapiens
gggaagggcctgccca

SEQ ID NO: 6333036 - DNA, 19 bp, Homo sapiens
gggaaggggaacacagacc

SEQ ID NO: 6333037 - DNA, 16 bp, Homo sapiens
gggaaggggaggaggg

SEQ ID NO: 6333038 - DNA, 13 bp, Homo sapiens
gggaaggggatgg

SEQ ID NO: 6333039 - DNA, 20 bp, Homo sapiens
gggaaggggatggaggccag

SEQ ID NO: 6333040 - DNA, 18 bp, Homo sapiens
gggaaggggcctccctcc

SEQ ID NO: 6333041 - DNA, 19 bp, Homo sapiens
gggaaggggcctgggctgt

SEQ ID NO: 6333042 - DNA, 15 bp, Homo sapiens
gggaaggggctaggg

SEQ ID NO: 6333043 - DNA, 13 bp, Homo sapiens
gggaaggggctga

SEQ ID NO: 6333044 - DNA, 17 bp, Homo sapiens
gggaagggggcaggccc

SEQ ID NO: 6333045 - DNA, 17 bp, Homo sapiens
gggaagggggctgggac

SEQ ID NO: 6333046 - DNA, 14 bp, Homo sapiens
gggaaggggtgcag

SEQ ID NO: 6333047 - DNA, 19 bp, Homo sapiens
gggaaggggtgcaggtggg

SEQ ID NO: 6333048 - DNA, 19 bp, Homo sapiens
gggaaggggtgggagccaa

SEQ ID NO: 6333049 - DNA, 19 bp, Homo sapiens
gggaagggtgcctggctgg

SEQ ID NO: 6333050 - DNA, 23 bp, Homo sapiens
gggaagggtggcctgttccctag

SEQ ID NO: 6333051 - DNA, 16 bp, Homo sapiens
gggaagggtgggccct

SEQ ID NO: 6333052 - DNA, 18 bp, Homo sapiens
gggaagggtgggccctgg

SEQ ID NO: 6333053 - DNA, 21 bp, Homo sapiens
gggaagggtgggccctggagg

SEQ ID NO: 6333054 - DNA, 17 bp, Homo sapiens
gggaaggttccatgaag

SEQ ID NO: 6333055 - DNA, 14 bp, Homo sapiens
gggaagtaacagac

SEQ ID NO: 6333056 - DNA, 18 bp, Homo sapiens
gggaagtagttatcatgt

SEQ ID NO: 6333057 - DNA, 15 bp, Homo sapiens
gggaagtcaggggag

SEQ ID NO: 6333058 - DNA, 23 bp, Homo sapiens
gggaagtccccgagtttccccag

SEQ ID NO: 6333059 - DNA, 14 bp, Homo sapiens
gggaagtcctccct

SEQ ID NO: 6333060 - DNA, 16 bp, Homo sapiens
gggaagtcgaggctgc

SEQ ID NO: 6333061 - DNA, 23 bp, Homo sapiens
gggaagtgaagactggaagctaa

SEQ ID NO: 6333062 - DNA, 14 bp, Homo sapiens
gggaagtgaccaag

SEQ ID NO: 6333063 - DNA, 15 bp, Homo sapiens
gggaagtgctcccca

SEQ ID NO: 6333064 - DNA, 20 bp, Homo sapiens
gggaagtgctccccacacgt

SEQ ID NO: 6333065 - DNA, 18 bp, Homo sapiens
gggaagtggtccagaaac

SEQ ID NO: 6333066 - DNA, 16 bp, Homo sapiens
gggaagtttctgggtg

SEQ ID NO: 6333067 - DNA, 22 bp, Homo sapiens
gggaagtttgctgtgctttgga

SEQ ID NO: 6333068 - DNA, 18 bp, Homo sapiens
gggaataaacctggcact

SEQ ID NO: 6333069 - DNA, 19 bp, Homo sapiens
gggaataaatatgcctctc

SEQ ID NO: 6333070 - DNA, 16 bp, Homo sapiens
gggaataagccatgac

SEQ ID NO: 6333071 - DNA, 23 bp, Homo sapiens
gggaataatttccttcaggcagc

SEQ ID NO: 6333072 - DNA, 12 bp, Homo sapiens
gggaatacaaaa

SEQ ID NO: 6333073 - DNA, 16 bp, Homo sapiens
gggaatacatctgtgg

SEQ ID NO: 6333074 - DNA, 19 bp, Homo sapiens
gggaatactagggagaagg

SEQ ID NO: 6333075 - DNA, 18 bp, Homo sapiens
gggaatactcacattttg

SEQ ID NO: 6333076 - DNA, 22 bp, Homo sapiens
gggaatatgagtgcgtggtgcg

SEQ ID NO: 6333077 - DNA, 13 bp, Homo sapiens
gggaatatttgaa

SEQ ID NO: 6333078 - DNA, 18 bp, Homo sapiens
gggaatatttgaatcttg

SEQ ID NO: 6333079 - DNA, 12 bp, Homo sapiens
gggaatatttta

SEQ ID NO: 6333080 - DNA, 14 bp, Homo sapiens
gggaatattttatt

SEQ ID NO: 6333081 - DNA, 12 bp, Homo sapiens
gggaatcaagat

SEQ ID NO: 6333082 - DNA, 14 bp, Homo sapiens
gggaatcagggagc

SEQ ID NO: 6333083 - DNA, 19 bp, Homo sapiens
gggaatcagggagcactgg

SEQ ID NO: 6333084 - DNA, 18 bp, Homo sapiens
gggaatccgcctgcagag

SEQ ID NO: 6333085 - DNA, 14 bp, Homo sapiens
gggaatcctgctgc

SEQ ID NO: 6333086 - DNA, 15 bp, Homo sapiens
gggaatcctgctgcc

SEQ ID NO: 6333087 - DNA, 21 bp, Homo sapiens
gggaatcctgctgccagagaa

SEQ ID NO: 6333088 - DNA, 12 bp, Homo sapiens
gggaatcctgga

SEQ ID NO: 6333089 - DNA, 20 bp, Homo sapiens
gggaatcggttcatcaattt

SEQ ID NO: 6333090 - DNA, 21 bp, Homo sapiens
gggaatctaagtgggagacaa

SEQ ID NO: 6333091 - DNA, 21 bp, Homo sapiens
gggaatctaatatccccaaat

SEQ ID NO: 6333092 - DNA, 14 bp, Homo sapiens
gggaatgagcccag

SEQ ID NO: 6333093 - DNA, 15 bp, Homo sapiens
gggaatgagcccaga

SEQ ID NO: 6333094 - DNA, 16 bp, Homo sapiens
gggaatgagcccagag

SEQ ID NO: 6333095 - DNA, 12 bp, Homo sapiens
gggaatgagggg

SEQ ID NO: 6333096 - DNA, 13 bp, Homo sapiens
gggaatgaggggg

SEQ ID NO: 6333097 - DNA, 17 bp, Homo sapiens
gggaatgatgcaactgg

SEQ ID NO: 6333098 - DNA, 13 bp, Homo sapiens
gggaatgcctgga

SEQ ID NO: 6333099 - DNA, 12 bp, Homo sapiens
gggaatggaaga

SEQ ID NO: 6333100 - DNA, 17 bp, Homo sapiens
gggaatggaataactat

SEQ ID NO: 6333101 - DNA, 15 bp, Homo sapiens
gggaatggcagctgc

SEQ ID NO: 6333102 - DNA, 15 bp, Homo sapiens
gggaatgggcaggtg

SEQ ID NO: 6333103 - DNA, 21 bp, Homo sapiens
gggaatgtattattctgcagc

SEQ ID NO: 6333104 - DNA, 23 bp, Homo sapiens
gggaatgttccctgcaccctgga

SEQ ID NO: 6333105 - DNA, 11 bp, Homo sapiens
gggaatgtttg

SEQ ID NO: 6333106 - DNA, 21 bp, Homo sapiens
gggaatgtttgcctctgcctc

SEQ ID NO: 6333107 - DNA, 16 bp, Homo sapiens
gggaattaaatagtgt

SEQ ID NO: 6333108 - DNA, 22 bp, Homo sapiens
gggaattctttacaataaacat

SEQ ID NO: 6333109 - DNA, 12 bp, Homo sapiens
gggaattttcat

SEQ ID NO: 6333110 - DNA, 22 bp, Homo sapiens
gggaattttcattggatgcagt

SEQ ID NO: 6333111 - DNA, 16 bp, Homo sapiens
gggaattttcattttc

SEQ ID NO: 6333112 - DNA, 22 bp, Homo sapiens
gggacaaagaggcctttaacca

SEQ ID NO: 6333113 - DNA, 22 bp, Homo sapiens
gggacaaatttaaaacaaacaa

SEQ ID NO: 6333114 - DNA, 20 bp, Homo sapiens
gggacaacaaagaggacacc

SEQ ID NO: 6333115 - DNA, 15 bp, Homo sapiens
gggacaaccttggct

SEQ ID NO: 6333116 - DNA, 20 bp, Homo sapiens
gggacaaccttggcttggcc

SEQ ID NO: 6333117 - DNA, 14 bp, Homo sapiens
gggacaagcaggcc

SEQ ID NO: 6333118 - DNA, 20 bp, Homo sapiens
gggacaagcaggccgccctc

SEQ ID NO: 6333119 - DNA, 23 bp, Homo sapiens
gggacaagccaggccctctctgc

SEQ ID NO: 6333120 - DNA, 19 bp, Homo sapiens
gggacaagggattctggga

SEQ ID NO: 6333121 - DNA, 18 bp, Homo sapiens
gggacaagtggactcagg

SEQ ID NO: 6333122 - DNA, 16 bp, Homo sapiens
gggacaatggcaatag

SEQ ID NO: 6333123 - DNA, 12 bp, Homo sapiens
gggacacacaca

SEQ ID NO: 6333124 - DNA, 13 bp, Homo sapiens
gggacacacagcc

SEQ ID NO: 6333125 - DNA, 17 bp, Homo sapiens
gggacacacatcaaaaa

SEQ ID NO: 6333126 - DNA, 12 bp, Homo sapiens
gggacacagaga

SEQ ID NO: 6333127 - DNA, 14 bp, Homo sapiens
gggacacagagacc

SEQ ID NO: 6333128 - DNA, 16 bp, Homo sapiens
gggacacaggagacca

SEQ ID NO: 6333129 - DNA, 22 bp, Homo sapiens
gggacacaggatcctggcctga

SEQ ID NO: 6333130 - DNA, 21 bp, Homo sapiens
gggacacatgcccctccccca

SEQ ID NO: 6333131 - DNA, 20 bp, Homo sapiens
gggacaccaagccttggctc

SEQ ID NO: 6333132 - DNA, 19 bp, Homo sapiens
gggacaccagccaggctct

SEQ ID NO: 6333133 - DNA, 17 bp, Homo sapiens
gggacaccagggaagaa

SEQ ID NO: 6333134 - DNA, 14 bp, Homo sapiens
gggacacccagaaa

SEQ ID NO: 6333135 - DNA, 15 bp, Homo sapiens
gggacaccctcctgc

SEQ ID NO: 6333136 - DNA, 16 bp, Homo sapiens
gggacaccctcctgcc

SEQ ID NO: 6333137 - DNA, 19 bp, Homo sapiens
gggacaccctcctgccccc

SEQ ID NO: 6333138 - DNA, 19 bp, Homo sapiens
gggacaccgtggggaaggg

SEQ ID NO: 6333139 - DNA, 14 bp, Homo sapiens
gggacacctgccct

SEQ ID NO: 6333140 - DNA, 14 bp, Homo sapiens
gggacacgggcagc

SEQ ID NO: 6333141 - DNA, 16 bp, Homo sapiens
gggacactacaaacat

SEQ ID NO: 6333142 - DNA, 11 bp, Homo sapiens
gggacactgaa

SEQ ID NO: 6333143 - DNA, 15 bp, Homo sapiens
gggacactggcccca

SEQ ID NO: 6333144 - DNA, 21 bp, Homo sapiens
gggacactgggcagcaaggct

SEQ ID NO: 6333145 - DNA, 22 bp, Homo sapiens
gggacactgtggcagcaggagg

SEQ ID NO: 6333146 - DNA, 15 bp, Homo sapiens
gggacagacagcagc

SEQ ID NO: 6333147 - DNA, 17 bp, Homo sapiens
gggacagacagcagctg

SEQ ID NO: 6333148 - DNA, 14 bp, Homo sapiens
gggacagaccagca

SEQ ID NO: 6333149 - DNA, 16 bp, Homo sapiens
gggacagaccagcagc

SEQ ID NO: 6333150 - DNA, 14 bp, Homo sapiens
gggacagaccagcc

SEQ ID NO: 6333151 - DNA, 21 bp, Homo sapiens
gggacagaccagcccttcccc

SEQ ID NO: 6333152 - DNA, 15 bp, Homo sapiens
gggacagacctggac

SEQ ID NO: 6333153 - DNA, 11 bp, Homo sapiens
gggacagagaa

SEQ ID NO: 6333154 - DNA, 17 bp, Homo sapiens
gggacagagacacctgc

SEQ ID NO: 6333155 - DNA, 20 bp, Homo sapiens
gggacagagacacctgcacc

SEQ ID NO: 6333156 - DNA, 23 bp, Homo sapiens
gggacagagaggagttgccaggg

SEQ ID NO: 6333157 - DNA, 16 bp, Homo sapiens
gggacagagccacccc

SEQ ID NO: 6333158 - DNA, 12 bp, Homo sapiens
gggacagagctg

SEQ ID NO: 6333159 - DNA, 19 bp, Homo sapiens
gggacagaggccccagcct

SEQ ID NO: 6333160 - DNA, 21 bp, Homo sapiens
gggacagaggccccagcctcc

SEQ ID NO: 6333161 - DNA, 14 bp, Homo sapiens
gggacagaggccct

SEQ ID NO: 6333162 - DNA, 13 bp, Homo sapiens
gggacagaggggg

SEQ ID NO: 6333163 - DNA, 22 bp, Homo sapiens
gggacagagggggtggcctccc

SEQ ID NO: 6333164 - DNA, 12 bp, Homo sapiens
gggacagagggt

SEQ ID NO: 6333165 - DNA, 22 bp, Homo sapiens
gggacagagtagccaggttctg

SEQ ID NO: 6333166 - DNA, 18 bp, Homo sapiens
gggacagccagagctggg

SEQ ID NO: 6333167 - DNA, 16 bp, Homo sapiens
gggacagcccagagcc

SEQ ID NO: 6333168 - DNA, 14 bp, Homo sapiens
gggacagccccagg

SEQ ID NO: 6333169 - DNA, 21 bp, Homo sapiens
gggacagcctcttcagcccct

SEQ ID NO: 6333170 - DNA, 12 bp, Homo sapiens
gggacagcctgc

SEQ ID NO: 6333171 - DNA, 13 bp, Homo sapiens
gggacagcggccc

SEQ ID NO: 6333172 - DNA, 22 bp, Homo sapiens
gggacagcggccccgcggagcc

SEQ ID NO: 6333173 - DNA, 15 bp, Homo sapiens
gggacagctccttct

SEQ ID NO: 6333174 - DNA, 16 bp, Homo sapiens
gggacagctccttctg

SEQ ID NO: 6333175 - DNA, 16 bp, Homo sapiens
gggacagctttcctgg

SEQ ID NO: 6333176 - DNA, 17 bp, Homo sapiens
gggacaggcctcacctc

SEQ ID NO: 6333177 - DNA, 22 bp, Homo sapiens
gggacaggcctttctggcctgc

SEQ ID NO: 6333178 - DNA, 22 bp, Homo sapiens
gggacaggctggaatgagggag

SEQ ID NO: 6333179 - DNA, 13 bp, Homo sapiens
gggacagggaggg

SEQ ID NO: 6333180 - DNA, 14 bp, Homo sapiens
gggacagggagggg

SEQ ID NO: 6333181 - DNA, 23 bp, Homo sapiens
gggacagggaggtgtgaggcagg

SEQ ID NO: 6333182 - DNA, 14 bp, Homo sapiens
gggacagggcaggc

SEQ ID NO: 6333183 - DNA, 17 bp, Homo sapiens
gggacagggctggccca

SEQ ID NO: 6333184 - DNA, 21 bp, Homo sapiens
gggacagggctggcccagccc

SEQ ID NO: 6333185 - DNA, 22 bp, Homo sapiens
gggacagggctggcccagccct

SEQ ID NO: 6333186 - DNA, 19 bp, Homo sapiens
gggacagggcttctcctgc

SEQ ID NO: 6333187 - DNA, 15 bp, Homo sapiens
gggacagggcttggg

SEQ ID NO: 6333188 - DNA, 15 bp, Homo sapiens
gggacagtctcacca

SEQ ID NO: 6333189 - DNA, 16 bp, Homo sapiens
gggacagtctggaggt

SEQ ID NO: 6333190 - DNA, 17 bp, Homo sapiens
gggacagtgctgcagct

SEQ ID NO: 6333191 - DNA, 20 bp, Homo sapiens
gggacagtttatcatgaagc

SEQ ID NO: 6333192 - DNA, 21 bp, Homo sapiens
gggacagtttatcatgaagcc

SEQ ID NO: 6333193 - DNA, 17 bp, Homo sapiens
gggacatcacagggtgg

SEQ ID NO: 6333194 - DNA, 18 bp, Homo sapiens
gggacatcacagggtggg

SEQ ID NO: 6333195 - DNA, 22 bp, Homo sapiens
gggacatcacagggtgggcctc

SEQ ID NO: 6333196 - DNA, 22 bp, Homo sapiens
gggacatgaaataaatgcccca

SEQ ID NO: 6333197 - DNA, 17 bp, Homo sapiens
gggacatgccctgtgtg

SEQ ID NO: 6333198 - DNA, 16 bp, Homo sapiens
gggacatggaaaagaa

SEQ ID NO: 6333199 - DNA, 15 bp, Homo sapiens
gggacatggggcaag

SEQ ID NO: 6333200 - DNA, 18 bp, Homo sapiens
gggacatgggtcgcccat

SEQ ID NO: 6333201 - DNA, 16 bp, Homo sapiens
gggacatgtatgtggc

SEQ ID NO: 6333202 - DNA, 13 bp, Homo sapiens
gggacatgtggaa

SEQ ID NO: 6333203 - DNA, 20 bp, Homo sapiens
gggacattccaaagaacagc

SEQ ID NO: 6333204 - DNA, 15 bp, Homo sapiens
gggacatttccctcc

SEQ ID NO: 6333205 - DNA, 18 bp, Homo sapiens
gggacatttccctcctgg

SEQ ID NO: 6333206 - DNA, 19 bp, Homo sapiens
gtggaagcagaggccctgc

SEQ ID NO: 6333207 - DNA, 13 bp, Homo sapiens
gtggaagccctcc

SEQ ID NO: 6333208 - DNA, 14 bp, Homo sapiens
gtggaagccctcct

SEQ ID NO: 6333209 - DNA, 18 bp, Homo sapiens
gtggaagccctccttcca

SEQ ID NO: 6333210 - DNA, 21 bp, Homo sapiens
gtggaaggaccctgtgccctc

SEQ ID NO: 6333211 - DNA, 15 bp, Homo sapiens
gtggaaggactgtgg

SEQ ID NO: 6333212 - DNA, 19 bp, Homo sapiens
gtggaaggactgtggctgc

SEQ ID NO: 6333213 - DNA, 23 bp, Homo sapiens
gtggaaggcacccgccctttcct

SEQ ID NO: 6333214 - DNA, 20 bp, Homo sapiens
gtggaaggcagacagcaggc

SEQ ID NO: 6333215 - DNA, 17 bp, Homo sapiens
gtggaaggcagagaaat

SEQ ID NO: 6333216 - DNA, 21 bp, Homo sapiens
gtggaaggcattgtcctgtga

SEQ ID NO: 6333217 - DNA, 17 bp, Homo sapiens
gtggaaggcctccctct

SEQ ID NO: 6333218 - DNA, 15 bp, Homo sapiens
gtggaagggcaggag

SEQ ID NO: 6333219 - DNA, 13 bp, Homo sapiens
gtggaagggctgg

SEQ ID NO: 6333220 - DNA, 15 bp, Homo sapiens
gtggaagggctgggt

SEQ ID NO: 6333221 - DNA, 17 bp, Homo sapiens
gtggaagggggtgtgcg

SEQ ID NO: 6333222 - DNA, 19 bp, Homo sapiens
gtggaagtgtgggtctgtg

SEQ ID NO: 6333223 - DNA, 20 bp, Homo sapiens
gtggaagtgtgggtctgtgt

SEQ ID NO: 6333224 - DNA, 19 bp, Homo sapiens
gtggaagtgttcctgtctc

SEQ ID NO: 6333225 - DNA, 21 bp, Homo sapiens
gtggaagtgttcctgtctcaa

SEQ ID NO: 6333226 - DNA, 22 bp, Homo sapiens
gtggaatagtatcctccaggtt

SEQ ID NO: 6333227 - DNA, 15 bp, Homo sapiens
gtggaatccagtgtg

SEQ ID NO: 6333228 - DNA, 15 bp, Homo sapiens
gtggaatgtcgcaga

SEQ ID NO: 6333229 - DNA, 22 bp, Homo sapiens
gtggaattacataacaggcatt

SEQ ID NO: 6333230 - DNA, 23 bp, Homo sapiens
gtggaattacataacaggcattg

SEQ ID NO: 6333231 - DNA, 18 bp, Homo sapiens
gtggaattattttaaaag

SEQ ID NO: 6333232 - DNA, 18 bp, Homo sapiens
gtggaatttcttgtttct

SEQ ID NO: 6333233 - DNA, 19 bp, Homo sapiens
gtggaattttgagaaaaat

SEQ ID NO: 6333234 - DNA, 17 bp, Homo sapiens
gtggacaaactggagtc

SEQ ID NO: 6333235 - DNA, 22 bp, Homo sapiens
gtggacacagctcttctccagg

SEQ ID NO: 6333236 - DNA, 23 bp, Homo sapiens
gtggacaccactgagctctgcct

SEQ ID NO: 6333237 - DNA, 15 bp, Homo sapiens
gtggacaccaggagt

SEQ ID NO: 6333238 - DNA, 14 bp, Homo sapiens
gtggacaccgctca

SEQ ID NO: 6333239 - DNA, 17 bp, Homo sapiens
gtggacaccgctcagta

SEQ ID NO: 6333240 - DNA, 12 bp, Homo sapiens
gtggacacctgc

SEQ ID NO: 6333241 - DNA, 18 bp, Homo sapiens
gtggacacctgccctgcc

SEQ ID NO: 6333242 - DNA, 19 bp, Homo sapiens
gtggacacctgccctgccc

SEQ ID NO: 6333243 - DNA, 12 bp, Homo sapiens
gtggacagaagc

SEQ ID NO: 6333244 - DNA, 19 bp, Homo sapiens
gtggacagcagctggactg

SEQ ID NO: 6333245 - DNA, 20 bp, Homo sapiens
gtggacagcagctggactgg

SEQ ID NO: 6333246 - DNA, 14 bp, Homo sapiens
gtggacagcccggg

SEQ ID NO: 6333247 - DNA, 18 bp, Homo sapiens
gtggacagcgctgtattt

SEQ ID NO: 6333248 - DNA, 20 bp, Homo sapiens
gtggacaggatgaggacaga

SEQ ID NO: 6333249 - DNA, 14 bp, Homo sapiens
gtggacagtcaggg

SEQ ID NO: 6333250 - DNA, 14 bp, Homo sapiens
gtggacagtcctgg

SEQ ID NO: 6333251 - DNA, 15 bp, Homo sapiens
gtggacagtcctggg

SEQ ID NO: 6333252 - DNA, 16 bp, Homo sapiens
gtggacatcatgaagc

SEQ ID NO: 6333253 - DNA, 20 bp, Homo sapiens
gtggacatgcataaaaatta

SEQ ID NO: 6333254 - DNA, 17 bp, Homo sapiens
gtggacatggctgttca

SEQ ID NO: 6333255 - DNA, 20 bp, Homo sapiens
gtggacatggtcacagtcct

SEQ ID NO: 6333256 - DNA, 21 bp, Homo sapiens
gtggacatgtgggtggagaag

SEQ ID NO: 6333257 - DNA, 23 bp, Homo sapiens
gtggacatgtgggtggagaaggg

SEQ ID NO: 6333258 - DNA, 23 bp, Homo sapiens
gtggaccaaacccttagcagccc

SEQ ID NO: 6333259 - DNA, 13 bp, Homo sapiens
gtggaccaggaca

SEQ ID NO: 6333260 - DNA, 22 bp, Homo sapiens
gtggaccaggaggattgccttt

SEQ ID NO: 6333261 - DNA, 16 bp, Homo sapiens
gtggaccaggcctgga

SEQ ID NO: 6333262 - DNA, 22 bp, Homo sapiens
gtggaccaggcctggagggcac

SEQ ID NO: 6333263 - DNA, 19 bp, Homo sapiens
gtggaccctcgctctctgt

SEQ ID NO: 6333264 - DNA, 18 bp, Homo sapiens
gtggaccctgaaatgtgt

SEQ ID NO: 6333265 - DNA, 19 bp, Homo sapiens
gtggaccctgaaatgtgtg

SEQ ID NO: 6333266 - DNA, 19 bp, Homo sapiens
gtggaccggccgcagcccc

SEQ ID NO: 6333267 - DNA, 20 bp, Homo sapiens
gtggaccggccgcagccccc

SEQ ID NO: 6333268 - DNA, 21 bp, Homo sapiens
gtggaccggccgcagccccca

SEQ ID NO: 6333269 - DNA, 17 bp, Homo sapiens
gtggaccgtggacaggc

SEQ ID NO: 6333270 - DNA, 21 bp, Homo sapiens
gtggaccgtggacaggcccag

SEQ ID NO: 6333271 - DNA, 14 bp, Homo sapiens
gtggacctagcctg

SEQ ID NO: 6333272 - DNA, 13 bp, Homo sapiens
gtggacgctgcag

SEQ ID NO: 6333273 - DNA, 16 bp, Homo sapiens
gtggacgctgcagacc

SEQ ID NO: 6333274 - DNA, 12 bp, Homo sapiens
gtggacggagag

SEQ ID NO: 6333275 - DNA, 15 bp, Homo sapiens
gtggacggagagcct

SEQ ID NO: 6333276 - DNA, 14 bp, Homo sapiens
gtggacggcagacc

SEQ ID NO: 6333277 - DNA, 17 bp, Homo sapiens
gtggacggcgctgcctc

SEQ ID NO: 6333278 - DNA, 18 bp, Homo sapiens
gtggacggcgctgcctca

SEQ ID NO: 6333279 - DNA, 21 bp, Homo sapiens
gtggacggcgctgcctcaggc

SEQ ID NO: 6333280 - DNA, 18 bp, Homo sapiens
gtggacgtcacgctccct

SEQ ID NO: 6333281 - DNA, 20 bp, Homo sapiens
gtggacgtcacgctccctga

SEQ ID NO: 6333282 - DNA, 17 bp, Homo sapiens
gtggacgtgggctccag

SEQ ID NO: 6333283 - DNA, 14 bp, Homo sapiens
gtggactaaaagat

SEQ ID NO: 6333284 - DNA, 15 bp, Homo sapiens
gtggactcagggcag

SEQ ID NO: 6333285 - DNA, 21 bp, Homo sapiens
gtggactcagggcagcgccag

SEQ ID NO: 6333286 - DNA, 14 bp, Homo sapiens
gtggactccagact

SEQ ID NO: 6333287 - DNA, 21 bp, Homo sapiens
gtggactccagactctctgtg

SEQ ID NO: 6333288 - DNA, 13 bp, Homo sapiens
gtggactccagct

SEQ ID NO: 6333289 - DNA, 16 bp, Homo sapiens
gtggactcgcgagagg

SEQ ID NO: 6333290 - DNA, 24 bp, Homo sapiens
gtggactctctgcctgcttcctgg

SEQ ID NO: 6333291 - DNA, 15 bp, Homo sapiens
gtggactctgctaga

SEQ ID NO: 6333292 - DNA, 12 bp, Homo sapiens
gtggactctgga

SEQ ID NO: 6333293 - DNA, 15 bp, Homo sapiens
gtggactctggactg

SEQ ID NO: 6333294 - DNA, 16 bp, Homo sapiens
gtggactctggactgg

SEQ ID NO: 6333295 - DNA, 12 bp, Homo sapiens
gtggactctggt

SEQ ID NO: 6333296 - DNA, 18 bp, Homo sapiens
gtggactgagtgggaagc

SEQ ID NO: 6333297 - DNA, 23 bp, Homo sapiens
gtggactgcagtcggcatgccag

SEQ ID NO: 6333298 - DNA, 20 bp, Homo sapiens
gtggactgcatttaaatttg

SEQ ID NO: 6333299 - DNA, 17 bp, Homo sapiens
gtggactggcccctggg

SEQ ID NO: 6333300 - DNA, 16 bp, Homo sapiens
gtggactggctgtgcc

SEQ ID NO: 6333301 - DNA, 17 bp, Homo sapiens
gtggactggctgtgccc

SEQ ID NO: 6333302 - DNA, 18 bp, Homo sapiens
gtggactgggaagcatta

SEQ ID NO: 6333303 - DNA, 19 bp, Homo sapiens
gtggactgggaagcattac

SEQ ID NO: 6333304 - DNA, 13 bp, Homo sapiens
gtggactgtattt

SEQ ID NO: 6333305 - DNA, 15 bp, Homo sapiens
gtggactgtcctgag

SEQ ID NO: 6333306 - DNA, 16 bp, Homo sapiens
gtggactgtcctgagg

SEQ ID NO: 6333307 - DNA, 20 bp, Homo sapiens
gtggactgtcctgaggagcc

SEQ ID NO: 6333308 - DNA, 22 bp, Homo sapiens
gtggactgtcctgaggagccct

SEQ ID NO: 6333309 - DNA, 12 bp, Homo sapiens
gtggactgtgcc

SEQ ID NO: 6333310 - DNA, 14 bp, Homo sapiens
gtggactgtggcac

SEQ ID NO: 6333311 - DNA, 21 bp, Homo sapiens
gtggactgtggcacttgcctg

SEQ ID NO: 6333312 - DNA, 19 bp, Homo sapiens
gtggacttagaaagcaggg

SEQ ID NO: 6333313 - DNA, 20 bp, Homo sapiens
gtggacttagaaagcagggg

SEQ ID NO: 6333314 - DNA, 22 bp, Homo sapiens
gtggacttagaaagcaggggct

SEQ ID NO: 6333315 - DNA, 15 bp, Homo sapiens
gtggacttgaacttt

SEQ ID NO: 6333316 - DNA, 12 bp, Homo sapiens
gtggacttggag

SEQ ID NO: 6333317 - DNA, 17 bp, Homo sapiens
gtggacttgtctcccag

SEQ ID NO: 6333318 - DNA, 20 bp, Homo sapiens
gtggactttatttaatttca

SEQ ID NO: 6333319 - DNA, 21 bp, Homo sapiens
gtggactttatttaatttcat

SEQ ID NO: 6333320 - DNA, 16 bp, Homo sapiens
gtggactttccacccc

SEQ ID NO: 6333321 - DNA, 17 bp, Homo sapiens
gtggactttccaccccc

SEQ ID NO: 6333322 - DNA, 20 bp, Homo sapiens
gtggactttccaccccctcc

SEQ ID NO: 6333323 - DNA, 11 bp, Homo sapiens
gtggagaaatg

SEQ ID NO: 6333324 - DNA, 23 bp, Homo sapiens
gtggagaacaaagaccaatgtga

SEQ ID NO: 6333325 - DNA, 23 bp, Homo sapiens
gtggagaagagtgccctgctttg

SEQ ID NO: 6333326 - DNA, 20 bp, Homo sapiens
gtggagaagccacaggcctg

SEQ ID NO: 6333327 - DNA, 13 bp, Homo sapiens
gtggagaagccat

SEQ ID NO: 6333328 - DNA, 20 bp, Homo sapiens
gtggagaagccattgtcttc

SEQ ID NO: 6333329 - DNA, 20 bp, Homo sapiens
gtggagaagcggctggcagc

SEQ ID NO: 6333330 - DNA, 15 bp, Homo sapiens
gtggagaagtgtgtt

SEQ ID NO: 6333331 - DNA, 22 bp, Homo sapiens
gtggagaatttttactggggat

SEQ ID NO: 6333332 - DNA, 23 bp, Homo sapiens
gtggagaatttttactggggatt

SEQ ID NO: 6333333 - DNA, 22 bp, Homo sapiens
gtggagacaatgtctgcagccc

SEQ ID NO: 6333334 - DNA, 11 bp, Homo sapiens
gtggagacagc

SEQ ID NO: 6333335 - DNA, 17 bp, Homo sapiens
gtggagacagccctgcc

SEQ ID NO: 6333336 - DNA, 14 bp, Homo sapiens
gtggagacagtcct

SEQ ID NO: 6333337 - DNA, 22 bp, Homo sapiens
gtggagactgctcctgagcccc

SEQ ID NO: 6333338 - DNA, 14 bp, Homo sapiens
gtggagactggcag

SEQ ID NO: 6333339 - DNA, 17 bp, Homo sapiens
gtggagactttctgtta

SEQ ID NO: 6333340 - DNA, 22 bp, Homo sapiens
gtggagagaaagccaaggctgc

SEQ ID NO: 6333341 - DNA, 12 bp, Homo sapiens
gtggagagacca

SEQ ID NO: 6333342 - DNA, 18 bp, Homo sapiens
gtggagagaccagccttt

SEQ ID NO: 6333343 - DNA, 23 bp, Homo sapiens
gtggagagaccagcctttcttcc

SEQ ID NO: 6333344 - DNA, 15 bp, Homo sapiens
gtggagagagcaggg

SEQ ID NO: 6333345 - DNA, 14 bp, Homo sapiens
gtggagagcccggc

SEQ ID NO: 6333346 - DNA, 16 bp, Homo sapiens
gtggagagctggtgcc

SEQ ID NO: 6333347 - DNA, 14 bp, Homo sapiens
gtggagaggagaga

SEQ ID NO: 6333348 - DNA, 14 bp, Homo sapiens
gtggagagggaatg

SEQ ID NO: 6333349 - DNA, 22 bp, Homo sapiens
gtggagagggatgaggtgctgg

SEQ ID NO: 6333350 - DNA, 20 bp, Homo sapiens
gtggagaggggtgcacccac

SEQ ID NO: 6333351 - DNA, 14 bp, Homo sapiens
gtggagagtgagaa

SEQ ID NO: 6333352 - DNA, 15 bp, Homo sapiens
gtggagagtgagaat

SEQ ID NO: 6333353 - DNA, 16 bp, Homo sapiens
gtggagagtggaagga

SEQ ID NO: 6333354 - DNA, 21 bp, Homo sapiens
gtggagatcccacatatttca

SEQ ID NO: 6333355 - DNA, 16 bp, Homo sapiens
gtggagatgtcttcgt

SEQ ID NO: 6333356 - DNA, 19 bp, Homo sapiens
gtggagatgtcttcgtaca

SEQ ID NO: 6333357 - DNA, 21 bp, Homo sapiens
gtggagcaaaaggcagctcac

SEQ ID NO: 6333358 - DNA, 19 bp, Homo sapiens
gtggagcaaagtgagggcc

SEQ ID NO: 6333359 - DNA, 15 bp, Homo sapiens
gtggagcactggact

SEQ ID NO: 6333360 - DNA, 14 bp, Homo sapiens
gtggagcagagctc

SEQ ID NO: 6333361 - DNA, 22 bp, Homo sapiens
gtggagcagccagagctgtgcc

SEQ ID NO: 6333362 - DNA, 19 bp, Homo sapiens
gtggagcaggactcccacc

SEQ ID NO: 6333363 - DNA, 16 bp, Homo sapiens
gtggagcatgggcctg

SEQ ID NO: 6333364 - DNA, 17 bp, Homo sapiens
gtggagcatgggcctgg

SEQ ID NO: 6333365 - DNA, 12 bp, Homo sapiens
gtggagccaggc

SEQ ID NO: 6333366 - DNA, 22 bp, Homo sapiens
gtggagccattgaacagctgtg

SEQ ID NO: 6333367 - DNA, 22 bp, Homo sapiens
gtggagcctgccgcccccgcct

SEQ ID NO: 6333368 - DNA, 19 bp, Homo sapiens
gtggagctactccccacct

SEQ ID NO: 6333369 - DNA, 14 bp, Homo sapiens
gtggagctcagccc

SEQ ID NO: 6333370 - DNA, 15 bp, Homo sapiens
gtggagctcagcccc

SEQ ID NO: 6333371 - DNA, 17 bp, Homo sapiens
gtggagctcgcccctcc

SEQ ID NO: 6333372 - DNA, 23 bp, Homo sapiens
gtggagctcgcccctcccctcag

SEQ ID NO: 6333373 - DNA, 19 bp, Homo sapiens
gtggagctgagaagaggag

SEQ ID NO: 6333374 - DNA, 12 bp, Homo sapiens
gtggagctggga

SEQ ID NO: 6333375 - DNA, 17 bp, Homo sapiens
gtggagctgtctgtctc

SEQ ID NO: 6333376 - DNA, 16 bp, Homo sapiens
gtggagcttgcagtga

SEQ ID NO: 6333377 - DNA, 21 bp, Homo sapiens
gtggagcttggagccccctgg

SEQ ID NO: 6333378 - DNA, 22 bp, Homo sapiens
gtggagcttggagccccctggc

SEQ ID NO: 6333379 - DNA, 21 bp, Homo sapiens
gtggaggaagagccacctgca

SEQ ID NO: 6333380 - DNA, 16 bp, Homo sapiens
gtggaggaagatccaa

SEQ ID NO: 6333381 - DNA, 14 bp, Homo sapiens
gtggaggaaggatt

SEQ ID NO: 6333382 - DNA, 19 bp, Homo sapiens
gtggaggaaggattgtaaa

SEQ ID NO: 6333383 - DNA, 17 bp, Homo sapiens
gtggaggaagggctggg

SEQ ID NO: 6333384 - DNA, 11 bp, Homo sapiens
gggaccaaata

SEQ ID NO: 6333385 - DNA, 12 bp, Homo sapiens
gggaccaaatag

SEQ ID NO: 6333386 - DNA, 18 bp, Homo sapiens
gggaccaaccctggggaa

SEQ ID NO: 6333387 - DNA, 16 bp, Homo sapiens
gggaccaacctgacct

SEQ ID NO: 6333388 - DNA, 19 bp, Homo sapiens
gggaccaacgggagcgagt

SEQ ID NO: 6333389 - DNA, 16 bp, Homo sapiens
gggaccaactgggccc

SEQ ID NO: 6333390 - DNA, 17 bp, Homo sapiens
gggaccaaggacccctc

SEQ ID NO: 6333391 - DNA, 12 bp, Homo sapiens
gggaccacagag

SEQ ID NO: 6333392 - DNA, 15 bp, Homo sapiens
gggaccacagctgct

SEQ ID NO: 6333393 - DNA, 23 bp, Homo sapiens
gggaccacagctgctggccaggg

SEQ ID NO: 6333394 - DNA, 21 bp, Homo sapiens
gggaccacatccaccccagcc

SEQ ID NO: 6333395 - DNA, 13 bp, Homo sapiens
gggaccacatgcc

SEQ ID NO: 6333396 - DNA, 13 bp, Homo sapiens
gggaccaccctcc

SEQ ID NO: 6333397 - DNA, 16 bp, Homo sapiens
gggaccactgggcccc

SEQ ID NO: 6333398 - DNA, 19 bp, Homo sapiens
gggaccactgggcccctca

SEQ ID NO: 6333399 - DNA, 14 bp, Homo sapiens
gggaccagagccag

SEQ ID NO: 6333400 - DNA, 20 bp, Homo sapiens
gggaccagagctgccacctg

SEQ ID NO: 6333401 - DNA, 15 bp, Homo sapiens
gggaccagattgact

SEQ ID NO: 6333402 - DNA, 18 bp, Homo sapiens
gggaccagcccagcctgc

SEQ ID NO: 6333403 - DNA, 13 bp, Homo sapiens
gggaccagctggg

SEQ ID NO: 6333404 - DNA, 12 bp, Homo sapiens
gggaccaggagc

SEQ ID NO: 6333405 - DNA, 14 bp, Homo sapiens
gggaccaggccaat

SEQ ID NO: 6333406 - DNA, 13 bp, Homo sapiens
gggaccaggctcc

SEQ ID NO: 6333407 - DNA, 15 bp, Homo sapiens
gggaccagggcatat

SEQ ID NO: 6333408 - DNA, 19 bp, Homo sapiens
gggaccaggtttgcaggag

SEQ ID NO: 6333409 - DNA, 17 bp, Homo sapiens
gggaccagtcccacacc

SEQ ID NO: 6333410 - DNA, 13 bp, Homo sapiens
gggaccatgtgtc

SEQ ID NO: 6333411 - DNA, 17 bp, Homo sapiens
gggaccattgacctcag

SEQ ID NO: 6333412 - DNA, 19 bp, Homo sapiens
gggacccaaagcaggatga

SEQ ID NO: 6333413 - DNA, 18 bp, Homo sapiens
gggacccacccagcccct

SEQ ID NO: 6333414 - DNA, 12 bp, Homo sapiens
gggacccacctg

SEQ ID NO: 6333415 - DNA, 16 bp, Homo sapiens
gggacccacctgctag

SEQ ID NO: 6333416 - DNA, 22 bp, Homo sapiens
gggacccagctactctgtccag

SEQ ID NO: 6333417 - DNA, 20 bp, Homo sapiens
gggacccagctcctctgagc

SEQ ID NO: 6333418 - DNA, 23 bp, Homo sapiens
gggacccagctcctctgagccat

SEQ ID NO: 6333419 - DNA, 18 bp, Homo sapiens
gggacccaggcacctgca

SEQ ID NO: 6333420 - DNA, 17 bp, Homo sapiens
gggacccaggctcccag

SEQ ID NO: 6333421 - DNA, 19 bp, Homo sapiens
gggacccaggctcccagcc

SEQ ID NO: 6333422 - DNA, 21 bp, Homo sapiens
gggacccaggtgtgcctgtgc

SEQ ID NO: 6333423 - DNA, 16 bp, Homo sapiens
gggacccagtgcagaa

SEQ ID NO: 6333424 - DNA, 22 bp, Homo sapiens
gggaccccaacctcagaggcag

SEQ ID NO: 6333425 - DNA, 15 bp, Homo sapiens
gggaccccacccctc

SEQ ID NO: 6333426 - DNA, 18 bp, Homo sapiens
gggaccccacccctcatc

SEQ ID NO: 6333427 - DNA, 18 bp, Homo sapiens
gggaccccacttcagaag

SEQ ID NO: 6333428 - DNA, 13 bp, Homo sapiens
gggaccccagctg

SEQ ID NO: 6333429 - DNA, 23 bp, Homo sapiens
gggaccccagctgctctaagccc

SEQ ID NO: 6333430 - DNA, 15 bp, Homo sapiens
gggaccccaggccca

SEQ ID NO: 6333431 - DNA, 22 bp, Homo sapiens
gggacccccaacattctgccct

SEQ ID NO: 6333432 - DNA, 13 bp, Homo sapiens
gggacccccagga

SEQ ID NO: 6333433 - DNA, 13 bp, Homo sapiens
gggacccccgccc

SEQ ID NO: 6333434 - DNA, 19 bp, Homo sapiens
gggacccccgccccctgcc

SEQ ID NO: 6333435 - DNA, 21 bp, Homo sapiens
gggacccccgccccctgccct

SEQ ID NO: 6333436 - DNA, 22 bp, Homo sapiens
gggacccccggcctccaggctg

SEQ ID NO: 6333437 - DNA, 18 bp, Homo sapiens
gggaccccctcaccatcc

SEQ ID NO: 6333438 - DNA, 15 bp, Homo sapiens
gggaccccctcagga

SEQ ID NO: 6333439 - DNA, 16 bp, Homo sapiens
gggaccccgagcctgg

SEQ ID NO: 6333440 - DNA, 19 bp, Homo sapiens
gggacccctcgcaaccctg

SEQ ID NO: 6333441 - DNA, 21 bp, Homo sapiens
gggacccctcgcaaccctgcc

SEQ ID NO: 6333442 - DNA, 23 bp, Homo sapiens
gggacccctcgcaaccctgcctg

SEQ ID NO: 6333443 - DNA, 19 bp, Homo sapiens
gggacccctcgccccagcc

SEQ ID NO: 6333444 - DNA, 20 bp, Homo sapiens
gggacccctcgccccagcct

SEQ ID NO: 6333445 - DNA, 23 bp, Homo sapiens
gggacccctgctcccagcctgct

SEQ ID NO: 6333446 - DNA, 13 bp, Homo sapiens
gggacccgggcct

SEQ ID NO: 6333447 - DNA, 20 bp, Homo sapiens
gggaccctaagactcctcgg

SEQ ID NO: 6333448 - DNA, 20 bp, Homo sapiens
gggaccctccaaggccaggc

SEQ ID NO: 6333449 - DNA, 12 bp, Homo sapiens
gggaccctgctt

SEQ ID NO: 6333450 - DNA, 14 bp, Homo sapiens
gggaccctgggtgg

SEQ ID NO: 6333451 - DNA, 22 bp, Homo sapiens
gggaccctgtccggcccagtgc

SEQ ID NO: 6333452 - DNA, 17 bp, Homo sapiens
gggacccttgcctgcct

SEQ ID NO: 6333453 - DNA, 18 bp, Homo sapiens
gggacccttgcctgcctc

SEQ ID NO: 6333454 - DNA, 15 bp, Homo sapiens
gggaccgcctggccc

SEQ ID NO: 6333455 - DNA, 16 bp, Homo sapiens
gggaccgcctggccct

SEQ ID NO: 6333456 - DNA, 22 bp, Homo sapiens
gggaccgcctggccctccctcc

SEQ ID NO: 6333457 - DNA, 19 bp, Homo sapiens
gggaccgcgctagggctcc

SEQ ID NO: 6333458 - DNA, 17 bp, Homo sapiens
gggaccggcagagctct

SEQ ID NO: 6333459 - DNA, 21 bp, Homo sapiens
gggaccggcagagctctacag

SEQ ID NO: 6333460 - DNA, 22 bp, Homo sapiens
gggaccgtgccccacctcccca

SEQ ID NO: 6333461 - DNA, 18 bp, Homo sapiens
gggaccgtgcgagctgcc

SEQ ID NO: 6333462 - DNA, 17 bp, Homo sapiens
gggacctataactgccc

SEQ ID NO: 6333463 - DNA, 12 bp, Homo sapiens
gggacctcagcc

SEQ ID NO: 6333464 - DNA, 16 bp, Homo sapiens
gggacctcagcctgca

SEQ ID NO: 6333465 - DNA, 12 bp, Homo sapiens
gggacctcaggc

SEQ ID NO: 6333466 - DNA, 15 bp, Homo sapiens
gggacctcaggcctg

SEQ ID NO: 6333467 - DNA, 14 bp, Homo sapiens
gggacctcaggggc

SEQ ID NO: 6333468 - DNA, 20 bp, Homo sapiens
gggacctccccagcccagga

SEQ ID NO: 6333469 - DNA, 16 bp, Homo sapiens
gggacctcctccctca

SEQ ID NO: 6333470 - DNA, 19 bp, Homo sapiens
gggacctgaactgtcctgg

SEQ ID NO: 6333471 - DNA, 17 bp, Homo sapiens
gggacctgccaggcagg

SEQ ID NO: 6333472 - DNA, 18 bp, Homo sapiens
gggacctgccaggcaggg

SEQ ID NO: 6333473 - DNA, 17 bp, Homo sapiens
gggacctggagctgcca

SEQ ID NO: 6333474 - DNA, 12 bp, Homo sapiens
gggacctggggg

SEQ ID NO: 6333475 - DNA, 22 bp, Homo sapiens
gggacctggggtggggaggcag

SEQ ID NO: 6333476 - DNA, 23 bp, Homo sapiens
gggacctgtcccccactctctca

SEQ ID NO: 6333477 - DNA, 12 bp, Homo sapiens
gggaccttcagg

SEQ ID NO: 6333478 - DNA, 13 bp, Homo sapiens
gggaccttggtct

SEQ ID NO: 6333479 - DNA, 17 bp, Homo sapiens
gggaccttgtgggacca

SEQ ID NO: 6333480 - DNA, 14 bp, Homo sapiens
gggacctttaactt

SEQ ID NO: 6333481 - DNA, 15 bp, Homo sapiens
gggacctttagtggt

SEQ ID NO: 6333482 - DNA, 13 bp, Homo sapiens
gggaccttttggg

SEQ ID NO: 6333483 - DNA, 20 bp, Homo sapiens
gggacgaagaagagccacag

SEQ ID NO: 6333484 - DNA, 21 bp, Homo sapiens
gggacgagcagagcgcagccc

SEQ ID NO: 6333485 - DNA, 22 bp, Homo sapiens
gggacgagcagagcgcagcccc

SEQ ID NO: 6333486 - DNA, 12 bp, Homo sapiens
gggacgcaggcc

SEQ ID NO: 6333487 - DNA, 18 bp, Homo sapiens
gggacgcaggcccctctc

SEQ ID NO: 6333488 - DNA, 15 bp, Homo sapiens
gggacgcccagcccc

SEQ ID NO: 6333489 - DNA, 16 bp, Homo sapiens
gggacgcccagccccc

SEQ ID NO: 6333490 - DNA, 17 bp, Homo sapiens
gggacgcccagccccca

SEQ ID NO: 6333491 - DNA, 12 bp, Homo sapiens
gggacgcccctt

SEQ ID NO: 6333492 - DNA, 16 bp, Homo sapiens
gggacgcctgccctgc

SEQ ID NO: 6333493 - DNA, 22 bp, Homo sapiens
gggacgcctgggggtgccagga

SEQ ID NO: 6333494 - DNA, 17 bp, Homo sapiens
gggacgcgcacacacac

SEQ ID NO: 6333495 - DNA, 20 bp, Homo sapiens
gggacgcgcacacacaccgg

SEQ ID NO: 6333496 - DNA, 16 bp, Homo sapiens
gggacgcggaggagga

SEQ ID NO: 6333497 - DNA, 21 bp, Homo sapiens
gggacgcggaggaggaagagg

SEQ ID NO: 6333498 - DNA, 13 bp, Homo sapiens
gggacgcttccag

SEQ ID NO: 6333499 - DNA, 15 bp, Homo sapiens
gggacgcttccagac

SEQ ID NO: 6333500 - DNA, 22 bp, Homo sapiens
gggacggagcactgtgcagccg

SEQ ID NO: 6333501 - DNA, 13 bp, Homo sapiens
gggacggctcctg

SEQ ID NO: 6333502 - DNA, 14 bp, Homo sapiens
gggacgggacagac

SEQ ID NO: 6333503 - DNA, 17 bp, Homo sapiens
gggacgggatgaggagc

SEQ ID NO: 6333504 - DNA, 20 bp, Homo sapiens
gggacggggcccgccccagg

SEQ ID NO: 6333505 - DNA, 14 bp, Homo sapiens
gggacggggctccc

SEQ ID NO: 6333506 - DNA, 21 bp, Homo sapiens
gggacggggggccccagtcag

SEQ ID NO: 6333507 - DNA, 20 bp, Homo sapiens
gggacggtcagtttggtgtc

SEQ ID NO: 6333508 - DNA, 16 bp, Homo sapiens
gggacgtccctgccca

SEQ ID NO: 6333509 - DNA, 18 bp, Homo sapiens
gggacgtctcatctccca

SEQ ID NO: 6333510 - DNA, 22 bp, Homo sapiens
gggacgtggctcagccagcact

SEQ ID NO: 6333511 - DNA, 17 bp, Homo sapiens
gggacgtgtacagcaca

SEQ ID NO: 6333512 - DNA, 21 bp, Homo sapiens
gggacgttgctgagccagctg

SEQ ID NO: 6333513 - DNA, 19 bp, Homo sapiens
gggactaacccaatgcctg

SEQ ID NO: 6333514 - DNA, 14 bp, Homo sapiens
gggactacagaagt

SEQ ID NO: 6333515 - DNA, 17 bp, Homo sapiens
gggactacaggcaccca

SEQ ID NO: 6333516 - DNA, 20 bp, Homo sapiens
gggactacccatagacatga

SEQ ID NO: 6333517 - DNA, 16 bp, Homo sapiens
gggactagaggcacgc

SEQ ID NO: 6333518 - DNA, 18 bp, Homo sapiens
gggactagcctggcttgg

SEQ ID NO: 6333519 - DNA, 20 bp, Homo sapiens
gggactcaagggtccagaag

SEQ ID NO: 6333520 - DNA, 16 bp, Homo sapiens
gggactcaatgcactg

SEQ ID NO: 6333521 - DNA, 17 bp, Homo sapiens
gggactcaatgcactga

SEQ ID NO: 6333522 - DNA, 23 bp, Homo sapiens
gggactcaatgcactgacattgt

SEQ ID NO: 6333523 - DNA, 18 bp, Homo sapiens
gggactcagcgtcccctg

SEQ ID NO: 6333524 - DNA, 14 bp, Homo sapiens
gggactcaggccag

SEQ ID NO: 6333525 - DNA, 15 bp, Homo sapiens
gggactcagggaccg

SEQ ID NO: 6333526 - DNA, 14 bp, Homo sapiens
gggactcaggtctg

SEQ ID NO: 6333527 - DNA, 21 bp, Homo sapiens
gggactccaagccctggggca

SEQ ID NO: 6333528 - DNA, 21 bp, Homo sapiens
gggactccatgctccttgaga

SEQ ID NO: 6333529 - DNA, 15 bp, Homo sapiens
gggactcccagcaga

SEQ ID NO: 6333530 - DNA, 12 bp, Homo sapiens
gggactcctcaa

SEQ ID NO: 6333531 - DNA, 16 bp, Homo sapiens
gggactcctccctggg

SEQ ID NO: 6333532 - DNA, 14 bp, Homo sapiens
gggactcctggtgc

SEQ ID NO: 6333533 - DNA, 16 bp, Homo sapiens
gggactcggtgagccg

SEQ ID NO: 6333534 - DNA, 13 bp, Homo sapiens
gggactctcctcc

SEQ ID NO: 6333535 - DNA, 20 bp, Homo sapiens
gggactctgaagcctctggg

SEQ ID NO: 6333536 - DNA, 22 bp, Homo sapiens
gggactctgagcgggaggcaga

SEQ ID NO: 6333537 - DNA, 20 bp, Homo sapiens
gggactctgcttggctgtcc

SEQ ID NO: 6333538 - DNA, 14 bp, Homo sapiens
gggactctggcaca

SEQ ID NO: 6333539 - DNA, 21 bp, Homo sapiens
gggactctgggctgtgcctga

SEQ ID NO: 6333540 - DNA, 16 bp, Homo sapiens
gggactctgtccaaca

SEQ ID NO: 6333541 - DNA, 19 bp, Homo sapiens
gggactctgtctggccagg

SEQ ID NO: 6333542 - DNA, 18 bp, Homo sapiens
gggactgaagccaaagtt

SEQ ID NO: 6333543 - DNA, 11 bp, Homo sapiens
gggactgagag

SEQ ID NO: 6333544 - DNA, 21 bp, Homo sapiens
gggactgaggggaggggagca

SEQ ID NO: 6333545 - DNA, 16 bp, Homo sapiens
gggactgatgtcatct

SEQ ID NO: 6333546 - DNA, 14 bp, Homo sapiens
gggactgccacctc

SEQ ID NO: 6333547 - DNA, 18 bp, Homo sapiens
gggactgccacctcccct

SEQ ID NO: 6333548 - DNA, 14 bp, Homo sapiens
gggactgcctctgc

SEQ ID NO: 6333549 - DNA, 21 bp, Homo sapiens
gggactgccttgtctctagta

SEQ ID NO: 6333550 - DNA, 17 bp, Homo sapiens
gggactgcggaggaagg

SEQ ID NO: 6333551 - DNA, 15 bp, Homo sapiens
gggactgctaaataa

SEQ ID NO: 6333552 - DNA, 21 bp, Homo sapiens
gggactgctacctctgagaag

SEQ ID NO: 6333553 - DNA, 12 bp, Homo sapiens
gggactgctgct

SEQ ID NO: 6333554 - DNA, 14 bp, Homo sapiens
gggactgctgctct

SEQ ID NO: 6333555 - DNA, 12 bp, Homo sapiens
gggactgctgtg

SEQ ID NO: 6333556 - DNA, 16 bp, Homo sapiens
gggactggacagccag

SEQ ID NO: 6333557 - DNA, 22 bp, Homo sapiens
gggactggcccacccctcttcc

SEQ ID NO: 6333558 - DNA, 20 bp, Homo sapiens
gggactgggagccgcagcag

SEQ ID NO: 6333559 - DNA, 13 bp, Homo sapiens
gggactgggaggg

SEQ ID NO: 6333560 - DNA, 14 bp, Homo sapiens
gggactgggagggc

SEQ ID NO: 6333561 - DNA, 12 bp, Homo sapiens
gggactgggggg

SEQ ID NO: 6333562 - DNA, 12 bp, Homo sapiens
gggactgggttt

SEQ ID NO: 6333563 - DNA, 21 bp, Homo sapiens
gggactgggtttggaccccag

SEQ ID NO: 6333564 - DNA, 16 bp, Homo sapiens
gtggaggaatgctccc

SEQ ID NO: 6333565 - DNA, 23 bp, Homo sapiens
gtggaggaatgctcccccatcct

SEQ ID NO: 6333566 - DNA, 18 bp, Homo sapiens
gtggaggaccgttctctg

SEQ ID NO: 6333567 - DNA, 17 bp, Homo sapiens
gtggaggagagcctggt

SEQ ID NO: 6333568 - DNA, 13 bp, Homo sapiens
gtggaggagagga

SEQ ID NO: 6333569 - DNA, 16 bp, Homo sapiens
gtggaggagctcagga

SEQ ID NO: 6333570 - DNA, 20 bp, Homo sapiens
gtggaggagctcaggacact

SEQ ID NO: 6333571 - DNA, 22 bp, Homo sapiens
gtggaggagctgagggagggag

SEQ ID NO: 6333572 - DNA, 21 bp, Homo sapiens
gtggaggagctgggcttctgt

SEQ ID NO: 6333573 - DNA, 17 bp, Homo sapiens
gtggaggaggaaggcaa

SEQ ID NO: 6333574 - DNA, 12 bp, Homo sapiens
gtggaggaggag

SEQ ID NO: 6333575 - DNA, 15 bp, Homo sapiens
gtggaggaggcctgg

SEQ ID NO: 6333576 - DNA, 19 bp, Homo sapiens
gtggaggagggagagccct

SEQ ID NO: 6333577 - DNA, 15 bp, Homo sapiens
gtggaggaggttggg

SEQ ID NO: 6333578 - DNA, 17 bp, Homo sapiens
gtggaggattgctgcca

SEQ ID NO: 6333579 - DNA, 18 bp, Homo sapiens
gtggaggattgctgccag

SEQ ID NO: 6333580 - DNA, 15 bp, Homo sapiens
gtggaggcagccagg

SEQ ID NO: 6333581 - DNA, 13 bp, Homo sapiens
gtggaggcctgat

SEQ ID NO: 6333582 - DNA, 17 bp, Homo sapiens
gtggaggcctgatgctg

SEQ ID NO: 6333583 - DNA, 18 bp, Homo sapiens
gtggaggcctgatgctgc

SEQ ID NO: 6333584 - DNA, 15 bp, Homo sapiens
gtggaggctcctgtg

SEQ ID NO: 6333585 - DNA, 13 bp, Homo sapiens
gtggaggctgctg

SEQ ID NO: 6333586 - DNA, 12 bp, Homo sapiens
gtggagggaggg

SEQ ID NO: 6333587 - DNA, 18 bp, Homo sapiens
gtggagggattgaacaca

SEQ ID NO: 6333588 - DNA, 22 bp, Homo sapiens
gtggagggattgaacacaggca

SEQ ID NO: 6333589 - DNA, 13 bp, Homo sapiens
gtggagggcacag

SEQ ID NO: 6333590 - DNA, 11 bp, Homo sapiens
gtggagggctg

SEQ ID NO: 6333591 - DNA, 22 bp, Homo sapiens
gtggaggggaatcggttcatca

SEQ ID NO: 6333592 - DNA, 13 bp, Homo sapiens
gtggaggggagct

SEQ ID NO: 6333593 - DNA, 15 bp, Homo sapiens
gtggaggggccctcc

SEQ ID NO: 6333594 - DNA, 14 bp, Homo sapiens
gtggaggggcttgg

SEQ ID NO: 6333595 - DNA, 15 bp, Homo sapiens
gtggaggggcttggg

SEQ ID NO: 6333596 - DNA, 23 bp, Homo sapiens
gtggagggggaggggagaagcca

SEQ ID NO: 6333597 - DNA, 15 bp, Homo sapiens
gtggagggggctggg

SEQ ID NO: 6333598 - DNA, 17 bp, Homo sapiens
gtggagggggctgggct

SEQ ID NO: 6333599 - DNA, 22 bp, Homo sapiens
gtggaggggtaggggctgggaa

SEQ ID NO: 6333600 - DNA, 12 bp, Homo sapiens
gtggaggggtgt

SEQ ID NO: 6333601 - DNA, 15 bp, Homo sapiens
gtggaggggtgtggc

SEQ ID NO: 6333602 - DNA, 16 bp, Homo sapiens
gtggaggggtgtggca

SEQ ID NO: 6333603 - DNA, 23 bp, Homo sapiens
gtggaggggtgtggcagtggttt

SEQ ID NO: 6333604 - DNA, 14 bp, Homo sapiens
gtggagggtagggg

SEQ ID NO: 6333605 - DNA, 19 bp, Homo sapiens
gtggagggtttgcactcca

SEQ ID NO: 6333606 - DNA, 17 bp, Homo sapiens
gtggaggtgtcaggctg

SEQ ID NO: 6333607 - DNA, 20 bp, Homo sapiens
gtggaggttctgtattttaa

SEQ ID NO: 6333608 - DNA, 19 bp, Homo sapiens
gtggaggttgagtgagccg

SEQ ID NO: 6333609 - DNA, 16 bp, Homo sapiens
gtggaggttgcagtga

SEQ ID NO: 6333610 - DNA, 23 bp, Homo sapiens
gtggaggttgcagtgaactgaga

SEQ ID NO: 6333611 - DNA, 15 bp, Homo sapiens
gtggaggttgtgcat

SEQ ID NO: 6333612 - DNA, 14 bp, Homo sapiens
gtggagtaaatatt

SEQ ID NO: 6333613 - DNA, 21 bp, Homo sapiens
gtggagtccagatggcaggct

SEQ ID NO: 6333614 - DNA, 15 bp, Homo sapiens
gtggagtccagctct

SEQ ID NO: 6333615 - DNA, 18 bp, Homo sapiens
gtggagtccagctctact

SEQ ID NO: 6333616 - DNA, 13 bp, Homo sapiens
gtggagtcccaac

SEQ ID NO: 6333617 - DNA, 20 bp, Homo sapiens
gtggagtcccttttgcatca

SEQ ID NO: 6333618 - DNA, 17 bp, Homo sapiens
gtggagtcgagctggcc

SEQ ID NO: 6333619 - DNA, 20 bp, Homo sapiens
gtggagtcggagtggacacc

SEQ ID NO: 6333620 - DNA, 13 bp, Homo sapiens
gtggagtctgagt

SEQ ID NO: 6333621 - DNA, 21 bp, Homo sapiens
gtggagtgagagcctttgcct

SEQ ID NO: 6333622 - DNA, 17 bp, Homo sapiens
gtggagtgcagtggtgc

SEQ ID NO: 6333623 - DNA, 15 bp, Homo sapiens
gtggagtggggcagt

SEQ ID NO: 6333624 - DNA, 14 bp, Homo sapiens
gtggagtgtattaa

SEQ ID NO: 6333625 - DNA, 18 bp, Homo sapiens
gtggagttctctgttcta

SEQ ID NO: 6333626 - DNA, 20 bp, Homo sapiens
gtggagtttgacattgtatg

SEQ ID NO: 6333627 - DNA, 17 bp, Homo sapiens
gtggagttttcatgaca

SEQ ID NO: 6333628 - DNA, 17 bp, Homo sapiens
gtggataaaactgtgta

SEQ ID NO: 6333629 - DNA, 18 bp, Homo sapiens
gtggataaaactgtgtaa

SEQ ID NO: 6333630 - DNA, 17 bp, Homo sapiens
gtggataaattttggaa

SEQ ID NO: 6333631 - DNA, 18 bp, Homo sapiens
gtggataaattttggaag

SEQ ID NO: 6333632 - DNA, 14 bp, Homo sapiens
gtggataacaaaga

SEQ ID NO: 6333633 - DNA, 15 bp, Homo sapiens
gtggataagggagag

SEQ ID NO: 6333634 - DNA, 20 bp, Homo sapiens
gtggataagtggctgtttca

SEQ ID NO: 6333635 - DNA, 20 bp, Homo sapiens
gtggataatcaggaaaaatg

SEQ ID NO: 6333636 - DNA, 15 bp, Homo sapiens
gtggatacagagcca

SEQ ID NO: 6333637 - DNA, 16 bp, Homo sapiens
gtggatacagagccac

SEQ ID NO: 6333638 - DNA, 17 bp, Homo sapiens
gtggatacgtgtcaatg

SEQ ID NO: 6333639 - DNA, 19 bp, Homo sapiens
gtggatactggggggcagg

SEQ ID NO: 6333640 - DNA, 22 bp, Homo sapiens
gtggatagagcagcctgctgct

SEQ ID NO: 6333641 - DNA, 16 bp, Homo sapiens
gtggatataaaatgtg

SEQ ID NO: 6333642 - DNA, 20 bp, Homo sapiens
gtggatatgacccacactgc

SEQ ID NO: 6333643 - DNA, 24 bp, Homo sapiens
gtggatatggtgcagagaagctgg

SEQ ID NO: 6333644 - DNA, 20 bp, Homo sapiens
gtggatatttatttaaacaa

SEQ ID NO: 6333645 - DNA, 22 bp, Homo sapiens
gtggatcacacctcagtgggaa

SEQ ID NO: 6333646 - DNA, 13 bp, Homo sapiens
gtggatcacagag

SEQ ID NO: 6333647 - DNA, 14 bp, Homo sapiens
gtggatcacagagg

SEQ ID NO: 6333648 - DNA, 21 bp, Homo sapiens
gtggatcaccagaggtcagga

SEQ ID NO: 6333649 - DNA, 19 bp, Homo sapiens
gtggatcatgaggtcagga

SEQ ID NO: 6333650 - DNA, 19 bp, Homo sapiens
gtggatccaaactgatcca

SEQ ID NO: 6333651 - DNA, 23 bp, Homo sapiens
gtggatcccctgcggtcaggctg

SEQ ID NO: 6333652 - DNA, 16 bp, Homo sapiens
gtggatctccttccct

SEQ ID NO: 6333653 - DNA, 14 bp, Homo sapiens
gtggatgacacaat

SEQ ID NO: 6333654 - DNA, 20 bp, Homo sapiens
gtggatgaggcttcttcctg

SEQ ID NO: 6333655 - DNA, 23 bp, Homo sapiens
gtggatgagggccaccaggaagc

SEQ ID NO: 6333656 - DNA, 15 bp, Homo sapiens
gtggatgatgtttcg

SEQ ID NO: 6333657 - DNA, 16 bp, Homo sapiens
gtggatgcaatttttc

SEQ ID NO: 6333658 - DNA, 19 bp, Homo sapiens
gtggatgcgcggaggagct

SEQ ID NO: 6333659 - DNA, 21 bp, Homo sapiens
gtggatgctccagggcagcct

SEQ ID NO: 6333660 - DNA, 14 bp, Homo sapiens
gtggatgctctcag

SEQ ID NO: 6333661 - DNA, 16 bp, Homo sapiens
gtggatgctctcaggc

SEQ ID NO: 6333662 - DNA, 22 bp, Homo sapiens
gtggatgctctcaggctgaggg

SEQ ID NO: 6333663 - DNA, 15 bp, Homo sapiens
gtggatgctgagctg

SEQ ID NO: 6333664 - DNA, 15 bp, Homo sapiens
gtggatgctgtgcta

SEQ ID NO: 6333665 - DNA, 13 bp, Homo sapiens
gtggatggacaga

SEQ ID NO: 6333666 - DNA, 14 bp, Homo sapiens
gtggatggacagat

SEQ ID NO: 6333667 - DNA, 16 bp, Homo sapiens
gtggatggacagatgg

SEQ ID NO: 6333668 - DNA, 18 bp, Homo sapiens
gtggatggacagatggac

SEQ ID NO: 6333669 - DNA, 17 bp, Homo sapiens
gtggatggatggacaga

SEQ ID NO: 6333670 - DNA, 17 bp, Homo sapiens
gtggatggattcatcat

SEQ ID NO: 6333671 - DNA, 13 bp, Homo sapiens
gtggatggcagtg

SEQ ID NO: 6333672 - DNA, 20 bp, Homo sapiens
gtggatggcccagcaggcag

SEQ ID NO: 6333673 - DNA, 16 bp, Homo sapiens
gtggatggccccagca

SEQ ID NO: 6333674 - DNA, 18 bp, Homo sapiens
gtggatggccgtggatgc

SEQ ID NO: 6333675 - DNA, 22 bp, Homo sapiens
gtggatgggaatttgtcagcgt

SEQ ID NO: 6333676 - DNA, 13 bp, Homo sapiens
gtggatgggaggc

SEQ ID NO: 6333677 - DNA, 20 bp, Homo sapiens
gtggatgggaggctcctggt

SEQ ID NO: 6333678 - DNA, 15 bp, Homo sapiens
gtggatgggccctgc

SEQ ID NO: 6333679 - DNA, 21 bp, Homo sapiens
gtggatgggttttatgagatg

SEQ ID NO: 6333680 - DNA, 18 bp, Homo sapiens
gtggatggtctccacctg

SEQ ID NO: 6333681 - DNA, 16 bp, Homo sapiens
gtggatggtgactttt

SEQ ID NO: 6333682 - DNA, 14 bp, Homo sapiens
gtggatgtaaattt

SEQ ID NO: 6333683 - DNA, 22 bp, Homo sapiens
gtggatgtccctattctgccat

SEQ ID NO: 6333684 - DNA, 19 bp, Homo sapiens
gtggatgtcccttccccac

SEQ ID NO: 6333685 - DNA, 22 bp, Homo sapiens
gtggatgtctctgacaaagtgt

SEQ ID NO: 6333686 - DNA, 13 bp, Homo sapiens
gtggatgtcttcc

SEQ ID NO: 6333687 - DNA, 13 bp, Homo sapiens
gtggatgtgagca

SEQ ID NO: 6333688 - DNA, 16 bp, Homo sapiens
gtggatgtgagcagaa

SEQ ID NO: 6333689 - DNA, 16 bp, Homo sapiens
gtggatgtgctggagg

SEQ ID NO: 6333690 - DNA, 18 bp, Homo sapiens
gtggatgtgctggagggg

SEQ ID NO: 6333691 - DNA, 15 bp, Homo sapiens
gtggatgttatgaac

SEQ ID NO: 6333692 - DNA, 14 bp, Homo sapiens
gtggatgtttttaa

SEQ ID NO: 6333693 - DNA, 21 bp, Homo sapiens
gtggattaaacttatgaatgt

SEQ ID NO: 6333694 - DNA, 18 bp, Homo sapiens
gtggattaatgtcaatgt

SEQ ID NO: 6333695 - DNA, 17 bp, Homo sapiens
gtggattatttcatttt

SEQ ID NO: 6333696 - DNA, 20 bp, Homo sapiens
gtggattcctccccaccctg

SEQ ID NO: 6333697 - DNA, 19 bp, Homo sapiens
gtggattcctgggcaagaa

SEQ ID NO: 6333698 - DNA, 13 bp, Homo sapiens
gtggattctatat

SEQ ID NO: 6333699 - DNA, 18 bp, Homo sapiens
gtggattcttgttttgct

SEQ ID NO: 6333700 - DNA, 13 bp, Homo sapiens
gtggattctttaa

SEQ ID NO: 6333701 - DNA, 16 bp, Homo sapiens
gtggattggctttgtg

SEQ ID NO: 6333702 - DNA, 22 bp, Homo sapiens
gtggattgggcagaatcctggg

SEQ ID NO: 6333703 - DNA, 19 bp, Homo sapiens
gtggattgggctgcaggct

SEQ ID NO: 6333704 - DNA, 20 bp, Homo sapiens
gtggattgtatttaagacat

SEQ ID NO: 6333705 - DNA, 14 bp, Homo sapiens
gtggattgtttttt

SEQ ID NO: 6333706 - DNA, 21 bp, Homo sapiens
gtggatttactgagagaaggt

SEQ ID NO: 6333707 - DNA, 14 bp, Homo sapiens
gtggatttcagttt

SEQ ID NO: 6333708 - DNA, 20 bp, Homo sapiens
gtggatttggagaccgaaga

SEQ ID NO: 6333709 - DNA, 20 bp, Homo sapiens
gtggattttctactgtaaga

SEQ ID NO: 6333710 - DNA, 16 bp, Homo sapiens
gtggattttgtagatg

SEQ ID NO: 6333711 - DNA, 19 bp, Homo sapiens
gtggattttttattattat

SEQ ID NO: 6333712 - DNA, 15 bp, Homo sapiens
gtggcaaaaaagaac

SEQ ID NO: 6333713 - DNA, 18 bp, Homo sapiens
gtggcaaaaagagtcaga

SEQ ID NO: 6333714 - DNA, 14 bp, Homo sapiens
gtggcaaaatatta

SEQ ID NO: 6333715 - DNA, 18 bp, Homo sapiens
gtggcaaagagaggtcca

SEQ ID NO: 6333716 - DNA, 21 bp, Homo sapiens
gtggcaaagcagcaactattc

SEQ ID NO: 6333717 - DNA, 22 bp, Homo sapiens
gtggcaaagccttcattgcctt

SEQ ID NO: 6333718 - DNA, 19 bp, Homo sapiens
gtggcaacatttggggaga

SEQ ID NO: 6333719 - DNA, 20 bp, Homo sapiens
gtggcaacatttggggagag

SEQ ID NO: 6333720 - DNA, 15 bp, Homo sapiens
gtggcaaccccagac

SEQ ID NO: 6333721 - DNA, 18 bp, Homo sapiens
gtggcaaccctcagctgc

SEQ ID NO: 6333722 - DNA, 14 bp, Homo sapiens
gtggcaacctgctt

SEQ ID NO: 6333723 - DNA, 15 bp, Homo sapiens
gtggcaagaccaaaa

SEQ ID NO: 6333724 - DNA, 13 bp, Homo sapiens
gtggcaagctgca

SEQ ID NO: 6333725 - DNA, 15 bp, Homo sapiens
gtggcaaggctgtgc

SEQ ID NO: 6333726 - DNA, 16 bp, Homo sapiens
gtggcaagggggcggg

SEQ ID NO: 6333727 - DNA, 21 bp, Homo sapiens
gtggcaataaaggagaagaga

SEQ ID NO: 6333728 - DNA, 21 bp, Homo sapiens
gtggcaatgcttaaactaaat

SEQ ID NO: 6333729 - DNA, 18 bp, Homo sapiens
gtggcacacactgaccac

SEQ ID NO: 6333730 - DNA, 13 bp, Homo sapiens
gtggcacaccacc

SEQ ID NO: 6333731 - DNA, 13 bp, Homo sapiens
gtggcacagccct

SEQ ID NO: 6333732 - DNA, 15 bp, Homo sapiens
gtggcacagccctga

SEQ ID NO: 6333733 - DNA, 13 bp, Homo sapiens
gtggcacaggcac

SEQ ID NO: 6333734 - DNA, 16 bp, Homo sapiens
gtggcacaggcactga

SEQ ID NO: 6333735 - DNA, 19 bp, Homo sapiens
gtggcaccagaggtgcttc

SEQ ID NO: 6333736 - DNA, 20 bp, Homo sapiens
gtggcaccagatgcaacctc

SEQ ID NO: 6333737 - DNA, 13 bp, Homo sapiens
gtggcaccagcag

SEQ ID NO: 6333738 - DNA, 14 bp, Homo sapiens
gtggcaccagcagc

SEQ ID NO: 6333739 - DNA, 12 bp, Homo sapiens
gtggcacctcct

SEQ ID NO: 6333740 - DNA, 15 bp, Homo sapiens
gtggcacctcctgag

SEQ ID NO: 6333741 - DNA, 17 bp, Homo sapiens
gtggcacctcctgagaa

SEQ ID NO: 6333742 - DNA, 20 bp, Homo sapiens
gtggcacctcctgagaaggc

SEQ ID NO: 6333743 - DNA, 15 bp, Homo sapiens
gtggcacctgtctgc

SEQ ID NO: 6333744 - DNA, 18 bp, Homo sapiens
gggactggtccaggcatg

SEQ ID NO: 6333745 - DNA, 13 bp, Homo sapiens
gggactgtacaca

SEQ ID NO: 6333746 - DNA, 23 bp, Homo sapiens
gggactgtcttcaaccctgccct

SEQ ID NO: 6333747 - DNA, 15 bp, Homo sapiens
gggactgtgcctggc

SEQ ID NO: 6333748 - DNA, 16 bp, Homo sapiens
gggactgtgcctggct

SEQ ID NO: 6333749 - DNA, 21 bp, Homo sapiens
gggactgtgcctggctccctg

SEQ ID NO: 6333750 - DNA, 12 bp, Homo sapiens
gggactgttcct

SEQ ID NO: 6333751 - DNA, 19 bp, Homo sapiens
gggacttccttgctctccc

SEQ ID NO: 6333752 - DNA, 18 bp, Homo sapiens
gggacttcgggggcggct

SEQ ID NO: 6333753 - DNA, 22 bp, Homo sapiens
gggacttcgggggcggctctgg

SEQ ID NO: 6333754 - DNA, 19 bp, Homo sapiens
gggacttcttacccaaagc

SEQ ID NO: 6333755 - DNA, 13 bp, Homo sapiens
gggacttgaagtt

SEQ ID NO: 6333756 - DNA, 17 bp, Homo sapiens
gggacttggaagctccg

SEQ ID NO: 6333757 - DNA, 21 bp, Homo sapiens
gggacttggagagcaaaggcc

SEQ ID NO: 6333758 - DNA, 22 bp, Homo sapiens
gggacttggagagcaaaggccc

SEQ ID NO: 6333759 - DNA, 13 bp, Homo sapiens
gggacttggctgt

SEQ ID NO: 6333760 - DNA, 21 bp, Homo sapiens
gggacttggctgtccttcccc

SEQ ID NO: 6333761 - DNA, 21 bp, Homo sapiens
gggacttggggctgagagagt

SEQ ID NO: 6333762 - DNA, 13 bp, Homo sapiens
gggacttgtaaca

SEQ ID NO: 6333763 - DNA, 18 bp, Homo sapiens
gggacttgtcccaagtct

SEQ ID NO: 6333764 - DNA, 19 bp, Homo sapiens
gggactttcccacccagga

SEQ ID NO: 6333765 - DNA, 23 bp, Homo sapiens
gggactttcccacccaggaaagg

SEQ ID NO: 6333766 - DNA, 16 bp, Homo sapiens
gggactttccttccct

SEQ ID NO: 6333767 - DNA, 20 bp, Homo sapiens
gggactttccttccctctcc

SEQ ID NO: 6333768 - DNA, 22 bp, Homo sapiens
gggactttccttccctctcctg

SEQ ID NO: 6333769 - DNA, 12 bp, Homo sapiens
gggacttttatt

SEQ ID NO: 6333770 - DNA, 11 bp, Homo sapiens
gggagaaaaga

SEQ ID NO: 6333771 - DNA, 22 bp, Homo sapiens
gggagaaaagacggatggcagg

SEQ ID NO: 6333772 - DNA, 22 bp, Homo sapiens
gggagaaaaggaaaagaaaaaa

SEQ ID NO: 6333773 - DNA, 14 bp, Homo sapiens
gggagaaaatcatc

SEQ ID NO: 6333774 - DNA, 18 bp, Homo sapiens
gggagaaaatccaggtca

SEQ ID NO: 6333775 - DNA, 15 bp, Homo sapiens
gggagaaaattcaat

SEQ ID NO: 6333776 - DNA, 19 bp, Homo sapiens
gggagaaactgaaagtgtt

SEQ ID NO: 6333777 - DNA, 13 bp, Homo sapiens
gggagaaagcaat

SEQ ID NO: 6333778 - DNA, 14 bp, Homo sapiens
gggagaaagcaata

SEQ ID NO: 6333779 - DNA, 12 bp, Homo sapiens
gggagaaatact

SEQ ID NO: 6333780 - DNA, 19 bp, Homo sapiens
gggagaaatacttgaactt

SEQ ID NO: 6333781 - DNA, 16 bp, Homo sapiens
gggagaacccttcctg

SEQ ID NO: 6333782 - DNA, 14 bp, Homo sapiens
gggagaacctcagg

SEQ ID NO: 6333783 - DNA, 20 bp, Homo sapiens
gggagaacctcgttgacatg

SEQ ID NO: 6333784 - DNA, 13 bp, Homo sapiens
gggagaactgaag

SEQ ID NO: 6333785 - DNA, 13 bp, Homo sapiens
gggagaagaaaga

SEQ ID NO: 6333786 - DNA, 16 bp, Homo sapiens
gggagaagaaatccat

SEQ ID NO: 6333787 - DNA, 14 bp, Homo sapiens
gggagaagaagaat

SEQ ID NO: 6333788 - DNA, 15 bp, Homo sapiens
gggagaagaccgact

SEQ ID NO: 6333789 - DNA, 16 bp, Homo sapiens
gggagaagagtgtcag

SEQ ID NO: 6333790 - DNA, 20 bp, Homo sapiens
gggagaagctttttttcttg

SEQ ID NO: 6333791 - DNA, 14 bp, Homo sapiens
gggagaaggagagg

SEQ ID NO: 6333792 - DNA, 17 bp, Homo sapiens
gggagaaggagaggctc

SEQ ID NO: 6333793 - DNA, 13 bp, Homo sapiens
gggagaaggcctc

SEQ ID NO: 6333794 - DNA, 19 bp, Homo sapiens
gggagaaggcctcccctga

SEQ ID NO: 6333795 - DNA, 19 bp, Homo sapiens
gggagaagggccagcccta

SEQ ID NO: 6333796 - DNA, 16 bp, Homo sapiens
gggagaagggggtcaa

SEQ ID NO: 6333797 - DNA, 23 bp, Homo sapiens
gggagaaggtctccaagggaggg

SEQ ID NO: 6333798 - DNA, 17 bp, Homo sapiens
gggagacacctcagagc

SEQ ID NO: 6333799 - DNA, 14 bp, Homo sapiens
gggagacactggcc

SEQ ID NO: 6333800 - DNA, 14 bp, Homo sapiens
gggagacagcagcc

SEQ ID NO: 6333801 - DNA, 12 bp, Homo sapiens
gggagacagcat

SEQ ID NO: 6333802 - DNA, 18 bp, Homo sapiens
gggagacaggagcctagc

SEQ ID NO: 6333803 - DNA, 13 bp, Homo sapiens
gggagacaggcct

SEQ ID NO: 6333804 - DNA, 15 bp, Homo sapiens
gggagacagggctgc

SEQ ID NO: 6333805 - DNA, 19 bp, Homo sapiens
gggagacagggctgctccc

SEQ ID NO: 6333806 - DNA, 14 bp, Homo sapiens
gggagacagggtag

SEQ ID NO: 6333807 - DNA, 15 bp, Homo sapiens
gggagacatgtgaca

SEQ ID NO: 6333808 - DNA, 11 bp, Homo sapiens
gggagacccaa

SEQ ID NO: 6333809 - DNA, 16 bp, Homo sapiens
gggagaccctccccac

SEQ ID NO: 6333810 - DNA, 20 bp, Homo sapiens
gggagaccggcctgccagga

SEQ ID NO: 6333811 - DNA, 22 bp, Homo sapiens
gggagaccggcctgccaggagg

SEQ ID NO: 6333812 - DNA, 11 bp, Homo sapiens
gggagacctgg

SEQ ID NO: 6333813 - DNA, 18 bp, Homo sapiens
gggagacctgttggcctg

SEQ ID NO: 6333814 - DNA, 22 bp, Homo sapiens
gggagacctgttggcctgtggg

SEQ ID NO: 6333815 - DNA, 20 bp, Homo sapiens
gggagacggtttccagggag

SEQ ID NO: 6333816 - DNA, 17 bp, Homo sapiens
gggagacttggggccag

SEQ ID NO: 6333817 - DNA, 17 bp, Homo sapiens
gggagagaactgagcat

SEQ ID NO: 6333818 - DNA, 20 bp, Homo sapiens
gggagagacactcccaggga

SEQ ID NO: 6333819 - DNA, 21 bp, Homo sapiens
gggagagacaggcagcccagc

SEQ ID NO: 6333820 - DNA, 12 bp, Homo sapiens
gggagagactcg

SEQ ID NO: 6333821 - DNA, 15 bp, Homo sapiens
gggagagagaagcag

SEQ ID NO: 6333822 - DNA, 18 bp, Homo sapiens
gggagagagacgtgtaca

SEQ ID NO: 6333823 - DNA, 18 bp, Homo sapiens
gggagagagtgagagaga

SEQ ID NO: 6333824 - DNA, 19 bp, Homo sapiens
gggagagataatgaggcaa

SEQ ID NO: 6333825 - DNA, 21 bp, Homo sapiens
gggagagatccctgcagaacc

SEQ ID NO: 6333826 - DNA, 23 bp, Homo sapiens
gggagagcaggctggcagctctc

SEQ ID NO: 6333827 - DNA, 15 bp, Homo sapiens
gggagagccagctcc

SEQ ID NO: 6333828 - DNA, 15 bp, Homo sapiens
gggagagccagctct

SEQ ID NO: 6333829 - DNA, 13 bp, Homo sapiens
gggagagcccagg

SEQ ID NO: 6333830 - DNA, 14 bp, Homo sapiens
gggagagcccctgg

SEQ ID NO: 6333831 - DNA, 15 bp, Homo sapiens
gggagagcccctggg

SEQ ID NO: 6333832 - DNA, 11 bp, Homo sapiens
gggagagccct

SEQ ID NO: 6333833 - DNA, 14 bp, Homo sapiens
gggagagcctctgt

SEQ ID NO: 6333834 - DNA, 12 bp, Homo sapiens
gggagagcctgg

SEQ ID NO: 6333835 - DNA, 14 bp, Homo sapiens
gggagagcctggca

SEQ ID NO: 6333836 - DNA, 13 bp, Homo sapiens
gggagagcgccac

SEQ ID NO: 6333837 - DNA, 22 bp, Homo sapiens
gggagagcgccacccgcccgcc

SEQ ID NO: 6333838 - DNA, 23 bp, Homo sapiens
gggagagcgccacccgcccgccc

SEQ ID NO: 6333839 - DNA, 13 bp, Homo sapiens
gggagagcgcctc

SEQ ID NO: 6333840 - DNA, 14 bp, Homo sapiens
gggagagcggctgg

SEQ ID NO: 6333841 - DNA, 22 bp, Homo sapiens
gggagagctgagccagttgtcc

SEQ ID NO: 6333842 - DNA, 14 bp, Homo sapiens
gggagaggaagaga

SEQ ID NO: 6333843 - DNA, 12 bp, Homo sapiens
gggagaggaagc

SEQ ID NO: 6333844 - DNA, 15 bp, Homo sapiens
gggagaggacaggga

SEQ ID NO: 6333845 - DNA, 17 bp, Homo sapiens
gggagaggagaggctgc

SEQ ID NO: 6333846 - DNA, 21 bp, Homo sapiens
gggagaggatttttttctgag

SEQ ID NO: 6333847 - DNA, 13 bp, Homo sapiens
gggagaggcagaa

SEQ ID NO: 6333848 - DNA, 21 bp, Homo sapiens
gggagaggcagcccaggaagt

SEQ ID NO: 6333849 - DNA, 22 bp, Homo sapiens
gggagaggccatgattcgccca

SEQ ID NO: 6333850 - DNA, 17 bp, Homo sapiens
gggagagggaggtcact

SEQ ID NO: 6333851 - DNA, 20 bp, Homo sapiens
gggagagggcgcaggccgtg

SEQ ID NO: 6333852 - DNA, 15 bp, Homo sapiens
gggagagggggaggt

SEQ ID NO: 6333853 - DNA, 19 bp, Homo sapiens
gggagaggtcaccagctgc

SEQ ID NO: 6333854 - DNA, 16 bp, Homo sapiens
gggagaggtgccagca

SEQ ID NO: 6333855 - DNA, 18 bp, Homo sapiens
gggagagtacctgtgtgt

SEQ ID NO: 6333856 - DNA, 11 bp, Homo sapiens
gggagagtcca

SEQ ID NO: 6333857 - DNA, 17 bp, Homo sapiens
gggagagtccttagcct

SEQ ID NO: 6333858 - DNA, 21 bp, Homo sapiens
gggagagtccttagcctgggc

SEQ ID NO: 6333859 - DNA, 13 bp, Homo sapiens
gggagagtgaggt

SEQ ID NO: 6333860 - DNA, 18 bp, Homo sapiens
gggagagtgaggtcatcc

SEQ ID NO: 6333861 - DNA, 18 bp, Homo sapiens
gggagagtgtcaaccaga

SEQ ID NO: 6333862 - DNA, 16 bp, Homo sapiens
gggagagttccagagg

SEQ ID NO: 6333863 - DNA, 21 bp, Homo sapiens
gggagagttgaccgttttcat

SEQ ID NO: 6333864 - DNA, 20 bp, Homo sapiens
gggagagttgtgatggaggg

SEQ ID NO: 6333865 - DNA, 14 bp, Homo sapiens
gggagatccgccct

SEQ ID NO: 6333866 - DNA, 19 bp, Homo sapiens
gggagatcggggccagagg

SEQ ID NO: 6333867 - DNA, 16 bp, Homo sapiens
gggagatgcttctctc

SEQ ID NO: 6333868 - DNA, 12 bp, Homo sapiens
gggagatggagg

SEQ ID NO: 6333869 - DNA, 23 bp, Homo sapiens
gggagatggaggtagggctggct

SEQ ID NO: 6333870 - DNA, 14 bp, Homo sapiens
gggagatgggggct

SEQ ID NO: 6333871 - DNA, 22 bp, Homo sapiens
gggagatgggggcttcttcctc

SEQ ID NO: 6333872 - DNA, 18 bp, Homo sapiens
gggagatgggtgggagga

SEQ ID NO: 6333873 - DNA, 23 bp, Homo sapiens
gggagattaaaaccagagagaaa

SEQ ID NO: 6333874 - DNA, 16 bp, Homo sapiens
gggagatttggaatac

SEQ ID NO: 6333875 - DNA, 14 bp, Homo sapiens
gggagcaaaagaaa

SEQ ID NO: 6333876 - DNA, 17 bp, Homo sapiens
gggagcaaaaggcggtg

SEQ ID NO: 6333877 - DNA, 16 bp, Homo sapiens
gggagcaagccttcct

SEQ ID NO: 6333878 - DNA, 14 bp, Homo sapiens
gggagcacaaggcc

SEQ ID NO: 6333879 - DNA, 15 bp, Homo sapiens
gggagcaccctgagg

SEQ ID NO: 6333880 - DNA, 14 bp, Homo sapiens
gggagcactgcgtt

SEQ ID NO: 6333881 - DNA, 16 bp, Homo sapiens
gggagcactggagtgc

SEQ ID NO: 6333882 - DNA, 14 bp, Homo sapiens
gggagcactgttca

SEQ ID NO: 6333883 - DNA, 22 bp, Homo sapiens
gggagcacttgcgtcctgcaga

SEQ ID NO: 6333884 - DNA, 23 bp, Homo sapiens
gggagcacttgcgtcctgcagag

SEQ ID NO: 6333885 - DNA, 11 bp, Homo sapiens
gggagcagaaa

SEQ ID NO: 6333886 - DNA, 23 bp, Homo sapiens
gggagcagagaggtggatcctgt

SEQ ID NO: 6333887 - DNA, 15 bp, Homo sapiens
gggagcagctgggca

SEQ ID NO: 6333888 - DNA, 19 bp, Homo sapiens
gggagcagctgggcactgg

SEQ ID NO: 6333889 - DNA, 13 bp, Homo sapiens
gggagcaggagat

SEQ ID NO: 6333890 - DNA, 15 bp, Homo sapiens
gggagcaggaggcca

SEQ ID NO: 6333891 - DNA, 20 bp, Homo sapiens
gggagcaggaggccaataaa

SEQ ID NO: 6333892 - DNA, 17 bp, Homo sapiens
gggagcaggcagtgggg

SEQ ID NO: 6333893 - DNA, 20 bp, Homo sapiens
gggagcaggcagtggggctg

SEQ ID NO: 6333894 - DNA, 15 bp, Homo sapiens
gggagcagggaggtc

SEQ ID NO: 6333895 - DNA, 15 bp, Homo sapiens
gggagcaggtctctg

SEQ ID NO: 6333896 - DNA, 22 bp, Homo sapiens
gggagcaggtctctggcagaga

SEQ ID NO: 6333897 - DNA, 23 bp, Homo sapiens
gggagcaggttccccaagggccc

SEQ ID NO: 6333898 - DNA, 20 bp, Homo sapiens
gggagcagtgtcttccataa

SEQ ID NO: 6333899 - DNA, 19 bp, Homo sapiens
gggagcagttttcccctgg

SEQ ID NO: 6333900 - DNA, 20 bp, Homo sapiens
gggagcatagcagaggggcc

SEQ ID NO: 6333901 - DNA, 24 bp, Homo sapiens
gggagcatcggagggagtcccaga

SEQ ID NO: 6333902 - DNA, 19 bp, Homo sapiens
gggagcattctgcctgcct

SEQ ID NO: 6333903 - DNA, 22 bp, Homo sapiens
gggagcatttaatggcagctag

SEQ ID NO: 6333904 - DNA, 9 bp, Homo sapiens
gggagccaa

SEQ ID NO: 6333905 - DNA, 11 bp, Homo sapiens
gggagccaagg

SEQ ID NO: 6333906 - DNA, 12 bp, Homo sapiens
gggagccaaggg

SEQ ID NO: 6333907 - DNA, 14 bp, Homo sapiens
gggagccaagggat

SEQ ID NO: 6333908 - DNA, 15 bp, Homo sapiens
gggagccaagggatg

SEQ ID NO: 6333909 - DNA, 22 bp, Homo sapiens
gggagccaatactgagtgcctg

SEQ ID NO: 6333910 - DNA, 13 bp, Homo sapiens
gggagccacaggg

SEQ ID NO: 6333911 - DNA, 23 bp, Homo sapiens
gggagccacagggacgacccggg

SEQ ID NO: 6333912 - DNA, 23 bp, Homo sapiens
gggagccagaaatgggcagttct

SEQ ID NO: 6333913 - DNA, 15 bp, Homo sapiens
gggagccagactgtc

SEQ ID NO: 6333914 - DNA, 19 bp, Homo sapiens
gggagccagaggccaggat

SEQ ID NO: 6333915 - DNA, 13 bp, Homo sapiens
gggagccagctgc

SEQ ID NO: 6333916 - DNA, 14 bp, Homo sapiens
gggagccagctgct

SEQ ID NO: 6333917 - DNA, 18 bp, Homo sapiens
gggcagcctgtgggagaa

SEQ ID NO: 6333918 - DNA, 18 bp, Homo sapiens
gggcagcgcatgtgtgca

SEQ ID NO: 6333919 - DNA, 18 bp, Homo sapiens
gggcagcgcccttcctct

SEQ ID NO: 6333920 - DNA, 20 bp, Homo sapiens
gggcagcgcccttcctctcc

SEQ ID NO: 6333921 - DNA, 23 bp, Homo sapiens
gggcagcgcccttcctctccacc

SEQ ID NO: 6333922 - DNA, 21 bp, Homo sapiens
gggcagcggccccgcacccct

SEQ ID NO: 6333923 - DNA, 17 bp, Homo sapiens
gggcagcgggccaggcc

SEQ ID NO: 6333924 - DNA, 20 bp, Homo sapiens
gggcagcgggccaggcccgc

SEQ ID NO: 6333925 - DNA, 14 bp, Homo sapiens
gggcagcggggctg

SEQ ID NO: 6333926 - DNA, 15 bp, Homo sapiens
gggcagcggggctgg

SEQ ID NO: 6333927 - DNA, 22 bp, Homo sapiens
gggcagcggggctggccatgag

SEQ ID NO: 6333928 - DNA, 11 bp, Homo sapiens
gggcagctcct

SEQ ID NO: 6333929 - DNA, 17 bp, Homo sapiens
gggcagctcctctgtct

SEQ ID NO: 6333930 - DNA, 19 bp, Homo sapiens
gggcagctcctgaccaaag

SEQ ID NO: 6333931 - DNA, 12 bp, Homo sapiens
gggcagctgcct

SEQ ID NO: 6333932 - DNA, 17 bp, Homo sapiens
gtggggcagctcctctg

SEQ ID NO: 6333933 - DNA, 21 bp, Homo sapiens
gtggggcaggagtgccaggac

SEQ ID NO: 6333934 - DNA, 22 bp, Homo sapiens
gtggggcaggattctctgcagc

SEQ ID NO: 6333935 - DNA, 15 bp, Homo sapiens
gtggggccagcgctg

SEQ ID NO: 6333936 - DNA, 14 bp, Homo sapiens
gtggggccaggacc

SEQ ID NO: 6333937 - DNA, 13 bp, Homo sapiens
gtggggccaggcc

SEQ ID NO: 6333938 - DNA, 15 bp, Homo sapiens
gtggggccaggccag

SEQ ID NO: 6333939 - DNA, 22 bp, Homo sapiens
gtggggccaggccaggaccaca

SEQ ID NO: 6333940 - DNA, 14 bp, Homo sapiens
gtggggccaggtca

SEQ ID NO: 6333941 - DNA, 22 bp, Homo sapiens
gtggggccatgctgagagctgg

SEQ ID NO: 6333942 - DNA, 20 bp, Homo sapiens
gtggggcccatggccccagc

SEQ ID NO: 6333943 - DNA, 14 bp, Homo sapiens
gtggggcccatggg

SEQ ID NO: 6333944 - DNA, 21 bp, Homo sapiens
gtggggccccaaagcccagcc

SEQ ID NO: 6333945 - DNA, 13 bp, Homo sapiens
gtggggcccccag

SEQ ID NO: 6333946 - DNA, 19 bp, Homo sapiens
gtggggcccccagcaccct

SEQ ID NO: 6333947 - DNA, 23 bp, Homo sapiens
gtggggcccttggccccagagga

SEQ ID NO: 6333948 - DNA, 17 bp, Homo sapiens
gtggggccgccgcctct

SEQ ID NO: 6333949 - DNA, 13 bp, Homo sapiens
gtggggcctcagc

SEQ ID NO: 6333950 - DNA, 21 bp, Homo sapiens
gtggggcctttgccagcagag

SEQ ID NO: 6333951 - DNA, 22 bp, Homo sapiens
gtggggcctttgccagcagagc

SEQ ID NO: 6333952 - DNA, 22 bp, Homo sapiens
gtggggcgaattcatcccctcc

SEQ ID NO: 6333953 - DNA, 14 bp, Homo sapiens
gtggggcgaggcag

SEQ ID NO: 6333954 - DNA, 19 bp, Homo sapiens
gtggggctagactgggctg

SEQ ID NO: 6333955 - DNA, 21 bp, Homo sapiens
gtggggctaggggctggggcc

SEQ ID NO: 6333956 - DNA, 17 bp, Homo sapiens
gtggggctcctacctgg

SEQ ID NO: 6333957 - DNA, 18 bp, Homo sapiens
gtggggctgagctgggga

SEQ ID NO: 6333958 - DNA, 14 bp, Homo sapiens
gtggggctgcatcc

SEQ ID NO: 6333959 - DNA, 14 bp, Homo sapiens
gtggggctgccgga

SEQ ID NO: 6333960 - DNA, 12 bp, Homo sapiens
gtggggctgctc

SEQ ID NO: 6333961 - DNA, 13 bp, Homo sapiens
gtggggctggcat

SEQ ID NO: 6333962 - DNA, 12 bp, Homo sapiens
gtggggctgggc

SEQ ID NO: 6333963 - DNA, 14 bp, Homo sapiens
gtggggctgggcac

SEQ ID NO: 6333964 - DNA, 21 bp, Homo sapiens
gtggggctgggcaccgtgtcc

SEQ ID NO: 6333965 - DNA, 20 bp, Homo sapiens
gtggggctggtgggtctgca

SEQ ID NO: 6333966 - DNA, 13 bp, Homo sapiens
gtggggctgtcct

SEQ ID NO: 6333967 - DNA, 20 bp, Homo sapiens
gtggggcttagaatggggct

SEQ ID NO: 6333968 - DNA, 13 bp, Homo sapiens
gtggggcttcctg

SEQ ID NO: 6333969 - DNA, 17 bp, Homo sapiens
gtggggcttctctggga

SEQ ID NO: 6333970 - DNA, 13 bp, Homo sapiens
gtggggcttggcg

SEQ ID NO: 6333971 - DNA, 15 bp, Homo sapiens
gtggggcttggcgtg

SEQ ID NO: 6333972 - DNA, 18 bp, Homo sapiens
gtgggggaactgacgctg

SEQ ID NO: 6333973 - DNA, 20 bp, Homo sapiens
gtgggggaactgacgctgga

SEQ ID NO: 6333974 - DNA, 17 bp, Homo sapiens
gtgggggaagacctggc

SEQ ID NO: 6333975 - DNA, 21 bp, Homo sapiens
gtgggggagaatggctctggc

SEQ ID NO: 6333976 - DNA, 11 bp, Homo sapiens
gtgggggagcc

SEQ ID NO: 6333977 - DNA, 17 bp, Homo sapiens
gtgggggagcctctgga

SEQ ID NO: 6333978 - DNA, 16 bp, Homo sapiens
gtgggggagcctggag

SEQ ID NO: 6333979 - DNA, 20 bp, Homo sapiens
gtgggggatcacagcctctg

SEQ ID NO: 6333980 - DNA, 23 bp, Homo sapiens
gtgggggccaaacctgggacccc

SEQ ID NO: 6333981 - DNA, 18 bp, Homo sapiens
gtgggggccacctgcctg

SEQ ID NO: 6333982 - DNA, 19 bp, Homo sapiens
gtgggggccacctgcctgc

SEQ ID NO: 6333983 - DNA, 13 bp, Homo sapiens
gtgggggccaggc

SEQ ID NO: 6333984 - DNA, 13 bp, Homo sapiens
gtgggggcctgct

SEQ ID NO: 6333985 - DNA, 14 bp, Homo sapiens
gtgggggcggggaa

SEQ ID NO: 6333986 - DNA, 15 bp, Homo sapiens
gtgggggctgtggcc

SEQ ID NO: 6333987 - DNA, 16 bp, Homo sapiens
gtgggggctgtggccc

SEQ ID NO: 6333988 - DNA, 15 bp, Homo sapiens
gtggggggaggaagc

SEQ ID NO: 6333989 - DNA, 13 bp, Homo sapiens
gtggggggcagga

SEQ ID NO: 6333990 - DNA, 18 bp, Homo sapiens
gtggggggcaggatgggg

SEQ ID NO: 6333991 - DNA, 23 bp, Homo sapiens
gtggggggccatgttcccagaac

SEQ ID NO: 6333992 - DNA, 23 bp, Homo sapiens
gtgggggggagaaggcctcccct

SEQ ID NO: 6333993 - DNA, 17 bp, Homo sapiens
gtggggggtccagtctg

SEQ ID NO: 6333994 - DNA, 19 bp, Homo sapiens
gtggggggtcccaaagagt

SEQ ID NO: 6333995 - DNA, 17 bp, Homo sapiens
gtggggggtctgtgtca

SEQ ID NO: 6333996 - DNA, 19 bp, Homo sapiens
gtggggggtgcaggtgggc

SEQ ID NO: 6333997 - DNA, 17 bp, Homo sapiens
gtggggggtggacacag

SEQ ID NO: 6333998 - DNA, 12 bp, Homo sapiens
gtgggggtcatc

SEQ ID NO: 6333999 - DNA, 19 bp, Homo sapiens
gtgggggtcatcagggagg

SEQ ID NO: 6334000 - DNA, 16 bp, Homo sapiens
gtgggggtctgggagg

SEQ ID NO: 6334001 - DNA, 10 bp, Homo sapiens
gtgggggtgg

SEQ ID NO: 6334002 - DNA, 15 bp, Homo sapiens
gtgggggtggaggct

SEQ ID NO: 6334003 - DNA, 13 bp, Homo sapiens
gtgggggtggcca

SEQ ID NO: 6334004 - DNA, 14 bp, Homo sapiens
gtgggggtggccat

SEQ ID NO: 6334005 - DNA, 12 bp, Homo sapiens
gtgggggtgggt

SEQ ID NO: 6334006 - DNA, 14 bp, Homo sapiens
gtgggggtgggtca

SEQ ID NO: 6334007 - DNA, 22 bp, Homo sapiens
gtgggggtgtcacagaggcagt

SEQ ID NO: 6334008 - DNA, 18 bp, Homo sapiens
gtggggtaaggaggagaa

SEQ ID NO: 6334009 - DNA, 18 bp, Homo sapiens
gtggggtacatttctctg

SEQ ID NO: 6334010 - DNA, 23 bp, Homo sapiens
gtggggtcaagctgagctggctt

SEQ ID NO: 6334011 - DNA, 22 bp, Homo sapiens
gtggggtcactctggcagctca

SEQ ID NO: 6334012 - DNA, 13 bp, Homo sapiens
gtggggtctcagt

SEQ ID NO: 6334013 - DNA, 17 bp, Homo sapiens
gtggggtctccctctcc

SEQ ID NO: 6334014 - DNA, 21 bp, Homo sapiens
gtggggtctccctctcctgcc

SEQ ID NO: 6334015 - DNA, 16 bp, Homo sapiens
gtggggtctgggaggg

SEQ ID NO: 6334016 - DNA, 17 bp, Homo sapiens
gtggggtgaagctgggg

SEQ ID NO: 6334017 - DNA, 17 bp, Homo sapiens
gtggggtgcagctgggt

SEQ ID NO: 6334018 - DNA, 18 bp, Homo sapiens
gtggggtgcagctgggtg

SEQ ID NO: 6334019 - DNA, 21 bp, Homo sapiens
gtggggtgcagctgggtgggg

SEQ ID NO: 6334020 - DNA, 13 bp, Homo sapiens
gtggggtgcctga

SEQ ID NO: 6334021 - DNA, 21 bp, Homo sapiens
gtggggtgctggggctgcatg

SEQ ID NO: 6334022 - DNA, 19 bp, Homo sapiens
gtggggtggacctgggaca

SEQ ID NO: 6334023 - DNA, 20 bp, Homo sapiens
gtggggtggagcactggact

SEQ ID NO: 6334024 - DNA, 15 bp, Homo sapiens
gtggggtggctgcag

SEQ ID NO: 6334025 - DNA, 18 bp, Homo sapiens
gtggggtggctgcagcct

SEQ ID NO: 6334026 - DNA, 19 bp, Homo sapiens
gtggggtggctgcagcctc

SEQ ID NO: 6334027 - DNA, 10 bp, Homo sapiens
gtggggtggg

SEQ ID NO: 6334028 - DNA, 11 bp, Homo sapiens
gtggggtggga

SEQ ID NO: 6334029 - DNA, 15 bp, Homo sapiens
gtggggtgggctgga

SEQ ID NO: 6334030 - DNA, 12 bp, Homo sapiens
gtggggtggggg

SEQ ID NO: 6334031 - DNA, 16 bp, Homo sapiens
gtggggtggtgtcaga

SEQ ID NO: 6334032 - DNA, 19 bp, Homo sapiens
gtggggtgtgcatgccacg

SEQ ID NO: 6334033 - DNA, 16 bp, Homo sapiens
gtggggtgtgctggga

SEQ ID NO: 6334034 - DNA, 19 bp, Homo sapiens
gtggggtgtgctgggagct

SEQ ID NO: 6334035 - DNA, 14 bp, Homo sapiens
gtggggttatgtga

SEQ ID NO: 6334036 - DNA, 16 bp, Homo sapiens
gtggggttcagtagag

SEQ ID NO: 6334037 - DNA, 17 bp, Homo sapiens
gtggggttctgctggga

SEQ ID NO: 6334038 - DNA, 18 bp, Homo sapiens
gtggggttggggcaaagc

SEQ ID NO: 6334039 - DNA, 15 bp, Homo sapiens
gtggggtttcctgca

SEQ ID NO: 6334040 - DNA, 18 bp, Homo sapiens
gtggggtttcgcagcctg

SEQ ID NO: 6334041 - DNA, 22 bp, Homo sapiens
gtgggtaagactaaatctgtaa

SEQ ID NO: 6334042 - DNA, 13 bp, Homo sapiens
gtgggtaagagga

SEQ ID NO: 6334043 - DNA, 14 bp, Homo sapiens
gtgggtaagaggag

SEQ ID NO: 6334044 - DNA, 18 bp, Homo sapiens
gtgggtaagaggagcaga

SEQ ID NO: 6334045 - DNA, 22 bp, Homo sapiens
gtgggtaattgtacaataaatt

SEQ ID NO: 6334046 - DNA, 18 bp, Homo sapiens
gtgggtacccaggctggt

SEQ ID NO: 6334047 - DNA, 20 bp, Homo sapiens
gtgggtacccccaggaccag

SEQ ID NO: 6334048 - DNA, 20 bp, Homo sapiens
gtgggtaggagcccttctct

SEQ ID NO: 6334049 - DNA, 16 bp, Homo sapiens
gtgggtataaaagatg

SEQ ID NO: 6334050 - DNA, 17 bp, Homo sapiens
gtgggtatcccacctcc

SEQ ID NO: 6334051 - DNA, 16 bp, Homo sapiens
gtgggtatttcctgct

SEQ ID NO: 6334052 - DNA, 19 bp, Homo sapiens
gtgggtatttcctgctaca

SEQ ID NO: 6334053 - DNA, 17 bp, Homo sapiens
gtgggtcaactccaagg

SEQ ID NO: 6334054 - DNA, 14 bp, Homo sapiens
gtgggtcacctgac

SEQ ID NO: 6334055 - DNA, 19 bp, Homo sapiens
gtgggtcacctgacctctg

SEQ ID NO: 6334056 - DNA, 16 bp, Homo sapiens
gtgggtcagaacatgt

SEQ ID NO: 6334057 - DNA, 22 bp, Homo sapiens
gtgggtcagcccagcacctgct

SEQ ID NO: 6334058 - DNA, 13 bp, Homo sapiens
gtgggtcagtgtg

SEQ ID NO: 6334059 - DNA, 12 bp, Homo sapiens
gtgggtccagga

SEQ ID NO: 6334060 - DNA, 19 bp, Homo sapiens
gtgggtccaggaaggcagc

SEQ ID NO: 6334061 - DNA, 21 bp, Homo sapiens
gtgggtccaggaaggcagctg

SEQ ID NO: 6334062 - DNA, 17 bp, Homo sapiens
gtgggtccaggagatga

SEQ ID NO: 6334063 - DNA, 19 bp, Homo sapiens
gtgggtccaggggcccctc

SEQ ID NO: 6334064 - DNA, 23 bp, Homo sapiens
gtgggtccaggggcccctccagc

SEQ ID NO: 6334065 - DNA, 21 bp, Homo sapiens
gtgggtcccacttcccctcct

SEQ ID NO: 6334066 - DNA, 16 bp, Homo sapiens
gtgggtcccagagacc

SEQ ID NO: 6334067 - DNA, 18 bp, Homo sapiens
gtgggtcccggctctgtg

SEQ ID NO: 6334068 - DNA, 12 bp, Homo sapiens
gtgggtcctggg

SEQ ID NO: 6334069 - DNA, 15 bp, Homo sapiens
gtgggtcgaggattc

SEQ ID NO: 6334070 - DNA, 22 bp, Homo sapiens
gtgggtcgaggattctgtgcct

SEQ ID NO: 6334071 - DNA, 22 bp, Homo sapiens
gtgggtctacctcatctctgaa

SEQ ID NO: 6334072 - DNA, 14 bp, Homo sapiens
gtgggtctctggaa

SEQ ID NO: 6334073 - DNA, 18 bp, Homo sapiens
gtgggtctctgtgtgtgt

SEQ ID NO: 6334074 - DNA, 14 bp, Homo sapiens
gtgggtctgagctg

SEQ ID NO: 6334075 - DNA, 16 bp, Homo sapiens
gtgggtctgagctgga

SEQ ID NO: 6334076 - DNA, 24 bp, Homo sapiens
gtgggtctgtaagaccttggtagg

SEQ ID NO: 6334077 - DNA, 16 bp, Homo sapiens
gtgggtctgtgtgtgt

SEQ ID NO: 6334078 - DNA, 21 bp, Homo sapiens
gtgggtcttcagggggccagg

SEQ ID NO: 6334079 - DNA, 20 bp, Homo sapiens
gtgggtgaagtgcctgctgg

SEQ ID NO: 6334080 - DNA, 15 bp, Homo sapiens
gtgggtgagatgctg

SEQ ID NO: 6334081 - DNA, 20 bp, Homo sapiens
gtgggtgagatgctggagaa

SEQ ID NO: 6334082 - DNA, 13 bp, Homo sapiens
gtgggtgaggctg

SEQ ID NO: 6334083 - DNA, 17 bp, Homo sapiens
gtgggtgatcagaaggc

SEQ ID NO: 6334084 - DNA, 23 bp, Homo sapiens
gtgggtgatgcttttgctgctgc

SEQ ID NO: 6334085 - DNA, 17 bp, Homo sapiens
gtgggtgattcctccca

SEQ ID NO: 6334086 - DNA, 14 bp, Homo sapiens
gtgggtgccctctc

SEQ ID NO: 6334087 - DNA, 15 bp, Homo sapiens
gtgggtgccctctcc

SEQ ID NO: 6334088 - DNA, 13 bp, Homo sapiens
gtgggtgctcaga

SEQ ID NO: 6334089 - DNA, 13 bp, Homo sapiens
gtgggtgctgata

SEQ ID NO: 6334090 - DNA, 15 bp, Homo sapiens
gtgggtgctgccctg

SEQ ID NO: 6334091 - DNA, 17 bp, Homo sapiens
gtgggtggaagggctgg

SEQ ID NO: 6334092 - DNA, 18 bp, Homo sapiens
gtgggtggaagggctggg

SEQ ID NO: 6334093 - DNA, 17 bp, Homo sapiens
gtgggtggatcacctga

SEQ ID NO: 6334094 - DNA, 18 bp, Homo sapiens
gtgggtggcacctcctga

SEQ ID NO: 6334095 - DNA, 20 bp, Homo sapiens
gtgggtgggaatgcaagtga

SEQ ID NO: 6334096 - DNA, 17 bp, Homo sapiens
gtgggtgggcagggagg

SEQ ID NO: 6334097 - DNA, 16 bp, Homo sapiens
gtgggtgggcctgact

SEQ ID NO: 6334098 - DNA, 15 bp, Homo sapiens
gtgggtggggaagga

SEQ ID NO: 6334099 - DNA, 18 bp, Homo sapiens
gtgggtggggaggccctg

SEQ ID NO: 6334100 - DNA, 22 bp, Homo sapiens
gtgggtggggaggccctgcctg

SEQ ID NO: 6334101 - DNA, 12 bp, Homo sapiens
gtgggtggggct

SEQ ID NO: 6334102 - DNA, 19 bp, Homo sapiens
gtgggtggggtacaggcag

SEQ ID NO: 6334103 - DNA, 20 bp, Homo sapiens
gtgggtgtagattacctgcc

SEQ ID NO: 6334104 - DNA, 16 bp, Homo sapiens
gtgggtgtctccctcg

SEQ ID NO: 6334105 - DNA, 15 bp, Homo sapiens
gtgggtgtgagcagg

SEQ ID NO: 6334106 - DNA, 15 bp, Homo sapiens
gtgggtgtgtgactc

SEQ ID NO: 6334107 - DNA, 13 bp, Homo sapiens
gtgggtgtgtgcg

SEQ ID NO: 6334108 - DNA, 14 bp, Homo sapiens
gtgggtgtgtgcgc

SEQ ID NO: 6334109 - DNA, 23 bp, Homo sapiens
gtgggtgtttattacaagtggct

SEQ ID NO: 6334110 - DNA, 17 bp, Homo sapiens
gtgggttatcagttaac

SEQ ID NO: 6334111 - DNA, 22 bp, Homo sapiens
gtgggttcagaaccaagatgcc

SEQ ID NO: 6334112 - DNA, 23 bp, Homo sapiens
gggcagctgcctcccctcctctg

SEQ ID NO: 6334113 - DNA, 15 bp, Homo sapiens
gggcagctgcctggc

SEQ ID NO: 6334114 - DNA, 17 bp, Homo sapiens
gggcagctggctctgaa

SEQ ID NO: 6334115 - DNA, 13 bp, Homo sapiens
gggcagctgggcc

SEQ ID NO: 6334116 - DNA, 14 bp, Homo sapiens
gggcagctgggccc

SEQ ID NO: 6334117 - DNA, 18 bp, Homo sapiens
gggcagctgggcccaacc

SEQ ID NO: 6334118 - DNA, 23 bp, Homo sapiens
gggcaggaacggtggaggcagag

SEQ ID NO: 6334119 - DNA, 16 bp, Homo sapiens
gggcaggaaggagagc

SEQ ID NO: 6334120 - DNA, 18 bp, Homo sapiens
gggcaggaaggagagcct

SEQ ID NO: 6334121 - DNA, 18 bp, Homo sapiens
gggcaggaatcaaggagc

SEQ ID NO: 6334122 - DNA, 19 bp, Homo sapiens
gggcaggaatcaaggagcc

SEQ ID NO: 6334123 - DNA, 22 bp, Homo sapiens
gggcaggacaggtcctccctgc

SEQ ID NO: 6334124 - DNA, 14 bp, Homo sapiens
gggcaggaccagcc

SEQ ID NO: 6334125 - DNA, 16 bp, Homo sapiens
gggcaggaccctgctg

SEQ ID NO: 6334126 - DNA, 22 bp, Homo sapiens
gggcaggactcagctccccaga

SEQ ID NO: 6334127 - DNA, 14 bp, Homo sapiens
gggcaggagcctag

SEQ ID NO: 6334128 - DNA, 20 bp, Homo sapiens
gggcaggagcctagaggagg

SEQ ID NO: 6334129 - DNA, 21 bp, Homo sapiens
gggcaggagcctagaggagga

SEQ ID NO: 6334130 - DNA, 12 bp, Homo sapiens
gggcaggaggcc

SEQ ID NO: 6334131 - DNA, 18 bp, Homo sapiens
gggcaggaggcctggcct

SEQ ID NO: 6334132 - DNA, 18 bp, Homo sapiens
gggcaggagggccctacc

SEQ ID NO: 6334133 - DNA, 19 bp, Homo sapiens
gggcaggagtagctgagct

SEQ ID NO: 6334134 - DNA, 14 bp, Homo sapiens
gggcaggagtgcca

SEQ ID NO: 6334135 - DNA, 17 bp, Homo sapiens
gggcaggagtgccagga

SEQ ID NO: 6334136 - DNA, 19 bp, Homo sapiens
gggcaggatgggggagagg

SEQ ID NO: 6334137 - DNA, 20 bp, Homo sapiens
gggcaggattctctgcagcc

SEQ ID NO: 6334138 - DNA, 21 bp, Homo sapiens
gggcaggattctctgcagccc

SEQ ID NO: 6334139 - DNA, 15 bp, Homo sapiens
gggcaggcacagcac

SEQ ID NO: 6334140 - DNA, 13 bp, Homo sapiens
gggcaggcagaga

SEQ ID NO: 6334141 - DNA, 15 bp, Homo sapiens
gggcaggcagagctc

SEQ ID NO: 6334142 - DNA, 13 bp, Homo sapiens
gggcaggcagcta

SEQ ID NO: 6334143 - DNA, 23 bp, Homo sapiens
gggcaggcagctaggcagggagg

SEQ ID NO: 6334144 - DNA, 21 bp, Homo sapiens
gggcaggccacctggctctca

SEQ ID NO: 6334145 - DNA, 16 bp, Homo sapiens
gggcaggccaggggag

SEQ ID NO: 6334146 - DNA, 22 bp, Homo sapiens
gggcaggcccctttggacctgc

SEQ ID NO: 6334147 - DNA, 23 bp, Homo sapiens
gggcaggccctgcactgtcctgc

SEQ ID NO: 6334148 - DNA, 17 bp, Homo sapiens
gggcaggccgggcctgc

SEQ ID NO: 6334149 - DNA, 11 bp, Homo sapiens
gggcaggcctg

SEQ ID NO: 6334150 - DNA, 19 bp, Homo sapiens
gggcaggcctgggacccag

SEQ ID NO: 6334151 - DNA, 20 bp, Homo sapiens
gggcaggcctgttccctgag

SEQ ID NO: 6334152 - DNA, 19 bp, Homo sapiens
gggcaggcgcagaggtccc

SEQ ID NO: 6334153 - DNA, 16 bp, Homo sapiens
gggcaggctctctcct

SEQ ID NO: 6334154 - DNA, 13 bp, Homo sapiens
gggcaggctgggc

SEQ ID NO: 6334155 - DNA, 17 bp, Homo sapiens
gggcagggacttgcctc

SEQ ID NO: 6334156 - DNA, 19 bp, Homo sapiens
gggcagggagctgggcccg

SEQ ID NO: 6334157 - DNA, 13 bp, Homo sapiens
gggcagggagggg

SEQ ID NO: 6334158 - DNA, 15 bp, Homo sapiens
gggcagggaggtggg

SEQ ID NO: 6334159 - DNA, 12 bp, Homo sapiens
gggcagggcagc

SEQ ID NO: 6334160 - DNA, 13 bp, Homo sapiens
gggcagggcagcc

SEQ ID NO: 6334161 - DNA, 20 bp, Homo sapiens
gggcagggcatctcctgtgc

SEQ ID NO: 6334162 - DNA, 11 bp, Homo sapiens
gggcagggcca

SEQ ID NO: 6334163 - DNA, 12 bp, Homo sapiens
gggcagggccac

SEQ ID NO: 6334164 - DNA, 14 bp, Homo sapiens
gggcagggcccacg

SEQ ID NO: 6334165 - DNA, 16 bp, Homo sapiens
gggcagggcccacgtg

SEQ ID NO: 6334166 - DNA, 13 bp, Homo sapiens
gggcagggcccag

SEQ ID NO: 6334167 - DNA, 14 bp, Homo sapiens
gggcagggcccagg

SEQ ID NO: 6334168 - DNA, 15 bp, Homo sapiens
gggcagggccctgtg

SEQ ID NO: 6334169 - DNA, 21 bp, Homo sapiens
gggcagggcgagctgcaggaa

SEQ ID NO: 6334170 - DNA, 18 bp, Homo sapiens
gggcagggcggctaggcc

SEQ ID NO: 6334171 - DNA, 12 bp, Homo sapiens
gggcagggctgg

SEQ ID NO: 6334172 - DNA, 14 bp, Homo sapiens
gggcagggctggga

SEQ ID NO: 6334173 - DNA, 16 bp, Homo sapiens
gggcaggggcaggggc

SEQ ID NO: 6334174 - DNA, 12 bp, Homo sapiens
gggcaggggcgg

SEQ ID NO: 6334175 - DNA, 13 bp, Homo sapiens
gggcaggggctgg

SEQ ID NO: 6334176 - DNA, 23 bp, Homo sapiens
gggcagggggcttggctcgcacc

SEQ ID NO: 6334177 - DNA, 19 bp, Homo sapiens
gggcagggggtatgcagag

SEQ ID NO: 6334178 - DNA, 20 bp, Homo sapiens
gggcagggggttctgggacc

SEQ ID NO: 6334179 - DNA, 15 bp, Homo sapiens
gggcaggggtgtcct

SEQ ID NO: 6334180 - DNA, 19 bp, Homo sapiens
gggcagggtctctgctcca

SEQ ID NO: 6334181 - DNA, 14 bp, Homo sapiens
gggcagggtgaccc

SEQ ID NO: 6334182 - DNA, 16 bp, Homo sapiens
gggcagggtgagaagc

SEQ ID NO: 6334183 - DNA, 17 bp, Homo sapiens
gggcagggttctagaag

SEQ ID NO: 6334184 - DNA, 20 bp, Homo sapiens
gggcaggtcaggaccaggac

SEQ ID NO: 6334185 - DNA, 22 bp, Homo sapiens
gggcaggtccagctctgtgggc

SEQ ID NO: 6334186 - DNA, 22 bp, Homo sapiens
gggcaggtcctagtcgggcagg

SEQ ID NO: 6334187 - DNA, 18 bp, Homo sapiens
gggcaggtcctgcccatg

SEQ ID NO: 6334188 - DNA, 21 bp, Homo sapiens
gggcaggtcctggggaggctg

SEQ ID NO: 6334189 - DNA, 23 bp, Homo sapiens
gggcaggtcctggggaggctgag

SEQ ID NO: 6334190 - DNA, 11 bp, Homo sapiens
gggcaggtgaa

SEQ ID NO: 6334191 - DNA, 16 bp, Homo sapiens
gggcaggtggcctctg

SEQ ID NO: 6334192 - DNA, 16 bp, Homo sapiens
gggcaggtggtggagg

SEQ ID NO: 6334193 - DNA, 18 bp, Homo sapiens
gggcaggttcctggggcc

SEQ ID NO: 6334194 - DNA, 19 bp, Homo sapiens
gggcaggttcctggggccg

SEQ ID NO: 6334195 - DNA, 21 bp, Homo sapiens
gggcaggttctgcctgctttg

SEQ ID NO: 6334196 - DNA, 14 bp, Homo sapiens
gggcagtacctggg

SEQ ID NO: 6334197 - DNA, 16 bp, Homo sapiens
gggcagtactcctccc

SEQ ID NO: 6334198 - DNA, 19 bp, Homo sapiens
gggcagtactcctccctgg

SEQ ID NO: 6334199 - DNA, 23 bp, Homo sapiens
gggcagtactcctccctgggggc

SEQ ID NO: 6334200 - DNA, 20 bp, Homo sapiens
gggcagtagaaggtcggagg

SEQ ID NO: 6334201 - DNA, 21 bp, Homo sapiens
gggcagtatgtgatggactgg

SEQ ID NO: 6334202 - DNA, 16 bp, Homo sapiens
gggcagtcaccaccca

SEQ ID NO: 6334203 - DNA, 21 bp, Homo sapiens
gggcagtcaccacccagccct

SEQ ID NO: 6334204 - DNA, 13 bp, Homo sapiens
gggcagtcgctgc

SEQ ID NO: 6334205 - DNA, 16 bp, Homo sapiens
gggcagtcgctgcagg

SEQ ID NO: 6334206 - DNA, 17 bp, Homo sapiens
gggcagtctgagagagg

SEQ ID NO: 6334207 - DNA, 20 bp, Homo sapiens
gggcagtctgagagaggcca

SEQ ID NO: 6334208 - DNA, 14 bp, Homo sapiens
gggcagtctgctct

SEQ ID NO: 6334209 - DNA, 16 bp, Homo sapiens
gggcagtctgctctgc

SEQ ID NO: 6334210 - DNA, 17 bp, Homo sapiens
gggcagtctggaggggc

SEQ ID NO: 6334211 - DNA, 21 bp, Homo sapiens
gggcagtgacaagtggagggg

SEQ ID NO: 6334212 - DNA, 20 bp, Homo sapiens
gggcagtgagtgccatgctt

SEQ ID NO: 6334213 - DNA, 21 bp, Homo sapiens
gggcagtgccacagcctgctg

SEQ ID NO: 6334214 - DNA, 16 bp, Homo sapiens
gggcagtgccacccgc

SEQ ID NO: 6334215 - DNA, 11 bp, Homo sapiens
gggcagtgccc

SEQ ID NO: 6334216 - DNA, 14 bp, Homo sapiens
gggcagtgcctcct

SEQ ID NO: 6334217 - DNA, 15 bp, Homo sapiens
gggcagtgcctcctg

SEQ ID NO: 6334218 - DNA, 17 bp, Homo sapiens
gggcagtgcctcctggg

SEQ ID NO: 6334219 - DNA, 18 bp, Homo sapiens
gggcagtgcctcctggga

SEQ ID NO: 6334220 - DNA, 19 bp, Homo sapiens
gggcagtggagaggggact

SEQ ID NO: 6334221 - DNA, 15 bp, Homo sapiens
gggcagtggcctgga

SEQ ID NO: 6334222 - DNA, 22 bp, Homo sapiens
gggcagtggcctggatgcacag

SEQ ID NO: 6334223 - DNA, 15 bp, Homo sapiens
gggcagtggcttctt

SEQ ID NO: 6334224 - DNA, 21 bp, Homo sapiens
gggcagtgggacccatagatc

SEQ ID NO: 6334225 - DNA, 20 bp, Homo sapiens
gggcagtgggtggatcctgg

SEQ ID NO: 6334226 - DNA, 16 bp, Homo sapiens
gggcagtgtgaggacc

SEQ ID NO: 6334227 - DNA, 21 bp, Homo sapiens
gggcagtgtgaggacctccct

SEQ ID NO: 6334228 - DNA, 14 bp, Homo sapiens
gggcagtgtggcct

SEQ ID NO: 6334229 - DNA, 20 bp, Homo sapiens
gggcagttcgcagccaccct

SEQ ID NO: 6334230 - DNA, 24 bp, Homo sapiens
gggcagttctcactcctaggagag

SEQ ID NO: 6334231 - DNA, 17 bp, Homo sapiens
gggcagttgggtagatg

SEQ ID NO: 6334232 - DNA, 14 bp, Homo sapiens
gggcataaagtaaa

SEQ ID NO: 6334233 - DNA, 14 bp, Homo sapiens
gggcataaattatt

SEQ ID NO: 6334234 - DNA, 16 bp, Homo sapiens
gggcatagaaactgag

SEQ ID NO: 6334235 - DNA, 18 bp, Homo sapiens
gggcatagaaactgagga

SEQ ID NO: 6334236 - DNA, 23 bp, Homo sapiens
gggcataggtaagctgtgccttc

SEQ ID NO: 6334237 - DNA, 17 bp, Homo sapiens
gggcatatccaccacct

SEQ ID NO: 6334238 - DNA, 23 bp, Homo sapiens
gggcatcagctttccctggctca

SEQ ID NO: 6334239 - DNA, 13 bp, Homo sapiens
gggcatcaggcac

SEQ ID NO: 6334240 - DNA, 21 bp, Homo sapiens
gggcatcaggcactggtggca

SEQ ID NO: 6334241 - DNA, 20 bp, Homo sapiens
gggcatcagggcctttctcc

SEQ ID NO: 6334242 - DNA, 13 bp, Homo sapiens
gggcatcatgcat

SEQ ID NO: 6334243 - DNA, 12 bp, Homo sapiens
gggcatcatggg

SEQ ID NO: 6334244 - DNA, 23 bp, Homo sapiens
gggcatccacccagtgctgccat

SEQ ID NO: 6334245 - DNA, 21 bp, Homo sapiens
gggcatccaccttcctgccca

SEQ ID NO: 6334246 - DNA, 23 bp, Homo sapiens
gggcatccaccttcctgcccagg

SEQ ID NO: 6334247 - DNA, 20 bp, Homo sapiens
gggcatccataccagctcgc

SEQ ID NO: 6334248 - DNA, 13 bp, Homo sapiens
gggcatcctcagg

SEQ ID NO: 6334249 - DNA, 11 bp, Homo sapiens
gggcatcctgc

SEQ ID NO: 6334250 - DNA, 13 bp, Homo sapiens
gggcatcctgctt

SEQ ID NO: 6334251 - DNA, 17 bp, Homo sapiens
gggcatcctgcttcctg

SEQ ID NO: 6334252 - DNA, 18 bp, Homo sapiens
gggcatcctgcttcctga

SEQ ID NO: 6334253 - DNA, 20 bp, Homo sapiens
gggcatcctgcttcctgaaa

SEQ ID NO: 6334254 - DNA, 14 bp, Homo sapiens
gggcatcgcaggag

SEQ ID NO: 6334255 - DNA, 14 bp, Homo sapiens
gggcatctatggga

SEQ ID NO: 6334256 - DNA, 21 bp, Homo sapiens
gggcatctcgtgccagggcag

SEQ ID NO: 6334257 - DNA, 14 bp, Homo sapiens
gggcatctctgggc

SEQ ID NO: 6334258 - DNA, 22 bp, Homo sapiens
gggcatctgaagctttaccagg

SEQ ID NO: 6334259 - DNA, 20 bp, Homo sapiens
gggcatctgagtccagctcc

SEQ ID NO: 6334260 - DNA, 22 bp, Homo sapiens
gggcatctgagtccagctcccc

SEQ ID NO: 6334261 - DNA, 20 bp, Homo sapiens
gggcatctgcccctccccca

SEQ ID NO: 6334262 - DNA, 14 bp, Homo sapiens
gggcatctggccct

SEQ ID NO: 6334263 - DNA, 16 bp, Homo sapiens
gggcatctggccctgc

SEQ ID NO: 6334264 - DNA, 23 bp, Homo sapiens
gggcatctggccctgctgccccc

SEQ ID NO: 6334265 - DNA, 21 bp, Homo sapiens
gggcatctgtctgtctgtggg

SEQ ID NO: 6334266 - DNA, 23 bp, Homo sapiens
gggcatctgtctgtctgtgggct

SEQ ID NO: 6334267 - DNA, 15 bp, Homo sapiens
gggcatcttctggct

SEQ ID NO: 6334268 - DNA, 12 bp, Homo sapiens
gggcatgacacg

SEQ ID NO: 6334269 - DNA, 21 bp, Homo sapiens
gggcatgacccagtgaagatg

SEQ ID NO: 6334270 - DNA, 23 bp, Homo sapiens
gggcatgagctgctgtgcccagc

SEQ ID NO: 6334271 - DNA, 15 bp, Homo sapiens
gggcatgccaccctc

SEQ ID NO: 6334272 - DNA, 16 bp, Homo sapiens
gggcatgccaccctca

SEQ ID NO: 6334273 - DNA, 14 bp, Homo sapiens
gggcatgcctggcc

SEQ ID NO: 6334274 - DNA, 16 bp, Homo sapiens
gggcatgcctggcctg

SEQ ID NO: 6334275 - DNA, 20 bp, Homo sapiens
gggcatgcctggcctgagga

SEQ ID NO: 6334276 - DNA, 21 bp, Homo sapiens
gggcatggacagggccagggt

SEQ ID NO: 6334277 - DNA, 19 bp, Homo sapiens
gggcatggcaaatcagggg

SEQ ID NO: 6334278 - DNA, 22 bp, Homo sapiens
gggcatggcaaatcaggggcca

SEQ ID NO: 6334279 - DNA, 13 bp, Homo sapiens
gggcatggccgct

SEQ ID NO: 6334280 - DNA, 19 bp, Homo sapiens
gggcatgggcctctctggg

SEQ ID NO: 6334281 - DNA, 18 bp, Homo sapiens
gggcatgggtcgggagag

SEQ ID NO: 6334282 - DNA, 21 bp, Homo sapiens
gggcatgggtcgggagagggg

SEQ ID NO: 6334283 - DNA, 19 bp, Homo sapiens
gggcatggtggcaggcgcc

SEQ ID NO: 6334284 - DNA, 21 bp, Homo sapiens
gggcatggtggcatgtgcctg

SEQ ID NO: 6334285 - DNA, 21 bp, Homo sapiens
gggcatggtggctcatgcctg

SEQ ID NO: 6334286 - DNA, 19 bp, Homo sapiens
gggcatggtgttctcctgc

SEQ ID NO: 6334287 - DNA, 18 bp, Homo sapiens
gggcatgtattggcctgg

SEQ ID NO: 6334288 - DNA, 18 bp, Homo sapiens
gggcatgtgcggctgaac

SEQ ID NO: 6334289 - DNA, 20 bp, Homo sapiens
gggcatgtgcggctgaactg

SEQ ID NO: 6334290 - DNA, 13 bp, Homo sapiens
gtgggttctatgt

SEQ ID NO: 6334291 - DNA, 17 bp, Homo sapiens
gtgggtttccctgcgtc

SEQ ID NO: 6334292 - DNA, 21 bp, Homo sapiens
gtgggtttgggtgcctcctgc

SEQ ID NO: 6334293 - DNA, 19 bp, Homo sapiens
gtgggtttgtggggggagg

SEQ ID NO: 6334294 - DNA, 17 bp, Homo sapiens
gtgggtttttatttcct

SEQ ID NO: 6334295 - DNA, 18 bp, Homo sapiens
gtgggttttttagttgaa

SEQ ID NO: 6334296 - DNA, 14 bp, Homo sapiens
gtggtaaaaaagaa

SEQ ID NO: 6334297 - DNA, 20 bp, Homo sapiens
gtggtaaaaaagaaatgaaa

SEQ ID NO: 6334298 - DNA, 20 bp, Homo sapiens
gtggtaacaagaggagcagg

SEQ ID NO: 6334299 - DNA, 15 bp, Homo sapiens
gtggtaactgaaggt

SEQ ID NO: 6334300 - DNA, 21 bp, Homo sapiens
gtggtaacttctttgaagtta

SEQ ID NO: 6334301 - DNA, 17 bp, Homo sapiens
gtggtaagagaatgtta

SEQ ID NO: 6334302 - DNA, 18 bp, Homo sapiens
gtggtaagagaatgttat

SEQ ID NO: 6334303 - DNA, 17 bp, Homo sapiens
gtggtaagagatatgct

SEQ ID NO: 6334304 - DNA, 21 bp, Homo sapiens
gtggtaagcaacatggctttg

SEQ ID NO: 6334305 - DNA, 16 bp, Homo sapiens
gtggtaagggttgggc

SEQ ID NO: 6334306 - DNA, 15 bp, Homo sapiens
gtggtaagtggagga

SEQ ID NO: 6334307 - DNA, 12 bp, Homo sapiens
gtggtaatctac

SEQ ID NO: 6334308 - DNA, 14 bp, Homo sapiens
gtggtaccagctca

SEQ ID NO: 6334309 - DNA, 19 bp, Homo sapiens
gtggtacccccccttttct

SEQ ID NO: 6334310 - DNA, 15 bp, Homo sapiens
gtggtaccctggcag

SEQ ID NO: 6334311 - DNA, 21 bp, Homo sapiens
gtggtaccctggcagagaaga

SEQ ID NO: 6334312 - DNA, 18 bp, Homo sapiens
gtggtaccttcagccctg

SEQ ID NO: 6334313 - DNA, 15 bp, Homo sapiens
gtggtacttggcacc

SEQ ID NO: 6334314 - DNA, 17 bp, Homo sapiens
gtggtactttgcagctg

SEQ ID NO: 6334315 - DNA, 12 bp, Homo sapiens
gtggtagaaaca

SEQ ID NO: 6334316 - DNA, 14 bp, Homo sapiens
gtggtagctctgag

SEQ ID NO: 6334317 - DNA, 18 bp, Homo sapiens
gtggtagctctgagccct

SEQ ID NO: 6334318 - DNA, 16 bp, Homo sapiens
gtggtaggggcaggga

SEQ ID NO: 6334319 - DNA, 23 bp, Homo sapiens
gtggtaggtactttttgtgaaga

SEQ ID NO: 6334320 - DNA, 18 bp, Homo sapiens
gtggtagtaaaacacaga

SEQ ID NO: 6334321 - DNA, 18 bp, Homo sapiens
gtggtagtcctcccaagc

SEQ ID NO: 6334322 - DNA, 14 bp, Homo sapiens
gtggtatagaaatg

SEQ ID NO: 6334323 - DNA, 20 bp, Homo sapiens
gtggtatagtagaaaggcca

SEQ ID NO: 6334324 - DNA, 22 bp, Homo sapiens
gtggtatagtattagtggaaag

SEQ ID NO: 6334325 - DNA, 20 bp, Homo sapiens
gtggtatatttgtgtatgtg

SEQ ID NO: 6334326 - DNA, 22 bp, Homo sapiens
gtggtatcctacatacttcttt

SEQ ID NO: 6334327 - DNA, 16 bp, Homo sapiens
gtggtatcctgtgaca

SEQ ID NO: 6334328 - DNA, 19 bp, Homo sapiens
gtggtatgatcacggctca

SEQ ID NO: 6334329 - DNA, 13 bp, Homo sapiens
gtggtatgtgaca

SEQ ID NO: 6334330 - DNA, 12 bp, Homo sapiens
gtggtatgtgtg

SEQ ID NO: 6334331 - DNA, 15 bp, Homo sapiens
gtggtatgtgtgtgt

SEQ ID NO: 6334332 - DNA, 18 bp, Homo sapiens
gtggtattaattttgata

SEQ ID NO: 6334333 - DNA, 22 bp, Homo sapiens
gtggtattttaacatagcagct

SEQ ID NO: 6334334 - DNA, 23 bp, Homo sapiens
gtggtattttaacatagcagctg

SEQ ID NO: 6334335 - DNA, 23 bp, Homo sapiens
gtggtcaacatttctcatgttga

SEQ ID NO: 6334336 - DNA, 20 bp, Homo sapiens
gtggtcaacggagggagtgg

SEQ ID NO: 6334337 - DNA, 14 bp, Homo sapiens
gtggtcacaggctg

SEQ ID NO: 6334338 - DNA, 16 bp, Homo sapiens
gtggtcacccatgcat

SEQ ID NO: 6334339 - DNA, 19 bp, Homo sapiens
gtggtcactggtcagggca

SEQ ID NO: 6334340 - DNA, 19 bp, Homo sapiens
gtggtcactgtgcactgcc

SEQ ID NO: 6334341 - DNA, 17 bp, Homo sapiens
gtggtcacttatcctga

SEQ ID NO: 6334342 - DNA, 23 bp, Homo sapiens
gtggtcagagggactgtcagctg

SEQ ID NO: 6334343 - DNA, 15 bp, Homo sapiens
gtggtcagagtgcca

SEQ ID NO: 6334344 - DNA, 13 bp, Homo sapiens
gtggtcagatgca

SEQ ID NO: 6334345 - DNA, 16 bp, Homo sapiens
gtggtcagcagaaacc

SEQ ID NO: 6334346 - DNA, 22 bp, Homo sapiens
gtggtcagcagaaacccccagg

SEQ ID NO: 6334347 - DNA, 20 bp, Homo sapiens
gtggtcagccaaggctcccg

SEQ ID NO: 6334348 - DNA, 17 bp, Homo sapiens
gtggtcagcggcctggg

SEQ ID NO: 6334349 - DNA, 18 bp, Homo sapiens
gtggtcagcggtatgtgc

SEQ ID NO: 6334350 - DNA, 16 bp, Homo sapiens
gtggtcaggcccagcc

SEQ ID NO: 6334351 - DNA, 17 bp, Homo sapiens
gtggtcaggcccagcct

SEQ ID NO: 6334352 - DNA, 22 bp, Homo sapiens
gtggtcaggcgtagatcaccag

SEQ ID NO: 6334353 - DNA, 14 bp, Homo sapiens
gtggtcataaaata

SEQ ID NO: 6334354 - DNA, 21 bp, Homo sapiens
gtggtcatgtgagtctgggat

SEQ ID NO: 6334355 - DNA, 16 bp, Homo sapiens
gtggtcattaagcatt

SEQ ID NO: 6334356 - DNA, 18 bp, Homo sapiens
gtggtccaaccaggagct

SEQ ID NO: 6334357 - DNA, 19 bp, Homo sapiens
gtggtccacaagcttctgt

SEQ ID NO: 6334358 - DNA, 19 bp, Homo sapiens
gtggtccagaagaaattat

SEQ ID NO: 6334359 - DNA, 19 bp, Homo sapiens
gtggtccagcgtcactcca

SEQ ID NO: 6334360 - DNA, 12 bp, Homo sapiens
gtggtccagctc

SEQ ID NO: 6334361 - DNA, 15 bp, Homo sapiens
gtggtccagctcttg

SEQ ID NO: 6334362 - DNA, 16 bp, Homo sapiens
gtggtccagctcttgg

SEQ ID NO: 6334363 - DNA, 15 bp, Homo sapiens
gtggtccagggtcca

SEQ ID NO: 6334364 - DNA, 11 bp, Homo sapiens
gtggtccatgc

SEQ ID NO: 6334365 - DNA, 24 bp, Homo sapiens
gtggtcccaacaggaggacaattc

SEQ ID NO: 6334366 - DNA, 14 bp, Homo sapiens
gtggtcccacccag

SEQ ID NO: 6334367 - DNA, 16 bp, Homo sapiens
gtggtcccacccagga

SEQ ID NO: 6334368 - DNA, 15 bp, Homo sapiens
gtggtcccaccccac

SEQ ID NO: 6334369 - DNA, 15 bp, Homo sapiens
gtggtcctgagacct

SEQ ID NO: 6334370 - DNA, 16 bp, Homo sapiens
gtggtcggtgggaccc

SEQ ID NO: 6334371 - DNA, 12 bp, Homo sapiens
gtggtctaaagt

SEQ ID NO: 6334372 - DNA, 18 bp, Homo sapiens
gtggtctaaagtgtttag

SEQ ID NO: 6334373 - DNA, 20 bp, Homo sapiens
gtggtctaaagtgtttagct

SEQ ID NO: 6334374 - DNA, 20 bp, Homo sapiens
gtggtctataaaataaactt

SEQ ID NO: 6334375 - DNA, 13 bp, Homo sapiens
gtggtctatttct

SEQ ID NO: 6334376 - DNA, 20 bp, Homo sapiens
gtggtctcacctggaggcaa

SEQ ID NO: 6334377 - DNA, 12 bp, Homo sapiens
gtggtctcagga

SEQ ID NO: 6334378 - DNA, 23 bp, Homo sapiens
gtggtctccttgcactttctcag

SEQ ID NO: 6334379 - DNA, 19 bp, Homo sapiens
gtggtctctgccccagcct

SEQ ID NO: 6334380 - DNA, 20 bp, Homo sapiens
gtggtctctgccccagcctg

SEQ ID NO: 6334381 - DNA, 14 bp, Homo sapiens
gtggtctctgctgg

SEQ ID NO: 6334382 - DNA, 15 bp, Homo sapiens
gtggtctctgctggg

SEQ ID NO: 6334383 - DNA, 19 bp, Homo sapiens
gtggtctcttcctgtctgg

SEQ ID NO: 6334384 - DNA, 14 bp, Homo sapiens
gtggtctgaatgtt

SEQ ID NO: 6334385 - DNA, 17 bp, Homo sapiens
gtggtctgaatgttctg

SEQ ID NO: 6334386 - DNA, 19 bp, Homo sapiens
gtggtctgccaatctgtac

SEQ ID NO: 6334387 - DNA, 18 bp, Homo sapiens
gtggtctgctcgggccca

SEQ ID NO: 6334388 - DNA, 21 bp, Homo sapiens
gtggtctgcttttgctggggt

SEQ ID NO: 6334389 - DNA, 12 bp, Homo sapiens
gtggtctgtgtg

SEQ ID NO: 6334390 - DNA, 19 bp, Homo sapiens
gtggtcttcaaattgtctt

SEQ ID NO: 6334391 - DNA, 21 bp, Homo sapiens
gtggtcttgccttctgatttt

SEQ ID NO: 6334392 - DNA, 15 bp, Homo sapiens
gtggtcttggagagg

SEQ ID NO: 6334393 - DNA, 20 bp, Homo sapiens
gtggtcttggagaggaggtg

SEQ ID NO: 6334394 - DNA, 16 bp, Homo sapiens
gtggtctttctggaga

SEQ ID NO: 6334395 - DNA, 12 bp, Homo sapiens
gtggtctttgaa

SEQ ID NO: 6334396 - DNA, 15 bp, Homo sapiens
gtggtgaagaaaact

SEQ ID NO: 6334397 - DNA, 21 bp, Homo sapiens
gtggtgaaggaccctggctct

SEQ ID NO: 6334398 - DNA, 22 bp, Homo sapiens
gtggtgaagtgtggctggtgtc

SEQ ID NO: 6334399 - DNA, 23 bp, Homo sapiens
gtggtgaagtgtggctggtgtcc

SEQ ID NO: 6334400 - DNA, 17 bp, Homo sapiens
gtggtgacaggacgctg

SEQ ID NO: 6334401 - DNA, 14 bp, Homo sapiens
gtggtgacctctgc

SEQ ID NO: 6334402 - DNA, 17 bp, Homo sapiens
gtggtgacctctgcctg

SEQ ID NO: 6334403 - DNA, 18 bp, Homo sapiens
gtggtgaggggccactgg

SEQ ID NO: 6334404 - DNA, 20 bp, Homo sapiens
gtggtgaggttgtgctgcct

SEQ ID NO: 6334405 - DNA, 18 bp, Homo sapiens
gtggtgatgtccaaaaga

SEQ ID NO: 6334406 - DNA, 22 bp, Homo sapiens
gtggtgcagccccaggaccaag

SEQ ID NO: 6334407 - DNA, 15 bp, Homo sapiens
gtggtgcattcctga

SEQ ID NO: 6334408 - DNA, 16 bp, Homo sapiens
gtggtgccatccccag

SEQ ID NO: 6334409 - DNA, 17 bp, Homo sapiens
gtggtgcgagtgcgtga

SEQ ID NO: 6334410 - DNA, 17 bp, Homo sapiens
gtggtgcgggccaggtc

SEQ ID NO: 6334411 - DNA, 21 bp, Homo sapiens
gtggtgcgggccaggtctggc

SEQ ID NO: 6334412 - DNA, 15 bp, Homo sapiens
gtggtgctgacaaag

SEQ ID NO: 6334413 - DNA, 14 bp, Homo sapiens
gtggtgctgggact

SEQ ID NO: 6334414 - DNA, 22 bp, Homo sapiens
gtggtggagccagtaaacagag

SEQ ID NO: 6334415 - DNA, 23 bp, Homo sapiens
gtggtggaggaaacttccaactt

SEQ ID NO: 6334416 - DNA, 13 bp, Homo sapiens
gtggtggaggagg

SEQ ID NO: 6334417 - DNA, 14 bp, Homo sapiens
gtggtggaggagga

SEQ ID NO: 6334418 - DNA, 15 bp, Homo sapiens
gtggtggaggaggag

SEQ ID NO: 6334419 - DNA, 21 bp, Homo sapiens
gtggtggaggggcgcccaggg

SEQ ID NO: 6334420 - DNA, 14 bp, Homo sapiens
gtggtggagggggc

SEQ ID NO: 6334421 - DNA, 15 bp, Homo sapiens
gtggtggcagggcct

SEQ ID NO: 6334422 - DNA, 13 bp, Homo sapiens
gtggtggcatttt

SEQ ID NO: 6334423 - DNA, 18 bp, Homo sapiens
gtggtggcgggcgcctgt

SEQ ID NO: 6334424 - DNA, 18 bp, Homo sapiens
gtggtggctcacacctgc

SEQ ID NO: 6334425 - DNA, 18 bp, Homo sapiens
gtggtggctgtctctgtc

SEQ ID NO: 6334426 - DNA, 19 bp, Homo sapiens
gtggtggcttcggcctgct

SEQ ID NO: 6334427 - DNA, 12 bp, Homo sapiens
gtggtgggactc

SEQ ID NO: 6334428 - DNA, 22 bp, Homo sapiens
gtggtgggatccacgctgggcc

SEQ ID NO: 6334429 - DNA, 14 bp, Homo sapiens
gtggtgggcttctg

SEQ ID NO: 6334430 - DNA, 20 bp, Homo sapiens
gtggtggggaccagctaatt

SEQ ID NO: 6334431 - DNA, 12 bp, Homo sapiens
gtggtggggagg

SEQ ID NO: 6334432 - DNA, 16 bp, Homo sapiens
gtggtgggtgcctgta

SEQ ID NO: 6334433 - DNA, 16 bp, Homo sapiens
gtggtggtaaccctgg

SEQ ID NO: 6334434 - DNA, 19 bp, Homo sapiens
gtggtggtaaccctggtgg

SEQ ID NO: 6334435 - DNA, 15 bp, Homo sapiens
gtggtgtaaagctgg

SEQ ID NO: 6334436 - DNA, 20 bp, Homo sapiens
gtggtgtaaagctggccctg

SEQ ID NO: 6334437 - DNA, 11 bp, Homo sapiens
gtggtgtcact

SEQ ID NO: 6334438 - DNA, 18 bp, Homo sapiens
gtggtgtccttctcctct

SEQ ID NO: 6334439 - DNA, 15 bp, Homo sapiens
gtggtgtccttcttc

SEQ ID NO: 6334440 - DNA, 19 bp, Homo sapiens
gtggtgtcgtctgtgaatg

SEQ ID NO: 6334441 - DNA, 13 bp, Homo sapiens
gtggtgtgaccat

SEQ ID NO: 6334442 - DNA, 14 bp, Homo sapiens
gtggtgtgaggccc

SEQ ID NO: 6334443 - DNA, 18 bp, Homo sapiens
gtggtgtgaggcccccgg

SEQ ID NO: 6334444 - DNA, 19 bp, Homo sapiens
gtggtgtgaggcccccgga

SEQ ID NO: 6334445 - DNA, 22 bp, Homo sapiens
gtggtgtgatcccagctcactg

SEQ ID NO: 6334446 - DNA, 14 bp, Homo sapiens
gtggtgtggagaag

SEQ ID NO: 6334447 - DNA, 13 bp, Homo sapiens
gtggtgtggcccg

SEQ ID NO: 6334448 - DNA, 18 bp, Homo sapiens
gtggtgtgtttgccttgg

SEQ ID NO: 6334449 - DNA, 14 bp, Homo sapiens
gtggtgttgggaag

SEQ ID NO: 6334450 - DNA, 22 bp, Homo sapiens
gtggttaatccaatcaatttaa

SEQ ID NO: 6334451 - DNA, 14 bp, Homo sapiens
gtggttacacagtg

SEQ ID NO: 6334452 - DNA, 13 bp, Homo sapiens
gtggttagaatct

SEQ ID NO: 6334453 - DNA, 17 bp, Homo sapiens
gtggttataacttaatg

SEQ ID NO: 6334454 - DNA, 15 bp, Homo sapiens
gtggttatatttcaa

SEQ ID NO: 6334455 - DNA, 21 bp, Homo sapiens
gtggttatgttcccagcagtg

SEQ ID NO: 6334456 - DNA, 22 bp, Homo sapiens
gtggttattagcaaggctgggt

SEQ ID NO: 6334457 - DNA, 22 bp, Homo sapiens
gtggttattggactccaggcct

SEQ ID NO: 6334458 - DNA, 23 bp, Homo sapiens
gtggttattggactccaggcctg

SEQ ID NO: 6334459 - DNA, 14 bp, Homo sapiens
gtggttatttttat

SEQ ID NO: 6334460 - DNA, 19 bp, Homo sapiens
gtggttatttttatacagt

SEQ ID NO: 6334461 - DNA, 20 bp, Homo sapiens
gtggttcactcttggagcct

SEQ ID NO: 6334462 - DNA, 21 bp, Homo sapiens
gtggttcactcttggagcctg

SEQ ID NO: 6334463 - DNA, 22 bp, Homo sapiens
gtggttcactcttggagcctgc

SEQ ID NO: 6334464 - DNA, 16 bp, Homo sapiens
gtggttcagagactgg

SEQ ID NO: 6334465 - DNA, 15 bp, Homo sapiens
gtggttcagtgagct

SEQ ID NO: 6334466 - DNA, 13 bp, Homo sapiens
gtggttccgggct

SEQ ID NO: 6334467 - DNA, 13 bp, Homo sapiens
gtggttcctgtgg

SEQ ID NO: 6334468 - DNA, 19 bp, Homo sapiens
gtggttcctttgcaccctg

SEQ ID NO: 6334469 - DNA, 20 bp, Homo sapiens
gtggttctaatatttttagc

SEQ ID NO: 6334470 - DNA, 17 bp, Homo sapiens
gtggttctataataagt

SEQ ID NO: 6334471 - DNA, 16 bp, Homo sapiens
gtggttctattttact

SEQ ID NO: 6334472 - DNA, 20 bp, Homo sapiens
gtggttctgagatggctccc

SEQ ID NO: 6334473 - DNA, 16 bp, Homo sapiens
gtggttctgccactta

SEQ ID NO: 6334474 - DNA, 13 bp, Homo sapiens
gtggttgcctggg

SEQ ID NO: 6334475 - DNA, 18 bp, Homo sapiens
gtggttgctgttttcctc

SEQ ID NO: 6334476 - DNA, 20 bp, Homo sapiens
gtggttgctgttttcctccc

SEQ ID NO: 6334477 - DNA, 16 bp, Homo sapiens
gtggttgtagaaggag

SEQ ID NO: 6334478 - DNA, 15 bp, Homo sapiens
gtggttgtgcctttt

SEQ ID NO: 6334479 - DNA, 16 bp, Homo sapiens
gtggttgtgccttttg

SEQ ID NO: 6334480 - DNA, 22 bp, Homo sapiens
gtggttgttgccaactaagccc

SEQ ID NO: 6334481 - DNA, 22 bp, Homo sapiens
gtggtttcaaagtaaaggcctc

SEQ ID NO: 6334482 - DNA, 16 bp, Homo sapiens
gtggtttcagaaatgt

SEQ ID NO: 6334483 - DNA, 15 bp, Homo sapiens
gtggtttcagatgtg

SEQ ID NO: 6334484 - DNA, 18 bp, Homo sapiens
gtggtttcagatgtgcaa

SEQ ID NO: 6334485 - DNA, 16 bp, Homo sapiens
gtggtttgagacactg

SEQ ID NO: 6334486 - DNA, 19 bp, Homo sapiens
gtggtttgatcatttctgc

SEQ ID NO: 6334487 - DNA, 17 bp, Homo sapiens
gtggtttgcaggtcagc

SEQ ID NO: 6334488 - DNA, 16 bp, Homo sapiens
gtggtttggtttttgt

SEQ ID NO: 6334489 - DNA, 22 bp, Homo sapiens
gtggtttgtacatatcaaatag

SEQ ID NO: 6334490 - DNA, 20 bp, Homo sapiens
gtggttttcagagcaggagg

SEQ ID NO: 6334491 - DNA, 21 bp, Homo sapiens
gtggttttcagagcaggaggc

SEQ ID NO: 6334492 - DNA, 20 bp, Homo sapiens
gtggttttcccctccctggg

SEQ ID NO: 6334493 - DNA, 21 bp, Homo sapiens
gtggttttcccctccctgggt

SEQ ID NO: 6334494 - DNA, 17 bp, Homo sapiens
gtggttttctgttcttt

SEQ ID NO: 6334495 - DNA, 14 bp, Homo sapiens
gtggttttctgttt

SEQ ID NO: 6334496 - DNA, 12 bp, Homo sapiens
gtggttttctta

SEQ ID NO: 6334497 - DNA, 23 bp, Homo sapiens
gtggttttgggttttttctgttt

SEQ ID NO: 6334498 - DNA, 16 bp, Homo sapiens
gtggtttttaattttg

SEQ ID NO: 6334499 - DNA, 19 bp, Homo sapiens
gtgtaaaaaacaaacattt

SEQ ID NO: 6334500 - DNA, 14 bp, Homo sapiens
gtgtaaaaaagtgt

SEQ ID NO: 6334501 - DNA, 21 bp, Homo sapiens
gtgtaaaaaatggaaaaaaac

SEQ ID NO: 6334502 - DNA, 16 bp, Homo sapiens
gtgtaaaaagcctcct

SEQ ID NO: 6334503 - DNA, 18 bp, Homo sapiens
gtgtaaaaagcctccttg

SEQ ID NO: 6334504 - DNA, 13 bp, Homo sapiens
gtgtaaaaaggaa

SEQ ID NO: 6334505 - DNA, 15 bp, Homo sapiens
gtgtaaaaattcaga

SEQ ID NO: 6334506 - DNA, 23 bp, Homo sapiens
gtgtaaaacgagaatccacccat

SEQ ID NO: 6334507 - DNA, 20 bp, Homo sapiens
gtgtaaaagtagtgagttaa

SEQ ID NO: 6334508 - DNA, 14 bp, Homo sapiens
gtgtaaaattaatg

SEQ ID NO: 6334509 - DNA, 15 bp, Homo sapiens
gtgtaaaattaatgt

SEQ ID NO: 6334510 - DNA, 17 bp, Homo sapiens
gtgtaaagctggccctg

SEQ ID NO: 6334511 - DNA, 19 bp, Homo sapiens
gtgtaaagctggccctgcc

SEQ ID NO: 6334512 - DNA, 16 bp, Homo sapiens
gtgtaaaggaaaataa

SEQ ID NO: 6334513 - DNA, 18 bp, Homo sapiens
gtgtaaatacaattttgt

SEQ ID NO: 6334514 - DNA, 19 bp, Homo sapiens
gtgtaaatagttactccag

SEQ ID NO: 6334515 - DNA, 19 bp, Homo sapiens
gtgtaaatatatgtctgat

SEQ ID NO: 6334516 - DNA, 16 bp, Homo sapiens
gtgtaaatatgtacat

SEQ ID NO: 6334517 - DNA, 22 bp, Homo sapiens
gtgtaaatatgtacatttgtct

SEQ ID NO: 6334518 - DNA, 20 bp, Homo sapiens
gtgtaaatattagtgcagtt

SEQ ID NO: 6334519 - DNA, 20 bp, Homo sapiens
gtgtaaatctgaaaaactaa

SEQ ID NO: 6334520 - DNA, 17 bp, Homo sapiens
gtgtaacaattgtgtag

SEQ ID NO: 6334521 - DNA, 23 bp, Homo sapiens
gtgtaacaattgtgtagcctttt

SEQ ID NO: 6334522 - DNA, 19 bp, Homo sapiens
gtgtaacactgtgtacacc

SEQ ID NO: 6334523 - DNA, 14 bp, Homo sapiens
gtgtaacagctcct

SEQ ID NO: 6334524 - DNA, 21 bp, Homo sapiens
gtgtaacagctgaggtctctt

SEQ ID NO: 6334525 - DNA, 21 bp, Homo sapiens
gtgtaacaggatacaggtgac

SEQ ID NO: 6334526 - DNA, 19 bp, Homo sapiens
gtgtaacaggtctcctctt

SEQ ID NO: 6334527 - DNA, 21 bp, Homo sapiens
gtgtaaccagcagtcacaggt

SEQ ID NO: 6334528 - DNA, 23 bp, Homo sapiens
gtgtaacctcagtatttatgtaa

SEQ ID NO: 6334529 - DNA, 23 bp, Homo sapiens
gtgtaacctgagatggccctctg

SEQ ID NO: 6334530 - DNA, 15 bp, Homo sapiens
gtgtaactggctgct

SEQ ID NO: 6334531 - DNA, 18 bp, Homo sapiens
gtgtaactggctgctccc

SEQ ID NO: 6334532 - DNA, 11 bp, Homo sapiens
gtgtaactgtt

SEQ ID NO: 6334533 - DNA, 18 bp, Homo sapiens
gtgtaactgttctttgca

SEQ ID NO: 6334534 - DNA, 16 bp, Homo sapiens
gtgtaactttaaacat

SEQ ID NO: 6334535 - DNA, 19 bp, Homo sapiens
gtgtaactttattggtctt

SEQ ID NO: 6334536 - DNA, 20 bp, Homo sapiens
gtgtaagaaaacaaactaaa

SEQ ID NO: 6334537 - DNA, 24 bp, Homo sapiens
gtgtaagacacgtgcaacagactg

SEQ ID NO: 6334538 - DNA, 22 bp, Homo sapiens
gtgtaagacttcagatttcaaa

SEQ ID NO: 6334539 - DNA, 15 bp, Homo sapiens
gtgtaagcacttctg

SEQ ID NO: 6334540 - DNA, 13 bp, Homo sapiens
gtgtaagccatca

SEQ ID NO: 6334541 - DNA, 23 bp, Homo sapiens
gtgtaaggagtttttttgtcaga

SEQ ID NO: 6334542 - DNA, 18 bp, Homo sapiens
gtgtaataaagtgttttc

SEQ ID NO: 6334543 - DNA, 13 bp, Homo sapiens
gtgtaataagaca

SEQ ID NO: 6334544 - DNA, 17 bp, Homo sapiens
gtgtaatatcatttcat

SEQ ID NO: 6334545 - DNA, 14 bp, Homo sapiens
gtgtaatattactt

SEQ ID NO: 6334546 - DNA, 17 bp, Homo sapiens
gtgtaatcaataaacga

SEQ ID NO: 6334547 - DNA, 19 bp, Homo sapiens
gtgtaatcatttcttgggc

SEQ ID NO: 6334548 - DNA, 22 bp, Homo sapiens
gtgtaatcattttaaattccac

SEQ ID NO: 6334549 - DNA, 16 bp, Homo sapiens
gtgtaatgaatacctt

SEQ ID NO: 6334550 - DNA, 23 bp, Homo sapiens
gtgtaatgactgagatttgtaaa

SEQ ID NO: 6334551 - DNA, 14 bp, Homo sapiens
gtgtaatgcacaat

SEQ ID NO: 6334552 - DNA, 15 bp, Homo sapiens
gtgtaatggatcaaa

SEQ ID NO: 6334553 - DNA, 22 bp, Homo sapiens
gtgtaatgtagcgtgtttacat

SEQ ID NO: 6334554 - DNA, 14 bp, Homo sapiens
gtgtaattagcttt

SEQ ID NO: 6334555 - DNA, 15 bp, Homo sapiens
gtgtaattagctttt

SEQ ID NO: 6334556 - DNA, 14 bp, Homo sapiens
gtgtaatttaagtg

SEQ ID NO: 6334557 - DNA, 19 bp, Homo sapiens
gtgtaatttaagtgacaca

SEQ ID NO: 6334558 - DNA, 20 bp, Homo sapiens
gtgtaatttaagtgacacag

SEQ ID NO: 6334559 - DNA, 23 bp, Homo sapiens
gtgtaatttaagtgacacagaca

SEQ ID NO: 6334560 - DNA, 14 bp, Homo sapiens
gtgtaatttgaaga

SEQ ID NO: 6334561 - DNA, 15 bp, Homo sapiens
gtgtaatttgaagat

SEQ ID NO: 6334562 - DNA, 18 bp, Homo sapiens
gtgtaattttaaagtcag

SEQ ID NO: 6334563 - DNA, 23 bp, Homo sapiens
gtgtaattttgttctagttttca

SEQ ID NO: 6334564 - DNA, 13 bp, Homo sapiens
gtgtacaaagaaa

SEQ ID NO: 6334565 - DNA, 17 bp, Homo sapiens
gtgtacaacaatgcttt

SEQ ID NO: 6334566 - DNA, 16 bp, Homo sapiens
gtgtacaagttgcttt

SEQ ID NO: 6334567 - DNA, 19 bp, Homo sapiens
gtgtacaagttgctttgtt

SEQ ID NO: 6334568 - DNA, 16 bp, Homo sapiens
gtgtacaatgtacaca

SEQ ID NO: 6334569 - DNA, 12 bp, Homo sapiens
gtgtacacctgc

SEQ ID NO: 6334570 - DNA, 15 bp, Homo sapiens
gtgtacactaacatt

SEQ ID NO: 6334571 - DNA, 20 bp, Homo sapiens
gtgtacagaaacaactgcca

SEQ ID NO: 6334572 - DNA, 12 bp, Homo sapiens
gtgtacagaaga

SEQ ID NO: 6334573 - DNA, 14 bp, Homo sapiens
gtgtacagactctt

SEQ ID NO: 6334574 - DNA, 16 bp, Homo sapiens
gtgtacagccagacca

SEQ ID NO: 6334575 - DNA, 13 bp, Homo sapiens
gtgtacagtatgt

SEQ ID NO: 6334576 - DNA, 14 bp, Homo sapiens
gtgtacagtatgtg

SEQ ID NO: 6334577 - DNA, 15 bp, Homo sapiens
gtgtacagtatgtgt

SEQ ID NO: 6334578 - DNA, 20 bp, Homo sapiens
gtgtacagtatgtgtctagc

SEQ ID NO: 6334579 - DNA, 13 bp, Homo sapiens
gtgtacagtcttg

SEQ ID NO: 6334580 - DNA, 20 bp, Homo sapiens
gtgtacagtgaattgtcttt

SEQ ID NO: 6334581 - DNA, 12 bp, Homo sapiens
gtgtacagtgtg

SEQ ID NO: 6334582 - DNA, 17 bp, Homo sapiens
gtgtacagttggcatgg

SEQ ID NO: 6334583 - DNA, 19 bp, Homo sapiens
gtgtacatatatgtataat

SEQ ID NO: 6334584 - DNA, 17 bp, Homo sapiens
gtgtacatatgtaaaat

SEQ ID NO: 6334585 - DNA, 22 bp, Homo sapiens
gtgtacatatgtaaaatattgt

SEQ ID NO: 6334586 - DNA, 14 bp, Homo sapiens
gtgtacatcatgtt

SEQ ID NO: 6334587 - DNA, 20 bp, Homo sapiens
gtgtacatcctgcagcttat

SEQ ID NO: 6334588 - DNA, 22 bp, Homo sapiens
gtgtacatggaataacatgtaa

SEQ ID NO: 6334589 - DNA, 18 bp, Homo sapiens
gtgtacatgtgtgcagag

SEQ ID NO: 6334590 - DNA, 20 bp, Homo sapiens
gtgtacatgtgtgcagagca

SEQ ID NO: 6334591 - DNA, 17 bp, Homo sapiens
gtgtacattaccatata

SEQ ID NO: 6334592 - DNA, 21 bp, Homo sapiens
gtgtacatttatgttccttta

SEQ ID NO: 6334593 - DNA, 16 bp, Homo sapiens
gtgtacattttataaa

SEQ ID NO: 6334594 - DNA, 21 bp, Homo sapiens
gtgtacattttataaagttta

SEQ ID NO: 6334595 - DNA, 22 bp, Homo sapiens
gtgtaccacaccctgcctgctg

SEQ ID NO: 6334596 - DNA, 16 bp, Homo sapiens
gtgtaccacttcctga

SEQ ID NO: 6334597 - DNA, 21 bp, Homo sapiens
gtgtaccacttcctgaggcct

SEQ ID NO: 6334598 - DNA, 18 bp, Homo sapiens
gtgtaccacttctgtggg

SEQ ID NO: 6334599 - DNA, 15 bp, Homo sapiens
gtgtaccattaaaat

SEQ ID NO: 6334600 - DNA, 17 bp, Homo sapiens
gtgtaccatttgcctcc

SEQ ID NO: 6334601 - DNA, 18 bp, Homo sapiens
gtgtacctgctggaagaa

SEQ ID NO: 6334602 - DNA, 16 bp, Homo sapiens
gtgtacgtatcatttc

SEQ ID NO: 6334603 - DNA, 17 bp, Homo sapiens
gtgtacgtatcatttct

SEQ ID NO: 6334604 - DNA, 13 bp, Homo sapiens
gtgtactcagggc

SEQ ID NO: 6334605 - DNA, 21 bp, Homo sapiens
gtgtactcccagggcttacgg

SEQ ID NO: 6334606 - DNA, 22 bp, Homo sapiens
gtgtactctgtgtgtgtatgag

SEQ ID NO: 6334607 - DNA, 19 bp, Homo sapiens
gtgtactgtatagacagtt

SEQ ID NO: 6334608 - DNA, 15 bp, Homo sapiens
gtgtactgtgcctgg

SEQ ID NO: 6334609 - DNA, 16 bp, Homo sapiens
gtgtactgtgcctggt

SEQ ID NO: 6334610 - DNA, 13 bp, Homo sapiens
gtgtactgtgtca

SEQ ID NO: 6334611 - DNA, 23 bp, Homo sapiens
gtgtacttcccgggccagggctg

SEQ ID NO: 6334612 - DNA, 19 bp, Homo sapiens
gtgtacttttcctttgcta

SEQ ID NO: 6334613 - DNA, 14 bp, Homo sapiens
gtgtagaacactaa

SEQ ID NO: 6334614 - DNA, 17 bp, Homo sapiens
gtgtagaagcattcctt

SEQ ID NO: 6334615 - DNA, 19 bp, Homo sapiens
gtgtagaagcattccttct

SEQ ID NO: 6334616 - DNA, 16 bp, Homo sapiens
gtgtagacctgagctg

SEQ ID NO: 6334617 - DNA, 21 bp, Homo sapiens
gtgtagactggccatgcaagt

SEQ ID NO: 6334618 - DNA, 23 bp, Homo sapiens
gtgtagagcccctactgtgggca

SEQ ID NO: 6334619 - DNA, 23 bp, Homo sapiens
gtgtagatagttaaaagactgca

SEQ ID NO: 6334620 - DNA, 18 bp, Homo sapiens
gtgtagatgtagcattgt

SEQ ID NO: 6334621 - DNA, 17 bp, Homo sapiens
gtgtagatttgttttgt

SEQ ID NO: 6334622 - DNA, 16 bp, Homo sapiens
gtgtagcaactacagt

SEQ ID NO: 6334623 - DNA, 16 bp, Homo sapiens
gtgtagcatcttcctc

SEQ ID NO: 6334624 - DNA, 15 bp, Homo sapiens
gtgtagccccgggct

SEQ ID NO: 6334625 - DNA, 16 bp, Homo sapiens
gtgtagccccgggctg

SEQ ID NO: 6334626 - DNA, 20 bp, Homo sapiens
gtgtagccccgggctgaccc

SEQ ID NO: 6334627 - DNA, 16 bp, Homo sapiens
gtgtagccgccctgag

SEQ ID NO: 6334628 - DNA, 19 bp, Homo sapiens
gtgtagcctaaagggcagg

SEQ ID NO: 6334629 - DNA, 20 bp, Homo sapiens
gtgtagcctaaagggcaggg

SEQ ID NO: 6334630 - DNA, 21 bp, Homo sapiens
gtgtagcctaaagggcagggc

SEQ ID NO: 6334631 - DNA, 14 bp, Homo sapiens
gtgtagcctgtgca

SEQ ID NO: 6334632 - DNA, 16 bp, Homo sapiens
gtgtagccttctcccc

SEQ ID NO: 6334633 - DNA, 18 bp, Homo sapiens
gtgtagcgggaggaagcc

SEQ ID NO: 6334634 - DNA, 18 bp, Homo sapiens
gtgtagctaacagttgcc

SEQ ID NO: 6334635 - DNA, 23 bp, Homo sapiens
gtgtagctaacagttgccacatc

SEQ ID NO: 6334636 - DNA, 16 bp, Homo sapiens
gtgtagctacagagaa

SEQ ID NO: 6334637 - DNA, 23 bp, Homo sapiens
gtgtagctgcaaaaataatcatg

SEQ ID NO: 6334638 - DNA, 12 bp, Homo sapiens
gtgtagctgtaa

SEQ ID NO: 6334639 - DNA, 19 bp, Homo sapiens
gtgtagctgtaagggcagt

SEQ ID NO: 6334640 - DNA, 23 bp, Homo sapiens
gtgtagctgtaagggcagtgccc

SEQ ID NO: 6334641 - DNA, 12 bp, Homo sapiens
gtgtagctgtga

SEQ ID NO: 6334642 - DNA, 15 bp, Homo sapiens
gtgtagctgtgacct

SEQ ID NO: 6334643 - DNA, 21 bp, Homo sapiens
gtgtagctgtgacctgctgag

SEQ ID NO: 6334644 - DNA, 14 bp, Homo sapiens
gtgtagctttgctc

SEQ ID NO: 6334645 - DNA, 17 bp, Homo sapiens
gtgtaggaaatctgaag

SEQ ID NO: 6334646 - DNA, 14 bp, Homo sapiens
gggcatgtgggctt

SEQ ID NO: 6334647 - DNA, 20 bp, Homo sapiens
gggcatgtgtgcctgtggca

SEQ ID NO: 6334648 - DNA, 23 bp, Homo sapiens
gggcatgtttgtctgtgtgctgt

SEQ ID NO: 6334649 - DNA, 18 bp, Homo sapiens
gggcattagcaaggcaga

SEQ ID NO: 6334650 - DNA, 20 bp, Homo sapiens
gggcattagcaaggcagagc

SEQ ID NO: 6334651 - DNA, 13 bp, Homo sapiens
gggcattctctct

SEQ ID NO: 6334652 - DNA, 18 bp, Homo sapiens
gggcattctctctccaag

SEQ ID NO: 6334653 - DNA, 14 bp, Homo sapiens
gggcattgctcagc

SEQ ID NO: 6334654 - DNA, 14 bp, Homo sapiens
gggcatttggcttc

SEQ ID NO: 6334655 - DNA, 20 bp, Homo sapiens
gggcatttggcttcctctgc

SEQ ID NO: 6334656 - DNA, 20 bp, Homo sapiens
gggcattttacaagaagtac

SEQ ID NO: 6334657 - DNA, 12 bp, Homo sapiens
gggcatttttat

SEQ ID NO: 6334658 - DNA, 22 bp, Homo sapiens
gggccaaacccacttctggcct

SEQ ID NO: 6334659 - DNA, 16 bp, Homo sapiens
gggccaaacctgggac

SEQ ID NO: 6334660 - DNA, 17 bp, Homo sapiens
gggccaaagaaggcagg

SEQ ID NO: 6334661 - DNA, 23 bp, Homo sapiens
gggccaaatatattctctttggt

SEQ ID NO: 6334662 - DNA, 21 bp, Homo sapiens
gggccaaatccgctctcttcc

SEQ ID NO: 6334663 - DNA, 11 bp, Homo sapiens
gggccaacacc

SEQ ID NO: 6334664 - DNA, 15 bp, Homo sapiens
gggccaacaccaggg

SEQ ID NO: 6334665 - DNA, 23 bp, Homo sapiens
gggccaacttgagggcccagagc

SEQ ID NO: 6334666 - DNA, 15 bp, Homo sapiens
gggccaagagatctg

SEQ ID NO: 6334667 - DNA, 18 bp, Homo sapiens
gggccaagagatctgtgt

SEQ ID NO: 6334668 - DNA, 15 bp, Homo sapiens
gggccaagcaggcac

SEQ ID NO: 6334669 - DNA, 13 bp, Homo sapiens
gggccaagccagc

SEQ ID NO: 6334670 - DNA, 19 bp, Homo sapiens
gggccaagccagctgccta

SEQ ID NO: 6334671 - DNA, 22 bp, Homo sapiens
gggccaagccagctgcctaggt

SEQ ID NO: 6334672 - DNA, 23 bp, Homo sapiens
gggccaagccagggttccagaca

SEQ ID NO: 6334673 - DNA, 15 bp, Homo sapiens
gggccaaggacctga

SEQ ID NO: 6334674 - DNA, 19 bp, Homo sapiens
gggccaagtccactgtcct

SEQ ID NO: 6334675 - DNA, 15 bp, Homo sapiens
gggccaagtcccacc

SEQ ID NO: 6334676 - DNA, 13 bp, Homo sapiens
gggccaattaaaa

SEQ ID NO: 6334677 - DNA, 18 bp, Homo sapiens
gggccaattaaaatatat

SEQ ID NO: 6334678 - DNA, 18 bp, Homo sapiens
gggccacacccaggaagg

SEQ ID NO: 6334679 - DNA, 20 bp, Homo sapiens
gggccacacctgagcgctgt

SEQ ID NO: 6334680 - DNA, 14 bp, Homo sapiens
gggccacagggcaa

SEQ ID NO: 6334681 - DNA, 16 bp, Homo sapiens
gggccacagggcggtg

SEQ ID NO: 6334682 - DNA, 19 bp, Homo sapiens
gggccacatagatgctgat

SEQ ID NO: 6334683 - DNA, 16 bp, Homo sapiens
gggccaccaaagctgc

SEQ ID NO: 6334684 - DNA, 17 bp, Homo sapiens
gggccaccaaagctgcc

SEQ ID NO: 6334685 - DNA, 19 bp, Homo sapiens
gggccaccaaagctgccca

SEQ ID NO: 6334686 - DNA, 18 bp, Homo sapiens
gggccaccacctttggct

SEQ ID NO: 6334687 - DNA, 19 bp, Homo sapiens
gggccaccagctccactgg

SEQ ID NO: 6334688 - DNA, 20 bp, Homo sapiens
gggccaccatgaccccttct

SEQ ID NO: 6334689 - DNA, 14 bp, Homo sapiens
gggccacccaccag

SEQ ID NO: 6334690 - DNA, 17 bp, Homo sapiens
gggccacccaccagggc

SEQ ID NO: 6334691 - DNA, 14 bp, Homo sapiens
gggccaccccactc

SEQ ID NO: 6334692 - DNA, 15 bp, Homo sapiens
gggccaccccactct

SEQ ID NO: 6334693 - DNA, 22 bp, Homo sapiens
gggccaccccgtgcccctgtgc

SEQ ID NO: 6334694 - DNA, 17 bp, Homo sapiens
gggccaccctgagcaga

SEQ ID NO: 6334695 - DNA, 20 bp, Homo sapiens
gggccaccgcccagctcatg

SEQ ID NO: 6334696 - DNA, 19 bp, Homo sapiens
gggccaccgtgcctggctg

SEQ ID NO: 6334697 - DNA, 15 bp, Homo sapiens
gggccacctccccag

SEQ ID NO: 6334698 - DNA, 12 bp, Homo sapiens
gggccacctcct

SEQ ID NO: 6334699 - DNA, 22 bp, Homo sapiens
gggccacctcctaccccttcct

SEQ ID NO: 6334700 - DNA, 15 bp, Homo sapiens
gggccacctgcctgc

SEQ ID NO: 6334701 - DNA, 17 bp, Homo sapiens
gggccacgccccagccc

SEQ ID NO: 6334702 - DNA, 22 bp, Homo sapiens
gggccacgccccagcccgacaa

SEQ ID NO: 6334703 - DNA, 17 bp, Homo sapiens
gggccacgccggccaca

SEQ ID NO: 6334704 - DNA, 24 bp, Homo sapiens
gggccacggaggagggatgctgct

SEQ ID NO: 6334705 - DNA, 17 bp, Homo sapiens
gggccacggctgagcct

SEQ ID NO: 6334706 - DNA, 18 bp, Homo sapiens
gggccacggctgagcctt

SEQ ID NO: 6334707 - DNA, 18 bp, Homo sapiens
gggccacgtgccaggccc

SEQ ID NO: 6334708 - DNA, 19 bp, Homo sapiens
gggccacgtgccaggcccg

SEQ ID NO: 6334709 - DNA, 16 bp, Homo sapiens
gggccactcctcttca

SEQ ID NO: 6334710 - DNA, 16 bp, Homo sapiens
gggccactccttcctg

SEQ ID NO: 6334711 - DNA, 12 bp, Homo sapiens
gggccactgcca

SEQ ID NO: 6334712 - DNA, 23 bp, Homo sapiens
gggccactggcatctctggagtg

SEQ ID NO: 6334713 - DNA, 13 bp, Homo sapiens
gggccactgggga

SEQ ID NO: 6334714 - DNA, 22 bp, Homo sapiens
gggccactggggactttattta

SEQ ID NO: 6334715 - DNA, 22 bp, Homo sapiens
gggccagaaggagggcagagcc

SEQ ID NO: 6334716 - DNA, 20 bp, Homo sapiens
gggccagacagaccttcaca

SEQ ID NO: 6334717 - DNA, 15 bp, Homo sapiens
gggccagactggctg

SEQ ID NO: 6334718 - DNA, 11 bp, Homo sapiens
gggccagagct

SEQ ID NO: 6334719 - DNA, 12 bp, Homo sapiens
gggccagaggca

SEQ ID NO: 6334720 - DNA, 14 bp, Homo sapiens
gggccagaggcagc

SEQ ID NO: 6334721 - DNA, 12 bp, Homo sapiens
gggccagaggct

SEQ ID NO: 6334722 - DNA, 11 bp, Homo sapiens
gggccagaggg

SEQ ID NO: 6334723 - DNA, 12 bp, Homo sapiens
gggccagaggga

SEQ ID NO: 6334724 - DNA, 20 bp, Homo sapiens
gggccagagggactttgcct

SEQ ID NO: 6334725 - DNA, 14 bp, Homo sapiens
gggccagatccagc

SEQ ID NO: 6334726 - DNA, 16 bp, Homo sapiens
gggccagcaggcagcg

SEQ ID NO: 6334727 - DNA, 19 bp, Homo sapiens
gggccagcaggcagcgcct

SEQ ID NO: 6334728 - DNA, 13 bp, Homo sapiens
gggccagcaggct

SEQ ID NO: 6334729 - DNA, 18 bp, Homo sapiens
gggccagcatagggggga

SEQ ID NO: 6334730 - DNA, 21 bp, Homo sapiens
gggccagcataggggggaggg

SEQ ID NO: 6334731 - DNA, 15 bp, Homo sapiens
gggccagcccaggat

SEQ ID NO: 6334732 - DNA, 14 bp, Homo sapiens
gggccagcccctcc

SEQ ID NO: 6334733 - DNA, 17 bp, Homo sapiens
gggccagcccctccccg

SEQ ID NO: 6334734 - DNA, 20 bp, Homo sapiens
gggccagcccttgctctacc

SEQ ID NO: 6334735 - DNA, 21 bp, Homo sapiens
gggccagccgattcctccagc

SEQ ID NO: 6334736 - DNA, 11 bp, Homo sapiens
gggccagccta

SEQ ID NO: 6334737 - DNA, 22 bp, Homo sapiens
gggccagcctcagctcagcctc

SEQ ID NO: 6334738 - DNA, 18 bp, Homo sapiens
gggccagcggccctccca

SEQ ID NO: 6334739 - DNA, 22 bp, Homo sapiens
gggccagcggccctcccaggcg

SEQ ID NO: 6334740 - DNA, 11 bp, Homo sapiens
gggccagctgg

SEQ ID NO: 6334741 - DNA, 18 bp, Homo sapiens
gggccagctggggagatg

SEQ ID NO: 6334742 - DNA, 15 bp, Homo sapiens
gggccagctggtgct

SEQ ID NO: 6334743 - DNA, 17 bp, Homo sapiens
gggccaggactgagccc

SEQ ID NO: 6334744 - DNA, 15 bp, Homo sapiens
gggccaggagagaga

SEQ ID NO: 6334745 - DNA, 11 bp, Homo sapiens
gggccaggagc

SEQ ID NO: 6334746 - DNA, 12 bp, Homo sapiens
gggccaggcaga

SEQ ID NO: 6334747 - DNA, 13 bp, Homo sapiens
gggccaggcagaa

SEQ ID NO: 6334748 - DNA, 21 bp, Homo sapiens
gggccaggcagaatggctgca

SEQ ID NO: 6334749 - DNA, 23 bp, Homo sapiens
gggccaggcaggtgcctggacat

SEQ ID NO: 6334750 - DNA, 10 bp, Homo sapiens
gggccaggcc

SEQ ID NO: 6334751 - DNA, 11 bp, Homo sapiens
gggccaggccc

SEQ ID NO: 6334752 - DNA, 17 bp, Homo sapiens
gggccaggcccaggcag

SEQ ID NO: 6334753 - DNA, 12 bp, Homo sapiens
gggccaggcccc

SEQ ID NO: 6334754 - DNA, 14 bp, Homo sapiens
gggccaggcccgca

SEQ ID NO: 6334755 - DNA, 13 bp, Homo sapiens
gggccaggccctg

SEQ ID NO: 6334756 - DNA, 21 bp, Homo sapiens
gggccaggccctggagggcag

SEQ ID NO: 6334757 - DNA, 14 bp, Homo sapiens
gggccaggctgggt

SEQ ID NO: 6334758 - DNA, 24 bp, Homo sapiens
gggccaggctggtccgagctgagg

SEQ ID NO: 6334759 - DNA, 15 bp, Homo sapiens
gggccagggacccag

SEQ ID NO: 6334760 - DNA, 12 bp, Homo sapiens
gggccagggagg

SEQ ID NO: 6334761 - DNA, 15 bp, Homo sapiens
gggccagggaggcag

SEQ ID NO: 6334762 - DNA, 16 bp, Homo sapiens
gggccagggcagatgt

SEQ ID NO: 6334763 - DNA, 16 bp, Homo sapiens
gggccagggctgcccc

SEQ ID NO: 6334764 - DNA, 20 bp, Homo sapiens
gggccagggctgccctgaga

SEQ ID NO: 6334765 - DNA, 21 bp, Homo sapiens
gggccagggctggatggacag

SEQ ID NO: 6334766 - DNA, 22 bp, Homo sapiens
gggccagggctggatggacaga

SEQ ID NO: 6334767 - DNA, 18 bp, Homo sapiens
gggccaggggcaggcagg

SEQ ID NO: 6334768 - DNA, 19 bp, Homo sapiens
gggccaggggcaggcaggg

SEQ ID NO: 6334769 - DNA, 10 bp, Homo sapiens
gggccagggt

SEQ ID NO: 6334770 - DNA, 17 bp, Homo sapiens
gggccagggtgggaaga

SEQ ID NO: 6334771 - DNA, 16 bp, Homo sapiens
gggccagtagagagtg

SEQ ID NO: 6334772 - DNA, 15 bp, Homo sapiens
gggccagtcctgcct

SEQ ID NO: 6334773 - DNA, 21 bp, Homo sapiens
gggccagtcctgcctggccag

SEQ ID NO: 6334774 - DNA, 15 bp, Homo sapiens
gggccagtctgggct

SEQ ID NO: 6334775 - DNA, 20 bp, Homo sapiens
gggccagtctgggctgccgg

SEQ ID NO: 6334776 - DNA, 18 bp, Homo sapiens
gggccagtgctccagcca

SEQ ID NO: 6334777 - DNA, 21 bp, Homo sapiens
gggccagtggattcccacagc

SEQ ID NO: 6334778 - DNA, 15 bp, Homo sapiens
gggccagtggcactc

SEQ ID NO: 6334779 - DNA, 14 bp, Homo sapiens
gggccagtggggaa

SEQ ID NO: 6334780 - DNA, 20 bp, Homo sapiens
gggccagtggggaactgagg

SEQ ID NO: 6334781 - DNA, 15 bp, Homo sapiens
gggccagtggggcct

SEQ ID NO: 6334782 - DNA, 16 bp, Homo sapiens
gggccagtggggcctg

SEQ ID NO: 6334783 - DNA, 19 bp, Homo sapiens
gggccagtgtaaggcatag

SEQ ID NO: 6334784 - DNA, 20 bp, Homo sapiens
gggccagtgtaaggcatagg

SEQ ID NO: 6334785 - DNA, 14 bp, Homo sapiens
gggccatactggcc

SEQ ID NO: 6334786 - DNA, 16 bp, Homo sapiens
gggccatactggcctc

SEQ ID NO: 6334787 - DNA, 15 bp, Homo sapiens
gggccatagctcctg

SEQ ID NO: 6334788 - DNA, 22 bp, Homo sapiens
gggccatatgtgctatggagag

SEQ ID NO: 6334789 - DNA, 23 bp, Homo sapiens
gggccatcacaggatgccagccc

SEQ ID NO: 6334790 - DNA, 14 bp, Homo sapiens
gggccatccactgt

SEQ ID NO: 6334791 - DNA, 15 bp, Homo sapiens
gggccatccactgtg

SEQ ID NO: 6334792 - DNA, 13 bp, Homo sapiens
gggccatccttcc

SEQ ID NO: 6334793 - DNA, 24 bp, Homo sapiens
gggccatctgactgccaagccaga

SEQ ID NO: 6334794 - DNA, 23 bp, Homo sapiens
gggccatgatggcaacagatctg

SEQ ID NO: 6334795 - DNA, 22 bp, Homo sapiens
gggccatgcctcctcaggagcc

SEQ ID NO: 6334796 - DNA, 15 bp, Homo sapiens
gggccatgctgaagg

SEQ ID NO: 6334797 - DNA, 14 bp, Homo sapiens
gggccatgctgagg

SEQ ID NO: 6334798 - DNA, 21 bp, Homo sapiens
gggccatgctgaggcctgggc

SEQ ID NO: 6334799 - DNA, 23 bp, Homo sapiens
gggccatgctgaggcctgggccg

SEQ ID NO: 6334800 - DNA, 19 bp, Homo sapiens
gggccatggtggagggcac

SEQ ID NO: 6334801 - DNA, 14 bp, Homo sapiens
gggccatgtccaaa

SEQ ID NO: 6334802 - DNA, 15 bp, Homo sapiens
gggccatgtccaaag

SEQ ID NO: 6334803 - DNA, 17 bp, Homo sapiens
gggccatgtccaaagag

SEQ ID NO: 6334804 - DNA, 23 bp, Homo sapiens
gggccatgtccaaagaggctgcc

SEQ ID NO: 6334805 - DNA, 16 bp, Homo sapiens
gggccattctccacag

SEQ ID NO: 6334806 - DNA, 15 bp, Homo sapiens
gggccatttggccgg

SEQ ID NO: 6334807 - DNA, 16 bp, Homo sapiens
gggccatttggccggc

SEQ ID NO: 6334808 - DNA, 17 bp, Homo sapiens
gggccatttggccggct

SEQ ID NO: 6334809 - DNA, 16 bp, Homo sapiens
gggcccaaccctgtct

SEQ ID NO: 6334810 - DNA, 16 bp, Homo sapiens
gggcccaagaactgca

SEQ ID NO: 6334811 - DNA, 18 bp, Homo sapiens
gggcccaagacagatgcc

SEQ ID NO: 6334812 - DNA, 23 bp, Homo sapiens
gggcccaagacagatgccccaga

SEQ ID NO: 6334813 - DNA, 15 bp, Homo sapiens
gggcccaagagagac

SEQ ID NO: 6334814 - DNA, 20 bp, Homo sapiens
gggcccaagcaaggggccta

SEQ ID NO: 6334815 - DNA, 16 bp, Homo sapiens
gggcccaagccccatc

SEQ ID NO: 6334816 - DNA, 19 bp, Homo sapiens
gggcccaaggcggcccctc

SEQ ID NO: 6334817 - DNA, 21 bp, Homo sapiens
gggcccaagttgcagtgagca

SEQ ID NO: 6334818 - DNA, 12 bp, Homo sapiens
gggcccacaaag

SEQ ID NO: 6334819 - DNA, 20 bp, Homo sapiens
gggcccacagacagatccca

SEQ ID NO: 6334820 - DNA, 18 bp, Homo sapiens
gggcccacagagcctggc

SEQ ID NO: 6334821 - DNA, 13 bp, Homo sapiens
gggcccacccaca

SEQ ID NO: 6334822 - DNA, 13 bp, Homo sapiens
gggcccacctggc

SEQ ID NO: 6334823 - DNA, 19 bp, Homo sapiens
gggcccacctggccacctg

SEQ ID NO: 6334824 - DNA, 11 bp, Homo sapiens
gggcccagaac

SEQ ID NO: 6334825 - DNA, 20 bp, Homo sapiens
gggcccagaactgcccccac

SEQ ID NO: 6334826 - DNA, 18 bp, Homo sapiens
gtgtaggaagaggccgct

SEQ ID NO: 6334827 - DNA, 22 bp, Homo sapiens
gtgtaggaagaggccgctgcag

SEQ ID NO: 6334828 - DNA, 13 bp, Homo sapiens
gtgtaggcagaca

SEQ ID NO: 6334829 - DNA, 15 bp, Homo sapiens
gtgtaggcagacaca

SEQ ID NO: 6334830 - DNA, 21 bp, Homo sapiens
gtgtagggaccagtgggatgg

SEQ ID NO: 6334831 - DNA, 20 bp, Homo sapiens
gtgtaggggagccacattta

SEQ ID NO: 6334832 - DNA, 14 bp, Homo sapiens
gtgtaggttatctt

SEQ ID NO: 6334833 - DNA, 22 bp, Homo sapiens
gtgtaggttatctttttaaaaa

SEQ ID NO: 6334834 - DNA, 23 bp, Homo sapiens
gtgtaggttccgtatctccctgg

SEQ ID NO: 6334835 - DNA, 13 bp, Homo sapiens
gtgtagtcaggtg

SEQ ID NO: 6334836 - DNA, 17 bp, Homo sapiens
gtgtagtggaagagcag

SEQ ID NO: 6334837 - DNA, 19 bp, Homo sapiens
gtgtagtggaagagcagcc

SEQ ID NO: 6334838 - DNA, 23 bp, Homo sapiens
gtgtagtggaagagcagcctgat

SEQ ID NO: 6334839 - DNA, 15 bp, Homo sapiens
gtgtagttcatgtaa

SEQ ID NO: 6334840 - DNA, 18 bp, Homo sapiens
gtgtagttccctctgcct

SEQ ID NO: 6334841 - DNA, 19 bp, Homo sapiens
gtgtataaacaagaaaaat

SEQ ID NO: 6334842 - DNA, 16 bp, Homo sapiens
gtgtataaactgctgt

SEQ ID NO: 6334843 - DNA, 19 bp, Homo sapiens
gtgtataaatgtacatttc

SEQ ID NO: 6334844 - DNA, 17 bp, Homo sapiens
gtgtataagtgcacaca

SEQ ID NO: 6334845 - DNA, 20 bp, Homo sapiens
gtgtataagttgtattatta

SEQ ID NO: 6334846 - DNA, 17 bp, Homo sapiens
gtgtataatgtgcttta

SEQ ID NO: 6334847 - DNA, 13 bp, Homo sapiens
gtgtataatgttg

SEQ ID NO: 6334848 - DNA, 16 bp, Homo sapiens
gtgtataatgttggtg

SEQ ID NO: 6334849 - DNA, 14 bp, Homo sapiens
gtgtataatttacc

SEQ ID NO: 6334850 - DNA, 17 bp, Homo sapiens
gtgtatacatatgtatg

SEQ ID NO: 6334851 - DNA, 21 bp, Homo sapiens
gtgtatacatatgtatgtgtg

SEQ ID NO: 6334852 - DNA, 23 bp, Homo sapiens
gtgtatagctgtgtgtgtgttca

SEQ ID NO: 6334853 - DNA, 18 bp, Homo sapiens
gtgtatagggaattttca

SEQ ID NO: 6334854 - DNA, 14 bp, Homo sapiens
gtgtatagtgttca

SEQ ID NO: 6334855 - DNA, 22 bp, Homo sapiens
gtgtatagtgttcacaaactgt

SEQ ID NO: 6334856 - DNA, 23 bp, Homo sapiens
gtgtatagtgttcacaaactgtg

SEQ ID NO: 6334857 - DNA, 13 bp, Homo sapiens
gtgtatatatctt

SEQ ID NO: 6334858 - DNA, 13 bp, Homo sapiens
gtgtatatatgtg

SEQ ID NO: 6334859 - DNA, 22 bp, Homo sapiens
gtgtatatattatatatacatt

SEQ ID NO: 6334860 - DNA, 12 bp, Homo sapiens
gtgtatatcatg

SEQ ID NO: 6334861 - DNA, 18 bp, Homo sapiens
gtgtatatcatgaagcct

SEQ ID NO: 6334862 - DNA, 14 bp, Homo sapiens
gtgtatatgtatgt

SEQ ID NO: 6334863 - DNA, 14 bp, Homo sapiens
gtgtatatgtattt

SEQ ID NO: 6334864 - DNA, 13 bp, Homo sapiens
gtgtatatgtgct

SEQ ID NO: 6334865 - DNA, 18 bp, Homo sapiens
gtgtatatgttggtttaa

SEQ ID NO: 6334866 - DNA, 22 bp, Homo sapiens
gtgtatattatcttctggtgca

SEQ ID NO: 6334867 - DNA, 14 bp, Homo sapiens
gtgtatattatttg

SEQ ID NO: 6334868 - DNA, 15 bp, Homo sapiens
gtgtatattatttgg

SEQ ID NO: 6334869 - DNA, 19 bp, Homo sapiens
gtgtatattatttggcagt

SEQ ID NO: 6334870 - DNA, 15 bp, Homo sapiens
gtgtatcaaaatgct

SEQ ID NO: 6334871 - DNA, 21 bp, Homo sapiens
gtgtatcaggtcagggacttg

SEQ ID NO: 6334872 - DNA, 16 bp, Homo sapiens
gtgtatcagtttccat

SEQ ID NO: 6334873 - DNA, 12 bp, Homo sapiens
gtgtatcattaa

SEQ ID NO: 6334874 - DNA, 13 bp, Homo sapiens
gtgtatcattaaa

SEQ ID NO: 6334875 - DNA, 14 bp, Homo sapiens
gtgtatcattaaaa

SEQ ID NO: 6334876 - DNA, 20 bp, Homo sapiens
gtgtatccattatcatgtgt

SEQ ID NO: 6334877 - DNA, 21 bp, Homo sapiens
gtgtatccgactctaagctgt

SEQ ID NO: 6334878 - DNA, 12 bp, Homo sapiens
gtgtatcctggc

SEQ ID NO: 6334879 - DNA, 14 bp, Homo sapiens
gtgtatcctggccc

SEQ ID NO: 6334880 - DNA, 13 bp, Homo sapiens
gtgtatcctgggg

SEQ ID NO: 6334881 - DNA, 19 bp, Homo sapiens
gtgtatctaaaggatggaa

SEQ ID NO: 6334882 - DNA, 17 bp, Homo sapiens
gtgtatctcaataaagc

SEQ ID NO: 6334883 - DNA, 20 bp, Homo sapiens
gtgtatctcgaagtcttcca

SEQ ID NO: 6334884 - DNA, 22 bp, Homo sapiens
gtgtatcttgattaatgtactt

SEQ ID NO: 6334885 - DNA, 16 bp, Homo sapiens
gtgtatgactaaagag

SEQ ID NO: 6334886 - DNA, 21 bp, Homo sapiens
gtgtatgagaagtactttgtg

SEQ ID NO: 6334887 - DNA, 19 bp, Homo sapiens
gtgtatgagtgtgaatgat

SEQ ID NO: 6334888 - DNA, 19 bp, Homo sapiens
gtgtatgctactacaaaaa

SEQ ID NO: 6334889 - DNA, 21 bp, Homo sapiens
gtgtatggaaaaaccatttga

SEQ ID NO: 6334890 - DNA, 19 bp, Homo sapiens
gtgtatggaaataaatgta

SEQ ID NO: 6334891 - DNA, 21 bp, Homo sapiens
gtgtatggaagacaaatacac

SEQ ID NO: 6334892 - DNA, 23 bp, Homo sapiens
gtgtatggaatttttgaatctat

SEQ ID NO: 6334893 - DNA, 20 bp, Homo sapiens
gtgtatggagagaaaacaga

SEQ ID NO: 6334894 - DNA, 22 bp, Homo sapiens
gtgtatgggggaaggcgctggg

SEQ ID NO: 6334895 - DNA, 22 bp, Homo sapiens
gtgtatgggtgtgtgtttgtgt

SEQ ID NO: 6334896 - DNA, 14 bp, Homo sapiens
gtgtatggtgacct

SEQ ID NO: 6334897 - DNA, 14 bp, Homo sapiens
gtgtatgtctatgt

SEQ ID NO: 6334898 - DNA, 17 bp, Homo sapiens
gtgtatgtctatgtgta

SEQ ID NO: 6334899 - DNA, 18 bp, Homo sapiens
gtgtatgtctatgtgtat

SEQ ID NO: 6334900 - DNA, 13 bp, Homo sapiens
gtgtatgtctatt

SEQ ID NO: 6334901 - DNA, 13 bp, Homo sapiens
gtgtatgtggggg

SEQ ID NO: 6334902 - DNA, 21 bp, Homo sapiens
gtgtatgtgggggtctgtgtg

SEQ ID NO: 6334903 - DNA, 16 bp, Homo sapiens
gtgtatgtgtgtgtgt

SEQ ID NO: 6334904 - DNA, 13 bp, Homo sapiens
gtgtatgtgttta

SEQ ID NO: 6334905 - DNA, 19 bp, Homo sapiens
gtgtatgtgtttataattg

SEQ ID NO: 6334906 - DNA, 22 bp, Homo sapiens
gtgtatgtgtttataattgtta

SEQ ID NO: 6334907 - DNA, 14 bp, Homo sapiens
gtgtatgttaatat

SEQ ID NO: 6334908 - DNA, 12 bp, Homo sapiens
gtgtatgtttct

SEQ ID NO: 6334909 - DNA, 20 bp, Homo sapiens
gtgtatgttttatatcaaat

SEQ ID NO: 6334910 - DNA, 14 bp, Homo sapiens
gtgtattaaacctt

SEQ ID NO: 6334911 - DNA, 22 bp, Homo sapiens
gtgtattaacatgcaataacaa

SEQ ID NO: 6334912 - DNA, 21 bp, Homo sapiens
gtgtattacaacaatctggag

SEQ ID NO: 6334913 - DNA, 23 bp, Homo sapiens
gtgtattacaacaatctggagat

SEQ ID NO: 6334914 - DNA, 16 bp, Homo sapiens
gtgtattcagaggcag

SEQ ID NO: 6334915 - DNA, 14 bp, Homo sapiens
gtgtattcaggacc

SEQ ID NO: 6334916 - DNA, 13 bp, Homo sapiens
gtgtattcatatt

SEQ ID NO: 6334917 - DNA, 23 bp, Homo sapiens
gtgtattcatattaccagaaaat

SEQ ID NO: 6334918 - DNA, 14 bp, Homo sapiens
gtgtattctggctg

SEQ ID NO: 6334919 - DNA, 12 bp, Homo sapiens
gtgtattctgtg

SEQ ID NO: 6334920 - DNA, 20 bp, Homo sapiens
gtgtattctgtggattctat

SEQ ID NO: 6334921 - DNA, 13 bp, Homo sapiens
gtgtattgtaatg

SEQ ID NO: 6334922 - DNA, 23 bp, Homo sapiens
gtgtatttaaaaaaaagaaactt

SEQ ID NO: 6334923 - DNA, 20 bp, Homo sapiens
gtgtatttaattgtaaactg

SEQ ID NO: 6334924 - DNA, 22 bp, Homo sapiens
gtgtatttaattgtaaactgta

SEQ ID NO: 6334925 - DNA, 17 bp, Homo sapiens
gtgtatttacgctttga

SEQ ID NO: 6334926 - DNA, 21 bp, Homo sapiens
gtgtatttacgctttgattca

SEQ ID NO: 6334927 - DNA, 14 bp, Homo sapiens
gtgtatttatataa

SEQ ID NO: 6334928 - DNA, 15 bp, Homo sapiens
gtgtatttattacat

SEQ ID NO: 6334929 - DNA, 12 bp, Homo sapiens
gtgtatttattt

SEQ ID NO: 6334930 - DNA, 16 bp, Homo sapiens
gtgtatttatttaaaa

SEQ ID NO: 6334931 - DNA, 19 bp, Homo sapiens
gtgtatttattttacagct

SEQ ID NO: 6334932 - DNA, 15 bp, Homo sapiens
gtgtatttctctgtg

SEQ ID NO: 6334933 - DNA, 16 bp, Homo sapiens
gtgtatttctctgtga

SEQ ID NO: 6334934 - DNA, 13 bp, Homo sapiens
gtgtatttgtatt

SEQ ID NO: 6334935 - DNA, 14 bp, Homo sapiens
gtgtatttgtatta

SEQ ID NO: 6334936 - DNA, 16 bp, Homo sapiens
gtgtatttgtattaat

SEQ ID NO: 6334937 - DNA, 20 bp, Homo sapiens
gtgtatttgtattaataaag

SEQ ID NO: 6334938 - DNA, 17 bp, Homo sapiens
gtgtattttaaaataga

SEQ ID NO: 6334939 - DNA, 18 bp, Homo sapiens
gtgtattttataaaatta

SEQ ID NO: 6334940 - DNA, 20 bp, Homo sapiens
gtgtattttataaaattaaa

SEQ ID NO: 6334941 - DNA, 14 bp, Homo sapiens
gtgtattttattca

SEQ ID NO: 6334942 - DNA, 17 bp, Homo sapiens
gtgtattttattcagta

SEQ ID NO: 6334943 - DNA, 16 bp, Homo sapiens
gtgtattttcctggat

SEQ ID NO: 6334944 - DNA, 19 bp, Homo sapiens
gtgtatttttgtaaaaaat

SEQ ID NO: 6334945 - DNA, 16 bp, Homo sapiens
gtgtcaaataaacact

SEQ ID NO: 6334946 - DNA, 17 bp, Homo sapiens
gtgtcaaataaacactg

SEQ ID NO: 6334947 - DNA, 20 bp, Homo sapiens
gtgtcaaatcgatggcctgg

SEQ ID NO: 6334948 - DNA, 13 bp, Homo sapiens
gtgtcaaattttt

SEQ ID NO: 6334949 - DNA, 16 bp, Homo sapiens
gtgtcaaccagacaga

SEQ ID NO: 6334950 - DNA, 15 bp, Homo sapiens
gtgtcaactttcatt

SEQ ID NO: 6334951 - DNA, 16 bp, Homo sapiens
gtgtcaagaaggaaga

SEQ ID NO: 6334952 - DNA, 16 bp, Homo sapiens
gtgtcaagacatttct

SEQ ID NO: 6334953 - DNA, 21 bp, Homo sapiens
gtgtcaagctgctctgagcca

SEQ ID NO: 6334954 - DNA, 14 bp, Homo sapiens
gtgtcaaggggccc

SEQ ID NO: 6334955 - DNA, 15 bp, Homo sapiens
gtgtcaaggggccct

SEQ ID NO: 6334956 - DNA, 23 bp, Homo sapiens
gtgtcaaggggccctaggaacct

SEQ ID NO: 6334957 - DNA, 17 bp, Homo sapiens
gtgtcaagtggcaaagc

SEQ ID NO: 6334958 - DNA, 16 bp, Homo sapiens
gtgtcaagttgtgctt

SEQ ID NO: 6334959 - DNA, 18 bp, Homo sapiens
gtgtcaagttgtgcttgt

SEQ ID NO: 6334960 - DNA, 16 bp, Homo sapiens
gtgtcaatttccctca

SEQ ID NO: 6334961 - DNA, 12 bp, Homo sapiens
gtgtcacaaagc

SEQ ID NO: 6334962 - DNA, 12 bp, Homo sapiens
gtgtcacagaga

SEQ ID NO: 6334963 - DNA, 15 bp, Homo sapiens
gtgtcacagagagct

SEQ ID NO: 6334964 - DNA, 15 bp, Homo sapiens
gtgtcacagaggcag

SEQ ID NO: 6334965 - DNA, 23 bp, Homo sapiens
gtgtcacagaggcagtggcagca

SEQ ID NO: 6334966 - DNA, 15 bp, Homo sapiens
gtgtcaccagcctgt

SEQ ID NO: 6334967 - DNA, 22 bp, Homo sapiens
gtgtcaccccagagccacacat

SEQ ID NO: 6334968 - DNA, 14 bp, Homo sapiens
gtgtcaccctgcag

SEQ ID NO: 6334969 - DNA, 18 bp, Homo sapiens
gtgtcaccctgcagagct

SEQ ID NO: 6334970 - DNA, 14 bp, Homo sapiens
gtgtcaccctgtgg

SEQ ID NO: 6334971 - DNA, 16 bp, Homo sapiens
gtgtcaccctgtgggt

SEQ ID NO: 6334972 - DNA, 13 bp, Homo sapiens
gtgtcacctctct

SEQ ID NO: 6334973 - DNA, 16 bp, Homo sapiens
gtgtcacctctctcag

SEQ ID NO: 6334974 - DNA, 20 bp, Homo sapiens
gtgtcacctctctcagagca

SEQ ID NO: 6334975 - DNA, 22 bp, Homo sapiens
gtgtcacctgaagactcattct

SEQ ID NO: 6334976 - DNA, 22 bp, Homo sapiens
gtgtcacctgcacagggccctc

SEQ ID NO: 6334977 - DNA, 15 bp, Homo sapiens
gtgtcacctttcttc

SEQ ID NO: 6334978 - DNA, 17 bp, Homo sapiens
gtgtcaccttttcttgc

SEQ ID NO: 6334979 - DNA, 15 bp, Homo sapiens
gtgtcacggccaggc

SEQ ID NO: 6334980 - DNA, 19 bp, Homo sapiens
gtgtcacgtgaccctgtgc

SEQ ID NO: 6334981 - DNA, 17 bp, Homo sapiens
gtgtcactccataaaaa

SEQ ID NO: 6334982 - DNA, 19 bp, Homo sapiens
gtgtcactccataaaaaga

SEQ ID NO: 6334983 - DNA, 20 bp, Homo sapiens
gtgtcactgtccctcctggt

SEQ ID NO: 6334984 - DNA, 23 bp, Homo sapiens
gtgtcactttttaaaccactgta

SEQ ID NO: 6334985 - DNA, 20 bp, Homo sapiens
gtgtcagaaaccctggtctc

SEQ ID NO: 6334986 - DNA, 12 bp, Homo sapiens
gtgtcagaagct

SEQ ID NO: 6334987 - DNA, 14 bp, Homo sapiens
gtgtcagagcccag

SEQ ID NO: 6334988 - DNA, 20 bp, Homo sapiens
gtgtcagagcccagcccagg

SEQ ID NO: 6334989 - DNA, 12 bp, Homo sapiens
gtgtcagagcct

SEQ ID NO: 6334990 - DNA, 16 bp, Homo sapiens
gtgtcagcatagaagt

SEQ ID NO: 6334991 - DNA, 13 bp, Homo sapiens
gtgtcagcccctc

SEQ ID NO: 6334992 - DNA, 16 bp, Homo sapiens
gtgtcagcccctcttc

SEQ ID NO: 6334993 - DNA, 23 bp, Homo sapiens
gtgtcagcgcctggcctacccag

SEQ ID NO: 6334994 - DNA, 21 bp, Homo sapiens
gtgtcagcgggtgcaccatgg

SEQ ID NO: 6334995 - DNA, 14 bp, Homo sapiens
gtgtcagctcaggc

SEQ ID NO: 6334996 - DNA, 23 bp, Homo sapiens
gtgtcaggaaacatatttaagaa

SEQ ID NO: 6334997 - DNA, 23 bp, Homo sapiens
gtgtcaggatggtaattcttatt

SEQ ID NO: 6334998 - DNA, 19 bp, Homo sapiens
gtgtcaggattgaggatga

SEQ ID NO: 6334999 - DNA, 12 bp, Homo sapiens
gtgtcaggcccg

SEQ ID NO: 6335000 - DNA, 21 bp, Homo sapiens
gtgtcaggcccgtcggagctg

SEQ ID NO: 6335001 - DNA, 23 bp, Homo sapiens
gtgtcaggcccgtcggagctgcc

SEQ ID NO: 6335002 - DNA, 15 bp, Homo sapiens
gtgtcaggccctctg

SEQ ID NO: 6335003 - DNA, 17 bp, Homo sapiens
gtgtcagggtccaggag

SEQ ID NO: 6335004 - DNA, 18 bp, Homo sapiens
gtgtcaggtggggcagct

SEQ ID NO: 6335005 - DNA, 11 bp, Homo sapiens
gggcccagacc

SEQ ID NO: 6335006 - DNA, 14 bp, Homo sapiens
gggcccagagcagg

SEQ ID NO: 6335007 - DNA, 13 bp, Homo sapiens
gggcccagagccc

SEQ ID NO: 6335008 - DNA, 20 bp, Homo sapiens
gggcccagagcccagctcca

SEQ ID NO: 6335009 - DNA, 19 bp, Homo sapiens
gggcccagagcccttgact

SEQ ID NO: 6335010 - DNA, 11 bp, Homo sapiens
gggcccagagg

SEQ ID NO: 6335011 - DNA, 12 bp, Homo sapiens
gggcccagagtg

SEQ ID NO: 6335012 - DNA, 11 bp, Homo sapiens
gggcccagcat

SEQ ID NO: 6335013 - DNA, 11 bp, Homo sapiens
gggcccagccc

SEQ ID NO: 6335014 - DNA, 12 bp, Homo sapiens
gggcccagccca

SEQ ID NO: 6335015 - DNA, 17 bp, Homo sapiens
gggcccagcccagagcc

SEQ ID NO: 6335016 - DNA, 19 bp, Homo sapiens
gggcccagcccagagccac

SEQ ID NO: 6335017 - DNA, 17 bp, Homo sapiens
gggcccagcctcctctg

SEQ ID NO: 6335018 - DNA, 23 bp, Homo sapiens
gggcccagcgctctcctggacgc

SEQ ID NO: 6335019 - DNA, 15 bp, Homo sapiens
gggcccagctgggct

SEQ ID NO: 6335020 - DNA, 16 bp, Homo sapiens
gggcccagctgtagcc

SEQ ID NO: 6335021 - DNA, 24 bp, Homo sapiens
gggcccaggaccagctggggcgtg

SEQ ID NO: 6335022 - DNA, 13 bp, Homo sapiens
gggcccaggaggg

SEQ ID NO: 6335023 - DNA, 13 bp, Homo sapiens
gggcccaggcaga

SEQ ID NO: 6335024 - DNA, 20 bp, Homo sapiens
gggcccaggccatcttccag

SEQ ID NO: 6335025 - DNA, 12 bp, Homo sapiens
gggcccaggccc

SEQ ID NO: 6335026 - DNA, 18 bp, Homo sapiens
gggcccaggcccagcctc

SEQ ID NO: 6335027 - DNA, 14 bp, Homo sapiens
gggcccaggcctgg

SEQ ID NO: 6335028 - DNA, 13 bp, Homo sapiens
gggcccaggctcc

SEQ ID NO: 6335029 - DNA, 20 bp, Homo sapiens
gggcccaggctcccctgccc

SEQ ID NO: 6335030 - DNA, 19 bp, Homo sapiens
gggcccaggctctgggaag

SEQ ID NO: 6335031 - DNA, 13 bp, Homo sapiens
gggcccagggagg

SEQ ID NO: 6335032 - DNA, 20 bp, Homo sapiens
gggcccagggaggtggcagg

SEQ ID NO: 6335033 - DNA, 17 bp, Homo sapiens
gggcccagggcctctgg

SEQ ID NO: 6335034 - DNA, 17 bp, Homo sapiens
gggcccaggggctgtgg

SEQ ID NO: 6335035 - DNA, 13 bp, Homo sapiens
gggcccagtgcat

SEQ ID NO: 6335036 - DNA, 13 bp, Homo sapiens
gggcccatcaggc

SEQ ID NO: 6335037 - DNA, 15 bp, Homo sapiens
gggcccatggcccca

SEQ ID NO: 6335038 - DNA, 18 bp, Homo sapiens
gggcccatggccccagct

SEQ ID NO: 6335039 - DNA, 22 bp, Homo sapiens
gggcccatgtagctggcaagct

SEQ ID NO: 6335040 - DNA, 22 bp, Homo sapiens
gggccccaaacgggctgccctg

SEQ ID NO: 6335041 - DNA, 18 bp, Homo sapiens
gggccccaaagcccagcc

SEQ ID NO: 6335042 - DNA, 13 bp, Homo sapiens
gggccccacctac

SEQ ID NO: 6335043 - DNA, 17 bp, Homo sapiens
gggccccacctcggcac

SEQ ID NO: 6335044 - DNA, 22 bp, Homo sapiens
gggccccacgtccctgcggaag

SEQ ID NO: 6335045 - DNA, 13 bp, Homo sapiens
gggccccactgga

SEQ ID NO: 6335046 - DNA, 17 bp, Homo sapiens
gggccccactggctgga

SEQ ID NO: 6335047 - DNA, 18 bp, Homo sapiens
gggccccagaaggcaggg

SEQ ID NO: 6335048 - DNA, 17 bp, Homo sapiens
gggccccagatctgcct

SEQ ID NO: 6335049 - DNA, 20 bp, Homo sapiens
gggccccagatctgcctggg

SEQ ID NO: 6335050 - DNA, 21 bp, Homo sapiens
gggccccagatctgcctgggc

SEQ ID NO: 6335051 - DNA, 18 bp, Homo sapiens
gggccccagcccaccctc

SEQ ID NO: 6335052 - DNA, 20 bp, Homo sapiens
gggccccagcgtctgcaggg

SEQ ID NO: 6335053 - DNA, 11 bp, Homo sapiens
gggccccagct

SEQ ID NO: 6335054 - DNA, 13 bp, Homo sapiens
gggccccaggggc

SEQ ID NO: 6335055 - DNA, 15 bp, Homo sapiens
gggccccaggggcag

SEQ ID NO: 6335056 - DNA, 18 bp, Homo sapiens
gggccccatcagctgcca

SEQ ID NO: 6335057 - DNA, 21 bp, Homo sapiens
gggccccatcctcatccctga

SEQ ID NO: 6335058 - DNA, 15 bp, Homo sapiens
gggccccatcttgat

SEQ ID NO: 6335059 - DNA, 18 bp, Homo sapiens
gggccccatgctctgccc

SEQ ID NO: 6335060 - DNA, 19 bp, Homo sapiens
gggccccatgctctgcccc

SEQ ID NO: 6335061 - DNA, 23 bp, Homo sapiens
gggccccattctccctccatggc

SEQ ID NO: 6335062 - DNA, 22 bp, Homo sapiens
gggcccccaataaaccagtgtg

SEQ ID NO: 6335063 - DNA, 19 bp, Homo sapiens
gggcccccaccgccggggt

SEQ ID NO: 6335064 - DNA, 23 bp, Homo sapiens
gggcccccagagacctttgccca

SEQ ID NO: 6335065 - DNA, 16 bp, Homo sapiens
gggcccccagcctggc

SEQ ID NO: 6335066 - DNA, 17 bp, Homo sapiens
gggcccccagcctggcc

SEQ ID NO: 6335067 - DNA, 14 bp, Homo sapiens
gggcccccatctca

SEQ ID NO: 6335068 - DNA, 15 bp, Homo sapiens
gggccccccagctca

SEQ ID NO: 6335069 - DNA, 23 bp, Homo sapiens
gggccccccagctcaggggcagc

SEQ ID NO: 6335070 - DNA, 15 bp, Homo sapiens
gggcccccctccttg

SEQ ID NO: 6335071 - DNA, 19 bp, Homo sapiens
gggcccccctccttgctct

SEQ ID NO: 6335072 - DNA, 21 bp, Homo sapiens
gggcccccctccttgctctgc

SEQ ID NO: 6335073 - DNA, 21 bp, Homo sapiens
gggcccccctgaaccgcaccc

SEQ ID NO: 6335074 - DNA, 12 bp, Homo sapiens
gggcccccgccc

SEQ ID NO: 6335075 - DNA, 15 bp, Homo sapiens
gggcccccggccacg

SEQ ID NO: 6335076 - DNA, 13 bp, Homo sapiens
gggccccctctct

SEQ ID NO: 6335077 - DNA, 23 bp, Homo sapiens
gggccccctctcttaccccgtcc

SEQ ID NO: 6335078 - DNA, 21 bp, Homo sapiens
gggccccgacgtttgcggcag

SEQ ID NO: 6335079 - DNA, 15 bp, Homo sapiens
gggccccgccagggc

SEQ ID NO: 6335080 - DNA, 17 bp, Homo sapiens
gggccccgccagggctg

SEQ ID NO: 6335081 - DNA, 21 bp, Homo sapiens
gggccccggatgacttgggga

SEQ ID NO: 6335082 - DNA, 17 bp, Homo sapiens
gggccccggggctggca

SEQ ID NO: 6335083 - DNA, 23 bp, Homo sapiens
gggccccgggttcagcctggcct

SEQ ID NO: 6335084 - DNA, 23 bp, Homo sapiens
gggcccctcacctggtacctgga

SEQ ID NO: 6335085 - DNA, 16 bp, Homo sapiens
gggcccctcagagccc

SEQ ID NO: 6335086 - DNA, 12 bp, Homo sapiens
gggcccctcagc

SEQ ID NO: 6335087 - DNA, 16 bp, Homo sapiens
gggcccctcaggggaa

SEQ ID NO: 6335088 - DNA, 14 bp, Homo sapiens
gggcccctccacgc

SEQ ID NO: 6335089 - DNA, 13 bp, Homo sapiens
gggcccctccagc

SEQ ID NO: 6335090 - DNA, 13 bp, Homo sapiens
gggcccctcccct

SEQ ID NO: 6335091 - DNA, 19 bp, Homo sapiens
gggcccctcccctcagagc

SEQ ID NO: 6335092 - DNA, 22 bp, Homo sapiens
gggcccctcccctcagagccca

SEQ ID NO: 6335093 - DNA, 13 bp, Homo sapiens
gggcccctccctc

SEQ ID NO: 6335094 - DNA, 17 bp, Homo sapiens
gggcccctccctctgcc

SEQ ID NO: 6335095 - DNA, 23 bp, Homo sapiens
gggcccctcctccagagcctggg

SEQ ID NO: 6335096 - DNA, 17 bp, Homo sapiens
gggcccctcctctgtgc

SEQ ID NO: 6335097 - DNA, 22 bp, Homo sapiens
gggcccctccttgtgctgccag

SEQ ID NO: 6335098 - DNA, 17 bp, Homo sapiens
gggcccctctcagccct

SEQ ID NO: 6335099 - DNA, 15 bp, Homo sapiens
gggcccctctgccca

SEQ ID NO: 6335100 - DNA, 22 bp, Homo sapiens
gggcccctctgcccagcttggg

SEQ ID NO: 6335101 - DNA, 13 bp, Homo sapiens
gggcccctgagga

SEQ ID NO: 6335102 - DNA, 19 bp, Homo sapiens
gggcccctgcctctctgca

SEQ ID NO: 6335103 - DNA, 16 bp, Homo sapiens
gggcccctgcctgcct

SEQ ID NO: 6335104 - DNA, 13 bp, Homo sapiens
gggcccctgctca

SEQ ID NO: 6335105 - DNA, 19 bp, Homo sapiens
gggcccctgcttctccagc

SEQ ID NO: 6335106 - DNA, 21 bp, Homo sapiens
gggcccctgcttctccagcct

SEQ ID NO: 6335107 - DNA, 11 bp, Homo sapiens
gggcccctggc

SEQ ID NO: 6335108 - DNA, 12 bp, Homo sapiens
gggcccctggca

SEQ ID NO: 6335109 - DNA, 13 bp, Homo sapiens
gggcccctggcac

SEQ ID NO: 6335110 - DNA, 14 bp, Homo sapiens
gggcccctggccca

SEQ ID NO: 6335111 - DNA, 15 bp, Homo sapiens
gggcccctggcccag

SEQ ID NO: 6335112 - DNA, 19 bp, Homo sapiens
gggcccctggcccaggagg

SEQ ID NO: 6335113 - DNA, 14 bp, Homo sapiens
gggcccctggggac

SEQ ID NO: 6335114 - DNA, 15 bp, Homo sapiens
gggcccctggggaca

SEQ ID NO: 6335115 - DNA, 21 bp, Homo sapiens
gggcccctgtccccagtcccc

SEQ ID NO: 6335116 - DNA, 21 bp, Homo sapiens
gggcccgacaggtgggcctgg

SEQ ID NO: 6335117 - DNA, 22 bp, Homo sapiens
gggcccgacaggtgggcctggg

SEQ ID NO: 6335118 - DNA, 23 bp, Homo sapiens
gggcccgagcctgaactgagccc

SEQ ID NO: 6335119 - DNA, 13 bp, Homo sapiens
gggcccgagcgcg

SEQ ID NO: 6335120 - DNA, 16 bp, Homo sapiens
gggcccgagcgcgtgc

SEQ ID NO: 6335121 - DNA, 23 bp, Homo sapiens
gggcccgagcgcgtgccttcccc

SEQ ID NO: 6335122 - DNA, 22 bp, Homo sapiens
gggcccgcagtgctgggaccag

SEQ ID NO: 6335123 - DNA, 15 bp, Homo sapiens
gggcccgccccaggc

SEQ ID NO: 6335124 - DNA, 20 bp, Homo sapiens
gggcccgcctcacaccccag

SEQ ID NO: 6335125 - DNA, 21 bp, Homo sapiens
gggcccgcctcacaccccagt

SEQ ID NO: 6335126 - DNA, 17 bp, Homo sapiens
gggcccgcctgccacct

SEQ ID NO: 6335127 - DNA, 19 bp, Homo sapiens
gggcccgcctgccacctct

SEQ ID NO: 6335128 - DNA, 16 bp, Homo sapiens
gggcccgcctggcaga

SEQ ID NO: 6335129 - DNA, 20 bp, Homo sapiens
gggcccgcctggcagaactg

SEQ ID NO: 6335130 - DNA, 17 bp, Homo sapiens
gggcccgctcaacctct

SEQ ID NO: 6335131 - DNA, 21 bp, Homo sapiens
gggcccgctcaacctctcaga

SEQ ID NO: 6335132 - DNA, 13 bp, Homo sapiens
gggcccgcttgcc

SEQ ID NO: 6335133 - DNA, 21 bp, Homo sapiens
gggcccgcttgcctcggctcc

SEQ ID NO: 6335134 - DNA, 23 bp, Homo sapiens
gggcccgcttgcctcggctcctg

SEQ ID NO: 6335135 - DNA, 15 bp, Homo sapiens
gggcccggatccagg

SEQ ID NO: 6335136 - DNA, 16 bp, Homo sapiens
gggcccggccacaccc

SEQ ID NO: 6335137 - DNA, 16 bp, Homo sapiens
gggcccggccagccat

SEQ ID NO: 6335138 - DNA, 15 bp, Homo sapiens
gggcccgggcaccca

SEQ ID NO: 6335139 - DNA, 13 bp, Homo sapiens
gggcccgggcagg

SEQ ID NO: 6335140 - DNA, 17 bp, Homo sapiens
gggcccgggcaggccag

SEQ ID NO: 6335141 - DNA, 16 bp, Homo sapiens
gggcccgggcccaggc

SEQ ID NO: 6335142 - DNA, 14 bp, Homo sapiens
gggcccgggccccc

SEQ ID NO: 6335143 - DNA, 16 bp, Homo sapiens
gggcccggtccacagg

SEQ ID NO: 6335144 - DNA, 19 bp, Homo sapiens
gggcccggtggcggcaggg

SEQ ID NO: 6335145 - DNA, 22 bp, Homo sapiens
gggcccgttgtctccctggccc

SEQ ID NO: 6335146 - DNA, 17 bp, Homo sapiens
gggccctaccctcctgc

SEQ ID NO: 6335147 - DNA, 20 bp, Homo sapiens
gggccctaccctcctgctga

SEQ ID NO: 6335148 - DNA, 23 bp, Homo sapiens
gggccctaccctcctgctgagct

SEQ ID NO: 6335149 - DNA, 12 bp, Homo sapiens
gggccctacctg

SEQ ID NO: 6335150 - DNA, 16 bp, Homo sapiens
gggccctacctgggga

SEQ ID NO: 6335151 - DNA, 21 bp, Homo sapiens
gggccctatgtctcaggagtg

SEQ ID NO: 6335152 - DNA, 14 bp, Homo sapiens
gggccctcactcag

SEQ ID NO: 6335153 - DNA, 21 bp, Homo sapiens
gggccctcagaggaaaggcag

SEQ ID NO: 6335154 - DNA, 14 bp, Homo sapiens
gggccctcagccct

SEQ ID NO: 6335155 - DNA, 18 bp, Homo sapiens
gggccctcagcgtctccc

SEQ ID NO: 6335156 - DNA, 21 bp, Homo sapiens
gggccctcagcgtctccccat

SEQ ID NO: 6335157 - DNA, 20 bp, Homo sapiens
gggccctcagctcctgggga

SEQ ID NO: 6335158 - DNA, 13 bp, Homo sapiens
gggccctcaggcc

SEQ ID NO: 6335159 - DNA, 19 bp, Homo sapiens
gggccctcaggccattccc

SEQ ID NO: 6335160 - DNA, 13 bp, Homo sapiens
gggccctcccagc

SEQ ID NO: 6335161 - DNA, 23 bp, Homo sapiens
gggccctccgacagccccctctg

SEQ ID NO: 6335162 - DNA, 12 bp, Homo sapiens
gggccctcctga

SEQ ID NO: 6335163 - DNA, 22 bp, Homo sapiens
gggccctccttccctcctgtgc

SEQ ID NO: 6335164 - DNA, 17 bp, Homo sapiens
gggccctctatgctggc

SEQ ID NO: 6335165 - DNA, 17 bp, Homo sapiens
gggccctctctccgccc

SEQ ID NO: 6335166 - DNA, 17 bp, Homo sapiens
gggccctctctctgggc

SEQ ID NO: 6335167 - DNA, 15 bp, Homo sapiens
gggccctctgtagct

SEQ ID NO: 6335168 - DNA, 14 bp, Homo sapiens
gggccctctgtcca

SEQ ID NO: 6335169 - DNA, 18 bp, Homo sapiens
gggccctctttccctgcg

SEQ ID NO: 6335170 - DNA, 22 bp, Homo sapiens
gggccctgagctcggtggaccc

SEQ ID NO: 6335171 - DNA, 13 bp, Homo sapiens
gggccctgcagga

SEQ ID NO: 6335172 - DNA, 18 bp, Homo sapiens
gggccctgcaggaggcct

SEQ ID NO: 6335173 - DNA, 22 bp, Homo sapiens
gggccctgcaggaggcctggga

SEQ ID NO: 6335174 - DNA, 20 bp, Homo sapiens
gggccctgcattggcctggc

SEQ ID NO: 6335175 - DNA, 12 bp, Homo sapiens
gggccctgcccc

SEQ ID NO: 6335176 - DNA, 19 bp, Homo sapiens
gggccctgccccaggcctg

SEQ ID NO: 6335177 - DNA, 20 bp, Homo sapiens
gggccctgccccaggcctgg

SEQ ID NO: 6335178 - DNA, 22 bp, Homo sapiens
gggccctgcccctaggatgctg

SEQ ID NO: 6335179 - DNA, 18 bp, Homo sapiens
gggccctgcccggggagc

SEQ ID NO: 6335180 - DNA, 13 bp, Homo sapiens
gggccctgccctg

SEQ ID NO: 6335181 - DNA, 19 bp, Homo sapiens
gggccctgccctggcaggg

SEQ ID NO: 6335182 - DNA, 14 bp, Homo sapiens
gggccctgccctgt

SEQ ID NO: 6335183 - DNA, 12 bp, Homo sapiens
gggccctgccgt

SEQ ID NO: 6335184 - DNA, 12 bp, Homo sapiens
gggccctgcctg

SEQ ID NO: 6335185 - DNA, 19 bp, Homo sapiens
gtgtcagtactaaggtgac

SEQ ID NO: 6335186 - DNA, 21 bp, Homo sapiens
gtgtcagttcaactttcagaa

SEQ ID NO: 6335187 - DNA, 19 bp, Homo sapiens
gtgtcatagaatagcatgt

SEQ ID NO: 6335188 - DNA, 17 bp, Homo sapiens
gtgtcatcatcagactt

SEQ ID NO: 6335189 - DNA, 20 bp, Homo sapiens
gtgtcatctaattaagggaa

SEQ ID NO: 6335190 - DNA, 15 bp, Homo sapiens
gtgtcatctgctcct

SEQ ID NO: 6335191 - DNA, 13 bp, Homo sapiens
gtgtcatctgtca

SEQ ID NO: 6335192 - DNA, 19 bp, Homo sapiens
gtgtcatgaagtgcacagg

SEQ ID NO: 6335193 - DNA, 16 bp, Homo sapiens
gtgtcatggctgaagt

SEQ ID NO: 6335194 - DNA, 21 bp, Homo sapiens
gtgtcatggtgatgcaagtca

SEQ ID NO: 6335195 - DNA, 17 bp, Homo sapiens
gtgtcattctgcctgct

SEQ ID NO: 6335196 - DNA, 18 bp, Homo sapiens
gtgtcattctgcctgctc

SEQ ID NO: 6335197 - DNA, 15 bp, Homo sapiens
gtgtcatttataact

SEQ ID NO: 6335198 - DNA, 18 bp, Homo sapiens
gtgtcatttatgaaaaga

SEQ ID NO: 6335199 - DNA, 16 bp, Homo sapiens
gtgtcatttcattcca

SEQ ID NO: 6335200 - DNA, 17 bp, Homo sapiens
gtgtcatttcattccat

SEQ ID NO: 6335201 - DNA, 19 bp, Homo sapiens
gtgtcatttccggctgctg

SEQ ID NO: 6335202 - DNA, 20 bp, Homo sapiens
gtgtcatttccggctgctgt

SEQ ID NO: 6335203 - DNA, 16 bp, Homo sapiens
gtgtcatttctcatcc

SEQ ID NO: 6335204 - DNA, 17 bp, Homo sapiens
gtgtcatttcttcactt

SEQ ID NO: 6335205 - DNA, 12 bp, Homo sapiens
gtgtcattttct

SEQ ID NO: 6335206 - DNA, 22 bp, Homo sapiens
gtgtcattttctgttatacaca

SEQ ID NO: 6335207 - DNA, 23 bp, Homo sapiens
gtgtcattttctgttatacacag

SEQ ID NO: 6335208 - DNA, 14 bp, Homo sapiens
gtgtcatttttgaa

SEQ ID NO: 6335209 - DNA, 15 bp, Homo sapiens
gtgtcatttttgaat

SEQ ID NO: 6335210 - DNA, 15 bp, Homo sapiens
gtgtccaactccagt

SEQ ID NO: 6335211 - DNA, 23 bp, Homo sapiens
gtgtccaactccagtactggagc

SEQ ID NO: 6335212 - DNA, 17 bp, Homo sapiens
gtgtccaagtgtgtgtg

SEQ ID NO: 6335213 - DNA, 22 bp, Homo sapiens
gtgtccaattatgcactggcca

SEQ ID NO: 6335214 - DNA, 12 bp, Homo sapiens
gtgtccacagtg

SEQ ID NO: 6335215 - DNA, 17 bp, Homo sapiens
gtgtccagcttccaaag

SEQ ID NO: 6335216 - DNA, 22 bp, Homo sapiens
gtgtccatcatattaaaaatat

SEQ ID NO: 6335217 - DNA, 13 bp, Homo sapiens
gtgtccatcccag

SEQ ID NO: 6335218 - DNA, 21 bp, Homo sapiens
gtgtccatgcgctcagggcca

SEQ ID NO: 6335219 - DNA, 14 bp, Homo sapiens
gtgtccatgtgtgt

SEQ ID NO: 6335220 - DNA, 15 bp, Homo sapiens
gtgtccatgtgtgtg

SEQ ID NO: 6335221 - DNA, 23 bp, Homo sapiens
gtgtccattgacatgtacagaga

SEQ ID NO: 6335222 - DNA, 20 bp, Homo sapiens
gtgtcccaaaaagaaaggag

SEQ ID NO: 6335223 - DNA, 21 bp, Homo sapiens
gtgtcccaaaatcccctcagc

SEQ ID NO: 6335224 - DNA, 12 bp, Homo sapiens
gtgtcccaagct

SEQ ID NO: 6335225 - DNA, 21 bp, Homo sapiens
gtgtcccagccacgcagggcc

SEQ ID NO: 6335226 - DNA, 23 bp, Homo sapiens
gtgtcccaggcagcacagtgtgt

SEQ ID NO: 6335227 - DNA, 19 bp, Homo sapiens
gtgtcccaggcagggagac

SEQ ID NO: 6335228 - DNA, 13 bp, Homo sapiens
gtgtcccagggcc

SEQ ID NO: 6335229 - DNA, 17 bp, Homo sapiens
gtgtcccagtcccagcc

SEQ ID NO: 6335230 - DNA, 21 bp, Homo sapiens
gtgtcccagtgtctggcccag

SEQ ID NO: 6335231 - DNA, 12 bp, Homo sapiens
gtgtccccaaca

SEQ ID NO: 6335232 - DNA, 18 bp, Homo sapiens
gtgtccccaacagcgccc

SEQ ID NO: 6335233 - DNA, 20 bp, Homo sapiens
gtgtccccaacgtcccctcc

SEQ ID NO: 6335234 - DNA, 21 bp, Homo sapiens
gtgtccccaacgtcccctccg

SEQ ID NO: 6335235 - DNA, 12 bp, Homo sapiens
gtgtccccagcc

SEQ ID NO: 6335236 - DNA, 22 bp, Homo sapiens
gtgtccccccttgaagcaataa

SEQ ID NO: 6335237 - DNA, 23 bp, Homo sapiens
gtgtccccccttgaagcaataac

SEQ ID NO: 6335238 - DNA, 18 bp, Homo sapiens
gtgtccccctctgtccag

SEQ ID NO: 6335239 - DNA, 18 bp, Homo sapiens
gtgtccccggggcccagg

SEQ ID NO: 6335240 - DNA, 19 bp, Homo sapiens
gtgtccccggggcccaggg

SEQ ID NO: 6335241 - DNA, 18 bp, Homo sapiens
gtgtcccctatcctcccc

SEQ ID NO: 6335242 - DNA, 20 bp, Homo sapiens
gtgtcccctccactgtcaca

SEQ ID NO: 6335243 - DNA, 18 bp, Homo sapiens
gtgtcccctgacagggcc

SEQ ID NO: 6335244 - DNA, 20 bp, Homo sapiens
gtgtcccctgacctgtccag

SEQ ID NO: 6335245 - DNA, 21 bp, Homo sapiens
gtgtcccctgacctgtccagg

SEQ ID NO: 6335246 - DNA, 15 bp, Homo sapiens
gtgtccccttcccct

SEQ ID NO: 6335247 - DNA, 17 bp, Homo sapiens
gtgtccccttcccctgc

SEQ ID NO: 6335248 - DNA, 23 bp, Homo sapiens
gtgtccccttcccctgctgacct

SEQ ID NO: 6335249 - DNA, 18 bp, Homo sapiens
gtgtcccgcggtgctgac

SEQ ID NO: 6335250 - DNA, 14 bp, Homo sapiens
gtgtcccgttgtgt

SEQ ID NO: 6335251 - DNA, 16 bp, Homo sapiens
gtgtccctgcacttgc

SEQ ID NO: 6335252 - DNA, 23 bp, Homo sapiens
gtgtccctgcacttgcagactct

SEQ ID NO: 6335253 - DNA, 15 bp, Homo sapiens
gtgtccctgcctggc

SEQ ID NO: 6335254 - DNA, 15 bp, Homo sapiens
gtgtccctggatgtg

SEQ ID NO: 6335255 - DNA, 20 bp, Homo sapiens
gtgtcccttcccagcgctgc

SEQ ID NO: 6335256 - DNA, 18 bp, Homo sapiens
gtgtccctttcacactgt

SEQ ID NO: 6335257 - DNA, 14 bp, Homo sapiens
gtgtccgctctctc

SEQ ID NO: 6335258 - DNA, 18 bp, Homo sapiens
gtgtccgctgctgctttc

SEQ ID NO: 6335259 - DNA, 14 bp, Homo sapiens
gtgtccggtccctg

SEQ ID NO: 6335260 - DNA, 13 bp, Homo sapiens
gtgtcctacagaa

SEQ ID NO: 6335261 - DNA, 14 bp, Homo sapiens
gtgtcctacagaaa

SEQ ID NO: 6335262 - DNA, 21 bp, Homo sapiens
gtgtcctccaccatgcactca

SEQ ID NO: 6335263 - DNA, 16 bp, Homo sapiens
gtgtcctccaggagct

SEQ ID NO: 6335264 - DNA, 13 bp, Homo sapiens
gtgtcctccctcc

SEQ ID NO: 6335265 - DNA, 20 bp, Homo sapiens
gtgtcctcctctgaggaagc

SEQ ID NO: 6335266 - DNA, 12 bp, Homo sapiens
gtgtcctcctgc

SEQ ID NO: 6335267 - DNA, 15 bp, Homo sapiens
gtgtcctctccagct

SEQ ID NO: 6335268 - DNA, 23 bp, Homo sapiens
gtgtcctctcccctctgccctgt

SEQ ID NO: 6335269 - DNA, 16 bp, Homo sapiens
gtgtcctctgcctggg

SEQ ID NO: 6335270 - DNA, 14 bp, Homo sapiens
gtgtcctctgtccg

SEQ ID NO: 6335271 - DNA, 14 bp, Homo sapiens
gtgtcctctgtgcc

SEQ ID NO: 6335272 - DNA, 21 bp, Homo sapiens
gtgtcctgaaacgctcctttg

SEQ ID NO: 6335273 - DNA, 16 bp, Homo sapiens
gtgtcctgaccaccct

SEQ ID NO: 6335274 - DNA, 17 bp, Homo sapiens
gtgtcctgaccaccctc

SEQ ID NO: 6335275 - DNA, 13 bp, Homo sapiens
gtgtcctgcccac

SEQ ID NO: 6335276 - DNA, 17 bp, Homo sapiens
gtgtcctgcctgtctgc

SEQ ID NO: 6335277 - DNA, 21 bp, Homo sapiens
gtgtcctgccttgatgaagcc

SEQ ID NO: 6335278 - DNA, 13 bp, Homo sapiens
gtgtcctgctctg

SEQ ID NO: 6335279 - DNA, 12 bp, Homo sapiens
gtgtcctggctg

SEQ ID NO: 6335280 - DNA, 22 bp, Homo sapiens
gtgtcctggtaattcctctcca

SEQ ID NO: 6335281 - DNA, 12 bp, Homo sapiens
gtgtcctggtga

SEQ ID NO: 6335282 - DNA, 21 bp, Homo sapiens
gtgtcctggtgagaaaatata

SEQ ID NO: 6335283 - DNA, 23 bp, Homo sapiens
gtgtcctggtgctctctgccact

SEQ ID NO: 6335284 - DNA, 14 bp, Homo sapiens
gtgtcctgtctgct

SEQ ID NO: 6335285 - DNA, 19 bp, Homo sapiens
gtgtcctgtctgctgggct

SEQ ID NO: 6335286 - DNA, 16 bp, Homo sapiens
gtgtcctgtgctttct

SEQ ID NO: 6335287 - DNA, 14 bp, Homo sapiens
gtgtccttccctgc

SEQ ID NO: 6335288 - DNA, 19 bp, Homo sapiens
gtgtccttcctccacaagg

SEQ ID NO: 6335289 - DNA, 16 bp, Homo sapiens
gtgtccttctcctctt

SEQ ID NO: 6335290 - DNA, 22 bp, Homo sapiens
gtgtccttctcctcttgtagcc

SEQ ID NO: 6335291 - DNA, 21 bp, Homo sapiens
gtgtccttgaactgaggccct

SEQ ID NO: 6335292 - DNA, 20 bp, Homo sapiens
gtgtcctttcccctctctgc

SEQ ID NO: 6335293 - DNA, 23 bp, Homo sapiens
gtgtccttttctcatttgtggct

SEQ ID NO: 6335294 - DNA, 22 bp, Homo sapiens
gtgtcgaggccacattgctggc

SEQ ID NO: 6335295 - DNA, 17 bp, Homo sapiens
gtgtcgagtcaaaatgt

SEQ ID NO: 6335296 - DNA, 21 bp, Homo sapiens
gtgtcgcctctcactctggca

SEQ ID NO: 6335297 - DNA, 22 bp, Homo sapiens
gtgtcgcctctcactctggcag

SEQ ID NO: 6335298 - DNA, 23 bp, Homo sapiens
gtgtcgctctgctggcctggccg

SEQ ID NO: 6335299 - DNA, 15 bp, Homo sapiens
gtgtcggctgtgagg

SEQ ID NO: 6335300 - DNA, 13 bp, Homo sapiens
gtgtcgggccctt

SEQ ID NO: 6335301 - DNA, 18 bp, Homo sapiens
gtgtcgtaacagcaggag

SEQ ID NO: 6335302 - DNA, 14 bp, Homo sapiens
gtgtcgtcctgcag

SEQ ID NO: 6335303 - DNA, 15 bp, Homo sapiens
gtgtcgtctgtgaat

SEQ ID NO: 6335304 - DNA, 14 bp, Homo sapiens
gtgtctaaaaacac

SEQ ID NO: 6335305 - DNA, 13 bp, Homo sapiens
gtgtctaaactgc

SEQ ID NO: 6335306 - DNA, 17 bp, Homo sapiens
gtgtctaagattctaga

SEQ ID NO: 6335307 - DNA, 19 bp, Homo sapiens
gtgtctaagattctagatc

SEQ ID NO: 6335308 - DNA, 15 bp, Homo sapiens
gtgtctaatgcatta

SEQ ID NO: 6335309 - DNA, 21 bp, Homo sapiens
gtgtctaatgcattaactttt

SEQ ID NO: 6335310 - DNA, 14 bp, Homo sapiens
gtgtctacagagaa

SEQ ID NO: 6335311 - DNA, 19 bp, Homo sapiens
gtgtctaggcactgagcag

SEQ ID NO: 6335312 - DNA, 19 bp, Homo sapiens
gtgtctagtagaacaatgt

SEQ ID NO: 6335313 - DNA, 22 bp, Homo sapiens
gtgtctatgaactagagactct

SEQ ID NO: 6335314 - DNA, 15 bp, Homo sapiens
gtgtctatgatgttg

SEQ ID NO: 6335315 - DNA, 15 bp, Homo sapiens
gtgtctatggagcag

SEQ ID NO: 6335316 - DNA, 18 bp, Homo sapiens
gtgtctatggagcagccg

SEQ ID NO: 6335317 - DNA, 19 bp, Homo sapiens
gtgtctcactctttcttct

SEQ ID NO: 6335318 - DNA, 20 bp, Homo sapiens
gtgtctcaggctcaagtttt

SEQ ID NO: 6335319 - DNA, 19 bp, Homo sapiens
gtgtctcaggctgcctgag

SEQ ID NO: 6335320 - DNA, 17 bp, Homo sapiens
gtgtctcatgccagcag

SEQ ID NO: 6335321 - DNA, 18 bp, Homo sapiens
gtgtctccaaccccccag

SEQ ID NO: 6335322 - DNA, 19 bp, Homo sapiens
gtgtctccaaccccccagc

SEQ ID NO: 6335323 - DNA, 21 bp, Homo sapiens
gtgtctccaaccccccagcac

SEQ ID NO: 6335324 - DNA, 17 bp, Homo sapiens
gtgtctcccaacatggg

SEQ ID NO: 6335325 - DNA, 18 bp, Homo sapiens
gtgtctcccaacatggga

SEQ ID NO: 6335326 - DNA, 16 bp, Homo sapiens
gtgtctccccgtgtcc

SEQ ID NO: 6335327 - DNA, 11 bp, Homo sapiens
gtgtctccctc

SEQ ID NO: 6335328 - DNA, 19 bp, Homo sapiens
gtgtctcctgtttcagacc

SEQ ID NO: 6335329 - DNA, 15 bp, Homo sapiens
gtgtctcgctgcatc

SEQ ID NO: 6335330 - DNA, 21 bp, Homo sapiens
gtgtctcggagggattcccct

SEQ ID NO: 6335331 - DNA, 12 bp, Homo sapiens
gtgtctctccca

SEQ ID NO: 6335332 - DNA, 14 bp, Homo sapiens
gtgtctctgccatg

SEQ ID NO: 6335333 - DNA, 14 bp, Homo sapiens
gtgtctctgctttc

SEQ ID NO: 6335334 - DNA, 14 bp, Homo sapiens
gtgtctctgggcct

SEQ ID NO: 6335335 - DNA, 13 bp, Homo sapiens
gtgtctctggtct

SEQ ID NO: 6335336 - DNA, 14 bp, Homo sapiens
gtgtctctggtctt

SEQ ID NO: 6335337 - DNA, 15 bp, Homo sapiens
gtgtctctgtttcct

SEQ ID NO: 6335338 - DNA, 17 bp, Homo sapiens
gtgtctctgtttcctga

SEQ ID NO: 6335339 - DNA, 21 bp, Homo sapiens
gtgtctctgtttcctgaaata

SEQ ID NO: 6335340 - DNA, 19 bp, Homo sapiens
gtgtctcttgactggctca

SEQ ID NO: 6335341 - DNA, 21 bp, Homo sapiens
gtgtctcttggtcctgctgca

SEQ ID NO: 6335342 - DNA, 19 bp, Homo sapiens
gtgtctgaaccaccctgga

SEQ ID NO: 6335343 - DNA, 22 bp, Homo sapiens
gtgtctgaaccaccctggaaat

SEQ ID NO: 6335344 - DNA, 12 bp, Homo sapiens
gtgtctgagccc

SEQ ID NO: 6335345 - DNA, 14 bp, Homo sapiens
gtgtctgagcccaa

SEQ ID NO: 6335346 - DNA, 16 bp, Homo sapiens
gtgtctgagcccaacc

SEQ ID NO: 6335347 - DNA, 14 bp, Homo sapiens
gtgtctgcacccag

SEQ ID NO: 6335348 - DNA, 22 bp, Homo sapiens
gtgtctgcagacaagtcttgct

SEQ ID NO: 6335349 - DNA, 20 bp, Homo sapiens
gtgtctgcattgttattgtg

SEQ ID NO: 6335350 - DNA, 15 bp, Homo sapiens
gtgtctgccacttct

SEQ ID NO: 6335351 - DNA, 22 bp, Homo sapiens
gtgtctgccagctgggcccagc

SEQ ID NO: 6335352 - DNA, 17 bp, Homo sapiens
gtgtctgcgaagtccta

SEQ ID NO: 6335353 - DNA, 15 bp, Homo sapiens
gtgtctgctaatgta

SEQ ID NO: 6335354 - DNA, 15 bp, Homo sapiens
gtgtctgctcagtaa

SEQ ID NO: 6335355 - DNA, 23 bp, Homo sapiens
gtgtctggaattgtggctatcct

SEQ ID NO: 6335356 - DNA, 20 bp, Homo sapiens
gtgtctggatgatgctgtgc

SEQ ID NO: 6335357 - DNA, 17 bp, Homo sapiens
gtgtctggattcccagg

SEQ ID NO: 6335358 - DNA, 21 bp, Homo sapiens
gtgtctggattcccaggatga

SEQ ID NO: 6335359 - DNA, 20 bp, Homo sapiens
gtgtctggccctaactccta

SEQ ID NO: 6335360 - DNA, 23 bp, Homo sapiens
gtgtctggccctaactcctataa

SEQ ID NO: 6335361 - DNA, 15 bp, Homo sapiens
gtgtctggcctgagg

SEQ ID NO: 6335362 - DNA, 18 bp, Homo sapiens
gtgtctggcgttgtgggg

SEQ ID NO: 6335363 - DNA, 18 bp, Homo sapiens
gggccctgcctgcagcca

SEQ ID NO: 6335364 - DNA, 11 bp, Homo sapiens
gggccctgcta

SEQ ID NO: 6335365 - DNA, 16 bp, Homo sapiens
gggccctgctcaggcc

SEQ ID NO: 6335366 - DNA, 19 bp, Homo sapiens
gggccctgctcaggcctca

SEQ ID NO: 6335367 - DNA, 12 bp, Homo sapiens
gggccctggagg

SEQ ID NO: 6335368 - DNA, 13 bp, Homo sapiens
gggccctgggctg

SEQ ID NO: 6335369 - DNA, 15 bp, Homo sapiens
gggccctggggcctg

SEQ ID NO: 6335370 - DNA, 21 bp, Homo sapiens
gggccctggggtctctgagca

SEQ ID NO: 6335371 - DNA, 22 bp, Homo sapiens
gggccctggggtctctgagcag

SEQ ID NO: 6335372 - DNA, 18 bp, Homo sapiens
gggccctggttcccccag

SEQ ID NO: 6335373 - DNA, 22 bp, Homo sapiens
gggccctggttcccccaggacc

SEQ ID NO: 6335374 - DNA, 12 bp, Homo sapiens
gggccctgtcca

SEQ ID NO: 6335375 - DNA, 22 bp, Homo sapiens
gggccctgtgccaggccaaaga

SEQ ID NO: 6335376 - DNA, 18 bp, Homo sapiens
gggccctgtggagtccag

SEQ ID NO: 6335377 - DNA, 20 bp, Homo sapiens
gggccctgtggagtccagct

SEQ ID NO: 6335378 - DNA, 19 bp, Homo sapiens
gggccctgtggctccagga

SEQ ID NO: 6335379 - DNA, 13 bp, Homo sapiens
gggcccttcctcg

SEQ ID NO: 6335380 - DNA, 19 bp, Homo sapiens
gggcccttgggacagccag

SEQ ID NO: 6335381 - DNA, 18 bp, Homo sapiens
gggccctttttcccttcc

SEQ ID NO: 6335382 - DNA, 13 bp, Homo sapiens
gggccgaaagaga

SEQ ID NO: 6335383 - DNA, 21 bp, Homo sapiens
gggccgaacctgatacctgcc

SEQ ID NO: 6335384 - DNA, 19 bp, Homo sapiens
gggccgaatcccccaggga

SEQ ID NO: 6335385 - DNA, 13 bp, Homo sapiens
gggccgaccagag

SEQ ID NO: 6335386 - DNA, 17 bp, Homo sapiens
gggccgaccctgcggcc

SEQ ID NO: 6335387 - DNA, 15 bp, Homo sapiens
gggccgagcctgcct

SEQ ID NO: 6335388 - DNA, 16 bp, Homo sapiens
gggccgaggaatgtga

SEQ ID NO: 6335389 - DNA, 14 bp, Homo sapiens
gggccgaggcccag

SEQ ID NO: 6335390 - DNA, 22 bp, Homo sapiens
gggccgaggcccagcgggcaga

SEQ ID NO: 6335391 - DNA, 16 bp, Homo sapiens
gggccgagtccaggag

SEQ ID NO: 6335392 - DNA, 17 bp, Homo sapiens
gggccgcaagggcctgg

SEQ ID NO: 6335393 - DNA, 19 bp, Homo sapiens
gggccgcaagggcctggac

SEQ ID NO: 6335394 - DNA, 17 bp, Homo sapiens
gggccgcaggagggagg

SEQ ID NO: 6335395 - DNA, 18 bp, Homo sapiens
gggccgcaggagggaggc

SEQ ID NO: 6335396 - DNA, 23 bp, Homo sapiens
gggccgcaggcgggaaaagcagc

SEQ ID NO: 6335397 - DNA, 21 bp, Homo sapiens
gggccgccacggcctggctgg

SEQ ID NO: 6335398 - DNA, 21 bp, Homo sapiens
gggccgcccccacctgcggcc

SEQ ID NO: 6335399 - DNA, 16 bp, Homo sapiens
gggccgcccgctccct

SEQ ID NO: 6335400 - DNA, 16 bp, Homo sapiens
gggccgcctcctccag

SEQ ID NO: 6335401 - DNA, 18 bp, Homo sapiens
gggccgcctcctccagac

SEQ ID NO: 6335402 - DNA, 15 bp, Homo sapiens
gggccgcctgccctg

SEQ ID NO: 6335403 - DNA, 21 bp, Homo sapiens
gggccgcctgccctgccttgc

SEQ ID NO: 6335404 - DNA, 16 bp, Homo sapiens
gggccgcctgccttag

SEQ ID NO: 6335405 - DNA, 17 bp, Homo sapiens
gggccgcctgccttagc

SEQ ID NO: 6335406 - DNA, 14 bp, Homo sapiens
gggccgcctgtcct

SEQ ID NO: 6335407 - DNA, 17 bp, Homo sapiens
gggccgcggccgcccgc

SEQ ID NO: 6335408 - DNA, 21 bp, Homo sapiens
gggccgcgtgccgggccccca

SEQ ID NO: 6335409 - DNA, 20 bp, Homo sapiens
gggccgctctccccctgcag

SEQ ID NO: 6335410 - DNA, 21 bp, Homo sapiens
gggccgctctccccctgcagc

SEQ ID NO: 6335411 - DNA, 15 bp, Homo sapiens
gggccgctgccaccc

SEQ ID NO: 6335412 - DNA, 14 bp, Homo sapiens
gggccgctggccca

SEQ ID NO: 6335413 - DNA, 16 bp, Homo sapiens
gggccgctggcccagg

SEQ ID NO: 6335414 - DNA, 22 bp, Homo sapiens
gggccgcttcgccatgtgctgt

SEQ ID NO: 6335415 - DNA, 14 bp, Homo sapiens
gggccggacctgag

SEQ ID NO: 6335416 - DNA, 16 bp, Homo sapiens
gggccggacctgagcc

SEQ ID NO: 6335417 - DNA, 20 bp, Homo sapiens
gggccggacctgagcccgca

SEQ ID NO: 6335418 - DNA, 19 bp, Homo sapiens
gggccggacgcaggtgctg

SEQ ID NO: 6335419 - DNA, 15 bp, Homo sapiens
gggccggagggtcag

SEQ ID NO: 6335420 - DNA, 21 bp, Homo sapiens
gggccggccaggtgggcgggc

SEQ ID NO: 6335421 - DNA, 15 bp, Homo sapiens
gggccggcccccttc

SEQ ID NO: 6335422 - DNA, 15 bp, Homo sapiens
gggccggcgaggggg

SEQ ID NO: 6335423 - DNA, 18 bp, Homo sapiens
gggccggcggctctgagc

SEQ ID NO: 6335424 - DNA, 14 bp, Homo sapiens
gggccggctgagtg

SEQ ID NO: 6335425 - DNA, 18 bp, Homo sapiens
gggccggctgagtggcag

SEQ ID NO: 6335426 - DNA, 21 bp, Homo sapiens
gggccgggcacggtcacacgg

SEQ ID NO: 6335427 - DNA, 12 bp, Homo sapiens
gggccgggcagg

SEQ ID NO: 6335428 - DNA, 14 bp, Homo sapiens
gggccgggcagggg

SEQ ID NO: 6335429 - DNA, 13 bp, Homo sapiens
gggccgggcaggt

SEQ ID NO: 6335430 - DNA, 14 bp, Homo sapiens
gggccgggcccagg

SEQ ID NO: 6335431 - DNA, 14 bp, Homo sapiens
gggccgggcctggg

SEQ ID NO: 6335432 - DNA, 22 bp, Homo sapiens
gggccgggctggcttctccctg

SEQ ID NO: 6335433 - DNA, 14 bp, Homo sapiens
gggccggggatgga

SEQ ID NO: 6335434 - DNA, 14 bp, Homo sapiens
gggccggggcaggg

SEQ ID NO: 6335435 - DNA, 15 bp, Homo sapiens
gggccggggcctctg

SEQ ID NO: 6335436 - DNA, 15 bp, Homo sapiens
gggccggggctgccg

SEQ ID NO: 6335437 - DNA, 17 bp, Homo sapiens
gggccggggcttctgtg

SEQ ID NO: 6335438 - DNA, 22 bp, Homo sapiens
gggccggggggaaagaaaagga

SEQ ID NO: 6335439 - DNA, 22 bp, Homo sapiens
gggccggtagaggctccccagg

SEQ ID NO: 6335440 - DNA, 16 bp, Homo sapiens
gggccggtgaggggag

SEQ ID NO: 6335441 - DNA, 17 bp, Homo sapiens
gggccggtgaggggagg

SEQ ID NO: 6335442 - DNA, 22 bp, Homo sapiens
gggccggtgaggggaggggcct

SEQ ID NO: 6335443 - DNA, 23 bp, Homo sapiens
gggccggtgaggggaggggcctc

SEQ ID NO: 6335444 - DNA, 23 bp, Homo sapiens
gggccggtgctgggggcacagct

SEQ ID NO: 6335445 - DNA, 20 bp, Homo sapiens
gggccgtaccccaccctcag

SEQ ID NO: 6335446 - DNA, 22 bp, Homo sapiens
gggccgtaccccaccctcagca

SEQ ID NO: 6335447 - DNA, 20 bp, Homo sapiens
gggccgtaggggctcctgag

SEQ ID NO: 6335448 - DNA, 16 bp, Homo sapiens
gggccgtcccctctcc

SEQ ID NO: 6335449 - DNA, 19 bp, Homo sapiens
gggccgtcccgcctgcaga

SEQ ID NO: 6335450 - DNA, 13 bp, Homo sapiens
gggccgtgcccag

SEQ ID NO: 6335451 - DNA, 14 bp, Homo sapiens
gggccgtgcccagg

SEQ ID NO: 6335452 - DNA, 17 bp, Homo sapiens
gggccgtgcccaggggc

SEQ ID NO: 6335453 - DNA, 20 bp, Homo sapiens
gggccgtgtcccgcggtgct

SEQ ID NO: 6335454 - DNA, 22 bp, Homo sapiens
gggccgtgtcccgcggtgctga

SEQ ID NO: 6335455 - DNA, 16 bp, Homo sapiens
gggcctaataaaactg

SEQ ID NO: 6335456 - DNA, 15 bp, Homo sapiens
gggcctaggctgcat

SEQ ID NO: 6335457 - DNA, 23 bp, Homo sapiens
gggcctagtggcttcagcccctg

SEQ ID NO: 6335458 - DNA, 14 bp, Homo sapiens
gggcctatcagtgt

SEQ ID NO: 6335459 - DNA, 19 bp, Homo sapiens
gggcctatggagagccctg

SEQ ID NO: 6335460 - DNA, 20 bp, Homo sapiens
gggcctatggagagccctgg

SEQ ID NO: 6335461 - DNA, 16 bp, Homo sapiens
gggcctcacctgcccc

SEQ ID NO: 6335462 - DNA, 23 bp, Homo sapiens
gggcctcacctttcccacagtct

SEQ ID NO: 6335463 - DNA, 22 bp, Homo sapiens
gggcctcagaccccctcagcct

SEQ ID NO: 6335464 - DNA, 16 bp, Homo sapiens
gggcctcagcctccag

SEQ ID NO: 6335465 - DNA, 19 bp, Homo sapiens
gggcctcagcctccaggca

SEQ ID NO: 6335466 - DNA, 14 bp, Homo sapiens
gggcctcaggctcc

SEQ ID NO: 6335467 - DNA, 18 bp, Homo sapiens
gggcctcaggctctgcac

SEQ ID NO: 6335468 - DNA, 15 bp, Homo sapiens
gggcctcagggtcct

SEQ ID NO: 6335469 - DNA, 15 bp, Homo sapiens
gggcctcaggtccta

SEQ ID NO: 6335470 - DNA, 11 bp, Homo sapiens
gggcctcagtg

SEQ ID NO: 6335471 - DNA, 13 bp, Homo sapiens
gggcctcagtgcc

SEQ ID NO: 6335472 - DNA, 16 bp, Homo sapiens
gggcctcagtttcccc

SEQ ID NO: 6335473 - DNA, 17 bp, Homo sapiens
gggcctcagtttcccca

SEQ ID NO: 6335474 - DNA, 22 bp, Homo sapiens
gggcctcatcttccccagccct

SEQ ID NO: 6335475 - DNA, 14 bp, Homo sapiens
gggcctccacctct

SEQ ID NO: 6335476 - DNA, 15 bp, Homo sapiens
gggcctccacctctg

SEQ ID NO: 6335477 - DNA, 18 bp, Homo sapiens
gggcctccatgccccagc

SEQ ID NO: 6335478 - DNA, 19 bp, Homo sapiens
gggcctccattcctggagc

SEQ ID NO: 6335479 - DNA, 16 bp, Homo sapiens
gggcctcccaccagag

SEQ ID NO: 6335480 - DNA, 18 bp, Homo sapiens
gggcctcccaccgcagcg

SEQ ID NO: 6335481 - DNA, 23 bp, Homo sapiens
gggcctcccactcccatggctct

SEQ ID NO: 6335482 - DNA, 18 bp, Homo sapiens
gggcctcccataattgct

SEQ ID NO: 6335483 - DNA, 17 bp, Homo sapiens
gggcctccccccagccc

SEQ ID NO: 6335484 - DNA, 17 bp, Homo sapiens
gggcctcccctgggcag

SEQ ID NO: 6335485 - DNA, 20 bp, Homo sapiens
gggcctcccgtccgtccgcc

SEQ ID NO: 6335486 - DNA, 14 bp, Homo sapiens
gggcctccctcctt

SEQ ID NO: 6335487 - DNA, 16 bp, Homo sapiens
gggcctccctccttgg

SEQ ID NO: 6335488 - DNA, 19 bp, Homo sapiens
gggcctccctggcactgaa

SEQ ID NO: 6335489 - DNA, 16 bp, Homo sapiens
gggcctccctgttcac

SEQ ID NO: 6335490 - DNA, 17 bp, Homo sapiens
gggcctcccttgggctg

SEQ ID NO: 6335491 - DNA, 15 bp, Homo sapiens
gggcctccttcttcc

SEQ ID NO: 6335492 - DNA, 18 bp, Homo sapiens
gggcctccttcttccact

SEQ ID NO: 6335493 - DNA, 16 bp, Homo sapiens
gggcctcgctttccca

SEQ ID NO: 6335494 - DNA, 18 bp, Homo sapiens
gggcctcggaggctcctc

SEQ ID NO: 6335495 - DNA, 20 bp, Homo sapiens
gggcctcggaggctcctccc

SEQ ID NO: 6335496 - DNA, 16 bp, Homo sapiens
gggcctcggcctggct

SEQ ID NO: 6335497 - DNA, 17 bp, Homo sapiens
gggcctcggcctggctt

SEQ ID NO: 6335498 - DNA, 15 bp, Homo sapiens
gggcctctcctgccc

SEQ ID NO: 6335499 - DNA, 19 bp, Homo sapiens
gggcctctcctgccctctg

SEQ ID NO: 6335500 - DNA, 12 bp, Homo sapiens
gggcctctctcc

SEQ ID NO: 6335501 - DNA, 14 bp, Homo sapiens
gggcctctctgggg

SEQ ID NO: 6335502 - DNA, 15 bp, Homo sapiens
gggcctctctggggg

SEQ ID NO: 6335503 - DNA, 21 bp, Homo sapiens
gggcctctctgggggaggcag

SEQ ID NO: 6335504 - DNA, 21 bp, Homo sapiens
gggcctctgaaatttcccaca

SEQ ID NO: 6335505 - DNA, 15 bp, Homo sapiens
gggcctctgcctggg

SEQ ID NO: 6335506 - DNA, 21 bp, Homo sapiens
gggcctctgcggagcacactg

SEQ ID NO: 6335507 - DNA, 21 bp, Homo sapiens
gggcctctgcttgccagccag

SEQ ID NO: 6335508 - DNA, 17 bp, Homo sapiens
gggcctctggctgcctg

SEQ ID NO: 6335509 - DNA, 18 bp, Homo sapiens
gggcctctggctgcctgg

SEQ ID NO: 6335510 - DNA, 19 bp, Homo sapiens
gggcctctggctgcctggc

SEQ ID NO: 6335511 - DNA, 14 bp, Homo sapiens
gggcctctggcttc

SEQ ID NO: 6335512 - DNA, 19 bp, Homo sapiens
gggcctctggcttccctgc

SEQ ID NO: 6335513 - DNA, 20 bp, Homo sapiens
gggcctctggcttccctgcc

SEQ ID NO: 6335514 - DNA, 22 bp, Homo sapiens
gggcctctgttcctttctctgg

SEQ ID NO: 6335515 - DNA, 20 bp, Homo sapiens
gggcctcttatgggctgggt

SEQ ID NO: 6335516 - DNA, 16 bp, Homo sapiens
gggcctcttccctcag

SEQ ID NO: 6335517 - DNA, 23 bp, Homo sapiens
gggcctcttgcggtcccttctta

SEQ ID NO: 6335518 - DNA, 21 bp, Homo sapiens
gggcctcttggaaaaagtgat

SEQ ID NO: 6335519 - DNA, 19 bp, Homo sapiens
gggcctctttttgcccttt

SEQ ID NO: 6335520 - DNA, 20 bp, Homo sapiens
gggcctctttttgcccttta

SEQ ID NO: 6335521 - DNA, 17 bp, Homo sapiens
gggcctgaaagcaacag

SEQ ID NO: 6335522 - DNA, 22 bp, Homo sapiens
gggcctgacaggttcccagcag

SEQ ID NO: 6335523 - DNA, 15 bp, Homo sapiens
gggcctgacctccag

SEQ ID NO: 6335524 - DNA, 16 bp, Homo sapiens
gggcctgacctccagt

SEQ ID NO: 6335525 - DNA, 19 bp, Homo sapiens
gggcctgacctccccctcc

SEQ ID NO: 6335526 - DNA, 23 bp, Homo sapiens
gggcctgacctccccctccttcc

SEQ ID NO: 6335527 - DNA, 11 bp, Homo sapiens
gggcctgactt

SEQ ID NO: 6335528 - DNA, 18 bp, Homo sapiens
gggcctgacttgagccac

SEQ ID NO: 6335529 - DNA, 21 bp, Homo sapiens
gggcctgagcagtccttggcc

SEQ ID NO: 6335530 - DNA, 18 bp, Homo sapiens
gggcctgagcctggccag

SEQ ID NO: 6335531 - DNA, 18 bp, Homo sapiens
gggcctgaggctccttag

SEQ ID NO: 6335532 - DNA, 19 bp, Homo sapiens
gggcctgagggtccacctg

SEQ ID NO: 6335533 - DNA, 22 bp, Homo sapiens
gggcctgagggtccacctggag

SEQ ID NO: 6335534 - DNA, 23 bp, Homo sapiens
gggcctgaggtctggctgcttgc

SEQ ID NO: 6335535 - DNA, 21 bp, Homo sapiens
gggcctgcaggacctgcctgt

SEQ ID NO: 6335536 - DNA, 16 bp, Homo sapiens
gggcctgcaggccagt

SEQ ID NO: 6335537 - DNA, 18 bp, Homo sapiens
gggcctgcaggccccagc

SEQ ID NO: 6335538 - DNA, 22 bp, Homo sapiens
gggcctgcaggccccagccaag

SEQ ID NO: 6335539 - DNA, 12 bp, Homo sapiens
gggcctgcaggt

SEQ ID NO: 6335540 - DNA, 23 bp, Homo sapiens
gggcctgcagtgattcagcaggc

SEQ ID NO: 6335541 - DNA, 19 bp, Homo sapiens
gtgtctgggctcaagcttt

SEQ ID NO: 6335542 - DNA, 12 bp, Homo sapiens
gtgtctgggctg

SEQ ID NO: 6335543 - DNA, 13 bp, Homo sapiens
gtgtctgggctga

SEQ ID NO: 6335544 - DNA, 18 bp, Homo sapiens
gtgtctggtgagggtcct

SEQ ID NO: 6335545 - DNA, 12 bp, Homo sapiens
gtgtctggtgca

SEQ ID NO: 6335546 - DNA, 21 bp, Homo sapiens
gtgtctgtaggtgtctctggg

SEQ ID NO: 6335547 - DNA, 21 bp, Homo sapiens
gtgtctgtatttcatgtggct

SEQ ID NO: 6335548 - DNA, 12 bp, Homo sapiens
gtgtctgtcaca

SEQ ID NO: 6335549 - DNA, 18 bp, Homo sapiens
gtgtctgtcacaggctgg

SEQ ID NO: 6335550 - DNA, 21 bp, Homo sapiens
gtgtctgtcacaggctgggtc

SEQ ID NO: 6335551 - DNA, 23 bp, Homo sapiens
gtgtctgtcatttctctttcaaa

SEQ ID NO: 6335552 - DNA, 15 bp, Homo sapiens
gtgtctgtctttgtg

SEQ ID NO: 6335553 - DNA, 14 bp, Homo sapiens
gtgtctgtgccatg

SEQ ID NO: 6335554 - DNA, 15 bp, Homo sapiens
gtgtctgtgccatgg

SEQ ID NO: 6335555 - DNA, 20 bp, Homo sapiens
gtgtctgtgccctccaaaga

SEQ ID NO: 6335556 - DNA, 15 bp, Homo sapiens
gtgtctgtggccctc

SEQ ID NO: 6335557 - DNA, 14 bp, Homo sapiens
gtgtctgtgtttaa

SEQ ID NO: 6335558 - DNA, 12 bp, Homo sapiens
gtgtctgttgct

SEQ ID NO: 6335559 - DNA, 20 bp, Homo sapiens
gtgtctgtttccttctcttt

SEQ ID NO: 6335560 - DNA, 12 bp, Homo sapiens
gtgtctgtttgg

SEQ ID NO: 6335561 - DNA, 14 bp, Homo sapiens
gtgtcttaattatt

SEQ ID NO: 6335562 - DNA, 19 bp, Homo sapiens
gtgtcttaattattatttg

SEQ ID NO: 6335563 - DNA, 15 bp, Homo sapiens
gtgtcttccctgcct

SEQ ID NO: 6335564 - DNA, 17 bp, Homo sapiens
gtgtcttccctgcctgt

SEQ ID NO: 6335565 - DNA, 21 bp, Homo sapiens
gtgtcttccctgcctgtggca

SEQ ID NO: 6335566 - DNA, 19 bp, Homo sapiens
gtgtcttcctcccaagtgg

SEQ ID NO: 6335567 - DNA, 14 bp, Homo sapiens
gtgtcttcctgtgg

SEQ ID NO: 6335568 - DNA, 14 bp, Homo sapiens
gtgtcttctgcccc

SEQ ID NO: 6335569 - DNA, 22 bp, Homo sapiens
gtgtcttgagctctaaagtagc

SEQ ID NO: 6335570 - DNA, 19 bp, Homo sapiens
gtgtcttgcaatggcagcc

SEQ ID NO: 6335571 - DNA, 11 bp, Homo sapiens
gtgtcttgttc

SEQ ID NO: 6335572 - DNA, 18 bp, Homo sapiens
gtgtctttaaatgctgct

SEQ ID NO: 6335573 - DNA, 19 bp, Homo sapiens
gtgtctttaaatgctgctt

SEQ ID NO: 6335574 - DNA, 17 bp, Homo sapiens
gtgtctttagatagccc

SEQ ID NO: 6335575 - DNA, 17 bp, Homo sapiens
gtgtctttatagatgta

SEQ ID NO: 6335576 - DNA, 13 bp, Homo sapiens
gtgtctttatcag

SEQ ID NO: 6335577 - DNA, 19 bp, Homo sapiens
gtgtctttcggaattttta

SEQ ID NO: 6335578 - DNA, 22 bp, Homo sapiens
gtgtctttctttggtgcctttc

SEQ ID NO: 6335579 - DNA, 12 bp, Homo sapiens
gtgtctttggag

SEQ ID NO: 6335580 - DNA, 18 bp, Homo sapiens
gtgtcttttataaaaagt

SEQ ID NO: 6335581 - DNA, 17 bp, Homo sapiens
gtgtcttttatatttga

SEQ ID NO: 6335582 - DNA, 17 bp, Homo sapiens
gtgtcttttccactcct

SEQ ID NO: 6335583 - DNA, 16 bp, Homo sapiens
gtgtcttttgcatgat

SEQ ID NO: 6335584 - DNA, 23 bp, Homo sapiens
gtgtcttttgttctctcttggtc

SEQ ID NO: 6335585 - DNA, 19 bp, Homo sapiens
gtgtctttttttacttatg

SEQ ID NO: 6335586 - DNA, 17 bp, Homo sapiens
gtgtgaaaatgtgtgtg

SEQ ID NO: 6335587 - DNA, 13 bp, Homo sapiens
gtgtgaaatatat

SEQ ID NO: 6335588 - DNA, 23 bp, Homo sapiens
gtgtgaaccaccacacccagccc

SEQ ID NO: 6335589 - DNA, 20 bp, Homo sapiens
gtgtgaactcaccctgggag

SEQ ID NO: 6335590 - DNA, 15 bp, Homo sapiens
gtgtgaacttggaag

SEQ ID NO: 6335591 - DNA, 13 bp, Homo sapiens
gtgtgaagaaagc

SEQ ID NO: 6335592 - DNA, 16 bp, Homo sapiens
gtgtgaagaaagccag

SEQ ID NO: 6335593 - DNA, 13 bp, Homo sapiens
gtgtgaagacact

SEQ ID NO: 6335594 - DNA, 22 bp, Homo sapiens
gtgtgaagacactgtgcaggcc

SEQ ID NO: 6335595 - DNA, 23 bp, Homo sapiens
gtgtgaagacactgtgcaggccc

SEQ ID NO: 6335596 - DNA, 12 bp, Homo sapiens
gtgtgaagttag

SEQ ID NO: 6335597 - DNA, 17 bp, Homo sapiens
gtgtgaagttagaattc

SEQ ID NO: 6335598 - DNA, 14 bp, Homo sapiens
gtgtgaataaagtt

SEQ ID NO: 6335599 - DNA, 18 bp, Homo sapiens
gtgtgaatactggaagct

SEQ ID NO: 6335600 - DNA, 15 bp, Homo sapiens
gtgtgaatagcctgg

SEQ ID NO: 6335601 - DNA, 19 bp, Homo sapiens
gtgtgaatattcctttatt

SEQ ID NO: 6335602 - DNA, 13 bp, Homo sapiens
gtgtgaatgaaca

SEQ ID NO: 6335603 - DNA, 17 bp, Homo sapiens
gtgtgaatgctgtacct

SEQ ID NO: 6335604 - DNA, 11 bp, Homo sapiens
gtgtgaatgtg

SEQ ID NO: 6335605 - DNA, 23 bp, Homo sapiens
gtgtgaatgtgggcactggccca

SEQ ID NO: 6335606 - DNA, 17 bp, Homo sapiens
gtgtgaattctgcaact

SEQ ID NO: 6335607 - DNA, 21 bp, Homo sapiens
gtgtgaatttgccagaggacc

SEQ ID NO: 6335608 - DNA, 19 bp, Homo sapiens
gtgtgacaccaccactgtg

SEQ ID NO: 6335609 - DNA, 13 bp, Homo sapiens
gtgtgacagggcc

SEQ ID NO: 6335610 - DNA, 23 bp, Homo sapiens
gtgtgacagggccagtggggcct

SEQ ID NO: 6335611 - DNA, 17 bp, Homo sapiens
gtgtgacagtgtatggg

SEQ ID NO: 6335612 - DNA, 17 bp, Homo sapiens
gtgtgacagtttccaaa

SEQ ID NO: 6335613 - DNA, 18 bp, Homo sapiens
gtgtgacagtttccaaat

SEQ ID NO: 6335614 - DNA, 14 bp, Homo sapiens
gtgtgaccaactgt

SEQ ID NO: 6335615 - DNA, 15 bp, Homo sapiens
gtgtgaccaactgtg

SEQ ID NO: 6335616 - DNA, 16 bp, Homo sapiens
gtgtgaccaactgtgt

SEQ ID NO: 6335617 - DNA, 14 bp, Homo sapiens
gtgtgaccccactg

SEQ ID NO: 6335618 - DNA, 18 bp, Homo sapiens
gtgtgacccctcctgggg

SEQ ID NO: 6335619 - DNA, 13 bp, Homo sapiens
gtgtgaccctggg

SEQ ID NO: 6335620 - DNA, 16 bp, Homo sapiens
gtgtgaccctgggcag

SEQ ID NO: 6335621 - DNA, 23 bp, Homo sapiens
gtgtgaccggcgctaggaaatga

SEQ ID NO: 6335622 - DNA, 17 bp, Homo sapiens
gtgtgactactccccca

SEQ ID NO: 6335623 - DNA, 16 bp, Homo sapiens
gtgtgactcgggagct

SEQ ID NO: 6335624 - DNA, 18 bp, Homo sapiens
gtgtgactcgggagctgc

SEQ ID NO: 6335625 - DNA, 19 bp, Homo sapiens
gtgtgactctagcaaggct

SEQ ID NO: 6335626 - DNA, 21 bp, Homo sapiens
gtgtgagaagtgaatgctggg

SEQ ID NO: 6335627 - DNA, 21 bp, Homo sapiens
gtgtgagaagtgccttctcct

SEQ ID NO: 6335628 - DNA, 16 bp, Homo sapiens
gtgtgagagagagggc

SEQ ID NO: 6335629 - DNA, 22 bp, Homo sapiens
gtgtgagagagagggcgcccag

SEQ ID NO: 6335630 - DNA, 22 bp, Homo sapiens
gtgtgagatggtgccccctggg

SEQ ID NO: 6335631 - DNA, 17 bp, Homo sapiens
gtgtgagcatctctgtg

SEQ ID NO: 6335632 - DNA, 14 bp, Homo sapiens
gtgtgagccacagc

SEQ ID NO: 6335633 - DNA, 20 bp, Homo sapiens
gtgtgagccactgcgcccag

SEQ ID NO: 6335634 - DNA, 13 bp, Homo sapiens
gtgtgagcgcctt

SEQ ID NO: 6335635 - DNA, 17 bp, Homo sapiens
gtgtgagctcttccctt

SEQ ID NO: 6335636 - DNA, 13 bp, Homo sapiens
gtgtgaggagagg

SEQ ID NO: 6335637 - DNA, 19 bp, Homo sapiens
gtgtgaggagctgctggct

SEQ ID NO: 6335638 - DNA, 12 bp, Homo sapiens
gtgtgaggccag

SEQ ID NO: 6335639 - DNA, 12 bp, Homo sapiens
gtgtgaggcccc

SEQ ID NO: 6335640 - DNA, 14 bp, Homo sapiens
gtgtgaggctccct

SEQ ID NO: 6335641 - DNA, 14 bp, Homo sapiens
gtgtgagggcagca

SEQ ID NO: 6335642 - DNA, 14 bp, Homo sapiens
gtgtgagggtgcag

SEQ ID NO: 6335643 - DNA, 20 bp, Homo sapiens
gtgtgagtcaccaagcccag

SEQ ID NO: 6335644 - DNA, 17 bp, Homo sapiens
gtgtgagtgagcacacc

SEQ ID NO: 6335645 - DNA, 19 bp, Homo sapiens
gtgtgagtgagggagacag

SEQ ID NO: 6335646 - DNA, 16 bp, Homo sapiens
gtgtgagtggcagcca

SEQ ID NO: 6335647 - DNA, 20 bp, Homo sapiens
gtgtgagtggcagccatgcc

SEQ ID NO: 6335648 - DNA, 21 bp, Homo sapiens
gtgtgagtggcagccatgcct

SEQ ID NO: 6335649 - DNA, 11 bp, Homo sapiens
gtgtgagtgtg

SEQ ID NO: 6335650 - DNA, 18 bp, Homo sapiens
gtgtgagtgtgacagggc

SEQ ID NO: 6335651 - DNA, 19 bp, Homo sapiens
gtgtgagtgtgacagggcc

SEQ ID NO: 6335652 - DNA, 19 bp, Homo sapiens
gtgtgataaaatgttgaac

SEQ ID NO: 6335653 - DNA, 18 bp, Homo sapiens
gtgtgataaatcagtcaa

SEQ ID NO: 6335654 - DNA, 22 bp, Homo sapiens
gtgtgatatttcagaaatacag

SEQ ID NO: 6335655 - DNA, 15 bp, Homo sapiens
gtgtgatccagccct

SEQ ID NO: 6335656 - DNA, 16 bp, Homo sapiens
gtgtgatccagccctg

SEQ ID NO: 6335657 - DNA, 19 bp, Homo sapiens
gtgtgatcccaagtgccag

SEQ ID NO: 6335658 - DNA, 19 bp, Homo sapiens
gtgtgatcccagctcactg

SEQ ID NO: 6335659 - DNA, 21 bp, Homo sapiens
gtgtgatgaatagcgaatcat

SEQ ID NO: 6335660 - DNA, 19 bp, Homo sapiens
gtgtgatgcaggaagacca

SEQ ID NO: 6335661 - DNA, 13 bp, Homo sapiens
gtgtgatgtatgt

SEQ ID NO: 6335662 - DNA, 14 bp, Homo sapiens
gtgtgatgtatgtt

SEQ ID NO: 6335663 - DNA, 15 bp, Homo sapiens
gtgtgattgcacaga

SEQ ID NO: 6335664 - DNA, 17 bp, Homo sapiens
gtgtgatttcctaaaca

SEQ ID NO: 6335665 - DNA, 20 bp, Homo sapiens
gtgtgatttcctaaacataa

SEQ ID NO: 6335666 - DNA, 16 bp, Homo sapiens
gtgtgatttgtctctg

SEQ ID NO: 6335667 - DNA, 14 bp, Homo sapiens
gtgtgatttttctg

SEQ ID NO: 6335668 - DNA, 22 bp, Homo sapiens
gtgtgcaaagatctctagagtt

SEQ ID NO: 6335669 - DNA, 20 bp, Homo sapiens
gtgtgcaactggccagccaa

SEQ ID NO: 6335670 - DNA, 14 bp, Homo sapiens
gtgtgcaaggcagc

SEQ ID NO: 6335671 - DNA, 22 bp, Homo sapiens
gtgtgcacacacaccacacata

SEQ ID NO: 6335672 - DNA, 17 bp, Homo sapiens
gtgtgcacaccaccctc

SEQ ID NO: 6335673 - DNA, 19 bp, Homo sapiens
gtgtgcacacgtgtgtatg

SEQ ID NO: 6335674 - DNA, 20 bp, Homo sapiens
gtgtgcacacgtgtgtatga

SEQ ID NO: 6335675 - DNA, 15 bp, Homo sapiens
gtgtgcacagaaaac

SEQ ID NO: 6335676 - DNA, 23 bp, Homo sapiens
gtgtgcacatccgcgtgtgcctg

SEQ ID NO: 6335677 - DNA, 22 bp, Homo sapiens
gtgtgcaccttaccaactttct

SEQ ID NO: 6335678 - DNA, 15 bp, Homo sapiens
gtgtgcacgagtggg

SEQ ID NO: 6335679 - DNA, 21 bp, Homo sapiens
gtgtgcagaattctaggcagc

SEQ ID NO: 6335680 - DNA, 14 bp, Homo sapiens
gtgtgcagacagcc

SEQ ID NO: 6335681 - DNA, 13 bp, Homo sapiens
gtgtgcagactga

SEQ ID NO: 6335682 - DNA, 13 bp, Homo sapiens
gtgtgcagactgt

SEQ ID NO: 6335683 - DNA, 18 bp, Homo sapiens
gtgtgcagactgtggctg

SEQ ID NO: 6335684 - DNA, 14 bp, Homo sapiens
gtgtgcaggagcct

SEQ ID NO: 6335685 - DNA, 13 bp, Homo sapiens
gtgtgcaggagcg

SEQ ID NO: 6335686 - DNA, 13 bp, Homo sapiens
gtgtgcagtgaag

SEQ ID NO: 6335687 - DNA, 19 bp, Homo sapiens
gtgtgcatagcgtcctgcc

SEQ ID NO: 6335688 - DNA, 22 bp, Homo sapiens
gtgtgcatagcgtcctgccctg

SEQ ID NO: 6335689 - DNA, 23 bp, Homo sapiens
gtgtgcatagcgtcctgccctgc

SEQ ID NO: 6335690 - DNA, 15 bp, Homo sapiens
gtgtgcatattgtac

SEQ ID NO: 6335691 - DNA, 22 bp, Homo sapiens
gtgtgcatattgtacacttttt

SEQ ID NO: 6335692 - DNA, 22 bp, Homo sapiens
gtgtgcatggaggccctcctgt

SEQ ID NO: 6335693 - DNA, 13 bp, Homo sapiens
gtgtgcatgtatg

SEQ ID NO: 6335694 - DNA, 16 bp, Homo sapiens
gtgtgcatgtatgtgc

SEQ ID NO: 6335695 - DNA, 20 bp, Homo sapiens
gtgtgcatgtgtgtgctcag

SEQ ID NO: 6335696 - DNA, 14 bp, Homo sapiens
gtgtgccaagccct

SEQ ID NO: 6335697 - DNA, 15 bp, Homo sapiens
gtgtgccaagccctg

SEQ ID NO: 6335698 - DNA, 12 bp, Homo sapiens
gtgtgccacacc

SEQ ID NO: 6335699 - DNA, 17 bp, Homo sapiens
gtgtgccacaggctgca

SEQ ID NO: 6335700 - DNA, 17 bp, Homo sapiens
gtgtgccaccctctgca

SEQ ID NO: 6335701 - DNA, 22 bp, Homo sapiens
gtgtgccaccctctgcagggca

SEQ ID NO: 6335702 - DNA, 23 bp, Homo sapiens
gtgtgccaccctctgcagggcag

SEQ ID NO: 6335703 - DNA, 20 bp, Homo sapiens
gtgtgcccacccgtgttctc

SEQ ID NO: 6335704 - DNA, 12 bp, Homo sapiens
gtgtgcccagca

SEQ ID NO: 6335705 - DNA, 18 bp, Homo sapiens
gtgtgccccaagaggcta

SEQ ID NO: 6335706 - DNA, 11 bp, Homo sapiens
gtgtgccccac

SEQ ID NO: 6335707 - DNA, 16 bp, Homo sapiens
gtgtgccccactccag

SEQ ID NO: 6335708 - DNA, 17 bp, Homo sapiens
gtgtgccccactccagc

SEQ ID NO: 6335709 - DNA, 18 bp, Homo sapiens
gtgtgccccactccagcc

SEQ ID NO: 6335710 - DNA, 19 bp, Homo sapiens
gtgtgccccactccagcct

SEQ ID NO: 6335711 - DNA, 20 bp, Homo sapiens
gtgtgccccactccagcctg

SEQ ID NO: 6335712 - DNA, 16 bp, Homo sapiens
gtgtgccccccatcct

SEQ ID NO: 6335713 - DNA, 20 bp, Homo sapiens
gtgtgccccccatcctggcc

SEQ ID NO: 6335714 - DNA, 22 bp, Homo sapiens
gtgtgccccccatcctggccca

SEQ ID NO: 6335715 - DNA, 13 bp, Homo sapiens
gtgtgccctaggg

SEQ ID NO: 6335716 - DNA, 22 bp, Homo sapiens
gtgtgccctatcttttctccca

SEQ ID NO: 6335717 - DNA, 16 bp, Homo sapiens
gtgtgccctggactgt

SEQ ID NO: 6335718 - DNA, 12 bp, Homo sapiens
gtgtgccctggg

SEQ ID NO: 6335719 - DNA, 13 bp, Homo sapiens
gtgtgccctgggc

SEQ ID NO: 6335720 - DNA, 17 bp, Homo sapiens
gtgtgccctgggccagg

SEQ ID NO: 6335721 - DNA, 15 bp, Homo sapiens
gggcctgcatggaga

SEQ ID NO: 6335722 - DNA, 13 bp, Homo sapiens
gggcctgccacct

SEQ ID NO: 6335723 - DNA, 21 bp, Homo sapiens
gggcctgccactctcctgagg

SEQ ID NO: 6335724 - DNA, 23 bp, Homo sapiens
gggcctgccctctgccccatcat

SEQ ID NO: 6335725 - DNA, 12 bp, Homo sapiens
gggcctgcctgc

SEQ ID NO: 6335726 - DNA, 14 bp, Homo sapiens
gggcctgcctgcct

SEQ ID NO: 6335727 - DNA, 16 bp, Homo sapiens
gggcctgcctgcctcc

SEQ ID NO: 6335728 - DNA, 13 bp, Homo sapiens
gggcctgcctggc

SEQ ID NO: 6335729 - DNA, 14 bp, Homo sapiens
gggcctgcctggcc

SEQ ID NO: 6335730 - DNA, 18 bp, Homo sapiens
gggcctgcgcccagagct

SEQ ID NO: 6335731 - DNA, 19 bp, Homo sapiens
gggcctgcgcccagagctg

SEQ ID NO: 6335732 - DNA, 23 bp, Homo sapiens
gggcctgcggggttccctgcgcg

SEQ ID NO: 6335733 - DNA, 13 bp, Homo sapiens
gggcctgctccag

SEQ ID NO: 6335734 - DNA, 14 bp, Homo sapiens
gggcctgctctgct

SEQ ID NO: 6335735 - DNA, 11 bp, Homo sapiens
gggcctgctgc

SEQ ID NO: 6335736 - DNA, 20 bp, Homo sapiens
gggcctgctgcgtcagacca

SEQ ID NO: 6335737 - DNA, 20 bp, Homo sapiens
gggcctgctgctgagaacct

SEQ ID NO: 6335738 - DNA, 14 bp, Homo sapiens
gggcctgctggagg

SEQ ID NO: 6335739 - DNA, 14 bp, Homo sapiens
gggcctgctggagt

SEQ ID NO: 6335740 - DNA, 16 bp, Homo sapiens
gggcctgctggagttc

SEQ ID NO: 6335741 - DNA, 18 bp, Homo sapiens
gggcctgcttttccagga

SEQ ID NO: 6335742 - DNA, 23 bp, Homo sapiens
gggcctggacctatgcagggagg

SEQ ID NO: 6335743 - DNA, 14 bp, Homo sapiens
gggcctggacctgc

SEQ ID NO: 6335744 - DNA, 12 bp, Homo sapiens
gggcctggactg

SEQ ID NO: 6335745 - DNA, 13 bp, Homo sapiens
gggcctggagagg

SEQ ID NO: 6335746 - DNA, 18 bp, Homo sapiens
gggcctggagaggggcct

SEQ ID NO: 6335747 - DNA, 15 bp, Homo sapiens
gggcctggagcatgg

SEQ ID NO: 6335748 - DNA, 14 bp, Homo sapiens
gggcctggagcccc

SEQ ID NO: 6335749 - DNA, 21 bp, Homo sapiens
gggcctggagccctgggcgga

SEQ ID NO: 6335750 - DNA, 16 bp, Homo sapiens
gggcctggaggtctgg

SEQ ID NO: 6335751 - DNA, 20 bp, Homo sapiens
gggcctggaggtctggctga

SEQ ID NO: 6335752 - DNA, 10 bp, Homo sapiens
gggcctggca

SEQ ID NO: 6335753 - DNA, 22 bp, Homo sapiens
gggcctggcagccgtgccttca

SEQ ID NO: 6335754 - DNA, 16 bp, Homo sapiens
gggcctggcagctcag

SEQ ID NO: 6335755 - DNA, 20 bp, Homo sapiens
gggcctggcaggccagtgtc

SEQ ID NO: 6335756 - DNA, 15 bp, Homo sapiens
gggcctggccagtcc

SEQ ID NO: 6335757 - DNA, 14 bp, Homo sapiens
gggcctggcccatg

SEQ ID NO: 6335758 - DNA, 14 bp, Homo sapiens
gggcctggccctca

SEQ ID NO: 6335759 - DNA, 12 bp, Homo sapiens
gggcctggcctg

SEQ ID NO: 6335760 - DNA, 17 bp, Homo sapiens
gggcctggcctgagctg

SEQ ID NO: 6335761 - DNA, 19 bp, Homo sapiens
gggcctggcctgagctggg

SEQ ID NO: 6335762 - DNA, 14 bp, Homo sapiens
gggcctggcctggg

SEQ ID NO: 6335763 - DNA, 14 bp, Homo sapiens
gggcctggctcagg

SEQ ID NO: 6335764 - DNA, 13 bp, Homo sapiens
gggcctggctccc

SEQ ID NO: 6335765 - DNA, 15 bp, Homo sapiens
gggcctggctggctg

SEQ ID NO: 6335766 - DNA, 17 bp, Homo sapiens
gggcctggctggctgag

SEQ ID NO: 6335767 - DNA, 18 bp, Homo sapiens
gggcctggctggctgagg

SEQ ID NO: 6335768 - DNA, 12 bp, Homo sapiens
gggcctgggagg

SEQ ID NO: 6335769 - DNA, 22 bp, Homo sapiens
gggcctgggagggttcccctgg

SEQ ID NO: 6335770 - DNA, 15 bp, Homo sapiens
gggcctgggcagccc

SEQ ID NO: 6335771 - DNA, 15 bp, Homo sapiens
gggcctgggcaggag

SEQ ID NO: 6335772 - DNA, 16 bp, Homo sapiens
gggcctgggcaggagg

SEQ ID NO: 6335773 - DNA, 13 bp, Homo sapiens
gggcctgggcctc

SEQ ID NO: 6335774 - DNA, 13 bp, Homo sapiens
gggcctgggcggg

SEQ ID NO: 6335775 - DNA, 15 bp, Homo sapiens
gggcctgggcggggc

SEQ ID NO: 6335776 - DNA, 16 bp, Homo sapiens
gggcctgggctcctgg

SEQ ID NO: 6335777 - DNA, 22 bp, Homo sapiens
gggcctgggctgtgaggacagg

SEQ ID NO: 6335778 - DNA, 23 bp, Homo sapiens
gggcctgggctgtgaggacaggg

SEQ ID NO: 6335779 - DNA, 12 bp, Homo sapiens
gggcctggggct

SEQ ID NO: 6335780 - DNA, 18 bp, Homo sapiens
gggcctggggtaggagga

SEQ ID NO: 6335781 - DNA, 22 bp, Homo sapiens
gggcctgggtccccctcctgca

SEQ ID NO: 6335782 - DNA, 16 bp, Homo sapiens
gggcctggtccctggg

SEQ ID NO: 6335783 - DNA, 19 bp, Homo sapiens
gggcctggtccctgggagg

SEQ ID NO: 6335784 - DNA, 18 bp, Homo sapiens
gggcctggtcgttttcaa

SEQ ID NO: 6335785 - DNA, 21 bp, Homo sapiens
gggcctggtctcaccctggag

SEQ ID NO: 6335786 - DNA, 22 bp, Homo sapiens
gggcctggttaaataaggcagg

SEQ ID NO: 6335787 - DNA, 23 bp, Homo sapiens
gggcctggttaaataaggcaggg

SEQ ID NO: 6335788 - DNA, 15 bp, Homo sapiens
gggcctggttgaaga

SEQ ID NO: 6335789 - DNA, 17 bp, Homo sapiens
gggcctgtacagtctgt

SEQ ID NO: 6335790 - DNA, 17 bp, Homo sapiens
gggcctgtactgcctgc

SEQ ID NO: 6335791 - DNA, 13 bp, Homo sapiens
gggcctgtgcact

SEQ ID NO: 6335792 - DNA, 14 bp, Homo sapiens
gggcctgtgcactg

SEQ ID NO: 6335793 - DNA, 14 bp, Homo sapiens
gggcctgtgcagca

SEQ ID NO: 6335794 - DNA, 18 bp, Homo sapiens
gggcctgtgcagcagccc

SEQ ID NO: 6335795 - DNA, 20 bp, Homo sapiens
gggcctgtgcagcagcccag

SEQ ID NO: 6335796 - DNA, 22 bp, Homo sapiens
gggcctgtggggactgaacctg

SEQ ID NO: 6335797 - DNA, 18 bp, Homo sapiens
gggcctgtgtggaggcct

SEQ ID NO: 6335798 - DNA, 20 bp, Homo sapiens
gggcctgttctcttggctgc

SEQ ID NO: 6335799 - DNA, 12 bp, Homo sapiens
gggcctgttgcc

SEQ ID NO: 6335800 - DNA, 22 bp, Homo sapiens
gggccttacctcccctgccagg

SEQ ID NO: 6335801 - DNA, 17 bp, Homo sapiens
gggccttagggagcccc

SEQ ID NO: 6335802 - DNA, 21 bp, Homo sapiens
gggccttagggcactgggctg

SEQ ID NO: 6335803 - DNA, 17 bp, Homo sapiens
gggccttagtgggccag

SEQ ID NO: 6335804 - DNA, 22 bp, Homo sapiens
gggccttagtgggccagggctg

SEQ ID NO: 6335805 - DNA, 20 bp, Homo sapiens
gggccttccttttgaggagc

SEQ ID NO: 6335806 - DNA, 19 bp, Homo sapiens
gggccttctcagctctcca

SEQ ID NO: 6335807 - DNA, 18 bp, Homo sapiens
gggccttctgcctgctga

SEQ ID NO: 6335808 - DNA, 16 bp, Homo sapiens
gggccttcttaagata

SEQ ID NO: 6335809 - DNA, 20 bp, Homo sapiens
gggccttgaagactccctga

SEQ ID NO: 6335810 - DNA, 23 bp, Homo sapiens
gggccttgatgactgccttgcct

SEQ ID NO: 6335811 - DNA, 12 bp, Homo sapiens
gggccttgccca

SEQ ID NO: 6335812 - DNA, 22 bp, Homo sapiens
gggccttgcccagagatgcctc

SEQ ID NO: 6335813 - DNA, 13 bp, Homo sapiens
gggccttgctaaa

SEQ ID NO: 6335814 - DNA, 16 bp, Homo sapiens
gggccttgctctgagc

SEQ ID NO: 6335815 - DNA, 18 bp, Homo sapiens
gggccttgctctgagcac

SEQ ID NO: 6335816 - DNA, 21 bp, Homo sapiens
gggccttgctgctgctgcacc

SEQ ID NO: 6335817 - DNA, 14 bp, Homo sapiens
gggccttgcttctc

SEQ ID NO: 6335818 - DNA, 16 bp, Homo sapiens
gggccttgcttctctt

SEQ ID NO: 6335819 - DNA, 15 bp, Homo sapiens
gggccttggcctgga

SEQ ID NO: 6335820 - DNA, 16 bp, Homo sapiens
gggccttggcctggag

SEQ ID NO: 6335821 - DNA, 18 bp, Homo sapiens
gggccttggcctggagca

SEQ ID NO: 6335822 - DNA, 15 bp, Homo sapiens
gggccttggctgggc

SEQ ID NO: 6335823 - DNA, 22 bp, Homo sapiens
gggcctttaaaacgcgtctgcc

SEQ ID NO: 6335824 - DNA, 11 bp, Homo sapiens
gggcctttccc

SEQ ID NO: 6335825 - DNA, 22 bp, Homo sapiens
gggcctttctcctccccacctg

SEQ ID NO: 6335826 - DNA, 15 bp, Homo sapiens
gggcctttgagagcc

SEQ ID NO: 6335827 - DNA, 15 bp, Homo sapiens
gggcctttgcaagat

SEQ ID NO: 6335828 - DNA, 14 bp, Homo sapiens
gggcctttgcagcg

SEQ ID NO: 6335829 - DNA, 14 bp, Homo sapiens
gggcctttgccagc

SEQ ID NO: 6335830 - DNA, 20 bp, Homo sapiens
gggcctttgccagcagagcc

SEQ ID NO: 6335831 - DNA, 23 bp, Homo sapiens
gggcctttgccagcagagccagg

SEQ ID NO: 6335832 - DNA, 20 bp, Homo sapiens
gggcctttgttctgggggga

SEQ ID NO: 6335833 - DNA, 20 bp, Homo sapiens
gggccttttagaaacctcat

SEQ ID NO: 6335834 - DNA, 13 bp, Homo sapiens
gggcgacaaaaac

SEQ ID NO: 6335835 - DNA, 13 bp, Homo sapiens
gggcgaccagggc

SEQ ID NO: 6335836 - DNA, 19 bp, Homo sapiens
gggcgagaagggcgcagga

SEQ ID NO: 6335837 - DNA, 14 bp, Homo sapiens
gggcgagctgcagg

SEQ ID NO: 6335838 - DNA, 16 bp, Homo sapiens
gggcgaggcagaggac

SEQ ID NO: 6335839 - DNA, 14 bp, Homo sapiens
gggcgaggcctgac

SEQ ID NO: 6335840 - DNA, 15 bp, Homo sapiens
gggcgaggcctgaca

SEQ ID NO: 6335841 - DNA, 20 bp, Homo sapiens
gggcgaggggttggtgggag

SEQ ID NO: 6335842 - DNA, 18 bp, Homo sapiens
gggcgatcaagtccagag

SEQ ID NO: 6335843 - DNA, 19 bp, Homo sapiens
gggcgatgtcactcagccc

SEQ ID NO: 6335844 - DNA, 13 bp, Homo sapiens
gggcgcaaagggc

SEQ ID NO: 6335845 - DNA, 17 bp, Homo sapiens
gggcgcaccccacagct

SEQ ID NO: 6335846 - DNA, 20 bp, Homo sapiens
gggcgcaccccacagctggg

SEQ ID NO: 6335847 - DNA, 13 bp, Homo sapiens
gggcgcagccctc

SEQ ID NO: 6335848 - DNA, 19 bp, Homo sapiens
gggcgcagctgaagcctgg

SEQ ID NO: 6335849 - DNA, 19 bp, Homo sapiens
gggcgcaggaaccgaggac

SEQ ID NO: 6335850 - DNA, 13 bp, Homo sapiens
gggcgcaggccca

SEQ ID NO: 6335851 - DNA, 22 bp, Homo sapiens
gggcgcagtggctcacgcctgt

SEQ ID NO: 6335852 - DNA, 17 bp, Homo sapiens
gggcgcatgcctcccag

SEQ ID NO: 6335853 - DNA, 20 bp, Homo sapiens
gggcgcatgcctcccaggcc

SEQ ID NO: 6335854 - DNA, 19 bp, Homo sapiens
gggcgccaagtctggcacc

SEQ ID NO: 6335855 - DNA, 13 bp, Homo sapiens
gggcgccaggaca

SEQ ID NO: 6335856 - DNA, 17 bp, Homo sapiens
gggcgccaggacagcag

SEQ ID NO: 6335857 - DNA, 16 bp, Homo sapiens
gggcgcccagcagcct

SEQ ID NO: 6335858 - DNA, 17 bp, Homo sapiens
gggcgcccagcagcctg

SEQ ID NO: 6335859 - DNA, 20 bp, Homo sapiens
gggcgcccagcagcctgcca

SEQ ID NO: 6335860 - DNA, 22 bp, Homo sapiens
gggcgcccagcagcctgccagc

SEQ ID NO: 6335861 - DNA, 12 bp, Homo sapiens
gggcgcccagcc

SEQ ID NO: 6335862 - DNA, 13 bp, Homo sapiens
gggcgcccagccc

SEQ ID NO: 6335863 - DNA, 22 bp, Homo sapiens
gggcgcccattcgtctgtccca

SEQ ID NO: 6335864 - DNA, 13 bp, Homo sapiens
gggcgccccaaga

SEQ ID NO: 6335865 - DNA, 14 bp, Homo sapiens
gggcgcccggactg

SEQ ID NO: 6335866 - DNA, 14 bp, Homo sapiens
gggcgccctggaag

SEQ ID NO: 6335867 - DNA, 13 bp, Homo sapiens
gggcgcctagagc

SEQ ID NO: 6335868 - DNA, 15 bp, Homo sapiens
gggcgcctgcgctcc

SEQ ID NO: 6335869 - DNA, 15 bp, Homo sapiens
gggcgcctggagagc

SEQ ID NO: 6335870 - DNA, 18 bp, Homo sapiens
gggcgcctggagagcgag

SEQ ID NO: 6335871 - DNA, 13 bp, Homo sapiens
gggcgcctggagg

SEQ ID NO: 6335872 - DNA, 20 bp, Homo sapiens
gggcgcctgggtcctcccag

SEQ ID NO: 6335873 - DNA, 18 bp, Homo sapiens
gggcgcgatcccacacag

SEQ ID NO: 6335874 - DNA, 23 bp, Homo sapiens
gggcgcgcaggcagggagaaggg

SEQ ID NO: 6335875 - DNA, 18 bp, Homo sapiens
gggcgcggccagccccgg

SEQ ID NO: 6335876 - DNA, 16 bp, Homo sapiens
gggcgcgggagggggc

SEQ ID NO: 6335877 - DNA, 16 bp, Homo sapiens
gggcgcggtggctcac

SEQ ID NO: 6335878 - DNA, 15 bp, Homo sapiens
gggcgctcagacggc

SEQ ID NO: 6335879 - DNA, 20 bp, Homo sapiens
gggcgctcagacggcggcca

SEQ ID NO: 6335880 - DNA, 23 bp, Homo sapiens
gggcgctcagacggcggccaggc

SEQ ID NO: 6335881 - DNA, 16 bp, Homo sapiens
gggcgctccggcagag

SEQ ID NO: 6335882 - DNA, 19 bp, Homo sapiens
gggcgctcctcccagctgt

SEQ ID NO: 6335883 - DNA, 16 bp, Homo sapiens
gggcgctgagggcagg

SEQ ID NO: 6335884 - DNA, 17 bp, Homo sapiens
gggcgctgcagcctccc

SEQ ID NO: 6335885 - DNA, 16 bp, Homo sapiens
gggcgctgcctgctct

SEQ ID NO: 6335886 - DNA, 19 bp, Homo sapiens
gggcgctgctgggagcaga

SEQ ID NO: 6335887 - DNA, 17 bp, Homo sapiens
gggcgctggcccagccg

SEQ ID NO: 6335888 - DNA, 16 bp, Homo sapiens
gggcgctgtggctcct

SEQ ID NO: 6335889 - DNA, 16 bp, Homo sapiens
gggcgcttcccacctg

SEQ ID NO: 6335890 - DNA, 17 bp, Homo sapiens
gggcgcttcccacctgc

SEQ ID NO: 6335891 - DNA, 20 bp, Homo sapiens
gggcgcttcccacctgcccc

SEQ ID NO: 6335892 - DNA, 18 bp, Homo sapiens
gggcggaagagttacaat

SEQ ID NO: 6335893 - DNA, 14 bp, Homo sapiens
gggcggaaggggac

SEQ ID NO: 6335894 - DNA, 18 bp, Homo sapiens
gggcggacaaaagggcca

SEQ ID NO: 6335895 - DNA, 23 bp, Homo sapiens
gggcggacaaaagggccaggtgc

SEQ ID NO: 6335896 - DNA, 16 bp, Homo sapiens
gggcggagaggctgca

SEQ ID NO: 6335897 - DNA, 17 bp, Homo sapiens
gggcggagcgcctcctt

SEQ ID NO: 6335898 - DNA, 14 bp, Homo sapiens
gggcggagggaggg

SEQ ID NO: 6335899 - DNA, 15 bp, Homo sapiens
gggcggcaggaggga

SEQ ID NO: 6335900 - DNA, 17 bp, Homo sapiens
gggcggcaggggcctgg

SEQ ID NO: 6335901 - DNA, 14 bp, Homo sapiens
gggcggccaggcaa

SEQ ID NO: 6335902 - DNA, 19 bp, Homo sapiens
gtgtgccctgggccaggca

SEQ ID NO: 6335903 - DNA, 17 bp, Homo sapiens
gtgtgcctctagctgaa

SEQ ID NO: 6335904 - DNA, 23 bp, Homo sapiens
gtgtgcctctagctgaattgagc

SEQ ID NO: 6335905 - DNA, 17 bp, Homo sapiens
gtgtgcctgccctggag

SEQ ID NO: 6335906 - DNA, 19 bp, Homo sapiens
gtgtgcctgctatccagcc

SEQ ID NO: 6335907 - DNA, 20 bp, Homo sapiens
gtgtgcctgctatccagccg

SEQ ID NO: 6335908 - DNA, 11 bp, Homo sapiens
gtgtgcctggc

SEQ ID NO: 6335909 - DNA, 23 bp, Homo sapiens
gtgtgcctgggggagttttcctc

SEQ ID NO: 6335910 - DNA, 19 bp, Homo sapiens
gtgtgcctgtcactactgg

SEQ ID NO: 6335911 - DNA, 12 bp, Homo sapiens
gtgtgcctgtgc

SEQ ID NO: 6335912 - DNA, 18 bp, Homo sapiens
gtgtgcctgtgctcctgc

SEQ ID NO: 6335913 - DNA, 20 bp, Homo sapiens
gtgtgcctgtgctcctgccc

SEQ ID NO: 6335914 - DNA, 22 bp, Homo sapiens
gtgtgcctgtgctcctgcccag

SEQ ID NO: 6335915 - DNA, 15 bp, Homo sapiens
gtgtgcctgtggcag

SEQ ID NO: 6335916 - DNA, 12 bp, Homo sapiens
gtgtgccttcca

SEQ ID NO: 6335917 - DNA, 18 bp, Homo sapiens
gtgtgcgcccctccccac

SEQ ID NO: 6335918 - DNA, 21 bp, Homo sapiens
gtgtgcgcccctccccacccc

SEQ ID NO: 6335919 - DNA, 13 bp, Homo sapiens
gtgtgcgctgcct

SEQ ID NO: 6335920 - DNA, 15 bp, Homo sapiens
gtgtgcgctgcctgg

SEQ ID NO: 6335921 - DNA, 18 bp, Homo sapiens
gtgtgcgctgcctggcca

SEQ ID NO: 6335922 - DNA, 18 bp, Homo sapiens
gtgtgcgtgcgtgtgcgt

SEQ ID NO: 6335923 - DNA, 16 bp, Homo sapiens
gtgtgcgtgtttgcac

SEQ ID NO: 6335924 - DNA, 22 bp, Homo sapiens
gtgtgctaaacgtgtatgtttt

SEQ ID NO: 6335925 - DNA, 17 bp, Homo sapiens
gtgtgctattcgtaagt

SEQ ID NO: 6335926 - DNA, 16 bp, Homo sapiens
gtgtgctcaggagccc

SEQ ID NO: 6335927 - DNA, 19 bp, Homo sapiens
gtgtgctcaggagccctgg

SEQ ID NO: 6335928 - DNA, 15 bp, Homo sapiens
gtgtgctcaggggac

SEQ ID NO: 6335929 - DNA, 21 bp, Homo sapiens
gtgtgctccaggcttcctgcc

SEQ ID NO: 6335930 - DNA, 22 bp, Homo sapiens
gtgtgctccaggcttcctgccc

SEQ ID NO: 6335931 - DNA, 22 bp, Homo sapiens
gtgtgctctccccggcaggcct

SEQ ID NO: 6335932 - DNA, 19 bp, Homo sapiens
gtgtgctctgagccacaga

SEQ ID NO: 6335933 - DNA, 12 bp, Homo sapiens
gtgtgctctgat

SEQ ID NO: 6335934 - DNA, 22 bp, Homo sapiens
gtgtgctcttatccccagctgt

SEQ ID NO: 6335935 - DNA, 19 bp, Homo sapiens
gtgtgctctttttttaaaa

SEQ ID NO: 6335936 - DNA, 14 bp, Homo sapiens
gtgtgctgaacaca

SEQ ID NO: 6335937 - DNA, 13 bp, Homo sapiens
gtgtgctgctgct

SEQ ID NO: 6335938 - DNA, 11 bp, Homo sapiens
gtgtgctgtaa

SEQ ID NO: 6335939 - DNA, 16 bp, Homo sapiens
gtgtgctgtggccagg

SEQ ID NO: 6335940 - DNA, 14 bp, Homo sapiens
gtgtgctgttgttt

SEQ ID NO: 6335941 - DNA, 18 bp, Homo sapiens
gtgtgcttacctgttgtc

SEQ ID NO: 6335942 - DNA, 14 bp, Homo sapiens
gtgtgcttcacaca

SEQ ID NO: 6335943 - DNA, 15 bp, Homo sapiens
gtgtgcttcacacaa

SEQ ID NO: 6335944 - DNA, 19 bp, Homo sapiens
gtgtgcttcccaaatacat

SEQ ID NO: 6335945 - DNA, 11 bp, Homo sapiens
gtgtgctttat

SEQ ID NO: 6335946 - DNA, 18 bp, Homo sapiens
gtgtgctttatgctgaaa

SEQ ID NO: 6335947 - DNA, 22 bp, Homo sapiens
gtgtgctttatgctgaaacaga

SEQ ID NO: 6335948 - DNA, 15 bp, Homo sapiens
gtgtggaaaaaaatt

SEQ ID NO: 6335949 - DNA, 20 bp, Homo sapiens
gtgtggaaattaagaagaaa

SEQ ID NO: 6335950 - DNA, 20 bp, Homo sapiens
gtgtggaaggcacccgccct

SEQ ID NO: 6335951 - DNA, 17 bp, Homo sapiens
gtgtggaagggaccaag

SEQ ID NO: 6335952 - DNA, 14 bp, Homo sapiens
gtgtggacaggact

SEQ ID NO: 6335953 - DNA, 20 bp, Homo sapiens
gtgtggaccggccgcagccc

SEQ ID NO: 6335954 - DNA, 15 bp, Homo sapiens
gtgtggactgtgatg

SEQ ID NO: 6335955 - DNA, 19 bp, Homo sapiens
gtgtggagaactcagtgcc

SEQ ID NO: 6335956 - DNA, 22 bp, Homo sapiens
gtgtggagaagccacaggcctg

SEQ ID NO: 6335957 - DNA, 21 bp, Homo sapiens
gtgtggagaagcggctggcag

SEQ ID NO: 6335958 - DNA, 16 bp, Homo sapiens
gtgtggagaccctgcc

SEQ ID NO: 6335959 - DNA, 21 bp, Homo sapiens
gtgtggagaccctgccacagc

SEQ ID NO: 6335960 - DNA, 10 bp, Homo sapiens
gtgtggagca

SEQ ID NO: 6335961 - DNA, 12 bp, Homo sapiens
gtgtggagcacg

SEQ ID NO: 6335962 - DNA, 12 bp, Homo sapiens
gtgtggagctgc

SEQ ID NO: 6335963 - DNA, 12 bp, Homo sapiens
gtgtggagggct

SEQ ID NO: 6335964 - DNA, 13 bp, Homo sapiens
gtgtggagggctg

SEQ ID NO: 6335965 - DNA, 12 bp, Homo sapiens
gtgtggagtgga

SEQ ID NO: 6335966 - DNA, 22 bp, Homo sapiens
gtgtggagttcaccttggaagg

SEQ ID NO: 6335967 - DNA, 15 bp, Homo sapiens
gtgtggagttttcat

SEQ ID NO: 6335968 - DNA, 23 bp, Homo sapiens
gtgtggatgtaattagctctggg

SEQ ID NO: 6335969 - DNA, 15 bp, Homo sapiens
gtgtggattttctac

SEQ ID NO: 6335970 - DNA, 16 bp, Homo sapiens
gtgtggcagcaggcag

SEQ ID NO: 6335971 - DNA, 14 bp, Homo sapiens
gtgtggcagtggtt

SEQ ID NO: 6335972 - DNA, 20 bp, Homo sapiens
gtgtggccaaccaggaccca

SEQ ID NO: 6335973 - DNA, 20 bp, Homo sapiens
gtgtggccaaggctgagagc

SEQ ID NO: 6335974 - DNA, 19 bp, Homo sapiens
gtgtggccacttctgtcca

SEQ ID NO: 6335975 - DNA, 11 bp, Homo sapiens
gtgtggccagc

SEQ ID NO: 6335976 - DNA, 13 bp, Homo sapiens
gtgtggccccgcc

SEQ ID NO: 6335977 - DNA, 13 bp, Homo sapiens
gtgtggccctgca

SEQ ID NO: 6335978 - DNA, 15 bp, Homo sapiens
gtgtggcctcagccc

SEQ ID NO: 6335979 - DNA, 17 bp, Homo sapiens
gtgtggcctcagccctc

SEQ ID NO: 6335980 - DNA, 15 bp, Homo sapiens
gtgtggcctccctgg

SEQ ID NO: 6335981 - DNA, 20 bp, Homo sapiens
gtgtggcctccgtcctgtca

SEQ ID NO: 6335982 - DNA, 21 bp, Homo sapiens
gtgtggcctccgtcctgtcac

SEQ ID NO: 6335983 - DNA, 11 bp, Homo sapiens
gtgtggcctct

SEQ ID NO: 6335984 - DNA, 11 bp, Homo sapiens
gtgtggcctgg

SEQ ID NO: 6335985 - DNA, 12 bp, Homo sapiens
gtgtggcctgga

SEQ ID NO: 6335986 - DNA, 13 bp, Homo sapiens
gtgtggcctggat

SEQ ID NO: 6335987 - DNA, 15 bp, Homo sapiens
gtgtggcctgggtcc

SEQ ID NO: 6335988 - DNA, 15 bp, Homo sapiens
gtgtggcctggtggg

SEQ ID NO: 6335989 - DNA, 19 bp, Homo sapiens
gtgtggctcacgtgtgtga

SEQ ID NO: 6335990 - DNA, 20 bp, Homo sapiens
gtgtggctcctaccagcaaa

SEQ ID NO: 6335991 - DNA, 16 bp, Homo sapiens
gtgtggctcctctgtt

SEQ ID NO: 6335992 - DNA, 13 bp, Homo sapiens
gtgtggctcctgg

SEQ ID NO: 6335993 - DNA, 14 bp, Homo sapiens
gtgtggctcctggg

SEQ ID NO: 6335994 - DNA, 13 bp, Homo sapiens
gtgtggctgagga

SEQ ID NO: 6335995 - DNA, 15 bp, Homo sapiens
gtgtggctgaggagg

SEQ ID NO: 6335996 - DNA, 13 bp, Homo sapiens
gtgtggctgcccc

SEQ ID NO: 6335997 - DNA, 17 bp, Homo sapiens
gtgtggctggtgtcccc

SEQ ID NO: 6335998 - DNA, 18 bp, Homo sapiens
gtgtggctggtgtcccct

SEQ ID NO: 6335999 - DNA, 16 bp, Homo sapiens
gtgtggctgtattcag

SEQ ID NO: 6336000 - DNA, 14 bp, Homo sapiens
gtgtggctgtgagg

SEQ ID NO: 6336001 - DNA, 13 bp, Homo sapiens
gtgtggctgtgca

SEQ ID NO: 6336002 - DNA, 13 bp, Homo sapiens
gtgtggcttggaa

SEQ ID NO: 6336003 - DNA, 19 bp, Homo sapiens
gtgtggctttcagagcctc

SEQ ID NO: 6336004 - DNA, 12 bp, Homo sapiens
gtgtggctttcc

SEQ ID NO: 6336005 - DNA, 19 bp, Homo sapiens
gtgtgggatacttagtggt

SEQ ID NO: 6336006 - DNA, 16 bp, Homo sapiens
gtgtgggccagagatc

SEQ ID NO: 6336007 - DNA, 11 bp, Homo sapiens
gtgtgggctcc

SEQ ID NO: 6336008 - DNA, 20 bp, Homo sapiens
gtgtggggacacagcagtga

SEQ ID NO: 6336009 - DNA, 15 bp, Homo sapiens
gtgtggggaggcagc

SEQ ID NO: 6336010 - DNA, 12 bp, Homo sapiens
gtgtggggaggg

SEQ ID NO: 6336011 - DNA, 16 bp, Homo sapiens
gtgtggggagggcagg

SEQ ID NO: 6336012 - DNA, 14 bp, Homo sapiens
gtgtggggagggtg

SEQ ID NO: 6336013 - DNA, 23 bp, Homo sapiens
gtgtggggccatgcctcctcagg

SEQ ID NO: 6336014 - DNA, 11 bp, Homo sapiens
gtgtgggggag

SEQ ID NO: 6336015 - DNA, 17 bp, Homo sapiens
gtgtgggggagattctg

SEQ ID NO: 6336016 - DNA, 22 bp, Homo sapiens
gtgtgggggagattctgggttt

SEQ ID NO: 6336017 - DNA, 14 bp, Homo sapiens
gtgtgggggccccg

SEQ ID NO: 6336018 - DNA, 17 bp, Homo sapiens
gtgtggggggtgcccca

SEQ ID NO: 6336019 - DNA, 15 bp, Homo sapiens
gtgtgggtctctggg

SEQ ID NO: 6336020 - DNA, 16 bp, Homo sapiens
gtgtgggtctctgggc

SEQ ID NO: 6336021 - DNA, 23 bp, Homo sapiens
gtgtgggtgatcagaaggctggg

SEQ ID NO: 6336022 - DNA, 13 bp, Homo sapiens
gtgtgggtgccag

SEQ ID NO: 6336023 - DNA, 17 bp, Homo sapiens
gtgtgggtgctgataat

SEQ ID NO: 6336024 - DNA, 18 bp, Homo sapiens
gtgtgggtggaagggctg

SEQ ID NO: 6336025 - DNA, 23 bp, Homo sapiens
gtgtgggtgtcctgcctgtctgc

SEQ ID NO: 6336026 - DNA, 15 bp, Homo sapiens
gtgtgggtgtgtgcg

SEQ ID NO: 6336027 - DNA, 15 bp, Homo sapiens
gtgtggtacagagaa

SEQ ID NO: 6336028 - DNA, 18 bp, Homo sapiens
gtgtggtacagagaagcc

SEQ ID NO: 6336029 - DNA, 19 bp, Homo sapiens
gtgtggtacagagaagcca

SEQ ID NO: 6336030 - DNA, 21 bp, Homo sapiens
gtgtggtccatgcccactgct

SEQ ID NO: 6336031 - DNA, 12 bp, Homo sapiens
gtgtggtccctc

SEQ ID NO: 6336032 - DNA, 19 bp, Homo sapiens
gtgtggtctccagctcctc

SEQ ID NO: 6336033 - DNA, 21 bp, Homo sapiens
gtgtggtctctgccccagcct

SEQ ID NO: 6336034 - DNA, 21 bp, Homo sapiens
gtgtggtctcttacatggcca

SEQ ID NO: 6336035 - DNA, 20 bp, Homo sapiens
gtgtggtgaggggctttctc

SEQ ID NO: 6336036 - DNA, 21 bp, Homo sapiens
gtgtggtgaggggctttctct

SEQ ID NO: 6336037 - DNA, 23 bp, Homo sapiens
gtgtggtggcctcagctgaatgc

SEQ ID NO: 6336038 - DNA, 14 bp, Homo sapiens
gtgtggtggcctgt

SEQ ID NO: 6336039 - DNA, 15 bp, Homo sapiens
gtgtggtggcctgtg

SEQ ID NO: 6336040 - DNA, 13 bp, Homo sapiens
gtgtggtggctca

SEQ ID NO: 6336041 - DNA, 23 bp, Homo sapiens
gtgtggtgggttctttggaagga

SEQ ID NO: 6336042 - DNA, 22 bp, Homo sapiens
gtgtggtgtcgtctgtgaatgc

SEQ ID NO: 6336043 - DNA, 15 bp, Homo sapiens
gtgtggtgtcttgcg

SEQ ID NO: 6336044 - DNA, 15 bp, Homo sapiens
gtgtggtgtgtgtgc

SEQ ID NO: 6336045 - DNA, 18 bp, Homo sapiens
gtgtggtttagtgtaaaa

SEQ ID NO: 6336046 - DNA, 17 bp, Homo sapiens
gtgtggtttcccctttc

SEQ ID NO: 6336047 - DNA, 19 bp, Homo sapiens
gtgtggtttcccctttctt

SEQ ID NO: 6336048 - DNA, 19 bp, Homo sapiens
gtgtgtaaatatgtacatt

SEQ ID NO: 6336049 - DNA, 16 bp, Homo sapiens
gtgtgtaacactgtgt

SEQ ID NO: 6336050 - DNA, 13 bp, Homo sapiens
gtgtgtaattgtt

SEQ ID NO: 6336051 - DNA, 14 bp, Homo sapiens
gtgtgtaatttaaa

SEQ ID NO: 6336052 - DNA, 23 bp, Homo sapiens
gtgtgtaccacaccctgcctgct

SEQ ID NO: 6336053 - DNA, 16 bp, Homo sapiens
gtgtgtactcagggca

SEQ ID NO: 6336054 - DNA, 15 bp, Homo sapiens
gtgtgtactctgtcc

SEQ ID NO: 6336055 - DNA, 17 bp, Homo sapiens
gtgtgtagacaaatatt

SEQ ID NO: 6336056 - DNA, 14 bp, Homo sapiens
gtgtgtaggctggg

SEQ ID NO: 6336057 - DNA, 22 bp, Homo sapiens
gtgtgtataagtgcacacagaa

SEQ ID NO: 6336058 - DNA, 12 bp, Homo sapiens
gtgtgtatatat

SEQ ID NO: 6336059 - DNA, 22 bp, Homo sapiens
gtgtgtatcaccctcagctggc

SEQ ID NO: 6336060 - DNA, 22 bp, Homo sapiens
gtgtgtatccgactctaagctg

SEQ ID NO: 6336061 - DNA, 11 bp, Homo sapiens
gtgtgtatgag

SEQ ID NO: 6336062 - DNA, 20 bp, Homo sapiens
gtgtgtatgtatacacacat

SEQ ID NO: 6336063 - DNA, 21 bp, Homo sapiens
gtgtgtatgtctatgtgtata

SEQ ID NO: 6336064 - DNA, 15 bp, Homo sapiens
gtgtgtatgtggggg

SEQ ID NO: 6336065 - DNA, 11 bp, Homo sapiens
gtgtgtattaa

SEQ ID NO: 6336066 - DNA, 20 bp, Homo sapiens
gtgtgtattaaaaaaaacaa

SEQ ID NO: 6336067 - DNA, 11 bp, Homo sapiens
gtgtgtatttc

SEQ ID NO: 6336068 - DNA, 21 bp, Homo sapiens
gtgtgtatttgtattaataaa

SEQ ID NO: 6336069 - DNA, 15 bp, Homo sapiens
gtgtgtattttttca

SEQ ID NO: 6336070 - DNA, 20 bp, Homo sapiens
gtgtgtcacactgagctggg

SEQ ID NO: 6336071 - DNA, 21 bp, Homo sapiens
gtgtgtcacactgagctgggc

SEQ ID NO: 6336072 - DNA, 17 bp, Homo sapiens
gtgtgtcaggccctctg

SEQ ID NO: 6336073 - DNA, 19 bp, Homo sapiens
gtgtgtcaggccctctgcc

SEQ ID NO: 6336074 - DNA, 22 bp, Homo sapiens
gtgtgtcatactgtgcaggcct

SEQ ID NO: 6336075 - DNA, 19 bp, Homo sapiens
gtgtgtccaaaactgcctc

SEQ ID NO: 6336076 - DNA, 18 bp, Homo sapiens
gtgtgtcccaggcaggga

SEQ ID NO: 6336077 - DNA, 16 bp, Homo sapiens
gtgtgtccccctctgt

SEQ ID NO: 6336078 - DNA, 18 bp, Homo sapiens
gtgtgtcccctcacgcaa

SEQ ID NO: 6336079 - DNA, 19 bp, Homo sapiens
gtgtgtccctggacacagc

SEQ ID NO: 6336080 - DNA, 20 bp, Homo sapiens
gtgtgtccctggacacagct

SEQ ID NO: 6336081 - DNA, 21 bp, Homo sapiens
gtgtgtccctggacacagctc

SEQ ID NO: 6336082 - DNA, 22 bp, Homo sapiens
gtgtgtccctggacacagctct

SEQ ID NO: 6336083 - DNA, 14 bp, Homo sapiens
gggcggccagggac

SEQ ID NO: 6336084 - DNA, 23 bp, Homo sapiens
gggcggcccacgccagctggccc

SEQ ID NO: 6336085 - DNA, 18 bp, Homo sapiens
gggcggcctcccaggtcc

SEQ ID NO: 6336086 - DNA, 20 bp, Homo sapiens
gggcggcctgcagaccctgc

SEQ ID NO: 6336087 - DNA, 14 bp, Homo sapiens
gggcggctcctggt

SEQ ID NO: 6336088 - DNA, 22 bp, Homo sapiens
gggcggctgagctccagccacc

SEQ ID NO: 6336089 - DNA, 17 bp, Homo sapiens
gggcgggacccaggcac

SEQ ID NO: 6336090 - DNA, 12 bp, Homo sapiens
gggcgggactcc

SEQ ID NO: 6336091 - DNA, 13 bp, Homo sapiens
gggcgggactcct

SEQ ID NO: 6336092 - DNA, 20 bp, Homo sapiens
gggcgggcagcacagcaagg

SEQ ID NO: 6336093 - DNA, 14 bp, Homo sapiens
gggcgggcagccag

SEQ ID NO: 6336094 - DNA, 19 bp, Homo sapiens
gggcgggcagccaggctgg

SEQ ID NO: 6336095 - DNA, 23 bp, Homo sapiens
gggcgggcagtcgctgcagggag

SEQ ID NO: 6336096 - DNA, 13 bp, Homo sapiens
gggcgggcggagg

SEQ ID NO: 6336097 - DNA, 15 bp, Homo sapiens
gggcgggctcagagc

SEQ ID NO: 6336098 - DNA, 15 bp, Homo sapiens
gggcggggactgctg

SEQ ID NO: 6336099 - DNA, 20 bp, Homo sapiens
gggcggggctcgaggctggt

SEQ ID NO: 6336100 - DNA, 21 bp, Homo sapiens
gggcggggttagagccaagct

SEQ ID NO: 6336101 - DNA, 21 bp, Homo sapiens
gggcggtccagaggaggtgcc

SEQ ID NO: 6336102 - DNA, 20 bp, Homo sapiens
gggcggtgaggtgggggcag

SEQ ID NO: 6336103 - DNA, 22 bp, Homo sapiens
gggcggtgtgtctttccagaag

SEQ ID NO: 6336104 - DNA, 15 bp, Homo sapiens
gggcgtcaggggtgc

SEQ ID NO: 6336105 - DNA, 16 bp, Homo sapiens
gggcgtcaggggtgca

SEQ ID NO: 6336106 - DNA, 20 bp, Homo sapiens
gggcgtcgctggacaaccca

SEQ ID NO: 6336107 - DNA, 23 bp, Homo sapiens
gggcgtcgctggacaacccagaa

SEQ ID NO: 6336108 - DNA, 14 bp, Homo sapiens
gggcgtctccccca

SEQ ID NO: 6336109 - DNA, 16 bp, Homo sapiens
gggcgtgactcaccca

SEQ ID NO: 6336110 - DNA, 16 bp, Homo sapiens
gggcgtgacttcagac

SEQ ID NO: 6336111 - DNA, 18 bp, Homo sapiens
gggcgtgagacctgcccc

SEQ ID NO: 6336112 - DNA, 14 bp, Homo sapiens
gggcgtgaggaact

SEQ ID NO: 6336113 - DNA, 18 bp, Homo sapiens
gggcgtgcctgccaagct

SEQ ID NO: 6336114 - DNA, 21 bp, Homo sapiens
gggcgtggagggaggccccag

SEQ ID NO: 6336115 - DNA, 14 bp, Homo sapiens
gggcgtggctctgg

SEQ ID NO: 6336116 - DNA, 18 bp, Homo sapiens
gggcgtggctctgggtgg

SEQ ID NO: 6336117 - DNA, 18 bp, Homo sapiens
gggcgtggctggcctttc

SEQ ID NO: 6336118 - DNA, 18 bp, Homo sapiens
gggcgtgggtctctgggg

SEQ ID NO: 6336119 - DNA, 15 bp, Homo sapiens
gggcgtggtggtgag

SEQ ID NO: 6336120 - DNA, 20 bp, Homo sapiens
gggcgtgtggtttccctgcc

SEQ ID NO: 6336121 - DNA, 21 bp, Homo sapiens
gggcgttatttatggaccact

SEQ ID NO: 6336122 - DNA, 18 bp, Homo sapiens
gggcgttctcccaaagat

SEQ ID NO: 6336123 - DNA, 18 bp, Homo sapiens
gggctaaaaaggtcctgt

SEQ ID NO: 6336124 - DNA, 20 bp, Homo sapiens
gggctaaaggggagaaactg

SEQ ID NO: 6336125 - DNA, 14 bp, Homo sapiens
gggctaaataaaga

SEQ ID NO: 6336126 - DNA, 18 bp, Homo sapiens
gggctaacgggaggctgg

SEQ ID NO: 6336127 - DNA, 22 bp, Homo sapiens
gggctaacgggaggctgggcac

SEQ ID NO: 6336128 - DNA, 16 bp, Homo sapiens
gggctaacgggcgcct

SEQ ID NO: 6336129 - DNA, 15 bp, Homo sapiens
gggctaactggcccc

SEQ ID NO: 6336130 - DNA, 20 bp, Homo sapiens
gggctaagagctagcgctgc

SEQ ID NO: 6336131 - DNA, 22 bp, Homo sapiens
gggctaattctgggaagggaga

SEQ ID NO: 6336132 - DNA, 18 bp, Homo sapiens
gggctacaaaccaggagc

SEQ ID NO: 6336133 - DNA, 19 bp, Homo sapiens
gggctacaaaccaggagca

SEQ ID NO: 6336134 - DNA, 14 bp, Homo sapiens
gggctacacagacc

SEQ ID NO: 6336135 - DNA, 21 bp, Homo sapiens
gggctacagaaaccacagtct

SEQ ID NO: 6336136 - DNA, 22 bp, Homo sapiens
gggctacagaatagggtggcag

SEQ ID NO: 6336137 - DNA, 15 bp, Homo sapiens
gggctaccaggaaag

SEQ ID NO: 6336138 - DNA, 10 bp, Homo sapiens
gggctaccat

SEQ ID NO: 6336139 - DNA, 23 bp, Homo sapiens
gggctaccctaaagggagaagga

SEQ ID NO: 6336140 - DNA, 13 bp, Homo sapiens
gggctaccctgag

SEQ ID NO: 6336141 - DNA, 16 bp, Homo sapiens
gggctaccctgagctg

SEQ ID NO: 6336142 - DNA, 19 bp, Homo sapiens
gggctaccctgagctgagg

SEQ ID NO: 6336143 - DNA, 18 bp, Homo sapiens
gggctactgccactgtgt

SEQ ID NO: 6336144 - DNA, 18 bp, Homo sapiens
gggctactggcagctcct

SEQ ID NO: 6336145 - DNA, 17 bp, Homo sapiens
gggctagactgggctgg

SEQ ID NO: 6336146 - DNA, 14 bp, Homo sapiens
gggctagagggtgc

SEQ ID NO: 6336147 - DNA, 14 bp, Homo sapiens
gggctagcactgga

SEQ ID NO: 6336148 - DNA, 21 bp, Homo sapiens
gggctagccacctcctcgtcc

SEQ ID NO: 6336149 - DNA, 14 bp, Homo sapiens
gggctagggagacg

SEQ ID NO: 6336150 - DNA, 17 bp, Homo sapiens
gggctagggaggaccaa

SEQ ID NO: 6336151 - DNA, 13 bp, Homo sapiens
gggctaggggagg

SEQ ID NO: 6336152 - DNA, 14 bp, Homo sapiens
gggctaggggctgg

SEQ ID NO: 6336153 - DNA, 22 bp, Homo sapiens
gggctagtcttcccttacctca

SEQ ID NO: 6336154 - DNA, 17 bp, Homo sapiens
gggctagtgtgagtggc

SEQ ID NO: 6336155 - DNA, 18 bp, Homo sapiens
gggctatcccttctcaga

SEQ ID NO: 6336156 - DNA, 13 bp, Homo sapiens
gggctatggacac

SEQ ID NO: 6336157 - DNA, 15 bp, Homo sapiens
gggctatggacacag

SEQ ID NO: 6336158 - DNA, 15 bp, Homo sapiens
gggctatggcaaggg

SEQ ID NO: 6336159 - DNA, 17 bp, Homo sapiens
gggctatggcaaggggg

SEQ ID NO: 6336160 - DNA, 18 bp, Homo sapiens
gggctatttctctcccca

SEQ ID NO: 6336161 - DNA, 13 bp, Homo sapiens
gggctcaaagccc

SEQ ID NO: 6336162 - DNA, 21 bp, Homo sapiens
gggctcaaatgatcctcccac

SEQ ID NO: 6336163 - DNA, 21 bp, Homo sapiens
gggctcaagcaatcctcctgc

SEQ ID NO: 6336164 - DNA, 23 bp, Homo sapiens
gggctcaaggcaccgcagcctgt

SEQ ID NO: 6336165 - DNA, 10 bp, Homo sapiens
gggctcacac

SEQ ID NO: 6336166 - DNA, 20 bp, Homo sapiens
gggctcacaccagccctggt

SEQ ID NO: 6336167 - DNA, 22 bp, Homo sapiens
gggctcacaccggcactgtgca

SEQ ID NO: 6336168 - DNA, 15 bp, Homo sapiens
gggctcacactcctg

SEQ ID NO: 6336169 - DNA, 16 bp, Homo sapiens
gggctcacactcctgg

SEQ ID NO: 6336170 - DNA, 17 bp, Homo sapiens
gggctcacactcctggg

SEQ ID NO: 6336171 - DNA, 19 bp, Homo sapiens
gggctcacactcctgggct

SEQ ID NO: 6336172 - DNA, 14 bp, Homo sapiens
gggctcacagggca

SEQ ID NO: 6336173 - DNA, 15 bp, Homo sapiens
gggctcacagggcag

SEQ ID NO: 6336174 - DNA, 22 bp, Homo sapiens
gggctcaccagctggggtcctg

SEQ ID NO: 6336175 - DNA, 17 bp, Homo sapiens
gggctcacggggcctcc

SEQ ID NO: 6336176 - DNA, 14 bp, Homo sapiens
gggctcactctggc

SEQ ID NO: 6336177 - DNA, 16 bp, Homo sapiens
gggctcactctggccc

SEQ ID NO: 6336178 - DNA, 22 bp, Homo sapiens
gggctcagagaggacaaaataa

SEQ ID NO: 6336179 - DNA, 19 bp, Homo sapiens
gggctcagagctgctgagc

SEQ ID NO: 6336180 - DNA, 13 bp, Homo sapiens
gggctcagagctt

SEQ ID NO: 6336181 - DNA, 21 bp, Homo sapiens
gggctcagagctttgtcactt

SEQ ID NO: 6336182 - DNA, 21 bp, Homo sapiens
gggctcagagtgaccctcagc

SEQ ID NO: 6336183 - DNA, 15 bp, Homo sapiens
gggctcagatcctgg

SEQ ID NO: 6336184 - DNA, 17 bp, Homo sapiens
gggctcagatcctgggc

SEQ ID NO: 6336185 - DNA, 20 bp, Homo sapiens
gggctcagatggactgggag

SEQ ID NO: 6336186 - DNA, 21 bp, Homo sapiens
gggctcagatggactgggagg

SEQ ID NO: 6336187 - DNA, 22 bp, Homo sapiens
gggctcagatggggcctgggct

SEQ ID NO: 6336188 - DNA, 22 bp, Homo sapiens
gggctcagcaaaagatgcttct

SEQ ID NO: 6336189 - DNA, 20 bp, Homo sapiens
gggctcagcagccagaggag

SEQ ID NO: 6336190 - DNA, 18 bp, Homo sapiens
gggctcagcagggctggt

SEQ ID NO: 6336191 - DNA, 22 bp, Homo sapiens
gggctcagcataagtaaacaac

SEQ ID NO: 6336192 - DNA, 16 bp, Homo sapiens
gggctcagcctggtgg

SEQ ID NO: 6336193 - DNA, 18 bp, Homo sapiens
gggctcagctctggctca

SEQ ID NO: 6336194 - DNA, 17 bp, Homo sapiens
gggctcagggagggagg

SEQ ID NO: 6336195 - DNA, 14 bp, Homo sapiens
gggctcagggccag

SEQ ID NO: 6336196 - DNA, 13 bp, Homo sapiens
gggctcagggctg

SEQ ID NO: 6336197 - DNA, 13 bp, Homo sapiens
gggctcagggttg

SEQ ID NO: 6336198 - DNA, 12 bp, Homo sapiens
gggctcattttc

SEQ ID NO: 6336199 - DNA, 19 bp, Homo sapiens
gggctccacacagcagtgt

SEQ ID NO: 6336200 - DNA, 18 bp, Homo sapiens
gggctccagcaccttctt

SEQ ID NO: 6336201 - DNA, 23 bp, Homo sapiens
gggctccagcaccttctttctgg

SEQ ID NO: 6336202 - DNA, 16 bp, Homo sapiens
gggctccagcatccag

SEQ ID NO: 6336203 - DNA, 23 bp, Homo sapiens
gggctccagcccctcttggagaa

SEQ ID NO: 6336204 - DNA, 13 bp, Homo sapiens
gggctccagcctg

SEQ ID NO: 6336205 - DNA, 12 bp, Homo sapiens
gggctccaggct

SEQ ID NO: 6336206 - DNA, 22 bp, Homo sapiens
gggctccagggggtgccctccc

SEQ ID NO: 6336207 - DNA, 18 bp, Homo sapiens
gggctccatgcctctgga

SEQ ID NO: 6336208 - DNA, 19 bp, Homo sapiens
gggctccatgcctctggag

SEQ ID NO: 6336209 - DNA, 21 bp, Homo sapiens
gggctccatgctgaaggctcc

SEQ ID NO: 6336210 - DNA, 13 bp, Homo sapiens
gggctccatggag

SEQ ID NO: 6336211 - DNA, 14 bp, Homo sapiens
gggctccatggagg

SEQ ID NO: 6336212 - DNA, 19 bp, Homo sapiens
gggctccatggaggaggtg

SEQ ID NO: 6336213 - DNA, 14 bp, Homo sapiens
gggctcccacgccc

SEQ ID NO: 6336214 - DNA, 15 bp, Homo sapiens
gggctcccagccagg

SEQ ID NO: 6336215 - DNA, 11 bp, Homo sapiens
gggctcccagg

SEQ ID NO: 6336216 - DNA, 12 bp, Homo sapiens
gggctccccagg

SEQ ID NO: 6336217 - DNA, 23 bp, Homo sapiens
gggctccccaggaagcccactgc

SEQ ID NO: 6336218 - DNA, 12 bp, Homo sapiens
gggctcccctct

SEQ ID NO: 6336219 - DNA, 21 bp, Homo sapiens
gggctccccttcgcgtatttc

SEQ ID NO: 6336220 - DNA, 13 bp, Homo sapiens
gggctccccttgc

SEQ ID NO: 6336221 - DNA, 16 bp, Homo sapiens
gggctccccttgccct

SEQ ID NO: 6336222 - DNA, 18 bp, Homo sapiens
gggctcccctttcgccca

SEQ ID NO: 6336223 - DNA, 13 bp, Homo sapiens
gggctcccgcctc

SEQ ID NO: 6336224 - DNA, 22 bp, Homo sapiens
gggctcccggagagggagtcag

SEQ ID NO: 6336225 - DNA, 20 bp, Homo sapiens
gggctccctacattccccag

SEQ ID NO: 6336226 - DNA, 14 bp, Homo sapiens
gggctccctcctct

SEQ ID NO: 6336227 - DNA, 20 bp, Homo sapiens
gggctccctcctctggcagg

SEQ ID NO: 6336228 - DNA, 21 bp, Homo sapiens
gggctccctcctggagcatcc

SEQ ID NO: 6336229 - DNA, 13 bp, Homo sapiens
gggctccctctct

SEQ ID NO: 6336230 - DNA, 14 bp, Homo sapiens
gggctccctgactg

SEQ ID NO: 6336231 - DNA, 18 bp, Homo sapiens
gggctccctgactgggag

SEQ ID NO: 6336232 - DNA, 16 bp, Homo sapiens
gggctccctggcagga

SEQ ID NO: 6336233 - DNA, 15 bp, Homo sapiens
gggctccctggccca

SEQ ID NO: 6336234 - DNA, 23 bp, Homo sapiens
gggctccctggcccagccagcca

SEQ ID NO: 6336235 - DNA, 17 bp, Homo sapiens
gggctcccttcccacct

SEQ ID NO: 6336236 - DNA, 13 bp, Homo sapiens
gggctcccttcct

SEQ ID NO: 6336237 - DNA, 16 bp, Homo sapiens
gggctccgctgtgccc

SEQ ID NO: 6336238 - DNA, 17 bp, Homo sapiens
gggctccgtgtgggaga

SEQ ID NO: 6336239 - DNA, 22 bp, Homo sapiens
gggctcctccagggtggcagca

SEQ ID NO: 6336240 - DNA, 23 bp, Homo sapiens
gggctcctccagggtggcagcaa

SEQ ID NO: 6336241 - DNA, 16 bp, Homo sapiens
gggctcctcctgaagg

SEQ ID NO: 6336242 - DNA, 18 bp, Homo sapiens
gggctcctcctgaaggag

SEQ ID NO: 6336243 - DNA, 16 bp, Homo sapiens
gggctcctcctgccct

SEQ ID NO: 6336244 - DNA, 18 bp, Homo sapiens
gggctcctgcacttactt

SEQ ID NO: 6336245 - DNA, 14 bp, Homo sapiens
gggctcctgcccag

SEQ ID NO: 6336246 - DNA, 16 bp, Homo sapiens
gggctcctgcccaggc

SEQ ID NO: 6336247 - DNA, 18 bp, Homo sapiens
gggctcctgccttctgtc

SEQ ID NO: 6336248 - DNA, 12 bp, Homo sapiens
gggctcctggaa

SEQ ID NO: 6336249 - DNA, 20 bp, Homo sapiens
gggctcctggaaaggctcag

SEQ ID NO: 6336250 - DNA, 13 bp, Homo sapiens
gggctcctggacc

SEQ ID NO: 6336251 - DNA, 18 bp, Homo sapiens
gggctcctggcagaaggg

SEQ ID NO: 6336252 - DNA, 14 bp, Homo sapiens
gggctcctggctgc

SEQ ID NO: 6336253 - DNA, 15 bp, Homo sapiens
gggctcctggctgcc

SEQ ID NO: 6336254 - DNA, 17 bp, Homo sapiens
gggctcctggctgccag

SEQ ID NO: 6336255 - DNA, 14 bp, Homo sapiens
gggctcctggggca

SEQ ID NO: 6336256 - DNA, 16 bp, Homo sapiens
gggctcctggggcaga

SEQ ID NO: 6336257 - DNA, 20 bp, Homo sapiens
gggctcctgggttggaggga

SEQ ID NO: 6336258 - DNA, 22 bp, Homo sapiens
gggctcctgggttggagggaac

SEQ ID NO: 6336259 - DNA, 15 bp, Homo sapiens
gggctccttcccctg

SEQ ID NO: 6336260 - DNA, 20 bp, Homo sapiens
gggctccttctccaccccag

SEQ ID NO: 6336261 - DNA, 12 bp, Homo sapiens
gggctcctttcc

SEQ ID NO: 6336262 - DNA, 10 bp, Homo sapiens
gtgtgtcctt

SEQ ID NO: 6336263 - DNA, 20 bp, Homo sapiens
gtgtgtccttgaactgaggc

SEQ ID NO: 6336264 - DNA, 23 bp, Homo sapiens
gtgtgtctatttggcaattcaca

SEQ ID NO: 6336265 - DNA, 16 bp, Homo sapiens
gtgtgtctcctgcatg

SEQ ID NO: 6336266 - DNA, 18 bp, Homo sapiens
gtgtgtctcgtgtcagta

SEQ ID NO: 6336267 - DNA, 22 bp, Homo sapiens
gtgtgtctcgtgtcagtaattt

SEQ ID NO: 6336268 - DNA, 13 bp, Homo sapiens
gtgtgtctgaaga

SEQ ID NO: 6336269 - DNA, 15 bp, Homo sapiens
gtgtgtctgaagact

SEQ ID NO: 6336270 - DNA, 15 bp, Homo sapiens
gtgtgtctgctcagt

SEQ ID NO: 6336271 - DNA, 13 bp, Homo sapiens
gtgtgtctgtcct

SEQ ID NO: 6336272 - DNA, 13 bp, Homo sapiens
gtgtgtctgtctt

SEQ ID NO: 6336273 - DNA, 11 bp, Homo sapiens
gtgtgtctgtg

SEQ ID NO: 6336274 - DNA, 13 bp, Homo sapiens
gtgtgtctgtgcg

SEQ ID NO: 6336275 - DNA, 22 bp, Homo sapiens
gtgtgtctgttcacttttcctc

SEQ ID NO: 6336276 - DNA, 16 bp, Homo sapiens
gtgtgtcttctgcccc

SEQ ID NO: 6336277 - DNA, 18 bp, Homo sapiens
gtgtgtctttataaagct

SEQ ID NO: 6336278 - DNA, 20 bp, Homo sapiens
gtgtgtctttcctccctgaa

SEQ ID NO: 6336279 - DNA, 18 bp, Homo sapiens
gtgtgtcttttataaaaa

SEQ ID NO: 6336280 - DNA, 19 bp, Homo sapiens
gtgtgtgaaaattcaggtg

SEQ ID NO: 6336281 - DNA, 22 bp, Homo sapiens
gtgtgtgacccctcctggggcc

SEQ ID NO: 6336282 - DNA, 14 bp, Homo sapiens
gtgtgtgagtgtga

SEQ ID NO: 6336283 - DNA, 10 bp, Homo sapiens
gtgtgtgcac

SEQ ID NO: 6336284 - DNA, 17 bp, Homo sapiens
gtgtgtgcagagctgaa

SEQ ID NO: 6336285 - DNA, 21 bp, Homo sapiens
gtgtgtgcagagtccatttcc

SEQ ID NO: 6336286 - DNA, 17 bp, Homo sapiens
gtgtgtgcatatgtgtg

SEQ ID NO: 6336287 - DNA, 13 bp, Homo sapiens
gtgtgtgcatgta

SEQ ID NO: 6336288 - DNA, 17 bp, Homo sapiens
gtgtgtgcatgtgccga

SEQ ID NO: 6336289 - DNA, 15 bp, Homo sapiens
gtgtgtgccaagccc

SEQ ID NO: 6336290 - DNA, 19 bp, Homo sapiens
gtgtgtgccaagccctggc

SEQ ID NO: 6336291 - DNA, 17 bp, Homo sapiens
gtgtgtgccatcatgcc

SEQ ID NO: 6336292 - DNA, 21 bp, Homo sapiens
gtgtgtgccctctgggctctg

SEQ ID NO: 6336293 - DNA, 15 bp, Homo sapiens
gtgtgtgccctgggc

SEQ ID NO: 6336294 - DNA, 24 bp, Homo sapiens
gtgtgtgccctgggccaggcaggc

SEQ ID NO: 6336295 - DNA, 21 bp, Homo sapiens
gtgtgtgcgcctacaggagtg

SEQ ID NO: 6336296 - DNA, 24 bp, Homo sapiens
gtgtgtggaaggcagggacagaga

SEQ ID NO: 6336297 - DNA, 17 bp, Homo sapiens
gtgtgtggcagagagag

SEQ ID NO: 6336298 - DNA, 14 bp, Homo sapiens
gtgtgtggccccgc

SEQ ID NO: 6336299 - DNA, 13 bp, Homo sapiens
gtgtgtgggcagg

SEQ ID NO: 6336300 - DNA, 14 bp, Homo sapiens
gtgtgtgggggaga

SEQ ID NO: 6336301 - DNA, 21 bp, Homo sapiens
gtgtgtgggtggatataaata

SEQ ID NO: 6336302 - DNA, 15 bp, Homo sapiens
gtgtgtgggtggggt

SEQ ID NO: 6336303 - DNA, 13 bp, Homo sapiens
gtgtgtggtgcac

SEQ ID NO: 6336304 - DNA, 15 bp, Homo sapiens
gtgtgtggttggaaa

SEQ ID NO: 6336305 - DNA, 15 bp, Homo sapiens
gtgtgtgtatatata

SEQ ID NO: 6336306 - DNA, 15 bp, Homo sapiens
gtgtgtgtatgtata

SEQ ID NO: 6336307 - DNA, 13 bp, Homo sapiens
gtgtgtgtatgtg

SEQ ID NO: 6336308 - DNA, 14 bp, Homo sapiens
gtgtgtgtatgtgg

SEQ ID NO: 6336309 - DNA, 17 bp, Homo sapiens
gtgtgtgtatgtttgca

SEQ ID NO: 6336310 - DNA, 15 bp, Homo sapiens
gtgtgtgtctgcttt

SEQ ID NO: 6336311 - DNA, 11 bp, Homo sapiens
gtgtgtgtgca

SEQ ID NO: 6336312 - DNA, 15 bp, Homo sapiens
gtgtgtgtgcatgtg

SEQ ID NO: 6336313 - DNA, 15 bp, Homo sapiens
gtgtgtgtgcgtgtt

SEQ ID NO: 6336314 - DNA, 15 bp, Homo sapiens
gtgtgtgtggacagc

SEQ ID NO: 6336315 - DNA, 13 bp, Homo sapiens
gtgtgtgtggccg

SEQ ID NO: 6336316 - DNA, 10 bp, Homo sapiens
gtgtgtgtgt

SEQ ID NO: 6336317 - DNA, 12 bp, Homo sapiens
gtgtgtgtgtga

SEQ ID NO: 6336318 - DNA, 14 bp, Homo sapiens
gtgtgtgtgtgaaa

SEQ ID NO: 6336319 - DNA, 13 bp, Homo sapiens
gtgtgtgtgtgcg

SEQ ID NO: 6336320 - DNA, 16 bp, Homo sapiens
gtgtgtgtgtgtatgt

SEQ ID NO: 6336321 - DNA, 20 bp, Homo sapiens
gtgtgttatattccaaggaa

SEQ ID NO: 6336322 - DNA, 23 bp, Homo sapiens
gtgtgttatgggtgctgaactct

SEQ ID NO: 6336323 - DNA, 23 bp, Homo sapiens
gtgtgttatttccccagccacag

SEQ ID NO: 6336324 - DNA, 22 bp, Homo sapiens
gtgtgttcaccttcaaaatgtt

SEQ ID NO: 6336325 - DNA, 23 bp, Homo sapiens
gtgtgttcaccttcaaaatgttc

SEQ ID NO: 6336326 - DNA, 20 bp, Homo sapiens
gtgtgttcagtagttccagg

SEQ ID NO: 6336327 - DNA, 18 bp, Homo sapiens
gtgtgttccaactgcccc

SEQ ID NO: 6336328 - DNA, 16 bp, Homo sapiens
gtgtgttccaagtttc

SEQ ID NO: 6336329 - DNA, 11 bp, Homo sapiens
gtgtgttcctg

SEQ ID NO: 6336330 - DNA, 20 bp, Homo sapiens
gtgtgttcgttgcacagctg

SEQ ID NO: 6336331 - DNA, 21 bp, Homo sapiens
gtgtgttcgttgcacagctgt

SEQ ID NO: 6336332 - DNA, 13 bp, Homo sapiens
gtgtgttctgatg

SEQ ID NO: 6336333 - DNA, 18 bp, Homo sapiens
gtgtgttctgattagaaa

SEQ ID NO: 6336334 - DNA, 12 bp, Homo sapiens
gtgtgttctgta

SEQ ID NO: 6336335 - DNA, 22 bp, Homo sapiens
gtgtgttcttcaagccagctct

SEQ ID NO: 6336336 - DNA, 18 bp, Homo sapiens
gtgtgttcttttgataca

SEQ ID NO: 6336337 - DNA, 21 bp, Homo sapiens
gtgtgttcttttgatacattt

SEQ ID NO: 6336338 - DNA, 19 bp, Homo sapiens
gtgtgttgatactgttgca

SEQ ID NO: 6336339 - DNA, 15 bp, Homo sapiens
gtgtgttgccacagg

SEQ ID NO: 6336340 - DNA, 16 bp, Homo sapiens
gtgtgttgtctgtgca

SEQ ID NO: 6336341 - DNA, 21 bp, Homo sapiens
gtgtgttgtctgtgcagctgc

SEQ ID NO: 6336342 - DNA, 12 bp, Homo sapiens
gtgtgttgtgtg

SEQ ID NO: 6336343 - DNA, 14 bp, Homo sapiens
gtgtgttgtgtgtg

SEQ ID NO: 6336344 - DNA, 13 bp, Homo sapiens
gtgtgttgtttcc

SEQ ID NO: 6336345 - DNA, 15 bp, Homo sapiens
gtgtgtttaaataaa

SEQ ID NO: 6336346 - DNA, 23 bp, Homo sapiens
gtgtgtttccagatcgatcctgg

SEQ ID NO: 6336347 - DNA, 13 bp, Homo sapiens
gtgtgtttcccta

SEQ ID NO: 6336348 - DNA, 15 bp, Homo sapiens
gtgtgtttcttgctt

SEQ ID NO: 6336349 - DNA, 16 bp, Homo sapiens
gtgtgtttcttgcttt

SEQ ID NO: 6336350 - DNA, 20 bp, Homo sapiens
gtgtgtttggcttggccttg

SEQ ID NO: 6336351 - DNA, 19 bp, Homo sapiens
gtgtgtttgtgagtatgtg

SEQ ID NO: 6336352 - DNA, 13 bp, Homo sapiens
gtgtgttttaaaa

SEQ ID NO: 6336353 - DNA, 19 bp, Homo sapiens
gtgtgttttaaaatgagaa

SEQ ID NO: 6336354 - DNA, 13 bp, Homo sapiens
gtgtgttttcaat

SEQ ID NO: 6336355 - DNA, 21 bp, Homo sapiens
gtgtgttttgagagtatatta

SEQ ID NO: 6336356 - DNA, 12 bp, Homo sapiens
gtgtgtttttat

SEQ ID NO: 6336357 - DNA, 21 bp, Homo sapiens
gtgtgtttttgggatgtctta

SEQ ID NO: 6336358 - DNA, 14 bp, Homo sapiens
gtgttaaaattttt

SEQ ID NO: 6336359 - DNA, 19 bp, Homo sapiens
gtgttaaaggttttctcta

SEQ ID NO: 6336360 - DNA, 13 bp, Homo sapiens
gtgttaaattcat

SEQ ID NO: 6336361 - DNA, 14 bp, Homo sapiens
gtgttaacagaagg

SEQ ID NO: 6336362 - DNA, 14 bp, Homo sapiens
gtgttaacattcca

SEQ ID NO: 6336363 - DNA, 12 bp, Homo sapiens
gtgttaacgtgc

SEQ ID NO: 6336364 - DNA, 16 bp, Homo sapiens
gtgttaataaatggat

SEQ ID NO: 6336365 - DNA, 19 bp, Homo sapiens
gtgttaatactagttgtga

SEQ ID NO: 6336366 - DNA, 15 bp, Homo sapiens
gtgttaatcaattta

SEQ ID NO: 6336367 - DNA, 18 bp, Homo sapiens
gtgttaatcaatttaaac

SEQ ID NO: 6336368 - DNA, 20 bp, Homo sapiens
gtgttaattataaacagcag

SEQ ID NO: 6336369 - DNA, 12 bp, Homo sapiens
gtgttaatttat

SEQ ID NO: 6336370 - DNA, 12 bp, Homo sapiens
gtgttaattttt

SEQ ID NO: 6336371 - DNA, 15 bp, Homo sapiens
gtgttaatttttgat

SEQ ID NO: 6336372 - DNA, 13 bp, Homo sapiens
gtgttacacatac

SEQ ID NO: 6336373 - DNA, 20 bp, Homo sapiens
gtgttactaaaaaaaagatg

SEQ ID NO: 6336374 - DNA, 16 bp, Homo sapiens
gtgttactaaagtcac

SEQ ID NO: 6336375 - DNA, 14 bp, Homo sapiens
gtgttactaagttt

SEQ ID NO: 6336376 - DNA, 19 bp, Homo sapiens
gtgttactgctttgcaaag

SEQ ID NO: 6336377 - DNA, 20 bp, Homo sapiens
gtgttactgctttgcaaaga

SEQ ID NO: 6336378 - DNA, 17 bp, Homo sapiens
gtgttacttgaagtaac

SEQ ID NO: 6336379 - DNA, 18 bp, Homo sapiens
gtgttagaaaaaactgga

SEQ ID NO: 6336380 - DNA, 21 bp, Homo sapiens
gtgttagactatagcccctgg

SEQ ID NO: 6336381 - DNA, 19 bp, Homo sapiens
gtgttaggaggctgcatgc

SEQ ID NO: 6336382 - DNA, 14 bp, Homo sapiens
gtgttagtggcacc

SEQ ID NO: 6336383 - DNA, 14 bp, Homo sapiens
gtgttagtgggaag

SEQ ID NO: 6336384 - DNA, 21 bp, Homo sapiens
gtgttagtgggaagagctggg

SEQ ID NO: 6336385 - DNA, 18 bp, Homo sapiens
gtgttagtgtgtgtgcat

SEQ ID NO: 6336386 - DNA, 18 bp, Homo sapiens
gtgttatattccaaggaa

SEQ ID NO: 6336387 - DNA, 21 bp, Homo sapiens
gtgttatcggacattctaatg

SEQ ID NO: 6336388 - DNA, 17 bp, Homo sapiens
gtgttatcttttgaatt

SEQ ID NO: 6336389 - DNA, 18 bp, Homo sapiens
gtgttatgactccagaat

SEQ ID NO: 6336390 - DNA, 15 bp, Homo sapiens
gtgttatgagccagg

SEQ ID NO: 6336391 - DNA, 17 bp, Homo sapiens
gtgttattattattata

SEQ ID NO: 6336392 - DNA, 16 bp, Homo sapiens
gtgttattctttgcgt

SEQ ID NO: 6336393 - DNA, 22 bp, Homo sapiens
gtgttattgagagagatgtgta

SEQ ID NO: 6336394 - DNA, 24 bp, Homo sapiens
gtgttattgagagagatgtgtaat

SEQ ID NO: 6336395 - DNA, 13 bp, Homo sapiens
gtgttattgcatg

SEQ ID NO: 6336396 - DNA, 21 bp, Homo sapiens
gtgttatttattgctacttcc

SEQ ID NO: 6336397 - DNA, 16 bp, Homo sapiens
gtgttatttcagatga

SEQ ID NO: 6336398 - DNA, 19 bp, Homo sapiens
gtgttatttcatccaggga

SEQ ID NO: 6336399 - DNA, 21 bp, Homo sapiens
gtgttatttccccagccacag

SEQ ID NO: 6336400 - DNA, 20 bp, Homo sapiens
gtgttattttcattcaaagt

SEQ ID NO: 6336401 - DNA, 18 bp, Homo sapiens
gtgttcaaaatactactg

SEQ ID NO: 6336402 - DNA, 15 bp, Homo sapiens
gtgttcaaattctga

SEQ ID NO: 6336403 - DNA, 16 bp, Homo sapiens
gtgttcaaattctgat

SEQ ID NO: 6336404 - DNA, 14 bp, Homo sapiens
gtgttcaatattta

SEQ ID NO: 6336405 - DNA, 23 bp, Homo sapiens
gtgttcaatatttagaaaatttt

SEQ ID NO: 6336406 - DNA, 19 bp, Homo sapiens
gtgttcacactgtaaacat

SEQ ID NO: 6336407 - DNA, 20 bp, Homo sapiens
gtgttcacactgtaaacatt

SEQ ID NO: 6336408 - DNA, 16 bp, Homo sapiens
gtgttcactgaagacg

SEQ ID NO: 6336409 - DNA, 14 bp, Homo sapiens
gtgttcagaaaaaa

SEQ ID NO: 6336410 - DNA, 21 bp, Homo sapiens
gtgttcagaagaatcttcctg

SEQ ID NO: 6336411 - DNA, 16 bp, Homo sapiens
gtgttcaggcattcca

SEQ ID NO: 6336412 - DNA, 17 bp, Homo sapiens
gtgttcagtgttgacat

SEQ ID NO: 6336413 - DNA, 21 bp, Homo sapiens
gtgttcagtgttgacatagcc

SEQ ID NO: 6336414 - DNA, 22 bp, Homo sapiens
gtgttcatccagctacttagct

SEQ ID NO: 6336415 - DNA, 21 bp, Homo sapiens
gtgttcatgcgaattcttgct

SEQ ID NO: 6336416 - DNA, 21 bp, Homo sapiens
gtgttccagccaaagcatgcc

SEQ ID NO: 6336417 - DNA, 20 bp, Homo sapiens
gtgttccagtgtctgtctga

SEQ ID NO: 6336418 - DNA, 20 bp, Homo sapiens
gtgttccccccatagagacc

SEQ ID NO: 6336419 - DNA, 23 bp, Homo sapiens
gtgttccccttccactgagggca

SEQ ID NO: 6336420 - DNA, 13 bp, Homo sapiens
gtgttcccgtgcc

SEQ ID NO: 6336421 - DNA, 15 bp, Homo sapiens
gtgttcccgtgcctg

SEQ ID NO: 6336422 - DNA, 20 bp, Homo sapiens
gtgttccctttgtctttcaa

SEQ ID NO: 6336423 - DNA, 21 bp, Homo sapiens
gtgttcctataaaatcaaaga

SEQ ID NO: 6336424 - DNA, 22 bp, Homo sapiens
gtgttcctcggtgggccagagc

SEQ ID NO: 6336425 - DNA, 16 bp, Homo sapiens
gtgttcctctttgcat

SEQ ID NO: 6336426 - DNA, 16 bp, Homo sapiens
gtgttcctgaagctgc

SEQ ID NO: 6336427 - DNA, 17 bp, Homo sapiens
gtgttcctgaagctgct

SEQ ID NO: 6336428 - DNA, 20 bp, Homo sapiens
gtgttcctgaagctgctgtg

SEQ ID NO: 6336429 - DNA, 22 bp, Homo sapiens
gtgttcctgaagctgctgtgtc

SEQ ID NO: 6336430 - DNA, 11 bp, Homo sapiens
gtgttcctgga

SEQ ID NO: 6336431 - DNA, 15 bp, Homo sapiens
gtgttcctggaagca

SEQ ID NO: 6336432 - DNA, 15 bp, Homo sapiens
gtgttcctgtctcaa

SEQ ID NO: 6336433 - DNA, 23 bp, Homo sapiens
gtgttcctgtgcttatattcagt

SEQ ID NO: 6336434 - DNA, 18 bp, Homo sapiens
gtgttccttctgtgaaga

SEQ ID NO: 6336435 - DNA, 19 bp, Homo sapiens
gtgttccttctgtgaagaa

SEQ ID NO: 6336436 - DNA, 21 bp, Homo sapiens
gtgttcgtggagccacaggca

SEQ ID NO: 6336437 - DNA, 11 bp, Homo sapiens
gtgttcgttct

SEQ ID NO: 6336438 - DNA, 15 bp, Homo sapiens
gtgttcgttcttgtt

SEQ ID NO: 6336439 - DNA, 20 bp, Homo sapiens
gtgttcgttgcacagctgtt

SEQ ID NO: 6336440 - DNA, 14 bp, Homo sapiens
gtgttcgtttccat

SEQ ID NO: 6336441 - DNA, 17 bp, Homo sapiens
gtgttcgtttccatcat

SEQ ID NO: 6336442 - DNA, 14 bp, Homo sapiens
gggctcgcactgcc

SEQ ID NO: 6336443 - DNA, 16 bp, Homo sapiens
gggctctaacgcctga

SEQ ID NO: 6336444 - DNA, 18 bp, Homo sapiens
gggctctaacgcctgagc

SEQ ID NO: 6336445 - DNA, 22 bp, Homo sapiens
gggctctaacgcctgagcccag

SEQ ID NO: 6336446 - DNA, 23 bp, Homo sapiens
gggctctaacgcctgagcccagg

SEQ ID NO: 6336447 - DNA, 13 bp, Homo sapiens
gggctctacctct

SEQ ID NO: 6336448 - DNA, 15 bp, Homo sapiens
gggctctagaattcc

SEQ ID NO: 6336449 - DNA, 16 bp, Homo sapiens
gggctctatgcctgca

SEQ ID NO: 6336450 - DNA, 22 bp, Homo sapiens
gggctctatgcctgcactggga

SEQ ID NO: 6336451 - DNA, 13 bp, Homo sapiens
gggctctcagctc

SEQ ID NO: 6336452 - DNA, 13 bp, Homo sapiens
gggctctccaaag

SEQ ID NO: 6336453 - DNA, 21 bp, Homo sapiens
gggctctccaaaggggctgct

SEQ ID NO: 6336454 - DNA, 23 bp, Homo sapiens
gggctctccaaaggggctgctgg

SEQ ID NO: 6336455 - DNA, 13 bp, Homo sapiens
gggctctccacct

SEQ ID NO: 6336456 - DNA, 14 bp, Homo sapiens
gggctctccacctc

SEQ ID NO: 6336457 - DNA, 17 bp, Homo sapiens
gggctctccacctcagc

SEQ ID NO: 6336458 - DNA, 14 bp, Homo sapiens
gggctctcctgccc

SEQ ID NO: 6336459 - DNA, 14 bp, Homo sapiens
gggctctctggacc

SEQ ID NO: 6336460 - DNA, 15 bp, Homo sapiens
gggctctctggacca

SEQ ID NO: 6336461 - DNA, 18 bp, Homo sapiens
gggctctgaaataaaaat

SEQ ID NO: 6336462 - DNA, 23 bp, Homo sapiens
gggctctgacagccctgcggaga

SEQ ID NO: 6336463 - DNA, 12 bp, Homo sapiens
gggctctgaggc

SEQ ID NO: 6336464 - DNA, 10 bp, Homo sapiens
gggctctgat

SEQ ID NO: 6336465 - DNA, 23 bp, Homo sapiens
gggctctgcaattcccctctgct

SEQ ID NO: 6336466 - DNA, 16 bp, Homo sapiens
gggctctgcacccacg

SEQ ID NO: 6336467 - DNA, 11 bp, Homo sapiens
gggctctgcag

SEQ ID NO: 6336468 - DNA, 16 bp, Homo sapiens
gggctctgcaggccac

SEQ ID NO: 6336469 - DNA, 21 bp, Homo sapiens
gggctctgccaatgtgggctg

SEQ ID NO: 6336470 - DNA, 14 bp, Homo sapiens
gggctctgccccag

SEQ ID NO: 6336471 - DNA, 23 bp, Homo sapiens
gggctctgccccagaggcctctc

SEQ ID NO: 6336472 - DNA, 19 bp, Homo sapiens
gggctctgccccagctctg

SEQ ID NO: 6336473 - DNA, 20 bp, Homo sapiens
gggctctgccccagctctgg

SEQ ID NO: 6336474 - DNA, 18 bp, Homo sapiens
gggctctgccccaggccc

SEQ ID NO: 6336475 - DNA, 15 bp, Homo sapiens
gggctctgccccagt

SEQ ID NO: 6336476 - DNA, 11 bp, Homo sapiens
gggctctgcct

SEQ ID NO: 6336477 - DNA, 20 bp, Homo sapiens
gggctctgccttctcaggcc

SEQ ID NO: 6336478 - DNA, 11 bp, Homo sapiens
gggctctggac

SEQ ID NO: 6336479 - DNA, 18 bp, Homo sapiens
gggctctggacctcagga

SEQ ID NO: 6336480 - DNA, 13 bp, Homo sapiens
gggctctggactc

SEQ ID NO: 6336481 - DNA, 14 bp, Homo sapiens
gggctctggagaga

SEQ ID NO: 6336482 - DNA, 16 bp, Homo sapiens
gggctctggccaaggg

SEQ ID NO: 6336483 - DNA, 19 bp, Homo sapiens
gggctctggccaagggcca

SEQ ID NO: 6336484 - DNA, 13 bp, Homo sapiens
gggctctggccac

SEQ ID NO: 6336485 - DNA, 19 bp, Homo sapiens
gggctctggccaccctggc

SEQ ID NO: 6336486 - DNA, 13 bp, Homo sapiens
gggctctggtggg

SEQ ID NO: 6336487 - DNA, 19 bp, Homo sapiens
gggctctgtctacccagtg

SEQ ID NO: 6336488 - DNA, 16 bp, Homo sapiens
gggctctgtcttcctg

SEQ ID NO: 6336489 - DNA, 14 bp, Homo sapiens
gggctctgtgggct

SEQ ID NO: 6336490 - DNA, 19 bp, Homo sapiens
gggctctgtgggctgcact

SEQ ID NO: 6336491 - DNA, 16 bp, Homo sapiens
gggctctgtgttagga

SEQ ID NO: 6336492 - DNA, 16 bp, Homo sapiens
gggctctgttacacta

SEQ ID NO: 6336493 - DNA, 19 bp, Homo sapiens
gggctcttcatctgcctgc

SEQ ID NO: 6336494 - DNA, 11 bp, Homo sapiens
gggctcttccc

SEQ ID NO: 6336495 - DNA, 23 bp, Homo sapiens
gggctcttcccctagacctcccc

SEQ ID NO: 6336496 - DNA, 22 bp, Homo sapiens
gggctcttctcaggggctctag

SEQ ID NO: 6336497 - DNA, 17 bp, Homo sapiens
gggctcttttcctgctg

SEQ ID NO: 6336498 - DNA, 19 bp, Homo sapiens
gggctgaacatgcctgcca

SEQ ID NO: 6336499 - DNA, 21 bp, Homo sapiens
gggctgaaccctcagccttga

SEQ ID NO: 6336500 - DNA, 17 bp, Homo sapiens
gggctgaagccacacag

SEQ ID NO: 6336501 - DNA, 19 bp, Homo sapiens
gggctgaagccacacagcc

SEQ ID NO: 6336502 - DNA, 22 bp, Homo sapiens
gggctgaagccacacagcccag

SEQ ID NO: 6336503 - DNA, 23 bp, Homo sapiens
gggctgaagccacacagcccaga

SEQ ID NO: 6336504 - DNA, 17 bp, Homo sapiens
gggctgaaggttgaaga

SEQ ID NO: 6336505 - DNA, 17 bp, Homo sapiens
gggctgaatcttctgga

SEQ ID NO: 6336506 - DNA, 15 bp, Homo sapiens
gggctgacacccagg

SEQ ID NO: 6336507 - DNA, 23 bp, Homo sapiens
gggctgacccagtgtgtgctcag

SEQ ID NO: 6336508 - DNA, 20 bp, Homo sapiens
gggctgaccttcctcgcaga

SEQ ID NO: 6336509 - DNA, 17 bp, Homo sapiens
gggctgactgggccaca

SEQ ID NO: 6336510 - DNA, 16 bp, Homo sapiens
gggctgagagggctgt

SEQ ID NO: 6336511 - DNA, 11 bp, Homo sapiens
gggctgagagt

SEQ ID NO: 6336512 - DNA, 16 bp, Homo sapiens
gggctgagagtggggc

SEQ ID NO: 6336513 - DNA, 16 bp, Homo sapiens
gggctgagatgagtga

SEQ ID NO: 6336514 - DNA, 23 bp, Homo sapiens
gggctgagccaaagccagagtgg

SEQ ID NO: 6336515 - DNA, 14 bp, Homo sapiens
gggctgagccatgg

SEQ ID NO: 6336516 - DNA, 15 bp, Homo sapiens
gggctgagcccctac

SEQ ID NO: 6336517 - DNA, 14 bp, Homo sapiens
gggctgagcccctc

SEQ ID NO: 6336518 - DNA, 19 bp, Homo sapiens
gggctgagcccctcctctc

SEQ ID NO: 6336519 - DNA, 13 bp, Homo sapiens
gggctgagccctg

SEQ ID NO: 6336520 - DNA, 15 bp, Homo sapiens
gggctgagccctggc

SEQ ID NO: 6336521 - DNA, 16 bp, Homo sapiens
gggctgagccctggca

SEQ ID NO: 6336522 - DNA, 22 bp, Homo sapiens
gggctgagcctgaggccttcca

SEQ ID NO: 6336523 - DNA, 17 bp, Homo sapiens
gggctgagcgtggaagg

SEQ ID NO: 6336524 - DNA, 23 bp, Homo sapiens
gggctgagcgtggaagggggagg

SEQ ID NO: 6336525 - DNA, 13 bp, Homo sapiens
gggctgagctggg

SEQ ID NO: 6336526 - DNA, 16 bp, Homo sapiens
gggctgaggagcagcc

SEQ ID NO: 6336527 - DNA, 20 bp, Homo sapiens
gggctgaggagcagccagga

SEQ ID NO: 6336528 - DNA, 14 bp, Homo sapiens
gggctgaggccaga

SEQ ID NO: 6336529 - DNA, 15 bp, Homo sapiens
gggctgaggccagag

SEQ ID NO: 6336530 - DNA, 14 bp, Homo sapiens
gggctgagggagcc

SEQ ID NO: 6336531 - DNA, 21 bp, Homo sapiens
gggctgaggggcctgcgccca

SEQ ID NO: 6336532 - DNA, 16 bp, Homo sapiens
gggctgaggtgggagg

SEQ ID NO: 6336533 - DNA, 12 bp, Homo sapiens
gggctgagtctg

SEQ ID NO: 6336534 - DNA, 15 bp, Homo sapiens
gggctgagtgcagcc

SEQ ID NO: 6336535 - DNA, 18 bp, Homo sapiens
gggctgatctcagggaag

SEQ ID NO: 6336536 - DNA, 21 bp, Homo sapiens
gggctgatggattccaaacca

SEQ ID NO: 6336537 - DNA, 21 bp, Homo sapiens
gggctgatgggtgccctttcc

SEQ ID NO: 6336538 - DNA, 14 bp, Homo sapiens
gggctgatttacat

SEQ ID NO: 6336539 - DNA, 17 bp, Homo sapiens
gggctgcaaaactggaa

SEQ ID NO: 6336540 - DNA, 14 bp, Homo sapiens
gggctgcagaagat

SEQ ID NO: 6336541 - DNA, 19 bp, Homo sapiens
gggctgcagcatgttgctg

SEQ ID NO: 6336542 - DNA, 19 bp, Homo sapiens
gggctgcagccccctgctt

SEQ ID NO: 6336543 - DNA, 18 bp, Homo sapiens
gggctgcagcccgccttg

SEQ ID NO: 6336544 - DNA, 21 bp, Homo sapiens
gggctgcaggcaggcggctcc

SEQ ID NO: 6336545 - DNA, 22 bp, Homo sapiens
gggctgcagggccactggaagg

SEQ ID NO: 6336546 - DNA, 15 bp, Homo sapiens
gggctgcagggctgg

SEQ ID NO: 6336547 - DNA, 20 bp, Homo sapiens
gggctgcagggctgggtcag

SEQ ID NO: 6336548 - DNA, 18 bp, Homo sapiens
gggctgccaccagccccc

SEQ ID NO: 6336549 - DNA, 17 bp, Homo sapiens
gggctgccagcagcccc

SEQ ID NO: 6336550 - DNA, 18 bp, Homo sapiens
gggctgccagcagccccg

SEQ ID NO: 6336551 - DNA, 15 bp, Homo sapiens
gggctgccagcccag

SEQ ID NO: 6336552 - DNA, 16 bp, Homo sapiens
gggctgccagcccagc

SEQ ID NO: 6336553 - DNA, 18 bp, Homo sapiens
gggctgccagcccagctg

SEQ ID NO: 6336554 - DNA, 14 bp, Homo sapiens
gggctgccagcctg

SEQ ID NO: 6336555 - DNA, 20 bp, Homo sapiens
gggctgccagcctgagcgga

SEQ ID NO: 6336556 - DNA, 22 bp, Homo sapiens
gggctgcccacctggctgccaa

SEQ ID NO: 6336557 - DNA, 17 bp, Homo sapiens
gggctgcccagctgctc

SEQ ID NO: 6336558 - DNA, 23 bp, Homo sapiens
gggctgcccagctgctcccctgc

SEQ ID NO: 6336559 - DNA, 20 bp, Homo sapiens
gggctgcccctaatctctgt

SEQ ID NO: 6336560 - DNA, 20 bp, Homo sapiens
gggctgcccctcgcacacag

SEQ ID NO: 6336561 - DNA, 18 bp, Homo sapiens
gggctgcccgctcccagt

SEQ ID NO: 6336562 - DNA, 14 bp, Homo sapiens
gggctgccctggtg

SEQ ID NO: 6336563 - DNA, 19 bp, Homo sapiens
gggctgcccttcgctgcca

SEQ ID NO: 6336564 - DNA, 22 bp, Homo sapiens
gggctgcccttcgctgccagga

SEQ ID NO: 6336565 - DNA, 19 bp, Homo sapiens
gggctgccgggccaggcgc

SEQ ID NO: 6336566 - DNA, 21 bp, Homo sapiens
gggctgccgtgcacggggcca

SEQ ID NO: 6336567 - DNA, 22 bp, Homo sapiens
gggctgccgtgcacggggccag

SEQ ID NO: 6336568 - DNA, 10 bp, Homo sapiens
gggctgcctc

SEQ ID NO: 6336569 - DNA, 20 bp, Homo sapiens
gggctgcctcctcctgagag

SEQ ID NO: 6336570 - DNA, 21 bp, Homo sapiens
gggctgcctgcccctgctgct

SEQ ID NO: 6336571 - DNA, 12 bp, Homo sapiens
gggctgcctggg

SEQ ID NO: 6336572 - DNA, 12 bp, Homo sapiens
gggctgcctttg

SEQ ID NO: 6336573 - DNA, 24 bp, Homo sapiens
gggctgcctttgtggtgggcgctg

SEQ ID NO: 6336574 - DNA, 16 bp, Homo sapiens
gggctgcgtccctgct

SEQ ID NO: 6336575 - DNA, 21 bp, Homo sapiens
gggctgcgtccctgctcagcc

SEQ ID NO: 6336576 - DNA, 23 bp, Homo sapiens
gggctgcgtccctgctcagccca

SEQ ID NO: 6336577 - DNA, 22 bp, Homo sapiens
gggctgctcatcacccagtcct

SEQ ID NO: 6336578 - DNA, 13 bp, Homo sapiens
gggctgctcccac

SEQ ID NO: 6336579 - DNA, 11 bp, Homo sapiens
gggctgctcct

SEQ ID NO: 6336580 - DNA, 14 bp, Homo sapiens
gggctgctcctcat

SEQ ID NO: 6336581 - DNA, 19 bp, Homo sapiens
gggctgctctttccacttg

SEQ ID NO: 6336582 - DNA, 17 bp, Homo sapiens
gggctgctgacctccac

SEQ ID NO: 6336583 - DNA, 16 bp, Homo sapiens
gggctgctgcactgcc

SEQ ID NO: 6336584 - DNA, 14 bp, Homo sapiens
gggctgctgcaggc

SEQ ID NO: 6336585 - DNA, 18 bp, Homo sapiens
gggctgctgctcctctct

SEQ ID NO: 6336586 - DNA, 12 bp, Homo sapiens
gggctgctgggg

SEQ ID NO: 6336587 - DNA, 15 bp, Homo sapiens
gggctgctggggcag

SEQ ID NO: 6336588 - DNA, 16 bp, Homo sapiens
gggctgctggggcagg

SEQ ID NO: 6336589 - DNA, 16 bp, Homo sapiens
gggctgctggggcatg

SEQ ID NO: 6336590 - DNA, 13 bp, Homo sapiens
gggctgctggggg

SEQ ID NO: 6336591 - DNA, 15 bp, Homo sapiens
gggctgctgtggccc

SEQ ID NO: 6336592 - DNA, 14 bp, Homo sapiens
gggctgcttttctt

SEQ ID NO: 6336593 - DNA, 15 bp, Homo sapiens
gggctggaagcagaa

SEQ ID NO: 6336594 - DNA, 16 bp, Homo sapiens
gggctggaaggacctg

SEQ ID NO: 6336595 - DNA, 21 bp, Homo sapiens
gggctggaatctggagagcta

SEQ ID NO: 6336596 - DNA, 16 bp, Homo sapiens
gggctggaatgggaga

SEQ ID NO: 6336597 - DNA, 20 bp, Homo sapiens
gggctggaatgggagacctg

SEQ ID NO: 6336598 - DNA, 15 bp, Homo sapiens
gggctggacctgctg

SEQ ID NO: 6336599 - DNA, 15 bp, Homo sapiens
gggctggactgaggc

SEQ ID NO: 6336600 - DNA, 17 bp, Homo sapiens
gggctggactggctgtc

SEQ ID NO: 6336601 - DNA, 16 bp, Homo sapiens
gggctggagaaagagc

SEQ ID NO: 6336602 - DNA, 19 bp, Homo sapiens
gggctggagaaagagctgc

SEQ ID NO: 6336603 - DNA, 23 bp, Homo sapiens
gggctggagaaagagctgcctgg

SEQ ID NO: 6336604 - DNA, 17 bp, Homo sapiens
gggctggagcctggggt

SEQ ID NO: 6336605 - DNA, 14 bp, Homo sapiens
gggctggaggagcc

SEQ ID NO: 6336606 - DNA, 23 bp, Homo sapiens
gggctggaggagcccaggccagg

SEQ ID NO: 6336607 - DNA, 15 bp, Homo sapiens
gggctggagggaagg

SEQ ID NO: 6336608 - DNA, 20 bp, Homo sapiens
gggctggagggaagggcaca

SEQ ID NO: 6336609 - DNA, 20 bp, Homo sapiens
gggctggagggctgggcagg

SEQ ID NO: 6336610 - DNA, 16 bp, Homo sapiens
gggctggaggtggcgc

SEQ ID NO: 6336611 - DNA, 17 bp, Homo sapiens
gggctggatggacagac

SEQ ID NO: 6336612 - DNA, 13 bp, Homo sapiens
gggctggcaagca

SEQ ID NO: 6336613 - DNA, 17 bp, Homo sapiens
gggctggcaagcaggga

SEQ ID NO: 6336614 - DNA, 16 bp, Homo sapiens
gggctggcacagcccc

SEQ ID NO: 6336615 - DNA, 14 bp, Homo sapiens
gggctggcaccagc

SEQ ID NO: 6336616 - DNA, 19 bp, Homo sapiens
gggctggcaccagcaggca

SEQ ID NO: 6336617 - DNA, 14 bp, Homo sapiens
gggctggcagggcg

SEQ ID NO: 6336618 - DNA, 16 bp, Homo sapiens
gggctggcatggggag

SEQ ID NO: 6336619 - DNA, 23 bp, Homo sapiens
gggctggcatggggaggggagag

SEQ ID NO: 6336620 - DNA, 17 bp, Homo sapiens
gggctggccatgagggt

SEQ ID NO: 6336621 - DNA, 16 bp, Homo sapiens
gggctggcccagccaa

SEQ ID NO: 6336622 - DNA, 14 bp, Homo sapiens
gtgttctaaaatga

SEQ ID NO: 6336623 - DNA, 15 bp, Homo sapiens
gtgttctaagactct

SEQ ID NO: 6336624 - DNA, 16 bp, Homo sapiens
gtgttctaagactctg

SEQ ID NO: 6336625 - DNA, 22 bp, Homo sapiens
gtgttctaagatgtgatattct

SEQ ID NO: 6336626 - DNA, 14 bp, Homo sapiens
gtgttctaagcaat

SEQ ID NO: 6336627 - DNA, 14 bp, Homo sapiens
gtgttctattaatc

SEQ ID NO: 6336628 - DNA, 14 bp, Homo sapiens
gtgttctcaacaca

SEQ ID NO: 6336629 - DNA, 17 bp, Homo sapiens
gtgttctcaacacacag

SEQ ID NO: 6336630 - DNA, 19 bp, Homo sapiens
gtgttctcaatgcttttct

SEQ ID NO: 6336631 - DNA, 16 bp, Homo sapiens
gtgttctcatgaagca

SEQ ID NO: 6336632 - DNA, 18 bp, Homo sapiens
gtgttctcatgaagcagg

SEQ ID NO: 6336633 - DNA, 20 bp, Homo sapiens
gtgttctcctgctgctccct

SEQ ID NO: 6336634 - DNA, 11 bp, Homo sapiens
gtgttctcctt

SEQ ID NO: 6336635 - DNA, 16 bp, Homo sapiens
gtgttctccttttcct

SEQ ID NO: 6336636 - DNA, 14 bp, Homo sapiens
gtgttctctccgga

SEQ ID NO: 6336637 - DNA, 21 bp, Homo sapiens
gtgttctgaaggtgcccagga

SEQ ID NO: 6336638 - DNA, 16 bp, Homo sapiens
gtgttctgattagaaa

SEQ ID NO: 6336639 - DNA, 23 bp, Homo sapiens
gtgttctgctccataccttttct

SEQ ID NO: 6336640 - DNA, 12 bp, Homo sapiens
gtgttctgctga

SEQ ID NO: 6336641 - DNA, 20 bp, Homo sapiens
gtgttctggcctctggcctg

SEQ ID NO: 6336642 - DNA, 16 bp, Homo sapiens
gtgttctgggctgggg

SEQ ID NO: 6336643 - DNA, 17 bp, Homo sapiens
gtgttctgggctggggc

SEQ ID NO: 6336644 - DNA, 18 bp, Homo sapiens
gtgttctgggctggggcc

SEQ ID NO: 6336645 - DNA, 18 bp, Homo sapiens
gtgttctggtgaggcctt

SEQ ID NO: 6336646 - DNA, 12 bp, Homo sapiens
gtgttctgtatt

SEQ ID NO: 6336647 - DNA, 19 bp, Homo sapiens
gtgttctgtgggcttggcc

SEQ ID NO: 6336648 - DNA, 15 bp, Homo sapiens
gtgttctgttacaaa

SEQ ID NO: 6336649 - DNA, 18 bp, Homo sapiens
gtgttctgttacaaaatg

SEQ ID NO: 6336650 - DNA, 14 bp, Homo sapiens
gtgttctgttgttt

SEQ ID NO: 6336651 - DNA, 14 bp, Homo sapiens
gtgttctgtttccc

SEQ ID NO: 6336652 - DNA, 23 bp, Homo sapiens
gtgttctgtttgttattgttttg

SEQ ID NO: 6336653 - DNA, 18 bp, Homo sapiens
gtgttcttaaaatattgt

SEQ ID NO: 6336654 - DNA, 20 bp, Homo sapiens
gtgttcttaaaatattgtgt

SEQ ID NO: 6336655 - DNA, 13 bp, Homo sapiens
gtgttcttaggtt

SEQ ID NO: 6336656 - DNA, 19 bp, Homo sapiens
gtgttcttaggtttactgt

SEQ ID NO: 6336657 - DNA, 21 bp, Homo sapiens
gtgttcttaggtttactgtga

SEQ ID NO: 6336658 - DNA, 16 bp, Homo sapiens
gtgttctttccccagg

SEQ ID NO: 6336659 - DNA, 16 bp, Homo sapiens
gtgttctttcctgccc

SEQ ID NO: 6336660 - DNA, 13 bp, Homo sapiens
gtgttctttgtgt

SEQ ID NO: 6336661 - DNA, 17 bp, Homo sapiens
gtgttcttttgatacat

SEQ ID NO: 6336662 - DNA, 16 bp, Homo sapiens
gtgttgaaaatgttca

SEQ ID NO: 6336663 - DNA, 20 bp, Homo sapiens
gtgttgaaactcaagtcccg

SEQ ID NO: 6336664 - DNA, 20 bp, Homo sapiens
gtgttgaagaagagtttgca

SEQ ID NO: 6336665 - DNA, 14 bp, Homo sapiens
gtgttgacatagcc

SEQ ID NO: 6336666 - DNA, 11 bp, Homo sapiens
gtgttgacatt

SEQ ID NO: 6336667 - DNA, 19 bp, Homo sapiens
gtgttgaccactccagaga

SEQ ID NO: 6336668 - DNA, 14 bp, Homo sapiens
gtgttgactgctgc

SEQ ID NO: 6336669 - DNA, 14 bp, Homo sapiens
gtgttgagacccag

SEQ ID NO: 6336670 - DNA, 20 bp, Homo sapiens
gtgttgagcgtattcttgaa

SEQ ID NO: 6336671 - DNA, 20 bp, Homo sapiens
gtgttgaggaggggagcaag

SEQ ID NO: 6336672 - DNA, 13 bp, Homo sapiens
gtgttgagtgaag

SEQ ID NO: 6336673 - DNA, 13 bp, Homo sapiens
gtgttgatactgt

SEQ ID NO: 6336674 - DNA, 17 bp, Homo sapiens
gtgttgatactgttgca

SEQ ID NO: 6336675 - DNA, 18 bp, Homo sapiens
gtgttgatactgttgcac

SEQ ID NO: 6336676 - DNA, 23 bp, Homo sapiens
gtgttgatactgttgcacgtgtg

SEQ ID NO: 6336677 - DNA, 13 bp, Homo sapiens
gtgttgattgcca

SEQ ID NO: 6336678 - DNA, 12 bp, Homo sapiens
gtgttgcaaatt

SEQ ID NO: 6336679 - DNA, 14 bp, Homo sapiens
gtgttgcactgaac

SEQ ID NO: 6336680 - DNA, 13 bp, Homo sapiens
gtgttgcagaagg

SEQ ID NO: 6336681 - DNA, 19 bp, Homo sapiens
gtgttgcagccgcagagaa

SEQ ID NO: 6336682 - DNA, 12 bp, Homo sapiens
gtgttgccaaag

SEQ ID NO: 6336683 - DNA, 20 bp, Homo sapiens
gtgttgccaaatatgtcctg

SEQ ID NO: 6336684 - DNA, 14 bp, Homo sapiens
gtgttgccaagctc

SEQ ID NO: 6336685 - DNA, 18 bp, Homo sapiens
gtgttgccaagctccaag

SEQ ID NO: 6336686 - DNA, 17 bp, Homo sapiens
gtgttgccacaggacac

SEQ ID NO: 6336687 - DNA, 18 bp, Homo sapiens
gtgttgccacaggacaca

SEQ ID NO: 6336688 - DNA, 14 bp, Homo sapiens
gtgttgccatttct

SEQ ID NO: 6336689 - DNA, 12 bp, Homo sapiens
gtgttgcccagg

SEQ ID NO: 6336690 - DNA, 23 bp, Homo sapiens
gtgttgcctgctgagctgtgccc

SEQ ID NO: 6336691 - DNA, 21 bp, Homo sapiens
gtgttgccttgaaccacttcc

SEQ ID NO: 6336692 - DNA, 23 bp, Homo sapiens
gtgttgctgtttttcttgtcgtt

SEQ ID NO: 6336693 - DNA, 14 bp, Homo sapiens
gtgttggcattggt

SEQ ID NO: 6336694 - DNA, 17 bp, Homo sapiens
gtgttggcccaagctct

SEQ ID NO: 6336695 - DNA, 18 bp, Homo sapiens
gtgttggcccaagctctt

SEQ ID NO: 6336696 - DNA, 24 bp, Homo sapiens
gtgttggctgagggattctatttg

SEQ ID NO: 6336697 - DNA, 21 bp, Homo sapiens
gtgttggcttgtgatctggga

SEQ ID NO: 6336698 - DNA, 21 bp, Homo sapiens
gtgttgggaaggggtcctgca

SEQ ID NO: 6336699 - DNA, 22 bp, Homo sapiens
gtgttgggaaggggtcctgcag

SEQ ID NO: 6336700 - DNA, 16 bp, Homo sapiens
gtgttgggacctgctg

SEQ ID NO: 6336701 - DNA, 15 bp, Homo sapiens
gtgttgggccccagg

SEQ ID NO: 6336702 - DNA, 14 bp, Homo sapiens
gtgttggggctggg

SEQ ID NO: 6336703 - DNA, 19 bp, Homo sapiens
gtgttgggggaaatgttgt

SEQ ID NO: 6336704 - DNA, 15 bp, Homo sapiens
gtgttgggtggagga

SEQ ID NO: 6336705 - DNA, 14 bp, Homo sapiens
gtgttggtctttct

SEQ ID NO: 6336706 - DNA, 15 bp, Homo sapiens
gtgttggtctttcta

SEQ ID NO: 6336707 - DNA, 15 bp, Homo sapiens
gtgttggtgaaaata

SEQ ID NO: 6336708 - DNA, 18 bp, Homo sapiens
gtgttggtttacagggta

SEQ ID NO: 6336709 - DNA, 19 bp, Homo sapiens
gtgttgtactcaattttaa

SEQ ID NO: 6336710 - DNA, 23 bp, Homo sapiens
gtgttgtatctacagtaatgaaa

SEQ ID NO: 6336711 - DNA, 14 bp, Homo sapiens
gtgttgtatgcctt

SEQ ID NO: 6336712 - DNA, 15 bp, Homo sapiens
gtgttgtatttctat

SEQ ID NO: 6336713 - DNA, 16 bp, Homo sapiens
gtgttgtatttctata

SEQ ID NO: 6336714 - DNA, 19 bp, Homo sapiens
gtgttgtcagcatcttctc

SEQ ID NO: 6336715 - DNA, 15 bp, Homo sapiens
gtgttgtcagcctgt

SEQ ID NO: 6336716 - DNA, 21 bp, Homo sapiens
gtgttgtcattgtaaacaaac

SEQ ID NO: 6336717 - DNA, 19 bp, Homo sapiens
gtgttgtccgtgtctgttg

SEQ ID NO: 6336718 - DNA, 20 bp, Homo sapiens
gtgttgtctctttcctacaa

SEQ ID NO: 6336719 - DNA, 20 bp, Homo sapiens
gtgttgtgatagctaacatt

SEQ ID NO: 6336720 - DNA, 16 bp, Homo sapiens
gtgttgtgttcctggc

SEQ ID NO: 6336721 - DNA, 21 bp, Homo sapiens
gtgttgttatcatttaagatt

SEQ ID NO: 6336722 - DNA, 15 bp, Homo sapiens
gtgttgttgcttctt

SEQ ID NO: 6336723 - DNA, 20 bp, Homo sapiens
gtgttgttgtttttgataat

SEQ ID NO: 6336724 - DNA, 16 bp, Homo sapiens
gtgttgttttctctga

SEQ ID NO: 6336725 - DNA, 18 bp, Homo sapiens
gtgtttaaagagaggtta

SEQ ID NO: 6336726 - DNA, 11 bp, Homo sapiens
gtgtttaaata

SEQ ID NO: 6336727 - DNA, 16 bp, Homo sapiens
gtgtttaagtcatttt

SEQ ID NO: 6336728 - DNA, 21 bp, Homo sapiens
gtgtttaattgtactcaatgg

SEQ ID NO: 6336729 - DNA, 14 bp, Homo sapiens
gtgtttacagacag

SEQ ID NO: 6336730 - DNA, 18 bp, Homo sapiens
gtgtttacagacagaaga

SEQ ID NO: 6336731 - DNA, 12 bp, Homo sapiens
gtgtttacatta

SEQ ID NO: 6336732 - DNA, 16 bp, Homo sapiens
gtgtttactttaaatc

SEQ ID NO: 6336733 - DNA, 18 bp, Homo sapiens
gtgtttagaattgaaggt

SEQ ID NO: 6336734 - DNA, 20 bp, Homo sapiens
gtgtttagcattaaaaataa

SEQ ID NO: 6336735 - DNA, 14 bp, Homo sapiens
gtgtttagctattt

SEQ ID NO: 6336736 - DNA, 15 bp, Homo sapiens
gtgtttagttgcaga

SEQ ID NO: 6336737 - DNA, 13 bp, Homo sapiens
gtgtttataaaat

SEQ ID NO: 6336738 - DNA, 14 bp, Homo sapiens
gtgtttataaaata

SEQ ID NO: 6336739 - DNA, 17 bp, Homo sapiens
gtgtttatcagaaaggg

SEQ ID NO: 6336740 - DNA, 17 bp, Homo sapiens
gtgtttatcctttcata

SEQ ID NO: 6336741 - DNA, 22 bp, Homo sapiens
gtgtttatgtgaacattcctat

SEQ ID NO: 6336742 - DNA, 12 bp, Homo sapiens
gtgtttatgtgt

SEQ ID NO: 6336743 - DNA, 19 bp, Homo sapiens
gtgtttattataaagctta

SEQ ID NO: 6336744 - DNA, 15 bp, Homo sapiens
gtgtttattcttcca

SEQ ID NO: 6336745 - DNA, 13 bp, Homo sapiens
gtgtttattgtca

SEQ ID NO: 6336746 - DNA, 11 bp, Homo sapiens
gtgtttcaatt

SEQ ID NO: 6336747 - DNA, 12 bp, Homo sapiens
gtgtttcacaaa

SEQ ID NO: 6336748 - DNA, 18 bp, Homo sapiens
gtgtttcacttaatgttt

SEQ ID NO: 6336749 - DNA, 23 bp, Homo sapiens
gtgtttcaggtggaacaggagga

SEQ ID NO: 6336750 - DNA, 19 bp, Homo sapiens
gtgtttcatgttctgtgtc

SEQ ID NO: 6336751 - DNA, 22 bp, Homo sapiens
gtgtttcatgttctgtgtcacg

SEQ ID NO: 6336752 - DNA, 23 bp, Homo sapiens
gtgtttccactcaaaatatgtca

SEQ ID NO: 6336753 - DNA, 14 bp, Homo sapiens
gtgtttcccttcct

SEQ ID NO: 6336754 - DNA, 16 bp, Homo sapiens
gtgtttcccttcctcg

SEQ ID NO: 6336755 - DNA, 23 bp, Homo sapiens
gtgtttcctcatctatggttcta

SEQ ID NO: 6336756 - DNA, 20 bp, Homo sapiens
gtgtttccttcatttctgat

SEQ ID NO: 6336757 - DNA, 20 bp, Homo sapiens
gtgtttccttttcaggagat

SEQ ID NO: 6336758 - DNA, 21 bp, Homo sapiens
gtgtttcgtgaactgcagtga

SEQ ID NO: 6336759 - DNA, 16 bp, Homo sapiens
gtgtttctagcactgg

SEQ ID NO: 6336760 - DNA, 22 bp, Homo sapiens
gtgtttctagcactggcctgca

SEQ ID NO: 6336761 - DNA, 12 bp, Homo sapiens
gtgtttctatga

SEQ ID NO: 6336762 - DNA, 19 bp, Homo sapiens
gtgtttctatgagtggaaa

SEQ ID NO: 6336763 - DNA, 22 bp, Homo sapiens
gtgtttctccctctcactgtct

SEQ ID NO: 6336764 - DNA, 17 bp, Homo sapiens
gtgtttctgacacaaga

SEQ ID NO: 6336765 - DNA, 18 bp, Homo sapiens
gtgtttctgacacaagat

SEQ ID NO: 6336766 - DNA, 13 bp, Homo sapiens
gtgtttctgcaga

SEQ ID NO: 6336767 - DNA, 19 bp, Homo sapiens
gtgtttctgcagaggcagc

SEQ ID NO: 6336768 - DNA, 12 bp, Homo sapiens
gtgtttctgggg

SEQ ID NO: 6336769 - DNA, 11 bp, Homo sapiens
gtgtttctgta

SEQ ID NO: 6336770 - DNA, 13 bp, Homo sapiens
gtgtttctgtgca

SEQ ID NO: 6336771 - DNA, 12 bp, Homo sapiens
gtgtttcttatt

SEQ ID NO: 6336772 - DNA, 15 bp, Homo sapiens
gtgtttcttgcctca

SEQ ID NO: 6336773 - DNA, 16 bp, Homo sapiens
gtgtttcttgcctcat

SEQ ID NO: 6336774 - DNA, 16 bp, Homo sapiens
gtgtttctttagtttt

SEQ ID NO: 6336775 - DNA, 20 bp, Homo sapiens
gtgtttgatatttgtgtaaa

SEQ ID NO: 6336776 - DNA, 23 bp, Homo sapiens
gtgtttgatggtgccagagaggg

SEQ ID NO: 6336777 - DNA, 20 bp, Homo sapiens
gtgtttgcagcctgctctag

SEQ ID NO: 6336778 - DNA, 10 bp, Homo sapiens
gtgtttgctt

SEQ ID NO: 6336779 - DNA, 17 bp, Homo sapiens
gtgtttgcttgaatgct

SEQ ID NO: 6336780 - DNA, 21 bp, Homo sapiens
gtgtttggatacatctgctgt

SEQ ID NO: 6336781 - DNA, 18 bp, Homo sapiens
gtgtttggatcaaaaaga

SEQ ID NO: 6336782 - DNA, 16 bp, Homo sapiens
gtgtttggcaatgcta

SEQ ID NO: 6336783 - DNA, 22 bp, Homo sapiens
gtgtttgggaagcaacaaagag

SEQ ID NO: 6336784 - DNA, 21 bp, Homo sapiens
gtgtttgggtcacccctccag

SEQ ID NO: 6336785 - DNA, 17 bp, Homo sapiens
gtgtttggtttacattt

SEQ ID NO: 6336786 - DNA, 20 bp, Homo sapiens
gtgtttggtttacatttaaa

SEQ ID NO: 6336787 - DNA, 17 bp, Homo sapiens
gtgtttggtttcttcat

SEQ ID NO: 6336788 - DNA, 19 bp, Homo sapiens
gtgtttgtatgtctgtgta

SEQ ID NO: 6336789 - DNA, 12 bp, Homo sapiens
gtgtttgtcatg

SEQ ID NO: 6336790 - DNA, 13 bp, Homo sapiens
gtgtttgtcatgg

SEQ ID NO: 6336791 - DNA, 14 bp, Homo sapiens
gtgtttgtcctggg

SEQ ID NO: 6336792 - DNA, 15 bp, Homo sapiens
gtgtttgtcctgggt

SEQ ID NO: 6336793 - DNA, 12 bp, Homo sapiens
gtgtttgtgagt

SEQ ID NO: 6336794 - DNA, 13 bp, Homo sapiens
gtgtttgtgtgct

SEQ ID NO: 6336795 - DNA, 14 bp, Homo sapiens
gtgtttgtgtgtgt

SEQ ID NO: 6336796 - DNA, 16 bp, Homo sapiens
gtgtttgtgtgtttca

SEQ ID NO: 6336797 - DNA, 12 bp, Homo sapiens
gtgtttgttcct

SEQ ID NO: 6336798 - DNA, 18 bp, Homo sapiens
gtgtttgttgctggcttg

SEQ ID NO: 6336799 - DNA, 14 bp, Homo sapiens
gtgtttgtttttgc

SEQ ID NO: 6336800 - DNA, 17 bp, Homo sapiens
gtgtttgtttttgcaca

SEQ ID NO: 6336801 - DNA, 19 bp, Homo sapiens
gtgttttaaaaaaactgaa

SEQ ID NO: 6336802 - DNA, 18 bp, Homo sapiens
gtgttttaaaatgagaaa

SEQ ID NO: 6336803 - DNA, 16 bp, Homo sapiens
gggctggcccagccct

SEQ ID NO: 6336804 - DNA, 22 bp, Homo sapiens
gggctggccccagggcaccctg

SEQ ID NO: 6336805 - DNA, 11 bp, Homo sapiens
gggctggccct

SEQ ID NO: 6336806 - DNA, 12 bp, Homo sapiens
gggctggcccta

SEQ ID NO: 6336807 - DNA, 16 bp, Homo sapiens
gggctggccctgccct

SEQ ID NO: 6336808 - DNA, 17 bp, Homo sapiens
gggctggccctgccctc

SEQ ID NO: 6336809 - DNA, 21 bp, Homo sapiens
gggctggccctgccctccccc

SEQ ID NO: 6336810 - DNA, 14 bp, Homo sapiens
gggctggccctgtg

SEQ ID NO: 6336811 - DNA, 21 bp, Homo sapiens
gggctggccctgtgcagacct

SEQ ID NO: 6336812 - DNA, 13 bp, Homo sapiens
gggctggcctagg

SEQ ID NO: 6336813 - DNA, 14 bp, Homo sapiens
gggctggcgggcct

SEQ ID NO: 6336814 - DNA, 19 bp, Homo sapiens
gggctggctcccagggtgg

SEQ ID NO: 6336815 - DNA, 13 bp, Homo sapiens
gggctggctccct

SEQ ID NO: 6336816 - DNA, 16 bp, Homo sapiens
gggctggctcctctgc

SEQ ID NO: 6336817 - DNA, 14 bp, Homo sapiens
gggctggctcctga

SEQ ID NO: 6336818 - DNA, 13 bp, Homo sapiens
gggctggctctga

SEQ ID NO: 6336819 - DNA, 13 bp, Homo sapiens
gggctggctctgc

SEQ ID NO: 6336820 - DNA, 14 bp, Homo sapiens
gggctggctgcctt

SEQ ID NO: 6336821 - DNA, 15 bp, Homo sapiens
gggctggctgccttc

SEQ ID NO: 6336822 - DNA, 22 bp, Homo sapiens
gggctggctgccttctgcggag

SEQ ID NO: 6336823 - DNA, 18 bp, Homo sapiens
gggctggctggaggaagg

SEQ ID NO: 6336824 - DNA, 17 bp, Homo sapiens
gggctggcttctccctg

SEQ ID NO: 6336825 - DNA, 11 bp, Homo sapiens
gggctgggaga

SEQ ID NO: 6336826 - DNA, 21 bp, Homo sapiens
gggctgggagaaggtgcttgg

SEQ ID NO: 6336827 - DNA, 16 bp, Homo sapiens
gggctgggagctctgc

SEQ ID NO: 6336828 - DNA, 13 bp, Homo sapiens
gggctgggcagaa

SEQ ID NO: 6336829 - DNA, 14 bp, Homo sapiens
gggctgggcagaag

SEQ ID NO: 6336830 - DNA, 15 bp, Homo sapiens
gggctgggcagaggg

SEQ ID NO: 6336831 - DNA, 12 bp, Homo sapiens
gggctgggcagc

SEQ ID NO: 6336832 - DNA, 13 bp, Homo sapiens
gggctgggcagcc

SEQ ID NO: 6336833 - DNA, 14 bp, Homo sapiens
gggctgggcagggc

SEQ ID NO: 6336834 - DNA, 19 bp, Homo sapiens
gggctgggcaggtcctggg

SEQ ID NO: 6336835 - DNA, 23 bp, Homo sapiens
gggctgggcatcccagcttgccc

SEQ ID NO: 6336836 - DNA, 17 bp, Homo sapiens
gggctgggccaccaggg

SEQ ID NO: 6336837 - DNA, 19 bp, Homo sapiens
gggctgggccaccagggat

SEQ ID NO: 6336838 - DNA, 16 bp, Homo sapiens
gggctgggccaggtct

SEQ ID NO: 6336839 - DNA, 22 bp, Homo sapiens
gggctgggcccacagagatgca

SEQ ID NO: 6336840 - DNA, 15 bp, Homo sapiens
gggctgggcccaccc

SEQ ID NO: 6336841 - DNA, 19 bp, Homo sapiens
gggctgggcccttcctggc

SEQ ID NO: 6336842 - DNA, 21 bp, Homo sapiens
gggctgggcccttcctggcta

SEQ ID NO: 6336843 - DNA, 22 bp, Homo sapiens
gggctgggcctcggaccccact

SEQ ID NO: 6336844 - DNA, 16 bp, Homo sapiens
gggctgggctgagccc

SEQ ID NO: 6336845 - DNA, 17 bp, Homo sapiens
gggctgggctgggctgg

SEQ ID NO: 6336846 - DNA, 21 bp, Homo sapiens
gggctggggactctggcacag

SEQ ID NO: 6336847 - DNA, 13 bp, Homo sapiens
gggctggggactg

SEQ ID NO: 6336848 - DNA, 17 bp, Homo sapiens
gggctggggactgggga

SEQ ID NO: 6336849 - DNA, 12 bp, Homo sapiens
gggctggggagg

SEQ ID NO: 6336850 - DNA, 15 bp, Homo sapiens
gggctggggaggagg

SEQ ID NO: 6336851 - DNA, 16 bp, Homo sapiens
gggctggggaggagga

SEQ ID NO: 6336852 - DNA, 13 bp, Homo sapiens
gggctggggcagg

SEQ ID NO: 6336853 - DNA, 23 bp, Homo sapiens
gggctggggcaggggcctgggcc

SEQ ID NO: 6336854 - DNA, 21 bp, Homo sapiens
gggctggggccaccatccctg

SEQ ID NO: 6336855 - DNA, 13 bp, Homo sapiens
gggctggggcctc

SEQ ID NO: 6336856 - DNA, 19 bp, Homo sapiens
gggctgggggatgggcctg

SEQ ID NO: 6336857 - DNA, 21 bp, Homo sapiens
gggctgggggatgggcctgag

SEQ ID NO: 6336858 - DNA, 20 bp, Homo sapiens
gggctgggggccagggctgg

SEQ ID NO: 6336859 - DNA, 24 bp, Homo sapiens
gggctgggggccagggctggatgg

SEQ ID NO: 6336860 - DNA, 17 bp, Homo sapiens
gggctgggggctgcagg

SEQ ID NO: 6336861 - DNA, 19 bp, Homo sapiens
gggctgggggctgccgagc

SEQ ID NO: 6336862 - DNA, 11 bp, Homo sapiens
gggctggggtt

SEQ ID NO: 6336863 - DNA, 16 bp, Homo sapiens
gggctggggttgccag

SEQ ID NO: 6336864 - DNA, 19 bp, Homo sapiens
gggctggggttgccagagg

SEQ ID NO: 6336865 - DNA, 20 bp, Homo sapiens
gggctgggttctacccaggt

SEQ ID NO: 6336866 - DNA, 21 bp, Homo sapiens
gggctgggttggcgcaccctc

SEQ ID NO: 6336867 - DNA, 23 bp, Homo sapiens
gggctgggttggcgcaccctccc

SEQ ID NO: 6336868 - DNA, 16 bp, Homo sapiens
gggctgggtttgctgt

SEQ ID NO: 6336869 - DNA, 18 bp, Homo sapiens
gggctggtagctcaggtg

SEQ ID NO: 6336870 - DNA, 18 bp, Homo sapiens
gggctggtattctctcta

SEQ ID NO: 6336871 - DNA, 21 bp, Homo sapiens
gggctggtgaggccggccctg

SEQ ID NO: 6336872 - DNA, 23 bp, Homo sapiens
gggctggtgaggccggccctgcc

SEQ ID NO: 6336873 - DNA, 20 bp, Homo sapiens
gggctggtggagatgtagga

SEQ ID NO: 6336874 - DNA, 19 bp, Homo sapiens
gggctggtgggtgcctagg

SEQ ID NO: 6336875 - DNA, 17 bp, Homo sapiens
gggctggttggagaagg

SEQ ID NO: 6336876 - DNA, 17 bp, Homo sapiens
gggctggtttctgccct

SEQ ID NO: 6336877 - DNA, 19 bp, Homo sapiens
gggctggtttggtggccag

SEQ ID NO: 6336878 - DNA, 22 bp, Homo sapiens
gggctgtaactgccaggctctc

SEQ ID NO: 6336879 - DNA, 20 bp, Homo sapiens
gggctgtagtttggagacaa

SEQ ID NO: 6336880 - DNA, 21 bp, Homo sapiens
gggctgtatttatctctgagg

SEQ ID NO: 6336881 - DNA, 17 bp, Homo sapiens
gggctgtcatctgtgca

SEQ ID NO: 6336882 - DNA, 13 bp, Homo sapiens
gggctgtcccagc

SEQ ID NO: 6336883 - DNA, 15 bp, Homo sapiens
gggctgtcccagccc

SEQ ID NO: 6336884 - DNA, 17 bp, Homo sapiens
gggctgtccgtgtgcct

SEQ ID NO: 6336885 - DNA, 20 bp, Homo sapiens
gggctgtccgtgtgcctcct

SEQ ID NO: 6336886 - DNA, 22 bp, Homo sapiens
gggctgtccgtgtgcctcctgt

SEQ ID NO: 6336887 - DNA, 10 bp, Homo sapiens
gggctgtcct

SEQ ID NO: 6336888 - DNA, 16 bp, Homo sapiens
gggctgtcctccttcc

SEQ ID NO: 6336889 - DNA, 20 bp, Homo sapiens
gggctgtcctccttcctggg

SEQ ID NO: 6336890 - DNA, 22 bp, Homo sapiens
gggctgtcctccttcctgggac

SEQ ID NO: 6336891 - DNA, 23 bp, Homo sapiens
gggctgtcctccttcctgggacc

SEQ ID NO: 6336892 - DNA, 22 bp, Homo sapiens
gggctgtcctgccacccagccc

SEQ ID NO: 6336893 - DNA, 15 bp, Homo sapiens
gggctgtcctgctca

SEQ ID NO: 6336894 - DNA, 14 bp, Homo sapiens
gggctgtcctgctg

SEQ ID NO: 6336895 - DNA, 14 bp, Homo sapiens
gggctgtctcagac

SEQ ID NO: 6336896 - DNA, 22 bp, Homo sapiens
gggctgtgactctgggcaggga

SEQ ID NO: 6336897 - DNA, 12 bp, Homo sapiens
gggctgtgccaa

SEQ ID NO: 6336898 - DNA, 14 bp, Homo sapiens
gggctgtgccaacc

SEQ ID NO: 6336899 - DNA, 13 bp, Homo sapiens
gggctgtgcctga

SEQ ID NO: 6336900 - DNA, 23 bp, Homo sapiens
gggctgtgcctgaggctggctgg

SEQ ID NO: 6336901 - DNA, 16 bp, Homo sapiens
gggctgtggctgggtg

SEQ ID NO: 6336902 - DNA, 17 bp, Homo sapiens
gggctgtggctgggtgg

SEQ ID NO: 6336903 - DNA, 17 bp, Homo sapiens
gggctgtgttgactgct

SEQ ID NO: 6336904 - DNA, 17 bp, Homo sapiens
gggctgttagctcagag

SEQ ID NO: 6336905 - DNA, 20 bp, Homo sapiens
gggctgttaggacagcaaag

SEQ ID NO: 6336906 - DNA, 19 bp, Homo sapiens
gggctgttcatggcaagtg

SEQ ID NO: 6336907 - DNA, 20 bp, Homo sapiens
gggctgttcttccaggaggc

SEQ ID NO: 6336908 - DNA, 19 bp, Homo sapiens
gggctgttgagatgcctgt

SEQ ID NO: 6336909 - DNA, 22 bp, Homo sapiens
gggctgttggacagctgcttgt

SEQ ID NO: 6336910 - DNA, 20 bp, Homo sapiens
gggctgttgtgtctggagcc

SEQ ID NO: 6336911 - DNA, 22 bp, Homo sapiens
gggctgtttaggggatctggaa

SEQ ID NO: 6336912 - DNA, 20 bp, Homo sapiens
gggctgttttagtgccaggc

SEQ ID NO: 6336913 - DNA, 16 bp, Homo sapiens
gggcttaattccccca

SEQ ID NO: 6336914 - DNA, 15 bp, Homo sapiens
gggcttacaggcatg

SEQ ID NO: 6336915 - DNA, 17 bp, Homo sapiens
gggcttacaggcatgga

SEQ ID NO: 6336916 - DNA, 16 bp, Homo sapiens
gggcttacggccctgg

SEQ ID NO: 6336917 - DNA, 13 bp, Homo sapiens
gggcttagagcag

SEQ ID NO: 6336918 - DNA, 24 bp, Homo sapiens
gggcttagagcagtttctgtcctg

SEQ ID NO: 6336919 - DNA, 19 bp, Homo sapiens
gggcttatatctggcctct

SEQ ID NO: 6336920 - DNA, 21 bp, Homo sapiens
gggcttatatgtacttttatt

SEQ ID NO: 6336921 - DNA, 23 bp, Homo sapiens
gggcttatcagaactcctttcta

SEQ ID NO: 6336922 - DNA, 23 bp, Homo sapiens
gggcttatctagccaaagagctc

SEQ ID NO: 6336923 - DNA, 18 bp, Homo sapiens
gggcttatggccagggga

SEQ ID NO: 6336924 - DNA, 14 bp, Homo sapiens
gggcttatgggtgg

SEQ ID NO: 6336925 - DNA, 18 bp, Homo sapiens
gggcttatgtctctgcct

SEQ ID NO: 6336926 - DNA, 19 bp, Homo sapiens
gggcttatgtctctgcctt

SEQ ID NO: 6336927 - DNA, 21 bp, Homo sapiens
gggcttcaaccttgagacagc

SEQ ID NO: 6336928 - DNA, 17 bp, Homo sapiens
gggcttcacagccacac

SEQ ID NO: 6336929 - DNA, 14 bp, Homo sapiens
gggcttcagccagt

SEQ ID NO: 6336930 - DNA, 15 bp, Homo sapiens
gggcttcaggtctct

SEQ ID NO: 6336931 - DNA, 17 bp, Homo sapiens
gggcttcagtggcagct

SEQ ID NO: 6336932 - DNA, 20 bp, Homo sapiens
gggcttcatcctcctcagat

SEQ ID NO: 6336933 - DNA, 24 bp, Homo sapiens
gggcttcattccggactggcagaa

SEQ ID NO: 6336934 - DNA, 16 bp, Homo sapiens
gggcttccacagtgtg

SEQ ID NO: 6336935 - DNA, 23 bp, Homo sapiens
gggcttccatttgtgtgtgtgca

SEQ ID NO: 6336936 - DNA, 20 bp, Homo sapiens
gggcttccctagatggttcc

SEQ ID NO: 6336937 - DNA, 15 bp, Homo sapiens
gggcttccctctgct

SEQ ID NO: 6336938 - DNA, 18 bp, Homo sapiens
gggcttccctctgctcca

SEQ ID NO: 6336939 - DNA, 19 bp, Homo sapiens
gggcttccctctgctccac

SEQ ID NO: 6336940 - DNA, 19 bp, Homo sapiens
gggcttccctggcctcccg

SEQ ID NO: 6336941 - DNA, 13 bp, Homo sapiens
gggcttccctggg

SEQ ID NO: 6336942 - DNA, 22 bp, Homo sapiens
gggcttccctgggcctcagcct

SEQ ID NO: 6336943 - DNA, 19 bp, Homo sapiens
gggcttcctctagaagcca

SEQ ID NO: 6336944 - DNA, 23 bp, Homo sapiens
gggcttcctgcccttccctctgg

SEQ ID NO: 6336945 - DNA, 19 bp, Homo sapiens
gggcttcctgctgggactg

SEQ ID NO: 6336946 - DNA, 12 bp, Homo sapiens
gggcttcctggg

SEQ ID NO: 6336947 - DNA, 12 bp, Homo sapiens
gggcttctcctc

SEQ ID NO: 6336948 - DNA, 21 bp, Homo sapiens
gggcttctcctcctctgtctt

SEQ ID NO: 6336949 - DNA, 13 bp, Homo sapiens
gggcttctcctct

SEQ ID NO: 6336950 - DNA, 15 bp, Homo sapiens
gggcttctcctgcgg

SEQ ID NO: 6336951 - DNA, 15 bp, Homo sapiens
gggcttctgcaccct

SEQ ID NO: 6336952 - DNA, 16 bp, Homo sapiens
gggcttctgcaccctc

SEQ ID NO: 6336953 - DNA, 18 bp, Homo sapiens
gggcttctgcaccctcca

SEQ ID NO: 6336954 - DNA, 19 bp, Homo sapiens
gggcttctgcaccctccac

SEQ ID NO: 6336955 - DNA, 16 bp, Homo sapiens
gggcttctgtgcccag

SEQ ID NO: 6336956 - DNA, 17 bp, Homo sapiens
gggcttctgttctctgc

SEQ ID NO: 6336957 - DNA, 13 bp, Homo sapiens
gggcttgaatttg

SEQ ID NO: 6336958 - DNA, 16 bp, Homo sapiens
gggcttgactttggct

SEQ ID NO: 6336959 - DNA, 13 bp, Homo sapiens
gggcttgagagct

SEQ ID NO: 6336960 - DNA, 19 bp, Homo sapiens
gggcttgcaagtatgtttt

SEQ ID NO: 6336961 - DNA, 16 bp, Homo sapiens
gggcttgccccactct

SEQ ID NO: 6336962 - DNA, 17 bp, Homo sapiens
gggcttgccctgggtca

SEQ ID NO: 6336963 - DNA, 21 bp, Homo sapiens
gggcttggacttcctggggcc

SEQ ID NO: 6336964 - DNA, 13 bp, Homo sapiens
gggcttggagcag

SEQ ID NO: 6336965 - DNA, 14 bp, Homo sapiens
gggcttggagcaga

SEQ ID NO: 6336966 - DNA, 14 bp, Homo sapiens
gggcttggccagcg

SEQ ID NO: 6336967 - DNA, 13 bp, Homo sapiens
gggcttggcctgc

SEQ ID NO: 6336968 - DNA, 16 bp, Homo sapiens
gggcttggcctgctgt

SEQ ID NO: 6336969 - DNA, 17 bp, Homo sapiens
gggcttggcctgctgtg

SEQ ID NO: 6336970 - DNA, 17 bp, Homo sapiens
gggcttggctcgcaccc

SEQ ID NO: 6336971 - DNA, 20 bp, Homo sapiens
gggcttggctcggcgccccc

SEQ ID NO: 6336972 - DNA, 15 bp, Homo sapiens
gggcttgggccctgc

SEQ ID NO: 6336973 - DNA, 15 bp, Homo sapiens
gggcttgggcctagg

SEQ ID NO: 6336974 - DNA, 21 bp, Homo sapiens
gggcttggggaccagagctgc

SEQ ID NO: 6336975 - DNA, 22 bp, Homo sapiens
gggcttggggaccagagctgcc

SEQ ID NO: 6336976 - DNA, 22 bp, Homo sapiens
gggcttggggagcaggtctctg

SEQ ID NO: 6336977 - DNA, 18 bp, Homo sapiens
gggcttggggtagagagg

SEQ ID NO: 6336978 - DNA, 20 bp, Homo sapiens
gggcttggggtagagaggac

SEQ ID NO: 6336979 - DNA, 22 bp, Homo sapiens
gggcttggggtagagaggacag

SEQ ID NO: 6336980 - DNA, 22 bp, Homo sapiens
gggcttggtggccaagcctggc

SEQ ID NO: 6336981 - DNA, 18 bp, Homo sapiens
gtgttttaaagagaatgt

SEQ ID NO: 6336982 - DNA, 20 bp, Homo sapiens
gtgttttaagactgaatgtt

SEQ ID NO: 6336983 - DNA, 21 bp, Homo sapiens
gtgttttaagactgaatgttt

SEQ ID NO: 6336984 - DNA, 15 bp, Homo sapiens
gtgttttaattccaa

SEQ ID NO: 6336985 - DNA, 14 bp, Homo sapiens
gtgttttaattgta

SEQ ID NO: 6336986 - DNA, 13 bp, Homo sapiens
gtgttttaattta

SEQ ID NO: 6336987 - DNA, 16 bp, Homo sapiens
gtgttttagatggttt

SEQ ID NO: 6336988 - DNA, 17 bp, Homo sapiens
gtgttttagatgttact

SEQ ID NO: 6336989 - DNA, 18 bp, Homo sapiens
gtgttttagatgttacta

SEQ ID NO: 6336990 - DNA, 14 bp, Homo sapiens
gtgttttagggtga

SEQ ID NO: 6336991 - DNA, 13 bp, Homo sapiens
gtgttttcatcat

SEQ ID NO: 6336992 - DNA, 17 bp, Homo sapiens
gtgttttcccaaagcac

SEQ ID NO: 6336993 - DNA, 17 bp, Homo sapiens
gtgttttcgatgatgat

SEQ ID NO: 6336994 - DNA, 19 bp, Homo sapiens
gtgttttctgaataacatt

SEQ ID NO: 6336995 - DNA, 16 bp, Homo sapiens
gtgttttgaattgtgt

SEQ ID NO: 6336996 - DNA, 16 bp, Homo sapiens
gtgttttgcaagtgct

SEQ ID NO: 6336997 - DNA, 14 bp, Homo sapiens
gtgttttggagaaa

SEQ ID NO: 6336998 - DNA, 19 bp, Homo sapiens
gtgttttgtcagacttcca

SEQ ID NO: 6336999 - DNA, 17 bp, Homo sapiens
gtgttttgtctgagcct

SEQ ID NO: 6337000 - DNA, 13 bp, Homo sapiens
gtgttttgttttg

SEQ ID NO: 6337001 - DNA, 22 bp, Homo sapiens
gtgttttgttttggactctctg

SEQ ID NO: 6337002 - DNA, 23 bp, Homo sapiens
gtgttttgttttggactctctgt

SEQ ID NO: 6337003 - DNA, 16 bp, Homo sapiens
gtgtttttaaattttg

SEQ ID NO: 6337004 - DNA, 15 bp, Homo sapiens
gtgtttttacatata

SEQ ID NO: 6337005 - DNA, 16 bp, Homo sapiens
gtgtttttcatgtttt

SEQ ID NO: 6337006 - DNA, 17 bp, Homo sapiens
gtgtttttcatgtttta

SEQ ID NO: 6337007 - DNA, 14 bp, Homo sapiens
gtgtttttccaaaa

SEQ ID NO: 6337008 - DNA, 17 bp, Homo sapiens
gtgtttttctattaaaa

SEQ ID NO: 6337009 - DNA, 22 bp, Homo sapiens
gtgtttttctattaaaagactc

SEQ ID NO: 6337010 - DNA, 14 bp, Homo sapiens
gtgtttttctccag

SEQ ID NO: 6337011 - DNA, 15 bp, Homo sapiens
gtgtttttctccagt

SEQ ID NO: 6337012 - DNA, 18 bp, Homo sapiens
gtgtttttctccagtgct

SEQ ID NO: 6337013 - DNA, 13 bp, Homo sapiens
gtgtttttctctc

SEQ ID NO: 6337014 - DNA, 17 bp, Homo sapiens
gtgtttttctctctgga

SEQ ID NO: 6337015 - DNA, 19 bp, Homo sapiens
gtgtttttctgcttttgaa

SEQ ID NO: 6337016 - DNA, 18 bp, Homo sapiens
gtgtttttgggatgtctt

SEQ ID NO: 6337017 - DNA, 20 bp, Homo sapiens
gtgtttttggttttctcctt

SEQ ID NO: 6337018 - DNA, 14 bp, Homo sapiens
gtgtttttgtaaag

SEQ ID NO: 6337019 - DNA, 13 bp, Homo sapiens
gtgttttttaaaa

SEQ ID NO: 6337020 - DNA, 15 bp, Homo sapiens
gtgttttttaagata

SEQ ID NO: 6337021 - DNA, 21 bp, Homo sapiens
gtgttttttaagatagtgtaa

SEQ ID NO: 6337022 - DNA, 20 bp, Homo sapiens
gtgttttttaggaaaagcat

SEQ ID NO: 6337023 - DNA, 17 bp, Homo sapiens
gtgtttttttatttcta

SEQ ID NO: 6337024 - DNA, 19 bp, Homo sapiens
gtgtttttttatttctact

SEQ ID NO: 6337025 - DNA, 15 bp, Homo sapiens
gtgtttttttctaaa

SEQ ID NO: 6337026 - DNA, 18 bp, Homo sapiens
gtgtttttttctaaaaag

SEQ ID NO: 6337027 - DNA, 18 bp, Homo sapiens
gtgtttttttgaggggaa

SEQ ID NO: 6337028 - DNA, 13 bp, Homo sapiens
gttaaaaaaaaaa

SEQ ID NO: 6337029 - DNA, 20 bp, Homo sapiens
gttaaaaaaaggcattgttt

SEQ ID NO: 6337030 - DNA, 15 bp, Homo sapiens
gttaaaaaaatggca

SEQ ID NO: 6337031 - DNA, 18 bp, Homo sapiens
gttaaaaaacaaatgttc

SEQ ID NO: 6337032 - DNA, 14 bp, Homo sapiens
gttaaaaaagcgag

SEQ ID NO: 6337033 - DNA, 20 bp, Homo sapiens
gttaaaaacagatttggaaa

SEQ ID NO: 6337034 - DNA, 13 bp, Homo sapiens
gttaaaaaccatt

SEQ ID NO: 6337035 - DNA, 22 bp, Homo sapiens
gttaaaaaccattataaaatct

SEQ ID NO: 6337036 - DNA, 20 bp, Homo sapiens
gttaaaaaggccaaagataa

SEQ ID NO: 6337037 - DNA, 20 bp, Homo sapiens
gttaaaaatggctcaagtag

SEQ ID NO: 6337038 - DNA, 15 bp, Homo sapiens
gttaaaacaatgaag

SEQ ID NO: 6337039 - DNA, 14 bp, Homo sapiens
gttaaaacacatat

SEQ ID NO: 6337040 - DNA, 23 bp, Homo sapiens
gttaaaacataaacacatttcca

SEQ ID NO: 6337041 - DNA, 15 bp, Homo sapiens
gttaaaacatagctt

SEQ ID NO: 6337042 - DNA, 12 bp, Homo sapiens
gttaaaacatca

SEQ ID NO: 6337043 - DNA, 21 bp, Homo sapiens
gttaaaactcatcacataaag

SEQ ID NO: 6337044 - DNA, 19 bp, Homo sapiens
gttaaaactggatggaaat

SEQ ID NO: 6337045 - DNA, 18 bp, Homo sapiens
gttaaaactgtacattta

SEQ ID NO: 6337046 - DNA, 19 bp, Homo sapiens
gttaaaactgtacatttaa

SEQ ID NO: 6337047 - DNA, 12 bp, Homo sapiens
gttaaaactgtc

SEQ ID NO: 6337048 - DNA, 14 bp, Homo sapiens
gttaaaagcatttt

SEQ ID NO: 6337049 - DNA, 22 bp, Homo sapiens
gttaaaagcattttaatactaa

SEQ ID NO: 6337050 - DNA, 23 bp, Homo sapiens
gttaaaagttatttgttcattat

SEQ ID NO: 6337051 - DNA, 22 bp, Homo sapiens
gttaaaataaagcctatttttc

SEQ ID NO: 6337052 - DNA, 17 bp, Homo sapiens
gttaaaatataaattaa

SEQ ID NO: 6337053 - DNA, 18 bp, Homo sapiens
gttaaaatataaattaag

SEQ ID NO: 6337054 - DNA, 19 bp, Homo sapiens
gttaaaatataaattaaga

SEQ ID NO: 6337055 - DNA, 21 bp, Homo sapiens
gttaaaatataaattaagact

SEQ ID NO: 6337056 - DNA, 12 bp, Homo sapiens
gttaaaatatag

SEQ ID NO: 6337057 - DNA, 17 bp, Homo sapiens
gttaaaatcacatttta

SEQ ID NO: 6337058 - DNA, 20 bp, Homo sapiens
gttaaaatcacattttaagt

SEQ ID NO: 6337059 - DNA, 23 bp, Homo sapiens
gttaaaatcacattttaagtgct

SEQ ID NO: 6337060 - DNA, 18 bp, Homo sapiens
gttaaaatcccaaatcta

SEQ ID NO: 6337061 - DNA, 14 bp, Homo sapiens
gttaaaatggattt

SEQ ID NO: 6337062 - DNA, 14 bp, Homo sapiens
gttaaaatgtacac

SEQ ID NO: 6337063 - DNA, 14 bp, Homo sapiens
gttaaaatgtgatt

SEQ ID NO: 6337064 - DNA, 12 bp, Homo sapiens
gttaaaatgtgt

SEQ ID NO: 6337065 - DNA, 20 bp, Homo sapiens
gttaaaatgtgtttttcagt

SEQ ID NO: 6337066 - DNA, 18 bp, Homo sapiens
gttaaaatgtttactgta

SEQ ID NO: 6337067 - DNA, 19 bp, Homo sapiens
gttaaaatgtttactgtaa

SEQ ID NO: 6337068 - DNA, 19 bp, Homo sapiens
gttaaacattaatatttac

SEQ ID NO: 6337069 - DNA, 21 bp, Homo sapiens
gttaaacattaatatttacca

SEQ ID NO: 6337070 - DNA, 14 bp, Homo sapiens
gttaaacattgaag

SEQ ID NO: 6337071 - DNA, 21 bp, Homo sapiens
gttaaaccatccatgtatttt

SEQ ID NO: 6337072 - DNA, 18 bp, Homo sapiens
gttaaaccatgggataaa

SEQ ID NO: 6337073 - DNA, 21 bp, Homo sapiens
gttaaacgtagcatgtggcat

SEQ ID NO: 6337074 - DNA, 15 bp, Homo sapiens
gttaaactaaaaaaa

SEQ ID NO: 6337075 - DNA, 22 bp, Homo sapiens
gttaaactagcatatctgcctt

SEQ ID NO: 6337076 - DNA, 23 bp, Homo sapiens
gttaaactagcatatctgccttt

SEQ ID NO: 6337077 - DNA, 16 bp, Homo sapiens
gttaaactgagacaat

SEQ ID NO: 6337078 - DNA, 13 bp, Homo sapiens
gttaaactgagag

SEQ ID NO: 6337079 - DNA, 18 bp, Homo sapiens
gttaaactggcttaactt

SEQ ID NO: 6337080 - DNA, 12 bp, Homo sapiens
gttaaactgtta

SEQ ID NO: 6337081 - DNA, 21 bp, Homo sapiens
gttaaactgttagcactgttg

SEQ ID NO: 6337082 - DNA, 16 bp, Homo sapiens
gttaaagagacaaata

SEQ ID NO: 6337083 - DNA, 18 bp, Homo sapiens
gttaaagagacaaatagt

SEQ ID NO: 6337084 - DNA, 21 bp, Homo sapiens
gttaaagaggcgtcttgtatt

SEQ ID NO: 6337085 - DNA, 11 bp, Homo sapiens
gttaaagcaga

SEQ ID NO: 6337086 - DNA, 11 bp, Homo sapiens
gttaaagccac

SEQ ID NO: 6337087 - DNA, 23 bp, Homo sapiens
gttaaagcttatttttatgtggt

SEQ ID NO: 6337088 - DNA, 20 bp, Homo sapiens
gttaaaggaagtttgttcac

SEQ ID NO: 6337089 - DNA, 12 bp, Homo sapiens
gttaaaggcagt

SEQ ID NO: 6337090 - DNA, 17 bp, Homo sapiens
gttaaaggcagtccaga

SEQ ID NO: 6337091 - DNA, 20 bp, Homo sapiens
gttaaaggcagtccagagct

SEQ ID NO: 6337092 - DNA, 21 bp, Homo sapiens
gttaaagggatatttttttct

SEQ ID NO: 6337093 - DNA, 18 bp, Homo sapiens
gttaaaggtctcccacaa

SEQ ID NO: 6337094 - DNA, 18 bp, Homo sapiens
gttaaaggttttctctaa

SEQ ID NO: 6337095 - DNA, 13 bp, Homo sapiens
gttaaagtttaag

SEQ ID NO: 6337096 - DNA, 14 bp, Homo sapiens
gttaaataaataga

SEQ ID NO: 6337097 - DNA, 20 bp, Homo sapiens
gttaaataaattgtatattc

SEQ ID NO: 6337098 - DNA, 20 bp, Homo sapiens
gttaaatacaggaaacagtt

SEQ ID NO: 6337099 - DNA, 22 bp, Homo sapiens
gttaaatactgtgcagaataat

SEQ ID NO: 6337100 - DNA, 17 bp, Homo sapiens
gttaaatatataaacaa

SEQ ID NO: 6337101 - DNA, 14 bp, Homo sapiens
gttaaatatgattt

SEQ ID NO: 6337102 - DNA, 12 bp, Homo sapiens
gttaaatattta

SEQ ID NO: 6337103 - DNA, 22 bp, Homo sapiens
gttaaatatttacatatgaaat

SEQ ID NO: 6337104 - DNA, 19 bp, Homo sapiens
gttaaatcattttcattaa

SEQ ID NO: 6337105 - DNA, 20 bp, Homo sapiens
gttaaatctacaaactttta

SEQ ID NO: 6337106 - DNA, 18 bp, Homo sapiens
gttaaatgaaattgtaaa

SEQ ID NO: 6337107 - DNA, 20 bp, Homo sapiens
gttaaatgaaattgtaaaac

SEQ ID NO: 6337108 - DNA, 22 bp, Homo sapiens
gttaaatgctatggaaatacat

SEQ ID NO: 6337109 - DNA, 11 bp, Homo sapiens
gttaaatgtgt

SEQ ID NO: 6337110 - DNA, 12 bp, Homo sapiens
gttaaatgtgtg

SEQ ID NO: 6337111 - DNA, 23 bp, Homo sapiens
gttaaatgtgtgtaaaaaagtgt

SEQ ID NO: 6337112 - DNA, 15 bp, Homo sapiens
gttaaattcatttta

SEQ ID NO: 6337113 - DNA, 20 bp, Homo sapiens
gttaaattgcacgtgcaata

SEQ ID NO: 6337114 - DNA, 17 bp, Homo sapiens
gttaaattgctgtgtat

SEQ ID NO: 6337115 - DNA, 13 bp, Homo sapiens
gttaaatttagtg

SEQ ID NO: 6337116 - DNA, 14 bp, Homo sapiens
gttaaatttgtaag

SEQ ID NO: 6337117 - DNA, 16 bp, Homo sapiens
gttaaatttgtaagtt

SEQ ID NO: 6337118 - DNA, 18 bp, Homo sapiens
gttaaatttgtaagtttc

SEQ ID NO: 6337119 - DNA, 19 bp, Homo sapiens
gttaaatttgtaagtttca

SEQ ID NO: 6337120 - DNA, 17 bp, Homo sapiens
gttaaattttctctaaa

SEQ ID NO: 6337121 - DNA, 20 bp, Homo sapiens
gttaaattttctctaaactg

SEQ ID NO: 6337122 - DNA, 21 bp, Homo sapiens
gttaaattttctctaaactgt

SEQ ID NO: 6337123 - DNA, 22 bp, Homo sapiens
gttaacaaggaatgcctgtgcc

SEQ ID NO: 6337124 - DNA, 17 bp, Homo sapiens
gttaacaataaagtgac

SEQ ID NO: 6337125 - DNA, 19 bp, Homo sapiens
gttaacaataaagtgacaa

SEQ ID NO: 6337126 - DNA, 14 bp, Homo sapiens
gttaacaatgatat

SEQ ID NO: 6337127 - DNA, 23 bp, Homo sapiens
gttaacaatgcctattgtaatat

SEQ ID NO: 6337128 - DNA, 12 bp, Homo sapiens
gttaacacattt

SEQ ID NO: 6337129 - DNA, 16 bp, Homo sapiens
gttaacacgtgacact

SEQ ID NO: 6337130 - DNA, 17 bp, Homo sapiens
gttaacactgtaatatc

SEQ ID NO: 6337131 - DNA, 12 bp, Homo sapiens
gttaacagagca

SEQ ID NO: 6337132 - DNA, 14 bp, Homo sapiens
gttaacagagctaa

SEQ ID NO: 6337133 - DNA, 23 bp, Homo sapiens
gttaacagcgtgtcaactttcat

SEQ ID NO: 6337134 - DNA, 19 bp, Homo sapiens
gttaacaggatattagaca

SEQ ID NO: 6337135 - DNA, 12 bp, Homo sapiens
gttaacagtaaa

SEQ ID NO: 6337136 - DNA, 17 bp, Homo sapiens
gttaacagtattttaag

SEQ ID NO: 6337137 - DNA, 16 bp, Homo sapiens
gttaacatcaagccat

SEQ ID NO: 6337138 - DNA, 14 bp, Homo sapiens
gttaacatctttta

SEQ ID NO: 6337139 - DNA, 21 bp, Homo sapiens
gttaacattcagtactttatg

SEQ ID NO: 6337140 - DNA, 23 bp, Homo sapiens
gttaacattccaagactctagag

SEQ ID NO: 6337141 - DNA, 21 bp, Homo sapiens
gttaacattgaccaagaactg

SEQ ID NO: 6337142 - DNA, 19 bp, Homo sapiens
gttaaccaaataaaacata

SEQ ID NO: 6337143 - DNA, 17 bp, Homo sapiens
gttaaccacccgccccg

SEQ ID NO: 6337144 - DNA, 15 bp, Homo sapiens
gttaacccagtgttc

SEQ ID NO: 6337145 - DNA, 17 bp, Homo sapiens
gttaaccttaaatacac

SEQ ID NO: 6337146 - DNA, 15 bp, Homo sapiens
gttaacctttttgta

SEQ ID NO: 6337147 - DNA, 22 bp, Homo sapiens
gttaactatgacagatatattt

SEQ ID NO: 6337148 - DNA, 20 bp, Homo sapiens
gttaactatgtacaatattt

SEQ ID NO: 6337149 - DNA, 23 bp, Homo sapiens
gttaactatgtacaatattttaa

SEQ ID NO: 6337150 - DNA, 15 bp, Homo sapiens
gttaactctcccagg

SEQ ID NO: 6337151 - DNA, 14 bp, Homo sapiens
gttaactgaatacc

SEQ ID NO: 6337152 - DNA, 20 bp, Homo sapiens
gttaactgaatttggaatgt

SEQ ID NO: 6337153 - DNA, 17 bp, Homo sapiens
gttaactgatttgcaat

SEQ ID NO: 6337154 - DNA, 16 bp, Homo sapiens
gttaactgcattttac

SEQ ID NO: 6337155 - DNA, 20 bp, Homo sapiens
gttaactgtcttgagagaaa

SEQ ID NO: 6337156 - DNA, 19 bp, Homo sapiens
gttaactgtgaaataccac

SEQ ID NO: 6337157 - DNA, 19 bp, Homo sapiens
gttaactgttaactatgac

SEQ ID NO: 6337158 - DNA, 19 bp, Homo sapiens
gttaactgttccccttggt

SEQ ID NO: 6337159 - DNA, 21 bp, Homo sapiens
gttaactgttcttggaaaaaa

SEQ ID NO: 6337160 - DNA, 20 bp, Homo sapiens
gggcttgtagaccactgtcc

SEQ ID NO: 6337161 - DNA, 22 bp, Homo sapiens
gggcttgtagaccactgtcctg

SEQ ID NO: 6337162 - DNA, 24 bp, Homo sapiens
gggcttgttgtttttaagtcctgt

SEQ ID NO: 6337163 - DNA, 12 bp, Homo sapiens
gggctttaaata

SEQ ID NO: 6337164 - DNA, 18 bp, Homo sapiens
gggctttcacgggcccca

SEQ ID NO: 6337165 - DNA, 15 bp, Homo sapiens
gggctttcccaggag

SEQ ID NO: 6337166 - DNA, 21 bp, Homo sapiens
gggctttcctgtgccaggtga

SEQ ID NO: 6337167 - DNA, 15 bp, Homo sapiens
gggctttcggggagg

SEQ ID NO: 6337168 - DNA, 17 bp, Homo sapiens
gggctttctcttcccct

SEQ ID NO: 6337169 - DNA, 19 bp, Homo sapiens
gggctttctcttccccttc

SEQ ID NO: 6337170 - DNA, 15 bp, Homo sapiens
gggctttctggagag

SEQ ID NO: 6337171 - DNA, 15 bp, Homo sapiens
gggctttctggggcc

SEQ ID NO: 6337172 - DNA, 20 bp, Homo sapiens
gggctttgattccatctcct

SEQ ID NO: 6337173 - DNA, 14 bp, Homo sapiens
gggctttgcaggct

SEQ ID NO: 6337174 - DNA, 16 bp, Homo sapiens
gggctttgcaggctct

SEQ ID NO: 6337175 - DNA, 17 bp, Homo sapiens
gggctttgcaggctctg

SEQ ID NO: 6337176 - DNA, 18 bp, Homo sapiens
gggctttgcaggctctgg

SEQ ID NO: 6337177 - DNA, 17 bp, Homo sapiens
gggctttgccttgcagc

SEQ ID NO: 6337178 - DNA, 21 bp, Homo sapiens
gggctttgcttttcaaaccag

SEQ ID NO: 6337179 - DNA, 24 bp, Homo sapiens
gggctttgggaagtttgctgtgct

SEQ ID NO: 6337180 - DNA, 18 bp, Homo sapiens
gggctttgggcccaagaa

SEQ ID NO: 6337181 - DNA, 20 bp, Homo sapiens
gggctttgggcccaagaact

SEQ ID NO: 6337182 - DNA, 13 bp, Homo sapiens
gggctttgggccg

SEQ ID NO: 6337183 - DNA, 23 bp, Homo sapiens
gggctttgtttgggccactgcca

SEQ ID NO: 6337184 - DNA, 14 bp, Homo sapiens
gggcttttattttt

SEQ ID NO: 6337185 - DNA, 16 bp, Homo sapiens
gggcttttatttttta

SEQ ID NO: 6337186 - DNA, 15 bp, Homo sapiens
gggcttttccctggg

SEQ ID NO: 6337187 - DNA, 23 bp, Homo sapiens
gggcttttccctgggtggagcag

SEQ ID NO: 6337188 - DNA, 18 bp, Homo sapiens
gggcttttccttttgcac

SEQ ID NO: 6337189 - DNA, 18 bp, Homo sapiens
gggcttttctggggccca

SEQ ID NO: 6337190 - DNA, 24 bp, Homo sapiens
gggcttttctggggcccaggaagc

SEQ ID NO: 6337191 - DNA, 16 bp, Homo sapiens
ggggaaaaaaaagaaa

SEQ ID NO: 6337192 - DNA, 18 bp, Homo sapiens
ggggaaaaaagcacatac

SEQ ID NO: 6337193 - DNA, 15 bp, Homo sapiens
ggggaaaattatttt

SEQ ID NO: 6337194 - DNA, 17 bp, Homo sapiens
ggggaaaattattttga

SEQ ID NO: 6337195 - DNA, 22 bp, Homo sapiens
ggggaaactgagggcagagagg

SEQ ID NO: 6337196 - DNA, 13 bp, Homo sapiens
ggggaaagaggga

SEQ ID NO: 6337197 - DNA, 16 bp, Homo sapiens
ggggaaagcctgaagg

SEQ ID NO: 6337198 - DNA, 17 bp, Homo sapiens
ggggaaaggcaaggtcc

SEQ ID NO: 6337199 - DNA, 22 bp, Homo sapiens
ggggaaaggcaaggtccggccc

SEQ ID NO: 6337200 - DNA, 16 bp, Homo sapiens
ggggaaagggaggaag

SEQ ID NO: 6337201 - DNA, 14 bp, Homo sapiens
ggggaaatgtaata

SEQ ID NO: 6337202 - DNA, 15 bp, Homo sapiens
ggggaaatgtggaga

SEQ ID NO: 6337203 - DNA, 22 bp, Homo sapiens
ggggaacacagaccaggaagct

SEQ ID NO: 6337204 - DNA, 13 bp, Homo sapiens
ggggaacacagct

SEQ ID NO: 6337205 - DNA, 13 bp, Homo sapiens
ggggaacagacca

SEQ ID NO: 6337206 - DNA, 17 bp, Homo sapiens
ggggaacatgagccttt

SEQ ID NO: 6337207 - DNA, 17 bp, Homo sapiens
ggggaacatggctggcc

SEQ ID NO: 6337208 - DNA, 20 bp, Homo sapiens
ggggaacatggctggcctgg

SEQ ID NO: 6337209 - DNA, 23 bp, Homo sapiens
ggggaacatttctgtaaatacca

SEQ ID NO: 6337210 - DNA, 22 bp, Homo sapiens
ggggaacctgccatgccaggaa

SEQ ID NO: 6337211 - DNA, 13 bp, Homo sapiens
ggggaacggatgc

SEQ ID NO: 6337212 - DNA, 16 bp, Homo sapiens
ggggaacgttctcttt

SEQ ID NO: 6337213 - DNA, 15 bp, Homo sapiens
ggggaactcccccag

SEQ ID NO: 6337214 - DNA, 20 bp, Homo sapiens
ggggaactcccccagaggtg

SEQ ID NO: 6337215 - DNA, 22 bp, Homo sapiens
ggggaagaacagccccggggcc

SEQ ID NO: 6337216 - DNA, 18 bp, Homo sapiens
ggggaagaagcagagaga

SEQ ID NO: 6337217 - DNA, 19 bp, Homo sapiens
ggggaagagatccaaagac

SEQ ID NO: 6337218 - DNA, 14 bp, Homo sapiens
ggggaagagcacag

SEQ ID NO: 6337219 - DNA, 16 bp, Homo sapiens
ggggaagagtgtactg

SEQ ID NO: 6337220 - DNA, 12 bp, Homo sapiens
ggggaagatgaa

SEQ ID NO: 6337221 - DNA, 15 bp, Homo sapiens
ggggaagctgcacat

SEQ ID NO: 6337222 - DNA, 15 bp, Homo sapiens
ggggaagctgggccc

SEQ ID NO: 6337223 - DNA, 13 bp, Homo sapiens
ggggaaggaagga

SEQ ID NO: 6337224 - DNA, 19 bp, Homo sapiens
ggggaaggaaggagggcac

SEQ ID NO: 6337225 - DNA, 14 bp, Homo sapiens
ggggaaggaccaac

SEQ ID NO: 6337226 - DNA, 21 bp, Homo sapiens
ggggaaggagccagtttgccg

SEQ ID NO: 6337227 - DNA, 21 bp, Homo sapiens
ggggaaggagggtacagctgg

SEQ ID NO: 6337228 - DNA, 13 bp, Homo sapiens
ggggaaggcagag

SEQ ID NO: 6337229 - DNA, 13 bp, Homo sapiens
ggggaaggcaggg

SEQ ID NO: 6337230 - DNA, 17 bp, Homo sapiens
ggggaaggccttgctgt

SEQ ID NO: 6337231 - DNA, 18 bp, Homo sapiens
ggggaaggcgctgggtgc

SEQ ID NO: 6337232 - DNA, 21 bp, Homo sapiens
ggggaagggaaccagccctcc

SEQ ID NO: 6337233 - DNA, 12 bp, Homo sapiens
ggggaaggggac

SEQ ID NO: 6337234 - DNA, 12 bp, Homo sapiens
ggggaaggggcc

SEQ ID NO: 6337235 - DNA, 15 bp, Homo sapiens
ggggaaggggcctgg

SEQ ID NO: 6337236 - DNA, 12 bp, Homo sapiens
ggggaagggggt

SEQ ID NO: 6337237 - DNA, 14 bp, Homo sapiens
ggggaagggtgggg

SEQ ID NO: 6337238 - DNA, 16 bp, Homo sapiens
ggggaagtcctctggg

SEQ ID NO: 6337239 - DNA, 16 bp, Homo sapiens
ggggaagtgtgctgag

SEQ ID NO: 6337240 - DNA, 18 bp, Homo sapiens
ggggaatgtgtcctcctg

SEQ ID NO: 6337241 - DNA, 22 bp, Homo sapiens
ggggaatgtgtcctcctgctct

SEQ ID NO: 6337242 - DNA, 23 bp, Homo sapiens
ggggacaaccccccaagaccatc

SEQ ID NO: 6337243 - DNA, 17 bp, Homo sapiens
ggggacacaggatcctg

SEQ ID NO: 6337244 - DNA, 14 bp, Homo sapiens
ggggacaccagagc

SEQ ID NO: 6337245 - DNA, 15 bp, Homo sapiens
ggggacaccctcctg

SEQ ID NO: 6337246 - DNA, 17 bp, Homo sapiens
ggggacaccctcctgcc

SEQ ID NO: 6337247 - DNA, 15 bp, Homo sapiens
ggggacactgaacct

SEQ ID NO: 6337248 - DNA, 15 bp, Homo sapiens
ggggacagaccagcc

SEQ ID NO: 6337249 - DNA, 21 bp, Homo sapiens
ggggacagaccagcccttccc

SEQ ID NO: 6337250 - DNA, 23 bp, Homo sapiens
ggggacagagcaagaccctgcct

SEQ ID NO: 6337251 - DNA, 14 bp, Homo sapiens
ggggacagaggccc

SEQ ID NO: 6337252 - DNA, 18 bp, Homo sapiens
ggggacagaggccctgcc

SEQ ID NO: 6337253 - DNA, 14 bp, Homo sapiens
ggggacagctcctt

SEQ ID NO: 6337254 - DNA, 20 bp, Homo sapiens
ggggacagctccttctgtcc

SEQ ID NO: 6337255 - DNA, 19 bp, Homo sapiens
ggggacaggaacacccagc

SEQ ID NO: 6337256 - DNA, 22 bp, Homo sapiens
ggggacaggaacacccagcccc

SEQ ID NO: 6337257 - DNA, 22 bp, Homo sapiens
ggggacaggattgtctgctgcc

SEQ ID NO: 6337258 - DNA, 13 bp, Homo sapiens
ggggacaggcctc

SEQ ID NO: 6337259 - DNA, 17 bp, Homo sapiens
ggggacaggcctcacct

SEQ ID NO: 6337260 - DNA, 19 bp, Homo sapiens
ggggacagggctggcccag

SEQ ID NO: 6337261 - DNA, 20 bp, Homo sapiens
ggggacagttggcagagaag

SEQ ID NO: 6337262 - DNA, 18 bp, Homo sapiens
ggggaccaattctggaca

SEQ ID NO: 6337263 - DNA, 14 bp, Homo sapiens
ggggaccactgggc

SEQ ID NO: 6337264 - DNA, 12 bp, Homo sapiens
ggggaccagagc

SEQ ID NO: 6337265 - DNA, 13 bp, Homo sapiens
ggggaccagagct

SEQ ID NO: 6337266 - DNA, 21 bp, Homo sapiens
ggggacccacccagcccctct

SEQ ID NO: 6337267 - DNA, 13 bp, Homo sapiens
ggggacccaggct

SEQ ID NO: 6337268 - DNA, 19 bp, Homo sapiens
ggggacccaggctccgccc

SEQ ID NO: 6337269 - DNA, 19 bp, Homo sapiens
ggggacccatgggggctgt

SEQ ID NO: 6337270 - DNA, 18 bp, Homo sapiens
ggggaccccaacctcaga

SEQ ID NO: 6337271 - DNA, 13 bp, Homo sapiens
ggggacccccgcc

SEQ ID NO: 6337272 - DNA, 23 bp, Homo sapiens
ggggacccctcgcaaccctgcct

SEQ ID NO: 6337273 - DNA, 21 bp, Homo sapiens
ggggacccctggctctgggcc

SEQ ID NO: 6337274 - DNA, 14 bp, Homo sapiens
ggggacccgctggg

SEQ ID NO: 6337275 - DNA, 11 bp, Homo sapiens
ggggaccctgt

SEQ ID NO: 6337276 - DNA, 23 bp, Homo sapiens
ggggaccgggcccctctctaggg

SEQ ID NO: 6337277 - DNA, 15 bp, Homo sapiens
ggggacctaggctcc

SEQ ID NO: 6337278 - DNA, 17 bp, Homo sapiens
ggggacctaggctcctc

SEQ ID NO: 6337279 - DNA, 15 bp, Homo sapiens
ggggacctcaggcct

SEQ ID NO: 6337280 - DNA, 17 bp, Homo sapiens
ggggacctcaggcctgg

SEQ ID NO: 6337281 - DNA, 16 bp, Homo sapiens
ggggacctggaaggga

SEQ ID NO: 6337282 - DNA, 22 bp, Homo sapiens
ggggacctggtttgaatggaga

SEQ ID NO: 6337283 - DNA, 17 bp, Homo sapiens
ggggacctgtcccccac

SEQ ID NO: 6337284 - DNA, 21 bp, Homo sapiens
ggggacctgtcccccactctc

SEQ ID NO: 6337285 - DNA, 22 bp, Homo sapiens
ggggacctgtcccccactctct

SEQ ID NO: 6337286 - DNA, 16 bp, Homo sapiens
ggggaccttggtctga

SEQ ID NO: 6337287 - DNA, 16 bp, Homo sapiens
ggggacgcaggcccct

SEQ ID NO: 6337288 - DNA, 14 bp, Homo sapiens
ggggacgcccagcc

SEQ ID NO: 6337289 - DNA, 22 bp, Homo sapiens
ggggacgcccagcccccacccc

SEQ ID NO: 6337290 - DNA, 23 bp, Homo sapiens
ggggacgcccagcccccaccccc

SEQ ID NO: 6337291 - DNA, 18 bp, Homo sapiens
ggggacgcctgccctgcc

SEQ ID NO: 6337292 - DNA, 21 bp, Homo sapiens
ggggacgcctgtgtcacgagc

SEQ ID NO: 6337293 - DNA, 18 bp, Homo sapiens
ggggacgcgcacacacac

SEQ ID NO: 6337294 - DNA, 16 bp, Homo sapiens
ggggacgctccgctgc

SEQ ID NO: 6337295 - DNA, 18 bp, Homo sapiens
ggggacgttgctgagcca

SEQ ID NO: 6337296 - DNA, 21 bp, Homo sapiens
ggggactagcccctgtggaga

SEQ ID NO: 6337297 - DNA, 13 bp, Homo sapiens
ggggactcagccc

SEQ ID NO: 6337298 - DNA, 16 bp, Homo sapiens
ggggactcagccctga

SEQ ID NO: 6337299 - DNA, 16 bp, Homo sapiens
ggggactcaggaccag

SEQ ID NO: 6337300 - DNA, 11 bp, Homo sapiens
ggggactcctc

SEQ ID NO: 6337301 - DNA, 21 bp, Homo sapiens
ggggactctgagcgggaggca

SEQ ID NO: 6337302 - DNA, 23 bp, Homo sapiens
ggggactctgagcgggaggcaga

SEQ ID NO: 6337303 - DNA, 13 bp, Homo sapiens
ggggactctgccg

SEQ ID NO: 6337304 - DNA, 22 bp, Homo sapiens
ggggactctgggctatggacac

SEQ ID NO: 6337305 - DNA, 18 bp, Homo sapiens
ggggactgagctggggag

SEQ ID NO: 6337306 - DNA, 15 bp, Homo sapiens
ggggactgccacctc

SEQ ID NO: 6337307 - DNA, 17 bp, Homo sapiens
ggggactgccacctccc

SEQ ID NO: 6337308 - DNA, 13 bp, Homo sapiens
ggggactgccttg

SEQ ID NO: 6337309 - DNA, 16 bp, Homo sapiens
ggggactgctggctca

SEQ ID NO: 6337310 - DNA, 19 bp, Homo sapiens
ggggactgctttcagtgcc

SEQ ID NO: 6337311 - DNA, 21 bp, Homo sapiens
ggggactgctttcagtgcctg

SEQ ID NO: 6337312 - DNA, 12 bp, Homo sapiens
ggggactgggcc

SEQ ID NO: 6337313 - DNA, 22 bp, Homo sapiens
ggggactgggccatgggtcctc

SEQ ID NO: 6337314 - DNA, 14 bp, Homo sapiens
ggggacttctcttc

SEQ ID NO: 6337315 - DNA, 15 bp, Homo sapiens
ggggacttgtgccag

SEQ ID NO: 6337316 - DNA, 14 bp, Homo sapiens
ggggactttattta

SEQ ID NO: 6337317 - DNA, 16 bp, Homo sapiens
ggggagaaacccagag

SEQ ID NO: 6337318 - DNA, 16 bp, Homo sapiens
ggggagaaactgaagc

SEQ ID NO: 6337319 - DNA, 10 bp, Homo sapiens
ggggagaaag

SEQ ID NO: 6337320 - DNA, 11 bp, Homo sapiens
ggggagaaagt

SEQ ID NO: 6337321 - DNA, 13 bp, Homo sapiens
ggggagaagagcc

SEQ ID NO: 6337322 - DNA, 16 bp, Homo sapiens
ggggagaaggcctccc

SEQ ID NO: 6337323 - DNA, 22 bp, Homo sapiens
ggggagaagtgatatggtgaag

SEQ ID NO: 6337324 - DNA, 16 bp, Homo sapiens
ggggagacacctcaga

SEQ ID NO: 6337325 - DNA, 12 bp, Homo sapiens
ggggagacctgg

SEQ ID NO: 6337326 - DNA, 20 bp, Homo sapiens
ggggagacggaggttgcagt

SEQ ID NO: 6337327 - DNA, 17 bp, Homo sapiens
ggggagactgggctgag

SEQ ID NO: 6337328 - DNA, 18 bp, Homo sapiens
ggggagactgggctgagg

SEQ ID NO: 6337329 - DNA, 18 bp, Homo sapiens
ggggagagacaggcagcc

SEQ ID NO: 6337330 - DNA, 23 bp, Homo sapiens
ggggagagacaggcagcccagca

SEQ ID NO: 6337331 - DNA, 19 bp, Homo sapiens
ggggagagagcagagaagt

SEQ ID NO: 6337332 - DNA, 13 bp, Homo sapiens
ggggagaggcact

SEQ ID NO: 6337333 - DNA, 19 bp, Homo sapiens
ggggagagggacgcacagc

SEQ ID NO: 6337334 - DNA, 13 bp, Homo sapiens
ggggagaggggga

SEQ ID NO: 6337335 - DNA, 14 bp, Homo sapiens
ggggagaggggtca

SEQ ID NO: 6337336 - DNA, 22 bp, Homo sapiens
ggggagaggggtcacacccacc

SEQ ID NO: 6337337 - DNA, 17 bp, Homo sapiens
ggggagaggtcagcctt

SEQ ID NO: 6337338 - DNA, 14 bp, Homo sapiens
ggggagatggggag

SEQ ID NO: 6337339 - DNA, 23 bp, Homo sapiens
ggggagattctgggtttgcccag

SEQ ID NO: 6337340 - DNA, 21 bp, Homo sapiens
gttaacttattcaaagagaaa

SEQ ID NO: 6337341 - DNA, 21 bp, Homo sapiens
gttaacttcaggtaaaaactt

SEQ ID NO: 6337342 - DNA, 15 bp, Homo sapiens
gttaacttgaagaaa

SEQ ID NO: 6337343 - DNA, 23 bp, Homo sapiens
gttaactttaagactgagcacct

SEQ ID NO: 6337344 - DNA, 22 bp, Homo sapiens
gttaagaaaggatataaaagga

SEQ ID NO: 6337345 - DNA, 11 bp, Homo sapiens
gttaagaaata

SEQ ID NO: 6337346 - DNA, 12 bp, Homo sapiens
gttaagaaatac

SEQ ID NO: 6337347 - DNA, 20 bp, Homo sapiens
gttaagaaatctgtttttgt

SEQ ID NO: 6337348 - DNA, 15 bp, Homo sapiens
gttaagaagctgttg

SEQ ID NO: 6337349 - DNA, 21 bp, Homo sapiens
gttaagaatgaagttctgcta

SEQ ID NO: 6337350 - DNA, 13 bp, Homo sapiens
gttaagaatgtat

SEQ ID NO: 6337351 - DNA, 14 bp, Homo sapiens
gttaagaatttcaa

SEQ ID NO: 6337352 - DNA, 13 bp, Homo sapiens
gttaagacctggc

SEQ ID NO: 6337353 - DNA, 11 bp, Homo sapiens
gttaagactga

SEQ ID NO: 6337354 - DNA, 10 bp, Homo sapiens
gttaagagaa

SEQ ID NO: 6337355 - DNA, 14 bp, Homo sapiens
gttaagagaaactt

SEQ ID NO: 6337356 - DNA, 15 bp, Homo sapiens
gttaagatatgatgt

SEQ ID NO: 6337357 - DNA, 18 bp, Homo sapiens
gttaagcagcctttctgt

SEQ ID NO: 6337358 - DNA, 15 bp, Homo sapiens
gttaagcagtacatc

SEQ ID NO: 6337359 - DNA, 16 bp, Homo sapiens
gttaagcagtacatct

SEQ ID NO: 6337360 - DNA, 12 bp, Homo sapiens
gttaagccatat

SEQ ID NO: 6337361 - DNA, 15 bp, Homo sapiens
gttaagctctgctat

SEQ ID NO: 6337362 - DNA, 17 bp, Homo sapiens
gttaagcttctattttt

SEQ ID NO: 6337363 - DNA, 14 bp, Homo sapiens
gttaagctttgaca

SEQ ID NO: 6337364 - DNA, 16 bp, Homo sapiens
gttaagctttgacact

SEQ ID NO: 6337365 - DNA, 17 bp, Homo sapiens
gttaaggaaaaaaaacg

SEQ ID NO: 6337366 - DNA, 16 bp, Homo sapiens
gttaaggaaactctta

SEQ ID NO: 6337367 - DNA, 21 bp, Homo sapiens
gttaaggacccttttaagcat

SEQ ID NO: 6337368 - DNA, 12 bp, Homo sapiens
gttaaggacttc

SEQ ID NO: 6337369 - DNA, 11 bp, Homo sapiens
gttaaggcctg

SEQ ID NO: 6337370 - DNA, 17 bp, Homo sapiens
gttaagggaagctgata

SEQ ID NO: 6337371 - DNA, 14 bp, Homo sapiens
gttaagggcagagt

SEQ ID NO: 6337372 - DNA, 15 bp, Homo sapiens
gttaaggggatctaa

SEQ ID NO: 6337373 - DNA, 19 bp, Homo sapiens
gttaaggggatctaaaagg

SEQ ID NO: 6337374 - DNA, 22 bp, Homo sapiens
gttaaggttagaccttatgtta

SEQ ID NO: 6337375 - DNA, 14 bp, Homo sapiens
gttaaggttgaact

SEQ ID NO: 6337376 - DNA, 15 bp, Homo sapiens
gttaagtaattgcat

SEQ ID NO: 6337377 - DNA, 18 bp, Homo sapiens
gttaagtcaattctgtta

SEQ ID NO: 6337378 - DNA, 18 bp, Homo sapiens
gttaagtctatctggtat

SEQ ID NO: 6337379 - DNA, 13 bp, Homo sapiens
gttaagtctgttt

SEQ ID NO: 6337380 - DNA, 11 bp, Homo sapiens
gttaagtgaca

SEQ ID NO: 6337381 - DNA, 20 bp, Homo sapiens
gttaagtgggcattttgaca

SEQ ID NO: 6337382 - DNA, 15 bp, Homo sapiens
gttaagttttcttgt

SEQ ID NO: 6337383 - DNA, 16 bp, Homo sapiens
gttaataaaggtttcg

SEQ ID NO: 6337384 - DNA, 20 bp, Homo sapiens
gttaataagttgatgttttc

SEQ ID NO: 6337385 - DNA, 22 bp, Homo sapiens
gttaataataagataatgatga

SEQ ID NO: 6337386 - DNA, 23 bp, Homo sapiens
gttaataataatgactctaaaga

SEQ ID NO: 6337387 - DNA, 17 bp, Homo sapiens
gttaataataattatta

SEQ ID NO: 6337388 - DNA, 16 bp, Homo sapiens
gttaataatctatgat

SEQ ID NO: 6337389 - DNA, 15 bp, Homo sapiens
gttaatacaaggtat

SEQ ID NO: 6337390 - DNA, 20 bp, Homo sapiens
gttaatacacagtactttat

SEQ ID NO: 6337391 - DNA, 13 bp, Homo sapiens
gttaataccagct

SEQ ID NO: 6337392 - DNA, 12 bp, Homo sapiens
gttaatactagt

SEQ ID NO: 6337393 - DNA, 13 bp, Homo sapiens
gttaatactgaga

SEQ ID NO: 6337394 - DNA, 20 bp, Homo sapiens
gttaatactggatagcatga

SEQ ID NO: 6337395 - DNA, 23 bp, Homo sapiens
gttaatacttaacattgatttat

SEQ ID NO: 6337396 - DNA, 19 bp, Homo sapiens
gttaatagattatttcata

SEQ ID NO: 6337397 - DNA, 16 bp, Homo sapiens
gttaataggaggacag

SEQ ID NO: 6337398 - DNA, 14 bp, Homo sapiens
gttaatagttcctg

SEQ ID NO: 6337399 - DNA, 12 bp, Homo sapiens
gttaatataccc

SEQ ID NO: 6337400 - DNA, 15 bp, Homo sapiens
gttaatattaattta

SEQ ID NO: 6337401 - DNA, 23 bp, Homo sapiens
gttaatattaatttatatttgtc

SEQ ID NO: 6337402 - DNA, 18 bp, Homo sapiens
gttaatattggaagtgaa

SEQ ID NO: 6337403 - DNA, 15 bp, Homo sapiens
gttaatatttaacct

SEQ ID NO: 6337404 - DNA, 13 bp, Homo sapiens
gttaatatttctt

SEQ ID NO: 6337405 - DNA, 18 bp, Homo sapiens
gttaatattttatgtgta

SEQ ID NO: 6337406 - DNA, 12 bp, Homo sapiens
gttaatcaattt

SEQ ID NO: 6337407 - DNA, 22 bp, Homo sapiens
gttaatcaatttaaacccattt

SEQ ID NO: 6337408 - DNA, 21 bp, Homo sapiens
gttaatcagaaagaaaaaatt

SEQ ID NO: 6337409 - DNA, 20 bp, Homo sapiens
gttaatcagtgttgattcta

SEQ ID NO: 6337410 - DNA, 17 bp, Homo sapiens
gttaatcatcttctctt

SEQ ID NO: 6337411 - DNA, 19 bp, Homo sapiens
gttaatcatcttctctttt

SEQ ID NO: 6337412 - DNA, 21 bp, Homo sapiens
gttaatccaatcaatttaaat

SEQ ID NO: 6337413 - DNA, 16 bp, Homo sapiens
gttaatccctttgtct

SEQ ID NO: 6337414 - DNA, 15 bp, Homo sapiens
gttaatctcccagcc

SEQ ID NO: 6337415 - DNA, 17 bp, Homo sapiens
gttaatctcccagccca

SEQ ID NO: 6337416 - DNA, 20 bp, Homo sapiens
gttaatctgatgtataatgt

SEQ ID NO: 6337417 - DNA, 17 bp, Homo sapiens
gttaatcttaatgtata

SEQ ID NO: 6337418 - DNA, 12 bp, Homo sapiens
gttaatcttagg

SEQ ID NO: 6337419 - DNA, 21 bp, Homo sapiens
gttaatcttgctttctttgtt

SEQ ID NO: 6337420 - DNA, 23 bp, Homo sapiens
gttaatctttgaaaactcataca

SEQ ID NO: 6337421 - DNA, 13 bp, Homo sapiens
gttaatgaaataa

SEQ ID NO: 6337422 - DNA, 14 bp, Homo sapiens
gttaatgaaataaa

SEQ ID NO: 6337423 - DNA, 17 bp, Homo sapiens
gttaatgatggcagagg

SEQ ID NO: 6337424 - DNA, 16 bp, Homo sapiens
gttaatgattcttgtg

SEQ ID NO: 6337425 - DNA, 13 bp, Homo sapiens
gttaatgcattgt

SEQ ID NO: 6337426 - DNA, 13 bp, Homo sapiens
gttaatgctttct

SEQ ID NO: 6337427 - DNA, 20 bp, Homo sapiens
gttaatgtaatctgatggct

SEQ ID NO: 6337428 - DNA, 19 bp, Homo sapiens
gttaatgtagtatggtata

SEQ ID NO: 6337429 - DNA, 17 bp, Homo sapiens
gttaatgtatataaaaa

SEQ ID NO: 6337430 - DNA, 18 bp, Homo sapiens
gttaatgtatataaaaat

SEQ ID NO: 6337431 - DNA, 11 bp, Homo sapiens
gttaatgtatt

SEQ ID NO: 6337432 - DNA, 22 bp, Homo sapiens
gttaatgtcattgctaaaaaat

SEQ ID NO: 6337433 - DNA, 14 bp, Homo sapiens
gttaatgtgccaaa

SEQ ID NO: 6337434 - DNA, 12 bp, Homo sapiens
gttaatgtggac

SEQ ID NO: 6337435 - DNA, 21 bp, Homo sapiens
gttaattaaactgaagaagga

SEQ ID NO: 6337436 - DNA, 18 bp, Homo sapiens
gttaattaaatatttctt

SEQ ID NO: 6337437 - DNA, 16 bp, Homo sapiens
gttaattaatgtcatg

SEQ ID NO: 6337438 - DNA, 21 bp, Homo sapiens
gttaattaatgtcatgttgct

SEQ ID NO: 6337439 - DNA, 14 bp, Homo sapiens
gttaattacttttg

SEQ ID NO: 6337440 - DNA, 19 bp, Homo sapiens
gttaattataaacagcagg

SEQ ID NO: 6337441 - DNA, 18 bp, Homo sapiens
gttaattcagcactgatt

SEQ ID NO: 6337442 - DNA, 22 bp, Homo sapiens
gttaattcattaaaagttttat

SEQ ID NO: 6337443 - DNA, 19 bp, Homo sapiens
gttaattccaattatatga

SEQ ID NO: 6337444 - DNA, 15 bp, Homo sapiens
gttaattcctatgaa

SEQ ID NO: 6337445 - DNA, 19 bp, Homo sapiens
gttaattgattaaaatctg

SEQ ID NO: 6337446 - DNA, 20 bp, Homo sapiens
gttaattgattaaactgtat

SEQ ID NO: 6337447 - DNA, 19 bp, Homo sapiens
gttaattgcgtagaggcta

SEQ ID NO: 6337448 - DNA, 12 bp, Homo sapiens
gttaatttaagt

SEQ ID NO: 6337449 - DNA, 23 bp, Homo sapiens
gttaatttaagttttgacaagct

SEQ ID NO: 6337450 - DNA, 17 bp, Homo sapiens
gttaatttataatgtat

SEQ ID NO: 6337451 - DNA, 17 bp, Homo sapiens
gttaatttattttgctc

SEQ ID NO: 6337452 - DNA, 20 bp, Homo sapiens
gttaatttattttgctccct

SEQ ID NO: 6337453 - DNA, 21 bp, Homo sapiens
gttaatttattttgctccctc

SEQ ID NO: 6337454 - DNA, 23 bp, Homo sapiens
gttaatttattttgctccctctg

SEQ ID NO: 6337455 - DNA, 18 bp, Homo sapiens
gttaatttcttgcaattt

SEQ ID NO: 6337456 - DNA, 22 bp, Homo sapiens
gttaatttcttgcaatttgaag

SEQ ID NO: 6337457 - DNA, 22 bp, Homo sapiens
gttaatttggaccattttcctg

SEQ ID NO: 6337458 - DNA, 18 bp, Homo sapiens
gttaatttgtgtgttttt

SEQ ID NO: 6337459 - DNA, 16 bp, Homo sapiens
gttaattttaatttct

SEQ ID NO: 6337460 - DNA, 18 bp, Homo sapiens
gttaattttcctcatttt

SEQ ID NO: 6337461 - DNA, 21 bp, Homo sapiens
gttaattttgctaactgggtt

SEQ ID NO: 6337462 - DNA, 15 bp, Homo sapiens
gttaatttttacatg

SEQ ID NO: 6337463 - DNA, 20 bp, Homo sapiens
gttaatttttccaactacta

SEQ ID NO: 6337464 - DNA, 16 bp, Homo sapiens
gttaatttttcctgca

SEQ ID NO: 6337465 - DNA, 20 bp, Homo sapiens
gttaatttttcctgcatgtt

SEQ ID NO: 6337466 - DNA, 21 bp, Homo sapiens
gttaatttttccttcctctgt

SEQ ID NO: 6337467 - DNA, 18 bp, Homo sapiens
gttaattttttggtacaa

SEQ ID NO: 6337468 - DNA, 21 bp, Homo sapiens
gttaattttttggtacaaaaa

SEQ ID NO: 6337469 - DNA, 16 bp, Homo sapiens
gttacaaaatgtaact

SEQ ID NO: 6337470 - DNA, 9 bp, Homo sapiens
gttacaaac

SEQ ID NO: 6337471 - DNA, 20 bp, Homo sapiens
gttacaaattataatgtatt

SEQ ID NO: 6337472 - DNA, 18 bp, Homo sapiens
gttacaacagatttgtga

SEQ ID NO: 6337473 - DNA, 21 bp, Homo sapiens
gttacaacagatttgtgaact

SEQ ID NO: 6337474 - DNA, 22 bp, Homo sapiens
gttacaacagatttgtgaactc

SEQ ID NO: 6337475 - DNA, 23 bp, Homo sapiens
gttacaacattaattttatgaac

SEQ ID NO: 6337476 - DNA, 13 bp, Homo sapiens
gttacaagtgttc

SEQ ID NO: 6337477 - DNA, 16 bp, Homo sapiens
gttacaagtgttctta

SEQ ID NO: 6337478 - DNA, 17 bp, Homo sapiens
gttacaagtttgctaaa

SEQ ID NO: 6337479 - DNA, 19 bp, Homo sapiens
gttacaataaagtttacaa

SEQ ID NO: 6337480 - DNA, 20 bp, Homo sapiens
gttacaataaagtttacaag

SEQ ID NO: 6337481 - DNA, 18 bp, Homo sapiens
gttacaatcattgctgaa

SEQ ID NO: 6337482 - DNA, 17 bp, Homo sapiens
gttacaatcgttctgtg

SEQ ID NO: 6337483 - DNA, 20 bp, Homo sapiens
gttacaatggcctttatcct

SEQ ID NO: 6337484 - DNA, 16 bp, Homo sapiens
gttacacaaaaatcta

SEQ ID NO: 6337485 - DNA, 17 bp, Homo sapiens
gttacacaaaggacctc

SEQ ID NO: 6337486 - DNA, 20 bp, Homo sapiens
gttacacattaagtaatcaa

SEQ ID NO: 6337487 - DNA, 16 bp, Homo sapiens
gttacacatttttcag

SEQ ID NO: 6337488 - DNA, 22 bp, Homo sapiens
gttacaccctttcttgacaaaa

SEQ ID NO: 6337489 - DNA, 18 bp, Homo sapiens
gttacactggatgaaaat

SEQ ID NO: 6337490 - DNA, 14 bp, Homo sapiens
gttacactgggctg

SEQ ID NO: 6337491 - DNA, 14 bp, Homo sapiens
gttacactgttaga

SEQ ID NO: 6337492 - DNA, 20 bp, Homo sapiens
gttacactgttagaacacta

SEQ ID NO: 6337493 - DNA, 13 bp, Homo sapiens
gttacagaagccc

SEQ ID NO: 6337494 - DNA, 13 bp, Homo sapiens
gttacagacaaag

SEQ ID NO: 6337495 - DNA, 15 bp, Homo sapiens
gttacagacaaagcg

SEQ ID NO: 6337496 - DNA, 17 bp, Homo sapiens
gttacagagacctatgt

SEQ ID NO: 6337497 - DNA, 16 bp, Homo sapiens
gttacagccaagtgcc

SEQ ID NO: 6337498 - DNA, 12 bp, Homo sapiens
gttacagcctgg

SEQ ID NO: 6337499 - DNA, 19 bp, Homo sapiens
gttacagcgagaggcagag

SEQ ID NO: 6337500 - DNA, 15 bp, Homo sapiens
gttacagcttcgctg

SEQ ID NO: 6337501 - DNA, 23 bp, Homo sapiens
gttacaggggttgtttttaaaga

SEQ ID NO: 6337502 - DNA, 9 bp, Homo sapiens
gttacataa

SEQ ID NO: 6337503 - DNA, 22 bp, Homo sapiens
gttacataagggcattatgtaa

SEQ ID NO: 6337504 - DNA, 22 bp, Homo sapiens
gttacataatcagtatatttgg

SEQ ID NO: 6337505 - DNA, 18 bp, Homo sapiens
gttacatcctgctacact

SEQ ID NO: 6337506 - DNA, 13 bp, Homo sapiens
gttacatgaatta

SEQ ID NO: 6337507 - DNA, 17 bp, Homo sapiens
gttacatgcataaaagg

SEQ ID NO: 6337508 - DNA, 19 bp, Homo sapiens
gttacatgcatacttcaaa

SEQ ID NO: 6337509 - DNA, 22 bp, Homo sapiens
gttacatgcatacttcaaaagt

SEQ ID NO: 6337510 - DNA, 23 bp, Homo sapiens
gttacatgcatacttcaaaagta

SEQ ID NO: 6337511 - DNA, 19 bp, Homo sapiens
gttacatggaaaagttctt

SEQ ID NO: 6337512 - DNA, 14 bp, Homo sapiens
gttacatgtttgca

SEQ ID NO: 6337513 - DNA, 16 bp, Homo sapiens
gttacattaatgttaa

SEQ ID NO: 6337514 - DNA, 22 bp, Homo sapiens
gttacattgctggtcttgtaag

SEQ ID NO: 6337515 - DNA, 23 bp, Homo sapiens
gttacattgctggtcttgtaaga

SEQ ID NO: 6337516 - DNA, 22 bp, Homo sapiens
gttacattgtcaaagcttgccg

SEQ ID NO: 6337517 - DNA, 17 bp, Homo sapiens
gttaccaaagcaatatt

SEQ ID NO: 6337518 - DNA, 19 bp, Homo sapiens
gttaccaagtatgaagtat

SEQ ID NO: 6337519 - DNA, 21 bp, Homo sapiens
ggggagcaaatcatctgcatt

SEQ ID NO: 6337520 - DNA, 13 bp, Homo sapiens
ggggagcaaggct

SEQ ID NO: 6337521 - DNA, 21 bp, Homo sapiens
ggggagcacaggtgtctgcct

SEQ ID NO: 6337522 - DNA, 14 bp, Homo sapiens
ggggagcaggcagc

SEQ ID NO: 6337523 - DNA, 20 bp, Homo sapiens
ggggagcaggtctctggcag

SEQ ID NO: 6337524 - DNA, 17 bp, Homo sapiens
ggggagccaacagcagc

SEQ ID NO: 6337525 - DNA, 19 bp, Homo sapiens
ggggagccagctgcttgac

SEQ ID NO: 6337526 - DNA, 11 bp, Homo sapiens
ggggagcccac

SEQ ID NO: 6337527 - DNA, 21 bp, Homo sapiens
ggggagcccactgaggggcca

SEQ ID NO: 6337528 - DNA, 14 bp, Homo sapiens
ggggagcccagtga

SEQ ID NO: 6337529 - DNA, 11 bp, Homo sapiens
ggggagccctc

SEQ ID NO: 6337530 - DNA, 19 bp, Homo sapiens
ggggagccctcaggctccc

SEQ ID NO: 6337531 - DNA, 15 bp, Homo sapiens
ggggagcctggagcc

SEQ ID NO: 6337532 - DNA, 18 bp, Homo sapiens
ggggagcggagcttggcc

SEQ ID NO: 6337533 - DNA, 22 bp, Homo sapiens
ggggagcggagcttggccctgc

SEQ ID NO: 6337534 - DNA, 12 bp, Homo sapiens
ggggagctctgg

SEQ ID NO: 6337535 - DNA, 16 bp, Homo sapiens
ggggagctctggaggt

SEQ ID NO: 6337536 - DNA, 16 bp, Homo sapiens
ggggagctgaggggca

SEQ ID NO: 6337537 - DNA, 19 bp, Homo sapiens
ggggagctgaggggcaggg

SEQ ID NO: 6337538 - DNA, 15 bp, Homo sapiens
ggggagctgcagagc

SEQ ID NO: 6337539 - DNA, 18 bp, Homo sapiens
ggggagctgcagagcagc

SEQ ID NO: 6337540 - DNA, 12 bp, Homo sapiens
ggggagctggac

SEQ ID NO: 6337541 - DNA, 15 bp, Homo sapiens
ggggagctgggcctg

SEQ ID NO: 6337542 - DNA, 22 bp, Homo sapiens
ggggagcttggctgagggtctg

SEQ ID NO: 6337543 - DNA, 21 bp, Homo sapiens
ggggaggaagaggctgcactg

SEQ ID NO: 6337544 - DNA, 21 bp, Homo sapiens
ggggaggaagttggctgagcc

SEQ ID NO: 6337545 - DNA, 18 bp, Homo sapiens
ggggaggaatcctggacc

SEQ ID NO: 6337546 - DNA, 14 bp, Homo sapiens
ggggaggagatgga

SEQ ID NO: 6337547 - DNA, 13 bp, Homo sapiens
ggggaggagcacc

SEQ ID NO: 6337548 - DNA, 16 bp, Homo sapiens
ggggaggagcaccccc

SEQ ID NO: 6337549 - DNA, 22 bp, Homo sapiens
ggggaggagcacccccagcctc

SEQ ID NO: 6337550 - DNA, 22 bp, Homo sapiens
ggggaggaggaacgggcagcca

SEQ ID NO: 6337551 - DNA, 14 bp, Homo sapiens
ggggaggaggaagc

SEQ ID NO: 6337552 - DNA, 21 bp, Homo sapiens
ggggaggaggacttggagggt

SEQ ID NO: 6337553 - DNA, 21 bp, Homo sapiens
ggggaggagtcaggggctctg

SEQ ID NO: 6337554 - DNA, 19 bp, Homo sapiens
ggggaggatcactggagcc

SEQ ID NO: 6337555 - DNA, 12 bp, Homo sapiens
ggggaggcaaga

SEQ ID NO: 6337556 - DNA, 20 bp, Homo sapiens
ggggaggcacaaagggcagg

SEQ ID NO: 6337557 - DNA, 13 bp, Homo sapiens
ggggaggcacact

SEQ ID NO: 6337558 - DNA, 20 bp, Homo sapiens
ggggaggcagctccaacagc

SEQ ID NO: 6337559 - DNA, 14 bp, Homo sapiens
ggggaggccagtgt

SEQ ID NO: 6337560 - DNA, 16 bp, Homo sapiens
ggggaggcccaaatga

SEQ ID NO: 6337561 - DNA, 17 bp, Homo sapiens
ggggaggcccaaatgat

SEQ ID NO: 6337562 - DNA, 15 bp, Homo sapiens
ggggaggcccatccc

SEQ ID NO: 6337563 - DNA, 21 bp, Homo sapiens
ggggaggcccctgaggcagcc

SEQ ID NO: 6337564 - DNA, 16 bp, Homo sapiens
ggggaggccctgcctg

SEQ ID NO: 6337565 - DNA, 17 bp, Homo sapiens
ggggaggccctgcctga

SEQ ID NO: 6337566 - DNA, 22 bp, Homo sapiens
ggggaggcctctttgccccgac

SEQ ID NO: 6337567 - DNA, 17 bp, Homo sapiens
ggggaggcttccagctc

SEQ ID NO: 6337568 - DNA, 12 bp, Homo sapiens
ggggagggaggt

SEQ ID NO: 6337569 - DNA, 14 bp, Homo sapiens
ggggagggatgaag

SEQ ID NO: 6337570 - DNA, 12 bp, Homo sapiens
ggggagggcagg

SEQ ID NO: 6337571 - DNA, 22 bp, Homo sapiens
ggggagggcaggtccagctctg

SEQ ID NO: 6337572 - DNA, 21 bp, Homo sapiens
ggggagggccgtaccccaccc

SEQ ID NO: 6337573 - DNA, 23 bp, Homo sapiens
ggggagggctcctggggcagaga

SEQ ID NO: 6337574 - DNA, 12 bp, Homo sapiens
ggggagggctgc

SEQ ID NO: 6337575 - DNA, 14 bp, Homo sapiens
ggggagggctgcga

SEQ ID NO: 6337576 - DNA, 21 bp, Homo sapiens
ggggaggggccctcaggccat

SEQ ID NO: 6337577 - DNA, 21 bp, Homo sapiens
ggggaggggcctagggagccg

SEQ ID NO: 6337578 - DNA, 15 bp, Homo sapiens
ggggagggggatccg

SEQ ID NO: 6337579 - DNA, 17 bp, Homo sapiens
ggggagggtaggcagga

SEQ ID NO: 6337580 - DNA, 22 bp, Homo sapiens
ggggagggtcttttaccctgtg

SEQ ID NO: 6337581 - DNA, 12 bp, Homo sapiens
ggggaggtggga

SEQ ID NO: 6337582 - DNA, 20 bp, Homo sapiens
ggggaggtgggtgtgggtgg

SEQ ID NO: 6337583 - DNA, 22 bp, Homo sapiens
ggggagtaaagaattattttgt

SEQ ID NO: 6337584 - DNA, 22 bp, Homo sapiens
ggggagtaataggaccagagcg

SEQ ID NO: 6337585 - DNA, 15 bp, Homo sapiens
ggggagtagccaagc

SEQ ID NO: 6337586 - DNA, 15 bp, Homo sapiens
ggggagtccctgcca

SEQ ID NO: 6337587 - DNA, 17 bp, Homo sapiens
ggggagtctgaagcaga

SEQ ID NO: 6337588 - DNA, 11 bp, Homo sapiens
ggggagtgagt

SEQ ID NO: 6337589 - DNA, 19 bp, Homo sapiens
ggggagtgggacagagtct

SEQ ID NO: 6337590 - DNA, 18 bp, Homo sapiens
ggggagtggttaggcagc

SEQ ID NO: 6337591 - DNA, 17 bp, Homo sapiens
ggggagttaagacctgg

SEQ ID NO: 6337592 - DNA, 21 bp, Homo sapiens
ggggagttaagacctggcagc

SEQ ID NO: 6337593 - DNA, 22 bp, Homo sapiens
ggggagtttccgcggcggcttc

SEQ ID NO: 6337594 - DNA, 17 bp, Homo sapiens
ggggataccataaaaag

SEQ ID NO: 6337595 - DNA, 21 bp, Homo sapiens
ggggatagaggggctgcaggg

SEQ ID NO: 6337596 - DNA, 17 bp, Homo sapiens
ggggatcacagcgtttc

SEQ ID NO: 6337597 - DNA, 15 bp, Homo sapiens
ggggatcataaagtt

SEQ ID NO: 6337598 - DNA, 23 bp, Homo sapiens
ggggatcatgttaaaaatagcag

SEQ ID NO: 6337599 - DNA, 13 bp, Homo sapiens
ggggatccagcca

SEQ ID NO: 6337600 - DNA, 14 bp, Homo sapiens
ggggatccagccac

SEQ ID NO: 6337601 - DNA, 17 bp, Homo sapiens
ggggatccagccacttc

SEQ ID NO: 6337602 - DNA, 14 bp, Homo sapiens
ggggatcccccgcc

SEQ ID NO: 6337603 - DNA, 13 bp, Homo sapiens
ggggatccccgcc

SEQ ID NO: 6337604 - DNA, 22 bp, Homo sapiens
ggggatctaaaaggaggacagg

SEQ ID NO: 6337605 - DNA, 23 bp, Homo sapiens
ggggatctaaaaggaggacaggg

SEQ ID NO: 6337606 - DNA, 21 bp, Homo sapiens
ggggatctgcattccccgctg

SEQ ID NO: 6337607 - DNA, 23 bp, Homo sapiens
ggggatctgcattccccgctgcc

SEQ ID NO: 6337608 - DNA, 22 bp, Homo sapiens
ggggatctggggggtggggagg

SEQ ID NO: 6337609 - DNA, 21 bp, Homo sapiens
ggggatgcaaataaagcctgc

SEQ ID NO: 6337610 - DNA, 17 bp, Homo sapiens
ggggatgcccctggccc

SEQ ID NO: 6337611 - DNA, 13 bp, Homo sapiens
ggggatgcttcat

SEQ ID NO: 6337612 - DNA, 15 bp, Homo sapiens
ggggatggacacccc

SEQ ID NO: 6337613 - DNA, 22 bp, Homo sapiens
ggggatggattggcctccaggg

SEQ ID NO: 6337614 - DNA, 13 bp, Homo sapiens
ggggatggccagg

SEQ ID NO: 6337615 - DNA, 21 bp, Homo sapiens
ggggatggtggcacaggcact

SEQ ID NO: 6337616 - DNA, 20 bp, Homo sapiens
ggggatggttccccaggagg

SEQ ID NO: 6337617 - DNA, 18 bp, Homo sapiens
ggggatgtgggagggagc

SEQ ID NO: 6337618 - DNA, 14 bp, Homo sapiens
ggggatgttctgcc

SEQ ID NO: 6337619 - DNA, 23 bp, Homo sapiens
ggggatgttctgcctctccctgg

SEQ ID NO: 6337620 - DNA, 22 bp, Homo sapiens
ggggattagctagactaggaga

SEQ ID NO: 6337621 - DNA, 20 bp, Homo sapiens
ggggattcaggggctttggg

SEQ ID NO: 6337622 - DNA, 17 bp, Homo sapiens
ggggattcccttccttc

SEQ ID NO: 6337623 - DNA, 16 bp, Homo sapiens
ggggattctgagcagt

SEQ ID NO: 6337624 - DNA, 19 bp, Homo sapiens
ggggatttcaagggactgg

SEQ ID NO: 6337625 - DNA, 15 bp, Homo sapiens
ggggatttctcccag

SEQ ID NO: 6337626 - DNA, 13 bp, Homo sapiens
ggggcaagagctc

SEQ ID NO: 6337627 - DNA, 19 bp, Homo sapiens
ggggcaagagctcaggaga

SEQ ID NO: 6337628 - DNA, 18 bp, Homo sapiens
ggggcaagatccaggtgg

SEQ ID NO: 6337629 - DNA, 12 bp, Homo sapiens
ggggcaagccag

SEQ ID NO: 6337630 - DNA, 17 bp, Homo sapiens
ggggcaagccagggccc

SEQ ID NO: 6337631 - DNA, 14 bp, Homo sapiens
ggggcaagcctgta

SEQ ID NO: 6337632 - DNA, 13 bp, Homo sapiens
ggggcaaggagaa

SEQ ID NO: 6337633 - DNA, 15 bp, Homo sapiens
ggggcaatggggaga

SEQ ID NO: 6337634 - DNA, 14 bp, Homo sapiens
ggggcacaagactg

SEQ ID NO: 6337635 - DNA, 16 bp, Homo sapiens
ggggcacaccactgcc

SEQ ID NO: 6337636 - DNA, 18 bp, Homo sapiens
ggggcacaccactgccct

SEQ ID NO: 6337637 - DNA, 21 bp, Homo sapiens
ggggcacagacctctcccacc

SEQ ID NO: 6337638 - DNA, 20 bp, Homo sapiens
ggggcacagctgtctgccag

SEQ ID NO: 6337639 - DNA, 22 bp, Homo sapiens
ggggcacagctgtctgccaggc

SEQ ID NO: 6337640 - DNA, 23 bp, Homo sapiens
ggggcacagctgtctgccaggca

SEQ ID NO: 6337641 - DNA, 13 bp, Homo sapiens
ggggcacaggagg

SEQ ID NO: 6337642 - DNA, 14 bp, Homo sapiens
ggggcaccatctgg

SEQ ID NO: 6337643 - DNA, 16 bp, Homo sapiens
ggggcaccggctcagg

SEQ ID NO: 6337644 - DNA, 13 bp, Homo sapiens
ggggcacctggga

SEQ ID NO: 6337645 - DNA, 17 bp, Homo sapiens
ggggcacggactgtcca

SEQ ID NO: 6337646 - DNA, 14 bp, Homo sapiens
ggggcacggctctg

SEQ ID NO: 6337647 - DNA, 19 bp, Homo sapiens
ggggcactaggtaggcttc

SEQ ID NO: 6337648 - DNA, 14 bp, Homo sapiens
ggggcactgtggtc

SEQ ID NO: 6337649 - DNA, 13 bp, Homo sapiens
ggggcagaaggag

SEQ ID NO: 6337650 - DNA, 15 bp, Homo sapiens
ggggcagagaggaag

SEQ ID NO: 6337651 - DNA, 14 bp, Homo sapiens
ggggcagagccagg

SEQ ID NO: 6337652 - DNA, 15 bp, Homo sapiens
ggggcagagccagga

SEQ ID NO: 6337653 - DNA, 17 bp, Homo sapiens
ggggcagagccctgctc

SEQ ID NO: 6337654 - DNA, 14 bp, Homo sapiens
ggggcagagcctcc

SEQ ID NO: 6337655 - DNA, 13 bp, Homo sapiens
ggggcagagcttc

SEQ ID NO: 6337656 - DNA, 23 bp, Homo sapiens
ggggcagaggcagtacctgggca

SEQ ID NO: 6337657 - DNA, 16 bp, Homo sapiens
ggggcagagggcagag

SEQ ID NO: 6337658 - DNA, 22 bp, Homo sapiens
ggggcagagggcagaggctgga

SEQ ID NO: 6337659 - DNA, 16 bp, Homo sapiens
ggggcagaggggcagc

SEQ ID NO: 6337660 - DNA, 14 bp, Homo sapiens
ggggcagagtggag

SEQ ID NO: 6337661 - DNA, 19 bp, Homo sapiens
ggggcagagtggagcccag

SEQ ID NO: 6337662 - DNA, 17 bp, Homo sapiens
ggggcagagtggcctgt

SEQ ID NO: 6337663 - DNA, 22 bp, Homo sapiens
ggggcagagtggcctgtgagca

SEQ ID NO: 6337664 - DNA, 13 bp, Homo sapiens
ggggcagcactcc

SEQ ID NO: 6337665 - DNA, 13 bp, Homo sapiens
ggggcagccacac

SEQ ID NO: 6337666 - DNA, 15 bp, Homo sapiens
ggggcagccagccct

SEQ ID NO: 6337667 - DNA, 16 bp, Homo sapiens
ggggcagccagccctg

SEQ ID NO: 6337668 - DNA, 14 bp, Homo sapiens
ggggcagccctgag

SEQ ID NO: 6337669 - DNA, 14 bp, Homo sapiens
ggggcagcctccag

SEQ ID NO: 6337670 - DNA, 12 bp, Homo sapiens
ggggcagcctct

SEQ ID NO: 6337671 - DNA, 14 bp, Homo sapiens
ggggcagcctgcct

SEQ ID NO: 6337672 - DNA, 13 bp, Homo sapiens
ggggcagctcctg

SEQ ID NO: 6337673 - DNA, 18 bp, Homo sapiens
ggggcagctcctgaccaa

SEQ ID NO: 6337674 - DNA, 19 bp, Homo sapiens
ggggcagctgccagagaag

SEQ ID NO: 6337675 - DNA, 23 bp, Homo sapiens
ggggcagcttctattagccagtc

SEQ ID NO: 6337676 - DNA, 12 bp, Homo sapiens
ggggcaggaagt

SEQ ID NO: 6337677 - DNA, 23 bp, Homo sapiens
ggggcaggaatcaaggagcctcc

SEQ ID NO: 6337678 - DNA, 16 bp, Homo sapiens
ggggcaggactgaaga

SEQ ID NO: 6337679 - DNA, 17 bp, Homo sapiens
ggggcaggagaggctgg

SEQ ID NO: 6337680 - DNA, 11 bp, Homo sapiens
ggggcaggagg

SEQ ID NO: 6337681 - DNA, 14 bp, Homo sapiens
ggggcaggaggcct

SEQ ID NO: 6337682 - DNA, 15 bp, Homo sapiens
ggggcaggaggcctg

SEQ ID NO: 6337683 - DNA, 11 bp, Homo sapiens
ggggcaggagt

SEQ ID NO: 6337684 - DNA, 19 bp, Homo sapiens
ggggcaggagtagctgagc

SEQ ID NO: 6337685 - DNA, 18 bp, Homo sapiens
ggggcaggagtgccagga

SEQ ID NO: 6337686 - DNA, 17 bp, Homo sapiens
ggggcaggatgggggag

SEQ ID NO: 6337687 - DNA, 14 bp, Homo sapiens
ggggcaggcacagc

SEQ ID NO: 6337688 - DNA, 11 bp, Homo sapiens
ggggcaggcag

SEQ ID NO: 6337689 - DNA, 14 bp, Homo sapiens
ggggcaggcagcta

SEQ ID NO: 6337690 - DNA, 13 bp, Homo sapiens
ggggcaggccagg

SEQ ID NO: 6337691 - DNA, 21 bp, Homo sapiens
ggggcaggccctgcactgtcc

SEQ ID NO: 6337692 - DNA, 11 bp, Homo sapiens
ggggcaggcct

SEQ ID NO: 6337693 - DNA, 23 bp, Homo sapiens
ggggcaggcctcccaagctgatg

SEQ ID NO: 6337694 - DNA, 12 bp, Homo sapiens
ggggcaggcctg

SEQ ID NO: 6337695 - DNA, 12 bp, Homo sapiens
ggggcaggcctt

SEQ ID NO: 6337696 - DNA, 22 bp, Homo sapiens
ggggcaggctctctcctctctc

SEQ ID NO: 6337697 - DNA, 13 bp, Homo sapiens
ggggcaggctggg

SEQ ID NO: 6337698 - DNA, 15 bp, Homo sapiens
ggggcaggctgggcc

SEQ ID NO: 6337699 - DNA, 13 bp, Homo sapiens
ggggcagggagag

SEQ ID NO: 6337700 - DNA, 22 bp, Homo sapiens
gttaccaatgtaacactggcca

SEQ ID NO: 6337701 - DNA, 21 bp, Homo sapiens
gttaccactcttttgctgtgc

SEQ ID NO: 6337702 - DNA, 14 bp, Homo sapiens
gttaccagacttca

SEQ ID NO: 6337703 - DNA, 21 bp, Homo sapiens
gttaccagtgttaataaatgg

SEQ ID NO: 6337704 - DNA, 20 bp, Homo sapiens
gttaccatactgtctctgga

SEQ ID NO: 6337705 - DNA, 21 bp, Homo sapiens
gttaccatatttatccatttg

SEQ ID NO: 6337706 - DNA, 22 bp, Homo sapiens
gttaccatgggtgtggatggca

SEQ ID NO: 6337707 - DNA, 23 bp, Homo sapiens
gttaccatgggtgtggatggcag

SEQ ID NO: 6337708 - DNA, 19 bp, Homo sapiens
gttaccattaaaccatctc

SEQ ID NO: 6337709 - DNA, 21 bp, Homo sapiens
gttaccattatttaatttgta

SEQ ID NO: 6337710 - DNA, 13 bp, Homo sapiens
gttaccattcaca

SEQ ID NO: 6337711 - DNA, 17 bp, Homo sapiens
gttacccactgccatgc

SEQ ID NO: 6337712 - DNA, 20 bp, Homo sapiens
gttacccagggctctgcagc

SEQ ID NO: 6337713 - DNA, 20 bp, Homo sapiens
gttacccagggtggagtgca

SEQ ID NO: 6337714 - DNA, 17 bp, Homo sapiens
gttacccattcaaccat

SEQ ID NO: 6337715 - DNA, 20 bp, Homo sapiens
gttaccccaccctgcccact

SEQ ID NO: 6337716 - DNA, 15 bp, Homo sapiens
gttacccctgaaatc

SEQ ID NO: 6337717 - DNA, 21 bp, Homo sapiens
gttaccgagacatgaatacta

SEQ ID NO: 6337718 - DNA, 15 bp, Homo sapiens
gttaccgagtatctg

SEQ ID NO: 6337719 - DNA, 16 bp, Homo sapiens
gttaccgagtatctgt

SEQ ID NO: 6337720 - DNA, 17 bp, Homo sapiens
gttaccgagtatctgta

SEQ ID NO: 6337721 - DNA, 18 bp, Homo sapiens
gttaccgctggccgagct

SEQ ID NO: 6337722 - DNA, 10 bp, Homo sapiens
gttacctaat

SEQ ID NO: 6337723 - DNA, 13 bp, Homo sapiens
gttacctaattat

SEQ ID NO: 6337724 - DNA, 16 bp, Homo sapiens
gttacctactttgact

SEQ ID NO: 6337725 - DNA, 14 bp, Homo sapiens
gttacctacttttt

SEQ ID NO: 6337726 - DNA, 12 bp, Homo sapiens
gttacctccctc

SEQ ID NO: 6337727 - DNA, 13 bp, Homo sapiens
gttacctccctcg

SEQ ID NO: 6337728 - DNA, 21 bp, Homo sapiens
gttacctctatataccaaagc

SEQ ID NO: 6337729 - DNA, 22 bp, Homo sapiens
gttacctgaaaacactgtgcac

SEQ ID NO: 6337730 - DNA, 21 bp, Homo sapiens
gttacctgatcaatgacagag

SEQ ID NO: 6337731 - DNA, 21 bp, Homo sapiens
gttacctggagaagtagtatt

SEQ ID NO: 6337732 - DNA, 13 bp, Homo sapiens
gttacctgtagat

SEQ ID NO: 6337733 - DNA, 20 bp, Homo sapiens
gttacctgtcattttgcact

SEQ ID NO: 6337734 - DNA, 21 bp, Homo sapiens
gttacctgtcttgctcctggg

SEQ ID NO: 6337735 - DNA, 13 bp, Homo sapiens
gttacctgtgtgc

SEQ ID NO: 6337736 - DNA, 18 bp, Homo sapiens
gttacctgttccattgtt

SEQ ID NO: 6337737 - DNA, 15 bp, Homo sapiens
gttaccttactgaaa

SEQ ID NO: 6337738 - DNA, 20 bp, Homo sapiens
gttaccttatagttactgtg

SEQ ID NO: 6337739 - DNA, 22 bp, Homo sapiens
gttaccttatagttactgtgta

SEQ ID NO: 6337740 - DNA, 15 bp, Homo sapiens
gttacctttgctgtc

SEQ ID NO: 6337741 - DNA, 18 bp, Homo sapiens
gttaccttttataagaca

SEQ ID NO: 6337742 - DNA, 22 bp, Homo sapiens
gttacggagggaggacatcata

SEQ ID NO: 6337743 - DNA, 17 bp, Homo sapiens
gttacgtataatgcttt

SEQ ID NO: 6337744 - DNA, 18 bp, Homo sapiens
gttacgtttgaagtctga

SEQ ID NO: 6337745 - DNA, 12 bp, Homo sapiens
gttactaaaaag

SEQ ID NO: 6337746 - DNA, 15 bp, Homo sapiens
gttactaaaaagtac

SEQ ID NO: 6337747 - DNA, 22 bp, Homo sapiens
gttactaaatagaaaacctaat

SEQ ID NO: 6337748 - DNA, 13 bp, Homo sapiens
gttactaagaaga

SEQ ID NO: 6337749 - DNA, 22 bp, Homo sapiens
gttactaagatgaaattgccaa

SEQ ID NO: 6337750 - DNA, 22 bp, Homo sapiens
gttactaatatatctgtaacac

SEQ ID NO: 6337751 - DNA, 15 bp, Homo sapiens
gttactatcctggct

SEQ ID NO: 6337752 - DNA, 14 bp, Homo sapiens
gttactatctgctt

SEQ ID NO: 6337753 - DNA, 15 bp, Homo sapiens
gttactatttttata

SEQ ID NO: 6337754 - DNA, 22 bp, Homo sapiens
gttactatttttatattctata

SEQ ID NO: 6337755 - DNA, 15 bp, Homo sapiens
gttactcagaattct

SEQ ID NO: 6337756 - DNA, 17 bp, Homo sapiens
gttactcagatataaga

SEQ ID NO: 6337757 - DNA, 20 bp, Homo sapiens
gttactcagcagcagagagc

SEQ ID NO: 6337758 - DNA, 16 bp, Homo sapiens
gttactcagccctggg

SEQ ID NO: 6337759 - DNA, 18 bp, Homo sapiens
gttactcagccctgggcc

SEQ ID NO: 6337760 - DNA, 14 bp, Homo sapiens
gttactcagggctc

SEQ ID NO: 6337761 - DNA, 12 bp, Homo sapiens
gttactcagggt

SEQ ID NO: 6337762 - DNA, 23 bp, Homo sapiens
gttactccattactgtgatttct

SEQ ID NO: 6337763 - DNA, 15 bp, Homo sapiens
gttactcccctggct

SEQ ID NO: 6337764 - DNA, 20 bp, Homo sapiens
gttactccctacactgatgc

SEQ ID NO: 6337765 - DNA, 16 bp, Homo sapiens
gttactctaaatagaa

SEQ ID NO: 6337766 - DNA, 22 bp, Homo sapiens
gttactctaaatagaaatatag

SEQ ID NO: 6337767 - DNA, 14 bp, Homo sapiens
gttactctccaacc

SEQ ID NO: 6337768 - DNA, 17 bp, Homo sapiens
gttactctccaacctgg

SEQ ID NO: 6337769 - DNA, 12 bp, Homo sapiens
gttactctgtcc

SEQ ID NO: 6337770 - DNA, 15 bp, Homo sapiens
gttactcttgggaca

SEQ ID NO: 6337771 - DNA, 21 bp, Homo sapiens
gttactgaaggtgatggaggt

SEQ ID NO: 6337772 - DNA, 21 bp, Homo sapiens
gttactgagatgtcttcaatg

SEQ ID NO: 6337773 - DNA, 13 bp, Homo sapiens
gttactgaggacc

SEQ ID NO: 6337774 - DNA, 12 bp, Homo sapiens
gttactgagtga

SEQ ID NO: 6337775 - DNA, 17 bp, Homo sapiens
gttactgattctcctgt

SEQ ID NO: 6337776 - DNA, 19 bp, Homo sapiens
gttactgcctataatctta

SEQ ID NO: 6337777 - DNA, 16 bp, Homo sapiens
gttactgctgattctt

SEQ ID NO: 6337778 - DNA, 20 bp, Homo sapiens
gttactgctgattcttgtaa

SEQ ID NO: 6337779 - DNA, 22 bp, Homo sapiens
gttactgctgattcttgtaaat

SEQ ID NO: 6337780 - DNA, 20 bp, Homo sapiens
gttactgcttctctttgtgc

SEQ ID NO: 6337781 - DNA, 23 bp, Homo sapiens
gttactgcttctctttgtgcagt

SEQ ID NO: 6337782 - DNA, 19 bp, Homo sapiens
gttactggataaattgttt

SEQ ID NO: 6337783 - DNA, 22 bp, Homo sapiens
gttactggcacctgaaattaat

SEQ ID NO: 6337784 - DNA, 22 bp, Homo sapiens
gttactggctctttgtgtgtct

SEQ ID NO: 6337785 - DNA, 18 bp, Homo sapiens
gttactggttggtgttct

SEQ ID NO: 6337786 - DNA, 13 bp, Homo sapiens
gttactggtttca

SEQ ID NO: 6337787 - DNA, 14 bp, Homo sapiens
gttactgtaaaatg

SEQ ID NO: 6337788 - DNA, 19 bp, Homo sapiens
gttactgtaaaatgcaaaa

SEQ ID NO: 6337789 - DNA, 12 bp, Homo sapiens
gttactgtaaat

SEQ ID NO: 6337790 - DNA, 13 bp, Homo sapiens
gttactgtaaatg

SEQ ID NO: 6337791 - DNA, 17 bp, Homo sapiens
gttactgtatttttcag

SEQ ID NO: 6337792 - DNA, 16 bp, Homo sapiens
gttactgtcattccca

SEQ ID NO: 6337793 - DNA, 16 bp, Homo sapiens
gttactgtctgtagtg

SEQ ID NO: 6337794 - DNA, 17 bp, Homo sapiens
gttactgtctgtagtgt

SEQ ID NO: 6337795 - DNA, 15 bp, Homo sapiens
gttactgtgtgaaga

SEQ ID NO: 6337796 - DNA, 14 bp, Homo sapiens
gttactgttcatgg

SEQ ID NO: 6337797 - DNA, 13 bp, Homo sapiens
gttactgttcttg

SEQ ID NO: 6337798 - DNA, 14 bp, Homo sapiens
gttactgttcttgc

SEQ ID NO: 6337799 - DNA, 15 bp, Homo sapiens
gttactgttcttgct

SEQ ID NO: 6337800 - DNA, 17 bp, Homo sapiens
gttactgttcttgctgc

SEQ ID NO: 6337801 - DNA, 19 bp, Homo sapiens
gttactgttcttgctgcta

SEQ ID NO: 6337802 - DNA, 22 bp, Homo sapiens
gttactgttcttgctgctagaa

SEQ ID NO: 6337803 - DNA, 15 bp, Homo sapiens
gttactgttgcactg

SEQ ID NO: 6337804 - DNA, 15 bp, Homo sapiens
gttactgttgcagct

SEQ ID NO: 6337805 - DNA, 14 bp, Homo sapiens
gttactgttgtgac

SEQ ID NO: 6337806 - DNA, 17 bp, Homo sapiens
gttactgtttttatcct

SEQ ID NO: 6337807 - DNA, 15 bp, Homo sapiens
gttacttaaacatca

SEQ ID NO: 6337808 - DNA, 12 bp, Homo sapiens
gttacttaagat

SEQ ID NO: 6337809 - DNA, 17 bp, Homo sapiens
gttacttacctaaacag

SEQ ID NO: 6337810 - DNA, 16 bp, Homo sapiens
gttacttcactttaat

SEQ ID NO: 6337811 - DNA, 15 bp, Homo sapiens
gttacttcagccacc

SEQ ID NO: 6337812 - DNA, 13 bp, Homo sapiens
gttacttcccttt

SEQ ID NO: 6337813 - DNA, 13 bp, Homo sapiens
gttacttccttcc

SEQ ID NO: 6337814 - DNA, 13 bp, Homo sapiens
gttacttctctga

SEQ ID NO: 6337815 - DNA, 19 bp, Homo sapiens
gttacttgaaataccagtg

SEQ ID NO: 6337816 - DNA, 15 bp, Homo sapiens
gttacttgcttcagt

SEQ ID NO: 6337817 - DNA, 21 bp, Homo sapiens
gttactttatgtttgtctttt

SEQ ID NO: 6337818 - DNA, 21 bp, Homo sapiens
gttactttccaattctccttt

SEQ ID NO: 6337819 - DNA, 20 bp, Homo sapiens
gttactttctttcagatgtt

SEQ ID NO: 6337820 - DNA, 13 bp, Homo sapiens
gttactttgtaat

SEQ ID NO: 6337821 - DNA, 17 bp, Homo sapiens
gttactttgtaattttt

SEQ ID NO: 6337822 - DNA, 21 bp, Homo sapiens
gttacttttcatatttgcact

SEQ ID NO: 6337823 - DNA, 17 bp, Homo sapiens
gttacttttccttgcat

SEQ ID NO: 6337824 - DNA, 15 bp, Homo sapiens
gttactttttgtaga

SEQ ID NO: 6337825 - DNA, 17 bp, Homo sapiens
gttagaaaaaactggaa

SEQ ID NO: 6337826 - DNA, 16 bp, Homo sapiens
gttagaaaatgactta

SEQ ID NO: 6337827 - DNA, 21 bp, Homo sapiens
gttagaaaatgacttatttct

SEQ ID NO: 6337828 - DNA, 22 bp, Homo sapiens
gttagaaaatgacttatttctg

SEQ ID NO: 6337829 - DNA, 18 bp, Homo sapiens
gttagaaaattcagctcc

SEQ ID NO: 6337830 - DNA, 14 bp, Homo sapiens
gttagaacactatt

SEQ ID NO: 6337831 - DNA, 19 bp, Homo sapiens
gttagaacactattttcag

SEQ ID NO: 6337832 - DNA, 18 bp, Homo sapiens
gttagaacctagattcaa

SEQ ID NO: 6337833 - DNA, 11 bp, Homo sapiens
gttagaagaac

SEQ ID NO: 6337834 - DNA, 23 bp, Homo sapiens
gttagaagcaaggagaaaatata

SEQ ID NO: 6337835 - DNA, 21 bp, Homo sapiens
gttagaagtgcaccaggtcac

SEQ ID NO: 6337836 - DNA, 16 bp, Homo sapiens
gttagaatcaaatact

SEQ ID NO: 6337837 - DNA, 18 bp, Homo sapiens
gttagaatcaaatactca

SEQ ID NO: 6337838 - DNA, 17 bp, Homo sapiens
gttagaatctattttct

SEQ ID NO: 6337839 - DNA, 22 bp, Homo sapiens
gttagaatctattttctatgta

SEQ ID NO: 6337840 - DNA, 19 bp, Homo sapiens
gttagaatgagatctgaat

SEQ ID NO: 6337841 - DNA, 20 bp, Homo sapiens
gttagaatgatcatctgtaa

SEQ ID NO: 6337842 - DNA, 15 bp, Homo sapiens
gttagaatgcaagca

SEQ ID NO: 6337843 - DNA, 12 bp, Homo sapiens
gttagaattcct

SEQ ID NO: 6337844 - DNA, 21 bp, Homo sapiens
gttagaattgccttaaggcca

SEQ ID NO: 6337845 - DNA, 14 bp, Homo sapiens
gttagacaagcctg

SEQ ID NO: 6337846 - DNA, 15 bp, Homo sapiens
gttagacaagcctgg

SEQ ID NO: 6337847 - DNA, 18 bp, Homo sapiens
gttagacaagcctggagg

SEQ ID NO: 6337848 - DNA, 21 bp, Homo sapiens
gttagacccctgggtgggccc

SEQ ID NO: 6337849 - DNA, 23 bp, Homo sapiens
gttagacgccttccaggtcagga

SEQ ID NO: 6337850 - DNA, 22 bp, Homo sapiens
gttagactgccagctcttccta

SEQ ID NO: 6337851 - DNA, 19 bp, Homo sapiens
gttagacttgctccctctc

SEQ ID NO: 6337852 - DNA, 19 bp, Homo sapiens
gttagacttgtgtgcatgg

SEQ ID NO: 6337853 - DNA, 15 bp, Homo sapiens
gttagagaatggcct

SEQ ID NO: 6337854 - DNA, 19 bp, Homo sapiens
gttagagaatggcctgaga

SEQ ID NO: 6337855 - DNA, 17 bp, Homo sapiens
gttagagagaaagagaa

SEQ ID NO: 6337856 - DNA, 22 bp, Homo sapiens
gttagagaggtagcgagctgct

SEQ ID NO: 6337857 - DNA, 18 bp, Homo sapiens
gttagagatgcctccctg

SEQ ID NO: 6337858 - DNA, 23 bp, Homo sapiens
gttagagattttacaaaatgctg

SEQ ID NO: 6337859 - DNA, 18 bp, Homo sapiens
gttagagatttttttgtt

SEQ ID NO: 6337860 - DNA, 19 bp, Homo sapiens
gttagagcagcctcgtgga

SEQ ID NO: 6337861 - DNA, 21 bp, Homo sapiens
gttagagcccattaatcttga

SEQ ID NO: 6337862 - DNA, 14 bp, Homo sapiens
gttagagggaacag

SEQ ID NO: 6337863 - DNA, 22 bp, Homo sapiens
gttagagtccaacgtggggcag

SEQ ID NO: 6337864 - DNA, 20 bp, Homo sapiens
gttagatattattttagctt

SEQ ID NO: 6337865 - DNA, 20 bp, Homo sapiens
gttagatgctattaagaagg

SEQ ID NO: 6337866 - DNA, 21 bp, Homo sapiens
gttagatgctattaagaaggc

SEQ ID NO: 6337867 - DNA, 21 bp, Homo sapiens
gttagattttgtattcagggg

SEQ ID NO: 6337868 - DNA, 15 bp, Homo sapiens
gttagcaatatttat

SEQ ID NO: 6337869 - DNA, 16 bp, Homo sapiens
gttagcacagaggatg

SEQ ID NO: 6337870 - DNA, 21 bp, Homo sapiens
gttagcactgaactgctttta

SEQ ID NO: 6337871 - DNA, 17 bp, Homo sapiens
gttagcagagtctgtct

SEQ ID NO: 6337872 - DNA, 19 bp, Homo sapiens
gttagcagggatgttcctt

SEQ ID NO: 6337873 - DNA, 18 bp, Homo sapiens
gttagcatacacatttta

SEQ ID NO: 6337874 - DNA, 17 bp, Homo sapiens
gttagcatccaggctgg

SEQ ID NO: 6337875 - DNA, 21 bp, Homo sapiens
gttagcatccaggctggccag

SEQ ID NO: 6337876 - DNA, 11 bp, Homo sapiens
gttagccaaac

SEQ ID NO: 6337877 - DNA, 15 bp, Homo sapiens
gttagccaaacaaca

SEQ ID NO: 6337878 - DNA, 13 bp, Homo sapiens
ggggcagggaggc

SEQ ID NO: 6337879 - DNA, 12 bp, Homo sapiens
ggggcagggccc

SEQ ID NO: 6337880 - DNA, 13 bp, Homo sapiens
ggggcagggccca

SEQ ID NO: 6337881 - DNA, 16 bp, Homo sapiens
ggggcagggcctggcc

SEQ ID NO: 6337882 - DNA, 16 bp, Homo sapiens
ggggcagggcctgggc

SEQ ID NO: 6337883 - DNA, 13 bp, Homo sapiens
ggggcaggggcag

SEQ ID NO: 6337884 - DNA, 17 bp, Homo sapiens
ggggcaggggggagagg

SEQ ID NO: 6337885 - DNA, 20 bp, Homo sapiens
ggggcaggtcaggaccagga

SEQ ID NO: 6337886 - DNA, 19 bp, Homo sapiens
ggggcagtactcctccctg

SEQ ID NO: 6337887 - DNA, 14 bp, Homo sapiens
ggggcagtcacctg

SEQ ID NO: 6337888 - DNA, 11 bp, Homo sapiens
ggggcagtctg

SEQ ID NO: 6337889 - DNA, 15 bp, Homo sapiens
ggggcagtgtgagga

SEQ ID NO: 6337890 - DNA, 20 bp, Homo sapiens
ggggcagttagagcagcctc

SEQ ID NO: 6337891 - DNA, 19 bp, Homo sapiens
ggggcatagaaactgagga

SEQ ID NO: 6337892 - DNA, 20 bp, Homo sapiens
ggggcatagaaactgaggag

SEQ ID NO: 6337893 - DNA, 23 bp, Homo sapiens
ggggcatagaaactgaggagtag

SEQ ID NO: 6337894 - DNA, 15 bp, Homo sapiens
ggggcatagcctttc

SEQ ID NO: 6337895 - DNA, 17 bp, Homo sapiens
ggggcatcagccagcta

SEQ ID NO: 6337896 - DNA, 16 bp, Homo sapiens
ggggcatcctgcttcc

SEQ ID NO: 6337897 - DNA, 18 bp, Homo sapiens
ggggcatcctgcttcctg

SEQ ID NO: 6337898 - DNA, 14 bp, Homo sapiens
ggggcatctgcccc

SEQ ID NO: 6337899 - DNA, 14 bp, Homo sapiens
ggggcatctgtctg

SEQ ID NO: 6337900 - DNA, 13 bp, Homo sapiens
ggggcatgaaaaa

SEQ ID NO: 6337901 - DNA, 17 bp, Homo sapiens
ggggcatgaccagatgc

SEQ ID NO: 6337902 - DNA, 16 bp, Homo sapiens
ggggcatgctggggca

SEQ ID NO: 6337903 - DNA, 20 bp, Homo sapiens
ggggcatggacagggccagg

SEQ ID NO: 6337904 - DNA, 21 bp, Homo sapiens
ggggcatggttccttccctgg

SEQ ID NO: 6337905 - DNA, 18 bp, Homo sapiens
ggggcatgtattggcctg

SEQ ID NO: 6337906 - DNA, 23 bp, Homo sapiens
ggggcatgtattggcctggaggt

SEQ ID NO: 6337907 - DNA, 17 bp, Homo sapiens
ggggcatttagggagca

SEQ ID NO: 6337908 - DNA, 16 bp, Homo sapiens
ggggccaaaaggaaaa

SEQ ID NO: 6337909 - DNA, 19 bp, Homo sapiens
ggggccaacctcaggctcc

SEQ ID NO: 6337910 - DNA, 20 bp, Homo sapiens
ggggccaacctcaggctcct

SEQ ID NO: 6337911 - DNA, 21 bp, Homo sapiens
ggggccaacctcaggctccta

SEQ ID NO: 6337912 - DNA, 15 bp, Homo sapiens
ggggccaaggacagg

SEQ ID NO: 6337913 - DNA, 14 bp, Homo sapiens
ggggccaccaaagc

SEQ ID NO: 6337914 - DNA, 17 bp, Homo sapiens
ggggccaccctggcccg

SEQ ID NO: 6337915 - DNA, 15 bp, Homo sapiens
ggggccactgaccca

SEQ ID NO: 6337916 - DNA, 22 bp, Homo sapiens
ggggccactgtgtttctgtgct

SEQ ID NO: 6337917 - DNA, 21 bp, Homo sapiens
ggggccacttggtagtgtccc

SEQ ID NO: 6337918 - DNA, 20 bp, Homo sapiens
ggggccagaatggctgtcct

SEQ ID NO: 6337919 - DNA, 13 bp, Homo sapiens
ggggccagacaca

SEQ ID NO: 6337920 - DNA, 15 bp, Homo sapiens
ggggccagacacaga

SEQ ID NO: 6337921 - DNA, 17 bp, Homo sapiens
ggggccagactggctgc

SEQ ID NO: 6337922 - DNA, 21 bp, Homo sapiens
ggggccagactggctgcacag

SEQ ID NO: 6337923 - DNA, 15 bp, Homo sapiens
ggggccagaggctgg

SEQ ID NO: 6337924 - DNA, 16 bp, Homo sapiens
ggggccagaggctggg

SEQ ID NO: 6337925 - DNA, 24 bp, Homo sapiens
ggggccagatgattttcctccctg

SEQ ID NO: 6337926 - DNA, 22 bp, Homo sapiens
ggggccagcagagggcgccacc

SEQ ID NO: 6337927 - DNA, 15 bp, Homo sapiens
ggggccagcccctcc

SEQ ID NO: 6337928 - DNA, 19 bp, Homo sapiens
ggggccagccggacacaag

SEQ ID NO: 6337929 - DNA, 16 bp, Homo sapiens
ggggccagcggccctc

SEQ ID NO: 6337930 - DNA, 18 bp, Homo sapiens
ggggccagcggccctccc

SEQ ID NO: 6337931 - DNA, 22 bp, Homo sapiens
ggggccagcggccctcccaggc

SEQ ID NO: 6337932 - DNA, 14 bp, Homo sapiens
ggggccagctccag

SEQ ID NO: 6337933 - DNA, 12 bp, Homo sapiens
ggggccagctgg

SEQ ID NO: 6337934 - DNA, 13 bp, Homo sapiens
ggggccagctggg

SEQ ID NO: 6337935 - DNA, 19 bp, Homo sapiens
ggggccagctggtgctgca

SEQ ID NO: 6337936 - DNA, 11 bp, Homo sapiens
ggggccaggac

SEQ ID NO: 6337937 - DNA, 14 bp, Homo sapiens
ggggccaggacacc

SEQ ID NO: 6337938 - DNA, 21 bp, Homo sapiens
ggggccaggacaccagtccag

SEQ ID NO: 6337939 - DNA, 12 bp, Homo sapiens
ggggccaggacc

SEQ ID NO: 6337940 - DNA, 12 bp, Homo sapiens
ggggccaggagt

SEQ ID NO: 6337941 - DNA, 19 bp, Homo sapiens
ggggccaggagtggggaga

SEQ ID NO: 6337942 - DNA, 23 bp, Homo sapiens
ggggccaggcaggggtgggagag

SEQ ID NO: 6337943 - DNA, 12 bp, Homo sapiens
ggggccaggccc

SEQ ID NO: 6337944 - DNA, 13 bp, Homo sapiens
ggggccaggccca

SEQ ID NO: 6337945 - DNA, 12 bp, Homo sapiens
ggggccaggcct

SEQ ID NO: 6337946 - DNA, 15 bp, Homo sapiens
ggggccagggctgga

SEQ ID NO: 6337947 - DNA, 18 bp, Homo sapiens
ggggccagggctggatgg

SEQ ID NO: 6337948 - DNA, 21 bp, Homo sapiens
ggggccagtggggaactgagg

SEQ ID NO: 6337949 - DNA, 18 bp, Homo sapiens
ggggccatattcttcctg

SEQ ID NO: 6337950 - DNA, 14 bp, Homo sapiens
ggggccatgaggcc

SEQ ID NO: 6337951 - DNA, 16 bp, Homo sapiens
ggggccatgaggcctc

SEQ ID NO: 6337952 - DNA, 17 bp, Homo sapiens
ggggccatggaagctgg

SEQ ID NO: 6337953 - DNA, 13 bp, Homo sapiens
ggggccatgggca

SEQ ID NO: 6337954 - DNA, 20 bp, Homo sapiens
ggggccatgttcccagaacc

SEQ ID NO: 6337955 - DNA, 21 bp, Homo sapiens
ggggcccaagcatgccccacc

SEQ ID NO: 6337956 - DNA, 17 bp, Homo sapiens
ggggcccaagttgcagt

SEQ ID NO: 6337957 - DNA, 11 bp, Homo sapiens
ggggcccacaa

SEQ ID NO: 6337958 - DNA, 22 bp, Homo sapiens
ggggcccacaggaagctcagcc

SEQ ID NO: 6337959 - DNA, 17 bp, Homo sapiens
ggggcccaccctctgcc

SEQ ID NO: 6337960 - DNA, 19 bp, Homo sapiens
ggggcccagcgctctcctg

SEQ ID NO: 6337961 - DNA, 18 bp, Homo sapiens
ggggcccagggaagcctg

SEQ ID NO: 6337962 - DNA, 19 bp, Homo sapiens
ggggcccagggcaagctcc

SEQ ID NO: 6337963 - DNA, 12 bp, Homo sapiens
ggggcccagggg

SEQ ID NO: 6337964 - DNA, 14 bp, Homo sapiens
ggggcccaggggct

SEQ ID NO: 6337965 - DNA, 12 bp, Homo sapiens
ggggcccagtcc

SEQ ID NO: 6337966 - DNA, 14 bp, Homo sapiens
ggggcccagtcctt

SEQ ID NO: 6337967 - DNA, 16 bp, Homo sapiens
ggggcccatggaggag

SEQ ID NO: 6337968 - DNA, 19 bp, Homo sapiens
ggggcccatggaggagaca

SEQ ID NO: 6337969 - DNA, 14 bp, Homo sapiens
ggggcccatggccc

SEQ ID NO: 6337970 - DNA, 19 bp, Homo sapiens
ggggcccattcagcctcgt

SEQ ID NO: 6337971 - DNA, 19 bp, Homo sapiens
ggggcccattctgcatgcc

SEQ ID NO: 6337972 - DNA, 22 bp, Homo sapiens
ggggcccattctgcatgccctc

SEQ ID NO: 6337973 - DNA, 23 bp, Homo sapiens
ggggccccacctcggcacacact

SEQ ID NO: 6337974 - DNA, 17 bp, Homo sapiens
ggggccccagatctgcc

SEQ ID NO: 6337975 - DNA, 19 bp, Homo sapiens
ggggccccagcgtctgcag

SEQ ID NO: 6337976 - DNA, 17 bp, Homo sapiens
ggggcccccagcaccct

SEQ ID NO: 6337977 - DNA, 18 bp, Homo sapiens
ggggcccccgtgttcagg

SEQ ID NO: 6337978 - DNA, 14 bp, Homo sapiens
ggggccccgccagg

SEQ ID NO: 6337979 - DNA, 17 bp, Homo sapiens
ggggccccgccagggct

SEQ ID NO: 6337980 - DNA, 20 bp, Homo sapiens
ggggccccgccagggctggg

SEQ ID NO: 6337981 - DNA, 21 bp, Homo sapiens
ggggccccgccagggctgggg

SEQ ID NO: 6337982 - DNA, 22 bp, Homo sapiens
ggggccccgccagggctgggga

SEQ ID NO: 6337983 - DNA, 14 bp, Homo sapiens
ggggccccggctcc

SEQ ID NO: 6337984 - DNA, 22 bp, Homo sapiens
ggggccccgggacccacggagc

SEQ ID NO: 6337985 - DNA, 18 bp, Homo sapiens
ggggccccggggctggca

SEQ ID NO: 6337986 - DNA, 23 bp, Homo sapiens
ggggccccgggttcagcctggcc

SEQ ID NO: 6337987 - DNA, 15 bp, Homo sapiens
ggggcccctcccctc

SEQ ID NO: 6337988 - DNA, 19 bp, Homo sapiens
ggggcccctcctctgtgct

SEQ ID NO: 6337989 - DNA, 18 bp, Homo sapiens
ggggcccctctcagccct

SEQ ID NO: 6337990 - DNA, 13 bp, Homo sapiens
ggggcccctgctc

SEQ ID NO: 6337991 - DNA, 19 bp, Homo sapiens
ggggcccgacaggtgggcc

SEQ ID NO: 6337992 - DNA, 19 bp, Homo sapiens
ggggcccgcctgccacctc

SEQ ID NO: 6337993 - DNA, 20 bp, Homo sapiens
ggggcccgcttgcctcggct

SEQ ID NO: 6337994 - DNA, 21 bp, Homo sapiens
ggggcccgcttgcctcggctc

SEQ ID NO: 6337995 - DNA, 23 bp, Homo sapiens
ggggcccgcttgcctcggctcct

SEQ ID NO: 6337996 - DNA, 19 bp, Homo sapiens
ggggcccgttgtctccctg

SEQ ID NO: 6337997 - DNA, 21 bp, Homo sapiens
ggggcccgttgtctccctggc

SEQ ID NO: 6337998 - DNA, 12 bp, Homo sapiens
ggggccctcagg

SEQ ID NO: 6337999 - DNA, 13 bp, Homo sapiens
ggggccctgagcc

SEQ ID NO: 6338000 - DNA, 10 bp, Homo sapiens
ggggccctgc

SEQ ID NO: 6338001 - DNA, 14 bp, Homo sapiens
ggggccctgcccca

SEQ ID NO: 6338002 - DNA, 16 bp, Homo sapiens
ggggccctgccccacc

SEQ ID NO: 6338003 - DNA, 11 bp, Homo sapiens
ggggccctggg

SEQ ID NO: 6338004 - DNA, 14 bp, Homo sapiens
ggggccctgggcct

SEQ ID NO: 6338005 - DNA, 14 bp, Homo sapiens
ggggccctgtacag

SEQ ID NO: 6338006 - DNA, 22 bp, Homo sapiens
ggggcccttccagattgggggc

SEQ ID NO: 6338007 - DNA, 14 bp, Homo sapiens
ggggcccttggagc

SEQ ID NO: 6338008 - DNA, 18 bp, Homo sapiens
ggggcccttggagcgtgg

SEQ ID NO: 6338009 - DNA, 18 bp, Homo sapiens
ggggccgccgctgaccct

SEQ ID NO: 6338010 - DNA, 14 bp, Homo sapiens
ggggccgctgccac

SEQ ID NO: 6338011 - DNA, 13 bp, Homo sapiens
ggggccgctggcc

SEQ ID NO: 6338012 - DNA, 14 bp, Homo sapiens
ggggccgctggccc

SEQ ID NO: 6338013 - DNA, 16 bp, Homo sapiens
ggggccgctggcccag

SEQ ID NO: 6338014 - DNA, 16 bp, Homo sapiens
ggggccgctggggtcc

SEQ ID NO: 6338015 - DNA, 21 bp, Homo sapiens
ggggccgcttcgccatgtgct

SEQ ID NO: 6338016 - DNA, 18 bp, Homo sapiens
ggggccggagcctttgga

SEQ ID NO: 6338017 - DNA, 16 bp, Homo sapiens
ggggccggccagtggc

SEQ ID NO: 6338018 - DNA, 20 bp, Homo sapiens
ggggccggcggggcccacgc

SEQ ID NO: 6338019 - DNA, 19 bp, Homo sapiens
ggggccggctggcctggag

SEQ ID NO: 6338020 - DNA, 22 bp, Homo sapiens
ggggccggctggcctggaggct

SEQ ID NO: 6338021 - DNA, 16 bp, Homo sapiens
ggggccgggcaggtcc

SEQ ID NO: 6338022 - DNA, 21 bp, Homo sapiens
ggggccgggcaggtcctgccc

SEQ ID NO: 6338023 - DNA, 18 bp, Homo sapiens
ggggccgggctggcttct

SEQ ID NO: 6338024 - DNA, 17 bp, Homo sapiens
ggggccgggggcagtct

SEQ ID NO: 6338025 - DNA, 16 bp, Homo sapiens
ggggccggggggaggg

SEQ ID NO: 6338026 - DNA, 22 bp, Homo sapiens
ggggccgtgtcccgcggtgctg

SEQ ID NO: 6338027 - DNA, 21 bp, Homo sapiens
ggggcctagcgatctctcctg

SEQ ID NO: 6338028 - DNA, 20 bp, Homo sapiens
ggggcctaggcctcagccag

SEQ ID NO: 6338029 - DNA, 22 bp, Homo sapiens
ggggcctcaatctaaggccttc

SEQ ID NO: 6338030 - DNA, 14 bp, Homo sapiens
ggggcctcacccag

SEQ ID NO: 6338031 - DNA, 18 bp, Homo sapiens
ggggcctcacccagaagg

SEQ ID NO: 6338032 - DNA, 19 bp, Homo sapiens
ggggcctcagcctggggct

SEQ ID NO: 6338033 - DNA, 14 bp, Homo sapiens
ggggcctcaggctc

SEQ ID NO: 6338034 - DNA, 15 bp, Homo sapiens
ggggcctccagaagc

SEQ ID NO: 6338035 - DNA, 19 bp, Homo sapiens
ggggcctccagaagctgct

SEQ ID NO: 6338036 - DNA, 21 bp, Homo sapiens
ggggcctccatgggccccagg

SEQ ID NO: 6338037 - DNA, 20 bp, Homo sapiens
ggggcctctgacgccgcgca

SEQ ID NO: 6338038 - DNA, 21 bp, Homo sapiens
ggggcctctgcctccaggagg

SEQ ID NO: 6338039 - DNA, 13 bp, Homo sapiens
ggggcctctggct

SEQ ID NO: 6338040 - DNA, 14 bp, Homo sapiens
ggggcctgactgct

SEQ ID NO: 6338041 - DNA, 15 bp, Homo sapiens
ggggcctgagagaat

SEQ ID NO: 6338042 - DNA, 16 bp, Homo sapiens
ggggcctgaggctcct

SEQ ID NO: 6338043 - DNA, 21 bp, Homo sapiens
ggggcctgcagaaggaaagaa

SEQ ID NO: 6338044 - DNA, 18 bp, Homo sapiens
ggggcctgcaggccccag

SEQ ID NO: 6338045 - DNA, 20 bp, Homo sapiens
ggggcctgccacctggaccc

SEQ ID NO: 6338046 - DNA, 12 bp, Homo sapiens
ggggcctgccct

SEQ ID NO: 6338047 - DNA, 20 bp, Homo sapiens
ggggcctgccctctgcccca

SEQ ID NO: 6338048 - DNA, 19 bp, Homo sapiens
ggggcctgcgcccagagct

SEQ ID NO: 6338049 - DNA, 23 bp, Homo sapiens
ggggcctgcggggttccctgcgc

SEQ ID NO: 6338050 - DNA, 14 bp, Homo sapiens
ggggcctggacctg

SEQ ID NO: 6338051 - DNA, 13 bp, Homo sapiens
ggggcctggactg

SEQ ID NO: 6338052 - DNA, 13 bp, Homo sapiens
ggggcctggagag

SEQ ID NO: 6338053 - DNA, 15 bp, Homo sapiens
ggggcctggagaggg

SEQ ID NO: 6338054 - DNA, 11 bp, Homo sapiens
ggggcctggca

SEQ ID NO: 6338055 - DNA, 19 bp, Homo sapiens
ggggcctggctggctgagg

SEQ ID NO: 6338056 - DNA, 14 bp, Homo sapiens
ggggcctggcttgc

SEQ ID NO: 6338057 - DNA, 19 bp, Homo sapiens
ggggcctggcttgctccag

SEQ ID NO: 6338058 - DNA, 16 bp, Homo sapiens
gttagccccagaaaat

SEQ ID NO: 6338059 - DNA, 14 bp, Homo sapiens
gttagccccaggga

SEQ ID NO: 6338060 - DNA, 15 bp, Homo sapiens
gttagccctcagtca

SEQ ID NO: 6338061 - DNA, 13 bp, Homo sapiens
gttagcctcttgc

SEQ ID NO: 6338062 - DNA, 15 bp, Homo sapiens
gttagcctggtgaca

SEQ ID NO: 6338063 - DNA, 20 bp, Homo sapiens
gttagcctggtgacaggcag

SEQ ID NO: 6338064 - DNA, 21 bp, Homo sapiens
gttagctcagaggagaggagc

SEQ ID NO: 6338065 - DNA, 16 bp, Homo sapiens
gttagctcctgtggcc

SEQ ID NO: 6338066 - DNA, 20 bp, Homo sapiens
gttagctgacagtcagctgt

SEQ ID NO: 6338067 - DNA, 11 bp, Homo sapiens
gttagctgagc

SEQ ID NO: 6338068 - DNA, 14 bp, Homo sapiens
gttagctgctcact

SEQ ID NO: 6338069 - DNA, 12 bp, Homo sapiens
gttagctggaca

SEQ ID NO: 6338070 - DNA, 14 bp, Homo sapiens
gttagctgggaaga

SEQ ID NO: 6338071 - DNA, 14 bp, Homo sapiens
gttagctgtcacat

SEQ ID NO: 6338072 - DNA, 11 bp, Homo sapiens
gttagctttcc

SEQ ID NO: 6338073 - DNA, 18 bp, Homo sapiens
gttaggaaaaaattgaaa

SEQ ID NO: 6338074 - DNA, 17 bp, Homo sapiens
gttaggaaataaaacct

SEQ ID NO: 6338075 - DNA, 23 bp, Homo sapiens
gttaggaaataaaacctttcaaa

SEQ ID NO: 6338076 - DNA, 16 bp, Homo sapiens
gttaggaacagcagtg

SEQ ID NO: 6338077 - DNA, 19 bp, Homo sapiens
gttaggaataacactgcag

SEQ ID NO: 6338078 - DNA, 16 bp, Homo sapiens
gttaggaatctcttca

SEQ ID NO: 6338079 - DNA, 14 bp, Homo sapiens
gttaggacaaggct

SEQ ID NO: 6338080 - DNA, 15 bp, Homo sapiens
gttaggacaaggctg

SEQ ID NO: 6338081 - DNA, 21 bp, Homo sapiens
gttaggactctccactcaatg

SEQ ID NO: 6338082 - DNA, 15 bp, Homo sapiens
gttaggaggctgcat

SEQ ID NO: 6338083 - DNA, 17 bp, Homo sapiens
gttaggaggctgcatgc

SEQ ID NO: 6338084 - DNA, 19 bp, Homo sapiens
gttaggaggctgcatgctc

SEQ ID NO: 6338085 - DNA, 19 bp, Homo sapiens
gttaggattaggtttagaa

SEQ ID NO: 6338086 - DNA, 22 bp, Homo sapiens
gttaggattaggtttagaatca

SEQ ID NO: 6338087 - DNA, 16 bp, Homo sapiens
gttaggattcaggcag

SEQ ID NO: 6338088 - DNA, 14 bp, Homo sapiens
gttaggcagtataa

SEQ ID NO: 6338089 - DNA, 19 bp, Homo sapiens
gttaggcattgtgggaagg

SEQ ID NO: 6338090 - DNA, 20 bp, Homo sapiens
gttaggcattgtgggaaggg

SEQ ID NO: 6338091 - DNA, 17 bp, Homo sapiens
gttaggccaactgcctc

SEQ ID NO: 6338092 - DNA, 18 bp, Homo sapiens
gttaggccaactgcctcc

SEQ ID NO: 6338093 - DNA, 14 bp, Homo sapiens
gttaggccacgctc

SEQ ID NO: 6338094 - DNA, 13 bp, Homo sapiens
gttaggctgggcc

SEQ ID NO: 6338095 - DNA, 18 bp, Homo sapiens
gttaggctgggcccagag

SEQ ID NO: 6338096 - DNA, 13 bp, Homo sapiens
gttaggctgtaca

SEQ ID NO: 6338097 - DNA, 23 bp, Homo sapiens
gttagggaaaacattccatcctt

SEQ ID NO: 6338098 - DNA, 15 bp, Homo sapiens
gttagggaagagaaa

SEQ ID NO: 6338099 - DNA, 21 bp, Homo sapiens
gttagggacatttccaagctg

SEQ ID NO: 6338100 - DNA, 20 bp, Homo sapiens
gttagggagagagaagcagg

SEQ ID NO: 6338101 - DNA, 11 bp, Homo sapiens
gttagggaggg

SEQ ID NO: 6338102 - DNA, 13 bp, Homo sapiens
gttagggaggggt

SEQ ID NO: 6338103 - DNA, 19 bp, Homo sapiens
gttaggggccaataaaatg

SEQ ID NO: 6338104 - DNA, 23 bp, Homo sapiens
gttaggggcctggcccaaagcag

SEQ ID NO: 6338105 - DNA, 18 bp, Homo sapiens
gttaggtagagggagttg

SEQ ID NO: 6338106 - DNA, 21 bp, Homo sapiens
gttaggtagagggagttgtca

SEQ ID NO: 6338107 - DNA, 22 bp, Homo sapiens
gttaggtggccgctcctccctg

SEQ ID NO: 6338108 - DNA, 17 bp, Homo sapiens
gttaggttgtctccagg

SEQ ID NO: 6338109 - DNA, 14 bp, Homo sapiens
gttagtaactttta

SEQ ID NO: 6338110 - DNA, 16 bp, Homo sapiens
gttagtaacttttagt

SEQ ID NO: 6338111 - DNA, 14 bp, Homo sapiens
gttagtaatacctc

SEQ ID NO: 6338112 - DNA, 15 bp, Homo sapiens
gttagtaatctgtat

SEQ ID NO: 6338113 - DNA, 19 bp, Homo sapiens
gttagtaatggcagagcag

SEQ ID NO: 6338114 - DNA, 13 bp, Homo sapiens
gttagtagaaatt

SEQ ID NO: 6338115 - DNA, 21 bp, Homo sapiens
gttagtagacactaattctgt

SEQ ID NO: 6338116 - DNA, 14 bp, Homo sapiens
gttagtagaggaaa

SEQ ID NO: 6338117 - DNA, 18 bp, Homo sapiens
gttagtagcagaaatata

SEQ ID NO: 6338118 - DNA, 21 bp, Homo sapiens
gttagtagcatgttgagccag

SEQ ID NO: 6338119 - DNA, 14 bp, Homo sapiens
gttagtatcttttg

SEQ ID NO: 6338120 - DNA, 18 bp, Homo sapiens
gttagtatcttttgatat

SEQ ID NO: 6338121 - DNA, 14 bp, Homo sapiens
gttagtattgattc

SEQ ID NO: 6338122 - DNA, 18 bp, Homo sapiens
gttagtcattgatagaac

SEQ ID NO: 6338123 - DNA, 23 bp, Homo sapiens
gttagtctactcttaagccatct

SEQ ID NO: 6338124 - DNA, 16 bp, Homo sapiens
gttagtgatttgctat

SEQ ID NO: 6338125 - DNA, 13 bp, Homo sapiens
gttagtggcaccg

SEQ ID NO: 6338126 - DNA, 17 bp, Homo sapiens
gttagtgggaagagctg

SEQ ID NO: 6338127 - DNA, 20 bp, Homo sapiens
gttagtgggaagagctgggt

SEQ ID NO: 6338128 - DNA, 21 bp, Homo sapiens
gttagtgggaagagctgggtt

SEQ ID NO: 6338129 - DNA, 16 bp, Homo sapiens
gttagtgtctgtccat

SEQ ID NO: 6338130 - DNA, 15 bp, Homo sapiens
gttagtgtgtgtgca

SEQ ID NO: 6338131 - DNA, 19 bp, Homo sapiens
gttagtgtgtgtgcatgtg

SEQ ID NO: 6338132 - DNA, 21 bp, Homo sapiens
gttagtgtgtgtgcatgtgtg

SEQ ID NO: 6338133 - DNA, 17 bp, Homo sapiens
gttagttaatccctttg

SEQ ID NO: 6338134 - DNA, 17 bp, Homo sapiens
gttagttaccttatagt

SEQ ID NO: 6338135 - DNA, 16 bp, Homo sapiens
gttagttccactgaga

SEQ ID NO: 6338136 - DNA, 13 bp, Homo sapiens
gttagtttcttgg

SEQ ID NO: 6338137 - DNA, 20 bp, Homo sapiens
gttagttttggttatttcta

SEQ ID NO: 6338138 - DNA, 15 bp, Homo sapiens
gttataaaaaatggt

SEQ ID NO: 6338139 - DNA, 13 bp, Homo sapiens
gttataaaaatac

SEQ ID NO: 6338140 - DNA, 17 bp, Homo sapiens
gttataaaataatgtac

SEQ ID NO: 6338141 - DNA, 11 bp, Homo sapiens
gttataaaatt

SEQ ID NO: 6338142 - DNA, 19 bp, Homo sapiens
gttataaagccttctaaaa

SEQ ID NO: 6338143 - DNA, 12 bp, Homo sapiens
gttataaagtag

SEQ ID NO: 6338144 - DNA, 17 bp, Homo sapiens
gttataaagtgtgccac

SEQ ID NO: 6338145 - DNA, 15 bp, Homo sapiens
gttataaatagcctt

SEQ ID NO: 6338146 - DNA, 20 bp, Homo sapiens
gttataaatagccttcaaaa

SEQ ID NO: 6338147 - DNA, 14 bp, Homo sapiens
gttataaatatttt

SEQ ID NO: 6338148 - DNA, 14 bp, Homo sapiens
gttataaattttgt

SEQ ID NO: 6338149 - DNA, 19 bp, Homo sapiens
gttataaattttgtacatt

SEQ ID NO: 6338150 - DNA, 22 bp, Homo sapiens
gttataagaaaactacatgtaa

SEQ ID NO: 6338151 - DNA, 13 bp, Homo sapiens
gttataagaagaa

SEQ ID NO: 6338152 - DNA, 19 bp, Homo sapiens
gttataataactgaactgt

SEQ ID NO: 6338153 - DNA, 20 bp, Homo sapiens
gttataatcagggaaactaa

SEQ ID NO: 6338154 - DNA, 14 bp, Homo sapiens
gttatacaaggcaa

SEQ ID NO: 6338155 - DNA, 22 bp, Homo sapiens
gttatacaataacccagttact

SEQ ID NO: 6338156 - DNA, 23 bp, Homo sapiens
gttatacaataacccagttactt

SEQ ID NO: 6338157 - DNA, 17 bp, Homo sapiens
gttatacagttataaaa

SEQ ID NO: 6338158 - DNA, 22 bp, Homo sapiens
gttatacagttataaaattaaa

SEQ ID NO: 6338159 - DNA, 20 bp, Homo sapiens
gttatacatcaatatgtata

SEQ ID NO: 6338160 - DNA, 17 bp, Homo sapiens
gttatacatcttcatta

SEQ ID NO: 6338161 - DNA, 18 bp, Homo sapiens
gttatacatgacactgaa

SEQ ID NO: 6338162 - DNA, 14 bp, Homo sapiens
gttatacatttaaa

SEQ ID NO: 6338163 - DNA, 13 bp, Homo sapiens
gttatacttcaaa

SEQ ID NO: 6338164 - DNA, 19 bp, Homo sapiens
gttatagaacttcatggat

SEQ ID NO: 6338165 - DNA, 16 bp, Homo sapiens
gttatagatttagcta

SEQ ID NO: 6338166 - DNA, 16 bp, Homo sapiens
gttatagccctgccct

SEQ ID NO: 6338167 - DNA, 17 bp, Homo sapiens
gttatagtaactcccat

SEQ ID NO: 6338168 - DNA, 15 bp, Homo sapiens
gttatagtatatctg

SEQ ID NO: 6338169 - DNA, 16 bp, Homo sapiens
gttatagtatatctgg

SEQ ID NO: 6338170 - DNA, 19 bp, Homo sapiens
gttatagtatatctggaca

SEQ ID NO: 6338171 - DNA, 15 bp, Homo sapiens
gttatagtgcaatat

SEQ ID NO: 6338172 - DNA, 14 bp, Homo sapiens
gttatagtgtttaa

SEQ ID NO: 6338173 - DNA, 13 bp, Homo sapiens
gttatagttcata

SEQ ID NO: 6338174 - DNA, 10 bp, Homo sapiens
gttatataaa

SEQ ID NO: 6338175 - DNA, 12 bp, Homo sapiens
gttatataaaaa

SEQ ID NO: 6338176 - DNA, 16 bp, Homo sapiens
gttatataaaaaaatt

SEQ ID NO: 6338177 - DNA, 14 bp, Homo sapiens
gttatataaagaga

SEQ ID NO: 6338178 - DNA, 12 bp, Homo sapiens
gttatataattt

SEQ ID NO: 6338179 - DNA, 17 bp, Homo sapiens
gttatatataataaata

SEQ ID NO: 6338180 - DNA, 13 bp, Homo sapiens
gttatatatatgt

SEQ ID NO: 6338181 - DNA, 16 bp, Homo sapiens
gttatatatctctttt

SEQ ID NO: 6338182 - DNA, 18 bp, Homo sapiens
gttatatatctcttttgg

SEQ ID NO: 6338183 - DNA, 22 bp, Homo sapiens
gttatatatggggatggtagtt

SEQ ID NO: 6338184 - DNA, 14 bp, Homo sapiens
gttatatattcctt

SEQ ID NO: 6338185 - DNA, 18 bp, Homo sapiens
gttatatattttgttttt

SEQ ID NO: 6338186 - DNA, 14 bp, Homo sapiens
gttatatcatcaat

SEQ ID NO: 6338187 - DNA, 18 bp, Homo sapiens
gttatatcatcaatactt

SEQ ID NO: 6338188 - DNA, 21 bp, Homo sapiens
gttatatgacttcttgttcat

SEQ ID NO: 6338189 - DNA, 22 bp, Homo sapiens
gttatatgacttcttgttcatg

SEQ ID NO: 6338190 - DNA, 16 bp, Homo sapiens
gttatatgtacagttt

SEQ ID NO: 6338191 - DNA, 20 bp, Homo sapiens
gttatattaaagaaaaactt

SEQ ID NO: 6338192 - DNA, 22 bp, Homo sapiens
gttatattacttgcctatctga

SEQ ID NO: 6338193 - DNA, 14 bp, Homo sapiens
gttatattcacagt

SEQ ID NO: 6338194 - DNA, 21 bp, Homo sapiens
gttatattccaaggaaaattg

SEQ ID NO: 6338195 - DNA, 12 bp, Homo sapiens
gttatatttcaa

SEQ ID NO: 6338196 - DNA, 11 bp, Homo sapiens
gttatatttgt

SEQ ID NO: 6338197 - DNA, 21 bp, Homo sapiens
gttatatttttcttaaaaagt

SEQ ID NO: 6338198 - DNA, 23 bp, Homo sapiens
gttatcaaacttcagctgtactt

SEQ ID NO: 6338199 - DNA, 14 bp, Homo sapiens
gttatcaaatacat

SEQ ID NO: 6338200 - DNA, 20 bp, Homo sapiens
gttatcacctagctgaatgt

SEQ ID NO: 6338201 - DNA, 13 bp, Homo sapiens
gttatcactttaa

SEQ ID NO: 6338202 - DNA, 15 bp, Homo sapiens
gttatcagttaacat

SEQ ID NO: 6338203 - DNA, 13 bp, Homo sapiens
gttatcatgaatt

SEQ ID NO: 6338204 - DNA, 16 bp, Homo sapiens
gttatcatgaatttta

SEQ ID NO: 6338205 - DNA, 20 bp, Homo sapiens
gttatcatgaattttaaagt

SEQ ID NO: 6338206 - DNA, 19 bp, Homo sapiens
gttatcattcttataacat

SEQ ID NO: 6338207 - DNA, 20 bp, Homo sapiens
gttatcattttttcctgttt

SEQ ID NO: 6338208 - DNA, 20 bp, Homo sapiens
gttatccacctgccttggct

SEQ ID NO: 6338209 - DNA, 23 bp, Homo sapiens
gttatccatattacgttgtttct

SEQ ID NO: 6338210 - DNA, 14 bp, Homo sapiens
gttatcctcctctc

SEQ ID NO: 6338211 - DNA, 21 bp, Homo sapiens
gttatcctcttgtatacttgt

SEQ ID NO: 6338212 - DNA, 12 bp, Homo sapiens
gttatcctgcaa

SEQ ID NO: 6338213 - DNA, 13 bp, Homo sapiens
gttatcctgcaag

SEQ ID NO: 6338214 - DNA, 14 bp, Homo sapiens
gttatcctgcaagg

SEQ ID NO: 6338215 - DNA, 13 bp, Homo sapiens
gttatcctgctag

SEQ ID NO: 6338216 - DNA, 16 bp, Homo sapiens
gttatcctttgtgagc

SEQ ID NO: 6338217 - DNA, 14 bp, Homo sapiens
gttatcgaaataac

SEQ ID NO: 6338218 - DNA, 21 bp, Homo sapiens
gttatcgaaataacaatgtta

SEQ ID NO: 6338219 - DNA, 15 bp, Homo sapiens
gttatctaaaagaaa

SEQ ID NO: 6338220 - DNA, 21 bp, Homo sapiens
gttatctaagttaatttaaag

SEQ ID NO: 6338221 - DNA, 22 bp, Homo sapiens
gttatctacctcaaggtaacaa

SEQ ID NO: 6338222 - DNA, 15 bp, Homo sapiens
gttatctagaaatta

SEQ ID NO: 6338223 - DNA, 19 bp, Homo sapiens
gttatctcaggtgagctgg

SEQ ID NO: 6338224 - DNA, 21 bp, Homo sapiens
gttatctcggactttgcagga

SEQ ID NO: 6338225 - DNA, 19 bp, Homo sapiens
gttatctgaagtcagatct

SEQ ID NO: 6338226 - DNA, 18 bp, Homo sapiens
gttatctgtctttatgat

SEQ ID NO: 6338227 - DNA, 19 bp, Homo sapiens
gttatctgtctttatgatt

SEQ ID NO: 6338228 - DNA, 16 bp, Homo sapiens
gttatctgtttcctgt

SEQ ID NO: 6338229 - DNA, 17 bp, Homo sapiens
gttatcttaaatatgaa

SEQ ID NO: 6338230 - DNA, 22 bp, Homo sapiens
gttatcttctcaagttctaaga

SEQ ID NO: 6338231 - DNA, 21 bp, Homo sapiens
gttatcttctttattattcct

SEQ ID NO: 6338232 - DNA, 16 bp, Homo sapiens
gttatcttgtgtatgg

SEQ ID NO: 6338233 - DNA, 14 bp, Homo sapiens
gttatcttgttatt

SEQ ID NO: 6338234 - DNA, 14 bp, Homo sapiens
gttatctttccctc

SEQ ID NO: 6338235 - DNA, 18 bp, Homo sapiens
gttatcttttaattacag

SEQ ID NO: 6338236 - DNA, 19 bp, Homo sapiens
gttatcttttgtgtcctgt

SEQ ID NO: 6338237 - DNA, 14 bp, Homo sapiens
gttatctttttgtg

SEQ ID NO: 6338238 - DNA, 13 bp, Homo sapiens
gttatgaaaatcc

SEQ ID NO: 6338239 - DNA, 16 bp, Homo sapiens
ggggcctgggaaagga

SEQ ID NO: 6338240 - DNA, 12 bp, Homo sapiens
ggggcctgggca

SEQ ID NO: 6338241 - DNA, 13 bp, Homo sapiens
ggggcctgggcag

SEQ ID NO: 6338242 - DNA, 13 bp, Homo sapiens
ggggcctgggccg

SEQ ID NO: 6338243 - DNA, 22 bp, Homo sapiens
ggggcctgtacaaaagggacat

SEQ ID NO: 6338244 - DNA, 15 bp, Homo sapiens
ggggcctgtactgcc

SEQ ID NO: 6338245 - DNA, 18 bp, Homo sapiens
ggggcctgtactgcctgc

SEQ ID NO: 6338246 - DNA, 19 bp, Homo sapiens
ggggcctgtactgcctgct

SEQ ID NO: 6338247 - DNA, 13 bp, Homo sapiens
ggggcctgtggtg

SEQ ID NO: 6338248 - DNA, 17 bp, Homo sapiens
ggggcctgtgtagccag

SEQ ID NO: 6338249 - DNA, 17 bp, Homo sapiens
ggggccttagggagccc

SEQ ID NO: 6338250 - DNA, 23 bp, Homo sapiens
ggggccttagggcactgggctgt

SEQ ID NO: 6338251 - DNA, 17 bp, Homo sapiens
ggggccttatcgggctc

SEQ ID NO: 6338252 - DNA, 21 bp, Homo sapiens
ggggccttccttttgaggagc

SEQ ID NO: 6338253 - DNA, 20 bp, Homo sapiens
ggggccttgaagactccctg

SEQ ID NO: 6338254 - DNA, 16 bp, Homo sapiens
ggggccttgcggaagc

SEQ ID NO: 6338255 - DNA, 18 bp, Homo sapiens
ggggccttgcggaagcca

SEQ ID NO: 6338256 - DNA, 19 bp, Homo sapiens
ggggccttgcggaagccat

SEQ ID NO: 6338257 - DNA, 20 bp, Homo sapiens
ggggccttgcggaagccata

SEQ ID NO: 6338258 - DNA, 21 bp, Homo sapiens
ggggccttgcggtatccgccc

SEQ ID NO: 6338259 - DNA, 20 bp, Homo sapiens
ggggcctttgggtgctgttt

SEQ ID NO: 6338260 - DNA, 17 bp, Homo sapiens
ggggcgacccctcagtg

SEQ ID NO: 6338261 - DNA, 17 bp, Homo sapiens
ggggcgaggcagaggac

SEQ ID NO: 6338262 - DNA, 20 bp, Homo sapiens
ggggcgatcaagtccagagc

SEQ ID NO: 6338263 - DNA, 21 bp, Homo sapiens
ggggcgatcgcggcggagctg

SEQ ID NO: 6338264 - DNA, 17 bp, Homo sapiens
ggggcgcaccccacagc

SEQ ID NO: 6338265 - DNA, 23 bp, Homo sapiens
ggggcgcaccccacagctggggc

SEQ ID NO: 6338266 - DNA, 21 bp, Homo sapiens
ggggcgcgcgcccccaggacc

SEQ ID NO: 6338267 - DNA, 15 bp, Homo sapiens
ggggcgcggctggga

SEQ ID NO: 6338268 - DNA, 16 bp, Homo sapiens
ggggcgcggctgggag

SEQ ID NO: 6338269 - DNA, 24 bp, Homo sapiens
ggggcgctcaggacccaggccctc

SEQ ID NO: 6338270 - DNA, 16 bp, Homo sapiens
ggggcgctcctcccag

SEQ ID NO: 6338271 - DNA, 13 bp, Homo sapiens
ggggcgctggaca

SEQ ID NO: 6338272 - DNA, 17 bp, Homo sapiens
ggggcgctggcccagcc

SEQ ID NO: 6338273 - DNA, 14 bp, Homo sapiens
ggggcggaggagga

SEQ ID NO: 6338274 - DNA, 18 bp, Homo sapiens
ggggcggcatccgagccc

SEQ ID NO: 6338275 - DNA, 21 bp, Homo sapiens
ggggcggccagccctcccagc

SEQ ID NO: 6338276 - DNA, 17 bp, Homo sapiens
ggggcggctgagctcca

SEQ ID NO: 6338277 - DNA, 15 bp, Homo sapiens
ggggcgggactcctc

SEQ ID NO: 6338278 - DNA, 15 bp, Homo sapiens
ggggcgggccagggt

SEQ ID NO: 6338279 - DNA, 18 bp, Homo sapiens
ggggcgggccctgcctga

SEQ ID NO: 6338280 - DNA, 13 bp, Homo sapiens
ggggcgggctcag

SEQ ID NO: 6338281 - DNA, 13 bp, Homo sapiens
ggggcggggactg

SEQ ID NO: 6338282 - DNA, 21 bp, Homo sapiens
ggggcgggtgatgagacctgg

SEQ ID NO: 6338283 - DNA, 14 bp, Homo sapiens
ggggcggtgtcagg

SEQ ID NO: 6338284 - DNA, 13 bp, Homo sapiens
ggggcgtccaggc

SEQ ID NO: 6338285 - DNA, 17 bp, Homo sapiens
ggggcgtgaggtcccag

SEQ ID NO: 6338286 - DNA, 19 bp, Homo sapiens
ggggcgtggagggaggccc

SEQ ID NO: 6338287 - DNA, 11 bp, Homo sapiens
ggggctaaggc

SEQ ID NO: 6338288 - DNA, 22 bp, Homo sapiens
ggggctaaggtttccagtcaga

SEQ ID NO: 6338289 - DNA, 24 bp, Homo sapiens
ggggctaaggtttccagtcagatg

SEQ ID NO: 6338290 - DNA, 20 bp, Homo sapiens
ggggctacttatattctgca

SEQ ID NO: 6338291 - DNA, 19 bp, Homo sapiens
ggggctagactgggctggc

SEQ ID NO: 6338292 - DNA, 20 bp, Homo sapiens
ggggctagactgggctggct

SEQ ID NO: 6338293 - DNA, 22 bp, Homo sapiens
ggggctagactgggctggctgc

SEQ ID NO: 6338294 - DNA, 18 bp, Homo sapiens
ggggctagggaggaccaa

SEQ ID NO: 6338295 - DNA, 16 bp, Homo sapiens
ggggctcactctggcc

SEQ ID NO: 6338296 - DNA, 17 bp, Homo sapiens
ggggctcagatggactg

SEQ ID NO: 6338297 - DNA, 18 bp, Homo sapiens
ggggctcagatggactgg

SEQ ID NO: 6338298 - DNA, 19 bp, Homo sapiens
ggggctcagatggactggg

SEQ ID NO: 6338299 - DNA, 22 bp, Homo sapiens
ggggctcagatggactgggagg

SEQ ID NO: 6338300 - DNA, 13 bp, Homo sapiens
ggggctcaggata

SEQ ID NO: 6338301 - DNA, 15 bp, Homo sapiens
ggggctccccacgcc

SEQ ID NO: 6338302 - DNA, 19 bp, Homo sapiens
ggggctccccgggtctctc

SEQ ID NO: 6338303 - DNA, 21 bp, Homo sapiens
ggggctcccggcatcctgaaa

SEQ ID NO: 6338304 - DNA, 15 bp, Homo sapiens
ggggctccggagggg

SEQ ID NO: 6338305 - DNA, 23 bp, Homo sapiens
ggggctcctgaatatcagtcact

SEQ ID NO: 6338306 - DNA, 12 bp, Homo sapiens
ggggctcctgcc

SEQ ID NO: 6338307 - DNA, 17 bp, Homo sapiens
ggggctcctgcccaggc

SEQ ID NO: 6338308 - DNA, 19 bp, Homo sapiens
ggggctcctgcccaggcca

SEQ ID NO: 6338309 - DNA, 20 bp, Homo sapiens
ggggctcctggcagtgacct

SEQ ID NO: 6338310 - DNA, 12 bp, Homo sapiens
ggggctcctggg

SEQ ID NO: 6338311 - DNA, 17 bp, Homo sapiens
ggggctcctgggaggga

SEQ ID NO: 6338312 - DNA, 13 bp, Homo sapiens
ggggctcctgggt

SEQ ID NO: 6338313 - DNA, 12 bp, Homo sapiens
ggggctcctggt

SEQ ID NO: 6338314 - DNA, 21 bp, Homo sapiens
ggggctcctggtggccttctg

SEQ ID NO: 6338315 - DNA, 22 bp, Homo sapiens
ggggctcctttctccagccagc

SEQ ID NO: 6338316 - DNA, 15 bp, Homo sapiens
ggggctcgaggctgg

SEQ ID NO: 6338317 - DNA, 15 bp, Homo sapiens
ggggctcggggaggc

SEQ ID NO: 6338318 - DNA, 17 bp, Homo sapiens
ggggctctaacgcctga

SEQ ID NO: 6338319 - DNA, 22 bp, Homo sapiens
ggggctctaacgcctgagccca

SEQ ID NO: 6338320 - DNA, 12 bp, Homo sapiens
ggggctctgcct

SEQ ID NO: 6338321 - DNA, 23 bp, Homo sapiens
ggggctctgccttctcaggcccc

SEQ ID NO: 6338322 - DNA, 13 bp, Homo sapiens
ggggctctggaga

SEQ ID NO: 6338323 - DNA, 14 bp, Homo sapiens
ggggctctggagag

SEQ ID NO: 6338324 - DNA, 16 bp, Homo sapiens
ggggctctggagagaa

SEQ ID NO: 6338325 - DNA, 17 bp, Homo sapiens
ggggctctggccaaggg

SEQ ID NO: 6338326 - DNA, 23 bp, Homo sapiens
ggggctcttcatctgcctgcgct

SEQ ID NO: 6338327 - DNA, 14 bp, Homo sapiens
ggggctcttctcat

SEQ ID NO: 6338328 - DNA, 22 bp, Homo sapiens
ggggctcttgatcagtgtgcta

SEQ ID NO: 6338329 - DNA, 20 bp, Homo sapiens
ggggctgaccttcctcgcag

SEQ ID NO: 6338330 - DNA, 23 bp, Homo sapiens
ggggctgaccttcctcgcagaga

SEQ ID NO: 6338331 - DNA, 23 bp, Homo sapiens
ggggctgagccctcctgagggcc

SEQ ID NO: 6338332 - DNA, 19 bp, Homo sapiens
ggggctgaggtgggaggat

SEQ ID NO: 6338333 - DNA, 18 bp, Homo sapiens
ggggctgagtctccaggg

SEQ ID NO: 6338334 - DNA, 21 bp, Homo sapiens
ggggctgcaccggctggcctg

SEQ ID NO: 6338335 - DNA, 19 bp, Homo sapiens
ggggctgcagccccctgct

SEQ ID NO: 6338336 - DNA, 22 bp, Homo sapiens
ggggctgcagccccctgcttct

SEQ ID NO: 6338337 - DNA, 14 bp, Homo sapiens
ggggctgcaggcag

SEQ ID NO: 6338338 - DNA, 21 bp, Homo sapiens
ggggctgcatcctcagcccca

SEQ ID NO: 6338339 - DNA, 15 bp, Homo sapiens
ggggctgcccgctcc

SEQ ID NO: 6338340 - DNA, 22 bp, Homo sapiens
ggggctgcgaccgccagattct

SEQ ID NO: 6338341 - DNA, 20 bp, Homo sapiens
ggggctgcgtccctgctcag

SEQ ID NO: 6338342 - DNA, 13 bp, Homo sapiens
ggggctgctccag

SEQ ID NO: 6338343 - DNA, 21 bp, Homo sapiens
ggggctgctgcactgccctcc

SEQ ID NO: 6338344 - DNA, 11 bp, Homo sapiens
ggggctgctgg

SEQ ID NO: 6338345 - DNA, 15 bp, Homo sapiens
ggggctgctggcctg

SEQ ID NO: 6338346 - DNA, 21 bp, Homo sapiens
ggggctgctggcctggccctt

SEQ ID NO: 6338347 - DNA, 21 bp, Homo sapiens
ggggctgctgggggctcccct

SEQ ID NO: 6338348 - DNA, 11 bp, Homo sapiens
ggggctgctgt

SEQ ID NO: 6338349 - DNA, 16 bp, Homo sapiens
ggggctgcttcctcct

SEQ ID NO: 6338350 - DNA, 20 bp, Homo sapiens
ggggctggagggggcagagt

SEQ ID NO: 6338351 - DNA, 21 bp, Homo sapiens
ggggctggagggggcagagtg

SEQ ID NO: 6338352 - DNA, 18 bp, Homo sapiens
ggggctggcaagcaggga

SEQ ID NO: 6338353 - DNA, 15 bp, Homo sapiens
ggggctggcagaggg

SEQ ID NO: 6338354 - DNA, 12 bp, Homo sapiens
ggggctggcccc

SEQ ID NO: 6338355 - DNA, 21 bp, Homo sapiens
ggggctggccccatcctggcc

SEQ ID NO: 6338356 - DNA, 12 bp, Homo sapiens
ggggctggccct

SEQ ID NO: 6338357 - DNA, 17 bp, Homo sapiens
ggggctggccctgccct

SEQ ID NO: 6338358 - DNA, 18 bp, Homo sapiens
ggggctggccctgccctc

SEQ ID NO: 6338359 - DNA, 16 bp, Homo sapiens
ggggctggccttcctg

SEQ ID NO: 6338360 - DNA, 19 bp, Homo sapiens
ggggctggccttcctgccc

SEQ ID NO: 6338361 - DNA, 16 bp, Homo sapiens
ggggctggctctgaga

SEQ ID NO: 6338362 - DNA, 13 bp, Homo sapiens
ggggctggctgca

SEQ ID NO: 6338363 - DNA, 13 bp, Homo sapiens
ggggctgggacat

SEQ ID NO: 6338364 - DNA, 14 bp, Homo sapiens
ggggctgggcagag

SEQ ID NO: 6338365 - DNA, 18 bp, Homo sapiens
ggggctgggctcacaggc

SEQ ID NO: 6338366 - DNA, 19 bp, Homo sapiens
ggggctggggaagaggact

SEQ ID NO: 6338367 - DNA, 13 bp, Homo sapiens
ggggctggggagg

SEQ ID NO: 6338368 - DNA, 13 bp, Homo sapiens
ggggctggggcag

SEQ ID NO: 6338369 - DNA, 18 bp, Homo sapiens
ggggctggggcaggaggg

SEQ ID NO: 6338370 - DNA, 16 bp, Homo sapiens
ggggctggggcaggct

SEQ ID NO: 6338371 - DNA, 17 bp, Homo sapiens
ggggctggggcaggctc

SEQ ID NO: 6338372 - DNA, 21 bp, Homo sapiens
ggggctggggccaaataaagt

SEQ ID NO: 6338373 - DNA, 12 bp, Homo sapiens
ggggctggggga

SEQ ID NO: 6338374 - DNA, 17 bp, Homo sapiens
ggggctgggggctgcag

SEQ ID NO: 6338375 - DNA, 19 bp, Homo sapiens
ggggctgggggctgcaggg

SEQ ID NO: 6338376 - DNA, 20 bp, Homo sapiens
ggggctggggtcacagaggc

SEQ ID NO: 6338377 - DNA, 10 bp, Homo sapiens
ggggctgggt

SEQ ID NO: 6338378 - DNA, 13 bp, Homo sapiens
ggggctgggttgg

SEQ ID NO: 6338379 - DNA, 23 bp, Homo sapiens
ggggctgggttggcgcaccctcc

SEQ ID NO: 6338380 - DNA, 18 bp, Homo sapiens
ggggctggtttctgccct

SEQ ID NO: 6338381 - DNA, 14 bp, Homo sapiens
ggggctgtcctcct

SEQ ID NO: 6338382 - DNA, 22 bp, Homo sapiens
ggggctgtcctccttcctggga

SEQ ID NO: 6338383 - DNA, 21 bp, Homo sapiens
ggggctgtcctgctgccctcc

SEQ ID NO: 6338384 - DNA, 20 bp, Homo sapiens
ggggctgtgactctgggcag

SEQ ID NO: 6338385 - DNA, 14 bp, Homo sapiens
ggggctgtgccaac

SEQ ID NO: 6338386 - DNA, 18 bp, Homo sapiens
ggggctgtggccctgccc

SEQ ID NO: 6338387 - DNA, 21 bp, Homo sapiens
ggggctgtggctctgggtggg

SEQ ID NO: 6338388 - DNA, 22 bp, Homo sapiens
ggggctgttagctcagaggaga

SEQ ID NO: 6338389 - DNA, 22 bp, Homo sapiens
ggggctgttcatggcaagtggg

SEQ ID NO: 6338390 - DNA, 18 bp, Homo sapiens
ggggctgttgaagtcacc

SEQ ID NO: 6338391 - DNA, 19 bp, Homo sapiens
ggggcttcatctgcaaagg

SEQ ID NO: 6338392 - DNA, 13 bp, Homo sapiens
ggggcttcctggt

SEQ ID NO: 6338393 - DNA, 21 bp, Homo sapiens
ggggcttctaatgacccagat

SEQ ID NO: 6338394 - DNA, 18 bp, Homo sapiens
ggggcttctctgctgaga

SEQ ID NO: 6338395 - DNA, 21 bp, Homo sapiens
ggggcttctctgggaccaggc

SEQ ID NO: 6338396 - DNA, 17 bp, Homo sapiens
ggggcttctcttgggtg

SEQ ID NO: 6338397 - DNA, 21 bp, Homo sapiens
ggggcttctggacctagggtg

SEQ ID NO: 6338398 - DNA, 14 bp, Homo sapiens
ggggcttctgggtg

SEQ ID NO: 6338399 - DNA, 18 bp, Homo sapiens
ggggcttctttctgctgg

SEQ ID NO: 6338400 - DNA, 20 bp, Homo sapiens
ggggcttgcccactgcctgc

SEQ ID NO: 6338401 - DNA, 22 bp, Homo sapiens
ggggcttgcccactgcctgcct

SEQ ID NO: 6338402 - DNA, 16 bp, Homo sapiens
ggggcttgccctgggt

SEQ ID NO: 6338403 - DNA, 17 bp, Homo sapiens
ggggcttggaagggcgc

SEQ ID NO: 6338404 - DNA, 18 bp, Homo sapiens
ggggcttggctcgcaccc

SEQ ID NO: 6338405 - DNA, 16 bp, Homo sapiens
ggggcttggctgcccc

SEQ ID NO: 6338406 - DNA, 14 bp, Homo sapiens
ggggcttgggcctg

SEQ ID NO: 6338407 - DNA, 20 bp, Homo sapiens
ggggctttcggggagggcgc

SEQ ID NO: 6338408 - DNA, 13 bp, Homo sapiens
ggggctttctctt

SEQ ID NO: 6338409 - DNA, 21 bp, Homo sapiens
ggggctttctcttccccttcc

SEQ ID NO: 6338410 - DNA, 15 bp, Homo sapiens
ggggctttctggaga

SEQ ID NO: 6338411 - DNA, 15 bp, Homo sapiens
ggggctttggaagct

SEQ ID NO: 6338412 - DNA, 14 bp, Homo sapiens
ggggctttgggccc

SEQ ID NO: 6338413 - DNA, 23 bp, Homo sapiens
ggggctttgggcccaagaactgc

SEQ ID NO: 6338414 - DNA, 17 bp, Homo sapiens
ggggcttttaaaaggaa

SEQ ID NO: 6338415 - DNA, 16 bp, Homo sapiens
ggggcttttgccactc

SEQ ID NO: 6338416 - DNA, 15 bp, Homo sapiens
gggggaaagagggag

SEQ ID NO: 6338417 - DNA, 22 bp, Homo sapiens
gttatgaaaatcctatatctgt

SEQ ID NO: 6338418 - DNA, 13 bp, Homo sapiens
gttatgaaacata

SEQ ID NO: 6338419 - DNA, 15 bp, Homo sapiens
gttatgaaacatatc

SEQ ID NO: 6338420 - DNA, 16 bp, Homo sapiens
gttatgaaacatatca

SEQ ID NO: 6338421 - DNA, 23 bp, Homo sapiens
gttatgaaacatatcatggtaat

SEQ ID NO: 6338422 - DNA, 18 bp, Homo sapiens
gttatgaaagaatatatt

SEQ ID NO: 6338423 - DNA, 20 bp, Homo sapiens
gttatgaaagaatatattta

SEQ ID NO: 6338424 - DNA, 20 bp, Homo sapiens
gttatgaaattcaccccctt

SEQ ID NO: 6338425 - DNA, 13 bp, Homo sapiens
gttatgaacatcc

SEQ ID NO: 6338426 - DNA, 20 bp, Homo sapiens
gttatgaacatccaagtctt

SEQ ID NO: 6338427 - DNA, 17 bp, Homo sapiens
gttatgactatgtaaac

SEQ ID NO: 6338428 - DNA, 11 bp, Homo sapiens
gttatgactcc

SEQ ID NO: 6338429 - DNA, 21 bp, Homo sapiens
gttatgactccagaatttccc

SEQ ID NO: 6338430 - DNA, 17 bp, Homo sapiens
gttatgagaaaaaaaca

SEQ ID NO: 6338431 - DNA, 20 bp, Homo sapiens
gttatgaggatataatgtgt

SEQ ID NO: 6338432 - DNA, 15 bp, Homo sapiens
gttatgataaaaaat

SEQ ID NO: 6338433 - DNA, 18 bp, Homo sapiens
gttatgataaaaaatttt

SEQ ID NO: 6338434 - DNA, 22 bp, Homo sapiens
gttatgataaaaaattttgtaa

SEQ ID NO: 6338435 - DNA, 21 bp, Homo sapiens
gttatgatattgtttaaaatt

SEQ ID NO: 6338436 - DNA, 16 bp, Homo sapiens
gttatgatgtgcttaa

SEQ ID NO: 6338437 - DNA, 20 bp, Homo sapiens
gttatgatttccttcaatgt

SEQ ID NO: 6338438 - DNA, 16 bp, Homo sapiens
gttatgcaaatgagat

SEQ ID NO: 6338439 - DNA, 15 bp, Homo sapiens
gttatgcaagcacaa

SEQ ID NO: 6338440 - DNA, 23 bp, Homo sapiens
gttatgcaagtcgccaggcagga

SEQ ID NO: 6338441 - DNA, 17 bp, Homo sapiens
gttatgcactgcctgcc

SEQ ID NO: 6338442 - DNA, 15 bp, Homo sapiens
gttatgcactgtggt

SEQ ID NO: 6338443 - DNA, 16 bp, Homo sapiens
gttatgcactttaaat

SEQ ID NO: 6338444 - DNA, 12 bp, Homo sapiens
gttatgcagtga

SEQ ID NO: 6338445 - DNA, 21 bp, Homo sapiens
gttatgcagtgaactattttt

SEQ ID NO: 6338446 - DNA, 13 bp, Homo sapiens
gttatgcatcccc

SEQ ID NO: 6338447 - DNA, 21 bp, Homo sapiens
gttatgcatccccatccccat

SEQ ID NO: 6338448 - DNA, 13 bp, Homo sapiens
gttatgctgtcat

SEQ ID NO: 6338449 - DNA, 13 bp, Homo sapiens
gttatgctgtttc

SEQ ID NO: 6338450 - DNA, 23 bp, Homo sapiens
gttatggcagatgacaagatggt

SEQ ID NO: 6338451 - DNA, 16 bp, Homo sapiens
gttatggtagaaaaat

SEQ ID NO: 6338452 - DNA, 16 bp, Homo sapiens
gttatggtttaatgtt

SEQ ID NO: 6338453 - DNA, 13 bp, Homo sapiens
gttatgtaaaact

SEQ ID NO: 6338454 - DNA, 19 bp, Homo sapiens
gttatgtaagtttctaaga

SEQ ID NO: 6338455 - DNA, 14 bp, Homo sapiens
gttatgtactgtac

SEQ ID NO: 6338456 - DNA, 19 bp, Homo sapiens
gttatgtactgtactaatt

SEQ ID NO: 6338457 - DNA, 22 bp, Homo sapiens
gttatgtcagaggaacagtcct

SEQ ID NO: 6338458 - DNA, 23 bp, Homo sapiens
gttatgtcagcagctctgagaca

SEQ ID NO: 6338459 - DNA, 15 bp, Homo sapiens
gttatgtcattgtgt

SEQ ID NO: 6338460 - DNA, 16 bp, Homo sapiens
gttatgtctgtttaag

SEQ ID NO: 6338461 - DNA, 23 bp, Homo sapiens
gttatgtcttgtatttaaaaaca

SEQ ID NO: 6338462 - DNA, 14 bp, Homo sapiens
gttatgtgagaaca

SEQ ID NO: 6338463 - DNA, 20 bp, Homo sapiens
gttatgtgtatgtgccattt

SEQ ID NO: 6338464 - DNA, 14 bp, Homo sapiens
gttatgtgtgtata

SEQ ID NO: 6338465 - DNA, 14 bp, Homo sapiens
gttatgttcagaaa

SEQ ID NO: 6338466 - DNA, 12 bp, Homo sapiens
gttatgttgtaa

SEQ ID NO: 6338467 - DNA, 22 bp, Homo sapiens
gttatgttgtaatattttgctg

SEQ ID NO: 6338468 - DNA, 17 bp, Homo sapiens
gttatgtttaataagct

SEQ ID NO: 6338469 - DNA, 17 bp, Homo sapiens
gttattaaaaaaacaca

SEQ ID NO: 6338470 - DNA, 13 bp, Homo sapiens
gttattaaaattg

SEQ ID NO: 6338471 - DNA, 12 bp, Homo sapiens
gttattaaacag

SEQ ID NO: 6338472 - DNA, 22 bp, Homo sapiens
gttattaaacgtatgcatgtga

SEQ ID NO: 6338473 - DNA, 21 bp, Homo sapiens
gttattaacgggcatgtatta

SEQ ID NO: 6338474 - DNA, 15 bp, Homo sapiens
gttattaattaaaga

SEQ ID NO: 6338475 - DNA, 17 bp, Homo sapiens
gttattaattaaagaaa

SEQ ID NO: 6338476 - DNA, 15 bp, Homo sapiens
gttattacatccttg

SEQ ID NO: 6338477 - DNA, 18 bp, Homo sapiens
gttattaccaaaacagga

SEQ ID NO: 6338478 - DNA, 21 bp, Homo sapiens
gttattacccagagtttttat

SEQ ID NO: 6338479 - DNA, 21 bp, Homo sapiens
gttattagggtggtatttagt

SEQ ID NO: 6338480 - DNA, 16 bp, Homo sapiens
gttattataaatgtta

SEQ ID NO: 6338481 - DNA, 18 bp, Homo sapiens
gttattataattgtatca

SEQ ID NO: 6338482 - DNA, 23 bp, Homo sapiens
gttattatagagcagaaattctg

SEQ ID NO: 6338483 - DNA, 20 bp, Homo sapiens
gttattatatatttaacatg

SEQ ID NO: 6338484 - DNA, 18 bp, Homo sapiens
gttattatatttgacatg

SEQ ID NO: 6338485 - DNA, 22 bp, Homo sapiens
gttattatctgggcttatatct

SEQ ID NO: 6338486 - DNA, 12 bp, Homo sapiens
gttattatgaag

SEQ ID NO: 6338487 - DNA, 23 bp, Homo sapiens
gttattattaccagcatttgtcc

SEQ ID NO: 6338488 - DNA, 19 bp, Homo sapiens
gttattattattatattgt

SEQ ID NO: 6338489 - DNA, 14 bp, Homo sapiens
gttattattggctt

SEQ ID NO: 6338490 - DNA, 19 bp, Homo sapiens
gttattattggcttgcact

SEQ ID NO: 6338491 - DNA, 14 bp, Homo sapiens
gttattcaaatgaa

SEQ ID NO: 6338492 - DNA, 18 bp, Homo sapiens
gttattcaaatttgtaca

SEQ ID NO: 6338493 - DNA, 20 bp, Homo sapiens
gttattcactctcccagagg

SEQ ID NO: 6338494 - DNA, 13 bp, Homo sapiens
gttattcagaaat

SEQ ID NO: 6338495 - DNA, 18 bp, Homo sapiens
gttattcataaagagaaa

SEQ ID NO: 6338496 - DNA, 14 bp, Homo sapiens
gttattcattattc

SEQ ID NO: 6338497 - DNA, 19 bp, Homo sapiens
gttattcattattcctcag

SEQ ID NO: 6338498 - DNA, 12 bp, Homo sapiens
gttattccatca

SEQ ID NO: 6338499 - DNA, 14 bp, Homo sapiens
gttattccatcaat

SEQ ID NO: 6338500 - DNA, 17 bp, Homo sapiens
gttattccttgatcatt

SEQ ID NO: 6338501 - DNA, 18 bp, Homo sapiens
gttattcgttactctaag

SEQ ID NO: 6338502 - DNA, 21 bp, Homo sapiens
gttattctaagccctttgcca

SEQ ID NO: 6338503 - DNA, 20 bp, Homo sapiens
gttattctagtactagaaac

SEQ ID NO: 6338504 - DNA, 20 bp, Homo sapiens
gttattcttcaaacacaagt

SEQ ID NO: 6338505 - DNA, 22 bp, Homo sapiens
gttattcttttccagaaagaaa

SEQ ID NO: 6338506 - DNA, 15 bp, Homo sapiens
gttattgaaaatata

SEQ ID NO: 6338507 - DNA, 17 bp, Homo sapiens
gttattgaagcagagtg

SEQ ID NO: 6338508 - DNA, 16 bp, Homo sapiens
gttattgacaaactct

SEQ ID NO: 6338509 - DNA, 19 bp, Homo sapiens
gttattgagagagatgtgt

SEQ ID NO: 6338510 - DNA, 20 bp, Homo sapiens
gttattgagagagatgtgta

SEQ ID NO: 6338511 - DNA, 22 bp, Homo sapiens
gttattgagagagatgtgtaat

SEQ ID NO: 6338512 - DNA, 14 bp, Homo sapiens
gttattgcagttta

SEQ ID NO: 6338513 - DNA, 16 bp, Homo sapiens
gttattgcagtttatc

SEQ ID NO: 6338514 - DNA, 16 bp, Homo sapiens
gttattgctgcataaa

SEQ ID NO: 6338515 - DNA, 17 bp, Homo sapiens
gttattgctgcataaat

SEQ ID NO: 6338516 - DNA, 19 bp, Homo sapiens
gttattgctgcataaattt

SEQ ID NO: 6338517 - DNA, 20 bp, Homo sapiens
gttattgctgcataaatttg

SEQ ID NO: 6338518 - DNA, 22 bp, Homo sapiens
gttattggaagctgattcccag

SEQ ID NO: 6338519 - DNA, 12 bp, Homo sapiens
gttattggactc

SEQ ID NO: 6338520 - DNA, 17 bp, Homo sapiens
gttattggactccaggc

SEQ ID NO: 6338521 - DNA, 18 bp, Homo sapiens
gttattggatcagtgaaa

SEQ ID NO: 6338522 - DNA, 21 bp, Homo sapiens
gttattgggcaagtgattgaa

SEQ ID NO: 6338523 - DNA, 12 bp, Homo sapiens
gttattgtgaat

SEQ ID NO: 6338524 - DNA, 12 bp, Homo sapiens
gttattgtggaa

SEQ ID NO: 6338525 - DNA, 22 bp, Homo sapiens
gttattgttaattatgtacaac

SEQ ID NO: 6338526 - DNA, 21 bp, Homo sapiens
gttattgttgaacatacttca

SEQ ID NO: 6338527 - DNA, 10 bp, Homo sapiens
gttatttaaa

SEQ ID NO: 6338528 - DNA, 13 bp, Homo sapiens
gttatttaaagaa

SEQ ID NO: 6338529 - DNA, 11 bp, Homo sapiens
gttatttaaat

SEQ ID NO: 6338530 - DNA, 14 bp, Homo sapiens
gttatttaagaatg

SEQ ID NO: 6338531 - DNA, 22 bp, Homo sapiens
gttatttaatcacagtcatctt

SEQ ID NO: 6338532 - DNA, 23 bp, Homo sapiens
gttatttaatcacagtcatcttt

SEQ ID NO: 6338533 - DNA, 14 bp, Homo sapiens
gttatttacactgg

SEQ ID NO: 6338534 - DNA, 17 bp, Homo sapiens
gttatttaccagaagtt

SEQ ID NO: 6338535 - DNA, 19 bp, Homo sapiens
gttatttactcctcctgct

SEQ ID NO: 6338536 - DNA, 13 bp, Homo sapiens
gttatttataatg

SEQ ID NO: 6338537 - DNA, 17 bp, Homo sapiens
gttatttatcaattttt

SEQ ID NO: 6338538 - DNA, 21 bp, Homo sapiens
gttatttatcaatttttccca

SEQ ID NO: 6338539 - DNA, 19 bp, Homo sapiens
gttatttatgctataaatt

SEQ ID NO: 6338540 - DNA, 19 bp, Homo sapiens
gttatttatggaccacttt

SEQ ID NO: 6338541 - DNA, 14 bp, Homo sapiens
gttatttattatta

SEQ ID NO: 6338542 - DNA, 22 bp, Homo sapiens
gttatttattctgggaatgtat

SEQ ID NO: 6338543 - DNA, 18 bp, Homo sapiens
gttatttattctttattt

SEQ ID NO: 6338544 - DNA, 13 bp, Homo sapiens
gttatttattgac

SEQ ID NO: 6338545 - DNA, 17 bp, Homo sapiens
gttatttatttaaatgt

SEQ ID NO: 6338546 - DNA, 23 bp, Homo sapiens
gttatttatttccttagtgccag

SEQ ID NO: 6338547 - DNA, 19 bp, Homo sapiens
gttatttattttttaagaa

SEQ ID NO: 6338548 - DNA, 23 bp, Homo sapiens
gttatttattttttaagaaaaaa

SEQ ID NO: 6338549 - DNA, 21 bp, Homo sapiens
gttatttccctacattaaaca

SEQ ID NO: 6338550 - DNA, 13 bp, Homo sapiens
gttatttctaaac

SEQ ID NO: 6338551 - DNA, 17 bp, Homo sapiens
gttatttctatgaaaat

SEQ ID NO: 6338552 - DNA, 16 bp, Homo sapiens
gttatttctgcctata

SEQ ID NO: 6338553 - DNA, 16 bp, Homo sapiens
gttatttctgtttgtt

SEQ ID NO: 6338554 - DNA, 19 bp, Homo sapiens
gttatttcttacaggcaca

SEQ ID NO: 6338555 - DNA, 14 bp, Homo sapiens
gttatttcttgttt

SEQ ID NO: 6338556 - DNA, 23 bp, Homo sapiens
gttatttgagcaagtaacattaa

SEQ ID NO: 6338557 - DNA, 17 bp, Homo sapiens
gttatttgtaatagatg

SEQ ID NO: 6338558 - DNA, 20 bp, Homo sapiens
gttatttgtacagttcagtt

SEQ ID NO: 6338559 - DNA, 19 bp, Homo sapiens
gttatttgttattttcagt

SEQ ID NO: 6338560 - DNA, 14 bp, Homo sapiens
gttattttaaatat

SEQ ID NO: 6338561 - DNA, 20 bp, Homo sapiens
gttattttaatacctttaaa

SEQ ID NO: 6338562 - DNA, 14 bp, Homo sapiens
gttattttcagtat

SEQ ID NO: 6338563 - DNA, 13 bp, Homo sapiens
gttattttctcct

SEQ ID NO: 6338564 - DNA, 23 bp, Homo sapiens
gttattttctttgaaattgttta

SEQ ID NO: 6338565 - DNA, 19 bp, Homo sapiens
gttattttctttttccttt

SEQ ID NO: 6338566 - DNA, 15 bp, Homo sapiens
gttattttgataaca

SEQ ID NO: 6338567 - DNA, 18 bp, Homo sapiens
gttattttgatgtaaaga

SEQ ID NO: 6338568 - DNA, 21 bp, Homo sapiens
gttattttgcatatatgttct

SEQ ID NO: 6338569 - DNA, 13 bp, Homo sapiens
gttattttgcttt

SEQ ID NO: 6338570 - DNA, 14 bp, Homo sapiens
gttattttgctttg

SEQ ID NO: 6338571 - DNA, 15 bp, Homo sapiens
gttattttgtgtcct

SEQ ID NO: 6338572 - DNA, 19 bp, Homo sapiens
gttatttttacattctgaa

SEQ ID NO: 6338573 - DNA, 16 bp, Homo sapiens
gttatttttatatcag

SEQ ID NO: 6338574 - DNA, 19 bp, Homo sapiens
gttatttttattaaatgta

SEQ ID NO: 6338575 - DNA, 22 bp, Homo sapiens
gttatttttctctttaaaaaaa

SEQ ID NO: 6338576 - DNA, 18 bp, Homo sapiens
gttatttttgtccctgct

SEQ ID NO: 6338577 - DNA, 20 bp, Homo sapiens
gttatttttgtccctgctcc

SEQ ID NO: 6338578 - DNA, 13 bp, Homo sapiens
gttcaaaaagaaa

SEQ ID NO: 6338579 - DNA, 22 bp, Homo sapiens
gttcaaaagaagttcattcctg

SEQ ID NO: 6338580 - DNA, 13 bp, Homo sapiens
gttcaaaatgtct

SEQ ID NO: 6338581 - DNA, 21 bp, Homo sapiens
gttcaaaatgttaataaaggt

SEQ ID NO: 6338582 - DNA, 16 bp, Homo sapiens
gttcaaacaatatcat

SEQ ID NO: 6338583 - DNA, 16 bp, Homo sapiens
gttcaaacctgtgaag

SEQ ID NO: 6338584 - DNA, 17 bp, Homo sapiens
gttcaaactactgtaca

SEQ ID NO: 6338585 - DNA, 18 bp, Homo sapiens
gttcaaactactgtacat

SEQ ID NO: 6338586 - DNA, 22 bp, Homo sapiens
gttcaaagaacccccctcccca

SEQ ID NO: 6338587 - DNA, 20 bp, Homo sapiens
gttcaaagatattttgcttt

SEQ ID NO: 6338588 - DNA, 17 bp, Homo sapiens
gttcaaagatgcatttt

SEQ ID NO: 6338589 - DNA, 17 bp, Homo sapiens
gttcaaagcaaccacct

SEQ ID NO: 6338590 - DNA, 20 bp, Homo sapiens
gttcaaagtcatgatgtttt

SEQ ID NO: 6338591 - DNA, 21 bp, Homo sapiens
gttcaaagtgtatatttattc

SEQ ID NO: 6338592 - DNA, 14 bp, Homo sapiens
gttcaaatcctcac

SEQ ID NO: 6338593 - DNA, 22 bp, Homo sapiens
gttcaaatgcattttgggggtt

SEQ ID NO: 6338594 - DNA, 22 bp, Homo sapiens
gttcaaattaaaaaagctgctg

SEQ ID NO: 6338595 - DNA, 19 bp, Homo sapiens
gggggaacactgagaaaga

SEQ ID NO: 6338596 - DNA, 12 bp, Homo sapiens
gggggaaccagc

SEQ ID NO: 6338597 - DNA, 17 bp, Homo sapiens
gggggaagagcacagcc

SEQ ID NO: 6338598 - DNA, 19 bp, Homo sapiens
gggggaagagcacagccct

SEQ ID NO: 6338599 - DNA, 18 bp, Homo sapiens
gggggaaggccaagggga

SEQ ID NO: 6338600 - DNA, 20 bp, Homo sapiens
gggggaagtcgaaggatgct

SEQ ID NO: 6338601 - DNA, 21 bp, Homo sapiens
gggggaatgagcccagagaac

SEQ ID NO: 6338602 - DNA, 17 bp, Homo sapiens
gggggaatgcacctccc

SEQ ID NO: 6338603 - DNA, 22 bp, Homo sapiens
gggggacactccatgagtgtct

SEQ ID NO: 6338604 - DNA, 19 bp, Homo sapiens
gggggacactgtggcagca

SEQ ID NO: 6338605 - DNA, 13 bp, Homo sapiens
gggggacaggaac

SEQ ID NO: 6338606 - DNA, 18 bp, Homo sapiens
gggggacagggctggccc

SEQ ID NO: 6338607 - DNA, 15 bp, Homo sapiens
gggggaccctgcctc

SEQ ID NO: 6338608 - DNA, 14 bp, Homo sapiens
gggggacctgtccc

SEQ ID NO: 6338609 - DNA, 22 bp, Homo sapiens
gggggacctgtcccccactctc

SEQ ID NO: 6338610 - DNA, 16 bp, Homo sapiens
gggggactagcccctg

SEQ ID NO: 6338611 - DNA, 21 bp, Homo sapiens
gggggactctgagcgggaggc

SEQ ID NO: 6338612 - DNA, 19 bp, Homo sapiens
gggggactgctgctgcctg

SEQ ID NO: 6338613 - DNA, 20 bp, Homo sapiens
gggggactgctttcagtgcc

SEQ ID NO: 6338614 - DNA, 22 bp, Homo sapiens
gggggagaaggcctcccctgag

SEQ ID NO: 6338615 - DNA, 12 bp, Homo sapiens
gggggagacccc

SEQ ID NO: 6338616 - DNA, 15 bp, Homo sapiens
gggggagcaaaagaa

SEQ ID NO: 6338617 - DNA, 17 bp, Homo sapiens
gggggagccaacagcag

SEQ ID NO: 6338618 - DNA, 18 bp, Homo sapiens
gggggagccaacagcagc

SEQ ID NO: 6338619 - DNA, 22 bp, Homo sapiens
gggggagccggtaactgtcctg

SEQ ID NO: 6338620 - DNA, 11 bp, Homo sapiens
gggggagctga

SEQ ID NO: 6338621 - DNA, 17 bp, Homo sapiens
gggggaggcccaatgag

SEQ ID NO: 6338622 - DNA, 18 bp, Homo sapiens
gggggaggccgaggcagg

SEQ ID NO: 6338623 - DNA, 12 bp, Homo sapiens
gggggagggaag

SEQ ID NO: 6338624 - DNA, 12 bp, Homo sapiens
gggggagggagg

SEQ ID NO: 6338625 - DNA, 14 bp, Homo sapiens
gggggagggcaccc

SEQ ID NO: 6338626 - DNA, 14 bp, Homo sapiens
gggggagggggagg

SEQ ID NO: 6338627 - DNA, 17 bp, Homo sapiens
gggggagtctgaagcag

SEQ ID NO: 6338628 - DNA, 13 bp, Homo sapiens
gggggagtggaat

SEQ ID NO: 6338629 - DNA, 14 bp, Homo sapiens
gggggataccagct

SEQ ID NO: 6338630 - DNA, 15 bp, Homo sapiens
gggggatattatgaa

SEQ ID NO: 6338631 - DNA, 15 bp, Homo sapiens
gggggatgggccagg

SEQ ID NO: 6338632 - DNA, 16 bp, Homo sapiens
gggggcacaagactga

SEQ ID NO: 6338633 - DNA, 14 bp, Homo sapiens
gggggcacagctgt

SEQ ID NO: 6338634 - DNA, 23 bp, Homo sapiens
gggggcacatgctgagtctccca

SEQ ID NO: 6338635 - DNA, 13 bp, Homo sapiens
gggggcagagggc

SEQ ID NO: 6338636 - DNA, 21 bp, Homo sapiens
gggggcagcacaggagggcgg

SEQ ID NO: 6338637 - DNA, 14 bp, Homo sapiens
gggggcaggcctcc

SEQ ID NO: 6338638 - DNA, 21 bp, Homo sapiens
gggggcagggcccatctgccg

SEQ ID NO: 6338639 - DNA, 15 bp, Homo sapiens
gggggcaggggcagg

SEQ ID NO: 6338640 - DNA, 18 bp, Homo sapiens
gggggcagggggcttggc

SEQ ID NO: 6338641 - DNA, 14 bp, Homo sapiens
gggggcaggtgctg

SEQ ID NO: 6338642 - DNA, 21 bp, Homo sapiens
gggggcagtctccccttcctg

SEQ ID NO: 6338643 - DNA, 14 bp, Homo sapiens
gggggccaaaagga

SEQ ID NO: 6338644 - DNA, 17 bp, Homo sapiens
gggggccaaggtcctgc

SEQ ID NO: 6338645 - DNA, 17 bp, Homo sapiens
gggggccacctccccag

SEQ ID NO: 6338646 - DNA, 16 bp, Homo sapiens
gggggccacctgcctg

SEQ ID NO: 6338647 - DNA, 13 bp, Homo sapiens
gggggccagacac

SEQ ID NO: 6338648 - DNA, 17 bp, Homo sapiens
gggggccagctggtgct

SEQ ID NO: 6338649 - DNA, 15 bp, Homo sapiens
gggggccagtgggga

SEQ ID NO: 6338650 - DNA, 21 bp, Homo sapiens
gggggccatgaggcctcagtg

SEQ ID NO: 6338651 - DNA, 17 bp, Homo sapiens
gggggccccagtcagcc

SEQ ID NO: 6338652 - DNA, 15 bp, Homo sapiens
gggggcccctcaggt

SEQ ID NO: 6338653 - DNA, 23 bp, Homo sapiens
gggggcccgacaggtgggcctgg

SEQ ID NO: 6338654 - DNA, 16 bp, Homo sapiens
gggggccgctggccca

SEQ ID NO: 6338655 - DNA, 12 bp, Homo sapiens
gggggccgggca

SEQ ID NO: 6338656 - DNA, 14 bp, Homo sapiens
gggggccgggcagg

SEQ ID NO: 6338657 - DNA, 20 bp, Homo sapiens
gggggccgggcaggtcctgc

SEQ ID NO: 6338658 - DNA, 23 bp, Homo sapiens
gggggccgggcaggtcctgccca

SEQ ID NO: 6338659 - DNA, 17 bp, Homo sapiens
gggggcctcagggcagc

SEQ ID NO: 6338660 - DNA, 15 bp, Homo sapiens
gggggcctcagtgcc

SEQ ID NO: 6338661 - DNA, 18 bp, Homo sapiens
gggggcctcagtgccact

SEQ ID NO: 6338662 - DNA, 12 bp, Homo sapiens
gggggcctctgc

SEQ ID NO: 6338663 - DNA, 21 bp, Homo sapiens
gggggcctgagttgaggggct

SEQ ID NO: 6338664 - DNA, 13 bp, Homo sapiens
gggggcctggctg

SEQ ID NO: 6338665 - DNA, 11 bp, Homo sapiens
gggggcctgtg

SEQ ID NO: 6338666 - DNA, 17 bp, Homo sapiens
gggggccttgaagactc

SEQ ID NO: 6338667 - DNA, 21 bp, Homo sapiens
gggggccttgcggaagccata

SEQ ID NO: 6338668 - DNA, 16 bp, Homo sapiens
gggggcgactggggag

SEQ ID NO: 6338669 - DNA, 15 bp, Homo sapiens
gggggcgaggcccct

SEQ ID NO: 6338670 - DNA, 14 bp, Homo sapiens
gggggcgcctggag

SEQ ID NO: 6338671 - DNA, 15 bp, Homo sapiens
gggggcgcctgtggt

SEQ ID NO: 6338672 - DNA, 13 bp, Homo sapiens
gggggcggcaggg

SEQ ID NO: 6338673 - DNA, 16 bp, Homo sapiens
gggggcggctctggga

SEQ ID NO: 6338674 - DNA, 21 bp, Homo sapiens
gggggcgggattctctctcta

SEQ ID NO: 6338675 - DNA, 21 bp, Homo sapiens
gggggcgtgcctgccaagctc

SEQ ID NO: 6338676 - DNA, 16 bp, Homo sapiens
gggggctcagcaaggc

SEQ ID NO: 6338677 - DNA, 13 bp, Homo sapiens
gggggctcccctt

SEQ ID NO: 6338678 - DNA, 18 bp, Homo sapiens
gggggctcctgcccaggc

SEQ ID NO: 6338679 - DNA, 18 bp, Homo sapiens
gggggctcctggcagtga

SEQ ID NO: 6338680 - DNA, 14 bp, Homo sapiens
gggggctcctggtg

SEQ ID NO: 6338681 - DNA, 21 bp, Homo sapiens
gggggctcctggtggccttct

SEQ ID NO: 6338682 - DNA, 23 bp, Homo sapiens
gggggctcctggtggccttctgc

SEQ ID NO: 6338683 - DNA, 16 bp, Homo sapiens
gggggctgcttctcca

SEQ ID NO: 6338684 - DNA, 13 bp, Homo sapiens
gggggctggacct

SEQ ID NO: 6338685 - DNA, 12 bp, Homo sapiens
gggggctggctc

SEQ ID NO: 6338686 - DNA, 20 bp, Homo sapiens
gggggctgggctcacaggcc

SEQ ID NO: 6338687 - DNA, 13 bp, Homo sapiens
gggggctggggca

SEQ ID NO: 6338688 - DNA, 18 bp, Homo sapiens
gggggctggggtcacaga

SEQ ID NO: 6338689 - DNA, 16 bp, Homo sapiens
gggggctggtcctgag

SEQ ID NO: 6338690 - DNA, 19 bp, Homo sapiens
gggggctggtgccagcctt

SEQ ID NO: 6338691 - DNA, 13 bp, Homo sapiens
gggggctgtggcc

SEQ ID NO: 6338692 - DNA, 14 bp, Homo sapiens
gggggctgtggccc

SEQ ID NO: 6338693 - DNA, 11 bp, Homo sapiens
gggggcttcat

SEQ ID NO: 6338694 - DNA, 19 bp, Homo sapiens
gggggctttcggggagggc

SEQ ID NO: 6338695 - DNA, 13 bp, Homo sapiens
ggggggacagaca

SEQ ID NO: 6338696 - DNA, 13 bp, Homo sapiens
ggggggagctctg

SEQ ID NO: 6338697 - DNA, 11 bp, Homo sapiens
ggggggaggca

SEQ ID NO: 6338698 - DNA, 11 bp, Homo sapiens
ggggggcagag

SEQ ID NO: 6338699 - DNA, 12 bp, Homo sapiens
ggggggctcctg

SEQ ID NO: 6338700 - DNA, 12 bp, Homo sapiens
ggggggctgcct

SEQ ID NO: 6338701 - DNA, 11 bp, Homo sapiens
ggggggtggga

SEQ ID NO: 6338702 - DNA, 14 bp, Homo sapiens
gggggtagcctgga

SEQ ID NO: 6338703 - DNA, 23 bp, Homo sapiens
gggggtcagaagaagtgggagca

SEQ ID NO: 6338704 - DNA, 20 bp, Homo sapiens
gggggtcaggcagccagtga

SEQ ID NO: 6338705 - DNA, 16 bp, Homo sapiens
gggggtccacccagca

SEQ ID NO: 6338706 - DNA, 13 bp, Homo sapiens
gggggtcccagga

SEQ ID NO: 6338707 - DNA, 22 bp, Homo sapiens
gggggtcccagtgggaggggca

SEQ ID NO: 6338708 - DNA, 13 bp, Homo sapiens
gggggtccggaag

SEQ ID NO: 6338709 - DNA, 23 bp, Homo sapiens
gggggtctgctctgtgcctggga

SEQ ID NO: 6338710 - DNA, 12 bp, Homo sapiens
gggggtctggct

SEQ ID NO: 6338711 - DNA, 22 bp, Homo sapiens
gggggtctggctggtgttaaca

SEQ ID NO: 6338712 - DNA, 22 bp, Homo sapiens
gggggtgatgagggcagcagcc

SEQ ID NO: 6338713 - DNA, 19 bp, Homo sapiens
gggggtggagtgagactga

SEQ ID NO: 6338714 - DNA, 23 bp, Homo sapiens
gggggtggccgctgagtggcagg

SEQ ID NO: 6338715 - DNA, 12 bp, Homo sapiens
gggggtgggagg

SEQ ID NO: 6338716 - DNA, 14 bp, Homo sapiens
gggggtgggggtgc

SEQ ID NO: 6338717 - DNA, 16 bp, Homo sapiens
gggggtgtcttccctg

SEQ ID NO: 6338718 - DNA, 20 bp, Homo sapiens
gggggttcgcaccgtgctgg

SEQ ID NO: 6338719 - DNA, 19 bp, Homo sapiens
gggggttctggcaggacct

SEQ ID NO: 6338720 - DNA, 21 bp, Homo sapiens
gggggttctggcaggacctgc

SEQ ID NO: 6338721 - DNA, 18 bp, Homo sapiens
gggggttgcggggggagg

SEQ ID NO: 6338722 - DNA, 15 bp, Homo sapiens
gggggttgggttcca

SEQ ID NO: 6338723 - DNA, 22 bp, Homo sapiens
gggggtttcacctgggccctgg

SEQ ID NO: 6338724 - DNA, 22 bp, Homo sapiens
ggggtaaagtatcacttttctg

SEQ ID NO: 6338725 - DNA, 20 bp, Homo sapiens
ggggtaaatatatgttttga

SEQ ID NO: 6338726 - DNA, 21 bp, Homo sapiens
ggggtacaaggggcccagtgc

SEQ ID NO: 6338727 - DNA, 14 bp, Homo sapiens
ggggtacaggcagt

SEQ ID NO: 6338728 - DNA, 13 bp, Homo sapiens
ggggtagagagga

SEQ ID NO: 6338729 - DNA, 15 bp, Homo sapiens
ggggtagagaggaca

SEQ ID NO: 6338730 - DNA, 13 bp, Homo sapiens
ggggtagaggctg

SEQ ID NO: 6338731 - DNA, 15 bp, Homo sapiens
ggggtagcagctgga

SEQ ID NO: 6338732 - DNA, 15 bp, Homo sapiens
ggggtagccccgccc

SEQ ID NO: 6338733 - DNA, 12 bp, Homo sapiens
ggggtagcctgg

SEQ ID NO: 6338734 - DNA, 21 bp, Homo sapiens
ggggtagctagcgtgtgccag

SEQ ID NO: 6338735 - DNA, 14 bp, Homo sapiens
ggggtaggagagca

SEQ ID NO: 6338736 - DNA, 16 bp, Homo sapiens
ggggtaggagagcact

SEQ ID NO: 6338737 - DNA, 19 bp, Homo sapiens
ggggtaggagagcactgcc

SEQ ID NO: 6338738 - DNA, 14 bp, Homo sapiens
ggggtaggagagga

SEQ ID NO: 6338739 - DNA, 17 bp, Homo sapiens
ggggtaggaggaacagg

SEQ ID NO: 6338740 - DNA, 16 bp, Homo sapiens
ggggtcaagctgagct

SEQ ID NO: 6338741 - DNA, 12 bp, Homo sapiens
ggggtcacaccc

SEQ ID NO: 6338742 - DNA, 21 bp, Homo sapiens
ggggtcacacccaccccctgc

SEQ ID NO: 6338743 - DNA, 12 bp, Homo sapiens
ggggtcacaggc

SEQ ID NO: 6338744 - DNA, 14 bp, Homo sapiens
ggggtcacaggccc

SEQ ID NO: 6338745 - DNA, 18 bp, Homo sapiens
ggggtcacccatggcctc

SEQ ID NO: 6338746 - DNA, 22 bp, Homo sapiens
ggggtcactctggcagctcaga

SEQ ID NO: 6338747 - DNA, 12 bp, Homo sapiens
ggggtcagaaga

SEQ ID NO: 6338748 - DNA, 21 bp, Homo sapiens
ggggtcagaagaagtgggagc

SEQ ID NO: 6338749 - DNA, 22 bp, Homo sapiens
ggggtcagaagaagtgggagca

SEQ ID NO: 6338750 - DNA, 19 bp, Homo sapiens
ggggtcagcaggcccagga

SEQ ID NO: 6338751 - DNA, 14 bp, Homo sapiens
ggggtcagccccaa

SEQ ID NO: 6338752 - DNA, 20 bp, Homo sapiens
ggggtcaggaacagtggctg

SEQ ID NO: 6338753 - DNA, 22 bp, Homo sapiens
ggggtcagggaccaaggacccc

SEQ ID NO: 6338754 - DNA, 20 bp, Homo sapiens
ggggtcaggtgccactgacc

SEQ ID NO: 6338755 - DNA, 17 bp, Homo sapiens
ggggtcatgaagggctg

SEQ ID NO: 6338756 - DNA, 14 bp, Homo sapiens
ggggtccaggcccg

SEQ ID NO: 6338757 - DNA, 13 bp, Homo sapiens
ggggtccagggct

SEQ ID NO: 6338758 - DNA, 21 bp, Homo sapiens
ggggtccaggtcaccagcctg

SEQ ID NO: 6338759 - DNA, 13 bp, Homo sapiens
ggggtccagtctg

SEQ ID NO: 6338760 - DNA, 19 bp, Homo sapiens
ggggtccccactccctgtc

SEQ ID NO: 6338761 - DNA, 23 bp, Homo sapiens
ggggtccccatcatcccagctgc

SEQ ID NO: 6338762 - DNA, 15 bp, Homo sapiens
ggggtcccccctccc

SEQ ID NO: 6338763 - DNA, 14 bp, Homo sapiens
ggggtcctctctga

SEQ ID NO: 6338764 - DNA, 24 bp, Homo sapiens
ggggtcctctctgagtcaaatcca

SEQ ID NO: 6338765 - DNA, 18 bp, Homo sapiens
ggggtcctgccggagagg

SEQ ID NO: 6338766 - DNA, 19 bp, Homo sapiens
ggggtcctggagcagacca

SEQ ID NO: 6338767 - DNA, 12 bp, Homo sapiens
ggggtcctggga

SEQ ID NO: 6338768 - DNA, 13 bp, Homo sapiens
ggggtcctgggag

SEQ ID NO: 6338769 - DNA, 20 bp, Homo sapiens
ggggtcctgggaggctgcag

SEQ ID NO: 6338770 - DNA, 15 bp, Homo sapiens
ggggtcctgtggcag

SEQ ID NO: 6338771 - DNA, 19 bp, Homo sapiens
ggggtcctgtggcaggcag

SEQ ID NO: 6338772 - DNA, 14 bp, Homo sapiens
ggggtcggctcctg

SEQ ID NO: 6338773 - DNA, 21 bp, Homo sapiens
ggggtcgggggaggagcaccc

SEQ ID NO: 6338774 - DNA, 22 bp, Homo sapiens
ggggtcgggggaggagcacccc

SEQ ID NO: 6338775 - DNA, 17 bp, Homo sapiens
ggggtcgtgaggcaaga

SEQ ID NO: 6338776 - DNA, 19 bp, Homo sapiens
ggggtctcatgtcctgctg

SEQ ID NO: 6338777 - DNA, 12 bp, Homo sapiens
gttcaaattctc

SEQ ID NO: 6338778 - DNA, 15 bp, Homo sapiens
gttcaacccacagct

SEQ ID NO: 6338779 - DNA, 16 bp, Homo sapiens
gttcaacccacagcta

SEQ ID NO: 6338780 - DNA, 13 bp, Homo sapiens
gttcaactacatg

SEQ ID NO: 6338781 - DNA, 12 bp, Homo sapiens
gttcaactattt

SEQ ID NO: 6338782 - DNA, 14 bp, Homo sapiens
gttcaactatttta

SEQ ID NO: 6338783 - DNA, 12 bp, Homo sapiens
gttcaactccac

SEQ ID NO: 6338784 - DNA, 13 bp, Homo sapiens
gttcaagaaatga

SEQ ID NO: 6338785 - DNA, 18 bp, Homo sapiens
gttcaagaccagcctggc

SEQ ID NO: 6338786 - DNA, 15 bp, Homo sapiens
gttcaagaggcgtgt

SEQ ID NO: 6338787 - DNA, 14 bp, Homo sapiens
gttcaagatcaaaa

SEQ ID NO: 6338788 - DNA, 14 bp, Homo sapiens
gttcaagcacactg

SEQ ID NO: 6338789 - DNA, 21 bp, Homo sapiens
gttcaagccattctgcctcag

SEQ ID NO: 6338790 - DNA, 13 bp, Homo sapiens
gttcaagcccagg

SEQ ID NO: 6338791 - DNA, 17 bp, Homo sapiens
gttcaagcgattctctt

SEQ ID NO: 6338792 - DNA, 18 bp, Homo sapiens
gttcaagcgattcttctg

SEQ ID NO: 6338793 - DNA, 19 bp, Homo sapiens
gttcaagcttttcctttct

SEQ ID NO: 6338794 - DNA, 14 bp, Homo sapiens
gttcaaggaccaac

SEQ ID NO: 6338795 - DNA, 12 bp, Homo sapiens
gttcaaggacta

SEQ ID NO: 6338796 - DNA, 18 bp, Homo sapiens
gttcaaggccatccttcc

SEQ ID NO: 6338797 - DNA, 20 bp, Homo sapiens
gttcaagtaattctgctgtc

SEQ ID NO: 6338798 - DNA, 17 bp, Homo sapiens
gttcaagtattaagcag

SEQ ID NO: 6338799 - DNA, 19 bp, Homo sapiens
gttcaagtgattctcctgc

SEQ ID NO: 6338800 - DNA, 22 bp, Homo sapiens
gttcaatcctgattcatattta

SEQ ID NO: 6338801 - DNA, 16 bp, Homo sapiens
gttcaatctgtgaagc

SEQ ID NO: 6338802 - DNA, 22 bp, Homo sapiens
gttcaatctgtgaagcctttat

SEQ ID NO: 6338803 - DNA, 15 bp, Homo sapiens
gttcaatgaaataaa

SEQ ID NO: 6338804 - DNA, 22 bp, Homo sapiens
gttcaatgaagaggaagttaaa

SEQ ID NO: 6338805 - DNA, 20 bp, Homo sapiens
gttcaatgatctaggtttaa

SEQ ID NO: 6338806 - DNA, 22 bp, Homo sapiens
gttcaatgatctaggtttaact

SEQ ID NO: 6338807 - DNA, 14 bp, Homo sapiens
gttcaatgttccat

SEQ ID NO: 6338808 - DNA, 17 bp, Homo sapiens
gttcaattccctgaagg

SEQ ID NO: 6338809 - DNA, 18 bp, Homo sapiens
gttcaatttcagaaacta

SEQ ID NO: 6338810 - DNA, 20 bp, Homo sapiens
gttcaatttgccattggttt

SEQ ID NO: 6338811 - DNA, 16 bp, Homo sapiens
gttcacaaactacctc

SEQ ID NO: 6338812 - DNA, 19 bp, Homo sapiens
gttcacacagcccagttcc

SEQ ID NO: 6338813 - DNA, 16 bp, Homo sapiens
gttcacaccagagaac

SEQ ID NO: 6338814 - DNA, 19 bp, Homo sapiens
gttcacaccattctcctgc

SEQ ID NO: 6338815 - DNA, 13 bp, Homo sapiens
gttcacactccta

SEQ ID NO: 6338816 - DNA, 12 bp, Homo sapiens
gttcacaggagg

SEQ ID NO: 6338817 - DNA, 19 bp, Homo sapiens
gttcacagtgtttcttatt

SEQ ID NO: 6338818 - DNA, 20 bp, Homo sapiens
gttcacatcccatgtagaaa

SEQ ID NO: 6338819 - DNA, 23 bp, Homo sapiens
gttcacatttttacaaataggta

SEQ ID NO: 6338820 - DNA, 12 bp, Homo sapiens
gttcaccagccc

SEQ ID NO: 6338821 - DNA, 16 bp, Homo sapiens
gttcacccacagggct

SEQ ID NO: 6338822 - DNA, 14 bp, Homo sapiens
gttcacccctccac

SEQ ID NO: 6338823 - DNA, 16 bp, Homo sapiens
gttcacccctccaccc

SEQ ID NO: 6338824 - DNA, 20 bp, Homo sapiens
gttcaccctgcattacatgt

SEQ ID NO: 6338825 - DNA, 22 bp, Homo sapiens
gttcaccgtagtaacacataaa

SEQ ID NO: 6338826 - DNA, 15 bp, Homo sapiens
gttcacctctgtaca

SEQ ID NO: 6338827 - DNA, 16 bp, Homo sapiens
gttcacctgtgactcc

SEQ ID NO: 6338828 - DNA, 17 bp, Homo sapiens
gttcaccttatgtatta

SEQ ID NO: 6338829 - DNA, 18 bp, Homo sapiens
gttcaccttatgtattat

SEQ ID NO: 6338830 - DNA, 21 bp, Homo sapiens
gttcaccttatgtattatttt

SEQ ID NO: 6338831 - DNA, 17 bp, Homo sapiens
gttcaccttctgtgcat

SEQ ID NO: 6338832 - DNA, 20 bp, Homo sapiens
gttcaccttctgtgcatctg

SEQ ID NO: 6338833 - DNA, 22 bp, Homo sapiens
gttcaccttgaagaacctctca

SEQ ID NO: 6338834 - DNA, 15 bp, Homo sapiens
gttcacgcaacttga

SEQ ID NO: 6338835 - DNA, 16 bp, Homo sapiens
gttcacgcaacttgaa

SEQ ID NO: 6338836 - DNA, 16 bp, Homo sapiens
gttcacgctcacccag

SEQ ID NO: 6338837 - DNA, 19 bp, Homo sapiens
gttcacgtaatcctcctga

SEQ ID NO: 6338838 - DNA, 18 bp, Homo sapiens
gttcacgtcactgccaga

SEQ ID NO: 6338839 - DNA, 18 bp, Homo sapiens
gttcacgtgactcctcaa

SEQ ID NO: 6338840 - DNA, 15 bp, Homo sapiens
gttcactaaactctg

SEQ ID NO: 6338841 - DNA, 13 bp, Homo sapiens
gttcactccattt

SEQ ID NO: 6338842 - DNA, 20 bp, Homo sapiens
gttcactccccgcctcccca

SEQ ID NO: 6338843 - DNA, 19 bp, Homo sapiens
gttcactctccatttaata

SEQ ID NO: 6338844 - DNA, 20 bp, Homo sapiens
gttcactcttctcagccact

SEQ ID NO: 6338845 - DNA, 17 bp, Homo sapiens
gttcactcttggagcct

SEQ ID NO: 6338846 - DNA, 18 bp, Homo sapiens
gttcactcttggagcctg

SEQ ID NO: 6338847 - DNA, 24 bp, Homo sapiens
gttcactcttggagcctgcagagc

SEQ ID NO: 6338848 - DNA, 21 bp, Homo sapiens
gttcactgagctccccagatc

SEQ ID NO: 6338849 - DNA, 19 bp, Homo sapiens
gttcactgcaacctccgcc

SEQ ID NO: 6338850 - DNA, 15 bp, Homo sapiens
gttcactgcagcatg

SEQ ID NO: 6338851 - DNA, 12 bp, Homo sapiens
gttcactgtgag

SEQ ID NO: 6338852 - DNA, 19 bp, Homo sapiens
gttcactgttgtacacagt

SEQ ID NO: 6338853 - DNA, 16 bp, Homo sapiens
gttcacttaaattctt

SEQ ID NO: 6338854 - DNA, 21 bp, Homo sapiens
gttcacttctttgcagagcct

SEQ ID NO: 6338855 - DNA, 23 bp, Homo sapiens
gttcacttgggctctctctagct

SEQ ID NO: 6338856 - DNA, 15 bp, Homo sapiens
gttcagaaaaccact

SEQ ID NO: 6338857 - DNA, 15 bp, Homo sapiens
gttcagaaaattaaa

SEQ ID NO: 6338858 - DNA, 11 bp, Homo sapiens
gttcagaacca

SEQ ID NO: 6338859 - DNA, 19 bp, Homo sapiens
gttcagaacttcatctgcc

SEQ ID NO: 6338860 - DNA, 14 bp, Homo sapiens
gttcagaagaaatt

SEQ ID NO: 6338861 - DNA, 12 bp, Homo sapiens
gttcagaagaat

SEQ ID NO: 6338862 - DNA, 14 bp, Homo sapiens
gttcagaaggtgtg

SEQ ID NO: 6338863 - DNA, 22 bp, Homo sapiens
gttcagaatggcagtcctggag

SEQ ID NO: 6338864 - DNA, 23 bp, Homo sapiens
gttcagaatggcagtcctggagg

SEQ ID NO: 6338865 - DNA, 18 bp, Homo sapiens
gttcagaattttggaaaa

SEQ ID NO: 6338866 - DNA, 16 bp, Homo sapiens
gttcagacaagacaga

SEQ ID NO: 6338867 - DNA, 17 bp, Homo sapiens
gttcagacacagctctt

SEQ ID NO: 6338868 - DNA, 14 bp, Homo sapiens
gttcagacacctgt

SEQ ID NO: 6338869 - DNA, 15 bp, Homo sapiens
gttcagacccctgcc

SEQ ID NO: 6338870 - DNA, 16 bp, Homo sapiens
gttcagagactggcag

SEQ ID NO: 6338871 - DNA, 23 bp, Homo sapiens
gttcagagccaagccttaaactg

SEQ ID NO: 6338872 - DNA, 19 bp, Homo sapiens
gttcagagctgccctctcc

SEQ ID NO: 6338873 - DNA, 20 bp, Homo sapiens
gttcagagctgccctctcct

SEQ ID NO: 6338874 - DNA, 15 bp, Homo sapiens
gttcagaggaagcac

SEQ ID NO: 6338875 - DNA, 19 bp, Homo sapiens
gttcagagtccttaaaatg

SEQ ID NO: 6338876 - DNA, 22 bp, Homo sapiens
gttcagagtggctcactggctg

SEQ ID NO: 6338877 - DNA, 20 bp, Homo sapiens
gttcagatcttaatataaat

SEQ ID NO: 6338878 - DNA, 14 bp, Homo sapiens
gttcagatgtgcat

SEQ ID NO: 6338879 - DNA, 17 bp, Homo sapiens
gttcagatgtgcatttc

SEQ ID NO: 6338880 - DNA, 20 bp, Homo sapiens
gttcagcaagtagagcagag

SEQ ID NO: 6338881 - DNA, 12 bp, Homo sapiens
gttcagcagaac

SEQ ID NO: 6338882 - DNA, 15 bp, Homo sapiens
gttcagcagaacctg

SEQ ID NO: 6338883 - DNA, 22 bp, Homo sapiens
gttcagcagaacctgcacacag

SEQ ID NO: 6338884 - DNA, 12 bp, Homo sapiens
gttcagccaagg

SEQ ID NO: 6338885 - DNA, 23 bp, Homo sapiens
gttcagccaccctgaggcctctg

SEQ ID NO: 6338886 - DNA, 17 bp, Homo sapiens
gttcagccactgaggga

SEQ ID NO: 6338887 - DNA, 14 bp, Homo sapiens
gttcagccattgtg

SEQ ID NO: 6338888 - DNA, 14 bp, Homo sapiens
gttcagcccctcct

SEQ ID NO: 6338889 - DNA, 18 bp, Homo sapiens
gttcagcccctcctctgc

SEQ ID NO: 6338890 - DNA, 19 bp, Homo sapiens
gttcagcccctcctctgcc

SEQ ID NO: 6338891 - DNA, 21 bp, Homo sapiens
gttcagcccctcctctgccac

SEQ ID NO: 6338892 - DNA, 14 bp, Homo sapiens
gttcagcctcctgt

SEQ ID NO: 6338893 - DNA, 14 bp, Homo sapiens
gttcagcctggcct

SEQ ID NO: 6338894 - DNA, 21 bp, Homo sapiens
gttcagccttcgtgtggctcc

SEQ ID NO: 6338895 - DNA, 22 bp, Homo sapiens
gttcagccttcgtgtggctcct

SEQ ID NO: 6338896 - DNA, 24 bp, Homo sapiens
gttcagccttcgtgtggctcctgg

SEQ ID NO: 6338897 - DNA, 17 bp, Homo sapiens
gttcagcggagctagca

SEQ ID NO: 6338898 - DNA, 15 bp, Homo sapiens
gttcagcggagctga

SEQ ID NO: 6338899 - DNA, 17 bp, Homo sapiens
gttcagctactttccat

SEQ ID NO: 6338900 - DNA, 21 bp, Homo sapiens
gttcagctactttccatttgg

SEQ ID NO: 6338901 - DNA, 23 bp, Homo sapiens
gttcagctactttccatttggta

SEQ ID NO: 6338902 - DNA, 15 bp, Homo sapiens
gttcagctccagctc

SEQ ID NO: 6338903 - DNA, 23 bp, Homo sapiens
gttcagctcccccaggctgttct

SEQ ID NO: 6338904 - DNA, 18 bp, Homo sapiens
gttcagctctttccaaat

SEQ ID NO: 6338905 - DNA, 17 bp, Homo sapiens
gttcagctgtcctccct

SEQ ID NO: 6338906 - DNA, 18 bp, Homo sapiens
gttcagctgtcctccctc

SEQ ID NO: 6338907 - DNA, 23 bp, Homo sapiens
gttcagcttgtaaatagctcagg

SEQ ID NO: 6338908 - DNA, 13 bp, Homo sapiens
gttcaggagctga

SEQ ID NO: 6338909 - DNA, 18 bp, Homo sapiens
gttcaggagtccaaacct

SEQ ID NO: 6338910 - DNA, 18 bp, Homo sapiens
gttcaggagtcccaagga

SEQ ID NO: 6338911 - DNA, 14 bp, Homo sapiens
gttcaggctggctc

SEQ ID NO: 6338912 - DNA, 14 bp, Homo sapiens
gttcagggaagcag

SEQ ID NO: 6338913 - DNA, 15 bp, Homo sapiens
gttcagggaagcagg

SEQ ID NO: 6338914 - DNA, 19 bp, Homo sapiens
gttcagggaagcaggcaga

SEQ ID NO: 6338915 - DNA, 13 bp, Homo sapiens
gttcagggagggg

SEQ ID NO: 6338916 - DNA, 16 bp, Homo sapiens
gttcagggaggggccg

SEQ ID NO: 6338917 - DNA, 14 bp, Homo sapiens
gttcagggatgctc

SEQ ID NO: 6338918 - DNA, 16 bp, Homo sapiens
gttcaggtcagggcta

SEQ ID NO: 6338919 - DNA, 22 bp, Homo sapiens
gttcaggtcccacgtctggcca

SEQ ID NO: 6338920 - DNA, 22 bp, Homo sapiens
gttcagtaacagggccttgcta

SEQ ID NO: 6338921 - DNA, 14 bp, Homo sapiens
gttcagtaccacat

SEQ ID NO: 6338922 - DNA, 13 bp, Homo sapiens
gttcagtacctgg

SEQ ID NO: 6338923 - DNA, 16 bp, Homo sapiens
gttcagtacctggagg

SEQ ID NO: 6338924 - DNA, 23 bp, Homo sapiens
gttcagtactctacaattcctct

SEQ ID NO: 6338925 - DNA, 24 bp, Homo sapiens
gttcagtactctacaattcctctg

SEQ ID NO: 6338926 - DNA, 17 bp, Homo sapiens
gttcagtagatttcctt

SEQ ID NO: 6338927 - DNA, 14 bp, Homo sapiens
gttcagtagcttat

SEQ ID NO: 6338928 - DNA, 19 bp, Homo sapiens
gttcagtatttaatgaaac

SEQ ID NO: 6338929 - DNA, 23 bp, Homo sapiens
gttcagtctgaatgctgccacaa

SEQ ID NO: 6338930 - DNA, 23 bp, Homo sapiens
gttcagtgagatatcatagagac

SEQ ID NO: 6338931 - DNA, 16 bp, Homo sapiens
gttcagtgagctgcac

SEQ ID NO: 6338932 - DNA, 16 bp, Homo sapiens
gttcagtgccttcctc

SEQ ID NO: 6338933 - DNA, 16 bp, Homo sapiens
gttcagtgccttggag

SEQ ID NO: 6338934 - DNA, 17 bp, Homo sapiens
gttcagtgccttggagc

SEQ ID NO: 6338935 - DNA, 16 bp, Homo sapiens
gttcagtgtcccaggc

SEQ ID NO: 6338936 - DNA, 21 bp, Homo sapiens
gttcagtgtcgggaattttcc

SEQ ID NO: 6338937 - DNA, 12 bp, Homo sapiens
gttcagtgttga

SEQ ID NO: 6338938 - DNA, 17 bp, Homo sapiens
gttcagtgttgacatag

SEQ ID NO: 6338939 - DNA, 18 bp, Homo sapiens
gttcagtgttgacatagc

SEQ ID NO: 6338940 - DNA, 20 bp, Homo sapiens
gttcagtgttgacatagcct

SEQ ID NO: 6338941 - DNA, 17 bp, Homo sapiens
gttcagtgtttctgggg

SEQ ID NO: 6338942 - DNA, 12 bp, Homo sapiens
gttcagttacag

SEQ ID NO: 6338943 - DNA, 15 bp, Homo sapiens
gttcagttacagaaa

SEQ ID NO: 6338944 - DNA, 16 bp, Homo sapiens
gttcagttacagaaag

SEQ ID NO: 6338945 - DNA, 17 bp, Homo sapiens
gttcagttacagaaagt

SEQ ID NO: 6338946 - DNA, 15 bp, Homo sapiens
gttcagttccagctt

SEQ ID NO: 6338947 - DNA, 20 bp, Homo sapiens
gttcagttcctctttgcatg

SEQ ID NO: 6338948 - DNA, 17 bp, Homo sapiens
gttcagttgccactaag

SEQ ID NO: 6338949 - DNA, 19 bp, Homo sapiens
gttcataacagtgccattg

SEQ ID NO: 6338950 - DNA, 22 bp, Homo sapiens
gttcataacagtgccattgtct

SEQ ID NO: 6338951 - DNA, 23 bp, Homo sapiens
gttcataacagtgccattgtctt

SEQ ID NO: 6338952 - DNA, 14 bp, Homo sapiens
gttcatacagtttt

SEQ ID NO: 6338953 - DNA, 23 bp, Homo sapiens
gttcatacatatttttgtagcac

SEQ ID NO: 6338954 - DNA, 14 bp, Homo sapiens
gttcatacatttga

SEQ ID NO: 6338955 - DNA, 17 bp, Homo sapiens
gttcatacctaagtact

SEQ ID NO: 6338956 - DNA, 22 bp, Homo sapiens
ggggtctccctctcctgcctac

SEQ ID NO: 6338957 - DNA, 17 bp, Homo sapiens
ggggtctccctgagcct

SEQ ID NO: 6338958 - DNA, 20 bp, Homo sapiens
ggggtctccctgagcctgcc

SEQ ID NO: 6338959 - DNA, 15 bp, Homo sapiens
ggggtctctcacaga

SEQ ID NO: 6338960 - DNA, 19 bp, Homo sapiens
ggggtctctcacagacagg

SEQ ID NO: 6338961 - DNA, 23 bp, Homo sapiens
ggggtctcttctgaataaagcaa

SEQ ID NO: 6338962 - DNA, 13 bp, Homo sapiens
ggggtctgcctcc

SEQ ID NO: 6338963 - DNA, 13 bp, Homo sapiens
ggggtctgggagg

SEQ ID NO: 6338964 - DNA, 17 bp, Homo sapiens
ggggtctgggaggcagg

SEQ ID NO: 6338965 - DNA, 18 bp, Homo sapiens
ggggtctgggaggcaggt

SEQ ID NO: 6338966 - DNA, 13 bp, Homo sapiens
ggggtctgggcag

SEQ ID NO: 6338967 - DNA, 22 bp, Homo sapiens
ggggtctgggcagtgccacagc

SEQ ID NO: 6338968 - DNA, 13 bp, Homo sapiens
ggggtctgtgctg

SEQ ID NO: 6338969 - DNA, 14 bp, Homo sapiens
ggggtcttaccttg

SEQ ID NO: 6338970 - DNA, 22 bp, Homo sapiens
ggggtctttgtgagagtgagct

SEQ ID NO: 6338971 - DNA, 12 bp, Homo sapiens
ggggtgacacag

SEQ ID NO: 6338972 - DNA, 11 bp, Homo sapiens
ggggtgacagt

SEQ ID NO: 6338973 - DNA, 21 bp, Homo sapiens
ggggtgacagtcatcatcagg

SEQ ID NO: 6338974 - DNA, 22 bp, Homo sapiens
ggggtgacctccggccaggtgc

SEQ ID NO: 6338975 - DNA, 22 bp, Homo sapiens
ggggtgactttgtctctcctgg

SEQ ID NO: 6338976 - DNA, 12 bp, Homo sapiens
ggggtgagcccc

SEQ ID NO: 6338977 - DNA, 14 bp, Homo sapiens
ggggtgagccccgc

SEQ ID NO: 6338978 - DNA, 19 bp, Homo sapiens
ggggtgagcgaagccccca

SEQ ID NO: 6338979 - DNA, 13 bp, Homo sapiens
ggggtgaggacca

SEQ ID NO: 6338980 - DNA, 15 bp, Homo sapiens
ggggtgataaggggc

SEQ ID NO: 6338981 - DNA, 21 bp, Homo sapiens
ggggtgatgatgaccaagaat

SEQ ID NO: 6338982 - DNA, 21 bp, Homo sapiens
ggggtgatggccagaggaatg

SEQ ID NO: 6338983 - DNA, 17 bp, Homo sapiens
ggggtgcaaagactctg

SEQ ID NO: 6338984 - DNA, 19 bp, Homo sapiens
ggggtgcaaagactctgag

SEQ ID NO: 6338985 - DNA, 20 bp, Homo sapiens
ggggtgcaaagactctgagc

SEQ ID NO: 6338986 - DNA, 22 bp, Homo sapiens
ggggtgcaaagactctgagcca

SEQ ID NO: 6338987 - DNA, 13 bp, Homo sapiens
ggggtgcacagga

SEQ ID NO: 6338988 - DNA, 15 bp, Homo sapiens
ggggtgcacaggagg

SEQ ID NO: 6338989 - DNA, 14 bp, Homo sapiens
ggggtgcagctggg

SEQ ID NO: 6338990 - DNA, 16 bp, Homo sapiens
ggggtgcagctgggtg

SEQ ID NO: 6338991 - DNA, 22 bp, Homo sapiens
ggggtgccatggtgttggaggg

SEQ ID NO: 6338992 - DNA, 18 bp, Homo sapiens
ggggtgccccacaaggcc

SEQ ID NO: 6338993 - DNA, 23 bp, Homo sapiens
ggggtgccccacaaggcccagcc

SEQ ID NO: 6338994 - DNA, 15 bp, Homo sapiens
ggggtgccccagcta

SEQ ID NO: 6338995 - DNA, 20 bp, Homo sapiens
ggggtgccccctcctctccc

SEQ ID NO: 6338996 - DNA, 21 bp, Homo sapiens
ggggtgccctccactgccctc

SEQ ID NO: 6338997 - DNA, 14 bp, Homo sapiens
ggggtgccctctgg

SEQ ID NO: 6338998 - DNA, 14 bp, Homo sapiens
ggggtgccgcctgc

SEQ ID NO: 6338999 - DNA, 18 bp, Homo sapiens
ggggtgccgctgtctctg

SEQ ID NO: 6339000 - DNA, 14 bp, Homo sapiens
ggggtgcctgctgt

SEQ ID NO: 6339001 - DNA, 23 bp, Homo sapiens
ggggtgcctggtgcgctgtgctc

SEQ ID NO: 6339002 - DNA, 22 bp, Homo sapiens
ggggtgcgagagaggtgggcag

SEQ ID NO: 6339003 - DNA, 20 bp, Homo sapiens
ggggtgcggcggtcccagct

SEQ ID NO: 6339004 - DNA, 11 bp, Homo sapiens
ggggtgctgcc

SEQ ID NO: 6339005 - DNA, 14 bp, Homo sapiens
ggggtgctggggcc

SEQ ID NO: 6339006 - DNA, 23 bp, Homo sapiens
ggggtggaatgccgctgtctctg

SEQ ID NO: 6339007 - DNA, 17 bp, Homo sapiens
ggggtggaggaccgagg

SEQ ID NO: 6339008 - DNA, 12 bp, Homo sapiens
ggggtggaggct

SEQ ID NO: 6339009 - DNA, 22 bp, Homo sapiens
ggggtggaggctaagcctggac

SEQ ID NO: 6339010 - DNA, 13 bp, Homo sapiens
ggggtggccgtcc

SEQ ID NO: 6339011 - DNA, 13 bp, Homo sapiens
ggggtggcctgtg

SEQ ID NO: 6339012 - DNA, 11 bp, Homo sapiens
ggggtggcgcg

SEQ ID NO: 6339013 - DNA, 11 bp, Homo sapiens
ggggtgggagc

SEQ ID NO: 6339014 - DNA, 12 bp, Homo sapiens
ggggtgggaggc

SEQ ID NO: 6339015 - DNA, 16 bp, Homo sapiens
ggggtgggaggctccc

SEQ ID NO: 6339016 - DNA, 17 bp, Homo sapiens
ggggtgggaggctccca

SEQ ID NO: 6339017 - DNA, 19 bp, Homo sapiens
ggggtgggagggcgtcagg

SEQ ID NO: 6339018 - DNA, 17 bp, Homo sapiens
ggggtgggccaggctga

SEQ ID NO: 6339019 - DNA, 23 bp, Homo sapiens
ggggtgggctggagtcctctcca

SEQ ID NO: 6339020 - DNA, 17 bp, Homo sapiens
ggggtggggcaggatct

SEQ ID NO: 6339021 - DNA, 18 bp, Homo sapiens
ggggtgggggctgtcctg

SEQ ID NO: 6339022 - DNA, 18 bp, Homo sapiens
ggggtgggggtggaggct

SEQ ID NO: 6339023 - DNA, 22 bp, Homo sapiens
ggggtggttattggactccagg

SEQ ID NO: 6339024 - DNA, 14 bp, Homo sapiens
ggggtgtcagaagc

SEQ ID NO: 6339025 - DNA, 15 bp, Homo sapiens
ggggtgtcagaagct

SEQ ID NO: 6339026 - DNA, 15 bp, Homo sapiens
ggggtgtcccagtcc

SEQ ID NO: 6339027 - DNA, 22 bp, Homo sapiens
ggggtgtctggaagctgagcag

SEQ ID NO: 6339028 - DNA, 22 bp, Homo sapiens
ggggtgtctgtatcctgcagga

SEQ ID NO: 6339029 - DNA, 19 bp, Homo sapiens
ggggtgtggctccttccca

SEQ ID NO: 6339030 - DNA, 15 bp, Homo sapiens
ggggtgtggtggcct

SEQ ID NO: 6339031 - DNA, 16 bp, Homo sapiens
ggggtgttcttcttgg

SEQ ID NO: 6339032 - DNA, 18 bp, Homo sapiens
ggggtgtttgggagctgc

SEQ ID NO: 6339033 - DNA, 18 bp, Homo sapiens
ggggttaagtctcctgtc

SEQ ID NO: 6339034 - DNA, 15 bp, Homo sapiens
ggggttaatttatca

SEQ ID NO: 6339035 - DNA, 21 bp, Homo sapiens
ggggttagagccaagctgcac

SEQ ID NO: 6339036 - DNA, 22 bp, Homo sapiens
ggggttagagccaagctgcaca

SEQ ID NO: 6339037 - DNA, 17 bp, Homo sapiens
ggggttcagcccctcct

SEQ ID NO: 6339038 - DNA, 14 bp, Homo sapiens
ggggttcaggcccg

SEQ ID NO: 6339039 - DNA, 20 bp, Homo sapiens
ggggttcataggtcactggc

SEQ ID NO: 6339040 - DNA, 13 bp, Homo sapiens
ggggttccctcct

SEQ ID NO: 6339041 - DNA, 22 bp, Homo sapiens
ggggttcccttgagggctgcag

SEQ ID NO: 6339042 - DNA, 18 bp, Homo sapiens
ggggttcctcaaattttt

SEQ ID NO: 6339043 - DNA, 20 bp, Homo sapiens
ggggttcggttgcagggctg

SEQ ID NO: 6339044 - DNA, 22 bp, Homo sapiens
ggggttctgagaagcgctgccc

SEQ ID NO: 6339045 - DNA, 20 bp, Homo sapiens
ggggttgccacaggcctccc

SEQ ID NO: 6339046 - DNA, 13 bp, Homo sapiens
ggggttgccagag

SEQ ID NO: 6339047 - DNA, 19 bp, Homo sapiens
ggggttgccagaggccctg

SEQ ID NO: 6339048 - DNA, 13 bp, Homo sapiens
ggggttgcccagc

SEQ ID NO: 6339049 - DNA, 13 bp, Homo sapiens
ggggttgccctgg

SEQ ID NO: 6339050 - DNA, 19 bp, Homo sapiens
ggggttgcctcgagtcccc

SEQ ID NO: 6339051 - DNA, 20 bp, Homo sapiens
ggggttggatgggaagatgg

SEQ ID NO: 6339052 - DNA, 20 bp, Homo sapiens
ggggttggcagcgcctcgcc

SEQ ID NO: 6339053 - DNA, 19 bp, Homo sapiens
ggggttggctgttccagac

SEQ ID NO: 6339054 - DNA, 18 bp, Homo sapiens
ggggttgggacagggagg

SEQ ID NO: 6339055 - DNA, 16 bp, Homo sapiens
ggggttggtcaaggcc

SEQ ID NO: 6339056 - DNA, 18 bp, Homo sapiens
ggggttgtggcaaaagcc

SEQ ID NO: 6339057 - DNA, 19 bp, Homo sapiens
ggggtttccacacaggccc

SEQ ID NO: 6339058 - DNA, 20 bp, Homo sapiens
ggggtttctggttggaggcc

SEQ ID NO: 6339059 - DNA, 20 bp, Homo sapiens
ggggtttgaccacccacctg

SEQ ID NO: 6339060 - DNA, 22 bp, Homo sapiens
ggggttttatggtggatgaggc

SEQ ID NO: 6339061 - DNA, 16 bp, Homo sapiens
ggggttttccaagccc

SEQ ID NO: 6339062 - DNA, 23 bp, Homo sapiens
ggggttttcgaagctcagcccac

SEQ ID NO: 6339063 - DNA, 11 bp, Homo sapiens
ggggttttgtt

SEQ ID NO: 6339064 - DNA, 20 bp, Homo sapiens
ggggtttttttcatccctgc

SEQ ID NO: 6339065 - DNA, 14 bp, Homo sapiens
gggtaaaaagagaa

SEQ ID NO: 6339066 - DNA, 21 bp, Homo sapiens
gggtaaaaagagaaggcaagc

SEQ ID NO: 6339067 - DNA, 17 bp, Homo sapiens
gggtaaagtttgctcta

SEQ ID NO: 6339068 - DNA, 19 bp, Homo sapiens
gggtaaatatatgttttga

SEQ ID NO: 6339069 - DNA, 18 bp, Homo sapiens
gggtaacagtgaggctgg

SEQ ID NO: 6339070 - DNA, 15 bp, Homo sapiens
gggtaactggggggc

SEQ ID NO: 6339071 - DNA, 17 bp, Homo sapiens
gggtaactggggggcca

SEQ ID NO: 6339072 - DNA, 17 bp, Homo sapiens
gggtaagaaaagctggt

SEQ ID NO: 6339073 - DNA, 22 bp, Homo sapiens
gggtaagaagggtgggagtggg

SEQ ID NO: 6339074 - DNA, 12 bp, Homo sapiens
gggtaagacaat

SEQ ID NO: 6339075 - DNA, 17 bp, Homo sapiens
gggtaagccagagcctg

SEQ ID NO: 6339076 - DNA, 14 bp, Homo sapiens
gggtaaggggaggc

SEQ ID NO: 6339077 - DNA, 13 bp, Homo sapiens
gggtaaggtgcct

SEQ ID NO: 6339078 - DNA, 23 bp, Homo sapiens
gggtacacagagctaaggccaat

SEQ ID NO: 6339079 - DNA, 16 bp, Homo sapiens
gggtacactcttctcc

SEQ ID NO: 6339080 - DNA, 17 bp, Homo sapiens
gggtacagaggggacaa

SEQ ID NO: 6339081 - DNA, 16 bp, Homo sapiens
gggtacagatccccag

SEQ ID NO: 6339082 - DNA, 15 bp, Homo sapiens
gggtacagctgggct

SEQ ID NO: 6339083 - DNA, 15 bp, Homo sapiens
gggtacatttataat

SEQ ID NO: 6339084 - DNA, 19 bp, Homo sapiens
gggtacatttccctgtgct

SEQ ID NO: 6339085 - DNA, 17 bp, Homo sapiens
gggtacatttctctgag

SEQ ID NO: 6339086 - DNA, 17 bp, Homo sapiens
gggtacccaggctggtt

SEQ ID NO: 6339087 - DNA, 14 bp, Homo sapiens
gggtactagaagct

SEQ ID NO: 6339088 - DNA, 17 bp, Homo sapiens
gggtactccagcaggta

SEQ ID NO: 6339089 - DNA, 19 bp, Homo sapiens
gggtacttgtggacacagc

SEQ ID NO: 6339090 - DNA, 21 bp, Homo sapiens
gggtagaaaaattattagaac

SEQ ID NO: 6339091 - DNA, 21 bp, Homo sapiens
gggtagaagccacccttccct

SEQ ID NO: 6339092 - DNA, 20 bp, Homo sapiens
gggtagaatgattaatcaaa

SEQ ID NO: 6339093 - DNA, 15 bp, Homo sapiens
gggtagaggagggca

SEQ ID NO: 6339094 - DNA, 19 bp, Homo sapiens
gggtagagggtggggcccg

SEQ ID NO: 6339095 - DNA, 15 bp, Homo sapiens
gggtagatttctctt

SEQ ID NO: 6339096 - DNA, 14 bp, Homo sapiens
gggtagcagctgga

SEQ ID NO: 6339097 - DNA, 22 bp, Homo sapiens
gggtagcaggtaccactgattt

SEQ ID NO: 6339098 - DNA, 17 bp, Homo sapiens
gggtagccccgccccag

SEQ ID NO: 6339099 - DNA, 21 bp, Homo sapiens
gggtagcccgcctgccagtcc

SEQ ID NO: 6339100 - DNA, 16 bp, Homo sapiens
gggtagctagaggaac

SEQ ID NO: 6339101 - DNA, 21 bp, Homo sapiens
gggtaggaaaccaccctgagg

SEQ ID NO: 6339102 - DNA, 17 bp, Homo sapiens
gggtaggagagcactgc

SEQ ID NO: 6339103 - DNA, 14 bp, Homo sapiens
gggtaggaggaaca

SEQ ID NO: 6339104 - DNA, 18 bp, Homo sapiens
gggtaggaggatgggctc

SEQ ID NO: 6339105 - DNA, 12 bp, Homo sapiens
gggtaggcagga

SEQ ID NO: 6339106 - DNA, 14 bp, Homo sapiens
gggtaggccccaca

SEQ ID NO: 6339107 - DNA, 22 bp, Homo sapiens
gggtaggccccacaaggcctgg

SEQ ID NO: 6339108 - DNA, 16 bp, Homo sapiens
gggtaggcgggaagga

SEQ ID NO: 6339109 - DNA, 17 bp, Homo sapiens
gggtaggctgctccctg

SEQ ID NO: 6339110 - DNA, 23 bp, Homo sapiens
gggtaggctgctgccctgctgtg

SEQ ID NO: 6339111 - DNA, 14 bp, Homo sapiens
gggtaggctggagt

SEQ ID NO: 6339112 - DNA, 14 bp, Homo sapiens
gggtagggaatgtt

SEQ ID NO: 6339113 - DNA, 14 bp, Homo sapiens
gggtagggagcctc

SEQ ID NO: 6339114 - DNA, 24 bp, Homo sapiens
gggtaggggaagaagagctatcag

SEQ ID NO: 6339115 - DNA, 17 bp, Homo sapiens
gggtagggggtagtgag

SEQ ID NO: 6339116 - DNA, 22 bp, Homo sapiens
gggtagggtaaatcagtaagag

SEQ ID NO: 6339117 - DNA, 12 bp, Homo sapiens
gggtagtgagca

SEQ ID NO: 6339118 - DNA, 18 bp, Homo sapiens
gggtataatgtgtctgtg

SEQ ID NO: 6339119 - DNA, 18 bp, Homo sapiens
gggtatactgaggggtct

SEQ ID NO: 6339120 - DNA, 20 bp, Homo sapiens
gggtatataaattggggtga

SEQ ID NO: 6339121 - DNA, 17 bp, Homo sapiens
gggtatatttttgatac

SEQ ID NO: 6339122 - DNA, 20 bp, Homo sapiens
gggtatatttttgtttgttt

SEQ ID NO: 6339123 - DNA, 19 bp, Homo sapiens
gggtatccaagttggactg

SEQ ID NO: 6339124 - DNA, 21 bp, Homo sapiens
gggtatccaagttggactggg

SEQ ID NO: 6339125 - DNA, 15 bp, Homo sapiens
gggtatgaagagctg

SEQ ID NO: 6339126 - DNA, 16 bp, Homo sapiens
gggtatgagctggagc

SEQ ID NO: 6339127 - DNA, 13 bp, Homo sapiens
gggtatggcgtaa

SEQ ID NO: 6339128 - DNA, 22 bp, Homo sapiens
gggtatgtttaatctgttatgt

SEQ ID NO: 6339129 - DNA, 12 bp, Homo sapiens
gggtattggaaa

SEQ ID NO: 6339130 - DNA, 23 bp, Homo sapiens
gggtatttaatgtatttttgtaa

SEQ ID NO: 6339131 - DNA, 18 bp, Homo sapiens
gggtcaaaagagccctgg

SEQ ID NO: 6339132 - DNA, 19 bp, Homo sapiens
gggtcaaaagagccctggc

SEQ ID NO: 6339133 - DNA, 13 bp, Homo sapiens
gggtcaaacctgt

SEQ ID NO: 6339134 - DNA, 21 bp, Homo sapiens
gggtcaaagacagaatggtgg

SEQ ID NO: 6339135 - DNA, 21 bp, Homo sapiens
gttcatacctaagtactgtaa

SEQ ID NO: 6339136 - DNA, 23 bp, Homo sapiens
gttcatacggggtggctgaaagt

SEQ ID NO: 6339137 - DNA, 17 bp, Homo sapiens
gttcatagaaatacatc

SEQ ID NO: 6339138 - DNA, 17 bp, Homo sapiens
gttcatagaccctctca

SEQ ID NO: 6339139 - DNA, 13 bp, Homo sapiens
gttcatagcccag

SEQ ID NO: 6339140 - DNA, 14 bp, Homo sapiens
gttcataggggcag

SEQ ID NO: 6339141 - DNA, 17 bp, Homo sapiens
gttcatagggtctcttc

SEQ ID NO: 6339142 - DNA, 18 bp, Homo sapiens
gttcatagggtctcttca

SEQ ID NO: 6339143 - DNA, 20 bp, Homo sapiens
gttcatagggtctcttcagg

SEQ ID NO: 6339144 - DNA, 20 bp, Homo sapiens
gttcataggtcactggctct

SEQ ID NO: 6339145 - DNA, 20 bp, Homo sapiens
gttcatagtcaatcaaacag

SEQ ID NO: 6339146 - DNA, 15 bp, Homo sapiens
gttcatagtttctgt

SEQ ID NO: 6339147 - DNA, 17 bp, Homo sapiens
gttcatagtttctgtaa

SEQ ID NO: 6339148 - DNA, 14 bp, Homo sapiens
gttcatatatacat

SEQ ID NO: 6339149 - DNA, 20 bp, Homo sapiens
gttcatatctatgggaaaaa

SEQ ID NO: 6339150 - DNA, 18 bp, Homo sapiens
gttcatatctggagcctg

SEQ ID NO: 6339151 - DNA, 19 bp, Homo sapiens
gttcatatgtaccatgtac

SEQ ID NO: 6339152 - DNA, 19 bp, Homo sapiens
gttcatatgtacttgtttg

SEQ ID NO: 6339153 - DNA, 22 bp, Homo sapiens
gttcatatgtacttgtttgcta

SEQ ID NO: 6339154 - DNA, 13 bp, Homo sapiens
gttcatattggat

SEQ ID NO: 6339155 - DNA, 15 bp, Homo sapiens
gttcatattttatag

SEQ ID NO: 6339156 - DNA, 16 bp, Homo sapiens
gttcatcaatgaatga

SEQ ID NO: 6339157 - DNA, 18 bp, Homo sapiens
gttcatcaccatttcctc

SEQ ID NO: 6339158 - DNA, 14 bp, Homo sapiens
gttcatcagtgtta

SEQ ID NO: 6339159 - DNA, 22 bp, Homo sapiens
gttcatcatccctccctgccta

SEQ ID NO: 6339160 - DNA, 11 bp, Homo sapiens
gttcatcattg

SEQ ID NO: 6339161 - DNA, 23 bp, Homo sapiens
gttcatccaaggaacctaattga

SEQ ID NO: 6339162 - DNA, 18 bp, Homo sapiens
gttcatccaatcctcact

SEQ ID NO: 6339163 - DNA, 20 bp, Homo sapiens
gttcatccaatcctcactgg

SEQ ID NO: 6339164 - DNA, 22 bp, Homo sapiens
gttcatccaatcctcactgggt

SEQ ID NO: 6339165 - DNA, 20 bp, Homo sapiens
gttcatccagaagtgtattc

SEQ ID NO: 6339166 - DNA, 16 bp, Homo sapiens
gttcatcccttctctt

SEQ ID NO: 6339167 - DNA, 20 bp, Homo sapiens
gttcatcccttctcttccag

SEQ ID NO: 6339168 - DNA, 16 bp, Homo sapiens
gttcatctcatttgta

SEQ ID NO: 6339169 - DNA, 20 bp, Homo sapiens
gttcatctgagcaagagctg

SEQ ID NO: 6339170 - DNA, 19 bp, Homo sapiens
gttcatgagtggatggatg

SEQ ID NO: 6339171 - DNA, 14 bp, Homo sapiens
gttcatgatagaaa

SEQ ID NO: 6339172 - DNA, 23 bp, Homo sapiens
gttcatgatagaaagaataaaat

SEQ ID NO: 6339173 - DNA, 14 bp, Homo sapiens
gttcatgcagacaa

SEQ ID NO: 6339174 - DNA, 18 bp, Homo sapiens
gttcatgcagacaaagcc

SEQ ID NO: 6339175 - DNA, 19 bp, Homo sapiens
gttcatgctgaatccacct

SEQ ID NO: 6339176 - DNA, 23 bp, Homo sapiens
gttcatgctgaatccacctcgga

SEQ ID NO: 6339177 - DNA, 19 bp, Homo sapiens
gttcatgctgagcaaagtt

SEQ ID NO: 6339178 - DNA, 23 bp, Homo sapiens
gttcatggaacgcgttgaaattg

SEQ ID NO: 6339179 - DNA, 14 bp, Homo sapiens
gttcatggagagct

SEQ ID NO: 6339180 - DNA, 16 bp, Homo sapiens
gttcatgtagagaaaa

SEQ ID NO: 6339181 - DNA, 18 bp, Homo sapiens
gttcatgtctctgattgg

SEQ ID NO: 6339182 - DNA, 19 bp, Homo sapiens
gttcatgtgtaacttctag

SEQ ID NO: 6339183 - DNA, 23 bp, Homo sapiens
gttcatgttagttttgctccttc

SEQ ID NO: 6339184 - DNA, 17 bp, Homo sapiens
gttcatgttcatatgta

SEQ ID NO: 6339185 - DNA, 14 bp, Homo sapiens
gttcatgtttgctt

SEQ ID NO: 6339186 - DNA, 15 bp, Homo sapiens
gttcatgtttgcttc

SEQ ID NO: 6339187 - DNA, 18 bp, Homo sapiens
gttcatgtttgtaaatta

SEQ ID NO: 6339188 - DNA, 18 bp, Homo sapiens
gttcatgttttgctaatg

SEQ ID NO: 6339189 - DNA, 13 bp, Homo sapiens
gttcattaaacag

SEQ ID NO: 6339190 - DNA, 20 bp, Homo sapiens
gttcattaaacgtcattcag

SEQ ID NO: 6339191 - DNA, 18 bp, Homo sapiens
gttcattaaattttctat

SEQ ID NO: 6339192 - DNA, 15 bp, Homo sapiens
gttcattattggaat

SEQ ID NO: 6339193 - DNA, 14 bp, Homo sapiens
gttcattattttgt

SEQ ID NO: 6339194 - DNA, 18 bp, Homo sapiens
gttcattattttgtggtt

SEQ ID NO: 6339195 - DNA, 16 bp, Homo sapiens
gttcattcaagctatt

SEQ ID NO: 6339196 - DNA, 20 bp, Homo sapiens
gttcattcaagctatttaat

SEQ ID NO: 6339197 - DNA, 14 bp, Homo sapiens
gttcattcatatta

SEQ ID NO: 6339198 - DNA, 19 bp, Homo sapiens
gttcattccccggccctcc

SEQ ID NO: 6339199 - DNA, 20 bp, Homo sapiens
gttcattccgaaaaaaaaat

SEQ ID NO: 6339200 - DNA, 13 bp, Homo sapiens
gttcattcctgtc

SEQ ID NO: 6339201 - DNA, 17 bp, Homo sapiens
gttcattctaccaagct

SEQ ID NO: 6339202 - DNA, 12 bp, Homo sapiens
gttcattctgat

SEQ ID NO: 6339203 - DNA, 14 bp, Homo sapiens
gttcattctgatgt

SEQ ID NO: 6339204 - DNA, 16 bp, Homo sapiens
gttcattctgatgtcc

SEQ ID NO: 6339205 - DNA, 18 bp, Homo sapiens
gttcattgcctttccagg

SEQ ID NO: 6339206 - DNA, 19 bp, Homo sapiens
gttcattgtaaaaattttt

SEQ ID NO: 6339207 - DNA, 16 bp, Homo sapiens
gttcatttctaaattt

SEQ ID NO: 6339208 - DNA, 17 bp, Homo sapiens
gttcatttctaaattta

SEQ ID NO: 6339209 - DNA, 13 bp, Homo sapiens
gttcatttctgtc

SEQ ID NO: 6339210 - DNA, 15 bp, Homo sapiens
gttcatttctgtctc

SEQ ID NO: 6339211 - DNA, 22 bp, Homo sapiens
gttcatttggtgttcctggaag

SEQ ID NO: 6339212 - DNA, 17 bp, Homo sapiens
gttcatttgtgtgctca

SEQ ID NO: 6339213 - DNA, 12 bp, Homo sapiens
gttcattttagt

SEQ ID NO: 6339214 - DNA, 17 bp, Homo sapiens
gttcattttagtgactg

SEQ ID NO: 6339215 - DNA, 17 bp, Homo sapiens
gttcattttgaaaatat

SEQ ID NO: 6339216 - DNA, 19 bp, Homo sapiens
gttcattttgagtattttt

SEQ ID NO: 6339217 - DNA, 15 bp, Homo sapiens
gttccaaaccctcct

SEQ ID NO: 6339218 - DNA, 17 bp, Homo sapiens
gttccaaagccagtgaa

SEQ ID NO: 6339219 - DNA, 23 bp, Homo sapiens
gttccaaataaggatttgttcac

SEQ ID NO: 6339220 - DNA, 15 bp, Homo sapiens
gttccaaatgaatgt

SEQ ID NO: 6339221 - DNA, 20 bp, Homo sapiens
gttccaaatttgctttacat

SEQ ID NO: 6339222 - DNA, 23 bp, Homo sapiens
gttccaacatgcaatactggtca

SEQ ID NO: 6339223 - DNA, 18 bp, Homo sapiens
gttccaacctcctgctct

SEQ ID NO: 6339224 - DNA, 13 bp, Homo sapiens
gttccaagacatt

SEQ ID NO: 6339225 - DNA, 17 bp, Homo sapiens
gttccaagacattgtca

SEQ ID NO: 6339226 - DNA, 16 bp, Homo sapiens
gttccaagagtctaaa

SEQ ID NO: 6339227 - DNA, 20 bp, Homo sapiens
gttccaagagtctaaagatg

SEQ ID NO: 6339228 - DNA, 17 bp, Homo sapiens
gttccaagtccaataag

SEQ ID NO: 6339229 - DNA, 19 bp, Homo sapiens
gttccaagtccaataagac

SEQ ID NO: 6339230 - DNA, 18 bp, Homo sapiens
gttccaagtgtgtgtgca

SEQ ID NO: 6339231 - DNA, 17 bp, Homo sapiens
gttccaagtttccaaac

SEQ ID NO: 6339232 - DNA, 17 bp, Homo sapiens
gttccacacatttaaaa

SEQ ID NO: 6339233 - DNA, 12 bp, Homo sapiens
gttccacagacg

SEQ ID NO: 6339234 - DNA, 12 bp, Homo sapiens
gttccacagagt

SEQ ID NO: 6339235 - DNA, 14 bp, Homo sapiens
gttccacagttgat

SEQ ID NO: 6339236 - DNA, 18 bp, Homo sapiens
gttccacagttgccacca

SEQ ID NO: 6339237 - DNA, 17 bp, Homo sapiens
gttccaccatcaagcca

SEQ ID NO: 6339238 - DNA, 18 bp, Homo sapiens
gttccaccattgctggaa

SEQ ID NO: 6339239 - DNA, 18 bp, Homo sapiens
gttccacggttgctaaat

SEQ ID NO: 6339240 - DNA, 21 bp, Homo sapiens
gttccacgtccccctggggct

SEQ ID NO: 6339241 - DNA, 12 bp, Homo sapiens
gttccactgaga

SEQ ID NO: 6339242 - DNA, 13 bp, Homo sapiens
gttccactgagct

SEQ ID NO: 6339243 - DNA, 18 bp, Homo sapiens
gttccactgagctccatg

SEQ ID NO: 6339244 - DNA, 20 bp, Homo sapiens
gttccactgcaaataaagcc

SEQ ID NO: 6339245 - DNA, 12 bp, Homo sapiens
gttccactggaa

SEQ ID NO: 6339246 - DNA, 19 bp, Homo sapiens
gttccacttatagcctctg

SEQ ID NO: 6339247 - DNA, 19 bp, Homo sapiens
gttccacttctctagagaa

SEQ ID NO: 6339248 - DNA, 20 bp, Homo sapiens
gttccagaacgtctctcacc

SEQ ID NO: 6339249 - DNA, 15 bp, Homo sapiens
gttccagacagagtg

SEQ ID NO: 6339250 - DNA, 22 bp, Homo sapiens
gttccagacagagtggatctgg

SEQ ID NO: 6339251 - DNA, 20 bp, Homo sapiens
gttccagacagggtggggct

SEQ ID NO: 6339252 - DNA, 21 bp, Homo sapiens
gttccagacagggtggggctt

SEQ ID NO: 6339253 - DNA, 14 bp, Homo sapiens
gttccagacattct

SEQ ID NO: 6339254 - DNA, 18 bp, Homo sapiens
gttccagactcaggttcc

SEQ ID NO: 6339255 - DNA, 14 bp, Homo sapiens
gttccagagctgct

SEQ ID NO: 6339256 - DNA, 13 bp, Homo sapiens
gttccagaggagc

SEQ ID NO: 6339257 - DNA, 21 bp, Homo sapiens
gttccagataaaaacaatata

SEQ ID NO: 6339258 - DNA, 14 bp, Homo sapiens
gttccagcaccaca

SEQ ID NO: 6339259 - DNA, 17 bp, Homo sapiens
gttccagcagtttcatg

SEQ ID NO: 6339260 - DNA, 19 bp, Homo sapiens
gttccagccaaagcatgcc

SEQ ID NO: 6339261 - DNA, 14 bp, Homo sapiens
gttccagctctttg

SEQ ID NO: 6339262 - DNA, 12 bp, Homo sapiens
gttccagctggt

SEQ ID NO: 6339263 - DNA, 23 bp, Homo sapiens
gttccaggacacagattatcaac

SEQ ID NO: 6339264 - DNA, 17 bp, Homo sapiens
gttccaggccctccagt

SEQ ID NO: 6339265 - DNA, 21 bp, Homo sapiens
gttccagggtccctctgtgta

SEQ ID NO: 6339266 - DNA, 17 bp, Homo sapiens
gttccagggttctcttg

SEQ ID NO: 6339267 - DNA, 23 bp, Homo sapiens
gttccagtttagcccttccctgc

SEQ ID NO: 6339268 - DNA, 13 bp, Homo sapiens
gttccataataaa

SEQ ID NO: 6339269 - DNA, 18 bp, Homo sapiens
gttccatagaaaaggcgt

SEQ ID NO: 6339270 - DNA, 23 bp, Homo sapiens
gttccatctcctataatctgtca

SEQ ID NO: 6339271 - DNA, 14 bp, Homo sapiens
gttccatcttgcta

SEQ ID NO: 6339272 - DNA, 16 bp, Homo sapiens
gttccatgaagacaaa

SEQ ID NO: 6339273 - DNA, 20 bp, Homo sapiens
gttccatgagttatcatgaa

SEQ ID NO: 6339274 - DNA, 19 bp, Homo sapiens
gttccatgcctgctctcga

SEQ ID NO: 6339275 - DNA, 16 bp, Homo sapiens
gttccatgcctggccc

SEQ ID NO: 6339276 - DNA, 20 bp, Homo sapiens
gttccatggcctcttcagat

SEQ ID NO: 6339277 - DNA, 20 bp, Homo sapiens
gttccatgttctatttttga

SEQ ID NO: 6339278 - DNA, 13 bp, Homo sapiens
gttccatgttttg

SEQ ID NO: 6339279 - DNA, 14 bp, Homo sapiens
gttccattctatga

SEQ ID NO: 6339280 - DNA, 22 bp, Homo sapiens
gttccattgaagccgactctgg

SEQ ID NO: 6339281 - DNA, 15 bp, Homo sapiens
gttcccaaagggagg

SEQ ID NO: 6339282 - DNA, 16 bp, Homo sapiens
gttcccaaagggaggg

SEQ ID NO: 6339283 - DNA, 23 bp, Homo sapiens
gttcccaagagcatcatgcctct

SEQ ID NO: 6339284 - DNA, 14 bp, Homo sapiens
gttcccaaggacat

SEQ ID NO: 6339285 - DNA, 22 bp, Homo sapiens
gttcccaaggacatgagtctgt

SEQ ID NO: 6339286 - DNA, 15 bp, Homo sapiens
gttcccaataaaagt

SEQ ID NO: 6339287 - DNA, 20 bp, Homo sapiens
gttcccacaagcctgcctcg

SEQ ID NO: 6339288 - DNA, 21 bp, Homo sapiens
gttcccacaagcctgcctcgc

SEQ ID NO: 6339289 - DNA, 18 bp, Homo sapiens
gttcccacattaaagaag

SEQ ID NO: 6339290 - DNA, 19 bp, Homo sapiens
gttcccaccaggctgctca

SEQ ID NO: 6339291 - DNA, 15 bp, Homo sapiens
gttcccaccattccc

SEQ ID NO: 6339292 - DNA, 18 bp, Homo sapiens
gttcccactgaaatggac

SEQ ID NO: 6339293 - DNA, 15 bp, Homo sapiens
gttcccactgccctg

SEQ ID NO: 6339294 - DNA, 19 bp, Homo sapiens
gttcccactgccctgggca

SEQ ID NO: 6339295 - DNA, 17 bp, Homo sapiens
gttcccactggctcctc

SEQ ID NO: 6339296 - DNA, 11 bp, Homo sapiens
gttcccagcag

SEQ ID NO: 6339297 - DNA, 13 bp, Homo sapiens
gttcccagcaggg

SEQ ID NO: 6339298 - DNA, 14 bp, Homo sapiens
gttcccagcccctc

SEQ ID NO: 6339299 - DNA, 23 bp, Homo sapiens
gttcccagcccctcctccctcag

SEQ ID NO: 6339300 - DNA, 15 bp, Homo sapiens
gttcccagcccctgc

SEQ ID NO: 6339301 - DNA, 16 bp, Homo sapiens
gttcccagcccctgca

SEQ ID NO: 6339302 - DNA, 13 bp, Homo sapiens
gttcccagctccc

SEQ ID NO: 6339303 - DNA, 21 bp, Homo sapiens
gttcccagctccccccgccca

SEQ ID NO: 6339304 - DNA, 16 bp, Homo sapiens
gttcccaggctgcccc

SEQ ID NO: 6339305 - DNA, 21 bp, Homo sapiens
gttcccagtgacacttcagag

SEQ ID NO: 6339306 - DNA, 21 bp, Homo sapiens
gttcccatcctcttcttttag

SEQ ID NO: 6339307 - DNA, 23 bp, Homo sapiens
gttcccatcctcttcttttagca

SEQ ID NO: 6339308 - DNA, 14 bp, Homo sapiens
gttcccatgttaaa

SEQ ID NO: 6339309 - DNA, 16 bp, Homo sapiens
gttcccatttcagctg

SEQ ID NO: 6339310 - DNA, 16 bp, Homo sapiens
gttcccatttgctcct

SEQ ID NO: 6339311 - DNA, 15 bp, Homo sapiens
gttccccaaatacaa

SEQ ID NO: 6339312 - DNA, 19 bp, Homo sapiens
gttccccaagggccctggc

SEQ ID NO: 6339313 - DNA, 17 bp, Homo sapiens
gttccccacaggtcctc

SEQ ID NO: 6339314 - DNA, 16 bp, Homo sapiens
gggtcaactccaaggc

SEQ ID NO: 6339315 - DNA, 22 bp, Homo sapiens
gggtcaactggcgaagcctgag

SEQ ID NO: 6339316 - DNA, 23 bp, Homo sapiens
gggtcaagctgagctggcttcgg

SEQ ID NO: 6339317 - DNA, 15 bp, Homo sapiens
gggtcaaggacaggg

SEQ ID NO: 6339318 - DNA, 18 bp, Homo sapiens
gggtcaaggacagggctg

SEQ ID NO: 6339319 - DNA, 18 bp, Homo sapiens
gggtcaatgtcataaatg

SEQ ID NO: 6339320 - DNA, 12 bp, Homo sapiens
gggtcacagagg

SEQ ID NO: 6339321 - DNA, 19 bp, Homo sapiens
gggtcacagaggcatagaa

SEQ ID NO: 6339322 - DNA, 16 bp, Homo sapiens
gggtcacatccatccc

SEQ ID NO: 6339323 - DNA, 24 bp, Homo sapiens
gggtcacctcctccaagaagccct

SEQ ID NO: 6339324 - DNA, 15 bp, Homo sapiens
gggtcactggcctct

SEQ ID NO: 6339325 - DNA, 17 bp, Homo sapiens
gggtcactggcctctcc

SEQ ID NO: 6339326 - DNA, 18 bp, Homo sapiens
gggtcagaaacaggaccg

SEQ ID NO: 6339327 - DNA, 18 bp, Homo sapiens
gggtcagaagaagtggga

SEQ ID NO: 6339328 - DNA, 19 bp, Homo sapiens
gggtcagaagaagtgggag

SEQ ID NO: 6339329 - DNA, 22 bp, Homo sapiens
gggtcagaagaagtgggagcag

SEQ ID NO: 6339330 - DNA, 12 bp, Homo sapiens
gggtcagcaggc

SEQ ID NO: 6339331 - DNA, 13 bp, Homo sapiens
gggtcagcaggcc

SEQ ID NO: 6339332 - DNA, 15 bp, Homo sapiens
gggtcagcaggccca

SEQ ID NO: 6339333 - DNA, 17 bp, Homo sapiens
gggtcagccagccctct

SEQ ID NO: 6339334 - DNA, 16 bp, Homo sapiens
gggtcagccagggcct

SEQ ID NO: 6339335 - DNA, 19 bp, Homo sapiens
gggtcagcccaagattctt

SEQ ID NO: 6339336 - DNA, 14 bp, Homo sapiens
gggtcagcccagca

SEQ ID NO: 6339337 - DNA, 22 bp, Homo sapiens
gggtcagcccagcacctgctcc

SEQ ID NO: 6339338 - DNA, 13 bp, Homo sapiens
gggtcagctctgg

SEQ ID NO: 6339339 - DNA, 17 bp, Homo sapiens
gggtcagctctggccac

SEQ ID NO: 6339340 - DNA, 21 bp, Homo sapiens
gggtcaggaggcactgctcat

SEQ ID NO: 6339341 - DNA, 15 bp, Homo sapiens
gggtcaggcagccag

SEQ ID NO: 6339342 - DNA, 12 bp, Homo sapiens
gggtcaggcctt

SEQ ID NO: 6339343 - DNA, 21 bp, Homo sapiens
gggtcaggcctttgagctcag

SEQ ID NO: 6339344 - DNA, 19 bp, Homo sapiens
gggtcaggggtacacagag

SEQ ID NO: 6339345 - DNA, 18 bp, Homo sapiens
gggtcaggtgtcaggccc

SEQ ID NO: 6339346 - DNA, 16 bp, Homo sapiens
gggtcatcccagcacc

SEQ ID NO: 6339347 - DNA, 20 bp, Homo sapiens
gggtcatcccagcacctgcc

SEQ ID NO: 6339348 - DNA, 22 bp, Homo sapiens
gggtcatcccagcacctgccag

SEQ ID NO: 6339349 - DNA, 23 bp, Homo sapiens
gggtcatcccagcacctgccagg

SEQ ID NO: 6339350 - DNA, 21 bp, Homo sapiens
gggtcatcctgtgctcggagg

SEQ ID NO: 6339351 - DNA, 15 bp, Homo sapiens
gggtcatccttgccc

SEQ ID NO: 6339352 - DNA, 21 bp, Homo sapiens
gggtcatccttggtctatgtg

SEQ ID NO: 6339353 - DNA, 21 bp, Homo sapiens
gggtcatctgtacctctgcct

SEQ ID NO: 6339354 - DNA, 13 bp, Homo sapiens
gggtcatgggcct

SEQ ID NO: 6339355 - DNA, 14 bp, Homo sapiens
gggtcatgggcctg

SEQ ID NO: 6339356 - DNA, 16 bp, Homo sapiens
gggtcatgggcctgtg

SEQ ID NO: 6339357 - DNA, 23 bp, Homo sapiens
gggtcattacttctgagccccag

SEQ ID NO: 6339358 - DNA, 20 bp, Homo sapiens
gggtcattgacctctcaggg

SEQ ID NO: 6339359 - DNA, 21 bp, Homo sapiens
gggtcattgacctctcagggc

SEQ ID NO: 6339360 - DNA, 23 bp, Homo sapiens
gggtcattgacctctcagggcct

SEQ ID NO: 6339361 - DNA, 17 bp, Homo sapiens
gggtcattttcctttct

SEQ ID NO: 6339362 - DNA, 15 bp, Homo sapiens
gggtccacagctgga

SEQ ID NO: 6339363 - DNA, 23 bp, Homo sapiens
gggtccaccagtgtgtgggggag

SEQ ID NO: 6339364 - DNA, 16 bp, Homo sapiens
gggtccacctggagag

SEQ ID NO: 6339365 - DNA, 13 bp, Homo sapiens
gggtccagaagac

SEQ ID NO: 6339366 - DNA, 20 bp, Homo sapiens
gggtccagaagaccccactt

SEQ ID NO: 6339367 - DNA, 17 bp, Homo sapiens
gggtccagaaggagaca

SEQ ID NO: 6339368 - DNA, 12 bp, Homo sapiens
gggtccaggagg

SEQ ID NO: 6339369 - DNA, 11 bp, Homo sapiens
gggtccaggcc

SEQ ID NO: 6339370 - DNA, 16 bp, Homo sapiens
gggtccagggagcagg

SEQ ID NO: 6339371 - DNA, 12 bp, Homo sapiens
gggtccatgggc

SEQ ID NO: 6339372 - DNA, 20 bp, Homo sapiens
gggtcccaagctgggcccca

SEQ ID NO: 6339373 - DNA, 22 bp, Homo sapiens
gggtcccaagctgggccccagc

SEQ ID NO: 6339374 - DNA, 23 bp, Homo sapiens
gggtcccaagctgggccccagcc

SEQ ID NO: 6339375 - DNA, 14 bp, Homo sapiens
gggtcccaccccca

SEQ ID NO: 6339376 - DNA, 12 bp, Homo sapiens
gggtcccactgc

SEQ ID NO: 6339377 - DNA, 22 bp, Homo sapiens
gggtcccagctaaagaggtggg

SEQ ID NO: 6339378 - DNA, 18 bp, Homo sapiens
gggtcccaggacctgagc

SEQ ID NO: 6339379 - DNA, 21 bp, Homo sapiens
gggtcccaggacctgagcctg

SEQ ID NO: 6339380 - DNA, 12 bp, Homo sapiens
gggtcccaggat

SEQ ID NO: 6339381 - DNA, 13 bp, Homo sapiens
gggtcccagggct

SEQ ID NO: 6339382 - DNA, 18 bp, Homo sapiens
gggtcccagggctggccc

SEQ ID NO: 6339383 - DNA, 14 bp, Homo sapiens
gggtcccagtggga

SEQ ID NO: 6339384 - DNA, 22 bp, Homo sapiens
gggtcccagtgggaggggcagg

SEQ ID NO: 6339385 - DNA, 23 bp, Homo sapiens
gggtcccagtgggaggggcaggc

SEQ ID NO: 6339386 - DNA, 13 bp, Homo sapiens
gggtcccattgtg

SEQ ID NO: 6339387 - DNA, 14 bp, Homo sapiens
gggtccccagctcc

SEQ ID NO: 6339388 - DNA, 15 bp, Homo sapiens
gggtccccagctccc

SEQ ID NO: 6339389 - DNA, 17 bp, Homo sapiens
gggtccccatcatccca

SEQ ID NO: 6339390 - DNA, 18 bp, Homo sapiens
gggtcccccctccattcc

SEQ ID NO: 6339391 - DNA, 14 bp, Homo sapiens
gggtcccccctccc

SEQ ID NO: 6339392 - DNA, 20 bp, Homo sapiens
gggtccccggacgctggctc

SEQ ID NO: 6339393 - DNA, 13 bp, Homo sapiens
gggtcccctctgt

SEQ ID NO: 6339394 - DNA, 14 bp, Homo sapiens
gggtcccggccgcg

SEQ ID NO: 6339395 - DNA, 18 bp, Homo sapiens
gggtcccggctctgtggg

SEQ ID NO: 6339396 - DNA, 11 bp, Homo sapiens
gggtccctgct

SEQ ID NO: 6339397 - DNA, 15 bp, Homo sapiens
gggtccctgctcccc

SEQ ID NO: 6339398 - DNA, 22 bp, Homo sapiens
gggtccctggagggcaagccct

SEQ ID NO: 6339399 - DNA, 15 bp, Homo sapiens
gggtcccttccccct

SEQ ID NO: 6339400 - DNA, 21 bp, Homo sapiens
gggtcccttgaaggaagaggg

SEQ ID NO: 6339401 - DNA, 19 bp, Homo sapiens
gggtccgattaatttatgg

SEQ ID NO: 6339402 - DNA, 15 bp, Homo sapiens
gggtccggcagcttc

SEQ ID NO: 6339403 - DNA, 15 bp, Homo sapiens
gggtccggcctctcc

SEQ ID NO: 6339404 - DNA, 21 bp, Homo sapiens
gggtccgtcttcacactgcgc

SEQ ID NO: 6339405 - DNA, 20 bp, Homo sapiens
gggtccgtggtagaggcctg

SEQ ID NO: 6339406 - DNA, 19 bp, Homo sapiens
gggtcctactcctggagca

SEQ ID NO: 6339407 - DNA, 14 bp, Homo sapiens
gggtcctagcccag

SEQ ID NO: 6339408 - DNA, 20 bp, Homo sapiens
gggtcctagcccttccctga

SEQ ID NO: 6339409 - DNA, 12 bp, Homo sapiens
gggtcctcaggc

SEQ ID NO: 6339410 - DNA, 21 bp, Homo sapiens
gggtcctcatctgcaaagcat

SEQ ID NO: 6339411 - DNA, 18 bp, Homo sapiens
gggtcctcctccagggac

SEQ ID NO: 6339412 - DNA, 20 bp, Homo sapiens
gggtcctcctccagggacag

SEQ ID NO: 6339413 - DNA, 17 bp, Homo sapiens
gggtcctcggccctgta

SEQ ID NO: 6339414 - DNA, 21 bp, Homo sapiens
gggtcctcggccctgtagccc

SEQ ID NO: 6339415 - DNA, 22 bp, Homo sapiens
gggtcctctagcccactccctg

SEQ ID NO: 6339416 - DNA, 22 bp, Homo sapiens
gggtcctctcttccacagtggc

SEQ ID NO: 6339417 - DNA, 15 bp, Homo sapiens
gggtcctctgagact

SEQ ID NO: 6339418 - DNA, 19 bp, Homo sapiens
gggtcctctgagactccag

SEQ ID NO: 6339419 - DNA, 21 bp, Homo sapiens
gggtcctcttagtccacaagg

SEQ ID NO: 6339420 - DNA, 14 bp, Homo sapiens
gggtcctgagtggc

SEQ ID NO: 6339421 - DNA, 19 bp, Homo sapiens
gggtcctgcaatctccagg

SEQ ID NO: 6339422 - DNA, 20 bp, Homo sapiens
gggtcctgcaatctccaggg

SEQ ID NO: 6339423 - DNA, 18 bp, Homo sapiens
gggtcctgcagcctgcag

SEQ ID NO: 6339424 - DNA, 12 bp, Homo sapiens
gggtcctgcctg

SEQ ID NO: 6339425 - DNA, 14 bp, Homo sapiens
gggtcctgctgctc

SEQ ID NO: 6339426 - DNA, 15 bp, Homo sapiens
gggtcctggccatcc

SEQ ID NO: 6339427 - DNA, 16 bp, Homo sapiens
gggtcctggccatccc

SEQ ID NO: 6339428 - DNA, 17 bp, Homo sapiens
gggtcctggccatccca

SEQ ID NO: 6339429 - DNA, 13 bp, Homo sapiens
gggtcctggctcc

SEQ ID NO: 6339430 - DNA, 11 bp, Homo sapiens
gggtcctggga

SEQ ID NO: 6339431 - DNA, 14 bp, Homo sapiens
gggtcctgggaggc

SEQ ID NO: 6339432 - DNA, 16 bp, Homo sapiens
gggtcctgggaggctg

SEQ ID NO: 6339433 - DNA, 21 bp, Homo sapiens
gggtcctgggaggctgcagcc

SEQ ID NO: 6339434 - DNA, 24 bp, Homo sapiens
gggtcctgggaggctgcagccagg

SEQ ID NO: 6339435 - DNA, 13 bp, Homo sapiens
gggtcctgggcag

SEQ ID NO: 6339436 - DNA, 13 bp, Homo sapiens
gggtcctgggctg

SEQ ID NO: 6339437 - DNA, 13 bp, Homo sapiens
gggtcctgtgcct

SEQ ID NO: 6339438 - DNA, 20 bp, Homo sapiens
gggtcctgtggcaggcagcg

SEQ ID NO: 6339439 - DNA, 16 bp, Homo sapiens
gggtccttccctctcc

SEQ ID NO: 6339440 - DNA, 18 bp, Homo sapiens
gggtccttccctctcccc

SEQ ID NO: 6339441 - DNA, 15 bp, Homo sapiens
gggtccttctccaca

SEQ ID NO: 6339442 - DNA, 19 bp, Homo sapiens
gggtccttgatgccagagg

SEQ ID NO: 6339443 - DNA, 21 bp, Homo sapiens
gggtccttgatgccagagggc

SEQ ID NO: 6339444 - DNA, 20 bp, Homo sapiens
gggtccttgggcctggccag

SEQ ID NO: 6339445 - DNA, 23 bp, Homo sapiens
gggtccttgggcctggccagtct

SEQ ID NO: 6339446 - DNA, 13 bp, Homo sapiens
gggtcgcccatga

SEQ ID NO: 6339447 - DNA, 15 bp, Homo sapiens
gggtcgcccctcctc

SEQ ID NO: 6339448 - DNA, 15 bp, Homo sapiens
gggtcgccctggact

SEQ ID NO: 6339449 - DNA, 20 bp, Homo sapiens
gggtcgcctatttttaaaaa

SEQ ID NO: 6339450 - DNA, 15 bp, Homo sapiens
gggtcggaagcctgt

SEQ ID NO: 6339451 - DNA, 18 bp, Homo sapiens
gggtcggaagcctgtcct

SEQ ID NO: 6339452 - DNA, 22 bp, Homo sapiens
gggtcggacggggcaggcgctg

SEQ ID NO: 6339453 - DNA, 16 bp, Homo sapiens
gggtcggccctgccca

SEQ ID NO: 6339454 - DNA, 15 bp, Homo sapiens
gggtcgggagagggg

SEQ ID NO: 6339455 - DNA, 21 bp, Homo sapiens
gggtcgggggaggagcacccc

SEQ ID NO: 6339456 - DNA, 14 bp, Homo sapiens
gggtcgtgaggcaa

SEQ ID NO: 6339457 - DNA, 19 bp, Homo sapiens
gggtcgtgggaaaggggag

SEQ ID NO: 6339458 - DNA, 20 bp, Homo sapiens
gggtcgtgggaaaggggagt

SEQ ID NO: 6339459 - DNA, 21 bp, Homo sapiens
gggtctaaggagcgctagtgc

SEQ ID NO: 6339460 - DNA, 22 bp, Homo sapiens
gggtctaaggagcgctagtgcc

SEQ ID NO: 6339461 - DNA, 23 bp, Homo sapiens
gggtctaccaatacaaaatgtat

SEQ ID NO: 6339462 - DNA, 12 bp, Homo sapiens
gggtctaccagg

SEQ ID NO: 6339463 - DNA, 17 bp, Homo sapiens
gggtctcactctgtcac

SEQ ID NO: 6339464 - DNA, 14 bp, Homo sapiens
gggtctcactgtgt

SEQ ID NO: 6339465 - DNA, 17 bp, Homo sapiens
gggtctcaggtccagct

SEQ ID NO: 6339466 - DNA, 18 bp, Homo sapiens
gggtctccattctgtgtg

SEQ ID NO: 6339467 - DNA, 19 bp, Homo sapiens
gggtctccctctcctgcct

SEQ ID NO: 6339468 - DNA, 16 bp, Homo sapiens
gggtctccctgagcct

SEQ ID NO: 6339469 - DNA, 22 bp, Homo sapiens
gggtctccctggctccctcctc

SEQ ID NO: 6339470 - DNA, 13 bp, Homo sapiens
gggtctccctggg

SEQ ID NO: 6339471 - DNA, 21 bp, Homo sapiens
gggtctcctcccagcggcctc

SEQ ID NO: 6339472 - DNA, 22 bp, Homo sapiens
gggtctcgctgtcactggctgg

SEQ ID NO: 6339473 - DNA, 24 bp, Homo sapiens
gggtctctcacagacaggacccct

SEQ ID NO: 6339474 - DNA, 14 bp, Homo sapiens
gggtctctccctca

SEQ ID NO: 6339475 - DNA, 17 bp, Homo sapiens
gggtctctctccaggtc

SEQ ID NO: 6339476 - DNA, 19 bp, Homo sapiens
gggtctctctccaggtcag

SEQ ID NO: 6339477 - DNA, 22 bp, Homo sapiens
gggtctctctccctacctccct

SEQ ID NO: 6339478 - DNA, 23 bp, Homo sapiens
gggtctctctccctacctccctc

SEQ ID NO: 6339479 - DNA, 16 bp, Homo sapiens
gggtctctctcggccc

SEQ ID NO: 6339480 - DNA, 13 bp, Homo sapiens
gggtctctgagca

SEQ ID NO: 6339481 - DNA, 12 bp, Homo sapiens
gggtctctgctg

SEQ ID NO: 6339482 - DNA, 17 bp, Homo sapiens
gggtctctggattcctg

SEQ ID NO: 6339483 - DNA, 20 bp, Homo sapiens
gggtctctgtgtgtgtatga

SEQ ID NO: 6339484 - DNA, 17 bp, Homo sapiens
gggtctcttttgtaaat

SEQ ID NO: 6339485 - DNA, 14 bp, Homo sapiens
gggtctgaaaggaa

SEQ ID NO: 6339486 - DNA, 22 bp, Homo sapiens
gggtctgaaggaatagccagag

SEQ ID NO: 6339487 - DNA, 15 bp, Homo sapiens
gggtctgacctggtg

SEQ ID NO: 6339488 - DNA, 15 bp, Homo sapiens
gggtctgagactgaa

SEQ ID NO: 6339489 - DNA, 17 bp, Homo sapiens
gggtctgagctccagct

SEQ ID NO: 6339490 - DNA, 12 bp, Homo sapiens
gggtctgaggaa

SEQ ID NO: 6339491 - DNA, 18 bp, Homo sapiens
gggtctgaggcccctgcc

SEQ ID NO: 6339492 - DNA, 15 bp, Homo sapiens
gggtctgcagcctgc

SEQ ID NO: 6339493 - DNA, 11 bp, Homo sapiens
gttccccaccc

SEQ ID NO: 6339494 - DNA, 13 bp, Homo sapiens
gttccccacccag

SEQ ID NO: 6339495 - DNA, 13 bp, Homo sapiens
gttccccacccct

SEQ ID NO: 6339496 - DNA, 21 bp, Homo sapiens
gttccccaccgccctgcctct

SEQ ID NO: 6339497 - DNA, 14 bp, Homo sapiens
gttccccactggag

SEQ ID NO: 6339498 - DNA, 12 bp, Homo sapiens
gttccccagaga

SEQ ID NO: 6339499 - DNA, 22 bp, Homo sapiens
gttccccagagagcaggcaggg

SEQ ID NO: 6339500 - DNA, 13 bp, Homo sapiens
gttccccaggagg

SEQ ID NO: 6339501 - DNA, 18 bp, Homo sapiens
gttccccatctgggtcct

SEQ ID NO: 6339502 - DNA, 12 bp, Homo sapiens
gttcccccagca

SEQ ID NO: 6339503 - DNA, 20 bp, Homo sapiens
gttcccccagccctgtggaa

SEQ ID NO: 6339504 - DNA, 16 bp, Homo sapiens
gttcccccagcctgcc

SEQ ID NO: 6339505 - DNA, 18 bp, Homo sapiens
gttccccctgtttcagag

SEQ ID NO: 6339506 - DNA, 17 bp, Homo sapiens
gttccccgctccacaga

SEQ ID NO: 6339507 - DNA, 17 bp, Homo sapiens
gttcccctaaccctaca

SEQ ID NO: 6339508 - DNA, 21 bp, Homo sapiens
gttcccctagtaagtgccttc

SEQ ID NO: 6339509 - DNA, 23 bp, Homo sapiens
gttcccctcagaaaaaaattcat

SEQ ID NO: 6339510 - DNA, 22 bp, Homo sapiens
gttcccctcctccactctcccc

SEQ ID NO: 6339511 - DNA, 21 bp, Homo sapiens
gttcccctcttgtctcccctg

SEQ ID NO: 6339512 - DNA, 21 bp, Homo sapiens
gttcccctggaagcagtgccc

SEQ ID NO: 6339513 - DNA, 16 bp, Homo sapiens
gttcccctgtcctgtg

SEQ ID NO: 6339514 - DNA, 17 bp, Homo sapiens
gttcccctgtttattca

SEQ ID NO: 6339515 - DNA, 13 bp, Homo sapiens
gttccccttggct

SEQ ID NO: 6339516 - DNA, 17 bp, Homo sapiens
gttccccttggcttcct

SEQ ID NO: 6339517 - DNA, 14 bp, Homo sapiens
gttcccgagggagc

SEQ ID NO: 6339518 - DNA, 22 bp, Homo sapiens
gttcccgagggagctgctggct

SEQ ID NO: 6339519 - DNA, 19 bp, Homo sapiens
gttcccgatggtctctctc

SEQ ID NO: 6339520 - DNA, 21 bp, Homo sapiens
gttcccggagcacagccctgg

SEQ ID NO: 6339521 - DNA, 23 bp, Homo sapiens
gttcccggagcacagccctggga

SEQ ID NO: 6339522 - DNA, 14 bp, Homo sapiens
gttcccgggagctg

SEQ ID NO: 6339523 - DNA, 21 bp, Homo sapiens
gttcccgggagctgggccctg

SEQ ID NO: 6339524 - DNA, 23 bp, Homo sapiens
gttcccgggagctgggccctgcc

SEQ ID NO: 6339525 - DNA, 19 bp, Homo sapiens
gttcccgggccctcctggg

SEQ ID NO: 6339526 - DNA, 15 bp, Homo sapiens
gttcccggtcccgag

SEQ ID NO: 6339527 - DNA, 18 bp, Homo sapiens
gttcccgtgtgcctgagc

SEQ ID NO: 6339528 - DNA, 14 bp, Homo sapiens
gttcccgtttctcc

SEQ ID NO: 6339529 - DNA, 18 bp, Homo sapiens
gttcccgtttctccacct

SEQ ID NO: 6339530 - DNA, 14 bp, Homo sapiens
gttccctaagtcca

SEQ ID NO: 6339531 - DNA, 16 bp, Homo sapiens
gttccctagagagaat

SEQ ID NO: 6339532 - DNA, 18 bp, Homo sapiens
gttccctagagagaataa

SEQ ID NO: 6339533 - DNA, 20 bp, Homo sapiens
gttccctagagagaataaat

SEQ ID NO: 6339534 - DNA, 15 bp, Homo sapiens
gttccctatggagag

SEQ ID NO: 6339535 - DNA, 22 bp, Homo sapiens
gttccctatttttctctcctgt

SEQ ID NO: 6339536 - DNA, 15 bp, Homo sapiens
gttccctcagccctc

SEQ ID NO: 6339537 - DNA, 19 bp, Homo sapiens
gttccctcagccctcatta

SEQ ID NO: 6339538 - DNA, 13 bp, Homo sapiens
gttccctccaggc

SEQ ID NO: 6339539 - DNA, 21 bp, Homo sapiens
gttccctcctgcccaggactg

SEQ ID NO: 6339540 - DNA, 23 bp, Homo sapiens
gttccctcctgcccaggactgca

SEQ ID NO: 6339541 - DNA, 16 bp, Homo sapiens
gttccctcctggtcct

SEQ ID NO: 6339542 - DNA, 19 bp, Homo sapiens
gttccctcctggtcctgga

SEQ ID NO: 6339543 - DNA, 14 bp, Homo sapiens
gttccctctgctca

SEQ ID NO: 6339544 - DNA, 16 bp, Homo sapiens
gttccctctgctcctg

SEQ ID NO: 6339545 - DNA, 18 bp, Homo sapiens
gttccctctggcttccca

SEQ ID NO: 6339546 - DNA, 20 bp, Homo sapiens
gttccctctttcctgtgcca

SEQ ID NO: 6339547 - DNA, 19 bp, Homo sapiens
gttccctgaaaacccagag

SEQ ID NO: 6339548 - DNA, 20 bp, Homo sapiens
gttccctgaaaacccagaga

SEQ ID NO: 6339549 - DNA, 15 bp, Homo sapiens
gttccctgaaacacg

SEQ ID NO: 6339550 - DNA, 18 bp, Homo sapiens
gttccctgaacatctgtg

SEQ ID NO: 6339551 - DNA, 19 bp, Homo sapiens
gttccctgaacatctgtgt

SEQ ID NO: 6339552 - DNA, 21 bp, Homo sapiens
gttccctgaacatctgtgtgt

SEQ ID NO: 6339553 - DNA, 12 bp, Homo sapiens
gttccctgcacc

SEQ ID NO: 6339554 - DNA, 14 bp, Homo sapiens
gttccctgcaccct

SEQ ID NO: 6339555 - DNA, 16 bp, Homo sapiens
gttccctgcaccctgg

SEQ ID NO: 6339556 - DNA, 21 bp, Homo sapiens
gttccctgcgcttcatctcat

SEQ ID NO: 6339557 - DNA, 22 bp, Homo sapiens
gttccctgcgcttcatctcatg

SEQ ID NO: 6339558 - DNA, 14 bp, Homo sapiens
gttccctgctgcgc

SEQ ID NO: 6339559 - DNA, 16 bp, Homo sapiens
gttccctgctgcgctg

SEQ ID NO: 6339560 - DNA, 22 bp, Homo sapiens
gttccctgctgcgctgcttggt

SEQ ID NO: 6339561 - DNA, 12 bp, Homo sapiens
gttccctgctgg

SEQ ID NO: 6339562 - DNA, 20 bp, Homo sapiens
gttccctgtcagaggctaag

SEQ ID NO: 6339563 - DNA, 16 bp, Homo sapiens
gttccctgtcttgtcc

SEQ ID NO: 6339564 - DNA, 15 bp, Homo sapiens
gttccctgttcttcc

SEQ ID NO: 6339565 - DNA, 15 bp, Homo sapiens
gttcccttcctcttc

SEQ ID NO: 6339566 - DNA, 20 bp, Homo sapiens
gttcccttcctcttcctgcc

SEQ ID NO: 6339567 - DNA, 21 bp, Homo sapiens
gttcccttcctcttcctgccc

SEQ ID NO: 6339568 - DNA, 23 bp, Homo sapiens
gttcccttcctcttcctgccctt

SEQ ID NO: 6339569 - DNA, 16 bp, Homo sapiens
gttcccttctccccct

SEQ ID NO: 6339570 - DNA, 15 bp, Homo sapiens
gttcccttggcctca

SEQ ID NO: 6339571 - DNA, 18 bp, Homo sapiens
gttcccttggcctcagaa

SEQ ID NO: 6339572 - DNA, 19 bp, Homo sapiens
gttcccttggcctcagaat

SEQ ID NO: 6339573 - DNA, 20 bp, Homo sapiens
gttcccttgtgtctgttgct

SEQ ID NO: 6339574 - DNA, 23 bp, Homo sapiens
gttccctttccccattcagtgac

SEQ ID NO: 6339575 - DNA, 19 bp, Homo sapiens
gttccctttccttccatcc

SEQ ID NO: 6339576 - DNA, 20 bp, Homo sapiens
gttccctttgacgccatccc

SEQ ID NO: 6339577 - DNA, 15 bp, Homo sapiens
gttccctttgcctta

SEQ ID NO: 6339578 - DNA, 16 bp, Homo sapiens
gttccctttgccttaa

SEQ ID NO: 6339579 - DNA, 13 bp, Homo sapiens
gttccctttgctc

SEQ ID NO: 6339580 - DNA, 14 bp, Homo sapiens
gttccctttttcat

SEQ ID NO: 6339581 - DNA, 20 bp, Homo sapiens
gttccgaaaccaaagaagaa

SEQ ID NO: 6339582 - DNA, 22 bp, Homo sapiens
gttccgaagatgctgtagtaac

SEQ ID NO: 6339583 - DNA, 14 bp, Homo sapiens
gttccgcactttcc

SEQ ID NO: 6339584 - DNA, 18 bp, Homo sapiens
gttccgcactttccactt

SEQ ID NO: 6339585 - DNA, 21 bp, Homo sapiens
gttccggggagaaacccagag

SEQ ID NO: 6339586 - DNA, 17 bp, Homo sapiens
gttccggtccccacaga

SEQ ID NO: 6339587 - DNA, 19 bp, Homo sapiens
gttccgtatctccctggag

SEQ ID NO: 6339588 - DNA, 18 bp, Homo sapiens
gttccgtcccaaacagag

SEQ ID NO: 6339589 - DNA, 22 bp, Homo sapiens
gttccgtctcctctccagccct

SEQ ID NO: 6339590 - DNA, 15 bp, Homo sapiens
gttcctaagggaaag

SEQ ID NO: 6339591 - DNA, 16 bp, Homo sapiens
gttcctaggggaatga

SEQ ID NO: 6339592 - DNA, 23 bp, Homo sapiens
gttcctagtgatggcttatgata

SEQ ID NO: 6339593 - DNA, 23 bp, Homo sapiens
gttcctataataaaatggcacct

SEQ ID NO: 6339594 - DNA, 14 bp, Homo sapiens
gttcctatggaaac

SEQ ID NO: 6339595 - DNA, 15 bp, Homo sapiens
gttcctatggaaaca

SEQ ID NO: 6339596 - DNA, 18 bp, Homo sapiens
gttcctatggaaacattt

SEQ ID NO: 6339597 - DNA, 15 bp, Homo sapiens
gttcctcaaattttt

SEQ ID NO: 6339598 - DNA, 20 bp, Homo sapiens
gttcctcaaattttttgact

SEQ ID NO: 6339599 - DNA, 18 bp, Homo sapiens
gttcctcaccaataactt

SEQ ID NO: 6339600 - DNA, 21 bp, Homo sapiens
gttcctcaccaataacttcag

SEQ ID NO: 6339601 - DNA, 19 bp, Homo sapiens
gttcctcccaagaggccag

SEQ ID NO: 6339602 - DNA, 20 bp, Homo sapiens
gttcctccccctgctcccct

SEQ ID NO: 6339603 - DNA, 17 bp, Homo sapiens
gttcctccccgccttcc

SEQ ID NO: 6339604 - DNA, 23 bp, Homo sapiens
gttcctcccctcctcctggactc

SEQ ID NO: 6339605 - DNA, 14 bp, Homo sapiens
gttcctcccctgta

SEQ ID NO: 6339606 - DNA, 14 bp, Homo sapiens
gttcctcctcagcc

SEQ ID NO: 6339607 - DNA, 17 bp, Homo sapiens
gttcctcctcagcctcc

SEQ ID NO: 6339608 - DNA, 11 bp, Homo sapiens
gttcctcctgc

SEQ ID NO: 6339609 - DNA, 15 bp, Homo sapiens
gttcctcctgctgta

SEQ ID NO: 6339610 - DNA, 17 bp, Homo sapiens
gttcctcgttctccctg

SEQ ID NO: 6339611 - DNA, 16 bp, Homo sapiens
gttcctctatactttg

SEQ ID NO: 6339612 - DNA, 21 bp, Homo sapiens
gttcctctatactttgttctg

SEQ ID NO: 6339613 - DNA, 22 bp, Homo sapiens
gttcctctatactttgttctgt

SEQ ID NO: 6339614 - DNA, 16 bp, Homo sapiens
gttcctctcccttccc

SEQ ID NO: 6339615 - DNA, 17 bp, Homo sapiens
gttcctctcccttccct

SEQ ID NO: 6339616 - DNA, 22 bp, Homo sapiens
gttcctctctggtggctctttg

SEQ ID NO: 6339617 - DNA, 12 bp, Homo sapiens
gttcctctgaag

SEQ ID NO: 6339618 - DNA, 14 bp, Homo sapiens
gttcctctgcctgc

SEQ ID NO: 6339619 - DNA, 16 bp, Homo sapiens
gttcctctgcctgccc

SEQ ID NO: 6339620 - DNA, 16 bp, Homo sapiens
gttcctctgtacagca

SEQ ID NO: 6339621 - DNA, 11 bp, Homo sapiens
gttcctgaaat

SEQ ID NO: 6339622 - DNA, 17 bp, Homo sapiens
gttcctgaagctgctgt

SEQ ID NO: 6339623 - DNA, 14 bp, Homo sapiens
gttcctgactgttc

SEQ ID NO: 6339624 - DNA, 15 bp, Homo sapiens
gttcctgactgttct

SEQ ID NO: 6339625 - DNA, 16 bp, Homo sapiens
gttcctgactgttctc

SEQ ID NO: 6339626 - DNA, 14 bp, Homo sapiens
gttcctgagacaga

SEQ ID NO: 6339627 - DNA, 12 bp, Homo sapiens
gttcctgcagca

SEQ ID NO: 6339628 - DNA, 17 bp, Homo sapiens
gttcctgcagcagagcc

SEQ ID NO: 6339629 - DNA, 18 bp, Homo sapiens
gttcctgcagcagagcct

SEQ ID NO: 6339630 - DNA, 22 bp, Homo sapiens
gttcctgcagccccagaagaaa

SEQ ID NO: 6339631 - DNA, 20 bp, Homo sapiens
gttcctgccaggctctccct

SEQ ID NO: 6339632 - DNA, 15 bp, Homo sapiens
gttcctgcccccgcc

SEQ ID NO: 6339633 - DNA, 22 bp, Homo sapiens
gttcctgcccccgccctgctgt

SEQ ID NO: 6339634 - DNA, 17 bp, Homo sapiens
gttcctgccttctcttc

SEQ ID NO: 6339635 - DNA, 16 bp, Homo sapiens
gttcctgctagaaatg

SEQ ID NO: 6339636 - DNA, 17 bp, Homo sapiens
gttcctgctagaaatgg

SEQ ID NO: 6339637 - DNA, 23 bp, Homo sapiens
gttcctgctccatgactggctgt

SEQ ID NO: 6339638 - DNA, 14 bp, Homo sapiens
gttcctgctctctg

SEQ ID NO: 6339639 - DNA, 18 bp, Homo sapiens
gttcctgctctctgctca

SEQ ID NO: 6339640 - DNA, 14 bp, Homo sapiens
gttcctgctgcctg

SEQ ID NO: 6339641 - DNA, 15 bp, Homo sapiens
gttcctgctgcctgg

SEQ ID NO: 6339642 - DNA, 17 bp, Homo sapiens
gttcctgctgcctgggt

SEQ ID NO: 6339643 - DNA, 22 bp, Homo sapiens
gttcctgctgctgtctgggtgc

SEQ ID NO: 6339644 - DNA, 18 bp, Homo sapiens
gttcctgctgtcctggtg

SEQ ID NO: 6339645 - DNA, 16 bp, Homo sapiens
gttcctggagttttga

SEQ ID NO: 6339646 - DNA, 14 bp, Homo sapiens
gttcctggcagttt

SEQ ID NO: 6339647 - DNA, 23 bp, Homo sapiens
gttcctggcagtttaaaaaaatt

SEQ ID NO: 6339648 - DNA, 17 bp, Homo sapiens
gttcctggcatttgctg

SEQ ID NO: 6339649 - DNA, 19 bp, Homo sapiens
gttcctggcccactctgta

SEQ ID NO: 6339650 - DNA, 15 bp, Homo sapiens
gttcctggccccctc

SEQ ID NO: 6339651 - DNA, 17 bp, Homo sapiens
gttcctggccttctgaa

SEQ ID NO: 6339652 - DNA, 21 bp, Homo sapiens
gttcctggctgatgatccaga

SEQ ID NO: 6339653 - DNA, 13 bp, Homo sapiens
gttcctggctttg

SEQ ID NO: 6339654 - DNA, 22 bp, Homo sapiens
gttcctgggatgtttaatcaag

SEQ ID NO: 6339655 - DNA, 20 bp, Homo sapiens
gttcctggggccgcctgccc

SEQ ID NO: 6339656 - DNA, 23 bp, Homo sapiens
gttcctggggccgcctgccctgc

SEQ ID NO: 6339657 - DNA, 17 bp, Homo sapiens
gttcctggtgactcctg

SEQ ID NO: 6339658 - DNA, 16 bp, Homo sapiens
gttcctgtcccacatg

SEQ ID NO: 6339659 - DNA, 13 bp, Homo sapiens
gttcctgtccctg

SEQ ID NO: 6339660 - DNA, 16 bp, Homo sapiens
gttcctgtccctgcgc

SEQ ID NO: 6339661 - DNA, 18 bp, Homo sapiens
gttcctgtctcaatagct

SEQ ID NO: 6339662 - DNA, 20 bp, Homo sapiens
gttcctgtgcagatgctgct

SEQ ID NO: 6339663 - DNA, 15 bp, Homo sapiens
gttcctgtggagaca

SEQ ID NO: 6339664 - DNA, 14 bp, Homo sapiens
gttcctgtggctcc

SEQ ID NO: 6339665 - DNA, 20 bp, Homo sapiens
gttcctgtggggttgttttt

SEQ ID NO: 6339666 - DNA, 22 bp, Homo sapiens
gttcctgttctcagcatccact

SEQ ID NO: 6339667 - DNA, 12 bp, Homo sapiens
gttcctgtttat

SEQ ID NO: 6339668 - DNA, 15 bp, Homo sapiens
gttccttacctttac

SEQ ID NO: 6339669 - DNA, 15 bp, Homo sapiens
gttccttatccctct

SEQ ID NO: 6339670 - DNA, 17 bp, Homo sapiens
gttccttatccctctct

SEQ ID NO: 6339671 - DNA, 17 bp, Homo sapiens
gggtctgcctccagcca

SEQ ID NO: 6339672 - DNA, 18 bp, Homo sapiens
gggtctgcgcttggtctt

SEQ ID NO: 6339673 - DNA, 19 bp, Homo sapiens
gggtctgctctttctctgc

SEQ ID NO: 6339674 - DNA, 20 bp, Homo sapiens
gggtctggagttgatctgga

SEQ ID NO: 6339675 - DNA, 21 bp, Homo sapiens
gggtctggcagagcctctgag

SEQ ID NO: 6339676 - DNA, 15 bp, Homo sapiens
gggtctggctgagct

SEQ ID NO: 6339677 - DNA, 15 bp, Homo sapiens
gggtctggctggtgt

SEQ ID NO: 6339678 - DNA, 14 bp, Homo sapiens
gggtctgggcagtg

SEQ ID NO: 6339679 - DNA, 21 bp, Homo sapiens
gggtctgggcagtgccacagc

SEQ ID NO: 6339680 - DNA, 15 bp, Homo sapiens
gggtctgggcgtcca

SEQ ID NO: 6339681 - DNA, 14 bp, Homo sapiens
gggtctgggctggg

SEQ ID NO: 6339682 - DNA, 20 bp, Homo sapiens
gggtctgggggcagctgtcc

SEQ ID NO: 6339683 - DNA, 14 bp, Homo sapiens
gggtctgtaaaatc

SEQ ID NO: 6339684 - DNA, 15 bp, Homo sapiens
gggtctgtgctgtgc

SEQ ID NO: 6339685 - DNA, 14 bp, Homo sapiens
gggtcttagctctt

SEQ ID NO: 6339686 - DNA, 20 bp, Homo sapiens
gggtcttcagggggccaggt

SEQ ID NO: 6339687 - DNA, 22 bp, Homo sapiens
gggtcttccttctcattgctgc

SEQ ID NO: 6339688 - DNA, 21 bp, Homo sapiens
gggtcttgctatgttgcccaa

SEQ ID NO: 6339689 - DNA, 18 bp, Homo sapiens
gggtcttgctctgtcccc

SEQ ID NO: 6339690 - DNA, 21 bp, Homo sapiens
gggtcttgggctactggcagc

SEQ ID NO: 6339691 - DNA, 18 bp, Homo sapiens
gggtctttaataaaacaa

SEQ ID NO: 6339692 - DNA, 21 bp, Homo sapiens
gggtctttctgatgacgcctg

SEQ ID NO: 6339693 - DNA, 15 bp, Homo sapiens
gggtcttttagctcc

SEQ ID NO: 6339694 - DNA, 21 bp, Homo sapiens
gggtcttttcatctgggaaag

SEQ ID NO: 6339695 - DNA, 20 bp, Homo sapiens
gggtcttttggctctgaagg

SEQ ID NO: 6339696 - DNA, 21 bp, Homo sapiens
gggtctttttctcttctgttc

SEQ ID NO: 6339697 - DNA, 23 bp, Homo sapiens
gggtgaaatccatactgtagaca

SEQ ID NO: 6339698 - DNA, 13 bp, Homo sapiens
gggtgaagctggg

SEQ ID NO: 6339699 - DNA, 14 bp, Homo sapiens
gggtgaaggctggc

SEQ ID NO: 6339700 - DNA, 14 bp, Homo sapiens
gggtgaagggagag

SEQ ID NO: 6339701 - DNA, 17 bp, Homo sapiens
gggtgaagtgaagacaa

SEQ ID NO: 6339702 - DNA, 23 bp, Homo sapiens
gggtgaataataaaagtatatat

SEQ ID NO: 6339703 - DNA, 12 bp, Homo sapiens
gggtgacagagc

SEQ ID NO: 6339704 - DNA, 19 bp, Homo sapiens
gggtgacagagcaagtgag

SEQ ID NO: 6339705 - DNA, 14 bp, Homo sapiens
gggtgacagaggga

SEQ ID NO: 6339706 - DNA, 18 bp, Homo sapiens
gggtgacagtcatcatca

SEQ ID NO: 6339707 - DNA, 15 bp, Homo sapiens
gggtgacatcccagg

SEQ ID NO: 6339708 - DNA, 21 bp, Homo sapiens
gggtgacatggggaaggcaga

SEQ ID NO: 6339709 - DNA, 13 bp, Homo sapiens
gggtgaccaggtc

SEQ ID NO: 6339710 - DNA, 18 bp, Homo sapiens
gggtgacccacagctctg

SEQ ID NO: 6339711 - DNA, 15 bp, Homo sapiens
gggtgacctccggcc

SEQ ID NO: 6339712 - DNA, 12 bp, Homo sapiens
gggtgacctgct

SEQ ID NO: 6339713 - DNA, 15 bp, Homo sapiens
gggtgacgcccagct

SEQ ID NO: 6339714 - DNA, 18 bp, Homo sapiens
gggtgacgcctgagacag

SEQ ID NO: 6339715 - DNA, 21 bp, Homo sapiens
gggtgactaaacgggcgccaa

SEQ ID NO: 6339716 - DNA, 15 bp, Homo sapiens
gggtgactcagaaga

SEQ ID NO: 6339717 - DNA, 17 bp, Homo sapiens
gggtgagaacaaccaaa

SEQ ID NO: 6339718 - DNA, 14 bp, Homo sapiens
gggtgagagacctg

SEQ ID NO: 6339719 - DNA, 18 bp, Homo sapiens
gggtgaggaccactcctg

SEQ ID NO: 6339720 - DNA, 14 bp, Homo sapiens
gggtgaggagctgg

SEQ ID NO: 6339721 - DNA, 15 bp, Homo sapiens
gggtgaggagctggg

SEQ ID NO: 6339722 - DNA, 12 bp, Homo sapiens
gggtgagggagt

SEQ ID NO: 6339723 - DNA, 15 bp, Homo sapiens
gggtgagggccttct

SEQ ID NO: 6339724 - DNA, 23 bp, Homo sapiens
gggtgagttggcttacctggccc

SEQ ID NO: 6339725 - DNA, 15 bp, Homo sapiens
gggtgataaggggcc

SEQ ID NO: 6339726 - DNA, 19 bp, Homo sapiens
gggtgataaggggccttgc

SEQ ID NO: 6339727 - DNA, 18 bp, Homo sapiens
gggtgatatggacagcag

SEQ ID NO: 6339728 - DNA, 18 bp, Homo sapiens
gggtgatgagggcagcag

SEQ ID NO: 6339729 - DNA, 19 bp, Homo sapiens
gggtgatgatgaccaagaa

SEQ ID NO: 6339730 - DNA, 18 bp, Homo sapiens
gggtgatgcttttgctgc

SEQ ID NO: 6339731 - DNA, 15 bp, Homo sapiens
gggtgatggggaggg

SEQ ID NO: 6339732 - DNA, 15 bp, Homo sapiens
gggtgattcctccca

SEQ ID NO: 6339733 - DNA, 17 bp, Homo sapiens
gggtgattcctcccagg

SEQ ID NO: 6339734 - DNA, 20 bp, Homo sapiens
gggtgcaaagactctgagcc

SEQ ID NO: 6339735 - DNA, 19 bp, Homo sapiens
gggtgcacacaggatggca

SEQ ID NO: 6339736 - DNA, 13 bp, Homo sapiens
gggtgcacaggag

SEQ ID NO: 6339737 - DNA, 14 bp, Homo sapiens
gggtgcacaggagg

SEQ ID NO: 6339738 - DNA, 15 bp, Homo sapiens
gggtgcacccacctg

SEQ ID NO: 6339739 - DNA, 14 bp, Homo sapiens
gggtgcacccactc

SEQ ID NO: 6339740 - DNA, 17 bp, Homo sapiens
gggtgcagaagctgtgg

SEQ ID NO: 6339741 - DNA, 14 bp, Homo sapiens
gggtgcagaccctg

SEQ ID NO: 6339742 - DNA, 14 bp, Homo sapiens
gggtgcagaggctg

SEQ ID NO: 6339743 - DNA, 16 bp, Homo sapiens
gggtgcagaggctgtg

SEQ ID NO: 6339744 - DNA, 13 bp, Homo sapiens
gggtgcagccctc

SEQ ID NO: 6339745 - DNA, 19 bp, Homo sapiens
gggtgcagccctcttgccc

SEQ ID NO: 6339746 - DNA, 13 bp, Homo sapiens
gggtgcaggtggg

SEQ ID NO: 6339747 - DNA, 18 bp, Homo sapiens
gggtgcaggtgggcactg

SEQ ID NO: 6339748 - DNA, 19 bp, Homo sapiens
gggtgcatatgtacagaag

SEQ ID NO: 6339749 - DNA, 15 bp, Homo sapiens
gggtgcatcctcctc

SEQ ID NO: 6339750 - DNA, 21 bp, Homo sapiens
gggtgcatcctcctcagcccc

SEQ ID NO: 6339751 - DNA, 15 bp, Homo sapiens
gggtgcatggcttgg

SEQ ID NO: 6339752 - DNA, 16 bp, Homo sapiens
gggtgccaggtgctgg

SEQ ID NO: 6339753 - DNA, 18 bp, Homo sapiens
gggtgccatccacatttt

SEQ ID NO: 6339754 - DNA, 21 bp, Homo sapiens
gggtgcccatttgtgatcagc

SEQ ID NO: 6339755 - DNA, 20 bp, Homo sapiens
gggtgccccgcctgagtcag

SEQ ID NO: 6339756 - DNA, 18 bp, Homo sapiens
gggtgcccgtatccagag

SEQ ID NO: 6339757 - DNA, 19 bp, Homo sapiens
gggtgcccgtgtggcctgg

SEQ ID NO: 6339758 - DNA, 18 bp, Homo sapiens
gggtgccctccactgccc

SEQ ID NO: 6339759 - DNA, 20 bp, Homo sapiens
gggtgccctcccagaccccc

SEQ ID NO: 6339760 - DNA, 15 bp, Homo sapiens
gggtgccctctcagg

SEQ ID NO: 6339761 - DNA, 14 bp, Homo sapiens
gggtgccctctgct

SEQ ID NO: 6339762 - DNA, 11 bp, Homo sapiens
gggtgccctga

SEQ ID NO: 6339763 - DNA, 17 bp, Homo sapiens
gggtgccctggctcctt

SEQ ID NO: 6339764 - DNA, 12 bp, Homo sapiens
gggtgccgcctg

SEQ ID NO: 6339765 - DNA, 18 bp, Homo sapiens
gggtgccgctctctctga

SEQ ID NO: 6339766 - DNA, 21 bp, Homo sapiens
gggtgccgctttctctgaggg

SEQ ID NO: 6339767 - DNA, 19 bp, Homo sapiens
gggtgcctaggttggtttc

SEQ ID NO: 6339768 - DNA, 19 bp, Homo sapiens
gggtgcctcagagcaggct

SEQ ID NO: 6339769 - DNA, 16 bp, Homo sapiens
gggtgcctcaggacct

SEQ ID NO: 6339770 - DNA, 13 bp, Homo sapiens
gggtgcctcctgc

SEQ ID NO: 6339771 - DNA, 16 bp, Homo sapiens
gggtgcctcctgcagt

SEQ ID NO: 6339772 - DNA, 15 bp, Homo sapiens
gggtgcctgagcccg

SEQ ID NO: 6339773 - DNA, 17 bp, Homo sapiens
gggtgcctgcagcgcct

SEQ ID NO: 6339774 - DNA, 23 bp, Homo sapiens
gggtgcctgctgcggcagacggg

SEQ ID NO: 6339775 - DNA, 15 bp, Homo sapiens
gggtgcctggctggg

SEQ ID NO: 6339776 - DNA, 21 bp, Homo sapiens
gggtgcctggtgcgctgtgct

SEQ ID NO: 6339777 - DNA, 20 bp, Homo sapiens
gggtgccttcactgggccag

SEQ ID NO: 6339778 - DNA, 23 bp, Homo sapiens
gggtgccttcactgggccagtca

SEQ ID NO: 6339779 - DNA, 19 bp, Homo sapiens
gggtgcgctcacctgcagc

SEQ ID NO: 6339780 - DNA, 20 bp, Homo sapiens
gggtgcgctcacctgcagcc

SEQ ID NO: 6339781 - DNA, 14 bp, Homo sapiens
gggtgcggcaggag

SEQ ID NO: 6339782 - DNA, 19 bp, Homo sapiens
gggtgcggggcctgcaggc

SEQ ID NO: 6339783 - DNA, 20 bp, Homo sapiens
gggtgcggtttgctcagccc

SEQ ID NO: 6339784 - DNA, 19 bp, Homo sapiens
gggtgcgtctccagtcatc

SEQ ID NO: 6339785 - DNA, 19 bp, Homo sapiens
gggtgctactggggaaact

SEQ ID NO: 6339786 - DNA, 16 bp, Homo sapiens
gggtgctcaataaact

SEQ ID NO: 6339787 - DNA, 18 bp, Homo sapiens
gggtgctcaccgcctgct

SEQ ID NO: 6339788 - DNA, 21 bp, Homo sapiens
gggtgctcagaataaggcagg

SEQ ID NO: 6339789 - DNA, 14 bp, Homo sapiens
gggtgctcagtctc

SEQ ID NO: 6339790 - DNA, 18 bp, Homo sapiens
gggtgctctctctgaggg

SEQ ID NO: 6339791 - DNA, 17 bp, Homo sapiens
gggtgctctgaggtcaa

SEQ ID NO: 6339792 - DNA, 20 bp, Homo sapiens
gggtgctctggctggagagg

SEQ ID NO: 6339793 - DNA, 21 bp, Homo sapiens
gggtgctctggctggagagga

SEQ ID NO: 6339794 - DNA, 18 bp, Homo sapiens
gggtgctctggtctgacc

SEQ ID NO: 6339795 - DNA, 15 bp, Homo sapiens
gggtgctgccagctg

SEQ ID NO: 6339796 - DNA, 20 bp, Homo sapiens
gggtgctgctaattctttgc

SEQ ID NO: 6339797 - DNA, 19 bp, Homo sapiens
gggtgctggcagcctcagg

SEQ ID NO: 6339798 - DNA, 17 bp, Homo sapiens
gggtgctggcccccagg

SEQ ID NO: 6339799 - DNA, 18 bp, Homo sapiens
gggtgctgggcccctgcc

SEQ ID NO: 6339800 - DNA, 19 bp, Homo sapiens
gggtgctggggcagagtgg

SEQ ID NO: 6339801 - DNA, 21 bp, Homo sapiens
gggtgctgtcatgcccagctt

SEQ ID NO: 6339802 - DNA, 24 bp, Homo sapiens
gggtgctgtgaggcttgcccagga

SEQ ID NO: 6339803 - DNA, 16 bp, Homo sapiens
gggtgctgttttgcca

SEQ ID NO: 6339804 - DNA, 17 bp, Homo sapiens
gggtggaagggcaggag

SEQ ID NO: 6339805 - DNA, 17 bp, Homo sapiens
gggtggaagggctgggt

SEQ ID NO: 6339806 - DNA, 14 bp, Homo sapiens
gggtggacagaagc

SEQ ID NO: 6339807 - DNA, 23 bp, Homo sapiens
gggtggaccccctgagtcaactg

SEQ ID NO: 6339808 - DNA, 20 bp, Homo sapiens
gggtggacgcaattgtggga

SEQ ID NO: 6339809 - DNA, 14 bp, Homo sapiens
gggtggagaagcca

SEQ ID NO: 6339810 - DNA, 22 bp, Homo sapiens
gggtggagactgcttcccatcc

SEQ ID NO: 6339811 - DNA, 20 bp, Homo sapiens
gggtggagagttgggggcca

SEQ ID NO: 6339812 - DNA, 17 bp, Homo sapiens
gggtggagcactggact

SEQ ID NO: 6339813 - DNA, 13 bp, Homo sapiens
gggtggagcagga

SEQ ID NO: 6339814 - DNA, 22 bp, Homo sapiens
gggtggaggaaggtgctgagct

SEQ ID NO: 6339815 - DNA, 18 bp, Homo sapiens
gggtggaggatggacgag

SEQ ID NO: 6339816 - DNA, 17 bp, Homo sapiens
gggtggagggaaggtga

SEQ ID NO: 6339817 - DNA, 22 bp, Homo sapiens
gggtggatcaccagaggtcagg

SEQ ID NO: 6339818 - DNA, 20 bp, Homo sapiens
gggtggatccactgtgcagg

SEQ ID NO: 6339819 - DNA, 15 bp, Homo sapiens
gggtggcaccagcag

SEQ ID NO: 6339820 - DNA, 13 bp, Homo sapiens
gggtggcagaaat

SEQ ID NO: 6339821 - DNA, 13 bp, Homo sapiens
gggtggcagagac

SEQ ID NO: 6339822 - DNA, 15 bp, Homo sapiens
gggtggcagagacag

SEQ ID NO: 6339823 - DNA, 21 bp, Homo sapiens
gggtggcagagacagtgggca

SEQ ID NO: 6339824 - DNA, 13 bp, Homo sapiens
gggtggcagcaac

SEQ ID NO: 6339825 - DNA, 16 bp, Homo sapiens
gggtggcagcgcccag

SEQ ID NO: 6339826 - DNA, 12 bp, Homo sapiens
gggtggcaggca

SEQ ID NO: 6339827 - DNA, 18 bp, Homo sapiens
gggtggcatcaggagctg

SEQ ID NO: 6339828 - DNA, 18 bp, Homo sapiens
gggtggcatcctccggag

SEQ ID NO: 6339829 - DNA, 20 bp, Homo sapiens
gggtggcatcttagggtagg

SEQ ID NO: 6339830 - DNA, 19 bp, Homo sapiens
gggtggccacacaggcagg

SEQ ID NO: 6339831 - DNA, 14 bp, Homo sapiens
gggtggccaggccg

SEQ ID NO: 6339832 - DNA, 15 bp, Homo sapiens
gggtggccagggctt

SEQ ID NO: 6339833 - DNA, 18 bp, Homo sapiens
gggtggcccatcccccct

SEQ ID NO: 6339834 - DNA, 18 bp, Homo sapiens
gggtggccccctgtgcca

SEQ ID NO: 6339835 - DNA, 19 bp, Homo sapiens
gggtggccggccctgcccc

SEQ ID NO: 6339836 - DNA, 11 bp, Homo sapiens
gggtggcctcg

SEQ ID NO: 6339837 - DNA, 14 bp, Homo sapiens
gggtggcctggccc

SEQ ID NO: 6339838 - DNA, 18 bp, Homo sapiens
gggtggcgcgcctgcctt

SEQ ID NO: 6339839 - DNA, 15 bp, Homo sapiens
gggtggcgctggtgc

SEQ ID NO: 6339840 - DNA, 18 bp, Homo sapiens
gggtggctactctgtgcc

SEQ ID NO: 6339841 - DNA, 22 bp, Homo sapiens
gggtggctcagcatcctccacg

SEQ ID NO: 6339842 - DNA, 11 bp, Homo sapiens
gggtggctcct

SEQ ID NO: 6339843 - DNA, 22 bp, Homo sapiens
gggtggctgtgacaaccctggc

SEQ ID NO: 6339844 - DNA, 17 bp, Homo sapiens
gggtggctttcaaggct

SEQ ID NO: 6339845 - DNA, 19 bp, Homo sapiens
gggtggctttcaaggctgg

SEQ ID NO: 6339846 - DNA, 20 bp, Homo sapiens
gggtggctttcaaggctggg

SEQ ID NO: 6339847 - DNA, 13 bp, Homo sapiens
gggtgggaaggga

SEQ ID NO: 6339848 - DNA, 17 bp, Homo sapiens
gggtgggaaggggatgg

SEQ ID NO: 6339849 - DNA, 18 bp, Homo sapiens
gggtgggaattggggagg

SEQ ID NO: 6339850 - DNA, 15 bp, Homo sapiens
gttccttatttctct

SEQ ID NO: 6339851 - DNA, 13 bp, Homo sapiens
gttccttcccaat

SEQ ID NO: 6339852 - DNA, 14 bp, Homo sapiens
gttccttccctggg

SEQ ID NO: 6339853 - DNA, 20 bp, Homo sapiens
gttccttccctgtgcctcct

SEQ ID NO: 6339854 - DNA, 21 bp, Homo sapiens
gttccttccgatgacagtgct

SEQ ID NO: 6339855 - DNA, 19 bp, Homo sapiens
gttccttcctatgcccagg

SEQ ID NO: 6339856 - DNA, 18 bp, Homo sapiens
gttccttcctctgagcct

SEQ ID NO: 6339857 - DNA, 20 bp, Homo sapiens
gttccttcctgcagacctgg

SEQ ID NO: 6339858 - DNA, 13 bp, Homo sapiens
gttccttctggtg

SEQ ID NO: 6339859 - DNA, 16 bp, Homo sapiens
gttccttctgtgaaga

SEQ ID NO: 6339860 - DNA, 12 bp, Homo sapiens
gttccttgcctt

SEQ ID NO: 6339861 - DNA, 20 bp, Homo sapiens
gttccttgccttaataaata

SEQ ID NO: 6339862 - DNA, 23 bp, Homo sapiens
gttccttgccttaataaatatgt

SEQ ID NO: 6339863 - DNA, 16 bp, Homo sapiens
gttccttgctagccct

SEQ ID NO: 6339864 - DNA, 21 bp, Homo sapiens
gttccttggtcctagtaagaa

SEQ ID NO: 6339865 - DNA, 19 bp, Homo sapiens
gttccttgtactcttagga

SEQ ID NO: 6339866 - DNA, 23 bp, Homo sapiens
gttcctttagaaagcagttaccc

SEQ ID NO: 6339867 - DNA, 22 bp, Homo sapiens
gttcctttatttaggaaacacc

SEQ ID NO: 6339868 - DNA, 15 bp, Homo sapiens
gttcctttcagatga

SEQ ID NO: 6339869 - DNA, 14 bp, Homo sapiens
gttcctttgttccc

SEQ ID NO: 6339870 - DNA, 19 bp, Homo sapiens
gttcctttttaaatgtgaa

SEQ ID NO: 6339871 - DNA, 20 bp, Homo sapiens
gttcctttttaaatgtgaat

SEQ ID NO: 6339872 - DNA, 14 bp, Homo sapiens
gttcctttttgtaa

SEQ ID NO: 6339873 - DNA, 22 bp, Homo sapiens
gttcgaaatagatatcctctcc

SEQ ID NO: 6339874 - DNA, 18 bp, Homo sapiens
gttcgacagtgaatattc

SEQ ID NO: 6339875 - DNA, 15 bp, Homo sapiens
gttcgagaccagcct

SEQ ID NO: 6339876 - DNA, 17 bp, Homo sapiens
gttcgagaccagcctcg

SEQ ID NO: 6339877 - DNA, 16 bp, Homo sapiens
gttcgagaccagcctg

SEQ ID NO: 6339878 - DNA, 16 bp, Homo sapiens
gttcgagaccagtctg

SEQ ID NO: 6339879 - DNA, 16 bp, Homo sapiens
gttcgagactccatct

SEQ ID NO: 6339880 - DNA, 18 bp, Homo sapiens
gttcgagagcagcctggc

SEQ ID NO: 6339881 - DNA, 16 bp, Homo sapiens
gttcgatacctggagc

SEQ ID NO: 6339882 - DNA, 18 bp, Homo sapiens
gttcgatgcctgcatgct

SEQ ID NO: 6339883 - DNA, 17 bp, Homo sapiens
gttcgatttctacctca

SEQ ID NO: 6339884 - DNA, 19 bp, Homo sapiens
gttcgcaccattctcctgc

SEQ ID NO: 6339885 - DNA, 13 bp, Homo sapiens
gttcgcagccacc

SEQ ID NO: 6339886 - DNA, 15 bp, Homo sapiens
gttcgcagccaccct

SEQ ID NO: 6339887 - DNA, 17 bp, Homo sapiens
gttcgcagccaccctga

SEQ ID NO: 6339888 - DNA, 20 bp, Homo sapiens
gttcgcagccaccctgagga

SEQ ID NO: 6339889 - DNA, 14 bp, Homo sapiens
gttcgcatggtcac

SEQ ID NO: 6339890 - DNA, 14 bp, Homo sapiens
gttcgctcctccca

SEQ ID NO: 6339891 - DNA, 18 bp, Homo sapiens
gttcgctggccattggct

SEQ ID NO: 6339892 - DNA, 15 bp, Homo sapiens
gttcgggattccctg

SEQ ID NO: 6339893 - DNA, 17 bp, Homo sapiens
gttcgggattccctggt

SEQ ID NO: 6339894 - DNA, 18 bp, Homo sapiens
gttcgggattccctggtg

SEQ ID NO: 6339895 - DNA, 15 bp, Homo sapiens
gttcggttccagaca

SEQ ID NO: 6339896 - DNA, 17 bp, Homo sapiens
gttcggtttttttcctg

SEQ ID NO: 6339897 - DNA, 13 bp, Homo sapiens
gttcgtagctttc

SEQ ID NO: 6339898 - DNA, 14 bp, Homo sapiens
gttcgtgctgtgct

SEQ ID NO: 6339899 - DNA, 19 bp, Homo sapiens
gttcgtggagccacaggca

SEQ ID NO: 6339900 - DNA, 21 bp, Homo sapiens
gttcgtggagccacaggcaga

SEQ ID NO: 6339901 - DNA, 23 bp, Homo sapiens
gttcgttcttgttctgttttgtt

SEQ ID NO: 6339902 - DNA, 19 bp, Homo sapiens
gttcgttggtagagccctc

SEQ ID NO: 6339903 - DNA, 20 bp, Homo sapiens
gttcgttggtagagccctca

SEQ ID NO: 6339904 - DNA, 18 bp, Homo sapiens
gttctaaaggactaacat

SEQ ID NO: 6339905 - DNA, 13 bp, Homo sapiens
gttctaaagttct

SEQ ID NO: 6339906 - DNA, 17 bp, Homo sapiens
gttctaaagttctaaga

SEQ ID NO: 6339907 - DNA, 18 bp, Homo sapiens
gttctaaagttctaagat

SEQ ID NO: 6339908 - DNA, 19 bp, Homo sapiens
gttctaaatgcaataagat

SEQ ID NO: 6339909 - DNA, 13 bp, Homo sapiens
gttctaaattcta

SEQ ID NO: 6339910 - DNA, 16 bp, Homo sapiens
gttctaacacatttcg

SEQ ID NO: 6339911 - DNA, 20 bp, Homo sapiens
gttctaactcttagaagtga

SEQ ID NO: 6339912 - DNA, 15 bp, Homo sapiens
gttctaagattctaa

SEQ ID NO: 6339913 - DNA, 17 bp, Homo sapiens
gttctaagattctaatg

SEQ ID NO: 6339914 - DNA, 20 bp, Homo sapiens
gttctaagattctaatgatg

SEQ ID NO: 6339915 - DNA, 13 bp, Homo sapiens
gttctaaggccta

SEQ ID NO: 6339916 - DNA, 21 bp, Homo sapiens
gttctaaggcctaggattcta

SEQ ID NO: 6339917 - DNA, 22 bp, Homo sapiens
gttctaaggcctaggattctaa

SEQ ID NO: 6339918 - DNA, 13 bp, Homo sapiens
gttctaaggctct

SEQ ID NO: 6339919 - DNA, 16 bp, Homo sapiens
gttctaagtctttcca

SEQ ID NO: 6339920 - DNA, 17 bp, Homo sapiens
gttctaagtctttccat

SEQ ID NO: 6339921 - DNA, 15 bp, Homo sapiens
gttctaagtttctaa

SEQ ID NO: 6339922 - DNA, 18 bp, Homo sapiens
gttctaagtttctaagat

SEQ ID NO: 6339923 - DNA, 14 bp, Homo sapiens
gttctaatattttt

SEQ ID NO: 6339924 - DNA, 23 bp, Homo sapiens
gttctaatcttgtcaaccagtgc

SEQ ID NO: 6339925 - DNA, 23 bp, Homo sapiens
gttctaattaagaaaactattaa

SEQ ID NO: 6339926 - DNA, 20 bp, Homo sapiens
gttctacaaatttttacttg

SEQ ID NO: 6339927 - DNA, 22 bp, Homo sapiens
gttctacaaatttttacttgaa

SEQ ID NO: 6339928 - DNA, 16 bp, Homo sapiens
gttctacaagcatatt

SEQ ID NO: 6339929 - DNA, 15 bp, Homo sapiens
gttctacaatctatt

SEQ ID NO: 6339930 - DNA, 18 bp, Homo sapiens
gttctacatggctttgat

SEQ ID NO: 6339931 - DNA, 20 bp, Homo sapiens
gttctacatggctttgataa

SEQ ID NO: 6339932 - DNA, 17 bp, Homo sapiens
gttctacccgttccaaa

SEQ ID NO: 6339933 - DNA, 18 bp, Homo sapiens
gttctacccgttccaaaa

SEQ ID NO: 6339934 - DNA, 19 bp, Homo sapiens
gttctaccgtggatttgta

SEQ ID NO: 6339935 - DNA, 17 bp, Homo sapiens
gttctactgacccaact

SEQ ID NO: 6339936 - DNA, 21 bp, Homo sapiens
gttctacttcctgtaatgtac

SEQ ID NO: 6339937 - DNA, 15 bp, Homo sapiens
gttctacttgatatt

SEQ ID NO: 6339938 - DNA, 12 bp, Homo sapiens
gttctagaaaaa

SEQ ID NO: 6339939 - DNA, 17 bp, Homo sapiens
gttctagaaaatatagt

SEQ ID NO: 6339940 - DNA, 19 bp, Homo sapiens
gttctagacttccccatcc

SEQ ID NO: 6339941 - DNA, 17 bp, Homo sapiens
gttctagcagtccccag

SEQ ID NO: 6339942 - DNA, 18 bp, Homo sapiens
gttctagcagtccccagc

SEQ ID NO: 6339943 - DNA, 21 bp, Homo sapiens
gttctagcagtccccagctga

SEQ ID NO: 6339944 - DNA, 22 bp, Homo sapiens
gttctagcatggcatatttttc

SEQ ID NO: 6339945 - DNA, 18 bp, Homo sapiens
gttctaggaactcagtgc

SEQ ID NO: 6339946 - DNA, 23 bp, Homo sapiens
gttctaggcactgtagttctaag

SEQ ID NO: 6339947 - DNA, 19 bp, Homo sapiens
gttctaggcatacttttca

SEQ ID NO: 6339948 - DNA, 13 bp, Homo sapiens
gttctaggccccc

SEQ ID NO: 6339949 - DNA, 13 bp, Homo sapiens
gttctaggccttt

SEQ ID NO: 6339950 - DNA, 17 bp, Homo sapiens
gttctaggcctttcctc

SEQ ID NO: 6339951 - DNA, 21 bp, Homo sapiens
gttctaggcctttcctctgca

SEQ ID NO: 6339952 - DNA, 22 bp, Homo sapiens
gttctaggcctttcctctgcac

SEQ ID NO: 6339953 - DNA, 14 bp, Homo sapiens
gttctaggtttcaa

SEQ ID NO: 6339954 - DNA, 19 bp, Homo sapiens
gttctaggtttcaaagatg

SEQ ID NO: 6339955 - DNA, 14 bp, Homo sapiens
gttctagtactgta

SEQ ID NO: 6339956 - DNA, 14 bp, Homo sapiens
gttctagtctctct

SEQ ID NO: 6339957 - DNA, 14 bp, Homo sapiens
gttctagttgcttg

SEQ ID NO: 6339958 - DNA, 14 bp, Homo sapiens
gttctagttttcag

SEQ ID NO: 6339959 - DNA, 14 bp, Homo sapiens
gttctagtttttta

SEQ ID NO: 6339960 - DNA, 18 bp, Homo sapiens
gttctatagagcctggcg

SEQ ID NO: 6339961 - DNA, 18 bp, Homo sapiens
gttctatataaggaggaa

SEQ ID NO: 6339962 - DNA, 20 bp, Homo sapiens
gttctatataaggaggaaaa

SEQ ID NO: 6339963 - DNA, 17 bp, Homo sapiens
gttctatattctttatt

SEQ ID NO: 6339964 - DNA, 14 bp, Homo sapiens
gttctatccaaaca

SEQ ID NO: 6339965 - DNA, 14 bp, Homo sapiens
gttctatgaacaac

SEQ ID NO: 6339966 - DNA, 16 bp, Homo sapiens
gttctatgatatacaa

SEQ ID NO: 6339967 - DNA, 19 bp, Homo sapiens
gttctatggaccaaatgta

SEQ ID NO: 6339968 - DNA, 22 bp, Homo sapiens
gttctatggaccaaatgtaaaa

SEQ ID NO: 6339969 - DNA, 16 bp, Homo sapiens
gttctatggttatgaa

SEQ ID NO: 6339970 - DNA, 20 bp, Homo sapiens
gttctatggttatgaaagaa

SEQ ID NO: 6339971 - DNA, 16 bp, Homo sapiens
gttctatttaaaatgg

SEQ ID NO: 6339972 - DNA, 23 bp, Homo sapiens
gttctatttaacaactgggtcat

SEQ ID NO: 6339973 - DNA, 15 bp, Homo sapiens
gttctatttaatgga

SEQ ID NO: 6339974 - DNA, 17 bp, Homo sapiens
gttctatttatttattg

SEQ ID NO: 6339975 - DNA, 22 bp, Homo sapiens
gttctatttctatctgcaaata

SEQ ID NO: 6339976 - DNA, 16 bp, Homo sapiens
gttctatttcttgaag

SEQ ID NO: 6339977 - DNA, 13 bp, Homo sapiens
gttctatttgcta

SEQ ID NO: 6339978 - DNA, 22 bp, Homo sapiens
gttctatttgctttaatgagaa

SEQ ID NO: 6339979 - DNA, 14 bp, Homo sapiens
gttctattttactg

SEQ ID NO: 6339980 - DNA, 17 bp, Homo sapiens
gttctattttactgtct

SEQ ID NO: 6339981 - DNA, 13 bp, Homo sapiens
gttctattttctt

SEQ ID NO: 6339982 - DNA, 15 bp, Homo sapiens
gttctattttcttaa

SEQ ID NO: 6339983 - DNA, 17 bp, Homo sapiens
gttctattttcttaaac

SEQ ID NO: 6339984 - DNA, 16 bp, Homo sapiens
gttctatttttcaatc

SEQ ID NO: 6339985 - DNA, 18 bp, Homo sapiens
gttctcaaaccctgttta

SEQ ID NO: 6339986 - DNA, 16 bp, Homo sapiens
gttctcaacacacagt

SEQ ID NO: 6339987 - DNA, 23 bp, Homo sapiens
gttctcaacacacagtatagata

SEQ ID NO: 6339988 - DNA, 19 bp, Homo sapiens
gttctcaacatactgtaat

SEQ ID NO: 6339989 - DNA, 17 bp, Homo sapiens
gttctcaagaatctaga

SEQ ID NO: 6339990 - DNA, 20 bp, Homo sapiens
gttctcaagaatctagaaga

SEQ ID NO: 6339991 - DNA, 21 bp, Homo sapiens
gttctcaagaatctagaagat

SEQ ID NO: 6339992 - DNA, 21 bp, Homo sapiens
gttctcaatcattgtcagaga

SEQ ID NO: 6339993 - DNA, 23 bp, Homo sapiens
gttctcaatcattgtcagagatg

SEQ ID NO: 6339994 - DNA, 12 bp, Homo sapiens
gttctcaatgaa

SEQ ID NO: 6339995 - DNA, 13 bp, Homo sapiens
gttctcaatgaaa

SEQ ID NO: 6339996 - DNA, 14 bp, Homo sapiens
gttctcaatgaaaa

SEQ ID NO: 6339997 - DNA, 16 bp, Homo sapiens
gttctcaatgcttttc

SEQ ID NO: 6339998 - DNA, 17 bp, Homo sapiens
gttctcaatgcttttct

SEQ ID NO: 6339999 - DNA, 14 bp, Homo sapiens
gttctcaattccaa

SEQ ID NO: 6340000 - DNA, 17 bp, Homo sapiens
gttctcaattccaacag

SEQ ID NO: 6340001 - DNA, 21 bp, Homo sapiens
gttctcaattccaacagttta

SEQ ID NO: 6340002 - DNA, 12 bp, Homo sapiens
gttctcacaccc

SEQ ID NO: 6340003 - DNA, 12 bp, Homo sapiens
gttctcactgtt

SEQ ID NO: 6340004 - DNA, 19 bp, Homo sapiens
gttctcactgttccctctg

SEQ ID NO: 6340005 - DNA, 13 bp, Homo sapiens
gttctcagagcac

SEQ ID NO: 6340006 - DNA, 13 bp, Homo sapiens
gttctcagagctc

SEQ ID NO: 6340007 - DNA, 17 bp, Homo sapiens
gttctcagatcttgaca

SEQ ID NO: 6340008 - DNA, 10 bp, Homo sapiens
gttctcagca

SEQ ID NO: 6340009 - DNA, 15 bp, Homo sapiens
gttctcagcaagtgt

SEQ ID NO: 6340010 - DNA, 20 bp, Homo sapiens
gttctcagcaagtgtacagt

SEQ ID NO: 6340011 - DNA, 12 bp, Homo sapiens
gttctcagctcc

SEQ ID NO: 6340012 - DNA, 17 bp, Homo sapiens
gttctcagctccccctg

SEQ ID NO: 6340013 - DNA, 19 bp, Homo sapiens
gttctcagctccccctgtc

SEQ ID NO: 6340014 - DNA, 16 bp, Homo sapiens
gttctcaggggtgctg

SEQ ID NO: 6340015 - DNA, 13 bp, Homo sapiens
gttctcagtgccg

SEQ ID NO: 6340016 - DNA, 18 bp, Homo sapiens
gttctcagtgccggaggc

SEQ ID NO: 6340017 - DNA, 21 bp, Homo sapiens
gttctcagtggtcaccttcct

SEQ ID NO: 6340018 - DNA, 23 bp, Homo sapiens
gttctcatccacagaggccaggc

SEQ ID NO: 6340019 - DNA, 23 bp, Homo sapiens
gttctcatcccagtctgatattc

SEQ ID NO: 6340020 - DNA, 12 bp, Homo sapiens
gttctcatgaag

SEQ ID NO: 6340021 - DNA, 19 bp, Homo sapiens
gttctcatgaagcaggagg

SEQ ID NO: 6340022 - DNA, 23 bp, Homo sapiens
gttctcatgataccacctttact

SEQ ID NO: 6340023 - DNA, 13 bp, Homo sapiens
gttctcatttctc

SEQ ID NO: 6340024 - DNA, 22 bp, Homo sapiens
gttctcatttggtctgccagaa

SEQ ID NO: 6340025 - DNA, 17 bp, Homo sapiens
gttctccacccaccagt

SEQ ID NO: 6340026 - DNA, 22 bp, Homo sapiens
gttctccagaatgtaagaaaac

SEQ ID NO: 6340027 - DNA, 19 bp, Homo sapiens
gttctccagactctagatg

SEQ ID NO: 6340028 - DNA, 17 bp, Homo sapiens
gttctccagcccacacc

SEQ ID NO: 6340029 - DNA, 16 bp, Homo sapiens
gggtgggacacagaga

SEQ ID NO: 6340030 - DNA, 18 bp, Homo sapiens
gggtgggacagcctcttc

SEQ ID NO: 6340031 - DNA, 14 bp, Homo sapiens
gggtgggacagggc

SEQ ID NO: 6340032 - DNA, 22 bp, Homo sapiens
gggtgggacagggcttctcctg

SEQ ID NO: 6340033 - DNA, 12 bp, Homo sapiens
gggtgggactct

SEQ ID NO: 6340034 - DNA, 14 bp, Homo sapiens
gggtgggagagccc

SEQ ID NO: 6340035 - DNA, 13 bp, Homo sapiens
gggtgggagccaa

SEQ ID NO: 6340036 - DNA, 15 bp, Homo sapiens
gggtgggagccacag

SEQ ID NO: 6340037 - DNA, 19 bp, Homo sapiens
gggtgggagggaggaggga

SEQ ID NO: 6340038 - DNA, 17 bp, Homo sapiens
gggtgggagggcgtcag

SEQ ID NO: 6340039 - DNA, 15 bp, Homo sapiens
gggtgggaggggcca

SEQ ID NO: 6340040 - DNA, 21 bp, Homo sapiens
gggtgggagggggcagggggc

SEQ ID NO: 6340041 - DNA, 14 bp, Homo sapiens
gggtgggaggtagg

SEQ ID NO: 6340042 - DNA, 12 bp, Homo sapiens
gggtgggaggtg

SEQ ID NO: 6340043 - DNA, 17 bp, Homo sapiens
gggtgggatggaggaga

SEQ ID NO: 6340044 - DNA, 11 bp, Homo sapiens
gggtgggcagg

SEQ ID NO: 6340045 - DNA, 15 bp, Homo sapiens
gggtgggcaggaaaa

SEQ ID NO: 6340046 - DNA, 12 bp, Homo sapiens
gggtgggcaggg

SEQ ID NO: 6340047 - DNA, 15 bp, Homo sapiens
gggtgggcagggctg

SEQ ID NO: 6340048 - DNA, 16 bp, Homo sapiens
gggtgggcagggctgg

SEQ ID NO: 6340049 - DNA, 15 bp, Homo sapiens
gggtgggcagttttt

SEQ ID NO: 6340050 - DNA, 19 bp, Homo sapiens
gggtgggccaggctgatgg

SEQ ID NO: 6340051 - DNA, 21 bp, Homo sapiens
gggtgggcccagaactgcccc

SEQ ID NO: 6340052 - DNA, 11 bp, Homo sapiens
gggtgggcctc

SEQ ID NO: 6340053 - DNA, 13 bp, Homo sapiens
gggtgggcctcgg

SEQ ID NO: 6340054 - DNA, 12 bp, Homo sapiens
gggtgggcctgg

SEQ ID NO: 6340055 - DNA, 13 bp, Homo sapiens
gggtgggcctggc

SEQ ID NO: 6340056 - DNA, 19 bp, Homo sapiens
gggtgggcctggccctgct

SEQ ID NO: 6340057 - DNA, 20 bp, Homo sapiens
gggtgggcctggccctgctt

SEQ ID NO: 6340058 - DNA, 19 bp, Homo sapiens
gggtgggcctggcctgagc

SEQ ID NO: 6340059 - DNA, 23 bp, Homo sapiens
gggtgggcctggcctgagctggg

SEQ ID NO: 6340060 - DNA, 20 bp, Homo sapiens
gggtgggctgctggccatga

SEQ ID NO: 6340061 - DNA, 12 bp, Homo sapiens
gggtgggctgga

SEQ ID NO: 6340062 - DNA, 13 bp, Homo sapiens
gggtgggctgggg

SEQ ID NO: 6340063 - DNA, 22 bp, Homo sapiens
gggtgggcttttccctgggtgg

SEQ ID NO: 6340064 - DNA, 13 bp, Homo sapiens
gggtggggagaga

SEQ ID NO: 6340065 - DNA, 18 bp, Homo sapiens
gggtggggaggccctgcc

SEQ ID NO: 6340066 - DNA, 14 bp, Homo sapiens
gggtggggaggggc

SEQ ID NO: 6340067 - DNA, 11 bp, Homo sapiens
gggtggggatg

SEQ ID NO: 6340068 - DNA, 22 bp, Homo sapiens
gggtggggcagcacacctctgg

SEQ ID NO: 6340069 - DNA, 14 bp, Homo sapiens
gggtggggcagtgc

SEQ ID NO: 6340070 - DNA, 13 bp, Homo sapiens
gggtggggctcct

SEQ ID NO: 6340071 - DNA, 14 bp, Homo sapiens
gggtggggctgctc

SEQ ID NO: 6340072 - DNA, 14 bp, Homo sapiens
gggtggggctggtg

SEQ ID NO: 6340073 - DNA, 16 bp, Homo sapiens
gggtgggggagggaaa

SEQ ID NO: 6340074 - DNA, 14 bp, Homo sapiens
gggtgggggcagca

SEQ ID NO: 6340075 - DNA, 14 bp, Homo sapiens
gggtgggggccagg

SEQ ID NO: 6340076 - DNA, 17 bp, Homo sapiens
gggtgggggccaggcct

SEQ ID NO: 6340077 - DNA, 16 bp, Homo sapiens
gggtgggggcctgctg

SEQ ID NO: 6340078 - DNA, 24 bp, Homo sapiens
gggtgggggcctgctgtgggtcag

SEQ ID NO: 6340079 - DNA, 11 bp, Homo sapiens
gggtgggggtg

SEQ ID NO: 6340080 - DNA, 18 bp, Homo sapiens
gggtgggggtgctgctct

SEQ ID NO: 6340081 - DNA, 17 bp, Homo sapiens
gggtggggtagggctga

SEQ ID NO: 6340082 - DNA, 21 bp, Homo sapiens
gggtggggtcatgccctcctc

SEQ ID NO: 6340083 - DNA, 18 bp, Homo sapiens
gggtggggtgcctgagcc

SEQ ID NO: 6340084 - DNA, 16 bp, Homo sapiens
gggtggggtggctgca

SEQ ID NO: 6340085 - DNA, 12 bp, Homo sapiens
gggtggggtggg

SEQ ID NO: 6340086 - DNA, 21 bp, Homo sapiens
gggtggggttggggcaaagcc

SEQ ID NO: 6340087 - DNA, 21 bp, Homo sapiens
gggtgggtcagaaccctgcca

SEQ ID NO: 6340088 - DNA, 16 bp, Homo sapiens
gggtgggtgagagaga

SEQ ID NO: 6340089 - DNA, 14 bp, Homo sapiens
gggtgggtgctcag

SEQ ID NO: 6340090 - DNA, 18 bp, Homo sapiens
gggtggtacttggcacca

SEQ ID NO: 6340091 - DNA, 18 bp, Homo sapiens
gggtggtattctggtagg

SEQ ID NO: 6340092 - DNA, 16 bp, Homo sapiens
gggtggtctgagcacc

SEQ ID NO: 6340093 - DNA, 21 bp, Homo sapiens
gggtggtctgagcaccccctc

SEQ ID NO: 6340094 - DNA, 21 bp, Homo sapiens
gggtggtcttcaagcctggcc

SEQ ID NO: 6340095 - DNA, 22 bp, Homo sapiens
gggtggtcttcaagcctggccc

SEQ ID NO: 6340096 - DNA, 15 bp, Homo sapiens
gggtggtggcctggt

SEQ ID NO: 6340097 - DNA, 16 bp, Homo sapiens
gggtggtgggtgctgg

SEQ ID NO: 6340098 - DNA, 13 bp, Homo sapiens
gggtggtgtcaga

SEQ ID NO: 6340099 - DNA, 17 bp, Homo sapiens
gggtggttattggactc

SEQ ID NO: 6340100 - DNA, 15 bp, Homo sapiens
gggtggttctctggg

SEQ ID NO: 6340101 - DNA, 13 bp, Homo sapiens
gggtggtttttat

SEQ ID NO: 6340102 - DNA, 19 bp, Homo sapiens
gggtggtttttatttttat

SEQ ID NO: 6340103 - DNA, 18 bp, Homo sapiens
gggtgtaaaacctggaga

SEQ ID NO: 6340104 - DNA, 19 bp, Homo sapiens
gggtgtaacaggtctcctc

SEQ ID NO: 6340105 - DNA, 15 bp, Homo sapiens
gggtgtaacttcctg

SEQ ID NO: 6340106 - DNA, 22 bp, Homo sapiens
gggtgtaacttcctgctgcacc

SEQ ID NO: 6340107 - DNA, 19 bp, Homo sapiens
gggtgtaggtgaaaggcat

SEQ ID NO: 6340108 - DNA, 17 bp, Homo sapiens
gggtgtcacagaggcag

SEQ ID NO: 6340109 - DNA, 20 bp, Homo sapiens
gggtgtcacgagcccattct

SEQ ID NO: 6340110 - DNA, 19 bp, Homo sapiens
gggtgtcacggccaggcag

SEQ ID NO: 6340111 - DNA, 15 bp, Homo sapiens
gggtgtcagaagctg

SEQ ID NO: 6340112 - DNA, 11 bp, Homo sapiens
gggtgtcagta

SEQ ID NO: 6340113 - DNA, 20 bp, Homo sapiens
gggtgtccccaacagcgccc

SEQ ID NO: 6340114 - DNA, 21 bp, Homo sapiens
gggtgtcccctggtgcccctc

SEQ ID NO: 6340115 - DNA, 23 bp, Homo sapiens
gggtgtcctgcaccggggcctgg

SEQ ID NO: 6340116 - DNA, 22 bp, Homo sapiens
gggtgtcctgcctgtctgcccc

SEQ ID NO: 6340117 - DNA, 15 bp, Homo sapiens
gggtgtcttccctgc

SEQ ID NO: 6340118 - DNA, 15 bp, Homo sapiens
gggtgtcttgggcag

SEQ ID NO: 6340119 - DNA, 17 bp, Homo sapiens
gggtgtgaacatgttct

SEQ ID NO: 6340120 - DNA, 16 bp, Homo sapiens
gggtgtgccctggctc

SEQ ID NO: 6340121 - DNA, 17 bp, Homo sapiens
gggtgtgccctggctcc

SEQ ID NO: 6340122 - DNA, 22 bp, Homo sapiens
gggtgtgctccaggcttcctgc

SEQ ID NO: 6340123 - DNA, 15 bp, Homo sapiens
gggtgtggatggcag

SEQ ID NO: 6340124 - DNA, 21 bp, Homo sapiens
gggtgtggcacgcacctgtag

SEQ ID NO: 6340125 - DNA, 16 bp, Homo sapiens
gggtgtggccctgcca

SEQ ID NO: 6340126 - DNA, 11 bp, Homo sapiens
gggtgtggcct

SEQ ID NO: 6340127 - DNA, 12 bp, Homo sapiens
gggtgtggcctc

SEQ ID NO: 6340128 - DNA, 13 bp, Homo sapiens
gggtgtggcctca

SEQ ID NO: 6340129 - DNA, 22 bp, Homo sapiens
gggtgtggctcgggtgcccagg

SEQ ID NO: 6340130 - DNA, 13 bp, Homo sapiens
gggtgtggctctg

SEQ ID NO: 6340131 - DNA, 12 bp, Homo sapiens
gggtgtggcttg

SEQ ID NO: 6340132 - DNA, 16 bp, Homo sapiens
gggtgtgggaggcccg

SEQ ID NO: 6340133 - DNA, 17 bp, Homo sapiens
gggtgtgggagtgaggg

SEQ ID NO: 6340134 - DNA, 22 bp, Homo sapiens
gggtgtggtatgagggggtggt

SEQ ID NO: 6340135 - DNA, 20 bp, Homo sapiens
gggtgttccaaagagaaggc

SEQ ID NO: 6340136 - DNA, 19 bp, Homo sapiens
gggtgttctttcctgccct

SEQ ID NO: 6340137 - DNA, 18 bp, Homo sapiens
gggtgttgtatggggagg

SEQ ID NO: 6340138 - DNA, 20 bp, Homo sapiens
gggtgttgtgagagctggga

SEQ ID NO: 6340139 - DNA, 22 bp, Homo sapiens
gggtgtttattacaagtggctc

SEQ ID NO: 6340140 - DNA, 19 bp, Homo sapiens
gggtgtttgcagctgtgag

SEQ ID NO: 6340141 - DNA, 22 bp, Homo sapiens
gggtgtttgggaaaggcagggc

SEQ ID NO: 6340142 - DNA, 19 bp, Homo sapiens
gggtgttttttttttttct

SEQ ID NO: 6340143 - DNA, 14 bp, Homo sapiens
gggttaaagaaagg

SEQ ID NO: 6340144 - DNA, 20 bp, Homo sapiens
gggttaaagaaaggcagaga

SEQ ID NO: 6340145 - DNA, 20 bp, Homo sapiens
gggttaaatattttgctaac

SEQ ID NO: 6340146 - DNA, 14 bp, Homo sapiens
gggttaacaaatga

SEQ ID NO: 6340147 - DNA, 18 bp, Homo sapiens
gggttaacagtaaatata

SEQ ID NO: 6340148 - DNA, 21 bp, Homo sapiens
gggttaacttggtcagagcca

SEQ ID NO: 6340149 - DNA, 16 bp, Homo sapiens
gggttaagaagacttt

SEQ ID NO: 6340150 - DNA, 14 bp, Homo sapiens
gggttaaggcctga

SEQ ID NO: 6340151 - DNA, 19 bp, Homo sapiens
gggttacttgctgctcaca

SEQ ID NO: 6340152 - DNA, 17 bp, Homo sapiens
gggttagagccaagctg

SEQ ID NO: 6340153 - DNA, 19 bp, Homo sapiens
gggttagagccaagctgca

SEQ ID NO: 6340154 - DNA, 21 bp, Homo sapiens
gggttagagccaagctgcaca

SEQ ID NO: 6340155 - DNA, 18 bp, Homo sapiens
gggttagatgttgccatg

SEQ ID NO: 6340156 - DNA, 16 bp, Homo sapiens
gggttagcaatattta

SEQ ID NO: 6340157 - DNA, 17 bp, Homo sapiens
gggttagcaatatttat

SEQ ID NO: 6340158 - DNA, 22 bp, Homo sapiens
gggttagcctgcaccgccgcca

SEQ ID NO: 6340159 - DNA, 12 bp, Homo sapiens
gggttataatca

SEQ ID NO: 6340160 - DNA, 20 bp, Homo sapiens
gggttatgtgtatgtgccat

SEQ ID NO: 6340161 - DNA, 19 bp, Homo sapiens
gggttatttttattaaatg

SEQ ID NO: 6340162 - DNA, 19 bp, Homo sapiens
gggttatttttgtccctgc

SEQ ID NO: 6340163 - DNA, 22 bp, Homo sapiens
gggttatttttgtccctgctcc

SEQ ID NO: 6340164 - DNA, 16 bp, Homo sapiens
gggttcaaaatgtctg

SEQ ID NO: 6340165 - DNA, 21 bp, Homo sapiens
gggttcaagagattctgcctc

SEQ ID NO: 6340166 - DNA, 23 bp, Homo sapiens
gggttcaagcaatcctcctgcct

SEQ ID NO: 6340167 - DNA, 22 bp, Homo sapiens
gggttcaagcgattcttctgct

SEQ ID NO: 6340168 - DNA, 23 bp, Homo sapiens
gggttcacgtaatcctcctgagt

SEQ ID NO: 6340169 - DNA, 18 bp, Homo sapiens
gggttcactagagctggg

SEQ ID NO: 6340170 - DNA, 19 bp, Homo sapiens
gggttcagaaatgctgcct

SEQ ID NO: 6340171 - DNA, 16 bp, Homo sapiens
gggttcagcccctcct

SEQ ID NO: 6340172 - DNA, 16 bp, Homo sapiens
gggttcagcctggcct

SEQ ID NO: 6340173 - DNA, 17 bp, Homo sapiens
gggttcagcctggcctg

SEQ ID NO: 6340174 - DNA, 21 bp, Homo sapiens
gggttcataggtcactggctc

SEQ ID NO: 6340175 - DNA, 15 bp, Homo sapiens
gggttcatctgtcca

SEQ ID NO: 6340176 - DNA, 14 bp, Homo sapiens
gggttcatgatgca

SEQ ID NO: 6340177 - DNA, 14 bp, Homo sapiens
gggttcatttgtgt

SEQ ID NO: 6340178 - DNA, 11 bp, Homo sapiens
gggttccaaat

SEQ ID NO: 6340179 - DNA, 12 bp, Homo sapiens
gggttccagaca

SEQ ID NO: 6340180 - DNA, 13 bp, Homo sapiens
gggttccagacag

SEQ ID NO: 6340181 - DNA, 16 bp, Homo sapiens
gggttccagcttccct

SEQ ID NO: 6340182 - DNA, 17 bp, Homo sapiens
gggttcccactggctcc

SEQ ID NO: 6340183 - DNA, 21 bp, Homo sapiens
gggttcccactggctcctcca

SEQ ID NO: 6340184 - DNA, 20 bp, Homo sapiens
gggttccccacacagggcac

SEQ ID NO: 6340185 - DNA, 14 bp, Homo sapiens
gggttcccccagcc

SEQ ID NO: 6340186 - DNA, 21 bp, Homo sapiens
gggttccctttccttccatcc

SEQ ID NO: 6340187 - DNA, 21 bp, Homo sapiens
gggttccgtgtccacccccat

SEQ ID NO: 6340188 - DNA, 17 bp, Homo sapiens
gggttcctcaaattttt

SEQ ID NO: 6340189 - DNA, 17 bp, Homo sapiens
gggttcctcccctccag

SEQ ID NO: 6340190 - DNA, 18 bp, Homo sapiens
gggttcctcccctccagc

SEQ ID NO: 6340191 - DNA, 14 bp, Homo sapiens
gggttcctgctgtg

SEQ ID NO: 6340192 - DNA, 22 bp, Homo sapiens
gggttcctggttgttcctgcat

SEQ ID NO: 6340193 - DNA, 21 bp, Homo sapiens
gggttccttcctctgagcctt

SEQ ID NO: 6340194 - DNA, 13 bp, Homo sapiens
gggttcgggaaga

SEQ ID NO: 6340195 - DNA, 18 bp, Homo sapiens
gggttcgtggaaagggtg

SEQ ID NO: 6340196 - DNA, 16 bp, Homo sapiens
gggttcgttggggaca

SEQ ID NO: 6340197 - DNA, 11 bp, Homo sapiens
gggttctagac

SEQ ID NO: 6340198 - DNA, 12 bp, Homo sapiens
gggttctagacg

SEQ ID NO: 6340199 - DNA, 22 bp, Homo sapiens
gggttctaggcatctctgtact

SEQ ID NO: 6340200 - DNA, 16 bp, Homo sapiens
gggttctcaattctgt

SEQ ID NO: 6340201 - DNA, 15 bp, Homo sapiens
gggttctcacagtgg

SEQ ID NO: 6340202 - DNA, 15 bp, Homo sapiens
gggttctcagtgccg

SEQ ID NO: 6340203 - DNA, 17 bp, Homo sapiens
gggttctccccctcctg

SEQ ID NO: 6340204 - DNA, 16 bp, Homo sapiens
gggttctcctctcccc

SEQ ID NO: 6340205 - DNA, 19 bp, Homo sapiens
gggttctctgctgtcctaa

SEQ ID NO: 6340206 - DNA, 21 bp, Homo sapiens
gggttctcttcattcccactg

SEQ ID NO: 6340207 - DNA, 21 bp, Homo sapiens
gggttctgccctgcctgagga

SEQ ID NO: 6340208 - DNA, 20 bp, Homo sapiens
gggttctgcctgccagctgc

SEQ ID NO: 6340209 - DNA, 22 bp, Homo sapiens
gttctccagcccacacccctcc

SEQ ID NO: 6340210 - DNA, 18 bp, Homo sapiens
gttctccagtcattatgt

SEQ ID NO: 6340211 - DNA, 20 bp, Homo sapiens
gttctcccagcactgcctcc

SEQ ID NO: 6340212 - DNA, 12 bp, Homo sapiens
gttctcccaggg

SEQ ID NO: 6340213 - DNA, 14 bp, Homo sapiens
gttctcccagggag

SEQ ID NO: 6340214 - DNA, 17 bp, Homo sapiens
gttctcccagggagtga

SEQ ID NO: 6340215 - DNA, 22 bp, Homo sapiens
gttctcccagggagtgagcagc

SEQ ID NO: 6340216 - DNA, 13 bp, Homo sapiens
gttctccccaggg

SEQ ID NO: 6340217 - DNA, 16 bp, Homo sapiens
gttctccccctcctga

SEQ ID NO: 6340218 - DNA, 15 bp, Homo sapiens
gttctccctttctct

SEQ ID NO: 6340219 - DNA, 18 bp, Homo sapiens
gttctccgggtgtggcct

SEQ ID NO: 6340220 - DNA, 23 bp, Homo sapiens
gttctccgggtgtggcctcagcc

SEQ ID NO: 6340221 - DNA, 22 bp, Homo sapiens
gttctccgttagctcctgtggc

SEQ ID NO: 6340222 - DNA, 20 bp, Homo sapiens
gttctcctatatcctccttc

SEQ ID NO: 6340223 - DNA, 18 bp, Homo sapiens
gttctcctccaaatgctg

SEQ ID NO: 6340224 - DNA, 14 bp, Homo sapiens
gttctcctcgtcca

SEQ ID NO: 6340225 - DNA, 18 bp, Homo sapiens
gttctcctgctgctccct

SEQ ID NO: 6340226 - DNA, 22 bp, Homo sapiens
gttctcctgctgctccctcaga

SEQ ID NO: 6340227 - DNA, 14 bp, Homo sapiens
gttctcctgcttgt

SEQ ID NO: 6340228 - DNA, 18 bp, Homo sapiens
gttctcctggaggcaggg

SEQ ID NO: 6340229 - DNA, 13 bp, Homo sapiens
gttctcctgtccc

SEQ ID NO: 6340230 - DNA, 14 bp, Homo sapiens
gttctcgtgccctt

SEQ ID NO: 6340231 - DNA, 19 bp, Homo sapiens
gttctcgttttgggccaga

SEQ ID NO: 6340232 - DNA, 19 bp, Homo sapiens
gttctctactccctcttgt

SEQ ID NO: 6340233 - DNA, 21 bp, Homo sapiens
gttctctactccctcttgtca

SEQ ID NO: 6340234 - DNA, 14 bp, Homo sapiens
gttctctagaaaga

SEQ ID NO: 6340235 - DNA, 18 bp, Homo sapiens
gttctctatcatttaata

SEQ ID NO: 6340236 - DNA, 22 bp, Homo sapiens
gttctctcatcggaggcccatg

SEQ ID NO: 6340237 - DNA, 18 bp, Homo sapiens
gttctctctatggtaaag

SEQ ID NO: 6340238 - DNA, 10 bp, Homo sapiens
gttctctgaa

SEQ ID NO: 6340239 - DNA, 12 bp, Homo sapiens
gttctctgagga

SEQ ID NO: 6340240 - DNA, 14 bp, Homo sapiens
gttctctgaggaca

SEQ ID NO: 6340241 - DNA, 16 bp, Homo sapiens
gttctctgatgcagaa

SEQ ID NO: 6340242 - DNA, 17 bp, Homo sapiens
gttctctgatgcagaaa

SEQ ID NO: 6340243 - DNA, 15 bp, Homo sapiens
gttctctgccctcca

SEQ ID NO: 6340244 - DNA, 17 bp, Homo sapiens
gttctctgccctccaag

SEQ ID NO: 6340245 - DNA, 12 bp, Homo sapiens
gttctctgcctt

SEQ ID NO: 6340246 - DNA, 14 bp, Homo sapiens
gttctctgctgtcc

SEQ ID NO: 6340247 - DNA, 12 bp, Homo sapiens
gttctctgcttg

SEQ ID NO: 6340248 - DNA, 21 bp, Homo sapiens
gttctctgggagaaaatcatc

SEQ ID NO: 6340249 - DNA, 19 bp, Homo sapiens
gttctctggtttcaccagc

SEQ ID NO: 6340250 - DNA, 14 bp, Homo sapiens
gttctctgtaatta

SEQ ID NO: 6340251 - DNA, 19 bp, Homo sapiens
gttctctgtaattacaact

SEQ ID NO: 6340252 - DNA, 14 bp, Homo sapiens
gttctctgtcctac

SEQ ID NO: 6340253 - DNA, 14 bp, Homo sapiens
gttctcttcattcc

SEQ ID NO: 6340254 - DNA, 18 bp, Homo sapiens
gttctcttcccaggcctt

SEQ ID NO: 6340255 - DNA, 20 bp, Homo sapiens
gttctcttcccaggcctttg

SEQ ID NO: 6340256 - DNA, 12 bp, Homo sapiens
gttctcttctcc

SEQ ID NO: 6340257 - DNA, 15 bp, Homo sapiens
gttctcttctcctgt

SEQ ID NO: 6340258 - DNA, 16 bp, Homo sapiens
gttctcttctcctgtg

SEQ ID NO: 6340259 - DNA, 11 bp, Homo sapiens
gttctctttaa

SEQ ID NO: 6340260 - DNA, 15 bp, Homo sapiens
gttctctttgctgac

SEQ ID NO: 6340261 - DNA, 18 bp, Homo sapiens
gttctctttgctgacact

SEQ ID NO: 6340262 - DNA, 12 bp, Homo sapiens
gttctctttgga

SEQ ID NO: 6340263 - DNA, 15 bp, Homo sapiens
gttctgaaataaact

SEQ ID NO: 6340264 - DNA, 14 bp, Homo sapiens
gttctgaaattaaa

SEQ ID NO: 6340265 - DNA, 13 bp, Homo sapiens
gttctgaagaaga

SEQ ID NO: 6340266 - DNA, 14 bp, Homo sapiens
gttctgaagaagat

SEQ ID NO: 6340267 - DNA, 18 bp, Homo sapiens
gttctgaaggtgcccagg

SEQ ID NO: 6340268 - DNA, 21 bp, Homo sapiens
gttctgaaggttggaactgct

SEQ ID NO: 6340269 - DNA, 21 bp, Homo sapiens
gttctgaagtgggaaaaaata

SEQ ID NO: 6340270 - DNA, 15 bp, Homo sapiens
gttctgaataatttc

SEQ ID NO: 6340271 - DNA, 16 bp, Homo sapiens
gttctgacattaacag

SEQ ID NO: 6340272 - DNA, 21 bp, Homo sapiens
gttctgacattaacagttttc

SEQ ID NO: 6340273 - DNA, 22 bp, Homo sapiens
gttctgaccgggtctgcttctg

SEQ ID NO: 6340274 - DNA, 13 bp, Homo sapiens
gttctgactttga

SEQ ID NO: 6340275 - DNA, 16 bp, Homo sapiens
gttctgagaagcgctg

SEQ ID NO: 6340276 - DNA, 20 bp, Homo sapiens
gttctgagaagcgctgccct

SEQ ID NO: 6340277 - DNA, 21 bp, Homo sapiens
gttctgagaagcgctgccctg

SEQ ID NO: 6340278 - DNA, 13 bp, Homo sapiens
gttctgagaccag

SEQ ID NO: 6340279 - DNA, 20 bp, Homo sapiens
gttctgagatggctcccagg

SEQ ID NO: 6340280 - DNA, 22 bp, Homo sapiens
gttctgagattattttaatcta

SEQ ID NO: 6340281 - DNA, 19 bp, Homo sapiens
gttctgagcccccacctgc

SEQ ID NO: 6340282 - DNA, 18 bp, Homo sapiens
gttctgagctgccagtgg

SEQ ID NO: 6340283 - DNA, 16 bp, Homo sapiens
gttctgaggccagaaa

SEQ ID NO: 6340284 - DNA, 18 bp, Homo sapiens
gttctgaggccagaaagg

SEQ ID NO: 6340285 - DNA, 19 bp, Homo sapiens
gttctgaggccagaaaggt

SEQ ID NO: 6340286 - DNA, 23 bp, Homo sapiens
gttctgaggggtgtccgagaggc

SEQ ID NO: 6340287 - DNA, 20 bp, Homo sapiens
gttctgagtaagtgtgttca

SEQ ID NO: 6340288 - DNA, 18 bp, Homo sapiens
gttctgagtcctgagact

SEQ ID NO: 6340289 - DNA, 14 bp, Homo sapiens
gttctgagtgtttt

SEQ ID NO: 6340290 - DNA, 14 bp, Homo sapiens
gttctgatgtctta

SEQ ID NO: 6340291 - DNA, 14 bp, Homo sapiens
gttctgattagaaa

SEQ ID NO: 6340292 - DNA, 18 bp, Homo sapiens
gttctgattagaaatgac

SEQ ID NO: 6340293 - DNA, 15 bp, Homo sapiens
gttctgcaaaataca

SEQ ID NO: 6340294 - DNA, 15 bp, Homo sapiens
gttctgcaaatagaa

SEQ ID NO: 6340295 - DNA, 19 bp, Homo sapiens
gttctgcaaatagaaaaca

SEQ ID NO: 6340296 - DNA, 22 bp, Homo sapiens
gttctgcaagaattaaaactga

SEQ ID NO: 6340297 - DNA, 16 bp, Homo sapiens
gttctgcactcctgga

SEQ ID NO: 6340298 - DNA, 21 bp, Homo sapiens
gttctgcagagacttctagga

SEQ ID NO: 6340299 - DNA, 17 bp, Homo sapiens
gttctgccacctctgac

SEQ ID NO: 6340300 - DNA, 12 bp, Homo sapiens
gttctgccactt

SEQ ID NO: 6340301 - DNA, 15 bp, Homo sapiens
gttctgccacttagg

SEQ ID NO: 6340302 - DNA, 18 bp, Homo sapiens
gttctgccacttgcactg

SEQ ID NO: 6340303 - DNA, 21 bp, Homo sapiens
gttctgccacttgcactgtgc

SEQ ID NO: 6340304 - DNA, 15 bp, Homo sapiens
gttctgccagatctt

SEQ ID NO: 6340305 - DNA, 14 bp, Homo sapiens
gttctgccaggaga

SEQ ID NO: 6340306 - DNA, 14 bp, Homo sapiens
gttctgccaggcaa

SEQ ID NO: 6340307 - DNA, 19 bp, Homo sapiens
gttctgcccccagcccaaa

SEQ ID NO: 6340308 - DNA, 13 bp, Homo sapiens
gttctgcctctcc

SEQ ID NO: 6340309 - DNA, 17 bp, Homo sapiens
gttctgcctctccctgg

SEQ ID NO: 6340310 - DNA, 23 bp, Homo sapiens
gttctgcctgccagctgcactga

SEQ ID NO: 6340311 - DNA, 12 bp, Homo sapiens
gttctgcctgga

SEQ ID NO: 6340312 - DNA, 19 bp, Homo sapiens
gttctgctaaatttcaaat

SEQ ID NO: 6340313 - DNA, 20 bp, Homo sapiens
gttctgctagagcagacagg

SEQ ID NO: 6340314 - DNA, 14 bp, Homo sapiens
gttctgctcagagg

SEQ ID NO: 6340315 - DNA, 18 bp, Homo sapiens
gttctgctcatcattctc

SEQ ID NO: 6340316 - DNA, 23 bp, Homo sapiens
gttctgctcatcattctctgtct

SEQ ID NO: 6340317 - DNA, 16 bp, Homo sapiens
gttctgctccagacag

SEQ ID NO: 6340318 - DNA, 17 bp, Homo sapiens
gttctgctccagacagg

SEQ ID NO: 6340319 - DNA, 14 bp, Homo sapiens
gttctgctccatac

SEQ ID NO: 6340320 - DNA, 21 bp, Homo sapiens
gttctgctcccagatgccttc

SEQ ID NO: 6340321 - DNA, 17 bp, Homo sapiens
gttctgctcctctccag

SEQ ID NO: 6340322 - DNA, 22 bp, Homo sapiens
gttctgctcctctccaggcacc

SEQ ID NO: 6340323 - DNA, 15 bp, Homo sapiens
gttctgctcctgctt

SEQ ID NO: 6340324 - DNA, 16 bp, Homo sapiens
gttctgctgaccaaat

SEQ ID NO: 6340325 - DNA, 21 bp, Homo sapiens
gttctgctgatatcaacagct

SEQ ID NO: 6340326 - DNA, 14 bp, Homo sapiens
gttctgctggcctg

SEQ ID NO: 6340327 - DNA, 12 bp, Homo sapiens
gttctgctgtct

SEQ ID NO: 6340328 - DNA, 21 bp, Homo sapiens
gttctgctttctgatacatct

SEQ ID NO: 6340329 - DNA, 18 bp, Homo sapiens
gttctgctttctgcctct

SEQ ID NO: 6340330 - DNA, 17 bp, Homo sapiens
gttctgcttttaagttt

SEQ ID NO: 6340331 - DNA, 11 bp, Homo sapiens
gttctggaaat

SEQ ID NO: 6340332 - DNA, 22 bp, Homo sapiens
gttctggactacacccaagcct

SEQ ID NO: 6340333 - DNA, 17 bp, Homo sapiens
gttctggactctgcccc

SEQ ID NO: 6340334 - DNA, 11 bp, Homo sapiens
gttctggagga

SEQ ID NO: 6340335 - DNA, 17 bp, Homo sapiens
gttctggatggtgtgcc

SEQ ID NO: 6340336 - DNA, 14 bp, Homo sapiens
gttctggatgtaaa

SEQ ID NO: 6340337 - DNA, 16 bp, Homo sapiens
gttctggccagaatgc

SEQ ID NO: 6340338 - DNA, 17 bp, Homo sapiens
gttctggcctcagacca

SEQ ID NO: 6340339 - DNA, 19 bp, Homo sapiens
gttctggcctctggcctgg

SEQ ID NO: 6340340 - DNA, 12 bp, Homo sapiens
gttctggctctt

SEQ ID NO: 6340341 - DNA, 20 bp, Homo sapiens
gttctggctgccccaacctg

SEQ ID NO: 6340342 - DNA, 19 bp, Homo sapiens
gttctggctttacatttta

SEQ ID NO: 6340343 - DNA, 21 bp, Homo sapiens
gttctggctttacattttatt

SEQ ID NO: 6340344 - DNA, 16 bp, Homo sapiens
gttctgggacacagtt

SEQ ID NO: 6340345 - DNA, 23 bp, Homo sapiens
gttctgggacacagttcaattct

SEQ ID NO: 6340346 - DNA, 17 bp, Homo sapiens
gttctgggactccaggt

SEQ ID NO: 6340347 - DNA, 21 bp, Homo sapiens
gttctgggagttgctgttaat

SEQ ID NO: 6340348 - DNA, 21 bp, Homo sapiens
gttctgggcatggcagggcca

SEQ ID NO: 6340349 - DNA, 14 bp, Homo sapiens
gttctgggctcagg

SEQ ID NO: 6340350 - DNA, 18 bp, Homo sapiens
gttctgggctctttcctc

SEQ ID NO: 6340351 - DNA, 15 bp, Homo sapiens
gttctgggctggggc

SEQ ID NO: 6340352 - DNA, 17 bp, Homo sapiens
gttctggggaggaaggg

SEQ ID NO: 6340353 - DNA, 15 bp, Homo sapiens
gttctggggcccctt

SEQ ID NO: 6340354 - DNA, 22 bp, Homo sapiens
gttctggggcccgcctgccacc

SEQ ID NO: 6340355 - DNA, 15 bp, Homo sapiens
gttctggggctgaga

SEQ ID NO: 6340356 - DNA, 16 bp, Homo sapiens
gttctggggctgagag

SEQ ID NO: 6340357 - DNA, 14 bp, Homo sapiens
gttctggggggacc

SEQ ID NO: 6340358 - DNA, 10 bp, Homo sapiens
gttctgggtg

SEQ ID NO: 6340359 - DNA, 18 bp, Homo sapiens
gttctgggtgataatttt

SEQ ID NO: 6340360 - DNA, 23 bp, Homo sapiens
gttctgggtgatggaaactgcca

SEQ ID NO: 6340361 - DNA, 11 bp, Homo sapiens
gttctgggtgg

SEQ ID NO: 6340362 - DNA, 22 bp, Homo sapiens
gttctggtatgcattctttata

SEQ ID NO: 6340363 - DNA, 16 bp, Homo sapiens
gttctggtatttcccc

SEQ ID NO: 6340364 - DNA, 20 bp, Homo sapiens
gttctggtatttcccctgtc

SEQ ID NO: 6340365 - DNA, 14 bp, Homo sapiens
gttctggtgaggcc

SEQ ID NO: 6340366 - DNA, 15 bp, Homo sapiens
gttctggtgaggcct

SEQ ID NO: 6340367 - DNA, 23 bp, Homo sapiens
gttctggttagctcagccccagc

SEQ ID NO: 6340368 - DNA, 20 bp, Homo sapiens
gttctggttcatgcagacaa

SEQ ID NO: 6340369 - DNA, 22 bp, Homo sapiens
gttctggttccatttttcctct

SEQ ID NO: 6340370 - DNA, 22 bp, Homo sapiens
gttctgtaaaatggaaaactta

SEQ ID NO: 6340371 - DNA, 22 bp, Homo sapiens
gttctgtagaaatggttgtatt

SEQ ID NO: 6340372 - DNA, 18 bp, Homo sapiens
gttctgtagactgccatc

SEQ ID NO: 6340373 - DNA, 16 bp, Homo sapiens
gttctgtagattcatg

SEQ ID NO: 6340374 - DNA, 21 bp, Homo sapiens
gttctgtagcttatctgcccc

SEQ ID NO: 6340375 - DNA, 18 bp, Homo sapiens
gttctgtagctttctgga

SEQ ID NO: 6340376 - DNA, 22 bp, Homo sapiens
gttctgtaggagagactggcca

SEQ ID NO: 6340377 - DNA, 16 bp, Homo sapiens
gttctgtataaaatgc

SEQ ID NO: 6340378 - DNA, 10 bp, Homo sapiens
gttctgtatt

SEQ ID NO: 6340379 - DNA, 11 bp, Homo sapiens
gttctgtattg

SEQ ID NO: 6340380 - DNA, 12 bp, Homo sapiens
gttctgtatttg

SEQ ID NO: 6340381 - DNA, 14 bp, Homo sapiens
gttctgtatttgaa

SEQ ID NO: 6340382 - DNA, 16 bp, Homo sapiens
gttctgtattttaaga

SEQ ID NO: 6340383 - DNA, 14 bp, Homo sapiens
gttctgtcttccca

SEQ ID NO: 6340384 - DNA, 12 bp, Homo sapiens
gttctgtgaaga

SEQ ID NO: 6340385 - DNA, 13 bp, Homo sapiens
gttctgtgaatag

SEQ ID NO: 6340386 - DNA, 19 bp, Homo sapiens
gttctgtgacatcctgctt

SEQ ID NO: 6340387 - DNA, 18 bp, Homo sapiens
gttctgtgacccatctgt

SEQ ID NO: 6340388 - DNA, 16 bp, Homo sapiens
gttctgtgactaggaa

SEQ ID NO: 6340389 - DNA, 18 bp, Homo sapiens
gttctgtgatagagcaga

SEQ ID NO: 6340390 - DNA, 21 bp, Homo sapiens
gggttctgcctgccagctgca

SEQ ID NO: 6340391 - DNA, 15 bp, Homo sapiens
gggttctgctgggac

SEQ ID NO: 6340392 - DNA, 17 bp, Homo sapiens
gggttctggcaggacct

SEQ ID NO: 6340393 - DNA, 22 bp, Homo sapiens
gggttctgtaaaatggaaaact

SEQ ID NO: 6340394 - DNA, 12 bp, Homo sapiens
gggttctgtatt

SEQ ID NO: 6340395 - DNA, 16 bp, Homo sapiens
gggttcttgagccagc

SEQ ID NO: 6340396 - DNA, 12 bp, Homo sapiens
gggttgaaaatt

SEQ ID NO: 6340397 - DNA, 12 bp, Homo sapiens
gggttgaagaaa

SEQ ID NO: 6340398 - DNA, 20 bp, Homo sapiens
gggttgaagacggaaaacaa

SEQ ID NO: 6340399 - DNA, 17 bp, Homo sapiens
gggttgaaggcagtctg

SEQ ID NO: 6340400 - DNA, 14 bp, Homo sapiens
gggttgagagccag

SEQ ID NO: 6340401 - DNA, 15 bp, Homo sapiens
gggttgagagccagt

SEQ ID NO: 6340402 - DNA, 18 bp, Homo sapiens
gggttgcatcagaaatgt

SEQ ID NO: 6340403 - DNA, 19 bp, Homo sapiens
gggttgccacaggcctccc

SEQ ID NO: 6340404 - DNA, 18 bp, Homo sapiens
gggttgccagaggccctg

SEQ ID NO: 6340405 - DNA, 17 bp, Homo sapiens
gggttgccagtcctgca

SEQ ID NO: 6340406 - DNA, 17 bp, Homo sapiens
gggttgcccagcctgga

SEQ ID NO: 6340407 - DNA, 14 bp, Homo sapiens
gggttgcctcgagt

SEQ ID NO: 6340408 - DNA, 22 bp, Homo sapiens
gggttgcgggggagctggaaat

SEQ ID NO: 6340409 - DNA, 20 bp, Homo sapiens
gggttgctggtcctgcacat

SEQ ID NO: 6340410 - DNA, 16 bp, Homo sapiens
gggttgcttgggccac

SEQ ID NO: 6340411 - DNA, 15 bp, Homo sapiens
gggttggaggcctca

SEQ ID NO: 6340412 - DNA, 17 bp, Homo sapiens
gggttggaggcctcacc

SEQ ID NO: 6340413 - DNA, 18 bp, Homo sapiens
gggttggatgggaagatg

SEQ ID NO: 6340414 - DNA, 13 bp, Homo sapiens
gggttggcagccc

SEQ ID NO: 6340415 - DNA, 12 bp, Homo sapiens
gggttggcagcg

SEQ ID NO: 6340416 - DNA, 20 bp, Homo sapiens
gggttggctgggcccagaag

SEQ ID NO: 6340417 - DNA, 13 bp, Homo sapiens
gggttggctgggt

SEQ ID NO: 6340418 - DNA, 14 bp, Homo sapiens
gggttggctgggta

SEQ ID NO: 6340419 - DNA, 15 bp, Homo sapiens
gggttggggtggggc

SEQ ID NO: 6340420 - DNA, 22 bp, Homo sapiens
gggttggggtggttgaggctaa

SEQ ID NO: 6340421 - DNA, 15 bp, Homo sapiens
gggttgggttccaga

SEQ ID NO: 6340422 - DNA, 13 bp, Homo sapiens
gggttggtcaagg

SEQ ID NO: 6340423 - DNA, 18 bp, Homo sapiens
gggttggtcctcttgcct

SEQ ID NO: 6340424 - DNA, 19 bp, Homo sapiens
gggttggtgcacagtgatt

SEQ ID NO: 6340425 - DNA, 15 bp, Homo sapiens
gggttggtgggaggg

SEQ ID NO: 6340426 - DNA, 20 bp, Homo sapiens
gggttggtgggctggcccag

SEQ ID NO: 6340427 - DNA, 14 bp, Homo sapiens
gggttggtgtgctg

SEQ ID NO: 6340428 - DNA, 23 bp, Homo sapiens
gggttgtaaattggcatggaaat

SEQ ID NO: 6340429 - DNA, 21 bp, Homo sapiens
gggttgtctcagccgagccca

SEQ ID NO: 6340430 - DNA, 15 bp, Homo sapiens
gggttgttcacctct

SEQ ID NO: 6340431 - DNA, 13 bp, Homo sapiens
gggttgttgcaga

SEQ ID NO: 6340432 - DNA, 17 bp, Homo sapiens
gggttgttgggaggagg

SEQ ID NO: 6340433 - DNA, 20 bp, Homo sapiens
gggtttcaccatgttagcca

SEQ ID NO: 6340434 - DNA, 20 bp, Homo sapiens
gggtttcaccgtgttagcca

SEQ ID NO: 6340435 - DNA, 16 bp, Homo sapiens
gggtttcacctgcagg

SEQ ID NO: 6340436 - DNA, 20 bp, Homo sapiens
gggtttcatcgtgttaacca

SEQ ID NO: 6340437 - DNA, 21 bp, Homo sapiens
gggtttcattgtgtgttagca

SEQ ID NO: 6340438 - DNA, 18 bp, Homo sapiens
gggtttccacacaggccc

SEQ ID NO: 6340439 - DNA, 15 bp, Homo sapiens
gggtttcccttgccc

SEQ ID NO: 6340440 - DNA, 20 bp, Homo sapiens
gggtttcctgcatggacagt

SEQ ID NO: 6340441 - DNA, 16 bp, Homo sapiens
gggtttcgactggtcc

SEQ ID NO: 6340442 - DNA, 17 bp, Homo sapiens
gggtttcgactggtcca

SEQ ID NO: 6340443 - DNA, 17 bp, Homo sapiens
gggtttcgagaagctgc

SEQ ID NO: 6340444 - DNA, 22 bp, Homo sapiens
gggtttctgacccaagaggtgg

SEQ ID NO: 6340445 - DNA, 16 bp, Homo sapiens
gggtttcttaaatata

SEQ ID NO: 6340446 - DNA, 15 bp, Homo sapiens
gggtttggccaggga

SEQ ID NO: 6340447 - DNA, 17 bp, Homo sapiens
gggtttggccagggagg

SEQ ID NO: 6340448 - DNA, 19 bp, Homo sapiens
gggtttgtaatggtgctta

SEQ ID NO: 6340449 - DNA, 13 bp, Homo sapiens
gggttttatcagt

SEQ ID NO: 6340450 - DNA, 23 bp, Homo sapiens
gggttttattgtccttcagagct

SEQ ID NO: 6340451 - DNA, 20 bp, Homo sapiens
gggttttattgtttaaaatc

SEQ ID NO: 6340452 - DNA, 20 bp, Homo sapiens
gggttttcacttcctagggt

SEQ ID NO: 6340453 - DNA, 16 bp, Homo sapiens
gggttttccaccctgg

SEQ ID NO: 6340454 - DNA, 23 bp, Homo sapiens
gggttttcccatgactcttggag

SEQ ID NO: 6340455 - DNA, 20 bp, Homo sapiens
gggttttctaactgtaaatc

SEQ ID NO: 6340456 - DNA, 21 bp, Homo sapiens
gggttttctaactgtaaatca

SEQ ID NO: 6340457 - DNA, 21 bp, Homo sapiens
gggttttgcaataacttctat

SEQ ID NO: 6340458 - DNA, 15 bp, Homo sapiens
gggttttgcctctgc

SEQ ID NO: 6340459 - DNA, 14 bp, Homo sapiens
gggttttggcctgc

SEQ ID NO: 6340460 - DNA, 18 bp, Homo sapiens
gggttttgttaggggtgg

SEQ ID NO: 6340461 - DNA, 18 bp, Homo sapiens
gggtttttagagaatgtg

SEQ ID NO: 6340462 - DNA, 16 bp, Homo sapiens
gggtttttattatttt

SEQ ID NO: 6340463 - DNA, 10 bp, Homo sapiens
gggtttttct

SEQ ID NO: 6340464 - DNA, 18 bp, Homo sapiens
gggtttttgccctggagc

SEQ ID NO: 6340465 - DNA, 18 bp, Homo sapiens
gggttttttttttctgaa

SEQ ID NO: 6340466 - DNA, 22 bp, Homo sapiens
gggttttttttttctgaataaa

SEQ ID NO: 6340467 - DNA, 14 bp, Homo sapiens
ggtaaaaaaaagaa

SEQ ID NO: 6340468 - DNA, 14 bp, Homo sapiens
ggtaaaaaatttat

SEQ ID NO: 6340469 - DNA, 20 bp, Homo sapiens
ggtaaaaacagcagctcata

SEQ ID NO: 6340470 - DNA, 15 bp, Homo sapiens
ggtaaaaacccagcg

SEQ ID NO: 6340471 - DNA, 17 bp, Homo sapiens
ggtaaaaactgcagtgt

SEQ ID NO: 6340472 - DNA, 23 bp, Homo sapiens
ggtaaaaagattatatatcataa

SEQ ID NO: 6340473 - DNA, 18 bp, Homo sapiens
ggtaaaaagtattttttc

SEQ ID NO: 6340474 - DNA, 12 bp, Homo sapiens
ggtaaaaagtgg

SEQ ID NO: 6340475 - DNA, 17 bp, Homo sapiens
ggtaaaaatgctgctct

SEQ ID NO: 6340476 - DNA, 21 bp, Homo sapiens
ggtaaaaggagggtggcctca

SEQ ID NO: 6340477 - DNA, 17 bp, Homo sapiens
ggtaaaataaaatgcct

SEQ ID NO: 6340478 - DNA, 13 bp, Homo sapiens
ggtaaaatgtatt

SEQ ID NO: 6340479 - DNA, 14 bp, Homo sapiens
ggtaaaattgcatg

SEQ ID NO: 6340480 - DNA, 19 bp, Homo sapiens
ggtaaacacataaatgaaa

SEQ ID NO: 6340481 - DNA, 13 bp, Homo sapiens
ggtaaagagatgt

SEQ ID NO: 6340482 - DNA, 21 bp, Homo sapiens
ggtaaagcagttcctgtccca

SEQ ID NO: 6340483 - DNA, 14 bp, Homo sapiens
ggtaaaggatgagg

SEQ ID NO: 6340484 - DNA, 14 bp, Homo sapiens
ggtaaagtttgctc

SEQ ID NO: 6340485 - DNA, 15 bp, Homo sapiens
ggtaaataaaaagaa

SEQ ID NO: 6340486 - DNA, 15 bp, Homo sapiens
ggtaaataaaccact

SEQ ID NO: 6340487 - DNA, 17 bp, Homo sapiens
ggtaaataaagctcaag

SEQ ID NO: 6340488 - DNA, 14 bp, Homo sapiens
ggtaaatactgtga

SEQ ID NO: 6340489 - DNA, 14 bp, Homo sapiens
ggtaaatatatgtt

SEQ ID NO: 6340490 - DNA, 16 bp, Homo sapiens
ggtaaatatatgtttt

SEQ ID NO: 6340491 - DNA, 13 bp, Homo sapiens
ggtaaatattttc

SEQ ID NO: 6340492 - DNA, 21 bp, Homo sapiens
ggtaaatcacactcaaacttt

SEQ ID NO: 6340493 - DNA, 14 bp, Homo sapiens
ggtaaatcagggac

SEQ ID NO: 6340494 - DNA, 23 bp, Homo sapiens
ggtaaatgacatctacgaagcca

SEQ ID NO: 6340495 - DNA, 10 bp, Homo sapiens
ggtaaatgtt

SEQ ID NO: 6340496 - DNA, 11 bp, Homo sapiens
ggtaaatgtta

SEQ ID NO: 6340497 - DNA, 14 bp, Homo sapiens
ggtaaattcagaca

SEQ ID NO: 6340498 - DNA, 22 bp, Homo sapiens
ggtaaattcagacaacattatg

SEQ ID NO: 6340499 - DNA, 13 bp, Homo sapiens
ggtaaattggtca

SEQ ID NO: 6340500 - DNA, 19 bp, Homo sapiens
ggtaaattgtaaacagcta

SEQ ID NO: 6340501 - DNA, 13 bp, Homo sapiens
ggtaaatttttga

SEQ ID NO: 6340502 - DNA, 18 bp, Homo sapiens
ggtaacagaacagcttca

SEQ ID NO: 6340503 - DNA, 14 bp, Homo sapiens
ggtaacaggcagat

SEQ ID NO: 6340504 - DNA, 17 bp, Homo sapiens
ggtaacagtgaggctgg

SEQ ID NO: 6340505 - DNA, 14 bp, Homo sapiens
ggtaacagtggctg

SEQ ID NO: 6340506 - DNA, 16 bp, Homo sapiens
ggtaacatcatcaggc

SEQ ID NO: 6340507 - DNA, 23 bp, Homo sapiens
ggtaaccagccacagtacatatg

SEQ ID NO: 6340508 - DNA, 21 bp, Homo sapiens
ggtaacctggccactgtccct

SEQ ID NO: 6340509 - DNA, 21 bp, Homo sapiens
ggtaaccttatatttacaata

SEQ ID NO: 6340510 - DNA, 22 bp, Homo sapiens
ggtaacgtattggacctgccca

SEQ ID NO: 6340511 - DNA, 23 bp, Homo sapiens
ggtaacgtgattgattcagtatc

SEQ ID NO: 6340512 - DNA, 18 bp, Homo sapiens
ggtaacgtggctccacct

SEQ ID NO: 6340513 - DNA, 12 bp, Homo sapiens
ggtaactaagaa

SEQ ID NO: 6340514 - DNA, 20 bp, Homo sapiens
ggtaactaggatatgtatat

SEQ ID NO: 6340515 - DNA, 14 bp, Homo sapiens
ggtaactgtcctgt

SEQ ID NO: 6340516 - DNA, 21 bp, Homo sapiens
ggtaacttgtttttattgcat

SEQ ID NO: 6340517 - DNA, 23 bp, Homo sapiens
ggtaacttgtttttattgcattt

SEQ ID NO: 6340518 - DNA, 12 bp, Homo sapiens
ggtaagaaaaag

SEQ ID NO: 6340519 - DNA, 15 bp, Homo sapiens
ggtaagaagaaagca

SEQ ID NO: 6340520 - DNA, 17 bp, Homo sapiens
ggtaagaagaaagcaaa

SEQ ID NO: 6340521 - DNA, 18 bp, Homo sapiens
ggtaagaagggtgggagt

SEQ ID NO: 6340522 - DNA, 23 bp, Homo sapiens
ggtaagaagttttaaaaagccag

SEQ ID NO: 6340523 - DNA, 23 bp, Homo sapiens
ggtaagagggaaactctggagag

SEQ ID NO: 6340524 - DNA, 12 bp, Homo sapiens
ggtaagagggag

SEQ ID NO: 6340525 - DNA, 21 bp, Homo sapiens
ggtaagaggttggtgtggagt

SEQ ID NO: 6340526 - DNA, 23 bp, Homo sapiens
ggtaagattgcactgttctgatt

SEQ ID NO: 6340527 - DNA, 20 bp, Homo sapiens
ggtaagccagagcctggggt

SEQ ID NO: 6340528 - DNA, 15 bp, Homo sapiens
ggtaagctgctctga

SEQ ID NO: 6340529 - DNA, 20 bp, Homo sapiens
ggtaaggaatacctgtcccc

SEQ ID NO: 6340530 - DNA, 18 bp, Homo sapiens
ggtaaggaggagaaaata

SEQ ID NO: 6340531 - DNA, 20 bp, Homo sapiens
ggtaagggactccagaagca

SEQ ID NO: 6340532 - DNA, 17 bp, Homo sapiens
ggtaagggagagggagg

SEQ ID NO: 6340533 - DNA, 17 bp, Homo sapiens
ggtaaggtgtgtactca

SEQ ID NO: 6340534 - DNA, 20 bp, Homo sapiens
ggtaagtaatgagggctgag

SEQ ID NO: 6340535 - DNA, 17 bp, Homo sapiens
ggtaagttgaagggaaa

SEQ ID NO: 6340536 - DNA, 15 bp, Homo sapiens
ggtaataaacttaga

SEQ ID NO: 6340537 - DNA, 14 bp, Homo sapiens
ggtaataagggaaa

SEQ ID NO: 6340538 - DNA, 20 bp, Homo sapiens
ggtaatacttccagaagtgc

SEQ ID NO: 6340539 - DNA, 18 bp, Homo sapiens
ggtaatatacctggttta

SEQ ID NO: 6340540 - DNA, 16 bp, Homo sapiens
ggtaatatatatattt

SEQ ID NO: 6340541 - DNA, 13 bp, Homo sapiens
ggtaatctacacc

SEQ ID NO: 6340542 - DNA, 14 bp, Homo sapiens
ggtaatctgaaaca

SEQ ID NO: 6340543 - DNA, 15 bp, Homo sapiens
ggtaatgtcactgtt

SEQ ID NO: 6340544 - DNA, 18 bp, Homo sapiens
ggtaatgtgttttagagt

SEQ ID NO: 6340545 - DNA, 19 bp, Homo sapiens
ggtaatgttttgtatatac

SEQ ID NO: 6340546 - DNA, 17 bp, Homo sapiens
ggtaattattttgagtg

SEQ ID NO: 6340547 - DNA, 12 bp, Homo sapiens
ggtaattgaatg

SEQ ID NO: 6340548 - DNA, 12 bp, Homo sapiens
ggtaattgtaca

SEQ ID NO: 6340549 - DNA, 14 bp, Homo sapiens
ggtacaaaaataaa

SEQ ID NO: 6340550 - DNA, 18 bp, Homo sapiens
ggtacaaataatttagaa

SEQ ID NO: 6340551 - DNA, 17 bp, Homo sapiens
ggtacaaccggatgcca

SEQ ID NO: 6340552 - DNA, 20 bp, Homo sapiens
ggtacaaccggatgccagcc

SEQ ID NO: 6340553 - DNA, 14 bp, Homo sapiens
ggtacaacggaggc

SEQ ID NO: 6340554 - DNA, 15 bp, Homo sapiens
ggtacaactgtattt

SEQ ID NO: 6340555 - DNA, 16 bp, Homo sapiens
ggtacaatttcttttg

SEQ ID NO: 6340556 - DNA, 14 bp, Homo sapiens
ggtacacacttgac

SEQ ID NO: 6340557 - DNA, 19 bp, Homo sapiens
ggtacagaaaacatgttta

SEQ ID NO: 6340558 - DNA, 20 bp, Homo sapiens
ggtacagaaaacatgtttaa

SEQ ID NO: 6340559 - DNA, 12 bp, Homo sapiens
ggtacagagaag

SEQ ID NO: 6340560 - DNA, 13 bp, Homo sapiens
ggtacagagaagc

SEQ ID NO: 6340561 - DNA, 21 bp, Homo sapiens
ggtacagagaagccagcttgt

SEQ ID NO: 6340562 - DNA, 22 bp, Homo sapiens
ggtacagcaacaggaatctcag

SEQ ID NO: 6340563 - DNA, 11 bp, Homo sapiens
ggtacagcagg

SEQ ID NO: 6340564 - DNA, 14 bp, Homo sapiens
ggtacagcccaggc

SEQ ID NO: 6340565 - DNA, 15 bp, Homo sapiens
ggtacagcccaggcg

SEQ ID NO: 6340566 - DNA, 18 bp, Homo sapiens
ggtacagcgggctgtgcc

SEQ ID NO: 6340567 - DNA, 23 bp, Homo sapiens
ggtacagcgggctgtgcccggcc

SEQ ID NO: 6340568 - DNA, 18 bp, Homo sapiens
ggtacagctgtatataaa

SEQ ID NO: 6340569 - DNA, 13 bp, Homo sapiens
ggtacaggagagg

SEQ ID NO: 6340570 - DNA, 15 bp, Homo sapiens
gttctgtgcctcccc

SEQ ID NO: 6340571 - DNA, 20 bp, Homo sapiens
gttctgtgcctccccccaga

SEQ ID NO: 6340572 - DNA, 22 bp, Homo sapiens
gttctgtgcctccccccagacc

SEQ ID NO: 6340573 - DNA, 11 bp, Homo sapiens
gttctgtggaa

SEQ ID NO: 6340574 - DNA, 12 bp, Homo sapiens
gttctgtggaaa

SEQ ID NO: 6340575 - DNA, 21 bp, Homo sapiens
gttctgtggaaagtgtaaagc

SEQ ID NO: 6340576 - DNA, 22 bp, Homo sapiens
gttctgtggaaagtgtaaagca

SEQ ID NO: 6340577 - DNA, 18 bp, Homo sapiens
gttctgtgggcttggcct

SEQ ID NO: 6340578 - DNA, 23 bp, Homo sapiens
gttctgtgggggtcatcagggag

SEQ ID NO: 6340579 - DNA, 21 bp, Homo sapiens
gttctgtggttttcccctccc

SEQ ID NO: 6340580 - DNA, 18 bp, Homo sapiens
gttctgtgtaaacagaag

SEQ ID NO: 6340581 - DNA, 15 bp, Homo sapiens
gttctgtgtctgctg

SEQ ID NO: 6340582 - DNA, 18 bp, Homo sapiens
gttctgtgtggtgcattc

SEQ ID NO: 6340583 - DNA, 15 bp, Homo sapiens
gttctgtgtttaatt

SEQ ID NO: 6340584 - DNA, 22 bp, Homo sapiens
gttctgtgtttaatttcttcaa

SEQ ID NO: 6340585 - DNA, 20 bp, Homo sapiens
gttctgttaaatatttttgt

SEQ ID NO: 6340586 - DNA, 14 bp, Homo sapiens
gttctgttaactga

SEQ ID NO: 6340587 - DNA, 18 bp, Homo sapiens
gttctgttaactgaatac

SEQ ID NO: 6340588 - DNA, 19 bp, Homo sapiens
gttctgttaactgaatacc

SEQ ID NO: 6340589 - DNA, 19 bp, Homo sapiens
gttctgttacccagggctc

SEQ ID NO: 6340590 - DNA, 22 bp, Homo sapiens
gttctgttataccccatatatt

SEQ ID NO: 6340591 - DNA, 22 bp, Homo sapiens
gttctgttccaacctcctgctc

SEQ ID NO: 6340592 - DNA, 21 bp, Homo sapiens
gttctgttgaaggtgccattt

SEQ ID NO: 6340593 - DNA, 14 bp, Homo sapiens
gttctgtttcaagg

SEQ ID NO: 6340594 - DNA, 20 bp, Homo sapiens
gttctgtttggcacttgtat

SEQ ID NO: 6340595 - DNA, 14 bp, Homo sapiens
gttctgtttgttat

SEQ ID NO: 6340596 - DNA, 12 bp, Homo sapiens
gttctgttttgt

SEQ ID NO: 6340597 - DNA, 16 bp, Homo sapiens
gttctgttttgttttg

SEQ ID NO: 6340598 - DNA, 23 bp, Homo sapiens
gttctgttttgttttgtttttta

SEQ ID NO: 6340599 - DNA, 14 bp, Homo sapiens
gttcttaaaatatt

SEQ ID NO: 6340600 - DNA, 14 bp, Homo sapiens
gttcttaaagtttg

SEQ ID NO: 6340601 - DNA, 16 bp, Homo sapiens
gttcttaacacttcct

SEQ ID NO: 6340602 - DNA, 20 bp, Homo sapiens
gttcttaaccagatggttgt

SEQ ID NO: 6340603 - DNA, 16 bp, Homo sapiens
gttcttaagacgtgat

SEQ ID NO: 6340604 - DNA, 13 bp, Homo sapiens
gttcttaattctt

SEQ ID NO: 6340605 - DNA, 16 bp, Homo sapiens
gttcttaattgtgaac

SEQ ID NO: 6340606 - DNA, 21 bp, Homo sapiens
gttcttacaagcttaaagctt

SEQ ID NO: 6340607 - DNA, 16 bp, Homo sapiens
gttcttacacatacag

SEQ ID NO: 6340608 - DNA, 22 bp, Homo sapiens
gttcttacctgtatgtctccag

SEQ ID NO: 6340609 - DNA, 16 bp, Homo sapiens
gttcttactgcttaat

SEQ ID NO: 6340610 - DNA, 18 bp, Homo sapiens
gttcttagatatcttttt

SEQ ID NO: 6340611 - DNA, 16 bp, Homo sapiens
gttcttagcaataaat

SEQ ID NO: 6340612 - DNA, 22 bp, Homo sapiens
gttcttaggcaccatagaagaa

SEQ ID NO: 6340613 - DNA, 21 bp, Homo sapiens
gttcttaggctccatcctgtt

SEQ ID NO: 6340614 - DNA, 18 bp, Homo sapiens
gttcttaggctgctggga

SEQ ID NO: 6340615 - DNA, 17 bp, Homo sapiens
gttcttaggtttactgt

SEQ ID NO: 6340616 - DNA, 20 bp, Homo sapiens
gttcttaggtttactgtgaa

SEQ ID NO: 6340617 - DNA, 22 bp, Homo sapiens
gttcttagttgacaacctagaa

SEQ ID NO: 6340618 - DNA, 17 bp, Homo sapiens
gttcttatagaataaaa

SEQ ID NO: 6340619 - DNA, 21 bp, Homo sapiens
gttcttatagaataaaagctg

SEQ ID NO: 6340620 - DNA, 15 bp, Homo sapiens
gttcttatgaggagg

SEQ ID NO: 6340621 - DNA, 20 bp, Homo sapiens
gttcttatgaggaggggagg

SEQ ID NO: 6340622 - DNA, 18 bp, Homo sapiens
gttcttatgcaaaatgga

SEQ ID NO: 6340623 - DNA, 16 bp, Homo sapiens
gttcttcaagaggaaa

SEQ ID NO: 6340624 - DNA, 15 bp, Homo sapiens
gttcttcaagccagc

SEQ ID NO: 6340625 - DNA, 21 bp, Homo sapiens
gttcttcaatgtgaaactgag

SEQ ID NO: 6340626 - DNA, 13 bp, Homo sapiens
gttcttcacctct

SEQ ID NO: 6340627 - DNA, 14 bp, Homo sapiens
gttcttcacctcta

SEQ ID NO: 6340628 - DNA, 17 bp, Homo sapiens
gttcttcacctctatcc

SEQ ID NO: 6340629 - DNA, 19 bp, Homo sapiens
gttcttcatttggaggaat

SEQ ID NO: 6340630 - DNA, 15 bp, Homo sapiens
gttcttccaaagcag

SEQ ID NO: 6340631 - DNA, 14 bp, Homo sapiens
gttcttcctcagcc

SEQ ID NO: 6340632 - DNA, 16 bp, Homo sapiens
gttcttcctcagccag

SEQ ID NO: 6340633 - DNA, 18 bp, Homo sapiens
gttcttcctcagccagcc

SEQ ID NO: 6340634 - DNA, 16 bp, Homo sapiens
gttcttcctcttacct

SEQ ID NO: 6340635 - DNA, 14 bp, Homo sapiens
gttcttcctgcaac

SEQ ID NO: 6340636 - DNA, 15 bp, Homo sapiens
gttcttcctgtaatc

SEQ ID NO: 6340637 - DNA, 20 bp, Homo sapiens
gttcttcgcagctcatcttt

SEQ ID NO: 6340638 - DNA, 22 bp, Homo sapiens
gttcttcgggaagagaggagtt

SEQ ID NO: 6340639 - DNA, 12 bp, Homo sapiens
gttcttctgtta

SEQ ID NO: 6340640 - DNA, 17 bp, Homo sapiens
gttcttcttcctgaagc

SEQ ID NO: 6340641 - DNA, 19 bp, Homo sapiens
gttcttcttgtctttgtcc

SEQ ID NO: 6340642 - DNA, 21 bp, Homo sapiens
gttcttcttgtctttgtccct

SEQ ID NO: 6340643 - DNA, 19 bp, Homo sapiens
gttcttctttctctgtatt

SEQ ID NO: 6340644 - DNA, 13 bp, Homo sapiens
gttcttctttctt

SEQ ID NO: 6340645 - DNA, 18 bp, Homo sapiens
gttcttgaaaataagatt

SEQ ID NO: 6340646 - DNA, 13 bp, Homo sapiens
gttcttgaagctg

SEQ ID NO: 6340647 - DNA, 12 bp, Homo sapiens
gttcttgaatcc

SEQ ID NO: 6340648 - DNA, 18 bp, Homo sapiens
gttcttgaattgttatga

SEQ ID NO: 6340649 - DNA, 17 bp, Homo sapiens
gttcttgagattttgta

SEQ ID NO: 6340650 - DNA, 16 bp, Homo sapiens
gttcttgagcagctga

SEQ ID NO: 6340651 - DNA, 21 bp, Homo sapiens
gttcttgaggggaccaggagt

SEQ ID NO: 6340652 - DNA, 22 bp, Homo sapiens
gttcttgaggggaccaggagtg

SEQ ID NO: 6340653 - DNA, 23 bp, Homo sapiens
gttcttgaggggaccaggagtgg

SEQ ID NO: 6340654 - DNA, 13 bp, Homo sapiens
gttcttgatgaca

SEQ ID NO: 6340655 - DNA, 15 bp, Homo sapiens
gttcttgcaataaga

SEQ ID NO: 6340656 - DNA, 15 bp, Homo sapiens
gttcttgcagcagag

SEQ ID NO: 6340657 - DNA, 21 bp, Homo sapiens
gttcttgcagtcatcagaagt

SEQ ID NO: 6340658 - DNA, 16 bp, Homo sapiens
gttcttgcctttctta

SEQ ID NO: 6340659 - DNA, 15 bp, Homo sapiens
gttcttgctgagcac

SEQ ID NO: 6340660 - DNA, 21 bp, Homo sapiens
gttcttgctgagcaccctctc

SEQ ID NO: 6340661 - DNA, 16 bp, Homo sapiens
gttcttgctgctagaa

SEQ ID NO: 6340662 - DNA, 19 bp, Homo sapiens
gttcttgctgctagaactt

SEQ ID NO: 6340663 - DNA, 22 bp, Homo sapiens
gttcttgctttctctctcatgc

SEQ ID NO: 6340664 - DNA, 15 bp, Homo sapiens
gttcttggaaaaaat

SEQ ID NO: 6340665 - DNA, 16 bp, Homo sapiens
gttcttggaccagttt

SEQ ID NO: 6340666 - DNA, 22 bp, Homo sapiens
gttcttggatggcgttctccta

SEQ ID NO: 6340667 - DNA, 16 bp, Homo sapiens
gttcttggattacttt

SEQ ID NO: 6340668 - DNA, 22 bp, Homo sapiens
gttcttggcctatgataagttc

SEQ ID NO: 6340669 - DNA, 14 bp, Homo sapiens
gttcttggcctgct

SEQ ID NO: 6340670 - DNA, 23 bp, Homo sapiens
gttcttgggcctcaggctctgca

SEQ ID NO: 6340671 - DNA, 21 bp, Homo sapiens
gttcttgggggaggccacccc

SEQ ID NO: 6340672 - DNA, 22 bp, Homo sapiens
gttcttgggggaggccacccca

SEQ ID NO: 6340673 - DNA, 20 bp, Homo sapiens
gttcttgggtggttcctaag

SEQ ID NO: 6340674 - DNA, 16 bp, Homo sapiens
gttcttggtaactgat

SEQ ID NO: 6340675 - DNA, 14 bp, Homo sapiens
gttcttggttcctg

SEQ ID NO: 6340676 - DNA, 15 bp, Homo sapiens
gttcttggtttgtaa

SEQ ID NO: 6340677 - DNA, 17 bp, Homo sapiens
gttcttgtaaaactgtg

SEQ ID NO: 6340678 - DNA, 18 bp, Homo sapiens
gttcttgtaaaactgtga

SEQ ID NO: 6340679 - DNA, 19 bp, Homo sapiens
gttcttgtaaaactgtgac

SEQ ID NO: 6340680 - DNA, 21 bp, Homo sapiens
gttcttgtaaaactgtgacat

SEQ ID NO: 6340681 - DNA, 18 bp, Homo sapiens
gttcttgtaattttacac

SEQ ID NO: 6340682 - DNA, 12 bp, Homo sapiens
gttcttgtattt

SEQ ID NO: 6340683 - DNA, 20 bp, Homo sapiens
gttcttgtattttaataaac

SEQ ID NO: 6340684 - DNA, 16 bp, Homo sapiens
gttcttgttctgtttt

SEQ ID NO: 6340685 - DNA, 16 bp, Homo sapiens
gttcttgttttgttat

SEQ ID NO: 6340686 - DNA, 23 bp, Homo sapiens
gttcttgttttttaaaatccaga

SEQ ID NO: 6340687 - DNA, 13 bp, Homo sapiens
gttctttaatgtt

SEQ ID NO: 6340688 - DNA, 19 bp, Homo sapiens
gttctttactcgtcccctt

SEQ ID NO: 6340689 - DNA, 19 bp, Homo sapiens
gttctttagaggctttcaa

SEQ ID NO: 6340690 - DNA, 17 bp, Homo sapiens
gttctttaggagatttt

SEQ ID NO: 6340691 - DNA, 12 bp, Homo sapiens
gttctttataac

SEQ ID NO: 6340692 - DNA, 11 bp, Homo sapiens
gttctttatat

SEQ ID NO: 6340693 - DNA, 13 bp, Homo sapiens
gttctttatatac

SEQ ID NO: 6340694 - DNA, 12 bp, Homo sapiens
gttctttcagaa

SEQ ID NO: 6340695 - DNA, 15 bp, Homo sapiens
gttctttcatctccc

SEQ ID NO: 6340696 - DNA, 14 bp, Homo sapiens
gttctttcccagcc

SEQ ID NO: 6340697 - DNA, 17 bp, Homo sapiens
gttctttccccaggggc

SEQ ID NO: 6340698 - DNA, 14 bp, Homo sapiens
gttctttcctcttt

SEQ ID NO: 6340699 - DNA, 16 bp, Homo sapiens
gttctttcctctttct

SEQ ID NO: 6340700 - DNA, 18 bp, Homo sapiens
gttctttcctctttctgc

SEQ ID NO: 6340701 - DNA, 20 bp, Homo sapiens
gttctttcctctttctgctc

SEQ ID NO: 6340702 - DNA, 23 bp, Homo sapiens
gttctttcctctttctgctctgc

SEQ ID NO: 6340703 - DNA, 22 bp, Homo sapiens
gttctttcctttcatcctcagc

SEQ ID NO: 6340704 - DNA, 23 bp, Homo sapiens
gttctttcctttcatcctcagca

SEQ ID NO: 6340705 - DNA, 17 bp, Homo sapiens
gttctttcttcctctgc

SEQ ID NO: 6340706 - DNA, 20 bp, Homo sapiens
gttctttgatttgtaccatt

SEQ ID NO: 6340707 - DNA, 16 bp, Homo sapiens
gttctttgcaagctta

SEQ ID NO: 6340708 - DNA, 15 bp, Homo sapiens
gttctttgcagtgaa

SEQ ID NO: 6340709 - DNA, 20 bp, Homo sapiens
gttctttgctggaccatcaa

SEQ ID NO: 6340710 - DNA, 18 bp, Homo sapiens
gttctttggaaggagtga

SEQ ID NO: 6340711 - DNA, 14 bp, Homo sapiens
gttctttggattct

SEQ ID NO: 6340712 - DNA, 17 bp, Homo sapiens
gttctttgggccagaca

SEQ ID NO: 6340713 - DNA, 12 bp, Homo sapiens
gttctttgtgta

SEQ ID NO: 6340714 - DNA, 20 bp, Homo sapiens
gttctttgttcatagcccag

SEQ ID NO: 6340715 - DNA, 15 bp, Homo sapiens
gttctttgttcctgc

SEQ ID NO: 6340716 - DNA, 18 bp, Homo sapiens
gttctttgttcctgcttt

SEQ ID NO: 6340717 - DNA, 11 bp, Homo sapiens
gttctttgttt

SEQ ID NO: 6340718 - DNA, 13 bp, Homo sapiens
gttcttttaaagg

SEQ ID NO: 6340719 - DNA, 13 bp, Homo sapiens
gttcttttactgt

SEQ ID NO: 6340720 - DNA, 19 bp, Homo sapiens
gttcttttcaatatatttg

SEQ ID NO: 6340721 - DNA, 20 bp, Homo sapiens
gttcttttctcctttaccag

SEQ ID NO: 6340722 - DNA, 13 bp, Homo sapiens
gttcttttctggt

SEQ ID NO: 6340723 - DNA, 14 bp, Homo sapiens
gttcttttgataca

SEQ ID NO: 6340724 - DNA, 18 bp, Homo sapiens
gttcttttgatacattta

SEQ ID NO: 6340725 - DNA, 21 bp, Homo sapiens
gttcttttgatacatttatct

SEQ ID NO: 6340726 - DNA, 17 bp, Homo sapiens
gttctttttattttaac

SEQ ID NO: 6340727 - DNA, 19 bp, Homo sapiens
gttctttttgaagtattta

SEQ ID NO: 6340728 - DNA, 16 bp, Homo sapiens
gttctttttgtacact

SEQ ID NO: 6340729 - DNA, 17 bp, Homo sapiens
gttcttttttgtacagt

SEQ ID NO: 6340730 - DNA, 13 bp, Homo sapiens
gttgaaaaaagaa

SEQ ID NO: 6340731 - DNA, 19 bp, Homo sapiens
gttgaaaaaggaaatattc

SEQ ID NO: 6340732 - DNA, 17 bp, Homo sapiens
gttgaaaaatagcatat

SEQ ID NO: 6340733 - DNA, 20 bp, Homo sapiens
gttgaaaaatctagtttttt

SEQ ID NO: 6340734 - DNA, 17 bp, Homo sapiens
gttgaaaagactccaaa

SEQ ID NO: 6340735 - DNA, 22 bp, Homo sapiens
gttgaaaagactccaaagaaat

SEQ ID NO: 6340736 - DNA, 23 bp, Homo sapiens
gttgaaaagactccaaagaaatg

SEQ ID NO: 6340737 - DNA, 14 bp, Homo sapiens
gttgaaaagccatg

SEQ ID NO: 6340738 - DNA, 15 bp, Homo sapiens
gttgaaaagccatgt

SEQ ID NO: 6340739 - DNA, 18 bp, Homo sapiens
gttgaaaatacattctta

SEQ ID NO: 6340740 - DNA, 13 bp, Homo sapiens
gttgaaacaaacc

SEQ ID NO: 6340741 - DNA, 12 bp, Homo sapiens
gttgaaacatat

SEQ ID NO: 6340742 - DNA, 22 bp, Homo sapiens
gttgaaacggatgatttctatg

SEQ ID NO: 6340743 - DNA, 19 bp, Homo sapiens
gttgaaacttacactgttt

SEQ ID NO: 6340744 - DNA, 21 bp, Homo sapiens
gttgaaacttacactgtttca

SEQ ID NO: 6340745 - DNA, 12 bp, Homo sapiens
gttgaaagacat

SEQ ID NO: 6340746 - DNA, 19 bp, Homo sapiens
gttgaaagacatcaatgaa

SEQ ID NO: 6340747 - DNA, 15 bp, Homo sapiens
gttgaaagagtccta

SEQ ID NO: 6340748 - DNA, 22 bp, Homo sapiens
gttgaaagctttgaaataaaat

SEQ ID NO: 6340749 - DNA, 17 bp, Homo sapiens
ggtacaggagaggcagc

SEQ ID NO: 6340750 - DNA, 22 bp, Homo sapiens
ggtacagtaaagaggcttccaa

SEQ ID NO: 6340751 - DNA, 16 bp, Homo sapiens
ggtacagttgcaggag

SEQ ID NO: 6340752 - DNA, 17 bp, Homo sapiens
ggtacatggcccgcagt

SEQ ID NO: 6340753 - DNA, 14 bp, Homo sapiens
ggtacatttctctg

SEQ ID NO: 6340754 - DNA, 14 bp, Homo sapiens
ggtaccagatgcag

SEQ ID NO: 6340755 - DNA, 18 bp, Homo sapiens
ggtaccagccctggggct

SEQ ID NO: 6340756 - DNA, 15 bp, Homo sapiens
ggtaccagctcactc

SEQ ID NO: 6340757 - DNA, 12 bp, Homo sapiens
ggtaccagctgc

SEQ ID NO: 6340758 - DNA, 23 bp, Homo sapiens
ggtaccaggcacatggctggggg

SEQ ID NO: 6340759 - DNA, 13 bp, Homo sapiens
ggtaccaggcccg

SEQ ID NO: 6340760 - DNA, 20 bp, Homo sapiens
ggtaccagttgaaatttttg

SEQ ID NO: 6340761 - DNA, 17 bp, Homo sapiens
ggtaccatgctttttct

SEQ ID NO: 6340762 - DNA, 13 bp, Homo sapiens
ggtacccactgct

SEQ ID NO: 6340763 - DNA, 17 bp, Homo sapiens
ggtacccggggcccagg

SEQ ID NO: 6340764 - DNA, 19 bp, Homo sapiens
ggtaccctggcagagaaga

SEQ ID NO: 6340765 - DNA, 23 bp, Homo sapiens
ggtaccctggcagagaagagacc

SEQ ID NO: 6340766 - DNA, 13 bp, Homo sapiens
ggtaccctgggtg

SEQ ID NO: 6340767 - DNA, 14 bp, Homo sapiens
ggtacctattttca

SEQ ID NO: 6340768 - DNA, 12 bp, Homo sapiens
ggtacctcagtt

SEQ ID NO: 6340769 - DNA, 20 bp, Homo sapiens
ggtacctcagtttctccttt

SEQ ID NO: 6340770 - DNA, 13 bp, Homo sapiens
ggtacctgccctc

SEQ ID NO: 6340771 - DNA, 12 bp, Homo sapiens
ggtacctggacg

SEQ ID NO: 6340772 - DNA, 15 bp, Homo sapiens
ggtaccttcagccct

SEQ ID NO: 6340773 - DNA, 16 bp, Homo sapiens
ggtaccttcagccctg

SEQ ID NO: 6340774 - DNA, 17 bp, Homo sapiens
ggtaccttcagccctgg

SEQ ID NO: 6340775 - DNA, 21 bp, Homo sapiens
ggtaccttctcacctgtgaga

SEQ ID NO: 6340776 - DNA, 18 bp, Homo sapiens
ggtaccttgaacactggg

SEQ ID NO: 6340777 - DNA, 12 bp, Homo sapiens
ggtaccttgcac

SEQ ID NO: 6340778 - DNA, 23 bp, Homo sapiens
ggtaccttgcacacatcatctgt

SEQ ID NO: 6340779 - DNA, 17 bp, Homo sapiens
ggtaccttgtgcccagg

SEQ ID NO: 6340780 - DNA, 16 bp, Homo sapiens
ggtacctttccaccca

SEQ ID NO: 6340781 - DNA, 17 bp, Homo sapiens
ggtacctttccacccag

SEQ ID NO: 6340782 - DNA, 19 bp, Homo sapiens
ggtacctttccacccagac

SEQ ID NO: 6340783 - DNA, 18 bp, Homo sapiens
ggtacctttctagcctta

SEQ ID NO: 6340784 - DNA, 19 bp, Homo sapiens
ggtacgaatctcatccctc

SEQ ID NO: 6340785 - DNA, 13 bp, Homo sapiens
ggtactaaaagaa

SEQ ID NO: 6340786 - DNA, 23 bp, Homo sapiens
ggtactataaaagctttctgcca

SEQ ID NO: 6340787 - DNA, 21 bp, Homo sapiens
ggtactccataaaaggtgtgt

SEQ ID NO: 6340788 - DNA, 21 bp, Homo sapiens
ggtactcccaaactgacaatt

SEQ ID NO: 6340789 - DNA, 19 bp, Homo sapiens
ggtactctgtgaaagaaga

SEQ ID NO: 6340790 - DNA, 18 bp, Homo sapiens
ggtactgaaggcttctgc

SEQ ID NO: 6340791 - DNA, 14 bp, Homo sapiens
ggtactgagacagg

SEQ ID NO: 6340792 - DNA, 18 bp, Homo sapiens
ggtactgagacagggtgc

SEQ ID NO: 6340793 - DNA, 18 bp, Homo sapiens
ggtactggggctgagggc

SEQ ID NO: 6340794 - DNA, 19 bp, Homo sapiens
ggtactggggtgggatctt

SEQ ID NO: 6340795 - DNA, 23 bp, Homo sapiens
ggtactggtgagggcaagaggtg

SEQ ID NO: 6340796 - DNA, 18 bp, Homo sapiens
ggtactgtacagctggct

SEQ ID NO: 6340797 - DNA, 21 bp, Homo sapiens
ggtactgtacagctggctcta

SEQ ID NO: 6340798 - DNA, 21 bp, Homo sapiens
ggtactgtatgatcaaatgtt

SEQ ID NO: 6340799 - DNA, 17 bp, Homo sapiens
ggtactgtctcggcaga

SEQ ID NO: 6340800 - DNA, 22 bp, Homo sapiens
ggtactgtctcggcagaggtgg

SEQ ID NO: 6340801 - DNA, 17 bp, Homo sapiens
ggtactgttgctttggg

SEQ ID NO: 6340802 - DNA, 20 bp, Homo sapiens
ggtacttatttctcagctgt

SEQ ID NO: 6340803 - DNA, 23 bp, Homo sapiens
ggtacttatttctcagctgtgcc

SEQ ID NO: 6340804 - DNA, 22 bp, Homo sapiens
ggtacttcaaatccttgaagat

SEQ ID NO: 6340805 - DNA, 15 bp, Homo sapiens
ggtacttcctcctga

SEQ ID NO: 6340806 - DNA, 21 bp, Homo sapiens
ggtacttctgtgttgtgattc

SEQ ID NO: 6340807 - DNA, 17 bp, Homo sapiens
ggtacttgtggacacag

SEQ ID NO: 6340808 - DNA, 22 bp, Homo sapiens
ggtacttttatgatgtatattt

SEQ ID NO: 6340809 - DNA, 23 bp, Homo sapiens
ggtacttttatgatgtatattta

SEQ ID NO: 6340810 - DNA, 16 bp, Homo sapiens
ggtagaaaaagggtca

SEQ ID NO: 6340811 - DNA, 22 bp, Homo sapiens
ggtagaaaatgcaccaaatagg

SEQ ID NO: 6340812 - DNA, 20 bp, Homo sapiens
ggtagaaacctgccgggctg

SEQ ID NO: 6340813 - DNA, 23 bp, Homo sapiens
ggtagaaacctgccgggctgttg

SEQ ID NO: 6340814 - DNA, 18 bp, Homo sapiens
ggtagaaatgcaaggggg

SEQ ID NO: 6340815 - DNA, 23 bp, Homo sapiens
ggtagaacgccagggaccccaga

SEQ ID NO: 6340816 - DNA, 12 bp, Homo sapiens
ggtagaagccac

SEQ ID NO: 6340817 - DNA, 21 bp, Homo sapiens
ggtagaagccttatgaaaatt

SEQ ID NO: 6340818 - DNA, 13 bp, Homo sapiens
ggtagaaggcaca

SEQ ID NO: 6340819 - DNA, 15 bp, Homo sapiens
ggtagaagggaaagc

SEQ ID NO: 6340820 - DNA, 18 bp, Homo sapiens
ggtagaatgaccttgtaa

SEQ ID NO: 6340821 - DNA, 17 bp, Homo sapiens
ggtagaatgattaatca

SEQ ID NO: 6340822 - DNA, 15 bp, Homo sapiens
ggtagaatgtaaagc

SEQ ID NO: 6340823 - DNA, 19 bp, Homo sapiens
ggtagaatgtaaagcttgt

SEQ ID NO: 6340824 - DNA, 15 bp, Homo sapiens
ggtagacacacatga

SEQ ID NO: 6340825 - DNA, 19 bp, Homo sapiens
ggtagaccaggatttctaa

SEQ ID NO: 6340826 - DNA, 22 bp, Homo sapiens
ggtagacctgtctcctggcggt

SEQ ID NO: 6340827 - DNA, 12 bp, Homo sapiens
ggtagaccttga

SEQ ID NO: 6340828 - DNA, 23 bp, Homo sapiens
ggtagaccttgagggtgggccag

SEQ ID NO: 6340829 - DNA, 23 bp, Homo sapiens
ggtagacttggacatctctctgg

SEQ ID NO: 6340830 - DNA, 15 bp, Homo sapiens
ggtagacttggagct

SEQ ID NO: 6340831 - DNA, 17 bp, Homo sapiens
ggtagacttggagctgt

SEQ ID NO: 6340832 - DNA, 12 bp, Homo sapiens
ggtagagacccc

SEQ ID NO: 6340833 - DNA, 14 bp, Homo sapiens
ggtagagaccccca

SEQ ID NO: 6340834 - DNA, 20 bp, Homo sapiens
ggtagagaggcgcggagtga

SEQ ID NO: 6340835 - DNA, 17 bp, Homo sapiens
ggtagagaggggactgg

SEQ ID NO: 6340836 - DNA, 17 bp, Homo sapiens
ggtagagatggaggagg

SEQ ID NO: 6340837 - DNA, 11 bp, Homo sapiens
ggtagagatgt

SEQ ID NO: 6340838 - DNA, 17 bp, Homo sapiens
ggtagagccacaaaaga

SEQ ID NO: 6340839 - DNA, 18 bp, Homo sapiens
ggtagagccctcagaacc

SEQ ID NO: 6340840 - DNA, 23 bp, Homo sapiens
ggtagagctgatccagagcacag

SEQ ID NO: 6340841 - DNA, 14 bp, Homo sapiens
ggtagagctggtgc

SEQ ID NO: 6340842 - DNA, 16 bp, Homo sapiens
ggtagaggcctggggc

SEQ ID NO: 6340843 - DNA, 17 bp, Homo sapiens
ggtagaggcctggggcc

SEQ ID NO: 6340844 - DNA, 17 bp, Homo sapiens
ggtagaggctccccagg

SEQ ID NO: 6340845 - DNA, 14 bp, Homo sapiens
ggtagaggctggga

SEQ ID NO: 6340846 - DNA, 16 bp, Homo sapiens
ggtagaggctgggagg

SEQ ID NO: 6340847 - DNA, 23 bp, Homo sapiens
ggtagaggggtgctttgcctgtt

SEQ ID NO: 6340848 - DNA, 15 bp, Homo sapiens
ggtagagtcattcat

SEQ ID NO: 6340849 - DNA, 20 bp, Homo sapiens
ggtagagttcctttctggga

SEQ ID NO: 6340850 - DNA, 12 bp, Homo sapiens
ggtagagtttat

SEQ ID NO: 6340851 - DNA, 22 bp, Homo sapiens
ggtagagtttatttttttgatg

SEQ ID NO: 6340852 - DNA, 18 bp, Homo sapiens
ggtagatcacgagatcaa

SEQ ID NO: 6340853 - DNA, 23 bp, Homo sapiens
ggtagatccagatccagactgta

SEQ ID NO: 6340854 - DNA, 16 bp, Homo sapiens
ggtagatcgcttgagc

SEQ ID NO: 6340855 - DNA, 22 bp, Homo sapiens
ggtagatcgcttgagcccagga

SEQ ID NO: 6340856 - DNA, 19 bp, Homo sapiens
ggtagatgacaaatattct

SEQ ID NO: 6340857 - DNA, 14 bp, Homo sapiens
ggtagatgggtggg

SEQ ID NO: 6340858 - DNA, 22 bp, Homo sapiens
ggtagattcgctgtcccctcag

SEQ ID NO: 6340859 - DNA, 16 bp, Homo sapiens
ggtagcaagagagcag

SEQ ID NO: 6340860 - DNA, 17 bp, Homo sapiens
ggtagcaagagagcagc

SEQ ID NO: 6340861 - DNA, 23 bp, Homo sapiens
ggtagcaattctacccagagcct

SEQ ID NO: 6340862 - DNA, 14 bp, Homo sapiens
ggtagcacagcact

SEQ ID NO: 6340863 - DNA, 12 bp, Homo sapiens
ggtagcagctgg

SEQ ID NO: 6340864 - DNA, 14 bp, Homo sapiens
ggtagcagctggac

SEQ ID NO: 6340865 - DNA, 14 bp, Homo sapiens
ggtagcattttaaa

SEQ ID NO: 6340866 - DNA, 21 bp, Homo sapiens
ggtagccccgccccagccctc

SEQ ID NO: 6340867 - DNA, 15 bp, Homo sapiens
ggtagccctggccag

SEQ ID NO: 6340868 - DNA, 20 bp, Homo sapiens
ggtagccctggccagaggct

SEQ ID NO: 6340869 - DNA, 15 bp, Homo sapiens
ggtagcctgctgtgg

SEQ ID NO: 6340870 - DNA, 17 bp, Homo sapiens
ggtagcctgctgtgggg

SEQ ID NO: 6340871 - DNA, 15 bp, Homo sapiens
ggtagcgagctgctc

SEQ ID NO: 6340872 - DNA, 17 bp, Homo sapiens
ggtagctagaggaacca

SEQ ID NO: 6340873 - DNA, 22 bp, Homo sapiens
ggtagctatagttgcagcccaa

SEQ ID NO: 6340874 - DNA, 12 bp, Homo sapiens
ggtagctcaggt

SEQ ID NO: 6340875 - DNA, 14 bp, Homo sapiens
ggtagctctgaagg

SEQ ID NO: 6340876 - DNA, 20 bp, Homo sapiens
ggtagctctggcttagacac

SEQ ID NO: 6340877 - DNA, 16 bp, Homo sapiens
ggtagctggggagccc

SEQ ID NO: 6340878 - DNA, 17 bp, Homo sapiens
ggtagctggggagccct

SEQ ID NO: 6340879 - DNA, 18 bp, Homo sapiens
ggtagcttacctgacaca

SEQ ID NO: 6340880 - DNA, 19 bp, Homo sapiens
ggtagcttctgacctcagc

SEQ ID NO: 6340881 - DNA, 20 bp, Homo sapiens
ggtagcttctgacctcagca

SEQ ID NO: 6340882 - DNA, 12 bp, Homo sapiens
ggtaggaaaatt

SEQ ID NO: 6340883 - DNA, 18 bp, Homo sapiens
ggtaggaaaccaccctga

SEQ ID NO: 6340884 - DNA, 16 bp, Homo sapiens
ggtaggaactgctggg

SEQ ID NO: 6340885 - DNA, 18 bp, Homo sapiens
ggtaggaactgctgggct

SEQ ID NO: 6340886 - DNA, 12 bp, Homo sapiens
ggtaggaccctc

SEQ ID NO: 6340887 - DNA, 16 bp, Homo sapiens
ggtaggaccctcgaga

SEQ ID NO: 6340888 - DNA, 21 bp, Homo sapiens
ggtaggaccctcgagagcctt

SEQ ID NO: 6340889 - DNA, 16 bp, Homo sapiens
ggtaggagagcactgc

SEQ ID NO: 6340890 - DNA, 15 bp, Homo sapiens
ggtaggagaggagaa

SEQ ID NO: 6340891 - DNA, 14 bp, Homo sapiens
ggtaggaggaggca

SEQ ID NO: 6340892 - DNA, 15 bp, Homo sapiens
ggtaggaggaggcat

SEQ ID NO: 6340893 - DNA, 21 bp, Homo sapiens
ggtaggaggaggcatggaaac

SEQ ID NO: 6340894 - DNA, 12 bp, Homo sapiens
ggtaggatgttg

SEQ ID NO: 6340895 - DNA, 23 bp, Homo sapiens
ggtaggcaaggctgccggctgca

SEQ ID NO: 6340896 - DNA, 18 bp, Homo sapiens
ggtaggccaaggtgtcct

SEQ ID NO: 6340897 - DNA, 21 bp, Homo sapiens
ggtaggccaaggtgtcctaca

SEQ ID NO: 6340898 - DNA, 23 bp, Homo sapiens
ggtaggccaaggtgtcctacaga

SEQ ID NO: 6340899 - DNA, 19 bp, Homo sapiens
ggtaggccccacaaggcct

SEQ ID NO: 6340900 - DNA, 21 bp, Homo sapiens
ggtaggccccacaaggcctgg

SEQ ID NO: 6340901 - DNA, 12 bp, Homo sapiens
ggtaggcccttg

SEQ ID NO: 6340902 - DNA, 19 bp, Homo sapiens
ggtaggcccttgtcctgcc

SEQ ID NO: 6340903 - DNA, 22 bp, Homo sapiens
ggtaggcccttgtcctgccagc

SEQ ID NO: 6340904 - DNA, 23 bp, Homo sapiens
ggtaggcccttgtcctgccagct

SEQ ID NO: 6340905 - DNA, 16 bp, Homo sapiens
ggtaggctacttttca

SEQ ID NO: 6340906 - DNA, 16 bp, Homo sapiens
ggtaggctgctgccct

SEQ ID NO: 6340907 - DNA, 14 bp, Homo sapiens
ggtagggaggcagc

SEQ ID NO: 6340908 - DNA, 21 bp, Homo sapiens
ggtagggatatggcaggactc

SEQ ID NO: 6340909 - DNA, 12 bp, Homo sapiens
ggtagggcagac

SEQ ID NO: 6340910 - DNA, 15 bp, Homo sapiens
ggtagggcagacatg

SEQ ID NO: 6340911 - DNA, 12 bp, Homo sapiens
ggtagggctggc

SEQ ID NO: 6340912 - DNA, 14 bp, Homo sapiens
ggtagggctggctg

SEQ ID NO: 6340913 - DNA, 14 bp, Homo sapiens
ggtaggggagggca

SEQ ID NO: 6340914 - DNA, 13 bp, Homo sapiens
ggtaggggcaggg

SEQ ID NO: 6340915 - DNA, 21 bp, Homo sapiens
ggtaggggcccctctcagccc

SEQ ID NO: 6340916 - DNA, 23 bp, Homo sapiens
ggtagggtgggccttcagggagt

SEQ ID NO: 6340917 - DNA, 19 bp, Homo sapiens
ggtaggtggcacactgggt

SEQ ID NO: 6340918 - DNA, 15 bp, Homo sapiens
ggtaggtgtggtggc

SEQ ID NO: 6340919 - DNA, 15 bp, Homo sapiens
ggtaggttcagccaa

SEQ ID NO: 6340920 - DNA, 16 bp, Homo sapiens
ggtagtacccagggcc

SEQ ID NO: 6340921 - DNA, 21 bp, Homo sapiens
ggtagtaccttttatatccca

SEQ ID NO: 6340922 - DNA, 23 bp, Homo sapiens
ggtagtactcctgcaaaatttta

SEQ ID NO: 6340923 - DNA, 20 bp, Homo sapiens
ggtagtcatgctgtgcattt

SEQ ID NO: 6340924 - DNA, 23 bp, Homo sapiens
ggtagtcctcccaagctgtgctg

SEQ ID NO: 6340925 - DNA, 24 bp, Homo sapiens
ggtagtcctcccaagctgtgctgg

SEQ ID NO: 6340926 - DNA, 20 bp, Homo sapiens
ggtagtctcactgcttgaac

SEQ ID NO: 6340927 - DNA, 13 bp, Homo sapiens
gttgaaaggtttt

SEQ ID NO: 6340928 - DNA, 13 bp, Homo sapiens
gttgaaagtaaaa

SEQ ID NO: 6340929 - DNA, 15 bp, Homo sapiens
gttgaaagtaaaagt

SEQ ID NO: 6340930 - DNA, 17 bp, Homo sapiens
gttgaaagtaagttgtt

SEQ ID NO: 6340931 - DNA, 16 bp, Homo sapiens
gttgaaatatgatgtt

SEQ ID NO: 6340932 - DNA, 11 bp, Homo sapiens
gttgaaatctt

SEQ ID NO: 6340933 - DNA, 17 bp, Homo sapiens
gttgaaatgttctgtca

SEQ ID NO: 6340934 - DNA, 23 bp, Homo sapiens
gttgaaatgttctgtcaaatgtg

SEQ ID NO: 6340935 - DNA, 13 bp, Homo sapiens
gttgaaattaagc

SEQ ID NO: 6340936 - DNA, 15 bp, Homo sapiens
gttgaaattgtaatt

SEQ ID NO: 6340937 - DNA, 13 bp, Homo sapiens
gttgaacagctat

SEQ ID NO: 6340938 - DNA, 18 bp, Homo sapiens
gttgaaccaaacctccct

SEQ ID NO: 6340939 - DNA, 18 bp, Homo sapiens
gttgaaccctccccacca

SEQ ID NO: 6340940 - DNA, 16 bp, Homo sapiens
gttgaacctatttctc

SEQ ID NO: 6340941 - DNA, 20 bp, Homo sapiens
gttgaactatgactggagta

SEQ ID NO: 6340942 - DNA, 14 bp, Homo sapiens
gttgaactgcagga

SEQ ID NO: 6340943 - DNA, 18 bp, Homo sapiens
gttgaactgcaggaagag

SEQ ID NO: 6340944 - DNA, 19 bp, Homo sapiens
gttgaactgcaggaagaga

SEQ ID NO: 6340945 - DNA, 17 bp, Homo sapiens
gttgaactgttagaatg

SEQ ID NO: 6340946 - DNA, 13 bp, Homo sapiens
gttgaagaaaaaa

SEQ ID NO: 6340947 - DNA, 12 bp, Homo sapiens
gttgaagaagag

SEQ ID NO: 6340948 - DNA, 20 bp, Homo sapiens
gttgaagaagagtttgcaaa

SEQ ID NO: 6340949 - DNA, 16 bp, Homo sapiens
gttgaagacagagcta

SEQ ID NO: 6340950 - DNA, 19 bp, Homo sapiens
gttgaagacctaaccaggg

SEQ ID NO: 6340951 - DNA, 19 bp, Homo sapiens
gttgaagagacagagacaa

SEQ ID NO: 6340952 - DNA, 18 bp, Homo sapiens
gttgaagatttgaggact

SEQ ID NO: 6340953 - DNA, 23 bp, Homo sapiens
gttgaagcaaatcgaatgaaatt

SEQ ID NO: 6340954 - DNA, 16 bp, Homo sapiens
gttgaagcgcggaccc

SEQ ID NO: 6340955 - DNA, 18 bp, Homo sapiens
gttgaaggaacttaaaac

SEQ ID NO: 6340956 - DNA, 19 bp, Homo sapiens
gttgaaggtgccattttaa

SEQ ID NO: 6340957 - DNA, 19 bp, Homo sapiens
gttgaagtcatgctcccct

SEQ ID NO: 6340958 - DNA, 12 bp, Homo sapiens
gttgaagtgaga

SEQ ID NO: 6340959 - DNA, 16 bp, Homo sapiens
gttgaagtgcatgtta

SEQ ID NO: 6340960 - DNA, 14 bp, Homo sapiens
gttgaataatttgt

SEQ ID NO: 6340961 - DNA, 13 bp, Homo sapiens
gttgaatactttt

SEQ ID NO: 6340962 - DNA, 18 bp, Homo sapiens
gttgaatatagcctgcct

SEQ ID NO: 6340963 - DNA, 21 bp, Homo sapiens
gttgaatatagcctgcctcag

SEQ ID NO: 6340964 - DNA, 13 bp, Homo sapiens
gttgaatatgatt

SEQ ID NO: 6340965 - DNA, 14 bp, Homo sapiens
gttgaatggctttt

SEQ ID NO: 6340966 - DNA, 14 bp, Homo sapiens
gttgaatttattgg

SEQ ID NO: 6340967 - DNA, 21 bp, Homo sapiens
gttgaatttattggcttttct

SEQ ID NO: 6340968 - DNA, 20 bp, Homo sapiens
gttgaattttattgaaagct

SEQ ID NO: 6340969 - DNA, 22 bp, Homo sapiens
gttgaattttttttaatgctta

SEQ ID NO: 6340970 - DNA, 19 bp, Homo sapiens
gttgacaaaatatataatg

SEQ ID NO: 6340971 - DNA, 15 bp, Homo sapiens
gttgacaacctagaa

SEQ ID NO: 6340972 - DNA, 17 bp, Homo sapiens
gttgacaacctagaatg

SEQ ID NO: 6340973 - DNA, 16 bp, Homo sapiens
gttgacaactgtgact

SEQ ID NO: 6340974 - DNA, 15 bp, Homo sapiens
gttgacaattctgca

SEQ ID NO: 6340975 - DNA, 16 bp, Homo sapiens
gttgacaattctgcat

SEQ ID NO: 6340976 - DNA, 19 bp, Homo sapiens
gttgacacatatgaacaca

SEQ ID NO: 6340977 - DNA, 21 bp, Homo sapiens
gttgacacattgcacacacag

SEQ ID NO: 6340978 - DNA, 16 bp, Homo sapiens
gttgacacctgagaaa

SEQ ID NO: 6340979 - DNA, 15 bp, Homo sapiens
gttgacacggccatg

SEQ ID NO: 6340980 - DNA, 16 bp, Homo sapiens
gttgacagcaaaatgt

SEQ ID NO: 6340981 - DNA, 17 bp, Homo sapiens
gttgacagcaacaaagc

SEQ ID NO: 6340982 - DNA, 12 bp, Homo sapiens
gttgacagcagg

SEQ ID NO: 6340983 - DNA, 21 bp, Homo sapiens
gttgacaggtacttggagggc

SEQ ID NO: 6340984 - DNA, 13 bp, Homo sapiens
gttgacagtatta

SEQ ID NO: 6340985 - DNA, 22 bp, Homo sapiens
gttgacagtattaacactaaat

SEQ ID NO: 6340986 - DNA, 16 bp, Homo sapiens
gttgacatagcctttg

SEQ ID NO: 6340987 - DNA, 23 bp, Homo sapiens
gttgacatatttaatgttttaaa

SEQ ID NO: 6340988 - DNA, 13 bp, Homo sapiens
gttgacatgggac

SEQ ID NO: 6340989 - DNA, 15 bp, Homo sapiens
gttgacattctgaat

SEQ ID NO: 6340990 - DNA, 18 bp, Homo sapiens
gttgacattctgaatgct

SEQ ID NO: 6340991 - DNA, 23 bp, Homo sapiens
gttgaccagataaatagaactat

SEQ ID NO: 6340992 - DNA, 18 bp, Homo sapiens
gttgaccaggctggagtg

SEQ ID NO: 6340993 - DNA, 22 bp, Homo sapiens
gttgaccatgtctatgattcgt

SEQ ID NO: 6340994 - DNA, 15 bp, Homo sapiens
gttgacccctcctga

SEQ ID NO: 6340995 - DNA, 15 bp, Homo sapiens
gttgacccctttccc

SEQ ID NO: 6340996 - DNA, 22 bp, Homo sapiens
gttgaccctactgtggattggt

SEQ ID NO: 6340997 - DNA, 19 bp, Homo sapiens
gttgacctaccctggaccg

SEQ ID NO: 6340998 - DNA, 23 bp, Homo sapiens
gttgacgggccgcaggagggagg

SEQ ID NO: 6340999 - DNA, 21 bp, Homo sapiens
gttgactcaagtttttacaaa

SEQ ID NO: 6341000 - DNA, 19 bp, Homo sapiens
gttgactcagagtgcaaga

SEQ ID NO: 6341001 - DNA, 21 bp, Homo sapiens
gttgactctagtactgtgaat

SEQ ID NO: 6341002 - DNA, 22 bp, Homo sapiens
gttgactctagtactgtgaatc

SEQ ID NO: 6341003 - DNA, 15 bp, Homo sapiens
gttgactgactgagc

SEQ ID NO: 6341004 - DNA, 20 bp, Homo sapiens
gttgacttattttctctgtg

SEQ ID NO: 6341005 - DNA, 16 bp, Homo sapiens
gttgacttcaaatgtg

SEQ ID NO: 6341006 - DNA, 19 bp, Homo sapiens
gttgacttcaaatgtgtaa

SEQ ID NO: 6341007 - DNA, 22 bp, Homo sapiens
gttgacttccaggcacggtttg

SEQ ID NO: 6341008 - DNA, 18 bp, Homo sapiens
gttgacttcgcagccccg

SEQ ID NO: 6341009 - DNA, 19 bp, Homo sapiens
gttgacttgacagaacact

SEQ ID NO: 6341010 - DNA, 23 bp, Homo sapiens
gttgactttttaaaattctgagt

SEQ ID NO: 6341011 - DNA, 18 bp, Homo sapiens
gttgagaaaaaagaccct

SEQ ID NO: 6341012 - DNA, 15 bp, Homo sapiens
gttgagaaacagttc

SEQ ID NO: 6341013 - DNA, 17 bp, Homo sapiens
gttgagaaggtgcctgc

SEQ ID NO: 6341014 - DNA, 18 bp, Homo sapiens
gttgagaaggtgcctgcc

SEQ ID NO: 6341015 - DNA, 21 bp, Homo sapiens
gttgagaatcactgctccagg

SEQ ID NO: 6341016 - DNA, 16 bp, Homo sapiens
gttgagaatgcagtga

SEQ ID NO: 6341017 - DNA, 20 bp, Homo sapiens
gttgagaattgtgctcaaaa

SEQ ID NO: 6341018 - DNA, 11 bp, Homo sapiens
gttgagagaac

SEQ ID NO: 6341019 - DNA, 12 bp, Homo sapiens
gttgagagccag

SEQ ID NO: 6341020 - DNA, 13 bp, Homo sapiens
gttgagagccagt

SEQ ID NO: 6341021 - DNA, 18 bp, Homo sapiens
gttgagaggacactcccg

SEQ ID NO: 6341022 - DNA, 16 bp, Homo sapiens
gttgagaggaggactt

SEQ ID NO: 6341023 - DNA, 19 bp, Homo sapiens
gttgagattgtactgttca

SEQ ID NO: 6341024 - DNA, 20 bp, Homo sapiens
gttgagatttttaagaactt

SEQ ID NO: 6341025 - DNA, 18 bp, Homo sapiens
gttgagccagcagacatt

SEQ ID NO: 6341026 - DNA, 22 bp, Homo sapiens
gttgagccagcagacattgtca

SEQ ID NO: 6341027 - DNA, 16 bp, Homo sapiens
gttgagccccaagtcc

SEQ ID NO: 6341028 - DNA, 19 bp, Homo sapiens
gttgagccccaagtcctga

SEQ ID NO: 6341029 - DNA, 20 bp, Homo sapiens
gttgagccccaagtcctgaa

SEQ ID NO: 6341030 - DNA, 16 bp, Homo sapiens
gttgagccccagtgct

SEQ ID NO: 6341031 - DNA, 17 bp, Homo sapiens
gttgagccccagtgctg

SEQ ID NO: 6341032 - DNA, 19 bp, Homo sapiens
gttgagccccagtgctgga

SEQ ID NO: 6341033 - DNA, 14 bp, Homo sapiens
gttgagccttttcc

SEQ ID NO: 6341034 - DNA, 23 bp, Homo sapiens
gttgagcgtacgatggaggccta

SEQ ID NO: 6341035 - DNA, 18 bp, Homo sapiens
gttgagcgtgcgcactgc

SEQ ID NO: 6341036 - DNA, 14 bp, Homo sapiens
gttgagctcaggtt

SEQ ID NO: 6341037 - DNA, 16 bp, Homo sapiens
gttgaggaactgtaca

SEQ ID NO: 6341038 - DNA, 17 bp, Homo sapiens
gttgaggatgtggcaca

SEQ ID NO: 6341039 - DNA, 15 bp, Homo sapiens
gttgaggccaaggaa

SEQ ID NO: 6341040 - DNA, 19 bp, Homo sapiens
gttgaggccactgtgttcc

SEQ ID NO: 6341041 - DNA, 18 bp, Homo sapiens
gttgaggcgagcagggca

SEQ ID NO: 6341042 - DNA, 19 bp, Homo sapiens
gttgagggaacagacagga

SEQ ID NO: 6341043 - DNA, 23 bp, Homo sapiens
gttgagggaacagacaggagaaa

SEQ ID NO: 6341044 - DNA, 16 bp, Homo sapiens
gttgagggagtgggga

SEQ ID NO: 6341045 - DNA, 20 bp, Homo sapiens
gttgagggcatttggcttcc

SEQ ID NO: 6341046 - DNA, 21 bp, Homo sapiens
gttgagggcatttggcttcct

SEQ ID NO: 6341047 - DNA, 13 bp, Homo sapiens
gttgaggggagag

SEQ ID NO: 6341048 - DNA, 18 bp, Homo sapiens
gttgaggggctcctggaa

SEQ ID NO: 6341049 - DNA, 20 bp, Homo sapiens
gttgaggtggaagccctcct

SEQ ID NO: 6341050 - DNA, 23 bp, Homo sapiens
gttgaggtggtctgaatgttctg

SEQ ID NO: 6341051 - DNA, 16 bp, Homo sapiens
gttgaggtttttaaat

SEQ ID NO: 6341052 - DNA, 15 bp, Homo sapiens
gttgagtatttgctg

SEQ ID NO: 6341053 - DNA, 14 bp, Homo sapiens
gttgagtctcctct

SEQ ID NO: 6341054 - DNA, 20 bp, Homo sapiens
gttgagtctcctctctgaga

SEQ ID NO: 6341055 - DNA, 22 bp, Homo sapiens
gttgagtctcctctctgagact

SEQ ID NO: 6341056 - DNA, 23 bp, Homo sapiens
gttgagtctcctctctgagactg

SEQ ID NO: 6341057 - DNA, 18 bp, Homo sapiens
gttgagtgggtatttctt

SEQ ID NO: 6341058 - DNA, 22 bp, Homo sapiens
gttgagttacattaaaataaac

SEQ ID NO: 6341059 - DNA, 21 bp, Homo sapiens
gttgagttcaggtagctgccc

SEQ ID NO: 6341060 - DNA, 16 bp, Homo sapiens
gttgagttggacacac

SEQ ID NO: 6341061 - DNA, 13 bp, Homo sapiens
gttgagttttcca

SEQ ID NO: 6341062 - DNA, 15 bp, Homo sapiens
gttgataaaaatact

SEQ ID NO: 6341063 - DNA, 21 bp, Homo sapiens
gttgataaaccaaaaacattt

SEQ ID NO: 6341064 - DNA, 12 bp, Homo sapiens
gttgataaatcc

SEQ ID NO: 6341065 - DNA, 17 bp, Homo sapiens
gttgataactttgcttg

SEQ ID NO: 6341066 - DNA, 17 bp, Homo sapiens
gttgataaggaacattt

SEQ ID NO: 6341067 - DNA, 13 bp, Homo sapiens
gttgataatttca

SEQ ID NO: 6341068 - DNA, 15 bp, Homo sapiens
gttgataatttcagg

SEQ ID NO: 6341069 - DNA, 18 bp, Homo sapiens
gttgatacaaaccactgt

SEQ ID NO: 6341070 - DNA, 13 bp, Homo sapiens
gttgatactgttg

SEQ ID NO: 6341071 - DNA, 16 bp, Homo sapiens
gttgatactgttgcac

SEQ ID NO: 6341072 - DNA, 23 bp, Homo sapiens
gttgatagcacagaccctgccct

SEQ ID NO: 6341073 - DNA, 19 bp, Homo sapiens
gttgataggagacttgtac

SEQ ID NO: 6341074 - DNA, 12 bp, Homo sapiens
gttgatagttta

SEQ ID NO: 6341075 - DNA, 23 bp, Homo sapiens
gttgatattggttctatttattt

SEQ ID NO: 6341076 - DNA, 18 bp, Homo sapiens
gttgatattgtttgctgt

SEQ ID NO: 6341077 - DNA, 15 bp, Homo sapiens
gttgatcatgcagga

SEQ ID NO: 6341078 - DNA, 16 bp, Homo sapiens
gttgatccatctcagt

SEQ ID NO: 6341079 - DNA, 16 bp, Homo sapiens
gttgatcccctctctg

SEQ ID NO: 6341080 - DNA, 15 bp, Homo sapiens
gttgatctgcatatt

SEQ ID NO: 6341081 - DNA, 14 bp, Homo sapiens
gttgatctgctctg

SEQ ID NO: 6341082 - DNA, 22 bp, Homo sapiens
gttgatctggaacccagactca

SEQ ID NO: 6341083 - DNA, 14 bp, Homo sapiens
gttgatcttcttca

SEQ ID NO: 6341084 - DNA, 15 bp, Homo sapiens
gttgatctttcacta

SEQ ID NO: 6341085 - DNA, 21 bp, Homo sapiens
gttgatgaggacccagagctg

SEQ ID NO: 6341086 - DNA, 12 bp, Homo sapiens
gttgatgcaatc

SEQ ID NO: 6341087 - DNA, 24 bp, Homo sapiens
gttgatgcaatccttacaaatgat

SEQ ID NO: 6341088 - DNA, 22 bp, Homo sapiens
gttgatgctaataaatattgtc

SEQ ID NO: 6341089 - DNA, 13 bp, Homo sapiens
gttgatggaaaat

SEQ ID NO: 6341090 - DNA, 17 bp, Homo sapiens
gttgatgggatgattga

SEQ ID NO: 6341091 - DNA, 18 bp, Homo sapiens
gttgatgggccttcagat

SEQ ID NO: 6341092 - DNA, 21 bp, Homo sapiens
gttgatggtagggtataatgt

SEQ ID NO: 6341093 - DNA, 13 bp, Homo sapiens
gttgatgtatctg

SEQ ID NO: 6341094 - DNA, 14 bp, Homo sapiens
gttgatgtatctga

SEQ ID NO: 6341095 - DNA, 19 bp, Homo sapiens
gttgatgtgggaagaagta

SEQ ID NO: 6341096 - DNA, 20 bp, Homo sapiens
gttgatgtgggaagaagtaa

SEQ ID NO: 6341097 - DNA, 17 bp, Homo sapiens
gttgatgttggctggga

SEQ ID NO: 6341098 - DNA, 14 bp, Homo sapiens
gttgattaaagatg

SEQ ID NO: 6341099 - DNA, 13 bp, Homo sapiens
gttgattctctcc

SEQ ID NO: 6341100 - DNA, 17 bp, Homo sapiens
gttgattctgtccccca

SEQ ID NO: 6341101 - DNA, 13 bp, Homo sapiens
gttgattgctaaa

SEQ ID NO: 6341102 - DNA, 16 bp, Homo sapiens
gttgattgctaaatgt

SEQ ID NO: 6341103 - DNA, 22 bp, Homo sapiens
gttgattgctaaatgtaacagt

SEQ ID NO: 6341104 - DNA, 15 bp, Homo sapiens
gttgattgtgcatgg

SEQ ID NO: 6341105 - DNA, 16 bp, Homo sapiens
gttgatttctagttat

SEQ ID NO: 6341106 - DNA, 18 bp, Homo sapiens
ggtagtgccaatgacagg

SEQ ID NO: 6341107 - DNA, 19 bp, Homo sapiens
ggtagtgccaatgacagga

SEQ ID NO: 6341108 - DNA, 20 bp, Homo sapiens
ggtagtgccaatgacaggac

SEQ ID NO: 6341109 - DNA, 21 bp, Homo sapiens
ggtagtgccgcagtggggtca

SEQ ID NO: 6341110 - DNA, 19 bp, Homo sapiens
ggtagtgctttaagaatga

SEQ ID NO: 6341111 - DNA, 15 bp, Homo sapiens
ggtagtggctggggt

SEQ ID NO: 6341112 - DNA, 19 bp, Homo sapiens
ggtagttagtagcatgttg

SEQ ID NO: 6341113 - DNA, 13 bp, Homo sapiens
ggtagttcaagaa

SEQ ID NO: 6341114 - DNA, 18 bp, Homo sapiens
ggtagttctgtgcctccc

SEQ ID NO: 6341115 - DNA, 20 bp, Homo sapiens
ggtagttctgtgcctccccc

SEQ ID NO: 6341116 - DNA, 19 bp, Homo sapiens
ggtagttgggtagaaaaat

SEQ ID NO: 6341117 - DNA, 23 bp, Homo sapiens
ggtagttttccatggtcacagag

SEQ ID NO: 6341118 - DNA, 12 bp, Homo sapiens
ggtataaaaaat

SEQ ID NO: 6341119 - DNA, 21 bp, Homo sapiens
ggtataaaactttcctcgcct

SEQ ID NO: 6341120 - DNA, 12 bp, Homo sapiens
ggtataaaagat

SEQ ID NO: 6341121 - DNA, 19 bp, Homo sapiens
ggtataaggatcttttgta

SEQ ID NO: 6341122 - DNA, 18 bp, Homo sapiens
ggtataagtggtgtgtgt

SEQ ID NO: 6341123 - DNA, 14 bp, Homo sapiens
ggtataatgtttaa

SEQ ID NO: 6341124 - DNA, 14 bp, Homo sapiens
ggtataattgaaac

SEQ ID NO: 6341125 - DNA, 14 bp, Homo sapiens
ggtatacaaataaa

SEQ ID NO: 6341126 - DNA, 13 bp, Homo sapiens
ggtatagaaatgc

SEQ ID NO: 6341127 - DNA, 13 bp, Homo sapiens
ggtataggtctca

SEQ ID NO: 6341128 - DNA, 13 bp, Homo sapiens
ggtatatactttg

SEQ ID NO: 6341129 - DNA, 13 bp, Homo sapiens
ggtatatatacat

SEQ ID NO: 6341130 - DNA, 22 bp, Homo sapiens
ggtatatatttaggatttgtgt

SEQ ID NO: 6341131 - DNA, 17 bp, Homo sapiens
ggtatatcaggagggga

SEQ ID NO: 6341132 - DNA, 19 bp, Homo sapiens
ggtatatccttttctgtgt

SEQ ID NO: 6341133 - DNA, 19 bp, Homo sapiens
ggtatatctaggtttatga

SEQ ID NO: 6341134 - DNA, 21 bp, Homo sapiens
ggtatatctaggtttatgaca

SEQ ID NO: 6341135 - DNA, 15 bp, Homo sapiens
ggtatatctgggctg

SEQ ID NO: 6341136 - DNA, 18 bp, Homo sapiens
ggtatatgtcattattta

SEQ ID NO: 6341137 - DNA, 13 bp, Homo sapiens
ggtatattcattt

SEQ ID NO: 6341138 - DNA, 13 bp, Homo sapiens
ggtatatttctgg

SEQ ID NO: 6341139 - DNA, 14 bp, Homo sapiens
ggtatcaaaattac

SEQ ID NO: 6341140 - DNA, 15 bp, Homo sapiens
ggtatcaagaaagtc

SEQ ID NO: 6341141 - DNA, 21 bp, Homo sapiens
ggtatcacacactttctgact

SEQ ID NO: 6341142 - DNA, 13 bp, Homo sapiens
ggtatcaggcaca

SEQ ID NO: 6341143 - DNA, 16 bp, Homo sapiens
ggtatcagttatatga

SEQ ID NO: 6341144 - DNA, 15 bp, Homo sapiens
ggtatcccctgcctc

SEQ ID NO: 6341145 - DNA, 20 bp, Homo sapiens
ggtatcccctgcctcctgcc

SEQ ID NO: 6341146 - DNA, 14 bp, Homo sapiens
ggtatcctccctgc

SEQ ID NO: 6341147 - DNA, 21 bp, Homo sapiens
ggtatcctcctaaagacctcc

SEQ ID NO: 6341148 - DNA, 15 bp, Homo sapiens
ggtatcctgcccagt

SEQ ID NO: 6341149 - DNA, 20 bp, Homo sapiens
ggtatctaattctttaatga

SEQ ID NO: 6341150 - DNA, 16 bp, Homo sapiens
ggtatctccaggattg

SEQ ID NO: 6341151 - DNA, 20 bp, Homo sapiens
ggtatctgatgatgttctga

SEQ ID NO: 6341152 - DNA, 13 bp, Homo sapiens
ggtatctggcttc

SEQ ID NO: 6341153 - DNA, 18 bp, Homo sapiens
ggtatctggcttccctgg

SEQ ID NO: 6341154 - DNA, 16 bp, Homo sapiens
ggtatctgttctttaa

SEQ ID NO: 6341155 - DNA, 23 bp, Homo sapiens
ggtatctttaattgtatctcctt

SEQ ID NO: 6341156 - DNA, 13 bp, Homo sapiens
ggtatgaagagtg

SEQ ID NO: 6341157 - DNA, 13 bp, Homo sapiens
ggtatgagggggt

SEQ ID NO: 6341158 - DNA, 16 bp, Homo sapiens
ggtatgatcaataaag

SEQ ID NO: 6341159 - DNA, 12 bp, Homo sapiens
ggtatgatcatt

SEQ ID NO: 6341160 - DNA, 19 bp, Homo sapiens
ggtatgatccttgttttaa

SEQ ID NO: 6341161 - DNA, 21 bp, Homo sapiens
ggtatgattctattatatatt

SEQ ID NO: 6341162 - DNA, 14 bp, Homo sapiens
ggtatgcaatcaaa

SEQ ID NO: 6341163 - DNA, 17 bp, Homo sapiens
ggtatgcagagcttgtg

SEQ ID NO: 6341164 - DNA, 20 bp, Homo sapiens
ggtatgctggccagcaccct

SEQ ID NO: 6341165 - DNA, 22 bp, Homo sapiens
ggtatgggctgttctgtttcct

SEQ ID NO: 6341166 - DNA, 18 bp, Homo sapiens
ggtatggtaaagagatgt

SEQ ID NO: 6341167 - DNA, 18 bp, Homo sapiens
ggtatgtagccagctgtg

SEQ ID NO: 6341168 - DNA, 20 bp, Homo sapiens
ggtatgtagcccggccaggg

SEQ ID NO: 6341169 - DNA, 23 bp, Homo sapiens
ggtatgtatattttcagtgggtt

SEQ ID NO: 6341170 - DNA, 13 bp, Homo sapiens
ggtatgtgccagg

SEQ ID NO: 6341171 - DNA, 12 bp, Homo sapiens
ggtatgtgcctg

SEQ ID NO: 6341172 - DNA, 24 bp, Homo sapiens
ggtatgtgcgtgtgcgtgttcctt

SEQ ID NO: 6341173 - DNA, 19 bp, Homo sapiens
ggtatgttaacctaggcag

SEQ ID NO: 6341174 - DNA, 14 bp, Homo sapiens
ggtatgttcctaag

SEQ ID NO: 6341175 - DNA, 21 bp, Homo sapiens
ggtattaaacaagtcaattct

SEQ ID NO: 6341176 - DNA, 11 bp, Homo sapiens
ggtattaaact

SEQ ID NO: 6341177 - DNA, 15 bp, Homo sapiens
ggtattaaagatgtg

SEQ ID NO: 6341178 - DNA, 22 bp, Homo sapiens
ggtattaacgtgtcagggctga

SEQ ID NO: 6341179 - DNA, 22 bp, Homo sapiens
ggtattaactttatacacttgg

SEQ ID NO: 6341180 - DNA, 16 bp, Homo sapiens
ggtattaataaaaaga

SEQ ID NO: 6341181 - DNA, 21 bp, Homo sapiens
ggtattaatcttattgtttaa

SEQ ID NO: 6341182 - DNA, 18 bp, Homo sapiens
ggtattaccatgtaaata

SEQ ID NO: 6341183 - DNA, 22 bp, Homo sapiens
ggtattaccatgtaaataatct

SEQ ID NO: 6341184 - DNA, 14 bp, Homo sapiens
ggtattagaaagtg

SEQ ID NO: 6341185 - DNA, 17 bp, Homo sapiens
ggtattatctagtaggt

SEQ ID NO: 6341186 - DNA, 18 bp, Homo sapiens
ggtattattctgttttgc

SEQ ID NO: 6341187 - DNA, 19 bp, Homo sapiens
ggtattcccactcaccagc

SEQ ID NO: 6341188 - DNA, 18 bp, Homo sapiens
ggtattccttttgtgtac

SEQ ID NO: 6341189 - DNA, 18 bp, Homo sapiens
ggtattctgtaatttggc

SEQ ID NO: 6341190 - DNA, 17 bp, Homo sapiens
ggtattgactcaacagt

SEQ ID NO: 6341191 - DNA, 20 bp, Homo sapiens
ggtattgcactacattatgg

SEQ ID NO: 6341192 - DNA, 21 bp, Homo sapiens
ggtattgcagagaagatttta

SEQ ID NO: 6341193 - DNA, 18 bp, Homo sapiens
ggtattgcgaaacaactt

SEQ ID NO: 6341194 - DNA, 23 bp, Homo sapiens
ggtattggctagaggttcaaaga

SEQ ID NO: 6341195 - DNA, 18 bp, Homo sapiens
ggtattggtggctttcct

SEQ ID NO: 6341196 - DNA, 12 bp, Homo sapiens
ggtattgtattt

SEQ ID NO: 6341197 - DNA, 17 bp, Homo sapiens
ggtattgtcttaaataa

SEQ ID NO: 6341198 - DNA, 15 bp, Homo sapiens
ggtatttaagactga

SEQ ID NO: 6341199 - DNA, 15 bp, Homo sapiens
ggtatttacacatac

SEQ ID NO: 6341200 - DNA, 14 bp, Homo sapiens
ggtatttataatat

SEQ ID NO: 6341201 - DNA, 20 bp, Homo sapiens
ggtatttatctattgtaaga

SEQ ID NO: 6341202 - DNA, 23 bp, Homo sapiens
ggtatttattctctatttattgg

SEQ ID NO: 6341203 - DNA, 12 bp, Homo sapiens
ggtatttcttat

SEQ ID NO: 6341204 - DNA, 19 bp, Homo sapiens
ggtatttggatatctgtta

SEQ ID NO: 6341205 - DNA, 14 bp, Homo sapiens
ggtatttgtttaat

SEQ ID NO: 6341206 - DNA, 21 bp, Homo sapiens
ggtatttgtttgtagctttcc

SEQ ID NO: 6341207 - DNA, 15 bp, Homo sapiens
ggtattttaacatag

SEQ ID NO: 6341208 - DNA, 12 bp, Homo sapiens
ggtattttgtca

SEQ ID NO: 6341209 - DNA, 19 bp, Homo sapiens
ggtattttgtcagttttaa

SEQ ID NO: 6341210 - DNA, 17 bp, Homo sapiens
ggtattttttgtgaatg

SEQ ID NO: 6341211 - DNA, 21 bp, Homo sapiens
ggtatttttttgtaattgctt

SEQ ID NO: 6341212 - DNA, 20 bp, Homo sapiens
ggtcaaactacattgagccc

SEQ ID NO: 6341213 - DNA, 14 bp, Homo sapiens
ggtcaaacttgttt

SEQ ID NO: 6341214 - DNA, 14 bp, Homo sapiens
ggtcaaaggaagac

SEQ ID NO: 6341215 - DNA, 16 bp, Homo sapiens
ggtcaaatgctagaaa

SEQ ID NO: 6341216 - DNA, 11 bp, Homo sapiens
ggtcaacagaa

SEQ ID NO: 6341217 - DNA, 17 bp, Homo sapiens
ggtcaacagaatgaaaa

SEQ ID NO: 6341218 - DNA, 20 bp, Homo sapiens
ggtcaacagaatgaaaaatg

SEQ ID NO: 6341219 - DNA, 21 bp, Homo sapiens
ggtcaacagaatgaaaaatga

SEQ ID NO: 6341220 - DNA, 18 bp, Homo sapiens
ggtcaacagctatgctgg

SEQ ID NO: 6341221 - DNA, 16 bp, Homo sapiens
ggtcaacagttttcct

SEQ ID NO: 6341222 - DNA, 23 bp, Homo sapiens
ggtcaacatcttttacattctgc

SEQ ID NO: 6341223 - DNA, 13 bp, Homo sapiens
ggtcaacccgctg

SEQ ID NO: 6341224 - DNA, 17 bp, Homo sapiens
ggtcaacccgctgcttc

SEQ ID NO: 6341225 - DNA, 19 bp, Homo sapiens
ggtcaacggccctgtttat

SEQ ID NO: 6341226 - DNA, 14 bp, Homo sapiens
ggtcaactccaagg

SEQ ID NO: 6341227 - DNA, 20 bp, Homo sapiens
ggtcaactccaaggcaaatg

SEQ ID NO: 6341228 - DNA, 18 bp, Homo sapiens
ggtcaacttgacaccact

SEQ ID NO: 6341229 - DNA, 14 bp, Homo sapiens
ggtcaagaaacagc

SEQ ID NO: 6341230 - DNA, 20 bp, Homo sapiens
ggtcaagaaaggaggggaga

SEQ ID NO: 6341231 - DNA, 22 bp, Homo sapiens
ggtcaagaaatgagtctgtttg

SEQ ID NO: 6341232 - DNA, 20 bp, Homo sapiens
ggtcaagattttgaatgctt

SEQ ID NO: 6341233 - DNA, 15 bp, Homo sapiens
ggtcaagcccaggag

SEQ ID NO: 6341234 - DNA, 17 bp, Homo sapiens
ggtcaagcccaggagga

SEQ ID NO: 6341235 - DNA, 17 bp, Homo sapiens
ggtcaagcctgcagcga

SEQ ID NO: 6341236 - DNA, 23 bp, Homo sapiens
ggtcaagctatttctctggatct

SEQ ID NO: 6341237 - DNA, 13 bp, Homo sapiens
ggtcaagctgagc

SEQ ID NO: 6341238 - DNA, 16 bp, Homo sapiens
ggtcaagctgagctgg

SEQ ID NO: 6341239 - DNA, 18 bp, Homo sapiens
ggtcaagctgagctggct

SEQ ID NO: 6341240 - DNA, 15 bp, Homo sapiens
ggtcaaggaaggaaa

SEQ ID NO: 6341241 - DNA, 23 bp, Homo sapiens
ggtcaaggcaccagcaaatttgg

SEQ ID NO: 6341242 - DNA, 15 bp, Homo sapiens
ggtcaagggctgggg

SEQ ID NO: 6341243 - DNA, 14 bp, Homo sapiens
ggtcaataaactta

SEQ ID NO: 6341244 - DNA, 21 bp, Homo sapiens
ggtcaataaacttagaggaaa

SEQ ID NO: 6341245 - DNA, 15 bp, Homo sapiens
ggtcaataaagcaga

SEQ ID NO: 6341246 - DNA, 16 bp, Homo sapiens
ggtcaataaagcagag

SEQ ID NO: 6341247 - DNA, 17 bp, Homo sapiens
ggtcaataaagcagagc

SEQ ID NO: 6341248 - DNA, 19 bp, Homo sapiens
ggtcaataacactgtattt

SEQ ID NO: 6341249 - DNA, 16 bp, Homo sapiens
ggtcaataattgtgga

SEQ ID NO: 6341250 - DNA, 20 bp, Homo sapiens
ggtcaatacagtacaggcag

SEQ ID NO: 6341251 - DNA, 13 bp, Homo sapiens
ggtcaatcccaaa

SEQ ID NO: 6341252 - DNA, 22 bp, Homo sapiens
ggtcaatgacacccctggcctg

SEQ ID NO: 6341253 - DNA, 23 bp, Homo sapiens
ggtcaatgctatttttgttttta

SEQ ID NO: 6341254 - DNA, 20 bp, Homo sapiens
ggtcacacaaaggcatgctg

SEQ ID NO: 6341255 - DNA, 16 bp, Homo sapiens
ggtcacacctcactgt

SEQ ID NO: 6341256 - DNA, 21 bp, Homo sapiens
ggtcacacctcactgtcatct

SEQ ID NO: 6341257 - DNA, 19 bp, Homo sapiens
ggtcacacgaccggggcca

SEQ ID NO: 6341258 - DNA, 20 bp, Homo sapiens
ggtcacactgtggaacacta

SEQ ID NO: 6341259 - DNA, 15 bp, Homo sapiens
ggtcacagacccctg

SEQ ID NO: 6341260 - DNA, 19 bp, Homo sapiens
ggtcacagacttctggcct

SEQ ID NO: 6341261 - DNA, 12 bp, Homo sapiens
ggtcacagaggc

SEQ ID NO: 6341262 - DNA, 13 bp, Homo sapiens
ggtcacagccagg

SEQ ID NO: 6341263 - DNA, 17 bp, Homo sapiens
ggtcacagccaggcgct

SEQ ID NO: 6341264 - DNA, 17 bp, Homo sapiens
ggtcacagcctcctctg

SEQ ID NO: 6341265 - DNA, 15 bp, Homo sapiens
ggtcacagcggaggt

SEQ ID NO: 6341266 - DNA, 15 bp, Homo sapiens
ggtcacagctggatc

SEQ ID NO: 6341267 - DNA, 14 bp, Homo sapiens
ggtcacaggaagga

SEQ ID NO: 6341268 - DNA, 11 bp, Homo sapiens
ggtcacaggca

SEQ ID NO: 6341269 - DNA, 11 bp, Homo sapiens
ggtcacaggcc

SEQ ID NO: 6341270 - DNA, 15 bp, Homo sapiens
ggtcacaggcccaga

SEQ ID NO: 6341271 - DNA, 21 bp, Homo sapiens
ggtcacattcaggaagatgaa

SEQ ID NO: 6341272 - DNA, 19 bp, Homo sapiens
ggtcaccaaggcagtgcat

SEQ ID NO: 6341273 - DNA, 20 bp, Homo sapiens
ggtcaccaaggcagtgcatg

SEQ ID NO: 6341274 - DNA, 23 bp, Homo sapiens
ggtcaccaaggcagtgcatgcat

SEQ ID NO: 6341275 - DNA, 12 bp, Homo sapiens
ggtcaccaccct

SEQ ID NO: 6341276 - DNA, 13 bp, Homo sapiens
ggtcaccaccctc

SEQ ID NO: 6341277 - DNA, 19 bp, Homo sapiens
ggtcaccagacggggctgg

SEQ ID NO: 6341278 - DNA, 19 bp, Homo sapiens
ggtcaccagcctgactgca

SEQ ID NO: 6341279 - DNA, 16 bp, Homo sapiens
ggtcaccagctcctcc

SEQ ID NO: 6341280 - DNA, 15 bp, Homo sapiens
ggtcaccagctgctg

SEQ ID NO: 6341281 - DNA, 14 bp, Homo sapiens
ggtcaccatgaaac

SEQ ID NO: 6341282 - DNA, 16 bp, Homo sapiens
ggtcacccatggcctc

SEQ ID NO: 6341283 - DNA, 12 bp, Homo sapiens
ggtcaccctgtg

SEQ ID NO: 6341284 - DNA, 18 bp, Homo sapiens
ggtcaccgagactcagcc

SEQ ID NO: 6341285 - DNA, 19 bp, Homo sapiens
ggtcaccgagactcagcct

SEQ ID NO: 6341286 - DNA, 16 bp, Homo sapiens
gttgattttgaacttt

SEQ ID NO: 6341287 - DNA, 18 bp, Homo sapiens
gttgattttgaacttttt

SEQ ID NO: 6341288 - DNA, 22 bp, Homo sapiens
gttgatttttttttttttttcc

SEQ ID NO: 6341289 - DNA, 14 bp, Homo sapiens
gttgcaaaggaaat

SEQ ID NO: 6341290 - DNA, 15 bp, Homo sapiens
gttgcaaaggaaata

SEQ ID NO: 6341291 - DNA, 24 bp, Homo sapiens
gttgcaagactcgaataaaatctg

SEQ ID NO: 6341292 - DNA, 14 bp, Homo sapiens
gttgcaagatgtga

SEQ ID NO: 6341293 - DNA, 16 bp, Homo sapiens
gttgcaagatgtgaat

SEQ ID NO: 6341294 - DNA, 14 bp, Homo sapiens
gttgcaagcccctc

SEQ ID NO: 6341295 - DNA, 23 bp, Homo sapiens
gttgcaaggatttttccatgtgt

SEQ ID NO: 6341296 - DNA, 16 bp, Homo sapiens
gttgcaaggccgctgt

SEQ ID NO: 6341297 - DNA, 17 bp, Homo sapiens
gttgcaaggccgctgtt

SEQ ID NO: 6341298 - DNA, 16 bp, Homo sapiens
gttgcaatgtgaaaaa

SEQ ID NO: 6341299 - DNA, 18 bp, Homo sapiens
gttgcaattgtttaagaa

SEQ ID NO: 6341300 - DNA, 20 bp, Homo sapiens
gttgcacacccactcagctc

SEQ ID NO: 6341301 - DNA, 15 bp, Homo sapiens
gttgcacactttggt

SEQ ID NO: 6341302 - DNA, 11 bp, Homo sapiens
gttgcacagca

SEQ ID NO: 6341303 - DNA, 16 bp, Homo sapiens
gttgcacagctatgaa

SEQ ID NO: 6341304 - DNA, 13 bp, Homo sapiens
gttgcacatcatt

SEQ ID NO: 6341305 - DNA, 19 bp, Homo sapiens
gttgcacatcattcattca

SEQ ID NO: 6341306 - DNA, 19 bp, Homo sapiens
gttgcacatgattgtataa

SEQ ID NO: 6341307 - DNA, 22 bp, Homo sapiens
gttgcacatgattgtataagca

SEQ ID NO: 6341308 - DNA, 19 bp, Homo sapiens
gttgcaccatctgcttggt

SEQ ID NO: 6341309 - DNA, 14 bp, Homo sapiens
gttgcacccagccc

SEQ ID NO: 6341310 - DNA, 15 bp, Homo sapiens
gttgcacccagccct

SEQ ID NO: 6341311 - DNA, 16 bp, Homo sapiens
gttgcacccagccctg

SEQ ID NO: 6341312 - DNA, 17 bp, Homo sapiens
gttgcacccagccctgg

SEQ ID NO: 6341313 - DNA, 12 bp, Homo sapiens
gttgcacctgag

SEQ ID NO: 6341314 - DNA, 21 bp, Homo sapiens
gttgcacctgagggggaaaaa

SEQ ID NO: 6341315 - DNA, 19 bp, Homo sapiens
gttgcacgtgtgtttttct

SEQ ID NO: 6341316 - DNA, 21 bp, Homo sapiens
gttgcacgtgtgtttttctat

SEQ ID NO: 6341317 - DNA, 23 bp, Homo sapiens
gttgcacgtgtgtttttctatta

SEQ ID NO: 6341318 - DNA, 19 bp, Homo sapiens
gttgcactaaaatgaggat

SEQ ID NO: 6341319 - DNA, 18 bp, Homo sapiens
gttgcactaactgctggt

SEQ ID NO: 6341320 - DNA, 19 bp, Homo sapiens
gttgcacttatgatttcat

SEQ ID NO: 6341321 - DNA, 19 bp, Homo sapiens
gttgcacttggcctctgga

SEQ ID NO: 6341322 - DNA, 17 bp, Homo sapiens
gttgcacttttgaatgt

SEQ ID NO: 6341323 - DNA, 20 bp, Homo sapiens
gttgcagacaggaatcttaa

SEQ ID NO: 6341324 - DNA, 20 bp, Homo sapiens
gttgcagatgaaatgttctg

SEQ ID NO: 6341325 - DNA, 19 bp, Homo sapiens
gttgcagatgtattgactg

SEQ ID NO: 6341326 - DNA, 14 bp, Homo sapiens
gttgcagcactgcc

SEQ ID NO: 6341327 - DNA, 21 bp, Homo sapiens
gttgcagcatgagactttctg

SEQ ID NO: 6341328 - DNA, 18 bp, Homo sapiens
gttgcagccgcagagaaa

SEQ ID NO: 6341329 - DNA, 11 bp, Homo sapiens
gttgcagctgc

SEQ ID NO: 6341330 - DNA, 15 bp, Homo sapiens
gttgcaggacctcag

SEQ ID NO: 6341331 - DNA, 14 bp, Homo sapiens
gttgcaggcagtgt

SEQ ID NO: 6341332 - DNA, 17 bp, Homo sapiens
gttgcaggcagtgtctt

SEQ ID NO: 6341333 - DNA, 14 bp, Homo sapiens
gttgcaggccaggt

SEQ ID NO: 6341334 - DNA, 17 bp, Homo sapiens
gttgcagtcactctagt

SEQ ID NO: 6341335 - DNA, 16 bp, Homo sapiens
gttgcagtcactgtga

SEQ ID NO: 6341336 - DNA, 15 bp, Homo sapiens
gttgcagtcagaaga

SEQ ID NO: 6341337 - DNA, 19 bp, Homo sapiens
gttgcagtctttcccccag

SEQ ID NO: 6341338 - DNA, 21 bp, Homo sapiens
gttgcagtctttcccccagga

SEQ ID NO: 6341339 - DNA, 20 bp, Homo sapiens
gttgcagtgagccgagatca

SEQ ID NO: 6341340 - DNA, 13 bp, Homo sapiens
gttgcagtgagct

SEQ ID NO: 6341341 - DNA, 15 bp, Homo sapiens
gttgcagtgagctga

SEQ ID NO: 6341342 - DNA, 17 bp, Homo sapiens
gttgcagtgagctgaga

SEQ ID NO: 6341343 - DNA, 17 bp, Homo sapiens
gttgcagtggcctggcc

SEQ ID NO: 6341344 - DNA, 23 bp, Homo sapiens
gttgcatagcagtatatgttaat

SEQ ID NO: 6341345 - DNA, 15 bp, Homo sapiens
gttgcatatagttaa

SEQ ID NO: 6341346 - DNA, 16 bp, Homo sapiens
gttgcatatagttaaa

SEQ ID NO: 6341347 - DNA, 16 bp, Homo sapiens
gttgcatcagaaatgt

SEQ ID NO: 6341348 - DNA, 22 bp, Homo sapiens
gttgcatcccccttagaatgtt

SEQ ID NO: 6341349 - DNA, 15 bp, Homo sapiens
gttgcatgataaaca

SEQ ID NO: 6341350 - DNA, 20 bp, Homo sapiens
gttgcatgataaacattcat

SEQ ID NO: 6341351 - DNA, 16 bp, Homo sapiens
gttgcatgatgtattt

SEQ ID NO: 6341352 - DNA, 13 bp, Homo sapiens
gttgcatggaaat

SEQ ID NO: 6341353 - DNA, 14 bp, Homo sapiens
gttgcatggaaatc

SEQ ID NO: 6341354 - DNA, 11 bp, Homo sapiens
gttgcatggta

SEQ ID NO: 6341355 - DNA, 17 bp, Homo sapiens
gttgcatgtttttgaaa

SEQ ID NO: 6341356 - DNA, 18 bp, Homo sapiens
gttgcattaattgtgctg

SEQ ID NO: 6341357 - DNA, 21 bp, Homo sapiens
gttgcattggtttgagaaagg

SEQ ID NO: 6341358 - DNA, 22 bp, Homo sapiens
gttgcattggtttgagaaaggc

SEQ ID NO: 6341359 - DNA, 16 bp, Homo sapiens
gttgcatttagaaatc

SEQ ID NO: 6341360 - DNA, 22 bp, Homo sapiens
gttgcatttagcttctttccct

SEQ ID NO: 6341361 - DNA, 23 bp, Homo sapiens
gttgcattttaaccctattttac

SEQ ID NO: 6341362 - DNA, 13 bp, Homo sapiens
gttgccaaagctg

SEQ ID NO: 6341363 - DNA, 14 bp, Homo sapiens
gttgccaaagctgg

SEQ ID NO: 6341364 - DNA, 16 bp, Homo sapiens
gttgccaaagctggtc

SEQ ID NO: 6341365 - DNA, 19 bp, Homo sapiens
gttgccaaagttttgctgt

SEQ ID NO: 6341366 - DNA, 20 bp, Homo sapiens
gttgccaaatatgtcctggg

SEQ ID NO: 6341367 - DNA, 20 bp, Homo sapiens
gttgccaaatctggctcctt

SEQ ID NO: 6341368 - DNA, 23 bp, Homo sapiens
gttgccaaattgctgcatatttg

SEQ ID NO: 6341369 - DNA, 20 bp, Homo sapiens
gttgccaactattctcaggc

SEQ ID NO: 6341370 - DNA, 14 bp, Homo sapiens
gttgccaagacaaa

SEQ ID NO: 6341371 - DNA, 20 bp, Homo sapiens
gttgccaagacaaatcaaca

SEQ ID NO: 6341372 - DNA, 15 bp, Homo sapiens
gttgccaatatgcca

SEQ ID NO: 6341373 - DNA, 14 bp, Homo sapiens
gttgccaatctaaa

SEQ ID NO: 6341374 - DNA, 20 bp, Homo sapiens
gttgccacaccaatcagaga

SEQ ID NO: 6341375 - DNA, 21 bp, Homo sapiens
gttgccacaccaatcagagag

SEQ ID NO: 6341376 - DNA, 17 bp, Homo sapiens
gttgccacaggcctccc

SEQ ID NO: 6341377 - DNA, 19 bp, Homo sapiens
gttgccacaggcctccctg

SEQ ID NO: 6341378 - DNA, 21 bp, Homo sapiens
gttgccaccacctctgtggca

SEQ ID NO: 6341379 - DNA, 18 bp, Homo sapiens
gttgccaccatgtattca

SEQ ID NO: 6341380 - DNA, 18 bp, Homo sapiens
gttgccacctgttaaaat

SEQ ID NO: 6341381 - DNA, 11 bp, Homo sapiens
gttgccagaga

SEQ ID NO: 6341382 - DNA, 12 bp, Homo sapiens
gttgccagaggc

SEQ ID NO: 6341383 - DNA, 18 bp, Homo sapiens
gttgccagaggccctgga

SEQ ID NO: 6341384 - DNA, 18 bp, Homo sapiens
gttgccaggttgcagctg

SEQ ID NO: 6341385 - DNA, 20 bp, Homo sapiens
gttgccaggttgcagctgct

SEQ ID NO: 6341386 - DNA, 18 bp, Homo sapiens
gttgccagtcaccccggc

SEQ ID NO: 6341387 - DNA, 23 bp, Homo sapiens
gttgccatcctaccgtcttttcc

SEQ ID NO: 6341388 - DNA, 22 bp, Homo sapiens
gttgccatggagatctgaaggg

SEQ ID NO: 6341389 - DNA, 17 bp, Homo sapiens
gttgccattattctatg

SEQ ID NO: 6341390 - DNA, 23 bp, Homo sapiens
gttgccattattctatgtagtgg

SEQ ID NO: 6341391 - DNA, 24 bp, Homo sapiens
gttgccattattctatgtagtggt

SEQ ID NO: 6341392 - DNA, 21 bp, Homo sapiens
gttgcccaaggttgcacagca

SEQ ID NO: 6341393 - DNA, 18 bp, Homo sapiens
gttgcccagcctctttcc

SEQ ID NO: 6341394 - DNA, 21 bp, Homo sapiens
gttgcccagcctctttccctt

SEQ ID NO: 6341395 - DNA, 12 bp, Homo sapiens
gttgcccaggca

SEQ ID NO: 6341396 - DNA, 18 bp, Homo sapiens
gttgcccaggcaggtctt

SEQ ID NO: 6341397 - DNA, 23 bp, Homo sapiens
gttgcccaggcaggtcttgaact

SEQ ID NO: 6341398 - DNA, 12 bp, Homo sapiens
gttgcccaggct

SEQ ID NO: 6341399 - DNA, 14 bp, Homo sapiens
gttgcccaggctgg

SEQ ID NO: 6341400 - DNA, 20 bp, Homo sapiens
gttgcccaggctggagtgca

SEQ ID NO: 6341401 - DNA, 18 bp, Homo sapiens
gttgcccaggctggcctg

SEQ ID NO: 6341402 - DNA, 18 bp, Homo sapiens
gttgcccaggctggtctt

SEQ ID NO: 6341403 - DNA, 18 bp, Homo sapiens
gttgcccccattcccagc

SEQ ID NO: 6341404 - DNA, 18 bp, Homo sapiens
gttgccctaattcatctt

SEQ ID NO: 6341405 - DNA, 18 bp, Homo sapiens
gttgccctagcccagact

SEQ ID NO: 6341406 - DNA, 13 bp, Homo sapiens
gttgccctggcat

SEQ ID NO: 6341407 - DNA, 23 bp, Homo sapiens
gttgccctgggggataccagctg

SEQ ID NO: 6341408 - DNA, 13 bp, Homo sapiens
gttgcccttttcc

SEQ ID NO: 6341409 - DNA, 14 bp, Homo sapiens
gttgcctaaatcca

SEQ ID NO: 6341410 - DNA, 15 bp, Homo sapiens
gttgcctaaatccat

SEQ ID NO: 6341411 - DNA, 21 bp, Homo sapiens
gttgcctaagcattgcctggc

SEQ ID NO: 6341412 - DNA, 21 bp, Homo sapiens
gttgcctaagtattaaaacat

SEQ ID NO: 6341413 - DNA, 22 bp, Homo sapiens
gttgcctaagtattaaaacatt

SEQ ID NO: 6341414 - DNA, 14 bp, Homo sapiens
gttgcctaattgga

SEQ ID NO: 6341415 - DNA, 16 bp, Homo sapiens
gttgcctaattggaaa

SEQ ID NO: 6341416 - DNA, 17 bp, Homo sapiens
gttgcctaattggaaag

SEQ ID NO: 6341417 - DNA, 13 bp, Homo sapiens
gttgcctcatggc

SEQ ID NO: 6341418 - DNA, 11 bp, Homo sapiens
gttgcctcctc

SEQ ID NO: 6341419 - DNA, 16 bp, Homo sapiens
gttgcctcctctctcc

SEQ ID NO: 6341420 - DNA, 22 bp, Homo sapiens
gttgcctcctctctccctgcct

SEQ ID NO: 6341421 - DNA, 13 bp, Homo sapiens
gttgcctctctgc

SEQ ID NO: 6341422 - DNA, 23 bp, Homo sapiens
gttgcctctcttgccccttgtcc

SEQ ID NO: 6341423 - DNA, 16 bp, Homo sapiens
gttgcctcttgcaatg

SEQ ID NO: 6341424 - DNA, 18 bp, Homo sapiens
gttgcctgcacccttccc

SEQ ID NO: 6341425 - DNA, 18 bp, Homo sapiens
gttgcctggattgggagc

SEQ ID NO: 6341426 - DNA, 23 bp, Homo sapiens
gttgcctggattgggagccattt

SEQ ID NO: 6341427 - DNA, 18 bp, Homo sapiens
gttgccttagcacttctt

SEQ ID NO: 6341428 - DNA, 19 bp, Homo sapiens
gttgccttgaaccacttcc

SEQ ID NO: 6341429 - DNA, 15 bp, Homo sapiens
gttgccttgcatttg

SEQ ID NO: 6341430 - DNA, 15 bp, Homo sapiens
gttgcgacggagaga

SEQ ID NO: 6341431 - DNA, 16 bp, Homo sapiens
gttgcgacggagagaa

SEQ ID NO: 6341432 - DNA, 18 bp, Homo sapiens
gttgcgccactgagacgg

SEQ ID NO: 6341433 - DNA, 23 bp, Homo sapiens
gttgcgtgacactctccttgcag

SEQ ID NO: 6341434 - DNA, 17 bp, Homo sapiens
gttgcgttcctttcttt

SEQ ID NO: 6341435 - DNA, 12 bp, Homo sapiens
gttgctaaaaaa

SEQ ID NO: 6341436 - DNA, 19 bp, Homo sapiens
gttgctaaacactgcgctt

SEQ ID NO: 6341437 - DNA, 16 bp, Homo sapiens
gttgctaaattataaa

SEQ ID NO: 6341438 - DNA, 21 bp, Homo sapiens
gttgctaacctcaatttatgt

SEQ ID NO: 6341439 - DNA, 14 bp, Homo sapiens
gttgctaactgaac

SEQ ID NO: 6341440 - DNA, 17 bp, Homo sapiens
gttgctaactgaacttt

SEQ ID NO: 6341441 - DNA, 21 bp, Homo sapiens
gttgctaactgaactttgaag

SEQ ID NO: 6341442 - DNA, 22 bp, Homo sapiens
gttgctaatgacagccttgcaa

SEQ ID NO: 6341443 - DNA, 14 bp, Homo sapiens
gttgctagggagag

SEQ ID NO: 6341444 - DNA, 15 bp, Homo sapiens
gttgctatacatgtt

SEQ ID NO: 6341445 - DNA, 14 bp, Homo sapiens
gttgctatagtgac

SEQ ID NO: 6341446 - DNA, 15 bp, Homo sapiens
gttgctatagtgaca

SEQ ID NO: 6341447 - DNA, 22 bp, Homo sapiens
gttgctatagtgacatgcagtt

SEQ ID NO: 6341448 - DNA, 13 bp, Homo sapiens
gttgctatttcca

SEQ ID NO: 6341449 - DNA, 20 bp, Homo sapiens
gttgctcaaatctattcaga

SEQ ID NO: 6341450 - DNA, 16 bp, Homo sapiens
gttgctcactcaggac

SEQ ID NO: 6341451 - DNA, 22 bp, Homo sapiens
gttgctcagagtgaagagtgaa

SEQ ID NO: 6341452 - DNA, 22 bp, Homo sapiens
gttgctccaggatgcattctga

SEQ ID NO: 6341453 - DNA, 19 bp, Homo sapiens
gttgctgaaacttgctgag

SEQ ID NO: 6341454 - DNA, 22 bp, Homo sapiens
gttgctgactactactctgcca

SEQ ID NO: 6341455 - DNA, 15 bp, Homo sapiens
gttgctgacttagaa

SEQ ID NO: 6341456 - DNA, 20 bp, Homo sapiens
gttgctgagttcctgtgggt

SEQ ID NO: 6341457 - DNA, 22 bp, Homo sapiens
gttgctgatccctgctctctga

SEQ ID NO: 6341458 - DNA, 23 bp, Homo sapiens
gttgctgatccctgctctctgag

SEQ ID NO: 6341459 - DNA, 23 bp, Homo sapiens
gttgctgatgaactcttaatcaa

SEQ ID NO: 6341460 - DNA, 17 bp, Homo sapiens
gttgctgatggcccctc

SEQ ID NO: 6341461 - DNA, 21 bp, Homo sapiens
gttgctgatgggtagtacctg

SEQ ID NO: 6341462 - DNA, 15 bp, Homo sapiens
gttgctgattgtcaa

SEQ ID NO: 6341463 - DNA, 20 bp, Homo sapiens
ggtcaccgagactcagcctc

SEQ ID NO: 6341464 - DNA, 17 bp, Homo sapiens
ggtcacctgccgccctg

SEQ ID NO: 6341465 - DNA, 22 bp, Homo sapiens
ggtcacctgccgccctgtggga

SEQ ID NO: 6341466 - DNA, 14 bp, Homo sapiens
ggtcacctgtgcta

SEQ ID NO: 6341467 - DNA, 17 bp, Homo sapiens
ggtcacgctcaaggaag

SEQ ID NO: 6341468 - DNA, 14 bp, Homo sapiens
ggtcacgctgaatg

SEQ ID NO: 6341469 - DNA, 22 bp, Homo sapiens
ggtcactcgtggtgaggctgac

SEQ ID NO: 6341470 - DNA, 20 bp, Homo sapiens
ggtcactctccccaaaatat

SEQ ID NO: 6341471 - DNA, 19 bp, Homo sapiens
ggtcactctgccctctgct

SEQ ID NO: 6341472 - DNA, 20 bp, Homo sapiens
ggtcactctgccctctgctg

SEQ ID NO: 6341473 - DNA, 21 bp, Homo sapiens
ggtcactctgccctctgctgc

SEQ ID NO: 6341474 - DNA, 22 bp, Homo sapiens
ggtcactctgccctctgctgct

SEQ ID NO: 6341475 - DNA, 24 bp, Homo sapiens
ggtcactctgccctctgctgctgc

SEQ ID NO: 6341476 - DNA, 16 bp, Homo sapiens
ggtcactctggcagct

SEQ ID NO: 6341477 - DNA, 17 bp, Homo sapiens
ggtcactcttttgatgg

SEQ ID NO: 6341478 - DNA, 24 bp, Homo sapiens
ggtcactgaggcctgagacccagg

SEQ ID NO: 6341479 - DNA, 19 bp, Homo sapiens
ggtcactgagtctggagtg

SEQ ID NO: 6341480 - DNA, 13 bp, Homo sapiens
ggtcactgcccac

SEQ ID NO: 6341481 - DNA, 15 bp, Homo sapiens
ggtcactggaaaggg

SEQ ID NO: 6341482 - DNA, 16 bp, Homo sapiens
ggtcactggctctcca

SEQ ID NO: 6341483 - DNA, 19 bp, Homo sapiens
ggtcactgggatgcctctt

SEQ ID NO: 6341484 - DNA, 14 bp, Homo sapiens
ggtcactgggttct

SEQ ID NO: 6341485 - DNA, 18 bp, Homo sapiens
ggtcactggtcagggcag

SEQ ID NO: 6341486 - DNA, 19 bp, Homo sapiens
ggtcactggtcagggcagt

SEQ ID NO: 6341487 - DNA, 13 bp, Homo sapiens
ggtcactgtcact

SEQ ID NO: 6341488 - DNA, 21 bp, Homo sapiens
ggtcactgtccttgaacccaa

SEQ ID NO: 6341489 - DNA, 15 bp, Homo sapiens
ggtcacttatcctga

SEQ ID NO: 6341490 - DNA, 15 bp, Homo sapiens
ggtcacttcttctgt

SEQ ID NO: 6341491 - DNA, 20 bp, Homo sapiens
ggtcagaagaagtgggagca

SEQ ID NO: 6341492 - DNA, 21 bp, Homo sapiens
ggtcagaagaagtgggagcag

SEQ ID NO: 6341493 - DNA, 17 bp, Homo sapiens
ggtcagagagacctcat

SEQ ID NO: 6341494 - DNA, 12 bp, Homo sapiens
ggtcagagccac

SEQ ID NO: 6341495 - DNA, 13 bp, Homo sapiens
ggtcagagcccag

SEQ ID NO: 6341496 - DNA, 11 bp, Homo sapiens
ggtcagagcct

SEQ ID NO: 6341497 - DNA, 14 bp, Homo sapiens
ggtcagagcctgca

SEQ ID NO: 6341498 - DNA, 15 bp, Homo sapiens
ggtcagagcctgcag

SEQ ID NO: 6341499 - DNA, 19 bp, Homo sapiens
ggtcagaggacctgtattt

SEQ ID NO: 6341500 - DNA, 21 bp, Homo sapiens
ggtcagaggagcgcaggcagc

SEQ ID NO: 6341501 - DNA, 13 bp, Homo sapiens
ggtcagaggaggg

SEQ ID NO: 6341502 - DNA, 14 bp, Homo sapiens
ggtcagagggccca

SEQ ID NO: 6341503 - DNA, 19 bp, Homo sapiens
ggtcagagtaagctgcttt

SEQ ID NO: 6341504 - DNA, 17 bp, Homo sapiens
ggtcagagtgccactgc

SEQ ID NO: 6341505 - DNA, 23 bp, Homo sapiens
ggtcagagtggcgtgagctgccc

SEQ ID NO: 6341506 - DNA, 11 bp, Homo sapiens
ggtcagatgca

SEQ ID NO: 6341507 - DNA, 24 bp, Homo sapiens
ggtcagatgcaccacccatggaga

SEQ ID NO: 6341508 - DNA, 12 bp, Homo sapiens
ggtcagatggag

SEQ ID NO: 6341509 - DNA, 20 bp, Homo sapiens
ggtcagattagggcggggag

SEQ ID NO: 6341510 - DNA, 16 bp, Homo sapiens
ggtcagatttatttgt

SEQ ID NO: 6341511 - DNA, 22 bp, Homo sapiens
ggtcagcagaaacccccaggag

SEQ ID NO: 6341512 - DNA, 13 bp, Homo sapiens
ggtcagcagagcc

SEQ ID NO: 6341513 - DNA, 14 bp, Homo sapiens
ggtcagcagagccg

SEQ ID NO: 6341514 - DNA, 21 bp, Homo sapiens
ggtcagcagatgccagtgaag

SEQ ID NO: 6341515 - DNA, 17 bp, Homo sapiens
ggtcagcaggcccagga

SEQ ID NO: 6341516 - DNA, 14 bp, Homo sapiens
ggtcagcatccagt

SEQ ID NO: 6341517 - DNA, 20 bp, Homo sapiens
ggtcagcatccagtgtgaga

SEQ ID NO: 6341518 - DNA, 19 bp, Homo sapiens
ggtcagccaaggctcccgt

SEQ ID NO: 6341519 - DNA, 16 bp, Homo sapiens
ggtcagccagccctct

SEQ ID NO: 6341520 - DNA, 13 bp, Homo sapiens
ggtcagcccagca

SEQ ID NO: 6341521 - DNA, 22 bp, Homo sapiens
ggtcagcccagcacctgctccc

SEQ ID NO: 6341522 - DNA, 13 bp, Homo sapiens
ggtcagcccatgg

SEQ ID NO: 6341523 - DNA, 17 bp, Homo sapiens
ggtcagcccatggaggc

SEQ ID NO: 6341524 - DNA, 21 bp, Homo sapiens
ggtcagcccattggctcccat

SEQ ID NO: 6341525 - DNA, 12 bp, Homo sapiens
ggtcagccccaa

SEQ ID NO: 6341526 - DNA, 15 bp, Homo sapiens
ggtcagcctggaagg

SEQ ID NO: 6341527 - DNA, 21 bp, Homo sapiens
ggtcagcgactggatgctcgc

SEQ ID NO: 6341528 - DNA, 13 bp, Homo sapiens
ggtcagcgagaag

SEQ ID NO: 6341529 - DNA, 15 bp, Homo sapiens
ggtcagcggcctggg

SEQ ID NO: 6341530 - DNA, 17 bp, Homo sapiens
ggtcagcggcctgggga

SEQ ID NO: 6341531 - DNA, 22 bp, Homo sapiens
ggtcagcggcctggggacggag

SEQ ID NO: 6341532 - DNA, 14 bp, Homo sapiens
ggtcagctcagagc

SEQ ID NO: 6341533 - DNA, 14 bp, Homo sapiens
ggtcagctgggagc

SEQ ID NO: 6341534 - DNA, 20 bp, Homo sapiens
ggtcagctgggagccagtgt

SEQ ID NO: 6341535 - DNA, 22 bp, Homo sapiens
ggtcagcttgctgccctaggct

SEQ ID NO: 6341536 - DNA, 19 bp, Homo sapiens
ggtcaggaacagtggctgg

SEQ ID NO: 6341537 - DNA, 20 bp, Homo sapiens
ggtcaggacggctcctcaga

SEQ ID NO: 6341538 - DNA, 17 bp, Homo sapiens
ggtcaggagatcgagac

SEQ ID NO: 6341539 - DNA, 22 bp, Homo sapiens
ggtcaggagttagaggccagcc

SEQ ID NO: 6341540 - DNA, 21 bp, Homo sapiens
ggtcaggagttcctaaccagc

SEQ ID NO: 6341541 - DNA, 18 bp, Homo sapiens
ggtcaggagttgtgtcta

SEQ ID NO: 6341542 - DNA, 19 bp, Homo sapiens
ggtcaggatgcacatttct

SEQ ID NO: 6341543 - DNA, 18 bp, Homo sapiens
ggtcaggcaatgccctgc

SEQ ID NO: 6341544 - DNA, 14 bp, Homo sapiens
ggtcaggcagccag

SEQ ID NO: 6341545 - DNA, 19 bp, Homo sapiens
ggtcaggcagccagtgaga

SEQ ID NO: 6341546 - DNA, 14 bp, Homo sapiens
ggtcaggccctgga

SEQ ID NO: 6341547 - DNA, 11 bp, Homo sapiens
ggtcaggcctt

SEQ ID NO: 6341548 - DNA, 12 bp, Homo sapiens
ggtcaggccttt

SEQ ID NO: 6341549 - DNA, 23 bp, Homo sapiens
ggtcaggctgggcagccccagag

SEQ ID NO: 6341550 - DNA, 15 bp, Homo sapiens
ggtcagggaaagtct

SEQ ID NO: 6341551 - DNA, 14 bp, Homo sapiens
ggtcagggaggggt

SEQ ID NO: 6341552 - DNA, 20 bp, Homo sapiens
ggtcagggagtgctggctca

SEQ ID NO: 6341553 - DNA, 21 bp, Homo sapiens
ggtcagggcagtggccaagcc

SEQ ID NO: 6341554 - DNA, 14 bp, Homo sapiens
ggtcagggccagac

SEQ ID NO: 6341555 - DNA, 18 bp, Homo sapiens
ggtcaggggtgacacaga

SEQ ID NO: 6341556 - DNA, 14 bp, Homo sapiens
ggtcagggtgtgag

SEQ ID NO: 6341557 - DNA, 18 bp, Homo sapiens
ggtcagggtgtgaggcca

SEQ ID NO: 6341558 - DNA, 12 bp, Homo sapiens
ggtcaggtcccc

SEQ ID NO: 6341559 - DNA, 15 bp, Homo sapiens
ggtcaggtgtcaggc

SEQ ID NO: 6341560 - DNA, 17 bp, Homo sapiens
ggtcaggtgtcaggccc

SEQ ID NO: 6341561 - DNA, 18 bp, Homo sapiens
ggtcaggtgtcaggcccg

SEQ ID NO: 6341562 - DNA, 16 bp, Homo sapiens
ggtcaggttcttgcct

SEQ ID NO: 6341563 - DNA, 14 bp, Homo sapiens
ggtcaggtttaaca

SEQ ID NO: 6341564 - DNA, 20 bp, Homo sapiens
ggtcagtagtttcatgtttt

SEQ ID NO: 6341565 - DNA, 18 bp, Homo sapiens
ggtcagtctttgctcagt

SEQ ID NO: 6341566 - DNA, 14 bp, Homo sapiens
ggtcagtgcaaata

SEQ ID NO: 6341567 - DNA, 14 bp, Homo sapiens
ggtcagtgctgcct

SEQ ID NO: 6341568 - DNA, 18 bp, Homo sapiens
ggtcagtggccaggtgcc

SEQ ID NO: 6341569 - DNA, 14 bp, Homo sapiens
ggtcagtgtgcaaa

SEQ ID NO: 6341570 - DNA, 23 bp, Homo sapiens
ggtcagtgtgccaccctctgcag

SEQ ID NO: 6341571 - DNA, 14 bp, Homo sapiens
ggtcagtgtggaga

SEQ ID NO: 6341572 - DNA, 18 bp, Homo sapiens
ggtcagttgggcccccat

SEQ ID NO: 6341573 - DNA, 18 bp, Homo sapiens
ggtcagttttcacagagg

SEQ ID NO: 6341574 - DNA, 19 bp, Homo sapiens
ggtcagttttcacagaggc

SEQ ID NO: 6341575 - DNA, 12 bp, Homo sapiens
ggtcataaaata

SEQ ID NO: 6341576 - DNA, 13 bp, Homo sapiens
ggtcataaaatag

SEQ ID NO: 6341577 - DNA, 21 bp, Homo sapiens
ggtcataggctcactctttcc

SEQ ID NO: 6341578 - DNA, 23 bp, Homo sapiens
ggtcatattcataccttctgatg

SEQ ID NO: 6341579 - DNA, 15 bp, Homo sapiens
ggtcatcagatgcct

SEQ ID NO: 6341580 - DNA, 19 bp, Homo sapiens
ggtcatcagatgcctgctt

SEQ ID NO: 6341581 - DNA, 14 bp, Homo sapiens
ggtcatcatttgtc

SEQ ID NO: 6341582 - DNA, 16 bp, Homo sapiens
ggtcatccaacctctt

SEQ ID NO: 6341583 - DNA, 19 bp, Homo sapiens
ggtcatcccggggccatgg

SEQ ID NO: 6341584 - DNA, 16 bp, Homo sapiens
ggtcatcctgggcatg

SEQ ID NO: 6341585 - DNA, 19 bp, Homo sapiens
ggtcatcctgggcatgtcc

SEQ ID NO: 6341586 - DNA, 14 bp, Homo sapiens
ggtcatccttgccc

SEQ ID NO: 6341587 - DNA, 19 bp, Homo sapiens
ggtcatcgagatggagcta

SEQ ID NO: 6341588 - DNA, 22 bp, Homo sapiens
ggtcatcgagatggagctacga

SEQ ID NO: 6341589 - DNA, 13 bp, Homo sapiens
ggtcatctggcgg

SEQ ID NO: 6341590 - DNA, 15 bp, Homo sapiens
ggtcatctggcggag

SEQ ID NO: 6341591 - DNA, 21 bp, Homo sapiens
ggtcatctggcggaggtctct

SEQ ID NO: 6341592 - DNA, 23 bp, Homo sapiens
ggtcatgaaggacactctgcagg

SEQ ID NO: 6341593 - DNA, 19 bp, Homo sapiens
ggtcatgaaggaggggacc

SEQ ID NO: 6341594 - DNA, 22 bp, Homo sapiens
ggtcatgaattcatactctgtt

SEQ ID NO: 6341595 - DNA, 21 bp, Homo sapiens
ggtcatgacaagatgggacag

SEQ ID NO: 6341596 - DNA, 18 bp, Homo sapiens
ggtcatgatttctgtgaa

SEQ ID NO: 6341597 - DNA, 17 bp, Homo sapiens
ggtcatgcagttcctgg

SEQ ID NO: 6341598 - DNA, 18 bp, Homo sapiens
ggtcatgcagttcctggc

SEQ ID NO: 6341599 - DNA, 17 bp, Homo sapiens
ggtcatgccctcctctc

SEQ ID NO: 6341600 - DNA, 13 bp, Homo sapiens
ggtcatgctcagc

SEQ ID NO: 6341601 - DNA, 22 bp, Homo sapiens
ggtcatgctcagccttgctgct

SEQ ID NO: 6341602 - DNA, 16 bp, Homo sapiens
ggtcatggagcagccc

SEQ ID NO: 6341603 - DNA, 13 bp, Homo sapiens
ggtcatggtctga

SEQ ID NO: 6341604 - DNA, 15 bp, Homo sapiens
ggtcatggtggtgca

SEQ ID NO: 6341605 - DNA, 13 bp, Homo sapiens
ggtcatgtacttc

SEQ ID NO: 6341606 - DNA, 16 bp, Homo sapiens
ggtcatgtgtgcatgt

SEQ ID NO: 6341607 - DNA, 14 bp, Homo sapiens
ggtcatgtttgcag

SEQ ID NO: 6341608 - DNA, 19 bp, Homo sapiens
ggtcattacttctgagccc

SEQ ID NO: 6341609 - DNA, 18 bp, Homo sapiens
ggtcattcttttgccaca

SEQ ID NO: 6341610 - DNA, 20 bp, Homo sapiens
ggtcattgacctctcagggc

SEQ ID NO: 6341611 - DNA, 24 bp, Homo sapiens
ggtcattgacctctcagggcctgg

SEQ ID NO: 6341612 - DNA, 13 bp, Homo sapiens
ggtcattgaggga

SEQ ID NO: 6341613 - DNA, 19 bp, Homo sapiens
ggtcatttcagagccctcg

SEQ ID NO: 6341614 - DNA, 14 bp, Homo sapiens
ggtcatttcttcag

SEQ ID NO: 6341615 - DNA, 17 bp, Homo sapiens
ggtcatttggtggctct

SEQ ID NO: 6341616 - DNA, 23 bp, Homo sapiens
ggtcatttgtagatatatatttc

SEQ ID NO: 6341617 - DNA, 14 bp, Homo sapiens
ggtcattttccttt

SEQ ID NO: 6341618 - DNA, 21 bp, Homo sapiens
ggtcattttcctttctgtatt

SEQ ID NO: 6341619 - DNA, 20 bp, Homo sapiens
ggtccaaaaaaggctgccct

SEQ ID NO: 6341620 - DNA, 13 bp, Homo sapiens
ggtccaaatgttt

SEQ ID NO: 6341621 - DNA, 14 bp, Homo sapiens
ggtccaagagacat

SEQ ID NO: 6341622 - DNA, 18 bp, Homo sapiens
ggtccaagattctggagc

SEQ ID NO: 6341623 - DNA, 20 bp, Homo sapiens
ggtccaaggctggtcccaca

SEQ ID NO: 6341624 - DNA, 16 bp, Homo sapiens
ggtccaatccagcctt

SEQ ID NO: 6341625 - DNA, 17 bp, Homo sapiens
ggtccaatccagccttc

SEQ ID NO: 6341626 - DNA, 18 bp, Homo sapiens
ggtccaatccagccttct

SEQ ID NO: 6341627 - DNA, 22 bp, Homo sapiens
ggtccaatgccacctagactct

SEQ ID NO: 6341628 - DNA, 23 bp, Homo sapiens
ggtccaatgccacctagactctc

SEQ ID NO: 6341629 - DNA, 21 bp, Homo sapiens
ggtccaatgctcaggtgctgg

SEQ ID NO: 6341630 - DNA, 12 bp, Homo sapiens
ggtccacacacc

SEQ ID NO: 6341631 - DNA, 13 bp, Homo sapiens
ggtccacagctgg

SEQ ID NO: 6341632 - DNA, 16 bp, Homo sapiens
ggtccacagctggaaa

SEQ ID NO: 6341633 - DNA, 21 bp, Homo sapiens
ggtccacagggctcctgaagg

SEQ ID NO: 6341634 - DNA, 17 bp, Homo sapiens
ggtccacaggtccaagg

SEQ ID NO: 6341635 - DNA, 18 bp, Homo sapiens
ggtccacaggtccaagga

SEQ ID NO: 6341636 - DNA, 18 bp, Homo sapiens
ggtccacaggtctagact

SEQ ID NO: 6341637 - DNA, 17 bp, Homo sapiens
ggtccacatcccgggac

SEQ ID NO: 6341638 - DNA, 17 bp, Homo sapiens
ggtccacattctgctgc

SEQ ID NO: 6341639 - DNA, 16 bp, Homo sapiens
ggtccaccagtgtgtg

SEQ ID NO: 6341640 - DNA, 20 bp, Homo sapiens
ggtccaccagtgtgtggggg

SEQ ID NO: 6341641 - DNA, 16 bp, Homo sapiens
ggtccacccagcaaag

SEQ ID NO: 6341642 - DNA, 14 bp, Homo sapiens
gttgctgattttat

SEQ ID NO: 6341643 - DNA, 20 bp, Homo sapiens
gttgctgattttgaccttgt

SEQ ID NO: 6341644 - DNA, 12 bp, Homo sapiens
gttgctgcctca

SEQ ID NO: 6341645 - DNA, 13 bp, Homo sapiens
gttgctgcctttc

SEQ ID NO: 6341646 - DNA, 15 bp, Homo sapiens
gttgctgctgctgct

SEQ ID NO: 6341647 - DNA, 12 bp, Homo sapiens
gttgctgctgtt

SEQ ID NO: 6341648 - DNA, 16 bp, Homo sapiens
gttgctgcttcaattt

SEQ ID NO: 6341649 - DNA, 18 bp, Homo sapiens
gttgctgcttctcccagg

SEQ ID NO: 6341650 - DNA, 22 bp, Homo sapiens
gttgctgcttctcccaggcaag

SEQ ID NO: 6341651 - DNA, 23 bp, Homo sapiens
gttgctgcttctcccaggcaagg

SEQ ID NO: 6341652 - DNA, 19 bp, Homo sapiens
gttgctggaaaatcatatt

SEQ ID NO: 6341653 - DNA, 14 bp, Homo sapiens
gttgctggaggggc

SEQ ID NO: 6341654 - DNA, 23 bp, Homo sapiens
gttgctggaggggctgtcctcct

SEQ ID NO: 6341655 - DNA, 18 bp, Homo sapiens
gttgctggcttgttgtaa

SEQ ID NO: 6341656 - DNA, 19 bp, Homo sapiens
gttgctggcttgttgtaaa

SEQ ID NO: 6341657 - DNA, 21 bp, Homo sapiens
gttgctggcttgttgtaaagc

SEQ ID NO: 6341658 - DNA, 16 bp, Homo sapiens
gttgctgggagctgaa

SEQ ID NO: 6341659 - DNA, 15 bp, Homo sapiens
gttgctggtcaggtc

SEQ ID NO: 6341660 - DNA, 20 bp, Homo sapiens
gttgctggttataagcagca

SEQ ID NO: 6341661 - DNA, 15 bp, Homo sapiens
gttgctggttgctgt

SEQ ID NO: 6341662 - DNA, 17 bp, Homo sapiens
gttgctgtcagtcttga

SEQ ID NO: 6341663 - DNA, 10 bp, Homo sapiens
gttgctgtcc

SEQ ID NO: 6341664 - DNA, 22 bp, Homo sapiens
gttgctgtcctccagggcgagc

SEQ ID NO: 6341665 - DNA, 16 bp, Homo sapiens
gttgctgttgctgttg

SEQ ID NO: 6341666 - DNA, 23 bp, Homo sapiens
gttgctgttggcatcttgctgct

SEQ ID NO: 6341667 - DNA, 15 bp, Homo sapiens
gttgctgtttatttt

SEQ ID NO: 6341668 - DNA, 17 bp, Homo sapiens
gttgctgttttcctccc

SEQ ID NO: 6341669 - DNA, 18 bp, Homo sapiens
gttgctgttttcctccct

SEQ ID NO: 6341670 - DNA, 23 bp, Homo sapiens
gttgctgttttcctcccttctgc

SEQ ID NO: 6341671 - DNA, 17 bp, Homo sapiens
gttgcttaatctagagc

SEQ ID NO: 6341672 - DNA, 16 bp, Homo sapiens
gttgcttacaattttt

SEQ ID NO: 6341673 - DNA, 23 bp, Homo sapiens
gttgcttagatgagggtgactgt

SEQ ID NO: 6341674 - DNA, 17 bp, Homo sapiens
gttgcttatttccctca

SEQ ID NO: 6341675 - DNA, 14 bp, Homo sapiens
gttgcttcccgctg

SEQ ID NO: 6341676 - DNA, 21 bp, Homo sapiens
gttgcttctcaggctatatgc

SEQ ID NO: 6341677 - DNA, 15 bp, Homo sapiens
gttgcttctgaatca

SEQ ID NO: 6341678 - DNA, 14 bp, Homo sapiens
gttgcttctggctc

SEQ ID NO: 6341679 - DNA, 13 bp, Homo sapiens
gttgcttctggga

SEQ ID NO: 6341680 - DNA, 17 bp, Homo sapiens
gttgcttcttgtgaagg

SEQ ID NO: 6341681 - DNA, 17 bp, Homo sapiens
gttgcttgggccactgc

SEQ ID NO: 6341682 - DNA, 14 bp, Homo sapiens
gttgcttgtcttct

SEQ ID NO: 6341683 - DNA, 20 bp, Homo sapiens
gttgctttaaagtacctgta

SEQ ID NO: 6341684 - DNA, 20 bp, Homo sapiens
gttgctttctattatcatgg

SEQ ID NO: 6341685 - DNA, 17 bp, Homo sapiens
gttgctttctgactgat

SEQ ID NO: 6341686 - DNA, 17 bp, Homo sapiens
gttgctttgccagagca

SEQ ID NO: 6341687 - DNA, 12 bp, Homo sapiens
gttgcttttacg

SEQ ID NO: 6341688 - DNA, 14 bp, Homo sapiens
gttgcttttctaat

SEQ ID NO: 6341689 - DNA, 17 bp, Homo sapiens
gttgcttttgaaaagtt

SEQ ID NO: 6341690 - DNA, 18 bp, Homo sapiens
gttgcttttgcacctacg

SEQ ID NO: 6341691 - DNA, 23 bp, Homo sapiens
gttgctttttcactgtttcctat

SEQ ID NO: 6341692 - DNA, 15 bp, Homo sapiens
gttggaaaaaatttg

SEQ ID NO: 6341693 - DNA, 12 bp, Homo sapiens
gttggaaaagaa

SEQ ID NO: 6341694 - DNA, 17 bp, Homo sapiens
gttggaaaatatctttg

SEQ ID NO: 6341695 - DNA, 18 bp, Homo sapiens
gttggaaacactaaatgt

SEQ ID NO: 6341696 - DNA, 22 bp, Homo sapiens
gttggaaacactaaatgttaaa

SEQ ID NO: 6341697 - DNA, 16 bp, Homo sapiens
gttggaaagcaggtgg

SEQ ID NO: 6341698 - DNA, 14 bp, Homo sapiens
gttggaaatgtgtt

SEQ ID NO: 6341699 - DNA, 17 bp, Homo sapiens
gttggaaatgtgttttt

SEQ ID NO: 6341700 - DNA, 23 bp, Homo sapiens
gttggaaattgggtgtgccctgg

SEQ ID NO: 6341701 - DNA, 13 bp, Homo sapiens
gttggaaccgtgt

SEQ ID NO: 6341702 - DNA, 18 bp, Homo sapiens
gttggaactgctgccatg

SEQ ID NO: 6341703 - DNA, 18 bp, Homo sapiens
gttggaagaaaagaatca

SEQ ID NO: 6341704 - DNA, 21 bp, Homo sapiens
gttggaagacggatttgcttt

SEQ ID NO: 6341705 - DNA, 20 bp, Homo sapiens
gttggaagcttgttttccag

SEQ ID NO: 6341706 - DNA, 15 bp, Homo sapiens
gttggaatgttgtta

SEQ ID NO: 6341707 - DNA, 14 bp, Homo sapiens
gttggacacactgt

SEQ ID NO: 6341708 - DNA, 15 bp, Homo sapiens
gttggacagccccct

SEQ ID NO: 6341709 - DNA, 13 bp, Homo sapiens
gttggacagtagt

SEQ ID NO: 6341710 - DNA, 20 bp, Homo sapiens
gttggacatttttttcgaat

SEQ ID NO: 6341711 - DNA, 17 bp, Homo sapiens
gttggaccagaggaagc

SEQ ID NO: 6341712 - DNA, 14 bp, Homo sapiens
gttggaccccagag

SEQ ID NO: 6341713 - DNA, 17 bp, Homo sapiens
gttggaccccagagatt

SEQ ID NO: 6341714 - DNA, 18 bp, Homo sapiens
gttggacccgctctggac

SEQ ID NO: 6341715 - DNA, 17 bp, Homo sapiens
gttggactgtggcctca

SEQ ID NO: 6341716 - DNA, 17 bp, Homo sapiens
gttggacttgagaaaga

SEQ ID NO: 6341717 - DNA, 23 bp, Homo sapiens
gttggacttttcgttaacattga

SEQ ID NO: 6341718 - DNA, 13 bp, Homo sapiens
gttggagagcagc

SEQ ID NO: 6341719 - DNA, 19 bp, Homo sapiens
gttggagagctagaacctg

SEQ ID NO: 6341720 - DNA, 22 bp, Homo sapiens
gttggagagctagaacctggag

SEQ ID NO: 6341721 - DNA, 18 bp, Homo sapiens
gttggagcagcaggcctc

SEQ ID NO: 6341722 - DNA, 21 bp, Homo sapiens
gttggagcagcaggcctctgg

SEQ ID NO: 6341723 - DNA, 20 bp, Homo sapiens
gttggagcagtgcttttcac

SEQ ID NO: 6341724 - DNA, 20 bp, Homo sapiens
gttggagccactcctgtccc

SEQ ID NO: 6341725 - DNA, 21 bp, Homo sapiens
gttggagccactcctgtcccg

SEQ ID NO: 6341726 - DNA, 16 bp, Homo sapiens
gttggagcctgcaggg

SEQ ID NO: 6341727 - DNA, 15 bp, Homo sapiens
gttggagctcattct

SEQ ID NO: 6341728 - DNA, 13 bp, Homo sapiens
gttggaggagact

SEQ ID NO: 6341729 - DNA, 17 bp, Homo sapiens
gttggaggagactgggc

SEQ ID NO: 6341730 - DNA, 18 bp, Homo sapiens
gttggaggagagagcctt

SEQ ID NO: 6341731 - DNA, 23 bp, Homo sapiens
gttggaggagagagccttgggag

SEQ ID NO: 6341732 - DNA, 15 bp, Homo sapiens
gttggaggcctcacc

SEQ ID NO: 6341733 - DNA, 21 bp, Homo sapiens
gttggagggaaagccagcctg

SEQ ID NO: 6341734 - DNA, 14 bp, Homo sapiens
gttggaggggcagg

SEQ ID NO: 6341735 - DNA, 23 bp, Homo sapiens
gttggaggtttcacttgcacatc

SEQ ID NO: 6341736 - DNA, 13 bp, Homo sapiens
gttggagtgctct

SEQ ID NO: 6341737 - DNA, 21 bp, Homo sapiens
gttggagtttgggctggagct

SEQ ID NO: 6341738 - DNA, 23 bp, Homo sapiens
gttggagtttgggctggagctcc

SEQ ID NO: 6341739 - DNA, 20 bp, Homo sapiens
gttggatccgtttgaccaat

SEQ ID NO: 6341740 - DNA, 13 bp, Homo sapiens
gttggatgtctgt

SEQ ID NO: 6341741 - DNA, 14 bp, Homo sapiens
gttggatttttgtc

SEQ ID NO: 6341742 - DNA, 20 bp, Homo sapiens
gttggatttttgtcttgtgt

SEQ ID NO: 6341743 - DNA, 14 bp, Homo sapiens
gttggcaaaaaggc

SEQ ID NO: 6341744 - DNA, 18 bp, Homo sapiens
gttggcaaaaaggcagga

SEQ ID NO: 6341745 - DNA, 11 bp, Homo sapiens
gttggcacaga

SEQ ID NO: 6341746 - DNA, 17 bp, Homo sapiens
gttggcacatttcatga

SEQ ID NO: 6341747 - DNA, 12 bp, Homo sapiens
gttggcacctgc

SEQ ID NO: 6341748 - DNA, 19 bp, Homo sapiens
gttggcacctgcacactcc

SEQ ID NO: 6341749 - DNA, 13 bp, Homo sapiens
gttggcaccttcc

SEQ ID NO: 6341750 - DNA, 18 bp, Homo sapiens
gttggcaccttccccctc

SEQ ID NO: 6341751 - DNA, 20 bp, Homo sapiens
gttggcactcacagacctgg

SEQ ID NO: 6341752 - DNA, 12 bp, Homo sapiens
gttggcacttat

SEQ ID NO: 6341753 - DNA, 19 bp, Homo sapiens
gttggcagaccgggccccc

SEQ ID NO: 6341754 - DNA, 14 bp, Homo sapiens
gttggcagagaagg

SEQ ID NO: 6341755 - DNA, 18 bp, Homo sapiens
gttggcagatgcagctct

SEQ ID NO: 6341756 - DNA, 23 bp, Homo sapiens
gttggcagatgcagctcttcctg

SEQ ID NO: 6341757 - DNA, 12 bp, Homo sapiens
gttggcagctct

SEQ ID NO: 6341758 - DNA, 17 bp, Homo sapiens
gttggcaggagctcctg

SEQ ID NO: 6341759 - DNA, 13 bp, Homo sapiens
gttggcaggccca

SEQ ID NO: 6341760 - DNA, 16 bp, Homo sapiens
gttggcaggcccactc

SEQ ID NO: 6341761 - DNA, 14 bp, Homo sapiens
gttggcaggctggc

SEQ ID NO: 6341762 - DNA, 15 bp, Homo sapiens
gttggcaggctggcc

SEQ ID NO: 6341763 - DNA, 20 bp, Homo sapiens
gttggcaggctggccagtcc

SEQ ID NO: 6341764 - DNA, 22 bp, Homo sapiens
gttggcagtgagtgagcctggc

SEQ ID NO: 6341765 - DNA, 12 bp, Homo sapiens
gttggcatgcat

SEQ ID NO: 6341766 - DNA, 14 bp, Homo sapiens
gttggcatgcatcc

SEQ ID NO: 6341767 - DNA, 19 bp, Homo sapiens
gttggcatttgctggcctg

SEQ ID NO: 6341768 - DNA, 20 bp, Homo sapiens
gttggcatttgctggcctgg

SEQ ID NO: 6341769 - DNA, 23 bp, Homo sapiens
gttggcatttgctggcctggcag

SEQ ID NO: 6341770 - DNA, 19 bp, Homo sapiens
gttggccagagggcccctc

SEQ ID NO: 6341771 - DNA, 19 bp, Homo sapiens
gttggccagattgtggggt

SEQ ID NO: 6341772 - DNA, 13 bp, Homo sapiens
gttggccaggagg

SEQ ID NO: 6341773 - DNA, 14 bp, Homo sapiens
gttggccaggctgc

SEQ ID NO: 6341774 - DNA, 19 bp, Homo sapiens
gttggccaggctgctcttg

SEQ ID NO: 6341775 - DNA, 18 bp, Homo sapiens
gttggccaggctggtcta

SEQ ID NO: 6341776 - DNA, 17 bp, Homo sapiens
gttggcccaagctcttg

SEQ ID NO: 6341777 - DNA, 20 bp, Homo sapiens
gttggccggctggccggtcc

SEQ ID NO: 6341778 - DNA, 19 bp, Homo sapiens
gttggccgtggtccagctc

SEQ ID NO: 6341779 - DNA, 22 bp, Homo sapiens
gttggccgtggtccagctcttg

SEQ ID NO: 6341780 - DNA, 23 bp, Homo sapiens
gttggcctcaagcaaggaagcag

SEQ ID NO: 6341781 - DNA, 22 bp, Homo sapiens
gttggcctcagggccaggaagg

SEQ ID NO: 6341782 - DNA, 23 bp, Homo sapiens
gttggcctcagggccaggaagga

SEQ ID NO: 6341783 - DNA, 13 bp, Homo sapiens
gttggcctccggc

SEQ ID NO: 6341784 - DNA, 21 bp, Homo sapiens
gttggcctcgcctgggcccag

SEQ ID NO: 6341785 - DNA, 12 bp, Homo sapiens
gttggcctctgc

SEQ ID NO: 6341786 - DNA, 13 bp, Homo sapiens
gttggcctctgca

SEQ ID NO: 6341787 - DNA, 20 bp, Homo sapiens
gttggcctcttcaggcctgc

SEQ ID NO: 6341788 - DNA, 11 bp, Homo sapiens
gttggcctgtg

SEQ ID NO: 6341789 - DNA, 23 bp, Homo sapiens
gttggcctgtgcttggaggcctc

SEQ ID NO: 6341790 - DNA, 21 bp, Homo sapiens
gttggcgcaccctcccctccc

SEQ ID NO: 6341791 - DNA, 18 bp, Homo sapiens
gttggcgtaggctacaga

SEQ ID NO: 6341792 - DNA, 15 bp, Homo sapiens
gttggctagtacttt

SEQ ID NO: 6341793 - DNA, 19 bp, Homo sapiens
gttggctagtctgtgcctc

SEQ ID NO: 6341794 - DNA, 13 bp, Homo sapiens
gttggctcagaaa

SEQ ID NO: 6341795 - DNA, 14 bp, Homo sapiens
gttggctcagaaaa

SEQ ID NO: 6341796 - DNA, 15 bp, Homo sapiens
gttggctctctgacg

SEQ ID NO: 6341797 - DNA, 20 bp, Homo sapiens
gttggctgattggaaaataa

SEQ ID NO: 6341798 - DNA, 14 bp, Homo sapiens
gttggctgctgcca

SEQ ID NO: 6341799 - DNA, 13 bp, Homo sapiens
gttggctgctgcg

SEQ ID NO: 6341800 - DNA, 13 bp, Homo sapiens
gttggctgggccc

SEQ ID NO: 6341801 - DNA, 17 bp, Homo sapiens
gttggctgggcccagaa

SEQ ID NO: 6341802 - DNA, 12 bp, Homo sapiens
gttggctggggg

SEQ ID NO: 6341803 - DNA, 23 bp, Homo sapiens
gttggctgtgttcgggggagcag

SEQ ID NO: 6341804 - DNA, 17 bp, Homo sapiens
gttggctgttccagact

SEQ ID NO: 6341805 - DNA, 16 bp, Homo sapiens
gttggcttacctggcc

SEQ ID NO: 6341806 - DNA, 20 bp, Homo sapiens
gttggcttctccctggggac

SEQ ID NO: 6341807 - DNA, 22 bp, Homo sapiens
gttggcttctccctggggacgg

SEQ ID NO: 6341808 - DNA, 23 bp, Homo sapiens
gttggcttctgtttctagttgag

SEQ ID NO: 6341809 - DNA, 15 bp, Homo sapiens
gttggcttctttgct

SEQ ID NO: 6341810 - DNA, 21 bp, Homo sapiens
gttggcttctttgctttctcg

SEQ ID NO: 6341811 - DNA, 14 bp, Homo sapiens
gttggctttacaaa

SEQ ID NO: 6341812 - DNA, 21 bp, Homo sapiens
gttggctttgcagctgctgtc

SEQ ID NO: 6341813 - DNA, 14 bp, Homo sapiens
gttgggaagacatg

SEQ ID NO: 6341814 - DNA, 18 bp, Homo sapiens
gttgggaaggggtcctgc

SEQ ID NO: 6341815 - DNA, 20 bp, Homo sapiens
gttgggaaggggtcctgcag

SEQ ID NO: 6341816 - DNA, 22 bp, Homo sapiens
gttgggaagtctcagcctgggc

SEQ ID NO: 6341817 - DNA, 19 bp, Homo sapiens
gttgggaatgaggcttgct

SEQ ID NO: 6341818 - DNA, 17 bp, Homo sapiens
gttgggaccaggccaat

SEQ ID NO: 6341819 - DNA, 21 bp, Homo sapiens
gttgggaccaggccaatccct

SEQ ID NO: 6341820 - DNA, 16 bp, Homo sapiens
gttgggacccagtggc

SEQ ID NO: 6341821 - DNA, 16 bp, Homo sapiens
ggtccacccaggagcc

SEQ ID NO: 6341822 - DNA, 17 bp, Homo sapiens
ggtccacccaggagccc

SEQ ID NO: 6341823 - DNA, 15 bp, Homo sapiens
ggtccaccccgtccc

SEQ ID NO: 6341824 - DNA, 18 bp, Homo sapiens
ggtccaccccgtcccggc

SEQ ID NO: 6341825 - DNA, 23 bp, Homo sapiens
ggtccaccccgtcccggccccgc

SEQ ID NO: 6341826 - DNA, 23 bp, Homo sapiens
ggtccaccctttcatagagaggc

SEQ ID NO: 6341827 - DNA, 18 bp, Homo sapiens
ggtccaccggcccctggc

SEQ ID NO: 6341828 - DNA, 17 bp, Homo sapiens
ggtccactccctgctcc

SEQ ID NO: 6341829 - DNA, 10 bp, Homo sapiens
ggtccactgt

SEQ ID NO: 6341830 - DNA, 13 bp, Homo sapiens
ggtccactgtgtt

SEQ ID NO: 6341831 - DNA, 16 bp, Homo sapiens
ggtccacttgccaggg

SEQ ID NO: 6341832 - DNA, 18 bp, Homo sapiens
ggtccacttgccagggct

SEQ ID NO: 6341833 - DNA, 20 bp, Homo sapiens
ggtccagaaggagcaggccc

SEQ ID NO: 6341834 - DNA, 16 bp, Homo sapiens
ggtccagaagtccctc

SEQ ID NO: 6341835 - DNA, 20 bp, Homo sapiens
ggtccagccctggctgaagg

SEQ ID NO: 6341836 - DNA, 23 bp, Homo sapiens
ggtccagccctggctgaaggact

SEQ ID NO: 6341837 - DNA, 20 bp, Homo sapiens
ggtccagcgtcactccagtg

SEQ ID NO: 6341838 - DNA, 11 bp, Homo sapiens
ggtccagctct

SEQ ID NO: 6341839 - DNA, 12 bp, Homo sapiens
ggtccagctctg

SEQ ID NO: 6341840 - DNA, 14 bp, Homo sapiens
ggtccagctctgac

SEQ ID NO: 6341841 - DNA, 20 bp, Homo sapiens
ggtccagctctgacatccct

SEQ ID NO: 6341842 - DNA, 23 bp, Homo sapiens
ggtccagctctgacatcccttcc

SEQ ID NO: 6341843 - DNA, 17 bp, Homo sapiens
ggtccagctctgtgggc

SEQ ID NO: 6341844 - DNA, 15 bp, Homo sapiens
ggtccagctggcctg

SEQ ID NO: 6341845 - DNA, 18 bp, Homo sapiens
ggtccagctggcctggac

SEQ ID NO: 6341846 - DNA, 18 bp, Homo sapiens
ggtccagcttgctcttca

SEQ ID NO: 6341847 - DNA, 20 bp, Homo sapiens
ggtccaggaaggcagctgct

SEQ ID NO: 6341848 - DNA, 21 bp, Homo sapiens
ggtccaggaaggcagctgctc

SEQ ID NO: 6341849 - DNA, 18 bp, Homo sapiens
ggtccaggagaagtgctc

SEQ ID NO: 6341850 - DNA, 22 bp, Homo sapiens
ggtccaggagaagtgctccctg

SEQ ID NO: 6341851 - DNA, 23 bp, Homo sapiens
ggtccaggagaagtgctccctgg

SEQ ID NO: 6341852 - DNA, 19 bp, Homo sapiens
ggtccaggattcctctttt

SEQ ID NO: 6341853 - DNA, 19 bp, Homo sapiens
ggtccaggccaggcctcat

SEQ ID NO: 6341854 - DNA, 12 bp, Homo sapiens
ggtccaggcccc

SEQ ID NO: 6341855 - DNA, 13 bp, Homo sapiens
ggtccaggctgtg

SEQ ID NO: 6341856 - DNA, 21 bp, Homo sapiens
ggtccagggaggggtccctgc

SEQ ID NO: 6341857 - DNA, 21 bp, Homo sapiens
ggtccagggcctgacaccccc

SEQ ID NO: 6341858 - DNA, 12 bp, Homo sapiens
ggtccagggctg

SEQ ID NO: 6341859 - DNA, 20 bp, Homo sapiens
ggtccaggggcccctccagc

SEQ ID NO: 6341860 - DNA, 23 bp, Homo sapiens
ggtccaggggcccctccagcttg

SEQ ID NO: 6341861 - DNA, 13 bp, Homo sapiens
ggtccagggttga

SEQ ID NO: 6341862 - DNA, 20 bp, Homo sapiens
ggtccaggtcaccagcctga

SEQ ID NO: 6341863 - DNA, 18 bp, Homo sapiens
ggtccagtggatgccaca

SEQ ID NO: 6341864 - DNA, 13 bp, Homo sapiens
ggtccagtgggga

SEQ ID NO: 6341865 - DNA, 19 bp, Homo sapiens
ggtccagtttctagagggc

SEQ ID NO: 6341866 - DNA, 15 bp, Homo sapiens
ggtccatagagagca

SEQ ID NO: 6341867 - DNA, 20 bp, Homo sapiens
ggtccatagagatgagccca

SEQ ID NO: 6341868 - DNA, 20 bp, Homo sapiens
ggtccatgcccactgctggt

SEQ ID NO: 6341869 - DNA, 17 bp, Homo sapiens
ggtccatggaatgcttg

SEQ ID NO: 6341870 - DNA, 21 bp, Homo sapiens
ggtccattaatacttccttat

SEQ ID NO: 6341871 - DNA, 19 bp, Homo sapiens
ggtccatttcatgtgatct

SEQ ID NO: 6341872 - DNA, 14 bp, Homo sapiens
ggtccatttgttcc

SEQ ID NO: 6341873 - DNA, 20 bp, Homo sapiens
ggtcccaaacagctgcctct

SEQ ID NO: 6341874 - DNA, 22 bp, Homo sapiens
ggtcccaacaggaggacaattc

SEQ ID NO: 6341875 - DNA, 16 bp, Homo sapiens
ggtcccaagctgggcc

SEQ ID NO: 6341876 - DNA, 20 bp, Homo sapiens
ggtcccaagctgggccccag

SEQ ID NO: 6341877 - DNA, 23 bp, Homo sapiens
ggtcccaagctgggccccagccc

SEQ ID NO: 6341878 - DNA, 23 bp, Homo sapiens
ggtcccaattcggggcctgctgg

SEQ ID NO: 6341879 - DNA, 19 bp, Homo sapiens
ggtcccacaaatgggcgcc

SEQ ID NO: 6341880 - DNA, 14 bp, Homo sapiens
ggtcccacagccac

SEQ ID NO: 6341881 - DNA, 22 bp, Homo sapiens
ggtcccacatccctgggcctgc

SEQ ID NO: 6341882 - DNA, 17 bp, Homo sapiens
ggtcccaccccacacac

SEQ ID NO: 6341883 - DNA, 22 bp, Homo sapiens
ggtcccaccccacacacgccag

SEQ ID NO: 6341884 - DNA, 22 bp, Homo sapiens
ggtcccacctccagcccgggag

SEQ ID NO: 6341885 - DNA, 16 bp, Homo sapiens
ggtcccacgccaggcc

SEQ ID NO: 6341886 - DNA, 19 bp, Homo sapiens
ggtcccacgccaggccagc

SEQ ID NO: 6341887 - DNA, 17 bp, Homo sapiens
ggtcccacttcccctcc

SEQ ID NO: 6341888 - DNA, 19 bp, Homo sapiens
ggtcccagacatgctgccc

SEQ ID NO: 6341889 - DNA, 20 bp, Homo sapiens
ggtcccagacatgctgccca

SEQ ID NO: 6341890 - DNA, 21 bp, Homo sapiens
ggtcccagacatgctgcccac

SEQ ID NO: 6341891 - DNA, 22 bp, Homo sapiens
ggtcccagagacctcatcagcc

SEQ ID NO: 6341892 - DNA, 18 bp, Homo sapiens
ggtcccagccccaggcct

SEQ ID NO: 6341893 - DNA, 19 bp, Homo sapiens
ggtcccagccccaggcctg

SEQ ID NO: 6341894 - DNA, 20 bp, Homo sapiens
ggtcccagccccaggcctgg

SEQ ID NO: 6341895 - DNA, 20 bp, Homo sapiens
ggtcccagcccctcctccct

SEQ ID NO: 6341896 - DNA, 23 bp, Homo sapiens
ggtcccagcccctcctccctcag

SEQ ID NO: 6341897 - DNA, 15 bp, Homo sapiens
ggtcccagcctgggc

SEQ ID NO: 6341898 - DNA, 22 bp, Homo sapiens
ggtcccagcctgggctcctctg

SEQ ID NO: 6341899 - DNA, 17 bp, Homo sapiens
ggtcccagcgagccaca

SEQ ID NO: 6341900 - DNA, 17 bp, Homo sapiens
ggtcccaggatcccctg

SEQ ID NO: 6341901 - DNA, 14 bp, Homo sapiens
ggtcccagggctgg

SEQ ID NO: 6341902 - DNA, 20 bp, Homo sapiens
ggtcccagggctggccctag

SEQ ID NO: 6341903 - DNA, 21 bp, Homo sapiens
ggtcccagggctggccctagg

SEQ ID NO: 6341904 - DNA, 13 bp, Homo sapiens
ggtcccagtccgg

SEQ ID NO: 6341905 - DNA, 19 bp, Homo sapiens
ggtcccagttgctgtcaca

SEQ ID NO: 6341906 - DNA, 12 bp, Homo sapiens
ggtcccatccag

SEQ ID NO: 6341907 - DNA, 22 bp, Homo sapiens
ggtcccatggcctgctgggctt

SEQ ID NO: 6341908 - DNA, 16 bp, Homo sapiens
ggtcccattgtgcaga

SEQ ID NO: 6341909 - DNA, 22 bp, Homo sapiens
ggtcccattgttggcgctgagg

SEQ ID NO: 6341910 - DNA, 16 bp, Homo sapiens
ggtccccacagactgc

SEQ ID NO: 6341911 - DNA, 21 bp, Homo sapiens
ggtccccacagactgccccag

SEQ ID NO: 6341912 - DNA, 23 bp, Homo sapiens
ggtccccacagactgccccagcc

SEQ ID NO: 6341913 - DNA, 21 bp, Homo sapiens
ggtccccactcaccccctttg

SEQ ID NO: 6341914 - DNA, 19 bp, Homo sapiens
ggtccccagcccttcctct

SEQ ID NO: 6341915 - DNA, 20 bp, Homo sapiens
ggtccccagctccccaggac

SEQ ID NO: 6341916 - DNA, 13 bp, Homo sapiens
ggtccccatcccc

SEQ ID NO: 6341917 - DNA, 20 bp, Homo sapiens
ggtcccccagagcatctgcc

SEQ ID NO: 6341918 - DNA, 19 bp, Homo sapiens
ggtcccccaggaggcagct

SEQ ID NO: 6341919 - DNA, 17 bp, Homo sapiens
ggtcccccatgccacca

SEQ ID NO: 6341920 - DNA, 20 bp, Homo sapiens
ggtcccccatgccaccaccc

SEQ ID NO: 6341921 - DNA, 16 bp, Homo sapiens
ggtcccccatgggctg

SEQ ID NO: 6341922 - DNA, 21 bp, Homo sapiens
ggtccccccaccgctcagtgt

SEQ ID NO: 6341923 - DNA, 23 bp, Homo sapiens
ggtccccccaccgctcagtgtca

SEQ ID NO: 6341924 - DNA, 14 bp, Homo sapiens
ggtcccccctccat

SEQ ID NO: 6341925 - DNA, 13 bp, Homo sapiens
ggtcccccctccc

SEQ ID NO: 6341926 - DNA, 13 bp, Homo sapiens
ggtccccctcagc

SEQ ID NO: 6341927 - DNA, 13 bp, Homo sapiens
ggtcccccttcca

SEQ ID NO: 6341928 - DNA, 18 bp, Homo sapiens
ggtcccccttccatggac

SEQ ID NO: 6341929 - DNA, 23 bp, Homo sapiens
ggtcccccttccatggactttgt

SEQ ID NO: 6341930 - DNA, 22 bp, Homo sapiens
ggtccccgagacacaggcacgg

SEQ ID NO: 6341931 - DNA, 18 bp, Homo sapiens
ggtccccgccctctctca

SEQ ID NO: 6341932 - DNA, 19 bp, Homo sapiens
ggtccccgccctctctcat

SEQ ID NO: 6341933 - DNA, 15 bp, Homo sapiens
ggtccccggttgctg

SEQ ID NO: 6341934 - DNA, 12 bp, Homo sapiens
ggtcccctccac

SEQ ID NO: 6341935 - DNA, 23 bp, Homo sapiens
ggtcccctccccagctcccttgg

SEQ ID NO: 6341936 - DNA, 14 bp, Homo sapiens
ggtcccctccctcg

SEQ ID NO: 6341937 - DNA, 11 bp, Homo sapiens
ggtcccctccg

SEQ ID NO: 6341938 - DNA, 14 bp, Homo sapiens
ggtcccctctgtgc

SEQ ID NO: 6341939 - DNA, 13 bp, Homo sapiens
ggtcccctgccac

SEQ ID NO: 6341940 - DNA, 15 bp, Homo sapiens
ggtcccctgccctga

SEQ ID NO: 6341941 - DNA, 16 bp, Homo sapiens
ggtcccctgccctgag

SEQ ID NO: 6341942 - DNA, 15 bp, Homo sapiens
ggtcccctgcctgga

SEQ ID NO: 6341943 - DNA, 17 bp, Homo sapiens
ggtcccctgcctggaac

SEQ ID NO: 6341944 - DNA, 13 bp, Homo sapiens
ggtcccctggcag

SEQ ID NO: 6341945 - DNA, 17 bp, Homo sapiens
ggtcccctggcagggga

SEQ ID NO: 6341946 - DNA, 21 bp, Homo sapiens
ggtcccgagccccctgtcctt

SEQ ID NO: 6341947 - DNA, 20 bp, Homo sapiens
ggtcccggccagctctggag

SEQ ID NO: 6341948 - DNA, 16 bp, Homo sapiens
ggtcccggctctgtgg

SEQ ID NO: 6341949 - DNA, 20 bp, Homo sapiens
ggtcccggtgtatcctggcc

SEQ ID NO: 6341950 - DNA, 18 bp, Homo sapiens
ggtccctaataaagctgt

SEQ ID NO: 6341951 - DNA, 24 bp, Homo sapiens
ggtccctaattctcttcgctgtga

SEQ ID NO: 6341952 - DNA, 20 bp, Homo sapiens
ggtccctccgcggctggagc

SEQ ID NO: 6341953 - DNA, 11 bp, Homo sapiens
ggtccctcctc

SEQ ID NO: 6341954 - DNA, 22 bp, Homo sapiens
ggtccctcgtccacaggggcag

SEQ ID NO: 6341955 - DNA, 12 bp, Homo sapiens
ggtccctctcag

SEQ ID NO: 6341956 - DNA, 13 bp, Homo sapiens
ggtccctctcttg

SEQ ID NO: 6341957 - DNA, 18 bp, Homo sapiens
ggtccctgaacgccctgg

SEQ ID NO: 6341958 - DNA, 22 bp, Homo sapiens
ggtccctgataacaacctggag

SEQ ID NO: 6341959 - DNA, 23 bp, Homo sapiens
ggtccctgataacaacctggaga

SEQ ID NO: 6341960 - DNA, 12 bp, Homo sapiens
ggtccctgccct

SEQ ID NO: 6341961 - DNA, 22 bp, Homo sapiens
ggtccctgccctcccctgctcc

SEQ ID NO: 6341962 - DNA, 18 bp, Homo sapiens
ggtccctgcgtctcctgc

SEQ ID NO: 6341963 - DNA, 15 bp, Homo sapiens
ggtccctggaccagc

SEQ ID NO: 6341964 - DNA, 23 bp, Homo sapiens
ggtccctggagggcaagccctgc

SEQ ID NO: 6341965 - DNA, 20 bp, Homo sapiens
ggtccctgggtagcggggga

SEQ ID NO: 6341966 - DNA, 14 bp, Homo sapiens
ggtccctggtcctt

SEQ ID NO: 6341967 - DNA, 16 bp, Homo sapiens
ggtccctggtccttca

SEQ ID NO: 6341968 - DNA, 23 bp, Homo sapiens
ggtccctgtgctgatcctgctga

SEQ ID NO: 6341969 - DNA, 22 bp, Homo sapiens
ggtcccttaaggcacagtggga

SEQ ID NO: 6341970 - DNA, 18 bp, Homo sapiens
ggtcccttccatgccctg

SEQ ID NO: 6341971 - DNA, 19 bp, Homo sapiens
ggtcccttccatgccctgg

SEQ ID NO: 6341972 - DNA, 21 bp, Homo sapiens
ggtcccttcttactcacacac

SEQ ID NO: 6341973 - DNA, 20 bp, Homo sapiens
ggtcccttgagacctcagcc

SEQ ID NO: 6341974 - DNA, 17 bp, Homo sapiens
ggtccgagctctgtcct

SEQ ID NO: 6341975 - DNA, 18 bp, Homo sapiens
ggtccgagctctgtcctc

SEQ ID NO: 6341976 - DNA, 21 bp, Homo sapiens
ggtccgagtgtgtttcatcct

SEQ ID NO: 6341977 - DNA, 17 bp, Homo sapiens
ggtccgatggcccgaga

SEQ ID NO: 6341978 - DNA, 18 bp, Homo sapiens
ggtccgattaatttatgg

SEQ ID NO: 6341979 - DNA, 22 bp, Homo sapiens
ggtccgattaatttatggtttc

SEQ ID NO: 6341980 - DNA, 15 bp, Homo sapiens
ggtccgcaccagctg

SEQ ID NO: 6341981 - DNA, 22 bp, Homo sapiens
ggtccgcaccagctgctctgcc

SEQ ID NO: 6341982 - DNA, 23 bp, Homo sapiens
ggtccgcaccagctgctctgccc

SEQ ID NO: 6341983 - DNA, 16 bp, Homo sapiens
ggtccgcaccctgtcc

SEQ ID NO: 6341984 - DNA, 20 bp, Homo sapiens
ggtccgccttaatctggaag

SEQ ID NO: 6341985 - DNA, 18 bp, Homo sapiens
ggtccgctttcctggagc

SEQ ID NO: 6341986 - DNA, 17 bp, Homo sapiens
ggtccggacactcctag

SEQ ID NO: 6341987 - DNA, 18 bp, Homo sapiens
ggtccggacactcctaga

SEQ ID NO: 6341988 - DNA, 20 bp, Homo sapiens
ggtccggacactcctagaga

SEQ ID NO: 6341989 - DNA, 17 bp, Homo sapiens
ggtccggcctctccctg

SEQ ID NO: 6341990 - DNA, 21 bp, Homo sapiens
ggtccggcctctccctgcctg

SEQ ID NO: 6341991 - DNA, 19 bp, Homo sapiens
ggtccggcgccccgcaccc

SEQ ID NO: 6341992 - DNA, 15 bp, Homo sapiens
ggtccgtagctcccc

SEQ ID NO: 6341993 - DNA, 14 bp, Homo sapiens
ggtccgtctgagtg

SEQ ID NO: 6341994 - DNA, 22 bp, Homo sapiens
ggtccgtcttcacactgcgcag

SEQ ID NO: 6341995 - DNA, 18 bp, Homo sapiens
ggtccgtgcccaggccct

SEQ ID NO: 6341996 - DNA, 20 bp, Homo sapiens
gttgggacccagtggcaggg

SEQ ID NO: 6341997 - DNA, 22 bp, Homo sapiens
gttgggacccagtggcagggca

SEQ ID NO: 6341998 - DNA, 16 bp, Homo sapiens
gttgggacctgctgct

SEQ ID NO: 6341999 - DNA, 16 bp, Homo sapiens
gttgggagcctgaaat

SEQ ID NO: 6342000 - DNA, 18 bp, Homo sapiens
gttgggaggatacagagg

SEQ ID NO: 6342001 - DNA, 18 bp, Homo sapiens
gttgggatactgcagggc

SEQ ID NO: 6342002 - DNA, 18 bp, Homo sapiens
gttgggattcctgaccca

SEQ ID NO: 6342003 - DNA, 21 bp, Homo sapiens
gttgggattcctgacccaggc

SEQ ID NO: 6342004 - DNA, 22 bp, Homo sapiens
gttgggattcctgacccaggcc

SEQ ID NO: 6342005 - DNA, 22 bp, Homo sapiens
gttgggattgggggctggtgcc

SEQ ID NO: 6342006 - DNA, 19 bp, Homo sapiens
gttgggcagccagaccagc

SEQ ID NO: 6342007 - DNA, 20 bp, Homo sapiens
gttgggccatactggcctcg

SEQ ID NO: 6342008 - DNA, 13 bp, Homo sapiens
gttgggcccagat

SEQ ID NO: 6342009 - DNA, 17 bp, Homo sapiens
gttgggctcgcactgcc

SEQ ID NO: 6342010 - DNA, 18 bp, Homo sapiens
gttgggctgaacatgtgt

SEQ ID NO: 6342011 - DNA, 17 bp, Homo sapiens
gttgggctggtgtcacc

SEQ ID NO: 6342012 - DNA, 13 bp, Homo sapiens
gttggggagctgg

SEQ ID NO: 6342013 - DNA, 14 bp, Homo sapiens
gttggggcaaagcc

SEQ ID NO: 6342014 - DNA, 15 bp, Homo sapiens
gttggggcccttaac

SEQ ID NO: 6342015 - DNA, 16 bp, Homo sapiens
gttggggcttcacagc

SEQ ID NO: 6342016 - DNA, 14 bp, Homo sapiens
gttgggggaatgca

SEQ ID NO: 6342017 - DNA, 18 bp, Homo sapiens
gttgggggacagccttca

SEQ ID NO: 6342018 - DNA, 15 bp, Homo sapiens
gttgggggcactcag

SEQ ID NO: 6342019 - DNA, 18 bp, Homo sapiens
gttgggggctcctgtttc

SEQ ID NO: 6342020 - DNA, 17 bp, Homo sapiens
gttgggggtattttcta

SEQ ID NO: 6342021 - DNA, 16 bp, Homo sapiens
gttgggggtgtggctc

SEQ ID NO: 6342022 - DNA, 18 bp, Homo sapiens
gttgggggtgtggctctg

SEQ ID NO: 6342023 - DNA, 19 bp, Homo sapiens
gttgggggtgtggctctgc

SEQ ID NO: 6342024 - DNA, 13 bp, Homo sapiens
gttggggtgacag

SEQ ID NO: 6342025 - DNA, 14 bp, Homo sapiens
gttggggtgacagt

SEQ ID NO: 6342026 - DNA, 19 bp, Homo sapiens
gttggggtgacagtcatca

SEQ ID NO: 6342027 - DNA, 16 bp, Homo sapiens
gttggggtgggagggc

SEQ ID NO: 6342028 - DNA, 13 bp, Homo sapiens
gttggggtggggc

SEQ ID NO: 6342029 - DNA, 14 bp, Homo sapiens
gttggggtggggca

SEQ ID NO: 6342030 - DNA, 16 bp, Homo sapiens
gttggggtggggcagg

SEQ ID NO: 6342031 - DNA, 21 bp, Homo sapiens
gttgggtcaccagacggggct

SEQ ID NO: 6342032 - DNA, 20 bp, Homo sapiens
gttgggtcagatttatttgt

SEQ ID NO: 6342033 - DNA, 19 bp, Homo sapiens
gttgggtctgaaaggaaaa

SEQ ID NO: 6342034 - DNA, 13 bp, Homo sapiens
gttgggtggagga

SEQ ID NO: 6342035 - DNA, 15 bp, Homo sapiens
gttgggtgggtgggc

SEQ ID NO: 6342036 - DNA, 21 bp, Homo sapiens
gttgggtgtctccttaagctg

SEQ ID NO: 6342037 - DNA, 16 bp, Homo sapiens
gttgggttccagacag

SEQ ID NO: 6342038 - DNA, 22 bp, Homo sapiens
gttgggttccagacagagtgga

SEQ ID NO: 6342039 - DNA, 14 bp, Homo sapiens
gttgggtttgctca

SEQ ID NO: 6342040 - DNA, 17 bp, Homo sapiens
gttgggtttgctcatgt

SEQ ID NO: 6342041 - DNA, 14 bp, Homo sapiens
gttggtaaacagtt

SEQ ID NO: 6342042 - DNA, 22 bp, Homo sapiens
gttggtacctttctagccttag

SEQ ID NO: 6342043 - DNA, 23 bp, Homo sapiens
gttggtagatattcaggaaatgt

SEQ ID NO: 6342044 - DNA, 15 bp, Homo sapiens
gttggtagccatttg

SEQ ID NO: 6342045 - DNA, 18 bp, Homo sapiens
gttggtagccatttggta

SEQ ID NO: 6342046 - DNA, 18 bp, Homo sapiens
gttggtatattttatatt

SEQ ID NO: 6342047 - DNA, 18 bp, Homo sapiens
gttggtatctcaggtctg

SEQ ID NO: 6342048 - DNA, 18 bp, Homo sapiens
gttggtattaataaaaag

SEQ ID NO: 6342049 - DNA, 13 bp, Homo sapiens
gttggtccactgt

SEQ ID NO: 6342050 - DNA, 15 bp, Homo sapiens
gttggtccactgtgt

SEQ ID NO: 6342051 - DNA, 14 bp, Homo sapiens
gttggtccagagcg

SEQ ID NO: 6342052 - DNA, 22 bp, Homo sapiens
gttggtccagagcggaggctgt

SEQ ID NO: 6342053 - DNA, 23 bp, Homo sapiens
gttggtctctgcatttttctgca

SEQ ID NO: 6342054 - DNA, 20 bp, Homo sapiens
gttggtctgccttctgctga

SEQ ID NO: 6342055 - DNA, 14 bp, Homo sapiens
gttggtctgtgtaa

SEQ ID NO: 6342056 - DNA, 21 bp, Homo sapiens
gttggtctttctaatgtagct

SEQ ID NO: 6342057 - DNA, 17 bp, Homo sapiens
gttggtgaacagagaga

SEQ ID NO: 6342058 - DNA, 22 bp, Homo sapiens
gttggtgaattttcaaggcctt

SEQ ID NO: 6342059 - DNA, 19 bp, Homo sapiens
gttggtgaccagtttctta

SEQ ID NO: 6342060 - DNA, 20 bp, Homo sapiens
gttggtgaccagtttcttaa

SEQ ID NO: 6342061 - DNA, 23 bp, Homo sapiens
gttggtgacttgtctgcctcctg

SEQ ID NO: 6342062 - DNA, 20 bp, Homo sapiens
gttggtggggggtccagtct

SEQ ID NO: 6342063 - DNA, 13 bp, Homo sapiens
gttggtggtgctg

SEQ ID NO: 6342064 - DNA, 20 bp, Homo sapiens
gttggtgtgctatttttgaa

SEQ ID NO: 6342065 - DNA, 12 bp, Homo sapiens
gttggtgttcct

SEQ ID NO: 6342066 - DNA, 19 bp, Homo sapiens
gttggtgttctaagactct

SEQ ID NO: 6342067 - DNA, 15 bp, Homo sapiens
gttggtgttgcagaa

SEQ ID NO: 6342068 - DNA, 18 bp, Homo sapiens
gttggttacctattgctg

SEQ ID NO: 6342069 - DNA, 21 bp, Homo sapiens
gttggttagccgactgtcttg

SEQ ID NO: 6342070 - DNA, 18 bp, Homo sapiens
gttggttccaagccctgg

SEQ ID NO: 6342071 - DNA, 22 bp, Homo sapiens
gttggttccaagtctttgctat

SEQ ID NO: 6342072 - DNA, 14 bp, Homo sapiens
gttggttccttggg

SEQ ID NO: 6342073 - DNA, 22 bp, Homo sapiens
gttggttgaattttttttaatg

SEQ ID NO: 6342074 - DNA, 14 bp, Homo sapiens
gttggttggataag

SEQ ID NO: 6342075 - DNA, 19 bp, Homo sapiens
gttggttggggtggggcag

SEQ ID NO: 6342076 - DNA, 15 bp, Homo sapiens
gttggtttactttca

SEQ ID NO: 6342077 - DNA, 23 bp, Homo sapiens
gttggtttcactgagagctgcct

SEQ ID NO: 6342078 - DNA, 14 bp, Homo sapiens
gttggtttgtatga

SEQ ID NO: 6342079 - DNA, 12 bp, Homo sapiens
gttggttttctt

SEQ ID NO: 6342080 - DNA, 20 bp, Homo sapiens
gttggttttgcatgtctgca

SEQ ID NO: 6342081 - DNA, 15 bp, Homo sapiens
gttggttttgctgtt

SEQ ID NO: 6342082 - DNA, 12 bp, Homo sapiens
gttggtttttat

SEQ ID NO: 6342083 - DNA, 13 bp, Homo sapiens
gttgtaaaatata

SEQ ID NO: 6342084 - DNA, 12 bp, Homo sapiens
gttgtaaagata

SEQ ID NO: 6342085 - DNA, 23 bp, Homo sapiens
gttgtaaagatattgtatctcct

SEQ ID NO: 6342086 - DNA, 14 bp, Homo sapiens
gttgtaaatacaat

SEQ ID NO: 6342087 - DNA, 16 bp, Homo sapiens
gttgtaaatacaattc

SEQ ID NO: 6342088 - DNA, 18 bp, Homo sapiens
gttgtaaatacaattcaa

SEQ ID NO: 6342089 - DNA, 14 bp, Homo sapiens
gttgtaaatatata

SEQ ID NO: 6342090 - DNA, 17 bp, Homo sapiens
gttgtaaatgaccaaga

SEQ ID NO: 6342091 - DNA, 18 bp, Homo sapiens
gttgtaaatgctcgtgtg

SEQ ID NO: 6342092 - DNA, 22 bp, Homo sapiens
gttgtaaattggcatggaaatt

SEQ ID NO: 6342093 - DNA, 20 bp, Homo sapiens
gttgtaacaaatacagatga

SEQ ID NO: 6342094 - DNA, 14 bp, Homo sapiens
gttgtaacctgctg

SEQ ID NO: 6342095 - DNA, 21 bp, Homo sapiens
gttgtaactaggctcagagat

SEQ ID NO: 6342096 - DNA, 12 bp, Homo sapiens
gttgtaacttat

SEQ ID NO: 6342097 - DNA, 16 bp, Homo sapiens
gttgtaagaattctga

SEQ ID NO: 6342098 - DNA, 22 bp, Homo sapiens
gttgtaagtactctaatataca

SEQ ID NO: 6342099 - DNA, 15 bp, Homo sapiens
gttgtaatagtccat

SEQ ID NO: 6342100 - DNA, 15 bp, Homo sapiens
gttgtaatttaatga

SEQ ID NO: 6342101 - DNA, 17 bp, Homo sapiens
gttgtacaaatgtattt

SEQ ID NO: 6342102 - DNA, 21 bp, Homo sapiens
gttgtacaaatgtattttgaa

SEQ ID NO: 6342103 - DNA, 21 bp, Homo sapiens
gttgtacaatcaaaacacact

SEQ ID NO: 6342104 - DNA, 15 bp, Homo sapiens
gttgtacaatcatgt

SEQ ID NO: 6342105 - DNA, 19 bp, Homo sapiens
gttgtacaatcatgttctg

SEQ ID NO: 6342106 - DNA, 18 bp, Homo sapiens
gttgtacaattactgtga

SEQ ID NO: 6342107 - DNA, 12 bp, Homo sapiens
gttgtacatgat

SEQ ID NO: 6342108 - DNA, 13 bp, Homo sapiens
gttgtacatgata

SEQ ID NO: 6342109 - DNA, 22 bp, Homo sapiens
gttgtacatgataagacatttt

SEQ ID NO: 6342110 - DNA, 18 bp, Homo sapiens
gttgtacatttatgattt

SEQ ID NO: 6342111 - DNA, 20 bp, Homo sapiens
gttgtacatttatgatttaa

SEQ ID NO: 6342112 - DNA, 15 bp, Homo sapiens
gttgtaccactgcta

SEQ ID NO: 6342113 - DNA, 22 bp, Homo sapiens
gttgtaccactgctaataaatg

SEQ ID NO: 6342114 - DNA, 22 bp, Homo sapiens
gttgtacccttgttttgaaact

SEQ ID NO: 6342115 - DNA, 18 bp, Homo sapiens
gttgtaccgcaatgtgac

SEQ ID NO: 6342116 - DNA, 23 bp, Homo sapiens
gttgtacctcttttgcttgccaa

SEQ ID NO: 6342117 - DNA, 18 bp, Homo sapiens
gttgtacgttttgcacat

SEQ ID NO: 6342118 - DNA, 23 bp, Homo sapiens
gttgtactatggaaaatcagctg

SEQ ID NO: 6342119 - DNA, 21 bp, Homo sapiens
gttgtactattgtttaaaaac

SEQ ID NO: 6342120 - DNA, 16 bp, Homo sapiens
gttgtactgtatgtga

SEQ ID NO: 6342121 - DNA, 16 bp, Homo sapiens
gttgtagactatggaa

SEQ ID NO: 6342122 - DNA, 22 bp, Homo sapiens
gttgtagcattttcctgtttac

SEQ ID NO: 6342123 - DNA, 19 bp, Homo sapiens
gttgtagttcttgtgcatg

SEQ ID NO: 6342124 - DNA, 15 bp, Homo sapiens
gttgtataaaaacat

SEQ ID NO: 6342125 - DNA, 17 bp, Homo sapiens
gttgtataaatttattt

SEQ ID NO: 6342126 - DNA, 23 bp, Homo sapiens
gttgtatacttccttatgcttct

SEQ ID NO: 6342127 - DNA, 14 bp, Homo sapiens
gttgtatatatcag

SEQ ID NO: 6342128 - DNA, 21 bp, Homo sapiens
gttgtatatcactaaaagcat

SEQ ID NO: 6342129 - DNA, 15 bp, Homo sapiens
gttgtatctacagta

SEQ ID NO: 6342130 - DNA, 14 bp, Homo sapiens
gttgtatgatctgt

SEQ ID NO: 6342131 - DNA, 16 bp, Homo sapiens
gttgtatgattccaat

SEQ ID NO: 6342132 - DNA, 23 bp, Homo sapiens
gttgtatgcctttaaatctgtga

SEQ ID NO: 6342133 - DNA, 23 bp, Homo sapiens
gttgtatggctgagcaagagaga

SEQ ID NO: 6342134 - DNA, 23 bp, Homo sapiens
gttgtatgggattggtgggctga

SEQ ID NO: 6342135 - DNA, 12 bp, Homo sapiens
gttgtatgtgtc

SEQ ID NO: 6342136 - DNA, 13 bp, Homo sapiens
gttgtattaacaa

SEQ ID NO: 6342137 - DNA, 14 bp, Homo sapiens
gttgtattagatgt

SEQ ID NO: 6342138 - DNA, 15 bp, Homo sapiens
gttgtattagatgtt

SEQ ID NO: 6342139 - DNA, 20 bp, Homo sapiens
gttgtattcaccccacaccc

SEQ ID NO: 6342140 - DNA, 13 bp, Homo sapiens
gttgtattctttg

SEQ ID NO: 6342141 - DNA, 14 bp, Homo sapiens
gttgtattctttga

SEQ ID NO: 6342142 - DNA, 16 bp, Homo sapiens
gttgtatttcaaatat

SEQ ID NO: 6342143 - DNA, 21 bp, Homo sapiens
gttgtatttctatatttattt

SEQ ID NO: 6342144 - DNA, 13 bp, Homo sapiens
gttgtatttgaag

SEQ ID NO: 6342145 - DNA, 15 bp, Homo sapiens
gttgtcaaagaagct

SEQ ID NO: 6342146 - DNA, 20 bp, Homo sapiens
gttgtcaaggaagaagaaat

SEQ ID NO: 6342147 - DNA, 22 bp, Homo sapiens
gttgtcaagtctctgctggccc

SEQ ID NO: 6342148 - DNA, 23 bp, Homo sapiens
gttgtcaatattaaatacagaca

SEQ ID NO: 6342149 - DNA, 16 bp, Homo sapiens
gttgtcacaaactgtg

SEQ ID NO: 6342150 - DNA, 17 bp, Homo sapiens
gttgtcacacccatggc

SEQ ID NO: 6342151 - DNA, 16 bp, Homo sapiens
gttgtcaccagatctg

SEQ ID NO: 6342152 - DNA, 18 bp, Homo sapiens
gttgtcaccattgcacaa

SEQ ID NO: 6342153 - DNA, 15 bp, Homo sapiens
gttgtcagcctgtgc

SEQ ID NO: 6342154 - DNA, 22 bp, Homo sapiens
gttgtcataacatttaaagaga

SEQ ID NO: 6342155 - DNA, 16 bp, Homo sapiens
gttgtcattgacttca

SEQ ID NO: 6342156 - DNA, 20 bp, Homo sapiens
gttgtcattgtaaacaaact

SEQ ID NO: 6342157 - DNA, 15 bp, Homo sapiens
gttgtcattgtccag

SEQ ID NO: 6342158 - DNA, 18 bp, Homo sapiens
gttgtcattgtccagctg

SEQ ID NO: 6342159 - DNA, 14 bp, Homo sapiens
gttgtccaactatt

SEQ ID NO: 6342160 - DNA, 13 bp, Homo sapiens
gttgtcccatctg

SEQ ID NO: 6342161 - DNA, 18 bp, Homo sapiens
gttgtcccatctgccctc

SEQ ID NO: 6342162 - DNA, 17 bp, Homo sapiens
gttgtccccgctggctc

SEQ ID NO: 6342163 - DNA, 13 bp, Homo sapiens
gttgtccctctgc

SEQ ID NO: 6342164 - DNA, 17 bp, Homo sapiens
gttgtccctctgctacg

SEQ ID NO: 6342165 - DNA, 14 bp, Homo sapiens
gttgtccctgcagg

SEQ ID NO: 6342166 - DNA, 15 bp, Homo sapiens
gttgtcctatgggag

SEQ ID NO: 6342167 - DNA, 14 bp, Homo sapiens
gttgtcctcctgtt

SEQ ID NO: 6342168 - DNA, 22 bp, Homo sapiens
gttgtcctccttccggggaagg

SEQ ID NO: 6342169 - DNA, 14 bp, Homo sapiens
gttgtccttgcccc

SEQ ID NO: 6342170 - DNA, 19 bp, Homo sapiens
gttgtccttgccccactcc

SEQ ID NO: 6342171 - DNA, 14 bp, Homo sapiens
gttgtccttttcat

SEQ ID NO: 6342172 - DNA, 16 bp, Homo sapiens
gttgtcgtttttagct

SEQ ID NO: 6342173 - DNA, 15 bp, Homo sapiens
gttgtctaaaaataa

SEQ ID NO: 6342174 - DNA, 14 bp, Homo sapiens
gttgtctaagaaat

SEQ ID NO: 6342175 - DNA, 13 bp, Homo sapiens
ggtccgtgggacg

SEQ ID NO: 6342176 - DNA, 22 bp, Homo sapiens
ggtccgtggtagaggcctgggg

SEQ ID NO: 6342177 - DNA, 17 bp, Homo sapiens
ggtcctaaccagtgagc

SEQ ID NO: 6342178 - DNA, 21 bp, Homo sapiens
ggtcctaaggcatctatctgt

SEQ ID NO: 6342179 - DNA, 22 bp, Homo sapiens
ggtcctaatatatatgtagaga

SEQ ID NO: 6342180 - DNA, 20 bp, Homo sapiens
ggtcctacccatccccgcag

SEQ ID NO: 6342181 - DNA, 19 bp, Homo sapiens
ggtcctacggagggaccag

SEQ ID NO: 6342182 - DNA, 14 bp, Homo sapiens
ggtcctagacaaac

SEQ ID NO: 6342183 - DNA, 22 bp, Homo sapiens
ggtcctagaggccctttgctgt

SEQ ID NO: 6342184 - DNA, 18 bp, Homo sapiens
ggtcctagcccttccctg

SEQ ID NO: 6342185 - DNA, 19 bp, Homo sapiens
ggtcctagcccttccctga

SEQ ID NO: 6342186 - DNA, 18 bp, Homo sapiens
ggtcctagggtgggaagg

SEQ ID NO: 6342187 - DNA, 18 bp, Homo sapiens
ggtcctaggtcctctgag

SEQ ID NO: 6342188 - DNA, 21 bp, Homo sapiens
ggtcctcagagaatttctacc

SEQ ID NO: 6342189 - DNA, 14 bp, Homo sapiens
ggtcctcagctgct

SEQ ID NO: 6342190 - DNA, 17 bp, Homo sapiens
ggtcctcagctgctccc

SEQ ID NO: 6342191 - DNA, 18 bp, Homo sapiens
ggtcctcaggtcagctgg

SEQ ID NO: 6342192 - DNA, 23 bp, Homo sapiens
ggtcctccatcccaacagccatg

SEQ ID NO: 6342193 - DNA, 21 bp, Homo sapiens
ggtcctccatttcaactccag

SEQ ID NO: 6342194 - DNA, 13 bp, Homo sapiens
ggtcctcccagct

SEQ ID NO: 6342195 - DNA, 17 bp, Homo sapiens
ggtcctcccctctcttg

SEQ ID NO: 6342196 - DNA, 16 bp, Homo sapiens
ggtcctccctcccaag

SEQ ID NO: 6342197 - DNA, 18 bp, Homo sapiens
ggtcctccctcccaagga

SEQ ID NO: 6342198 - DNA, 21 bp, Homo sapiens
ggtcctccgcctactgtccct

SEQ ID NO: 6342199 - DNA, 20 bp, Homo sapiens
ggtcctccggggctcagccc

SEQ ID NO: 6342200 - DNA, 20 bp, Homo sapiens
ggtcctcctaagtcccttcc

SEQ ID NO: 6342201 - DNA, 22 bp, Homo sapiens
ggtcctcctaagtcccttccta

SEQ ID NO: 6342202 - DNA, 18 bp, Homo sapiens
ggtcctcctccagggaca

SEQ ID NO: 6342203 - DNA, 12 bp, Homo sapiens
ggtcctcctcgc

SEQ ID NO: 6342204 - DNA, 23 bp, Homo sapiens
ggtcctcctcgctcctccttccc

SEQ ID NO: 6342205 - DNA, 14 bp, Homo sapiens
ggtcctcctggcct

SEQ ID NO: 6342206 - DNA, 13 bp, Homo sapiens
ggtcctcctgtgc

SEQ ID NO: 6342207 - DNA, 20 bp, Homo sapiens
ggtcctcggcccatctgtcc

SEQ ID NO: 6342208 - DNA, 16 bp, Homo sapiens
ggtcctcgggcccctg

SEQ ID NO: 6342209 - DNA, 19 bp, Homo sapiens
ggtcctcgggcccctgagc

SEQ ID NO: 6342210 - DNA, 22 bp, Homo sapiens
ggtcctctctctgtggggctga

SEQ ID NO: 6342211 - DNA, 11 bp, Homo sapiens
ggtcctctctg

SEQ ID NO: 6342212 - DNA, 12 bp, Homo sapiens
ggtcctctctga

SEQ ID NO: 6342213 - DNA, 18 bp, Homo sapiens
ggtcctctctgagtcaaa

SEQ ID NO: 6342214 - DNA, 24 bp, Homo sapiens
ggtcctctctgagtcaaatccagt

SEQ ID NO: 6342215 - DNA, 11 bp, Homo sapiens
ggtcctctctt

SEQ ID NO: 6342216 - DNA, 12 bp, Homo sapiens
ggtcctctcttc

SEQ ID NO: 6342217 - DNA, 13 bp, Homo sapiens
ggtcctctggagc

SEQ ID NO: 6342218 - DNA, 21 bp, Homo sapiens
ggtcctctgtcagtcacagcc

SEQ ID NO: 6342219 - DNA, 13 bp, Homo sapiens
ggtcctgagacct

SEQ ID NO: 6342220 - DNA, 20 bp, Homo sapiens
ggtcctgagcactgccagga

SEQ ID NO: 6342221 - DNA, 22 bp, Homo sapiens
ggtcctgagcactgccaggagg

SEQ ID NO: 6342222 - DNA, 14 bp, Homo sapiens
ggtcctgaggctgg

SEQ ID NO: 6342223 - DNA, 20 bp, Homo sapiens
ggtcctgatttctagaaccc

SEQ ID NO: 6342224 - DNA, 23 bp, Homo sapiens
ggtcctgcacagattcccaggcc

SEQ ID NO: 6342225 - DNA, 22 bp, Homo sapiens
ggtcctgcacatgagtggaaat

SEQ ID NO: 6342226 - DNA, 16 bp, Homo sapiens
ggtcctgcagggggag

SEQ ID NO: 6342227 - DNA, 12 bp, Homo sapiens
ggtcctgccagc

SEQ ID NO: 6342228 - DNA, 22 bp, Homo sapiens
ggtcctgcccatgtgtcccctc

SEQ ID NO: 6342229 - DNA, 11 bp, Homo sapiens
ggtcctgccct

SEQ ID NO: 6342230 - DNA, 17 bp, Homo sapiens
ggtcctgccctccggag

SEQ ID NO: 6342231 - DNA, 19 bp, Homo sapiens
ggtcctgccctccggagga

SEQ ID NO: 6342232 - DNA, 18 bp, Homo sapiens
ggtcctgcctaaatttca

SEQ ID NO: 6342233 - DNA, 15 bp, Homo sapiens
ggtcctgcctggtcc

SEQ ID NO: 6342234 - DNA, 16 bp, Homo sapiens
ggtcctgctccgctgc

SEQ ID NO: 6342235 - DNA, 18 bp, Homo sapiens
ggtcctgctccgctgcct

SEQ ID NO: 6342236 - DNA, 21 bp, Homo sapiens
ggtcctgctccgctgcctgga

SEQ ID NO: 6342237 - DNA, 14 bp, Homo sapiens
ggtcctgctgcagt

SEQ ID NO: 6342238 - DNA, 21 bp, Homo sapiens
ggtcctgctgcagttgccagt

SEQ ID NO: 6342239 - DNA, 20 bp, Homo sapiens
ggtcctgctgctcgggaagg

SEQ ID NO: 6342240 - DNA, 23 bp, Homo sapiens
ggtcctgcttgaactgctgccaa

SEQ ID NO: 6342241 - DNA, 19 bp, Homo sapiens
ggtcctggacacctcccag

SEQ ID NO: 6342242 - DNA, 17 bp, Homo sapiens
ggtcctggagcagacca

SEQ ID NO: 6342243 - DNA, 21 bp, Homo sapiens
ggtcctggagcagaccacccc

SEQ ID NO: 6342244 - DNA, 12 bp, Homo sapiens
ggtcctggccat

SEQ ID NO: 6342245 - DNA, 14 bp, Homo sapiens
ggtcctggccctct

SEQ ID NO: 6342246 - DNA, 12 bp, Homo sapiens
ggtcctggctcc

SEQ ID NO: 6342247 - DNA, 15 bp, Homo sapiens
ggtcctggctgcact

SEQ ID NO: 6342248 - DNA, 12 bp, Homo sapiens
ggtcctggctgg

SEQ ID NO: 6342249 - DNA, 16 bp, Homo sapiens
ggtcctggctggaagg

SEQ ID NO: 6342250 - DNA, 16 bp, Homo sapiens
ggtcctgggaggctgc

SEQ ID NO: 6342251 - DNA, 22 bp, Homo sapiens
ggtcctgggaggctgcagccag

SEQ ID NO: 6342252 - DNA, 12 bp, Homo sapiens
ggtcctgggcag

SEQ ID NO: 6342253 - DNA, 16 bp, Homo sapiens
ggtcctgggcaggtgg

SEQ ID NO: 6342254 - DNA, 12 bp, Homo sapiens
ggtcctgggctg

SEQ ID NO: 6342255 - DNA, 15 bp, Homo sapiens
ggtcctgggggctgc

SEQ ID NO: 6342256 - DNA, 22 bp, Homo sapiens
ggtcctgggggctgctgcactg

SEQ ID NO: 6342257 - DNA, 12 bp, Homo sapiens
ggtcctggtgcc

SEQ ID NO: 6342258 - DNA, 14 bp, Homo sapiens
ggtcctggtgccct

SEQ ID NO: 6342259 - DNA, 13 bp, Homo sapiens
ggtcctggtgctg

SEQ ID NO: 6342260 - DNA, 19 bp, Homo sapiens
ggtcctggtgctgccgagg

SEQ ID NO: 6342261 - DNA, 16 bp, Homo sapiens
ggtcctgtcaccctgg

SEQ ID NO: 6342262 - DNA, 18 bp, Homo sapiens
ggtcctgtcaccctggcc

SEQ ID NO: 6342263 - DNA, 12 bp, Homo sapiens
ggtcctgtcccc

SEQ ID NO: 6342264 - DNA, 21 bp, Homo sapiens
ggtcctgtcgccaccacttcc

SEQ ID NO: 6342265 - DNA, 13 bp, Homo sapiens
ggtcctgtctccc

SEQ ID NO: 6342266 - DNA, 23 bp, Homo sapiens
ggtcctgtctcccctctgctggc

SEQ ID NO: 6342267 - DNA, 15 bp, Homo sapiens
ggtcctgtctgtcct

SEQ ID NO: 6342268 - DNA, 14 bp, Homo sapiens
ggtcctgtgccccg

SEQ ID NO: 6342269 - DNA, 15 bp, Homo sapiens
ggtcctgtgccccga

SEQ ID NO: 6342270 - DNA, 21 bp, Homo sapiens
ggtcctgtggcaggcagcgcc

SEQ ID NO: 6342271 - DNA, 21 bp, Homo sapiens
ggtccttcaagttagctcagg

SEQ ID NO: 6342272 - DNA, 16 bp, Homo sapiens
ggtccttccaggcccc

SEQ ID NO: 6342273 - DNA, 22 bp, Homo sapiens
ggtccttcctttaggtctggtt

SEQ ID NO: 6342274 - DNA, 18 bp, Homo sapiens
ggtccttgatgccagagg

SEQ ID NO: 6342275 - DNA, 19 bp, Homo sapiens
ggtccttgatgccagaggg

SEQ ID NO: 6342276 - DNA, 21 bp, Homo sapiens
ggtccttgatgccagagggcc

SEQ ID NO: 6342277 - DNA, 22 bp, Homo sapiens
ggtccttgatgccagagggcca

SEQ ID NO: 6342278 - DNA, 23 bp, Homo sapiens
ggtccttgatgccagagggccag

SEQ ID NO: 6342279 - DNA, 20 bp, Homo sapiens
ggtccttgcctgaactccag

SEQ ID NO: 6342280 - DNA, 16 bp, Homo sapiens
ggtccttggccccctt

SEQ ID NO: 6342281 - DNA, 23 bp, Homo sapiens
ggtccttgtttctgccctgccag

SEQ ID NO: 6342282 - DNA, 16 bp, Homo sapiens
ggtcctttaggcagcc

SEQ ID NO: 6342283 - DNA, 21 bp, Homo sapiens
ggtcctttaggcagcctgccg

SEQ ID NO: 6342284 - DNA, 23 bp, Homo sapiens
ggtcctttctggaagtttctggt

SEQ ID NO: 6342285 - DNA, 17 bp, Homo sapiens
ggtcctttgagtgtcag

SEQ ID NO: 6342286 - DNA, 17 bp, Homo sapiens
ggtcctttggcaggcct

SEQ ID NO: 6342287 - DNA, 24 bp, Homo sapiens
ggtcctttggcaggcctccctttg

SEQ ID NO: 6342288 - DNA, 21 bp, Homo sapiens
ggtcctttgggaaaggagaag

SEQ ID NO: 6342289 - DNA, 21 bp, Homo sapiens
ggtcctttgttggcttctttg

SEQ ID NO: 6342290 - DNA, 16 bp, Homo sapiens
ggtccttttgacactg

SEQ ID NO: 6342291 - DNA, 20 bp, Homo sapiens
ggtcgaagcaatcagcaaac

SEQ ID NO: 6342292 - DNA, 20 bp, Homo sapiens
ggtcgaccccaaagcccctt

SEQ ID NO: 6342293 - DNA, 16 bp, Homo sapiens
ggtcgaggagtaacaa

SEQ ID NO: 6342294 - DNA, 14 bp, Homo sapiens
ggtcgaggtgggcg

SEQ ID NO: 6342295 - DNA, 17 bp, Homo sapiens
ggtcgccagtgaaatag

SEQ ID NO: 6342296 - DNA, 12 bp, Homo sapiens
ggtcgcccagga

SEQ ID NO: 6342297 - DNA, 18 bp, Homo sapiens
ggtcgcccatgagagcgc

SEQ ID NO: 6342298 - DNA, 22 bp, Homo sapiens
ggtcgccccgtgtttgcgcttg

SEQ ID NO: 6342299 - DNA, 13 bp, Homo sapiens
ggtcgcccctcct

SEQ ID NO: 6342300 - DNA, 14 bp, Homo sapiens
ggtcgcccctcctc

SEQ ID NO: 6342301 - DNA, 21 bp, Homo sapiens
ggtcgcccctcctcgggcgcc

SEQ ID NO: 6342302 - DNA, 15 bp, Homo sapiens
ggtcgccctaccctc

SEQ ID NO: 6342303 - DNA, 14 bp, Homo sapiens
ggtcgccctggact

SEQ ID NO: 6342304 - DNA, 13 bp, Homo sapiens
ggtcgctcctgcc

SEQ ID NO: 6342305 - DNA, 22 bp, Homo sapiens
ggtcgcttactttgagtgatcc

SEQ ID NO: 6342306 - DNA, 18 bp, Homo sapiens
ggtcgcttgggaatttta

SEQ ID NO: 6342307 - DNA, 16 bp, Homo sapiens
ggtcggacggggcagg

SEQ ID NO: 6342308 - DNA, 16 bp, Homo sapiens
ggtcggagtgcctgga

SEQ ID NO: 6342309 - DNA, 19 bp, Homo sapiens
ggtcggcaagagtgagact

SEQ ID NO: 6342310 - DNA, 15 bp, Homo sapiens
ggtcgggacagacca

SEQ ID NO: 6342311 - DNA, 13 bp, Homo sapiens
ggtcgggacagct

SEQ ID NO: 6342312 - DNA, 19 bp, Homo sapiens
ggtcgggacagctgtgccg

SEQ ID NO: 6342313 - DNA, 12 bp, Homo sapiens
ggtcgggagagg

SEQ ID NO: 6342314 - DNA, 14 bp, Homo sapiens
ggtcgggcagccag

SEQ ID NO: 6342315 - DNA, 21 bp, Homo sapiens
ggtcgggctgccagcccagct

SEQ ID NO: 6342316 - DNA, 20 bp, Homo sapiens
ggtcggggcatctggcctgg

SEQ ID NO: 6342317 - DNA, 21 bp, Homo sapiens
ggtcgggggaggagcaccccc

SEQ ID NO: 6342318 - DNA, 23 bp, Homo sapiens
ggtcgggggaggagcacccccag

SEQ ID NO: 6342319 - DNA, 15 bp, Homo sapiens
ggtcggtgccttcaa

SEQ ID NO: 6342320 - DNA, 17 bp, Homo sapiens
ggtcgtctttgtgtatg

SEQ ID NO: 6342321 - DNA, 15 bp, Homo sapiens
ggtcgtggagagcta

SEQ ID NO: 6342322 - DNA, 16 bp, Homo sapiens
ggtcgtggtataacaa

SEQ ID NO: 6342323 - DNA, 16 bp, Homo sapiens
ggtcgttttccaaaga

SEQ ID NO: 6342324 - DNA, 17 bp, Homo sapiens
ggtcgttttccaaagag

SEQ ID NO: 6342325 - DNA, 14 bp, Homo sapiens
ggtcgtttttttca

SEQ ID NO: 6342326 - DNA, 23 bp, Homo sapiens
ggtctaaaacagctatttccctt

SEQ ID NO: 6342327 - DNA, 13 bp, Homo sapiens
ggtctaaagagaa

SEQ ID NO: 6342328 - DNA, 18 bp, Homo sapiens
ggtctaaagtgagctcta

SEQ ID NO: 6342329 - DNA, 14 bp, Homo sapiens
ggtctaaagtgttt

SEQ ID NO: 6342330 - DNA, 19 bp, Homo sapiens
ggtctaaataggatcctgg

SEQ ID NO: 6342331 - DNA, 22 bp, Homo sapiens
ggtctaactgtggaatataaat

SEQ ID NO: 6342332 - DNA, 15 bp, Homo sapiens
ggtctaatcagtgat

SEQ ID NO: 6342333 - DNA, 13 bp, Homo sapiens
ggtctaatgttta

SEQ ID NO: 6342334 - DNA, 16 bp, Homo sapiens
ggtctacactgcaatc

SEQ ID NO: 6342335 - DNA, 17 bp, Homo sapiens
ggtctacactgtgctga

SEQ ID NO: 6342336 - DNA, 15 bp, Homo sapiens
ggtctactctagaag

SEQ ID NO: 6342337 - DNA, 18 bp, Homo sapiens
ggtctagaaggccaggcc

SEQ ID NO: 6342338 - DNA, 18 bp, Homo sapiens
ggtctagaccagggctgc

SEQ ID NO: 6342339 - DNA, 16 bp, Homo sapiens
ggtctagccgctgccc

SEQ ID NO: 6342340 - DNA, 19 bp, Homo sapiens
ggtctagccgctgccctgg

SEQ ID NO: 6342341 - DNA, 14 bp, Homo sapiens
ggtctagggagaga

SEQ ID NO: 6342342 - DNA, 22 bp, Homo sapiens
ggtctagtgacacggtagcacc

SEQ ID NO: 6342343 - DNA, 21 bp, Homo sapiens
ggtctataaaataaacttctt

SEQ ID NO: 6342344 - DNA, 16 bp, Homo sapiens
ggtctatgcccacata

SEQ ID NO: 6342345 - DNA, 13 bp, Homo sapiens
ggtctatggggag

SEQ ID NO: 6342346 - DNA, 22 bp, Homo sapiens
ggtctatgtcgagagctggcca

SEQ ID NO: 6342347 - DNA, 17 bp, Homo sapiens
ggtctattgtctgtatt

SEQ ID NO: 6342348 - DNA, 20 bp, Homo sapiens
ggtctattttataagggcac

SEQ ID NO: 6342349 - DNA, 17 bp, Homo sapiens
ggtctcaaactcctgac

SEQ ID NO: 6342350 - DNA, 16 bp, Homo sapiens
ggtctcacactcctcc

SEQ ID NO: 6342351 - DNA, 18 bp, Homo sapiens
ggtctcacactcctcctg

SEQ ID NO: 6342352 - DNA, 24 bp, Homo sapiens
ggtctcacactcctcctgccagct

SEQ ID NO: 6342353 - DNA, 18 bp, Homo sapiens
gttgtctaagaaattgaa

SEQ ID NO: 6342354 - DNA, 14 bp, Homo sapiens
gttgtctacattaa

SEQ ID NO: 6342355 - DNA, 19 bp, Homo sapiens
gttgtctagtcattgtcat

SEQ ID NO: 6342356 - DNA, 18 bp, Homo sapiens
gttgtctattctgagcct

SEQ ID NO: 6342357 - DNA, 18 bp, Homo sapiens
gttgtctccctctttctc

SEQ ID NO: 6342358 - DNA, 14 bp, Homo sapiens
gttgtctccctggc

SEQ ID NO: 6342359 - DNA, 13 bp, Homo sapiens
gttgtctccttcc

SEQ ID NO: 6342360 - DNA, 18 bp, Homo sapiens
gttgtctctagagcaggg

SEQ ID NO: 6342361 - DNA, 14 bp, Homo sapiens
gttgtctctgatgc

SEQ ID NO: 6342362 - DNA, 15 bp, Homo sapiens
gttgtctctgatgca

SEQ ID NO: 6342363 - DNA, 20 bp, Homo sapiens
gttgtctctgatgcagctta

SEQ ID NO: 6342364 - DNA, 22 bp, Homo sapiens
gttgtctgaagtcactgcacag

SEQ ID NO: 6342365 - DNA, 18 bp, Homo sapiens
gttgtctgaattgagaaa

SEQ ID NO: 6342366 - DNA, 13 bp, Homo sapiens
gttgtctgccgtg

SEQ ID NO: 6342367 - DNA, 21 bp, Homo sapiens
gttgtctgtccaggcccttag

SEQ ID NO: 6342368 - DNA, 20 bp, Homo sapiens
gttgtctgtgcttccttggt

SEQ ID NO: 6342369 - DNA, 23 bp, Homo sapiens
gttgtcttatgtgaaaaattaac

SEQ ID NO: 6342370 - DNA, 14 bp, Homo sapiens
gttgtgaaatgtaa

SEQ ID NO: 6342371 - DNA, 17 bp, Homo sapiens
gttgtgaagatgtttgc

SEQ ID NO: 6342372 - DNA, 13 bp, Homo sapiens
gttgtgaatgttc

SEQ ID NO: 6342373 - DNA, 18 bp, Homo sapiens
gttgtgactctaggcttc

SEQ ID NO: 6342374 - DNA, 23 bp, Homo sapiens
gttgtgactttttagccagtgac

SEQ ID NO: 6342375 - DNA, 19 bp, Homo sapiens
gttgtgagaatggcctgga

SEQ ID NO: 6342376 - DNA, 20 bp, Homo sapiens
gttgtgagtttaccttgtat

SEQ ID NO: 6342377 - DNA, 21 bp, Homo sapiens
gttgtgatagctaacatttta

SEQ ID NO: 6342378 - DNA, 16 bp, Homo sapiens
gttgtgatcttgcatt

SEQ ID NO: 6342379 - DNA, 14 bp, Homo sapiens
gttgtgatggaggg

SEQ ID NO: 6342380 - DNA, 21 bp, Homo sapiens
gttgtgatgtcttttcttggc

SEQ ID NO: 6342381 - DNA, 20 bp, Homo sapiens
gttgtgatttctgtggatcc

SEQ ID NO: 6342382 - DNA, 14 bp, Homo sapiens
gttgtgcagtgtgc

SEQ ID NO: 6342383 - DNA, 21 bp, Homo sapiens
gttgtggaaagataataaatt

SEQ ID NO: 6342384 - DNA, 20 bp, Homo sapiens
gttgtggaaagtagctgcta

SEQ ID NO: 6342385 - DNA, 21 bp, Homo sapiens
gttgtggagagtgcaacagta

SEQ ID NO: 6342386 - DNA, 17 bp, Homo sapiens
gttgtggatatcagggt

SEQ ID NO: 6342387 - DNA, 13 bp, Homo sapiens
gttgtggcaaccc

SEQ ID NO: 6342388 - DNA, 22 bp, Homo sapiens
gttgtggcctcattcagcagaa

SEQ ID NO: 6342389 - DNA, 13 bp, Homo sapiens
gttgtggcctttg

SEQ ID NO: 6342390 - DNA, 14 bp, Homo sapiens
gttgtggctcttat

SEQ ID NO: 6342391 - DNA, 18 bp, Homo sapiens
gttgtggctcttatttct

SEQ ID NO: 6342392 - DNA, 12 bp, Homo sapiens
gttgtggggagg

SEQ ID NO: 6342393 - DNA, 13 bp, Homo sapiens
gttgtggtactgt

SEQ ID NO: 6342394 - DNA, 15 bp, Homo sapiens
gttgtgtaagagaat

SEQ ID NO: 6342395 - DNA, 16 bp, Homo sapiens
gttgtgtacgtggaga

SEQ ID NO: 6342396 - DNA, 20 bp, Homo sapiens
gttgtgtactctggcctctg

SEQ ID NO: 6342397 - DNA, 16 bp, Homo sapiens
gttgtgtatattacac

SEQ ID NO: 6342398 - DNA, 16 bp, Homo sapiens
gttgtgtattgtggtt

SEQ ID NO: 6342399 - DNA, 17 bp, Homo sapiens
gttgtgtctggagcctg

SEQ ID NO: 6342400 - DNA, 23 bp, Homo sapiens
gttgtgtctgtgccctccaaaga

SEQ ID NO: 6342401 - DNA, 16 bp, Homo sapiens
gttgtgtgtatatgta

SEQ ID NO: 6342402 - DNA, 17 bp, Homo sapiens
gttgtgtgtatatgtat

SEQ ID NO: 6342403 - DNA, 12 bp, Homo sapiens
gttgtgtgtggg

SEQ ID NO: 6342404 - DNA, 13 bp, Homo sapiens
gttgtgtgtggga

SEQ ID NO: 6342405 - DNA, 16 bp, Homo sapiens
gttgtgtgtgggagtg

SEQ ID NO: 6342406 - DNA, 22 bp, Homo sapiens
gttgtgtgtgggagtgtgtaat

SEQ ID NO: 6342407 - DNA, 16 bp, Homo sapiens
gttgtgtgtgttctgt

SEQ ID NO: 6342408 - DNA, 20 bp, Homo sapiens
gttgtgttaacaatgcagta

SEQ ID NO: 6342409 - DNA, 12 bp, Homo sapiens
gttgtgttcctg

SEQ ID NO: 6342410 - DNA, 14 bp, Homo sapiens
gttgtgttcctggc

SEQ ID NO: 6342411 - DNA, 13 bp, Homo sapiens
gttgtgttcttct

SEQ ID NO: 6342412 - DNA, 23 bp, Homo sapiens
gttgttaaaacacaaaatgaata

SEQ ID NO: 6342413 - DNA, 21 bp, Homo sapiens
gttgttaaaacatttaatatt

SEQ ID NO: 6342414 - DNA, 19 bp, Homo sapiens
gttgttaaaactggtttag

SEQ ID NO: 6342415 - DNA, 20 bp, Homo sapiens
gttgttaaaggcaatggttt

SEQ ID NO: 6342416 - DNA, 13 bp, Homo sapiens
gttgttaaatgct

SEQ ID NO: 6342417 - DNA, 15 bp, Homo sapiens
gttgttaagagacat

SEQ ID NO: 6342418 - DNA, 19 bp, Homo sapiens
gttgttaatactatattgc

SEQ ID NO: 6342419 - DNA, 13 bp, Homo sapiens
gttgttaatttag

SEQ ID NO: 6342420 - DNA, 21 bp, Homo sapiens
gttgttaattttattgcaaag

SEQ ID NO: 6342421 - DNA, 20 bp, Homo sapiens
gttgttactaactaaactct

SEQ ID NO: 6342422 - DNA, 14 bp, Homo sapiens
gttgttagagaaaa

SEQ ID NO: 6342423 - DNA, 15 bp, Homo sapiens
gttgttagtgatttg

SEQ ID NO: 6342424 - DNA, 13 bp, Homo sapiens
gttgttatgatgt

SEQ ID NO: 6342425 - DNA, 13 bp, Homo sapiens
gttgttatgctat

SEQ ID NO: 6342426 - DNA, 17 bp, Homo sapiens
gttgttatgtgatcatg

SEQ ID NO: 6342427 - DNA, 24 bp, Homo sapiens
gttgttatttattgaaatgatttc

SEQ ID NO: 6342428 - DNA, 16 bp, Homo sapiens
gttgttcaactatttt

SEQ ID NO: 6342429 - DNA, 18 bp, Homo sapiens
gttgttcagtcctctgca

SEQ ID NO: 6342430 - DNA, 21 bp, Homo sapiens
gttgttcccactgaaatggac

SEQ ID NO: 6342431 - DNA, 19 bp, Homo sapiens
gttgttcctctatactttg

SEQ ID NO: 6342432 - DNA, 20 bp, Homo sapiens
gttgttcctctatactttgt

SEQ ID NO: 6342433 - DNA, 20 bp, Homo sapiens
gttgttcgatcgtttcacat

SEQ ID NO: 6342434 - DNA, 13 bp, Homo sapiens
gttgttcgggcca

SEQ ID NO: 6342435 - DNA, 21 bp, Homo sapiens
gttgttctcctccattgctgt

SEQ ID NO: 6342436 - DNA, 19 bp, Homo sapiens
gttgttctgaaatgtcagt

SEQ ID NO: 6342437 - DNA, 20 bp, Homo sapiens
gttgttctgtggtcacagtg

SEQ ID NO: 6342438 - DNA, 19 bp, Homo sapiens
gttgttcttggcaataaat

SEQ ID NO: 6342439 - DNA, 10 bp, Homo sapiens
gttgttcttt

SEQ ID NO: 6342440 - DNA, 15 bp, Homo sapiens
gttgttctttcagaa

SEQ ID NO: 6342441 - DNA, 17 bp, Homo sapiens
gttgttctttctcttct

SEQ ID NO: 6342442 - DNA, 23 bp, Homo sapiens
gttgttgagggcatttggcttcc

SEQ ID NO: 6342443 - DNA, 19 bp, Homo sapiens
gttgttgcaccatctgctt

SEQ ID NO: 6342444 - DNA, 23 bp, Homo sapiens
gttgttgcatatagttaaactga

SEQ ID NO: 6342445 - DNA, 17 bp, Homo sapiens
gttgttgcatgtttgaa

SEQ ID NO: 6342446 - DNA, 12 bp, Homo sapiens
gttgttgcattc

SEQ ID NO: 6342447 - DNA, 13 bp, Homo sapiens
gttgttgcattcc

SEQ ID NO: 6342448 - DNA, 22 bp, Homo sapiens
gttgttgccaggttgcagctgc

SEQ ID NO: 6342449 - DNA, 18 bp, Homo sapiens
gttgttgcttcttgtgaa

SEQ ID NO: 6342450 - DNA, 20 bp, Homo sapiens
gttgttgcttcttgtgaagg

SEQ ID NO: 6342451 - DNA, 16 bp, Homo sapiens
gttgttgttaaatatc

SEQ ID NO: 6342452 - DNA, 24 bp, Homo sapiens
gttgttgttaatgaaaatgtcaga

SEQ ID NO: 6342453 - DNA, 14 bp, Homo sapiens
gttgttgttgctgc

SEQ ID NO: 6342454 - DNA, 20 bp, Homo sapiens
gttgtttaaaaatttataac

SEQ ID NO: 6342455 - DNA, 18 bp, Homo sapiens
gttgtttaaagtatatgt

SEQ ID NO: 6342456 - DNA, 20 bp, Homo sapiens
gttgtttaacacttctgtat

SEQ ID NO: 6342457 - DNA, 21 bp, Homo sapiens
gttgtttaacacttctgtatg

SEQ ID NO: 6342458 - DNA, 16 bp, Homo sapiens
gttgtttaacataaat

SEQ ID NO: 6342459 - DNA, 18 bp, Homo sapiens
gttgtttaactgtgcatg

SEQ ID NO: 6342460 - DNA, 14 bp, Homo sapiens
gttgtttataaaaa

SEQ ID NO: 6342461 - DNA, 15 bp, Homo sapiens
gttgtttataaaaac

SEQ ID NO: 6342462 - DNA, 15 bp, Homo sapiens
gttgtttataataaa

SEQ ID NO: 6342463 - DNA, 16 bp, Homo sapiens
gttgtttataataaaa

SEQ ID NO: 6342464 - DNA, 23 bp, Homo sapiens
gttgtttcagtgaatatgcctgt

SEQ ID NO: 6342465 - DNA, 12 bp, Homo sapiens
gttgtttcatga

SEQ ID NO: 6342466 - DNA, 15 bp, Homo sapiens
gttgtttcctcgctg

SEQ ID NO: 6342467 - DNA, 17 bp, Homo sapiens
gttgtttctataaatga

SEQ ID NO: 6342468 - DNA, 14 bp, Homo sapiens
gttgtttctctgag

SEQ ID NO: 6342469 - DNA, 13 bp, Homo sapiens
gttgtttctgttc

SEQ ID NO: 6342470 - DNA, 13 bp, Homo sapiens
gttgtttcttata

SEQ ID NO: 6342471 - DNA, 15 bp, Homo sapiens
gttgtttctttctag

SEQ ID NO: 6342472 - DNA, 22 bp, Homo sapiens
gttgtttgatgcattaaaagaa

SEQ ID NO: 6342473 - DNA, 15 bp, Homo sapiens
gttgtttgatgtgta

SEQ ID NO: 6342474 - DNA, 14 bp, Homo sapiens
gttgtttgctgttt

SEQ ID NO: 6342475 - DNA, 14 bp, Homo sapiens
gttgtttgcttctt

SEQ ID NO: 6342476 - DNA, 15 bp, Homo sapiens
gttgtttgtaaataa

SEQ ID NO: 6342477 - DNA, 16 bp, Homo sapiens
gttgttttctactttg

SEQ ID NO: 6342478 - DNA, 18 bp, Homo sapiens
gttgttttggtgcctgcc

SEQ ID NO: 6342479 - DNA, 14 bp, Homo sapiens
gttgttttgtggat

SEQ ID NO: 6342480 - DNA, 14 bp, Homo sapiens
gttgtttttgtata

SEQ ID NO: 6342481 - DNA, 14 bp, Homo sapiens
gttgttttttcata

SEQ ID NO: 6342482 - DNA, 22 bp, Homo sapiens
gttgttttttcatagtgccttt

SEQ ID NO: 6342483 - DNA, 16 bp, Homo sapiens
gttgttttttgttcaa

SEQ ID NO: 6342484 - DNA, 17 bp, Homo sapiens
gtttaaaaaaagtatat

SEQ ID NO: 6342485 - DNA, 18 bp, Homo sapiens
gtttaaaaaaagtatata

SEQ ID NO: 6342486 - DNA, 23 bp, Homo sapiens
gtttaaaaaaagtatatattcta

SEQ ID NO: 6342487 - DNA, 14 bp, Homo sapiens
gtttaaaaaaataa

SEQ ID NO: 6342488 - DNA, 19 bp, Homo sapiens
gtttaaaaaaataacatct

SEQ ID NO: 6342489 - DNA, 22 bp, Homo sapiens
gtttaaaaaagtttaaaatgta

SEQ ID NO: 6342490 - DNA, 14 bp, Homo sapiens
gtttaaaaacagga

SEQ ID NO: 6342491 - DNA, 19 bp, Homo sapiens
gtttaaaaaccgaataaat

SEQ ID NO: 6342492 - DNA, 16 bp, Homo sapiens
gtttaaaaagatgaaa

SEQ ID NO: 6342493 - DNA, 13 bp, Homo sapiens
gtttaaaaagtaa

SEQ ID NO: 6342494 - DNA, 23 bp, Homo sapiens
gtttaaaaagtaagttaataatg

SEQ ID NO: 6342495 - DNA, 18 bp, Homo sapiens
gtttaaaaagtatgttct

SEQ ID NO: 6342496 - DNA, 14 bp, Homo sapiens
gtttaaaaatacac

SEQ ID NO: 6342497 - DNA, 17 bp, Homo sapiens
gtttaaaaatacacatg

SEQ ID NO: 6342498 - DNA, 16 bp, Homo sapiens
gtttaaaaatcaactt

SEQ ID NO: 6342499 - DNA, 16 bp, Homo sapiens
gtttaaaaatcagaaa

SEQ ID NO: 6342500 - DNA, 16 bp, Homo sapiens
gtttaaaaatctgcca

SEQ ID NO: 6342501 - DNA, 17 bp, Homo sapiens
gtttaaaaatctgccac

SEQ ID NO: 6342502 - DNA, 12 bp, Homo sapiens
gtttaaaaatgg

SEQ ID NO: 6342503 - DNA, 13 bp, Homo sapiens
gtttaaaacagta

SEQ ID NO: 6342504 - DNA, 11 bp, Homo sapiens
gtttaaaactt

SEQ ID NO: 6342505 - DNA, 18 bp, Homo sapiens
gtttaaaagaaaaaatga

SEQ ID NO: 6342506 - DNA, 19 bp, Homo sapiens
gtttaaaagtcacataaaa

SEQ ID NO: 6342507 - DNA, 19 bp, Homo sapiens
gtttaaaagtccactttta

SEQ ID NO: 6342508 - DNA, 21 bp, Homo sapiens
gtttaaaagttgtgcatgtat

SEQ ID NO: 6342509 - DNA, 20 bp, Homo sapiens
gtttaaaataaaagtaccta

SEQ ID NO: 6342510 - DNA, 22 bp, Homo sapiens
gtttaaaataggggagcctgtg

SEQ ID NO: 6342511 - DNA, 10 bp, Homo sapiens
gtttaaaatc

SEQ ID NO: 6342512 - DNA, 21 bp, Homo sapiens
gtttaaaatgtaatttaaatg

SEQ ID NO: 6342513 - DNA, 13 bp, Homo sapiens
gtttaaaattatt

SEQ ID NO: 6342514 - DNA, 13 bp, Homo sapiens
gtttaaaattcag

SEQ ID NO: 6342515 - DNA, 23 bp, Homo sapiens
gtttaaacccaagtgctgcacaa

SEQ ID NO: 6342516 - DNA, 22 bp, Homo sapiens
gtttaaactacctcaaaacact

SEQ ID NO: 6342517 - DNA, 17 bp, Homo sapiens
gtttaaacttctctgaa

SEQ ID NO: 6342518 - DNA, 23 bp, Homo sapiens
gtttaaacttctctgaagggagg

SEQ ID NO: 6342519 - DNA, 14 bp, Homo sapiens
gtttaaacttttat

SEQ ID NO: 6342520 - DNA, 13 bp, Homo sapiens
gtttaaagaaagt

SEQ ID NO: 6342521 - DNA, 14 bp, Homo sapiens
gtttaaagaaagtg

SEQ ID NO: 6342522 - DNA, 16 bp, Homo sapiens
gtttaaagaaagtgta

SEQ ID NO: 6342523 - DNA, 16 bp, Homo sapiens
gtttaaagaataaagt

SEQ ID NO: 6342524 - DNA, 17 bp, Homo sapiens
gtttaaagagtctagat

SEQ ID NO: 6342525 - DNA, 19 bp, Homo sapiens
gtttaaagagtctagattc

SEQ ID NO: 6342526 - DNA, 14 bp, Homo sapiens
gtttaaagcaactg

SEQ ID NO: 6342527 - DNA, 19 bp, Homo sapiens
gtttaaagcttttattcgt

SEQ ID NO: 6342528 - DNA, 13 bp, Homo sapiens
gtttaaagtactg

SEQ ID NO: 6342529 - DNA, 21 bp, Homo sapiens
gtttaaagttctgtgtattta

SEQ ID NO: 6342530 - DNA, 11 bp, Homo sapiens
gtttaaataaa

SEQ ID NO: 6342531 - DNA, 14 bp, Homo sapiens
gtttaaataaacac

SEQ ID NO: 6342532 - DNA, 15 bp, Homo sapiens
gtttaaataaagacc

SEQ ID NO: 6342533 - DNA, 18 bp, Homo sapiens
ggtctcacagtgttgccc

SEQ ID NO: 6342534 - DNA, 13 bp, Homo sapiens
ggtctcacccatg

SEQ ID NO: 6342535 - DNA, 21 bp, Homo sapiens
ggtctcaccggctctcacctg

SEQ ID NO: 6342536 - DNA, 20 bp, Homo sapiens
ggtctcacgcaacacatttt

SEQ ID NO: 6342537 - DNA, 21 bp, Homo sapiens
ggtctcactatgttgcccagg

SEQ ID NO: 6342538 - DNA, 23 bp, Homo sapiens
ggtctcactcctgagtggggcca

SEQ ID NO: 6342539 - DNA, 15 bp, Homo sapiens
ggtctcactctgtcg

SEQ ID NO: 6342540 - DNA, 16 bp, Homo sapiens
ggtctcactctgtcgc

SEQ ID NO: 6342541 - DNA, 22 bp, Homo sapiens
ggtctcactctgtcgcccagtc

SEQ ID NO: 6342542 - DNA, 17 bp, Homo sapiens
ggtctcactctgtcgct

SEQ ID NO: 6342543 - DNA, 19 bp, Homo sapiens
ggtctcactctgttgacca

SEQ ID NO: 6342544 - DNA, 19 bp, Homo sapiens
ggtctcactctgttgccca

SEQ ID NO: 6342545 - DNA, 21 bp, Homo sapiens
ggtctcactgtgttgcccagg

SEQ ID NO: 6342546 - DNA, 23 bp, Homo sapiens
ggtctcactgtgttgcccaggct

SEQ ID NO: 6342547 - DNA, 17 bp, Homo sapiens
ggtctcagcttcatttc

SEQ ID NO: 6342548 - DNA, 22 bp, Homo sapiens
ggtctcagcttcatttccgtga

SEQ ID NO: 6342549 - DNA, 18 bp, Homo sapiens
ggtctcaggctggtggga

SEQ ID NO: 6342550 - DNA, 15 bp, Homo sapiens
ggtctcaggttcttt

SEQ ID NO: 6342551 - DNA, 23 bp, Homo sapiens
ggtctcagtgttaatactgagaa

SEQ ID NO: 6342552 - DNA, 12 bp, Homo sapiens
ggtctcatctcc

SEQ ID NO: 6342553 - DNA, 15 bp, Homo sapiens
ggtctcatctcccag

SEQ ID NO: 6342554 - DNA, 15 bp, Homo sapiens
ggtctcatgccccgc

SEQ ID NO: 6342555 - DNA, 16 bp, Homo sapiens
ggtctcatgcctgaga

SEQ ID NO: 6342556 - DNA, 18 bp, Homo sapiens
ggtctcatgctccttaat

SEQ ID NO: 6342557 - DNA, 17 bp, Homo sapiens
ggtctcatgtcctgctg

SEQ ID NO: 6342558 - DNA, 19 bp, Homo sapiens
ggtctcatgtcctgctggc

SEQ ID NO: 6342559 - DNA, 23 bp, Homo sapiens
ggtctcatgtcctgctggcttcc

SEQ ID NO: 6342560 - DNA, 16 bp, Homo sapiens
ggtctccaagggaggg

SEQ ID NO: 6342561 - DNA, 18 bp, Homo sapiens
ggtctccacctcagggga

SEQ ID NO: 6342562 - DNA, 13 bp, Homo sapiens
ggtctccacctgt

SEQ ID NO: 6342563 - DNA, 17 bp, Homo sapiens
ggtctccacctgtgctt

SEQ ID NO: 6342564 - DNA, 15 bp, Homo sapiens
ggtctccaggggcct

SEQ ID NO: 6342565 - DNA, 18 bp, Homo sapiens
ggtctccaggggcctgca

SEQ ID NO: 6342566 - DNA, 21 bp, Homo sapiens
ggtctccaggggcctgcagaa

SEQ ID NO: 6342567 - DNA, 20 bp, Homo sapiens
ggtctccatttttcccagga

SEQ ID NO: 6342568 - DNA, 14 bp, Homo sapiens
ggtctcccaggaca

SEQ ID NO: 6342569 - DNA, 16 bp, Homo sapiens
ggtctccccacctgca

SEQ ID NO: 6342570 - DNA, 13 bp, Homo sapiens
ggtctcccctcct

SEQ ID NO: 6342571 - DNA, 17 bp, Homo sapiens
ggtctcccctcctgcac

SEQ ID NO: 6342572 - DNA, 21 bp, Homo sapiens
ggtctccctatgttgcccagg

SEQ ID NO: 6342573 - DNA, 16 bp, Homo sapiens
ggtctccctccagctg

SEQ ID NO: 6342574 - DNA, 18 bp, Homo sapiens
ggtctccctctcctgcct

SEQ ID NO: 6342575 - DNA, 16 bp, Homo sapiens
ggtctccctgagcctg

SEQ ID NO: 6342576 - DNA, 17 bp, Homo sapiens
ggtctccctgagcctgc

SEQ ID NO: 6342577 - DNA, 20 bp, Homo sapiens
ggtctccctgagcctgcccc

SEQ ID NO: 6342578 - DNA, 14 bp, Homo sapiens
ggtctccctggctc

SEQ ID NO: 6342579 - DNA, 15 bp, Homo sapiens
ggtctccctggctcc

SEQ ID NO: 6342580 - DNA, 16 bp, Homo sapiens
ggtctccctggctccc

SEQ ID NO: 6342581 - DNA, 20 bp, Homo sapiens
ggtctccctgggcaccctgc

SEQ ID NO: 6342582 - DNA, 17 bp, Homo sapiens
ggtctcccttccgtcca

SEQ ID NO: 6342583 - DNA, 20 bp, Homo sapiens
ggtctcccttccgtccatcc

SEQ ID NO: 6342584 - DNA, 21 bp, Homo sapiens
ggtctcccttccgtccatccc

SEQ ID NO: 6342585 - DNA, 17 bp, Homo sapiens
ggtctccgaaatgctgt

SEQ ID NO: 6342586 - DNA, 15 bp, Homo sapiens
ggtctccgagagagg

SEQ ID NO: 6342587 - DNA, 19 bp, Homo sapiens
ggtctcctcactcccttct

SEQ ID NO: 6342588 - DNA, 12 bp, Homo sapiens
ggtctcctcagg

SEQ ID NO: 6342589 - DNA, 19 bp, Homo sapiens
ggtctcctcaggaccaggg

SEQ ID NO: 6342590 - DNA, 22 bp, Homo sapiens
ggtctcctccaccgccatggct

SEQ ID NO: 6342591 - DNA, 14 bp, Homo sapiens
ggtctcctcccagc

SEQ ID NO: 6342592 - DNA, 21 bp, Homo sapiens
ggtctcctccccgtagccact

SEQ ID NO: 6342593 - DNA, 23 bp, Homo sapiens
ggtctcctgactggtgctgcagc

SEQ ID NO: 6342594 - DNA, 23 bp, Homo sapiens
ggtctcctgggaaagggagatgt

SEQ ID NO: 6342595 - DNA, 22 bp, Homo sapiens
ggtctccttactctgagcccag

SEQ ID NO: 6342596 - DNA, 23 bp, Homo sapiens
ggtctccttactctgagcccagg

SEQ ID NO: 6342597 - DNA, 16 bp, Homo sapiens
ggtctcgaactcctga

SEQ ID NO: 6342598 - DNA, 17 bp, Homo sapiens
ggtctcgatgctgctgg

SEQ ID NO: 6342599 - DNA, 21 bp, Homo sapiens
ggtctcgatgctgctggcctc

SEQ ID NO: 6342600 - DNA, 20 bp, Homo sapiens
ggtctcgcagcctgaagcct

SEQ ID NO: 6342601 - DNA, 15 bp, Homo sapiens
ggtctcgctctgtca

SEQ ID NO: 6342602 - DNA, 16 bp, Homo sapiens
ggtctcgctctgtcac

SEQ ID NO: 6342603 - DNA, 21 bp, Homo sapiens
ggtctcgctgatgctgggctg

SEQ ID NO: 6342604 - DNA, 22 bp, Homo sapiens
ggtctcgctgatgctgggctgg

SEQ ID NO: 6342605 - DNA, 23 bp, Homo sapiens
ggtctcgctgatgctgggctggg

SEQ ID NO: 6342606 - DNA, 19 bp, Homo sapiens
ggtctcgctgtcactggct

SEQ ID NO: 6342607 - DNA, 23 bp, Homo sapiens
ggtctcgctgtcactggctggct

SEQ ID NO: 6342608 - DNA, 18 bp, Homo sapiens
ggtctcgggggtgggctc

SEQ ID NO: 6342609 - DNA, 20 bp, Homo sapiens
ggtctcgtcttccgtctccc

SEQ ID NO: 6342610 - DNA, 22 bp, Homo sapiens
ggtctcgtcttccgtctccccc

SEQ ID NO: 6342611 - DNA, 17 bp, Homo sapiens
ggtctctaggctgggga

SEQ ID NO: 6342612 - DNA, 15 bp, Homo sapiens
ggtctctccactgct

SEQ ID NO: 6342613 - DNA, 14 bp, Homo sapiens
ggtctctccctccc

SEQ ID NO: 6342614 - DNA, 11 bp, Homo sapiens
ggtctctctcc

SEQ ID NO: 6342615 - DNA, 15 bp, Homo sapiens
ggtctctctccaggt

SEQ ID NO: 6342616 - DNA, 17 bp, Homo sapiens
ggtctctctccaggtca

SEQ ID NO: 6342617 - DNA, 22 bp, Homo sapiens
ggtctctctccaggtcagcctg

SEQ ID NO: 6342618 - DNA, 23 bp, Homo sapiens
ggtctctctccaggtcagcctgg

SEQ ID NO: 6342619 - DNA, 16 bp, Homo sapiens
ggtctctctccattta

SEQ ID NO: 6342620 - DNA, 14 bp, Homo sapiens
ggtctctctcccta

SEQ ID NO: 6342621 - DNA, 23 bp, Homo sapiens
ggtctctctccctacctccctcc

SEQ ID NO: 6342622 - DNA, 17 bp, Homo sapiens
ggtctctctcggcccct

SEQ ID NO: 6342623 - DNA, 18 bp, Homo sapiens
ggtctctctcggcccctg

SEQ ID NO: 6342624 - DNA, 13 bp, Homo sapiens
ggtctctctttgg

SEQ ID NO: 6342625 - DNA, 12 bp, Homo sapiens
ggtctctgaagg

SEQ ID NO: 6342626 - DNA, 20 bp, Homo sapiens
ggtctctgaagggacccccc

SEQ ID NO: 6342627 - DNA, 20 bp, Homo sapiens
ggtctctgcatttttctgca

SEQ ID NO: 6342628 - DNA, 22 bp, Homo sapiens
ggtctctgcatttttctgcaga

SEQ ID NO: 6342629 - DNA, 14 bp, Homo sapiens
ggtctctgccccag

SEQ ID NO: 6342630 - DNA, 15 bp, Homo sapiens
ggtctctgccccagc

SEQ ID NO: 6342631 - DNA, 16 bp, Homo sapiens
ggtctctgccccagcc

SEQ ID NO: 6342632 - DNA, 19 bp, Homo sapiens
ggtctctgccggctctttc

SEQ ID NO: 6342633 - DNA, 12 bp, Homo sapiens
ggtctctgctgc

SEQ ID NO: 6342634 - DNA, 17 bp, Homo sapiens
ggtctctggcagagaag

SEQ ID NO: 6342635 - DNA, 18 bp, Homo sapiens
ggtctctggcagagaagg

SEQ ID NO: 6342636 - DNA, 13 bp, Homo sapiens
ggtctctggctct

SEQ ID NO: 6342637 - DNA, 17 bp, Homo sapiens
ggtctctgggagcccag

SEQ ID NO: 6342638 - DNA, 11 bp, Homo sapiens
ggtctctgggg

SEQ ID NO: 6342639 - DNA, 10 bp, Homo sapiens
ggtctctgtt

SEQ ID NO: 6342640 - DNA, 20 bp, Homo sapiens
ggtctcttactttcctttcc

SEQ ID NO: 6342641 - DNA, 23 bp, Homo sapiens
ggtctcttccagcccagacatcc

SEQ ID NO: 6342642 - DNA, 11 bp, Homo sapiens
ggtctcttcct

SEQ ID NO: 6342643 - DNA, 22 bp, Homo sapiens
ggtctcttcctttgctctgagg

SEQ ID NO: 6342644 - DNA, 21 bp, Homo sapiens
ggtctcttctgaataaagcaa

SEQ ID NO: 6342645 - DNA, 19 bp, Homo sapiens
ggtctcttctgggcgtctg

SEQ ID NO: 6342646 - DNA, 20 bp, Homo sapiens
ggtctcttctgggcgtctga

SEQ ID NO: 6342647 - DNA, 18 bp, Homo sapiens
ggtctcttcttctttctg

SEQ ID NO: 6342648 - DNA, 17 bp, Homo sapiens
ggtctctttctttccaa

SEQ ID NO: 6342649 - DNA, 13 bp, Homo sapiens
ggtctctttgctt

SEQ ID NO: 6342650 - DNA, 14 bp, Homo sapiens
ggtctcttttctct

SEQ ID NO: 6342651 - DNA, 22 bp, Homo sapiens
ggtctgaaaagaggagccagag

SEQ ID NO: 6342652 - DNA, 12 bp, Homo sapiens
ggtctgaaatgg

SEQ ID NO: 6342653 - DNA, 23 bp, Homo sapiens
ggtctgaaggaatagccagagag

SEQ ID NO: 6342654 - DNA, 12 bp, Homo sapiens
ggtctgaatgtt

SEQ ID NO: 6342655 - DNA, 14 bp, Homo sapiens
ggtctgaatgttct

SEQ ID NO: 6342656 - DNA, 21 bp, Homo sapiens
ggtctgaatgttctgacatta

SEQ ID NO: 6342657 - DNA, 22 bp, Homo sapiens
ggtctgaatgttctgacattaa

SEQ ID NO: 6342658 - DNA, 15 bp, Homo sapiens
ggtctgacagtcctt

SEQ ID NO: 6342659 - DNA, 22 bp, Homo sapiens
ggtctgaccaaaaccagagggc

SEQ ID NO: 6342660 - DNA, 23 bp, Homo sapiens
ggtctgaccaaaaccagagggca

SEQ ID NO: 6342661 - DNA, 16 bp, Homo sapiens
ggtctgacccactgct

SEQ ID NO: 6342662 - DNA, 23 bp, Homo sapiens
ggtctgagccacagcagcatttt

SEQ ID NO: 6342663 - DNA, 16 bp, Homo sapiens
ggtctgagccctggtg

SEQ ID NO: 6342664 - DNA, 15 bp, Homo sapiens
ggtctgagctccagc

SEQ ID NO: 6342665 - DNA, 17 bp, Homo sapiens
ggtctgagctgtcccaa

SEQ ID NO: 6342666 - DNA, 22 bp, Homo sapiens
ggtctgaggggcaactgagtct

SEQ ID NO: 6342667 - DNA, 20 bp, Homo sapiens
ggtctgagtcatggccgggt

SEQ ID NO: 6342668 - DNA, 20 bp, Homo sapiens
ggtctgagtggggcttcctg

SEQ ID NO: 6342669 - DNA, 21 bp, Homo sapiens
ggtctgagttgttaccccaag

SEQ ID NO: 6342670 - DNA, 19 bp, Homo sapiens
ggtctgatgccaaagctgc

SEQ ID NO: 6342671 - DNA, 21 bp, Homo sapiens
ggtctgatggaactgtgtatt

SEQ ID NO: 6342672 - DNA, 14 bp, Homo sapiens
ggtctgatttgcag

SEQ ID NO: 6342673 - DNA, 18 bp, Homo sapiens
ggtctgcaagggcccaga

SEQ ID NO: 6342674 - DNA, 19 bp, Homo sapiens
ggtctgcaagggcccagag

SEQ ID NO: 6342675 - DNA, 14 bp, Homo sapiens
ggtctgcaagtcag

SEQ ID NO: 6342676 - DNA, 19 bp, Homo sapiens
ggtctgcaagtcagaggat

SEQ ID NO: 6342677 - DNA, 20 bp, Homo sapiens
ggtctgcaagtcagaggatg

SEQ ID NO: 6342678 - DNA, 21 bp, Homo sapiens
ggtctgcacacataacacaca

SEQ ID NO: 6342679 - DNA, 15 bp, Homo sapiens
ggtctgcacagattc

SEQ ID NO: 6342680 - DNA, 18 bp, Homo sapiens
ggtctgcaccccacagga

SEQ ID NO: 6342681 - DNA, 17 bp, Homo sapiens
ggtctgcagctggtgtg

SEQ ID NO: 6342682 - DNA, 23 bp, Homo sapiens
ggtctgcaggcagggctgactct

SEQ ID NO: 6342683 - DNA, 17 bp, Homo sapiens
ggtctgcaggccaccag

SEQ ID NO: 6342684 - DNA, 12 bp, Homo sapiens
ggtctgcaggga

SEQ ID NO: 6342685 - DNA, 17 bp, Homo sapiens
ggtctgccaggccccca

SEQ ID NO: 6342686 - DNA, 16 bp, Homo sapiens
ggtctgccaggggctt

SEQ ID NO: 6342687 - DNA, 15 bp, Homo sapiens
ggtctgcctccagcc

SEQ ID NO: 6342688 - DNA, 18 bp, Homo sapiens
ggtctgcctcccacgctg

SEQ ID NO: 6342689 - DNA, 23 bp, Homo sapiens
ggtctgcctcccacgctgggaca

SEQ ID NO: 6342690 - DNA, 23 bp, Homo sapiens
ggtctgcctcttctgggagggca

SEQ ID NO: 6342691 - DNA, 15 bp, Homo sapiens
ggtctgccttctgct

SEQ ID NO: 6342692 - DNA, 18 bp, Homo sapiens
ggtctgccttctgctgaa

SEQ ID NO: 6342693 - DNA, 12 bp, Homo sapiens
ggtctgctccca

SEQ ID NO: 6342694 - DNA, 13 bp, Homo sapiens
ggtctgctcctgg

SEQ ID NO: 6342695 - DNA, 15 bp, Homo sapiens
ggtctgctcctggga

SEQ ID NO: 6342696 - DNA, 18 bp, Homo sapiens
ggtctgctcgggcccagg

SEQ ID NO: 6342697 - DNA, 22 bp, Homo sapiens
ggtctgctcgggcccaggccat

SEQ ID NO: 6342698 - DNA, 18 bp, Homo sapiens
ggtctgctctttctctgc

SEQ ID NO: 6342699 - DNA, 19 bp, Homo sapiens
ggtctgctgcctcaggaat

SEQ ID NO: 6342700 - DNA, 16 bp, Homo sapiens
ggtctggactgacagc

SEQ ID NO: 6342701 - DNA, 17 bp, Homo sapiens
ggtctggagtcccaccc

SEQ ID NO: 6342702 - DNA, 18 bp, Homo sapiens
ggtctggagtcccacccg

SEQ ID NO: 6342703 - DNA, 22 bp, Homo sapiens
ggtctggatgggaggagagcca

SEQ ID NO: 6342704 - DNA, 11 bp, Homo sapiens
ggtctggcaga

SEQ ID NO: 6342705 - DNA, 19 bp, Homo sapiens
ggtctggcagagcctctga

SEQ ID NO: 6342706 - DNA, 18 bp, Homo sapiens
ggtctggcccgggcatcc

SEQ ID NO: 6342707 - DNA, 16 bp, Homo sapiens
ggtctggcgccagggg

SEQ ID NO: 6342708 - DNA, 17 bp, Homo sapiens
ggtctggcgccaggggc

SEQ ID NO: 6342709 - DNA, 23 bp, Homo sapiens
ggtctggcgccaggggcaggcag

SEQ ID NO: 6342710 - DNA, 16 bp, Homo sapiens
gtttaaataaagtatc

SEQ ID NO: 6342711 - DNA, 13 bp, Homo sapiens
gtttaaatatttc

SEQ ID NO: 6342712 - DNA, 23 bp, Homo sapiens
gtttaaatgaacaagagaagcat

SEQ ID NO: 6342713 - DNA, 14 bp, Homo sapiens
gtttaaatgccaaa

SEQ ID NO: 6342714 - DNA, 15 bp, Homo sapiens
gtttaaatgccaaaa

SEQ ID NO: 6342715 - DNA, 12 bp, Homo sapiens
gtttaaatgtat

SEQ ID NO: 6342716 - DNA, 20 bp, Homo sapiens
gtttaaattgatagcagata

SEQ ID NO: 6342717 - DNA, 15 bp, Homo sapiens
gtttaacaaatctaa

SEQ ID NO: 6342718 - DNA, 13 bp, Homo sapiens
gtttaacaagtat

SEQ ID NO: 6342719 - DNA, 18 bp, Homo sapiens
gtttaacaataataaaaa

SEQ ID NO: 6342720 - DNA, 15 bp, Homo sapiens
gtttaacagagtttt

SEQ ID NO: 6342721 - DNA, 12 bp, Homo sapiens
gtttaacataaa

SEQ ID NO: 6342722 - DNA, 23 bp, Homo sapiens
gtttaacataaattgtactgttg

SEQ ID NO: 6342723 - DNA, 15 bp, Homo sapiens
gtttaacatatatat

SEQ ID NO: 6342724 - DNA, 16 bp, Homo sapiens
gtttaacatatatatt

SEQ ID NO: 6342725 - DNA, 16 bp, Homo sapiens
gtttaacattaaagca

SEQ ID NO: 6342726 - DNA, 19 bp, Homo sapiens
gtttaacattcacagccca

SEQ ID NO: 6342727 - DNA, 21 bp, Homo sapiens
gtttaacatttgccttgcaga

SEQ ID NO: 6342728 - DNA, 22 bp, Homo sapiens
gtttaaccaaaaagaccagact

SEQ ID NO: 6342729 - DNA, 21 bp, Homo sapiens
gtttaacgtgaggtttcagta

SEQ ID NO: 6342730 - DNA, 23 bp, Homo sapiens
gtttaactaatatttgtctgtgt

SEQ ID NO: 6342731 - DNA, 15 bp, Homo sapiens
gtttaactcagatca

SEQ ID NO: 6342732 - DNA, 22 bp, Homo sapiens
gtttaactcagatcactactgc

SEQ ID NO: 6342733 - DNA, 22 bp, Homo sapiens
gtttaacttaatcaattaattt

SEQ ID NO: 6342734 - DNA, 20 bp, Homo sapiens
gtttaacttgtctttttgtt

SEQ ID NO: 6342735 - DNA, 18 bp, Homo sapiens
gtttaactttaaaactgt

SEQ ID NO: 6342736 - DNA, 21 bp, Homo sapiens
gtttaagaaaagtattttgaa

SEQ ID NO: 6342737 - DNA, 22 bp, Homo sapiens
gtttaagaaaagtattttgaag

SEQ ID NO: 6342738 - DNA, 23 bp, Homo sapiens
gtttaagaaaagtattttgaagt

SEQ ID NO: 6342739 - DNA, 19 bp, Homo sapiens
gtttaagaaatgagaaatt

SEQ ID NO: 6342740 - DNA, 14 bp, Homo sapiens
gtttaagaatcatg

SEQ ID NO: 6342741 - DNA, 15 bp, Homo sapiens
gtttaagaatcatgg

SEQ ID NO: 6342742 - DNA, 16 bp, Homo sapiens
gtttaagaatcatgga

SEQ ID NO: 6342743 - DNA, 17 bp, Homo sapiens
gtttaagaatcatggat

SEQ ID NO: 6342744 - DNA, 19 bp, Homo sapiens
gtttaagaatcatggattt

SEQ ID NO: 6342745 - DNA, 17 bp, Homo sapiens
gtttaagacaccaaata

SEQ ID NO: 6342746 - DNA, 20 bp, Homo sapiens
gtttaagactgtaatgaatc

SEQ ID NO: 6342747 - DNA, 13 bp, Homo sapiens
gtttaagatgaca

SEQ ID NO: 6342748 - DNA, 23 bp, Homo sapiens
gtttaagatttaatttgccaaaa

SEQ ID NO: 6342749 - DNA, 20 bp, Homo sapiens
gtttaagccaaaacaatgtt

SEQ ID NO: 6342750 - DNA, 23 bp, Homo sapiens
gtttaagccgcagacctggagct

SEQ ID NO: 6342751 - DNA, 22 bp, Homo sapiens
gtttaagctactaacgataaaa

SEQ ID NO: 6342752 - DNA, 17 bp, Homo sapiens
gtttaagctctgcccct

SEQ ID NO: 6342753 - DNA, 21 bp, Homo sapiens
gtttaagctgagccacggata

SEQ ID NO: 6342754 - DNA, 19 bp, Homo sapiens
gtttaaggaacttctgaag

SEQ ID NO: 6342755 - DNA, 17 bp, Homo sapiens
gtttaagggtggaaaaa

SEQ ID NO: 6342756 - DNA, 14 bp, Homo sapiens
gtttaagtctctga

SEQ ID NO: 6342757 - DNA, 18 bp, Homo sapiens
gtttaagttgattaaaaa

SEQ ID NO: 6342758 - DNA, 22 bp, Homo sapiens
gtttaataaagcgaaaaactca

SEQ ID NO: 6342759 - DNA, 14 bp, Homo sapiens
gtttaataaagctt

SEQ ID NO: 6342760 - DNA, 18 bp, Homo sapiens
gtttaataatatgtacaa

SEQ ID NO: 6342761 - DNA, 19 bp, Homo sapiens
gtttaataatatgtacaaa

SEQ ID NO: 6342762 - DNA, 21 bp, Homo sapiens
gtttaataatatgtacaaata

SEQ ID NO: 6342763 - DNA, 23 bp, Homo sapiens
gtttaataatatgtacaaataat

SEQ ID NO: 6342764 - DNA, 13 bp, Homo sapiens
gtttaatactcat

SEQ ID NO: 6342765 - DNA, 16 bp, Homo sapiens
gtttaatagaaaatta

SEQ ID NO: 6342766 - DNA, 16 bp, Homo sapiens
gtttaatattccaata

SEQ ID NO: 6342767 - DNA, 15 bp, Homo sapiens
gtttaatattgagaa

SEQ ID NO: 6342768 - DNA, 19 bp, Homo sapiens
gtttaatcagttctgtgtg

SEQ ID NO: 6342769 - DNA, 20 bp, Homo sapiens
gtttaatcatagttactgtg

SEQ ID NO: 6342770 - DNA, 18 bp, Homo sapiens
gtttaatcccagcacttt

SEQ ID NO: 6342771 - DNA, 19 bp, Homo sapiens
gtttaatcttttttttaaa

SEQ ID NO: 6342772 - DNA, 18 bp, Homo sapiens
gtttaatgaatgcttaaa

SEQ ID NO: 6342773 - DNA, 13 bp, Homo sapiens
gtttaatgcaaat

SEQ ID NO: 6342774 - DNA, 22 bp, Homo sapiens
gtttaatgcaagagaacatttt

SEQ ID NO: 6342775 - DNA, 12 bp, Homo sapiens
gtttaatggtag

SEQ ID NO: 6342776 - DNA, 23 bp, Homo sapiens
gtttaatgtcagggtcaaactac

SEQ ID NO: 6342777 - DNA, 21 bp, Homo sapiens
gtttaatgtgaacttgtagct

SEQ ID NO: 6342778 - DNA, 20 bp, Homo sapiens
gtttaatgttctgtgataca

SEQ ID NO: 6342779 - DNA, 12 bp, Homo sapiens
gtttaatgttta

SEQ ID NO: 6342780 - DNA, 17 bp, Homo sapiens
gtttaatgtttatacag

SEQ ID NO: 6342781 - DNA, 22 bp, Homo sapiens
gtttaatgtttatacagagtaa

SEQ ID NO: 6342782 - DNA, 15 bp, Homo sapiens
gtttaattctgtctt

SEQ ID NO: 6342783 - DNA, 23 bp, Homo sapiens
gtttaattgaaagaatgtaaagc

SEQ ID NO: 6342784 - DNA, 21 bp, Homo sapiens
gtttaattgtgatatttgaca

SEQ ID NO: 6342785 - DNA, 15 bp, Homo sapiens
gtttaattgtttgtc

SEQ ID NO: 6342786 - DNA, 19 bp, Homo sapiens
gtttaattttataaacaaa

SEQ ID NO: 6342787 - DNA, 20 bp, Homo sapiens
gtttacaaaaatttctgtaa

SEQ ID NO: 6342788 - DNA, 14 bp, Homo sapiens
gtttacaacaaaca

SEQ ID NO: 6342789 - DNA, 22 bp, Homo sapiens
gtttacaacacagtagtgttct

SEQ ID NO: 6342790 - DNA, 19 bp, Homo sapiens
gtttacaacatttttgcaa

SEQ ID NO: 6342791 - DNA, 16 bp, Homo sapiens
gtttacaatttacaaa

SEQ ID NO: 6342792 - DNA, 19 bp, Homo sapiens
gtttacaatttacaaagtg

SEQ ID NO: 6342793 - DNA, 21 bp, Homo sapiens
gtttacacacgtgcaatttgt

SEQ ID NO: 6342794 - DNA, 15 bp, Homo sapiens
gtttacactgcacat

SEQ ID NO: 6342795 - DNA, 21 bp, Homo sapiens
gtttacactgcggaagccaaa

SEQ ID NO: 6342796 - DNA, 14 bp, Homo sapiens
gtttacagaaaaat

SEQ ID NO: 6342797 - DNA, 11 bp, Homo sapiens
gtttacagaat

SEQ ID NO: 6342798 - DNA, 17 bp, Homo sapiens
gtttacagacagaagag

SEQ ID NO: 6342799 - DNA, 23 bp, Homo sapiens
gtttacagcactactctgtgcca

SEQ ID NO: 6342800 - DNA, 17 bp, Homo sapiens
gtttacaggaaagatgc

SEQ ID NO: 6342801 - DNA, 17 bp, Homo sapiens
gtttacaggaacccagc

SEQ ID NO: 6342802 - DNA, 14 bp, Homo sapiens
gtttacaggccctg

SEQ ID NO: 6342803 - DNA, 18 bp, Homo sapiens
gtttacaggccctgctcc

SEQ ID NO: 6342804 - DNA, 19 bp, Homo sapiens
gtttacaggccctgctcct

SEQ ID NO: 6342805 - DNA, 16 bp, Homo sapiens
gtttacagggagcctc

SEQ ID NO: 6342806 - DNA, 17 bp, Homo sapiens
gtttacagggagcctcc

SEQ ID NO: 6342807 - DNA, 23 bp, Homo sapiens
gtttacagggagcctcctgccca

SEQ ID NO: 6342808 - DNA, 14 bp, Homo sapiens
gtttacagggtata

SEQ ID NO: 6342809 - DNA, 17 bp, Homo sapiens
gtttacaggtggacaca

SEQ ID NO: 6342810 - DNA, 13 bp, Homo sapiens
gtttacagtaaat

SEQ ID NO: 6342811 - DNA, 15 bp, Homo sapiens
gtttacagtatttct

SEQ ID NO: 6342812 - DNA, 13 bp, Homo sapiens
gtttacagtgttc

SEQ ID NO: 6342813 - DNA, 16 bp, Homo sapiens
gtttacagtttgtgtt

SEQ ID NO: 6342814 - DNA, 17 bp, Homo sapiens
gtttacataagagaaag

SEQ ID NO: 6342815 - DNA, 18 bp, Homo sapiens
gtttacataagagaaaga

SEQ ID NO: 6342816 - DNA, 16 bp, Homo sapiens
gtttacatagcatttg

SEQ ID NO: 6342817 - DNA, 22 bp, Homo sapiens
gtttacatagtctgaagtgaag

SEQ ID NO: 6342818 - DNA, 23 bp, Homo sapiens
gtttacatgagttcaaatacttt

SEQ ID NO: 6342819 - DNA, 14 bp, Homo sapiens
gtttacatgcttat

SEQ ID NO: 6342820 - DNA, 21 bp, Homo sapiens
gtttacatttaaagcattgct

SEQ ID NO: 6342821 - DNA, 23 bp, Homo sapiens
gtttacatttaaagcattgctgt

SEQ ID NO: 6342822 - DNA, 19 bp, Homo sapiens
gtttacattttctttcata

SEQ ID NO: 6342823 - DNA, 12 bp, Homo sapiens
gtttacattttt

SEQ ID NO: 6342824 - DNA, 22 bp, Homo sapiens
gtttacatttttatttatgaag

SEQ ID NO: 6342825 - DNA, 15 bp, Homo sapiens
gtttaccagttgcct

SEQ ID NO: 6342826 - DNA, 21 bp, Homo sapiens
gtttaccatttgtaataaagt

SEQ ID NO: 6342827 - DNA, 22 bp, Homo sapiens
gtttaccctcaaccctattcat

SEQ ID NO: 6342828 - DNA, 17 bp, Homo sapiens
gtttaccctccctgtcc

SEQ ID NO: 6342829 - DNA, 18 bp, Homo sapiens
gtttaccctccctgtccc

SEQ ID NO: 6342830 - DNA, 22 bp, Homo sapiens
gtttaccgcccacccagcagcg

SEQ ID NO: 6342831 - DNA, 23 bp, Homo sapiens
gtttaccggttgtttagaaacag

SEQ ID NO: 6342832 - DNA, 19 bp, Homo sapiens
gtttaccgtagcgtataca

SEQ ID NO: 6342833 - DNA, 23 bp, Homo sapiens
gtttacctcactggtgcatttaa

SEQ ID NO: 6342834 - DNA, 22 bp, Homo sapiens
gtttacctcatccatgcacttt

SEQ ID NO: 6342835 - DNA, 23 bp, Homo sapiens
gtttacctcatccatgcacttta

SEQ ID NO: 6342836 - DNA, 22 bp, Homo sapiens
gtttacctgaataaatggtagt

SEQ ID NO: 6342837 - DNA, 21 bp, Homo sapiens
gtttacctggcttatttaata

SEQ ID NO: 6342838 - DNA, 14 bp, Homo sapiens
gtttacctggtgct

SEQ ID NO: 6342839 - DNA, 16 bp, Homo sapiens
gtttacctgtgaaata

SEQ ID NO: 6342840 - DNA, 23 bp, Homo sapiens
gtttaccttttaattaatgaaat

SEQ ID NO: 6342841 - DNA, 22 bp, Homo sapiens
gtttacgtgtaaaggaaaataa

SEQ ID NO: 6342842 - DNA, 17 bp, Homo sapiens
gtttactatgcctgtgt

SEQ ID NO: 6342843 - DNA, 20 bp, Homo sapiens
gtttactatgcctgtgtctt

SEQ ID NO: 6342844 - DNA, 23 bp, Homo sapiens
gtttactatgtgccagttcctgt

SEQ ID NO: 6342845 - DNA, 21 bp, Homo sapiens
gtttactcattgcccccacct

SEQ ID NO: 6342846 - DNA, 14 bp, Homo sapiens
gtttactccatgtt

SEQ ID NO: 6342847 - DNA, 13 bp, Homo sapiens
gtttactcccttc

SEQ ID NO: 6342848 - DNA, 12 bp, Homo sapiens
gtttactctgtg

SEQ ID NO: 6342849 - DNA, 13 bp, Homo sapiens
gtttactctgtgc

SEQ ID NO: 6342850 - DNA, 23 bp, Homo sapiens
gtttactgacatggtgctgtgtg

SEQ ID NO: 6342851 - DNA, 20 bp, Homo sapiens
gtttactgctccttccatct

SEQ ID NO: 6342852 - DNA, 13 bp, Homo sapiens
gtttactgctgtc

SEQ ID NO: 6342853 - DNA, 19 bp, Homo sapiens
gtttactgctgtcattgtc

SEQ ID NO: 6342854 - DNA, 12 bp, Homo sapiens
gtttactgcttt

SEQ ID NO: 6342855 - DNA, 13 bp, Homo sapiens
gtttactgtaaat

SEQ ID NO: 6342856 - DNA, 15 bp, Homo sapiens
gtttactgtgaagag

SEQ ID NO: 6342857 - DNA, 16 bp, Homo sapiens
gtttactgtgaagaga

SEQ ID NO: 6342858 - DNA, 16 bp, Homo sapiens
gtttacttaaagattt

SEQ ID NO: 6342859 - DNA, 20 bp, Homo sapiens
gtttacttatacctctctca

SEQ ID NO: 6342860 - DNA, 19 bp, Homo sapiens
gtttacttctgggcaattt

SEQ ID NO: 6342861 - DNA, 11 bp, Homo sapiens
gtttacttgtc

SEQ ID NO: 6342862 - DNA, 23 bp, Homo sapiens
gtttacttgtctttgattatgac

SEQ ID NO: 6342863 - DNA, 14 bp, Homo sapiens
gtttactttaactt

SEQ ID NO: 6342864 - DNA, 15 bp, Homo sapiens
gtttactttcaaatc

SEQ ID NO: 6342865 - DNA, 17 bp, Homo sapiens
gtttactttttggctgg

SEQ ID NO: 6342866 - DNA, 19 bp, Homo sapiens
gtttactttttggctggag

SEQ ID NO: 6342867 - DNA, 13 bp, Homo sapiens
gtttagaaagctt

SEQ ID NO: 6342868 - DNA, 13 bp, Homo sapiens
gtttagaaataaa

SEQ ID NO: 6342869 - DNA, 16 bp, Homo sapiens
gtttagaaattacaag

SEQ ID NO: 6342870 - DNA, 19 bp, Homo sapiens
gtttagaaattacaagttt

SEQ ID NO: 6342871 - DNA, 15 bp, Homo sapiens
gtttagaacaggttt

SEQ ID NO: 6342872 - DNA, 14 bp, Homo sapiens
gtttagaagctgag

SEQ ID NO: 6342873 - DNA, 23 bp, Homo sapiens
gtttagaagtacgtttttgcatt

SEQ ID NO: 6342874 - DNA, 19 bp, Homo sapiens
gtttagagaatgagaaatg

SEQ ID NO: 6342875 - DNA, 23 bp, Homo sapiens
gtttagagtaaataaactgttta

SEQ ID NO: 6342876 - DNA, 14 bp, Homo sapiens
gtttagataataca

SEQ ID NO: 6342877 - DNA, 15 bp, Homo sapiens
gtttagataatacac

SEQ ID NO: 6342878 - DNA, 23 bp, Homo sapiens
gtttagatcccatgtcacctcag

SEQ ID NO: 6342879 - DNA, 18 bp, Homo sapiens
gtttagatgaatgtcagt

SEQ ID NO: 6342880 - DNA, 21 bp, Homo sapiens
gtttagatgaggctcagagag

SEQ ID NO: 6342881 - DNA, 13 bp, Homo sapiens
gtttagattgtat

SEQ ID NO: 6342882 - DNA, 14 bp, Homo sapiens
gtttagatttcaag

SEQ ID NO: 6342883 - DNA, 16 bp, Homo sapiens
gtttagcattaaaaat

SEQ ID NO: 6342884 - DNA, 18 bp, Homo sapiens
gtttagcattaaaaataa

SEQ ID NO: 6342885 - DNA, 21 bp, Homo sapiens
gtttagccatcttacttggct

SEQ ID NO: 6342886 - DNA, 13 bp, Homo sapiens
ggtctggctgctt

SEQ ID NO: 6342887 - DNA, 15 bp, Homo sapiens
ggtctggctgtccct

SEQ ID NO: 6342888 - DNA, 23 bp, Homo sapiens
ggtctggcttgggtgaatttcag

SEQ ID NO: 6342889 - DNA, 15 bp, Homo sapiens
ggtctgggaggcagg

SEQ ID NO: 6342890 - DNA, 16 bp, Homo sapiens
ggtctgggaggcaggt

SEQ ID NO: 6342891 - DNA, 19 bp, Homo sapiens
ggtctgggagtcaggcccg

SEQ ID NO: 6342892 - DNA, 17 bp, Homo sapiens
ggtctgggatggacagg

SEQ ID NO: 6342893 - DNA, 21 bp, Homo sapiens
ggtctgggcaagtagcaggac

SEQ ID NO: 6342894 - DNA, 21 bp, Homo sapiens
ggtctgggcgtccagctcagc

SEQ ID NO: 6342895 - DNA, 16 bp, Homo sapiens
ggtctggggacaggcc

SEQ ID NO: 6342896 - DNA, 15 bp, Homo sapiens
ggtctgggggcagct

SEQ ID NO: 6342897 - DNA, 20 bp, Homo sapiens
ggtctgggggcagctgtcct

SEQ ID NO: 6342898 - DNA, 20 bp, Homo sapiens
ggtctgggggtcaggaggca

SEQ ID NO: 6342899 - DNA, 22 bp, Homo sapiens
ggtctgggggtcaggaggcagg

SEQ ID NO: 6342900 - DNA, 18 bp, Homo sapiens
ggtctgggtggggcccag

SEQ ID NO: 6342901 - DNA, 14 bp, Homo sapiens
ggtctgtaaaatct

SEQ ID NO: 6342902 - DNA, 17 bp, Homo sapiens
ggtctgtaactgcccag

SEQ ID NO: 6342903 - DNA, 18 bp, Homo sapiens
ggtctgtacgttacctct

SEQ ID NO: 6342904 - DNA, 18 bp, Homo sapiens
ggtctgtaggttgcacac

SEQ ID NO: 6342905 - DNA, 19 bp, Homo sapiens
ggtctgtaggttgcacact

SEQ ID NO: 6342906 - DNA, 14 bp, Homo sapiens
ggtctgtctggatc

SEQ ID NO: 6342907 - DNA, 13 bp, Homo sapiens
ggtctgtctttta

SEQ ID NO: 6342908 - DNA, 14 bp, Homo sapiens
ggtctgtgcccgag

SEQ ID NO: 6342909 - DNA, 16 bp, Homo sapiens
ggtctgtgctgtgcct

SEQ ID NO: 6342910 - DNA, 19 bp, Homo sapiens
ggtctgtgctgtgcctgct

SEQ ID NO: 6342911 - DNA, 23 bp, Homo sapiens
ggtctgtgtaacatccaagccag

SEQ ID NO: 6342912 - DNA, 24 bp, Homo sapiens
ggtctgtgtgaatgtgggcactgg

SEQ ID NO: 6342913 - DNA, 16 bp, Homo sapiens
ggtctgtgtgtgttct

SEQ ID NO: 6342914 - DNA, 23 bp, Homo sapiens
ggtctgtgttctcaacacacagt

SEQ ID NO: 6342915 - DNA, 13 bp, Homo sapiens
ggtctgttcttga

SEQ ID NO: 6342916 - DNA, 15 bp, Homo sapiens
ggtctgttcttgaat

SEQ ID NO: 6342917 - DNA, 13 bp, Homo sapiens
ggtctgttgccca

SEQ ID NO: 6342918 - DNA, 19 bp, Homo sapiens
ggtctgttggcaggctggc

SEQ ID NO: 6342919 - DNA, 15 bp, Homo sapiens
ggtctgtttaaagtg

SEQ ID NO: 6342920 - DNA, 20 bp, Homo sapiens
ggtctgttttcctttctcac

SEQ ID NO: 6342921 - DNA, 15 bp, Homo sapiens
ggtctgttttggtcc

SEQ ID NO: 6342922 - DNA, 23 bp, Homo sapiens
ggtctgttttggtcccctccctc

SEQ ID NO: 6342923 - DNA, 23 bp, Homo sapiens
ggtcttaaatgctcattttctgg

SEQ ID NO: 6342924 - DNA, 15 bp, Homo sapiens
ggtcttacccccacc

SEQ ID NO: 6342925 - DNA, 23 bp, Homo sapiens
ggtcttactttgtgcaaaagcag

SEQ ID NO: 6342926 - DNA, 20 bp, Homo sapiens
ggtcttaggatgtctgtaat

SEQ ID NO: 6342927 - DNA, 22 bp, Homo sapiens
ggtcttagggtacagcccaggc

SEQ ID NO: 6342928 - DNA, 17 bp, Homo sapiens
ggtcttagttctggttg

SEQ ID NO: 6342929 - DNA, 16 bp, Homo sapiens
ggtcttatgcttccat

SEQ ID NO: 6342930 - DNA, 22 bp, Homo sapiens
ggtcttcaagcctggcccagtg

SEQ ID NO: 6342931 - DNA, 15 bp, Homo sapiens
ggtcttcactgtgtg

SEQ ID NO: 6342932 - DNA, 22 bp, Homo sapiens
ggtcttcagcctccctcagccc

SEQ ID NO: 6342933 - DNA, 14 bp, Homo sapiens
ggtcttcagcttta

SEQ ID NO: 6342934 - DNA, 15 bp, Homo sapiens
ggtcttcagggctct

SEQ ID NO: 6342935 - DNA, 16 bp, Homo sapiens
ggtcttccagacctgc

SEQ ID NO: 6342936 - DNA, 18 bp, Homo sapiens
ggtcttccagacctgctt

SEQ ID NO: 6342937 - DNA, 17 bp, Homo sapiens
ggtcttcccaggctggg

SEQ ID NO: 6342938 - DNA, 22 bp, Homo sapiens
ggtcttccctacctcaggcagg

SEQ ID NO: 6342939 - DNA, 17 bp, Homo sapiens
ggtcttcctactcttct

SEQ ID NO: 6342940 - DNA, 13 bp, Homo sapiens
ggtcttcctgctt

SEQ ID NO: 6342941 - DNA, 12 bp, Homo sapiens
ggtcttcctgtg

SEQ ID NO: 6342942 - DNA, 20 bp, Homo sapiens
ggtcttctactgccttgaaa

SEQ ID NO: 6342943 - DNA, 13 bp, Homo sapiens
ggtcttctccatc

SEQ ID NO: 6342944 - DNA, 21 bp, Homo sapiens
ggtcttgaactcctggactca

SEQ ID NO: 6342945 - DNA, 21 bp, Homo sapiens
ggtcttgaactcctggcctca

SEQ ID NO: 6342946 - DNA, 22 bp, Homo sapiens
ggtcttgaactcctggcctcaa

SEQ ID NO: 6342947 - DNA, 22 bp, Homo sapiens
ggtcttgaagtcctggcttcag

SEQ ID NO: 6342948 - DNA, 23 bp, Homo sapiens
ggtcttgaatagattttctctgg

SEQ ID NO: 6342949 - DNA, 21 bp, Homo sapiens
ggtcttgagccagtaatcttt

SEQ ID NO: 6342950 - DNA, 19 bp, Homo sapiens
ggtcttgctatgttgccca

SEQ ID NO: 6342951 - DNA, 20 bp, Homo sapiens
ggtcttgctatgttgcccaa

SEQ ID NO: 6342952 - DNA, 23 bp, Homo sapiens
ggtcttggaacttgcctgccttt

SEQ ID NO: 6342953 - DNA, 16 bp, Homo sapiens
ggtcttggagaggagg

SEQ ID NO: 6342954 - DNA, 18 bp, Homo sapiens
ggtcttggagctgagcct

SEQ ID NO: 6342955 - DNA, 18 bp, Homo sapiens
ggtcttgggctactggca

SEQ ID NO: 6342956 - DNA, 19 bp, Homo sapiens
ggtcttgtgaaaaggcttt

SEQ ID NO: 6342957 - DNA, 19 bp, Homo sapiens
ggtcttgtttccaggagca

SEQ ID NO: 6342958 - DNA, 17 bp, Homo sapiens
ggtctttaataaaacaa

SEQ ID NO: 6342959 - DNA, 14 bp, Homo sapiens
ggtctttatgaatt

SEQ ID NO: 6342960 - DNA, 22 bp, Homo sapiens
ggtctttcagaaggaaaccgaa

SEQ ID NO: 6342961 - DNA, 16 bp, Homo sapiens
ggtctttcatggggtg

SEQ ID NO: 6342962 - DNA, 18 bp, Homo sapiens
ggtctttcctaaggctgc

SEQ ID NO: 6342963 - DNA, 20 bp, Homo sapiens
ggtctttctcctcaggacaa

SEQ ID NO: 6342964 - DNA, 20 bp, Homo sapiens
ggtctttgaaatatgcatgt

SEQ ID NO: 6342965 - DNA, 21 bp, Homo sapiens
ggtctttgaaatatgcatgta

SEQ ID NO: 6342966 - DNA, 23 bp, Homo sapiens
ggtctttgaaatatgcatgtact

SEQ ID NO: 6342967 - DNA, 11 bp, Homo sapiens
ggtctttgaat

SEQ ID NO: 6342968 - DNA, 14 bp, Homo sapiens
ggtctttgaataaa

SEQ ID NO: 6342969 - DNA, 12 bp, Homo sapiens
ggtctttgtaag

SEQ ID NO: 6342970 - DNA, 20 bp, Homo sapiens
ggtctttgtaagagtgtaga

SEQ ID NO: 6342971 - DNA, 19 bp, Homo sapiens
ggtcttttaccctgtgtca

SEQ ID NO: 6342972 - DNA, 22 bp, Homo sapiens
ggtcttttaccctgtgtcagag

SEQ ID NO: 6342973 - DNA, 19 bp, Homo sapiens
ggtcttttataggaaaaaa

SEQ ID NO: 6342974 - DNA, 21 bp, Homo sapiens
ggtcttttgacatgtggaaag

SEQ ID NO: 6342975 - DNA, 21 bp, Homo sapiens
ggtctttttctagggtccctg

SEQ ID NO: 6342976 - DNA, 21 bp, Homo sapiens
ggtctttttctcttctgttct

SEQ ID NO: 6342977 - DNA, 17 bp, Homo sapiens
ggtcttttttcatttct

SEQ ID NO: 6342978 - DNA, 18 bp, Homo sapiens
ggtcttttttctgggtct

SEQ ID NO: 6342979 - DNA, 20 bp, Homo sapiens
ggtgaaaatgccagtctgtg

SEQ ID NO: 6342980 - DNA, 22 bp, Homo sapiens
ggtgaaaattattttgttcata

SEQ ID NO: 6342981 - DNA, 12 bp, Homo sapiens
ggtgaaacacac

SEQ ID NO: 6342982 - DNA, 18 bp, Homo sapiens
ggtgaaagaaagggaccc

SEQ ID NO: 6342983 - DNA, 17 bp, Homo sapiens
ggtgaaagaaatcatgt

SEQ ID NO: 6342984 - DNA, 20 bp, Homo sapiens
ggtgaaagcataacatgggt

SEQ ID NO: 6342985 - DNA, 16 bp, Homo sapiens
ggtgaaataataaaat

SEQ ID NO: 6342986 - DNA, 14 bp, Homo sapiens
ggtgaaatcttgtt

SEQ ID NO: 6342987 - DNA, 10 bp, Homo sapiens
ggtgaaatta

SEQ ID NO: 6342988 - DNA, 12 bp, Homo sapiens
ggtgaaattatg

SEQ ID NO: 6342989 - DNA, 19 bp, Homo sapiens
ggtgaacaaagcagccacg

SEQ ID NO: 6342990 - DNA, 23 bp, Homo sapiens
ggtgaacaacgtactatggaagc

SEQ ID NO: 6342991 - DNA, 14 bp, Homo sapiens
ggtgaacactgtga

SEQ ID NO: 6342992 - DNA, 21 bp, Homo sapiens
ggtgaacagagagaaccagga

SEQ ID NO: 6342993 - DNA, 16 bp, Homo sapiens
ggtgaagaaaactcct

SEQ ID NO: 6342994 - DNA, 19 bp, Homo sapiens
ggtgaagatgggaacgcag

SEQ ID NO: 6342995 - DNA, 18 bp, Homo sapiens
ggtgaagcaccagggaga

SEQ ID NO: 6342996 - DNA, 14 bp, Homo sapiens
ggtgaagctgggga

SEQ ID NO: 6342997 - DNA, 14 bp, Homo sapiens
ggtgaaggaatata

SEQ ID NO: 6342998 - DNA, 19 bp, Homo sapiens
ggtgaaggatccaggaata

SEQ ID NO: 6342999 - DNA, 12 bp, Homo sapiens
ggtgaaggcagg

SEQ ID NO: 6343000 - DNA, 13 bp, Homo sapiens
ggtgaaggcagga

SEQ ID NO: 6343001 - DNA, 14 bp, Homo sapiens
ggtgaaggcctggc

SEQ ID NO: 6343002 - DNA, 17 bp, Homo sapiens
ggtgaaggcctggctgg

SEQ ID NO: 6343003 - DNA, 19 bp, Homo sapiens
ggtgaaggcctggctggaa

SEQ ID NO: 6343004 - DNA, 18 bp, Homo sapiens
ggtgaagggagagccagc

SEQ ID NO: 6343005 - DNA, 17 bp, Homo sapiens
ggtgaagggatggggga

SEQ ID NO: 6343006 - DNA, 20 bp, Homo sapiens
ggtgaagggatgggggaaga

SEQ ID NO: 6343007 - DNA, 12 bp, Homo sapiens
ggtgaaggggct

SEQ ID NO: 6343008 - DNA, 13 bp, Homo sapiens
ggtgaaggggctg

SEQ ID NO: 6343009 - DNA, 14 bp, Homo sapiens
ggtgaaggggctgg

SEQ ID NO: 6343010 - DNA, 22 bp, Homo sapiens
ggtgaagtcgggtcaaaaataa

SEQ ID NO: 6343011 - DNA, 23 bp, Homo sapiens
ggtgaagtgaaaaacagaaaaat

SEQ ID NO: 6343012 - DNA, 15 bp, Homo sapiens
ggtgaagtgaggaca

SEQ ID NO: 6343013 - DNA, 13 bp, Homo sapiens
ggtgaagtttgtc

SEQ ID NO: 6343014 - DNA, 17 bp, Homo sapiens
ggtgaataaagcaggga

SEQ ID NO: 6343015 - DNA, 18 bp, Homo sapiens
ggtgaatacttattttca

SEQ ID NO: 6343016 - DNA, 17 bp, Homo sapiens
ggtgaatcacctggctg

SEQ ID NO: 6343017 - DNA, 14 bp, Homo sapiens
ggtgaatggctttg

SEQ ID NO: 6343018 - DNA, 20 bp, Homo sapiens
ggtgaatggctttgtataga

SEQ ID NO: 6343019 - DNA, 14 bp, Homo sapiens
ggtgaatgtcttcc

SEQ ID NO: 6343020 - DNA, 19 bp, Homo sapiens
ggtgaatgtgtgaaggtct

SEQ ID NO: 6343021 - DNA, 15 bp, Homo sapiens
ggtgaatttgtttaa

SEQ ID NO: 6343022 - DNA, 23 bp, Homo sapiens
ggtgacaaaccatttccaacagc

SEQ ID NO: 6343023 - DNA, 12 bp, Homo sapiens
ggtgacacacag

SEQ ID NO: 6343024 - DNA, 12 bp, Homo sapiens
ggtgacacagac

SEQ ID NO: 6343025 - DNA, 19 bp, Homo sapiens
ggtgacacaggtcagggct

SEQ ID NO: 6343026 - DNA, 19 bp, Homo sapiens
ggtgacacattacaaagcc

SEQ ID NO: 6343027 - DNA, 13 bp, Homo sapiens
ggtgacaccagcc

SEQ ID NO: 6343028 - DNA, 16 bp, Homo sapiens
ggtgacaccagccttt

SEQ ID NO: 6343029 - DNA, 23 bp, Homo sapiens
ggtgacacgcttctgagcagggg

SEQ ID NO: 6343030 - DNA, 20 bp, Homo sapiens
ggtgacagagcgagactctg

SEQ ID NO: 6343031 - DNA, 21 bp, Homo sapiens
ggtgacagagtgagactctgt

SEQ ID NO: 6343032 - DNA, 17 bp, Homo sapiens
ggtgacagcagtcggtt

SEQ ID NO: 6343033 - DNA, 13 bp, Homo sapiens
ggtgacaggcaga

SEQ ID NO: 6343034 - DNA, 21 bp, Homo sapiens
ggtgacagtcatcatcagggc

SEQ ID NO: 6343035 - DNA, 23 bp, Homo sapiens
ggtgacagtcatcatcagggcct

SEQ ID NO: 6343036 - DNA, 23 bp, Homo sapiens
ggtgacagtgacgtgactcagag

SEQ ID NO: 6343037 - DNA, 13 bp, Homo sapiens
ggtgacagtgaga

SEQ ID NO: 6343038 - DNA, 23 bp, Homo sapiens
ggtgacagtgaggtcctgggggc

SEQ ID NO: 6343039 - DNA, 15 bp, Homo sapiens
ggtgacagtggctgc

SEQ ID NO: 6343040 - DNA, 18 bp, Homo sapiens
ggtgacatcaggtttttc

SEQ ID NO: 6343041 - DNA, 18 bp, Homo sapiens
ggtgacatggggaaggca

SEQ ID NO: 6343042 - DNA, 23 bp, Homo sapiens
ggtgacatggggaaggcagaggc

SEQ ID NO: 6343043 - DNA, 15 bp, Homo sapiens
ggtgacatgtgaaac

SEQ ID NO: 6343044 - DNA, 18 bp, Homo sapiens
ggtgacatgtgaaacctt

SEQ ID NO: 6343045 - DNA, 15 bp, Homo sapiens
ggtgacatttcccaa

SEQ ID NO: 6343046 - DNA, 22 bp, Homo sapiens
ggtgaccagcaccatctctcct

SEQ ID NO: 6343047 - DNA, 17 bp, Homo sapiens
ggtgaccagcctgtcac

SEQ ID NO: 6343048 - DNA, 17 bp, Homo sapiens
ggtgacccacagctctg

SEQ ID NO: 6343049 - DNA, 22 bp, Homo sapiens
ggtgacccatttcaggaggtgc

SEQ ID NO: 6343050 - DNA, 22 bp, Homo sapiens
ggtgaccccagggcacaggagc

SEQ ID NO: 6343051 - DNA, 21 bp, Homo sapiens
ggtgaccccttttcagcttct

SEQ ID NO: 6343052 - DNA, 15 bp, Homo sapiens
ggtgaccgcccagct

SEQ ID NO: 6343053 - DNA, 17 bp, Homo sapiens
ggtgaccggcctggacc

SEQ ID NO: 6343054 - DNA, 22 bp, Homo sapiens
ggtgacctcacacacctctgcc

SEQ ID NO: 6343055 - DNA, 16 bp, Homo sapiens
ggtgacctccgtcctc

SEQ ID NO: 6343056 - DNA, 22 bp, Homo sapiens
ggtgacctccgtcctctcccca

SEQ ID NO: 6343057 - DNA, 13 bp, Homo sapiens
ggtgacctctccg

SEQ ID NO: 6343058 - DNA, 20 bp, Homo sapiens
ggtgaccttccaagagcctg

SEQ ID NO: 6343059 - DNA, 21 bp, Homo sapiens
ggtgaccttccaagagcctga

SEQ ID NO: 6343060 - DNA, 15 bp, Homo sapiens
ggtgaccttctggga

SEQ ID NO: 6343061 - DNA, 14 bp, Homo sapiens
ggtgacgcccagct

SEQ ID NO: 6343062 - DNA, 15 bp, Homo sapiens
ggtgacgcccagctc

SEQ ID NO: 6343063 - DNA, 20 bp, Homo sapiens
gtttagcccatctctccaga

SEQ ID NO: 6343064 - DNA, 13 bp, Homo sapiens
gtttagctattta

SEQ ID NO: 6343065 - DNA, 12 bp, Homo sapiens
gtttagctctga

SEQ ID NO: 6343066 - DNA, 20 bp, Homo sapiens
gtttagctgacaaaatactt

SEQ ID NO: 6343067 - DNA, 21 bp, Homo sapiens
gtttagctggaaaagtatgtt

SEQ ID NO: 6343068 - DNA, 15 bp, Homo sapiens
gtttaggaaatttat

SEQ ID NO: 6343069 - DNA, 17 bp, Homo sapiens
gtttaggattacttaga

SEQ ID NO: 6343070 - DNA, 17 bp, Homo sapiens
gtttaggcctcatttct

SEQ ID NO: 6343071 - DNA, 23 bp, Homo sapiens
gtttaggcctcatttctttgtct

SEQ ID NO: 6343072 - DNA, 14 bp, Homo sapiens
gtttaggctatttg

SEQ ID NO: 6343073 - DNA, 15 bp, Homo sapiens
gtttaggctatttgt

SEQ ID NO: 6343074 - DNA, 18 bp, Homo sapiens
gtttaggctggtggccca

SEQ ID NO: 6343075 - DNA, 19 bp, Homo sapiens
gtttaggggaagtatgtgt

SEQ ID NO: 6343076 - DNA, 17 bp, Homo sapiens
gtttaggggtgaaggag

SEQ ID NO: 6343077 - DNA, 15 bp, Homo sapiens
gtttaggtgaattaa

SEQ ID NO: 6343078 - DNA, 13 bp, Homo sapiens
gtttagtaagttt

SEQ ID NO: 6343079 - DNA, 20 bp, Homo sapiens
gtttagtagctgataaagaa

SEQ ID NO: 6343080 - DNA, 22 bp, Homo sapiens
gtttagtgcatctttgcctctc

SEQ ID NO: 6343081 - DNA, 17 bp, Homo sapiens
gtttagtgccaatgttg

SEQ ID NO: 6343082 - DNA, 16 bp, Homo sapiens
gtttagtgtaaaaatg

SEQ ID NO: 6343083 - DNA, 17 bp, Homo sapiens
gtttagtgtaaaaatga

SEQ ID NO: 6343084 - DNA, 15 bp, Homo sapiens
gtttagttctgttga

SEQ ID NO: 6343085 - DNA, 14 bp, Homo sapiens
gtttagttgactaa

SEQ ID NO: 6343086 - DNA, 22 bp, Homo sapiens
gtttagttgcttgctaatattt

SEQ ID NO: 6343087 - DNA, 23 bp, Homo sapiens
gtttataaaacaatgacttttaa

SEQ ID NO: 6343088 - DNA, 18 bp, Homo sapiens
gtttataaaatataaaca

SEQ ID NO: 6343089 - DNA, 14 bp, Homo sapiens
gtttataaacagaa

SEQ ID NO: 6343090 - DNA, 13 bp, Homo sapiens
gtttataaactga

SEQ ID NO: 6343091 - DNA, 14 bp, Homo sapiens
gtttataaagcaga

SEQ ID NO: 6343092 - DNA, 14 bp, Homo sapiens
gtttataaagccaa

SEQ ID NO: 6343093 - DNA, 19 bp, Homo sapiens
gtttataaatgttctggta

SEQ ID NO: 6343094 - DNA, 17 bp, Homo sapiens
gtttataactattcagt

SEQ ID NO: 6343095 - DNA, 19 bp, Homo sapiens
gtttataactattcagttg

SEQ ID NO: 6343096 - DNA, 16 bp, Homo sapiens
gtttataagctgggca

SEQ ID NO: 6343097 - DNA, 14 bp, Homo sapiens
gtttataataaact

SEQ ID NO: 6343098 - DNA, 22 bp, Homo sapiens
gtttataatactactactgtta

SEQ ID NO: 6343099 - DNA, 18 bp, Homo sapiens
gtttataatctgaagata

SEQ ID NO: 6343100 - DNA, 13 bp, Homo sapiens
gtttataatgcag

SEQ ID NO: 6343101 - DNA, 13 bp, Homo sapiens
gtttataatgtta

SEQ ID NO: 6343102 - DNA, 14 bp, Homo sapiens
gtttataattggct

SEQ ID NO: 6343103 - DNA, 15 bp, Homo sapiens
gtttataattggctt

SEQ ID NO: 6343104 - DNA, 21 bp, Homo sapiens
gtttatacagaactcacagta

SEQ ID NO: 6343105 - DNA, 15 bp, Homo sapiens
gtttatacagtacag

SEQ ID NO: 6343106 - DNA, 16 bp, Homo sapiens
gtttatacagtgtaca

SEQ ID NO: 6343107 - DNA, 18 bp, Homo sapiens
gtttatacagtgtacatg

SEQ ID NO: 6343108 - DNA, 21 bp, Homo sapiens
gtttatacagtgtacatgtac

SEQ ID NO: 6343109 - DNA, 18 bp, Homo sapiens
gtttatacagttttaaag

SEQ ID NO: 6343110 - DNA, 15 bp, Homo sapiens
gtttatacctttgcc

SEQ ID NO: 6343111 - DNA, 20 bp, Homo sapiens
gtttatactgtatttctaag

SEQ ID NO: 6343112 - DNA, 17 bp, Homo sapiens
gtttatagacattatgt

SEQ ID NO: 6343113 - DNA, 21 bp, Homo sapiens
gtttatagatcactgcccttt

SEQ ID NO: 6343114 - DNA, 20 bp, Homo sapiens
gtttatagcaaaaatgtttt

SEQ ID NO: 6343115 - DNA, 17 bp, Homo sapiens
gtttatagcttcaggac

SEQ ID NO: 6343116 - DNA, 22 bp, Homo sapiens
gtttataggagaaagcaaaata

SEQ ID NO: 6343117 - DNA, 12 bp, Homo sapiens
gtttatataaat

SEQ ID NO: 6343118 - DNA, 22 bp, Homo sapiens
gtttatatacagtacacagata

SEQ ID NO: 6343119 - DNA, 17 bp, Homo sapiens
gtttatatattgaaagt

SEQ ID NO: 6343120 - DNA, 23 bp, Homo sapiens
gtttatatattgaaagttgcttt

SEQ ID NO: 6343121 - DNA, 15 bp, Homo sapiens
gtttatatgaaaaca

SEQ ID NO: 6343122 - DNA, 16 bp, Homo sapiens
gtttatatgaaaacac

SEQ ID NO: 6343123 - DNA, 19 bp, Homo sapiens
gtttatatggaagaaagta

SEQ ID NO: 6343124 - DNA, 14 bp, Homo sapiens
gtttatatgtcttg

SEQ ID NO: 6343125 - DNA, 21 bp, Homo sapiens
gtttatattgggaagctgtag

SEQ ID NO: 6343126 - DNA, 15 bp, Homo sapiens
gtttatattgtggaa

SEQ ID NO: 6343127 - DNA, 17 bp, Homo sapiens
gtttatatttggctctc

SEQ ID NO: 6343128 - DNA, 20 bp, Homo sapiens
gtttatatttttttaactgt

SEQ ID NO: 6343129 - DNA, 15 bp, Homo sapiens
gtttatcagatacat

SEQ ID NO: 6343130 - DNA, 18 bp, Homo sapiens
gtttatcagatacatcac

SEQ ID NO: 6343131 - DNA, 19 bp, Homo sapiens
gtttatcagatacatcact

SEQ ID NO: 6343132 - DNA, 15 bp, Homo sapiens
gtttatcagcaaaaa

SEQ ID NO: 6343133 - DNA, 17 bp, Homo sapiens
gtttatcattcaagtgt

SEQ ID NO: 6343134 - DNA, 16 bp, Homo sapiens
gtttatcctcttggtg

SEQ ID NO: 6343135 - DNA, 14 bp, Homo sapiens
gtttatcctgacat

SEQ ID NO: 6343136 - DNA, 23 bp, Homo sapiens
gtttatcctgacatattcaagtg

SEQ ID NO: 6343137 - DNA, 15 bp, Homo sapiens
gtttatcctttcata

SEQ ID NO: 6343138 - DNA, 18 bp, Homo sapiens
gtttatgaaaaagaagaa

SEQ ID NO: 6343139 - DNA, 15 bp, Homo sapiens
gtttatgacagtaat

SEQ ID NO: 6343140 - DNA, 19 bp, Homo sapiens
gtttatgagaactggttct

SEQ ID NO: 6343141 - DNA, 18 bp, Homo sapiens
gtttatgagatgctggtt

SEQ ID NO: 6343142 - DNA, 21 bp, Homo sapiens
gtttatgataataaaggcacc

SEQ ID NO: 6343143 - DNA, 21 bp, Homo sapiens
gtttatgatatttcttgcttt

SEQ ID NO: 6343144 - DNA, 14 bp, Homo sapiens
gtttatgattccac

SEQ ID NO: 6343145 - DNA, 22 bp, Homo sapiens
gtttatgcacacagagatttga

SEQ ID NO: 6343146 - DNA, 15 bp, Homo sapiens
gtttatgcagtgctg

SEQ ID NO: 6343147 - DNA, 12 bp, Homo sapiens
gtttatgcatat

SEQ ID NO: 6343148 - DNA, 12 bp, Homo sapiens
gtttatgcattt

SEQ ID NO: 6343149 - DNA, 15 bp, Homo sapiens
gtttatgccaccagg

SEQ ID NO: 6343150 - DNA, 23 bp, Homo sapiens
gtttatggccacatttaatatct

SEQ ID NO: 6343151 - DNA, 13 bp, Homo sapiens
gtttatggcctca

SEQ ID NO: 6343152 - DNA, 14 bp, Homo sapiens
gtttatggcctcag

SEQ ID NO: 6343153 - DNA, 22 bp, Homo sapiens
gtttatggcctcagctgcctca

SEQ ID NO: 6343154 - DNA, 20 bp, Homo sapiens
gtttatggccttaatatact

SEQ ID NO: 6343155 - DNA, 20 bp, Homo sapiens
gtttatgtaaacaaatcttt

SEQ ID NO: 6343156 - DNA, 22 bp, Homo sapiens
gtttatgtaacttcctgtggat

SEQ ID NO: 6343157 - DNA, 17 bp, Homo sapiens
gtttatgtactgtaaac

SEQ ID NO: 6343158 - DNA, 22 bp, Homo sapiens
gtttatgttcttatagaataaa

SEQ ID NO: 6343159 - DNA, 19 bp, Homo sapiens
gtttattaaaatactgttt

SEQ ID NO: 6343160 - DNA, 22 bp, Homo sapiens
gtttattaaaattctgaatttt

SEQ ID NO: 6343161 - DNA, 14 bp, Homo sapiens
gtttattaaatgct

SEQ ID NO: 6343162 - DNA, 15 bp, Homo sapiens
gtttattaaattgca

SEQ ID NO: 6343163 - DNA, 18 bp, Homo sapiens
gtttattaacaaattatg

SEQ ID NO: 6343164 - DNA, 18 bp, Homo sapiens
gtttattaagcatcagaa

SEQ ID NO: 6343165 - DNA, 14 bp, Homo sapiens
gtttattaatagaa

SEQ ID NO: 6343166 - DNA, 14 bp, Homo sapiens
gtttattaatctta

SEQ ID NO: 6343167 - DNA, 17 bp, Homo sapiens
gtttattaatgcctctc

SEQ ID NO: 6343168 - DNA, 22 bp, Homo sapiens
gtttattaatgcctctcccgca

SEQ ID NO: 6343169 - DNA, 14 bp, Homo sapiens
gtttattacaattt

SEQ ID NO: 6343170 - DNA, 13 bp, Homo sapiens
gtttattacagta

SEQ ID NO: 6343171 - DNA, 21 bp, Homo sapiens
gtttattacttccatgaattt

SEQ ID NO: 6343172 - DNA, 18 bp, Homo sapiens
gtttattataaactgtat

SEQ ID NO: 6343173 - DNA, 19 bp, Homo sapiens
gtttattattgtactttat

SEQ ID NO: 6343174 - DNA, 15 bp, Homo sapiens
gtttattattttcaa

SEQ ID NO: 6343175 - DNA, 13 bp, Homo sapiens
gtttattcatatg

SEQ ID NO: 6343176 - DNA, 19 bp, Homo sapiens
gtttattcatatgcatatt

SEQ ID NO: 6343177 - DNA, 19 bp, Homo sapiens
gtttattcatccagcagtg

SEQ ID NO: 6343178 - DNA, 21 bp, Homo sapiens
gtttattcccaagtatgcctt

SEQ ID NO: 6343179 - DNA, 13 bp, Homo sapiens
gtttattctgtgg

SEQ ID NO: 6343180 - DNA, 15 bp, Homo sapiens
gtttattctgtttca

SEQ ID NO: 6343181 - DNA, 15 bp, Homo sapiens
gtttattctttgcaa

SEQ ID NO: 6343182 - DNA, 18 bp, Homo sapiens
gtttattctttgcaaata

SEQ ID NO: 6343183 - DNA, 13 bp, Homo sapiens
gtttattgccatt

SEQ ID NO: 6343184 - DNA, 17 bp, Homo sapiens
gtttattgcttaatccc

SEQ ID NO: 6343185 - DNA, 14 bp, Homo sapiens
gtttattggaagtg

SEQ ID NO: 6343186 - DNA, 20 bp, Homo sapiens
gtttattgggcaataaaaga

SEQ ID NO: 6343187 - DNA, 13 bp, Homo sapiens
gtttattgtaaaa

SEQ ID NO: 6343188 - DNA, 14 bp, Homo sapiens
gtttatttaaggat

SEQ ID NO: 6343189 - DNA, 15 bp, Homo sapiens
gtttatttaaggatg

SEQ ID NO: 6343190 - DNA, 17 bp, Homo sapiens
gtttatttaaggatgga

SEQ ID NO: 6343191 - DNA, 21 bp, Homo sapiens
gtttatttaaggatggatggc

SEQ ID NO: 6343192 - DNA, 22 bp, Homo sapiens
gtttatttaaggatggatggca

SEQ ID NO: 6343193 - DNA, 14 bp, Homo sapiens
gtttatttatcagt

SEQ ID NO: 6343194 - DNA, 16 bp, Homo sapiens
gtttatttatcagtga

SEQ ID NO: 6343195 - DNA, 13 bp, Homo sapiens
gtttatttcacac

SEQ ID NO: 6343196 - DNA, 11 bp, Homo sapiens
gtttatttcat

SEQ ID NO: 6343197 - DNA, 14 bp, Homo sapiens
gtttatttcatgtg

SEQ ID NO: 6343198 - DNA, 16 bp, Homo sapiens
gtttatttcatgtggt

SEQ ID NO: 6343199 - DNA, 12 bp, Homo sapiens
gtttatttcatt

SEQ ID NO: 6343200 - DNA, 11 bp, Homo sapiens
gtttatttcct

SEQ ID NO: 6343201 - DNA, 14 bp, Homo sapiens
gtttatttctctct

SEQ ID NO: 6343202 - DNA, 13 bp, Homo sapiens
gtttatttgagaa

SEQ ID NO: 6343203 - DNA, 22 bp, Homo sapiens
gtttatttgatgagttctgtcc

SEQ ID NO: 6343204 - DNA, 21 bp, Homo sapiens
gtttatttgcaatttgagcca

SEQ ID NO: 6343205 - DNA, 12 bp, Homo sapiens
gtttattttcag

SEQ ID NO: 6343206 - DNA, 12 bp, Homo sapiens
gtttattttcat

SEQ ID NO: 6343207 - DNA, 20 bp, Homo sapiens
gtttattttcattctgccaa

SEQ ID NO: 6343208 - DNA, 20 bp, Homo sapiens
gtttattttctgtgtaaaat

SEQ ID NO: 6343209 - DNA, 23 bp, Homo sapiens
gtttattttgagtcctaggactt

SEQ ID NO: 6343210 - DNA, 15 bp, Homo sapiens
gtttatttttgtaat

SEQ ID NO: 6343211 - DNA, 13 bp, Homo sapiens
gtttcaaaaatct

SEQ ID NO: 6343212 - DNA, 14 bp, Homo sapiens
gtttcaaaaatctg

SEQ ID NO: 6343213 - DNA, 23 bp, Homo sapiens
gtttcaaaataaaaaccaagaag

SEQ ID NO: 6343214 - DNA, 21 bp, Homo sapiens
gtttcaaaatagacaagtttt

SEQ ID NO: 6343215 - DNA, 18 bp, Homo sapiens
gtttcaaacacaaatgca

SEQ ID NO: 6343216 - DNA, 19 bp, Homo sapiens
gtttcaaacacaaatgcag

SEQ ID NO: 6343217 - DNA, 21 bp, Homo sapiens
gtttcaaacatatataacaat

SEQ ID NO: 6343218 - DNA, 16 bp, Homo sapiens
gtttcaaactcctgac

SEQ ID NO: 6343219 - DNA, 16 bp, Homo sapiens
gtttcaaactttacta

SEQ ID NO: 6343220 - DNA, 17 bp, Homo sapiens
gtttcaaactttactat

SEQ ID NO: 6343221 - DNA, 19 bp, Homo sapiens
gtttcaaagatgctgtgag

SEQ ID NO: 6343222 - DNA, 13 bp, Homo sapiens
gtttcaaagcaca

SEQ ID NO: 6343223 - DNA, 19 bp, Homo sapiens
gtttcaaagtaaaggcctc

SEQ ID NO: 6343224 - DNA, 20 bp, Homo sapiens
gtttcaaagtaaaggcctcc

SEQ ID NO: 6343225 - DNA, 23 bp, Homo sapiens
gtttcaaagtaaaggcctcctcc

SEQ ID NO: 6343226 - DNA, 22 bp, Homo sapiens
gtttcaaagtgatagaaaagtg

SEQ ID NO: 6343227 - DNA, 17 bp, Homo sapiens
gtttcaacaaatttcat

SEQ ID NO: 6343228 - DNA, 20 bp, Homo sapiens
gtttcaacaaatttcattgc

SEQ ID NO: 6343229 - DNA, 24 bp, Homo sapiens
gtttcaacaaatttcattgcactt

SEQ ID NO: 6343230 - DNA, 18 bp, Homo sapiens
gtttcaacggaaagtgct

SEQ ID NO: 6343231 - DNA, 15 bp, Homo sapiens
gtttcaagaaaatct

SEQ ID NO: 6343232 - DNA, 13 bp, Homo sapiens
gtttcaagccctc

SEQ ID NO: 6343233 - DNA, 23 bp, Homo sapiens
gtttcaaggcactctagattcca

SEQ ID NO: 6343234 - DNA, 17 bp, Homo sapiens
gtttcaagttattcaaa

SEQ ID NO: 6343235 - DNA, 14 bp, Homo sapiens
gtttcaataaagtt

SEQ ID NO: 6343236 - DNA, 13 bp, Homo sapiens
gtttcaatgtgat

SEQ ID NO: 6343237 - DNA, 21 bp, Homo sapiens
gtttcaatgtgattctaatgt

SEQ ID NO: 6343238 - DNA, 22 bp, Homo sapiens
gtttcaattccacctgcaatca

SEQ ID NO: 6343239 - DNA, 16 bp, Homo sapiens
gtttcaattgcatctc

SEQ ID NO: 6343240 - DNA, 17 bp, Homo sapiens
gtttcaattgcatctcc

SEQ ID NO: 6343241 - DNA, 21 bp, Homo sapiens
gtttcacagcacttacaattt

SEQ ID NO: 6343242 - DNA, 16 bp, Homo sapiens
gtttcacagtttgaaa

SEQ ID NO: 6343243 - DNA, 16 bp, Homo sapiens
ggtgacgcccagctcc

SEQ ID NO: 6343244 - DNA, 22 bp, Homo sapiens
ggtgacggactcagactcctgg

SEQ ID NO: 6343245 - DNA, 12 bp, Homo sapiens
ggtgacggccct

SEQ ID NO: 6343246 - DNA, 19 bp, Homo sapiens
ggtgacggccctcatctat

SEQ ID NO: 6343247 - DNA, 19 bp, Homo sapiens
ggtgactcacttcaatgtg

SEQ ID NO: 6343248 - DNA, 20 bp, Homo sapiens
ggtgactcgagtgtttaaat

SEQ ID NO: 6343249 - DNA, 21 bp, Homo sapiens
ggtgactcgggggctgtctca

SEQ ID NO: 6343250 - DNA, 13 bp, Homo sapiens
ggtgactctgtcc

SEQ ID NO: 6343251 - DNA, 20 bp, Homo sapiens
ggtgactgaatttgggcctc

SEQ ID NO: 6343252 - DNA, 11 bp, Homo sapiens
ggtgactggaa

SEQ ID NO: 6343253 - DNA, 13 bp, Homo sapiens
ggtgactggagcc

SEQ ID NO: 6343254 - DNA, 19 bp, Homo sapiens
ggtgactgggccctgcctc

SEQ ID NO: 6343255 - DNA, 16 bp, Homo sapiens
ggtgactgtcccaccg

SEQ ID NO: 6343256 - DNA, 18 bp, Homo sapiens
ggtgacttctagcagaga

SEQ ID NO: 6343257 - DNA, 16 bp, Homo sapiens
ggtgacttctgctgct

SEQ ID NO: 6343258 - DNA, 16 bp, Homo sapiens
ggtgacttgtctgcct

SEQ ID NO: 6343259 - DNA, 14 bp, Homo sapiens
ggtgactttctgaa

SEQ ID NO: 6343260 - DNA, 15 bp, Homo sapiens
ggtgactttctgaaa

SEQ ID NO: 6343261 - DNA, 14 bp, Homo sapiens
ggtgactttggata

SEQ ID NO: 6343262 - DNA, 19 bp, Homo sapiens
ggtgactttggataataag

SEQ ID NO: 6343263 - DNA, 20 bp, Homo sapiens
ggtgactttggataataagg

SEQ ID NO: 6343264 - DNA, 21 bp, Homo sapiens
ggtgactttggataataagga

SEQ ID NO: 6343265 - DNA, 12 bp, Homo sapiens
ggtgagaaaaaa

SEQ ID NO: 6343266 - DNA, 14 bp, Homo sapiens
ggtgagaaaatata

SEQ ID NO: 6343267 - DNA, 23 bp, Homo sapiens
ggtgagaaacctgtatctttcta

SEQ ID NO: 6343268 - DNA, 21 bp, Homo sapiens
ggtgagaacctgggttgcaga

SEQ ID NO: 6343269 - DNA, 18 bp, Homo sapiens
ggtgagaacgtgcccagc

SEQ ID NO: 6343270 - DNA, 15 bp, Homo sapiens
ggtgagaagcagagg

SEQ ID NO: 6343271 - DNA, 15 bp, Homo sapiens
ggtgagaagggcagg

SEQ ID NO: 6343272 - DNA, 12 bp, Homo sapiens
ggtgagaagtac

SEQ ID NO: 6343273 - DNA, 19 bp, Homo sapiens
ggtgagaagtacagggcag

SEQ ID NO: 6343274 - DNA, 16 bp, Homo sapiens
ggtgagaattaaaata

SEQ ID NO: 6343275 - DNA, 19 bp, Homo sapiens
ggtgagacagcggtcccag

SEQ ID NO: 6343276 - DNA, 23 bp, Homo sapiens
ggtgagacagtgggggtgcctgg

SEQ ID NO: 6343277 - DNA, 14 bp, Homo sapiens
ggtgagaccacctc

SEQ ID NO: 6343278 - DNA, 20 bp, Homo sapiens
ggtgagaccccgcactgcag

SEQ ID NO: 6343279 - DNA, 21 bp, Homo sapiens
ggtgagaccccgcactgcaga

SEQ ID NO: 6343280 - DNA, 13 bp, Homo sapiens
ggtgagactctga

SEQ ID NO: 6343281 - DNA, 19 bp, Homo sapiens
ggtgagagacctgctcagg

SEQ ID NO: 6343282 - DNA, 20 bp, Homo sapiens
ggtgagagacctgctcaggc

SEQ ID NO: 6343283 - DNA, 21 bp, Homo sapiens
ggtgagagggccgggcagagg

SEQ ID NO: 6343284 - DNA, 19 bp, Homo sapiens
ggtgagatacccagagaga

SEQ ID NO: 6343285 - DNA, 20 bp, Homo sapiens
ggtgagatacccagagagaa

SEQ ID NO: 6343286 - DNA, 16 bp, Homo sapiens
ggtgagatcacagcct

SEQ ID NO: 6343287 - DNA, 18 bp, Homo sapiens
ggtgagatcacagcctcc

SEQ ID NO: 6343288 - DNA, 14 bp, Homo sapiens
ggtgagatgctgga

SEQ ID NO: 6343289 - DNA, 23 bp, Homo sapiens
ggtgagatgctggagaagagagg

SEQ ID NO: 6343290 - DNA, 14 bp, Homo sapiens
ggtgagcaaccagt

SEQ ID NO: 6343291 - DNA, 17 bp, Homo sapiens
ggtgagcacatctggga

SEQ ID NO: 6343292 - DNA, 20 bp, Homo sapiens
ggtgagcactctggggtggg

SEQ ID NO: 6343293 - DNA, 21 bp, Homo sapiens
ggtgagcactctggggtggga

SEQ ID NO: 6343294 - DNA, 22 bp, Homo sapiens
ggtgagcactctggggtgggag

SEQ ID NO: 6343295 - DNA, 19 bp, Homo sapiens
ggtgagcagaagtggagct

SEQ ID NO: 6343296 - DNA, 18 bp, Homo sapiens
ggtgagcagacaggacag

SEQ ID NO: 6343297 - DNA, 17 bp, Homo sapiens
ggtgagcatggcagctg

SEQ ID NO: 6343298 - DNA, 13 bp, Homo sapiens
ggtgagccccgcc

SEQ ID NO: 6343299 - DNA, 21 bp, Homo sapiens
ggtgagcctagccctgggaca

SEQ ID NO: 6343300 - DNA, 17 bp, Homo sapiens
ggtgagcgggtggggtg

SEQ ID NO: 6343301 - DNA, 14 bp, Homo sapiens
ggtgagctcagctc

SEQ ID NO: 6343302 - DNA, 13 bp, Homo sapiens
ggtgagctggtgc

SEQ ID NO: 6343303 - DNA, 20 bp, Homo sapiens
ggtgaggaatttgaagctca

SEQ ID NO: 6343304 - DNA, 23 bp, Homo sapiens
ggtgaggaatttgaagctcagaa

SEQ ID NO: 6343305 - DNA, 15 bp, Homo sapiens
ggtgaggaccactcc

SEQ ID NO: 6343306 - DNA, 18 bp, Homo sapiens
ggtgaggaccactcctgt

SEQ ID NO: 6343307 - DNA, 19 bp, Homo sapiens
ggtgaggacccgccggatg

SEQ ID NO: 6343308 - DNA, 15 bp, Homo sapiens
ggtgaggaggacaag

SEQ ID NO: 6343309 - DNA, 15 bp, Homo sapiens
ggtgaggcaataaaa

SEQ ID NO: 6343310 - DNA, 14 bp, Homo sapiens
ggtgaggcaggctt

SEQ ID NO: 6343311 - DNA, 12 bp, Homo sapiens
ggtgaggcaggg

SEQ ID NO: 6343312 - DNA, 15 bp, Homo sapiens
ggtgaggcccagcct

SEQ ID NO: 6343313 - DNA, 21 bp, Homo sapiens
ggtgaggccggccctgcccct

SEQ ID NO: 6343314 - DNA, 23 bp, Homo sapiens
ggtgaggctgggcagggcctggc

SEQ ID NO: 6343315 - DNA, 14 bp, Homo sapiens
ggtgagggaaggag

SEQ ID NO: 6343316 - DNA, 13 bp, Homo sapiens
ggtgagggaggcc

SEQ ID NO: 6343317 - DNA, 13 bp, Homo sapiens
ggtgagggatgtg

SEQ ID NO: 6343318 - DNA, 20 bp, Homo sapiens
ggtgagggcaagaggtgcct

SEQ ID NO: 6343319 - DNA, 13 bp, Homo sapiens
ggtgagggccttc

SEQ ID NO: 6343320 - DNA, 16 bp, Homo sapiens
ggtgaggggctttctc

SEQ ID NO: 6343321 - DNA, 11 bp, Homo sapiens
ggtgagggtga

SEQ ID NO: 6343322 - DNA, 12 bp, Homo sapiens
ggtgagggtgcg

SEQ ID NO: 6343323 - DNA, 16 bp, Homo sapiens
ggtgagggttggcgct

SEQ ID NO: 6343324 - DNA, 16 bp, Homo sapiens
ggtgaggtgaactcca

SEQ ID NO: 6343325 - DNA, 21 bp, Homo sapiens
ggtgaggtgaactccaggcat

SEQ ID NO: 6343326 - DNA, 14 bp, Homo sapiens
ggtgaggtggccca

SEQ ID NO: 6343327 - DNA, 15 bp, Homo sapiens
ggtgaggtggcccag

SEQ ID NO: 6343328 - DNA, 20 bp, Homo sapiens
ggtgaggtggcccaggcccc

SEQ ID NO: 6343329 - DNA, 16 bp, Homo sapiens
ggtgagtaaggcatgt

SEQ ID NO: 6343330 - DNA, 20 bp, Homo sapiens
ggtgagtcccctactccctc

SEQ ID NO: 6343331 - DNA, 15 bp, Homo sapiens
ggtgagtcctccaga

SEQ ID NO: 6343332 - DNA, 20 bp, Homo sapiens
ggtgagtcttggcggcagca

SEQ ID NO: 6343333 - DNA, 23 bp, Homo sapiens
ggtgagtcttggcggcagcagcc

SEQ ID NO: 6343334 - DNA, 20 bp, Homo sapiens
ggtgagtcttggttctaaag

SEQ ID NO: 6343335 - DNA, 18 bp, Homo sapiens
ggtgagtgcaagagcctg

SEQ ID NO: 6343336 - DNA, 22 bp, Homo sapiens
ggtgagtgccaccacactcagc

SEQ ID NO: 6343337 - DNA, 15 bp, Homo sapiens
ggtgagtggaaggga

SEQ ID NO: 6343338 - DNA, 14 bp, Homo sapiens
ggtgagtggctgac

SEQ ID NO: 6343339 - DNA, 12 bp, Homo sapiens
ggtgagtttttc

SEQ ID NO: 6343340 - DNA, 15 bp, Homo sapiens
ggtgagtttttcttt

SEQ ID NO: 6343341 - DNA, 14 bp, Homo sapiens
ggtgataagggaaa

SEQ ID NO: 6343342 - DNA, 14 bp, Homo sapiens
ggtgataaggggcc

SEQ ID NO: 6343343 - DNA, 18 bp, Homo sapiens
ggtgataaggggccttgc

SEQ ID NO: 6343344 - DNA, 16 bp, Homo sapiens
ggtgataagtggaaaa

SEQ ID NO: 6343345 - DNA, 18 bp, Homo sapiens
ggtgataagtggaaaaaa

SEQ ID NO: 6343346 - DNA, 16 bp, Homo sapiens
ggtgataggtaaattt

SEQ ID NO: 6343347 - DNA, 20 bp, Homo sapiens
ggtgatatataatttcctca

SEQ ID NO: 6343348 - DNA, 15 bp, Homo sapiens
ggtgatcagaaggct

SEQ ID NO: 6343349 - DNA, 17 bp, Homo sapiens
ggtgatcagaaggctgg

SEQ ID NO: 6343350 - DNA, 15 bp, Homo sapiens
ggtgatcagcagaga

SEQ ID NO: 6343351 - DNA, 12 bp, Homo sapiens
ggtgatcagtgc

SEQ ID NO: 6343352 - DNA, 18 bp, Homo sapiens
ggtgatccacccacctgg

SEQ ID NO: 6343353 - DNA, 20 bp, Homo sapiens
ggtgatccatgtaactgcct

SEQ ID NO: 6343354 - DNA, 23 bp, Homo sapiens
ggtgatcccccaaacagcatgtg

SEQ ID NO: 6343355 - DNA, 14 bp, Homo sapiens
ggtgatcctctatt

SEQ ID NO: 6343356 - DNA, 17 bp, Homo sapiens
ggtgatcctctattttg

SEQ ID NO: 6343357 - DNA, 20 bp, Homo sapiens
ggtgatcctgttctgcgctg

SEQ ID NO: 6343358 - DNA, 17 bp, Homo sapiens
ggtgatcgcacaaggac

SEQ ID NO: 6343359 - DNA, 12 bp, Homo sapiens
ggtgatgactta

SEQ ID NO: 6343360 - DNA, 16 bp, Homo sapiens
ggtgatgagggcagca

SEQ ID NO: 6343361 - DNA, 13 bp, Homo sapiens
ggtgatgccaggt

SEQ ID NO: 6343362 - DNA, 12 bp, Homo sapiens
ggtgatgcctaa

SEQ ID NO: 6343363 - DNA, 14 bp, Homo sapiens
ggtgatgctctggc

SEQ ID NO: 6343364 - DNA, 16 bp, Homo sapiens
ggtgatggaaaaagcg

SEQ ID NO: 6343365 - DNA, 22 bp, Homo sapiens
ggtgatggaaaaagcgctgttt

SEQ ID NO: 6343366 - DNA, 17 bp, Homo sapiens
ggtgatggaaactgcca

SEQ ID NO: 6343367 - DNA, 19 bp, Homo sapiens
ggtgatggggctgagcagg

SEQ ID NO: 6343368 - DNA, 14 bp, Homo sapiens
ggtgatgtcactca

SEQ ID NO: 6343369 - DNA, 22 bp, Homo sapiens
ggtgatgttgacatcactggca

SEQ ID NO: 6343370 - DNA, 18 bp, Homo sapiens
ggtgatgtttccagctgc

SEQ ID NO: 6343371 - DNA, 22 bp, Homo sapiens
ggtgatgtttccagctgccaag

SEQ ID NO: 6343372 - DNA, 16 bp, Homo sapiens
ggtgatgttttacttt

SEQ ID NO: 6343373 - DNA, 19 bp, Homo sapiens
ggtgattaaggtcctgctt

SEQ ID NO: 6343374 - DNA, 16 bp, Homo sapiens
ggtgattatgaaatgc

SEQ ID NO: 6343375 - DNA, 20 bp, Homo sapiens
ggtgattatgaaatgccaga

SEQ ID NO: 6343376 - DNA, 18 bp, Homo sapiens
ggtgattccgcagtgaga

SEQ ID NO: 6343377 - DNA, 19 bp, Homo sapiens
ggtgattcttacatatgat

SEQ ID NO: 6343378 - DNA, 22 bp, Homo sapiens
ggtgattgtatgaagtttgaat

SEQ ID NO: 6343379 - DNA, 20 bp, Homo sapiens
ggtgatttagcaggaagctg

SEQ ID NO: 6343380 - DNA, 12 bp, Homo sapiens
ggtgatttcctc

SEQ ID NO: 6343381 - DNA, 18 bp, Homo sapiens
ggtgattttcctgtgtcc

SEQ ID NO: 6343382 - DNA, 12 bp, Homo sapiens
ggtgcaaaaaaa

SEQ ID NO: 6343383 - DNA, 23 bp, Homo sapiens
ggtgcaaaaactcttatggccaa

SEQ ID NO: 6343384 - DNA, 16 bp, Homo sapiens
ggtgcaaagactctga

SEQ ID NO: 6343385 - DNA, 20 bp, Homo sapiens
ggtgcaaagactctgagcca

SEQ ID NO: 6343386 - DNA, 17 bp, Homo sapiens
ggtgcaaagtattgtaa

SEQ ID NO: 6343387 - DNA, 18 bp, Homo sapiens
ggtgcaaagttccctact

SEQ ID NO: 6343388 - DNA, 12 bp, Homo sapiens
ggtgcaaccagg

SEQ ID NO: 6343389 - DNA, 16 bp, Homo sapiens
ggtgcaacccttaccc

SEQ ID NO: 6343390 - DNA, 18 bp, Homo sapiens
ggtgcaagagacagagcc

SEQ ID NO: 6343391 - DNA, 14 bp, Homo sapiens
ggtgcaagcactcg

SEQ ID NO: 6343392 - DNA, 13 bp, Homo sapiens
ggtgcaaggaaaa

SEQ ID NO: 6343393 - DNA, 12 bp, Homo sapiens
ggtgcaatgacc

SEQ ID NO: 6343394 - DNA, 13 bp, Homo sapiens
ggtgcaatgacct

SEQ ID NO: 6343395 - DNA, 13 bp, Homo sapiens
ggtgcaatttcaa

SEQ ID NO: 6343396 - DNA, 21 bp, Homo sapiens
ggtgcacacatcaccaggtgc

SEQ ID NO: 6343397 - DNA, 22 bp, Homo sapiens
ggtgcacagcacaaattagtta

SEQ ID NO: 6343398 - DNA, 23 bp, Homo sapiens
ggtgcacaggcctctgcctgctg

SEQ ID NO: 6343399 - DNA, 13 bp, Homo sapiens
ggtgcacatgaca

SEQ ID NO: 6343400 - DNA, 14 bp, Homo sapiens
ggtgcacccacctg

SEQ ID NO: 6343401 - DNA, 15 bp, Homo sapiens
ggtgcacccacctgt

SEQ ID NO: 6343402 - DNA, 22 bp, Homo sapiens
ggtgcacccacctgttttctga

SEQ ID NO: 6343403 - DNA, 20 bp, Homo sapiens
ggtgcacccactcaccaggg

SEQ ID NO: 6343404 - DNA, 16 bp, Homo sapiens
ggtgcacgcaggcaca

SEQ ID NO: 6343405 - DNA, 19 bp, Homo sapiens
ggtgcacgcaggcacagca

SEQ ID NO: 6343406 - DNA, 21 bp, Homo sapiens
ggtgcacgccaccacacctgg

SEQ ID NO: 6343407 - DNA, 17 bp, Homo sapiens
ggtgcacgcctgagcgt

SEQ ID NO: 6343408 - DNA, 13 bp, Homo sapiens
ggtgcactccaga

SEQ ID NO: 6343409 - DNA, 16 bp, Homo sapiens
ggtgcactccagactc

SEQ ID NO: 6343410 - DNA, 21 bp, Homo sapiens
ggtgcactccagactctgggg

SEQ ID NO: 6343411 - DNA, 14 bp, Homo sapiens
ggtgcactgggagg

SEQ ID NO: 6343412 - DNA, 19 bp, Homo sapiens
ggtgcagacaatcttctgt

SEQ ID NO: 6343413 - DNA, 23 bp, Homo sapiens
ggtgcagacagaagtctcctcaa

SEQ ID NO: 6343414 - DNA, 18 bp, Homo sapiens
ggtgcagacgcggcgggg

SEQ ID NO: 6343415 - DNA, 19 bp, Homo sapiens
ggtgcagagaagctggact

SEQ ID NO: 6343416 - DNA, 16 bp, Homo sapiens
ggtgcagagctgaaga

SEQ ID NO: 6343417 - DNA, 14 bp, Homo sapiens
ggtgcagaggctgt

SEQ ID NO: 6343418 - DNA, 19 bp, Homo sapiens
ggtgcagaggtaccctggg

SEQ ID NO: 6343419 - DNA, 18 bp, Homo sapiens
ggtgcagaggtgagcaga

SEQ ID NO: 6343420 - DNA, 19 bp, Homo sapiens
ggtgcagagtgcccagaac

SEQ ID NO: 6343421 - DNA, 21 bp, Homo sapiens
ggtgcagatggtactgctgag

SEQ ID NO: 6343422 - DNA, 15 bp, Homo sapiens
ggtgcagcagtgagg

SEQ ID NO: 6343423 - DNA, 19 bp, Homo sapiens
gtttcacagtttgaaataa

SEQ ID NO: 6343424 - DNA, 16 bp, Homo sapiens
gtttcaccatgttagc

SEQ ID NO: 6343425 - DNA, 12 bp, Homo sapiens
gtttcaccattt

SEQ ID NO: 6343426 - DNA, 18 bp, Homo sapiens
gtttcaccgtgttagcca

SEQ ID NO: 6343427 - DNA, 15 bp, Homo sapiens
gtttcaccttccctc

SEQ ID NO: 6343428 - DNA, 15 bp, Homo sapiens
gtttcactccaccat

SEQ ID NO: 6343429 - DNA, 14 bp, Homo sapiens
gtttcactgagagc

SEQ ID NO: 6343430 - DNA, 21 bp, Homo sapiens
gtttcactgccaacttttagt

SEQ ID NO: 6343431 - DNA, 19 bp, Homo sapiens
gtttcactgtgttggccag

SEQ ID NO: 6343432 - DNA, 17 bp, Homo sapiens
gtttcacttaatgtttc

SEQ ID NO: 6343433 - DNA, 21 bp, Homo sapiens
gtttcactttcacatagatgt

SEQ ID NO: 6343434 - DNA, 11 bp, Homo sapiens
gtttcagaaat

SEQ ID NO: 6343435 - DNA, 21 bp, Homo sapiens
gtttcagaaattctcaaaata

SEQ ID NO: 6343436 - DNA, 15 bp, Homo sapiens
gtttcagaagcccca

SEQ ID NO: 6343437 - DNA, 13 bp, Homo sapiens
gtttcagaataaa

SEQ ID NO: 6343438 - DNA, 15 bp, Homo sapiens
gtttcagaataaaat

SEQ ID NO: 6343439 - DNA, 13 bp, Homo sapiens
gtttcagaccccc

SEQ ID NO: 6343440 - DNA, 20 bp, Homo sapiens
gtttcagataaatcatgggc

SEQ ID NO: 6343441 - DNA, 16 bp, Homo sapiens
gtttcagatatatatc

SEQ ID NO: 6343442 - DNA, 17 bp, Homo sapiens
gtttcagatatatatca

SEQ ID NO: 6343443 - DNA, 12 bp, Homo sapiens
gtttcagatgag

SEQ ID NO: 6343444 - DNA, 12 bp, Homo sapiens
gtttcagcacta

SEQ ID NO: 6343445 - DNA, 18 bp, Homo sapiens
gtttcagccaaggggctg

SEQ ID NO: 6343446 - DNA, 18 bp, Homo sapiens
gtttcagcgactccgttg

SEQ ID NO: 6343447 - DNA, 21 bp, Homo sapiens
gtttcagctaagggaagacat

SEQ ID NO: 6343448 - DNA, 22 bp, Homo sapiens
gtttcagctaagggaagacatt

SEQ ID NO: 6343449 - DNA, 14 bp, Homo sapiens
gtttcagctgacca

SEQ ID NO: 6343450 - DNA, 18 bp, Homo sapiens
gtttcagctgaccagaag

SEQ ID NO: 6343451 - DNA, 20 bp, Homo sapiens
gtttcagctggaaacttctg

SEQ ID NO: 6343452 - DNA, 22 bp, Homo sapiens
gtttcaggagagagttgaacct

SEQ ID NO: 6343453 - DNA, 12 bp, Homo sapiens
gtttcagggctg

SEQ ID NO: 6343454 - DNA, 15 bp, Homo sapiens
gtttcaggtgacatg

SEQ ID NO: 6343455 - DNA, 20 bp, Homo sapiens
gtttcaggtggaacaggagg

SEQ ID NO: 6343456 - DNA, 22 bp, Homo sapiens
gtttcagtaataaaacatcttt

SEQ ID NO: 6343457 - DNA, 18 bp, Homo sapiens
gtttcagtaatagctgaa

SEQ ID NO: 6343458 - DNA, 23 bp, Homo sapiens
gtttcagtgaagatgctgtaaat

SEQ ID NO: 6343459 - DNA, 21 bp, Homo sapiens
gtttcagtgtcaaataaacac

SEQ ID NO: 6343460 - DNA, 16 bp, Homo sapiens
gtttcagttctgtgta

SEQ ID NO: 6343461 - DNA, 18 bp, Homo sapiens
gtttcagtttttttaaat

SEQ ID NO: 6343462 - DNA, 20 bp, Homo sapiens
gtttcagtttttttaaatgc

SEQ ID NO: 6343463 - DNA, 18 bp, Homo sapiens
gtttcataagctttgtaa

SEQ ID NO: 6343464 - DNA, 18 bp, Homo sapiens
gtttcataattgtgtact

SEQ ID NO: 6343465 - DNA, 17 bp, Homo sapiens
gtttcatactctagatt

SEQ ID NO: 6343466 - DNA, 17 bp, Homo sapiens
gtttcataggagacaca

SEQ ID NO: 6343467 - DNA, 22 bp, Homo sapiens
gtttcatatataagactgctgc

SEQ ID NO: 6343468 - DNA, 16 bp, Homo sapiens
gtttcatccttttcat

SEQ ID NO: 6343469 - DNA, 12 bp, Homo sapiens
gtttcatctggt

SEQ ID NO: 6343470 - DNA, 19 bp, Homo sapiens
gtttcatgaagaaaaaatt

SEQ ID NO: 6343471 - DNA, 19 bp, Homo sapiens
gtttcatgtatgtatataa

SEQ ID NO: 6343472 - DNA, 21 bp, Homo sapiens
gtttcatgttagttaccttat

SEQ ID NO: 6343473 - DNA, 15 bp, Homo sapiens
gtttcatgttctgtg

SEQ ID NO: 6343474 - DNA, 17 bp, Homo sapiens
gtttcatgttctgtgtc

SEQ ID NO: 6343475 - DNA, 21 bp, Homo sapiens
gtttcatgttggatctgtcat

SEQ ID NO: 6343476 - DNA, 23 bp, Homo sapiens
gtttcattactgcccagatgttt

SEQ ID NO: 6343477 - DNA, 13 bp, Homo sapiens
gtttcattcactg

SEQ ID NO: 6343478 - DNA, 14 bp, Homo sapiens
gtttcattcactgt

SEQ ID NO: 6343479 - DNA, 16 bp, Homo sapiens
gtttcattcatcctga

SEQ ID NO: 6343480 - DNA, 13 bp, Homo sapiens
gtttcattctaaa

SEQ ID NO: 6343481 - DNA, 17 bp, Homo sapiens
gtttcattctaaaatca

SEQ ID NO: 6343482 - DNA, 15 bp, Homo sapiens
gtttcattctcctgc

SEQ ID NO: 6343483 - DNA, 19 bp, Homo sapiens
gtttcatttagtcatgtga

SEQ ID NO: 6343484 - DNA, 18 bp, Homo sapiens
gtttcatttatgatacaa

SEQ ID NO: 6343485 - DNA, 19 bp, Homo sapiens
gtttcatttctactgtgac

SEQ ID NO: 6343486 - DNA, 14 bp, Homo sapiens
gtttcatttctgca

SEQ ID NO: 6343487 - DNA, 15 bp, Homo sapiens
gtttcatttcttatc

SEQ ID NO: 6343488 - DNA, 22 bp, Homo sapiens
gtttccaaaaaggaacactgga

SEQ ID NO: 6343489 - DNA, 15 bp, Homo sapiens
gtttccaagaaattt

SEQ ID NO: 6343490 - DNA, 21 bp, Homo sapiens
gtttccaagcctgggccactg

SEQ ID NO: 6343491 - DNA, 23 bp, Homo sapiens
gtttccaagcctgggccactggc

SEQ ID NO: 6343492 - DNA, 24 bp, Homo sapiens
gtttccaagcctgggccactggca

SEQ ID NO: 6343493 - DNA, 15 bp, Homo sapiens
gtttccaaggagctg

SEQ ID NO: 6343494 - DNA, 15 bp, Homo sapiens
gtttccacacagcct

SEQ ID NO: 6343495 - DNA, 15 bp, Homo sapiens
gtttccacacaggcc

SEQ ID NO: 6343496 - DNA, 23 bp, Homo sapiens
gtttccacacaggcccatgccct

SEQ ID NO: 6343497 - DNA, 13 bp, Homo sapiens
gtttccacatgct

SEQ ID NO: 6343498 - DNA, 14 bp, Homo sapiens
gtttccacatgctc

SEQ ID NO: 6343499 - DNA, 16 bp, Homo sapiens
gtttccagaaaatata

SEQ ID NO: 6343500 - DNA, 20 bp, Homo sapiens
gtttccagaaaatataaatg

SEQ ID NO: 6343501 - DNA, 22 bp, Homo sapiens
gtttccagaaaatataaatgca

SEQ ID NO: 6343502 - DNA, 19 bp, Homo sapiens
gtttccagcattcccaggt

SEQ ID NO: 6343503 - DNA, 14 bp, Homo sapiens
gtttccaggaaaat

SEQ ID NO: 6343504 - DNA, 14 bp, Homo sapiens
gtttccagggaggg

SEQ ID NO: 6343505 - DNA, 18 bp, Homo sapiens
gtttccatcaaagccctc

SEQ ID NO: 6343506 - DNA, 16 bp, Homo sapiens
gtttccatcatgtctg

SEQ ID NO: 6343507 - DNA, 17 bp, Homo sapiens
gtttccatcatttctgt

SEQ ID NO: 6343508 - DNA, 18 bp, Homo sapiens
gtttccatcctttgcatt

SEQ ID NO: 6343509 - DNA, 22 bp, Homo sapiens
gtttccatgggtcaaagccggt

SEQ ID NO: 6343510 - DNA, 13 bp, Homo sapiens
gtttccatttact

SEQ ID NO: 6343511 - DNA, 21 bp, Homo sapiens
gtttccatttctcaatcagtg

SEQ ID NO: 6343512 - DNA, 22 bp, Homo sapiens
gtttcccaaaaaccccagtgtt

SEQ ID NO: 6343513 - DNA, 20 bp, Homo sapiens
gtttcccaaattccctggac

SEQ ID NO: 6343514 - DNA, 20 bp, Homo sapiens
gtttcccagtgagcctctgc

SEQ ID NO: 6343515 - DNA, 21 bp, Homo sapiens
gtttcccataattttcttcat

SEQ ID NO: 6343516 - DNA, 16 bp, Homo sapiens
gtttcccattggttca

SEQ ID NO: 6343517 - DNA, 22 bp, Homo sapiens
gtttcccatttgttgctgctgc

SEQ ID NO: 6343518 - DNA, 14 bp, Homo sapiens
gtttccccagggaa

SEQ ID NO: 6343519 - DNA, 18 bp, Homo sapiens
gtttccccatctctgtct

SEQ ID NO: 6343520 - DNA, 22 bp, Homo sapiens
gtttcccccacagttttaataa

SEQ ID NO: 6343521 - DNA, 21 bp, Homo sapiens
gtttcccctagcttactgata

SEQ ID NO: 6343522 - DNA, 21 bp, Homo sapiens
gtttcccctctcatctgacct

SEQ ID NO: 6343523 - DNA, 14 bp, Homo sapiens
gtttcccctctggc

SEQ ID NO: 6343524 - DNA, 14 bp, Homo sapiens
gtttcccctttctt

SEQ ID NO: 6343525 - DNA, 22 bp, Homo sapiens
gtttcccgccaggaggtcctcc

SEQ ID NO: 6343526 - DNA, 17 bp, Homo sapiens
gtttcccggtgacacat

SEQ ID NO: 6343527 - DNA, 15 bp, Homo sapiens
gtttcccgtaaggct

SEQ ID NO: 6343528 - DNA, 18 bp, Homo sapiens
gtttccctactgaagccc

SEQ ID NO: 6343529 - DNA, 16 bp, Homo sapiens
gtttccctatctgcaa

SEQ ID NO: 6343530 - DNA, 11 bp, Homo sapiens
gtttccctcca

SEQ ID NO: 6343531 - DNA, 13 bp, Homo sapiens
gtttccctccagg

SEQ ID NO: 6343532 - DNA, 14 bp, Homo sapiens
gtttccctccaggt

SEQ ID NO: 6343533 - DNA, 13 bp, Homo sapiens
gtttccctctcct

SEQ ID NO: 6343534 - DNA, 15 bp, Homo sapiens
gtttcccttgccctt

SEQ ID NO: 6343535 - DNA, 18 bp, Homo sapiens
gtttcccttttcctctag

SEQ ID NO: 6343536 - DNA, 16 bp, Homo sapiens
gtttccgcccccgccc

SEQ ID NO: 6343537 - DNA, 14 bp, Homo sapiens
gtttccgctttgct

SEQ ID NO: 6343538 - DNA, 21 bp, Homo sapiens
gtttccgtggcaaccctcagc

SEQ ID NO: 6343539 - DNA, 22 bp, Homo sapiens
gtttcctagctaggagcaggct

SEQ ID NO: 6343540 - DNA, 14 bp, Homo sapiens
gtttcctcaggctg

SEQ ID NO: 6343541 - DNA, 18 bp, Homo sapiens
gtttcctcaggctgctgg

SEQ ID NO: 6343542 - DNA, 22 bp, Homo sapiens
gtttcctcaggctgctggagga

SEQ ID NO: 6343543 - DNA, 14 bp, Homo sapiens
gtttcctcagtgat

SEQ ID NO: 6343544 - DNA, 22 bp, Homo sapiens
gtttcctcagtgatggaatatc

SEQ ID NO: 6343545 - DNA, 23 bp, Homo sapiens
gtttcctcatctatggttctaaa

SEQ ID NO: 6343546 - DNA, 20 bp, Homo sapiens
gtttcctccatttgagaaaa

SEQ ID NO: 6343547 - DNA, 22 bp, Homo sapiens
gtttcctccttgtcactgaaga

SEQ ID NO: 6343548 - DNA, 12 bp, Homo sapiens
gtttcctctaaa

SEQ ID NO: 6343549 - DNA, 14 bp, Homo sapiens
gtttcctgaaatat

SEQ ID NO: 6343550 - DNA, 15 bp, Homo sapiens
gtttcctgcaggcat

SEQ ID NO: 6343551 - DNA, 16 bp, Homo sapiens
gtttcctgcaggccag

SEQ ID NO: 6343552 - DNA, 20 bp, Homo sapiens
gtttcctgcccagcctgggg

SEQ ID NO: 6343553 - DNA, 22 bp, Homo sapiens
gtttcctgccctgggaggcagt

SEQ ID NO: 6343554 - DNA, 17 bp, Homo sapiens
gtttcctgctccagtgt

SEQ ID NO: 6343555 - DNA, 13 bp, Homo sapiens
gtttcctgctgct

SEQ ID NO: 6343556 - DNA, 15 bp, Homo sapiens
gtttcctggaagcag

SEQ ID NO: 6343557 - DNA, 20 bp, Homo sapiens
gtttcctggaagcagagcaa

SEQ ID NO: 6343558 - DNA, 22 bp, Homo sapiens
gtttcctggcactgcttccagt

SEQ ID NO: 6343559 - DNA, 17 bp, Homo sapiens
gtttcctggcactggac

SEQ ID NO: 6343560 - DNA, 19 bp, Homo sapiens
gtttcctggcactggaccc

SEQ ID NO: 6343561 - DNA, 15 bp, Homo sapiens
gtttcctggcctcag

SEQ ID NO: 6343562 - DNA, 19 bp, Homo sapiens
gtttcctggcctcagagct

SEQ ID NO: 6343563 - DNA, 21 bp, Homo sapiens
gtttcctgggtgccctggctc

SEQ ID NO: 6343564 - DNA, 21 bp, Homo sapiens
gtttcctgtgcccatcatctc

SEQ ID NO: 6343565 - DNA, 19 bp, Homo sapiens
gtttcctgtgtctccaagc

SEQ ID NO: 6343566 - DNA, 18 bp, Homo sapiens
gtttcctgttctcttgta

SEQ ID NO: 6343567 - DNA, 17 bp, Homo sapiens
gtttccttattccacag

SEQ ID NO: 6343568 - DNA, 20 bp, Homo sapiens
gtttccttgttggtcagagg

SEQ ID NO: 6343569 - DNA, 22 bp, Homo sapiens
gtttcctttaccttttctataa

SEQ ID NO: 6343570 - DNA, 23 bp, Homo sapiens
gtttcctttcatttactgtggct

SEQ ID NO: 6343571 - DNA, 22 bp, Homo sapiens
gtttccttttattctgtacctt

SEQ ID NO: 6343572 - DNA, 15 bp, Homo sapiens
gtttccttttttccc

SEQ ID NO: 6343573 - DNA, 22 bp, Homo sapiens
gtttcgactggtccagctctga

SEQ ID NO: 6343574 - DNA, 17 bp, Homo sapiens
gtttcgagaagctgctc

SEQ ID NO: 6343575 - DNA, 20 bp, Homo sapiens
gtttcgcattaagcacacac

SEQ ID NO: 6343576 - DNA, 20 bp, Homo sapiens
gtttcgctccatcgcccagg

SEQ ID NO: 6343577 - DNA, 17 bp, Homo sapiens
gtttcggggtgaagcaa

SEQ ID NO: 6343578 - DNA, 23 bp, Homo sapiens
gtttcggggtgaagcaagttcac

SEQ ID NO: 6343579 - DNA, 15 bp, Homo sapiens
gtttcgtggggaggt

SEQ ID NO: 6343580 - DNA, 16 bp, Homo sapiens
gtttcgttgcatggta

SEQ ID NO: 6343581 - DNA, 16 bp, Homo sapiens
gtttctaagattctaa

SEQ ID NO: 6343582 - DNA, 20 bp, Homo sapiens
gtttctaagattctaaaggt

SEQ ID NO: 6343583 - DNA, 13 bp, Homo sapiens
gtttctaagcagt

SEQ ID NO: 6343584 - DNA, 18 bp, Homo sapiens
gtttctaaggactttttc

SEQ ID NO: 6343585 - DNA, 22 bp, Homo sapiens
gtttctaaggtccggtgttcta

SEQ ID NO: 6343586 - DNA, 18 bp, Homo sapiens
gtttctaataaacttgga

SEQ ID NO: 6343587 - DNA, 17 bp, Homo sapiens
gtttctaatttgctgct

SEQ ID NO: 6343588 - DNA, 18 bp, Homo sapiens
gtttctaatttgctgctg

SEQ ID NO: 6343589 - DNA, 14 bp, Homo sapiens
gtttctacattctc

SEQ ID NO: 6343590 - DNA, 17 bp, Homo sapiens
gtttctacctatatgca

SEQ ID NO: 6343591 - DNA, 15 bp, Homo sapiens
gtttctacctcccag

SEQ ID NO: 6343592 - DNA, 20 bp, Homo sapiens
gtttctacttcccctgggat

SEQ ID NO: 6343593 - DNA, 16 bp, Homo sapiens
gtttctagaggcctca

SEQ ID NO: 6343594 - DNA, 18 bp, Homo sapiens
gtttctagaggcctcagt

SEQ ID NO: 6343595 - DNA, 15 bp, Homo sapiens
gtttctagagggcac

SEQ ID NO: 6343596 - DNA, 16 bp, Homo sapiens
gtttctagagggcact

SEQ ID NO: 6343597 - DNA, 21 bp, Homo sapiens
gtttctagcatgaagacagag

SEQ ID NO: 6343598 - DNA, 15 bp, Homo sapiens
gtttctagctctcac

SEQ ID NO: 6343599 - DNA, 21 bp, Homo sapiens
gtttctagggtgggccccagc

SEQ ID NO: 6343600 - DNA, 19 bp, Homo sapiens
gtttctatactgtttgtaa

SEQ ID NO: 6343601 - DNA, 14 bp, Homo sapiens
ggtgcagccccagg

SEQ ID NO: 6343602 - DNA, 15 bp, Homo sapiens
ggtgcagccccaggg

SEQ ID NO: 6343603 - DNA, 19 bp, Homo sapiens
ggtgcagccttcccctccc

SEQ ID NO: 6343604 - DNA, 21 bp, Homo sapiens
ggtgcagccttcccctccctg

SEQ ID NO: 6343605 - DNA, 21 bp, Homo sapiens
ggtgcagcggtggaaggagcc

SEQ ID NO: 6343606 - DNA, 13 bp, Homo sapiens
ggtgcagctgcgt

SEQ ID NO: 6343607 - DNA, 14 bp, Homo sapiens
ggtgcagctgggct

SEQ ID NO: 6343608 - DNA, 17 bp, Homo sapiens
ggtgcaggcagccttga

SEQ ID NO: 6343609 - DNA, 14 bp, Homo sapiens
ggtgcagggaccaa

SEQ ID NO: 6343610 - DNA, 12 bp, Homo sapiens
ggtgcagggaga

SEQ ID NO: 6343611 - DNA, 21 bp, Homo sapiens
ggtgcagggagacatctgcac

SEQ ID NO: 6343612 - DNA, 22 bp, Homo sapiens
ggtgcagggagacatctgcacc

SEQ ID NO: 6343613 - DNA, 14 bp, Homo sapiens
ggtgcagggcctgg

SEQ ID NO: 6343614 - DNA, 20 bp, Homo sapiens
ggtgcaggtctccacctgca

SEQ ID NO: 6343615 - DNA, 13 bp, Homo sapiens
ggtgcaggtgggg

SEQ ID NO: 6343616 - DNA, 18 bp, Homo sapiens
ggtgcagtaaccatttaa

SEQ ID NO: 6343617 - DNA, 17 bp, Homo sapiens
ggtgcagtttgaggggc

SEQ ID NO: 6343618 - DNA, 18 bp, Homo sapiens
ggtgcatagaactgggta

SEQ ID NO: 6343619 - DNA, 12 bp, Homo sapiens
ggtgcatcctcc

SEQ ID NO: 6343620 - DNA, 20 bp, Homo sapiens
ggtgcatcctcctcagcccc

SEQ ID NO: 6343621 - DNA, 16 bp, Homo sapiens
ggtgcatctgcaggca

SEQ ID NO: 6343622 - DNA, 11 bp, Homo sapiens
ggtgcatctgg

SEQ ID NO: 6343623 - DNA, 13 bp, Homo sapiens
ggtgcatctggca

SEQ ID NO: 6343624 - DNA, 16 bp, Homo sapiens
ggtgcatctggcacgt

SEQ ID NO: 6343625 - DNA, 20 bp, Homo sapiens
ggtgcatctggcacgtggcc

SEQ ID NO: 6343626 - DNA, 22 bp, Homo sapiens
ggtgcatctggcacgtggccag

SEQ ID NO: 6343627 - DNA, 17 bp, Homo sapiens
ggtgcatgatcttgagc

SEQ ID NO: 6343628 - DNA, 18 bp, Homo sapiens
ggtgcatgccgggaccat

SEQ ID NO: 6343629 - DNA, 21 bp, Homo sapiens
ggtgcatggcttggggagcag

SEQ ID NO: 6343630 - DNA, 19 bp, Homo sapiens
ggtgcattctgtttcctct

SEQ ID NO: 6343631 - DNA, 15 bp, Homo sapiens
ggtgcattgctgtgt

SEQ ID NO: 6343632 - DNA, 22 bp, Homo sapiens
ggtgcattgctgtgtgaatcca

SEQ ID NO: 6343633 - DNA, 23 bp, Homo sapiens
ggtgcattgtccttttcttttct

SEQ ID NO: 6343634 - DNA, 19 bp, Homo sapiens
ggtgcatttgagagaagcc

SEQ ID NO: 6343635 - DNA, 21 bp, Homo sapiens
ggtgcatttgagagaagccac

SEQ ID NO: 6343636 - DNA, 17 bp, Homo sapiens
ggtgccaaaaccaggcc

SEQ ID NO: 6343637 - DNA, 23 bp, Homo sapiens
ggtgccaaacaaaaaggttctca

SEQ ID NO: 6343638 - DNA, 21 bp, Homo sapiens
ggtgccaaacccagcccctgc

SEQ ID NO: 6343639 - DNA, 21 bp, Homo sapiens
ggtgccaaatagccccagact

SEQ ID NO: 6343640 - DNA, 15 bp, Homo sapiens
ggtgccaactggtgt

SEQ ID NO: 6343641 - DNA, 23 bp, Homo sapiens
ggtgccaagggccccaggggcag

SEQ ID NO: 6343642 - DNA, 12 bp, Homo sapiens
ggtgccaccaat

SEQ ID NO: 6343643 - DNA, 18 bp, Homo sapiens
ggtgccaccaataaaaat

SEQ ID NO: 6343644 - DNA, 23 bp, Homo sapiens
ggtgccaccaataaaaatcctac

SEQ ID NO: 6343645 - DNA, 10 bp, Homo sapiens
ggtgccacct

SEQ ID NO: 6343646 - DNA, 13 bp, Homo sapiens
ggtgccactccct

SEQ ID NO: 6343647 - DNA, 19 bp, Homo sapiens
ggtgccactccctgagctt

SEQ ID NO: 6343648 - DNA, 22 bp, Homo sapiens
ggtgccacttcttaaaggcctg

SEQ ID NO: 6343649 - DNA, 12 bp, Homo sapiens
ggtgccagaagc

SEQ ID NO: 6343650 - DNA, 12 bp, Homo sapiens
ggtgccagaggt

SEQ ID NO: 6343651 - DNA, 17 bp, Homo sapiens
ggtgccagcaaagcccc

SEQ ID NO: 6343652 - DNA, 14 bp, Homo sapiens
ggtgccagcaactg

SEQ ID NO: 6343653 - DNA, 15 bp, Homo sapiens
ggtgccagcaactga

SEQ ID NO: 6343654 - DNA, 15 bp, Homo sapiens
ggtgccagccttcct

SEQ ID NO: 6343655 - DNA, 22 bp, Homo sapiens
ggtgccagctgcccttgcaggg

SEQ ID NO: 6343656 - DNA, 20 bp, Homo sapiens
ggtgccaggcgcgtgtaaat

SEQ ID NO: 6343657 - DNA, 13 bp, Homo sapiens
ggtgccagggccc

SEQ ID NO: 6343658 - DNA, 23 bp, Homo sapiens
ggtgccagggcccaccccagcct

SEQ ID NO: 6343659 - DNA, 13 bp, Homo sapiens
ggtgccagggtgg

SEQ ID NO: 6343660 - DNA, 21 bp, Homo sapiens
ggtgccaggttttctgggtgt

SEQ ID NO: 6343661 - DNA, 19 bp, Homo sapiens
ggtgccagtcctcctcagg

SEQ ID NO: 6343662 - DNA, 15 bp, Homo sapiens
ggtgccagttatggc

SEQ ID NO: 6343663 - DNA, 16 bp, Homo sapiens
ggtgccatgcctgctc

SEQ ID NO: 6343664 - DNA, 21 bp, Homo sapiens
ggtgccatgcctgctccctgt

SEQ ID NO: 6343665 - DNA, 21 bp, Homo sapiens
ggtgcccacaaaatagagatt

SEQ ID NO: 6343666 - DNA, 14 bp, Homo sapiens
ggtgcccacagcag

SEQ ID NO: 6343667 - DNA, 18 bp, Homo sapiens
ggtgcccaccagctggct

SEQ ID NO: 6343668 - DNA, 19 bp, Homo sapiens
ggtgcccaccagctggctc

SEQ ID NO: 6343669 - DNA, 21 bp, Homo sapiens
ggtgcccaccagctggctctg

SEQ ID NO: 6343670 - DNA, 17 bp, Homo sapiens
ggtgcccactccgccag

SEQ ID NO: 6343671 - DNA, 19 bp, Homo sapiens
ggtgcccactccgccagcc

SEQ ID NO: 6343672 - DNA, 22 bp, Homo sapiens
ggtgcccactccgccagccaca

SEQ ID NO: 6343673 - DNA, 23 bp, Homo sapiens
ggtgcccactccgccagccacag

SEQ ID NO: 6343674 - DNA, 12 bp, Homo sapiens
ggtgcccaggag

SEQ ID NO: 6343675 - DNA, 13 bp, Homo sapiens
ggtgcccaggaga

SEQ ID NO: 6343676 - DNA, 12 bp, Homo sapiens
ggtgcccagggc

SEQ ID NO: 6343677 - DNA, 14 bp, Homo sapiens
ggtgcccagggcca

SEQ ID NO: 6343678 - DNA, 15 bp, Homo sapiens
ggtgcccatcctgcc

SEQ ID NO: 6343679 - DNA, 16 bp, Homo sapiens
ggtgcccatcctgcca

SEQ ID NO: 6343680 - DNA, 22 bp, Homo sapiens
ggtgccccacaaggcccagccc

SEQ ID NO: 6343681 - DNA, 15 bp, Homo sapiens
ggtgccccacagcta

SEQ ID NO: 6343682 - DNA, 15 bp, Homo sapiens
ggtgccccacctgcc

SEQ ID NO: 6343683 - DNA, 12 bp, Homo sapiens
ggtgccccagct

SEQ ID NO: 6343684 - DNA, 22 bp, Homo sapiens
ggtgccccaggaccagctcagg

SEQ ID NO: 6343685 - DNA, 20 bp, Homo sapiens
ggtgccccaggatgccacgc

SEQ ID NO: 6343686 - DNA, 20 bp, Homo sapiens
ggtgcccccagacagctgct

SEQ ID NO: 6343687 - DNA, 22 bp, Homo sapiens
ggtgccccccacccctggaaga

SEQ ID NO: 6343688 - DNA, 19 bp, Homo sapiens
ggtgccccccatgccctcc

SEQ ID NO: 6343689 - DNA, 22 bp, Homo sapiens
ggtgccccctcctctcccatcc

SEQ ID NO: 6343690 - DNA, 23 bp, Homo sapiens
ggtgccccctcctctcccatccc

SEQ ID NO: 6343691 - DNA, 18 bp, Homo sapiens
ggtgccccgactgtggga

SEQ ID NO: 6343692 - DNA, 23 bp, Homo sapiens
ggtgcccctcgccagcttctcct

SEQ ID NO: 6343693 - DNA, 23 bp, Homo sapiens
ggtgcccctcttccaaaggcagc

SEQ ID NO: 6343694 - DNA, 22 bp, Homo sapiens
ggtgcccctgctcactgggccc

SEQ ID NO: 6343695 - DNA, 21 bp, Homo sapiens
ggtgcccgagtgcggcgtgga

SEQ ID NO: 6343696 - DNA, 22 bp, Homo sapiens
ggtgcccgcgccaggccctcag

SEQ ID NO: 6343697 - DNA, 19 bp, Homo sapiens
ggtgcccgtaatcccagct

SEQ ID NO: 6343698 - DNA, 15 bp, Homo sapiens
ggtgcccgtgtggcc

SEQ ID NO: 6343699 - DNA, 17 bp, Homo sapiens
ggtgcccgtgtggcctg

SEQ ID NO: 6343700 - DNA, 19 bp, Homo sapiens
ggtgcccgtgtggcctggg

SEQ ID NO: 6343701 - DNA, 18 bp, Homo sapiens
ggtgccctcccagacccc

SEQ ID NO: 6343702 - DNA, 21 bp, Homo sapiens
ggtgccctcccagaccccctt

SEQ ID NO: 6343703 - DNA, 19 bp, Homo sapiens
ggtgccctctgctcaggcc

SEQ ID NO: 6343704 - DNA, 22 bp, Homo sapiens
ggtgccctctgctcaggcctcc

SEQ ID NO: 6343705 - DNA, 12 bp, Homo sapiens
ggtgccctgcat

SEQ ID NO: 6343706 - DNA, 19 bp, Homo sapiens
ggtgccctgctttcagata

SEQ ID NO: 6343707 - DNA, 15 bp, Homo sapiens
ggtgccctggatgcc

SEQ ID NO: 6343708 - DNA, 18 bp, Homo sapiens
ggtgccctggatgcccag

SEQ ID NO: 6343709 - DNA, 19 bp, Homo sapiens
ggtgccctggcccagcctg

SEQ ID NO: 6343710 - DNA, 21 bp, Homo sapiens
ggtgccctggcccagcctgtg

SEQ ID NO: 6343711 - DNA, 22 bp, Homo sapiens
ggtgccctggcccagcctgtgg

SEQ ID NO: 6343712 - DNA, 14 bp, Homo sapiens
ggtgccctttcctg

SEQ ID NO: 6343713 - DNA, 19 bp, Homo sapiens
ggtgccctttcctggcagt

SEQ ID NO: 6343714 - DNA, 14 bp, Homo sapiens
ggtgccgcctgccc

SEQ ID NO: 6343715 - DNA, 19 bp, Homo sapiens
ggtgccgctgtctctgagg

SEQ ID NO: 6343716 - DNA, 21 bp, Homo sapiens
ggtgccggcatctcccctagc

SEQ ID NO: 6343717 - DNA, 18 bp, Homo sapiens
ggtgccggggaggggcag

SEQ ID NO: 6343718 - DNA, 17 bp, Homo sapiens
ggtgccggtaccagcct

SEQ ID NO: 6343719 - DNA, 17 bp, Homo sapiens
ggtgcctaacctgggac

SEQ ID NO: 6343720 - DNA, 21 bp, Homo sapiens
ggtgcctaggattgtgcctgt

SEQ ID NO: 6343721 - DNA, 17 bp, Homo sapiens
ggtgcctagtattgaca

SEQ ID NO: 6343722 - DNA, 17 bp, Homo sapiens
ggtgcctatttattggg

SEQ ID NO: 6343723 - DNA, 20 bp, Homo sapiens
ggtgcctatttattggggat

SEQ ID NO: 6343724 - DNA, 23 bp, Homo sapiens
ggtgcctcccacacttgctgggg

SEQ ID NO: 6343725 - DNA, 17 bp, Homo sapiens
ggtgcctcccagccctg

SEQ ID NO: 6343726 - DNA, 23 bp, Homo sapiens
ggtgcctcctgcagtttgggaga

SEQ ID NO: 6343727 - DNA, 16 bp, Homo sapiens
ggtgcctctgtgcaca

SEQ ID NO: 6343728 - DNA, 18 bp, Homo sapiens
ggtgcctgagaggcaggc

SEQ ID NO: 6343729 - DNA, 19 bp, Homo sapiens
ggtgcctgagaggcaggca

SEQ ID NO: 6343730 - DNA, 12 bp, Homo sapiens
ggtgcctgagcc

SEQ ID NO: 6343731 - DNA, 13 bp, Homo sapiens
ggtgcctgagccc

SEQ ID NO: 6343732 - DNA, 16 bp, Homo sapiens
ggtgcctgagcccctc

SEQ ID NO: 6343733 - DNA, 17 bp, Homo sapiens
ggtgcctgagcccctca

SEQ ID NO: 6343734 - DNA, 14 bp, Homo sapiens
ggtgcctgagctgg

SEQ ID NO: 6343735 - DNA, 22 bp, Homo sapiens
ggtgcctgagctggggcctgga

SEQ ID NO: 6343736 - DNA, 21 bp, Homo sapiens
ggtgcctgattcggctgtctc

SEQ ID NO: 6343737 - DNA, 11 bp, Homo sapiens
ggtgcctgcag

SEQ ID NO: 6343738 - DNA, 16 bp, Homo sapiens
ggtgcctgccatagcc

SEQ ID NO: 6343739 - DNA, 19 bp, Homo sapiens
ggtgcctgccatagccagg

SEQ ID NO: 6343740 - DNA, 18 bp, Homo sapiens
ggtgcctgctcaggtgct

SEQ ID NO: 6343741 - DNA, 15 bp, Homo sapiens
ggtgcctgctctcct

SEQ ID NO: 6343742 - DNA, 16 bp, Homo sapiens
ggtgcctgctctcctt

SEQ ID NO: 6343743 - DNA, 12 bp, Homo sapiens
ggtgcctgctgt

SEQ ID NO: 6343744 - DNA, 15 bp, Homo sapiens
ggtgcctggcacagc

SEQ ID NO: 6343745 - DNA, 14 bp, Homo sapiens
ggtgcctggctggg

SEQ ID NO: 6343746 - DNA, 16 bp, Homo sapiens
ggtgcctggctgggct

SEQ ID NO: 6343747 - DNA, 17 bp, Homo sapiens
ggtgcctggcttgctgt

SEQ ID NO: 6343748 - DNA, 22 bp, Homo sapiens
ggtgcctggcttgctgtggcta

SEQ ID NO: 6343749 - DNA, 17 bp, Homo sapiens
ggtgcctgggaggagtg

SEQ ID NO: 6343750 - DNA, 18 bp, Homo sapiens
ggtgcctgggaggagtgg

SEQ ID NO: 6343751 - DNA, 18 bp, Homo sapiens
ggtgcctggggctggctg

SEQ ID NO: 6343752 - DNA, 21 bp, Homo sapiens
ggtgcctggggctggctgcag

SEQ ID NO: 6343753 - DNA, 16 bp, Homo sapiens
ggtgcctgggtggcca

SEQ ID NO: 6343754 - DNA, 23 bp, Homo sapiens
ggtgcctgggtggggctgctcct

SEQ ID NO: 6343755 - DNA, 18 bp, Homo sapiens
ggtgcctgtgaggcaggg

SEQ ID NO: 6343756 - DNA, 19 bp, Homo sapiens
ggtgccttacatcttttct

SEQ ID NO: 6343757 - DNA, 16 bp, Homo sapiens
ggtgccttccaccctg

SEQ ID NO: 6343758 - DNA, 19 bp, Homo sapiens
ggtgcctttcaaatttaga

SEQ ID NO: 6343759 - DNA, 12 bp, Homo sapiens
ggtgcctttcct

SEQ ID NO: 6343760 - DNA, 17 bp, Homo sapiens
ggtgcctttcctgttca

SEQ ID NO: 6343761 - DNA, 16 bp, Homo sapiens
ggtgcctttgagttct

SEQ ID NO: 6343762 - DNA, 19 bp, Homo sapiens
ggtgcgaccccatctgccc

SEQ ID NO: 6343763 - DNA, 22 bp, Homo sapiens
ggtgcgaccccatctgcccagg

SEQ ID NO: 6343764 - DNA, 22 bp, Homo sapiens
ggtgcgagagaggtgggcagca

SEQ ID NO: 6343765 - DNA, 15 bp, Homo sapiens
ggtgcgatctgggtt

SEQ ID NO: 6343766 - DNA, 19 bp, Homo sapiens
ggtgcgcacttacctgctt

SEQ ID NO: 6343767 - DNA, 13 bp, Homo sapiens
ggtgcgctgtgct

SEQ ID NO: 6343768 - DNA, 16 bp, Homo sapiens
ggtgcggaccggagcg

SEQ ID NO: 6343769 - DNA, 15 bp, Homo sapiens
ggtgcggcaggagca

SEQ ID NO: 6343770 - DNA, 18 bp, Homo sapiens
ggtgcggcaggagcagga

SEQ ID NO: 6343771 - DNA, 15 bp, Homo sapiens
ggtgcgggcctggcc

SEQ ID NO: 6343772 - DNA, 22 bp, Homo sapiens
ggtgcggggagaagaagcggcc

SEQ ID NO: 6343773 - DNA, 16 bp, Homo sapiens
ggtgcggggcctgcag

SEQ ID NO: 6343774 - DNA, 17 bp, Homo sapiens
ggtgcggggcctgcagg

SEQ ID NO: 6343775 - DNA, 19 bp, Homo sapiens
ggtgcggtaggtgctggcc

SEQ ID NO: 6343776 - DNA, 14 bp, Homo sapiens
ggtgcgtctgggag

SEQ ID NO: 6343777 - DNA, 12 bp, Homo sapiens
ggtgcgtggctg

SEQ ID NO: 6343778 - DNA, 13 bp, Homo sapiens
ggtgcgtggctgt

SEQ ID NO: 6343779 - DNA, 18 bp, Homo sapiens
gtttctatgcaaagttct

SEQ ID NO: 6343780 - DNA, 23 bp, Homo sapiens
gtttctattctctcctcagactg

SEQ ID NO: 6343781 - DNA, 14 bp, Homo sapiens
gtttctattctgtc

SEQ ID NO: 6343782 - DNA, 17 bp, Homo sapiens
gtttctcaaagaaattt

SEQ ID NO: 6343783 - DNA, 22 bp, Homo sapiens
gtttctcaagcgctatccacag

SEQ ID NO: 6343784 - DNA, 19 bp, Homo sapiens
gtttctcacattgctgtat

SEQ ID NO: 6343785 - DNA, 19 bp, Homo sapiens
gtttctcagaatccaaaga

SEQ ID NO: 6343786 - DNA, 14 bp, Homo sapiens
gtttctcagatcct

SEQ ID NO: 6343787 - DNA, 19 bp, Homo sapiens
gtttctcagatccttgttt

SEQ ID NO: 6343788 - DNA, 21 bp, Homo sapiens
gtttctcagatccttgtttca

SEQ ID NO: 6343789 - DNA, 13 bp, Homo sapiens
gtttctcattctt

SEQ ID NO: 6343790 - DNA, 14 bp, Homo sapiens
gtttctcatttgtt

SEQ ID NO: 6343791 - DNA, 20 bp, Homo sapiens
gtttctccaagtacttttgt

SEQ ID NO: 6343792 - DNA, 15 bp, Homo sapiens
gtttctccccctggg

SEQ ID NO: 6343793 - DNA, 17 bp, Homo sapiens
gtttctccccctgggct

SEQ ID NO: 6343794 - DNA, 20 bp, Homo sapiens
gtttctccctctcactgtct

SEQ ID NO: 6343795 - DNA, 15 bp, Homo sapiens
gtttctcctcagaag

SEQ ID NO: 6343796 - DNA, 15 bp, Homo sapiens
gtttctcctgagcta

SEQ ID NO: 6343797 - DNA, 14 bp, Homo sapiens
gtttctcctggtag

SEQ ID NO: 6343798 - DNA, 17 bp, Homo sapiens
gtttctccttgaagcaa

SEQ ID NO: 6343799 - DNA, 14 bp, Homo sapiens
gtttctccttttcc

SEQ ID NO: 6343800 - DNA, 15 bp, Homo sapiens
gtttctccttttcct

SEQ ID NO: 6343801 - DNA, 16 bp, Homo sapiens
gtttctcgtgctgcat

SEQ ID NO: 6343802 - DNA, 23 bp, Homo sapiens
gtttctcgtgctgcatccctgtg

SEQ ID NO: 6343803 - DNA, 15 bp, Homo sapiens
gtttctctaaggaat

SEQ ID NO: 6343804 - DNA, 19 bp, Homo sapiens
gtttctctaaggaattatt

SEQ ID NO: 6343805 - DNA, 22 bp, Homo sapiens
gtttctctcttgttgtccaggc

SEQ ID NO: 6343806 - DNA, 12 bp, Homo sapiens
gtttctctgcct

SEQ ID NO: 6343807 - DNA, 14 bp, Homo sapiens
gtttctctttcctt

SEQ ID NO: 6343808 - DNA, 21 bp, Homo sapiens
gtttctctttgattatttgca

SEQ ID NO: 6343809 - DNA, 22 bp, Homo sapiens
gtttctctttgattatttgcat

SEQ ID NO: 6343810 - DNA, 20 bp, Homo sapiens
gtttctcttttggtttctgc

SEQ ID NO: 6343811 - DNA, 13 bp, Homo sapiens
gtttctgaaaaga

SEQ ID NO: 6343812 - DNA, 20 bp, Homo sapiens
gtttctgaaaattaacactg

SEQ ID NO: 6343813 - DNA, 21 bp, Homo sapiens
gtttctgaaaattaacactgc

SEQ ID NO: 6343814 - DNA, 18 bp, Homo sapiens
gtttctgaaagggacgct

SEQ ID NO: 6343815 - DNA, 23 bp, Homo sapiens
gtttctgaaagtattcacatcat

SEQ ID NO: 6343816 - DNA, 17 bp, Homo sapiens
gtttctgaactctgaca

SEQ ID NO: 6343817 - DNA, 18 bp, Homo sapiens
gtttctgaactctgacag

SEQ ID NO: 6343818 - DNA, 23 bp, Homo sapiens
gtttctgaatattttaaatctta

SEQ ID NO: 6343819 - DNA, 20 bp, Homo sapiens
gtttctgaatgtttgtgtct

SEQ ID NO: 6343820 - DNA, 21 bp, Homo sapiens
gtttctgaatgtttgtgtctg

SEQ ID NO: 6343821 - DNA, 22 bp, Homo sapiens
gtttctgaatgtttgtgtctgt

SEQ ID NO: 6343822 - DNA, 17 bp, Homo sapiens
gtttctgactctgagct

SEQ ID NO: 6343823 - DNA, 22 bp, Homo sapiens
gtttctgaggctttatgataat

SEQ ID NO: 6343824 - DNA, 17 bp, Homo sapiens
gtttctgagttttacca

SEQ ID NO: 6343825 - DNA, 23 bp, Homo sapiens
gtttctgatctgtactttgtgtt

SEQ ID NO: 6343826 - DNA, 22 bp, Homo sapiens
gtttctgattcactattagaga

SEQ ID NO: 6343827 - DNA, 21 bp, Homo sapiens
gtttctgatttgctgctcttc

SEQ ID NO: 6343828 - DNA, 19 bp, Homo sapiens
gtttctgcagcccttgggc

SEQ ID NO: 6343829 - DNA, 22 bp, Homo sapiens
gtttctgcatgaatatcataca

SEQ ID NO: 6343830 - DNA, 12 bp, Homo sapiens
gtttctgcccag

SEQ ID NO: 6343831 - DNA, 16 bp, Homo sapiens
gtttctgccttcttta

SEQ ID NO: 6343832 - DNA, 16 bp, Homo sapiens
gtttctgcttatttca

SEQ ID NO: 6343833 - DNA, 14 bp, Homo sapiens
gtttctggaaatgt

SEQ ID NO: 6343834 - DNA, 23 bp, Homo sapiens
gtttctggaaatgttctttagat

SEQ ID NO: 6343835 - DNA, 20 bp, Homo sapiens
gtttctggacattctctttg

SEQ ID NO: 6343836 - DNA, 20 bp, Homo sapiens
gtttctggagtgattctaga

SEQ ID NO: 6343837 - DNA, 16 bp, Homo sapiens
gtttctggataaacca

SEQ ID NO: 6343838 - DNA, 22 bp, Homo sapiens
gtttctggggaaaaaaaagaga

SEQ ID NO: 6343839 - DNA, 21 bp, Homo sapiens
gtttctggggcaactgagagc

SEQ ID NO: 6343840 - DNA, 12 bp, Homo sapiens
gtttctgggggc

SEQ ID NO: 6343841 - DNA, 17 bp, Homo sapiens
gtttctgggtccctgct

SEQ ID NO: 6343842 - DNA, 19 bp, Homo sapiens
gtttctgggtccctgctcc

SEQ ID NO: 6343843 - DNA, 21 bp, Homo sapiens
gtttctgggtccctgctcccc

SEQ ID NO: 6343844 - DNA, 23 bp, Homo sapiens
gtttctgggtcctgaagaattaa

SEQ ID NO: 6343845 - DNA, 22 bp, Homo sapiens
gtttctgtagaaaagaaaacat

SEQ ID NO: 6343846 - DNA, 22 bp, Homo sapiens
gtttctgtatatgattctctgt

SEQ ID NO: 6343847 - DNA, 17 bp, Homo sapiens
gtttctgtcctgctggt

SEQ ID NO: 6343848 - DNA, 15 bp, Homo sapiens
gtttctgtcctgtaa

SEQ ID NO: 6343849 - DNA, 17 bp, Homo sapiens
gtttctgtcgttaaaaa

SEQ ID NO: 6343850 - DNA, 13 bp, Homo sapiens
gtttctgtgcccc

SEQ ID NO: 6343851 - DNA, 14 bp, Homo sapiens
gtttctgtgctcca

SEQ ID NO: 6343852 - DNA, 20 bp, Homo sapiens
gtttctgtggagtaaatatt

SEQ ID NO: 6343853 - DNA, 21 bp, Homo sapiens
gtttctgtggttggctgggaa

SEQ ID NO: 6343854 - DNA, 22 bp, Homo sapiens
gtttctgtggttggctgggaaa

SEQ ID NO: 6343855 - DNA, 13 bp, Homo sapiens
gtttctgtgtgtc

SEQ ID NO: 6343856 - DNA, 14 bp, Homo sapiens
gtttctgttctgcc

SEQ ID NO: 6343857 - DNA, 15 bp, Homo sapiens
gtttctgttctgtgg

SEQ ID NO: 6343858 - DNA, 18 bp, Homo sapiens
gtttctgttctgtggaaa

SEQ ID NO: 6343859 - DNA, 20 bp, Homo sapiens
gtttctgttctgtggaaagt

SEQ ID NO: 6343860 - DNA, 23 bp, Homo sapiens
gtttctgttgttcccgtgaattt

SEQ ID NO: 6343861 - DNA, 14 bp, Homo sapiens
gtttctgtttaact

SEQ ID NO: 6343862 - DNA, 19 bp, Homo sapiens
gtttctgtttaacttctta

SEQ ID NO: 6343863 - DNA, 22 bp, Homo sapiens
gtttctgtttataatgaagaac

SEQ ID NO: 6343864 - DNA, 18 bp, Homo sapiens
gtttctgtttcaaagcac

SEQ ID NO: 6343865 - DNA, 14 bp, Homo sapiens
gtttctgtttgaat

SEQ ID NO: 6343866 - DNA, 19 bp, Homo sapiens
gtttctgtttgaattttca

SEQ ID NO: 6343867 - DNA, 18 bp, Homo sapiens
gtttctgtttgattcttt

SEQ ID NO: 6343868 - DNA, 12 bp, Homo sapiens
gtttcttaaata

SEQ ID NO: 6343869 - DNA, 22 bp, Homo sapiens
gtttcttaaataagaaactttt

SEQ ID NO: 6343870 - DNA, 15 bp, Homo sapiens
gtttcttaagaaaac

SEQ ID NO: 6343871 - DNA, 17 bp, Homo sapiens
gtttcttaagggcacac

SEQ ID NO: 6343872 - DNA, 19 bp, Homo sapiens
gtttcttaagggcacacac

SEQ ID NO: 6343873 - DNA, 12 bp, Homo sapiens
gtttcttagccc

SEQ ID NO: 6343874 - DNA, 13 bp, Homo sapiens
gtttcttattcaa

SEQ ID NO: 6343875 - DNA, 20 bp, Homo sapiens
gtttcttcaacaggagaatt

SEQ ID NO: 6343876 - DNA, 13 bp, Homo sapiens
gtttcttcattct

SEQ ID NO: 6343877 - DNA, 11 bp, Homo sapiens
gtttcttccaa

SEQ ID NO: 6343878 - DNA, 16 bp, Homo sapiens
gtttcttcctgccagc

SEQ ID NO: 6343879 - DNA, 14 bp, Homo sapiens
gtttcttcctgtta

SEQ ID NO: 6343880 - DNA, 20 bp, Homo sapiens
gtttcttcctgttaatgtat

SEQ ID NO: 6343881 - DNA, 15 bp, Homo sapiens
gtttcttctctggag

SEQ ID NO: 6343882 - DNA, 14 bp, Homo sapiens
gtttcttctggctt

SEQ ID NO: 6343883 - DNA, 15 bp, Homo sapiens
gtttcttctgtaaat

SEQ ID NO: 6343884 - DNA, 13 bp, Homo sapiens
gtttcttcttgtg

SEQ ID NO: 6343885 - DNA, 17 bp, Homo sapiens
gtttcttctttctagag

SEQ ID NO: 6343886 - DNA, 14 bp, Homo sapiens
gtttcttcttttcc

SEQ ID NO: 6343887 - DNA, 18 bp, Homo sapiens
gtttcttgacaagctgac

SEQ ID NO: 6343888 - DNA, 18 bp, Homo sapiens
gtttcttgcaagctccag

SEQ ID NO: 6343889 - DNA, 14 bp, Homo sapiens
gtttcttgcctcat

SEQ ID NO: 6343890 - DNA, 18 bp, Homo sapiens
gtttcttgctctctctcc

SEQ ID NO: 6343891 - DNA, 11 bp, Homo sapiens
gtttcttgctt

SEQ ID NO: 6343892 - DNA, 13 bp, Homo sapiens
gtttcttgcttgt

SEQ ID NO: 6343893 - DNA, 13 bp, Homo sapiens
gtttcttgctttg

SEQ ID NO: 6343894 - DNA, 21 bp, Homo sapiens
gtttcttggggtcccagggaa

SEQ ID NO: 6343895 - DNA, 17 bp, Homo sapiens
gtttcttggtctcagct

SEQ ID NO: 6343896 - DNA, 18 bp, Homo sapiens
gtttcttggtctcagctt

SEQ ID NO: 6343897 - DNA, 21 bp, Homo sapiens
gtttcttgtgtagatttgaaa

SEQ ID NO: 6343898 - DNA, 22 bp, Homo sapiens
gtttcttgtgtagatttgaaaa

SEQ ID NO: 6343899 - DNA, 14 bp, Homo sapiens
gtttctttacttct

SEQ ID NO: 6343900 - DNA, 16 bp, Homo sapiens
gtttctttagcagttt

SEQ ID NO: 6343901 - DNA, 16 bp, Homo sapiens
gtttctttagtttttg

SEQ ID NO: 6343902 - DNA, 20 bp, Homo sapiens
gtttctttattttgtgtaaa

SEQ ID NO: 6343903 - DNA, 20 bp, Homo sapiens
gtttctttctgtctctctct

SEQ ID NO: 6343904 - DNA, 23 bp, Homo sapiens
gtttctttctttctttattttga

SEQ ID NO: 6343905 - DNA, 19 bp, Homo sapiens
gtttctttgaattttcatt

SEQ ID NO: 6343906 - DNA, 20 bp, Homo sapiens
gtttctttgaattttcattt

SEQ ID NO: 6343907 - DNA, 14 bp, Homo sapiens
gtttctttgtaatg

SEQ ID NO: 6343908 - DNA, 16 bp, Homo sapiens
gtttctttgtgtttgc

SEQ ID NO: 6343909 - DNA, 14 bp, Homo sapiens
gtttcttttgcaat

SEQ ID NO: 6343910 - DNA, 21 bp, Homo sapiens
gtttcttttgtatgtaaatgt

SEQ ID NO: 6343911 - DNA, 15 bp, Homo sapiens
gtttctttttacagc

SEQ ID NO: 6343912 - DNA, 16 bp, Homo sapiens
gtttctttttgaatct

SEQ ID NO: 6343913 - DNA, 23 bp, Homo sapiens
gtttcttttttcggctaaaaaga

SEQ ID NO: 6343914 - DNA, 23 bp, Homo sapiens
gtttcttttttctttcttccttt

SEQ ID NO: 6343915 - DNA, 19 bp, Homo sapiens
gtttctttttttatgactg

SEQ ID NO: 6343916 - DNA, 21 bp, Homo sapiens
gtttgaaaaactaattgagcc

SEQ ID NO: 6343917 - DNA, 11 bp, Homo sapiens
gtttgaaaagc

SEQ ID NO: 6343918 - DNA, 17 bp, Homo sapiens
gtttgaaaatgctctta

SEQ ID NO: 6343919 - DNA, 15 bp, Homo sapiens
gtttgaaagattatg

SEQ ID NO: 6343920 - DNA, 22 bp, Homo sapiens
gtttgaaatgaggtctgtttaa

SEQ ID NO: 6343921 - DNA, 14 bp, Homo sapiens
gtttgaaattctga

SEQ ID NO: 6343922 - DNA, 15 bp, Homo sapiens
gtttgaaattctgaa

SEQ ID NO: 6343923 - DNA, 19 bp, Homo sapiens
gtttgaaattctgaatttg

SEQ ID NO: 6343924 - DNA, 21 bp, Homo sapiens
gtttgaaattctgaatttgca

SEQ ID NO: 6343925 - DNA, 23 bp, Homo sapiens
gtttgaaattctgaatttgcaaa

SEQ ID NO: 6343926 - DNA, 13 bp, Homo sapiens
gtttgaaattttc

SEQ ID NO: 6343927 - DNA, 16 bp, Homo sapiens
gtttgaaccaagaact

SEQ ID NO: 6343928 - DNA, 12 bp, Homo sapiens
gtttgaacttca

SEQ ID NO: 6343929 - DNA, 22 bp, Homo sapiens
gtttgaagacacagcctccccc

SEQ ID NO: 6343930 - DNA, 19 bp, Homo sapiens
gtttgaagaccaatcaaat

SEQ ID NO: 6343931 - DNA, 21 bp, Homo sapiens
gtttgaagaccaatcaaatat

SEQ ID NO: 6343932 - DNA, 22 bp, Homo sapiens
gtttgaagagccattttggtaa

SEQ ID NO: 6343933 - DNA, 15 bp, Homo sapiens
gtttgaagattgcct

SEQ ID NO: 6343934 - DNA, 21 bp, Homo sapiens
gtttgaagcctgcccttgtct

SEQ ID NO: 6343935 - DNA, 22 bp, Homo sapiens
gtttgaagcctgtgcctcccag

SEQ ID NO: 6343936 - DNA, 16 bp, Homo sapiens
gtttgaagctgctgtc

SEQ ID NO: 6343937 - DNA, 20 bp, Homo sapiens
gtttgaagctgctgtctcta

SEQ ID NO: 6343938 - DNA, 16 bp, Homo sapiens
gtttgaaggaaacagt

SEQ ID NO: 6343939 - DNA, 13 bp, Homo sapiens
gtttgaaggctgc

SEQ ID NO: 6343940 - DNA, 23 bp, Homo sapiens
gtttgaatatttaagcaataaaa

SEQ ID NO: 6343941 - DNA, 21 bp, Homo sapiens
gtttgaatctatttatcttca

SEQ ID NO: 6343942 - DNA, 14 bp, Homo sapiens
gtttgaatgttaaa

SEQ ID NO: 6343943 - DNA, 16 bp, Homo sapiens
gtttgaatgttaaata

SEQ ID NO: 6343944 - DNA, 24 bp, Homo sapiens
gtttgaattacagggaagaaatca

SEQ ID NO: 6343945 - DNA, 14 bp, Homo sapiens
gtttgaattaggct

SEQ ID NO: 6343946 - DNA, 14 bp, Homo sapiens
gtttgaattcagta

SEQ ID NO: 6343947 - DNA, 15 bp, Homo sapiens
gtttgaattcagtaa

SEQ ID NO: 6343948 - DNA, 17 bp, Homo sapiens
gtttgaattcctcctct

SEQ ID NO: 6343949 - DNA, 15 bp, Homo sapiens
gtttgaattttcaaa

SEQ ID NO: 6343950 - DNA, 15 bp, Homo sapiens
gtttgacaaacacaa

SEQ ID NO: 6343951 - DNA, 19 bp, Homo sapiens
gtttgacaattttgtctta

SEQ ID NO: 6343952 - DNA, 10 bp, Homo sapiens
gtttgacact

SEQ ID NO: 6343953 - DNA, 13 bp, Homo sapiens
gtttgacctcaca

SEQ ID NO: 6343954 - DNA, 18 bp, Homo sapiens
gtttgactagatgatgga

SEQ ID NO: 6343955 - DNA, 20 bp, Homo sapiens
gtttgactagccatctcaag

SEQ ID NO: 6343956 - DNA, 13 bp, Homo sapiens
gtttgactgtgct

SEQ ID NO: 6343957 - DNA, 15 bp, Homo sapiens
ggtgcgtggctgtgg

SEQ ID NO: 6343958 - DNA, 21 bp, Homo sapiens
ggtgcgtggctgtggcacaga

SEQ ID NO: 6343959 - DNA, 22 bp, Homo sapiens
ggtgcgtgtggccctgtgggag

SEQ ID NO: 6343960 - DNA, 20 bp, Homo sapiens
ggtgcgtgttcagcagaacc

SEQ ID NO: 6343961 - DNA, 22 bp, Homo sapiens
ggtgcgtttataattggcttaa

SEQ ID NO: 6343962 - DNA, 13 bp, Homo sapiens
ggtgcgtttttac

SEQ ID NO: 6343963 - DNA, 17 bp, Homo sapiens
ggtgctaaagccaacca

SEQ ID NO: 6343964 - DNA, 21 bp, Homo sapiens
ggtgctaaatggtcgcccagg

SEQ ID NO: 6343965 - DNA, 22 bp, Homo sapiens
ggtgctaaatggtcgcccagga

SEQ ID NO: 6343966 - DNA, 23 bp, Homo sapiens
ggtgctaaatggtcgcccaggag

SEQ ID NO: 6343967 - DNA, 20 bp, Homo sapiens
ggtgctaagggtaagggaga

SEQ ID NO: 6343968 - DNA, 20 bp, Homo sapiens
ggtgctaatgtcaaaccact

SEQ ID NO: 6343969 - DNA, 23 bp, Homo sapiens
ggtgctacaaaaacacagcaagg

SEQ ID NO: 6343970 - DNA, 22 bp, Homo sapiens
ggtgctacacccttttccagct

SEQ ID NO: 6343971 - DNA, 23 bp, Homo sapiens
ggtgctacacccttttccagctg

SEQ ID NO: 6343972 - DNA, 15 bp, Homo sapiens
ggtgctacgcctgca

SEQ ID NO: 6343973 - DNA, 14 bp, Homo sapiens
ggtgctactgggga

SEQ ID NO: 6343974 - DNA, 21 bp, Homo sapiens
ggtgctactggggaaactggc

SEQ ID NO: 6343975 - DNA, 14 bp, Homo sapiens
ggtgctaggaagag

SEQ ID NO: 6343976 - DNA, 17 bp, Homo sapiens
ggtgctagggtgcctgc

SEQ ID NO: 6343977 - DNA, 20 bp, Homo sapiens
ggtgctagggtgcctgctct

SEQ ID NO: 6343978 - DNA, 19 bp, Homo sapiens
ggtgctagtaaattttcaa

SEQ ID NO: 6343979 - DNA, 19 bp, Homo sapiens
ggtgctataggctggagaa

SEQ ID NO: 6343980 - DNA, 19 bp, Homo sapiens
ggtgctatctcccccagcc

SEQ ID NO: 6343981 - DNA, 20 bp, Homo sapiens
ggtgctatctcccccagccc

SEQ ID NO: 6343982 - DNA, 21 bp, Homo sapiens
ggtgctatctcccccagcccc

SEQ ID NO: 6343983 - DNA, 22 bp, Homo sapiens
ggtgctatctcccccagcccca

SEQ ID NO: 6343984 - DNA, 22 bp, Homo sapiens
ggtgctattctgtgaaactaat

SEQ ID NO: 6343985 - DNA, 23 bp, Homo sapiens
ggtgctattggggttggggggga

SEQ ID NO: 6343986 - DNA, 15 bp, Homo sapiens
ggtgctcaaagatgt

SEQ ID NO: 6343987 - DNA, 23 bp, Homo sapiens
ggtgctcaaagatgtactgagag

SEQ ID NO: 6343988 - DNA, 16 bp, Homo sapiens
ggtgctcaataaactt

SEQ ID NO: 6343989 - DNA, 19 bp, Homo sapiens
ggtgctcaataaacttgtg

SEQ ID NO: 6343990 - DNA, 20 bp, Homo sapiens
ggtgctcaataaacttgtgc

SEQ ID NO: 6343991 - DNA, 18 bp, Homo sapiens
ggtgctcacgactcttcc

SEQ ID NO: 6343992 - DNA, 18 bp, Homo sapiens
ggtgctcagggcatgctt

SEQ ID NO: 6343993 - DNA, 15 bp, Homo sapiens
ggtgctcagggctga

SEQ ID NO: 6343994 - DNA, 16 bp, Homo sapiens
ggtgctcagggctgac

SEQ ID NO: 6343995 - DNA, 16 bp, Homo sapiens
ggtgctcatagcgggc

SEQ ID NO: 6343996 - DNA, 18 bp, Homo sapiens
ggtgctcatgctgctccc

SEQ ID NO: 6343997 - DNA, 17 bp, Homo sapiens
ggtgctccatctccgcc

SEQ ID NO: 6343998 - DNA, 15 bp, Homo sapiens
ggtgctccctctgtc

SEQ ID NO: 6343999 - DNA, 14 bp, Homo sapiens
ggtgctcgcttctc

SEQ ID NO: 6344000 - DNA, 20 bp, Homo sapiens
ggtgctcggagaagagcgca

SEQ ID NO: 6344001 - DNA, 21 bp, Homo sapiens
ggtgctcggagaagagcgcag

SEQ ID NO: 6344002 - DNA, 13 bp, Homo sapiens
ggtgctctctctg

SEQ ID NO: 6344003 - DNA, 16 bp, Homo sapiens
ggtgctctctctgagg

SEQ ID NO: 6344004 - DNA, 19 bp, Homo sapiens
ggtgctctgaggcctcact

SEQ ID NO: 6344005 - DNA, 16 bp, Homo sapiens
ggtgctctgaggtcaa

SEQ ID NO: 6344006 - DNA, 19 bp, Homo sapiens
ggtgctctggctggagagg

SEQ ID NO: 6344007 - DNA, 20 bp, Homo sapiens
ggtgctctggctggagagga

SEQ ID NO: 6344008 - DNA, 12 bp, Homo sapiens
ggtgctctggtc

SEQ ID NO: 6344009 - DNA, 12 bp, Homo sapiens
ggtgctctgtct

SEQ ID NO: 6344010 - DNA, 12 bp, Homo sapiens
ggtgctctgtgt

SEQ ID NO: 6344011 - DNA, 22 bp, Homo sapiens
ggtgctctgtgtccgtctgtgt

SEQ ID NO: 6344012 - DNA, 22 bp, Homo sapiens
ggtgctgaacgacagtcccagt

SEQ ID NO: 6344013 - DNA, 16 bp, Homo sapiens
ggtgctgacctatagt

SEQ ID NO: 6344014 - DNA, 16 bp, Homo sapiens
ggtgctgacggccagg

SEQ ID NO: 6344015 - DNA, 22 bp, Homo sapiens
ggtgctgagtagatgcgcagcc

SEQ ID NO: 6344016 - DNA, 23 bp, Homo sapiens
ggtgctgcagatttgatatttgc

SEQ ID NO: 6344017 - DNA, 21 bp, Homo sapiens
ggtgctgcagcaccgaggggc

SEQ ID NO: 6344018 - DNA, 21 bp, Homo sapiens
ggtgctgcaggagtgtcctgc

SEQ ID NO: 6344019 - DNA, 15 bp, Homo sapiens
ggtgctgccatccag

SEQ ID NO: 6344020 - DNA, 15 bp, Homo sapiens
ggtgctgcccaggcc

SEQ ID NO: 6344021 - DNA, 16 bp, Homo sapiens
ggtgctgccgagggct

SEQ ID NO: 6344022 - DNA, 15 bp, Homo sapiens
ggtgctgcctctcac

SEQ ID NO: 6344023 - DNA, 13 bp, Homo sapiens
ggtgctgctaccc

SEQ ID NO: 6344024 - DNA, 22 bp, Homo sapiens
ggtgctgctaccctccctgctg

SEQ ID NO: 6344025 - DNA, 12 bp, Homo sapiens
ggtgctgctctc

SEQ ID NO: 6344026 - DNA, 11 bp, Homo sapiens
ggtgctgctgg

SEQ ID NO: 6344027 - DNA, 11 bp, Homo sapiens
ggtgctgcttt

SEQ ID NO: 6344028 - DNA, 21 bp, Homo sapiens
ggtgctggaagtctccatgaa

SEQ ID NO: 6344029 - DNA, 20 bp, Homo sapiens
ggtgctggagcactgggctc

SEQ ID NO: 6344030 - DNA, 12 bp, Homo sapiens
ggtgctggagga

SEQ ID NO: 6344031 - DNA, 19 bp, Homo sapiens
ggtgctggaggcagactcg

SEQ ID NO: 6344032 - DNA, 19 bp, Homo sapiens
ggtgctggcccagcatgga

SEQ ID NO: 6344033 - DNA, 21 bp, Homo sapiens
ggtgctgggagatgctctctg

SEQ ID NO: 6344034 - DNA, 19 bp, Homo sapiens
ggtgctgggcccctgcctc

SEQ ID NO: 6344035 - DNA, 17 bp, Homo sapiens
ggtgctggggctgcatg

SEQ ID NO: 6344036 - DNA, 18 bp, Homo sapiens
ggtgctgggggcacagct

SEQ ID NO: 6344037 - DNA, 20 bp, Homo sapiens
ggtgctgggttcccactccc

SEQ ID NO: 6344038 - DNA, 11 bp, Homo sapiens
ggtgctggtcc

SEQ ID NO: 6344039 - DNA, 13 bp, Homo sapiens
ggtgctggtcccg

SEQ ID NO: 6344040 - DNA, 19 bp, Homo sapiens
ggtgctgtcctcaggtggc

SEQ ID NO: 6344041 - DNA, 20 bp, Homo sapiens
ggtgctgtcctcaggtggcc

SEQ ID NO: 6344042 - DNA, 16 bp, Homo sapiens
ggtgctgtggccaggg

SEQ ID NO: 6344043 - DNA, 19 bp, Homo sapiens
ggtgctgtggccagggtga

SEQ ID NO: 6344044 - DNA, 15 bp, Homo sapiens
ggtgctgttgaaaat

SEQ ID NO: 6344045 - DNA, 13 bp, Homo sapiens
ggtgctgtttaaa

SEQ ID NO: 6344046 - DNA, 17 bp, Homo sapiens
ggtgctgtttaaagtca

SEQ ID NO: 6344047 - DNA, 19 bp, Homo sapiens
ggtgcttccaacaaggaca

SEQ ID NO: 6344048 - DNA, 21 bp, Homo sapiens
ggtgcttctcacactggagga

SEQ ID NO: 6344049 - DNA, 22 bp, Homo sapiens
ggtgcttctcacactggaggag

SEQ ID NO: 6344050 - DNA, 16 bp, Homo sapiens
ggtgcttgctgtgtga

SEQ ID NO: 6344051 - DNA, 18 bp, Homo sapiens
ggtgcttggagggggaag

SEQ ID NO: 6344052 - DNA, 21 bp, Homo sapiens
ggtgcttggtgagtcttggtt

SEQ ID NO: 6344053 - DNA, 10 bp, Homo sapiens
ggtgctttcc

SEQ ID NO: 6344054 - DNA, 13 bp, Homo sapiens
ggtgctttctcca

SEQ ID NO: 6344055 - DNA, 21 bp, Homo sapiens
ggtgctttctgtgaaagcctt

SEQ ID NO: 6344056 - DNA, 17 bp, Homo sapiens
ggtgctttgcattttga

SEQ ID NO: 6344057 - DNA, 20 bp, Homo sapiens
ggtggaaaaactgagacagg

SEQ ID NO: 6344058 - DNA, 16 bp, Homo sapiens
ggtggaaagagaaatg

SEQ ID NO: 6344059 - DNA, 19 bp, Homo sapiens
ggtggaaattttatatgta

SEQ ID NO: 6344060 - DNA, 19 bp, Homo sapiens
ggtggaagaagggagaaga

SEQ ID NO: 6344061 - DNA, 16 bp, Homo sapiens
ggtggaagaggggaca

SEQ ID NO: 6344062 - DNA, 20 bp, Homo sapiens
ggtggaagcagaggccctgc

SEQ ID NO: 6344063 - DNA, 20 bp, Homo sapiens
ggtggaagccctccttccac

SEQ ID NO: 6344064 - DNA, 13 bp, Homo sapiens
ggtggaaggagcc

SEQ ID NO: 6344065 - DNA, 13 bp, Homo sapiens
ggtggaagggcag

SEQ ID NO: 6344066 - DNA, 15 bp, Homo sapiens
ggtggaagggcagga

SEQ ID NO: 6344067 - DNA, 14 bp, Homo sapiens
ggtggaagggctgg

SEQ ID NO: 6344068 - DNA, 15 bp, Homo sapiens
ggtggaagggctggg

SEQ ID NO: 6344069 - DNA, 20 bp, Homo sapiens
ggtggaagggtagagaggcg

SEQ ID NO: 6344070 - DNA, 17 bp, Homo sapiens
ggtggaagtgcccagcc

SEQ ID NO: 6344071 - DNA, 18 bp, Homo sapiens
ggtggaagtgcccagccc

SEQ ID NO: 6344072 - DNA, 21 bp, Homo sapiens
ggtggaatgccgctgtctctg

SEQ ID NO: 6344073 - DNA, 17 bp, Homo sapiens
ggtggaatgcgggggag

SEQ ID NO: 6344074 - DNA, 18 bp, Homo sapiens
ggtggaatgcgggggagc

SEQ ID NO: 6344075 - DNA, 23 bp, Homo sapiens
ggtggaatgcgggggagcaggca

SEQ ID NO: 6344076 - DNA, 18 bp, Homo sapiens
ggtggacacaacagcagt

SEQ ID NO: 6344077 - DNA, 18 bp, Homo sapiens
ggtggacagacccagggt

SEQ ID NO: 6344078 - DNA, 12 bp, Homo sapiens
ggtggacagcag

SEQ ID NO: 6344079 - DNA, 16 bp, Homo sapiens
ggtggacagtcctggg

SEQ ID NO: 6344080 - DNA, 17 bp, Homo sapiens
ggtggacagtcctggga

SEQ ID NO: 6344081 - DNA, 18 bp, Homo sapiens
ggtggacccagggaacag

SEQ ID NO: 6344082 - DNA, 15 bp, Homo sapiens
ggtggacgctgcaga

SEQ ID NO: 6344083 - DNA, 15 bp, Homo sapiens
ggtggactcgcctgt

SEQ ID NO: 6344084 - DNA, 20 bp, Homo sapiens
ggtggacttagaaagcaggg

SEQ ID NO: 6344085 - DNA, 22 bp, Homo sapiens
ggtggacttagctctgaggagt

SEQ ID NO: 6344086 - DNA, 20 bp, Homo sapiens
ggtggacttcagtgtgtgta

SEQ ID NO: 6344087 - DNA, 19 bp, Homo sapiens
ggtggagaatctgagggca

SEQ ID NO: 6344088 - DNA, 19 bp, Homo sapiens
ggtggagagttgggggcca

SEQ ID NO: 6344089 - DNA, 18 bp, Homo sapiens
ggtggagatgtcagtctg

SEQ ID NO: 6344090 - DNA, 13 bp, Homo sapiens
ggtggagcagcca

SEQ ID NO: 6344091 - DNA, 17 bp, Homo sapiens
ggtggagcagccagagc

SEQ ID NO: 6344092 - DNA, 18 bp, Homo sapiens
ggtggagcagccagagct

SEQ ID NO: 6344093 - DNA, 21 bp, Homo sapiens
ggtggagccaagtggtccagc

SEQ ID NO: 6344094 - DNA, 21 bp, Homo sapiens
ggtggagccagtaaacagagg

SEQ ID NO: 6344095 - DNA, 17 bp, Homo sapiens
ggtggaggaaggctctg

SEQ ID NO: 6344096 - DNA, 21 bp, Homo sapiens
ggtggaggaccgaggctacag

SEQ ID NO: 6344097 - DNA, 22 bp, Homo sapiens
ggtggaggaccgaggctacagc

SEQ ID NO: 6344098 - DNA, 15 bp, Homo sapiens
ggtggaggaggagga

SEQ ID NO: 6344099 - DNA, 10 bp, Homo sapiens
ggtggaggat

SEQ ID NO: 6344100 - DNA, 21 bp, Homo sapiens
ggtggaggattgctgccagag

SEQ ID NO: 6344101 - DNA, 12 bp, Homo sapiens
ggtggaggcaag

SEQ ID NO: 6344102 - DNA, 23 bp, Homo sapiens
ggtggaggctgccccattgagat

SEQ ID NO: 6344103 - DNA, 17 bp, Homo sapiens
ggtggagggcacagccc

SEQ ID NO: 6344104 - DNA, 13 bp, Homo sapiens
ggtggagggcact

SEQ ID NO: 6344105 - DNA, 18 bp, Homo sapiens
ggtggagggcacttcagg

SEQ ID NO: 6344106 - DNA, 13 bp, Homo sapiens
ggtggagggccac

SEQ ID NO: 6344107 - DNA, 16 bp, Homo sapiens
ggtggagggggctggg

SEQ ID NO: 6344108 - DNA, 17 bp, Homo sapiens
ggtggagggggctgggc

SEQ ID NO: 6344109 - DNA, 13 bp, Homo sapiens
ggtggaggtgggt

SEQ ID NO: 6344110 - DNA, 17 bp, Homo sapiens
ggtggaggtgtgggccg

SEQ ID NO: 6344111 - DNA, 20 bp, Homo sapiens
ggtggaggttgcagtgagcc

SEQ ID NO: 6344112 - DNA, 15 bp, Homo sapiens
ggtggagtcaggctt

SEQ ID NO: 6344113 - DNA, 21 bp, Homo sapiens
ggtggagtcagggctgtgctt

SEQ ID NO: 6344114 - DNA, 17 bp, Homo sapiens
ggtggagtgagactgac

SEQ ID NO: 6344115 - DNA, 22 bp, Homo sapiens
ggtggagtgaggttagttctgt

SEQ ID NO: 6344116 - DNA, 19 bp, Homo sapiens
ggtggagtgcagtggtgcg

SEQ ID NO: 6344117 - DNA, 13 bp, Homo sapiens
ggtggagtttctg

SEQ ID NO: 6344118 - DNA, 18 bp, Homo sapiens
ggtggataactagccaga

SEQ ID NO: 6344119 - DNA, 13 bp, Homo sapiens
ggtggatataaat

SEQ ID NO: 6344120 - DNA, 15 bp, Homo sapiens
ggtggatataaatat

SEQ ID NO: 6344121 - DNA, 16 bp, Homo sapiens
ggtggatcacaaggtc

SEQ ID NO: 6344122 - DNA, 22 bp, Homo sapiens
ggtggatcacgaggtcaggaga

SEQ ID NO: 6344123 - DNA, 21 bp, Homo sapiens
ggtggatcatgaggtcaggag

SEQ ID NO: 6344124 - DNA, 22 bp, Homo sapiens
ggtggatcatgaggtcaggagt

SEQ ID NO: 6344125 - DNA, 20 bp, Homo sapiens
ggtggatcctgtaggctaaa

SEQ ID NO: 6344126 - DNA, 18 bp, Homo sapiens
ggtggatctaagaagggc

SEQ ID NO: 6344127 - DNA, 19 bp, Homo sapiens
ggtggatgaggcttcttcc

SEQ ID NO: 6344128 - DNA, 14 bp, Homo sapiens
ggtggatgcctggt

SEQ ID NO: 6344129 - DNA, 16 bp, Homo sapiens
ggtggatgggccctgc

SEQ ID NO: 6344130 - DNA, 14 bp, Homo sapiens
ggtggatggtgact

SEQ ID NO: 6344131 - DNA, 17 bp, Homo sapiens
ggtggatgtgagcagaa

SEQ ID NO: 6344132 - DNA, 18 bp, Homo sapiens
ggtggatgtgctggaggg

SEQ ID NO: 6344133 - DNA, 22 bp, Homo sapiens
ggtggatgtgctggaggggtgg

SEQ ID NO: 6344134 - DNA, 14 bp, Homo sapiens
gtttgacttgtata

SEQ ID NO: 6344135 - DNA, 17 bp, Homo sapiens
gtttgacttgtttgtgc

SEQ ID NO: 6344136 - DNA, 17 bp, Homo sapiens
gtttgactttttggaat

SEQ ID NO: 6344137 - DNA, 18 bp, Homo sapiens
gtttgagacaagccctgg

SEQ ID NO: 6344138 - DNA, 22 bp, Homo sapiens
gtttgagacaagccctggcaac

SEQ ID NO: 6344139 - DNA, 18 bp, Homo sapiens
gtttgagacactggttta

SEQ ID NO: 6344140 - DNA, 15 bp, Homo sapiens
gtttgagaccagcct

SEQ ID NO: 6344141 - DNA, 21 bp, Homo sapiens
gtttgagactagcctggccag

SEQ ID NO: 6344142 - DNA, 17 bp, Homo sapiens
gtttgagatcagcctgg

SEQ ID NO: 6344143 - DNA, 15 bp, Homo sapiens
gtttgagattctcaa

SEQ ID NO: 6344144 - DNA, 17 bp, Homo sapiens
gtttgagcacaatctgt

SEQ ID NO: 6344145 - DNA, 20 bp, Homo sapiens
gtttgagcacaatctgttct

SEQ ID NO: 6344146 - DNA, 12 bp, Homo sapiens
gtttgagccctg

SEQ ID NO: 6344147 - DNA, 15 bp, Homo sapiens
gtttgagccctggac

SEQ ID NO: 6344148 - DNA, 13 bp, Homo sapiens
gtttgagctcaga

SEQ ID NO: 6344149 - DNA, 23 bp, Homo sapiens
gtttgagctctgcagcccaggga

SEQ ID NO: 6344150 - DNA, 18 bp, Homo sapiens
gtttgaggaaatttgcag

SEQ ID NO: 6344151 - DNA, 11 bp, Homo sapiens
gtttgaggctt

SEQ ID NO: 6344152 - DNA, 16 bp, Homo sapiens
gtttgaggtttttaag

SEQ ID NO: 6344153 - DNA, 14 bp, Homo sapiens
gtttgagtccctcc

SEQ ID NO: 6344154 - DNA, 18 bp, Homo sapiens
gtttgagtttttcctccc

SEQ ID NO: 6344155 - DNA, 14 bp, Homo sapiens
gtttgataaatagt

SEQ ID NO: 6344156 - DNA, 21 bp, Homo sapiens
gtttgatagtgcttcttgtaa

SEQ ID NO: 6344157 - DNA, 16 bp, Homo sapiens
gtttgatattgtcacc

SEQ ID NO: 6344158 - DNA, 19 bp, Homo sapiens
gtttgatcagacagcttga

SEQ ID NO: 6344159 - DNA, 17 bp, Homo sapiens
gtttgatcatagaattg

SEQ ID NO: 6344160 - DNA, 19 bp, Homo sapiens
gtttgatcatttctgccat

SEQ ID NO: 6344161 - DNA, 13 bp, Homo sapiens
gtttgatcttcct

SEQ ID NO: 6344162 - DNA, 22 bp, Homo sapiens
gtttgatcttcctctgctaaat

SEQ ID NO: 6344163 - DNA, 22 bp, Homo sapiens
gtttgatgccaaagcagacatt

SEQ ID NO: 6344164 - DNA, 14 bp, Homo sapiens
gtttgatgtatgtg

SEQ ID NO: 6344165 - DNA, 17 bp, Homo sapiens
gtttgatgtgagttgag

SEQ ID NO: 6344166 - DNA, 19 bp, Homo sapiens
gtttgatgtgtatgtgttt

SEQ ID NO: 6344167 - DNA, 19 bp, Homo sapiens
gtttgattaaattcttgca

SEQ ID NO: 6344168 - DNA, 14 bp, Homo sapiens
gtttgattattatg

SEQ ID NO: 6344169 - DNA, 15 bp, Homo sapiens
gtttgattattatgt

SEQ ID NO: 6344170 - DNA, 18 bp, Homo sapiens
gtttgattgaggagctgc

SEQ ID NO: 6344171 - DNA, 14 bp, Homo sapiens
gtttgattgtttac

SEQ ID NO: 6344172 - DNA, 13 bp, Homo sapiens
gtttgatttagta

SEQ ID NO: 6344173 - DNA, 15 bp, Homo sapiens
gtttgatttcattaa

SEQ ID NO: 6344174 - DNA, 21 bp, Homo sapiens
gtttgattttagctgcagaac

SEQ ID NO: 6344175 - DNA, 17 bp, Homo sapiens
gtttgatttttttaaag

SEQ ID NO: 6344176 - DNA, 18 bp, Homo sapiens
gtttgatttttttaaagt

SEQ ID NO: 6344177 - DNA, 18 bp, Homo sapiens
gtttgcaaagaccacctc

SEQ ID NO: 6344178 - DNA, 19 bp, Homo sapiens
gtttgcaaagaccacctcc

SEQ ID NO: 6344179 - DNA, 20 bp, Homo sapiens
gtttgcaaatgtcagtttcc

SEQ ID NO: 6344180 - DNA, 18 bp, Homo sapiens
gtttgcaaattaaaaagg

SEQ ID NO: 6344181 - DNA, 18 bp, Homo sapiens
gtttgcaacatatttaag

SEQ ID NO: 6344182 - DNA, 20 bp, Homo sapiens
gtttgcaacctctttgctca

SEQ ID NO: 6344183 - DNA, 13 bp, Homo sapiens
gtttgcaagaacc

SEQ ID NO: 6344184 - DNA, 22 bp, Homo sapiens
gtttgcaagaatgaaatgaatg

SEQ ID NO: 6344185 - DNA, 15 bp, Homo sapiens
gtttgcaccgcctgc

SEQ ID NO: 6344186 - DNA, 23 bp, Homo sapiens
gtttgcacgttatggtgtttctc

SEQ ID NO: 6344187 - DNA, 17 bp, Homo sapiens
gtttgcactatctttca

SEQ ID NO: 6344188 - DNA, 15 bp, Homo sapiens
gtttgcacttcctct

SEQ ID NO: 6344189 - DNA, 16 bp, Homo sapiens
gtttgcagatattctc

SEQ ID NO: 6344190 - DNA, 11 bp, Homo sapiens
gtttgcagcct

SEQ ID NO: 6344191 - DNA, 15 bp, Homo sapiens
gtttgcagctgtgag

SEQ ID NO: 6344192 - DNA, 16 bp, Homo sapiens
gtttgcaggggtgacg

SEQ ID NO: 6344193 - DNA, 18 bp, Homo sapiens
gtttgcatcatttaactg

SEQ ID NO: 6344194 - DNA, 19 bp, Homo sapiens
gtttgcattccagcgtctg

SEQ ID NO: 6344195 - DNA, 24 bp, Homo sapiens
gtttgcattccagcgtctgctgtt

SEQ ID NO: 6344196 - DNA, 14 bp, Homo sapiens
gtttgcatttcaga

SEQ ID NO: 6344197 - DNA, 17 bp, Homo sapiens
gtttgccactgtgtttc

SEQ ID NO: 6344198 - DNA, 20 bp, Homo sapiens
gtttgccactttgcaaagga

SEQ ID NO: 6344199 - DNA, 14 bp, Homo sapiens
gtttgccatacttt

SEQ ID NO: 6344200 - DNA, 18 bp, Homo sapiens
gtttgcccagtcctgggt

SEQ ID NO: 6344201 - DNA, 18 bp, Homo sapiens
gtttgccggtggtgcagg

SEQ ID NO: 6344202 - DNA, 23 bp, Homo sapiens
gtttgcctaaaacaatctaaaac

SEQ ID NO: 6344203 - DNA, 11 bp, Homo sapiens
gtttgcctctg

SEQ ID NO: 6344204 - DNA, 15 bp, Homo sapiens
gtttgccttccagaa

SEQ ID NO: 6344205 - DNA, 21 bp, Homo sapiens
gtttgcctttaggcaggaagt

SEQ ID NO: 6344206 - DNA, 16 bp, Homo sapiens
gtttgccttttatgta

SEQ ID NO: 6344207 - DNA, 19 bp, Homo sapiens
gtttgccttttatgtaaat

SEQ ID NO: 6344208 - DNA, 23 bp, Homo sapiens
gtttgcggggcttttaaaaggaa

SEQ ID NO: 6344209 - DNA, 21 bp, Homo sapiens
gtttgcgggggtctgagtcta

SEQ ID NO: 6344210 - DNA, 13 bp, Homo sapiens
gtttgctaagtga

SEQ ID NO: 6344211 - DNA, 13 bp, Homo sapiens
gtttgctaatgtt

SEQ ID NO: 6344212 - DNA, 18 bp, Homo sapiens
gtttgctcaaaattgctt

SEQ ID NO: 6344213 - DNA, 18 bp, Homo sapiens
gtttgctcacccaggacc

SEQ ID NO: 6344214 - DNA, 19 bp, Homo sapiens
gtttgctccaccttcatat

SEQ ID NO: 6344215 - DNA, 23 bp, Homo sapiens
gtttgctccccttccccttcctt

SEQ ID NO: 6344216 - DNA, 19 bp, Homo sapiens
gtttgctctaccaaatagt

SEQ ID NO: 6344217 - DNA, 22 bp, Homo sapiens
gtttgctgaaagatatgtatat

SEQ ID NO: 6344218 - DNA, 14 bp, Homo sapiens
gtttgctgaaattt

SEQ ID NO: 6344219 - DNA, 19 bp, Homo sapiens
gtttgctgaacaccttgtg

SEQ ID NO: 6344220 - DNA, 16 bp, Homo sapiens
gtttgctgatggtctg

SEQ ID NO: 6344221 - DNA, 17 bp, Homo sapiens
gtttgctgattatttat

SEQ ID NO: 6344222 - DNA, 17 bp, Homo sapiens
gtttgctgcttttgatg

SEQ ID NO: 6344223 - DNA, 13 bp, Homo sapiens
gtttgctgtgaac

SEQ ID NO: 6344224 - DNA, 17 bp, Homo sapiens
gtttgctgtgccaggag

SEQ ID NO: 6344225 - DNA, 13 bp, Homo sapiens
gtttgctgtgctt

SEQ ID NO: 6344226 - DNA, 18 bp, Homo sapiens
gtttgctgttgatttctt

SEQ ID NO: 6344227 - DNA, 14 bp, Homo sapiens
gtttgctgttgctg

SEQ ID NO: 6344228 - DNA, 18 bp, Homo sapiens
gtttgctgtttcccctgc

SEQ ID NO: 6344229 - DNA, 16 bp, Homo sapiens
gtttgcttcataaatg

SEQ ID NO: 6344230 - DNA, 20 bp, Homo sapiens
gtttgcttcatgtgtcccag

SEQ ID NO: 6344231 - DNA, 13 bp, Homo sapiens
gtttgcttttgaa

SEQ ID NO: 6344232 - DNA, 22 bp, Homo sapiens
gtttgcttttttttttttgctt

SEQ ID NO: 6344233 - DNA, 12 bp, Homo sapiens
gtttggaaaact

SEQ ID NO: 6344234 - DNA, 13 bp, Homo sapiens
gtttggaaggagc

SEQ ID NO: 6344235 - DNA, 15 bp, Homo sapiens
gtttggaatattaaa

SEQ ID NO: 6344236 - DNA, 16 bp, Homo sapiens
gtttggaatttaagaa

SEQ ID NO: 6344237 - DNA, 16 bp, Homo sapiens
gtttggaattttctgt

SEQ ID NO: 6344238 - DNA, 18 bp, Homo sapiens
gtttggaccaaaaaccag

SEQ ID NO: 6344239 - DNA, 17 bp, Homo sapiens
gtttggaccccagctgg

SEQ ID NO: 6344240 - DNA, 17 bp, Homo sapiens
gtttggactgttttcaa

SEQ ID NO: 6344241 - DNA, 23 bp, Homo sapiens
gtttggagacattcctgggcaca

SEQ ID NO: 6344242 - DNA, 17 bp, Homo sapiens
gtttggagagagcagac

SEQ ID NO: 6344243 - DNA, 21 bp, Homo sapiens
gtttggagcactagtttgatt

SEQ ID NO: 6344244 - DNA, 19 bp, Homo sapiens
gtttggaggctgctgcccc

SEQ ID NO: 6344245 - DNA, 16 bp, Homo sapiens
gtttggatacagctgc

SEQ ID NO: 6344246 - DNA, 20 bp, Homo sapiens
gtttggatacatctgctgtg

SEQ ID NO: 6344247 - DNA, 18 bp, Homo sapiens
gtttggatgtctgtagca

SEQ ID NO: 6344248 - DNA, 19 bp, Homo sapiens
gtttggatgtctgtagcat

SEQ ID NO: 6344249 - DNA, 22 bp, Homo sapiens
gtttggattcctcacagccttg

SEQ ID NO: 6344250 - DNA, 18 bp, Homo sapiens
gtttggattcttatgtag

SEQ ID NO: 6344251 - DNA, 19 bp, Homo sapiens
gtttggcaaaactcaggca

SEQ ID NO: 6344252 - DNA, 15 bp, Homo sapiens
gtttggcaaggaaag

SEQ ID NO: 6344253 - DNA, 15 bp, Homo sapiens
gtttggcaatagttt

SEQ ID NO: 6344254 - DNA, 20 bp, Homo sapiens
gtttggcacatgcaggtagt

SEQ ID NO: 6344255 - DNA, 15 bp, Homo sapiens
gtttggcacccaaat

SEQ ID NO: 6344256 - DNA, 12 bp, Homo sapiens
gtttggcaggca

SEQ ID NO: 6344257 - DNA, 21 bp, Homo sapiens
gtttggcatggtgagtgttgg

SEQ ID NO: 6344258 - DNA, 10 bp, Homo sapiens
gtttggccag

SEQ ID NO: 6344259 - DNA, 11 bp, Homo sapiens
gtttggccaga

SEQ ID NO: 6344260 - DNA, 23 bp, Homo sapiens
gtttggccagaagtcaaggctta

SEQ ID NO: 6344261 - DNA, 12 bp, Homo sapiens
gtttggccaggg

SEQ ID NO: 6344262 - DNA, 21 bp, Homo sapiens
gtttggcccaagactgggctg

SEQ ID NO: 6344263 - DNA, 14 bp, Homo sapiens
gtttggcccctgga

SEQ ID NO: 6344264 - DNA, 11 bp, Homo sapiens
gtttggccctg

SEQ ID NO: 6344265 - DNA, 18 bp, Homo sapiens
gtttggcctcaaaacaga

SEQ ID NO: 6344266 - DNA, 12 bp, Homo sapiens
gtttggcctcca

SEQ ID NO: 6344267 - DNA, 13 bp, Homo sapiens
gtttggcctccat

SEQ ID NO: 6344268 - DNA, 15 bp, Homo sapiens
gtttggcctccatcc

SEQ ID NO: 6344269 - DNA, 18 bp, Homo sapiens
gtttggcgggccaaggac

SEQ ID NO: 6344270 - DNA, 17 bp, Homo sapiens
gtttggctataagtgct

SEQ ID NO: 6344271 - DNA, 17 bp, Homo sapiens
gtttggctgaaattatg

SEQ ID NO: 6344272 - DNA, 18 bp, Homo sapiens
gtttggctgtgtctaaac

SEQ ID NO: 6344273 - DNA, 23 bp, Homo sapiens
gtttggctgtgtctaaactgcat

SEQ ID NO: 6344274 - DNA, 17 bp, Homo sapiens
gtttggcttggccttgg

SEQ ID NO: 6344275 - DNA, 13 bp, Homo sapiens
gtttggctttcag

SEQ ID NO: 6344276 - DNA, 18 bp, Homo sapiens
gtttgggaaaggcagggc

SEQ ID NO: 6344277 - DNA, 19 bp, Homo sapiens
gtttgggaaaggcagggcc

SEQ ID NO: 6344278 - DNA, 23 bp, Homo sapiens
gtttgggaagagcttagaaactg

SEQ ID NO: 6344279 - DNA, 22 bp, Homo sapiens
gtttgggaatggtgcccttgga

SEQ ID NO: 6344280 - DNA, 21 bp, Homo sapiens
gtttgggagagaccattgcat

SEQ ID NO: 6344281 - DNA, 12 bp, Homo sapiens
gtttgggagagt

SEQ ID NO: 6344282 - DNA, 14 bp, Homo sapiens
gtttgggagagtgg

SEQ ID NO: 6344283 - DNA, 14 bp, Homo sapiens
gtttgggagccagg

SEQ ID NO: 6344284 - DNA, 17 bp, Homo sapiens
gtttgggagccaggact

SEQ ID NO: 6344285 - DNA, 18 bp, Homo sapiens
gtttgggagccaggactc

SEQ ID NO: 6344286 - DNA, 13 bp, Homo sapiens
gtttgggctggag

SEQ ID NO: 6344287 - DNA, 22 bp, Homo sapiens
gtttgggctggagctcctccct

SEQ ID NO: 6344288 - DNA, 11 bp, Homo sapiens
gtttgggcttc

SEQ ID NO: 6344289 - DNA, 13 bp, Homo sapiens
gtttgggcttcag

SEQ ID NO: 6344290 - DNA, 15 bp, Homo sapiens
gtttggggactcagg

SEQ ID NO: 6344291 - DNA, 21 bp, Homo sapiens
gtttggggcaagtcatgtaaa

SEQ ID NO: 6344292 - DNA, 19 bp, Homo sapiens
gtttggggcagaaaggact

SEQ ID NO: 6344293 - DNA, 15 bp, Homo sapiens
gtttggggcaggagt

SEQ ID NO: 6344294 - DNA, 21 bp, Homo sapiens
gtttggggcaggagtagctga

SEQ ID NO: 6344295 - DNA, 11 bp, Homo sapiens
gtttggggcga

SEQ ID NO: 6344296 - DNA, 17 bp, Homo sapiens
gtttggggcgaggcaga

SEQ ID NO: 6344297 - DNA, 18 bp, Homo sapiens
gtttggggcgaggcagag

SEQ ID NO: 6344298 - DNA, 17 bp, Homo sapiens
gtttggggctggcccca

SEQ ID NO: 6344299 - DNA, 19 bp, Homo sapiens
gtttgggggcgccctctct

SEQ ID NO: 6344300 - DNA, 21 bp, Homo sapiens
gtttgggggcgccctctctgc

SEQ ID NO: 6344301 - DNA, 19 bp, Homo sapiens
gtttgggtaaaatactttt

SEQ ID NO: 6344302 - DNA, 20 bp, Homo sapiens
gtttgggtaaaatactttta

SEQ ID NO: 6344303 - DNA, 16 bp, Homo sapiens
gtttgggtatattcat

SEQ ID NO: 6344304 - DNA, 20 bp, Homo sapiens
gtttgggtcttttatacatg

SEQ ID NO: 6344305 - DNA, 20 bp, Homo sapiens
gtttgggtgcctcctgcagt

SEQ ID NO: 6344306 - DNA, 16 bp, Homo sapiens
gtttggtaaatgtttc

SEQ ID NO: 6344307 - DNA, 19 bp, Homo sapiens
gtttggtaaatgtttcttt

SEQ ID NO: 6344308 - DNA, 16 bp, Homo sapiens
gtttggtagttagcca

SEQ ID NO: 6344309 - DNA, 14 bp, Homo sapiens
gtttggtataaatt

SEQ ID NO: 6344310 - DNA, 19 bp, Homo sapiens
gtttggtataaattaattt

SEQ ID NO: 6344311 - DNA, 15 bp, Homo sapiens
gtttggtatgaaaca

SEQ ID NO: 6344312 - DNA, 18 bp, Homo sapiens
gtttggtattgtatttat

SEQ ID NO: 6344313 - DNA, 16 bp, Homo sapiens
gtttggtccagcctgg

SEQ ID NO: 6344314 - DNA, 19 bp, Homo sapiens
ggtggattccgagtggtga

SEQ ID NO: 6344315 - DNA, 18 bp, Homo sapiens
ggtggattcctgggcaag

SEQ ID NO: 6344316 - DNA, 22 bp, Homo sapiens
ggtggattcctgggcaagaacc

SEQ ID NO: 6344317 - DNA, 22 bp, Homo sapiens
ggtggattctccctgggcctca

SEQ ID NO: 6344318 - DNA, 14 bp, Homo sapiens
ggtggattgggcag

SEQ ID NO: 6344319 - DNA, 23 bp, Homo sapiens
ggtggattgggcagaatcctggg

SEQ ID NO: 6344320 - DNA, 21 bp, Homo sapiens
ggtggatttggagaccgaaga

SEQ ID NO: 6344321 - DNA, 20 bp, Homo sapiens
ggtggcaacatttggggaga

SEQ ID NO: 6344322 - DNA, 19 bp, Homo sapiens
ggtggcaaccccagaccca

SEQ ID NO: 6344323 - DNA, 19 bp, Homo sapiens
ggtggcaatgcttaaacta

SEQ ID NO: 6344324 - DNA, 19 bp, Homo sapiens
ggtggcacaccacccgagg

SEQ ID NO: 6344325 - DNA, 14 bp, Homo sapiens
ggtggcacacgcct

SEQ ID NO: 6344326 - DNA, 18 bp, Homo sapiens
ggtggcacaggccccctt

SEQ ID NO: 6344327 - DNA, 20 bp, Homo sapiens
ggtggcaccagatgcaacct

SEQ ID NO: 6344328 - DNA, 21 bp, Homo sapiens
ggtggcaccagatgcaacctc

SEQ ID NO: 6344329 - DNA, 20 bp, Homo sapiens
ggtggcaccagcagcctgga

SEQ ID NO: 6344330 - DNA, 23 bp, Homo sapiens
ggtggcaccagcgaagggagtgc

SEQ ID NO: 6344331 - DNA, 20 bp, Homo sapiens
ggtggcacctcctgagaagg

SEQ ID NO: 6344332 - DNA, 12 bp, Homo sapiens
ggtggcacctgc

SEQ ID NO: 6344333 - DNA, 22 bp, Homo sapiens
ggtggcacctgtttcccgggca

SEQ ID NO: 6344334 - DNA, 19 bp, Homo sapiens
ggtggcacgggccctccct

SEQ ID NO: 6344335 - DNA, 16 bp, Homo sapiens
ggtggcactgagcccc

SEQ ID NO: 6344336 - DNA, 13 bp, Homo sapiens
ggtggcactggga

SEQ ID NO: 6344337 - DNA, 20 bp, Homo sapiens
ggtggcactgggagggggtg

SEQ ID NO: 6344338 - DNA, 12 bp, Homo sapiens
ggtggcagacta

SEQ ID NO: 6344339 - DNA, 11 bp, Homo sapiens
ggtggcagaga

SEQ ID NO: 6344340 - DNA, 19 bp, Homo sapiens
ggtggcagagacagtgggc

SEQ ID NO: 6344341 - DNA, 16 bp, Homo sapiens
ggtggcagagtgagac

SEQ ID NO: 6344342 - DNA, 21 bp, Homo sapiens
ggtggcagatgtcttccctgg

SEQ ID NO: 6344343 - DNA, 18 bp, Homo sapiens
ggtggcagcgcccagcct

SEQ ID NO: 6344344 - DNA, 23 bp, Homo sapiens
ggtggcagctgcggtccacccag

SEQ ID NO: 6344345 - DNA, 17 bp, Homo sapiens
ggtggcaggaccaggac

SEQ ID NO: 6344346 - DNA, 11 bp, Homo sapiens
ggtggcaggat

SEQ ID NO: 6344347 - DNA, 14 bp, Homo sapiens
ggtggcaggtcact

SEQ ID NO: 6344348 - DNA, 20 bp, Homo sapiens
ggtggcaggtcactgtcact

SEQ ID NO: 6344349 - DNA, 21 bp, Homo sapiens
ggtggcatcaggagctgctca

SEQ ID NO: 6344350 - DNA, 13 bp, Homo sapiens
ggtggcatcccag

SEQ ID NO: 6344351 - DNA, 17 bp, Homo sapiens
ggtggcatcccagtggc

SEQ ID NO: 6344352 - DNA, 22 bp, Homo sapiens
ggtggcatcctccggagagaga

SEQ ID NO: 6344353 - DNA, 12 bp, Homo sapiens
ggtggcatgcat

SEQ ID NO: 6344354 - DNA, 16 bp, Homo sapiens
ggtggcatgcatggag

SEQ ID NO: 6344355 - DNA, 19 bp, Homo sapiens
ggtggcatgtgcctataat

SEQ ID NO: 6344356 - DNA, 15 bp, Homo sapiens
ggtggcatttgctga

SEQ ID NO: 6344357 - DNA, 16 bp, Homo sapiens
ggtggcatttttgctt

SEQ ID NO: 6344358 - DNA, 22 bp, Homo sapiens
ggtggccaagcctgccccggcc

SEQ ID NO: 6344359 - DNA, 23 bp, Homo sapiens
ggtggccaagcctgccccggcca

SEQ ID NO: 6344360 - DNA, 17 bp, Homo sapiens
ggtggccaagcctggcc

SEQ ID NO: 6344361 - DNA, 22 bp, Homo sapiens
ggtggccaatccaggtgggaga

SEQ ID NO: 6344362 - DNA, 18 bp, Homo sapiens
ggtggccacacaggcagg

SEQ ID NO: 6344363 - DNA, 19 bp, Homo sapiens
ggtggccacacaggcaggg

SEQ ID NO: 6344364 - DNA, 21 bp, Homo sapiens
ggtggccacacaggcagggcc

SEQ ID NO: 6344365 - DNA, 11 bp, Homo sapiens
ggtggccacag

SEQ ID NO: 6344366 - DNA, 13 bp, Homo sapiens
ggtggccacagca

SEQ ID NO: 6344367 - DNA, 17 bp, Homo sapiens
ggtggccacagcgccag

SEQ ID NO: 6344368 - DNA, 17 bp, Homo sapiens
ggtggccacagtgtcac

SEQ ID NO: 6344369 - DNA, 21 bp, Homo sapiens
ggtggccactccagacccctg

SEQ ID NO: 6344370 - DNA, 15 bp, Homo sapiens
ggtggccactgagct

SEQ ID NO: 6344371 - DNA, 17 bp, Homo sapiens
ggtggccaggcctgcca

SEQ ID NO: 6344372 - DNA, 13 bp, Homo sapiens
ggtggccagggct

SEQ ID NO: 6344373 - DNA, 23 bp, Homo sapiens
ggtggccatcacagccccatgga

SEQ ID NO: 6344374 - DNA, 16 bp, Homo sapiens
ggtggccatccctggg

SEQ ID NO: 6344375 - DNA, 19 bp, Homo sapiens
ggtggccatccctgggccc

SEQ ID NO: 6344376 - DNA, 10 bp, Homo sapiens
ggtggccatg

SEQ ID NO: 6344377 - DNA, 17 bp, Homo sapiens
ggtggccatgcctcagc

SEQ ID NO: 6344378 - DNA, 17 bp, Homo sapiens
ggtggccatgcttcttg

SEQ ID NO: 6344379 - DNA, 13 bp, Homo sapiens
ggtggcccatccc

SEQ ID NO: 6344380 - DNA, 22 bp, Homo sapiens
ggtggcccatcccccctcacca

SEQ ID NO: 6344381 - DNA, 21 bp, Homo sapiens
ggtggccccagctgtgactga

SEQ ID NO: 6344382 - DNA, 23 bp, Homo sapiens
ggtggcccggaagaaccagaagt

SEQ ID NO: 6344383 - DNA, 17 bp, Homo sapiens
ggtggccctcccaggct

SEQ ID NO: 6344384 - DNA, 14 bp, Homo sapiens
ggtggccctgggga

SEQ ID NO: 6344385 - DNA, 13 bp, Homo sapiens
ggtggccctgtcc

SEQ ID NO: 6344386 - DNA, 23 bp, Homo sapiens
ggtggccgcccctgaggcttcac

SEQ ID NO: 6344387 - DNA, 17 bp, Homo sapiens
ggtggccgctcctccct

SEQ ID NO: 6344388 - DNA, 20 bp, Homo sapiens
ggtggccgctgagtggcagg

SEQ ID NO: 6344389 - DNA, 14 bp, Homo sapiens
ggtggccggccctg

SEQ ID NO: 6344390 - DNA, 16 bp, Homo sapiens
ggtggccggccctgcc

SEQ ID NO: 6344391 - DNA, 15 bp, Homo sapiens
ggtggccgtcctgag

SEQ ID NO: 6344392 - DNA, 19 bp, Homo sapiens
ggtggcctaagagttgagc

SEQ ID NO: 6344393 - DNA, 22 bp, Homo sapiens
ggtggcctcaagaaaggcccgg

SEQ ID NO: 6344394 - DNA, 16 bp, Homo sapiens
ggtggcctccctccag

SEQ ID NO: 6344395 - DNA, 23 bp, Homo sapiens
ggtggcctctccttgtggcctgg

SEQ ID NO: 6344396 - DNA, 19 bp, Homo sapiens
ggtggcctctgctggtctc

SEQ ID NO: 6344397 - DNA, 12 bp, Homo sapiens
ggtggcctgccc

SEQ ID NO: 6344398 - DNA, 18 bp, Homo sapiens
ggtggcctggaggtgggc

SEQ ID NO: 6344399 - DNA, 14 bp, Homo sapiens
ggtggcctggccct

SEQ ID NO: 6344400 - DNA, 19 bp, Homo sapiens
ggtggcctggccctcctgg

SEQ ID NO: 6344401 - DNA, 20 bp, Homo sapiens
ggtggccttctgctgcccag

SEQ ID NO: 6344402 - DNA, 21 bp, Homo sapiens
ggtggccttctgctgcccagg

SEQ ID NO: 6344403 - DNA, 17 bp, Homo sapiens
ggtggcgctttctcctg

SEQ ID NO: 6344404 - DNA, 19 bp, Homo sapiens
ggtggcggcagggccaggc

SEQ ID NO: 6344405 - DNA, 16 bp, Homo sapiens
ggtggcggccccagca

SEQ ID NO: 6344406 - DNA, 18 bp, Homo sapiens
ggtggcgtctgcctagga

SEQ ID NO: 6344407 - DNA, 18 bp, Homo sapiens
ggtggcgttatggcagcc

SEQ ID NO: 6344408 - DNA, 14 bp, Homo sapiens
ggtggctactctgt

SEQ ID NO: 6344409 - DNA, 23 bp, Homo sapiens
ggtggctactctgtgccagagcc

SEQ ID NO: 6344410 - DNA, 20 bp, Homo sapiens
ggtggctagtcaagctcctc

SEQ ID NO: 6344411 - DNA, 22 bp, Homo sapiens
ggtggctagtcaagctcctcct

SEQ ID NO: 6344412 - DNA, 14 bp, Homo sapiens
ggtggctcacgcct

SEQ ID NO: 6344413 - DNA, 19 bp, Homo sapiens
ggtggctcacgcctataat

SEQ ID NO: 6344414 - DNA, 18 bp, Homo sapiens
ggtggctcactactgaac

SEQ ID NO: 6344415 - DNA, 13 bp, Homo sapiens
ggtggctcctgcc

SEQ ID NO: 6344416 - DNA, 13 bp, Homo sapiens
ggtggctctgaga

SEQ ID NO: 6344417 - DNA, 16 bp, Homo sapiens
ggtggctctggacagc

SEQ ID NO: 6344418 - DNA, 13 bp, Homo sapiens
ggtggctgaccca

SEQ ID NO: 6344419 - DNA, 19 bp, Homo sapiens
ggtggctgacccagtccct

SEQ ID NO: 6344420 - DNA, 14 bp, Homo sapiens
ggtggctgcagcct

SEQ ID NO: 6344421 - DNA, 15 bp, Homo sapiens
ggtggctgcagcctc

SEQ ID NO: 6344422 - DNA, 16 bp, Homo sapiens
ggtggctgcagcctca

SEQ ID NO: 6344423 - DNA, 20 bp, Homo sapiens
ggtggctgccagcccactgc

SEQ ID NO: 6344424 - DNA, 20 bp, Homo sapiens
ggtggctgccccggcctcct

SEQ ID NO: 6344425 - DNA, 17 bp, Homo sapiens
ggtggctgcgcccccag

SEQ ID NO: 6344426 - DNA, 20 bp, Homo sapiens
ggtggctgcgcccccagctt

SEQ ID NO: 6344427 - DNA, 21 bp, Homo sapiens
ggtggctgcgcccccagcttc

SEQ ID NO: 6344428 - DNA, 20 bp, Homo sapiens
ggtggctgggcccagcaggg

SEQ ID NO: 6344429 - DNA, 17 bp, Homo sapiens
ggtggctggtgagaccc

SEQ ID NO: 6344430 - DNA, 23 bp, Homo sapiens
ggtggctgtgacaaccctggcct

SEQ ID NO: 6344431 - DNA, 15 bp, Homo sapiens
ggtggctgtgtctct

SEQ ID NO: 6344432 - DNA, 18 bp, Homo sapiens
ggtggcttctggcacctg

SEQ ID NO: 6344433 - DNA, 20 bp, Homo sapiens
ggtggcttctggcacctggc

SEQ ID NO: 6344434 - DNA, 16 bp, Homo sapiens
ggtggcttgagctaga

SEQ ID NO: 6344435 - DNA, 18 bp, Homo sapiens
ggtggctttcaaggctgg

SEQ ID NO: 6344436 - DNA, 19 bp, Homo sapiens
ggtggctttcaaggctggg

SEQ ID NO: 6344437 - DNA, 21 bp, Homo sapiens
ggtggctttcaaggctggggc

SEQ ID NO: 6344438 - DNA, 22 bp, Homo sapiens
ggtggctttcaaggctggggca

SEQ ID NO: 6344439 - DNA, 23 bp, Homo sapiens
ggtggctttccttgtggcagagg

SEQ ID NO: 6344440 - DNA, 15 bp, Homo sapiens
ggtgggaaccctccc

SEQ ID NO: 6344441 - DNA, 17 bp, Homo sapiens
ggtgggaagcttgctgg

SEQ ID NO: 6344442 - DNA, 13 bp, Homo sapiens
ggtgggacaccct

SEQ ID NO: 6344443 - DNA, 13 bp, Homo sapiens
ggtgggacagccc

SEQ ID NO: 6344444 - DNA, 20 bp, Homo sapiens
ggtgggacagccccagggcc

SEQ ID NO: 6344445 - DNA, 15 bp, Homo sapiens
ggtgggacagcctct

SEQ ID NO: 6344446 - DNA, 18 bp, Homo sapiens
ggtgggacatggaaaaga

SEQ ID NO: 6344447 - DNA, 20 bp, Homo sapiens
ggtgggagaattgcttgagc

SEQ ID NO: 6344448 - DNA, 20 bp, Homo sapiens
ggtgggagacgaacggaagg

SEQ ID NO: 6344449 - DNA, 13 bp, Homo sapiens
ggtgggagagcca

SEQ ID NO: 6344450 - DNA, 12 bp, Homo sapiens
ggtgggagatgg

SEQ ID NO: 6344451 - DNA, 21 bp, Homo sapiens
ggtgggagcacagctttcctg

SEQ ID NO: 6344452 - DNA, 16 bp, Homo sapiens
ggtgggagcaggagat

SEQ ID NO: 6344453 - DNA, 15 bp, Homo sapiens
ggtgggagccacagg

SEQ ID NO: 6344454 - DNA, 18 bp, Homo sapiens
ggtgggagctgaaaagga

SEQ ID NO: 6344455 - DNA, 14 bp, Homo sapiens
ggtgggagggagga

SEQ ID NO: 6344456 - DNA, 12 bp, Homo sapiens
ggtgggagggcg

SEQ ID NO: 6344457 - DNA, 16 bp, Homo sapiens
ggtgggagggcgtcag

SEQ ID NO: 6344458 - DNA, 19 bp, Homo sapiens
ggtgggagggcgtcaggca

SEQ ID NO: 6344459 - DNA, 15 bp, Homo sapiens
ggtgggaggggaaga

SEQ ID NO: 6344460 - DNA, 12 bp, Homo sapiens
ggtgggaggggg

SEQ ID NO: 6344461 - DNA, 13 bp, Homo sapiens
ggtgggagggggc

SEQ ID NO: 6344462 - DNA, 20 bp, Homo sapiens
ggtgggagggtctgcaggga

SEQ ID NO: 6344463 - DNA, 18 bp, Homo sapiens
ggtgggatccagaatgga

SEQ ID NO: 6344464 - DNA, 14 bp, Homo sapiens
ggtgggatcctcca

SEQ ID NO: 6344465 - DNA, 16 bp, Homo sapiens
ggtgggatggaggaga

SEQ ID NO: 6344466 - DNA, 18 bp, Homo sapiens
ggtgggatttgctcctgg

SEQ ID NO: 6344467 - DNA, 17 bp, Homo sapiens
ggtgggatttgtaaagc

SEQ ID NO: 6344468 - DNA, 15 bp, Homo sapiens
ggtgggattttgcaa

SEQ ID NO: 6344469 - DNA, 22 bp, Homo sapiens
ggtgggattttttcccttttta

SEQ ID NO: 6344470 - DNA, 18 bp, Homo sapiens
ggtgggcaccaagagcca

SEQ ID NO: 6344471 - DNA, 18 bp, Homo sapiens
ggtgggcacccaccctgg

SEQ ID NO: 6344472 - DNA, 16 bp, Homo sapiens
ggtgggcagaggctgg

SEQ ID NO: 6344473 - DNA, 20 bp, Homo sapiens
ggtgggcagatcacttgagc

SEQ ID NO: 6344474 - DNA, 20 bp, Homo sapiens
ggtgggcagatcatgggtca

SEQ ID NO: 6344475 - DNA, 19 bp, Homo sapiens
ggtgggcagcagctcagcc

SEQ ID NO: 6344476 - DNA, 14 bp, Homo sapiens
ggtgggcaggaaaa

SEQ ID NO: 6344477 - DNA, 14 bp, Homo sapiens
ggtgggcagggagg

SEQ ID NO: 6344478 - DNA, 16 bp, Homo sapiens
ggtgggcatgccaccc

SEQ ID NO: 6344479 - DNA, 12 bp, Homo sapiens
ggtgggccactc

SEQ ID NO: 6344480 - DNA, 15 bp, Homo sapiens
ggtgggccactctcc

SEQ ID NO: 6344481 - DNA, 13 bp, Homo sapiens
ggtgggccagagc

SEQ ID NO: 6344482 - DNA, 18 bp, Homo sapiens
ggtgggcccaggaccagc

SEQ ID NO: 6344483 - DNA, 22 bp, Homo sapiens
ggtgggcccaggaccagctggg

SEQ ID NO: 6344484 - DNA, 14 bp, Homo sapiens
ggtgggcccaggga

SEQ ID NO: 6344485 - DNA, 13 bp, Homo sapiens
ggtgggccccaca

SEQ ID NO: 6344486 - DNA, 14 bp, Homo sapiens
ggtgggccccagcc

SEQ ID NO: 6344487 - DNA, 19 bp, Homo sapiens
ggtgggccctgagtcctgg

SEQ ID NO: 6344488 - DNA, 13 bp, Homo sapiens
ggtgggccctgga

SEQ ID NO: 6344489 - DNA, 15 bp, Homo sapiens
ggtgggccctggagg

SEQ ID NO: 6344490 - DNA, 21 bp, Homo sapiens
ggtgggccctggaggggccca

SEQ ID NO: 6344491 - DNA, 14 bp, Homo sapiens
ggtgggcctctggt

SEQ ID NO: 6344492 - DNA, 13 bp, Homo sapiens
ggtgggcctgact

SEQ ID NO: 6344493 - DNA, 17 bp, Homo sapiens
gtttggtcttaggtctt

SEQ ID NO: 6344494 - DNA, 23 bp, Homo sapiens
gtttggtcttaggtcttcctgtg

SEQ ID NO: 6344495 - DNA, 13 bp, Homo sapiens
gtttggtgaggac

SEQ ID NO: 6344496 - DNA, 16 bp, Homo sapiens
gtttggtgcaaagtat

SEQ ID NO: 6344497 - DNA, 15 bp, Homo sapiens
gtttggtggccaggc

SEQ ID NO: 6344498 - DNA, 19 bp, Homo sapiens
gtttggtgtaggtaaatct

SEQ ID NO: 6344499 - DNA, 18 bp, Homo sapiens
gtttggttagaggaaggc

SEQ ID NO: 6344500 - DNA, 14 bp, Homo sapiens
gtttggtttacatt

SEQ ID NO: 6344501 - DNA, 22 bp, Homo sapiens
gtttggtttcccattggttcac

SEQ ID NO: 6344502 - DNA, 15 bp, Homo sapiens
gtttggttttacatt

SEQ ID NO: 6344503 - DNA, 20 bp, Homo sapiens
gtttggttttccaaaagaac

SEQ ID NO: 6344504 - DNA, 14 bp, Homo sapiens
gtttggtttttatt

SEQ ID NO: 6344505 - DNA, 20 bp, Homo sapiens
gtttggtttttttgtacaat

SEQ ID NO: 6344506 - DNA, 14 bp, Homo sapiens
gtttgtaaaaatat

SEQ ID NO: 6344507 - DNA, 13 bp, Homo sapiens
gtttgtaaacaac

SEQ ID NO: 6344508 - DNA, 10 bp, Homo sapiens
gtttgtaaat

SEQ ID NO: 6344509 - DNA, 14 bp, Homo sapiens
gtttgtaaatgcct

SEQ ID NO: 6344510 - DNA, 19 bp, Homo sapiens
gtttgtaaatgttatttct

SEQ ID NO: 6344511 - DNA, 11 bp, Homo sapiens
gtttgtaaatt

SEQ ID NO: 6344512 - DNA, 15 bp, Homo sapiens
gtttgtaaattattt

SEQ ID NO: 6344513 - DNA, 18 bp, Homo sapiens
gtttgtaaattatttgct

SEQ ID NO: 6344514 - DNA, 15 bp, Homo sapiens
gtttgtaaattctgg

SEQ ID NO: 6344515 - DNA, 15 bp, Homo sapiens
gtttgtaacaagaaa

SEQ ID NO: 6344516 - DNA, 21 bp, Homo sapiens
gtttgtaacttgggctgtaaa

SEQ ID NO: 6344517 - DNA, 18 bp, Homo sapiens
gtttgtaactttttacat

SEQ ID NO: 6344518 - DNA, 22 bp, Homo sapiens
gtttgtaactttttacattaca

SEQ ID NO: 6344519 - DNA, 16 bp, Homo sapiens
gtttgtaatactttac

SEQ ID NO: 6344520 - DNA, 15 bp, Homo sapiens
gtttgtaatatacag

SEQ ID NO: 6344521 - DNA, 15 bp, Homo sapiens
gtttgtactcagtgg

SEQ ID NO: 6344522 - DNA, 20 bp, Homo sapiens
gtttgtagcatttttctaat

SEQ ID NO: 6344523 - DNA, 14 bp, Homo sapiens
gtttgtagccaggt

SEQ ID NO: 6344524 - DNA, 14 bp, Homo sapiens
gtttgtagtaaata

SEQ ID NO: 6344525 - DNA, 14 bp, Homo sapiens
gtttgtatgtctgt

SEQ ID NO: 6344526 - DNA, 20 bp, Homo sapiens
gtttgtatgtgtgtagacaa

SEQ ID NO: 6344527 - DNA, 12 bp, Homo sapiens
gtttgtattcat

SEQ ID NO: 6344528 - DNA, 16 bp, Homo sapiens
gtttgtattcatgttc

SEQ ID NO: 6344529 - DNA, 21 bp, Homo sapiens
gtttgtattctacctttgtaa

SEQ ID NO: 6344530 - DNA, 12 bp, Homo sapiens
gtttgtatttgg

SEQ ID NO: 6344531 - DNA, 22 bp, Homo sapiens
gtttgtatttggaatatttgaa

SEQ ID NO: 6344532 - DNA, 14 bp, Homo sapiens
gtttgtatttttta

SEQ ID NO: 6344533 - DNA, 18 bp, Homo sapiens
gtttgtatttttttccaa

SEQ ID NO: 6344534 - DNA, 15 bp, Homo sapiens
gtttgtcagcatctg

SEQ ID NO: 6344535 - DNA, 16 bp, Homo sapiens
gtttgtcagtaaatac

SEQ ID NO: 6344536 - DNA, 17 bp, Homo sapiens
gtttgtcatatattcat

SEQ ID NO: 6344537 - DNA, 19 bp, Homo sapiens
gtttgtcatatattcatgt

SEQ ID NO: 6344538 - DNA, 20 bp, Homo sapiens
gtttgtcatcagatggaaat

SEQ ID NO: 6344539 - DNA, 17 bp, Homo sapiens
gtttgtcatggtgaaat

SEQ ID NO: 6344540 - DNA, 13 bp, Homo sapiens
gtttgtcattagc

SEQ ID NO: 6344541 - DNA, 18 bp, Homo sapiens
gtttgtccacacaagaca

SEQ ID NO: 6344542 - DNA, 20 bp, Homo sapiens
gtttgtccctcctgccatgt

SEQ ID NO: 6344543 - DNA, 16 bp, Homo sapiens
gtttgtcctgggttct

SEQ ID NO: 6344544 - DNA, 22 bp, Homo sapiens
gtttgtccttgcacctgagcct

SEQ ID NO: 6344545 - DNA, 17 bp, Homo sapiens
gtttgtcctttaactat

SEQ ID NO: 6344546 - DNA, 17 bp, Homo sapiens
gtttgtcctttatgtat

SEQ ID NO: 6344547 - DNA, 19 bp, Homo sapiens
gtttgtcctttatgtattc

SEQ ID NO: 6344548 - DNA, 21 bp, Homo sapiens
gtttgtcctttttcactttga

SEQ ID NO: 6344549 - DNA, 23 bp, Homo sapiens
gtttgtctatggggatacatgaa

SEQ ID NO: 6344550 - DNA, 15 bp, Homo sapiens
gtttgtctattttaa

SEQ ID NO: 6344551 - DNA, 15 bp, Homo sapiens
gtttgtctcgtggtt

SEQ ID NO: 6344552 - DNA, 14 bp, Homo sapiens
gtttgtctcttctg

SEQ ID NO: 6344553 - DNA, 15 bp, Homo sapiens
gtttgtctgaacaaa

SEQ ID NO: 6344554 - DNA, 15 bp, Homo sapiens
gtttgtctgtcttca

SEQ ID NO: 6344555 - DNA, 11 bp, Homo sapiens
gtttgtctgtt

SEQ ID NO: 6344556 - DNA, 17 bp, Homo sapiens
gtttgtcttctccccag

SEQ ID NO: 6344557 - DNA, 11 bp, Homo sapiens
gtttgtgagag

SEQ ID NO: 6344558 - DNA, 20 bp, Homo sapiens
gtttgtgagccttgctgcca

SEQ ID NO: 6344559 - DNA, 23 bp, Homo sapiens
gtttgtgagccttgctgccaagt

SEQ ID NO: 6344560 - DNA, 22 bp, Homo sapiens
gtttgtgagctttttgttccct

SEQ ID NO: 6344561 - DNA, 16 bp, Homo sapiens
gtttgtgagtatgtgt

SEQ ID NO: 6344562 - DNA, 16 bp, Homo sapiens
gtttgtgcaaacataa

SEQ ID NO: 6344563 - DNA, 23 bp, Homo sapiens
gtttgtgcatatctgcctcccct

SEQ ID NO: 6344564 - DNA, 19 bp, Homo sapiens
gtttgtgctgtaaagagtt

SEQ ID NO: 6344565 - DNA, 13 bp, Homo sapiens
gtttgtgcttcta

SEQ ID NO: 6344566 - DNA, 19 bp, Homo sapiens
gtttgtggaaaatgaaaat

SEQ ID NO: 6344567 - DNA, 12 bp, Homo sapiens
gtttgtggcctc

SEQ ID NO: 6344568 - DNA, 15 bp, Homo sapiens
gtttgtggctattaa

SEQ ID NO: 6344569 - DNA, 14 bp, Homo sapiens
gtttgtggctgttg

SEQ ID NO: 6344570 - DNA, 22 bp, Homo sapiens
gtttgtgtatttacgctttgat

SEQ ID NO: 6344571 - DNA, 21 bp, Homo sapiens
gtttgtgtcaaaactggttta

SEQ ID NO: 6344572 - DNA, 14 bp, Homo sapiens
gtttgtgtctgtgg

SEQ ID NO: 6344573 - DNA, 13 bp, Homo sapiens
gtttgtgtgattt

SEQ ID NO: 6344574 - DNA, 15 bp, Homo sapiens
gtttgtgtggatacc

SEQ ID NO: 6344575 - DNA, 22 bp, Homo sapiens
gtttgtgtgtatttgtattaat

SEQ ID NO: 6344576 - DNA, 21 bp, Homo sapiens
gtttgtgtgtctatttggcaa

SEQ ID NO: 6344577 - DNA, 21 bp, Homo sapiens
gtttgtgtgttgtcttgaaag

SEQ ID NO: 6344578 - DNA, 15 bp, Homo sapiens
gtttgtgtgtttcaa

SEQ ID NO: 6344579 - DNA, 21 bp, Homo sapiens
gtttgtgtgttttgtacactt

SEQ ID NO: 6344580 - DNA, 15 bp, Homo sapiens
gtttgtgttctgttt

SEQ ID NO: 6344581 - DNA, 17 bp, Homo sapiens
gtttgtgttctgttttg

SEQ ID NO: 6344582 - DNA, 20 bp, Homo sapiens
gtttgtgttgttgttgctgc

SEQ ID NO: 6344583 - DNA, 18 bp, Homo sapiens
gtttgtgtttatgaaaca

SEQ ID NO: 6344584 - DNA, 17 bp, Homo sapiens
gtttgtgtttgattggc

SEQ ID NO: 6344585 - DNA, 15 bp, Homo sapiens
gtttgtgttttaaaa

SEQ ID NO: 6344586 - DNA, 22 bp, Homo sapiens
gtttgtgttttaaaaaaactga

SEQ ID NO: 6344587 - DNA, 12 bp, Homo sapiens
gtttgttactgt

SEQ ID NO: 6344588 - DNA, 17 bp, Homo sapiens
gtttgttactgtcattc

SEQ ID NO: 6344589 - DNA, 13 bp, Homo sapiens
gtttgttatttac

SEQ ID NO: 6344590 - DNA, 15 bp, Homo sapiens
gtttgttcacactcc

SEQ ID NO: 6344591 - DNA, 16 bp, Homo sapiens
gtttgttcacttaaat

SEQ ID NO: 6344592 - DNA, 14 bp, Homo sapiens
gtttgttccagaat

SEQ ID NO: 6344593 - DNA, 13 bp, Homo sapiens
gtttgttccctgt

SEQ ID NO: 6344594 - DNA, 18 bp, Homo sapiens
gtttgttcctttgaagaa

SEQ ID NO: 6344595 - DNA, 18 bp, Homo sapiens
gtttgttctacatggctt

SEQ ID NO: 6344596 - DNA, 18 bp, Homo sapiens
gtttgttcttgtttttaa

SEQ ID NO: 6344597 - DNA, 21 bp, Homo sapiens
gtttgttgagctggtaacatc

SEQ ID NO: 6344598 - DNA, 22 bp, Homo sapiens
gtttgttgagctggtaacatcg

SEQ ID NO: 6344599 - DNA, 16 bp, Homo sapiens
gtttgttgattttcta

SEQ ID NO: 6344600 - DNA, 18 bp, Homo sapiens
gtttgttgcacagtccct

SEQ ID NO: 6344601 - DNA, 16 bp, Homo sapiens
gtttgttgctggcttg

SEQ ID NO: 6344602 - DNA, 17 bp, Homo sapiens
gtttgttggatccgttt

SEQ ID NO: 6344603 - DNA, 19 bp, Homo sapiens
gtttgttggatcttcaatg

SEQ ID NO: 6344604 - DNA, 13 bp, Homo sapiens
gtttgttggtcac

SEQ ID NO: 6344605 - DNA, 12 bp, Homo sapiens
gtttgtttactt

SEQ ID NO: 6344606 - DNA, 19 bp, Homo sapiens
gtttgtttattagatgaat

SEQ ID NO: 6344607 - DNA, 10 bp, Homo sapiens
gtttgtttca

SEQ ID NO: 6344608 - DNA, 13 bp, Homo sapiens
gtttgtttcctgt

SEQ ID NO: 6344609 - DNA, 18 bp, Homo sapiens
gtttgtttctccccctgg

SEQ ID NO: 6344610 - DNA, 13 bp, Homo sapiens
gtttgtttcttct

SEQ ID NO: 6344611 - DNA, 20 bp, Homo sapiens
gtttgtttcttcttttcctt

SEQ ID NO: 6344612 - DNA, 14 bp, Homo sapiens
gtttgtttctttgt

SEQ ID NO: 6344613 - DNA, 13 bp, Homo sapiens
gtttgtttgctgc

SEQ ID NO: 6344614 - DNA, 20 bp, Homo sapiens
gtttgtttgctgcttttgat

SEQ ID NO: 6344615 - DNA, 12 bp, Homo sapiens
gtttgtttgctt

SEQ ID NO: 6344616 - DNA, 15 bp, Homo sapiens
gtttgtttgtctgtt

SEQ ID NO: 6344617 - DNA, 12 bp, Homo sapiens
gtttgtttgtgt

SEQ ID NO: 6344618 - DNA, 11 bp, Homo sapiens
gtttgtttgtt

SEQ ID NO: 6344619 - DNA, 12 bp, Homo sapiens
gtttgttttact

SEQ ID NO: 6344620 - DNA, 22 bp, Homo sapiens
gtttgttttagaagattctatg

SEQ ID NO: 6344621 - DNA, 18 bp, Homo sapiens
gtttgttttcttgtctgt

SEQ ID NO: 6344622 - DNA, 15 bp, Homo sapiens
gtttgttttgtgaat

SEQ ID NO: 6344623 - DNA, 16 bp, Homo sapiens
gtttgtttttcaaagc

SEQ ID NO: 6344624 - DNA, 17 bp, Homo sapiens
gtttgtttttgctttct

SEQ ID NO: 6344625 - DNA, 17 bp, Homo sapiens
gtttgttttttcaagaa

SEQ ID NO: 6344626 - DNA, 19 bp, Homo sapiens
gtttgttttttcaagaaaa

SEQ ID NO: 6344627 - DNA, 15 bp, Homo sapiens
gtttgtttttttgcc

SEQ ID NO: 6344628 - DNA, 17 bp, Homo sapiens
gttttaaaaaatacagt

SEQ ID NO: 6344629 - DNA, 20 bp, Homo sapiens
gttttaaaaaggaactgcag

SEQ ID NO: 6344630 - DNA, 21 bp, Homo sapiens
gttttaaaactggacctgtat

SEQ ID NO: 6344631 - DNA, 21 bp, Homo sapiens
gttttaaaataagttaaaggc

SEQ ID NO: 6344632 - DNA, 21 bp, Homo sapiens
gttttaaaataatatgtaaat

SEQ ID NO: 6344633 - DNA, 16 bp, Homo sapiens
gttttaaaatactgta

SEQ ID NO: 6344634 - DNA, 15 bp, Homo sapiens
gttttaaaatgagaa

SEQ ID NO: 6344635 - DNA, 22 bp, Homo sapiens
gttttaaaatgtgaggcaataa

SEQ ID NO: 6344636 - DNA, 12 bp, Homo sapiens
gttttaaaatta

SEQ ID NO: 6344637 - DNA, 17 bp, Homo sapiens
gttttaaaattatatag

SEQ ID NO: 6344638 - DNA, 16 bp, Homo sapiens
gttttaaacctttaat

SEQ ID NO: 6344639 - DNA, 18 bp, Homo sapiens
gttttaaacgacttttgt

SEQ ID NO: 6344640 - DNA, 19 bp, Homo sapiens
gttttaaagaaattttagt

SEQ ID NO: 6344641 - DNA, 23 bp, Homo sapiens
gttttaaagaagtccatgtgata

SEQ ID NO: 6344642 - DNA, 23 bp, Homo sapiens
gttttaaagggtgcccatttgtg

SEQ ID NO: 6344643 - DNA, 15 bp, Homo sapiens
gttttaaagtgatta

SEQ ID NO: 6344644 - DNA, 14 bp, Homo sapiens
gttttaaagttaaa

SEQ ID NO: 6344645 - DNA, 15 bp, Homo sapiens
gttttaaatgtacag

SEQ ID NO: 6344646 - DNA, 14 bp, Homo sapiens
gttttaaatgtgtt

SEQ ID NO: 6344647 - DNA, 11 bp, Homo sapiens
gttttaaatta

SEQ ID NO: 6344648 - DNA, 13 bp, Homo sapiens
gttttaaattctg

SEQ ID NO: 6344649 - DNA, 16 bp, Homo sapiens
gttttaaattctgaga

SEQ ID NO: 6344650 - DNA, 23 bp, Homo sapiens
gttttaaatttaaaacaatgaat

SEQ ID NO: 6344651 - DNA, 14 bp, Homo sapiens
gttttaacaaaaac

SEQ ID NO: 6344652 - DNA, 21 bp, Homo sapiens
gttttaacaaatgctattaaa

SEQ ID NO: 6344653 - DNA, 15 bp, Homo sapiens
gttttaacagatgcc

SEQ ID NO: 6344654 - DNA, 17 bp, Homo sapiens
gttttaacattgaaagt

SEQ ID NO: 6344655 - DNA, 16 bp, Homo sapiens
gttttaactcttttgg

SEQ ID NO: 6344656 - DNA, 17 bp, Homo sapiens
gttttaacttattgttg

SEQ ID NO: 6344657 - DNA, 14 bp, Homo sapiens
gttttaacttttat

SEQ ID NO: 6344658 - DNA, 14 bp, Homo sapiens
gttttaagaaatgt

SEQ ID NO: 6344659 - DNA, 17 bp, Homo sapiens
gttttaagattgtaatt

SEQ ID NO: 6344660 - DNA, 21 bp, Homo sapiens
gttttaagattgtaattcaga

SEQ ID NO: 6344661 - DNA, 23 bp, Homo sapiens
gttttaagattgtaattcagaaa

SEQ ID NO: 6344662 - DNA, 20 bp, Homo sapiens
gttttaagctaaaatgttac

SEQ ID NO: 6344663 - DNA, 18 bp, Homo sapiens
gttttaaggaagaaaaat

SEQ ID NO: 6344664 - DNA, 19 bp, Homo sapiens
gttttaaggaagaaaaatc

SEQ ID NO: 6344665 - DNA, 18 bp, Homo sapiens
gttttaaggatgcttgta

SEQ ID NO: 6344666 - DNA, 17 bp, Homo sapiens
gttttaaggattctgca

SEQ ID NO: 6344667 - DNA, 21 bp, Homo sapiens
gttttaaggattctgcagaaa

SEQ ID NO: 6344668 - DNA, 16 bp, Homo sapiens
gttttaataaacagta

SEQ ID NO: 6344669 - DNA, 20 bp, Homo sapiens
gttttaataccacagctatt

SEQ ID NO: 6344670 - DNA, 19 bp, Homo sapiens
gttttaatacttgtaattc

SEQ ID NO: 6344671 - DNA, 14 bp, Homo sapiens
gttttaatctactt

SEQ ID NO: 6344672 - DNA, 23 bp, Homo sapiens
gttttaatctactttttgtattt

SEQ ID NO: 6344673 - DNA, 18 bp, Homo sapiens
gttttaatctgaaattct

SEQ ID NO: 6344674 - DNA, 16 bp, Homo sapiens
ggtgggcctgactgtt

SEQ ID NO: 6344675 - DNA, 13 bp, Homo sapiens
ggtgggcctggcc

SEQ ID NO: 6344676 - DNA, 16 bp, Homo sapiens
ggtgggcctggcctga

SEQ ID NO: 6344677 - DNA, 15 bp, Homo sapiens
ggtgggccttgctgg

SEQ ID NO: 6344678 - DNA, 20 bp, Homo sapiens
ggtgggcggcacagccttct

SEQ ID NO: 6344679 - DNA, 14 bp, Homo sapiens
ggtgggctccagag

SEQ ID NO: 6344680 - DNA, 13 bp, Homo sapiens
ggtgggctctgtg

SEQ ID NO: 6344681 - DNA, 13 bp, Homo sapiens
ggtgggctgagcc

SEQ ID NO: 6344682 - DNA, 17 bp, Homo sapiens
ggtgggctgagccctgg

SEQ ID NO: 6344683 - DNA, 18 bp, Homo sapiens
ggtgggctgatttacatg

SEQ ID NO: 6344684 - DNA, 15 bp, Homo sapiens
ggtgggctggcccag

SEQ ID NO: 6344685 - DNA, 16 bp, Homo sapiens
ggtgggctggcccagc

SEQ ID NO: 6344686 - DNA, 17 bp, Homo sapiens
ggtgggctggcccagcc

SEQ ID NO: 6344687 - DNA, 19 bp, Homo sapiens
ggtgggctgggcccaccca

SEQ ID NO: 6344688 - DNA, 19 bp, Homo sapiens
ggtgggctggggctgctcc

SEQ ID NO: 6344689 - DNA, 17 bp, Homo sapiens
ggtgggcttcagggcag

SEQ ID NO: 6344690 - DNA, 14 bp, Homo sapiens
ggtgggcttcccag

SEQ ID NO: 6344691 - DNA, 23 bp, Homo sapiens
ggtgggcttcctgcccttccctc

SEQ ID NO: 6344692 - DNA, 17 bp, Homo sapiens
ggtgggcttttccctgg

SEQ ID NO: 6344693 - DNA, 12 bp, Homo sapiens
ggtggggaaagg

SEQ ID NO: 6344694 - DNA, 20 bp, Homo sapiens
ggtggggaaggagggacttg

SEQ ID NO: 6344695 - DNA, 13 bp, Homo sapiens
ggtggggacaggt

SEQ ID NO: 6344696 - DNA, 20 bp, Homo sapiens
ggtggggacattgctctctg

SEQ ID NO: 6344697 - DNA, 23 bp, Homo sapiens
ggtggggacattgctctctgggc

SEQ ID NO: 6344698 - DNA, 19 bp, Homo sapiens
ggtggggaccaaaaccatg

SEQ ID NO: 6344699 - DNA, 14 bp, Homo sapiens
ggtggggagacctg

SEQ ID NO: 6344700 - DNA, 19 bp, Homo sapiens
ggtggggagcccaggcctg

SEQ ID NO: 6344701 - DNA, 20 bp, Homo sapiens
ggtggggagcccaggcctgg

SEQ ID NO: 6344702 - DNA, 14 bp, Homo sapiens
ggtggggaggagga

SEQ ID NO: 6344703 - DNA, 19 bp, Homo sapiens
ggtggggaggcccaaatga

SEQ ID NO: 6344704 - DNA, 15 bp, Homo sapiens
ggtggggaggccctg

SEQ ID NO: 6344705 - DNA, 12 bp, Homo sapiens
ggtggggagggt

SEQ ID NO: 6344706 - DNA, 18 bp, Homo sapiens
ggtggggcaatggggaga

SEQ ID NO: 6344707 - DNA, 20 bp, Homo sapiens
ggtggggcaatggggagagg

SEQ ID NO: 6344708 - DNA, 12 bp, Homo sapiens
ggtggggcagct

SEQ ID NO: 6344709 - DNA, 15 bp, Homo sapiens
ggtggggccaggcca

SEQ ID NO: 6344710 - DNA, 15 bp, Homo sapiens
ggtggggcccccagc

SEQ ID NO: 6344711 - DNA, 13 bp, Homo sapiens
ggtggggccctgc

SEQ ID NO: 6344712 - DNA, 12 bp, Homo sapiens
ggtggggcctca

SEQ ID NO: 6344713 - DNA, 16 bp, Homo sapiens
ggtggggcgggaaagc

SEQ ID NO: 6344714 - DNA, 17 bp, Homo sapiens
ggtggggcgggaaagcc

SEQ ID NO: 6344715 - DNA, 13 bp, Homo sapiens
ggtggggctccta

SEQ ID NO: 6344716 - DNA, 16 bp, Homo sapiens
ggtggggctcctacct

SEQ ID NO: 6344717 - DNA, 14 bp, Homo sapiens
ggtggggctcctgg

SEQ ID NO: 6344718 - DNA, 15 bp, Homo sapiens
ggtggggctgtcctg

SEQ ID NO: 6344719 - DNA, 16 bp, Homo sapiens
ggtggggctgtcctgc

SEQ ID NO: 6344720 - DNA, 18 bp, Homo sapiens
ggtgggggaaggggagga

SEQ ID NO: 6344721 - DNA, 13 bp, Homo sapiens
ggtgggggagcct

SEQ ID NO: 6344722 - DNA, 18 bp, Homo sapiens
ggtgggggagcctctgga

SEQ ID NO: 6344723 - DNA, 12 bp, Homo sapiens
ggtgggggagga

SEQ ID NO: 6344724 - DNA, 19 bp, Homo sapiens
ggtgggggaggagcctctg

SEQ ID NO: 6344725 - DNA, 14 bp, Homo sapiens
ggtgggggagggaa

SEQ ID NO: 6344726 - DNA, 15 bp, Homo sapiens
ggtgggggatgctga

SEQ ID NO: 6344727 - DNA, 20 bp, Homo sapiens
ggtgggggccacctgcctgc

SEQ ID NO: 6344728 - DNA, 12 bp, Homo sapiens
ggtgggggccag

SEQ ID NO: 6344729 - DNA, 16 bp, Homo sapiens
ggtgggggcctgctgt

SEQ ID NO: 6344730 - DNA, 15 bp, Homo sapiens
ggtgggggctggagg

SEQ ID NO: 6344731 - DNA, 14 bp, Homo sapiens
ggtggggggacagg

SEQ ID NO: 6344732 - DNA, 17 bp, Homo sapiens
ggtggggggagggcacc

SEQ ID NO: 6344733 - DNA, 15 bp, Homo sapiens
ggtgggggggcagag

SEQ ID NO: 6344734 - DNA, 17 bp, Homo sapiens
ggtggggggggtgctgg

SEQ ID NO: 6344735 - DNA, 20 bp, Homo sapiens
ggtgggggtagggggctgga

SEQ ID NO: 6344736 - DNA, 16 bp, Homo sapiens
ggtgggggtgccgctg

SEQ ID NO: 6344737 - DNA, 18 bp, Homo sapiens
ggtgggggtgctgctctc

SEQ ID NO: 6344738 - DNA, 17 bp, Homo sapiens
ggtgggggttctggcag

SEQ ID NO: 6344739 - DNA, 19 bp, Homo sapiens
ggtggggtcatgccctcct

SEQ ID NO: 6344740 - DNA, 17 bp, Homo sapiens
ggtggggtgcctgagcc

SEQ ID NO: 6344741 - DNA, 18 bp, Homo sapiens
ggtggggtgcctgagccc

SEQ ID NO: 6344742 - DNA, 15 bp, Homo sapiens
ggtggggtgctgggg

SEQ ID NO: 6344743 - DNA, 16 bp, Homo sapiens
ggtggggtgcttgctg

SEQ ID NO: 6344744 - DNA, 11 bp, Homo sapiens
ggtggggtgga

SEQ ID NO: 6344745 - DNA, 15 bp, Homo sapiens
ggtgggtcagcccag

SEQ ID NO: 6344746 - DNA, 10 bp, Homo sapiens
ggtgggtcca

SEQ ID NO: 6344747 - DNA, 20 bp, Homo sapiens
ggtgggtccaggggcccctc

SEQ ID NO: 6344748 - DNA, 17 bp, Homo sapiens
ggtgggtccatgggcag

SEQ ID NO: 6344749 - DNA, 20 bp, Homo sapiens
ggtgggtccatgggcagagc

SEQ ID NO: 6344750 - DNA, 18 bp, Homo sapiens
ggtgggtcccggctctgt

SEQ ID NO: 6344751 - DNA, 17 bp, Homo sapiens
ggtgggtctgagctgga

SEQ ID NO: 6344752 - DNA, 22 bp, Homo sapiens
ggtgggtgagctctcaggccga

SEQ ID NO: 6344753 - DNA, 12 bp, Homo sapiens
ggtgggtgctca

SEQ ID NO: 6344754 - DNA, 18 bp, Homo sapiens
ggtgggtggagtcaggct

SEQ ID NO: 6344755 - DNA, 16 bp, Homo sapiens
ggtgggtggtggggag

SEQ ID NO: 6344756 - DNA, 23 bp, Homo sapiens
ggtgggttgaatatagcctgcct

SEQ ID NO: 6344757 - DNA, 16 bp, Homo sapiens
ggtgggttttcttccc

SEQ ID NO: 6344758 - DNA, 15 bp, Homo sapiens
ggtggtaaattcaga

SEQ ID NO: 6344759 - DNA, 15 bp, Homo sapiens
ggtggtaactgccag

SEQ ID NO: 6344760 - DNA, 16 bp, Homo sapiens
ggtggtaactgccagc

SEQ ID NO: 6344761 - DNA, 17 bp, Homo sapiens
ggtggtaactgccagcc

SEQ ID NO: 6344762 - DNA, 22 bp, Homo sapiens
ggtggtaccaggtctcctccac

SEQ ID NO: 6344763 - DNA, 16 bp, Homo sapiens
ggtggtagaaatgatt

SEQ ID NO: 6344764 - DNA, 14 bp, Homo sapiens
ggtggtaggcctat

SEQ ID NO: 6344765 - DNA, 14 bp, Homo sapiens
ggtggtatgtgtgt

SEQ ID NO: 6344766 - DNA, 13 bp, Homo sapiens
ggtggtcacaggc

SEQ ID NO: 6344767 - DNA, 15 bp, Homo sapiens
ggtggtcacaggctg

SEQ ID NO: 6344768 - DNA, 17 bp, Homo sapiens
ggtggtcacaggctgtg

SEQ ID NO: 6344769 - DNA, 14 bp, Homo sapiens
ggtggtcaggcgta

SEQ ID NO: 6344770 - DNA, 17 bp, Homo sapiens
ggtggtccaccaagttc

SEQ ID NO: 6344771 - DNA, 20 bp, Homo sapiens
ggtggtctcttcctgtctgg

SEQ ID NO: 6344772 - DNA, 15 bp, Homo sapiens
ggtggtctgaatgtt

SEQ ID NO: 6344773 - DNA, 19 bp, Homo sapiens
ggtggtctgaatgttctga

SEQ ID NO: 6344774 - DNA, 14 bp, Homo sapiens
ggtggtctgagctg

SEQ ID NO: 6344775 - DNA, 22 bp, Homo sapiens
ggtggtctgagctgtcccaagt

SEQ ID NO: 6344776 - DNA, 16 bp, Homo sapiens
ggtggtctgcaggcag

SEQ ID NO: 6344777 - DNA, 18 bp, Homo sapiens
ggtggtctgcaggcaggg

SEQ ID NO: 6344778 - DNA, 16 bp, Homo sapiens
ggtggtctgttggcag

SEQ ID NO: 6344779 - DNA, 22 bp, Homo sapiens
ggtggtctgttggcaggctggc

SEQ ID NO: 6344780 - DNA, 18 bp, Homo sapiens
ggtggtcttcaagcctgg

SEQ ID NO: 6344781 - DNA, 16 bp, Homo sapiens
ggtggtgaaggggctg

SEQ ID NO: 6344782 - DNA, 19 bp, Homo sapiens
ggtggtgaaggggctggtg

SEQ ID NO: 6344783 - DNA, 15 bp, Homo sapiens
ggtggtgacctctgc

SEQ ID NO: 6344784 - DNA, 16 bp, Homo sapiens
ggtggtgacctctgcc

SEQ ID NO: 6344785 - DNA, 23 bp, Homo sapiens
ggtggtgcagccccaggaccaag

SEQ ID NO: 6344786 - DNA, 21 bp, Homo sapiens
ggtggtgcaggtagacctgtc

SEQ ID NO: 6344787 - DNA, 15 bp, Homo sapiens
ggtggtggaggagga

SEQ ID NO: 6344788 - DNA, 15 bp, Homo sapiens
ggtggtggagggggc

SEQ ID NO: 6344789 - DNA, 14 bp, Homo sapiens
ggtggtggatctgt

SEQ ID NO: 6344790 - DNA, 14 bp, Homo sapiens
ggtggtgggggtca

SEQ ID NO: 6344791 - DNA, 19 bp, Homo sapiens
ggtggtggtattctgtcat

SEQ ID NO: 6344792 - DNA, 15 bp, Homo sapiens
ggtggtggtgaaggg

SEQ ID NO: 6344793 - DNA, 16 bp, Homo sapiens
ggtggttaaggccagg

SEQ ID NO: 6344794 - DNA, 22 bp, Homo sapiens
ggtggttattggactccaggcc

SEQ ID NO: 6344795 - DNA, 22 bp, Homo sapiens
ggtggttatttggtattaaact

SEQ ID NO: 6344796 - DNA, 22 bp, Homo sapiens
ggtggttcactcttggagcctg

SEQ ID NO: 6344797 - DNA, 23 bp, Homo sapiens
ggtggttcactcttggagcctgc

SEQ ID NO: 6344798 - DNA, 19 bp, Homo sapiens
ggtggttcattccacagga

SEQ ID NO: 6344799 - DNA, 19 bp, Homo sapiens
ggtggttcgtgctgtgctc

SEQ ID NO: 6344800 - DNA, 14 bp, Homo sapiens
ggtggttggaggcc

SEQ ID NO: 6344801 - DNA, 18 bp, Homo sapiens
ggtggtttcagaaagggc

SEQ ID NO: 6344802 - DNA, 17 bp, Homo sapiens
ggtggtttcagaaatgt

SEQ ID NO: 6344803 - DNA, 15 bp, Homo sapiens
ggtggtttgccatgt

SEQ ID NO: 6344804 - DNA, 19 bp, Homo sapiens
ggtggttttcagattccac

SEQ ID NO: 6344805 - DNA, 18 bp, Homo sapiens
ggtgtaaaatatctacct

SEQ ID NO: 6344806 - DNA, 15 bp, Homo sapiens
ggtgtaaagctggcc

SEQ ID NO: 6344807 - DNA, 22 bp, Homo sapiens
ggtgtaaagctggccctgcctc

SEQ ID NO: 6344808 - DNA, 17 bp, Homo sapiens
ggtgtaaagttgttcgc

SEQ ID NO: 6344809 - DNA, 17 bp, Homo sapiens
ggtgtaacttcctgctg

SEQ ID NO: 6344810 - DNA, 14 bp, Homo sapiens
ggtgtaataagaca

SEQ ID NO: 6344811 - DNA, 18 bp, Homo sapiens
ggtgtaataagacataac

SEQ ID NO: 6344812 - DNA, 18 bp, Homo sapiens
ggtgtaatcatgaaggag

SEQ ID NO: 6344813 - DNA, 18 bp, Homo sapiens
ggtgtaatcattttaaat

SEQ ID NO: 6344814 - DNA, 14 bp, Homo sapiens
ggtgtaatgcacaa

SEQ ID NO: 6344815 - DNA, 15 bp, Homo sapiens
ggtgtaatgcacaat

SEQ ID NO: 6344816 - DNA, 14 bp, Homo sapiens
ggtgtaatggagca

SEQ ID NO: 6344817 - DNA, 21 bp, Homo sapiens
ggtgtaattaataaacgaaga

SEQ ID NO: 6344818 - DNA, 16 bp, Homo sapiens
ggtgtacactaacatt

SEQ ID NO: 6344819 - DNA, 18 bp, Homo sapiens
ggtgtacactaacatttc

SEQ ID NO: 6344820 - DNA, 19 bp, Homo sapiens
ggtgtactctaggacttca

SEQ ID NO: 6344821 - DNA, 19 bp, Homo sapiens
ggtgtactgtactgaagaa

SEQ ID NO: 6344822 - DNA, 22 bp, Homo sapiens
ggtgtagaacactaattcataa

SEQ ID NO: 6344823 - DNA, 12 bp, Homo sapiens
ggtgtagccagg

SEQ ID NO: 6344824 - DNA, 15 bp, Homo sapiens
ggtgtagctacagag

SEQ ID NO: 6344825 - DNA, 17 bp, Homo sapiens
ggtgtaggggccacctc

SEQ ID NO: 6344826 - DNA, 20 bp, Homo sapiens
ggtgtatagggaattttcat

SEQ ID NO: 6344827 - DNA, 18 bp, Homo sapiens
ggtgtatatcatgaagcc

SEQ ID NO: 6344828 - DNA, 22 bp, Homo sapiens
ggtgtatatgtgccacattttc

SEQ ID NO: 6344829 - DNA, 14 bp, Homo sapiens
ggtgtattatcatt

SEQ ID NO: 6344830 - DNA, 16 bp, Homo sapiens
ggtgtattatcatttt

SEQ ID NO: 6344831 - DNA, 16 bp, Homo sapiens
ggtgtatttaaactat

SEQ ID NO: 6344832 - DNA, 17 bp, Homo sapiens
ggtgtatttattttcct

SEQ ID NO: 6344833 - DNA, 23 bp, Homo sapiens
ggtgtcaaacattcgtgagctgg

SEQ ID NO: 6344834 - DNA, 13 bp, Homo sapiens
ggtgtcaactaaa

SEQ ID NO: 6344835 - DNA, 19 bp, Homo sapiens
ggtgtcaagagggtctgag

SEQ ID NO: 6344836 - DNA, 12 bp, Homo sapiens
ggtgtcaataaa

SEQ ID NO: 6344837 - DNA, 19 bp, Homo sapiens
ggtgtcacagaggcagtgg

SEQ ID NO: 6344838 - DNA, 23 bp, Homo sapiens
ggtgtcacatggggcctggccca

SEQ ID NO: 6344839 - DNA, 16 bp, Homo sapiens
ggtgtcaccagcctgt

SEQ ID NO: 6344840 - DNA, 21 bp, Homo sapiens
ggtgtcacccaaaccggcagg

SEQ ID NO: 6344841 - DNA, 11 bp, Homo sapiens
ggtgtcacccc

SEQ ID NO: 6344842 - DNA, 13 bp, Homo sapiens
ggtgtcaccccag

SEQ ID NO: 6344843 - DNA, 14 bp, Homo sapiens
ggtgtcaccccaga

SEQ ID NO: 6344844 - DNA, 15 bp, Homo sapiens
ggtgtcaccccagag

SEQ ID NO: 6344845 - DNA, 17 bp, Homo sapiens
ggtgtcactctgcctct

SEQ ID NO: 6344846 - DNA, 14 bp, Homo sapiens
ggtgtcactgtccc

SEQ ID NO: 6344847 - DNA, 20 bp, Homo sapiens
ggtgtcactgtccctcctgg

SEQ ID NO: 6344848 - DNA, 21 bp, Homo sapiens
ggtgtcagaagctgggaacgt

SEQ ID NO: 6344849 - DNA, 23 bp, Homo sapiens
ggtgtcagaccctggaggcccca

SEQ ID NO: 6344850 - DNA, 13 bp, Homo sapiens
ggtgtcaggcagg

SEQ ID NO: 6344851 - DNA, 20 bp, Homo sapiens
ggtgtcaggctgctggcgcc

SEQ ID NO: 6344852 - DNA, 20 bp, Homo sapiens
ggtgtcattctgcctgctcc

SEQ ID NO: 6344853 - DNA, 23 bp, Homo sapiens
ggtgtcatttgacaacacatgtg

SEQ ID NO: 6344854 - DNA, 15 bp, Homo sapiens
ggtgtccagcatgga

SEQ ID NO: 6344855 - DNA, 20 bp, Homo sapiens
gttttaatctgaaattctaa

SEQ ID NO: 6344856 - DNA, 21 bp, Homo sapiens
gttttaatctgaaattctaaa

SEQ ID NO: 6344857 - DNA, 20 bp, Homo sapiens
gttttaattccaatatgatg

SEQ ID NO: 6344858 - DNA, 22 bp, Homo sapiens
gttttaattccatgaatcgctt

SEQ ID NO: 6344859 - DNA, 12 bp, Homo sapiens
gttttaattgta

SEQ ID NO: 6344860 - DNA, 20 bp, Homo sapiens
gttttaatttagtaaaccaa

SEQ ID NO: 6344861 - DNA, 19 bp, Homo sapiens
gttttaatttatactggca

SEQ ID NO: 6344862 - DNA, 21 bp, Homo sapiens
gttttaattttcagttctatt

SEQ ID NO: 6344863 - DNA, 18 bp, Homo sapiens
gttttacaaagaaacaaa

SEQ ID NO: 6344864 - DNA, 22 bp, Homo sapiens
gttttacaaagaaacaaaatat

SEQ ID NO: 6344865 - DNA, 19 bp, Homo sapiens
gttttacaagaaaacaatg

SEQ ID NO: 6344866 - DNA, 16 bp, Homo sapiens
gttttacaagttggag

SEQ ID NO: 6344867 - DNA, 13 bp, Homo sapiens
gttttacaatagt

SEQ ID NO: 6344868 - DNA, 20 bp, Homo sapiens
gttttacaatagttctgtgg

SEQ ID NO: 6344869 - DNA, 19 bp, Homo sapiens
gttttacaatgatttgtaa

SEQ ID NO: 6344870 - DNA, 22 bp, Homo sapiens
gttttacaatgatttgtaaagg

SEQ ID NO: 6344871 - DNA, 16 bp, Homo sapiens
gttttacacagagaaa

SEQ ID NO: 6344872 - DNA, 19 bp, Homo sapiens
gttttacactggatgtttc

SEQ ID NO: 6344873 - DNA, 19 bp, Homo sapiens
gttttacagagaggataca

SEQ ID NO: 6344874 - DNA, 23 bp, Homo sapiens
gttttacagagaggatacattta

SEQ ID NO: 6344875 - DNA, 20 bp, Homo sapiens
gttttacagctgcctttcgt

SEQ ID NO: 6344876 - DNA, 22 bp, Homo sapiens
gttttacattacaaatttctgt

SEQ ID NO: 6344877 - DNA, 19 bp, Homo sapiens
gttttacattccatttcat

SEQ ID NO: 6344878 - DNA, 12 bp, Homo sapiens
gttttacattgt

SEQ ID NO: 6344879 - DNA, 19 bp, Homo sapiens
gttttaccaataaactgag

SEQ ID NO: 6344880 - DNA, 14 bp, Homo sapiens
gttttaccagctcc

SEQ ID NO: 6344881 - DNA, 15 bp, Homo sapiens
gttttaccccagctc

SEQ ID NO: 6344882 - DNA, 16 bp, Homo sapiens
gttttaccctatatct

SEQ ID NO: 6344883 - DNA, 17 bp, Homo sapiens
gttttacgcaaggaagg

SEQ ID NO: 6344884 - DNA, 14 bp, Homo sapiens
gttttacgtgcaaa

SEQ ID NO: 6344885 - DNA, 23 bp, Homo sapiens
gttttacgtgcaaacaacctgaa

SEQ ID NO: 6344886 - DNA, 21 bp, Homo sapiens
gttttactcttaaatcatttg

SEQ ID NO: 6344887 - DNA, 12 bp, Homo sapiens
gttttactcttt

SEQ ID NO: 6344888 - DNA, 15 bp, Homo sapiens
gttttactgcatttt

SEQ ID NO: 6344889 - DNA, 17 bp, Homo sapiens
gttttactgcattttca

SEQ ID NO: 6344890 - DNA, 20 bp, Homo sapiens
gttttactgcattttcacaa

SEQ ID NO: 6344891 - DNA, 17 bp, Homo sapiens
gttttactgtcagatta

SEQ ID NO: 6344892 - DNA, 20 bp, Homo sapiens
gttttactgtcagattaaat

SEQ ID NO: 6344893 - DNA, 13 bp, Homo sapiens
gttttactgtcta

SEQ ID NO: 6344894 - DNA, 17 bp, Homo sapiens
gttttacttacaaaaat

SEQ ID NO: 6344895 - DNA, 21 bp, Homo sapiens
gttttacttacaaaaatggga

SEQ ID NO: 6344896 - DNA, 22 bp, Homo sapiens
gttttacttctggcctttccta

SEQ ID NO: 6344897 - DNA, 14 bp, Homo sapiens
gttttactttgttt

SEQ ID NO: 6344898 - DNA, 13 bp, Homo sapiens
gttttagaaaaca

SEQ ID NO: 6344899 - DNA, 23 bp, Homo sapiens
gttttagaagagagcctttttct

SEQ ID NO: 6344900 - DNA, 17 bp, Homo sapiens
gttttagaagattctat

SEQ ID NO: 6344901 - DNA, 16 bp, Homo sapiens
gttttagaaggttctc

SEQ ID NO: 6344902 - DNA, 21 bp, Homo sapiens
gttttagaagttaaagtcaat

SEQ ID NO: 6344903 - DNA, 23 bp, Homo sapiens
gttttagacaaatactcatgtgt

SEQ ID NO: 6344904 - DNA, 19 bp, Homo sapiens
gttttagagttaacaatga

SEQ ID NO: 6344905 - DNA, 20 bp, Homo sapiens
gttttagccattgttggctt

SEQ ID NO: 6344906 - DNA, 12 bp, Homo sapiens
gttttagctgta

SEQ ID NO: 6344907 - DNA, 21 bp, Homo sapiens
gttttaggaaaagtgaatctt

SEQ ID NO: 6344908 - DNA, 22 bp, Homo sapiens
gttttaggatacttaacaaata

SEQ ID NO: 6344909 - DNA, 21 bp, Homo sapiens
gttttaggttctaaagttcta

SEQ ID NO: 6344910 - DNA, 16 bp, Homo sapiens
gttttagtttcaaaat

SEQ ID NO: 6344911 - DNA, 14 bp, Homo sapiens
gttttataaaatag

SEQ ID NO: 6344912 - DNA, 20 bp, Homo sapiens
gttttataactatataaatg

SEQ ID NO: 6344913 - DNA, 22 bp, Homo sapiens
gttttataagcatcattattta

SEQ ID NO: 6344914 - DNA, 13 bp, Homo sapiens
gttttataatttg

SEQ ID NO: 6344915 - DNA, 18 bp, Homo sapiens
gttttatacataaacagt

SEQ ID NO: 6344916 - DNA, 22 bp, Homo sapiens
gttttatactgctctataaata

SEQ ID NO: 6344917 - DNA, 20 bp, Homo sapiens
gttttatagtattaagtgaa

SEQ ID NO: 6344918 - DNA, 18 bp, Homo sapiens
gttttatataatgcatgt

SEQ ID NO: 6344919 - DNA, 19 bp, Homo sapiens
gttttatatcaaatgcctt

SEQ ID NO: 6344920 - DNA, 12 bp, Homo sapiens
gttttatatctt

SEQ ID NO: 6344921 - DNA, 14 bp, Homo sapiens
gttttatcatgaca

SEQ ID NO: 6344922 - DNA, 13 bp, Homo sapiens
gttttatccataa

SEQ ID NO: 6344923 - DNA, 15 bp, Homo sapiens
gttttatccataatg

SEQ ID NO: 6344924 - DNA, 16 bp, Homo sapiens
gttttatccataatga

SEQ ID NO: 6344925 - DNA, 21 bp, Homo sapiens
gttttatcgtccagtgacttt

SEQ ID NO: 6344926 - DNA, 20 bp, Homo sapiens
gttttatctccatactttgg

SEQ ID NO: 6344927 - DNA, 21 bp, Homo sapiens
gttttatctccatactttgga

SEQ ID NO: 6344928 - DNA, 21 bp, Homo sapiens
gttttatgagaaagccttctt

SEQ ID NO: 6344929 - DNA, 19 bp, Homo sapiens
gttttatgagatggatcac

SEQ ID NO: 6344930 - DNA, 22 bp, Homo sapiens
gttttatgagatggatcacata

SEQ ID NO: 6344931 - DNA, 18 bp, Homo sapiens
gttttatgccccattgga

SEQ ID NO: 6344932 - DNA, 14 bp, Homo sapiens
gttttatgctactg

SEQ ID NO: 6344933 - DNA, 17 bp, Homo sapiens
gttttatgtcatactct

SEQ ID NO: 6344934 - DNA, 16 bp, Homo sapiens
gttttattataaattc

SEQ ID NO: 6344935 - DNA, 23 bp, Homo sapiens
gttttattattgtttatgccaaa

SEQ ID NO: 6344936 - DNA, 15 bp, Homo sapiens
gttttattctgactt

SEQ ID NO: 6344937 - DNA, 17 bp, Homo sapiens
gttttattcttggtttt

SEQ ID NO: 6344938 - DNA, 20 bp, Homo sapiens
gttttattgagttctgaagg

SEQ ID NO: 6344939 - DNA, 22 bp, Homo sapiens
gttttatttaaatgctttttat

SEQ ID NO: 6344940 - DNA, 12 bp, Homo sapiens
gttttatttaac

SEQ ID NO: 6344941 - DNA, 13 bp, Homo sapiens
gttttatttatat

SEQ ID NO: 6344942 - DNA, 23 bp, Homo sapiens
gttttatttatatcttgttatta

SEQ ID NO: 6344943 - DNA, 24 bp, Homo sapiens
gttttatttatatcttgttattaa

SEQ ID NO: 6344944 - DNA, 22 bp, Homo sapiens
gttttatttatatttattgact

SEQ ID NO: 6344945 - DNA, 12 bp, Homo sapiens
gttttatttcat

SEQ ID NO: 6344946 - DNA, 15 bp, Homo sapiens
gttttatttgtatta

SEQ ID NO: 6344947 - DNA, 15 bp, Homo sapiens
gttttatttgtcagt

SEQ ID NO: 6344948 - DNA, 17 bp, Homo sapiens
gttttatttgtcagttt

SEQ ID NO: 6344949 - DNA, 12 bp, Homo sapiens
gttttattttaa

SEQ ID NO: 6344950 - DNA, 17 bp, Homo sapiens
gttttattttaagaggg

SEQ ID NO: 6344951 - DNA, 17 bp, Homo sapiens
gttttattttatgttta

SEQ ID NO: 6344952 - DNA, 19 bp, Homo sapiens
gttttattttcaaatctgg

SEQ ID NO: 6344953 - DNA, 21 bp, Homo sapiens
gttttattttctaaagtactg

SEQ ID NO: 6344954 - DNA, 17 bp, Homo sapiens
gttttattttggaattg

SEQ ID NO: 6344955 - DNA, 16 bp, Homo sapiens
gttttatttttaagaa

SEQ ID NO: 6344956 - DNA, 14 bp, Homo sapiens
gttttcaaaatact

SEQ ID NO: 6344957 - DNA, 18 bp, Homo sapiens
gttttcaaactgctgcat

SEQ ID NO: 6344958 - DNA, 13 bp, Homo sapiens
gttttcaaattat

SEQ ID NO: 6344959 - DNA, 23 bp, Homo sapiens
gttttcaaattggactttcaaaa

SEQ ID NO: 6344960 - DNA, 21 bp, Homo sapiens
gttttcaacaagcctgaaagt

SEQ ID NO: 6344961 - DNA, 17 bp, Homo sapiens
gttttcaactcaggaac

SEQ ID NO: 6344962 - DNA, 19 bp, Homo sapiens
gttttcaaggaagaaaacg

SEQ ID NO: 6344963 - DNA, 13 bp, Homo sapiens
gttttcaagtcaa

SEQ ID NO: 6344964 - DNA, 17 bp, Homo sapiens
gttttcaagtcaaatta

SEQ ID NO: 6344965 - DNA, 20 bp, Homo sapiens
gttttcaataacaaagcaca

SEQ ID NO: 6344966 - DNA, 22 bp, Homo sapiens
gttttcaatgaattaagaaaga

SEQ ID NO: 6344967 - DNA, 23 bp, Homo sapiens
gttttcaatgaattaagaaagat

SEQ ID NO: 6344968 - DNA, 18 bp, Homo sapiens
gttttcaattttaaacat

SEQ ID NO: 6344969 - DNA, 12 bp, Homo sapiens
gttttcacacct

SEQ ID NO: 6344970 - DNA, 19 bp, Homo sapiens
gttttcacttgtattgact

SEQ ID NO: 6344971 - DNA, 16 bp, Homo sapiens
gttttcacttgtctcc

SEQ ID NO: 6344972 - DNA, 19 bp, Homo sapiens
gttttcagaacctcttccc

SEQ ID NO: 6344973 - DNA, 20 bp, Homo sapiens
gttttcagaacctcttcccc

SEQ ID NO: 6344974 - DNA, 14 bp, Homo sapiens
gttttcagactcag

SEQ ID NO: 6344975 - DNA, 17 bp, Homo sapiens
gttttcagactcagact

SEQ ID NO: 6344976 - DNA, 12 bp, Homo sapiens
gttttcagactg

SEQ ID NO: 6344977 - DNA, 19 bp, Homo sapiens
gttttcagcaaattccaga

SEQ ID NO: 6344978 - DNA, 19 bp, Homo sapiens
gttttcagcattgatattt

SEQ ID NO: 6344979 - DNA, 24 bp, Homo sapiens
gttttcaggagtgggttgatttca

SEQ ID NO: 6344980 - DNA, 16 bp, Homo sapiens
gttttcagtgtacatg

SEQ ID NO: 6344981 - DNA, 19 bp, Homo sapiens
gttttcataacttgctgaa

SEQ ID NO: 6344982 - DNA, 14 bp, Homo sapiens
gttttcataataaa

SEQ ID NO: 6344983 - DNA, 20 bp, Homo sapiens
gttttcatcatttcagccaa

SEQ ID NO: 6344984 - DNA, 18 bp, Homo sapiens
gttttcatccataactga

SEQ ID NO: 6344985 - DNA, 21 bp, Homo sapiens
gttttcatccataactgaaca

SEQ ID NO: 6344986 - DNA, 10 bp, Homo sapiens
gttttcatgg

SEQ ID NO: 6344987 - DNA, 23 bp, Homo sapiens
gttttcatggtgaaaatgtactg

SEQ ID NO: 6344988 - DNA, 16 bp, Homo sapiens
gttttcatgtaaataa

SEQ ID NO: 6344989 - DNA, 20 bp, Homo sapiens
gttttcattcattggtgaag

SEQ ID NO: 6344990 - DNA, 12 bp, Homo sapiens
gttttcatttca

SEQ ID NO: 6344991 - DNA, 16 bp, Homo sapiens
gttttcatttggttca

SEQ ID NO: 6344992 - DNA, 22 bp, Homo sapiens
gttttcattttaactggcatgt

SEQ ID NO: 6344993 - DNA, 20 bp, Homo sapiens
gttttcattttagacattca

SEQ ID NO: 6344994 - DNA, 18 bp, Homo sapiens
gttttccaaaagtaaaga

SEQ ID NO: 6344995 - DNA, 11 bp, Homo sapiens
gttttccaaac

SEQ ID NO: 6344996 - DNA, 20 bp, Homo sapiens
gttttccaagccctcagctg

SEQ ID NO: 6344997 - DNA, 18 bp, Homo sapiens
gttttccaatattttaat

SEQ ID NO: 6344998 - DNA, 18 bp, Homo sapiens
gttttccagtattgaaaa

SEQ ID NO: 6344999 - DNA, 17 bp, Homo sapiens
gttttccatgaaaacgt

SEQ ID NO: 6345000 - DNA, 18 bp, Homo sapiens
gttttccatgatttagca

SEQ ID NO: 6345001 - DNA, 17 bp, Homo sapiens
gttttccattgtttgaa

SEQ ID NO: 6345002 - DNA, 23 bp, Homo sapiens
gttttcccctggcctcagttccc

SEQ ID NO: 6345003 - DNA, 22 bp, Homo sapiens
gttttcccgagcaaagtctaaa

SEQ ID NO: 6345004 - DNA, 23 bp, Homo sapiens
gttttcccgagcaaagtctaaag

SEQ ID NO: 6345005 - DNA, 15 bp, Homo sapiens
gttttccctgcactg

SEQ ID NO: 6345006 - DNA, 16 bp, Homo sapiens
gttttcctaaatgcag

SEQ ID NO: 6345007 - DNA, 16 bp, Homo sapiens
gttttcctaaatgtat

SEQ ID NO: 6345008 - DNA, 24 bp, Homo sapiens
gttttcctaaatgtatacctgtaa

SEQ ID NO: 6345009 - DNA, 17 bp, Homo sapiens
gttttcctatgctttga

SEQ ID NO: 6345010 - DNA, 21 bp, Homo sapiens
gttttcctatgctttgaaaca

SEQ ID NO: 6345011 - DNA, 14 bp, Homo sapiens
gttttcctcccttc

SEQ ID NO: 6345012 - DNA, 18 bp, Homo sapiens
gttttcctcccttctgct

SEQ ID NO: 6345013 - DNA, 13 bp, Homo sapiens
gttttcctgaaga

SEQ ID NO: 6345014 - DNA, 22 bp, Homo sapiens
gttttccttgctatttcaataa

SEQ ID NO: 6345015 - DNA, 19 bp, Homo sapiens
gttttcctttgtcatcatt

SEQ ID NO: 6345016 - DNA, 20 bp, Homo sapiens
gttttccttttatttcttca

SEQ ID NO: 6345017 - DNA, 13 bp, Homo sapiens
gttttccttttgt

SEQ ID NO: 6345018 - DNA, 19 bp, Homo sapiens
gttttcgaagctcagccca

SEQ ID NO: 6345019 - DNA, 23 bp, Homo sapiens
gttttcgaagctcagcccacccc

SEQ ID NO: 6345020 - DNA, 14 bp, Homo sapiens
gttttcgatgatga

SEQ ID NO: 6345021 - DNA, 14 bp, Homo sapiens
gttttcgtcatctt

SEQ ID NO: 6345022 - DNA, 21 bp, Homo sapiens
gttttcgtcatcttccctgcc

SEQ ID NO: 6345023 - DNA, 19 bp, Homo sapiens
gttttctaaaaaaaaaaac

SEQ ID NO: 6345024 - DNA, 21 bp, Homo sapiens
gttttctaaaaaaaaaaactg

SEQ ID NO: 6345025 - DNA, 16 bp, Homo sapiens
gttttctaaatgtttc

SEQ ID NO: 6345026 - DNA, 20 bp, Homo sapiens
gttttctaaatgtttctttt

SEQ ID NO: 6345027 - DNA, 13 bp, Homo sapiens
gttttctaactgt

SEQ ID NO: 6345028 - DNA, 15 bp, Homo sapiens
gttttctaactgtaa

SEQ ID NO: 6345029 - DNA, 15 bp, Homo sapiens
gttttctaagatgtt

SEQ ID NO: 6345030 - DNA, 11 bp, Homo sapiens
gttttctaatt

SEQ ID NO: 6345031 - DNA, 18 bp, Homo sapiens
gttttctagatgacataa

SEQ ID NO: 6345032 - DNA, 16 bp, Homo sapiens
ggtgtcccagaccccg

SEQ ID NO: 6345033 - DNA, 13 bp, Homo sapiens
ggtgtccccacca

SEQ ID NO: 6345034 - DNA, 16 bp, Homo sapiens
ggtgtccccagcccac

SEQ ID NO: 6345035 - DNA, 20 bp, Homo sapiens
ggtgtccccgctgctgtgca

SEQ ID NO: 6345036 - DNA, 16 bp, Homo sapiens
ggtgtccccttcccct

SEQ ID NO: 6345037 - DNA, 20 bp, Homo sapiens
ggtgtccccttcccctgctg

SEQ ID NO: 6345038 - DNA, 16 bp, Homo sapiens
ggtgtccctgcctggc

SEQ ID NO: 6345039 - DNA, 17 bp, Homo sapiens
ggtgtccctgcctggcc

SEQ ID NO: 6345040 - DNA, 16 bp, Homo sapiens
ggtgtccctggatgtg

SEQ ID NO: 6345041 - DNA, 18 bp, Homo sapiens
ggtgtccctttcacactg

SEQ ID NO: 6345042 - DNA, 15 bp, Homo sapiens
ggtgtcctacagaaa

SEQ ID NO: 6345043 - DNA, 16 bp, Homo sapiens
ggtgtcctacagaaaa

SEQ ID NO: 6345044 - DNA, 21 bp, Homo sapiens
ggtgtcctacagaaaaacctt

SEQ ID NO: 6345045 - DNA, 23 bp, Homo sapiens
ggtgtcctctgtccgtctgtcct

SEQ ID NO: 6345046 - DNA, 13 bp, Homo sapiens
ggtgtcctgacca

SEQ ID NO: 6345047 - DNA, 14 bp, Homo sapiens
ggtgtcctgaccac

SEQ ID NO: 6345048 - DNA, 17 bp, Homo sapiens
ggtgtccttctcctctt

SEQ ID NO: 6345049 - DNA, 20 bp, Homo sapiens
ggtgtcctttcccctctctg

SEQ ID NO: 6345050 - DNA, 17 bp, Homo sapiens
ggtgtcctttccctcca

SEQ ID NO: 6345051 - DNA, 15 bp, Homo sapiens
ggtgtcgcgccttct

SEQ ID NO: 6345052 - DNA, 21 bp, Homo sapiens
ggtgtcgcgccttctcccccc

SEQ ID NO: 6345053 - DNA, 21 bp, Homo sapiens
ggtgtcgctctgctggcctgg

SEQ ID NO: 6345054 - DNA, 15 bp, Homo sapiens
ggtgtcgtcctgcag

SEQ ID NO: 6345055 - DNA, 18 bp, Homo sapiens
ggtgtctcaggctgcctg

SEQ ID NO: 6345056 - DNA, 21 bp, Homo sapiens
ggtgtctcaggctgcctgagt

SEQ ID NO: 6345057 - DNA, 23 bp, Homo sapiens
ggtgtctccaaccccccagcact

SEQ ID NO: 6345058 - DNA, 12 bp, Homo sapiens
ggtgtctccctc

SEQ ID NO: 6345059 - DNA, 15 bp, Homo sapiens
ggtgtctccttaagc

SEQ ID NO: 6345060 - DNA, 13 bp, Homo sapiens
ggtgtctctgggc

SEQ ID NO: 6345061 - DNA, 15 bp, Homo sapiens
ggtgtctgcacctta

SEQ ID NO: 6345062 - DNA, 13 bp, Homo sapiens
ggtgtctgcgggg

SEQ ID NO: 6345063 - DNA, 15 bp, Homo sapiens
ggtgtctggcctgag

SEQ ID NO: 6345064 - DNA, 16 bp, Homo sapiens
ggtgtctggcctgagg

SEQ ID NO: 6345065 - DNA, 13 bp, Homo sapiens
ggtgtcttgagac

SEQ ID NO: 6345066 - DNA, 21 bp, Homo sapiens
ggtgtcttgagaccagcctgc

SEQ ID NO: 6345067 - DNA, 23 bp, Homo sapiens
ggtgtcttggacccacctgaaat

SEQ ID NO: 6345068 - DNA, 10 bp, Homo sapiens
ggtgtctttt

SEQ ID NO: 6345069 - DNA, 16 bp, Homo sapiens
ggtgtgaacatgttct

SEQ ID NO: 6345070 - DNA, 18 bp, Homo sapiens
ggtgtgaacctacctgcc

SEQ ID NO: 6345071 - DNA, 13 bp, Homo sapiens
ggtgtgaactttt

SEQ ID NO: 6345072 - DNA, 17 bp, Homo sapiens
ggtgtgaatttgccaga

SEQ ID NO: 6345073 - DNA, 14 bp, Homo sapiens
ggtgtgaccatgtt

SEQ ID NO: 6345074 - DNA, 22 bp, Homo sapiens
ggtgtgacctgacacctgccgc

SEQ ID NO: 6345075 - DNA, 19 bp, Homo sapiens
ggtgtgactcgggagctgc

SEQ ID NO: 6345076 - DNA, 20 bp, Homo sapiens
ggtgtgactcgggagctgca

SEQ ID NO: 6345077 - DNA, 17 bp, Homo sapiens
ggtgtgagccacagcac

SEQ ID NO: 6345078 - DNA, 19 bp, Homo sapiens
ggtgtgaggacataaatct

SEQ ID NO: 6345079 - DNA, 11 bp, Homo sapiens
ggtgtgaggag

SEQ ID NO: 6345080 - DNA, 22 bp, Homo sapiens
ggtgtgaggaggacaaaataaa

SEQ ID NO: 6345081 - DNA, 13 bp, Homo sapiens
ggtgtgaggccac

SEQ ID NO: 6345082 - DNA, 15 bp, Homo sapiens
ggtgtgaggccacac

SEQ ID NO: 6345083 - DNA, 18 bp, Homo sapiens
ggtgtgagtcaccaagcc

SEQ ID NO: 6345084 - DNA, 15 bp, Homo sapiens
ggtgtgatcgtctga

SEQ ID NO: 6345085 - DNA, 20 bp, Homo sapiens
ggtgtgcaatgtctgagtga

SEQ ID NO: 6345086 - DNA, 18 bp, Homo sapiens
ggtgtgcacatctctgct

SEQ ID NO: 6345087 - DNA, 15 bp, Homo sapiens
ggtgtgcatctgtgt

SEQ ID NO: 6345088 - DNA, 15 bp, Homo sapiens
ggtgtgccaaactac

SEQ ID NO: 6345089 - DNA, 23 bp, Homo sapiens
ggtgtgccacaggctgcaagctg

SEQ ID NO: 6345090 - DNA, 23 bp, Homo sapiens
ggtgtgccagaaagtcccccctc

SEQ ID NO: 6345091 - DNA, 17 bp, Homo sapiens
ggtgtgccctggctccc

SEQ ID NO: 6345092 - DNA, 14 bp, Homo sapiens
ggtgtgcctgccct

SEQ ID NO: 6345093 - DNA, 15 bp, Homo sapiens
ggtgtgcctggcctc

SEQ ID NO: 6345094 - DNA, 13 bp, Homo sapiens
ggtgtgcctgtgc

SEQ ID NO: 6345095 - DNA, 21 bp, Homo sapiens
ggtgtgcctgtgctcctgccc

SEQ ID NO: 6345096 - DNA, 17 bp, Homo sapiens
ggtgtgccttccagatc

SEQ ID NO: 6345097 - DNA, 21 bp, Homo sapiens
ggtgtgcggaggcaggagcat

SEQ ID NO: 6345098 - DNA, 21 bp, Homo sapiens
ggtgtgcggcctttggcttca

SEQ ID NO: 6345099 - DNA, 20 bp, Homo sapiens
ggtgtgcgtgcgtgtgcgtg

SEQ ID NO: 6345100 - DNA, 13 bp, Homo sapiens
ggtgtgctacaga

SEQ ID NO: 6345101 - DNA, 14 bp, Homo sapiens
ggtgtgctatagct

SEQ ID NO: 6345102 - DNA, 15 bp, Homo sapiens
ggtgtgctccaggct

SEQ ID NO: 6345103 - DNA, 15 bp, Homo sapiens
ggtgtgctctgggct

SEQ ID NO: 6345104 - DNA, 12 bp, Homo sapiens
ggtgtgctggga

SEQ ID NO: 6345105 - DNA, 22 bp, Homo sapiens
ggtgtgctgggagctccactct

SEQ ID NO: 6345106 - DNA, 21 bp, Homo sapiens
ggtgtggaccgaggaacaact

SEQ ID NO: 6345107 - DNA, 19 bp, Homo sapiens
ggtgtggaccggccgcagc

SEQ ID NO: 6345108 - DNA, 12 bp, Homo sapiens
ggtgtggagaag

SEQ ID NO: 6345109 - DNA, 19 bp, Homo sapiens
ggtgtggagaccaggctcc

SEQ ID NO: 6345110 - DNA, 19 bp, Homo sapiens
ggtgtggagttggggctgc

SEQ ID NO: 6345111 - DNA, 18 bp, Homo sapiens
ggtgtggccctgccatct

SEQ ID NO: 6345112 - DNA, 13 bp, Homo sapiens
ggtgtggcctcag

SEQ ID NO: 6345113 - DNA, 19 bp, Homo sapiens
ggtgtggcctggcttctgg

SEQ ID NO: 6345114 - DNA, 12 bp, Homo sapiens
ggtgtggctcct

SEQ ID NO: 6345115 - DNA, 12 bp, Homo sapiens
ggtgtgggctcc

SEQ ID NO: 6345116 - DNA, 21 bp, Homo sapiens
ggtgtgggctcccacgccctc

SEQ ID NO: 6345117 - DNA, 22 bp, Homo sapiens
ggtgtggggacacagcagtgag

SEQ ID NO: 6345118 - DNA, 13 bp, Homo sapiens
ggtgtgggggaag

SEQ ID NO: 6345119 - DNA, 14 bp, Homo sapiens
ggtgtggggggctg

SEQ ID NO: 6345120 - DNA, 19 bp, Homo sapiens
ggtgtgggtaaagggacag

SEQ ID NO: 6345121 - DNA, 20 bp, Homo sapiens
ggtgtgggtggaagggctgg

SEQ ID NO: 6345122 - DNA, 19 bp, Homo sapiens
ggtgtgggtgtcctgcctg

SEQ ID NO: 6345123 - DNA, 16 bp, Homo sapiens
ggtgtggtacagagaa

SEQ ID NO: 6345124 - DNA, 20 bp, Homo sapiens
ggtgtggtacagagaagcca

SEQ ID NO: 6345125 - DNA, 21 bp, Homo sapiens
ggtgtggtacagagaagccag

SEQ ID NO: 6345126 - DNA, 21 bp, Homo sapiens
ggtgtggtcgtcatgctgtcc

SEQ ID NO: 6345127 - DNA, 23 bp, Homo sapiens
ggtgtggtcgtcatgctgtccgt

SEQ ID NO: 6345128 - DNA, 14 bp, Homo sapiens
ggtgtggtggctca

SEQ ID NO: 6345129 - DNA, 18 bp, Homo sapiens
ggtgtggtggctcatggc

SEQ ID NO: 6345130 - DNA, 16 bp, Homo sapiens
ggtgtgtactcagggc

SEQ ID NO: 6345131 - DNA, 14 bp, Homo sapiens
ggtgtgtcatttct

SEQ ID NO: 6345132 - DNA, 17 bp, Homo sapiens
ggtgtgtccctggacac

SEQ ID NO: 6345133 - DNA, 22 bp, Homo sapiens
ggtgtgtccctggacacagctc

SEQ ID NO: 6345134 - DNA, 18 bp, Homo sapiens
ggtgtgtccttgaactga

SEQ ID NO: 6345135 - DNA, 14 bp, Homo sapiens
ggtgtgtgaagttt

SEQ ID NO: 6345136 - DNA, 22 bp, Homo sapiens
ggtgtgtgccatcatgcctgac

SEQ ID NO: 6345137 - DNA, 15 bp, Homo sapiens
ggtgtgtgcgcctga

SEQ ID NO: 6345138 - DNA, 22 bp, Homo sapiens
ggtgtgtggccgcctggcaggt

SEQ ID NO: 6345139 - DNA, 18 bp, Homo sapiens
ggtgtgtggcctccctgg

SEQ ID NO: 6345140 - DNA, 23 bp, Homo sapiens
ggtgtgtgtgtgtgttttaattt

SEQ ID NO: 6345141 - DNA, 19 bp, Homo sapiens
ggtgtgttccaactgcccc

SEQ ID NO: 6345142 - DNA, 18 bp, Homo sapiens
ggtgtgtttcaggacagc

SEQ ID NO: 6345143 - DNA, 21 bp, Homo sapiens
ggtgtgtttcaggacagctgc

SEQ ID NO: 6345144 - DNA, 13 bp, Homo sapiens
ggtgtgtttgtaa

SEQ ID NO: 6345145 - DNA, 15 bp, Homo sapiens
ggtgttaaaacatca

SEQ ID NO: 6345146 - DNA, 13 bp, Homo sapiens
ggtgttaacagaa

SEQ ID NO: 6345147 - DNA, 15 bp, Homo sapiens
ggtgttaacagaagg

SEQ ID NO: 6345148 - DNA, 14 bp, Homo sapiens
ggtgttaatttttg

SEQ ID NO: 6345149 - DNA, 20 bp, Homo sapiens
ggtgttacacagcccaagag

SEQ ID NO: 6345150 - DNA, 20 bp, Homo sapiens
ggtgttatgtttatgtaaca

SEQ ID NO: 6345151 - DNA, 19 bp, Homo sapiens
ggtgttcaccaaaaccaaa

SEQ ID NO: 6345152 - DNA, 15 bp, Homo sapiens
ggtgttcagaggcag

SEQ ID NO: 6345153 - DNA, 20 bp, Homo sapiens
ggtgttcatgacaagtggaa

SEQ ID NO: 6345154 - DNA, 23 bp, Homo sapiens
ggtgttccaaagagaaggcctgg

SEQ ID NO: 6345155 - DNA, 23 bp, Homo sapiens
ggtgttccgtgggaccctcagca

SEQ ID NO: 6345156 - DNA, 18 bp, Homo sapiens
ggtgttcctaccaggact

SEQ ID NO: 6345157 - DNA, 12 bp, Homo sapiens
ggtgttcctgga

SEQ ID NO: 6345158 - DNA, 13 bp, Homo sapiens
ggtgttcctggaa

SEQ ID NO: 6345159 - DNA, 16 bp, Homo sapiens
ggtgttcctggaagca

SEQ ID NO: 6345160 - DNA, 17 bp, Homo sapiens
ggtgttcctggaagcag

SEQ ID NO: 6345161 - DNA, 13 bp, Homo sapiens
ggtgttctaagat

SEQ ID NO: 6345162 - DNA, 12 bp, Homo sapiens
ggtgttctggct

SEQ ID NO: 6345163 - DNA, 22 bp, Homo sapiens
ggtgttctttcctgccctgtcc

SEQ ID NO: 6345164 - DNA, 21 bp, Homo sapiens
ggtgttgcagccgcagagaaa

SEQ ID NO: 6345165 - DNA, 17 bp, Homo sapiens
ggtgttgccagttgtcc

SEQ ID NO: 6345166 - DNA, 13 bp, Homo sapiens
ggtgttgctgttt

SEQ ID NO: 6345167 - DNA, 16 bp, Homo sapiens
ggtgttggaggggcag

SEQ ID NO: 6345168 - DNA, 19 bp, Homo sapiens
ggtgttgtactcaatttta

SEQ ID NO: 6345169 - DNA, 13 bp, Homo sapiens
ggtgtttaaagtc

SEQ ID NO: 6345170 - DNA, 22 bp, Homo sapiens
ggtgtttatgtgaacattccta

SEQ ID NO: 6345171 - DNA, 22 bp, Homo sapiens
ggtgtttattacaagtggctcc

SEQ ID NO: 6345172 - DNA, 21 bp, Homo sapiens
ggtgtttattataaagcttaa

SEQ ID NO: 6345173 - DNA, 13 bp, Homo sapiens
ggtgtttattgca

SEQ ID NO: 6345174 - DNA, 20 bp, Homo sapiens
ggtgtttcccttcctcggtg

SEQ ID NO: 6345175 - DNA, 14 bp, Homo sapiens
ggtgtttcctctaa

SEQ ID NO: 6345176 - DNA, 10 bp, Homo sapiens
ggtgtttcta

SEQ ID NO: 6345177 - DNA, 21 bp, Homo sapiens
ggtgtttctagcactggcctg

SEQ ID NO: 6345178 - DNA, 15 bp, Homo sapiens
ggtgtttctatctct

SEQ ID NO: 6345179 - DNA, 20 bp, Homo sapiens
ggtgtttgaaaatagtttat

SEQ ID NO: 6345180 - DNA, 14 bp, Homo sapiens
ggtgttttaaacac

SEQ ID NO: 6345181 - DNA, 16 bp, Homo sapiens
ggtgttttcagaaaga

SEQ ID NO: 6345182 - DNA, 14 bp, Homo sapiens
ggtgttttcatgta

SEQ ID NO: 6345183 - DNA, 13 bp, Homo sapiens
ggtgttttctgtg

SEQ ID NO: 6345184 - DNA, 17 bp, Homo sapiens
ggtgttttctgtgtaac

SEQ ID NO: 6345185 - DNA, 22 bp, Homo sapiens
ggtgttttttatgaagtgcgtg

SEQ ID NO: 6345186 - DNA, 21 bp, Homo sapiens
ggttaaaactgtacatttaaa

SEQ ID NO: 6345187 - DNA, 12 bp, Homo sapiens
ggttaaaatgga

SEQ ID NO: 6345188 - DNA, 18 bp, Homo sapiens
ggttaaagctaaactgaa

SEQ ID NO: 6345189 - DNA, 11 bp, Homo sapiens
ggttaaataaa

SEQ ID NO: 6345190 - DNA, 18 bp, Homo sapiens
ggttaaatattttgctaa

SEQ ID NO: 6345191 - DNA, 15 bp, Homo sapiens
ggttaaatcatttgg

SEQ ID NO: 6345192 - DNA, 14 bp, Homo sapiens
ggttaaatgttttg

SEQ ID NO: 6345193 - DNA, 12 bp, Homo sapiens
ggttaacagtaa

SEQ ID NO: 6345194 - DNA, 20 bp, Homo sapiens
ggttaacagtaaatatacac

SEQ ID NO: 6345195 - DNA, 17 bp, Homo sapiens
ggttaagaaagcactta

SEQ ID NO: 6345196 - DNA, 13 bp, Homo sapiens
ggttaagaaatac

SEQ ID NO: 6345197 - DNA, 14 bp, Homo sapiens
ggttaagaaatacc

SEQ ID NO: 6345198 - DNA, 13 bp, Homo sapiens
ggttaagccatat

SEQ ID NO: 6345199 - DNA, 22 bp, Homo sapiens
ggttaaggctgaggaaaggcca

SEQ ID NO: 6345200 - DNA, 13 bp, Homo sapiens
ggttaagggactt

SEQ ID NO: 6345201 - DNA, 12 bp, Homo sapiens
ggttaaggggat

SEQ ID NO: 6345202 - DNA, 18 bp, Homo sapiens
ggttaataaaactgcaca

SEQ ID NO: 6345203 - DNA, 15 bp, Homo sapiens
ggttaataccagctt

SEQ ID NO: 6345204 - DNA, 17 bp, Homo sapiens
ggttaatcatatttgaa

SEQ ID NO: 6345205 - DNA, 22 bp, Homo sapiens
ggttaatcatatttgaaaacca

SEQ ID NO: 6345206 - DNA, 17 bp, Homo sapiens
ggttaatctttcctgat

SEQ ID NO: 6345207 - DNA, 18 bp, Homo sapiens
ggttaatgttgatttaaa

SEQ ID NO: 6345208 - DNA, 13 bp, Homo sapiens
ggttaattccata

SEQ ID NO: 6345209 - DNA, 13 bp, Homo sapiens
ggttaattgagaa

SEQ ID NO: 6345210 - DNA, 19 bp, Homo sapiens
ggttaatttttcctgcatg

SEQ ID NO: 6345211 - DNA, 13 bp, Homo sapiens
ggttacaacagat

SEQ ID NO: 6345212 - DNA, 14 bp, Homo sapiens
ggttacaacagatt

SEQ ID NO: 6345213 - DNA, 14 bp, Homo sapiens
gttttctagtgtat

SEQ ID NO: 6345214 - DNA, 23 bp, Homo sapiens
gttttctagtgtatcaaaatgct

SEQ ID NO: 6345215 - DNA, 20 bp, Homo sapiens
gttttctcagaacagctgaa

SEQ ID NO: 6345216 - DNA, 13 bp, Homo sapiens
gttttctccctct

SEQ ID NO: 6345217 - DNA, 10 bp, Homo sapiens
gttttctcct

SEQ ID NO: 6345218 - DNA, 21 bp, Homo sapiens
gttttctcctcccaggaactg

SEQ ID NO: 6345219 - DNA, 13 bp, Homo sapiens
gttttctctctat

SEQ ID NO: 6345220 - DNA, 14 bp, Homo sapiens
gttttctctgaaca

SEQ ID NO: 6345221 - DNA, 16 bp, Homo sapiens
gttttctgaaacacac

SEQ ID NO: 6345222 - DNA, 17 bp, Homo sapiens
gttttctgagaaagact

SEQ ID NO: 6345223 - DNA, 13 bp, Homo sapiens
gttttctgagccc

SEQ ID NO: 6345224 - DNA, 14 bp, Homo sapiens
gttttctgagcccg

SEQ ID NO: 6345225 - DNA, 15 bp, Homo sapiens
gttttctgagcccgg

SEQ ID NO: 6345226 - DNA, 19 bp, Homo sapiens
gttttctgagcccgggctg

SEQ ID NO: 6345227 - DNA, 19 bp, Homo sapiens
gttttctgggggaaaaagc

SEQ ID NO: 6345228 - DNA, 17 bp, Homo sapiens
gttttctgggtgtccaa

SEQ ID NO: 6345229 - DNA, 21 bp, Homo sapiens
gttttctgtaaattcatattt

SEQ ID NO: 6345230 - DNA, 12 bp, Homo sapiens
gttttctgtaga

SEQ ID NO: 6345231 - DNA, 15 bp, Homo sapiens
gttttctgtagtcat

SEQ ID NO: 6345232 - DNA, 15 bp, Homo sapiens
gttttctgtatatga

SEQ ID NO: 6345233 - DNA, 18 bp, Homo sapiens
gttttctgtgcactgtag

SEQ ID NO: 6345234 - DNA, 22 bp, Homo sapiens
gttttctgtgtggtctccagct

SEQ ID NO: 6345235 - DNA, 12 bp, Homo sapiens
gttttctgttct

SEQ ID NO: 6345236 - DNA, 15 bp, Homo sapiens
gttttctgttctttc

SEQ ID NO: 6345237 - DNA, 16 bp, Homo sapiens
gttttctgttctttct

SEQ ID NO: 6345238 - DNA, 12 bp, Homo sapiens
gttttcttccct

SEQ ID NO: 6345239 - DNA, 14 bp, Homo sapiens
gttttcttcgtgga

SEQ ID NO: 6345240 - DNA, 14 bp, Homo sapiens
gttttcttctttcc

SEQ ID NO: 6345241 - DNA, 17 bp, Homo sapiens
gttttcttctttccctg

SEQ ID NO: 6345242 - DNA, 22 bp, Homo sapiens
gttttcttctttccctggacag

SEQ ID NO: 6345243 - DNA, 21 bp, Homo sapiens
gttttcttgataattttcctt

SEQ ID NO: 6345244 - DNA, 23 bp, Homo sapiens
gttttcttgataattttccttta

SEQ ID NO: 6345245 - DNA, 14 bp, Homo sapiens
gttttcttgggaat

SEQ ID NO: 6345246 - DNA, 12 bp, Homo sapiens
gttttcttgtaa

SEQ ID NO: 6345247 - DNA, 14 bp, Homo sapiens
gttttcttgtttct

SEQ ID NO: 6345248 - DNA, 15 bp, Homo sapiens
gttttcttgtttctg

SEQ ID NO: 6345249 - DNA, 20 bp, Homo sapiens
gttttcttgtttctgcatct

SEQ ID NO: 6345250 - DNA, 13 bp, Homo sapiens
gttttctttagta

SEQ ID NO: 6345251 - DNA, 15 bp, Homo sapiens
gttttctttcctcct

SEQ ID NO: 6345252 - DNA, 18 bp, Homo sapiens
gttttctttcctcctttc

SEQ ID NO: 6345253 - DNA, 15 bp, Homo sapiens
gttttctttctttaa

SEQ ID NO: 6345254 - DNA, 16 bp, Homo sapiens
gttttctttctttaaa

SEQ ID NO: 6345255 - DNA, 17 bp, Homo sapiens
gttttctttctttaaat

SEQ ID NO: 6345256 - DNA, 18 bp, Homo sapiens
gttttctttgctgtgcca

SEQ ID NO: 6345257 - DNA, 16 bp, Homo sapiens
gttttctttgtaaagg

SEQ ID NO: 6345258 - DNA, 18 bp, Homo sapiens
gttttctttgtaaaggtc

SEQ ID NO: 6345259 - DNA, 18 bp, Homo sapiens
gttttcttttctgtggtt

SEQ ID NO: 6345260 - DNA, 17 bp, Homo sapiens
gttttcttttgccatga

SEQ ID NO: 6345261 - DNA, 11 bp, Homo sapiens
gttttcttttt

SEQ ID NO: 6345262 - DNA, 16 bp, Homo sapiens
gttttctttttctttt

SEQ ID NO: 6345263 - DNA, 20 bp, Homo sapiens
gttttgaaactagaaatctg

SEQ ID NO: 6345264 - DNA, 14 bp, Homo sapiens
gttttgaaagaaaa

SEQ ID NO: 6345265 - DNA, 19 bp, Homo sapiens
gttttgaaagtttaacaaa

SEQ ID NO: 6345266 - DNA, 18 bp, Homo sapiens
gttttgaaatcccatcag

SEQ ID NO: 6345267 - DNA, 17 bp, Homo sapiens
gttttgaactaataaaa

SEQ ID NO: 6345268 - DNA, 23 bp, Homo sapiens
gttttgaactaataaaagcataa

SEQ ID NO: 6345269 - DNA, 21 bp, Homo sapiens
gttttgaagcctgctaaatga

SEQ ID NO: 6345270 - DNA, 18 bp, Homo sapiens
gttttgaagctactgtgt

SEQ ID NO: 6345271 - DNA, 16 bp, Homo sapiens
gttttgacacttccca

SEQ ID NO: 6345272 - DNA, 16 bp, Homo sapiens
gttttgacataagatg

SEQ ID NO: 6345273 - DNA, 18 bp, Homo sapiens
gttttgacatcagccagc

SEQ ID NO: 6345274 - DNA, 17 bp, Homo sapiens
gttttgacatttttagt

SEQ ID NO: 6345275 - DNA, 21 bp, Homo sapiens
gttttgactactagagctcca

SEQ ID NO: 6345276 - DNA, 19 bp, Homo sapiens
gttttgacttaagtagaag

SEQ ID NO: 6345277 - DNA, 23 bp, Homo sapiens
gttttgaggtttccttcagacag

SEQ ID NO: 6345278 - DNA, 22 bp, Homo sapiens
gttttgagtaaaaagacatttt

SEQ ID NO: 6345279 - DNA, 23 bp, Homo sapiens
gttttgagtgtactgtgcctggt

SEQ ID NO: 6345280 - DNA, 15 bp, Homo sapiens
gttttgagttttgta

SEQ ID NO: 6345281 - DNA, 14 bp, Homo sapiens
gttttgataaagta

SEQ ID NO: 6345282 - DNA, 15 bp, Homo sapiens
gttttgatataatct

SEQ ID NO: 6345283 - DNA, 14 bp, Homo sapiens
gttttgatatgagt

SEQ ID NO: 6345284 - DNA, 16 bp, Homo sapiens
gttttgatatgagtat

SEQ ID NO: 6345285 - DNA, 19 bp, Homo sapiens
gttttgatctctgttcttt

SEQ ID NO: 6345286 - DNA, 19 bp, Homo sapiens
gttttgatgccatttgtct

SEQ ID NO: 6345287 - DNA, 15 bp, Homo sapiens
gttttgatgctgtat

SEQ ID NO: 6345288 - DNA, 22 bp, Homo sapiens
gttttgatgtttgtggcctcag

SEQ ID NO: 6345289 - DNA, 23 bp, Homo sapiens
gttttgattaatgtttcttaaat

SEQ ID NO: 6345290 - DNA, 13 bp, Homo sapiens
gttttgattgcat

SEQ ID NO: 6345291 - DNA, 19 bp, Homo sapiens
gttttgatttaataacata

SEQ ID NO: 6345292 - DNA, 21 bp, Homo sapiens
gttttgattttggaaagatgt

SEQ ID NO: 6345293 - DNA, 20 bp, Homo sapiens
gttttgcaaaggaaaataat

SEQ ID NO: 6345294 - DNA, 22 bp, Homo sapiens
gttttgcaagggaatgaatcca

SEQ ID NO: 6345295 - DNA, 13 bp, Homo sapiens
gttttgcaataac

SEQ ID NO: 6345296 - DNA, 15 bp, Homo sapiens
gttttgcacagccaa

SEQ ID NO: 6345297 - DNA, 19 bp, Homo sapiens
gttttgcacgtcttgctat

SEQ ID NO: 6345298 - DNA, 22 bp, Homo sapiens
gttttgcactcttgtttctccc

SEQ ID NO: 6345299 - DNA, 22 bp, Homo sapiens
gttttgccccaagtcctcattt

SEQ ID NO: 6345300 - DNA, 16 bp, Homo sapiens
gttttgcctctgccct

SEQ ID NO: 6345301 - DNA, 20 bp, Homo sapiens
gttttgcctctgcccttggg

SEQ ID NO: 6345302 - DNA, 15 bp, Homo sapiens
gttttgcctctttaa

SEQ ID NO: 6345303 - DNA, 17 bp, Homo sapiens
gttttgctacataatta

SEQ ID NO: 6345304 - DNA, 19 bp, Homo sapiens
gttttgctccttctgtgtt

SEQ ID NO: 6345305 - DNA, 17 bp, Homo sapiens
gttttgctgctataatt

SEQ ID NO: 6345306 - DNA, 20 bp, Homo sapiens
gttttgcttgggcctccctg

SEQ ID NO: 6345307 - DNA, 18 bp, Homo sapiens
gttttgctttggaaacac

SEQ ID NO: 6345308 - DNA, 11 bp, Homo sapiens
gttttgctttt

SEQ ID NO: 6345309 - DNA, 16 bp, Homo sapiens
gttttgctttttaaac

SEQ ID NO: 6345310 - DNA, 18 bp, Homo sapiens
gttttgctttttctgact

SEQ ID NO: 6345311 - DNA, 16 bp, Homo sapiens
gttttggaagtgatgt

SEQ ID NO: 6345312 - DNA, 12 bp, Homo sapiens
gttttggaatct

SEQ ID NO: 6345313 - DNA, 10 bp, Homo sapiens
gttttggaca

SEQ ID NO: 6345314 - DNA, 17 bp, Homo sapiens
gttttggacagtttacc

SEQ ID NO: 6345315 - DNA, 14 bp, Homo sapiens
gttttggactctct

SEQ ID NO: 6345316 - DNA, 19 bp, Homo sapiens
gttttggagaaaaattaca

SEQ ID NO: 6345317 - DNA, 19 bp, Homo sapiens
gttttggatcttgaatgtg

SEQ ID NO: 6345318 - DNA, 17 bp, Homo sapiens
gttttggatgttgctat

SEQ ID NO: 6345319 - DNA, 18 bp, Homo sapiens
gttttggatgttgctata

SEQ ID NO: 6345320 - DNA, 15 bp, Homo sapiens
gttttggcagctgac

SEQ ID NO: 6345321 - DNA, 15 bp, Homo sapiens
gttttggccacccct

SEQ ID NO: 6345322 - DNA, 22 bp, Homo sapiens
gttttggccaccccttgctctc

SEQ ID NO: 6345323 - DNA, 14 bp, Homo sapiens
gttttggctgctct

SEQ ID NO: 6345324 - DNA, 18 bp, Homo sapiens
gttttgggatcaggagcc

SEQ ID NO: 6345325 - DNA, 15 bp, Homo sapiens
gttttgggcctccat

SEQ ID NO: 6345326 - DNA, 15 bp, Homo sapiens
gttttgggggtcagg

SEQ ID NO: 6345327 - DNA, 18 bp, Homo sapiens
gttttggtcccctccctc

SEQ ID NO: 6345328 - DNA, 24 bp, Homo sapiens
gttttggtcccctccctcgtgggc

SEQ ID NO: 6345329 - DNA, 16 bp, Homo sapiens
gttttggtgtaacatc

SEQ ID NO: 6345330 - DNA, 14 bp, Homo sapiens
gttttggttttttt

SEQ ID NO: 6345331 - DNA, 19 bp, Homo sapiens
gttttgtaaaaactgaaga

SEQ ID NO: 6345332 - DNA, 13 bp, Homo sapiens
gttttgtaaaact

SEQ ID NO: 6345333 - DNA, 18 bp, Homo sapiens
gttttgtaaaactgttat

SEQ ID NO: 6345334 - DNA, 13 bp, Homo sapiens
gttttgtaaaaga

SEQ ID NO: 6345335 - DNA, 21 bp, Homo sapiens
gttttgtaaactttgaaatat

SEQ ID NO: 6345336 - DNA, 13 bp, Homo sapiens
gttttgtaaagtc

SEQ ID NO: 6345337 - DNA, 13 bp, Homo sapiens
gttttgtaaatgt

SEQ ID NO: 6345338 - DNA, 15 bp, Homo sapiens
gttttgtaaatgtac

SEQ ID NO: 6345339 - DNA, 13 bp, Homo sapiens
gttttgtaagaaa

SEQ ID NO: 6345340 - DNA, 18 bp, Homo sapiens
gttttgtaagccctcttt

SEQ ID NO: 6345341 - DNA, 22 bp, Homo sapiens
gttttgtacaaagttttccttt

SEQ ID NO: 6345342 - DNA, 15 bp, Homo sapiens
gttttgtacactgct

SEQ ID NO: 6345343 - DNA, 17 bp, Homo sapiens
gttttgtacatagattt

SEQ ID NO: 6345344 - DNA, 14 bp, Homo sapiens
gttttgtagcagtg

SEQ ID NO: 6345345 - DNA, 13 bp, Homo sapiens
gttttgtagcatt

SEQ ID NO: 6345346 - DNA, 15 bp, Homo sapiens
gttttgtataaaatc

SEQ ID NO: 6345347 - DNA, 22 bp, Homo sapiens
gttttgtataaaatctgaattt

SEQ ID NO: 6345348 - DNA, 22 bp, Homo sapiens
gttttgtatacaaatatattgt

SEQ ID NO: 6345349 - DNA, 20 bp, Homo sapiens
gttttgtatatgctgcattg

SEQ ID NO: 6345350 - DNA, 24 bp, Homo sapiens
gttttgtcaaactgtagaaatgat

SEQ ID NO: 6345351 - DNA, 16 bp, Homo sapiens
gttttgtcagacttcc

SEQ ID NO: 6345352 - DNA, 21 bp, Homo sapiens
gttttgtcatcaatccaggat

SEQ ID NO: 6345353 - DNA, 18 bp, Homo sapiens
gttttgtcccataatatg

SEQ ID NO: 6345354 - DNA, 15 bp, Homo sapiens
gttttgtgctttaaa

SEQ ID NO: 6345355 - DNA, 19 bp, Homo sapiens
gttttgtggaggagctcag

SEQ ID NO: 6345356 - DNA, 23 bp, Homo sapiens
gttttgtggtagtccttttggga

SEQ ID NO: 6345357 - DNA, 20 bp, Homo sapiens
gttttgtgtacagtatgtgt

SEQ ID NO: 6345358 - DNA, 16 bp, Homo sapiens
gttttgtgtactttta

SEQ ID NO: 6345359 - DNA, 20 bp, Homo sapiens
gttttgtgtatattggtgta

SEQ ID NO: 6345360 - DNA, 20 bp, Homo sapiens
gttttgtgtatatttgcttc

SEQ ID NO: 6345361 - DNA, 16 bp, Homo sapiens
gttttgtgtctcttat

SEQ ID NO: 6345362 - DNA, 14 bp, Homo sapiens
gttttgtgtgtata

SEQ ID NO: 6345363 - DNA, 15 bp, Homo sapiens
gttttgtgtgtatat

SEQ ID NO: 6345364 - DNA, 14 bp, Homo sapiens
gttttgttcccctc

SEQ ID NO: 6345365 - DNA, 16 bp, Homo sapiens
gttttgttcccctcct

SEQ ID NO: 6345366 - DNA, 21 bp, Homo sapiens
gttttgttcccctcctccact

SEQ ID NO: 6345367 - DNA, 22 bp, Homo sapiens
gttttgttctgtatattttgtt

SEQ ID NO: 6345368 - DNA, 15 bp, Homo sapiens
gttttgttctttaaa

SEQ ID NO: 6345369 - DNA, 18 bp, Homo sapiens
gttttgttgacattctga

SEQ ID NO: 6345370 - DNA, 18 bp, Homo sapiens
gttttgttgcactgaagt

SEQ ID NO: 6345371 - DNA, 15 bp, Homo sapiens
gttttgttgtatttt

SEQ ID NO: 6345372 - DNA, 13 bp, Homo sapiens
gttttgttgtttg

SEQ ID NO: 6345373 - DNA, 13 bp, Homo sapiens
gttttgtttcact

SEQ ID NO: 6345374 - DNA, 14 bp, Homo sapiens
gttttgtttcactt

SEQ ID NO: 6345375 - DNA, 20 bp, Homo sapiens
gttttgtttcgctctttgag

SEQ ID NO: 6345376 - DNA, 15 bp, Homo sapiens
gttttgtttctgaaa

SEQ ID NO: 6345377 - DNA, 18 bp, Homo sapiens
gttttgtttgctatctta

SEQ ID NO: 6345378 - DNA, 12 bp, Homo sapiens
gttttgtttgtc

SEQ ID NO: 6345379 - DNA, 14 bp, Homo sapiens
gttttgttttggac

SEQ ID NO: 6345380 - DNA, 16 bp, Homo sapiens
gttttgttttgtttta

SEQ ID NO: 6345381 - DNA, 20 bp, Homo sapiens
gttttgttttttagttccca

SEQ ID NO: 6345382 - DNA, 19 bp, Homo sapiens
gtttttaaaaaatgttttc

SEQ ID NO: 6345383 - DNA, 15 bp, Homo sapiens
gtttttaaaaagcaa

SEQ ID NO: 6345384 - DNA, 15 bp, Homo sapiens
gtttttaaaaattag

SEQ ID NO: 6345385 - DNA, 18 bp, Homo sapiens
gtttttaaaagtttcaat

SEQ ID NO: 6345386 - DNA, 17 bp, Homo sapiens
gtttttaaaatatcttt

SEQ ID NO: 6345387 - DNA, 13 bp, Homo sapiens
gtttttaaaatct

SEQ ID NO: 6345388 - DNA, 15 bp, Homo sapiens
gtttttaaaatctta

SEQ ID NO: 6345389 - DNA, 20 bp, Homo sapiens
gtttttaaaatttatttgca

SEQ ID NO: 6345390 - DNA, 21 bp, Homo sapiens
gtttttaaaatttatttgcaa

SEQ ID NO: 6345391 - DNA, 13 bp, Homo sapiens
gtttttaaactgt

SEQ ID NO: 6345392 - DNA, 18 bp, Homo sapiens
gtttttaaactgtacagt

SEQ ID NO: 6345393 - DNA, 20 bp, Homo sapiens
gtttttaaactgtacagtgt

SEQ ID NO: 6345394 - DNA, 23 bp, Homo sapiens
ggttacaatcattgctgaaaatg

SEQ ID NO: 6345395 - DNA, 20 bp, Homo sapiens
ggttacactgttagaacact

SEQ ID NO: 6345396 - DNA, 16 bp, Homo sapiens
ggttacagagacctat

SEQ ID NO: 6345397 - DNA, 19 bp, Homo sapiens
ggttacaggaaggcaggag

SEQ ID NO: 6345398 - DNA, 22 bp, Homo sapiens
ggttacagtatgcttgctctaa

SEQ ID NO: 6345399 - DNA, 22 bp, Homo sapiens
ggttaccaaaaatatccctttt

SEQ ID NO: 6345400 - DNA, 23 bp, Homo sapiens
ggttaccttggcgtgtgtccctg

SEQ ID NO: 6345401 - DNA, 14 bp, Homo sapiens
ggttacgaagacaa

SEQ ID NO: 6345402 - DNA, 17 bp, Homo sapiens
ggttactcagcagcaga

SEQ ID NO: 6345403 - DNA, 18 bp, Homo sapiens
ggttagaaaggcagccct

SEQ ID NO: 6345404 - DNA, 22 bp, Homo sapiens
ggttagacagccaaaggctggc

SEQ ID NO: 6345405 - DNA, 15 bp, Homo sapiens
ggttagacctacagg

SEQ ID NO: 6345406 - DNA, 19 bp, Homo sapiens
ggttagaccttatgttaga

SEQ ID NO: 6345407 - DNA, 21 bp, Homo sapiens
ggttagacgccttccaggtca

SEQ ID NO: 6345408 - DNA, 22 bp, Homo sapiens
ggttagaggtttgtcaacaaaa

SEQ ID NO: 6345409 - DNA, 20 bp, Homo sapiens
ggttagatatttcgaccctg

SEQ ID NO: 6345410 - DNA, 18 bp, Homo sapiens
ggttagattcaaggcccc

SEQ ID NO: 6345411 - DNA, 16 bp, Homo sapiens
ggttagcaatatttat

SEQ ID NO: 6345412 - DNA, 19 bp, Homo sapiens
ggttagcccaatggagaaa

SEQ ID NO: 6345413 - DNA, 21 bp, Homo sapiens
ggttagcctggtgacaggcag

SEQ ID NO: 6345414 - DNA, 22 bp, Homo sapiens
ggttagctcagccccagcccag

SEQ ID NO: 6345415 - DNA, 16 bp, Homo sapiens
ggttaggatttaacag

SEQ ID NO: 6345416 - DNA, 13 bp, Homo sapiens
ggttagggagggg

SEQ ID NO: 6345417 - DNA, 15 bp, Homo sapiens
ggttagggaggggta

SEQ ID NO: 6345418 - DNA, 21 bp, Homo sapiens
ggttaggggttcattctcccg

SEQ ID NO: 6345419 - DNA, 20 bp, Homo sapiens
ggttaggtcttaggaattga

SEQ ID NO: 6345420 - DNA, 22 bp, Homo sapiens
ggttaggtgactaaaagggctt

SEQ ID NO: 6345421 - DNA, 17 bp, Homo sapiens
ggttagtcattgataga

SEQ ID NO: 6345422 - DNA, 13 bp, Homo sapiens
ggttagtgcatgt

SEQ ID NO: 6345423 - DNA, 21 bp, Homo sapiens
ggttagtggatggaaggggct

SEQ ID NO: 6345424 - DNA, 23 bp, Homo sapiens
ggttataacttaatgaaaacaat

SEQ ID NO: 6345425 - DNA, 23 bp, Homo sapiens
ggttatacatgacactgaaatgc

SEQ ID NO: 6345426 - DNA, 15 bp, Homo sapiens
ggttatagtaacatc

SEQ ID NO: 6345427 - DNA, 17 bp, Homo sapiens
ggttatctcaaatttta

SEQ ID NO: 6345428 - DNA, 20 bp, Homo sapiens
ggttatctgaagtcagatct

SEQ ID NO: 6345429 - DNA, 12 bp, Homo sapiens
ggttatctgaat

SEQ ID NO: 6345430 - DNA, 16 bp, Homo sapiens
ggttatctgcctggcc

SEQ ID NO: 6345431 - DNA, 18 bp, Homo sapiens
ggttatctgcctggcctg

SEQ ID NO: 6345432 - DNA, 13 bp, Homo sapiens
ggttatgaaacat

SEQ ID NO: 6345433 - DNA, 14 bp, Homo sapiens
ggttatgatggaaa

SEQ ID NO: 6345434 - DNA, 13 bp, Homo sapiens
ggttatgattgaa

SEQ ID NO: 6345435 - DNA, 22 bp, Homo sapiens
ggttatgtgtatgtgccattta

SEQ ID NO: 6345436 - DNA, 17 bp, Homo sapiens
ggttattaaactgaata

SEQ ID NO: 6345437 - DNA, 18 bp, Homo sapiens
ggttattagcaaggctgg

SEQ ID NO: 6345438 - DNA, 18 bp, Homo sapiens
ggttatttaaaatgtaaa

SEQ ID NO: 6345439 - DNA, 11 bp, Homo sapiens
ggttatttaac

SEQ ID NO: 6345440 - DNA, 20 bp, Homo sapiens
ggttatttattgacacaccc

SEQ ID NO: 6345441 - DNA, 21 bp, Homo sapiens
ggttatttattgacacaccca

SEQ ID NO: 6345442 - DNA, 17 bp, Homo sapiens
ggttattttagtttctg

SEQ ID NO: 6345443 - DNA, 16 bp, Homo sapiens
ggttattttatatttg

SEQ ID NO: 6345444 - DNA, 14 bp, Homo sapiens
ggttattttgcttt

SEQ ID NO: 6345445 - DNA, 17 bp, Homo sapiens
ggttatttttattaaat

SEQ ID NO: 6345446 - DNA, 19 bp, Homo sapiens
ggttatttttattaaatgt

SEQ ID NO: 6345447 - DNA, 20 bp, Homo sapiens
ggttatttttattaaatgta

SEQ ID NO: 6345448 - DNA, 15 bp, Homo sapiens
ggttatttttctctt

SEQ ID NO: 6345449 - DNA, 13 bp, Homo sapiens
ggttcaagagact

SEQ ID NO: 6345450 - DNA, 24 bp, Homo sapiens
ggttcaagcaatcctcctgcctca

SEQ ID NO: 6345451 - DNA, 14 bp, Homo sapiens
ggttcaagcccagg

SEQ ID NO: 6345452 - DNA, 23 bp, Homo sapiens
ggttcaagcgattcttctgcttc

SEQ ID NO: 6345453 - DNA, 13 bp, Homo sapiens
ggttcaagcttgt

SEQ ID NO: 6345454 - DNA, 16 bp, Homo sapiens
ggttcaaggtcactgt

SEQ ID NO: 6345455 - DNA, 19 bp, Homo sapiens
ggttcacacagcccagttc

SEQ ID NO: 6345456 - DNA, 16 bp, Homo sapiens
ggttcaccattgagac

SEQ ID NO: 6345457 - DNA, 13 bp, Homo sapiens
ggttcaccttgcc

SEQ ID NO: 6345458 - DNA, 17 bp, Homo sapiens
ggttcacgccattctcc

SEQ ID NO: 6345459 - DNA, 20 bp, Homo sapiens
ggttcacgccattctcctgc

SEQ ID NO: 6345460 - DNA, 19 bp, Homo sapiens
ggttcacgtaatcctcctg

SEQ ID NO: 6345461 - DNA, 20 bp, Homo sapiens
ggttcacgtcactgccagag

SEQ ID NO: 6345462 - DNA, 20 bp, Homo sapiens
ggttcactccccgcctcccc

SEQ ID NO: 6345463 - DNA, 21 bp, Homo sapiens
ggttcactcttggagcctgca

SEQ ID NO: 6345464 - DNA, 21 bp, Homo sapiens
ggttcacttgccatgcaggaa

SEQ ID NO: 6345465 - DNA, 15 bp, Homo sapiens
ggttcagaaaattaa

SEQ ID NO: 6345466 - DNA, 16 bp, Homo sapiens
ggttcagaaatgctgc

SEQ ID NO: 6345467 - DNA, 19 bp, Homo sapiens
ggttcagacacagctcttc

SEQ ID NO: 6345468 - DNA, 17 bp, Homo sapiens
ggttcagcccctcctct

SEQ ID NO: 6345469 - DNA, 21 bp, Homo sapiens
ggttcagcccctcctctgcca

SEQ ID NO: 6345470 - DNA, 17 bp, Homo sapiens
ggttcagcctcctgtct

SEQ ID NO: 6345471 - DNA, 13 bp, Homo sapiens
ggttcagcctggc

SEQ ID NO: 6345472 - DNA, 20 bp, Homo sapiens
ggttcagcctggcctgcccg

SEQ ID NO: 6345473 - DNA, 19 bp, Homo sapiens
ggttcagctactttccatt

SEQ ID NO: 6345474 - DNA, 16 bp, Homo sapiens
ggttcaggcctggcgt

SEQ ID NO: 6345475 - DNA, 21 bp, Homo sapiens
ggttcatacgcatcccatctc

SEQ ID NO: 6345476 - DNA, 15 bp, Homo sapiens
ggttcataggggcag

SEQ ID NO: 6345477 - DNA, 19 bp, Homo sapiens
ggttcatcagtgttaaaaa

SEQ ID NO: 6345478 - DNA, 15 bp, Homo sapiens
ggttcatcatccctc

SEQ ID NO: 6345479 - DNA, 17 bp, Homo sapiens
ggttcatcatccctccc

SEQ ID NO: 6345480 - DNA, 22 bp, Homo sapiens
ggttcatccagaagtgtattca

SEQ ID NO: 6345481 - DNA, 20 bp, Homo sapiens
ggttcatccatcatctgctg

SEQ ID NO: 6345482 - DNA, 15 bp, Homo sapiens
ggttcatgcttctac

SEQ ID NO: 6345483 - DNA, 19 bp, Homo sapiens
ggttcattattggaattaa

SEQ ID NO: 6345484 - DNA, 12 bp, Homo sapiens
ggttcattccac

SEQ ID NO: 6345485 - DNA, 19 bp, Homo sapiens
ggttcattccccggccctc

SEQ ID NO: 6345486 - DNA, 17 bp, Homo sapiens
ggttcattctcccgctt

SEQ ID NO: 6345487 - DNA, 23 bp, Homo sapiens
ggttcatttcaaatacatctttg

SEQ ID NO: 6345488 - DNA, 20 bp, Homo sapiens
ggttcattttctgatgccca

SEQ ID NO: 6345489 - DNA, 18 bp, Homo sapiens
ggttccaaaccagtttat

SEQ ID NO: 6345490 - DNA, 23 bp, Homo sapiens
ggttccaagaaagatccaccctc

SEQ ID NO: 6345491 - DNA, 15 bp, Homo sapiens
ggttccactggagaa

SEQ ID NO: 6345492 - DNA, 13 bp, Homo sapiens
ggttccagacagg

SEQ ID NO: 6345493 - DNA, 14 bp, Homo sapiens
ggttccagacaggg

SEQ ID NO: 6345494 - DNA, 23 bp, Homo sapiens
ggttccagacagggtggggctta

SEQ ID NO: 6345495 - DNA, 20 bp, Homo sapiens
ggttccagcaattctcctgc

SEQ ID NO: 6345496 - DNA, 16 bp, Homo sapiens
ggttccagcctgccac

SEQ ID NO: 6345497 - DNA, 14 bp, Homo sapiens
ggttccagcttccc

SEQ ID NO: 6345498 - DNA, 19 bp, Homo sapiens
ggttccatgcagccttggg

SEQ ID NO: 6345499 - DNA, 18 bp, Homo sapiens
ggttccatttttcctctg

SEQ ID NO: 6345500 - DNA, 13 bp, Homo sapiens
ggttcccaaggac

SEQ ID NO: 6345501 - DNA, 16 bp, Homo sapiens
ggttcccaataaaagt

SEQ ID NO: 6345502 - DNA, 17 bp, Homo sapiens
ggttcccaataaaagtg

SEQ ID NO: 6345503 - DNA, 11 bp, Homo sapiens
ggttcccagaa

SEQ ID NO: 6345504 - DNA, 14 bp, Homo sapiens
ggttcccagcagct

SEQ ID NO: 6345505 - DNA, 22 bp, Homo sapiens
ggttcccagcagctgggccggc

SEQ ID NO: 6345506 - DNA, 23 bp, Homo sapiens
ggttcccattttcgctttcctct

SEQ ID NO: 6345507 - DNA, 14 bp, Homo sapiens
ggttccccaagggc

SEQ ID NO: 6345508 - DNA, 20 bp, Homo sapiens
ggttccccaagggccctggc

SEQ ID NO: 6345509 - DNA, 15 bp, Homo sapiens
ggttccccagagagc

SEQ ID NO: 6345510 - DNA, 19 bp, Homo sapiens
ggttcccccagacagagcc

SEQ ID NO: 6345511 - DNA, 13 bp, Homo sapiens
ggttcccccagcc

SEQ ID NO: 6345512 - DNA, 21 bp, Homo sapiens
ggttcccccagccctgtggaa

SEQ ID NO: 6345513 - DNA, 16 bp, Homo sapiens
ggttcccggtcccgag

SEQ ID NO: 6345514 - DNA, 11 bp, Homo sapiens
ggttccctccc

SEQ ID NO: 6345515 - DNA, 14 bp, Homo sapiens
ggttccctccccag

SEQ ID NO: 6345516 - DNA, 18 bp, Homo sapiens
ggttccctccccagctcc

SEQ ID NO: 6345517 - DNA, 13 bp, Homo sapiens
ggttccctctgag

SEQ ID NO: 6345518 - DNA, 21 bp, Homo sapiens
ggttccctgcctaggagctgg

SEQ ID NO: 6345519 - DNA, 21 bp, Homo sapiens
ggttccctgctgcgctgcttg

SEQ ID NO: 6345520 - DNA, 21 bp, Homo sapiens
ggttcccttgagggctgcagt

SEQ ID NO: 6345521 - DNA, 14 bp, Homo sapiens
ggttccctttcccc

SEQ ID NO: 6345522 - DNA, 21 bp, Homo sapiens
ggttccgcactttccacttct

SEQ ID NO: 6345523 - DNA, 19 bp, Homo sapiens
ggttccgccaggcgctgca

SEQ ID NO: 6345524 - DNA, 15 bp, Homo sapiens
ggttccgcttggagc

SEQ ID NO: 6345525 - DNA, 21 bp, Homo sapiens
ggttccgcttggagcagaggg

SEQ ID NO: 6345526 - DNA, 17 bp, Homo sapiens
ggttccgtgtccacccc

SEQ ID NO: 6345527 - DNA, 19 bp, Homo sapiens
ggttccgtgtccaccccca

SEQ ID NO: 6345528 - DNA, 15 bp, Homo sapiens
ggttcctacacagga

SEQ ID NO: 6345529 - DNA, 17 bp, Homo sapiens
ggttcctacaggagata

SEQ ID NO: 6345530 - DNA, 17 bp, Homo sapiens
ggttcctaggggaatga

SEQ ID NO: 6345531 - DNA, 22 bp, Homo sapiens
ggttcctatggctggccactgc

SEQ ID NO: 6345532 - DNA, 19 bp, Homo sapiens
ggttcctcaaattttttga

SEQ ID NO: 6345533 - DNA, 12 bp, Homo sapiens
ggttcctccagc

SEQ ID NO: 6345534 - DNA, 18 bp, Homo sapiens
ggttcctcccctccagct

SEQ ID NO: 6345535 - DNA, 22 bp, Homo sapiens
ggttcctcgcaggtctcagccc

SEQ ID NO: 6345536 - DNA, 11 bp, Homo sapiens
ggttcctctct

SEQ ID NO: 6345537 - DNA, 15 bp, Homo sapiens
ggttcctctctccca

SEQ ID NO: 6345538 - DNA, 15 bp, Homo sapiens
ggttcctctgcctgc

SEQ ID NO: 6345539 - DNA, 18 bp, Homo sapiens
ggttcctctgcctgcccc

SEQ ID NO: 6345540 - DNA, 18 bp, Homo sapiens
ggttcctctgtacagcaa

SEQ ID NO: 6345541 - DNA, 18 bp, Homo sapiens
ggttcctgactggcaaag

SEQ ID NO: 6345542 - DNA, 14 bp, Homo sapiens
ggttcctgctgtgg

SEQ ID NO: 6345543 - DNA, 23 bp, Homo sapiens
ggttcctggggccgcctgccctg

SEQ ID NO: 6345544 - DNA, 13 bp, Homo sapiens
ggttcctgtcctc

SEQ ID NO: 6345545 - DNA, 11 bp, Homo sapiens
ggttcctgtga

SEQ ID NO: 6345546 - DNA, 16 bp, Homo sapiens
ggttccttaagtggct

SEQ ID NO: 6345547 - DNA, 17 bp, Homo sapiens
ggttccttccttagttt

SEQ ID NO: 6345548 - DNA, 18 bp, Homo sapiens
ggttcctttgcaccctgt

SEQ ID NO: 6345549 - DNA, 15 bp, Homo sapiens
ggttccttttattag

SEQ ID NO: 6345550 - DNA, 17 bp, Homo sapiens
ggttcgagacccaaacc

SEQ ID NO: 6345551 - DNA, 18 bp, Homo sapiens
ggttcgcaccgtgctggg

SEQ ID NO: 6345552 - DNA, 20 bp, Homo sapiens
ggttcgcaccgtgctgggct

SEQ ID NO: 6345553 - DNA, 16 bp, Homo sapiens
ggttcggctgctttta

SEQ ID NO: 6345554 - DNA, 19 bp, Homo sapiens
ggttcgttctgtactgtta

SEQ ID NO: 6345555 - DNA, 22 bp, Homo sapiens
ggttctaaagttctaagattct

SEQ ID NO: 6345556 - DNA, 18 bp, Homo sapiens
ggttctacaatctattta

SEQ ID NO: 6345557 - DNA, 20 bp, Homo sapiens
ggttctacaggaaatacaga

SEQ ID NO: 6345558 - DNA, 11 bp, Homo sapiens
ggttctagaag

SEQ ID NO: 6345559 - DNA, 17 bp, Homo sapiens
ggttctagacgcccctc

SEQ ID NO: 6345560 - DNA, 19 bp, Homo sapiens
ggttctaggctaccagaag

SEQ ID NO: 6345561 - DNA, 16 bp, Homo sapiens
ggttctatatttactg

SEQ ID NO: 6345562 - DNA, 13 bp, Homo sapiens
ggttctatgcaaa

SEQ ID NO: 6345563 - DNA, 13 bp, Homo sapiens
ggttctattttct

SEQ ID NO: 6345564 - DNA, 13 bp, Homo sapiens
ggttctcaatgaa

SEQ ID NO: 6345565 - DNA, 18 bp, Homo sapiens
ggttctcaatttatttgg

SEQ ID NO: 6345566 - DNA, 15 bp, Homo sapiens
ggttctcagacctcc

SEQ ID NO: 6345567 - DNA, 17 bp, Homo sapiens
ggttctcagagccaagt

SEQ ID NO: 6345568 - DNA, 23 bp, Homo sapiens
ggttctcagtggtcaccttcctc

SEQ ID NO: 6345569 - DNA, 12 bp, Homo sapiens
ggttctcatctt

SEQ ID NO: 6345570 - DNA, 22 bp, Homo sapiens
ggttctcattaggttttgcttg

SEQ ID NO: 6345571 - DNA, 13 bp, Homo sapiens
ggttctcatttct

SEQ ID NO: 6345572 - DNA, 23 bp, Homo sapiens
gtttttaaatagagtttgctatt

SEQ ID NO: 6345573 - DNA, 17 bp, Homo sapiens
gtttttaaattgtttca

SEQ ID NO: 6345574 - DNA, 20 bp, Homo sapiens
gtttttaaattttgtaatga

SEQ ID NO: 6345575 - DNA, 17 bp, Homo sapiens
gtttttaaattttgtat

SEQ ID NO: 6345576 - DNA, 17 bp, Homo sapiens
gtttttaagaaaaacat

SEQ ID NO: 6345577 - DNA, 14 bp, Homo sapiens
gtttttaagctgtt

SEQ ID NO: 6345578 - DNA, 14 bp, Homo sapiens
gtttttaagggccg

SEQ ID NO: 6345579 - DNA, 15 bp, Homo sapiens
gtttttaagtcctgt

SEQ ID NO: 6345580 - DNA, 13 bp, Homo sapiens
gtttttaataatt

SEQ ID NO: 6345581 - DNA, 13 bp, Homo sapiens
gtttttaatagaa

SEQ ID NO: 6345582 - DNA, 18 bp, Homo sapiens
gtttttaatataaagcct

SEQ ID NO: 6345583 - DNA, 19 bp, Homo sapiens
gtttttaatcgtttttgtt

SEQ ID NO: 6345584 - DNA, 12 bp, Homo sapiens
gtttttaatgta

SEQ ID NO: 6345585 - DNA, 13 bp, Homo sapiens
gtttttaatgtat

SEQ ID NO: 6345586 - DNA, 19 bp, Homo sapiens
gtttttaattaaaaacttt

SEQ ID NO: 6345587 - DNA, 16 bp, Homo sapiens
gtttttaatttaaact

SEQ ID NO: 6345588 - DNA, 13 bp, Homo sapiens
gtttttaatttga

SEQ ID NO: 6345589 - DNA, 21 bp, Homo sapiens
gtttttaattttgtgttgcta

SEQ ID NO: 6345590 - DNA, 20 bp, Homo sapiens
gtttttacaaaactgctttg

SEQ ID NO: 6345591 - DNA, 13 bp, Homo sapiens
gtttttacagtta

SEQ ID NO: 6345592 - DNA, 17 bp, Homo sapiens
gtttttacagttagggt

SEQ ID NO: 6345593 - DNA, 19 bp, Homo sapiens
gtttttacattatgcaaat

SEQ ID NO: 6345594 - DNA, 18 bp, Homo sapiens
gtttttacccatatcccc

SEQ ID NO: 6345595 - DNA, 23 bp, Homo sapiens
gtttttacctgtcacattgcatt

SEQ ID NO: 6345596 - DNA, 20 bp, Homo sapiens
gtttttaccttgttttctct

SEQ ID NO: 6345597 - DNA, 22 bp, Homo sapiens
gtttttaccttgttttctctat

SEQ ID NO: 6345598 - DNA, 14 bp, Homo sapiens
gtttttactgctct

SEQ ID NO: 6345599 - DNA, 16 bp, Homo sapiens
gtttttactgctctga

SEQ ID NO: 6345600 - DNA, 13 bp, Homo sapiens
gtttttactgtat

SEQ ID NO: 6345601 - DNA, 13 bp, Homo sapiens
gtttttagaacat

SEQ ID NO: 6345602 - DNA, 18 bp, Homo sapiens
gtttttagaatgttgaaa

SEQ ID NO: 6345603 - DNA, 13 bp, Homo sapiens
gtttttagagaat

SEQ ID NO: 6345604 - DNA, 17 bp, Homo sapiens
gtttttagtaatctgta

SEQ ID NO: 6345605 - DNA, 20 bp, Homo sapiens
gtttttagtaatctgtacat

SEQ ID NO: 6345606 - DNA, 21 bp, Homo sapiens
gtttttagtaatctgtacatt

SEQ ID NO: 6345607 - DNA, 16 bp, Homo sapiens
gtttttataaaaacat

SEQ ID NO: 6345608 - DNA, 23 bp, Homo sapiens
gtttttataaaaacattgaaata

SEQ ID NO: 6345609 - DNA, 19 bp, Homo sapiens
gtttttatacctgtacaca

SEQ ID NO: 6345610 - DNA, 18 bp, Homo sapiens
gtttttatagttattaaa

SEQ ID NO: 6345611 - DNA, 14 bp, Homo sapiens
gtttttatattact

SEQ ID NO: 6345612 - DNA, 18 bp, Homo sapiens
gtttttatattacttttg

SEQ ID NO: 6345613 - DNA, 20 bp, Homo sapiens
gtttttatattacttttgta

SEQ ID NO: 6345614 - DNA, 18 bp, Homo sapiens
gtttttatcaaatttgcc

SEQ ID NO: 6345615 - DNA, 16 bp, Homo sapiens
gtttttatgaactgca

SEQ ID NO: 6345616 - DNA, 22 bp, Homo sapiens
gtttttatggcttttgtgcatt

SEQ ID NO: 6345617 - DNA, 18 bp, Homo sapiens
gtttttatggggctgaac

SEQ ID NO: 6345618 - DNA, 13 bp, Homo sapiens
gtttttatgtgta

SEQ ID NO: 6345619 - DNA, 15 bp, Homo sapiens
gtttttattctgtat

SEQ ID NO: 6345620 - DNA, 19 bp, Homo sapiens
gtttttatttcaattgttt

SEQ ID NO: 6345621 - DNA, 14 bp, Homo sapiens
gtttttatttcctc

SEQ ID NO: 6345622 - DNA, 15 bp, Homo sapiens
gtttttatttcctct

SEQ ID NO: 6345623 - DNA, 18 bp, Homo sapiens
gtttttatttcttttaga

SEQ ID NO: 6345624 - DNA, 19 bp, Homo sapiens
gtttttattttaaacattt

SEQ ID NO: 6345625 - DNA, 17 bp, Homo sapiens
gtttttattttcctctg

SEQ ID NO: 6345626 - DNA, 14 bp, Homo sapiens
gtttttcacatttt

SEQ ID NO: 6345627 - DNA, 16 bp, Homo sapiens
gtttttcacattttcc

SEQ ID NO: 6345628 - DNA, 15 bp, Homo sapiens
gtttttcagaaagtt

SEQ ID NO: 6345629 - DNA, 21 bp, Homo sapiens
gtttttcagcacccccaccca

SEQ ID NO: 6345630 - DNA, 21 bp, Homo sapiens
gtttttcagttcaaagtcatg

SEQ ID NO: 6345631 - DNA, 17 bp, Homo sapiens
gtttttcatcttttgaa

SEQ ID NO: 6345632 - DNA, 23 bp, Homo sapiens
gtttttcatggaaaagccttctt

SEQ ID NO: 6345633 - DNA, 12 bp, Homo sapiens
gtttttcatgtt

SEQ ID NO: 6345634 - DNA, 15 bp, Homo sapiens
gtttttcatgtttta

SEQ ID NO: 6345635 - DNA, 18 bp, Homo sapiens
gtttttcattaaataaat

SEQ ID NO: 6345636 - DNA, 13 bp, Homo sapiens
gtttttcattatt

SEQ ID NO: 6345637 - DNA, 17 bp, Homo sapiens
gtttttcatttgttttg

SEQ ID NO: 6345638 - DNA, 15 bp, Homo sapiens
gtttttccactactg

SEQ ID NO: 6345639 - DNA, 15 bp, Homo sapiens
gtttttccagttcca

SEQ ID NO: 6345640 - DNA, 18 bp, Homo sapiens
gtttttccagttccagga

SEQ ID NO: 6345641 - DNA, 16 bp, Homo sapiens
gtttttccatgtgttt

SEQ ID NO: 6345642 - DNA, 20 bp, Homo sapiens
gtttttccatgtgttttgct

SEQ ID NO: 6345643 - DNA, 15 bp, Homo sapiens
gtttttccctaatct

SEQ ID NO: 6345644 - DNA, 15 bp, Homo sapiens
gtttttccctcccca

SEQ ID NO: 6345645 - DNA, 12 bp, Homo sapiens
gtttttcctcat

SEQ ID NO: 6345646 - DNA, 17 bp, Homo sapiens
gtttttccttatttgct

SEQ ID NO: 6345647 - DNA, 18 bp, Homo sapiens
gtttttccttgtagcatt

SEQ ID NO: 6345648 - DNA, 19 bp, Homo sapiens
gtttttccttgtatttaaa

SEQ ID NO: 6345649 - DNA, 15 bp, Homo sapiens
gtttttcctttaaaa

SEQ ID NO: 6345650 - DNA, 22 bp, Homo sapiens
gtttttcctttcttaattttgt

SEQ ID NO: 6345651 - DNA, 19 bp, Homo sapiens
gtttttctacttttaaaga

SEQ ID NO: 6345652 - DNA, 18 bp, Homo sapiens
gtttttctaggcctgggg

SEQ ID NO: 6345653 - DNA, 12 bp, Homo sapiens
gtttttctatat

SEQ ID NO: 6345654 - DNA, 12 bp, Homo sapiens
gtttttctatta

SEQ ID NO: 6345655 - DNA, 13 bp, Homo sapiens
gtttttctattaa

SEQ ID NO: 6345656 - DNA, 18 bp, Homo sapiens
gtttttctattaaaagac

SEQ ID NO: 6345657 - DNA, 20 bp, Homo sapiens
gtttttctattaaaagactc

SEQ ID NO: 6345658 - DNA, 22 bp, Homo sapiens
gtttttctattaaaagactcat

SEQ ID NO: 6345659 - DNA, 13 bp, Homo sapiens
gtttttctcaaat

SEQ ID NO: 6345660 - DNA, 15 bp, Homo sapiens
gtttttctcaaataa

SEQ ID NO: 6345661 - DNA, 15 bp, Homo sapiens
gtttttctcgtcccc

SEQ ID NO: 6345662 - DNA, 22 bp, Homo sapiens
gtttttctcgtccccctccctg

SEQ ID NO: 6345663 - DNA, 15 bp, Homo sapiens
gtttttctctctgga

SEQ ID NO: 6345664 - DNA, 16 bp, Homo sapiens
gtttttctctctggac

SEQ ID NO: 6345665 - DNA, 11 bp, Homo sapiens
gtttttctgaa

SEQ ID NO: 6345666 - DNA, 14 bp, Homo sapiens
gtttttctgccagg

SEQ ID NO: 6345667 - DNA, 18 bp, Homo sapiens
gtttttctgctttagact

SEQ ID NO: 6345668 - DNA, 18 bp, Homo sapiens
gtttttctgtgtgtcagt

SEQ ID NO: 6345669 - DNA, 14 bp, Homo sapiens
gtttttctgtgtta

SEQ ID NO: 6345670 - DNA, 18 bp, Homo sapiens
gtttttctgttccctgct

SEQ ID NO: 6345671 - DNA, 19 bp, Homo sapiens
gtttttctgttccctgctg

SEQ ID NO: 6345672 - DNA, 21 bp, Homo sapiens
gtttttcttaaataataaaga

SEQ ID NO: 6345673 - DNA, 16 bp, Homo sapiens
gtttttcttaatatat

SEQ ID NO: 6345674 - DNA, 12 bp, Homo sapiens
gtttttcttcaa

SEQ ID NO: 6345675 - DNA, 15 bp, Homo sapiens
gtttttcttctgaaa

SEQ ID NO: 6345676 - DNA, 19 bp, Homo sapiens
gtttttcttttctttattt

SEQ ID NO: 6345677 - DNA, 18 bp, Homo sapiens
gtttttctttttccacaa

SEQ ID NO: 6345678 - DNA, 19 bp, Homo sapiens
gtttttgaaacccacagtt

SEQ ID NO: 6345679 - DNA, 13 bp, Homo sapiens
gtttttgaaagac

SEQ ID NO: 6345680 - DNA, 22 bp, Homo sapiens
gtttttgaaagacaaaatttag

SEQ ID NO: 6345681 - DNA, 15 bp, Homo sapiens
gtttttgaaatacct

SEQ ID NO: 6345682 - DNA, 20 bp, Homo sapiens
gtttttgaagaagggaaatt

SEQ ID NO: 6345683 - DNA, 20 bp, Homo sapiens
gtttttgaaggcagaaagca

SEQ ID NO: 6345684 - DNA, 16 bp, Homo sapiens
gtttttgagatattaa

SEQ ID NO: 6345685 - DNA, 23 bp, Homo sapiens
gtttttgaggctttctgttgcca

SEQ ID NO: 6345686 - DNA, 15 bp, Homo sapiens
gtttttgatgccttt

SEQ ID NO: 6345687 - DNA, 22 bp, Homo sapiens
gtttttgatgtgcgtgctgtct

SEQ ID NO: 6345688 - DNA, 15 bp, Homo sapiens
gtttttgcacatgtt

SEQ ID NO: 6345689 - DNA, 17 bp, Homo sapiens
gtttttgcactgtctgt

SEQ ID NO: 6345690 - DNA, 17 bp, Homo sapiens
gtttttgctaaatgtga

SEQ ID NO: 6345691 - DNA, 22 bp, Homo sapiens
gtttttgctaaatgtgagtatt

SEQ ID NO: 6345692 - DNA, 14 bp, Homo sapiens
gtttttgctataga

SEQ ID NO: 6345693 - DNA, 12 bp, Homo sapiens
gtttttgctatt

SEQ ID NO: 6345694 - DNA, 12 bp, Homo sapiens
gtttttgctctc

SEQ ID NO: 6345695 - DNA, 10 bp, Homo sapiens
gtttttgctt

SEQ ID NO: 6345696 - DNA, 13 bp, Homo sapiens
gtttttgcttctc

SEQ ID NO: 6345697 - DNA, 16 bp, Homo sapiens
gtttttggaaagaaat

SEQ ID NO: 6345698 - DNA, 16 bp, Homo sapiens
gtttttggatggctta

SEQ ID NO: 6345699 - DNA, 20 bp, Homo sapiens
gtttttggctgagtactgga

SEQ ID NO: 6345700 - DNA, 20 bp, Homo sapiens
gtttttggctgttttccctc

SEQ ID NO: 6345701 - DNA, 13 bp, Homo sapiens
gtttttgtaaaga

SEQ ID NO: 6345702 - DNA, 15 bp, Homo sapiens
gtttttgtaaagaaa

SEQ ID NO: 6345703 - DNA, 21 bp, Homo sapiens
gtttttgtaaagaaaaatatt

SEQ ID NO: 6345704 - DNA, 16 bp, Homo sapiens
gtttttgtaaagtgtg

SEQ ID NO: 6345705 - DNA, 21 bp, Homo sapiens
gtttttgtaaattaatctttt

SEQ ID NO: 6345706 - DNA, 11 bp, Homo sapiens
gtttttgtaat

SEQ ID NO: 6345707 - DNA, 21 bp, Homo sapiens
gtttttgtagtattggggccc

SEQ ID NO: 6345708 - DNA, 17 bp, Homo sapiens
gtttttgtataggagcc

SEQ ID NO: 6345709 - DNA, 14 bp, Homo sapiens
gtttttgtatattg

SEQ ID NO: 6345710 - DNA, 20 bp, Homo sapiens
gtttttgtatctttatgctg

SEQ ID NO: 6345711 - DNA, 19 bp, Homo sapiens
gtttttgtatgaagtactt

SEQ ID NO: 6345712 - DNA, 13 bp, Homo sapiens
gtttttgtattta

SEQ ID NO: 6345713 - DNA, 16 bp, Homo sapiens
gtttttgtcttaaaaa

SEQ ID NO: 6345714 - DNA, 17 bp, Homo sapiens
gtttttgtgctgtgggc

SEQ ID NO: 6345715 - DNA, 19 bp, Homo sapiens
gtttttgttaactttgggt

SEQ ID NO: 6345716 - DNA, 22 bp, Homo sapiens
gtttttgttcaccttctgtgca

SEQ ID NO: 6345717 - DNA, 11 bp, Homo sapiens
gtttttgttct

SEQ ID NO: 6345718 - DNA, 22 bp, Homo sapiens
gtttttgttgagtctctgaaca

SEQ ID NO: 6345719 - DNA, 14 bp, Homo sapiens
gtttttgtttactg

SEQ ID NO: 6345720 - DNA, 15 bp, Homo sapiens
gtttttgtttggaga

SEQ ID NO: 6345721 - DNA, 17 bp, Homo sapiens
gtttttgtttggagagc

SEQ ID NO: 6345722 - DNA, 17 bp, Homo sapiens
gtttttgtttgtttctt

SEQ ID NO: 6345723 - DNA, 17 bp, Homo sapiens
gtttttgtttttgcatg

SEQ ID NO: 6345724 - DNA, 19 bp, Homo sapiens
gtttttgtttttgttttgt

SEQ ID NO: 6345725 - DNA, 18 bp, Homo sapiens
gttttttaaaaatctgtg

SEQ ID NO: 6345726 - DNA, 17 bp, Homo sapiens
gttttttaaacaaatga

SEQ ID NO: 6345727 - DNA, 14 bp, Homo sapiens
gttttttaaagcaa

SEQ ID NO: 6345728 - DNA, 23 bp, Homo sapiens
gttttttaagggccctttttcaa

SEQ ID NO: 6345729 - DNA, 23 bp, Homo sapiens
gttttttactttggtttagtctt

SEQ ID NO: 6345730 - DNA, 18 bp, Homo sapiens
gttttttaggaaaagcat

SEQ ID NO: 6345731 - DNA, 20 bp, Homo sapiens
gttttttatacttcaaatgt

SEQ ID NO: 6345732 - DNA, 23 bp, Homo sapiens
gttttttatcttttctacagcaa

SEQ ID NO: 6345733 - DNA, 15 bp, Homo sapiens
gttttttcaaaatag

SEQ ID NO: 6345734 - DNA, 21 bp, Homo sapiens
gttttttcaagaaaattttgc

SEQ ID NO: 6345735 - DNA, 23 bp, Homo sapiens
gttttttcacctccatgtcatcc

SEQ ID NO: 6345736 - DNA, 11 bp, Homo sapiens
gttttttcatc

SEQ ID NO: 6345737 - DNA, 13 bp, Homo sapiens
gttttttccccct

SEQ ID NO: 6345738 - DNA, 15 bp, Homo sapiens
gttttttcctcagtg

SEQ ID NO: 6345739 - DNA, 20 bp, Homo sapiens
gttttttcctcagtgcattt

SEQ ID NO: 6345740 - DNA, 16 bp, Homo sapiens
gttttttcctttataa

SEQ ID NO: 6345741 - DNA, 16 bp, Homo sapiens
gttttttcctttgctc

SEQ ID NO: 6345742 - DNA, 21 bp, Homo sapiens
gttttttcttccttttcactg

SEQ ID NO: 6345743 - DNA, 9 bp, Homo sapiens
gttttttga

SEQ ID NO: 6345744 - DNA, 12 bp, Homo sapiens
gttttttgaaaa

SEQ ID NO: 6345745 - DNA, 21 bp, Homo sapiens
gttttttggcttgcttatgtg

SEQ ID NO: 6345746 - DNA, 18 bp, Homo sapiens
gttttttgttcttgcgat

SEQ ID NO: 6345747 - DNA, 22 bp, Homo sapiens
gttttttgttggagtgtttcta

SEQ ID NO: 6345748 - DNA, 19 bp, Homo sapiens
gtttttttatttggcataa

SEQ ID NO: 6345749 - DNA, 23 bp, Homo sapiens
gtttttttcattgccaaaaacta

SEQ ID NO: 6345750 - DNA, 14 bp, Homo sapiens
gtttttttctaata

SEQ ID NO: 6345751 - DNA, 19 bp, Homo sapiens
gtttttttcttctgtattt

SEQ ID NO: 6345752 - DNA, 13 bp, Homo sapiens
gtttttttgagat

SEQ ID NO: 6345753 - DNA, 10 bp, Homo sapiens
gtttttttgc

SEQ ID NO: 6345754 - DNA, 15 bp, Homo sapiens
gtttttttggtcact

SEQ ID NO: 6345755 - DNA, 21 bp, Homo sapiens
gtttttttggtcactccagta

SEQ ID NO: 6345756 - DNA, 19 bp, Homo sapiens
gtttttttgtatagtaaag

SEQ ID NO: 6345757 - DNA, 14 bp, Homo sapiens
gtttttttgttcat

SEQ ID NO: 6345758 - DNA, 20 bp, Homo sapiens
gttttttttaaataaaagca

SEQ ID NO: 6345759 - DNA, 18 bp, Homo sapiens
gttttttttaatgtgaat

SEQ ID NO: 6345760 - DNA, 15 bp, Homo sapiens
gttttttttcagttg

SEQ ID NO: 6345761 - DNA, 12 bp, Homo sapiens
gttttttttcct

SEQ ID NO: 6345762 - DNA, 14 bp, Homo sapiens
gttttttttcttct

SEQ ID NO: 6345763 - DNA, 23 bp, Homo sapiens
gtttttttttatacactgtaatg

SEQ ID NO: 6345764 - DNA, 15 bp, Homo sapiens
gttttttttttaagt

SEQ ID NO: 6345765 - DNA, 19 bp, Homo sapiens
gttttttttttctgaataa

SEQ ID NO: 6345766 - DNA, 16 bp, Homo sapiens
gtttttttttttaaaa

SEQ ID NO: 6345767 - DNA, 19 bp, Homo sapiens
gtttttttttttcttaaat

SEQ ID NO: 6345768 - DNA, 15 bp, Homo sapiens
gttttttttttttcc

SEQ ID NO: 6345769 - DNA, 17 bp, Homo sapiens
gttttttttttttgtat

SEQ ID NO: 6345770 - DNA, 21 bp, Homo sapiens
gttttttttttttgtatttct

SEQ ID NO: 6345771 - DNA, 23 bp, Homo sapiens
gttttttttttttgtatttcttt

SEQ ID NO: 6345772 - DNA, 20 bp, Homo sapiens
gttttttttttttttatgtg

SEQ ID NO: 6345773 - DNA, 23 bp, Homo sapiens
taaaaaaaaaaaaaaaagactaa

SEQ ID NO: 6345774 - DNA, 19 bp, Homo sapiens
taaaaaaaaaaaaaagctt

SEQ ID NO: 6345775 - DNA, 22 bp, Homo sapiens
taaaaaaaaaaaaaagctttat

SEQ ID NO: 6345776 - DNA, 22 bp, Homo sapiens
taaaaaaaaaaaaaatgttctt

SEQ ID NO: 6345777 - DNA, 20 bp, Homo sapiens
taaaaaaaaaaaaaggaaaa

SEQ ID NO: 6345778 - DNA, 16 bp, Homo sapiens
taaaaaaaaaaaagta

SEQ ID NO: 6345779 - DNA, 18 bp, Homo sapiens
taaaaaaaaaaaagttat

SEQ ID NO: 6345780 - DNA, 20 bp, Homo sapiens
taaaaaaaaaaaagttatat

SEQ ID NO: 6345781 - DNA, 19 bp, Homo sapiens
taaaaaaaaaaaatcattt

SEQ ID NO: 6345782 - DNA, 15 bp, Homo sapiens
taaaaaaaaaaacaa

SEQ ID NO: 6345783 - DNA, 22 bp, Homo sapiens
taaaaaaaaaaaccaaaactgt

SEQ ID NO: 6345784 - DNA, 19 bp, Homo sapiens
taaaaaaaaaaagattgta

SEQ ID NO: 6345785 - DNA, 20 bp, Homo sapiens
taaaaaaaaaactgctttat

SEQ ID NO: 6345786 - DNA, 21 bp, Homo sapiens
taaaaaaaaaagttacagaaa

SEQ ID NO: 6345787 - DNA, 21 bp, Homo sapiens
taaaaaaaaacctgagcccca

SEQ ID NO: 6345788 - DNA, 19 bp, Homo sapiens
taaaaaaaaagatctgttt

SEQ ID NO: 6345789 - DNA, 14 bp, Homo sapiens
taaaaaaaaaggca

SEQ ID NO: 6345790 - DNA, 15 bp, Homo sapiens
taaaaaaaaagtcag

SEQ ID NO: 6345791 - DNA, 18 bp, Homo sapiens
taaaaaaaaatactcttt

SEQ ID NO: 6345792 - DNA, 23 bp, Homo sapiens
taaaaaaaaatagatgtctttta

SEQ ID NO: 6345793 - DNA, 20 bp, Homo sapiens
taaaaaaaactctttaactt

SEQ ID NO: 6345794 - DNA, 13 bp, Homo sapiens
taaaaaaaagaaa

SEQ ID NO: 6345795 - DNA, 17 bp, Homo sapiens
taaaaaaaagaaaaaag

SEQ ID NO: 6345796 - DNA, 14 bp, Homo sapiens
taaaaaaaagaagt

SEQ ID NO: 6345797 - DNA, 13 bp, Homo sapiens
taaaaaaaagttg

SEQ ID NO: 6345798 - DNA, 16 bp, Homo sapiens
taaaaaaaataataaa

SEQ ID NO: 6345799 - DNA, 14 bp, Homo sapiens
taaaaaaaatagtt

SEQ ID NO: 6345800 - DNA, 13 bp, Homo sapiens
taaaaaaaatcag

SEQ ID NO: 6345801 - DNA, 13 bp, Homo sapiens
taaaaaaaatgaa

SEQ ID NO: 6345802 - DNA, 20 bp, Homo sapiens
taaaaaaaatgaaatgtttt

SEQ ID NO: 6345803 - DNA, 12 bp, Homo sapiens
taaaaaaaatgt

SEQ ID NO: 6345804 - DNA, 16 bp, Homo sapiens
taaaaaaaatgtgaaa

SEQ ID NO: 6345805 - DNA, 12 bp, Homo sapiens
taaaaaaaccac

SEQ ID NO: 6345806 - DNA, 12 bp, Homo sapiens
taaaaaaactga

SEQ ID NO: 6345807 - DNA, 21 bp, Homo sapiens
taaaaaaactggatatttcaa

SEQ ID NO: 6345808 - DNA, 14 bp, Homo sapiens
taaaaaaagaaaat

SEQ ID NO: 6345809 - DNA, 14 bp, Homo sapiens
taaaaaaagcaaaa

SEQ ID NO: 6345810 - DNA, 15 bp, Homo sapiens
taaaaaaagcaaaaa

SEQ ID NO: 6345811 - DNA, 14 bp, Homo sapiens
taaaaaaagtatat

SEQ ID NO: 6345812 - DNA, 15 bp, Homo sapiens
taaaaaaagtgcatg

SEQ ID NO: 6345813 - DNA, 16 bp, Homo sapiens
taaaaaaataaaacag

SEQ ID NO: 6345814 - DNA, 19 bp, Homo sapiens
taaaaaaataaaacatttt

SEQ ID NO: 6345815 - DNA, 15 bp, Homo sapiens
taaaaaaataacatc

SEQ ID NO: 6345816 - DNA, 16 bp, Homo sapiens
taaaaaaataacatct

SEQ ID NO: 6345817 - DNA, 18 bp, Homo sapiens
taaaaaaataactgattt

SEQ ID NO: 6345818 - DNA, 20 bp, Homo sapiens
taaaaaaataataataatgt

SEQ ID NO: 6345819 - DNA, 18 bp, Homo sapiens
taaaaaaataatataaat

SEQ ID NO: 6345820 - DNA, 20 bp, Homo sapiens
taaaaaaataatataaatga

SEQ ID NO: 6345821 - DNA, 21 bp, Homo sapiens
taaaaaaataattgagactga

SEQ ID NO: 6345822 - DNA, 12 bp, Homo sapiens
taaaaaaataca

SEQ ID NO: 6345823 - DNA, 13 bp, Homo sapiens
taaaaaaatacag

SEQ ID NO: 6345824 - DNA, 16 bp, Homo sapiens
taaaaaaatacagtaa

SEQ ID NO: 6345825 - DNA, 20 bp, Homo sapiens
taaaaaaatacagtaaagtt

SEQ ID NO: 6345826 - DNA, 12 bp, Homo sapiens
taaaaaaataga

SEQ ID NO: 6345827 - DNA, 13 bp, Homo sapiens
taaaaaaatgaca

SEQ ID NO: 6345828 - DNA, 12 bp, Homo sapiens
taaaaaacaaaa

SEQ ID NO: 6345829 - DNA, 14 bp, Homo sapiens
taaaaaacaaagaa

SEQ ID NO: 6345830 - DNA, 19 bp, Homo sapiens
taaaaaacaaagaagacaa

SEQ ID NO: 6345831 - DNA, 14 bp, Homo sapiens
taaaaaacaaatat

SEQ ID NO: 6345832 - DNA, 12 bp, Homo sapiens
taaaaaacaaga

SEQ ID NO: 6345833 - DNA, 11 bp, Homo sapiens
taaaaaacact

SEQ ID NO: 6345834 - DNA, 19 bp, Homo sapiens
taaaaaacactaaacattc

SEQ ID NO: 6345835 - DNA, 14 bp, Homo sapiens
taaaaaacattcaa

SEQ ID NO: 6345836 - DNA, 14 bp, Homo sapiens
taaaaaacatttgt

SEQ ID NO: 6345837 - DNA, 16 bp, Homo sapiens
taaaaaacatttgtac

SEQ ID NO: 6345838 - DNA, 19 bp, Homo sapiens
taaaaaaccaacaatgtga

SEQ ID NO: 6345839 - DNA, 15 bp, Homo sapiens
taaaaaaccacatgg

SEQ ID NO: 6345840 - DNA, 21 bp, Homo sapiens
taaaaaactcctgtcttgcta

SEQ ID NO: 6345841 - DNA, 15 bp, Homo sapiens
taaaaaactgtataa

SEQ ID NO: 6345842 - DNA, 15 bp, Homo sapiens
taaaaaacttgtaaa

SEQ ID NO: 6345843 - DNA, 15 bp, Homo sapiens
taaaaaagaaaacat

SEQ ID NO: 6345844 - DNA, 16 bp, Homo sapiens
taaaaaagaaacattt

SEQ ID NO: 6345845 - DNA, 12 bp, Homo sapiens
taaaaaagaaat

SEQ ID NO: 6345846 - DNA, 14 bp, Homo sapiens
taaaaaagaaatga

SEQ ID NO: 6345847 - DNA, 21 bp, Homo sapiens
taaaaaagactgaacatgttt

SEQ ID NO: 6345848 - DNA, 13 bp, Homo sapiens
taaaaaagagaca

SEQ ID NO: 6345849 - DNA, 22 bp, Homo sapiens
taaaaaagagttttctttagta

SEQ ID NO: 6345850 - DNA, 17 bp, Homo sapiens
taaaaaagatcccaaat

SEQ ID NO: 6345851 - DNA, 14 bp, Homo sapiens
taaaaaagattcta

SEQ ID NO: 6345852 - DNA, 16 bp, Homo sapiens
taaaaaagatttgtag

SEQ ID NO: 6345853 - DNA, 15 bp, Homo sapiens
taaaaaagcaaagga

SEQ ID NO: 6345854 - DNA, 15 bp, Homo sapiens
taaaaaagccttcct

SEQ ID NO: 6345855 - DNA, 19 bp, Homo sapiens
taaaaaagcttaaaacttt

SEQ ID NO: 6345856 - DNA, 21 bp, Homo sapiens
taaaaaaggtagtttttctgt

SEQ ID NO: 6345857 - DNA, 16 bp, Homo sapiens
taaaaaagtctctatt

SEQ ID NO: 6345858 - DNA, 22 bp, Homo sapiens
taaaaaagttaaatgtgtgtaa

SEQ ID NO: 6345859 - DNA, 21 bp, Homo sapiens
taaaaaagttgtaatagagaa

SEQ ID NO: 6345860 - DNA, 18 bp, Homo sapiens
taaaaaagtttaaaatgt

SEQ ID NO: 6345861 - DNA, 15 bp, Homo sapiens
taaaaaataacatat

SEQ ID NO: 6345862 - DNA, 17 bp, Homo sapiens
taaaaaataataataca

SEQ ID NO: 6345863 - DNA, 15 bp, Homo sapiens
taaaaaataatacaa

SEQ ID NO: 6345864 - DNA, 13 bp, Homo sapiens
taaaaaatacacc

SEQ ID NO: 6345865 - DNA, 12 bp, Homo sapiens
taaaaaatacag

SEQ ID NO: 6345866 - DNA, 15 bp, Homo sapiens
taaaaaatacagtat

SEQ ID NO: 6345867 - DNA, 12 bp, Homo sapiens
taaaaaatacca

SEQ ID NO: 6345868 - DNA, 20 bp, Homo sapiens
taaaaaatatatgtaatata

SEQ ID NO: 6345869 - DNA, 13 bp, Homo sapiens
taaaaaatatttt

SEQ ID NO: 6345870 - DNA, 19 bp, Homo sapiens
taaaaaatattttaagaaa

SEQ ID NO: 6345871 - DNA, 14 bp, Homo sapiens
taaaaaatcaaaag

SEQ ID NO: 6345872 - DNA, 12 bp, Homo sapiens
taaaaaatcaag

SEQ ID NO: 6345873 - DNA, 13 bp, Homo sapiens
taaaaaatcaatc

SEQ ID NO: 6345874 - DNA, 19 bp, Homo sapiens
taaaaaatcaatcaatggt

SEQ ID NO: 6345875 - DNA, 23 bp, Homo sapiens
taaaaaatcaatcaatggtgcaa

SEQ ID NO: 6345876 - DNA, 22 bp, Homo sapiens
taaaaaatcatgccagtatttt

SEQ ID NO: 6345877 - DNA, 23 bp, Homo sapiens
taaaaaatcctcaacactattgt

SEQ ID NO: 6345878 - DNA, 13 bp, Homo sapiens
taaaaaatgaaat

SEQ ID NO: 6345879 - DNA, 12 bp, Homo sapiens
taaaaaatgaat

SEQ ID NO: 6345880 - DNA, 13 bp, Homo sapiens
taaaaaatggaaa

SEQ ID NO: 6345881 - DNA, 16 bp, Homo sapiens
taaaaaatggagctca

SEQ ID NO: 6345882 - DNA, 12 bp, Homo sapiens
taaaaaatggtt

SEQ ID NO: 6345883 - DNA, 11 bp, Homo sapiens
taaaaaatgta

SEQ ID NO: 6345884 - DNA, 15 bp, Homo sapiens
taaaaaatgtaacat

SEQ ID NO: 6345885 - DNA, 11 bp, Homo sapiens
taaaaaatgtc

SEQ ID NO: 6345886 - DNA, 20 bp, Homo sapiens
taaaaaatgtgtgtattctt

SEQ ID NO: 6345887 - DNA, 21 bp, Homo sapiens
taaaaaatgttttctggggaa

SEQ ID NO: 6345888 - DNA, 16 bp, Homo sapiens
taaaaaattaaagccc

SEQ ID NO: 6345889 - DNA, 18 bp, Homo sapiens
taaaaaattaaagcccat

SEQ ID NO: 6345890 - DNA, 15 bp, Homo sapiens
taaaaaattatggaa

SEQ ID NO: 6345891 - DNA, 22 bp, Homo sapiens
taaaaaattatggaatatcatc

SEQ ID NO: 6345892 - DNA, 19 bp, Homo sapiens
taaaaaatttattatgtcc

SEQ ID NO: 6345893 - DNA, 21 bp, Homo sapiens
taaaaacaaaaacaaaaccag

SEQ ID NO: 6345894 - DNA, 22 bp, Homo sapiens
taaaaacaaaaacatcccaaga

SEQ ID NO: 6345895 - DNA, 22 bp, Homo sapiens
taaaaacaaaacaaacacacac

SEQ ID NO: 6345896 - DNA, 17 bp, Homo sapiens
taaaaacaaacaaacaa

SEQ ID NO: 6345897 - DNA, 21 bp, Homo sapiens
taaaaacaaagaaattatgtg

SEQ ID NO: 6345898 - DNA, 17 bp, Homo sapiens
taaaaacaaaggaataa

SEQ ID NO: 6345899 - DNA, 22 bp, Homo sapiens
taaaaacaaaggagataaatct

SEQ ID NO: 6345900 - DNA, 22 bp, Homo sapiens
taaaaacaacaaatacttccat

SEQ ID NO: 6345901 - DNA, 23 bp, Homo sapiens
taaaaacaatatatgtaaattat

SEQ ID NO: 6345902 - DNA, 16 bp, Homo sapiens
taaaaacaatatattt

SEQ ID NO: 6345903 - DNA, 18 bp, Homo sapiens
taaaaacaatatatttgt

SEQ ID NO: 6345904 - DNA, 20 bp, Homo sapiens
taaaaacaatccttttgata

SEQ ID NO: 6345905 - DNA, 20 bp, Homo sapiens
taaaaacacaaatgtgtact

SEQ ID NO: 6345906 - DNA, 20 bp, Homo sapiens
taaaaacacaccttaaaaca

SEQ ID NO: 6345907 - DNA, 19 bp, Homo sapiens
taaaaacactacttttgct

SEQ ID NO: 6345908 - DNA, 13 bp, Homo sapiens
taaaaacagaaaa

SEQ ID NO: 6345909 - DNA, 15 bp, Homo sapiens
taaaaacagattctg

SEQ ID NO: 6345910 - DNA, 16 bp, Homo sapiens
taaaaacagattctga

SEQ ID NO: 6345911 - DNA, 22 bp, Homo sapiens
taaaaacagatttggaaagact

SEQ ID NO: 6345912 - DNA, 17 bp, Homo sapiens
taaaaacagcattgctt

SEQ ID NO: 6345913 - DNA, 18 bp, Homo sapiens
taaaaacagcattgcttt

SEQ ID NO: 6345914 - DNA, 15 bp, Homo sapiens
taaaaacataacata

SEQ ID NO: 6345915 - DNA, 17 bp, Homo sapiens
taaaaacataacataaa

SEQ ID NO: 6345916 - DNA, 13 bp, Homo sapiens
taaaaacatgagt

SEQ ID NO: 6345917 - DNA, 11 bp, Homo sapiens
taaaaacattg

SEQ ID NO: 6345918 - DNA, 12 bp, Homo sapiens
taaaaacatttt

SEQ ID NO: 6345919 - DNA, 22 bp, Homo sapiens
taaaaacattttttatacattt

SEQ ID NO: 6345920 - DNA, 20 bp, Homo sapiens
taaaaacatttttttaagca

SEQ ID NO: 6345921 - DNA, 20 bp, Homo sapiens
taaaaaccaaactctgtgtc

SEQ ID NO: 6345922 - DNA, 19 bp, Homo sapiens
taaaaaccacccacaaaga

SEQ ID NO: 6345923 - DNA, 22 bp, Homo sapiens
taaaaaccacccacaaagaaac

SEQ ID NO: 6345924 - DNA, 21 bp, Homo sapiens
taaaaaccagaatcataattt

SEQ ID NO: 6345925 - DNA, 19 bp, Homo sapiens
taaaaaccataaacatttg

SEQ ID NO: 6345926 - DNA, 19 bp, Homo sapiens
taaaaaccatgctggtata

SEQ ID NO: 6345927 - DNA, 23 bp, Homo sapiens
taaaaaccatgctggtatatggc

SEQ ID NO: 6345928 - DNA, 16 bp, Homo sapiens
taaaaacccacaaaaa

SEQ ID NO: 6345929 - DNA, 23 bp, Homo sapiens
taaaaacccacaaaaatgttgaa

SEQ ID NO: 6345930 - DNA, 22 bp, Homo sapiens
taaaaacccataactaccagga

SEQ ID NO: 6345931 - DNA, 15 bp, Homo sapiens
taaaaaccctgctaa

SEQ ID NO: 6345932 - DNA, 13 bp, Homo sapiens
ggttctcatttgg

SEQ ID NO: 6345933 - DNA, 15 bp, Homo sapiens
ggttctccaacagag

SEQ ID NO: 6345934 - DNA, 13 bp, Homo sapiens
ggttctcctgatt

SEQ ID NO: 6345935 - DNA, 12 bp, Homo sapiens
ggttctctacag

SEQ ID NO: 6345936 - DNA, 23 bp, Homo sapiens
ggttctctacaggcctcttcctg

SEQ ID NO: 6345937 - DNA, 13 bp, Homo sapiens
ggttctctgcctt

SEQ ID NO: 6345938 - DNA, 20 bp, Homo sapiens
ggttctctgggcctcagttt

SEQ ID NO: 6345939 - DNA, 20 bp, Homo sapiens
ggttctgactctggaccatg

SEQ ID NO: 6345940 - DNA, 18 bp, Homo sapiens
ggttctgagaagcgctgc

SEQ ID NO: 6345941 - DNA, 17 bp, Homo sapiens
ggttctgcactcctgga

SEQ ID NO: 6345942 - DNA, 20 bp, Homo sapiens
ggttctgcagcggcagagca

SEQ ID NO: 6345943 - DNA, 17 bp, Homo sapiens
ggttctgccctgcctga

SEQ ID NO: 6345944 - DNA, 21 bp, Homo sapiens
ggttctgccctgcctgaggag

SEQ ID NO: 6345945 - DNA, 13 bp, Homo sapiens
ggttctgcctgct

SEQ ID NO: 6345946 - DNA, 19 bp, Homo sapiens
ggttctgcgccacttcctt

SEQ ID NO: 6345947 - DNA, 23 bp, Homo sapiens
ggttctggcaggacctgcctagc

SEQ ID NO: 6345948 - DNA, 16 bp, Homo sapiens
ggttctgggcctctga

SEQ ID NO: 6345949 - DNA, 17 bp, Homo sapiens
ggttctggggccccttt

SEQ ID NO: 6345950 - DNA, 15 bp, Homo sapiens
ggttctggggctgag

SEQ ID NO: 6345951 - DNA, 16 bp, Homo sapiens
ggttctggggctgaga

SEQ ID NO: 6345952 - DNA, 18 bp, Homo sapiens
ggttctggtgtgaactaa

SEQ ID NO: 6345953 - DNA, 20 bp, Homo sapiens
ggttctgtctagactggcct

SEQ ID NO: 6345954 - DNA, 15 bp, Homo sapiens
ggttctgtctggtgc

SEQ ID NO: 6345955 - DNA, 22 bp, Homo sapiens
ggttctgtgtcctctgcctggg

SEQ ID NO: 6345956 - DNA, 16 bp, Homo sapiens
ggttctgtgttgaaat

SEQ ID NO: 6345957 - DNA, 15 bp, Homo sapiens
ggttctgttttctaa

SEQ ID NO: 6345958 - DNA, 17 bp, Homo sapiens
ggttcttaaaaaggaac

SEQ ID NO: 6345959 - DNA, 15 bp, Homo sapiens
ggttcttaaaagcat

SEQ ID NO: 6345960 - DNA, 14 bp, Homo sapiens
ggttcttaaatgtt

SEQ ID NO: 6345961 - DNA, 18 bp, Homo sapiens
ggttcttacttttcctgg

SEQ ID NO: 6345962 - DNA, 23 bp, Homo sapiens
ggttcttagagccttagcagccc

SEQ ID NO: 6345963 - DNA, 14 bp, Homo sapiens
ggttcttattcact

SEQ ID NO: 6345964 - DNA, 23 bp, Homo sapiens
ggttcttattttgcattccagaa

SEQ ID NO: 6345965 - DNA, 19 bp, Homo sapiens
ggttcttcagggccagtcc

SEQ ID NO: 6345966 - DNA, 13 bp, Homo sapiens
ggttcttcctttc

SEQ ID NO: 6345967 - DNA, 16 bp, Homo sapiens
ggttcttcctttccct

SEQ ID NO: 6345968 - DNA, 17 bp, Homo sapiens
ggttcttcctttccctg

SEQ ID NO: 6345969 - DNA, 21 bp, Homo sapiens
ggttcttcctttccctggagc

SEQ ID NO: 6345970 - DNA, 20 bp, Homo sapiens
ggttcttctatagtgatgat

SEQ ID NO: 6345971 - DNA, 13 bp, Homo sapiens
ggttcttcttatt

SEQ ID NO: 6345972 - DNA, 23 bp, Homo sapiens
ggttcttcttgtctttgtccctg

SEQ ID NO: 6345973 - DNA, 22 bp, Homo sapiens
ggttcttgaggggaccaggagt

SEQ ID NO: 6345974 - DNA, 11 bp, Homo sapiens
ggttcttgctt

SEQ ID NO: 6345975 - DNA, 17 bp, Homo sapiens
ggttcttgctttctctc

SEQ ID NO: 6345976 - DNA, 14 bp, Homo sapiens
ggttcttgtattaa

SEQ ID NO: 6345977 - DNA, 14 bp, Homo sapiens
ggttcttgttggtg

SEQ ID NO: 6345978 - DNA, 17 bp, Homo sapiens
ggttctttatcatttct

SEQ ID NO: 6345979 - DNA, 19 bp, Homo sapiens
ggttctttatcatttctct

SEQ ID NO: 6345980 - DNA, 18 bp, Homo sapiens
ggttctttcatttgcttt

SEQ ID NO: 6345981 - DNA, 16 bp, Homo sapiens
ggttctttcttcctct

SEQ ID NO: 6345982 - DNA, 19 bp, Homo sapiens
ggttctttgaccagcacat

SEQ ID NO: 6345983 - DNA, 19 bp, Homo sapiens
ggttgaaaagattccattt

SEQ ID NO: 6345984 - DNA, 18 bp, Homo sapiens
ggttgaaaatgtgtttgc

SEQ ID NO: 6345985 - DNA, 20 bp, Homo sapiens
ggttgaaaatgtgtttgctg

SEQ ID NO: 6345986 - DNA, 12 bp, Homo sapiens
ggttgaaagaca

SEQ ID NO: 6345987 - DNA, 13 bp, Homo sapiens
ggttgaaagacat

SEQ ID NO: 6345988 - DNA, 19 bp, Homo sapiens
ggttgaagaggtgagcacg

SEQ ID NO: 6345989 - DNA, 21 bp, Homo sapiens
ggttgaaggcagtctgaaccc

SEQ ID NO: 6345990 - DNA, 11 bp, Homo sapiens
ggttgaataaa

SEQ ID NO: 6345991 - DNA, 18 bp, Homo sapiens
ggttgaatatagcctgcc

SEQ ID NO: 6345992 - DNA, 22 bp, Homo sapiens
ggttgacaccattctcctgcct

SEQ ID NO: 6345993 - DNA, 23 bp, Homo sapiens
ggttgaccccaatccaacccggg

SEQ ID NO: 6345994 - DNA, 15 bp, Homo sapiens
ggttgaccccagagg

SEQ ID NO: 6345995 - DNA, 17 bp, Homo sapiens
ggttgagagccagtggc

SEQ ID NO: 6345996 - DNA, 11 bp, Homo sapiens
ggttgaggaaa

SEQ ID NO: 6345997 - DNA, 16 bp, Homo sapiens
ggttgaggctgcagtg

SEQ ID NO: 6345998 - DNA, 18 bp, Homo sapiens
ggttgaggggcctggaga

SEQ ID NO: 6345999 - DNA, 23 bp, Homo sapiens
ggttgaggtccagccctggctga

SEQ ID NO: 6346000 - DNA, 20 bp, Homo sapiens
ggttgaggtgcgctcacctc

SEQ ID NO: 6346001 - DNA, 13 bp, Homo sapiens
ggttgattaaggc

SEQ ID NO: 6346002 - DNA, 14 bp, Homo sapiens
ggttgattgtttaa

SEQ ID NO: 6346003 - DNA, 13 bp, Homo sapiens
ggttgcaaagcta

SEQ ID NO: 6346004 - DNA, 14 bp, Homo sapiens
ggttgcagacagga

SEQ ID NO: 6346005 - DNA, 20 bp, Homo sapiens
ggttgcagcatgagactttc

SEQ ID NO: 6346006 - DNA, 13 bp, Homo sapiens
ggttgcagctgct

SEQ ID NO: 6346007 - DNA, 23 bp, Homo sapiens
ggttgcagtctttcccccaggaa

SEQ ID NO: 6346008 - DNA, 11 bp, Homo sapiens
ggttgcagtgc

SEQ ID NO: 6346009 - DNA, 13 bp, Homo sapiens
ggttgccacaggc

SEQ ID NO: 6346010 - DNA, 12 bp, Homo sapiens
ggttgccagagg

SEQ ID NO: 6346011 - DNA, 17 bp, Homo sapiens
ggttgccagaggccctg

SEQ ID NO: 6346012 - DNA, 15 bp, Homo sapiens
ggttgccagtcctgc

SEQ ID NO: 6346013 - DNA, 23 bp, Homo sapiens
ggttgccatggagatctgaaggg

SEQ ID NO: 6346014 - DNA, 14 bp, Homo sapiens
ggttgccatggtaa

SEQ ID NO: 6346015 - DNA, 11 bp, Homo sapiens
ggttgcccagc

SEQ ID NO: 6346016 - DNA, 18 bp, Homo sapiens
ggttgcctcaacagcagg

SEQ ID NO: 6346017 - DNA, 13 bp, Homo sapiens
ggttgcctccccc

SEQ ID NO: 6346018 - DNA, 17 bp, Homo sapiens
ggttgcctcgagtcccc

SEQ ID NO: 6346019 - DNA, 12 bp, Homo sapiens
ggttgcctctct

SEQ ID NO: 6346020 - DNA, 13 bp, Homo sapiens
ggttgcctgaggt

SEQ ID NO: 6346021 - DNA, 13 bp, Homo sapiens
ggttgcctggggg

SEQ ID NO: 6346022 - DNA, 18 bp, Homo sapiens
ggttgcgggggagctgga

SEQ ID NO: 6346023 - DNA, 21 bp, Homo sapiens
ggttgctgctgtccagtgcct

SEQ ID NO: 6346024 - DNA, 15 bp, Homo sapiens
ggttgctggtcaggt

SEQ ID NO: 6346025 - DNA, 17 bp, Homo sapiens
ggttgctggtcaggtcc

SEQ ID NO: 6346026 - DNA, 19 bp, Homo sapiens
ggttgctggtcctgcacat

SEQ ID NO: 6346027 - DNA, 20 bp, Homo sapiens
ggttgctggtcctgcacatg

SEQ ID NO: 6346028 - DNA, 11 bp, Homo sapiens
ggttgcttctg

SEQ ID NO: 6346029 - DNA, 11 bp, Homo sapiens
ggttgctttga

SEQ ID NO: 6346030 - DNA, 17 bp, Homo sapiens
ggttggaactgctgcca

SEQ ID NO: 6346031 - DNA, 18 bp, Homo sapiens
ggttggaactgctgccat

SEQ ID NO: 6346032 - DNA, 22 bp, Homo sapiens
ggttggaactttagggggtggg

SEQ ID NO: 6346033 - DNA, 21 bp, Homo sapiens
ggttggaagctagctcccctc

SEQ ID NO: 6346034 - DNA, 16 bp, Homo sapiens
ggttggacagccccct

SEQ ID NO: 6346035 - DNA, 14 bp, Homo sapiens
ggttggaccccaga

SEQ ID NO: 6346036 - DNA, 14 bp, Homo sapiens
ggttggagaaggag

SEQ ID NO: 6346037 - DNA, 13 bp, Homo sapiens
ggttggagagccc

SEQ ID NO: 6346038 - DNA, 17 bp, Homo sapiens
ggttggagcccagggca

SEQ ID NO: 6346039 - DNA, 12 bp, Homo sapiens
ggttggagggaa

SEQ ID NO: 6346040 - DNA, 18 bp, Homo sapiens
ggttggatgggaagatgg

SEQ ID NO: 6346041 - DNA, 18 bp, Homo sapiens
ggttggcaaaaaggcagg

SEQ ID NO: 6346042 - DNA, 15 bp, Homo sapiens
ggttggcaccccagc

SEQ ID NO: 6346043 - DNA, 14 bp, Homo sapiens
ggttggcagcccac

SEQ ID NO: 6346044 - DNA, 17 bp, Homo sapiens
ggttggcagcgcctcgc

SEQ ID NO: 6346045 - DNA, 12 bp, Homo sapiens
ggttggccagga

SEQ ID NO: 6346046 - DNA, 14 bp, Homo sapiens
ggttggccaggagg

SEQ ID NO: 6346047 - DNA, 18 bp, Homo sapiens
ggttggcccttgtctttt

SEQ ID NO: 6346048 - DNA, 14 bp, Homo sapiens
ggttggccggctgg

SEQ ID NO: 6346049 - DNA, 17 bp, Homo sapiens
ggttggcgcaccctccc

SEQ ID NO: 6346050 - DNA, 18 bp, Homo sapiens
ggttggcgcaccctcccc

SEQ ID NO: 6346051 - DNA, 13 bp, Homo sapiens
ggttggctcccgc

SEQ ID NO: 6346052 - DNA, 15 bp, Homo sapiens
ggttggctgggccca

SEQ ID NO: 6346053 - DNA, 17 bp, Homo sapiens
ggttggcttgctgatgg

SEQ ID NO: 6346054 - DNA, 19 bp, Homo sapiens
ggttgggaattcttgctgt

SEQ ID NO: 6346055 - DNA, 20 bp, Homo sapiens
ggttgggacaatggcaatag

SEQ ID NO: 6346056 - DNA, 18 bp, Homo sapiens
ggttgggaccaggccaat

SEQ ID NO: 6346057 - DNA, 22 bp, Homo sapiens
ggttgggacccagtggcagggc

SEQ ID NO: 6346058 - DNA, 18 bp, Homo sapiens
ggttgggaggctgtggag

SEQ ID NO: 6346059 - DNA, 16 bp, Homo sapiens
ggttgggggaatgcac

SEQ ID NO: 6346060 - DNA, 18 bp, Homo sapiens
ggttgggggacagccttc

SEQ ID NO: 6346061 - DNA, 20 bp, Homo sapiens
ggttgggggcaccatctgga

SEQ ID NO: 6346062 - DNA, 19 bp, Homo sapiens
ggttgggggcactcagcca

SEQ ID NO: 6346063 - DNA, 15 bp, Homo sapiens
ggttggggtgggagg

SEQ ID NO: 6346064 - DNA, 23 bp, Homo sapiens
ggttgggttgattgtatgttgag

SEQ ID NO: 6346065 - DNA, 21 bp, Homo sapiens
ggttggtatctcaggtctgaa

SEQ ID NO: 6346066 - DNA, 19 bp, Homo sapiens
ggttggtcctcttgcctcc

SEQ ID NO: 6346067 - DNA, 13 bp, Homo sapiens
ggttggtgggggc

SEQ ID NO: 6346068 - DNA, 16 bp, Homo sapiens
ggttggtgtgaagaaa

SEQ ID NO: 6346069 - DNA, 15 bp, Homo sapiens
ggttggttttatttg

SEQ ID NO: 6346070 - DNA, 19 bp, Homo sapiens
ggttgtaaatgctcgtgtg

SEQ ID NO: 6346071 - DNA, 20 bp, Homo sapiens
ggttgtaaatgctcgtgtga

SEQ ID NO: 6346072 - DNA, 16 bp, Homo sapiens
ggttgtaattaaattt

SEQ ID NO: 6346073 - DNA, 19 bp, Homo sapiens
ggttgtattagatgttctc

SEQ ID NO: 6346074 - DNA, 22 bp, Homo sapiens
ggttgtattctttgatgttaac

SEQ ID NO: 6346075 - DNA, 13 bp, Homo sapiens
ggttgtatttcta

SEQ ID NO: 6346076 - DNA, 20 bp, Homo sapiens
ggttgtcaaaactccactca

SEQ ID NO: 6346077 - DNA, 13 bp, Homo sapiens
ggttgtcagctct

SEQ ID NO: 6346078 - DNA, 14 bp, Homo sapiens
ggttgtccaggtct

SEQ ID NO: 6346079 - DNA, 15 bp, Homo sapiens
ggttgtccaggtcta

SEQ ID NO: 6346080 - DNA, 21 bp, Homo sapiens
ggttgtctcagccgagcccag

SEQ ID NO: 6346081 - DNA, 13 bp, Homo sapiens
ggttgtctccagg

SEQ ID NO: 6346082 - DNA, 14 bp, Homo sapiens
ggttgtctctcttc

SEQ ID NO: 6346083 - DNA, 18 bp, Homo sapiens
ggttgtctgaacccaggc

SEQ ID NO: 6346084 - DNA, 19 bp, Homo sapiens
ggttgtctgaacccaggca

SEQ ID NO: 6346085 - DNA, 20 bp, Homo sapiens
ggttgtctgaacccaggcag

SEQ ID NO: 6346086 - DNA, 22 bp, Homo sapiens
ggttgtctgaacccaggcagct

SEQ ID NO: 6346087 - DNA, 16 bp, Homo sapiens
ggttgtgaggcctggc

SEQ ID NO: 6346088 - DNA, 16 bp, Homo sapiens
ggttgtgccttccctt

SEQ ID NO: 6346089 - DNA, 18 bp, Homo sapiens
ggttgtgctttctagcaa

SEQ ID NO: 6346090 - DNA, 21 bp, Homo sapiens
ggttgtggcccccgccccctc

SEQ ID NO: 6346091 - DNA, 18 bp, Homo sapiens
ggttgtggggaggctgca

SEQ ID NO: 6346092 - DNA, 19 bp, Homo sapiens
ggttgtggggaggctgcac

SEQ ID NO: 6346093 - DNA, 14 bp, Homo sapiens
ggttgtgtcactga

SEQ ID NO: 6346094 - DNA, 11 bp, Homo sapiens
ggttgtgtgtg

SEQ ID NO: 6346095 - DNA, 22 bp, Homo sapiens
ggttgttaggcttttctgcctg

SEQ ID NO: 6346096 - DNA, 23 bp, Homo sapiens
ggttgttgatattgtttgctgtt

SEQ ID NO: 6346097 - DNA, 22 bp, Homo sapiens
ggttgttgcaccatctgcttgg

SEQ ID NO: 6346098 - DNA, 15 bp, Homo sapiens
ggttgttgccaggtt

SEQ ID NO: 6346099 - DNA, 15 bp, Homo sapiens
ggttgttggtctgtg

SEQ ID NO: 6346100 - DNA, 20 bp, Homo sapiens
ggttgtttaaatataaatct

SEQ ID NO: 6346101 - DNA, 14 bp, Homo sapiens
ggttgtttccagga

SEQ ID NO: 6346102 - DNA, 17 bp, Homo sapiens
ggttgtttttaaagaaa

SEQ ID NO: 6346103 - DNA, 16 bp, Homo sapiens
ggtttaaaagaaaaaa

SEQ ID NO: 6346104 - DNA, 17 bp, Homo sapiens
ggtttaaatatgaatga

SEQ ID NO: 6346105 - DNA, 16 bp, Homo sapiens
ggtttacaacaaacac

SEQ ID NO: 6346106 - DNA, 18 bp, Homo sapiens
ggtttacaacaaacactg

SEQ ID NO: 6346107 - DNA, 19 bp, Homo sapiens
ggtttacaacaaacactgt

SEQ ID NO: 6346108 - DNA, 23 bp, Homo sapiens
ggtttacactgcggaagccaaag

SEQ ID NO: 6346109 - DNA, 14 bp, Homo sapiens
ggtttacaggccct

SEQ ID NO: 6346110 - DNA, 19 bp, Homo sapiens
ggtttacattcatctcatt

SEQ ID NO: 6346111 - DNA, 18 bp, Homo sapiens
ggtttacatttaaagcat

SEQ ID NO: 6346112 - DNA, 12 bp, Homo sapiens
ggtttactctgt

SEQ ID NO: 6346113 - DNA, 17 bp, Homo sapiens
taaaaaccgaataaatg

SEQ ID NO: 6346114 - DNA, 18 bp, Homo sapiens
taaaaaccgaataaatgt

SEQ ID NO: 6346115 - DNA, 16 bp, Homo sapiens
taaaaaccttccaaac

SEQ ID NO: 6346116 - DNA, 23 bp, Homo sapiens
taaaaactaacagctacaaactt

SEQ ID NO: 6346117 - DNA, 17 bp, Homo sapiens
taaaaactactgaataa

SEQ ID NO: 6346118 - DNA, 19 bp, Homo sapiens
taaaaactagtagttctct

SEQ ID NO: 6346119 - DNA, 19 bp, Homo sapiens
taaaaactagttataaaaa

SEQ ID NO: 6346120 - DNA, 14 bp, Homo sapiens
taaaaactatctga

SEQ ID NO: 6346121 - DNA, 14 bp, Homo sapiens
taaaaactcctttt

SEQ ID NO: 6346122 - DNA, 15 bp, Homo sapiens
taaaaactcttcagt

SEQ ID NO: 6346123 - DNA, 13 bp, Homo sapiens
taaaaactgaaga

SEQ ID NO: 6346124 - DNA, 17 bp, Homo sapiens
taaaaactgaagaattt

SEQ ID NO: 6346125 - DNA, 11 bp, Homo sapiens
taaaaactgat

SEQ ID NO: 6346126 - DNA, 13 bp, Homo sapiens
taaaaactgtgta

SEQ ID NO: 6346127 - DNA, 23 bp, Homo sapiens
taaaaactgtgtatcattaaaat

SEQ ID NO: 6346128 - DNA, 14 bp, Homo sapiens
taaaaactttgcta

SEQ ID NO: 6346129 - DNA, 21 bp, Homo sapiens
taaaaacttttttctttgaaa

SEQ ID NO: 6346130 - DNA, 23 bp, Homo sapiens
taaaaacttttttctttgaaatg

SEQ ID NO: 6346131 - DNA, 23 bp, Homo sapiens
taaaaagaaaaaaaaagaattac

SEQ ID NO: 6346132 - DNA, 21 bp, Homo sapiens
taaaaagaaaacaaaaccaaa

SEQ ID NO: 6346133 - DNA, 17 bp, Homo sapiens
taaaaagaaaagataaa

SEQ ID NO: 6346134 - DNA, 16 bp, Homo sapiens
taaaaagaaaatcagt

SEQ ID NO: 6346135 - DNA, 13 bp, Homo sapiens
taaaaagaaaggc

SEQ ID NO: 6346136 - DNA, 18 bp, Homo sapiens
taaaaagaaattaatatg

SEQ ID NO: 6346137 - DNA, 23 bp, Homo sapiens
taaaaagaaattgtgaaaaatga

SEQ ID NO: 6346138 - DNA, 14 bp, Homo sapiens
taaaaagaagaaaa

SEQ ID NO: 6346139 - DNA, 15 bp, Homo sapiens
taaaaagaagtttct

SEQ ID NO: 6346140 - DNA, 21 bp, Homo sapiens
taaaaagaattccaccaggct

SEQ ID NO: 6346141 - DNA, 21 bp, Homo sapiens
taaaaagacacttatattttg

SEQ ID NO: 6346142 - DNA, 17 bp, Homo sapiens
taaaaagaccatgcatt

SEQ ID NO: 6346143 - DNA, 23 bp, Homo sapiens
taaaaagactattaagagcaata

SEQ ID NO: 6346144 - DNA, 14 bp, Homo sapiens
taaaaagagaaggc

SEQ ID NO: 6346145 - DNA, 23 bp, Homo sapiens
taaaaagaggatgatttcagaag

SEQ ID NO: 6346146 - DNA, 20 bp, Homo sapiens
taaaaagatgaaaaagaata

SEQ ID NO: 6346147 - DNA, 13 bp, Homo sapiens
taaaaagatgact

SEQ ID NO: 6346148 - DNA, 16 bp, Homo sapiens
taaaaagattagcaag

SEQ ID NO: 6346149 - DNA, 14 bp, Homo sapiens
taaaaagattatat

SEQ ID NO: 6346150 - DNA, 18 bp, Homo sapiens
taaaaagattgaagtatt

SEQ ID NO: 6346151 - DNA, 13 bp, Homo sapiens
taaaaagatttgt

SEQ ID NO: 6346152 - DNA, 12 bp, Homo sapiens
taaaaagcagca

SEQ ID NO: 6346153 - DNA, 22 bp, Homo sapiens
taaaaagcagtttttgaaagac

SEQ ID NO: 6346154 - DNA, 17 bp, Homo sapiens
taaaaagcatgttgtga

SEQ ID NO: 6346155 - DNA, 20 bp, Homo sapiens
taaaaagcccaacctcttcc

SEQ ID NO: 6346156 - DNA, 16 bp, Homo sapiens
taaaaagcctctttct

SEQ ID NO: 6346157 - DNA, 22 bp, Homo sapiens
taaaaagcgctgcagtagctgt

SEQ ID NO: 6346158 - DNA, 16 bp, Homo sapiens
taaaaagctaatgaca

SEQ ID NO: 6346159 - DNA, 17 bp, Homo sapiens
taaaaagcttttgtcta

SEQ ID NO: 6346160 - DNA, 10 bp, Homo sapiens
taaaaaggaa

SEQ ID NO: 6346161 - DNA, 12 bp, Homo sapiens
taaaaaggaaat

SEQ ID NO: 6346162 - DNA, 20 bp, Homo sapiens
taaaaaggaaatatttttca

SEQ ID NO: 6346163 - DNA, 13 bp, Homo sapiens
taaaaaggaacaa

SEQ ID NO: 6346164 - DNA, 16 bp, Homo sapiens
taaaaaggaacgtata

SEQ ID NO: 6346165 - DNA, 17 bp, Homo sapiens
taaaaaggaactgcagc

SEQ ID NO: 6346166 - DNA, 15 bp, Homo sapiens
taaaaaggaaggaga

SEQ ID NO: 6346167 - DNA, 22 bp, Homo sapiens
taaaaaggaagtggggacagat

SEQ ID NO: 6346168 - DNA, 16 bp, Homo sapiens
taaaaaggaattttgt

SEQ ID NO: 6346169 - DNA, 18 bp, Homo sapiens
taaaaaggaattttgtaa

SEQ ID NO: 6346170 - DNA, 19 bp, Homo sapiens
taaaaaggaattttgtaaa

SEQ ID NO: 6346171 - DNA, 21 bp, Homo sapiens
taaaaaggacatcagcaaaca

SEQ ID NO: 6346172 - DNA, 18 bp, Homo sapiens
taaaaaggagtatacaaa

SEQ ID NO: 6346173 - DNA, 15 bp, Homo sapiens
taaaaaggccaaaga

SEQ ID NO: 6346174 - DNA, 22 bp, Homo sapiens
taaaaaggcccttagagggaat

SEQ ID NO: 6346175 - DNA, 13 bp, Homo sapiens
taaaaaggccttt

SEQ ID NO: 6346176 - DNA, 17 bp, Homo sapiens
taaaaagggaaaaagac

SEQ ID NO: 6346177 - DNA, 23 bp, Homo sapiens
taaaaagggaaagttttgttctg

SEQ ID NO: 6346178 - DNA, 17 bp, Homo sapiens
taaaaagggagaaagaa

SEQ ID NO: 6346179 - DNA, 18 bp, Homo sapiens
taaaaagggccagaaaaa

SEQ ID NO: 6346180 - DNA, 19 bp, Homo sapiens
taaaaagggtaacttgttt

SEQ ID NO: 6346181 - DNA, 19 bp, Homo sapiens
taaaaagtaataaaattca

SEQ ID NO: 6346182 - DNA, 21 bp, Homo sapiens
taaaaagtaatgacttagaaa

SEQ ID NO: 6346183 - DNA, 22 bp, Homo sapiens
taaaaagtaattgtagatggaa

SEQ ID NO: 6346184 - DNA, 21 bp, Homo sapiens
taaaaagtaccacattccatg

SEQ ID NO: 6346185 - DNA, 19 bp, Homo sapiens
taaaaagtataaaatagta

SEQ ID NO: 6346186 - DNA, 16 bp, Homo sapiens
taaaaagtatatgtta

SEQ ID NO: 6346187 - DNA, 20 bp, Homo sapiens
taaaaagtattgccaaacat

SEQ ID NO: 6346188 - DNA, 22 bp, Homo sapiens
taaaaagtccataccttatata

SEQ ID NO: 6346189 - DNA, 23 bp, Homo sapiens
taaaaagtccttgcaagaatgga

SEQ ID NO: 6346190 - DNA, 16 bp, Homo sapiens
taaaaagtcttttaaa

SEQ ID NO: 6346191 - DNA, 14 bp, Homo sapiens
taaaaagtgaactt

SEQ ID NO: 6346192 - DNA, 16 bp, Homo sapiens
taaaaagtgaactttt

SEQ ID NO: 6346193 - DNA, 20 bp, Homo sapiens
taaaaagtgaacttttgtaa

SEQ ID NO: 6346194 - DNA, 21 bp, Homo sapiens
taaaaagtgaacttttgtaat

SEQ ID NO: 6346195 - DNA, 22 bp, Homo sapiens
taaaaagtgaacttttgtaatt

SEQ ID NO: 6346196 - DNA, 17 bp, Homo sapiens
taaaaagtgacacagca

SEQ ID NO: 6346197 - DNA, 17 bp, Homo sapiens
taaaaagtgcttttgtg

SEQ ID NO: 6346198 - DNA, 15 bp, Homo sapiens
taaaaagtggaaaaa

SEQ ID NO: 6346199 - DNA, 9 bp, Homo sapiens
taaaaagtt

SEQ ID NO: 6346200 - DNA, 17 bp, Homo sapiens
taaaaagttaaaaagtt

SEQ ID NO: 6346201 - DNA, 12 bp, Homo sapiens
taaaaagttaat

SEQ ID NO: 6346202 - DNA, 16 bp, Homo sapiens
taaaaagttgttcttt

SEQ ID NO: 6346203 - DNA, 18 bp, Homo sapiens
taaaaagtttcacgtctt

SEQ ID NO: 6346204 - DNA, 18 bp, Homo sapiens
taaaaagtttgccctgga

SEQ ID NO: 6346205 - DNA, 20 bp, Homo sapiens
taaaaagttttagttttgat

SEQ ID NO: 6346206 - DNA, 17 bp, Homo sapiens
taaaaataaaaatggaa

SEQ ID NO: 6346207 - DNA, 16 bp, Homo sapiens
taaaaataaaagctat

SEQ ID NO: 6346208 - DNA, 19 bp, Homo sapiens
taaaaataaaatgatgtat

SEQ ID NO: 6346209 - DNA, 19 bp, Homo sapiens
taaaaataaagcacaaacc

SEQ ID NO: 6346210 - DNA, 14 bp, Homo sapiens
taaaaataaagcta

SEQ ID NO: 6346211 - DNA, 22 bp, Homo sapiens
taaaaataaagctactgaattt

SEQ ID NO: 6346212 - DNA, 14 bp, Homo sapiens
taaaaataaaggaa

SEQ ID NO: 6346213 - DNA, 15 bp, Homo sapiens
taaaaataaaggaaa

SEQ ID NO: 6346214 - DNA, 17 bp, Homo sapiens
taaaaataaatagaaaa

SEQ ID NO: 6346215 - DNA, 21 bp, Homo sapiens
taaaaataaatagaaaagtag

SEQ ID NO: 6346216 - DNA, 13 bp, Homo sapiens
taaaaataaattt

SEQ ID NO: 6346217 - DNA, 13 bp, Homo sapiens
taaaaataactgt

SEQ ID NO: 6346218 - DNA, 15 bp, Homo sapiens
taaaaataactgtaa

SEQ ID NO: 6346219 - DNA, 17 bp, Homo sapiens
taaaaataactgtaatt

SEQ ID NO: 6346220 - DNA, 19 bp, Homo sapiens
taaaaataagttttataca

SEQ ID NO: 6346221 - DNA, 20 bp, Homo sapiens
taaaaataagttttatacat

SEQ ID NO: 6346222 - DNA, 14 bp, Homo sapiens
taaaaataatcagt

SEQ ID NO: 6346223 - DNA, 11 bp, Homo sapiens
taaaaataatt

SEQ ID NO: 6346224 - DNA, 22 bp, Homo sapiens
taaaaataattattttattgtg

SEQ ID NO: 6346225 - DNA, 15 bp, Homo sapiens
taaaaataattgggt

SEQ ID NO: 6346226 - DNA, 15 bp, Homo sapiens
taaaaatacaaacaa

SEQ ID NO: 6346227 - DNA, 23 bp, Homo sapiens
taaaaatacaattattgtatatt

SEQ ID NO: 6346228 - DNA, 17 bp, Homo sapiens
taaaaatacacatgaaa

SEQ ID NO: 6346229 - DNA, 20 bp, Homo sapiens
taaaaataccttctatgtat

SEQ ID NO: 6346230 - DNA, 12 bp, Homo sapiens
taaaaatactat

SEQ ID NO: 6346231 - DNA, 21 bp, Homo sapiens
taaaaatactatgaaatgaaa

SEQ ID NO: 6346232 - DNA, 19 bp, Homo sapiens
taaaaatactgtttcacta

SEQ ID NO: 6346233 - DNA, 12 bp, Homo sapiens
taaaaatagaaa

SEQ ID NO: 6346234 - DNA, 14 bp, Homo sapiens
taaaaatagaaaca

SEQ ID NO: 6346235 - DNA, 18 bp, Homo sapiens
taaaaatagaaataaagt

SEQ ID NO: 6346236 - DNA, 19 bp, Homo sapiens
taaaaatagaatacatttt

SEQ ID NO: 6346237 - DNA, 15 bp, Homo sapiens
taaaaatagaatcca

SEQ ID NO: 6346238 - DNA, 14 bp, Homo sapiens
taaaaatagacagt

SEQ ID NO: 6346239 - DNA, 15 bp, Homo sapiens
taaaaatagcaaaat

SEQ ID NO: 6346240 - DNA, 21 bp, Homo sapiens
taaaaataggctttttaggaa

SEQ ID NO: 6346241 - DNA, 12 bp, Homo sapiens
taaaaatataaa

SEQ ID NO: 6346242 - DNA, 16 bp, Homo sapiens
taaaaatataaacaat

SEQ ID NO: 6346243 - DNA, 18 bp, Homo sapiens
taaaaatataaacaatgt

SEQ ID NO: 6346244 - DNA, 15 bp, Homo sapiens
taaaaatataaattg

SEQ ID NO: 6346245 - DNA, 17 bp, Homo sapiens
taaaaatataaattgta

SEQ ID NO: 6346246 - DNA, 19 bp, Homo sapiens
taaaaatataaattgtaca

SEQ ID NO: 6346247 - DNA, 22 bp, Homo sapiens
taaaaatatacaagctacagtt

SEQ ID NO: 6346248 - DNA, 18 bp, Homo sapiens
taaaaatatctgaatata

SEQ ID NO: 6346249 - DNA, 23 bp, Homo sapiens
taaaaatatggaacttctaatat

SEQ ID NO: 6346250 - DNA, 10 bp, Homo sapiens
taaaaatatt

SEQ ID NO: 6346251 - DNA, 13 bp, Homo sapiens
taaaaatattcct

SEQ ID NO: 6346252 - DNA, 13 bp, Homo sapiens
taaaaatatttca

SEQ ID NO: 6346253 - DNA, 15 bp, Homo sapiens
taaaaatatttcaga

SEQ ID NO: 6346254 - DNA, 17 bp, Homo sapiens
taaaaatatttcagata

SEQ ID NO: 6346255 - DNA, 18 bp, Homo sapiens
taaaaatattttttctgt

SEQ ID NO: 6346256 - DNA, 16 bp, Homo sapiens
taaaaatcacactgta

SEQ ID NO: 6346257 - DNA, 17 bp, Homo sapiens
taaaaatcactatgatt

SEQ ID NO: 6346258 - DNA, 17 bp, Homo sapiens
taaaaatcaggagcctg

SEQ ID NO: 6346259 - DNA, 21 bp, Homo sapiens
taaaaatcaggagcctgctaa

SEQ ID NO: 6346260 - DNA, 15 bp, Homo sapiens
taaaaatcatataga

SEQ ID NO: 6346261 - DNA, 16 bp, Homo sapiens
taaaaatcatatagac

SEQ ID NO: 6346262 - DNA, 13 bp, Homo sapiens
taaaaatcatgtg

SEQ ID NO: 6346263 - DNA, 18 bp, Homo sapiens
taaaaatcctaaaatatg

SEQ ID NO: 6346264 - DNA, 19 bp, Homo sapiens
taaaaatcctaaaatatgt

SEQ ID NO: 6346265 - DNA, 22 bp, Homo sapiens
taaaaatctaagcagcttattg

SEQ ID NO: 6346266 - DNA, 20 bp, Homo sapiens
taaaaatctaccttctgtag

SEQ ID NO: 6346267 - DNA, 17 bp, Homo sapiens
taaaaatctacgtcttt

SEQ ID NO: 6346268 - DNA, 22 bp, Homo sapiens
taaaaatctagcacactcttct

SEQ ID NO: 6346269 - DNA, 21 bp, Homo sapiens
taaaaatctcaaatttctaaa

SEQ ID NO: 6346270 - DNA, 16 bp, Homo sapiens
taaaaatctctcattt

SEQ ID NO: 6346271 - DNA, 15 bp, Homo sapiens
taaaaatctcttttc

SEQ ID NO: 6346272 - DNA, 11 bp, Homo sapiens
taaaaatcttt

SEQ ID NO: 6346273 - DNA, 12 bp, Homo sapiens
taaaaatctttc

SEQ ID NO: 6346274 - DNA, 21 bp, Homo sapiens
taaaaatctttcagaatacaa

SEQ ID NO: 6346275 - DNA, 12 bp, Homo sapiens
taaaaatgaaaa

SEQ ID NO: 6346276 - DNA, 12 bp, Homo sapiens
taaaaatgaaga

SEQ ID NO: 6346277 - DNA, 21 bp, Homo sapiens
taaaaatgaaggaattacatt

SEQ ID NO: 6346278 - DNA, 13 bp, Homo sapiens
taaaaatgagaac

SEQ ID NO: 6346279 - DNA, 14 bp, Homo sapiens
taaaaatgagactt

SEQ ID NO: 6346280 - DNA, 17 bp, Homo sapiens
taaaaatgagacttttt

SEQ ID NO: 6346281 - DNA, 16 bp, Homo sapiens
taaaaatgagatttct

SEQ ID NO: 6346282 - DNA, 18 bp, Homo sapiens
taaaaatgagatttctta

SEQ ID NO: 6346283 - DNA, 19 bp, Homo sapiens
taaaaatgagatttcttat

SEQ ID NO: 6346284 - DNA, 18 bp, Homo sapiens
taaaaatgagtcatttgt

SEQ ID NO: 6346285 - DNA, 16 bp, Homo sapiens
taaaaatgatattgct

SEQ ID NO: 6346286 - DNA, 16 bp, Homo sapiens
taaaaatgcaaatcct

SEQ ID NO: 6346287 - DNA, 19 bp, Homo sapiens
taaaaatgcaaatcctatg

SEQ ID NO: 6346288 - DNA, 13 bp, Homo sapiens
taaaaatgctgtg

SEQ ID NO: 6346289 - DNA, 20 bp, Homo sapiens
taaaaatggcaaatgcactg

SEQ ID NO: 6346290 - DNA, 23 bp, Homo sapiens
taaaaatggcagggggtggaatt

SEQ ID NO: 6346291 - DNA, 20 bp, Homo sapiens
taaaaatggctaactgatga

SEQ ID NO: 6346292 - DNA, 23 bp, Homo sapiens
ggtttactctgtggccaaaggag

SEQ ID NO: 6346293 - DNA, 18 bp, Homo sapiens
ggtttactgctgtcattg

SEQ ID NO: 6346294 - DNA, 13 bp, Homo sapiens
ggtttagaacccc

SEQ ID NO: 6346295 - DNA, 16 bp, Homo sapiens
ggtttagaaccccagg

SEQ ID NO: 6346296 - DNA, 17 bp, Homo sapiens
ggtttagccgggcccca

SEQ ID NO: 6346297 - DNA, 23 bp, Homo sapiens
ggtttagtatatgtcttgagagg

SEQ ID NO: 6346298 - DNA, 14 bp, Homo sapiens
ggtttatgactttg

SEQ ID NO: 6346299 - DNA, 10 bp, Homo sapiens
ggtttattct

SEQ ID NO: 6346300 - DNA, 21 bp, Homo sapiens
ggtttattctatctgttttta

SEQ ID NO: 6346301 - DNA, 11 bp, Homo sapiens
ggtttatttgg

SEQ ID NO: 6346302 - DNA, 18 bp, Homo sapiens
ggtttatttgttgttttc

SEQ ID NO: 6346303 - DNA, 22 bp, Homo sapiens
ggtttatttgttgttttctggg

SEQ ID NO: 6346304 - DNA, 15 bp, Homo sapiens
ggtttatttttgtaa

SEQ ID NO: 6346305 - DNA, 16 bp, Homo sapiens
ggtttatttttgtaat

SEQ ID NO: 6346306 - DNA, 21 bp, Homo sapiens
ggtttcaacaaatttcattgc

SEQ ID NO: 6346307 - DNA, 23 bp, Homo sapiens
ggtttcaacaaatttcattgcac

SEQ ID NO: 6346308 - DNA, 12 bp, Homo sapiens
ggtttcaattta

SEQ ID NO: 6346309 - DNA, 20 bp, Homo sapiens
ggtttcaccatgttggtcag

SEQ ID NO: 6346310 - DNA, 20 bp, Homo sapiens
ggtttcacccttaacccaag

SEQ ID NO: 6346311 - DNA, 13 bp, Homo sapiens
ggtttcaccttcc

SEQ ID NO: 6346312 - DNA, 12 bp, Homo sapiens
ggtttcagaagc

SEQ ID NO: 6346313 - DNA, 19 bp, Homo sapiens
ggtttcagccaaggggctg

SEQ ID NO: 6346314 - DNA, 20 bp, Homo sapiens
ggtttcagttctgtgtacat

SEQ ID NO: 6346315 - DNA, 17 bp, Homo sapiens
ggtttcatactctagat

SEQ ID NO: 6346316 - DNA, 17 bp, Homo sapiens
ggtttcatatttcttat

SEQ ID NO: 6346317 - DNA, 14 bp, Homo sapiens
ggtttcattttcat

SEQ ID NO: 6346318 - DNA, 15 bp, Homo sapiens
ggtttcccaatggtg

SEQ ID NO: 6346319 - DNA, 18 bp, Homo sapiens
ggtttcccaatggtgttt

SEQ ID NO: 6346320 - DNA, 19 bp, Homo sapiens
ggtttcccagtgagcctct

SEQ ID NO: 6346321 - DNA, 23 bp, Homo sapiens
ggtttcccatttgttgctgctgc

SEQ ID NO: 6346322 - DNA, 15 bp, Homo sapiens
ggtttccctgcccct

SEQ ID NO: 6346323 - DNA, 21 bp, Homo sapiens
ggtttcctctgccccctcctt

SEQ ID NO: 6346324 - DNA, 14 bp, Homo sapiens
ggtttcctgcaggc

SEQ ID NO: 6346325 - DNA, 20 bp, Homo sapiens
ggtttcctggcactggaccc

SEQ ID NO: 6346326 - DNA, 11 bp, Homo sapiens
ggtttcctggt

SEQ ID NO: 6346327 - DNA, 13 bp, Homo sapiens
ggtttcctttctc

SEQ ID NO: 6346328 - DNA, 18 bp, Homo sapiens
ggtttccttttggaacat

SEQ ID NO: 6346329 - DNA, 16 bp, Homo sapiens
ggtttcgactggtcca

SEQ ID NO: 6346330 - DNA, 22 bp, Homo sapiens
ggtttcgactggtccagctctg

SEQ ID NO: 6346331 - DNA, 15 bp, Homo sapiens
ggtttcgagaagctg

SEQ ID NO: 6346332 - DNA, 22 bp, Homo sapiens
ggtttcggaaaaaaaaaaagaa

SEQ ID NO: 6346333 - DNA, 16 bp, Homo sapiens
ggtttctaaagctgcc

SEQ ID NO: 6346334 - DNA, 21 bp, Homo sapiens
ggtttctaagcataaaagatg

SEQ ID NO: 6346335 - DNA, 22 bp, Homo sapiens
ggtttctacttcccctgggatg

SEQ ID NO: 6346336 - DNA, 18 bp, Homo sapiens
ggtttctagatcactgtg

SEQ ID NO: 6346337 - DNA, 12 bp, Homo sapiens
ggtttctagcat

SEQ ID NO: 6346338 - DNA, 22 bp, Homo sapiens
ggtttctagggtgggccccagc

SEQ ID NO: 6346339 - DNA, 14 bp, Homo sapiens
ggtttctccccgga

SEQ ID NO: 6346340 - DNA, 23 bp, Homo sapiens
ggtttctccttgaagcaaatgtg

SEQ ID NO: 6346341 - DNA, 11 bp, Homo sapiens
ggtttctctcc

SEQ ID NO: 6346342 - DNA, 12 bp, Homo sapiens
ggtttctctctt

SEQ ID NO: 6346343 - DNA, 12 bp, Homo sapiens
ggtttctctgtg

SEQ ID NO: 6346344 - DNA, 22 bp, Homo sapiens
ggtttctctgtggctccaggcc

SEQ ID NO: 6346345 - DNA, 22 bp, Homo sapiens
ggtttctcttctccccttccat

SEQ ID NO: 6346346 - DNA, 23 bp, Homo sapiens
ggtttctgacccaagaggtgggg

SEQ ID NO: 6346347 - DNA, 14 bp, Homo sapiens
ggtttctgagctgc

SEQ ID NO: 6346348 - DNA, 20 bp, Homo sapiens
ggtttctgatctgtactttg

SEQ ID NO: 6346349 - DNA, 17 bp, Homo sapiens
ggtttctgccctgccca

SEQ ID NO: 6346350 - DNA, 18 bp, Homo sapiens
ggtttctgccctgcccac

SEQ ID NO: 6346351 - DNA, 12 bp, Homo sapiens
ggtttctgggtg

SEQ ID NO: 6346352 - DNA, 16 bp, Homo sapiens
ggtttcttctctggag

SEQ ID NO: 6346353 - DNA, 17 bp, Homo sapiens
ggtttcttctctggaga

SEQ ID NO: 6346354 - DNA, 12 bp, Homo sapiens
ggtttgaaagcc

SEQ ID NO: 6346355 - DNA, 13 bp, Homo sapiens
ggtttgaaatttt

SEQ ID NO: 6346356 - DNA, 15 bp, Homo sapiens
ggtttgaagcctgga

SEQ ID NO: 6346357 - DNA, 17 bp, Homo sapiens
ggtttgaagcctggaac

SEQ ID NO: 6346358 - DNA, 13 bp, Homo sapiens
ggtttgaagctgc

SEQ ID NO: 6346359 - DNA, 16 bp, Homo sapiens
ggtttgacaattttgt

SEQ ID NO: 6346360 - DNA, 16 bp, Homo sapiens
ggtttgaccaggaaag

SEQ ID NO: 6346361 - DNA, 19 bp, Homo sapiens
ggtttgaccaggaaagcag

SEQ ID NO: 6346362 - DNA, 23 bp, Homo sapiens
ggtttgaggaccctcccaggttt

SEQ ID NO: 6346363 - DNA, 15 bp, Homo sapiens
ggtttgatcatttct

SEQ ID NO: 6346364 - DNA, 16 bp, Homo sapiens
ggtttgatgccaaagc

SEQ ID NO: 6346365 - DNA, 19 bp, Homo sapiens
ggtttgatgccaaagcaga

SEQ ID NO: 6346366 - DNA, 11 bp, Homo sapiens
ggtttgattgt

SEQ ID NO: 6346367 - DNA, 18 bp, Homo sapiens
ggtttgcaaaagggcttc

SEQ ID NO: 6346368 - DNA, 21 bp, Homo sapiens
ggtttgccaaaattcatttct

SEQ ID NO: 6346369 - DNA, 17 bp, Homo sapiens
ggtttgcccagtcctgg

SEQ ID NO: 6346370 - DNA, 20 bp, Homo sapiens
ggtttgccttttatgtaaat

SEQ ID NO: 6346371 - DNA, 19 bp, Homo sapiens
ggtttggaaaataacttta

SEQ ID NO: 6346372 - DNA, 13 bp, Homo sapiens
ggtttggacagac

SEQ ID NO: 6346373 - DNA, 15 bp, Homo sapiens
ggtttggagctgatc

SEQ ID NO: 6346374 - DNA, 14 bp, Homo sapiens
ggtttggccaggga

SEQ ID NO: 6346375 - DNA, 15 bp, Homo sapiens
ggtttggccagggag

SEQ ID NO: 6346376 - DNA, 23 bp, Homo sapiens
ggtttggccagggaggcgcaggg

SEQ ID NO: 6346377 - DNA, 23 bp, Homo sapiens
ggtttggccatctctggatgcct

SEQ ID NO: 6346378 - DNA, 14 bp, Homo sapiens
ggtttggcccctgg

SEQ ID NO: 6346379 - DNA, 14 bp, Homo sapiens
ggtttggcgggcca

SEQ ID NO: 6346380 - DNA, 15 bp, Homo sapiens
ggtttggctgtgtct

SEQ ID NO: 6346381 - DNA, 21 bp, Homo sapiens
ggtttggctgtgtctaaactg

SEQ ID NO: 6346382 - DNA, 17 bp, Homo sapiens
ggtttgggaaagatgga

SEQ ID NO: 6346383 - DNA, 15 bp, Homo sapiens
ggtttgggagagacc

SEQ ID NO: 6346384 - DNA, 16 bp, Homo sapiens
ggtttgggatggagat

SEQ ID NO: 6346385 - DNA, 16 bp, Homo sapiens
ggtttgggcagtggag

SEQ ID NO: 6346386 - DNA, 22 bp, Homo sapiens
ggtttgggcagtggagagggga

SEQ ID NO: 6346387 - DNA, 19 bp, Homo sapiens
ggtttggggagcagagaca

SEQ ID NO: 6346388 - DNA, 21 bp, Homo sapiens
ggtttggggccatggtggagg

SEQ ID NO: 6346389 - DNA, 17 bp, Homo sapiens
ggtttggggctggcccc

SEQ ID NO: 6346390 - DNA, 21 bp, Homo sapiens
ggtttgggggcttccctgggc

SEQ ID NO: 6346391 - DNA, 22 bp, Homo sapiens
ggtttgggtgggggctgtggcc

SEQ ID NO: 6346392 - DNA, 16 bp, Homo sapiens
ggtttggtacagttca

SEQ ID NO: 6346393 - DNA, 17 bp, Homo sapiens
ggtttgtaatggtgctt

SEQ ID NO: 6346394 - DNA, 23 bp, Homo sapiens
ggtttgtcgggcaccagccagcg

SEQ ID NO: 6346395 - DNA, 19 bp, Homo sapiens
ggtttgtgagccttgctgc

SEQ ID NO: 6346396 - DNA, 19 bp, Homo sapiens
ggtttgtgggtccaggaga

SEQ ID NO: 6346397 - DNA, 21 bp, Homo sapiens
ggtttgtgtttgattggcttt

SEQ ID NO: 6346398 - DNA, 16 bp, Homo sapiens
ggtttgttgtaaataa

SEQ ID NO: 6346399 - DNA, 12 bp, Homo sapiens
ggtttgtttgct

SEQ ID NO: 6346400 - DNA, 14 bp, Homo sapiens
ggtttgtttgctgc

SEQ ID NO: 6346401 - DNA, 13 bp, Homo sapiens
ggtttgtttgctt

SEQ ID NO: 6346402 - DNA, 17 bp, Homo sapiens
ggtttgtttttcaaagc

SEQ ID NO: 6346403 - DNA, 13 bp, Homo sapiens
ggttttaaacttt

SEQ ID NO: 6346404 - DNA, 16 bp, Homo sapiens
ggttttaaatgtgttg

SEQ ID NO: 6346405 - DNA, 22 bp, Homo sapiens
ggttttaagctaaaatgttact

SEQ ID NO: 6346406 - DNA, 12 bp, Homo sapiens
ggttttaatgta

SEQ ID NO: 6346407 - DNA, 21 bp, Homo sapiens
ggttttactgctttttctctg

SEQ ID NO: 6346408 - DNA, 19 bp, Homo sapiens
ggttttagaaattctataa

SEQ ID NO: 6346409 - DNA, 20 bp, Homo sapiens
ggttttagatttttaaaagg

SEQ ID NO: 6346410 - DNA, 19 bp, Homo sapiens
ggttttatactatattaac

SEQ ID NO: 6346411 - DNA, 19 bp, Homo sapiens
ggttttattgtttaaaatc

SEQ ID NO: 6346412 - DNA, 22 bp, Homo sapiens
ggttttcacataaatgcagccc

SEQ ID NO: 6346413 - DNA, 17 bp, Homo sapiens
ggttttcacattggaaa

SEQ ID NO: 6346414 - DNA, 14 bp, Homo sapiens
ggttttcacttcct

SEQ ID NO: 6346415 - DNA, 18 bp, Homo sapiens
ggttttcagagcaggagg

SEQ ID NO: 6346416 - DNA, 15 bp, Homo sapiens
ggttttccaagccct

SEQ ID NO: 6346417 - DNA, 21 bp, Homo sapiens
ggttttcccatgactcttgga

SEQ ID NO: 6346418 - DNA, 18 bp, Homo sapiens
ggttttcccctccctggg

SEQ ID NO: 6346419 - DNA, 18 bp, Homo sapiens
ggttttcctcagctctag

SEQ ID NO: 6346420 - DNA, 10 bp, Homo sapiens
ggttttcctg

SEQ ID NO: 6346421 - DNA, 19 bp, Homo sapiens
ggttttcgaagctcagccc

SEQ ID NO: 6346422 - DNA, 19 bp, Homo sapiens
ggttttcgtcatcttccct

SEQ ID NO: 6346423 - DNA, 16 bp, Homo sapiens
ggttttctaactgtaa

SEQ ID NO: 6346424 - DNA, 17 bp, Homo sapiens
ggttttctaactgtaaa

SEQ ID NO: 6346425 - DNA, 13 bp, Homo sapiens
ggttttctccttc

SEQ ID NO: 6346426 - DNA, 16 bp, Homo sapiens
ggttttctccttccca

SEQ ID NO: 6346427 - DNA, 21 bp, Homo sapiens
ggttttctctaacttctcaag

SEQ ID NO: 6346428 - DNA, 16 bp, Homo sapiens
ggttttctctctggat

SEQ ID NO: 6346429 - DNA, 15 bp, Homo sapiens
ggttttctgctctgt

SEQ ID NO: 6346430 - DNA, 18 bp, Homo sapiens
ggttttctggtggggctg

SEQ ID NO: 6346431 - DNA, 22 bp, Homo sapiens
ggttttctggtggggctgtcct

SEQ ID NO: 6346432 - DNA, 18 bp, Homo sapiens
ggttttcttaaccatctt

SEQ ID NO: 6346433 - DNA, 13 bp, Homo sapiens
ggttttcttttct

SEQ ID NO: 6346434 - DNA, 14 bp, Homo sapiens
ggttttgaaatgtt

SEQ ID NO: 6346435 - DNA, 16 bp, Homo sapiens
ggttttgaaatgtttc

SEQ ID NO: 6346436 - DNA, 20 bp, Homo sapiens
ggttttgcttccccgtgcat

SEQ ID NO: 6346437 - DNA, 15 bp, Homo sapiens
ggttttggcatctct

SEQ ID NO: 6346438 - DNA, 17 bp, Homo sapiens
ggttttggggaaatgtg

SEQ ID NO: 6346439 - DNA, 17 bp, Homo sapiens
ggttttgtaagatgctg

SEQ ID NO: 6346440 - DNA, 20 bp, Homo sapiens
ggttttgtaagatgctgggt

SEQ ID NO: 6346441 - DNA, 20 bp, Homo sapiens
ggttttgtaatttgtttgaa

SEQ ID NO: 6346442 - DNA, 11 bp, Homo sapiens
ggttttgtaca

SEQ ID NO: 6346443 - DNA, 23 bp, Homo sapiens
ggttttgtccattattaataatt

SEQ ID NO: 6346444 - DNA, 17 bp, Homo sapiens
ggttttgttaggggtgg

SEQ ID NO: 6346445 - DNA, 19 bp, Homo sapiens
ggttttgttcccctcctcc

SEQ ID NO: 6346446 - DNA, 21 bp, Homo sapiens
ggttttgtttctttccttctg

SEQ ID NO: 6346447 - DNA, 12 bp, Homo sapiens
ggttttgtttgc

SEQ ID NO: 6346448 - DNA, 22 bp, Homo sapiens
ggttttgttttcaatgaattaa

SEQ ID NO: 6346449 - DNA, 19 bp, Homo sapiens
ggtttttaaaaaatgtttt

SEQ ID NO: 6346450 - DNA, 16 bp, Homo sapiens
ggtttttaaaacccag

SEQ ID NO: 6346451 - DNA, 19 bp, Homo sapiens
ggtttttaatctcttgtca

SEQ ID NO: 6346452 - DNA, 20 bp, Homo sapiens
ggtttttacctgtcacattg

SEQ ID NO: 6346453 - DNA, 17 bp, Homo sapiens
ggtttttacttaactgt

SEQ ID NO: 6346454 - DNA, 19 bp, Homo sapiens
ggtttttacttaactgttt

SEQ ID NO: 6346455 - DNA, 15 bp, Homo sapiens
ggtttttagagaatg

SEQ ID NO: 6346456 - DNA, 15 bp, Homo sapiens
ggtttttattagtac

SEQ ID NO: 6346457 - DNA, 21 bp, Homo sapiens
ggtttttatttctcgggtgca

SEQ ID NO: 6346458 - DNA, 18 bp, Homo sapiens
ggtttttcaattaaacgg

SEQ ID NO: 6346459 - DNA, 20 bp, Homo sapiens
ggtttttcaattaaacggat

SEQ ID NO: 6346460 - DNA, 16 bp, Homo sapiens
ggtttttcatctttta

SEQ ID NO: 6346461 - DNA, 16 bp, Homo sapiens
ggtttttgatgccttt

SEQ ID NO: 6346462 - DNA, 12 bp, Homo sapiens
ggtttttgctct

SEQ ID NO: 6346463 - DNA, 13 bp, Homo sapiens
ggtttttgctctc

SEQ ID NO: 6346464 - DNA, 20 bp, Homo sapiens
ggtttttggacttctggggt

SEQ ID NO: 6346465 - DNA, 20 bp, Homo sapiens
ggtttttggctctttcagag

SEQ ID NO: 6346466 - DNA, 18 bp, Homo sapiens
ggttttttataaagtcta

SEQ ID NO: 6346467 - DNA, 17 bp, Homo sapiens
ggttttttcttctttct

SEQ ID NO: 6346468 - DNA, 14 bp, Homo sapiens
ggttttttggccta

SEQ ID NO: 6346469 - DNA, 13 bp, Homo sapiens
ggtttttttaagt

SEQ ID NO: 6346470 - DNA, 13 bp, Homo sapiens
ggtttttttcctt

SEQ ID NO: 6346471 - DNA, 22 bp, Homo sapiens
ggtttttttctttggctgcagg

SEQ ID NO: 6346472 - DNA, 22 bp, Homo sapiens
taaaaatggctaactgatgaat

SEQ ID NO: 6346473 - DNA, 20 bp, Homo sapiens
taaaaatggtatcaaaatta

SEQ ID NO: 6346474 - DNA, 23 bp, Homo sapiens
taaaaatggtggcttcagctcca

SEQ ID NO: 6346475 - DNA, 15 bp, Homo sapiens
taaaaatggtttaaa

SEQ ID NO: 6346476 - DNA, 18 bp, Homo sapiens
taaaaatggtttaaatgg

SEQ ID NO: 6346477 - DNA, 11 bp, Homo sapiens
taaaaatgtaa

SEQ ID NO: 6346478 - DNA, 20 bp, Homo sapiens
taaaaatgtaaatattctat

SEQ ID NO: 6346479 - DNA, 18 bp, Homo sapiens
taaaaatgtaaattagtt

SEQ ID NO: 6346480 - DNA, 21 bp, Homo sapiens
taaaaatgtaaattagtttga

SEQ ID NO: 6346481 - DNA, 19 bp, Homo sapiens
taaaaatgtagaaattctt

SEQ ID NO: 6346482 - DNA, 12 bp, Homo sapiens
taaaaatgtata

SEQ ID NO: 6346483 - DNA, 13 bp, Homo sapiens
taaaaatgtcttt

SEQ ID NO: 6346484 - DNA, 13 bp, Homo sapiens
taaaaatgtgaat

SEQ ID NO: 6346485 - DNA, 19 bp, Homo sapiens
taaaaattaaggcaactga

SEQ ID NO: 6346486 - DNA, 15 bp, Homo sapiens
taaaaattaattctt

SEQ ID NO: 6346487 - DNA, 19 bp, Homo sapiens
taaaaattacataattcaa

SEQ ID NO: 6346488 - DNA, 17 bp, Homo sapiens
taaaaattacatatata

SEQ ID NO: 6346489 - DNA, 23 bp, Homo sapiens
taaaaattactgtttaattgaca

SEQ ID NO: 6346490 - DNA, 16 bp, Homo sapiens
taaaaattagatggaa

SEQ ID NO: 6346491 - DNA, 14 bp, Homo sapiens
taaaaattagcatg

SEQ ID NO: 6346492 - DNA, 17 bp, Homo sapiens
taaaaattatgaaatat

SEQ ID NO: 6346493 - DNA, 17 bp, Homo sapiens
taaaaattcatataaag

SEQ ID NO: 6346494 - DNA, 16 bp, Homo sapiens
taaaaattcccttcct

SEQ ID NO: 6346495 - DNA, 17 bp, Homo sapiens
taaaaattcccttcctg

SEQ ID NO: 6346496 - DNA, 19 bp, Homo sapiens
taaaaattcccttcctgtt

SEQ ID NO: 6346497 - DNA, 12 bp, Homo sapiens
taaaaattgaaa

SEQ ID NO: 6346498 - DNA, 15 bp, Homo sapiens
taaaaattgaactgt

SEQ ID NO: 6346499 - DNA, 22 bp, Homo sapiens
taaaaattgaactgtaaactct

SEQ ID NO: 6346500 - DNA, 22 bp, Homo sapiens
taaaaattgaatgtggctgaag

SEQ ID NO: 6346501 - DNA, 23 bp, Homo sapiens
taaaaattgtcttcatgtacatt

SEQ ID NO: 6346502 - DNA, 17 bp, Homo sapiens
taaaaattgtgatcaga

SEQ ID NO: 6346503 - DNA, 22 bp, Homo sapiens
taaaaattgttaatttttccta

SEQ ID NO: 6346504 - DNA, 14 bp, Homo sapiens
taaaaattgtttct

SEQ ID NO: 6346505 - DNA, 17 bp, Homo sapiens
taaaaatttataacagt

SEQ ID NO: 6346506 - DNA, 22 bp, Homo sapiens
taaaaattttgtcctttcatgt

SEQ ID NO: 6346507 - DNA, 14 bp, Homo sapiens
taaaaatttttaaa

SEQ ID NO: 6346508 - DNA, 19 bp, Homo sapiens
taaaaatttttacaaaact

SEQ ID NO: 6346509 - DNA, 12 bp, Homo sapiens
taaaacaaaaaa

SEQ ID NO: 6346510 - DNA, 17 bp, Homo sapiens
taaaacaaaaaacaata

SEQ ID NO: 6346511 - DNA, 11 bp, Homo sapiens
taaaacaaaag

SEQ ID NO: 6346512 - DNA, 12 bp, Homo sapiens
taaaacaaaaga

SEQ ID NO: 6346513 - DNA, 20 bp, Homo sapiens
taaaacaaaaggaaagaaac

SEQ ID NO: 6346514 - DNA, 12 bp, Homo sapiens
taaaacaaaatc

SEQ ID NO: 6346515 - DNA, 23 bp, Homo sapiens
taaaacaaaccagcaacttttct

SEQ ID NO: 6346516 - DNA, 22 bp, Homo sapiens
taaaacaaagccactttcaatc

SEQ ID NO: 6346517 - DNA, 16 bp, Homo sapiens
taaaacaaaggaacta

SEQ ID NO: 6346518 - DNA, 20 bp, Homo sapiens
taaaacaaaggaactaactt

SEQ ID NO: 6346519 - DNA, 15 bp, Homo sapiens
taaaacaaataaata

SEQ ID NO: 6346520 - DNA, 15 bp, Homo sapiens
taaaacaaatataca

SEQ ID NO: 6346521 - DNA, 12 bp, Homo sapiens
taaaacaaatga

SEQ ID NO: 6346522 - DNA, 15 bp, Homo sapiens
taaaacaaatgaaat

SEQ ID NO: 6346523 - DNA, 17 bp, Homo sapiens
taaaacaaatgaaattt

SEQ ID NO: 6346524 - DNA, 15 bp, Homo sapiens
taaaacaacactcac

SEQ ID NO: 6346525 - DNA, 16 bp, Homo sapiens
taaaacaacagctcga

SEQ ID NO: 6346526 - DNA, 22 bp, Homo sapiens
taaaacaaccagttaaagccac

SEQ ID NO: 6346527 - DNA, 14 bp, Homo sapiens
taaaacaagctgat

SEQ ID NO: 6346528 - DNA, 22 bp, Homo sapiens
taaaacaaggcttaaaagagta

SEQ ID NO: 6346529 - DNA, 19 bp, Homo sapiens
taaaacaagggaaaaattt

SEQ ID NO: 6346530 - DNA, 22 bp, Homo sapiens
taaaacaaggggttactttaca

SEQ ID NO: 6346531 - DNA, 21 bp, Homo sapiens
taaaacaagtgtataactaaa

SEQ ID NO: 6346532 - DNA, 17 bp, Homo sapiens
taaaacaatccttacta

SEQ ID NO: 6346533 - DNA, 14 bp, Homo sapiens
taaaacaatgccat

SEQ ID NO: 6346534 - DNA, 18 bp, Homo sapiens
taaaacaatgtttttcat

SEQ ID NO: 6346535 - DNA, 21 bp, Homo sapiens
taaaacaattctgtgacatac

SEQ ID NO: 6346536 - DNA, 18 bp, Homo sapiens
taaaacaattgtgacagc

SEQ ID NO: 6346537 - DNA, 15 bp, Homo sapiens
taaaacaatttattt

SEQ ID NO: 6346538 - DNA, 22 bp, Homo sapiens
taaaacaattttttttttcctc

SEQ ID NO: 6346539 - DNA, 22 bp, Homo sapiens
taaaacacaacatctttttcta

SEQ ID NO: 6346540 - DNA, 23 bp, Homo sapiens
taaaacacaacatctttttctac

SEQ ID NO: 6346541 - DNA, 19 bp, Homo sapiens
taaaacacaagactgtcat

SEQ ID NO: 6346542 - DNA, 12 bp, Homo sapiens
taaaacacagag

SEQ ID NO: 6346543 - DNA, 14 bp, Homo sapiens
taaaacacagcttt

SEQ ID NO: 6346544 - DNA, 17 bp, Homo sapiens
taaaacacagtattgta

SEQ ID NO: 6346545 - DNA, 22 bp, Homo sapiens
taaaacacagtattgtagaaag

SEQ ID NO: 6346546 - DNA, 19 bp, Homo sapiens
taaaacacccttgaaaata

SEQ ID NO: 6346547 - DNA, 22 bp, Homo sapiens
taaaacacctctgctttctgat

SEQ ID NO: 6346548 - DNA, 15 bp, Homo sapiens
taaaacacctttcct

SEQ ID NO: 6346549 - DNA, 13 bp, Homo sapiens
taaaacagaaaaa

SEQ ID NO: 6346550 - DNA, 22 bp, Homo sapiens
taaaacagaaaaggttctgaat

SEQ ID NO: 6346551 - DNA, 14 bp, Homo sapiens
taaaacagaagcct

SEQ ID NO: 6346552 - DNA, 15 bp, Homo sapiens
taaaacagacaataa

SEQ ID NO: 6346553 - DNA, 13 bp, Homo sapiens
taaaacagacact

SEQ ID NO: 6346554 - DNA, 22 bp, Homo sapiens
taaaacagagaaggtcaatcta

SEQ ID NO: 6346555 - DNA, 17 bp, Homo sapiens
taaaacagagtaatctt

SEQ ID NO: 6346556 - DNA, 13 bp, Homo sapiens
taaaacagcctgg

SEQ ID NO: 6346557 - DNA, 20 bp, Homo sapiens
taaaacagctattttagtaa

SEQ ID NO: 6346558 - DNA, 21 bp, Homo sapiens
taaaacaggcaaagttttaca

SEQ ID NO: 6346559 - DNA, 14 bp, Homo sapiens
taaaacaggctgct

SEQ ID NO: 6346560 - DNA, 15 bp, Homo sapiens
taaaacaggctgctt

SEQ ID NO: 6346561 - DNA, 23 bp, Homo sapiens
taaaacagtattctgtaaagctt

SEQ ID NO: 6346562 - DNA, 13 bp, Homo sapiens
taaaacagtattt

SEQ ID NO: 6346563 - DNA, 21 bp, Homo sapiens
taaaacagtatttattttgta

SEQ ID NO: 6346564 - DNA, 22 bp, Homo sapiens
taaaacagtcatctagaattca

SEQ ID NO: 6346565 - DNA, 16 bp, Homo sapiens
taaaacagtgaaagcc

SEQ ID NO: 6346566 - DNA, 15 bp, Homo sapiens
taaaacataaacaca

SEQ ID NO: 6346567 - DNA, 15 bp, Homo sapiens
taaaacatagcaaat

SEQ ID NO: 6346568 - DNA, 14 bp, Homo sapiens
taaaacatatttca

SEQ ID NO: 6346569 - DNA, 16 bp, Homo sapiens
taaaacatatttcatt

SEQ ID NO: 6346570 - DNA, 20 bp, Homo sapiens
taaaacatatttcattttaa

SEQ ID NO: 6346571 - DNA, 19 bp, Homo sapiens
taaaacatcaattgatatt

SEQ ID NO: 6346572 - DNA, 18 bp, Homo sapiens
taaaacatcagaaactga

SEQ ID NO: 6346573 - DNA, 12 bp, Homo sapiens
taaaacatcttt

SEQ ID NO: 6346574 - DNA, 18 bp, Homo sapiens
taaaacatgactcctaca

SEQ ID NO: 6346575 - DNA, 15 bp, Homo sapiens
taaaacatgctgttt

SEQ ID NO: 6346576 - DNA, 12 bp, Homo sapiens
taaaacatgtaa

SEQ ID NO: 6346577 - DNA, 19 bp, Homo sapiens
taaaacattaaaatataat

SEQ ID NO: 6346578 - DNA, 14 bp, Homo sapiens
taaaacattaagaa

SEQ ID NO: 6346579 - DNA, 18 bp, Homo sapiens
taaaacattagaagaaaa

SEQ ID NO: 6346580 - DNA, 19 bp, Homo sapiens
taaaacattagaagaaaac

SEQ ID NO: 6346581 - DNA, 12 bp, Homo sapiens
taaaacattatg

SEQ ID NO: 6346582 - DNA, 13 bp, Homo sapiens
taaaacattcaca

SEQ ID NO: 6346583 - DNA, 15 bp, Homo sapiens
taaaacattggatta

SEQ ID NO: 6346584 - DNA, 22 bp, Homo sapiens
taaaacattggattatcctgag

SEQ ID NO: 6346585 - DNA, 14 bp, Homo sapiens
taaaacatttcatg

SEQ ID NO: 6346586 - DNA, 14 bp, Homo sapiens
taaaacatttctct

SEQ ID NO: 6346587 - DNA, 18 bp, Homo sapiens
taaaacatttgtttcccc

SEQ ID NO: 6346588 - DNA, 15 bp, Homo sapiens
taaaacattttgact

SEQ ID NO: 6346589 - DNA, 22 bp, Homo sapiens
taaaaccaaaccctatgccttt

SEQ ID NO: 6346590 - DNA, 11 bp, Homo sapiens
taaaaccaaag

SEQ ID NO: 6346591 - DNA, 18 bp, Homo sapiens
taaaaccaaagaatagtt

SEQ ID NO: 6346592 - DNA, 20 bp, Homo sapiens
taaaaccaactaaataaaaa

SEQ ID NO: 6346593 - DNA, 23 bp, Homo sapiens
taaaaccaactaaataaaaaatt

SEQ ID NO: 6346594 - DNA, 13 bp, Homo sapiens
taaaaccaagcct

SEQ ID NO: 6346595 - DNA, 11 bp, Homo sapiens
taaaaccacta

SEQ ID NO: 6346596 - DNA, 14 bp, Homo sapiens
taaaaccataaaca

SEQ ID NO: 6346597 - DNA, 21 bp, Homo sapiens
taaaaccatcagatatttctt

SEQ ID NO: 6346598 - DNA, 18 bp, Homo sapiens
taaaaccatgtagtttta

SEQ ID NO: 6346599 - DNA, 19 bp, Homo sapiens
taaaacccaatacttttgt

SEQ ID NO: 6346600 - DNA, 19 bp, Homo sapiens
taaaacccacaagtgtcta

SEQ ID NO: 6346601 - DNA, 17 bp, Homo sapiens
taaaacccagcatgtac

SEQ ID NO: 6346602 - DNA, 21 bp, Homo sapiens
taaaaccccagccaactcatt

SEQ ID NO: 6346603 - DNA, 17 bp, Homo sapiens
taaaacccgttgattac

SEQ ID NO: 6346604 - DNA, 15 bp, Homo sapiens
taaaaccctatacaa

SEQ ID NO: 6346605 - DNA, 20 bp, Homo sapiens
taaaaccctttaaatgtaaa

SEQ ID NO: 6346606 - DNA, 15 bp, Homo sapiens
taaaacctaaaatta

SEQ ID NO: 6346607 - DNA, 18 bp, Homo sapiens
taaaacctcagctagctc

SEQ ID NO: 6346608 - DNA, 17 bp, Homo sapiens
taaaacctgcttttcaa

SEQ ID NO: 6346609 - DNA, 14 bp, Homo sapiens
taaaaccttactta

SEQ ID NO: 6346610 - DNA, 18 bp, Homo sapiens
taaaaccttacttaaagc

SEQ ID NO: 6346611 - DNA, 22 bp, Homo sapiens
taaaaccttgaaggtctgtcat

SEQ ID NO: 6346612 - DNA, 19 bp, Homo sapiens
taaaaccttgttctatttt

SEQ ID NO: 6346613 - DNA, 20 bp, Homo sapiens
taaaaccttgttctattttt

SEQ ID NO: 6346614 - DNA, 10 bp, Homo sapiens
taaaaccttt

SEQ ID NO: 6346615 - DNA, 14 bp, Homo sapiens
taaaacctttcaaa

SEQ ID NO: 6346616 - DNA, 20 bp, Homo sapiens
taaaacctttcaaatttcac

SEQ ID NO: 6346617 - DNA, 18 bp, Homo sapiens
taaaaccttttttcttgc

SEQ ID NO: 6346618 - DNA, 19 bp, Homo sapiens
taaaacgaatggtctttgc

SEQ ID NO: 6346619 - DNA, 20 bp, Homo sapiens
taaaacgctgtcaaaagttg

SEQ ID NO: 6346620 - DNA, 23 bp, Homo sapiens
taaaacggtgctgtgagggaggg

SEQ ID NO: 6346621 - DNA, 18 bp, Homo sapiens
taaaacgtatagtcaata

SEQ ID NO: 6346622 - DNA, 21 bp, Homo sapiens
taaaacgtcttagagcctttt

SEQ ID NO: 6346623 - DNA, 15 bp, Homo sapiens
taaaactaaatagca

SEQ ID NO: 6346624 - DNA, 20 bp, Homo sapiens
taaaactaaatagcatgtat

SEQ ID NO: 6346625 - DNA, 18 bp, Homo sapiens
taaaactaaatgtgtaca

SEQ ID NO: 6346626 - DNA, 19 bp, Homo sapiens
taaaactaaatgtgtacac

SEQ ID NO: 6346627 - DNA, 14 bp, Homo sapiens
taaaactaagcaca

SEQ ID NO: 6346628 - DNA, 21 bp, Homo sapiens
taaaactaagctctttgagaa

SEQ ID NO: 6346629 - DNA, 18 bp, Homo sapiens
taaaactaatgagtatga

SEQ ID NO: 6346630 - DNA, 19 bp, Homo sapiens
taaaactactgcctttcaa

SEQ ID NO: 6346631 - DNA, 23 bp, Homo sapiens
taaaactagataacttaaataat

SEQ ID NO: 6346632 - DNA, 16 bp, Homo sapiens
taaaactagcaactct

SEQ ID NO: 6346633 - DNA, 21 bp, Homo sapiens
taaaactaggcatttgtaaat

SEQ ID NO: 6346634 - DNA, 19 bp, Homo sapiens
taaaactaggctcaaaata

SEQ ID NO: 6346635 - DNA, 22 bp, Homo sapiens
taaaactaggtaatgttttgta

SEQ ID NO: 6346636 - DNA, 15 bp, Homo sapiens
taaaactataacatt

SEQ ID NO: 6346637 - DNA, 22 bp, Homo sapiens
taaaactatggttcccaataaa

SEQ ID NO: 6346638 - DNA, 13 bp, Homo sapiens
taaaactatgtgt

SEQ ID NO: 6346639 - DNA, 14 bp, Homo sapiens
taaaactatttaaa

SEQ ID NO: 6346640 - DNA, 15 bp, Homo sapiens
taaaactatttaaaa

SEQ ID NO: 6346641 - DNA, 20 bp, Homo sapiens
taaaactatttattgtgctg

SEQ ID NO: 6346642 - DNA, 13 bp, Homo sapiens
taaaactatttgt

SEQ ID NO: 6346643 - DNA, 15 bp, Homo sapiens
taaaactatttgtat

SEQ ID NO: 6346644 - DNA, 16 bp, Homo sapiens
taaaactatttgtata

SEQ ID NO: 6346645 - DNA, 14 bp, Homo sapiens
taaaactcaacatt

SEQ ID NO: 6346646 - DNA, 14 bp, Homo sapiens
taaaactcacctcc

SEQ ID NO: 6346647 - DNA, 22 bp, Homo sapiens
taaaactcactcactgtttata

SEQ ID NO: 6346648 - DNA, 23 bp, Homo sapiens
taaaactcactcactgtttataa

SEQ ID NO: 6346649 - DNA, 16 bp, Homo sapiens
taaaactcactgtgat

SEQ ID NO: 6346650 - DNA, 13 bp, Homo sapiens
taaaactcagaat

SEQ ID NO: 6346651 - DNA, 21 bp, Homo sapiens
ggtttttttgtactttgtaca

SEQ ID NO: 6346652 - DNA, 16 bp, Homo sapiens
ggtttttttgtctttc

SEQ ID NO: 6346653 - DNA, 16 bp, Homo sapiens
ggttttttttttctga

SEQ ID NO: 6346654 - DNA, 19 bp, Homo sapiens
gtaaaaaaaaaaacaatta

SEQ ID NO: 6346655 - DNA, 23 bp, Homo sapiens
gtaaaaaaaaatgcctttgagac

SEQ ID NO: 6346656 - DNA, 13 bp, Homo sapiens
gtaaaaaaaccac

SEQ ID NO: 6346657 - DNA, 14 bp, Homo sapiens
gtaaaaaaagcaaa

SEQ ID NO: 6346658 - DNA, 15 bp, Homo sapiens
gtaaaaaacaaacat

SEQ ID NO: 6346659 - DNA, 11 bp, Homo sapiens
gtaaaaaatgt

SEQ ID NO: 6346660 - DNA, 23 bp, Homo sapiens
gtaaaaaatgtctcatgtcaatg

SEQ ID NO: 6346661 - DNA, 18 bp, Homo sapiens
gtaaaaaattcacataat

SEQ ID NO: 6346662 - DNA, 13 bp, Homo sapiens
gtaaaaacaaaaa

SEQ ID NO: 6346663 - DNA, 22 bp, Homo sapiens
gtaaaaaccctgctaaatgact

SEQ ID NO: 6346664 - DNA, 22 bp, Homo sapiens
gtaaaaactgaagttctgcctc

SEQ ID NO: 6346665 - DNA, 11 bp, Homo sapiens
gtaaaaagaaa

SEQ ID NO: 6346666 - DNA, 15 bp, Homo sapiens
gtaaaaagaaattgt

SEQ ID NO: 6346667 - DNA, 15 bp, Homo sapiens
gtaaaaagagaaggc

SEQ ID NO: 6346668 - DNA, 21 bp, Homo sapiens
gtaaaaagccctatgtgaaaa

SEQ ID NO: 6346669 - DNA, 21 bp, Homo sapiens
gtaaaaagcctccttgtgcaa

SEQ ID NO: 6346670 - DNA, 12 bp, Homo sapiens
gtaaaaagtggc

SEQ ID NO: 6346671 - DNA, 18 bp, Homo sapiens
gtaaaaataaactgttat

SEQ ID NO: 6346672 - DNA, 22 bp, Homo sapiens
gtaaaaatagcaaaatattatc

SEQ ID NO: 6346673 - DNA, 20 bp, Homo sapiens
gtaaaaatcctggaagacaa

SEQ ID NO: 6346674 - DNA, 13 bp, Homo sapiens
gtaaaaatgagaa

SEQ ID NO: 6346675 - DNA, 16 bp, Homo sapiens
gtaaaaatgagaacat

SEQ ID NO: 6346676 - DNA, 19 bp, Homo sapiens
gtaaaaatgagtcatttgt

SEQ ID NO: 6346677 - DNA, 15 bp, Homo sapiens
gtaaaaatgatttca

SEQ ID NO: 6346678 - DNA, 13 bp, Homo sapiens
gtaaaaatgctgc

SEQ ID NO: 6346679 - DNA, 15 bp, Homo sapiens
gtaaaaatgctgctc

SEQ ID NO: 6346680 - DNA, 18 bp, Homo sapiens
gtaaaaatgctgctctca

SEQ ID NO: 6346681 - DNA, 20 bp, Homo sapiens
gtaaaacaaaaatgtaatga

SEQ ID NO: 6346682 - DNA, 14 bp, Homo sapiens
gtaaaacaaaattt

SEQ ID NO: 6346683 - DNA, 19 bp, Homo sapiens
gtaaaacaaacaatacctg

SEQ ID NO: 6346684 - DNA, 13 bp, Homo sapiens
gtaaaacaaatga

SEQ ID NO: 6346685 - DNA, 14 bp, Homo sapiens
gtaaaacaaatgaa

SEQ ID NO: 6346686 - DNA, 16 bp, Homo sapiens
gtaaaacaaatgaaat

SEQ ID NO: 6346687 - DNA, 13 bp, Homo sapiens
gtaaaacacagag

SEQ ID NO: 6346688 - DNA, 20 bp, Homo sapiens
gtaaaacagatttgttcatt

SEQ ID NO: 6346689 - DNA, 13 bp, Homo sapiens
gtaaaaccaaagg

SEQ ID NO: 6346690 - DNA, 16 bp, Homo sapiens
gtaaaaccacagcagt

SEQ ID NO: 6346691 - DNA, 15 bp, Homo sapiens
gtaaaaccataaaca

SEQ ID NO: 6346692 - DNA, 20 bp, Homo sapiens
gtaaaacctggagatggtgg

SEQ ID NO: 6346693 - DNA, 21 bp, Homo sapiens
gtaaaactacacatccctaat

SEQ ID NO: 6346694 - DNA, 17 bp, Homo sapiens
gtaaaactcgcttttat

SEQ ID NO: 6346695 - DNA, 15 bp, Homo sapiens
gtaaaactgtgacat

SEQ ID NO: 6346696 - DNA, 11 bp, Homo sapiens
gtaaaacttct

SEQ ID NO: 6346697 - DNA, 15 bp, Homo sapiens
gtaaaacttctgctc

SEQ ID NO: 6346698 - DNA, 16 bp, Homo sapiens
gtaaaacttctgctcg

SEQ ID NO: 6346699 - DNA, 14 bp, Homo sapiens
gtaaaagaaatgta

SEQ ID NO: 6346700 - DNA, 18 bp, Homo sapiens
gtaaaagaacagtaaaca

SEQ ID NO: 6346701 - DNA, 18 bp, Homo sapiens
gtaaaagagataataaga

SEQ ID NO: 6346702 - DNA, 16 bp, Homo sapiens
gtaaaagagccaagtt

SEQ ID NO: 6346703 - DNA, 18 bp, Homo sapiens
gtaaaagcaaaaaagaaa

SEQ ID NO: 6346704 - DNA, 19 bp, Homo sapiens
gtaaaagcaaaaaagaaaa

SEQ ID NO: 6346705 - DNA, 17 bp, Homo sapiens
gtaaaaggattattact

SEQ ID NO: 6346706 - DNA, 12 bp, Homo sapiens
gtaaaagtctac

SEQ ID NO: 6346707 - DNA, 12 bp, Homo sapiens
gtaaaagtgaca

SEQ ID NO: 6346708 - DNA, 15 bp, Homo sapiens
gtaaaagttaagatc

SEQ ID NO: 6346709 - DNA, 16 bp, Homo sapiens
gtaaaagttttatagt

SEQ ID NO: 6346710 - DNA, 12 bp, Homo sapiens
gtaaaataaaaa

SEQ ID NO: 6346711 - DNA, 13 bp, Homo sapiens
gtaaaataaaaaa

SEQ ID NO: 6346712 - DNA, 14 bp, Homo sapiens
gtaaaataaaatgc

SEQ ID NO: 6346713 - DNA, 14 bp, Homo sapiens
gtaaaataaaatta

SEQ ID NO: 6346714 - DNA, 12 bp, Homo sapiens
gtaaaataagaa

SEQ ID NO: 6346715 - DNA, 17 bp, Homo sapiens
gtaaaataaggttatga

SEQ ID NO: 6346716 - DNA, 17 bp, Homo sapiens
gtaaaatacatgtacct

SEQ ID NO: 6346717 - DNA, 17 bp, Homo sapiens
gtaaaatactattgcct

SEQ ID NO: 6346718 - DNA, 21 bp, Homo sapiens
gtaaaataggcaccattgctt

SEQ ID NO: 6346719 - DNA, 22 bp, Homo sapiens
gtaaaatagtggatctcagttt

SEQ ID NO: 6346720 - DNA, 18 bp, Homo sapiens
gtaaaatatagctgtaca

SEQ ID NO: 6346721 - DNA, 12 bp, Homo sapiens
gtaaaatatgta

SEQ ID NO: 6346722 - DNA, 16 bp, Homo sapiens
gtaaaatatgtaaaac

SEQ ID NO: 6346723 - DNA, 12 bp, Homo sapiens
gtaaaatatgtc

SEQ ID NO: 6346724 - DNA, 15 bp, Homo sapiens
gtaaaatattttgaa

SEQ ID NO: 6346725 - DNA, 14 bp, Homo sapiens
gtaaaatcacagat

SEQ ID NO: 6346726 - DNA, 21 bp, Homo sapiens
gtaaaatctgacataaaaaca

SEQ ID NO: 6346727 - DNA, 21 bp, Homo sapiens
gtaaaatcttcagctggtgga

SEQ ID NO: 6346728 - DNA, 20 bp, Homo sapiens
gtaaaatcttgtcatgtgta

SEQ ID NO: 6346729 - DNA, 21 bp, Homo sapiens
gtaaaatcttgtcatgtgtat

SEQ ID NO: 6346730 - DNA, 15 bp, Homo sapiens
gtaaaatgaattgaa

SEQ ID NO: 6346731 - DNA, 17 bp, Homo sapiens
gtaaaatgaattgaaaa

SEQ ID NO: 6346732 - DNA, 16 bp, Homo sapiens
gtaaaatgacaatcat

SEQ ID NO: 6346733 - DNA, 21 bp, Homo sapiens
gtaaaatgaggccggacagag

SEQ ID NO: 6346734 - DNA, 18 bp, Homo sapiens
gtaaaatgagtgatctca

SEQ ID NO: 6346735 - DNA, 19 bp, Homo sapiens
gtaaaatgcagtccagaat

SEQ ID NO: 6346736 - DNA, 22 bp, Homo sapiens
gtaaaatgctggtgaaatgctg

SEQ ID NO: 6346737 - DNA, 23 bp, Homo sapiens
gtaaaatgctggtgaaatgctgt

SEQ ID NO: 6346738 - DNA, 20 bp, Homo sapiens
gtaaaatggaaaacttagtt

SEQ ID NO: 6346739 - DNA, 17 bp, Homo sapiens
gtaaaatggcagtttga

SEQ ID NO: 6346740 - DNA, 19 bp, Homo sapiens
gtaaaatgtgaagtgaatg

SEQ ID NO: 6346741 - DNA, 16 bp, Homo sapiens
gtaaaatgttgaataa

SEQ ID NO: 6346742 - DNA, 11 bp, Homo sapiens
gtaaaatgttt

SEQ ID NO: 6346743 - DNA, 16 bp, Homo sapiens
gtaaaatgtttgctgt

SEQ ID NO: 6346744 - DNA, 9 bp, Homo sapiens
gtaaaatta

SEQ ID NO: 6346745 - DNA, 11 bp, Homo sapiens
gtaaaattaat

SEQ ID NO: 6346746 - DNA, 15 bp, Homo sapiens
gtaaaattacagaag

SEQ ID NO: 6346747 - DNA, 17 bp, Homo sapiens
gtaaaattataaacttt

SEQ ID NO: 6346748 - DNA, 17 bp, Homo sapiens
gtaaaattatctgttct

SEQ ID NO: 6346749 - DNA, 18 bp, Homo sapiens
gtaaaattatctgttcta

SEQ ID NO: 6346750 - DNA, 22 bp, Homo sapiens
gtaaaattatctgttctatgga

SEQ ID NO: 6346751 - DNA, 20 bp, Homo sapiens
gtaaaattattccctgaatt

SEQ ID NO: 6346752 - DNA, 12 bp, Homo sapiens
gtaaaattctaa

SEQ ID NO: 6346753 - DNA, 14 bp, Homo sapiens
gtaaaattctaaat

SEQ ID NO: 6346754 - DNA, 12 bp, Homo sapiens
gtaaaattgcat

SEQ ID NO: 6346755 - DNA, 19 bp, Homo sapiens
gtaaaattgccatattgca

SEQ ID NO: 6346756 - DNA, 20 bp, Homo sapiens
gtaaaattgccatattgcac

SEQ ID NO: 6346757 - DNA, 21 bp, Homo sapiens
gtaaaattgccatattgcaca

SEQ ID NO: 6346758 - DNA, 16 bp, Homo sapiens
gtaaaattgttcctga

SEQ ID NO: 6346759 - DNA, 12 bp, Homo sapiens
gtaaaatttatt

SEQ ID NO: 6346760 - DNA, 19 bp, Homo sapiens
gtaaacaaaccacagcagg

SEQ ID NO: 6346761 - DNA, 14 bp, Homo sapiens
gtaaacaaactctt

SEQ ID NO: 6346762 - DNA, 20 bp, Homo sapiens
gtaaacaaactgtgtaactg

SEQ ID NO: 6346763 - DNA, 15 bp, Homo sapiens
gtaaacaaagacttt

SEQ ID NO: 6346764 - DNA, 13 bp, Homo sapiens
gtaaacacataaa

SEQ ID NO: 6346765 - DNA, 18 bp, Homo sapiens
gtaaacacataaatgaaa

SEQ ID NO: 6346766 - DNA, 21 bp, Homo sapiens
gtaaacacataaatgaaagaa

SEQ ID NO: 6346767 - DNA, 22 bp, Homo sapiens
gtaaacacataaatgaaagaaa

SEQ ID NO: 6346768 - DNA, 15 bp, Homo sapiens
gtaaacactcagctg

SEQ ID NO: 6346769 - DNA, 20 bp, Homo sapiens
gtaaacactccacattcttc

SEQ ID NO: 6346770 - DNA, 14 bp, Homo sapiens
gtaaacagaataaa

SEQ ID NO: 6346771 - DNA, 20 bp, Homo sapiens
gtaaacagaataaaagttcc

SEQ ID NO: 6346772 - DNA, 20 bp, Homo sapiens
gtaaacaggtatttttttaa

SEQ ID NO: 6346773 - DNA, 23 bp, Homo sapiens
gtaaacaggtatttttttaaatc

SEQ ID NO: 6346774 - DNA, 20 bp, Homo sapiens
gtaaacagtgcctgctgaat

SEQ ID NO: 6346775 - DNA, 22 bp, Homo sapiens
gtaaacagtgcctgctgaatga

SEQ ID NO: 6346776 - DNA, 13 bp, Homo sapiens
gtaaacagttctg

SEQ ID NO: 6346777 - DNA, 15 bp, Homo sapiens
gtaaacataaaaact

SEQ ID NO: 6346778 - DNA, 20 bp, Homo sapiens
gtaaacataaaaactgattt

SEQ ID NO: 6346779 - DNA, 23 bp, Homo sapiens
gtaaacataattcttgtatatta

SEQ ID NO: 6346780 - DNA, 17 bp, Homo sapiens
gtaaacataggtataat

SEQ ID NO: 6346781 - DNA, 22 bp, Homo sapiens
gtaaacatgtgttttaattcca

SEQ ID NO: 6346782 - DNA, 21 bp, Homo sapiens
gtaaacattagttctatttct

SEQ ID NO: 6346783 - DNA, 18 bp, Homo sapiens
gtaaacatttgtaaaaat

SEQ ID NO: 6346784 - DNA, 23 bp, Homo sapiens
gtaaacatttgtaaaaatactgt

SEQ ID NO: 6346785 - DNA, 22 bp, Homo sapiens
gtaaaccaaaccctataaacct

SEQ ID NO: 6346786 - DNA, 24 bp, Homo sapiens
gtaaaccacataatttttgtacat

SEQ ID NO: 6346787 - DNA, 13 bp, Homo sapiens
gtaaaccactgaa

SEQ ID NO: 6346788 - DNA, 14 bp, Homo sapiens
gtaaaccactgaaa

SEQ ID NO: 6346789 - DNA, 15 bp, Homo sapiens
gtaaaccagaaaaaa

SEQ ID NO: 6346790 - DNA, 22 bp, Homo sapiens
gtaaaccagaaaaaataaatgt

SEQ ID NO: 6346791 - DNA, 21 bp, Homo sapiens
gtaaaccgctttggcctgagt

SEQ ID NO: 6346792 - DNA, 17 bp, Homo sapiens
gtaaacctgaacaaacc

SEQ ID NO: 6346793 - DNA, 13 bp, Homo sapiens
gtaaacctggagg

SEQ ID NO: 6346794 - DNA, 17 bp, Homo sapiens
gtaaacgaaggcataat

SEQ ID NO: 6346795 - DNA, 17 bp, Homo sapiens
gtaaacggcccaggcca

SEQ ID NO: 6346796 - DNA, 18 bp, Homo sapiens
gtaaacggcccaggccag

SEQ ID NO: 6346797 - DNA, 16 bp, Homo sapiens
gtaaacgtttcagtaa

SEQ ID NO: 6346798 - DNA, 18 bp, Homo sapiens
gtaaactacggtaccagt

SEQ ID NO: 6346799 - DNA, 14 bp, Homo sapiens
gtaaactattctta

SEQ ID NO: 6346800 - DNA, 19 bp, Homo sapiens
gtaaactcatctgaaatgt

SEQ ID NO: 6346801 - DNA, 21 bp, Homo sapiens
gtaaactcttcaccttggttt

SEQ ID NO: 6346802 - DNA, 19 bp, Homo sapiens
gtaaactgatgtttgtgat

SEQ ID NO: 6346803 - DNA, 17 bp, Homo sapiens
gtaaactggaattaaaa

SEQ ID NO: 6346804 - DNA, 13 bp, Homo sapiens
gtaaactgtttct

SEQ ID NO: 6346805 - DNA, 13 bp, Homo sapiens
gtaaacttctgaa

SEQ ID NO: 6346806 - DNA, 12 bp, Homo sapiens
gtaaacttgaaa

SEQ ID NO: 6346807 - DNA, 15 bp, Homo sapiens
gtaaacttgtgtatt

SEQ ID NO: 6346808 - DNA, 19 bp, Homo sapiens
gtaaactttatcacttaaa

SEQ ID NO: 6346809 - DNA, 22 bp, Homo sapiens
gtaaactttgcttctccaaata

SEQ ID NO: 6346810 - DNA, 17 bp, Homo sapiens
gtaaactttttcaatgg

SEQ ID NO: 6346811 - DNA, 14 bp, Homo sapiens
gtaaagaaaaatat

SEQ ID NO: 6346812 - DNA, 21 bp, Homo sapiens
gtaaagaaaaatatttaatgt

SEQ ID NO: 6346813 - DNA, 17 bp, Homo sapiens
gtaaagaaagagagaaa

SEQ ID NO: 6346814 - DNA, 20 bp, Homo sapiens
gtaaagaaagagagaaaata

SEQ ID NO: 6346815 - DNA, 22 bp, Homo sapiens
gtaaagaaatacacagggaggg

SEQ ID NO: 6346816 - DNA, 13 bp, Homo sapiens
gtaaagaaatgtc

SEQ ID NO: 6346817 - DNA, 19 bp, Homo sapiens
gtaaagaaatttactatat

SEQ ID NO: 6346818 - DNA, 20 bp, Homo sapiens
gtaaagaacttaaattatgt

SEQ ID NO: 6346819 - DNA, 14 bp, Homo sapiens
gtaaagaataaatg

SEQ ID NO: 6346820 - DNA, 18 bp, Homo sapiens
gtaaagaataaatgaatc

SEQ ID NO: 6346821 - DNA, 14 bp, Homo sapiens
gtaaagaattattt

SEQ ID NO: 6346822 - DNA, 12 bp, Homo sapiens
gtaaagaattta

SEQ ID NO: 6346823 - DNA, 14 bp, Homo sapiens
gtaaagacaaataa

SEQ ID NO: 6346824 - DNA, 17 bp, Homo sapiens
gtaaagacagagtgaat

SEQ ID NO: 6346825 - DNA, 14 bp, Homo sapiens
gtaaagactggctt

SEQ ID NO: 6346826 - DNA, 15 bp, Homo sapiens
gtaaagactggcttt

SEQ ID NO: 6346827 - DNA, 14 bp, Homo sapiens
gtaaagactggttt

SEQ ID NO: 6346828 - DNA, 16 bp, Homo sapiens
gtaaagactgtagaag

SEQ ID NO: 6346829 - DNA, 15 bp, Homo sapiens
gtaaagagaaacttt

SEQ ID NO: 6346830 - DNA, 19 bp, Homo sapiens
gtaaagagaaactttgtgc

SEQ ID NO: 6346831 - DNA, 20 bp, Homo sapiens
gtaaagagaaactttgtgct

SEQ ID NO: 6346832 - DNA, 19 bp, Homo sapiens
taaaactcagaatataaca

SEQ ID NO: 6346833 - DNA, 18 bp, Homo sapiens
taaaactcagttaaaatg

SEQ ID NO: 6346834 - DNA, 15 bp, Homo sapiens
taaaactcatcacat

SEQ ID NO: 6346835 - DNA, 22 bp, Homo sapiens
taaaactcatcacataaagaaa

SEQ ID NO: 6346836 - DNA, 17 bp, Homo sapiens
taaaactcccttcctta

SEQ ID NO: 6346837 - DNA, 18 bp, Homo sapiens
taaaactcccttccttat

SEQ ID NO: 6346838 - DNA, 22 bp, Homo sapiens
taaaactctcagttgtttatta

SEQ ID NO: 6346839 - DNA, 13 bp, Homo sapiens
taaaactgaaata

SEQ ID NO: 6346840 - DNA, 22 bp, Homo sapiens
taaaactgaaataaacctgcac

SEQ ID NO: 6346841 - DNA, 17 bp, Homo sapiens
taaaactgaagtctgaa

SEQ ID NO: 6346842 - DNA, 20 bp, Homo sapiens
taaaactgaagtctgaaatt

SEQ ID NO: 6346843 - DNA, 15 bp, Homo sapiens
taaaactgcattttt

SEQ ID NO: 6346844 - DNA, 19 bp, Homo sapiens
taaaactgcatttttaatc

SEQ ID NO: 6346845 - DNA, 22 bp, Homo sapiens
taaaactgcatttttaatcagt

SEQ ID NO: 6346846 - DNA, 21 bp, Homo sapiens
taaaactgcctgacaattatg

SEQ ID NO: 6346847 - DNA, 22 bp, Homo sapiens
taaaactgcgaggacatcaaag

SEQ ID NO: 6346848 - DNA, 23 bp, Homo sapiens
taaaactgcgaggacatcaaagt

SEQ ID NO: 6346849 - DNA, 23 bp, Homo sapiens
taaaactgctcatttcatgaagc

SEQ ID NO: 6346850 - DNA, 12 bp, Homo sapiens
taaaactgcttt

SEQ ID NO: 6346851 - DNA, 16 bp, Homo sapiens
taaaactgctttgtat

SEQ ID NO: 6346852 - DNA, 21 bp, Homo sapiens
taaaactgcttttttttttcc

SEQ ID NO: 6346853 - DNA, 18 bp, Homo sapiens
taaaactggacctgtata

SEQ ID NO: 6346854 - DNA, 17 bp, Homo sapiens
taaaactggatggaaat

SEQ ID NO: 6346855 - DNA, 16 bp, Homo sapiens
taaaactggcctgact

SEQ ID NO: 6346856 - DNA, 23 bp, Homo sapiens
taaaactgggattaagaaacctt

SEQ ID NO: 6346857 - DNA, 22 bp, Homo sapiens
taaaactggtgggtctttaata

SEQ ID NO: 6346858 - DNA, 16 bp, Homo sapiens
taaaactgtactttga

SEQ ID NO: 6346859 - DNA, 20 bp, Homo sapiens
taaaactgtactttgattca

SEQ ID NO: 6346860 - DNA, 14 bp, Homo sapiens
taaaactgtattta

SEQ ID NO: 6346861 - DNA, 18 bp, Homo sapiens
taaaactgtatttaagga

SEQ ID NO: 6346862 - DNA, 13 bp, Homo sapiens
taaaactgtccct

SEQ ID NO: 6346863 - DNA, 11 bp, Homo sapiens
taaaactgtga

SEQ ID NO: 6346864 - DNA, 14 bp, Homo sapiens
taaaactgtgacat

SEQ ID NO: 6346865 - DNA, 16 bp, Homo sapiens
taaaactgtgacattc

SEQ ID NO: 6346866 - DNA, 20 bp, Homo sapiens
taaaactgtgacattccaca

SEQ ID NO: 6346867 - DNA, 20 bp, Homo sapiens
taaaactgtgactaggcata

SEQ ID NO: 6346868 - DNA, 17 bp, Homo sapiens
taaaactgttatttttt

SEQ ID NO: 6346869 - DNA, 16 bp, Homo sapiens
taaaacttaagatatt

SEQ ID NO: 6346870 - DNA, 20 bp, Homo sapiens
taaaacttcttaaatatctt

SEQ ID NO: 6346871 - DNA, 22 bp, Homo sapiens
taaaacttgatgtgttatctct

SEQ ID NO: 6346872 - DNA, 13 bp, Homo sapiens
taaaacttgctgc

SEQ ID NO: 6346873 - DNA, 17 bp, Homo sapiens
taaaacttggatggact

SEQ ID NO: 6346874 - DNA, 12 bp, Homo sapiens
taaaactttaaa

SEQ ID NO: 6346875 - DNA, 18 bp, Homo sapiens
taaaactttatgtactgc

SEQ ID NO: 6346876 - DNA, 17 bp, Homo sapiens
taaaactttattaaaag

SEQ ID NO: 6346877 - DNA, 13 bp, Homo sapiens
taaaactttcctc

SEQ ID NO: 6346878 - DNA, 14 bp, Homo sapiens
taaaactttgaagt

SEQ ID NO: 6346879 - DNA, 15 bp, Homo sapiens
taaaactttgaagtt

SEQ ID NO: 6346880 - DNA, 14 bp, Homo sapiens
taaaactttgctgc

SEQ ID NO: 6346881 - DNA, 16 bp, Homo sapiens
taaaactttgtagaca

SEQ ID NO: 6346882 - DNA, 22 bp, Homo sapiens
taaaactttgtagacattttga

SEQ ID NO: 6346883 - DNA, 12 bp, Homo sapiens
taaaagaaaaag

SEQ ID NO: 6346884 - DNA, 17 bp, Homo sapiens
taaaagaaaatctatta

SEQ ID NO: 6346885 - DNA, 20 bp, Homo sapiens
taaaagaaaatgtaaaaaac

SEQ ID NO: 6346886 - DNA, 15 bp, Homo sapiens
taaaagaaaccactt

SEQ ID NO: 6346887 - DNA, 23 bp, Homo sapiens
taaaagaaagggttctgtaaaat

SEQ ID NO: 6346888 - DNA, 14 bp, Homo sapiens
taaaagaaatatat

SEQ ID NO: 6346889 - DNA, 18 bp, Homo sapiens
taaaagaaatatattttt

SEQ ID NO: 6346890 - DNA, 17 bp, Homo sapiens
taaaagaaatgcacaat

SEQ ID NO: 6346891 - DNA, 14 bp, Homo sapiens
taaaagaaatgtat

SEQ ID NO: 6346892 - DNA, 15 bp, Homo sapiens
taaaagaaatttatt

SEQ ID NO: 6346893 - DNA, 17 bp, Homo sapiens
taaaagaacagtaaaca

SEQ ID NO: 6346894 - DNA, 15 bp, Homo sapiens
taaaagaacatgctt

SEQ ID NO: 6346895 - DNA, 17 bp, Homo sapiens
taaaagaagaaactatt

SEQ ID NO: 6346896 - DNA, 18 bp, Homo sapiens
taaaagaagaaactattt

SEQ ID NO: 6346897 - DNA, 13 bp, Homo sapiens
taaaagaagagag

SEQ ID NO: 6346898 - DNA, 17 bp, Homo sapiens
taaaagaatattcagag

SEQ ID NO: 6346899 - DNA, 16 bp, Homo sapiens
taaaagaatattttaa

SEQ ID NO: 6346900 - DNA, 15 bp, Homo sapiens
taaaagaatcatttg

SEQ ID NO: 6346901 - DNA, 21 bp, Homo sapiens
taaaagaatgggcagttacat

SEQ ID NO: 6346902 - DNA, 16 bp, Homo sapiens
taaaagaatgtacaga

SEQ ID NO: 6346903 - DNA, 18 bp, Homo sapiens
taaaagaatgtacagaaa

SEQ ID NO: 6346904 - DNA, 13 bp, Homo sapiens
taaaagaattttt

SEQ ID NO: 6346905 - DNA, 20 bp, Homo sapiens
taaaagaatttttttgtctt

SEQ ID NO: 6346906 - DNA, 12 bp, Homo sapiens
taaaagacaaat

SEQ ID NO: 6346907 - DNA, 17 bp, Homo sapiens
taaaagacaaatatgta

SEQ ID NO: 6346908 - DNA, 20 bp, Homo sapiens
taaaagacaaatcaaagcag

SEQ ID NO: 6346909 - DNA, 23 bp, Homo sapiens
taaaagacactgtttacaagaaa

SEQ ID NO: 6346910 - DNA, 12 bp, Homo sapiens
taaaagacagtg

SEQ ID NO: 6346911 - DNA, 20 bp, Homo sapiens
taaaagacagtgaaagaaaa

SEQ ID NO: 6346912 - DNA, 20 bp, Homo sapiens
taaaagacatttgatagaaa

SEQ ID NO: 6346913 - DNA, 13 bp, Homo sapiens
taaaagactcatc

SEQ ID NO: 6346914 - DNA, 20 bp, Homo sapiens
taaaagactgcagctgctga

SEQ ID NO: 6346915 - DNA, 21 bp, Homo sapiens
taaaagacttccctaacactt

SEQ ID NO: 6346916 - DNA, 12 bp, Homo sapiens
taaaagactttg

SEQ ID NO: 6346917 - DNA, 19 bp, Homo sapiens
taaaagagacaaactgtaa

SEQ ID NO: 6346918 - DNA, 23 bp, Homo sapiens
taaaagagaccacccatatcatg

SEQ ID NO: 6346919 - DNA, 14 bp, Homo sapiens
taaaagagataata

SEQ ID NO: 6346920 - DNA, 16 bp, Homo sapiens
taaaagagatttcaag

SEQ ID NO: 6346921 - DNA, 17 bp, Homo sapiens
taaaagagatttcaaga

SEQ ID NO: 6346922 - DNA, 16 bp, Homo sapiens
taaaagagctgtctga

SEQ ID NO: 6346923 - DNA, 17 bp, Homo sapiens
taaaagagctgtctgac

SEQ ID NO: 6346924 - DNA, 19 bp, Homo sapiens
taaaagagctgtctgactg

SEQ ID NO: 6346925 - DNA, 17 bp, Homo sapiens
taaaagagctgttcttt

SEQ ID NO: 6346926 - DNA, 23 bp, Homo sapiens
taaaagagctgttctttttgact

SEQ ID NO: 6346927 - DNA, 11 bp, Homo sapiens
taaaagagctt

SEQ ID NO: 6346928 - DNA, 18 bp, Homo sapiens
taaaagaggaaattaaat

SEQ ID NO: 6346929 - DNA, 19 bp, Homo sapiens
taaaagaggaaattaaata

SEQ ID NO: 6346930 - DNA, 22 bp, Homo sapiens
taaaagaggaaattaaataatt

SEQ ID NO: 6346931 - DNA, 19 bp, Homo sapiens
taaaagaggtttttcttaa

SEQ ID NO: 6346932 - DNA, 14 bp, Homo sapiens
taaaagagtagaat

SEQ ID NO: 6346933 - DNA, 17 bp, Homo sapiens
taaaagataaatattat

SEQ ID NO: 6346934 - DNA, 14 bp, Homo sapiens
taaaagataaatta

SEQ ID NO: 6346935 - DNA, 20 bp, Homo sapiens
taaaagataaatttgttgaa

SEQ ID NO: 6346936 - DNA, 21 bp, Homo sapiens
taaaagataaatttgttgaat

SEQ ID NO: 6346937 - DNA, 19 bp, Homo sapiens
taaaagataacctttcttt

SEQ ID NO: 6346938 - DNA, 13 bp, Homo sapiens
taaaagatagcaa

SEQ ID NO: 6346939 - DNA, 13 bp, Homo sapiens
taaaagatataag

SEQ ID NO: 6346940 - DNA, 11 bp, Homo sapiens
taaaagatatg

SEQ ID NO: 6346941 - DNA, 17 bp, Homo sapiens
taaaagatcaccttgta

SEQ ID NO: 6346942 - DNA, 13 bp, Homo sapiens
taaaagatcgcag

SEQ ID NO: 6346943 - DNA, 19 bp, Homo sapiens
taaaagatcttcaaaagta

SEQ ID NO: 6346944 - DNA, 23 bp, Homo sapiens
taaaagatcttcaaaagtaatgc

SEQ ID NO: 6346945 - DNA, 16 bp, Homo sapiens
taaaagatgcaatgta

SEQ ID NO: 6346946 - DNA, 23 bp, Homo sapiens
taaaagatgcagagtaagtatta

SEQ ID NO: 6346947 - DNA, 12 bp, Homo sapiens
taaaagatgctt

SEQ ID NO: 6346948 - DNA, 20 bp, Homo sapiens
taaaagatggggtctgtaaa

SEQ ID NO: 6346949 - DNA, 22 bp, Homo sapiens
taaaagatggggtctgtaaaat

SEQ ID NO: 6346950 - DNA, 19 bp, Homo sapiens
taaaagatggttgtagcat

SEQ ID NO: 6346951 - DNA, 13 bp, Homo sapiens
taaaagattcacc

SEQ ID NO: 6346952 - DNA, 14 bp, Homo sapiens
taaaagattcattt

SEQ ID NO: 6346953 - DNA, 14 bp, Homo sapiens
taaaagattcttta

SEQ ID NO: 6346954 - DNA, 19 bp, Homo sapiens
taaaagattctttaaacta

SEQ ID NO: 6346955 - DNA, 11 bp, Homo sapiens
taaaagatttt

SEQ ID NO: 6346956 - DNA, 12 bp, Homo sapiens
taaaagcaaaaa

SEQ ID NO: 6346957 - DNA, 18 bp, Homo sapiens
taaaagcaaaaaagaaaa

SEQ ID NO: 6346958 - DNA, 23 bp, Homo sapiens
taaaagcaaatactgattttcaa

SEQ ID NO: 6346959 - DNA, 14 bp, Homo sapiens
taaaagcaaatcat

SEQ ID NO: 6346960 - DNA, 19 bp, Homo sapiens
taaaagcaacatcagcttg

SEQ ID NO: 6346961 - DNA, 14 bp, Homo sapiens
taaaagcacaatca

SEQ ID NO: 6346962 - DNA, 11 bp, Homo sapiens
taaaagcagca

SEQ ID NO: 6346963 - DNA, 20 bp, Homo sapiens
taaaagcagcatctgctaat

SEQ ID NO: 6346964 - DNA, 15 bp, Homo sapiens
taaaagcagggcagc

SEQ ID NO: 6346965 - DNA, 16 bp, Homo sapiens
taaaagcagggcagca

SEQ ID NO: 6346966 - DNA, 13 bp, Homo sapiens
taaaagcatgaaa

SEQ ID NO: 6346967 - DNA, 15 bp, Homo sapiens
taaaagcatgaaaca

SEQ ID NO: 6346968 - DNA, 17 bp, Homo sapiens
taaaagcatgaaacatt

SEQ ID NO: 6346969 - DNA, 11 bp, Homo sapiens
taaaagcattg

SEQ ID NO: 6346970 - DNA, 12 bp, Homo sapiens
taaaagcattgt

SEQ ID NO: 6346971 - DNA, 21 bp, Homo sapiens
taaaagcattttaatactaag

SEQ ID NO: 6346972 - DNA, 16 bp, Homo sapiens
taaaagcattttgtaa

SEQ ID NO: 6346973 - DNA, 19 bp, Homo sapiens
taaaagcatttttattata

SEQ ID NO: 6346974 - DNA, 15 bp, Homo sapiens
taaaagccatcatgt

SEQ ID NO: 6346975 - DNA, 16 bp, Homo sapiens
taaaagcccaggagcc

SEQ ID NO: 6346976 - DNA, 19 bp, Homo sapiens
taaaagcccaggagcccat

SEQ ID NO: 6346977 - DNA, 14 bp, Homo sapiens
taaaagccccagct

SEQ ID NO: 6346978 - DNA, 14 bp, Homo sapiens
taaaagcctgctca

SEQ ID NO: 6346979 - DNA, 12 bp, Homo sapiens
taaaagccttcc

SEQ ID NO: 6346980 - DNA, 12 bp, Homo sapiens
taaaagccttgg

SEQ ID NO: 6346981 - DNA, 20 bp, Homo sapiens
taaaagctagatactggaaa

SEQ ID NO: 6346982 - DNA, 15 bp, Homo sapiens
taaaagctattactt

SEQ ID NO: 6346983 - DNA, 21 bp, Homo sapiens
taaaagctattacttggcaaa

SEQ ID NO: 6346984 - DNA, 17 bp, Homo sapiens
taaaagctcagatgaca

SEQ ID NO: 6346985 - DNA, 18 bp, Homo sapiens
taaaagctcagatgacat

SEQ ID NO: 6346986 - DNA, 17 bp, Homo sapiens
taaaagctttagattga

SEQ ID NO: 6346987 - DNA, 18 bp, Homo sapiens
taaaagctttagattgaa

SEQ ID NO: 6346988 - DNA, 21 bp, Homo sapiens
taaaagctttagattgaaatt

SEQ ID NO: 6346989 - DNA, 15 bp, Homo sapiens
taaaaggaaaaaaga

SEQ ID NO: 6346990 - DNA, 14 bp, Homo sapiens
taaaaggaaaaata

SEQ ID NO: 6346991 - DNA, 13 bp, Homo sapiens
taaaaggaaaacc

SEQ ID NO: 6346992 - DNA, 12 bp, Homo sapiens
taaaaggaaaag

SEQ ID NO: 6346993 - DNA, 15 bp, Homo sapiens
taaaaggaaagaaaa

SEQ ID NO: 6346994 - DNA, 21 bp, Homo sapiens
taaaaggaaagaaaacatctt

SEQ ID NO: 6346995 - DNA, 16 bp, Homo sapiens
taaaaggactctggaa

SEQ ID NO: 6346996 - DNA, 22 bp, Homo sapiens
taaaaggactctggaagatttt

SEQ ID NO: 6346997 - DNA, 19 bp, Homo sapiens
taaaaggagagaagaaagt

SEQ ID NO: 6346998 - DNA, 12 bp, Homo sapiens
taaaaggagcca

SEQ ID NO: 6346999 - DNA, 15 bp, Homo sapiens
taaaaggaggacagg

SEQ ID NO: 6347000 - DNA, 20 bp, Homo sapiens
taaaaggaggacagggaggg

SEQ ID NO: 6347001 - DNA, 14 bp, Homo sapiens
taaaaggatggcaa

SEQ ID NO: 6347002 - DNA, 20 bp, Homo sapiens
taaaaggatgttacaagttt

SEQ ID NO: 6347003 - DNA, 15 bp, Homo sapiens
taaaaggcaactcaa

SEQ ID NO: 6347004 - DNA, 21 bp, Homo sapiens
taaaaggcaactcaaagatga

SEQ ID NO: 6347005 - DNA, 18 bp, Homo sapiens
taaaaggccaaacctctg

SEQ ID NO: 6347006 - DNA, 20 bp, Homo sapiens
taaaaggccaaacctctgtt

SEQ ID NO: 6347007 - DNA, 12 bp, Homo sapiens
taaaaggcccag

SEQ ID NO: 6347008 - DNA, 22 bp, Homo sapiens
taaaaggcccatagcagccagt

SEQ ID NO: 6347009 - DNA, 14 bp, Homo sapiens
taaaaggccctgtg

SEQ ID NO: 6347010 - DNA, 17 bp, Homo sapiens
taaaaggccctgtggtc

SEQ ID NO: 6347011 - DNA, 23 bp, Homo sapiens
taaaaggcttccaggctgagagc

SEQ ID NO: 6347012 - DNA, 14 bp, Homo sapiens
gtaaagagacctac

SEQ ID NO: 6347013 - DNA, 16 bp, Homo sapiens
gtaaagagatgtcaaa

SEQ ID NO: 6347014 - DNA, 20 bp, Homo sapiens
gtaaagagatgtcaaaatgt

SEQ ID NO: 6347015 - DNA, 20 bp, Homo sapiens
gtaaagaggtcaggggaatg

SEQ ID NO: 6347016 - DNA, 17 bp, Homo sapiens
gtaaagagtacactcag

SEQ ID NO: 6347017 - DNA, 11 bp, Homo sapiens
gtaaagagtgg

SEQ ID NO: 6347018 - DNA, 18 bp, Homo sapiens
gtaaagagtggagcaaat

SEQ ID NO: 6347019 - DNA, 17 bp, Homo sapiens
gtaaagataaaaggata

SEQ ID NO: 6347020 - DNA, 21 bp, Homo sapiens
gtaaagataaaaggataggaa

SEQ ID NO: 6347021 - DNA, 15 bp, Homo sapiens
gtaaagatattgtat

SEQ ID NO: 6347022 - DNA, 16 bp, Homo sapiens
gtaaagatattgtatc

SEQ ID NO: 6347023 - DNA, 18 bp, Homo sapiens
gtaaagatctacatgaat

SEQ ID NO: 6347024 - DNA, 21 bp, Homo sapiens
gtaaagatgtttatttcaggc

SEQ ID NO: 6347025 - DNA, 13 bp, Homo sapiens
gtaaagattgttt

SEQ ID NO: 6347026 - DNA, 14 bp, Homo sapiens
gtaaagatttctgt

SEQ ID NO: 6347027 - DNA, 16 bp, Homo sapiens
gtaaagatttctgttc

SEQ ID NO: 6347028 - DNA, 20 bp, Homo sapiens
gtaaagccatgttaaatgac

SEQ ID NO: 6347029 - DNA, 20 bp, Homo sapiens
gtaaagccctcagatcccag

SEQ ID NO: 6347030 - DNA, 21 bp, Homo sapiens
gtaaagccctcagatcccagg

SEQ ID NO: 6347031 - DNA, 22 bp, Homo sapiens
gtaaagccctcagatcccaggg

SEQ ID NO: 6347032 - DNA, 15 bp, Homo sapiens
gtaaagctaaaataa

SEQ ID NO: 6347033 - DNA, 15 bp, Homo sapiens
gtaaagctagaaatg

SEQ ID NO: 6347034 - DNA, 16 bp, Homo sapiens
gtaaagctggccctgc

SEQ ID NO: 6347035 - DNA, 20 bp, Homo sapiens
gtaaaggaaataagagcagt

SEQ ID NO: 6347036 - DNA, 15 bp, Homo sapiens
gtaaaggagaaatga

SEQ ID NO: 6347037 - DNA, 12 bp, Homo sapiens
gtaaaggaggaa

SEQ ID NO: 6347038 - DNA, 15 bp, Homo sapiens
gtaaaggcattccac

SEQ ID NO: 6347039 - DNA, 19 bp, Homo sapiens
gtaaaggcattccacagga

SEQ ID NO: 6347040 - DNA, 18 bp, Homo sapiens
gtaaaggcctcctccccc

SEQ ID NO: 6347041 - DNA, 19 bp, Homo sapiens
gtaaaggcctcctccccca

SEQ ID NO: 6347042 - DNA, 23 bp, Homo sapiens
gtaaaggtacgattatacttgag

SEQ ID NO: 6347043 - DNA, 17 bp, Homo sapiens
gtaaaggtcaacaataa

SEQ ID NO: 6347044 - DNA, 22 bp, Homo sapiens
gtaaaggtgatgaatttaccat

SEQ ID NO: 6347045 - DNA, 16 bp, Homo sapiens
gtaaagtaatgcattt

SEQ ID NO: 6347046 - DNA, 21 bp, Homo sapiens
gtaaagtaatgcatttgagca

SEQ ID NO: 6347047 - DNA, 14 bp, Homo sapiens
gtaaagtacttgta

SEQ ID NO: 6347048 - DNA, 22 bp, Homo sapiens
gtaaagtatcaggatactatat

SEQ ID NO: 6347049 - DNA, 17 bp, Homo sapiens
gtaaagtatgtattatt

SEQ ID NO: 6347050 - DNA, 19 bp, Homo sapiens
gtaaagtgaagaatccttt

SEQ ID NO: 6347051 - DNA, 19 bp, Homo sapiens
gtaaagtgaagaatttatc

SEQ ID NO: 6347052 - DNA, 14 bp, Homo sapiens
gtaaagtgcaatgg

SEQ ID NO: 6347053 - DNA, 21 bp, Homo sapiens
gtaaagtggttctctgccttt

SEQ ID NO: 6347054 - DNA, 20 bp, Homo sapiens
gtaaagtgtaacatatgcaa

SEQ ID NO: 6347055 - DNA, 14 bp, Homo sapiens
gtaaagtgtcagaa

SEQ ID NO: 6347056 - DNA, 22 bp, Homo sapiens
gtaaagtgtggtcccaacagga

SEQ ID NO: 6347057 - DNA, 17 bp, Homo sapiens
gtaaagttacactttta

SEQ ID NO: 6347058 - DNA, 17 bp, Homo sapiens
gtaaagttatgtattta

SEQ ID NO: 6347059 - DNA, 15 bp, Homo sapiens
gtaaagttgagggga

SEQ ID NO: 6347060 - DNA, 18 bp, Homo sapiens
gtaaagttggttggataa

SEQ ID NO: 6347061 - DNA, 20 bp, Homo sapiens
gtaaagtttcccctctattt

SEQ ID NO: 6347062 - DNA, 21 bp, Homo sapiens
gtaaagtttccgtgcgtggca

SEQ ID NO: 6347063 - DNA, 15 bp, Homo sapiens
gtaaagtttgctcta

SEQ ID NO: 6347064 - DNA, 19 bp, Homo sapiens
gtaaagtttgttgaaaaca

SEQ ID NO: 6347065 - DNA, 13 bp, Homo sapiens
gtaaataaaaaga

SEQ ID NO: 6347066 - DNA, 14 bp, Homo sapiens
gtaaataaaaagaa

SEQ ID NO: 6347067 - DNA, 14 bp, Homo sapiens
gtaaataaaaatag

SEQ ID NO: 6347068 - DNA, 17 bp, Homo sapiens
gtaaataaaagtacaaa

SEQ ID NO: 6347069 - DNA, 17 bp, Homo sapiens
gtaaataaaatgtgtac

SEQ ID NO: 6347070 - DNA, 18 bp, Homo sapiens
gtaaataaaatgtgtaca

SEQ ID NO: 6347071 - DNA, 23 bp, Homo sapiens
gtaaataaaatgtgtacagtgaa

SEQ ID NO: 6347072 - DNA, 14 bp, Homo sapiens
gtaaataaaccact

SEQ ID NO: 6347073 - DNA, 17 bp, Homo sapiens
gtaaataaactatttat

SEQ ID NO: 6347074 - DNA, 23 bp, Homo sapiens
gtaaataaactcttcaaggccaa

SEQ ID NO: 6347075 - DNA, 12 bp, Homo sapiens
gtaaataaactg

SEQ ID NO: 6347076 - DNA, 16 bp, Homo sapiens
gtaaataaactttcag

SEQ ID NO: 6347077 - DNA, 11 bp, Homo sapiens
gtaaataaagc

SEQ ID NO: 6347078 - DNA, 15 bp, Homo sapiens
gtaaataaagccctg

SEQ ID NO: 6347079 - DNA, 18 bp, Homo sapiens
gtaaataaatgctgcttt

SEQ ID NO: 6347080 - DNA, 12 bp, Homo sapiens
gtaaataaattt

SEQ ID NO: 6347081 - DNA, 20 bp, Homo sapiens
gtaaataaccccattctttg

SEQ ID NO: 6347082 - DNA, 21 bp, Homo sapiens
gtaaataactggaaaacagaa

SEQ ID NO: 6347083 - DNA, 12 bp, Homo sapiens
gtaaataactgt

SEQ ID NO: 6347084 - DNA, 11 bp, Homo sapiens
gtaaataagag

SEQ ID NO: 6347085 - DNA, 16 bp, Homo sapiens
gtaaataagagatttg

SEQ ID NO: 6347086 - DNA, 15 bp, Homo sapiens
gtaaataataaataa

SEQ ID NO: 6347087 - DNA, 23 bp, Homo sapiens
gtaaataatgattcaatgtgaat

SEQ ID NO: 6347088 - DNA, 14 bp, Homo sapiens
gtaaataattcttt

SEQ ID NO: 6347089 - DNA, 15 bp, Homo sapiens
gtaaataattctttt

SEQ ID NO: 6347090 - DNA, 14 bp, Homo sapiens
gtaaataatttatt

SEQ ID NO: 6347091 - DNA, 17 bp, Homo sapiens
gtaaataatttgcactg

SEQ ID NO: 6347092 - DNA, 13 bp, Homo sapiens
gtaaatacaaaat

SEQ ID NO: 6347093 - DNA, 18 bp, Homo sapiens
gtaaatacaacacatcta

SEQ ID NO: 6347094 - DNA, 12 bp, Homo sapiens
gtaaatacacca

SEQ ID NO: 6347095 - DNA, 18 bp, Homo sapiens
gtaaatacactgtgaaga

SEQ ID NO: 6347096 - DNA, 14 bp, Homo sapiens
gtaaatacaggtag

SEQ ID NO: 6347097 - DNA, 16 bp, Homo sapiens
gtaaatacatcactgt

SEQ ID NO: 6347098 - DNA, 20 bp, Homo sapiens
gtaaatacatcctttttctg

SEQ ID NO: 6347099 - DNA, 22 bp, Homo sapiens
gtaaatacatcctttttctgct

SEQ ID NO: 6347100 - DNA, 17 bp, Homo sapiens
gtaaatacatgcatata

SEQ ID NO: 6347101 - DNA, 14 bp, Homo sapiens
gtaaatacatgtgt

SEQ ID NO: 6347102 - DNA, 16 bp, Homo sapiens
gtaaatacatgtgtgg

SEQ ID NO: 6347103 - DNA, 17 bp, Homo sapiens
gtaaatacatgtgtgga

SEQ ID NO: 6347104 - DNA, 16 bp, Homo sapiens
gtaaatacccatatgt

SEQ ID NO: 6347105 - DNA, 18 bp, Homo sapiens
gtaaatactcatgaatga

SEQ ID NO: 6347106 - DNA, 14 bp, Homo sapiens
gtaaatactggact

SEQ ID NO: 6347107 - DNA, 18 bp, Homo sapiens
gtaaatactggactcagg

SEQ ID NO: 6347108 - DNA, 19 bp, Homo sapiens
gtaaatactggtaccttcc

SEQ ID NO: 6347109 - DNA, 23 bp, Homo sapiens
gtaaatagaagagtttaaaagca

SEQ ID NO: 6347110 - DNA, 17 bp, Homo sapiens
gtaaatagagtgcataa

SEQ ID NO: 6347111 - DNA, 20 bp, Homo sapiens
gtaaatagagtgcataaata

SEQ ID NO: 6347112 - DNA, 21 bp, Homo sapiens
gtaaatagagtgcataaataa

SEQ ID NO: 6347113 - DNA, 18 bp, Homo sapiens
gtaaatagcaacatgctt

SEQ ID NO: 6347114 - DNA, 22 bp, Homo sapiens
gtaaatagcttttcatcaattc

SEQ ID NO: 6347115 - DNA, 20 bp, Homo sapiens
gtaaataggatttttagaat

SEQ ID NO: 6347116 - DNA, 22 bp, Homo sapiens
gtaaataggtattatattttgg

SEQ ID NO: 6347117 - DNA, 17 bp, Homo sapiens
gtaaataggttcttctt

SEQ ID NO: 6347118 - DNA, 13 bp, Homo sapiens
gtaaataggtttc

SEQ ID NO: 6347119 - DNA, 15 bp, Homo sapiens
gtaaatagtatttga

SEQ ID NO: 6347120 - DNA, 22 bp, Homo sapiens
gtaaatagtttgaattcagtaa

SEQ ID NO: 6347121 - DNA, 21 bp, Homo sapiens
gtaaatagttttaaatatgaa

SEQ ID NO: 6347122 - DNA, 12 bp, Homo sapiens
gtaaatataaag

SEQ ID NO: 6347123 - DNA, 14 bp, Homo sapiens
gtaaatataaagac

SEQ ID NO: 6347124 - DNA, 15 bp, Homo sapiens
gtaaatataaagacg

SEQ ID NO: 6347125 - DNA, 21 bp, Homo sapiens
gtaaatatatatgtcaatatt

SEQ ID NO: 6347126 - DNA, 18 bp, Homo sapiens
gtaaatatatgttttgag

SEQ ID NO: 6347127 - DNA, 17 bp, Homo sapiens
gtaaatatgaagagttt

SEQ ID NO: 6347128 - DNA, 15 bp, Homo sapiens
gtaaatatgaatctg

SEQ ID NO: 6347129 - DNA, 16 bp, Homo sapiens
gtaaatatgaatctgc

SEQ ID NO: 6347130 - DNA, 19 bp, Homo sapiens
gtaaatatggggatagtct

SEQ ID NO: 6347131 - DNA, 23 bp, Homo sapiens
gtaaatatgtacatttctcaggc

SEQ ID NO: 6347132 - DNA, 16 bp, Homo sapiens
gtaaatatgtttcacc

SEQ ID NO: 6347133 - DNA, 19 bp, Homo sapiens
gtaaatatgtttgtgcctt

SEQ ID NO: 6347134 - DNA, 16 bp, Homo sapiens
gtaaatattaaagctc

SEQ ID NO: 6347135 - DNA, 19 bp, Homo sapiens
gtaaatattatgattttat

SEQ ID NO: 6347136 - DNA, 15 bp, Homo sapiens
gtaaatattcatatt

SEQ ID NO: 6347137 - DNA, 16 bp, Homo sapiens
gtaaatattcatatta

SEQ ID NO: 6347138 - DNA, 21 bp, Homo sapiens
gtaaatattctacacatgtaa

SEQ ID NO: 6347139 - DNA, 12 bp, Homo sapiens
gtaaatatttat

SEQ ID NO: 6347140 - DNA, 15 bp, Homo sapiens
gtaaatatttcataa

SEQ ID NO: 6347141 - DNA, 14 bp, Homo sapiens
gtaaatattttaaa

SEQ ID NO: 6347142 - DNA, 19 bp, Homo sapiens
gtaaatattttgatacaaa

SEQ ID NO: 6347143 - DNA, 15 bp, Homo sapiens
gtaaatatttttccc

SEQ ID NO: 6347144 - DNA, 17 bp, Homo sapiens
gtaaatatttttccctc

SEQ ID NO: 6347145 - DNA, 16 bp, Homo sapiens
gtaaatcaaatttgaa

SEQ ID NO: 6347146 - DNA, 13 bp, Homo sapiens
gtaaatcacttgt

SEQ ID NO: 6347147 - DNA, 16 bp, Homo sapiens
gtaaatcacttgtaaa

SEQ ID NO: 6347148 - DNA, 20 bp, Homo sapiens
gtaaatcacttgtaaataaa

SEQ ID NO: 6347149 - DNA, 21 bp, Homo sapiens
gtaaatcacttgtaaataaat

SEQ ID NO: 6347150 - DNA, 18 bp, Homo sapiens
gtaaatcagaaagtaaca

SEQ ID NO: 6347151 - DNA, 22 bp, Homo sapiens
gtaaatcagatgttgaattctt

SEQ ID NO: 6347152 - DNA, 14 bp, Homo sapiens
gtaaatcagtaaga

SEQ ID NO: 6347153 - DNA, 19 bp, Homo sapiens
gtaaatcatatttccctta

SEQ ID NO: 6347154 - DNA, 18 bp, Homo sapiens
gtaaatcccattattcaa

SEQ ID NO: 6347155 - DNA, 20 bp, Homo sapiens
gtaaatcccattattcaaag

SEQ ID NO: 6347156 - DNA, 21 bp, Homo sapiens
gtaaatcccattattcaaagt

SEQ ID NO: 6347157 - DNA, 13 bp, Homo sapiens
gtaaatcctgtgt

SEQ ID NO: 6347158 - DNA, 17 bp, Homo sapiens
gtaaatcgggaaggatg

SEQ ID NO: 6347159 - DNA, 20 bp, Homo sapiens
gtaaatcgggaaggatggga

SEQ ID NO: 6347160 - DNA, 22 bp, Homo sapiens
gtaaatctaactacaaggacaa

SEQ ID NO: 6347161 - DNA, 15 bp, Homo sapiens
gtaaatctagagttt

SEQ ID NO: 6347162 - DNA, 22 bp, Homo sapiens
gtaaatctagagtttatacagt

SEQ ID NO: 6347163 - DNA, 19 bp, Homo sapiens
gtaaatctatctctatata

SEQ ID NO: 6347164 - DNA, 12 bp, Homo sapiens
gtaaatctgaaa

SEQ ID NO: 6347165 - DNA, 21 bp, Homo sapiens
gtaaatctgaagaaagttatt

SEQ ID NO: 6347166 - DNA, 17 bp, Homo sapiens
gtaaatctgtacttttt

SEQ ID NO: 6347167 - DNA, 23 bp, Homo sapiens
gtaaatctttgtgaacattctgt

SEQ ID NO: 6347168 - DNA, 19 bp, Homo sapiens
gtaaatctttttgcttcta

SEQ ID NO: 6347169 - DNA, 13 bp, Homo sapiens
gtaaatgaaactt

SEQ ID NO: 6347170 - DNA, 14 bp, Homo sapiens
gtaaatgaacataa

SEQ ID NO: 6347171 - DNA, 17 bp, Homo sapiens
gtaaatgaacataatga

SEQ ID NO: 6347172 - DNA, 17 bp, Homo sapiens
gtaaatgaactgatttt

SEQ ID NO: 6347173 - DNA, 20 bp, Homo sapiens
gtaaatgaagatctttatat

SEQ ID NO: 6347174 - DNA, 21 bp, Homo sapiens
gtaaatgaagatctttatatt

SEQ ID NO: 6347175 - DNA, 23 bp, Homo sapiens
gtaaatgaagggtcatttctctt

SEQ ID NO: 6347176 - DNA, 16 bp, Homo sapiens
gtaaatgaccaagaaa

SEQ ID NO: 6347177 - DNA, 20 bp, Homo sapiens
gtaaatgactttcataataa

SEQ ID NO: 6347178 - DNA, 16 bp, Homo sapiens
gtaaatgagacacata

SEQ ID NO: 6347179 - DNA, 15 bp, Homo sapiens
gtaaatgatatgtct

SEQ ID NO: 6347180 - DNA, 23 bp, Homo sapiens
gtaaatgcagccttcttttcaaa

SEQ ID NO: 6347181 - DNA, 17 bp, Homo sapiens
gtaaatgcagcgtgaag

SEQ ID NO: 6347182 - DNA, 24 bp, Homo sapiens
gtaaatgcatctgtcctcatgtgt

SEQ ID NO: 6347183 - DNA, 11 bp, Homo sapiens
gtaaatgccac

SEQ ID NO: 6347184 - DNA, 15 bp, Homo sapiens
gtaaatgctattata

SEQ ID NO: 6347185 - DNA, 19 bp, Homo sapiens
gtaaatgctcattttcttt

SEQ ID NO: 6347186 - DNA, 22 bp, Homo sapiens
gtaaatgctcattttctttagg

SEQ ID NO: 6347187 - DNA, 10 bp, Homo sapiens
gtaaatgctg

SEQ ID NO: 6347188 - DNA, 19 bp, Homo sapiens
gtaaatgctgtaaatattt

SEQ ID NO: 6347189 - DNA, 17 bp, Homo sapiens
gtaaatgcttaaatttc

SEQ ID NO: 6347190 - DNA, 18 bp, Homo sapiens
gtaaatggttaaatttta

SEQ ID NO: 6347191 - DNA, 18 bp, Homo sapiens
taaaaggcttgaagctgt

SEQ ID NO: 6347192 - DNA, 19 bp, Homo sapiens
taaaagggatacacaggac

SEQ ID NO: 6347193 - DNA, 19 bp, Homo sapiens
taaaagggattacccaagc

SEQ ID NO: 6347194 - DNA, 20 bp, Homo sapiens
taaaagggattacccaagca

SEQ ID NO: 6347195 - DNA, 23 bp, Homo sapiens
taaaagggggctattccctggag

SEQ ID NO: 6347196 - DNA, 17 bp, Homo sapiens
taaaagggtcaaacctg

SEQ ID NO: 6347197 - DNA, 15 bp, Homo sapiens
taaaagggtggtagt

SEQ ID NO: 6347198 - DNA, 20 bp, Homo sapiens
taaaaggtagagtcttacaa

SEQ ID NO: 6347199 - DNA, 13 bp, Homo sapiens
taaaaggtattga

SEQ ID NO: 6347200 - DNA, 19 bp, Homo sapiens
taaaaggtgacccttctgt

SEQ ID NO: 6347201 - DNA, 15 bp, Homo sapiens
taaaaggtgagctca

SEQ ID NO: 6347202 - DNA, 17 bp, Homo sapiens
taaaaggtgagctcagc

SEQ ID NO: 6347203 - DNA, 21 bp, Homo sapiens
taaaaggtggagtttctctgt

SEQ ID NO: 6347204 - DNA, 13 bp, Homo sapiens
taaaaggttgcca

SEQ ID NO: 6347205 - DNA, 12 bp, Homo sapiens
taaaagtaaaca

SEQ ID NO: 6347206 - DNA, 13 bp, Homo sapiens
taaaagtaaacat

SEQ ID NO: 6347207 - DNA, 14 bp, Homo sapiens
taaaagtaaacatt

SEQ ID NO: 6347208 - DNA, 16 bp, Homo sapiens
taaaagtaaagactat

SEQ ID NO: 6347209 - DNA, 19 bp, Homo sapiens
taaaagtaagttttaagga

SEQ ID NO: 6347210 - DNA, 18 bp, Homo sapiens
taaaagtaataaagagaa

SEQ ID NO: 6347211 - DNA, 14 bp, Homo sapiens
taaaagtaattaat

SEQ ID NO: 6347212 - DNA, 21 bp, Homo sapiens
taaaagtactgaagacccgtt

SEQ ID NO: 6347213 - DNA, 14 bp, Homo sapiens
taaaagtagtaaat

SEQ ID NO: 6347214 - DNA, 15 bp, Homo sapiens
taaaagtataatttt

SEQ ID NO: 6347215 - DNA, 22 bp, Homo sapiens
taaaagtatctttaacaattgt

SEQ ID NO: 6347216 - DNA, 15 bp, Homo sapiens
taaaagtatgaatct

SEQ ID NO: 6347217 - DNA, 11 bp, Homo sapiens
taaaagtatta

SEQ ID NO: 6347218 - DNA, 20 bp, Homo sapiens
taaaagtcagcattttctta

SEQ ID NO: 6347219 - DNA, 15 bp, Homo sapiens
taaaagtcataaatg

SEQ ID NO: 6347220 - DNA, 18 bp, Homo sapiens
taaaagtcattattcctg

SEQ ID NO: 6347221 - DNA, 16 bp, Homo sapiens
taaaagtcattcaaga

SEQ ID NO: 6347222 - DNA, 20 bp, Homo sapiens
taaaagtcccagttaagtga

SEQ ID NO: 6347223 - DNA, 20 bp, Homo sapiens
taaaagtctattttattatg

SEQ ID NO: 6347224 - DNA, 13 bp, Homo sapiens
taaaagtcttgtg

SEQ ID NO: 6347225 - DNA, 21 bp, Homo sapiens
taaaagtgaagtgaatctgat

SEQ ID NO: 6347226 - DNA, 18 bp, Homo sapiens
taaaagtgaatgaaagat

SEQ ID NO: 6347227 - DNA, 13 bp, Homo sapiens
taaaagtgatcaa

SEQ ID NO: 6347228 - DNA, 15 bp, Homo sapiens
taaaagtgatcaata

SEQ ID NO: 6347229 - DNA, 15 bp, Homo sapiens
taaaagtgatgtgat

SEQ ID NO: 6347230 - DNA, 13 bp, Homo sapiens
taaaagtgcattt

SEQ ID NO: 6347231 - DNA, 14 bp, Homo sapiens
taaaagtgcattta

SEQ ID NO: 6347232 - DNA, 16 bp, Homo sapiens
taaaagtgcatttaag

SEQ ID NO: 6347233 - DNA, 21 bp, Homo sapiens
taaaagtgcatttaaggagat

SEQ ID NO: 6347234 - DNA, 12 bp, Homo sapiens
taaaagtgctgc

SEQ ID NO: 6347235 - DNA, 22 bp, Homo sapiens
taaaagtgggcttgattctgca

SEQ ID NO: 6347236 - DNA, 19 bp, Homo sapiens
taaaagtggtctctgctgg

SEQ ID NO: 6347237 - DNA, 14 bp, Homo sapiens
taaaagtgtacaga

SEQ ID NO: 6347238 - DNA, 18 bp, Homo sapiens
taaaagtgtcactaagaa

SEQ ID NO: 6347239 - DNA, 21 bp, Homo sapiens
taaaagtgtcactaagaatat

SEQ ID NO: 6347240 - DNA, 18 bp, Homo sapiens
taaaagtgtccattgaaa

SEQ ID NO: 6347241 - DNA, 22 bp, Homo sapiens
taaaagttaaactacttgtaaa

SEQ ID NO: 6347242 - DNA, 22 bp, Homo sapiens
taaaagttaagtgtcatttctt

SEQ ID NO: 6347243 - DNA, 13 bp, Homo sapiens
taaaagttactaa

SEQ ID NO: 6347244 - DNA, 17 bp, Homo sapiens
taaaagttactaatata

SEQ ID NO: 6347245 - DNA, 23 bp, Homo sapiens
taaaagttactaatatatctgta

SEQ ID NO: 6347246 - DNA, 16 bp, Homo sapiens
taaaagttagcattgt

SEQ ID NO: 6347247 - DNA, 15 bp, Homo sapiens
taaaagttatatcta

SEQ ID NO: 6347248 - DNA, 14 bp, Homo sapiens
taaaagttcctctc

SEQ ID NO: 6347249 - DNA, 23 bp, Homo sapiens
taaaagttcctctcccttccctt

SEQ ID NO: 6347250 - DNA, 20 bp, Homo sapiens
taaaagttctcaaatattgg

SEQ ID NO: 6347251 - DNA, 18 bp, Homo sapiens
taaaagttgaaaagccaa

SEQ ID NO: 6347252 - DNA, 20 bp, Homo sapiens
taaaagttgaccaatgaaat

SEQ ID NO: 6347253 - DNA, 17 bp, Homo sapiens
taaaagttgtactgcat

SEQ ID NO: 6347254 - DNA, 14 bp, Homo sapiens
taaaagttgtgatt

SEQ ID NO: 6347255 - DNA, 21 bp, Homo sapiens
taaaagttgtgattccagata

SEQ ID NO: 6347256 - DNA, 19 bp, Homo sapiens
taaaagtttaaagaagagt

SEQ ID NO: 6347257 - DNA, 16 bp, Homo sapiens
taaaagtttagaactt

SEQ ID NO: 6347258 - DNA, 14 bp, Homo sapiens
taaaagtttgcatg

SEQ ID NO: 6347259 - DNA, 17 bp, Homo sapiens
taaaagtttgtccttta

SEQ ID NO: 6347260 - DNA, 18 bp, Homo sapiens
taaaagtttgtcctttaa

SEQ ID NO: 6347261 - DNA, 17 bp, Homo sapiens
taaaagttttaacctca

SEQ ID NO: 6347262 - DNA, 22 bp, Homo sapiens
taaaagttttctaatttgcact

SEQ ID NO: 6347263 - DNA, 19 bp, Homo sapiens
taaaagttttgaaggaaac

SEQ ID NO: 6347264 - DNA, 12 bp, Homo sapiens
taaaataaaaaa

SEQ ID NO: 6347265 - DNA, 15 bp, Homo sapiens
taaaataaaaaccag

SEQ ID NO: 6347266 - DNA, 16 bp, Homo sapiens
taaaataaaaaccaga

SEQ ID NO: 6347267 - DNA, 13 bp, Homo sapiens
taaaataaaaata

SEQ ID NO: 6347268 - DNA, 18 bp, Homo sapiens
taaaataaaacaagcctt

SEQ ID NO: 6347269 - DNA, 13 bp, Homo sapiens
taaaataaaagta

SEQ ID NO: 6347270 - DNA, 22 bp, Homo sapiens
taaaataaaagtacctattgaa

SEQ ID NO: 6347271 - DNA, 15 bp, Homo sapiens
taaaataaaatgaaa

SEQ ID NO: 6347272 - DNA, 21 bp, Homo sapiens
taaaataaaatgaaaattgta

SEQ ID NO: 6347273 - DNA, 14 bp, Homo sapiens
taaaataaacagtt

SEQ ID NO: 6347274 - DNA, 16 bp, Homo sapiens
taaaataaacagttgt

SEQ ID NO: 6347275 - DNA, 18 bp, Homo sapiens
taaaataaaccaaatatg

SEQ ID NO: 6347276 - DNA, 18 bp, Homo sapiens
taaaataaacgaaacatt

SEQ ID NO: 6347277 - DNA, 14 bp, Homo sapiens
taaaataaactaga

SEQ ID NO: 6347278 - DNA, 13 bp, Homo sapiens
taaaataaactgt

SEQ ID NO: 6347279 - DNA, 14 bp, Homo sapiens
taaaataaactgta

SEQ ID NO: 6347280 - DNA, 15 bp, Homo sapiens
taaaataaactttct

SEQ ID NO: 6347281 - DNA, 13 bp, Homo sapiens
taaaataaagcct

SEQ ID NO: 6347282 - DNA, 18 bp, Homo sapiens
taaaataaaggctctgtg

SEQ ID NO: 6347283 - DNA, 13 bp, Homo sapiens
taaaataaagtat

SEQ ID NO: 6347284 - DNA, 17 bp, Homo sapiens
taaaataaagtatatat

SEQ ID NO: 6347285 - DNA, 14 bp, Homo sapiens
taaaataaataatc

SEQ ID NO: 6347286 - DNA, 12 bp, Homo sapiens
taaaataaatat

SEQ ID NO: 6347287 - DNA, 17 bp, Homo sapiens
taaaataaatatactaa

SEQ ID NO: 6347288 - DNA, 19 bp, Homo sapiens
taaaataaatatactaata

SEQ ID NO: 6347289 - DNA, 14 bp, Homo sapiens
taaaataaatattg

SEQ ID NO: 6347290 - DNA, 17 bp, Homo sapiens
taaaataaatgaagtga

SEQ ID NO: 6347291 - DNA, 19 bp, Homo sapiens
taaaataacagatttctca

SEQ ID NO: 6347292 - DNA, 21 bp, Homo sapiens
taaaataacatattttttctt

SEQ ID NO: 6347293 - DNA, 24 bp, Homo sapiens
taaaataactagtgttgcttggac

SEQ ID NO: 6347294 - DNA, 20 bp, Homo sapiens
taaaataactatcaggcaga

SEQ ID NO: 6347295 - DNA, 17 bp, Homo sapiens
taaaataacttgcatct

SEQ ID NO: 6347296 - DNA, 15 bp, Homo sapiens
taaaataagaagggg

SEQ ID NO: 6347297 - DNA, 19 bp, Homo sapiens
taaaataaggataataatc

SEQ ID NO: 6347298 - DNA, 14 bp, Homo sapiens
taaaataagtaaca

SEQ ID NO: 6347299 - DNA, 18 bp, Homo sapiens
taaaataagtaacatata

SEQ ID NO: 6347300 - DNA, 14 bp, Homo sapiens
taaaataagtctga

SEQ ID NO: 6347301 - DNA, 15 bp, Homo sapiens
taaaataagtctgat

SEQ ID NO: 6347302 - DNA, 17 bp, Homo sapiens
taaaataagtctgattt

SEQ ID NO: 6347303 - DNA, 19 bp, Homo sapiens
taaaataagtctgatttaa

SEQ ID NO: 6347304 - DNA, 23 bp, Homo sapiens
taaaataagtggattttgtattt

SEQ ID NO: 6347305 - DNA, 14 bp, Homo sapiens
taaaataatgattt

SEQ ID NO: 6347306 - DNA, 15 bp, Homo sapiens
taaaataatgattta

SEQ ID NO: 6347307 - DNA, 22 bp, Homo sapiens
taaaataatgatttaagcattt

SEQ ID NO: 6347308 - DNA, 16 bp, Homo sapiens
taaaataatgctttga

SEQ ID NO: 6347309 - DNA, 22 bp, Homo sapiens
taaaataatgtactgaattctt

SEQ ID NO: 6347310 - DNA, 16 bp, Homo sapiens
taaaataattatatga

SEQ ID NO: 6347311 - DNA, 20 bp, Homo sapiens
taaaataattatatgaagca

SEQ ID NO: 6347312 - DNA, 21 bp, Homo sapiens
taaaataattcatatctaaat

SEQ ID NO: 6347313 - DNA, 22 bp, Homo sapiens
taaaataattcatatctaaata

SEQ ID NO: 6347314 - DNA, 15 bp, Homo sapiens
taaaataattctaaa

SEQ ID NO: 6347315 - DNA, 15 bp, Homo sapiens
taaaataattctcaa

SEQ ID NO: 6347316 - DNA, 16 bp, Homo sapiens
taaaataattctgagt

SEQ ID NO: 6347317 - DNA, 18 bp, Homo sapiens
taaaataatttctctaca

SEQ ID NO: 6347318 - DNA, 22 bp, Homo sapiens
taaaataattttatctctttct

SEQ ID NO: 6347319 - DNA, 18 bp, Homo sapiens
taaaatacaagactgcca

SEQ ID NO: 6347320 - DNA, 18 bp, Homo sapiens
taaaatacacgtgtatat

SEQ ID NO: 6347321 - DNA, 23 bp, Homo sapiens
taaaatacacgtgtatatgagga

SEQ ID NO: 6347322 - DNA, 14 bp, Homo sapiens
taaaatacatacta

SEQ ID NO: 6347323 - DNA, 20 bp, Homo sapiens
taaaatacatggtatctctt

SEQ ID NO: 6347324 - DNA, 20 bp, Homo sapiens
taaaatacctctaataaaca

SEQ ID NO: 6347325 - DNA, 22 bp, Homo sapiens
taaaatacctctaataaacact

SEQ ID NO: 6347326 - DNA, 21 bp, Homo sapiens
taaaatacgatcggtttcata

SEQ ID NO: 6347327 - DNA, 22 bp, Homo sapiens
taaaatacgatcggtttcatat

SEQ ID NO: 6347328 - DNA, 18 bp, Homo sapiens
taaaatacggtacctggc

SEQ ID NO: 6347329 - DNA, 17 bp, Homo sapiens
taaaatactatattaaa

SEQ ID NO: 6347330 - DNA, 20 bp, Homo sapiens
taaaatactgtagataatta

SEQ ID NO: 6347331 - DNA, 16 bp, Homo sapiens
taaaatacttattatg

SEQ ID NO: 6347332 - DNA, 22 bp, Homo sapiens
taaaatacttctttttacaatg

SEQ ID NO: 6347333 - DNA, 17 bp, Homo sapiens
taaaatacttgtttcag

SEQ ID NO: 6347334 - DNA, 18 bp, Homo sapiens
taaaatactttttatcac

SEQ ID NO: 6347335 - DNA, 17 bp, Homo sapiens
taaaatagaaataagtg

SEQ ID NO: 6347336 - DNA, 22 bp, Homo sapiens
taaaatagaaatatagccaaaa

SEQ ID NO: 6347337 - DNA, 14 bp, Homo sapiens
taaaatagaataat

SEQ ID NO: 6347338 - DNA, 16 bp, Homo sapiens
taaaatagaataattc

SEQ ID NO: 6347339 - DNA, 16 bp, Homo sapiens
taaaatagacactata

SEQ ID NO: 6347340 - DNA, 20 bp, Homo sapiens
taaaatagataaataaatat

SEQ ID NO: 6347341 - DNA, 18 bp, Homo sapiens
taaaatagatataaattt

SEQ ID NO: 6347342 - DNA, 18 bp, Homo sapiens
taaaatagcacatgattt

SEQ ID NO: 6347343 - DNA, 18 bp, Homo sapiens
taaaatagcatactgtgt

SEQ ID NO: 6347344 - DNA, 23 bp, Homo sapiens
taaaatagcatactgtgtatgtt

SEQ ID NO: 6347345 - DNA, 19 bp, Homo sapiens
taaaatagcgttcttgtaa

SEQ ID NO: 6347346 - DNA, 21 bp, Homo sapiens
taaaatagcgttcttgtaatt

SEQ ID NO: 6347347 - DNA, 14 bp, Homo sapiens
taaaatagcttgta

SEQ ID NO: 6347348 - DNA, 18 bp, Homo sapiens
taaaataggtgcattgtc

SEQ ID NO: 6347349 - DNA, 20 bp, Homo sapiens
taaaataggtgcattgtcct

SEQ ID NO: 6347350 - DNA, 13 bp, Homo sapiens
taaaatagttaca

SEQ ID NO: 6347351 - DNA, 16 bp, Homo sapiens
taaaatagtttaaaaa

SEQ ID NO: 6347352 - DNA, 18 bp, Homo sapiens
taaaatataatttttaat

SEQ ID NO: 6347353 - DNA, 15 bp, Homo sapiens
taaaatatacaaaca

SEQ ID NO: 6347354 - DNA, 16 bp, Homo sapiens
taaaatatacaaacat

SEQ ID NO: 6347355 - DNA, 19 bp, Homo sapiens
taaaatatagtgttgtgtt

SEQ ID NO: 6347356 - DNA, 15 bp, Homo sapiens
taaaatatatataaa

SEQ ID NO: 6347357 - DNA, 17 bp, Homo sapiens
taaaatatatataaata

SEQ ID NO: 6347358 - DNA, 16 bp, Homo sapiens
taaaatatatctggaa

SEQ ID NO: 6347359 - DNA, 20 bp, Homo sapiens
taaaatatatgtatttaaaa

SEQ ID NO: 6347360 - DNA, 16 bp, Homo sapiens
taaaatatatgttctg

SEQ ID NO: 6347361 - DNA, 22 bp, Homo sapiens
taaaatatatgttctgcaagaa

SEQ ID NO: 6347362 - DNA, 16 bp, Homo sapiens
taaaatatatttatga

SEQ ID NO: 6347363 - DNA, 17 bp, Homo sapiens
taaaatatatttcagat

SEQ ID NO: 6347364 - DNA, 18 bp, Homo sapiens
taaaatatcataaagcat

SEQ ID NO: 6347365 - DNA, 17 bp, Homo sapiens
taaaatatcattcagca

SEQ ID NO: 6347366 - DNA, 18 bp, Homo sapiens
taaaatatcattcagcaa

SEQ ID NO: 6347367 - DNA, 12 bp, Homo sapiens
taaaatatctat

SEQ ID NO: 6347368 - DNA, 14 bp, Homo sapiens
taaaatatctattt

SEQ ID NO: 6347369 - DNA, 14 bp, Homo sapiens
taaaatatctccaa

SEQ ID NO: 6347370 - DNA, 23 bp, Homo sapiens
gtaaatggttaaattttacatga

SEQ ID NO: 6347371 - DNA, 15 bp, Homo sapiens
gtaaatggttttcaa

SEQ ID NO: 6347372 - DNA, 12 bp, Homo sapiens
gtaaatgtactg

SEQ ID NO: 6347373 - DNA, 12 bp, Homo sapiens
gtaaatgtattt

SEQ ID NO: 6347374 - DNA, 17 bp, Homo sapiens
gtaaatgtctcactgag

SEQ ID NO: 6347375 - DNA, 19 bp, Homo sapiens
gtaaatgtctcactgagca

SEQ ID NO: 6347376 - DNA, 18 bp, Homo sapiens
gtaaatgtctgcactgag

SEQ ID NO: 6347377 - DNA, 22 bp, Homo sapiens
gtaaatgtctgtggccttgttc

SEQ ID NO: 6347378 - DNA, 20 bp, Homo sapiens
gtaaatgtcttcatgttgat

SEQ ID NO: 6347379 - DNA, 13 bp, Homo sapiens
gtaaatgtctttg

SEQ ID NO: 6347380 - DNA, 15 bp, Homo sapiens
gtaaatgtgacaaaa

SEQ ID NO: 6347381 - DNA, 15 bp, Homo sapiens
gtaaatgtggacaca

SEQ ID NO: 6347382 - DNA, 19 bp, Homo sapiens
gtaaatgtgttggacaaat

SEQ ID NO: 6347383 - DNA, 22 bp, Homo sapiens
gtaaatgttatcttatactgta

SEQ ID NO: 6347384 - DNA, 12 bp, Homo sapiens
gtaaatgttatt

SEQ ID NO: 6347385 - DNA, 13 bp, Homo sapiens
gtaaatgttatta

SEQ ID NO: 6347386 - DNA, 14 bp, Homo sapiens
gtaaatgtttaata

SEQ ID NO: 6347387 - DNA, 14 bp, Homo sapiens
gtaaatgtttcttt

SEQ ID NO: 6347388 - DNA, 19 bp, Homo sapiens
gtaaattaagtgtgtgtat

SEQ ID NO: 6347389 - DNA, 23 bp, Homo sapiens
gtaaattaccagtaaagtgtaac

SEQ ID NO: 6347390 - DNA, 18 bp, Homo sapiens
gtaaattataagtaactt

SEQ ID NO: 6347391 - DNA, 20 bp, Homo sapiens
gtaaattatatttgtgctat

SEQ ID NO: 6347392 - DNA, 17 bp, Homo sapiens
gtaaattatgatgtcca

SEQ ID NO: 6347393 - DNA, 14 bp, Homo sapiens
gtaaattattcagt

SEQ ID NO: 6347394 - DNA, 22 bp, Homo sapiens
gtaaattattcagttaagaaaa

SEQ ID NO: 6347395 - DNA, 14 bp, Homo sapiens
gtaaattattgtaa

SEQ ID NO: 6347396 - DNA, 15 bp, Homo sapiens
gtaaattattgtaaa

SEQ ID NO: 6347397 - DNA, 19 bp, Homo sapiens
gtaaattattgtaaacttt

SEQ ID NO: 6347398 - DNA, 15 bp, Homo sapiens
gtaaattattttaaa

SEQ ID NO: 6347399 - DNA, 21 bp, Homo sapiens
gtaaattattttaaattataa

SEQ ID NO: 6347400 - DNA, 20 bp, Homo sapiens
gtaaattcagacaacattat

SEQ ID NO: 6347401 - DNA, 21 bp, Homo sapiens
gtaaattcagacaacattatg

SEQ ID NO: 6347402 - DNA, 17 bp, Homo sapiens
gtaaattccccttccca

SEQ ID NO: 6347403 - DNA, 15 bp, Homo sapiens
gtaaattctgatttc

SEQ ID NO: 6347404 - DNA, 16 bp, Homo sapiens
gtaaattctggaaatg

SEQ ID NO: 6347405 - DNA, 11 bp, Homo sapiens
gtaaattctgt

SEQ ID NO: 6347406 - DNA, 16 bp, Homo sapiens
gtaaattgcacagagc

SEQ ID NO: 6347407 - DNA, 17 bp, Homo sapiens
gtaaatttatgtgatgg

SEQ ID NO: 6347408 - DNA, 18 bp, Homo sapiens
gtaaatttccccaacagt

SEQ ID NO: 6347409 - DNA, 21 bp, Homo sapiens
gtaaatttccccaacagtgtg

SEQ ID NO: 6347410 - DNA, 16 bp, Homo sapiens
gtaaatttggcttctg

SEQ ID NO: 6347411 - DNA, 20 bp, Homo sapiens
gtaaatttgtactatttaac

SEQ ID NO: 6347412 - DNA, 17 bp, Homo sapiens
gtaaatttgtataaata

SEQ ID NO: 6347413 - DNA, 12 bp, Homo sapiens
gtaaattttaga

SEQ ID NO: 6347414 - DNA, 18 bp, Homo sapiens
gtaaattttgtatgaaaa

SEQ ID NO: 6347415 - DNA, 17 bp, Homo sapiens
gtaaatttttgaaaaat

SEQ ID NO: 6347416 - DNA, 23 bp, Homo sapiens
gtaaattttttacgtagctattt

SEQ ID NO: 6347417 - DNA, 21 bp, Homo sapiens
gtaacaaaattgacagctttc

SEQ ID NO: 6347418 - DNA, 18 bp, Homo sapiens
gtaacaaaggtttaaagt

SEQ ID NO: 6347419 - DNA, 17 bp, Homo sapiens
gtaacaaagtttgctga

SEQ ID NO: 6347420 - DNA, 17 bp, Homo sapiens
gtaacaaattgatctgt

SEQ ID NO: 6347421 - DNA, 15 bp, Homo sapiens
gtaacaacaattatt

SEQ ID NO: 6347422 - DNA, 15 bp, Homo sapiens
gtaacaagaaaacat

SEQ ID NO: 6347423 - DNA, 21 bp, Homo sapiens
gtaacaagagtgattcttgct

SEQ ID NO: 6347424 - DNA, 17 bp, Homo sapiens
gtaacaatacatgagaa

SEQ ID NO: 6347425 - DNA, 18 bp, Homo sapiens
gtaacaatacatgagaaa

SEQ ID NO: 6347426 - DNA, 17 bp, Homo sapiens
gtaacaatgaagataaa

SEQ ID NO: 6347427 - DNA, 19 bp, Homo sapiens
gtaacaattttaatgctat

SEQ ID NO: 6347428 - DNA, 17 bp, Homo sapiens
gtaacacaagccacaga

SEQ ID NO: 6347429 - DNA, 19 bp, Homo sapiens
gtaacacaagccacagaag

SEQ ID NO: 6347430 - DNA, 20 bp, Homo sapiens
gtaacacaagccacagaagc

SEQ ID NO: 6347431 - DNA, 12 bp, Homo sapiens
gtaacacatctt

SEQ ID NO: 6347432 - DNA, 15 bp, Homo sapiens
gtaacactattacag

SEQ ID NO: 6347433 - DNA, 15 bp, Homo sapiens
gtaacactcctctgc

SEQ ID NO: 6347434 - DNA, 14 bp, Homo sapiens
gtaacactttgctt

SEQ ID NO: 6347435 - DNA, 11 bp, Homo sapiens
gtaacagaaag

SEQ ID NO: 6347436 - DNA, 12 bp, Homo sapiens
gtaacagaaagg

SEQ ID NO: 6347437 - DNA, 16 bp, Homo sapiens
gtaacagaaagggcaa

SEQ ID NO: 6347438 - DNA, 15 bp, Homo sapiens
gtaacagaacagctt

SEQ ID NO: 6347439 - DNA, 18 bp, Homo sapiens
gtaacagaacagcttcag

SEQ ID NO: 6347440 - DNA, 13 bp, Homo sapiens
gtaacagacattg

SEQ ID NO: 6347441 - DNA, 21 bp, Homo sapiens
gtaacagcaggagcatggccg

SEQ ID NO: 6347442 - DNA, 16 bp, Homo sapiens
gtaacagctaatcttt

SEQ ID NO: 6347443 - DNA, 12 bp, Homo sapiens
gtaacagctcct

SEQ ID NO: 6347444 - DNA, 18 bp, Homo sapiens
gtaacagctccttgggag

SEQ ID NO: 6347445 - DNA, 23 bp, Homo sapiens
gtaacagctccttgggaggaagc

SEQ ID NO: 6347446 - DNA, 22 bp, Homo sapiens
gtaacaggatacaggtgacagt

SEQ ID NO: 6347447 - DNA, 12 bp, Homo sapiens
gtaacaggcaga

SEQ ID NO: 6347448 - DNA, 19 bp, Homo sapiens
gtaacaggccttgagcaca

SEQ ID NO: 6347449 - DNA, 22 bp, Homo sapiens
gtaacaggtattttgtttcttt

SEQ ID NO: 6347450 - DNA, 22 bp, Homo sapiens
gtaacaggtccttcccagattt

SEQ ID NO: 6347451 - DNA, 21 bp, Homo sapiens
gtaacaggtctcctcttaaaa

SEQ ID NO: 6347452 - DNA, 22 bp, Homo sapiens
gtaacaggtgtgtatgtaaagt

SEQ ID NO: 6347453 - DNA, 17 bp, Homo sapiens
gtaacagtgaggctggg

SEQ ID NO: 6347454 - DNA, 17 bp, Homo sapiens
gtaacagtgcaagattt

SEQ ID NO: 6347455 - DNA, 18 bp, Homo sapiens
gtaacagttcatgtttgc

SEQ ID NO: 6347456 - DNA, 20 bp, Homo sapiens
gtaacagttcatgtttgctt

SEQ ID NO: 6347457 - DNA, 18 bp, Homo sapiens
gtaacataactgcttctt

SEQ ID NO: 6347458 - DNA, 20 bp, Homo sapiens
gtaacatagatgcctgggcc

SEQ ID NO: 6347459 - DNA, 23 bp, Homo sapiens
gtaacatagctgaggtaaaaact

SEQ ID NO: 6347460 - DNA, 13 bp, Homo sapiens
gtaacatatctgt

SEQ ID NO: 6347461 - DNA, 14 bp, Homo sapiens
gtaacatatgcaaa

SEQ ID NO: 6347462 - DNA, 20 bp, Homo sapiens
gtaacatcactatccatgca

SEQ ID NO: 6347463 - DNA, 16 bp, Homo sapiens
gtaacatcagccattt

SEQ ID NO: 6347464 - DNA, 15 bp, Homo sapiens
gtaacatcagggacc

SEQ ID NO: 6347465 - DNA, 18 bp, Homo sapiens
gtaacatcataattacat

SEQ ID NO: 6347466 - DNA, 16 bp, Homo sapiens
gtaacatccaagccag

SEQ ID NO: 6347467 - DNA, 17 bp, Homo sapiens
gtaacatccaagccaga

SEQ ID NO: 6347468 - DNA, 19 bp, Homo sapiens
gtaacatcgcacagtttac

SEQ ID NO: 6347469 - DNA, 12 bp, Homo sapiens
gtaacatgatgt

SEQ ID NO: 6347470 - DNA, 17 bp, Homo sapiens
gtaacatgcaacaaaaa

SEQ ID NO: 6347471 - DNA, 18 bp, Homo sapiens
gtaacatgtctaaagtta

SEQ ID NO: 6347472 - DNA, 17 bp, Homo sapiens
gtaacattctatttcaa

SEQ ID NO: 6347473 - DNA, 18 bp, Homo sapiens
gtaacattgggtcctggg

SEQ ID NO: 6347474 - DNA, 14 bp, Homo sapiens
gtaacattggtgaa

SEQ ID NO: 6347475 - DNA, 15 bp, Homo sapiens
gtaacattgtaaagt

SEQ ID NO: 6347476 - DNA, 18 bp, Homo sapiens
gtaacatttatagaagaa

SEQ ID NO: 6347477 - DNA, 13 bp, Homo sapiens
gtaacatttctgt

SEQ ID NO: 6347478 - DNA, 20 bp, Homo sapiens
gtaaccaactgaacgacaaa

SEQ ID NO: 6347479 - DNA, 20 bp, Homo sapiens
gtaaccaagagtattccatt

SEQ ID NO: 6347480 - DNA, 19 bp, Homo sapiens
gtaaccaaggccctgtctc

SEQ ID NO: 6347481 - DNA, 14 bp, Homo sapiens
gtaaccacctctct

SEQ ID NO: 6347482 - DNA, 19 bp, Homo sapiens
gtaaccacctctctgtctt

SEQ ID NO: 6347483 - DNA, 23 bp, Homo sapiens
gtaaccacctctctgtctttttc

SEQ ID NO: 6347484 - DNA, 17 bp, Homo sapiens
gtaaccaggccccagcc

SEQ ID NO: 6347485 - DNA, 13 bp, Homo sapiens
gtaaccaggggct

SEQ ID NO: 6347486 - DNA, 23 bp, Homo sapiens
gtaaccattttcctttggactgt

SEQ ID NO: 6347487 - DNA, 17 bp, Homo sapiens
gtaacccaactctcctg

SEQ ID NO: 6347488 - DNA, 18 bp, Homo sapiens
gtaacccaactctcctgg

SEQ ID NO: 6347489 - DNA, 16 bp, Homo sapiens
gtaacccctcctggct

SEQ ID NO: 6347490 - DNA, 18 bp, Homo sapiens
gtaaccctcgccctgtcc

SEQ ID NO: 6347491 - DNA, 23 bp, Homo sapiens
gtaaccctcgccctgtccctccc

SEQ ID NO: 6347492 - DNA, 14 bp, Homo sapiens
gtaaccctggtggt

SEQ ID NO: 6347493 - DNA, 21 bp, Homo sapiens
gtaaccctggtggttgctgtt

SEQ ID NO: 6347494 - DNA, 19 bp, Homo sapiens
gtaaccgagccagcagctg

SEQ ID NO: 6347495 - DNA, 18 bp, Homo sapiens
gtaaccggacaccttaga

SEQ ID NO: 6347496 - DNA, 22 bp, Homo sapiens
gtaacctatttatcgcaacatg

SEQ ID NO: 6347497 - DNA, 18 bp, Homo sapiens
gtaacctcagctctggga

SEQ ID NO: 6347498 - DNA, 17 bp, Homo sapiens
gtaacctgaagttttat

SEQ ID NO: 6347499 - DNA, 20 bp, Homo sapiens
gtaacctgagatggccctct

SEQ ID NO: 6347500 - DNA, 21 bp, Homo sapiens
gtaacctgctggatgggactc

SEQ ID NO: 6347501 - DNA, 16 bp, Homo sapiens
gtaacgagaagacaaa

SEQ ID NO: 6347502 - DNA, 23 bp, Homo sapiens
gtaacgattgacaccaaaatgaa

SEQ ID NO: 6347503 - DNA, 18 bp, Homo sapiens
gtaacgtgctcactgtgt

SEQ ID NO: 6347504 - DNA, 14 bp, Homo sapiens
gtaacgtgttactg

SEQ ID NO: 6347505 - DNA, 15 bp, Homo sapiens
gtaactaaaataatt

SEQ ID NO: 6347506 - DNA, 20 bp, Homo sapiens
gtaactaaaataattttgta

SEQ ID NO: 6347507 - DNA, 20 bp, Homo sapiens
gtaactaaagtatttaaaga

SEQ ID NO: 6347508 - DNA, 17 bp, Homo sapiens
gtaactaactgcttcat

SEQ ID NO: 6347509 - DNA, 15 bp, Homo sapiens
gtaactaatttgtgg

SEQ ID NO: 6347510 - DNA, 21 bp, Homo sapiens
gtaactaattttgttgaaaat

SEQ ID NO: 6347511 - DNA, 10 bp, Homo sapiens
gtaactacaa

SEQ ID NO: 6347512 - DNA, 21 bp, Homo sapiens
gtaactacaaagctttgctac

SEQ ID NO: 6347513 - DNA, 16 bp, Homo sapiens
gtaactacaatgatgg

SEQ ID NO: 6347514 - DNA, 17 bp, Homo sapiens
gtaactacactaataaa

SEQ ID NO: 6347515 - DNA, 12 bp, Homo sapiens
gtaactacttta

SEQ ID NO: 6347516 - DNA, 20 bp, Homo sapiens
gtaactactttttatactcc

SEQ ID NO: 6347517 - DNA, 22 bp, Homo sapiens
gtaactagaccatttttaaatg

SEQ ID NO: 6347518 - DNA, 12 bp, Homo sapiens
gtaactagtggg

SEQ ID NO: 6347519 - DNA, 16 bp, Homo sapiens
gtaactattaaccttt

SEQ ID NO: 6347520 - DNA, 23 bp, Homo sapiens
gtaactattaaccttttttgtct

SEQ ID NO: 6347521 - DNA, 18 bp, Homo sapiens
gtaactatttcttcagag

SEQ ID NO: 6347522 - DNA, 14 bp, Homo sapiens
gtaactcagacatt

SEQ ID NO: 6347523 - DNA, 13 bp, Homo sapiens
gtaactcatctgt

SEQ ID NO: 6347524 - DNA, 12 bp, Homo sapiens
gtaactccacca

SEQ ID NO: 6347525 - DNA, 18 bp, Homo sapiens
gtaactcccactcctaat

SEQ ID NO: 6347526 - DNA, 21 bp, Homo sapiens
gtaactcttacctaaactgag

SEQ ID NO: 6347527 - DNA, 18 bp, Homo sapiens
gtaactcttggccagagc

SEQ ID NO: 6347528 - DNA, 18 bp, Homo sapiens
gtaactgaagcataaaca

SEQ ID NO: 6347529 - DNA, 18 bp, Homo sapiens
gtaactgaggtaaaatgt

SEQ ID NO: 6347530 - DNA, 18 bp, Homo sapiens
gtaactgcattgagaact

SEQ ID NO: 6347531 - DNA, 12 bp, Homo sapiens
gtaactgccagg

SEQ ID NO: 6347532 - DNA, 23 bp, Homo sapiens
gtaactgccattttttgtctgtg

SEQ ID NO: 6347533 - DNA, 17 bp, Homo sapiens
gtaactgcccagcccct

SEQ ID NO: 6347534 - DNA, 22 bp, Homo sapiens
gtaactgcccagccccttttct

SEQ ID NO: 6347535 - DNA, 19 bp, Homo sapiens
gtaactgcccttttaaatg

SEQ ID NO: 6347536 - DNA, 21 bp, Homo sapiens
gtaactgctcagagctttaaa

SEQ ID NO: 6347537 - DNA, 15 bp, Homo sapiens
gtaactgctgaaaac

SEQ ID NO: 6347538 - DNA, 12 bp, Homo sapiens
gtaactgctgtc

SEQ ID NO: 6347539 - DNA, 15 bp, Homo sapiens
gtaactgctttctgt

SEQ ID NO: 6347540 - DNA, 22 bp, Homo sapiens
gtaactgctttctgttccaaat

SEQ ID NO: 6347541 - DNA, 14 bp, Homo sapiens
gtaactggctgctc

SEQ ID NO: 6347542 - DNA, 17 bp, Homo sapiens
gtaactggctgctccct

SEQ ID NO: 6347543 - DNA, 18 bp, Homo sapiens
gtaactggctgctccctg

SEQ ID NO: 6347544 - DNA, 19 bp, Homo sapiens
gtaactggctgctccctgc

SEQ ID NO: 6347545 - DNA, 21 bp, Homo sapiens
gtaactggctgctccctgctc

SEQ ID NO: 6347546 - DNA, 17 bp, Homo sapiens
gtaactggggggccacc

SEQ ID NO: 6347547 - DNA, 19 bp, Homo sapiens
gtaactggggggccaccat

SEQ ID NO: 6347548 - DNA, 20 bp, Homo sapiens
gtaactgtaaagatgaatgt

SEQ ID NO: 6347549 - DNA, 19 bp, Homo sapiens
taaaatatgaagacataaa

SEQ ID NO: 6347550 - DNA, 13 bp, Homo sapiens
taaaatatgcact

SEQ ID NO: 6347551 - DNA, 14 bp, Homo sapiens
taaaatatgcacta

SEQ ID NO: 6347552 - DNA, 15 bp, Homo sapiens
taaaatatggaaaat

SEQ ID NO: 6347553 - DNA, 18 bp, Homo sapiens
taaaatatggctataaat

SEQ ID NO: 6347554 - DNA, 22 bp, Homo sapiens
taaaatatgtgaagttttcctt

SEQ ID NO: 6347555 - DNA, 16 bp, Homo sapiens
taaaatatgttcttta

SEQ ID NO: 6347556 - DNA, 20 bp, Homo sapiens
taaaatattatttgatatct

SEQ ID NO: 6347557 - DNA, 21 bp, Homo sapiens
taaaatattatttgatatctg

SEQ ID NO: 6347558 - DNA, 15 bp, Homo sapiens
taaaatattcactct

SEQ ID NO: 6347559 - DNA, 17 bp, Homo sapiens
taaaatattcactctcc

SEQ ID NO: 6347560 - DNA, 21 bp, Homo sapiens
taaaatattgtgtaagaatca

SEQ ID NO: 6347561 - DNA, 15 bp, Homo sapiens
taaaatattgttact

SEQ ID NO: 6347562 - DNA, 23 bp, Homo sapiens
taaaatattgttgaacacttgaa

SEQ ID NO: 6347563 - DNA, 19 bp, Homo sapiens
taaaatatttaactttttt

SEQ ID NO: 6347564 - DNA, 15 bp, Homo sapiens
taaaatatttatgaa

SEQ ID NO: 6347565 - DNA, 17 bp, Homo sapiens
taaaatatttatgaaga

SEQ ID NO: 6347566 - DNA, 18 bp, Homo sapiens
taaaatatttgaatgaaa

SEQ ID NO: 6347567 - DNA, 16 bp, Homo sapiens
taaaatatttgagaat

SEQ ID NO: 6347568 - DNA, 17 bp, Homo sapiens
taaaatatttgcctttt

SEQ ID NO: 6347569 - DNA, 13 bp, Homo sapiens
taaaatattttag

SEQ ID NO: 6347570 - DNA, 21 bp, Homo sapiens
taaaatattttagatgttatt

SEQ ID NO: 6347571 - DNA, 14 bp, Homo sapiens
taaaatattttcca

SEQ ID NO: 6347572 - DNA, 13 bp, Homo sapiens
taaaatattttct

SEQ ID NO: 6347573 - DNA, 20 bp, Homo sapiens
taaaatattttctgtgtgtt

SEQ ID NO: 6347574 - DNA, 22 bp, Homo sapiens
taaaatattttctgtgtgttcc

SEQ ID NO: 6347575 - DNA, 13 bp, Homo sapiens
taaaatcaaagaa

SEQ ID NO: 6347576 - DNA, 19 bp, Homo sapiens
taaaatcaaagaaaacata

SEQ ID NO: 6347577 - DNA, 17 bp, Homo sapiens
taaaatcaaatgtaaat

SEQ ID NO: 6347578 - DNA, 19 bp, Homo sapiens
taaaatcaaatgtaaatca

SEQ ID NO: 6347579 - DNA, 14 bp, Homo sapiens
taaaatcaactttt

SEQ ID NO: 6347580 - DNA, 14 bp, Homo sapiens
taaaatcacaaact

SEQ ID NO: 6347581 - DNA, 16 bp, Homo sapiens
taaaatcacaaactca

SEQ ID NO: 6347582 - DNA, 20 bp, Homo sapiens
taaaatcaccctgactgtgg

SEQ ID NO: 6347583 - DNA, 15 bp, Homo sapiens
taaaatcacgttaaa

SEQ ID NO: 6347584 - DNA, 11 bp, Homo sapiens
taaaatcacta

SEQ ID NO: 6347585 - DNA, 15 bp, Homo sapiens
taaaatcagactctt

SEQ ID NO: 6347586 - DNA, 20 bp, Homo sapiens
taaaatcagaggtaaataga

SEQ ID NO: 6347587 - DNA, 15 bp, Homo sapiens
taaaatcagccaatt

SEQ ID NO: 6347588 - DNA, 17 bp, Homo sapiens
taaaatcagccaattat

SEQ ID NO: 6347589 - DNA, 14 bp, Homo sapiens
taaaatcataacat

SEQ ID NO: 6347590 - DNA, 10 bp, Homo sapiens
taaaatcatt

SEQ ID NO: 6347591 - DNA, 18 bp, Homo sapiens
taaaatccaatattgtaa

SEQ ID NO: 6347592 - DNA, 19 bp, Homo sapiens
taaaatccaatattgtaat

SEQ ID NO: 6347593 - DNA, 14 bp, Homo sapiens
taaaatccacagct

SEQ ID NO: 6347594 - DNA, 21 bp, Homo sapiens
taaaatccagcatcccaagat

SEQ ID NO: 6347595 - DNA, 18 bp, Homo sapiens
taaaatccatacatttgt

SEQ ID NO: 6347596 - DNA, 13 bp, Homo sapiens
taaaatccataga

SEQ ID NO: 6347597 - DNA, 18 bp, Homo sapiens
taaaatccatagatttat

SEQ ID NO: 6347598 - DNA, 15 bp, Homo sapiens
taaaatccattttag

SEQ ID NO: 6347599 - DNA, 15 bp, Homo sapiens
taaaatcccattgta

SEQ ID NO: 6347600 - DNA, 17 bp, Homo sapiens
taaaatcccattgtatt

SEQ ID NO: 6347601 - DNA, 20 bp, Homo sapiens
taaaatcccattgtatttaa

SEQ ID NO: 6347602 - DNA, 21 bp, Homo sapiens
taaaatcccattgtatttaaa

SEQ ID NO: 6347603 - DNA, 20 bp, Homo sapiens
taaaatccctctaatttctc

SEQ ID NO: 6347604 - DNA, 22 bp, Homo sapiens
taaaatcctaagacacaaatgc

SEQ ID NO: 6347605 - DNA, 17 bp, Homo sapiens
taaaatcctacagtgaa

SEQ ID NO: 6347606 - DNA, 21 bp, Homo sapiens
taaaatctaaaatttcataat

SEQ ID NO: 6347607 - DNA, 17 bp, Homo sapiens
taaaatctattctgtgt

SEQ ID NO: 6347608 - DNA, 17 bp, Homo sapiens
taaaatctattttgtct

SEQ ID NO: 6347609 - DNA, 19 bp, Homo sapiens
taaaatctcacgctgccat

SEQ ID NO: 6347610 - DNA, 20 bp, Homo sapiens
taaaatctcacgctgccatt

SEQ ID NO: 6347611 - DNA, 23 bp, Homo sapiens
taaaatctgaattttgcaatgta

SEQ ID NO: 6347612 - DNA, 20 bp, Homo sapiens
taaaatctgagggaaatgtt

SEQ ID NO: 6347613 - DNA, 23 bp, Homo sapiens
taaaatctgagggaaatgttttg

SEQ ID NO: 6347614 - DNA, 20 bp, Homo sapiens
taaaatctgatatgtattgt

SEQ ID NO: 6347615 - DNA, 23 bp, Homo sapiens
taaaatctgatatgtattgtttg

SEQ ID NO: 6347616 - DNA, 16 bp, Homo sapiens
taaaatctgatttaat

SEQ ID NO: 6347617 - DNA, 17 bp, Homo sapiens
taaaatctgatttaatg

SEQ ID NO: 6347618 - DNA, 21 bp, Homo sapiens
taaaatctgatttaatgtttt

SEQ ID NO: 6347619 - DNA, 23 bp, Homo sapiens
taaaatctgatttaatgttttct

SEQ ID NO: 6347620 - DNA, 14 bp, Homo sapiens
taaaatctggaaat

SEQ ID NO: 6347621 - DNA, 22 bp, Homo sapiens
taaaatctgtaaaccataggta

SEQ ID NO: 6347622 - DNA, 17 bp, Homo sapiens
taaaatctgtattgcta

SEQ ID NO: 6347623 - DNA, 18 bp, Homo sapiens
taaaatctgtattgctaa

SEQ ID NO: 6347624 - DNA, 13 bp, Homo sapiens
taaaatctgtcac

SEQ ID NO: 6347625 - DNA, 17 bp, Homo sapiens
taaaatcttatagttct

SEQ ID NO: 6347626 - DNA, 14 bp, Homo sapiens
taaaatcttattaa

SEQ ID NO: 6347627 - DNA, 21 bp, Homo sapiens
taaaatcttattaaagtttca

SEQ ID NO: 6347628 - DNA, 21 bp, Homo sapiens
taaaatcttgcagttttgtaa

SEQ ID NO: 6347629 - DNA, 14 bp, Homo sapiens
taaaatcttgtcat

SEQ ID NO: 6347630 - DNA, 19 bp, Homo sapiens
taaaatcttgtcatgtgta

SEQ ID NO: 6347631 - DNA, 21 bp, Homo sapiens
taaaatcttgtcatgtgtata

SEQ ID NO: 6347632 - DNA, 22 bp, Homo sapiens
taaaatcttgtcatgtgtataa

SEQ ID NO: 6347633 - DNA, 21 bp, Homo sapiens
taaaatctttctttggggaaa

SEQ ID NO: 6347634 - DNA, 16 bp, Homo sapiens
taaaatgaaaattgta

SEQ ID NO: 6347635 - DNA, 18 bp, Homo sapiens
taaaatgaaatgcatttt

SEQ ID NO: 6347636 - DNA, 15 bp, Homo sapiens
taaaatgaaatgcta

SEQ ID NO: 6347637 - DNA, 16 bp, Homo sapiens
taaaatgaacatctct

SEQ ID NO: 6347638 - DNA, 17 bp, Homo sapiens
taaaatgaacatctctt

SEQ ID NO: 6347639 - DNA, 21 bp, Homo sapiens
taaaatgaacatctcttgaaa

SEQ ID NO: 6347640 - DNA, 16 bp, Homo sapiens
taaaatgaagaattta

SEQ ID NO: 6347641 - DNA, 17 bp, Homo sapiens
taaaatgaagcaattta

SEQ ID NO: 6347642 - DNA, 23 bp, Homo sapiens
taaaatgacaaagccattctttt

SEQ ID NO: 6347643 - DNA, 23 bp, Homo sapiens
taaaatgacaataactaaagcta

SEQ ID NO: 6347644 - DNA, 14 bp, Homo sapiens
taaaatgacaatca

SEQ ID NO: 6347645 - DNA, 19 bp, Homo sapiens
taaaatgacaatcatgtgt

SEQ ID NO: 6347646 - DNA, 15 bp, Homo sapiens
taaaatgagaaatct

SEQ ID NO: 6347647 - DNA, 15 bp, Homo sapiens
taaaatgaggatcca

SEQ ID NO: 6347648 - DNA, 21 bp, Homo sapiens
taaaatgaggatccagggcag

SEQ ID NO: 6347649 - DNA, 20 bp, Homo sapiens
taaaatgaggccggacagag

SEQ ID NO: 6347650 - DNA, 20 bp, Homo sapiens
taaaatgaggttcaactgtt

SEQ ID NO: 6347651 - DNA, 21 bp, Homo sapiens
taaaatgagtaggatgtctct

SEQ ID NO: 6347652 - DNA, 13 bp, Homo sapiens
taaaatgagtttg

SEQ ID NO: 6347653 - DNA, 21 bp, Homo sapiens
taaaatgagtttgtattatta

SEQ ID NO: 6347654 - DNA, 14 bp, Homo sapiens
taaaatgatcctgc

SEQ ID NO: 6347655 - DNA, 23 bp, Homo sapiens
taaaatgattcacttttattgta

SEQ ID NO: 6347656 - DNA, 14 bp, Homo sapiens
taaaatgattgtaa

SEQ ID NO: 6347657 - DNA, 17 bp, Homo sapiens
taaaatgattgtaaaat

SEQ ID NO: 6347658 - DNA, 18 bp, Homo sapiens
taaaatgattgtaaaata

SEQ ID NO: 6347659 - DNA, 20 bp, Homo sapiens
taaaatgattgtaaaatagc

SEQ ID NO: 6347660 - DNA, 22 bp, Homo sapiens
taaaatgattgtaaaatagctt

SEQ ID NO: 6347661 - DNA, 16 bp, Homo sapiens
taaaatgcaaatgaat

SEQ ID NO: 6347662 - DNA, 18 bp, Homo sapiens
taaaatgcaacatgtgta

SEQ ID NO: 6347663 - DNA, 11 bp, Homo sapiens
taaaatgcaag

SEQ ID NO: 6347664 - DNA, 23 bp, Homo sapiens
taaaatgcaaggacaagcaatta

SEQ ID NO: 6347665 - DNA, 18 bp, Homo sapiens
taaaatgcagtccagaat

SEQ ID NO: 6347666 - DNA, 20 bp, Homo sapiens
taaaatgcagtccagaataa

SEQ ID NO: 6347667 - DNA, 24 bp, Homo sapiens
taaaatgcatactgttgatacaaa

SEQ ID NO: 6347668 - DNA, 21 bp, Homo sapiens
taaaatgcatatttctatgtt

SEQ ID NO: 6347669 - DNA, 17 bp, Homo sapiens
taaaatgccgattacac

SEQ ID NO: 6347670 - DNA, 18 bp, Homo sapiens
taaaatgccgattacacc

SEQ ID NO: 6347671 - DNA, 17 bp, Homo sapiens
taaaatgcctcagctat

SEQ ID NO: 6347672 - DNA, 18 bp, Homo sapiens
taaaatgcctcagctatg

SEQ ID NO: 6347673 - DNA, 20 bp, Homo sapiens
taaaatgcctcagctatgta

SEQ ID NO: 6347674 - DNA, 17 bp, Homo sapiens
taaaatgcctcagtgta

SEQ ID NO: 6347675 - DNA, 20 bp, Homo sapiens
taaaatgcctcagtgtattt

SEQ ID NO: 6347676 - DNA, 19 bp, Homo sapiens
taaaatgctattttaaaat

SEQ ID NO: 6347677 - DNA, 20 bp, Homo sapiens
taaaatgctattttaaaatt

SEQ ID NO: 6347678 - DNA, 17 bp, Homo sapiens
taaaatgctcaatttca

SEQ ID NO: 6347679 - DNA, 21 bp, Homo sapiens
taaaatgctgcttttaaaaca

SEQ ID NO: 6347680 - DNA, 20 bp, Homo sapiens
taaaatggaaaacttagttt

SEQ ID NO: 6347681 - DNA, 22 bp, Homo sapiens
taaaatggaaaattttctcctt

SEQ ID NO: 6347682 - DNA, 17 bp, Homo sapiens
taaaatggaataacata

SEQ ID NO: 6347683 - DNA, 18 bp, Homo sapiens
taaaatggaataacatat

SEQ ID NO: 6347684 - DNA, 20 bp, Homo sapiens
taaaatggaataacatatca

SEQ ID NO: 6347685 - DNA, 12 bp, Homo sapiens
taaaatggaatt

SEQ ID NO: 6347686 - DNA, 17 bp, Homo sapiens
taaaatggacacaaatt

SEQ ID NO: 6347687 - DNA, 22 bp, Homo sapiens
taaaatggacacaaattttcaa

SEQ ID NO: 6347688 - DNA, 15 bp, Homo sapiens
taaaatggacatttt

SEQ ID NO: 6347689 - DNA, 22 bp, Homo sapiens
taaaatggatgccttgaataat

SEQ ID NO: 6347690 - DNA, 16 bp, Homo sapiens
taaaatggatttaatc

SEQ ID NO: 6347691 - DNA, 20 bp, Homo sapiens
taaaatggcaccttccccct

SEQ ID NO: 6347692 - DNA, 18 bp, Homo sapiens
taaaatggctgtaatcat

SEQ ID NO: 6347693 - DNA, 19 bp, Homo sapiens
taaaatgggaattctgact

SEQ ID NO: 6347694 - DNA, 9 bp, Homo sapiens
taaaatggt

SEQ ID NO: 6347695 - DNA, 18 bp, Homo sapiens
taaaatggtttgtcctga

SEQ ID NO: 6347696 - DNA, 10 bp, Homo sapiens
taaaatgtaa

SEQ ID NO: 6347697 - DNA, 19 bp, Homo sapiens
taaaatgtaaaactccatt

SEQ ID NO: 6347698 - DNA, 18 bp, Homo sapiens
taaaatgtaaagccatgc

SEQ ID NO: 6347699 - DNA, 23 bp, Homo sapiens
taaaatgtaaagccatgctggaa

SEQ ID NO: 6347700 - DNA, 16 bp, Homo sapiens
taaaatgtaacactga

SEQ ID NO: 6347701 - DNA, 14 bp, Homo sapiens
taaaatgtaacttt

SEQ ID NO: 6347702 - DNA, 21 bp, Homo sapiens
taaaatgtaatttaaatgaaa

SEQ ID NO: 6347703 - DNA, 19 bp, Homo sapiens
taaaatgtacactggatat

SEQ ID NO: 6347704 - DNA, 17 bp, Homo sapiens
taaaatgtagaaattct

SEQ ID NO: 6347705 - DNA, 23 bp, Homo sapiens
taaaatgtagttttaaataaagt

SEQ ID NO: 6347706 - DNA, 22 bp, Homo sapiens
taaaatgtatagcttaagatca

SEQ ID NO: 6347707 - DNA, 13 bp, Homo sapiens
taaaatgtatatt

SEQ ID NO: 6347708 - DNA, 20 bp, Homo sapiens
taaaatgtatatttttaaag

SEQ ID NO: 6347709 - DNA, 17 bp, Homo sapiens
taaaatgtatctaagaa

SEQ ID NO: 6347710 - DNA, 16 bp, Homo sapiens
taaaatgtatctgcat

SEQ ID NO: 6347711 - DNA, 18 bp, Homo sapiens
taaaatgtatctgcatat

SEQ ID NO: 6347712 - DNA, 19 bp, Homo sapiens
taaaatgtatgcatgttgt

SEQ ID NO: 6347713 - DNA, 15 bp, Homo sapiens
taaaatgtcaagaaa

SEQ ID NO: 6347714 - DNA, 21 bp, Homo sapiens
taaaatgtcagtgtttgggaa

SEQ ID NO: 6347715 - DNA, 20 bp, Homo sapiens
taaaatgtctcgagtcctaa

SEQ ID NO: 6347716 - DNA, 14 bp, Homo sapiens
taaaatgtcttcaa

SEQ ID NO: 6347717 - DNA, 13 bp, Homo sapiens
taaaatgtcttgg

SEQ ID NO: 6347718 - DNA, 16 bp, Homo sapiens
taaaatgtctttccaa

SEQ ID NO: 6347719 - DNA, 20 bp, Homo sapiens
taaaatgtgatgttctaagg

SEQ ID NO: 6347720 - DNA, 22 bp, Homo sapiens
taaaatgtgatgttctaaggct

SEQ ID NO: 6347721 - DNA, 14 bp, Homo sapiens
taaaatgtgcagta

SEQ ID NO: 6347722 - DNA, 18 bp, Homo sapiens
taaaatgtgggattatgg

SEQ ID NO: 6347723 - DNA, 13 bp, Homo sapiens
taaaatgtgtaca

SEQ ID NO: 6347724 - DNA, 18 bp, Homo sapiens
taaaatgtgtacagtgaa

SEQ ID NO: 6347725 - DNA, 23 bp, Homo sapiens
taaaatgtgtacagtgaacaaat

SEQ ID NO: 6347726 - DNA, 23 bp, Homo sapiens
gtaactgtagtgtagtcaggtgc

SEQ ID NO: 6347727 - DNA, 20 bp, Homo sapiens
gtaactgtccgtagtatcag

SEQ ID NO: 6347728 - DNA, 15 bp, Homo sapiens
gtaactgtcctgtcc

SEQ ID NO: 6347729 - DNA, 17 bp, Homo sapiens
gtaactgtcctgtcctg

SEQ ID NO: 6347730 - DNA, 12 bp, Homo sapiens
gtaactgttacc

SEQ ID NO: 6347731 - DNA, 17 bp, Homo sapiens
gtaactgttaccattgg

SEQ ID NO: 6347732 - DNA, 20 bp, Homo sapiens
gtaactgttaccattggaaa

SEQ ID NO: 6347733 - DNA, 13 bp, Homo sapiens
gtaactgttcttg

SEQ ID NO: 6347734 - DNA, 22 bp, Homo sapiens
gtaactgtttagatgaatgtca

SEQ ID NO: 6347735 - DNA, 13 bp, Homo sapiens
gtaacttaattat

SEQ ID NO: 6347736 - DNA, 22 bp, Homo sapiens
gtaacttatattgaagacaatt

SEQ ID NO: 6347737 - DNA, 15 bp, Homo sapiens
gtaacttattagaaa

SEQ ID NO: 6347738 - DNA, 13 bp, Homo sapiens
gtaacttattttg

SEQ ID NO: 6347739 - DNA, 12 bp, Homo sapiens
gtaacttcctct

SEQ ID NO: 6347740 - DNA, 16 bp, Homo sapiens
gtaacttcctgctgca

SEQ ID NO: 6347741 - DNA, 16 bp, Homo sapiens
gtaacttcctgtggat

SEQ ID NO: 6347742 - DNA, 17 bp, Homo sapiens
gtaacttctttgaagtt

SEQ ID NO: 6347743 - DNA, 18 bp, Homo sapiens
gtaacttgagattcaaga

SEQ ID NO: 6347744 - DNA, 23 bp, Homo sapiens
gtaacttgatccatttctaatta

SEQ ID NO: 6347745 - DNA, 17 bp, Homo sapiens
gtaacttggttatacat

SEQ ID NO: 6347746 - DNA, 18 bp, Homo sapiens
gtaacttggttatacatg

SEQ ID NO: 6347747 - DNA, 14 bp, Homo sapiens
gtaacttgtcttaa

SEQ ID NO: 6347748 - DNA, 16 bp, Homo sapiens
gtaactttaaacatct

SEQ ID NO: 6347749 - DNA, 21 bp, Homo sapiens
gtaactttactctgtgtttaa

SEQ ID NO: 6347750 - DNA, 15 bp, Homo sapiens
gtaactttatgtgta

SEQ ID NO: 6347751 - DNA, 15 bp, Homo sapiens
gtaactttgcatgtt

SEQ ID NO: 6347752 - DNA, 14 bp, Homo sapiens
gtaacttttgtaag

SEQ ID NO: 6347753 - DNA, 22 bp, Homo sapiens
gtaacttttgtagtcttatgaa

SEQ ID NO: 6347754 - DNA, 17 bp, Homo sapiens
gtaacttttttgtgtat

SEQ ID NO: 6347755 - DNA, 22 bp, Homo sapiens
gtaacttttttgtgtatgtact

SEQ ID NO: 6347756 - DNA, 17 bp, Homo sapiens
gtaactttttttcagtt

SEQ ID NO: 6347757 - DNA, 20 bp, Homo sapiens
gtaagaaaacaaactaaatg

SEQ ID NO: 6347758 - DNA, 12 bp, Homo sapiens
gtaagaaaagct

SEQ ID NO: 6347759 - DNA, 17 bp, Homo sapiens
gtaagaaaagtggttgt

SEQ ID NO: 6347760 - DNA, 14 bp, Homo sapiens
gtaagaaaatattt

SEQ ID NO: 6347761 - DNA, 22 bp, Homo sapiens
gtaagaaaatattttgtctaaa

SEQ ID NO: 6347762 - DNA, 23 bp, Homo sapiens
gtaagaaaatattttgtctaaaa

SEQ ID NO: 6347763 - DNA, 20 bp, Homo sapiens
gtaagaaacctactgcccag

SEQ ID NO: 6347764 - DNA, 16 bp, Homo sapiens
gtaagaaatgggcctc

SEQ ID NO: 6347765 - DNA, 20 bp, Homo sapiens
gtaagaaatgggcctcagcc

SEQ ID NO: 6347766 - DNA, 18 bp, Homo sapiens
gtaagaacaactacctga

SEQ ID NO: 6347767 - DNA, 23 bp, Homo sapiens
gtaagaacaactacctgagctaa

SEQ ID NO: 6347768 - DNA, 18 bp, Homo sapiens
gtaagaacacattttaaa

SEQ ID NO: 6347769 - DNA, 22 bp, Homo sapiens
gtaagaacagctcatcttcaaa

SEQ ID NO: 6347770 - DNA, 19 bp, Homo sapiens
gtaagaacatcataaaatt

SEQ ID NO: 6347771 - DNA, 18 bp, Homo sapiens
gtaagaactgtacattgt

SEQ ID NO: 6347772 - DNA, 20 bp, Homo sapiens
gtaagaactgtacattgtga

SEQ ID NO: 6347773 - DNA, 12 bp, Homo sapiens
gtaagaagaaag

SEQ ID NO: 6347774 - DNA, 15 bp, Homo sapiens
gtaagaagagactgg

SEQ ID NO: 6347775 - DNA, 17 bp, Homo sapiens
gtaagaagaggagcctc

SEQ ID NO: 6347776 - DNA, 20 bp, Homo sapiens
gtaagaagaggagcctcaga

SEQ ID NO: 6347777 - DNA, 21 bp, Homo sapiens
gtaagaagaggagcctcagaa

SEQ ID NO: 6347778 - DNA, 21 bp, Homo sapiens
gtaagaagcccgatccacatt

SEQ ID NO: 6347779 - DNA, 22 bp, Homo sapiens
gtaagaagggtgggagtggggc

SEQ ID NO: 6347780 - DNA, 19 bp, Homo sapiens
gtaagaatgtgtgtgcaga

SEQ ID NO: 6347781 - DNA, 13 bp, Homo sapiens
gtaagaattctga

SEQ ID NO: 6347782 - DNA, 12 bp, Homo sapiens
gtaagacaacat

SEQ ID NO: 6347783 - DNA, 17 bp, Homo sapiens
gtaagacacacagcctt

SEQ ID NO: 6347784 - DNA, 16 bp, Homo sapiens
gtaagacatctcaaat

SEQ ID NO: 6347785 - DNA, 20 bp, Homo sapiens
gtaagaccaccttcccttcc

SEQ ID NO: 6347786 - DNA, 19 bp, Homo sapiens
gtaagaccggaagctcctg

SEQ ID NO: 6347787 - DNA, 21 bp, Homo sapiens
gtaagactttctgaaaacact

SEQ ID NO: 6347788 - DNA, 23 bp, Homo sapiens
gtaagagacagaatgtatctgtg

SEQ ID NO: 6347789 - DNA, 15 bp, Homo sapiens
gtaagagacatgaat

SEQ ID NO: 6347790 - DNA, 18 bp, Homo sapiens
gtaagagcttgctccaga

SEQ ID NO: 6347791 - DNA, 18 bp, Homo sapiens
gtaagaggagcagagggc

SEQ ID NO: 6347792 - DNA, 13 bp, Homo sapiens
gtaagaggctgga

SEQ ID NO: 6347793 - DNA, 16 bp, Homo sapiens
gtaagaggcttcaaaa

SEQ ID NO: 6347794 - DNA, 21 bp, Homo sapiens
gtaagagggaaactctggaga

SEQ ID NO: 6347795 - DNA, 23 bp, Homo sapiens
gtaagagggaaactctggagagc

SEQ ID NO: 6347796 - DNA, 23 bp, Homo sapiens
gtaagagtactgggagaatcact

SEQ ID NO: 6347797 - DNA, 15 bp, Homo sapiens
gtaagagtgtagaag

SEQ ID NO: 6347798 - DNA, 14 bp, Homo sapiens
gtaagagtgtttat

SEQ ID NO: 6347799 - DNA, 18 bp, Homo sapiens
gtaagagtttacaagaaa

SEQ ID NO: 6347800 - DNA, 18 bp, Homo sapiens
gtaagatacaagtttcag

SEQ ID NO: 6347801 - DNA, 22 bp, Homo sapiens
gtaagatatctcaatgaaccat

SEQ ID NO: 6347802 - DNA, 15 bp, Homo sapiens
gtaagatgactctga

SEQ ID NO: 6347803 - DNA, 12 bp, Homo sapiens
gtaagatgctgg

SEQ ID NO: 6347804 - DNA, 16 bp, Homo sapiens
gtaagatgctgggttg

SEQ ID NO: 6347805 - DNA, 19 bp, Homo sapiens
gtaagatggcttatttgta

SEQ ID NO: 6347806 - DNA, 14 bp, Homo sapiens
gtaagattttgaaa

SEQ ID NO: 6347807 - DNA, 18 bp, Homo sapiens
gtaagcaattctaagtga

SEQ ID NO: 6347808 - DNA, 18 bp, Homo sapiens
gtaagcaccagctgcctc

SEQ ID NO: 6347809 - DNA, 17 bp, Homo sapiens
gtaagcatctcaatctt

SEQ ID NO: 6347810 - DNA, 17 bp, Homo sapiens
gtaagccaaagaaatga

SEQ ID NO: 6347811 - DNA, 22 bp, Homo sapiens
gtaagccaaagaaatgaacatt

SEQ ID NO: 6347812 - DNA, 14 bp, Homo sapiens
gtaagccagagcct

SEQ ID NO: 6347813 - DNA, 14 bp, Homo sapiens
gtaagccagagtca

SEQ ID NO: 6347814 - DNA, 16 bp, Homo sapiens
gtaagcccagcatttg

SEQ ID NO: 6347815 - DNA, 16 bp, Homo sapiens
gtaagcgatttgaaac

SEQ ID NO: 6347816 - DNA, 13 bp, Homo sapiens
gtaagcggaataa

SEQ ID NO: 6347817 - DNA, 15 bp, Homo sapiens
gtaagcggaataaac

SEQ ID NO: 6347818 - DNA, 22 bp, Homo sapiens
gtaagcggctcaagcccaggag

SEQ ID NO: 6347819 - DNA, 17 bp, Homo sapiens
gtaagctccatgagggc

SEQ ID NO: 6347820 - DNA, 16 bp, Homo sapiens
gtaagctctatctgca

SEQ ID NO: 6347821 - DNA, 17 bp, Homo sapiens
gtaagctctggctttct

SEQ ID NO: 6347822 - DNA, 17 bp, Homo sapiens
gtaagctgctctattgt

SEQ ID NO: 6347823 - DNA, 14 bp, Homo sapiens
gtaagctgctgaat

SEQ ID NO: 6347824 - DNA, 17 bp, Homo sapiens
gtaagctggtttacaga

SEQ ID NO: 6347825 - DNA, 13 bp, Homo sapiens
gtaagctgtgcct

SEQ ID NO: 6347826 - DNA, 16 bp, Homo sapiens
gtaagctttgttctgg

SEQ ID NO: 6347827 - DNA, 17 bp, Homo sapiens
gtaagcttttaaaatta

SEQ ID NO: 6347828 - DNA, 18 bp, Homo sapiens
gtaagcttttaagaaaaa

SEQ ID NO: 6347829 - DNA, 20 bp, Homo sapiens
gtaagcttttaagaaaaaca

SEQ ID NO: 6347830 - DNA, 21 bp, Homo sapiens
gtaagcttttaagaaaaacaa

SEQ ID NO: 6347831 - DNA, 23 bp, Homo sapiens
gtaaggaatacctgtccccctga

SEQ ID NO: 6347832 - DNA, 13 bp, Homo sapiens
gtaaggaatgatt

SEQ ID NO: 6347833 - DNA, 14 bp, Homo sapiens
gtaaggacttgtgc

SEQ ID NO: 6347834 - DNA, 16 bp, Homo sapiens
gtaaggaggagaaaat

SEQ ID NO: 6347835 - DNA, 17 bp, Homo sapiens
gtaaggcagctctgtcg

SEQ ID NO: 6347836 - DNA, 22 bp, Homo sapiens
gtaaggccttagccatgatctg

SEQ ID NO: 6347837 - DNA, 14 bp, Homo sapiens
gtaaggctctagat

SEQ ID NO: 6347838 - DNA, 17 bp, Homo sapiens
gtaaggctgtacatagt

SEQ ID NO: 6347839 - DNA, 21 bp, Homo sapiens
gtaaggctgtacatagtcctt

SEQ ID NO: 6347840 - DNA, 17 bp, Homo sapiens
gtaagggaaactgccag

SEQ ID NO: 6347841 - DNA, 15 bp, Homo sapiens
gtaagggaaatagaa

SEQ ID NO: 6347842 - DNA, 17 bp, Homo sapiens
gtaagggaataaatttt

SEQ ID NO: 6347843 - DNA, 24 bp, Homo sapiens
gtaagggaccttcagggagagctg

SEQ ID NO: 6347844 - DNA, 15 bp, Homo sapiens
gtaagggctttaaat

SEQ ID NO: 6347845 - DNA, 18 bp, Homo sapiens
gtaagggctttaaataaa

SEQ ID NO: 6347846 - DNA, 21 bp, Homo sapiens
gtaagggctttaaataaaaga

SEQ ID NO: 6347847 - DNA, 23 bp, Homo sapiens
gtaagggggggatcgaaaagaag

SEQ ID NO: 6347848 - DNA, 21 bp, Homo sapiens
gtaaggggttggtatctcagg

SEQ ID NO: 6347849 - DNA, 13 bp, Homo sapiens
gtaaggtctttgt

SEQ ID NO: 6347850 - DNA, 22 bp, Homo sapiens
gtaaggtctttgtaaaatcttg

SEQ ID NO: 6347851 - DNA, 17 bp, Homo sapiens
gtaaggtgcttggagtt

SEQ ID NO: 6347852 - DNA, 18 bp, Homo sapiens
gtaaggtgtgtactcagg

SEQ ID NO: 6347853 - DNA, 15 bp, Homo sapiens
gtaaggtttcaatgc

SEQ ID NO: 6347854 - DNA, 15 bp, Homo sapiens
gtaagtaaatgtctg

SEQ ID NO: 6347855 - DNA, 14 bp, Homo sapiens
gtaagtaacacagt

SEQ ID NO: 6347856 - DNA, 15 bp, Homo sapiens
gtaagtaacacagta

SEQ ID NO: 6347857 - DNA, 16 bp, Homo sapiens
gtaagtaagtaagaaa

SEQ ID NO: 6347858 - DNA, 20 bp, Homo sapiens
gtaagtaatatcaaagcatt

SEQ ID NO: 6347859 - DNA, 14 bp, Homo sapiens
gtaagtacagagaa

SEQ ID NO: 6347860 - DNA, 16 bp, Homo sapiens
gtaagtacagagaagc

SEQ ID NO: 6347861 - DNA, 19 bp, Homo sapiens
gtaagtacagagaagccat

SEQ ID NO: 6347862 - DNA, 16 bp, Homo sapiens
gtaagtaccacatcta

SEQ ID NO: 6347863 - DNA, 13 bp, Homo sapiens
gtaagtacttcca

SEQ ID NO: 6347864 - DNA, 15 bp, Homo sapiens
gtaagtagaggtggc

SEQ ID NO: 6347865 - DNA, 22 bp, Homo sapiens
gtaagtagcaaccctgtgatac

SEQ ID NO: 6347866 - DNA, 20 bp, Homo sapiens
gtaagtataacaaactatgt

SEQ ID NO: 6347867 - DNA, 14 bp, Homo sapiens
gtaagtataagaaa

SEQ ID NO: 6347868 - DNA, 17 bp, Homo sapiens
gtaagtcaggacagctt

SEQ ID NO: 6347869 - DNA, 14 bp, Homo sapiens
gtaagtcagtgttg

SEQ ID NO: 6347870 - DNA, 13 bp, Homo sapiens
gtaagtcatctac

SEQ ID NO: 6347871 - DNA, 15 bp, Homo sapiens
gtaagtcccccaggg

SEQ ID NO: 6347872 - DNA, 19 bp, Homo sapiens
gtaagtctgatttttaaga

SEQ ID NO: 6347873 - DNA, 22 bp, Homo sapiens
gtaagtcttttttttttccaaa

SEQ ID NO: 6347874 - DNA, 15 bp, Homo sapiens
gtaagtgaaattaag

SEQ ID NO: 6347875 - DNA, 16 bp, Homo sapiens
gtaagtgagagagaca

SEQ ID NO: 6347876 - DNA, 21 bp, Homo sapiens
gtaagtggggttgcaaccact

SEQ ID NO: 6347877 - DNA, 22 bp, Homo sapiens
gtaagtggtttttatattttca

SEQ ID NO: 6347878 - DNA, 13 bp, Homo sapiens
gtaagtgtacaat

SEQ ID NO: 6347879 - DNA, 23 bp, Homo sapiens
gtaagtgtgttcattaatgttta

SEQ ID NO: 6347880 - DNA, 16 bp, Homo sapiens
gtaagtgttctcatga

SEQ ID NO: 6347881 - DNA, 14 bp, Homo sapiens
gtaagttactgggc

SEQ ID NO: 6347882 - DNA, 17 bp, Homo sapiens
gtaagttcagcacttgt

SEQ ID NO: 6347883 - DNA, 14 bp, Homo sapiens
gtaagttctgtggt

SEQ ID NO: 6347884 - DNA, 19 bp, Homo sapiens
gtaagttgaagggaaatca

SEQ ID NO: 6347885 - DNA, 19 bp, Homo sapiens
gtaagttgagaaaaattta

SEQ ID NO: 6347886 - DNA, 21 bp, Homo sapiens
gtaagttggctcacatcatgt

SEQ ID NO: 6347887 - DNA, 23 bp, Homo sapiens
gtaagttgggcttgctattctgt

SEQ ID NO: 6347888 - DNA, 16 bp, Homo sapiens
gtaagttgtacaaatg

SEQ ID NO: 6347889 - DNA, 17 bp, Homo sapiens
gtaagttgtacaaatgt

SEQ ID NO: 6347890 - DNA, 22 bp, Homo sapiens
gtaagtttatggccttgaagtg

SEQ ID NO: 6347891 - DNA, 19 bp, Homo sapiens
gtaagtttatgtctaaaga

SEQ ID NO: 6347892 - DNA, 14 bp, Homo sapiens
gtaagtttcaggtg

SEQ ID NO: 6347893 - DNA, 14 bp, Homo sapiens
gtaagtttctaaga

SEQ ID NO: 6347894 - DNA, 18 bp, Homo sapiens
gtaagtttgcatatcagt

SEQ ID NO: 6347895 - DNA, 14 bp, Homo sapiens
gtaataaaaagaga

SEQ ID NO: 6347896 - DNA, 21 bp, Homo sapiens
gtaataaaaagagatgaaata

SEQ ID NO: 6347897 - DNA, 17 bp, Homo sapiens
gtaataaaaagcctctt

SEQ ID NO: 6347898 - DNA, 17 bp, Homo sapiens
gtaataaaaagtaacac

SEQ ID NO: 6347899 - DNA, 13 bp, Homo sapiens
gtaataaaacatt

SEQ ID NO: 6347900 - DNA, 21 bp, Homo sapiens
gtaataaaagctttgactccc

SEQ ID NO: 6347901 - DNA, 12 bp, Homo sapiens
gtaataaaatca

SEQ ID NO: 6347902 - DNA, 19 bp, Homo sapiens
gtaataaaatggtacattt

SEQ ID NO: 6347903 - DNA, 13 bp, Homo sapiens
gtaataaaattaa

SEQ ID NO: 6347904 - DNA, 10 bp, Homo sapiens
gtaataaact

SEQ ID NO: 6347905 - DNA, 21 bp, Homo sapiens
taaaatgtgtttttcagttat

SEQ ID NO: 6347906 - DNA, 21 bp, Homo sapiens
taaaatgttaaaacataaaca

SEQ ID NO: 6347907 - DNA, 17 bp, Homo sapiens
taaaatgttcacttttg

SEQ ID NO: 6347908 - DNA, 13 bp, Homo sapiens
taaaatgttcagt

SEQ ID NO: 6347909 - DNA, 15 bp, Homo sapiens
taaaatgttcctttt

SEQ ID NO: 6347910 - DNA, 15 bp, Homo sapiens
taaaatgttctcctt

SEQ ID NO: 6347911 - DNA, 15 bp, Homo sapiens
taaaatgttgaaaag

SEQ ID NO: 6347912 - DNA, 17 bp, Homo sapiens
taaaatgttgaaaagtc

SEQ ID NO: 6347913 - DNA, 13 bp, Homo sapiens
taaaatgttgaac

SEQ ID NO: 6347914 - DNA, 13 bp, Homo sapiens
taaaatgtttaca

SEQ ID NO: 6347915 - DNA, 14 bp, Homo sapiens
taaaatgtttacat

SEQ ID NO: 6347916 - DNA, 23 bp, Homo sapiens
taaaatgtttacattttctttca

SEQ ID NO: 6347917 - DNA, 19 bp, Homo sapiens
taaaatgtttactgtaaat

SEQ ID NO: 6347918 - DNA, 17 bp, Homo sapiens
taaaatgtttaggaaat

SEQ ID NO: 6347919 - DNA, 14 bp, Homo sapiens
taaaatgtttctct

SEQ ID NO: 6347920 - DNA, 21 bp, Homo sapiens
taaaatgttttatgacatttt

SEQ ID NO: 6347921 - DNA, 12 bp, Homo sapiens
taaaatgttttc

SEQ ID NO: 6347922 - DNA, 13 bp, Homo sapiens
taaaatgttttca

SEQ ID NO: 6347923 - DNA, 17 bp, Homo sapiens
taaaattaaaatttaac

SEQ ID NO: 6347924 - DNA, 12 bp, Homo sapiens
taaaattaaaga

SEQ ID NO: 6347925 - DNA, 16 bp, Homo sapiens
taaaattaaagctgaa

SEQ ID NO: 6347926 - DNA, 15 bp, Homo sapiens
taaaattaaatactt

SEQ ID NO: 6347927 - DNA, 14 bp, Homo sapiens
taaaattaaatgcc

SEQ ID NO: 6347928 - DNA, 14 bp, Homo sapiens
taaaattaagaatg

SEQ ID NO: 6347929 - DNA, 15 bp, Homo sapiens
taaaattaagttgaa

SEQ ID NO: 6347930 - DNA, 16 bp, Homo sapiens
taaaattaagttgaaa

SEQ ID NO: 6347931 - DNA, 18 bp, Homo sapiens
taaaattaagttgaaaaa

SEQ ID NO: 6347932 - DNA, 16 bp, Homo sapiens
taaaattaatatatta

SEQ ID NO: 6347933 - DNA, 17 bp, Homo sapiens
taaaattaatgtaataa

SEQ ID NO: 6347934 - DNA, 17 bp, Homo sapiens
taaaattaatttgtgca

SEQ ID NO: 6347935 - DNA, 15 bp, Homo sapiens
taaaattacagaaga

SEQ ID NO: 6347936 - DNA, 16 bp, Homo sapiens
taaaattacagaagaa

SEQ ID NO: 6347937 - DNA, 18 bp, Homo sapiens
taaaattacagtggattg

SEQ ID NO: 6347938 - DNA, 16 bp, Homo sapiens
taaaattactattctt

SEQ ID NO: 6347939 - DNA, 17 bp, Homo sapiens
taaaattacttggcttt

SEQ ID NO: 6347940 - DNA, 22 bp, Homo sapiens
taaaattagaaaaaaacaaact

SEQ ID NO: 6347941 - DNA, 21 bp, Homo sapiens
taaaattaggaacagtaaaat

SEQ ID NO: 6347942 - DNA, 20 bp, Homo sapiens
taaaattagtgagatttgta

SEQ ID NO: 6347943 - DNA, 22 bp, Homo sapiens
taaaattagtgagatttgtatt

SEQ ID NO: 6347944 - DNA, 14 bp, Homo sapiens
taaaattagtgctg

SEQ ID NO: 6347945 - DNA, 20 bp, Homo sapiens
taaaattagttttaaaatac

SEQ ID NO: 6347946 - DNA, 15 bp, Homo sapiens
taaaattataaactt

SEQ ID NO: 6347947 - DNA, 15 bp, Homo sapiens
taaaattatacctgt

SEQ ID NO: 6347948 - DNA, 20 bp, Homo sapiens
taaaattatagctctaatgt

SEQ ID NO: 6347949 - DNA, 16 bp, Homo sapiens
taaaattatatagcaa

SEQ ID NO: 6347950 - DNA, 17 bp, Homo sapiens
taaaattatatagcaaa

SEQ ID NO: 6347951 - DNA, 21 bp, Homo sapiens
taaaattatatagcaaagata

SEQ ID NO: 6347952 - DNA, 18 bp, Homo sapiens
taaaattatatagctgct

SEQ ID NO: 6347953 - DNA, 21 bp, Homo sapiens
taaaattatatagctgctcct

SEQ ID NO: 6347954 - DNA, 13 bp, Homo sapiens
taaaattatattt

SEQ ID NO: 6347955 - DNA, 19 bp, Homo sapiens
taaaattatctgttctatg

SEQ ID NO: 6347956 - DNA, 22 bp, Homo sapiens
taaaattatgagattggttttc

SEQ ID NO: 6347957 - DNA, 19 bp, Homo sapiens
taaaattatggaaacagat

SEQ ID NO: 6347958 - DNA, 15 bp, Homo sapiens
taaaattatggtgaa

SEQ ID NO: 6347959 - DNA, 19 bp, Homo sapiens
taaaattatgttactgtat

SEQ ID NO: 6347960 - DNA, 13 bp, Homo sapiens
taaaattattaaa

SEQ ID NO: 6347961 - DNA, 14 bp, Homo sapiens
taaaattattaaaa

SEQ ID NO: 6347962 - DNA, 20 bp, Homo sapiens
taaaattattaaaaattata

SEQ ID NO: 6347963 - DNA, 21 bp, Homo sapiens
taaaattattaaaaattatag

SEQ ID NO: 6347964 - DNA, 23 bp, Homo sapiens
taaaattattccctgaattgttt

SEQ ID NO: 6347965 - DNA, 14 bp, Homo sapiens
taaaattattcctt

SEQ ID NO: 6347966 - DNA, 14 bp, Homo sapiens
taaaattattttgg

SEQ ID NO: 6347967 - DNA, 21 bp, Homo sapiens
taaaattattttggattttgt

SEQ ID NO: 6347968 - DNA, 20 bp, Homo sapiens
taaaattatttttattaaat

SEQ ID NO: 6347969 - DNA, 18 bp, Homo sapiens
taaaattcaacaaatgat

SEQ ID NO: 6347970 - DNA, 23 bp, Homo sapiens
taaaattcaagaaaataaaacta

SEQ ID NO: 6347971 - DNA, 20 bp, Homo sapiens
taaaattcagtttttgtatc

SEQ ID NO: 6347972 - DNA, 23 bp, Homo sapiens
taaaattcagtttttgtatcttg

SEQ ID NO: 6347973 - DNA, 14 bp, Homo sapiens
taaaattcatatta

SEQ ID NO: 6347974 - DNA, 15 bp, Homo sapiens
taaaattcattccat

SEQ ID NO: 6347975 - DNA, 19 bp, Homo sapiens
taaaattcattccatttgc

SEQ ID NO: 6347976 - DNA, 17 bp, Homo sapiens
taaaattccaaattcat

SEQ ID NO: 6347977 - DNA, 18 bp, Homo sapiens
taaaattccattatctta

SEQ ID NO: 6347978 - DNA, 16 bp, Homo sapiens
taaaattccttctata

SEQ ID NO: 6347979 - DNA, 12 bp, Homo sapiens
taaaattctaaa

SEQ ID NO: 6347980 - DNA, 23 bp, Homo sapiens
taaaattctgatgtttctgtgaa

SEQ ID NO: 6347981 - DNA, 15 bp, Homo sapiens
taaaattctgtaatt

SEQ ID NO: 6347982 - DNA, 17 bp, Homo sapiens
taaaattcttgggagtg

SEQ ID NO: 6347983 - DNA, 18 bp, Homo sapiens
taaaattgaaaacactaa

SEQ ID NO: 6347984 - DNA, 14 bp, Homo sapiens
taaaattgcacttt

SEQ ID NO: 6347985 - DNA, 13 bp, Homo sapiens
taaaattgcagca

SEQ ID NO: 6347986 - DNA, 22 bp, Homo sapiens
taaaattgcagcagttgctagc

SEQ ID NO: 6347987 - DNA, 20 bp, Homo sapiens
taaaattgcagtttcatgta

SEQ ID NO: 6347988 - DNA, 21 bp, Homo sapiens
taaaattgcatgggttttgta

SEQ ID NO: 6347989 - DNA, 19 bp, Homo sapiens
taaaattgccatattgcac

SEQ ID NO: 6347990 - DNA, 17 bp, Homo sapiens
taaaattgctaacgttt

SEQ ID NO: 6347991 - DNA, 17 bp, Homo sapiens
taaaattgctagtgatt

SEQ ID NO: 6347992 - DNA, 23 bp, Homo sapiens
taaaattgctatgttactatttt

SEQ ID NO: 6347993 - DNA, 22 bp, Homo sapiens
taaaattggtaattgaatggaa

SEQ ID NO: 6347994 - DNA, 19 bp, Homo sapiens
taaaattggtatatttgaa

SEQ ID NO: 6347995 - DNA, 22 bp, Homo sapiens
taaaattggtatatttgaaata

SEQ ID NO: 6347996 - DNA, 14 bp, Homo sapiens
taaaattgtaaaat

SEQ ID NO: 6347997 - DNA, 15 bp, Homo sapiens
taaaattgtaaaatt

SEQ ID NO: 6347998 - DNA, 19 bp, Homo sapiens
taaaattgtaaaattgtat

SEQ ID NO: 6347999 - DNA, 22 bp, Homo sapiens
taaaattgtaaaattgtataga

SEQ ID NO: 6348000 - DNA, 18 bp, Homo sapiens
taaaattgtaacctgcat

SEQ ID NO: 6348001 - DNA, 16 bp, Homo sapiens
taaaattgtatagaga

SEQ ID NO: 6348002 - DNA, 17 bp, Homo sapiens
taaaattgtatgaaaat

SEQ ID NO: 6348003 - DNA, 21 bp, Homo sapiens
taaaattgtcacctctgttaa

SEQ ID NO: 6348004 - DNA, 13 bp, Homo sapiens
taaaattgtgcat

SEQ ID NO: 6348005 - DNA, 14 bp, Homo sapiens
taaaattgtgcata

SEQ ID NO: 6348006 - DNA, 18 bp, Homo sapiens
taaaattgtgcataatgc

SEQ ID NO: 6348007 - DNA, 21 bp, Homo sapiens
taaaattgtgttcttaaaata

SEQ ID NO: 6348008 - DNA, 15 bp, Homo sapiens
taaaattgttaacct

SEQ ID NO: 6348009 - DNA, 17 bp, Homo sapiens
taaaattgttatttcaa

SEQ ID NO: 6348010 - DNA, 18 bp, Homo sapiens
taaaattgttatttcaat

SEQ ID NO: 6348011 - DNA, 19 bp, Homo sapiens
taaaattgttctcttaaat

SEQ ID NO: 6348012 - DNA, 12 bp, Homo sapiens
taaaattgtttc

SEQ ID NO: 6348013 - DNA, 15 bp, Homo sapiens
taaaatttaaaaaac

SEQ ID NO: 6348014 - DNA, 23 bp, Homo sapiens
taaaatttaaatggcttttgcca

SEQ ID NO: 6348015 - DNA, 16 bp, Homo sapiens
taaaatttaacatctg

SEQ ID NO: 6348016 - DNA, 18 bp, Homo sapiens
taaaatttaacttcttca

SEQ ID NO: 6348017 - DNA, 23 bp, Homo sapiens
taaaatttacatttaatacagat

SEQ ID NO: 6348018 - DNA, 21 bp, Homo sapiens
taaaatttatcttaagttcta

SEQ ID NO: 6348019 - DNA, 17 bp, Homo sapiens
taaaatttattctactt

SEQ ID NO: 6348020 - DNA, 23 bp, Homo sapiens
taaaatttattgcttgatacttt

SEQ ID NO: 6348021 - DNA, 16 bp, Homo sapiens
taaaatttatttatat

SEQ ID NO: 6348022 - DNA, 15 bp, Homo sapiens
taaaatttatttcat

SEQ ID NO: 6348023 - DNA, 19 bp, Homo sapiens
taaaatttatttgcaaata

SEQ ID NO: 6348024 - DNA, 13 bp, Homo sapiens
taaaatttcaaca

SEQ ID NO: 6348025 - DNA, 22 bp, Homo sapiens
taaaatttcagggaaaacagaa

SEQ ID NO: 6348026 - DNA, 20 bp, Homo sapiens
taaaatttcataattctgaa

SEQ ID NO: 6348027 - DNA, 21 bp, Homo sapiens
taaaatttcataattctgaaa

SEQ ID NO: 6348028 - DNA, 21 bp, Homo sapiens
taaaatttcccctaatctttt

SEQ ID NO: 6348029 - DNA, 18 bp, Homo sapiens
taaaatttccttcaggtt

SEQ ID NO: 6348030 - DNA, 17 bp, Homo sapiens
taaaatttgaaacattg

SEQ ID NO: 6348031 - DNA, 16 bp, Homo sapiens
taaaatttgccctccc

SEQ ID NO: 6348032 - DNA, 13 bp, Homo sapiens
taaaatttgtaat

SEQ ID NO: 6348033 - DNA, 14 bp, Homo sapiens
taaaatttgtaata

SEQ ID NO: 6348034 - DNA, 15 bp, Homo sapiens
taaaatttgtaatat

SEQ ID NO: 6348035 - DNA, 14 bp, Homo sapiens
taaaatttgtagaa

SEQ ID NO: 6348036 - DNA, 17 bp, Homo sapiens
taaaatttgtagaattg

SEQ ID NO: 6348037 - DNA, 16 bp, Homo sapiens
taaaatttgtgtaaat

SEQ ID NO: 6348038 - DNA, 20 bp, Homo sapiens
taaaatttgttcttgtattt

SEQ ID NO: 6348039 - DNA, 14 bp, Homo sapiens
taaaatttgttgtt

SEQ ID NO: 6348040 - DNA, 18 bp, Homo sapiens
taaaattttaagctagga

SEQ ID NO: 6348041 - DNA, 13 bp, Homo sapiens
taaaattttaatt

SEQ ID NO: 6348042 - DNA, 17 bp, Homo sapiens
taaaattttaggcaagt

SEQ ID NO: 6348043 - DNA, 17 bp, Homo sapiens
taaaattttcattctga

SEQ ID NO: 6348044 - DNA, 12 bp, Homo sapiens
taaaattttcta

SEQ ID NO: 6348045 - DNA, 20 bp, Homo sapiens
taaaattttctaagattaac

SEQ ID NO: 6348046 - DNA, 19 bp, Homo sapiens
taaaattttgcctaataca

SEQ ID NO: 6348047 - DNA, 18 bp, Homo sapiens
taaaattttgctaccaaa

SEQ ID NO: 6348048 - DNA, 19 bp, Homo sapiens
taaaattttgctaccaaag

SEQ ID NO: 6348049 - DNA, 19 bp, Homo sapiens
taaaattttgcttttaatt

SEQ ID NO: 6348050 - DNA, 21 bp, Homo sapiens
taaaattttgcttttaattaa

SEQ ID NO: 6348051 - DNA, 15 bp, Homo sapiens
taaaattttggatta

SEQ ID NO: 6348052 - DNA, 19 bp, Homo sapiens
taaaattttggattaattt

SEQ ID NO: 6348053 - DNA, 18 bp, Homo sapiens
taaaattttgtgttcctt

SEQ ID NO: 6348054 - DNA, 17 bp, Homo sapiens
taaaatttttaatcttt

SEQ ID NO: 6348055 - DNA, 19 bp, Homo sapiens
taaaatttttaatctttaa

SEQ ID NO: 6348056 - DNA, 20 bp, Homo sapiens
taaaatttttatgtaattat

SEQ ID NO: 6348057 - DNA, 15 bp, Homo sapiens
taaaattttttactt

SEQ ID NO: 6348058 - DNA, 23 bp, Homo sapiens
taaaattttttgatgtcagcctt

SEQ ID NO: 6348059 - DNA, 18 bp, Homo sapiens
taaaatttttttagaaag

SEQ ID NO: 6348060 - DNA, 19 bp, Homo sapiens
taaaattttttttcatgtt

SEQ ID NO: 6348061 - DNA, 23 bp, Homo sapiens
taaacaaaaaacccacaattgaa

SEQ ID NO: 6348062 - DNA, 22 bp, Homo sapiens
taaacaaaaacacattgagttt

SEQ ID NO: 6348063 - DNA, 18 bp, Homo sapiens
taaacaaaaactttccat

SEQ ID NO: 6348064 - DNA, 19 bp, Homo sapiens
taaacaaaaactttccatg

SEQ ID NO: 6348065 - DNA, 22 bp, Homo sapiens
taaacaaaaactttccatgaca

SEQ ID NO: 6348066 - DNA, 23 bp, Homo sapiens
taaacaaaaactttccatgacag

SEQ ID NO: 6348067 - DNA, 11 bp, Homo sapiens
taaacaaaagt

SEQ ID NO: 6348068 - DNA, 18 bp, Homo sapiens
taaacaaaagtgtacctg

SEQ ID NO: 6348069 - DNA, 17 bp, Homo sapiens
taaacaaaatagaaagt

SEQ ID NO: 6348070 - DNA, 24 bp, Homo sapiens
taaacaaaatgtagacaaagtgaa

SEQ ID NO: 6348071 - DNA, 14 bp, Homo sapiens
taaacaaaattgca

SEQ ID NO: 6348072 - DNA, 17 bp, Homo sapiens
taaacaaaattgcaatt

SEQ ID NO: 6348073 - DNA, 19 bp, Homo sapiens
taaacaaaatttatgtcat

SEQ ID NO: 6348074 - DNA, 15 bp, Homo sapiens
taaacaaacaaacaa

SEQ ID NO: 6348075 - DNA, 18 bp, Homo sapiens
taaacaaacaaacaaaaa

SEQ ID NO: 6348076 - DNA, 21 bp, Homo sapiens
taaacaaacaaacaaaaattg

SEQ ID NO: 6348077 - DNA, 13 bp, Homo sapiens
taaacaaacattg

SEQ ID NO: 6348078 - DNA, 22 bp, Homo sapiens
taaacaaacattgtgttgacat

SEQ ID NO: 6348079 - DNA, 18 bp, Homo sapiens
taaacaaaccacagcagg

SEQ ID NO: 6348080 - DNA, 13 bp, Homo sapiens
taaacaaactctt

SEQ ID NO: 6348081 - DNA, 19 bp, Homo sapiens
taaacaaactgtgtaactg

SEQ ID NO: 6348082 - DNA, 12 bp, Homo sapiens
taaacaaagaca

SEQ ID NO: 6348083 - DNA, 12 bp, Homo sapiens
gtaataaactat

SEQ ID NO: 6348084 - DNA, 14 bp, Homo sapiens
gtaataaactattt

SEQ ID NO: 6348085 - DNA, 11 bp, Homo sapiens
gtaataaactc

SEQ ID NO: 6348086 - DNA, 15 bp, Homo sapiens
gtaataaactctcta

SEQ ID NO: 6348087 - DNA, 15 bp, Homo sapiens
gtaataaactttaat

SEQ ID NO: 6348088 - DNA, 10 bp, Homo sapiens
gtaataaaga

SEQ ID NO: 6348089 - DNA, 14 bp, Homo sapiens
gtaataaagagaaa

SEQ ID NO: 6348090 - DNA, 21 bp, Homo sapiens
gtaataaagatacaaaatgtt

SEQ ID NO: 6348091 - DNA, 16 bp, Homo sapiens
gtaataaagtgttttc

SEQ ID NO: 6348092 - DNA, 12 bp, Homo sapiens
gtaataaatatg

SEQ ID NO: 6348093 - DNA, 13 bp, Homo sapiens
gtaataaatatga

SEQ ID NO: 6348094 - DNA, 14 bp, Homo sapiens
gtaataaatatgag

SEQ ID NO: 6348095 - DNA, 16 bp, Homo sapiens
gtaataaatcaaaatt

SEQ ID NO: 6348096 - DNA, 23 bp, Homo sapiens
gtaataaatctaggatgtgatga

SEQ ID NO: 6348097 - DNA, 22 bp, Homo sapiens
gtaataaattcaaaacctgcag

SEQ ID NO: 6348098 - DNA, 17 bp, Homo sapiens
gtaataacacccttcct

SEQ ID NO: 6348099 - DNA, 16 bp, Homo sapiens
gtaataacatttaatt

SEQ ID NO: 6348100 - DNA, 19 bp, Homo sapiens
gtaataacattttatacaa

SEQ ID NO: 6348101 - DNA, 14 bp, Homo sapiens
gtaataagacataa

SEQ ID NO: 6348102 - DNA, 20 bp, Homo sapiens
gtaataagcactgtaaactt

SEQ ID NO: 6348103 - DNA, 22 bp, Homo sapiens
gtaataagcacttgcctggaat

SEQ ID NO: 6348104 - DNA, 12 bp, Homo sapiens
gtaataataaag

SEQ ID NO: 6348105 - DNA, 14 bp, Homo sapiens
gtaataatacctca

SEQ ID NO: 6348106 - DNA, 22 bp, Homo sapiens
gtaataatacctcaatgtttga

SEQ ID NO: 6348107 - DNA, 22 bp, Homo sapiens
gtaataatattttagaaaatgt

SEQ ID NO: 6348108 - DNA, 18 bp, Homo sapiens
gtaataatgtaatactgt

SEQ ID NO: 6348109 - DNA, 15 bp, Homo sapiens
gtaataatgtacaga

SEQ ID NO: 6348110 - DNA, 19 bp, Homo sapiens
gtaataatgtacagaggaa

SEQ ID NO: 6348111 - DNA, 17 bp, Homo sapiens
gtaataatgtgaatcat

SEQ ID NO: 6348112 - DNA, 16 bp, Homo sapiens
gtaataatgtgcaaat

SEQ ID NO: 6348113 - DNA, 17 bp, Homo sapiens
gtaatacacatatctaa

SEQ ID NO: 6348114 - DNA, 20 bp, Homo sapiens
gtaatacacatatctaaaaa

SEQ ID NO: 6348115 - DNA, 20 bp, Homo sapiens
gtaatacctgagtacccatg

SEQ ID NO: 6348116 - DNA, 17 bp, Homo sapiens
gtaatacttcttgtgtg

SEQ ID NO: 6348117 - DNA, 14 bp, Homo sapiens
gtaatacttttgta

SEQ ID NO: 6348118 - DNA, 15 bp, Homo sapiens
gtaatagagcaaaat

SEQ ID NO: 6348119 - DNA, 12 bp, Homo sapiens
gtaatagctgaa

SEQ ID NO: 6348120 - DNA, 13 bp, Homo sapiens
gtaatagcttctg

SEQ ID NO: 6348121 - DNA, 15 bp, Homo sapiens
gtaatagcttctgtg

SEQ ID NO: 6348122 - DNA, 16 bp, Homo sapiens
gtaatagcttctgtgt

SEQ ID NO: 6348123 - DNA, 14 bp, Homo sapiens
gtaataggaaaatg

SEQ ID NO: 6348124 - DNA, 13 bp, Homo sapiens
gtaataggaagaa

SEQ ID NO: 6348125 - DNA, 17 bp, Homo sapiens
gtaataggaccagagcg

SEQ ID NO: 6348126 - DNA, 17 bp, Homo sapiens
gtaataggcattttaag

SEQ ID NO: 6348127 - DNA, 12 bp, Homo sapiens
gtaatataaaag

SEQ ID NO: 6348128 - DNA, 14 bp, Homo sapiens
gtaatataaaagat

SEQ ID NO: 6348129 - DNA, 19 bp, Homo sapiens
gtaatataaagtattcaac

SEQ ID NO: 6348130 - DNA, 12 bp, Homo sapiens
gtaatataaatt

SEQ ID NO: 6348131 - DNA, 23 bp, Homo sapiens
gtaatataataatgtcctttccc

SEQ ID NO: 6348132 - DNA, 21 bp, Homo sapiens
gtaatataatacacaaaatca

SEQ ID NO: 6348133 - DNA, 19 bp, Homo sapiens
gtaatataatggaagagaa

SEQ ID NO: 6348134 - DNA, 22 bp, Homo sapiens
gtaatataatggaagagaaatc

SEQ ID NO: 6348135 - DNA, 21 bp, Homo sapiens
gtaatatacaagcaagcaaaa

SEQ ID NO: 6348136 - DNA, 15 bp, Homo sapiens
gtaatatacctggtt

SEQ ID NO: 6348137 - DNA, 15 bp, Homo sapiens
gtaatatattgctgc

SEQ ID NO: 6348138 - DNA, 16 bp, Homo sapiens
gtaatatattgctgct

SEQ ID NO: 6348139 - DNA, 16 bp, Homo sapiens
gtaatatattgtacaa

SEQ ID NO: 6348140 - DNA, 20 bp, Homo sapiens
gtaatatatttcagacattt

SEQ ID NO: 6348141 - DNA, 15 bp, Homo sapiens
gtaatatcatttcat

SEQ ID NO: 6348142 - DNA, 16 bp, Homo sapiens
gtaatatcatttcata

SEQ ID NO: 6348143 - DNA, 17 bp, Homo sapiens
gtaatatcatttcataa

SEQ ID NO: 6348144 - DNA, 15 bp, Homo sapiens
gtaatatcattttat

SEQ ID NO: 6348145 - DNA, 19 bp, Homo sapiens
gtaatatcattttatagaa

SEQ ID NO: 6348146 - DNA, 21 bp, Homo sapiens
gtaatatcattttatagaaaa

SEQ ID NO: 6348147 - DNA, 21 bp, Homo sapiens
gtaatatctattattataaaa

SEQ ID NO: 6348148 - DNA, 16 bp, Homo sapiens
gtaatatgaaagccac

SEQ ID NO: 6348149 - DNA, 14 bp, Homo sapiens
gtaatatgacagat

SEQ ID NO: 6348150 - DNA, 17 bp, Homo sapiens
gtaatatgagaatgtat

SEQ ID NO: 6348151 - DNA, 17 bp, Homo sapiens
gtaatatgcacacattt

SEQ ID NO: 6348152 - DNA, 12 bp, Homo sapiens
gtaatatgtata

SEQ ID NO: 6348153 - DNA, 15 bp, Homo sapiens
gtaatatgtctgcca

SEQ ID NO: 6348154 - DNA, 14 bp, Homo sapiens
gtaatattaaattc

SEQ ID NO: 6348155 - DNA, 23 bp, Homo sapiens
gtaatattaaattcctcctgtct

SEQ ID NO: 6348156 - DNA, 18 bp, Homo sapiens
gtaatattaactaaataa

SEQ ID NO: 6348157 - DNA, 23 bp, Homo sapiens
gtaatattgtaaatactggactc

SEQ ID NO: 6348158 - DNA, 12 bp, Homo sapiens
gtaatatttaca

SEQ ID NO: 6348159 - DNA, 23 bp, Homo sapiens
gtaatatttacaatgtattaagc

SEQ ID NO: 6348160 - DNA, 16 bp, Homo sapiens
gtaatatttattaaat

SEQ ID NO: 6348161 - DNA, 17 bp, Homo sapiens
gtaatatttattaaatt

SEQ ID NO: 6348162 - DNA, 14 bp, Homo sapiens
gtaatatttcttca

SEQ ID NO: 6348163 - DNA, 19 bp, Homo sapiens
gtaatatttcttcaagtga

SEQ ID NO: 6348164 - DNA, 18 bp, Homo sapiens
gtaatattttactttgag

SEQ ID NO: 6348165 - DNA, 17 bp, Homo sapiens
gtaatattttccataaa

SEQ ID NO: 6348166 - DNA, 18 bp, Homo sapiens
gtaatatttttatataca

SEQ ID NO: 6348167 - DNA, 17 bp, Homo sapiens
gtaatcaataaacgatt

SEQ ID NO: 6348168 - DNA, 18 bp, Homo sapiens
gtaatcaataaacgattt

SEQ ID NO: 6348169 - DNA, 21 bp, Homo sapiens
gtaatcaatacagacaaggtt

SEQ ID NO: 6348170 - DNA, 21 bp, Homo sapiens
gtaatcaatgaatattgaagt

SEQ ID NO: 6348171 - DNA, 17 bp, Homo sapiens
gtaatcactcccatttt

SEQ ID NO: 6348172 - DNA, 16 bp, Homo sapiens
gtaatcagctctcctg

SEQ ID NO: 6348173 - DNA, 18 bp, Homo sapiens
gtaatcagctctcctggc

SEQ ID NO: 6348174 - DNA, 19 bp, Homo sapiens
gtaatcagctctcctggct

SEQ ID NO: 6348175 - DNA, 16 bp, Homo sapiens
gtaatcaggattgaat

SEQ ID NO: 6348176 - DNA, 19 bp, Homo sapiens
gtaatcaggcaaggaggag

SEQ ID NO: 6348177 - DNA, 21 bp, Homo sapiens
gtaatcaggcaaggaggagga

SEQ ID NO: 6348178 - DNA, 15 bp, Homo sapiens
gtaatcaggcagcct

SEQ ID NO: 6348179 - DNA, 17 bp, Homo sapiens
gtaatcatatgtgtctt

SEQ ID NO: 6348180 - DNA, 21 bp, Homo sapiens
gtaatcatatgtgtctttata

SEQ ID NO: 6348181 - DNA, 12 bp, Homo sapiens
gtaatcatatta

SEQ ID NO: 6348182 - DNA, 24 bp, Homo sapiens
gtaatcatttatcttatctagcaa

SEQ ID NO: 6348183 - DNA, 13 bp, Homo sapiens
gtaatcattttaa

SEQ ID NO: 6348184 - DNA, 14 bp, Homo sapiens
gtaatcattttaaa

SEQ ID NO: 6348185 - DNA, 21 bp, Homo sapiens
gtaatccaagcaaatgtgaat

SEQ ID NO: 6348186 - DNA, 19 bp, Homo sapiens
gtaatccaggcacagctga

SEQ ID NO: 6348187 - DNA, 20 bp, Homo sapiens
gtaatccaggcacagctgag

SEQ ID NO: 6348188 - DNA, 15 bp, Homo sapiens
gtaatccaggggtgt

SEQ ID NO: 6348189 - DNA, 12 bp, Homo sapiens
gtaatcccagca

SEQ ID NO: 6348190 - DNA, 16 bp, Homo sapiens
gtaatcccagcacact

SEQ ID NO: 6348191 - DNA, 14 bp, Homo sapiens
gtaatcccagcact

SEQ ID NO: 6348192 - DNA, 18 bp, Homo sapiens
gtaatcccagcactttgg

SEQ ID NO: 6348193 - DNA, 20 bp, Homo sapiens
gtaatcccagcactttggga

SEQ ID NO: 6348194 - DNA, 13 bp, Homo sapiens
gtaatcccagcag

SEQ ID NO: 6348195 - DNA, 15 bp, Homo sapiens
gtaatcccagctact

SEQ ID NO: 6348196 - DNA, 20 bp, Homo sapiens
gtaatcccagctacttggga

SEQ ID NO: 6348197 - DNA, 20 bp, Homo sapiens
gtaatcccagtgacttagga

SEQ ID NO: 6348198 - DNA, 21 bp, Homo sapiens
gtaatcccagttactcaggag

SEQ ID NO: 6348199 - DNA, 18 bp, Homo sapiens
gtaatccctgctttttgt

SEQ ID NO: 6348200 - DNA, 20 bp, Homo sapiens
gtaatcctattaaaacacag

SEQ ID NO: 6348201 - DNA, 22 bp, Homo sapiens
gtaatcctcaagaaataaaagg

SEQ ID NO: 6348202 - DNA, 12 bp, Homo sapiens
gtaatcctgtag

SEQ ID NO: 6348203 - DNA, 15 bp, Homo sapiens
gtaatcgacctgcct

SEQ ID NO: 6348204 - DNA, 17 bp, Homo sapiens
gtaatcgcttaaagatg

SEQ ID NO: 6348205 - DNA, 15 bp, Homo sapiens
gtaatcgtgtcccct

SEQ ID NO: 6348206 - DNA, 18 bp, Homo sapiens
gtaatcgttatgtgtgta

SEQ ID NO: 6348207 - DNA, 22 bp, Homo sapiens
gtaatctagttgtcaataaatg

SEQ ID NO: 6348208 - DNA, 20 bp, Homo sapiens
gtaatctcgtttcaaaaaca

SEQ ID NO: 6348209 - DNA, 18 bp, Homo sapiens
gtaatctctctgcagctg

SEQ ID NO: 6348210 - DNA, 20 bp, Homo sapiens
gtaatctctctgcagctgcc

SEQ ID NO: 6348211 - DNA, 23 bp, Homo sapiens
gtaatctctgattaaatttaata

SEQ ID NO: 6348212 - DNA, 17 bp, Homo sapiens
gtaatctgatcgttctt

SEQ ID NO: 6348213 - DNA, 22 bp, Homo sapiens
gtaatctgtataatactttgta

SEQ ID NO: 6348214 - DNA, 12 bp, Homo sapiens
gtaatctgtgta

SEQ ID NO: 6348215 - DNA, 16 bp, Homo sapiens
gtaatctgtgtacaaa

SEQ ID NO: 6348216 - DNA, 17 bp, Homo sapiens
gtaatcttgggtttcta

SEQ ID NO: 6348217 - DNA, 17 bp, Homo sapiens
gtaatcttgttggttca

SEQ ID NO: 6348218 - DNA, 13 bp, Homo sapiens
gtaatctttaaac

SEQ ID NO: 6348219 - DNA, 17 bp, Homo sapiens
gtaatctttacctgtat

SEQ ID NO: 6348220 - DNA, 19 bp, Homo sapiens
gtaatctttacctgtatac

SEQ ID NO: 6348221 - DNA, 19 bp, Homo sapiens
gtaatgaaccgctgaatat

SEQ ID NO: 6348222 - DNA, 21 bp, Homo sapiens
gtaatgaaggcatatttccaa

SEQ ID NO: 6348223 - DNA, 14 bp, Homo sapiens
gtaatgacacttct

SEQ ID NO: 6348224 - DNA, 23 bp, Homo sapiens
gtaatgacagagagttctggtga

SEQ ID NO: 6348225 - DNA, 17 bp, Homo sapiens
gtaatgaccatgaaaga

SEQ ID NO: 6348226 - DNA, 20 bp, Homo sapiens
gtaatgagtcagtgaagtct

SEQ ID NO: 6348227 - DNA, 22 bp, Homo sapiens
gtaatgagttaaataaaacatt

SEQ ID NO: 6348228 - DNA, 21 bp, Homo sapiens
gtaatgatactgattatgaaa

SEQ ID NO: 6348229 - DNA, 14 bp, Homo sapiens
gtaatgatcttgga

SEQ ID NO: 6348230 - DNA, 20 bp, Homo sapiens
gtaatgatgaaatctttctt

SEQ ID NO: 6348231 - DNA, 18 bp, Homo sapiens
gtaatgatgtcgtttgaa

SEQ ID NO: 6348232 - DNA, 16 bp, Homo sapiens
gtaatgcaaaaggctg

SEQ ID NO: 6348233 - DNA, 13 bp, Homo sapiens
gtaatgcacaatt

SEQ ID NO: 6348234 - DNA, 21 bp, Homo sapiens
gtaatgcacaatttagaaaac

SEQ ID NO: 6348235 - DNA, 18 bp, Homo sapiens
gtaatgcactcctgcccc

SEQ ID NO: 6348236 - DNA, 21 bp, Homo sapiens
gtaatgcactgtttttaatct

SEQ ID NO: 6348237 - DNA, 15 bp, Homo sapiens
gtaatgcagttttta

SEQ ID NO: 6348238 - DNA, 19 bp, Homo sapiens
gtaatgccaatatgacaca

SEQ ID NO: 6348239 - DNA, 16 bp, Homo sapiens
gtaatgccagcgcttt

SEQ ID NO: 6348240 - DNA, 15 bp, Homo sapiens
gtaatgcgattttat

SEQ ID NO: 6348241 - DNA, 19 bp, Homo sapiens
gtaatgcgattttattact

SEQ ID NO: 6348242 - DNA, 16 bp, Homo sapiens
gtaatgctaaatgtgt

SEQ ID NO: 6348243 - DNA, 20 bp, Homo sapiens
gtaatgctacgtgtgatttt

SEQ ID NO: 6348244 - DNA, 12 bp, Homo sapiens
gtaatgctgcac

SEQ ID NO: 6348245 - DNA, 21 bp, Homo sapiens
gtaatgcttaagggagtttaa

SEQ ID NO: 6348246 - DNA, 20 bp, Homo sapiens
gtaatgcttagagaatgttc

SEQ ID NO: 6348247 - DNA, 20 bp, Homo sapiens
gtaatgcttccaatcttgct

SEQ ID NO: 6348248 - DNA, 15 bp, Homo sapiens
gtaatggaggccaag

SEQ ID NO: 6348249 - DNA, 20 bp, Homo sapiens
gtaatggaggtcccagccct

SEQ ID NO: 6348250 - DNA, 22 bp, Homo sapiens
gtaatggaggtcccagccctgg

SEQ ID NO: 6348251 - DNA, 14 bp, Homo sapiens
gtaatggcagagca

SEQ ID NO: 6348252 - DNA, 23 bp, Homo sapiens
gtaatgggatctatttttgcact

SEQ ID NO: 6348253 - DNA, 15 bp, Homo sapiens
gtaatgggcctgccc

SEQ ID NO: 6348254 - DNA, 17 bp, Homo sapiens
gtaatgggtaattctga

SEQ ID NO: 6348255 - DNA, 17 bp, Homo sapiens
gtaatgggtatattgat

SEQ ID NO: 6348256 - DNA, 23 bp, Homo sapiens
gtaatggtactgactttgcttgc

SEQ ID NO: 6348257 - DNA, 11 bp, Homo sapiens
gtaatggttgg

SEQ ID NO: 6348258 - DNA, 16 bp, Homo sapiens
gtaatgtaaataaact

SEQ ID NO: 6348259 - DNA, 12 bp, Homo sapiens
gtaatgtaactg

SEQ ID NO: 6348260 - DNA, 14 bp, Homo sapiens
gtaatgtaactgct

SEQ ID NO: 6348261 - DNA, 12 bp, Homo sapiens
gtaatgtagaaa

SEQ ID NO: 6348262 - DNA, 18 bp, Homo sapiens
gtaatgtagcgtgtttac

SEQ ID NO: 6348263 - DNA, 15 bp, Homo sapiens
taaacaaagacattg

SEQ ID NO: 6348264 - DNA, 13 bp, Homo sapiens
taaacaaagcagt

SEQ ID NO: 6348265 - DNA, 14 bp, Homo sapiens
taaacaaagcagta

SEQ ID NO: 6348266 - DNA, 18 bp, Homo sapiens
taaacaaagcagtatata

SEQ ID NO: 6348267 - DNA, 18 bp, Homo sapiens
taaacaaagtgactgttt

SEQ ID NO: 6348268 - DNA, 23 bp, Homo sapiens
taaacaaagtttcagagtatatt

SEQ ID NO: 6348269 - DNA, 16 bp, Homo sapiens
taaacaaatatgaaaa

SEQ ID NO: 6348270 - DNA, 16 bp, Homo sapiens
taaacaaatctttcca

SEQ ID NO: 6348271 - DNA, 16 bp, Homo sapiens
taaacaaatgtgtaat

SEQ ID NO: 6348272 - DNA, 21 bp, Homo sapiens
taaacaaattcatattctgtc

SEQ ID NO: 6348273 - DNA, 14 bp, Homo sapiens
taaacaacacctcc

SEQ ID NO: 6348274 - DNA, 20 bp, Homo sapiens
taaacaacagaaacttctca

SEQ ID NO: 6348275 - DNA, 21 bp, Homo sapiens
taaacaagaaaaataaagaaa

SEQ ID NO: 6348276 - DNA, 15 bp, Homo sapiens
taaacaagaaccatt

SEQ ID NO: 6348277 - DNA, 18 bp, Homo sapiens
taaacaagaaccatttgc

SEQ ID NO: 6348278 - DNA, 19 bp, Homo sapiens
taaacaagaaccatttgca

SEQ ID NO: 6348279 - DNA, 23 bp, Homo sapiens
taaacaagaccacgtttctaaag

SEQ ID NO: 6348280 - DNA, 18 bp, Homo sapiens
taaacaaggtcatacata

SEQ ID NO: 6348281 - DNA, 15 bp, Homo sapiens
taaacaagtaagaaa

SEQ ID NO: 6348282 - DNA, 18 bp, Homo sapiens
taaacaagtaagaaaaat

SEQ ID NO: 6348283 - DNA, 18 bp, Homo sapiens
taaacaatatcagacttt

SEQ ID NO: 6348284 - DNA, 23 bp, Homo sapiens
taaacaatgaaatattgctgtat

SEQ ID NO: 6348285 - DNA, 20 bp, Homo sapiens
taaacaatgaattcttcaac

SEQ ID NO: 6348286 - DNA, 22 bp, Homo sapiens
taaacaatgatgccctgctcca

SEQ ID NO: 6348287 - DNA, 23 bp, Homo sapiens
taaacaatgatgccctgctccag

SEQ ID NO: 6348288 - DNA, 14 bp, Homo sapiens
taaacaatgtataa

SEQ ID NO: 6348289 - DNA, 16 bp, Homo sapiens
taaacaatgtataaag

SEQ ID NO: 6348290 - DNA, 16 bp, Homo sapiens
taaacaattcaagtga

SEQ ID NO: 6348291 - DNA, 17 bp, Homo sapiens
taaacaattcatgcctt

SEQ ID NO: 6348292 - DNA, 20 bp, Homo sapiens
taaacaattcatgcctttca

SEQ ID NO: 6348293 - DNA, 18 bp, Homo sapiens
taaacacaagaaggaatc

SEQ ID NO: 6348294 - DNA, 22 bp, Homo sapiens
taaacacaagattggtgttttt

SEQ ID NO: 6348295 - DNA, 18 bp, Homo sapiens
taaacacacagatacaca

SEQ ID NO: 6348296 - DNA, 19 bp, Homo sapiens
taaacacacttagaatact

SEQ ID NO: 6348297 - DNA, 23 bp, Homo sapiens
taaacacacttttctttttaaat

SEQ ID NO: 6348298 - DNA, 14 bp, Homo sapiens
taaacacagacagg

SEQ ID NO: 6348299 - DNA, 23 bp, Homo sapiens
taaacacagaggttttaaacagt

SEQ ID NO: 6348300 - DNA, 16 bp, Homo sapiens
taaacacagtaagata

SEQ ID NO: 6348301 - DNA, 18 bp, Homo sapiens
taaacacagtcaaaataa

SEQ ID NO: 6348302 - DNA, 12 bp, Homo sapiens
taaacacagtgc

SEQ ID NO: 6348303 - DNA, 17 bp, Homo sapiens
taaacacagtgtttcct

SEQ ID NO: 6348304 - DNA, 16 bp, Homo sapiens
taaacacataaatgaa

SEQ ID NO: 6348305 - DNA, 13 bp, Homo sapiens
taaacacatagat

SEQ ID NO: 6348306 - DNA, 17 bp, Homo sapiens
taaacacatcaataaat

SEQ ID NO: 6348307 - DNA, 22 bp, Homo sapiens
taaacacattaaaggtactttg

SEQ ID NO: 6348308 - DNA, 13 bp, Homo sapiens
taaacacattttg

SEQ ID NO: 6348309 - DNA, 16 bp, Homo sapiens
taaacactacacattt

SEQ ID NO: 6348310 - DNA, 15 bp, Homo sapiens
taaacactcagctgt

SEQ ID NO: 6348311 - DNA, 16 bp, Homo sapiens
taaacactcagctgtt

SEQ ID NO: 6348312 - DNA, 17 bp, Homo sapiens
taaacactcagctgttc

SEQ ID NO: 6348313 - DNA, 14 bp, Homo sapiens
taaacactgcgctt

SEQ ID NO: 6348314 - DNA, 15 bp, Homo sapiens
taaacactggctctg

SEQ ID NO: 6348315 - DNA, 17 bp, Homo sapiens
taaacactggctctggg

SEQ ID NO: 6348316 - DNA, 14 bp, Homo sapiens
taaacactgtaatc

SEQ ID NO: 6348317 - DNA, 20 bp, Homo sapiens
taaacactgtaatcttaaaa

SEQ ID NO: 6348318 - DNA, 20 bp, Homo sapiens
taaacacttatcttctggat

SEQ ID NO: 6348319 - DNA, 16 bp, Homo sapiens
taaacacttctcctta

SEQ ID NO: 6348320 - DNA, 18 bp, Homo sapiens
taaacacttctccttaac

SEQ ID NO: 6348321 - DNA, 16 bp, Homo sapiens
taaacacttgcaacct

SEQ ID NO: 6348322 - DNA, 21 bp, Homo sapiens
taaacagaaatgctctgatta

SEQ ID NO: 6348323 - DNA, 16 bp, Homo sapiens
taaacagaaattgcaa

SEQ ID NO: 6348324 - DNA, 24 bp, Homo sapiens
taaacagaactcccttcaaaagcc

SEQ ID NO: 6348325 - DNA, 13 bp, Homo sapiens
taaacagaaggag

SEQ ID NO: 6348326 - DNA, 23 bp, Homo sapiens
taaacagactatttaacttgagg

SEQ ID NO: 6348327 - DNA, 16 bp, Homo sapiens
taaacagactgttaat

SEQ ID NO: 6348328 - DNA, 15 bp, Homo sapiens
taaacagagtccctc

SEQ ID NO: 6348329 - DNA, 21 bp, Homo sapiens
taaacagatataaatggctgg

SEQ ID NO: 6348330 - DNA, 14 bp, Homo sapiens
taaacagatatctt

SEQ ID NO: 6348331 - DNA, 19 bp, Homo sapiens
taaacagatatcttcagtt

SEQ ID NO: 6348332 - DNA, 18 bp, Homo sapiens
taaacagatgatgagaat

SEQ ID NO: 6348333 - DNA, 19 bp, Homo sapiens
taaacagatgatgagaatt

SEQ ID NO: 6348334 - DNA, 15 bp, Homo sapiens
taaacagatgtatta

SEQ ID NO: 6348335 - DNA, 16 bp, Homo sapiens
taaacagatgtccatc

SEQ ID NO: 6348336 - DNA, 16 bp, Homo sapiens
taaacagcaaagccat

SEQ ID NO: 6348337 - DNA, 18 bp, Homo sapiens
taaacagcaaagccatat

SEQ ID NO: 6348338 - DNA, 18 bp, Homo sapiens
taaacagcaactacagaa

SEQ ID NO: 6348339 - DNA, 14 bp, Homo sapiens
taaacagcacacct

SEQ ID NO: 6348340 - DNA, 13 bp, Homo sapiens
taaacagcagggt

SEQ ID NO: 6348341 - DNA, 21 bp, Homo sapiens
taaacagcagggtttgagcac

SEQ ID NO: 6348342 - DNA, 22 bp, Homo sapiens
taaacagcagtgttccccatct

SEQ ID NO: 6348343 - DNA, 12 bp, Homo sapiens
taaacagcattt

SEQ ID NO: 6348344 - DNA, 14 bp, Homo sapiens
taaacagcatttat

SEQ ID NO: 6348345 - DNA, 19 bp, Homo sapiens
taaacagcatttattacct

SEQ ID NO: 6348346 - DNA, 14 bp, Homo sapiens
taaacagctattta

SEQ ID NO: 6348347 - DNA, 13 bp, Homo sapiens
taaacagctgctt

SEQ ID NO: 6348348 - DNA, 12 bp, Homo sapiens
taaacaggccca

SEQ ID NO: 6348349 - DNA, 14 bp, Homo sapiens
taaacaggcccagc

SEQ ID NO: 6348350 - DNA, 17 bp, Homo sapiens
taaacagtaagatatct

SEQ ID NO: 6348351 - DNA, 17 bp, Homo sapiens
taaacagtagttgtatt

SEQ ID NO: 6348352 - DNA, 21 bp, Homo sapiens
taaacagtatattctttggtt

SEQ ID NO: 6348353 - DNA, 23 bp, Homo sapiens
taaacagtgagaaaagaaaggct

SEQ ID NO: 6348354 - DNA, 19 bp, Homo sapiens
taaacagtgagcatatctg

SEQ ID NO: 6348355 - DNA, 23 bp, Homo sapiens
taaacagtgagcctgaattttgt

SEQ ID NO: 6348356 - DNA, 12 bp, Homo sapiens
taaacagtgcct

SEQ ID NO: 6348357 - DNA, 18 bp, Homo sapiens
taaacagtgcctgctgaa

SEQ ID NO: 6348358 - DNA, 16 bp, Homo sapiens
taaacagtgtttatga

SEQ ID NO: 6348359 - DNA, 14 bp, Homo sapiens
taaacagttatttc

SEQ ID NO: 6348360 - DNA, 17 bp, Homo sapiens
taaacagttatttctgt

SEQ ID NO: 6348361 - DNA, 18 bp, Homo sapiens
taaacagttgaataattt

SEQ ID NO: 6348362 - DNA, 19 bp, Homo sapiens
taaacagttgcacagcatc

SEQ ID NO: 6348363 - DNA, 21 bp, Homo sapiens
taaacagttttccttatcaga

SEQ ID NO: 6348364 - DNA, 17 bp, Homo sapiens
taaacataaataaatat

SEQ ID NO: 6348365 - DNA, 16 bp, Homo sapiens
taaacataagctaaat

SEQ ID NO: 6348366 - DNA, 15 bp, Homo sapiens
taaacataagttgca

SEQ ID NO: 6348367 - DNA, 19 bp, Homo sapiens
taaacataagttgcattta

SEQ ID NO: 6348368 - DNA, 15 bp, Homo sapiens
taaacataataaatc

SEQ ID NO: 6348369 - DNA, 16 bp, Homo sapiens
taaacataataaatca

SEQ ID NO: 6348370 - DNA, 22 bp, Homo sapiens
taaacataataaatcacacatt

SEQ ID NO: 6348371 - DNA, 23 bp, Homo sapiens
taaacataattgtggattataaa

SEQ ID NO: 6348372 - DNA, 19 bp, Homo sapiens
taaacatagtcagctctga

SEQ ID NO: 6348373 - DNA, 19 bp, Homo sapiens
taaacatagtggtatttta

SEQ ID NO: 6348374 - DNA, 19 bp, Homo sapiens
taaacatatacagaaaaat

SEQ ID NO: 6348375 - DNA, 15 bp, Homo sapiens
taaacatatgatttc

SEQ ID NO: 6348376 - DNA, 15 bp, Homo sapiens
taaacatatggcttt

SEQ ID NO: 6348377 - DNA, 16 bp, Homo sapiens
taaacatattcaagga

SEQ ID NO: 6348378 - DNA, 15 bp, Homo sapiens
taaacatcaatcttt

SEQ ID NO: 6348379 - DNA, 15 bp, Homo sapiens
taaacatcacacaca

SEQ ID NO: 6348380 - DNA, 15 bp, Homo sapiens
taaacatcattcatt

SEQ ID NO: 6348381 - DNA, 17 bp, Homo sapiens
taaacatccaatatttt

SEQ ID NO: 6348382 - DNA, 16 bp, Homo sapiens
taaacatccttgtaca

SEQ ID NO: 6348383 - DNA, 19 bp, Homo sapiens
taaacatctagcagtaaat

SEQ ID NO: 6348384 - DNA, 22 bp, Homo sapiens
taaacatctagcagtaaatact

SEQ ID NO: 6348385 - DNA, 14 bp, Homo sapiens
taaacatctgatct

SEQ ID NO: 6348386 - DNA, 16 bp, Homo sapiens
taaacatctgatctgt

SEQ ID NO: 6348387 - DNA, 15 bp, Homo sapiens
taaacatctgtgtct

SEQ ID NO: 6348388 - DNA, 13 bp, Homo sapiens
taaacatgaattt

SEQ ID NO: 6348389 - DNA, 16 bp, Homo sapiens
taaacatgaatttaat

SEQ ID NO: 6348390 - DNA, 17 bp, Homo sapiens
taaacatgaatttaatg

SEQ ID NO: 6348391 - DNA, 17 bp, Homo sapiens
taaacatgaccctgggc

SEQ ID NO: 6348392 - DNA, 15 bp, Homo sapiens
taaacatgattatct

SEQ ID NO: 6348393 - DNA, 16 bp, Homo sapiens
taaacatggttacaat

SEQ ID NO: 6348394 - DNA, 16 bp, Homo sapiens
taaacatgtccccttc

SEQ ID NO: 6348395 - DNA, 13 bp, Homo sapiens
taaacatgtttaa

SEQ ID NO: 6348396 - DNA, 14 bp, Homo sapiens
taaacattaaaaga

SEQ ID NO: 6348397 - DNA, 17 bp, Homo sapiens
taaacattaagtaaatg

SEQ ID NO: 6348398 - DNA, 20 bp, Homo sapiens
taaacattaatagcagcctt

SEQ ID NO: 6348399 - DNA, 21 bp, Homo sapiens
taaacattaatagcagccttt

SEQ ID NO: 6348400 - DNA, 22 bp, Homo sapiens
taaacattaatcaatcatctgt

SEQ ID NO: 6348401 - DNA, 20 bp, Homo sapiens
taaacattaattttgtgcat

SEQ ID NO: 6348402 - DNA, 23 bp, Homo sapiens
taaacattagttctatttctatc

SEQ ID NO: 6348403 - DNA, 13 bp, Homo sapiens
taaacattcatat

SEQ ID NO: 6348404 - DNA, 15 bp, Homo sapiens
taaacattcatattt

SEQ ID NO: 6348405 - DNA, 15 bp, Homo sapiens
taaacattcctccag

SEQ ID NO: 6348406 - DNA, 23 bp, Homo sapiens
taaacattcctccagcctcccct

SEQ ID NO: 6348407 - DNA, 20 bp, Homo sapiens
taaacattgacgattccttc

SEQ ID NO: 6348408 - DNA, 19 bp, Homo sapiens
taaacattggttcttgtat

SEQ ID NO: 6348409 - DNA, 21 bp, Homo sapiens
taaacattgtgatgattatta

SEQ ID NO: 6348410 - DNA, 19 bp, Homo sapiens
taaacatttgtaaaaatac

SEQ ID NO: 6348411 - DNA, 16 bp, Homo sapiens
taaacatttgttcctg

SEQ ID NO: 6348412 - DNA, 20 bp, Homo sapiens
taaacatttttcacatctct

SEQ ID NO: 6348413 - DNA, 17 bp, Homo sapiens
taaaccaaaacacccca

SEQ ID NO: 6348414 - DNA, 21 bp, Homo sapiens
taaaccaaaacaccccaactt

SEQ ID NO: 6348415 - DNA, 17 bp, Homo sapiens
taaaccaaacccagcca

SEQ ID NO: 6348416 - DNA, 19 bp, Homo sapiens
taaaccaaacggaactctt

SEQ ID NO: 6348417 - DNA, 21 bp, Homo sapiens
taaaccaaaggacattatgtg

SEQ ID NO: 6348418 - DNA, 13 bp, Homo sapiens
taaaccaaccttt

SEQ ID NO: 6348419 - DNA, 23 bp, Homo sapiens
taaaccaacctttaaaattgtca

SEQ ID NO: 6348420 - DNA, 17 bp, Homo sapiens
taaaccaactctaatat

SEQ ID NO: 6348421 - DNA, 15 bp, Homo sapiens
taaaccaaggactga

SEQ ID NO: 6348422 - DNA, 19 bp, Homo sapiens
taaaccaagttatttttct

SEQ ID NO: 6348423 - DNA, 15 bp, Homo sapiens
taaaccaataaaaca

SEQ ID NO: 6348424 - DNA, 16 bp, Homo sapiens
taaaccaatgaagaag

SEQ ID NO: 6348425 - DNA, 18 bp, Homo sapiens
taaaccaatgaagaagac

SEQ ID NO: 6348426 - DNA, 21 bp, Homo sapiens
taaaccaatgaagaagacaaa

SEQ ID NO: 6348427 - DNA, 16 bp, Homo sapiens
taaaccacaaaagttg

SEQ ID NO: 6348428 - DNA, 21 bp, Homo sapiens
taaaccacaaggctgttgcat

SEQ ID NO: 6348429 - DNA, 23 bp, Homo sapiens
taaaccacacacacaaggtgctc

SEQ ID NO: 6348430 - DNA, 17 bp, Homo sapiens
taaaccacatcatggac

SEQ ID NO: 6348431 - DNA, 18 bp, Homo sapiens
taaaccaccctctgggga

SEQ ID NO: 6348432 - DNA, 22 bp, Homo sapiens
taaaccacttctctgctgcctc

SEQ ID NO: 6348433 - DNA, 17 bp, Homo sapiens
taaaccacttgagccta

SEQ ID NO: 6348434 - DNA, 20 bp, Homo sapiens
taaaccagaaaaaataaatg

SEQ ID NO: 6348435 - DNA, 13 bp, Homo sapiens
taaaccagaagga

SEQ ID NO: 6348436 - DNA, 14 bp, Homo sapiens
taaaccagaaggaa

SEQ ID NO: 6348437 - DNA, 16 bp, Homo sapiens
taaaccagaaggaagc

SEQ ID NO: 6348438 - DNA, 22 bp, Homo sapiens
taaaccagaaggaagccctctc

SEQ ID NO: 6348439 - DNA, 11 bp, Homo sapiens
taaaccagcag

SEQ ID NO: 6348440 - DNA, 13 bp, Homo sapiens
taaaccagcagaa

SEQ ID NO: 6348441 - DNA, 20 bp, Homo sapiens
gtaatgtagggttatatttg

SEQ ID NO: 6348442 - DNA, 21 bp, Homo sapiens
gtaatgtagggttatatttgg

SEQ ID NO: 6348443 - DNA, 17 bp, Homo sapiens
gtaatgtagttctttgt

SEQ ID NO: 6348444 - DNA, 17 bp, Homo sapiens
gtaatgtatacttgaaa

SEQ ID NO: 6348445 - DNA, 12 bp, Homo sapiens
gtaatgtcacca

SEQ ID NO: 6348446 - DNA, 17 bp, Homo sapiens
gtaatgtcagactttgc

SEQ ID NO: 6348447 - DNA, 22 bp, Homo sapiens
gtaatgtcagactttgctgcat

SEQ ID NO: 6348448 - DNA, 13 bp, Homo sapiens
gtaatgtgaatct

SEQ ID NO: 6348449 - DNA, 20 bp, Homo sapiens
gtaatgtgtatgtctggtaa

SEQ ID NO: 6348450 - DNA, 17 bp, Homo sapiens
gtaatgtgtcaaagaga

SEQ ID NO: 6348451 - DNA, 20 bp, Homo sapiens
gtaatgtgtggtggcctcag

SEQ ID NO: 6348452 - DNA, 17 bp, Homo sapiens
gtaatgtgttttagagt

SEQ ID NO: 6348453 - DNA, 20 bp, Homo sapiens
gtaatgttactgatcatgca

SEQ ID NO: 6348454 - DNA, 23 bp, Homo sapiens
gtaatgttactgatcatgcattg

SEQ ID NO: 6348455 - DNA, 15 bp, Homo sapiens
gtaatgttgtgaata

SEQ ID NO: 6348456 - DNA, 17 bp, Homo sapiens
gtaatgtttttatttca

SEQ ID NO: 6348457 - DNA, 19 bp, Homo sapiens
gtaattaaaagactccaca

SEQ ID NO: 6348458 - DNA, 20 bp, Homo sapiens
gtaattaaaagcaaatcatt

SEQ ID NO: 6348459 - DNA, 21 bp, Homo sapiens
gtaattaaaagcaaatcattt

SEQ ID NO: 6348460 - DNA, 16 bp, Homo sapiens
gtaattaaactgttaa

SEQ ID NO: 6348461 - DNA, 15 bp, Homo sapiens
gtaattaaattgtaa

SEQ ID NO: 6348462 - DNA, 14 bp, Homo sapiens
gtaattaaattttt

SEQ ID NO: 6348463 - DNA, 17 bp, Homo sapiens
gtaattaactgtaaact

SEQ ID NO: 6348464 - DNA, 15 bp, Homo sapiens
gtaattaaggtacat

SEQ ID NO: 6348465 - DNA, 17 bp, Homo sapiens
gtaattaaggtacatca

SEQ ID NO: 6348466 - DNA, 21 bp, Homo sapiens
gtaattaaggtacatcattat

SEQ ID NO: 6348467 - DNA, 14 bp, Homo sapiens
gtaattaagtacta

SEQ ID NO: 6348468 - DNA, 16 bp, Homo sapiens
gtaattaataaagaaa

SEQ ID NO: 6348469 - DNA, 21 bp, Homo sapiens
gtaattaataaagaaaaagaa

SEQ ID NO: 6348470 - DNA, 21 bp, Homo sapiens
gtaattaataactttctctgt

SEQ ID NO: 6348471 - DNA, 22 bp, Homo sapiens
gtaattaatatctcctggaaca

SEQ ID NO: 6348472 - DNA, 16 bp, Homo sapiens
gtaattacatatttga

SEQ ID NO: 6348473 - DNA, 14 bp, Homo sapiens
gtaattacattaaa

SEQ ID NO: 6348474 - DNA, 20 bp, Homo sapiens
gtaattaggataactaaaat

SEQ ID NO: 6348475 - DNA, 21 bp, Homo sapiens
gtaattagtgccacttaatgt

SEQ ID NO: 6348476 - DNA, 14 bp, Homo sapiens
gtaattagtttaaa

SEQ ID NO: 6348477 - DNA, 13 bp, Homo sapiens
gtaattatgtacc

SEQ ID NO: 6348478 - DNA, 18 bp, Homo sapiens
gtaattattatttaactc

SEQ ID NO: 6348479 - DNA, 12 bp, Homo sapiens
gtaattattgtg

SEQ ID NO: 6348480 - DNA, 23 bp, Homo sapiens
gtaattattgtgatttcccgtgg

SEQ ID NO: 6348481 - DNA, 15 bp, Homo sapiens
gtaattatttgaatg

SEQ ID NO: 6348482 - DNA, 17 bp, Homo sapiens
gtaattattttggtact

SEQ ID NO: 6348483 - DNA, 18 bp, Homo sapiens
gtaattcaactggaaatt

SEQ ID NO: 6348484 - DNA, 15 bp, Homo sapiens
gtaattcaagaggcc

SEQ ID NO: 6348485 - DNA, 14 bp, Homo sapiens
gtaattcaggactc

SEQ ID NO: 6348486 - DNA, 17 bp, Homo sapiens
gtaattcaggtttttcc

SEQ ID NO: 6348487 - DNA, 22 bp, Homo sapiens
gtaattcatctgtgaatctgct

SEQ ID NO: 6348488 - DNA, 23 bp, Homo sapiens
gtaattccacatcatgttacttg

SEQ ID NO: 6348489 - DNA, 17 bp, Homo sapiens
gtaattcctctccaggc

SEQ ID NO: 6348490 - DNA, 14 bp, Homo sapiens
gtaattctaaatga

SEQ ID NO: 6348491 - DNA, 18 bp, Homo sapiens
gtaattctaaatgaatgt

SEQ ID NO: 6348492 - DNA, 18 bp, Homo sapiens
gtaattctaataatgcac

SEQ ID NO: 6348493 - DNA, 17 bp, Homo sapiens
gtaattcttattctttc

SEQ ID NO: 6348494 - DNA, 20 bp, Homo sapiens
gtaattcttctcctttgtca

SEQ ID NO: 6348495 - DNA, 13 bp, Homo sapiens
gtaattctttctg

SEQ ID NO: 6348496 - DNA, 14 bp, Homo sapiens
gtaattctttctgt

SEQ ID NO: 6348497 - DNA, 20 bp, Homo sapiens
gtaattctttctgtctccct

SEQ ID NO: 6348498 - DNA, 17 bp, Homo sapiens
gtaattgacagagtaaa

SEQ ID NO: 6348499 - DNA, 17 bp, Homo sapiens
gtaattgcatttctgct

SEQ ID NO: 6348500 - DNA, 12 bp, Homo sapiens
gtaattgcttac

SEQ ID NO: 6348501 - DNA, 16 bp, Homo sapiens
gtaattgcttacattt

SEQ ID NO: 6348502 - DNA, 17 bp, Homo sapiens
gtaattgcttacatttt

SEQ ID NO: 6348503 - DNA, 22 bp, Homo sapiens
gtaattgcttacatttttacaa

SEQ ID NO: 6348504 - DNA, 17 bp, Homo sapiens
gtaattgctttgtgcct

SEQ ID NO: 6348505 - DNA, 12 bp, Homo sapiens
gtaattgctttt

SEQ ID NO: 6348506 - DNA, 15 bp, Homo sapiens
gtaattggaaaggca

SEQ ID NO: 6348507 - DNA, 21 bp, Homo sapiens
gtaattggtgacaatgtcaca

SEQ ID NO: 6348508 - DNA, 12 bp, Homo sapiens
gtaattgtacaa

SEQ ID NO: 6348509 - DNA, 15 bp, Homo sapiens
gtaattgtacaataa

SEQ ID NO: 6348510 - DNA, 18 bp, Homo sapiens
gtaattgtccctctgtgg

SEQ ID NO: 6348511 - DNA, 15 bp, Homo sapiens
gtaattgtctcaaag

SEQ ID NO: 6348512 - DNA, 13 bp, Homo sapiens
gtaattgtgaaaa

SEQ ID NO: 6348513 - DNA, 14 bp, Homo sapiens
gtaattgtgaaaaa

SEQ ID NO: 6348514 - DNA, 19 bp, Homo sapiens
gtaattgtggattaatgtc

SEQ ID NO: 6348515 - DNA, 22 bp, Homo sapiens
gtaattgtggattaatgtcaat

SEQ ID NO: 6348516 - DNA, 17 bp, Homo sapiens
gtaattgtgtaaaaaat

SEQ ID NO: 6348517 - DNA, 21 bp, Homo sapiens
gtaattgtgtggattctttaa

SEQ ID NO: 6348518 - DNA, 13 bp, Homo sapiens
gtaattgtgttta

SEQ ID NO: 6348519 - DNA, 17 bp, Homo sapiens
gtaattgtgtttacatt

SEQ ID NO: 6348520 - DNA, 21 bp, Homo sapiens
gtaattgttccagagacaaat

SEQ ID NO: 6348521 - DNA, 14 bp, Homo sapiens
gtaattgttccttt

SEQ ID NO: 6348522 - DNA, 21 bp, Homo sapiens
gtaattgttgctaatcttctt

SEQ ID NO: 6348523 - DNA, 21 bp, Homo sapiens
gtaattgttgtttgtatgtat

SEQ ID NO: 6348524 - DNA, 16 bp, Homo sapiens
gtaattgttttggaat

SEQ ID NO: 6348525 - DNA, 22 bp, Homo sapiens
gtaatttaaaacttttgtttaa

SEQ ID NO: 6348526 - DNA, 20 bp, Homo sapiens
gtaatttaaaattgtgatgt

SEQ ID NO: 6348527 - DNA, 23 bp, Homo sapiens
gtaatttaaaattgtgatgtgtc

SEQ ID NO: 6348528 - DNA, 19 bp, Homo sapiens
gtaatttaaacaggcccag

SEQ ID NO: 6348529 - DNA, 20 bp, Homo sapiens
gtaatttaaacaggcccagc

SEQ ID NO: 6348530 - DNA, 19 bp, Homo sapiens
gtaatttaaatgaaagaaa

SEQ ID NO: 6348531 - DNA, 21 bp, Homo sapiens
gtaatttaagtgacacagaca

SEQ ID NO: 6348532 - DNA, 21 bp, Homo sapiens
gtaatttaattccccttccct

SEQ ID NO: 6348533 - DNA, 17 bp, Homo sapiens
gtaatttaatttgtaaa

SEQ ID NO: 6348534 - DNA, 18 bp, Homo sapiens
gtaatttaatttgtaaaa

SEQ ID NO: 6348535 - DNA, 18 bp, Homo sapiens
gtaatttagaaatcattt

SEQ ID NO: 6348536 - DNA, 20 bp, Homo sapiens
gtaatttagaagatattatt

SEQ ID NO: 6348537 - DNA, 18 bp, Homo sapiens
gtaatttagattgtaaac

SEQ ID NO: 6348538 - DNA, 19 bp, Homo sapiens
gtaatttagggtactaaat

SEQ ID NO: 6348539 - DNA, 20 bp, Homo sapiens
gtaatttagggtactaaatt

SEQ ID NO: 6348540 - DNA, 19 bp, Homo sapiens
gtaatttagtctaacacag

SEQ ID NO: 6348541 - DNA, 13 bp, Homo sapiens
gtaatttagtgta

SEQ ID NO: 6348542 - DNA, 22 bp, Homo sapiens
gtaatttagtgtatatgtgatt

SEQ ID NO: 6348543 - DNA, 18 bp, Homo sapiens
gtaatttagttaataaaa

SEQ ID NO: 6348544 - DNA, 20 bp, Homo sapiens
gtaatttatagtttatacag

SEQ ID NO: 6348545 - DNA, 14 bp, Homo sapiens
gtaatttcatttaa

SEQ ID NO: 6348546 - DNA, 13 bp, Homo sapiens
gtaatttcctaga

SEQ ID NO: 6348547 - DNA, 22 bp, Homo sapiens
gtaatttcctgagctaaatgct

SEQ ID NO: 6348548 - DNA, 12 bp, Homo sapiens
gtaatttctgcc

SEQ ID NO: 6348549 - DNA, 21 bp, Homo sapiens
gtaatttctttttttcctttt

SEQ ID NO: 6348550 - DNA, 13 bp, Homo sapiens
gtaatttgaagat

SEQ ID NO: 6348551 - DNA, 19 bp, Homo sapiens
gtaatttgaagatgtggat

SEQ ID NO: 6348552 - DNA, 14 bp, Homo sapiens
gtaatttgaagatt

SEQ ID NO: 6348553 - DNA, 23 bp, Homo sapiens
gtaatttgagagaaatatgaaga

SEQ ID NO: 6348554 - DNA, 18 bp, Homo sapiens
gtaatttggtttaaaaat

SEQ ID NO: 6348555 - DNA, 13 bp, Homo sapiens
gtaatttgtaaag

SEQ ID NO: 6348556 - DNA, 14 bp, Homo sapiens
gtaatttgtatctg

SEQ ID NO: 6348557 - DNA, 20 bp, Homo sapiens
gtaatttgtgatacaatgct

SEQ ID NO: 6348558 - DNA, 20 bp, Homo sapiens
gtaatttgtgtaataaagtg

SEQ ID NO: 6348559 - DNA, 22 bp, Homo sapiens
gtaatttgttatatcagcagac

SEQ ID NO: 6348560 - DNA, 17 bp, Homo sapiens
gtaattttaaaagtcta

SEQ ID NO: 6348561 - DNA, 13 bp, Homo sapiens
gtaattttaaagt

SEQ ID NO: 6348562 - DNA, 15 bp, Homo sapiens
gtaattttatatgaa

SEQ ID NO: 6348563 - DNA, 16 bp, Homo sapiens
gtaattttattttaaa

SEQ ID NO: 6348564 - DNA, 18 bp, Homo sapiens
gtaattttcatattaaac

SEQ ID NO: 6348565 - DNA, 17 bp, Homo sapiens
gtaattttcttctcatt

SEQ ID NO: 6348566 - DNA, 18 bp, Homo sapiens
gtaattttcttgatgact

SEQ ID NO: 6348567 - DNA, 14 bp, Homo sapiens
gtaattttggattt

SEQ ID NO: 6348568 - DNA, 16 bp, Homo sapiens
gtaattttgtgtaaga

SEQ ID NO: 6348569 - DNA, 20 bp, Homo sapiens
gtaattttgtgtaagaaata

SEQ ID NO: 6348570 - DNA, 19 bp, Homo sapiens
gtaattttgttcctgttta

SEQ ID NO: 6348571 - DNA, 21 bp, Homo sapiens
gtaattttgttctagttttca

SEQ ID NO: 6348572 - DNA, 15 bp, Homo sapiens
gtaattttgtttgta

SEQ ID NO: 6348573 - DNA, 18 bp, Homo sapiens
gtaattttgtttgtaatc

SEQ ID NO: 6348574 - DNA, 22 bp, Homo sapiens
gtaatttttaccctaatgtctt

SEQ ID NO: 6348575 - DNA, 13 bp, Homo sapiens
gtaatttttgctc

SEQ ID NO: 6348576 - DNA, 23 bp, Homo sapiens
gtaatttttgctccaatatccat

SEQ ID NO: 6348577 - DNA, 21 bp, Homo sapiens
gtaatttttttaatttacaaa

SEQ ID NO: 6348578 - DNA, 16 bp, Homo sapiens
gtaatttttttctagt

SEQ ID NO: 6348579 - DNA, 19 bp, Homo sapiens
gtaatttttttgaaaaaag

SEQ ID NO: 6348580 - DNA, 19 bp, Homo sapiens
gtaatttttttttgtaaag

SEQ ID NO: 6348581 - DNA, 21 bp, Homo sapiens
gtacaaaaaaataatcaagtg

SEQ ID NO: 6348582 - DNA, 21 bp, Homo sapiens
gtacaaaaaagttataagaaa

SEQ ID NO: 6348583 - DNA, 22 bp, Homo sapiens
gtacaaaaaagttataagaaaa

SEQ ID NO: 6348584 - DNA, 13 bp, Homo sapiens
gtacaaaaacaca

SEQ ID NO: 6348585 - DNA, 18 bp, Homo sapiens
gtacaaaaataaatttat

SEQ ID NO: 6348586 - DNA, 16 bp, Homo sapiens
gtacaaaagggacatg

SEQ ID NO: 6348587 - DNA, 16 bp, Homo sapiens
gtacaaaatggtccta

SEQ ID NO: 6348588 - DNA, 13 bp, Homo sapiens
gtacaaaattgcc

SEQ ID NO: 6348589 - DNA, 15 bp, Homo sapiens
gtacaaacagtattt

SEQ ID NO: 6348590 - DNA, 15 bp, Homo sapiens
gtacaaacatgaaaa

SEQ ID NO: 6348591 - DNA, 21 bp, Homo sapiens
gtacaaactaactaataaaat

SEQ ID NO: 6348592 - DNA, 17 bp, Homo sapiens
gtacaaactatttcaga

SEQ ID NO: 6348593 - DNA, 14 bp, Homo sapiens
gtacaaagacaggg

SEQ ID NO: 6348594 - DNA, 15 bp, Homo sapiens
gtacaaagacaggga

SEQ ID NO: 6348595 - DNA, 14 bp, Homo sapiens
gtacaaagggaagc

SEQ ID NO: 6348596 - DNA, 14 bp, Homo sapiens
gtacaaagtagaga

SEQ ID NO: 6348597 - DNA, 15 bp, Homo sapiens
gtacaaagtagagaa

SEQ ID NO: 6348598 - DNA, 18 bp, Homo sapiens
gtacaaagtagagaagta

SEQ ID NO: 6348599 - DNA, 14 bp, Homo sapiens
gtacaaagttttcc

SEQ ID NO: 6348600 - DNA, 18 bp, Homo sapiens
gtacaaagttttcctttg

SEQ ID NO: 6348601 - DNA, 15 bp, Homo sapiens
gtacaaataaacctg

SEQ ID NO: 6348602 - DNA, 19 bp, Homo sapiens
gtacaaataatattgcctt

SEQ ID NO: 6348603 - DNA, 12 bp, Homo sapiens
gtacaaatactg

SEQ ID NO: 6348604 - DNA, 22 bp, Homo sapiens
gtacaaatataagaataaaatg

SEQ ID NO: 6348605 - DNA, 22 bp, Homo sapiens
gtacaaatgccttaaaatggaa

SEQ ID NO: 6348606 - DNA, 19 bp, Homo sapiens
gtacaaatgtgataatata

SEQ ID NO: 6348607 - DNA, 23 bp, Homo sapiens
gtacaaattgtcgtttttattcc

SEQ ID NO: 6348608 - DNA, 19 bp, Homo sapiens
gtacaaattgttcatgtta

SEQ ID NO: 6348609 - DNA, 20 bp, Homo sapiens
gtacaaccccctccaccccc

SEQ ID NO: 6348610 - DNA, 15 bp, Homo sapiens
gtacaacggaggcct

SEQ ID NO: 6348611 - DNA, 13 bp, Homo sapiens
gtacaactgtatt

SEQ ID NO: 6348612 - DNA, 15 bp, Homo sapiens
gtacaactgtattta

SEQ ID NO: 6348613 - DNA, 17 bp, Homo sapiens
gtacaagagtccctttg

SEQ ID NO: 6348614 - DNA, 16 bp, Homo sapiens
gtacaagctcttgttt

SEQ ID NO: 6348615 - DNA, 23 bp, Homo sapiens
gtacaagctcttgtttctgttta

SEQ ID NO: 6348616 - DNA, 17 bp, Homo sapiens
gtacaaggcgatcccat

SEQ ID NO: 6348617 - DNA, 19 bp, Homo sapiens
gtacaaggggcccagtgct

SEQ ID NO: 6348618 - DNA, 16 bp, Homo sapiens
gtacaaggtaattgtt

SEQ ID NO: 6348619 - DNA, 14 bp, Homo sapiens
taaaccagcagaaa

SEQ ID NO: 6348620 - DNA, 15 bp, Homo sapiens
taaaccagcagaaaa

SEQ ID NO: 6348621 - DNA, 20 bp, Homo sapiens
taaaccagcagaaaagtgct

SEQ ID NO: 6348622 - DNA, 18 bp, Homo sapiens
taaaccaggtttgcacct

SEQ ID NO: 6348623 - DNA, 13 bp, Homo sapiens
taaaccagtgtga

SEQ ID NO: 6348624 - DNA, 15 bp, Homo sapiens
taaaccagtgtgaac

SEQ ID NO: 6348625 - DNA, 16 bp, Homo sapiens
taaaccagtgtgaacc

SEQ ID NO: 6348626 - DNA, 17 bp, Homo sapiens
taaaccataaaaagctg

SEQ ID NO: 6348627 - DNA, 18 bp, Homo sapiens
taaaccatgggataaatg

SEQ ID NO: 6348628 - DNA, 21 bp, Homo sapiens
taaaccatgggataaatgcca

SEQ ID NO: 6348629 - DNA, 21 bp, Homo sapiens
taaaccatttttgctgaattc

SEQ ID NO: 6348630 - DNA, 20 bp, Homo sapiens
taaacccacaagctgcctct

SEQ ID NO: 6348631 - DNA, 14 bp, Homo sapiens
taaacccacataaa

SEQ ID NO: 6348632 - DNA, 18 bp, Homo sapiens
taaacccacataaacact

SEQ ID NO: 6348633 - DNA, 19 bp, Homo sapiens
taaacccatacaatgtatg

SEQ ID NO: 6348634 - DNA, 15 bp, Homo sapiens
taaacccatctgtaa

SEQ ID NO: 6348635 - DNA, 14 bp, Homo sapiens
taaacccattttag

SEQ ID NO: 6348636 - DNA, 22 bp, Homo sapiens
taaacccccgctccagatctgc

SEQ ID NO: 6348637 - DNA, 14 bp, Homo sapiens
taaacccctgtccc

SEQ ID NO: 6348638 - DNA, 20 bp, Homo sapiens
taaacccgaatcattgtttt

SEQ ID NO: 6348639 - DNA, 15 bp, Homo sapiens
taaaccctatctgtg

SEQ ID NO: 6348640 - DNA, 14 bp, Homo sapiens
taaaccctccaagg

SEQ ID NO: 6348641 - DNA, 14 bp, Homo sapiens
taaaccctccttgg

SEQ ID NO: 6348642 - DNA, 20 bp, Homo sapiens
taaaccctccttggtgcctc

SEQ ID NO: 6348643 - DNA, 13 bp, Homo sapiens
taaaccctctgtg

SEQ ID NO: 6348644 - DNA, 15 bp, Homo sapiens
taaaccctctgtgaa

SEQ ID NO: 6348645 - DNA, 23 bp, Homo sapiens
taaaccctttagtgctttgtgat

SEQ ID NO: 6348646 - DNA, 18 bp, Homo sapiens
taaaccgccaaggctggg

SEQ ID NO: 6348647 - DNA, 17 bp, Homo sapiens
taaaccgctaaaagaaa

SEQ ID NO: 6348648 - DNA, 16 bp, Homo sapiens
taaaccggaccatctc

SEQ ID NO: 6348649 - DNA, 17 bp, Homo sapiens
taaaccgtttttaacac

SEQ ID NO: 6348650 - DNA, 19 bp, Homo sapiens
taaaccgtttttaacacat

SEQ ID NO: 6348651 - DNA, 13 bp, Homo sapiens
taaacctaaaaaa

SEQ ID NO: 6348652 - DNA, 16 bp, Homo sapiens
taaacctaaaaaagat

SEQ ID NO: 6348653 - DNA, 17 bp, Homo sapiens
taaacctagtaaaacct

SEQ ID NO: 6348654 - DNA, 15 bp, Homo sapiens
taaacctatctgtat

SEQ ID NO: 6348655 - DNA, 15 bp, Homo sapiens
taaacctccgccaat

SEQ ID NO: 6348656 - DNA, 13 bp, Homo sapiens
taaacctcctgcc

SEQ ID NO: 6348657 - DNA, 18 bp, Homo sapiens
taaacctggaacatctca

SEQ ID NO: 6348658 - DNA, 18 bp, Homo sapiens
taaacctggagatgatga

SEQ ID NO: 6348659 - DNA, 13 bp, Homo sapiens
taaacctgggcaa

SEQ ID NO: 6348660 - DNA, 18 bp, Homo sapiens
taaacctgggctcagcct

SEQ ID NO: 6348661 - DNA, 19 bp, Homo sapiens
taaacctgtagaatcaatt

SEQ ID NO: 6348662 - DNA, 21 bp, Homo sapiens
taaacctgtgctttcatgttt

SEQ ID NO: 6348663 - DNA, 14 bp, Homo sapiens
taaacctgttttgc

SEQ ID NO: 6348664 - DNA, 12 bp, Homo sapiens
taaaccttaata

SEQ ID NO: 6348665 - DNA, 13 bp, Homo sapiens
taaaccttcagaa

SEQ ID NO: 6348666 - DNA, 21 bp, Homo sapiens
taaaccttcagattaatgact

SEQ ID NO: 6348667 - DNA, 17 bp, Homo sapiens
taaaccttgtttctttc

SEQ ID NO: 6348668 - DNA, 18 bp, Homo sapiens
taaaccttgtttctttct

SEQ ID NO: 6348669 - DNA, 14 bp, Homo sapiens
taaacctttaatga

SEQ ID NO: 6348670 - DNA, 17 bp, Homo sapiens
taaacctttttcttgat

SEQ ID NO: 6348671 - DNA, 13 bp, Homo sapiens
taaaccttttttg

SEQ ID NO: 6348672 - DNA, 18 bp, Homo sapiens
taaacgatatatgtaaat

SEQ ID NO: 6348673 - DNA, 14 bp, Homo sapiens
taaacgattagtga

SEQ ID NO: 6348674 - DNA, 19 bp, Homo sapiens
taaacgattagtgatgtcc

SEQ ID NO: 6348675 - DNA, 19 bp, Homo sapiens
taaacgatttttaaaatgt

SEQ ID NO: 6348676 - DNA, 16 bp, Homo sapiens
taaacgcattatcagc

SEQ ID NO: 6348677 - DNA, 21 bp, Homo sapiens
taaacgcgtgatgaagacaga

SEQ ID NO: 6348678 - DNA, 17 bp, Homo sapiens
taaacgcttcttatgta

SEQ ID NO: 6348679 - DNA, 16 bp, Homo sapiens
taaacggattattttt

SEQ ID NO: 6348680 - DNA, 15 bp, Homo sapiens
taaacggattccaaa

SEQ ID NO: 6348681 - DNA, 13 bp, Homo sapiens
taaacggcccagg

SEQ ID NO: 6348682 - DNA, 14 bp, Homo sapiens
taaacggcccaggc

SEQ ID NO: 6348683 - DNA, 15 bp, Homo sapiens
taaacggcccaggcc

SEQ ID NO: 6348684 - DNA, 20 bp, Homo sapiens
taaacggcccaggccaggtg

SEQ ID NO: 6348685 - DNA, 21 bp, Homo sapiens
taaacggcccaggccaggtgc

SEQ ID NO: 6348686 - DNA, 23 bp, Homo sapiens
taaacggggcagtactcctccct

SEQ ID NO: 6348687 - DNA, 17 bp, Homo sapiens
taaacggtgctatttct

SEQ ID NO: 6348688 - DNA, 14 bp, Homo sapiens
taaacggttcctgg

SEQ ID NO: 6348689 - DNA, 22 bp, Homo sapiens
taaacggttcctggtgactcct

SEQ ID NO: 6348690 - DNA, 14 bp, Homo sapiens
taaacgtaaatgtt

SEQ ID NO: 6348691 - DNA, 18 bp, Homo sapiens
taaacgtaagcactgttt

SEQ ID NO: 6348692 - DNA, 14 bp, Homo sapiens
taaacgtagcatgt

SEQ ID NO: 6348693 - DNA, 16 bp, Homo sapiens
taaacgtctttttaag

SEQ ID NO: 6348694 - DNA, 22 bp, Homo sapiens
taaacgtgaactaagatttcct

SEQ ID NO: 6348695 - DNA, 17 bp, Homo sapiens
taaacgtgatgatcagc

SEQ ID NO: 6348696 - DNA, 18 bp, Homo sapiens
taaacgtggattttaaaa

SEQ ID NO: 6348697 - DNA, 20 bp, Homo sapiens
taaacgtgtatgtttttcag

SEQ ID NO: 6348698 - DNA, 14 bp, Homo sapiens
taaacgtttgaaat

SEQ ID NO: 6348699 - DNA, 15 bp, Homo sapiens
taaacgtttgaaatt

SEQ ID NO: 6348700 - DNA, 18 bp, Homo sapiens
taaactaaaaatttacaa

SEQ ID NO: 6348701 - DNA, 20 bp, Homo sapiens
taaactaaaatctgttacca

SEQ ID NO: 6348702 - DNA, 23 bp, Homo sapiens
taaactaaagtatggtacatcta

SEQ ID NO: 6348703 - DNA, 19 bp, Homo sapiens
taaactaaagtgtgcttta

SEQ ID NO: 6348704 - DNA, 20 bp, Homo sapiens
taaactaaagtgtgctttat

SEQ ID NO: 6348705 - DNA, 22 bp, Homo sapiens
taaactaaagtgtgctttataa

SEQ ID NO: 6348706 - DNA, 13 bp, Homo sapiens
taaactaaataat

SEQ ID NO: 6348707 - DNA, 14 bp, Homo sapiens
taaactaaataatg

SEQ ID NO: 6348708 - DNA, 18 bp, Homo sapiens
taaactaaataatgaata

SEQ ID NO: 6348709 - DNA, 13 bp, Homo sapiens
taaactaaattac

SEQ ID NO: 6348710 - DNA, 14 bp, Homo sapiens
taaactaaattact

SEQ ID NO: 6348711 - DNA, 17 bp, Homo sapiens
taaactaacaagattaa

SEQ ID NO: 6348712 - DNA, 12 bp, Homo sapiens
taaactaacctt

SEQ ID NO: 6348713 - DNA, 16 bp, Homo sapiens
taaactaagatctgtt

SEQ ID NO: 6348714 - DNA, 18 bp, Homo sapiens
taaactacaaagtaaaat

SEQ ID NO: 6348715 - DNA, 19 bp, Homo sapiens
taaactacctcaaaacact

SEQ ID NO: 6348716 - DNA, 16 bp, Homo sapiens
taaactactctttgat

SEQ ID NO: 6348717 - DNA, 14 bp, Homo sapiens
taaactactgaact

SEQ ID NO: 6348718 - DNA, 15 bp, Homo sapiens
taaactactgtaatt

SEQ ID NO: 6348719 - DNA, 21 bp, Homo sapiens
taaactactgtaattaagtgc

SEQ ID NO: 6348720 - DNA, 14 bp, Homo sapiens
taaactagagaagg

SEQ ID NO: 6348721 - DNA, 15 bp, Homo sapiens
taaactagagaaggg

SEQ ID NO: 6348722 - DNA, 16 bp, Homo sapiens
taaactagagaaggga

SEQ ID NO: 6348723 - DNA, 19 bp, Homo sapiens
taaactagcatatctgcct

SEQ ID NO: 6348724 - DNA, 22 bp, Homo sapiens
taaactagtaatgggccaatta

SEQ ID NO: 6348725 - DNA, 13 bp, Homo sapiens
taaactagtttcc

SEQ ID NO: 6348726 - DNA, 18 bp, Homo sapiens
taaactagtttccagtgg

SEQ ID NO: 6348727 - DNA, 14 bp, Homo sapiens
taaactataaaaca

SEQ ID NO: 6348728 - DNA, 22 bp, Homo sapiens
taaactataaaacaaaaatttg

SEQ ID NO: 6348729 - DNA, 20 bp, Homo sapiens
taaactataaactactgtaa

SEQ ID NO: 6348730 - DNA, 18 bp, Homo sapiens
taaactatatataatgta

SEQ ID NO: 6348731 - DNA, 23 bp, Homo sapiens
taaactatgttcctaacaaaatg

SEQ ID NO: 6348732 - DNA, 21 bp, Homo sapiens
taaactattagagtatttccc

SEQ ID NO: 6348733 - DNA, 22 bp, Homo sapiens
taaactattagagtatttccct

SEQ ID NO: 6348734 - DNA, 23 bp, Homo sapiens
taaactattagagtatttccctt

SEQ ID NO: 6348735 - DNA, 14 bp, Homo sapiens
taaactattcttaa

SEQ ID NO: 6348736 - DNA, 18 bp, Homo sapiens
taaactatttttttctta

SEQ ID NO: 6348737 - DNA, 16 bp, Homo sapiens
taaactcaaaactctt

SEQ ID NO: 6348738 - DNA, 15 bp, Homo sapiens
taaactcaaaactta

SEQ ID NO: 6348739 - DNA, 19 bp, Homo sapiens
taaactcaaaacttaacat

SEQ ID NO: 6348740 - DNA, 14 bp, Homo sapiens
taaactcaaaatat

SEQ ID NO: 6348741 - DNA, 22 bp, Homo sapiens
taaactcaaaatatttgtacat

SEQ ID NO: 6348742 - DNA, 21 bp, Homo sapiens
taaactcaaatgtaatagttt

SEQ ID NO: 6348743 - DNA, 15 bp, Homo sapiens
taaactcaagacaat

SEQ ID NO: 6348744 - DNA, 22 bp, Homo sapiens
taaactcaagatttgaccaaat

SEQ ID NO: 6348745 - DNA, 13 bp, Homo sapiens
taaactcagtcaa

SEQ ID NO: 6348746 - DNA, 18 bp, Homo sapiens
taaactcatctgaaatgt

SEQ ID NO: 6348747 - DNA, 15 bp, Homo sapiens
taaactccaggattt

SEQ ID NO: 6348748 - DNA, 17 bp, Homo sapiens
taaactcctactaaatc

SEQ ID NO: 6348749 - DNA, 14 bp, Homo sapiens
taaactcctgtcct

SEQ ID NO: 6348750 - DNA, 15 bp, Homo sapiens
taaactccttcctgg

SEQ ID NO: 6348751 - DNA, 15 bp, Homo sapiens
taaactctaaacatt

SEQ ID NO: 6348752 - DNA, 14 bp, Homo sapiens
taaactctaaagat

SEQ ID NO: 6348753 - DNA, 20 bp, Homo sapiens
taaactctaagtgtaaaaaa

SEQ ID NO: 6348754 - DNA, 21 bp, Homo sapiens
taaactctagatcagaattgt

SEQ ID NO: 6348755 - DNA, 15 bp, Homo sapiens
taaactctcctttga

SEQ ID NO: 6348756 - DNA, 12 bp, Homo sapiens
taaactctctag

SEQ ID NO: 6348757 - DNA, 14 bp, Homo sapiens
taaactctctagct

SEQ ID NO: 6348758 - DNA, 16 bp, Homo sapiens
taaactctgaaatcag

SEQ ID NO: 6348759 - DNA, 18 bp, Homo sapiens
taaactctgaatttatct

SEQ ID NO: 6348760 - DNA, 20 bp, Homo sapiens
taaactctgagtgcaaactt

SEQ ID NO: 6348761 - DNA, 13 bp, Homo sapiens
taaactctgcatc

SEQ ID NO: 6348762 - DNA, 17 bp, Homo sapiens
taaactctgcatccaga

SEQ ID NO: 6348763 - DNA, 12 bp, Homo sapiens
taaactctgcca

SEQ ID NO: 6348764 - DNA, 15 bp, Homo sapiens
taaactctgttgcaa

SEQ ID NO: 6348765 - DNA, 19 bp, Homo sapiens
taaactctgttgtaagtaa

SEQ ID NO: 6348766 - DNA, 17 bp, Homo sapiens
taaactcttcaaggcca

SEQ ID NO: 6348767 - DNA, 20 bp, Homo sapiens
taaactcttcacaaaatctg

SEQ ID NO: 6348768 - DNA, 19 bp, Homo sapiens
taaactgaaaaatgtcagt

SEQ ID NO: 6348769 - DNA, 22 bp, Homo sapiens
taaactgaaacatgcacatttt

SEQ ID NO: 6348770 - DNA, 16 bp, Homo sapiens
taaactgaatataaag

SEQ ID NO: 6348771 - DNA, 20 bp, Homo sapiens
taaactgaatataaagctta

SEQ ID NO: 6348772 - DNA, 17 bp, Homo sapiens
taaactgaatattttgg

SEQ ID NO: 6348773 - DNA, 13 bp, Homo sapiens
taaactgaatttg

SEQ ID NO: 6348774 - DNA, 20 bp, Homo sapiens
taaactgaatttttcttgcg

SEQ ID NO: 6348775 - DNA, 16 bp, Homo sapiens
taaactgagagtaatt

SEQ ID NO: 6348776 - DNA, 12 bp, Homo sapiens
taaactgagcct

SEQ ID NO: 6348777 - DNA, 11 bp, Homo sapiens
taaactgagcg

SEQ ID NO: 6348778 - DNA, 14 bp, Homo sapiens
taaactgagcgacc

SEQ ID NO: 6348779 - DNA, 13 bp, Homo sapiens
taaactgaggccc

SEQ ID NO: 6348780 - DNA, 21 bp, Homo sapiens
taaactgagtagcagaaaaca

SEQ ID NO: 6348781 - DNA, 19 bp, Homo sapiens
taaactgatgtatagcttt

SEQ ID NO: 6348782 - DNA, 15 bp, Homo sapiens
taaactgatgtttga

SEQ ID NO: 6348783 - DNA, 18 bp, Homo sapiens
taaactgcaaacagaaat

SEQ ID NO: 6348784 - DNA, 21 bp, Homo sapiens
taaactgcaagttcattttaa

SEQ ID NO: 6348785 - DNA, 22 bp, Homo sapiens
taaactgcaagttcattttaaa

SEQ ID NO: 6348786 - DNA, 21 bp, Homo sapiens
taaactgcagcctctctggct

SEQ ID NO: 6348787 - DNA, 11 bp, Homo sapiens
taaactgccat

SEQ ID NO: 6348788 - DNA, 13 bp, Homo sapiens
taaactgccatat

SEQ ID NO: 6348789 - DNA, 15 bp, Homo sapiens
taaactgctgtcaat

SEQ ID NO: 6348790 - DNA, 21 bp, Homo sapiens
taaactgctgtcaataaatga

SEQ ID NO: 6348791 - DNA, 23 bp, Homo sapiens
taaactgctgtcaataaatgaca

SEQ ID NO: 6348792 - DNA, 16 bp, Homo sapiens
taaactggtatgaata

SEQ ID NO: 6348793 - DNA, 14 bp, Homo sapiens
taaactgtacaaat

SEQ ID NO: 6348794 - DNA, 16 bp, Homo sapiens
taaactgtacaaatga

SEQ ID NO: 6348795 - DNA, 20 bp, Homo sapiens
taaactgtacagaatttcca

SEQ ID NO: 6348796 - DNA, 14 bp, Homo sapiens
taaactgtacagtg

SEQ ID NO: 6348797 - DNA, 19 bp, Homo sapiens
taaactgtacagtgtcttt

SEQ ID NO: 6348798 - DNA, 20 bp, Homo sapiens
taaactgtatcaaatctgta

SEQ ID NO: 6348799 - DNA, 15 bp, Homo sapiens
gtacaaggtatttac

SEQ ID NO: 6348800 - DNA, 16 bp, Homo sapiens
gtacaaggtatttaca

SEQ ID NO: 6348801 - DNA, 16 bp, Homo sapiens
gtacaagtagttctgt

SEQ ID NO: 6348802 - DNA, 21 bp, Homo sapiens
gtacaagtatataatatgtca

SEQ ID NO: 6348803 - DNA, 17 bp, Homo sapiens
gtacaagtcagtttcta

SEQ ID NO: 6348804 - DNA, 17 bp, Homo sapiens
gtacaagttgctttgtt

SEQ ID NO: 6348805 - DNA, 21 bp, Homo sapiens
gtacaagttgttattgttgaa

SEQ ID NO: 6348806 - DNA, 10 bp, Homo sapiens
gtacaataaa

SEQ ID NO: 6348807 - DNA, 11 bp, Homo sapiens
gtacaataaaa

SEQ ID NO: 6348808 - DNA, 18 bp, Homo sapiens
gtacaataaataaaagaa

SEQ ID NO: 6348809 - DNA, 12 bp, Homo sapiens
gtacaataaatt

SEQ ID NO: 6348810 - DNA, 22 bp, Homo sapiens
gtacaataagttacttgaaata

SEQ ID NO: 6348811 - DNA, 15 bp, Homo sapiens
gtacaataatgtact

SEQ ID NO: 6348812 - DNA, 18 bp, Homo sapiens
gtacaataatgtactcac

SEQ ID NO: 6348813 - DNA, 19 bp, Homo sapiens
gtacaataattcatattct

SEQ ID NO: 6348814 - DNA, 16 bp, Homo sapiens
gtacaatacaatgtac

SEQ ID NO: 6348815 - DNA, 19 bp, Homo sapiens
gtacaatacaatgtacaat

SEQ ID NO: 6348816 - DNA, 20 bp, Homo sapiens
gtacaatacaatgtacaatt

SEQ ID NO: 6348817 - DNA, 21 bp, Homo sapiens
gtacaatacaatgtacaatta

SEQ ID NO: 6348818 - DNA, 18 bp, Homo sapiens
gtacaataccgtgtggtg

SEQ ID NO: 6348819 - DNA, 14 bp, Homo sapiens
gtacaatatttaaa

SEQ ID NO: 6348820 - DNA, 19 bp, Homo sapiens
gtacaatattttaagcatt

SEQ ID NO: 6348821 - DNA, 16 bp, Homo sapiens
gtacaatcaaaacaca

SEQ ID NO: 6348822 - DNA, 12 bp, Homo sapiens
gtacaatcatgt

SEQ ID NO: 6348823 - DNA, 14 bp, Homo sapiens
gtacaatcatgttc

SEQ ID NO: 6348824 - DNA, 16 bp, Homo sapiens
gtacaatctggctcac

SEQ ID NO: 6348825 - DNA, 20 bp, Homo sapiens
gtacaatgaactgcttttcc

SEQ ID NO: 6348826 - DNA, 20 bp, Homo sapiens
gtacaatgactttattgcat

SEQ ID NO: 6348827 - DNA, 18 bp, Homo sapiens
gtacaatggcccgacatt

SEQ ID NO: 6348828 - DNA, 14 bp, Homo sapiens
gtacaatggtttat

SEQ ID NO: 6348829 - DNA, 17 bp, Homo sapiens
gtacaatggtttattcc

SEQ ID NO: 6348830 - DNA, 22 bp, Homo sapiens
gtacaatgtgactttgaaaata

SEQ ID NO: 6348831 - DNA, 17 bp, Homo sapiens
gtacaatgtgtttttct

SEQ ID NO: 6348832 - DNA, 13 bp, Homo sapiens
gtacaatgtttca

SEQ ID NO: 6348833 - DNA, 16 bp, Homo sapiens
gtacaattaagttaca

SEQ ID NO: 6348834 - DNA, 22 bp, Homo sapiens
gtacaattaattatcttttcaa

SEQ ID NO: 6348835 - DNA, 14 bp, Homo sapiens
gtacaattactgtg

SEQ ID NO: 6348836 - DNA, 15 bp, Homo sapiens
gtacaattactgtga

SEQ ID NO: 6348837 - DNA, 14 bp, Homo sapiens
gtacaattcattgt

SEQ ID NO: 6348838 - DNA, 16 bp, Homo sapiens
gtacaattcattgttt

SEQ ID NO: 6348839 - DNA, 13 bp, Homo sapiens
gtacaattttaaa

SEQ ID NO: 6348840 - DNA, 18 bp, Homo sapiens
gtacaattttcatcccac

SEQ ID NO: 6348841 - DNA, 21 bp, Homo sapiens
gtacacaactagttttgttta

SEQ ID NO: 6348842 - DNA, 23 bp, Homo sapiens
gtacacaacttagaaaccaaatt

SEQ ID NO: 6348843 - DNA, 11 bp, Homo sapiens
gtacacacaca

SEQ ID NO: 6348844 - DNA, 19 bp, Homo sapiens
gtacacacacagacacaca

SEQ ID NO: 6348845 - DNA, 20 bp, Homo sapiens
gtacacacacagacacacaa

SEQ ID NO: 6348846 - DNA, 12 bp, Homo sapiens
gtacacaccaga

SEQ ID NO: 6348847 - DNA, 13 bp, Homo sapiens
gtacacagagaag

SEQ ID NO: 6348848 - DNA, 11 bp, Homo sapiens
gtacacagagc

SEQ ID NO: 6348849 - DNA, 21 bp, Homo sapiens
gtacacagagggacttgagcc

SEQ ID NO: 6348850 - DNA, 16 bp, Homo sapiens
gtacacagcaccagaa

SEQ ID NO: 6348851 - DNA, 18 bp, Homo sapiens
gtacacagcaccagaatg

SEQ ID NO: 6348852 - DNA, 15 bp, Homo sapiens
gtacacatttcttaa

SEQ ID NO: 6348853 - DNA, 17 bp, Homo sapiens
gtacaccatagtttaca

SEQ ID NO: 6348854 - DNA, 17 bp, Homo sapiens
gtacacccaattttaaa

SEQ ID NO: 6348855 - DNA, 14 bp, Homo sapiens
gtacacctgtgtgg

SEQ ID NO: 6348856 - DNA, 22 bp, Homo sapiens
gtacacggaccatcgcctctgt

SEQ ID NO: 6348857 - DNA, 14 bp, Homo sapiens
gtacacgtgtcctg

SEQ ID NO: 6348858 - DNA, 15 bp, Homo sapiens
gtacacgtgtcctgt

SEQ ID NO: 6348859 - DNA, 17 bp, Homo sapiens
gtacacgtgtcctgtag

SEQ ID NO: 6348860 - DNA, 15 bp, Homo sapiens
gtacactcagccact

SEQ ID NO: 6348861 - DNA, 13 bp, Homo sapiens
gtacactctgctg

SEQ ID NO: 6348862 - DNA, 18 bp, Homo sapiens
gtacactctgctgtttga

SEQ ID NO: 6348863 - DNA, 15 bp, Homo sapiens
gtacactgaatattt

SEQ ID NO: 6348864 - DNA, 17 bp, Homo sapiens
gtacactgaatttttat

SEQ ID NO: 6348865 - DNA, 13 bp, Homo sapiens
gtacactgcctgc

SEQ ID NO: 6348866 - DNA, 17 bp, Homo sapiens
gtacactgcctgcctta

SEQ ID NO: 6348867 - DNA, 13 bp, Homo sapiens
gtacactgctgta

SEQ ID NO: 6348868 - DNA, 23 bp, Homo sapiens
gtacactgctgtacccagatgcc

SEQ ID NO: 6348869 - DNA, 19 bp, Homo sapiens
gtacactgtttcaaacttt

SEQ ID NO: 6348870 - DNA, 21 bp, Homo sapiens
gtacactgtttcaaactttac

SEQ ID NO: 6348871 - DNA, 19 bp, Homo sapiens
gtacacttaattacagtta

SEQ ID NO: 6348872 - DNA, 22 bp, Homo sapiens
gtacacttctcttaagtggtct

SEQ ID NO: 6348873 - DNA, 17 bp, Homo sapiens
gtacacttggtgtactg

SEQ ID NO: 6348874 - DNA, 13 bp, Homo sapiens
gtacactttttac

SEQ ID NO: 6348875 - DNA, 17 bp, Homo sapiens
gtacactttttacagca

SEQ ID NO: 6348876 - DNA, 16 bp, Homo sapiens
gtacagaaaaatactt

SEQ ID NO: 6348877 - DNA, 14 bp, Homo sapiens
gtacagaaaacatg

SEQ ID NO: 6348878 - DNA, 22 bp, Homo sapiens
gtacagaacacaaatgtctagt

SEQ ID NO: 6348879 - DNA, 18 bp, Homo sapiens
gtacagaacagtaaagtt

SEQ ID NO: 6348880 - DNA, 18 bp, Homo sapiens
gtacagaatagaatacat

SEQ ID NO: 6348881 - DNA, 17 bp, Homo sapiens
gtacagaatcattgctt

SEQ ID NO: 6348882 - DNA, 18 bp, Homo sapiens
gtacagaatttgaattat

SEQ ID NO: 6348883 - DNA, 22 bp, Homo sapiens
gtacagaatttttaatgacttt

SEQ ID NO: 6348884 - DNA, 21 bp, Homo sapiens
gtacagacatggagatgtaaa

SEQ ID NO: 6348885 - DNA, 19 bp, Homo sapiens
gtacagaccgagaggccag

SEQ ID NO: 6348886 - DNA, 20 bp, Homo sapiens
gtacagaccgagaggccagt

SEQ ID NO: 6348887 - DNA, 21 bp, Homo sapiens
gtacagaccgagaggccagtt

SEQ ID NO: 6348888 - DNA, 15 bp, Homo sapiens
gtacagagaagccag

SEQ ID NO: 6348889 - DNA, 16 bp, Homo sapiens
gtacagagaagccatc

SEQ ID NO: 6348890 - DNA, 14 bp, Homo sapiens
gtacagagaaggaa

SEQ ID NO: 6348891 - DNA, 14 bp, Homo sapiens
gtacagagactcta

SEQ ID NO: 6348892 - DNA, 14 bp, Homo sapiens
gtacagaggggaca

SEQ ID NO: 6348893 - DNA, 19 bp, Homo sapiens
gtacagagtggaataagac

SEQ ID NO: 6348894 - DNA, 16 bp, Homo sapiens
gtacagatactgtgag

SEQ ID NO: 6348895 - DNA, 16 bp, Homo sapiens
gtacagatcaagaaaa

SEQ ID NO: 6348896 - DNA, 14 bp, Homo sapiens
gtacagcacagaat

SEQ ID NO: 6348897 - DNA, 22 bp, Homo sapiens
gtacagcactttcttcttccca

SEQ ID NO: 6348898 - DNA, 13 bp, Homo sapiens
gtacagcccaggc

SEQ ID NO: 6348899 - DNA, 14 bp, Homo sapiens
gtacagcccaggcg

SEQ ID NO: 6348900 - DNA, 23 bp, Homo sapiens
gtacagcggctcccctctgcttc

SEQ ID NO: 6348901 - DNA, 14 bp, Homo sapiens
gtacagcgggctgt

SEQ ID NO: 6348902 - DNA, 16 bp, Homo sapiens
gtacagcgggctgtgc

SEQ ID NO: 6348903 - DNA, 23 bp, Homo sapiens
gtacagctgacggtttctccccg

SEQ ID NO: 6348904 - DNA, 12 bp, Homo sapiens
gtacagctggct

SEQ ID NO: 6348905 - DNA, 18 bp, Homo sapiens
gtacagctgtttaagatg

SEQ ID NO: 6348906 - DNA, 15 bp, Homo sapiens
gtacagcttctggag

SEQ ID NO: 6348907 - DNA, 20 bp, Homo sapiens
gtacaggaaggtgcctggcc

SEQ ID NO: 6348908 - DNA, 17 bp, Homo sapiens
gtacaggacatatattt

SEQ ID NO: 6348909 - DNA, 15 bp, Homo sapiens
gtacaggagaggcag

SEQ ID NO: 6348910 - DNA, 18 bp, Homo sapiens
gtacaggagtcagccatg

SEQ ID NO: 6348911 - DNA, 13 bp, Homo sapiens
gtacagggcagaa

SEQ ID NO: 6348912 - DNA, 16 bp, Homo sapiens
gtacagggcaggagct

SEQ ID NO: 6348913 - DNA, 18 bp, Homo sapiens
gtacagggcaggagctgc

SEQ ID NO: 6348914 - DNA, 19 bp, Homo sapiens
gtacagggcaggagctgct

SEQ ID NO: 6348915 - DNA, 17 bp, Homo sapiens
gtacaggggccatgccc

SEQ ID NO: 6348916 - DNA, 16 bp, Homo sapiens
gtacaggtactttgtc

SEQ ID NO: 6348917 - DNA, 20 bp, Homo sapiens
gtacaggtcacccatcagga

SEQ ID NO: 6348918 - DNA, 18 bp, Homo sapiens
gtacaggtcatctgctgg

SEQ ID NO: 6348919 - DNA, 11 bp, Homo sapiens
gtacaggttgg

SEQ ID NO: 6348920 - DNA, 18 bp, Homo sapiens
gtacagtagcttaaataa

SEQ ID NO: 6348921 - DNA, 23 bp, Homo sapiens
gtacagtagcttaaataaattca

SEQ ID NO: 6348922 - DNA, 18 bp, Homo sapiens
gtacagtagtatctgctt

SEQ ID NO: 6348923 - DNA, 22 bp, Homo sapiens
gtacagtagtttccctactgaa

SEQ ID NO: 6348924 - DNA, 13 bp, Homo sapiens
gtacagtattttg

SEQ ID NO: 6348925 - DNA, 13 bp, Homo sapiens
gtacagtattttt

SEQ ID NO: 6348926 - DNA, 22 bp, Homo sapiens
gtacagtatttttcagatataa

SEQ ID NO: 6348927 - DNA, 14 bp, Homo sapiens
gtacagtctgtcat

SEQ ID NO: 6348928 - DNA, 13 bp, Homo sapiens
gtacagtctgtct

SEQ ID NO: 6348929 - DNA, 17 bp, Homo sapiens
gtacagtctgtcttctg

SEQ ID NO: 6348930 - DNA, 19 bp, Homo sapiens
gtacagtctgtcttctgta

SEQ ID NO: 6348931 - DNA, 15 bp, Homo sapiens
gtacagtgaattgtc

SEQ ID NO: 6348932 - DNA, 21 bp, Homo sapiens
gtacagtggttctacaatcta

SEQ ID NO: 6348933 - DNA, 14 bp, Homo sapiens
gtacagtgtctttt

SEQ ID NO: 6348934 - DNA, 15 bp, Homo sapiens
gtacagtgtcttttt

SEQ ID NO: 6348935 - DNA, 16 bp, Homo sapiens
gtacagtgttctgttt

SEQ ID NO: 6348936 - DNA, 20 bp, Homo sapiens
gtacagttatacatacctct

SEQ ID NO: 6348937 - DNA, 14 bp, Homo sapiens
gtacagttatctaa

SEQ ID NO: 6348938 - DNA, 16 bp, Homo sapiens
gtacagttcagttcct

SEQ ID NO: 6348939 - DNA, 17 bp, Homo sapiens
gtacagttcataaattt

SEQ ID NO: 6348940 - DNA, 16 bp, Homo sapiens
gtacagttgagctcag

SEQ ID NO: 6348941 - DNA, 21 bp, Homo sapiens
gtacagtttattgatattcaa

SEQ ID NO: 6348942 - DNA, 15 bp, Homo sapiens
gtacagtttgctgta

SEQ ID NO: 6348943 - DNA, 21 bp, Homo sapiens
gtacagtttgtgaggaccttt

SEQ ID NO: 6348944 - DNA, 21 bp, Homo sapiens
gtacagttttgtggactgagc

SEQ ID NO: 6348945 - DNA, 12 bp, Homo sapiens
gtacagttttta

SEQ ID NO: 6348946 - DNA, 14 bp, Homo sapiens
gtacataaaggtga

SEQ ID NO: 6348947 - DNA, 22 bp, Homo sapiens
gtacataaaggtggtatgtgtg

SEQ ID NO: 6348948 - DNA, 23 bp, Homo sapiens
gtacataaaggtggtatgtgtgt

SEQ ID NO: 6348949 - DNA, 20 bp, Homo sapiens
gtacataaagtaataactgt

SEQ ID NO: 6348950 - DNA, 19 bp, Homo sapiens
gtacataaataagaaaaac

SEQ ID NO: 6348951 - DNA, 20 bp, Homo sapiens
gtacataaattgcataaagc

SEQ ID NO: 6348952 - DNA, 22 bp, Homo sapiens
gtacataaattgcataaagcat

SEQ ID NO: 6348953 - DNA, 23 bp, Homo sapiens
gtacataaattgcataaagcata

SEQ ID NO: 6348954 - DNA, 17 bp, Homo sapiens
gtacataactcctgtcc

SEQ ID NO: 6348955 - DNA, 20 bp, Homo sapiens
gtacataactcctgtccctt

SEQ ID NO: 6348956 - DNA, 15 bp, Homo sapiens
gtacataatactgaa

SEQ ID NO: 6348957 - DNA, 16 bp, Homo sapiens
gtacataatactgaac

SEQ ID NO: 6348958 - DNA, 18 bp, Homo sapiens
gtacataatactgaacca

SEQ ID NO: 6348959 - DNA, 16 bp, Homo sapiens
gtacataattgattaa

SEQ ID NO: 6348960 - DNA, 16 bp, Homo sapiens
gtacataattgcatga

SEQ ID NO: 6348961 - DNA, 19 bp, Homo sapiens
gtacataattgcatgaaaa

SEQ ID NO: 6348962 - DNA, 20 bp, Homo sapiens
gtacataattgcatgaaaat

SEQ ID NO: 6348963 - DNA, 18 bp, Homo sapiens
gtacatacgtgttctata

SEQ ID NO: 6348964 - DNA, 14 bp, Homo sapiens
gtacatactggcct

SEQ ID NO: 6348965 - DNA, 16 bp, Homo sapiens
gtacatactggcctct

SEQ ID NO: 6348966 - DNA, 21 bp, Homo sapiens
gtacatactggcctctgtgat

SEQ ID NO: 6348967 - DNA, 13 bp, Homo sapiens
gtacatacttttt

SEQ ID NO: 6348968 - DNA, 14 bp, Homo sapiens
gtacatagcctata

SEQ ID NO: 6348969 - DNA, 17 bp, Homo sapiens
gtacataggcttctatt

SEQ ID NO: 6348970 - DNA, 17 bp, Homo sapiens
gtacatagtctgttcct

SEQ ID NO: 6348971 - DNA, 17 bp, Homo sapiens
gtacatagttatttatt

SEQ ID NO: 6348972 - DNA, 18 bp, Homo sapiens
gtacatagttatttattt

SEQ ID NO: 6348973 - DNA, 14 bp, Homo sapiens
gtacatatatacca

SEQ ID NO: 6348974 - DNA, 20 bp, Homo sapiens
gtacatatcctttggtcctg

SEQ ID NO: 6348975 - DNA, 16 bp, Homo sapiens
gtacatatgtaattct

SEQ ID NO: 6348976 - DNA, 17 bp, Homo sapiens
gtacatatgtaattctt

SEQ ID NO: 6348977 - DNA, 13 bp, Homo sapiens
gtacatattgtta

SEQ ID NO: 6348978 - DNA, 17 bp, Homo sapiens
gtacatatttattttct

SEQ ID NO: 6348979 - DNA, 12 bp, Homo sapiens
taaactgtatta

SEQ ID NO: 6348980 - DNA, 16 bp, Homo sapiens
taaactgtattaaatc

SEQ ID NO: 6348981 - DNA, 18 bp, Homo sapiens
taaactgtcctctttcag

SEQ ID NO: 6348982 - DNA, 17 bp, Homo sapiens
taaactgtcgtgtcata

SEQ ID NO: 6348983 - DNA, 13 bp, Homo sapiens
taaactgtgagat

SEQ ID NO: 6348984 - DNA, 17 bp, Homo sapiens
taaactgtgagataaat

SEQ ID NO: 6348985 - DNA, 18 bp, Homo sapiens
taaactgtgagataaata

SEQ ID NO: 6348986 - DNA, 17 bp, Homo sapiens
taaactgtgtctgtccc

SEQ ID NO: 6348987 - DNA, 21 bp, Homo sapiens
taaactgttaacttattcaaa

SEQ ID NO: 6348988 - DNA, 17 bp, Homo sapiens
taaactgttagcactgt

SEQ ID NO: 6348989 - DNA, 23 bp, Homo sapiens
taaactgttagcactgttgatgt

SEQ ID NO: 6348990 - DNA, 18 bp, Homo sapiens
taaactgttatgagtagt

SEQ ID NO: 6348991 - DNA, 20 bp, Homo sapiens
taaactgttgggaaagctct

SEQ ID NO: 6348992 - DNA, 13 bp, Homo sapiens
taaactgtttata

SEQ ID NO: 6348993 - DNA, 12 bp, Homo sapiens
taaactgtttct

SEQ ID NO: 6348994 - DNA, 14 bp, Homo sapiens
taaactgtttctca

SEQ ID NO: 6348995 - DNA, 16 bp, Homo sapiens
taaactgttttcaagt

SEQ ID NO: 6348996 - DNA, 14 bp, Homo sapiens
taaactgttttcat

SEQ ID NO: 6348997 - DNA, 17 bp, Homo sapiens
taaactgttttcatgtg

SEQ ID NO: 6348998 - DNA, 18 bp, Homo sapiens
taaacttaaaactttgta

SEQ ID NO: 6348999 - DNA, 15 bp, Homo sapiens
taaacttaaaataaa

SEQ ID NO: 6349000 - DNA, 14 bp, Homo sapiens
taaacttaaagcta

SEQ ID NO: 6349001 - DNA, 17 bp, Homo sapiens
taaacttaaagctactg

SEQ ID NO: 6349002 - DNA, 14 bp, Homo sapiens
taaacttaacttta

SEQ ID NO: 6349003 - DNA, 15 bp, Homo sapiens
taaacttacaaactt

SEQ ID NO: 6349004 - DNA, 16 bp, Homo sapiens
taaacttagaaatatg

SEQ ID NO: 6349005 - DNA, 15 bp, Homo sapiens
taaacttagaataaa

SEQ ID NO: 6349006 - DNA, 17 bp, Homo sapiens
taaacttagaggaaaat

SEQ ID NO: 6349007 - DNA, 18 bp, Homo sapiens
taaacttagaggaaaatg

SEQ ID NO: 6349008 - DNA, 19 bp, Homo sapiens
taaacttagaggaaaatga

SEQ ID NO: 6349009 - DNA, 21 bp, Homo sapiens
taaacttagaggaaaatgagt

SEQ ID NO: 6349010 - DNA, 22 bp, Homo sapiens
taaacttagtgcggacaagttt

SEQ ID NO: 6349011 - DNA, 16 bp, Homo sapiens
taaacttataaatcat

SEQ ID NO: 6349012 - DNA, 18 bp, Homo sapiens
taaacttataaatcatat

SEQ ID NO: 6349013 - DNA, 12 bp, Homo sapiens
taaacttatgaa

SEQ ID NO: 6349014 - DNA, 15 bp, Homo sapiens
taaacttatgaatgt

SEQ ID NO: 6349015 - DNA, 16 bp, Homo sapiens
taaacttatgaatgtt

SEQ ID NO: 6349016 - DNA, 17 bp, Homo sapiens
taaacttatgaatgttt

SEQ ID NO: 6349017 - DNA, 18 bp, Homo sapiens
taaacttatgaatgtttc

SEQ ID NO: 6349018 - DNA, 23 bp, Homo sapiens
taaacttcagttttactgcattt

SEQ ID NO: 6349019 - DNA, 13 bp, Homo sapiens
taaacttcatctt

SEQ ID NO: 6349020 - DNA, 14 bp, Homo sapiens
taaacttctactga

SEQ ID NO: 6349021 - DNA, 14 bp, Homo sapiens
taaacttctctgaa

SEQ ID NO: 6349022 - DNA, 23 bp, Homo sapiens
taaacttctgaagactgagaact

SEQ ID NO: 6349023 - DNA, 14 bp, Homo sapiens
taaacttcttaaca

SEQ ID NO: 6349024 - DNA, 19 bp, Homo sapiens
taaacttcttaacgaaatt

SEQ ID NO: 6349025 - DNA, 12 bp, Homo sapiens
taaacttgaaaa

SEQ ID NO: 6349026 - DNA, 13 bp, Homo sapiens
taaacttgaaata

SEQ ID NO: 6349027 - DNA, 14 bp, Homo sapiens
taaacttgcaatga

SEQ ID NO: 6349028 - DNA, 16 bp, Homo sapiens
taaacttgcacatttg

SEQ ID NO: 6349029 - DNA, 19 bp, Homo sapiens
taaacttgcacatttgaat

SEQ ID NO: 6349030 - DNA, 22 bp, Homo sapiens
taaacttggtgcttattgatat

SEQ ID NO: 6349031 - DNA, 15 bp, Homo sapiens
taaacttgtacatgg

SEQ ID NO: 6349032 - DNA, 13 bp, Homo sapiens
taaacttgtagga

SEQ ID NO: 6349033 - DNA, 21 bp, Homo sapiens
taaacttgtaggacttttaaa

SEQ ID NO: 6349034 - DNA, 13 bp, Homo sapiens
taaacttgtgaat

SEQ ID NO: 6349035 - DNA, 17 bp, Homo sapiens
taaacttgtttgctgtg

SEQ ID NO: 6349036 - DNA, 22 bp, Homo sapiens
taaacttgtttgctgtgaacaa

SEQ ID NO: 6349037 - DNA, 15 bp, Homo sapiens
taaactttaatatgt

SEQ ID NO: 6349038 - DNA, 16 bp, Homo sapiens
taaactttaccttttt

SEQ ID NO: 6349039 - DNA, 22 bp, Homo sapiens
taaactttaccttttttataca

SEQ ID NO: 6349040 - DNA, 11 bp, Homo sapiens
taaactttatt

SEQ ID NO: 6349041 - DNA, 12 bp, Homo sapiens
taaactttattt

SEQ ID NO: 6349042 - DNA, 22 bp, Homo sapiens
taaactttcaaattgaaatgac

SEQ ID NO: 6349043 - DNA, 14 bp, Homo sapiens
taaactttcaatat

SEQ ID NO: 6349044 - DNA, 13 bp, Homo sapiens
taaactttctcca

SEQ ID NO: 6349045 - DNA, 14 bp, Homo sapiens
taaactttctccat

SEQ ID NO: 6349046 - DNA, 12 bp, Homo sapiens
taaactttctct

SEQ ID NO: 6349047 - DNA, 12 bp, Homo sapiens
taaactttgaaa

SEQ ID NO: 6349048 - DNA, 20 bp, Homo sapiens
taaactttgaataaaagaat

SEQ ID NO: 6349049 - DNA, 15 bp, Homo sapiens
taaactttggccttt

SEQ ID NO: 6349050 - DNA, 12 bp, Homo sapiens
taaactttgtca

SEQ ID NO: 6349051 - DNA, 14 bp, Homo sapiens
taaacttttaccac

SEQ ID NO: 6349052 - DNA, 22 bp, Homo sapiens
taaacttttaccacttgctgca

SEQ ID NO: 6349053 - DNA, 17 bp, Homo sapiens
taaacttttagaaactt

SEQ ID NO: 6349054 - DNA, 13 bp, Homo sapiens
taaacttttcatt

SEQ ID NO: 6349055 - DNA, 20 bp, Homo sapiens
taaacttttttcttactgtc

SEQ ID NO: 6349056 - DNA, 17 bp, Homo sapiens
taaactttttttcaatg

SEQ ID NO: 6349057 - DNA, 18 bp, Homo sapiens
taaactttttttctgtac

SEQ ID NO: 6349058 - DNA, 22 bp, Homo sapiens
taaactttttttgtccttttaa

SEQ ID NO: 6349059 - DNA, 9 bp, Homo sapiens
taaagaaaa

SEQ ID NO: 6349060 - DNA, 12 bp, Homo sapiens
taaagaaaaaaa

SEQ ID NO: 6349061 - DNA, 17 bp, Homo sapiens
taaagaaaaaaaaggca

SEQ ID NO: 6349062 - DNA, 23 bp, Homo sapiens
taaagaaaaaaacaatcccagca

SEQ ID NO: 6349063 - DNA, 15 bp, Homo sapiens
taaagaaaaaaatac

SEQ ID NO: 6349064 - DNA, 22 bp, Homo sapiens
taaagaaaaaaatagttttaca

SEQ ID NO: 6349065 - DNA, 23 bp, Homo sapiens
taaagaaaaaaatagttttacat

SEQ ID NO: 6349066 - DNA, 16 bp, Homo sapiens
taaagaaaaaaatgtc

SEQ ID NO: 6349067 - DNA, 15 bp, Homo sapiens
taaagaaaaaaattg

SEQ ID NO: 6349068 - DNA, 22 bp, Homo sapiens
taaagaaaaaaattgaaatgta

SEQ ID NO: 6349069 - DNA, 15 bp, Homo sapiens
taaagaaaaacaaac

SEQ ID NO: 6349070 - DNA, 17 bp, Homo sapiens
taaagaaaaactttaaa

SEQ ID NO: 6349071 - DNA, 16 bp, Homo sapiens
taaagaaaaagaagta

SEQ ID NO: 6349072 - DNA, 14 bp, Homo sapiens
taaagaaaaagata

SEQ ID NO: 6349073 - DNA, 13 bp, Homo sapiens
taaagaaaaataa

SEQ ID NO: 6349074 - DNA, 14 bp, Homo sapiens
taaagaaaaatatt

SEQ ID NO: 6349075 - DNA, 17 bp, Homo sapiens
taaagaaaaatatttaa

SEQ ID NO: 6349076 - DNA, 13 bp, Homo sapiens
taaagaaaaatca

SEQ ID NO: 6349077 - DNA, 13 bp, Homo sapiens
taaagaaaaccac

SEQ ID NO: 6349078 - DNA, 19 bp, Homo sapiens
taaagaaaaccacagttat

SEQ ID NO: 6349079 - DNA, 13 bp, Homo sapiens
taaagaaaagatg

SEQ ID NO: 6349080 - DNA, 16 bp, Homo sapiens
taaagaaaagttttgt

SEQ ID NO: 6349081 - DNA, 19 bp, Homo sapiens
taaagaaaatatctgaaat

SEQ ID NO: 6349082 - DNA, 17 bp, Homo sapiens
taaagaaaatcaatgaa

SEQ ID NO: 6349083 - DNA, 18 bp, Homo sapiens
taaagaaaatctctgtga

SEQ ID NO: 6349084 - DNA, 23 bp, Homo sapiens
taaagaaaatgtgtctgcaacat

SEQ ID NO: 6349085 - DNA, 13 bp, Homo sapiens
taaagaaaattgc

SEQ ID NO: 6349086 - DNA, 15 bp, Homo sapiens
taaagaaaattgcca

SEQ ID NO: 6349087 - DNA, 16 bp, Homo sapiens
taaagaaaattgccaa

SEQ ID NO: 6349088 - DNA, 13 bp, Homo sapiens
taaagaaacagct

SEQ ID NO: 6349089 - DNA, 23 bp, Homo sapiens
taaagaaacagctttcaagtgcc

SEQ ID NO: 6349090 - DNA, 16 bp, Homo sapiens
taaagaaactgaggcc

SEQ ID NO: 6349091 - DNA, 14 bp, Homo sapiens
taaagaaactgctt

SEQ ID NO: 6349092 - DNA, 17 bp, Homo sapiens
taaagaaacttttgaaa

SEQ ID NO: 6349093 - DNA, 18 bp, Homo sapiens
taaagaaagaatgcattc

SEQ ID NO: 6349094 - DNA, 13 bp, Homo sapiens
taaagaaagagag

SEQ ID NO: 6349095 - DNA, 14 bp, Homo sapiens
taaagaaagagaga

SEQ ID NO: 6349096 - DNA, 19 bp, Homo sapiens
taaagaaagagagaaaata

SEQ ID NO: 6349097 - DNA, 20 bp, Homo sapiens
taaagaaagagagaaaataa

SEQ ID NO: 6349098 - DNA, 21 bp, Homo sapiens
taaagaaagagagaaaataaa

SEQ ID NO: 6349099 - DNA, 22 bp, Homo sapiens
taaagaaagagagaaaataaaa

SEQ ID NO: 6349100 - DNA, 16 bp, Homo sapiens
taaagaaagcaacttt

SEQ ID NO: 6349101 - DNA, 16 bp, Homo sapiens
taaagaaaggaaaaga

SEQ ID NO: 6349102 - DNA, 16 bp, Homo sapiens
taaagaaaggcagaga

SEQ ID NO: 6349103 - DNA, 17 bp, Homo sapiens
taaagaaagtcgaatta

SEQ ID NO: 6349104 - DNA, 11 bp, Homo sapiens
taaagaaagtg

SEQ ID NO: 6349105 - DNA, 15 bp, Homo sapiens
taaagaaagtgaaaa

SEQ ID NO: 6349106 - DNA, 17 bp, Homo sapiens
taaagaaatagaacaag

SEQ ID NO: 6349107 - DNA, 15 bp, Homo sapiens
taaagaaatgtctta

SEQ ID NO: 6349108 - DNA, 15 bp, Homo sapiens
taaagaaatttacta

SEQ ID NO: 6349109 - DNA, 16 bp, Homo sapiens
taaagaaatttactat

SEQ ID NO: 6349110 - DNA, 20 bp, Homo sapiens
taaagaaatttactatatat

SEQ ID NO: 6349111 - DNA, 16 bp, Homo sapiens
taaagaaatttggtac

SEQ ID NO: 6349112 - DNA, 13 bp, Homo sapiens
taaagaacaaagt

SEQ ID NO: 6349113 - DNA, 15 bp, Homo sapiens
taaagaaccagtccc

SEQ ID NO: 6349114 - DNA, 23 bp, Homo sapiens
taaagaactccttattttgtatt

SEQ ID NO: 6349115 - DNA, 23 bp, Homo sapiens
taaagaacttaaattatgtttta

SEQ ID NO: 6349116 - DNA, 17 bp, Homo sapiens
taaagaagaaaataacc

SEQ ID NO: 6349117 - DNA, 19 bp, Homo sapiens
taaagaagaaacttgtaaa

SEQ ID NO: 6349118 - DNA, 20 bp, Homo sapiens
taaagaagaaacttgtaaat

SEQ ID NO: 6349119 - DNA, 22 bp, Homo sapiens
taaagaagaaacttgtaaatat

SEQ ID NO: 6349120 - DNA, 11 bp, Homo sapiens
taaagaagaag

SEQ ID NO: 6349121 - DNA, 23 bp, Homo sapiens
taaagaagagccttcacatgaaa

SEQ ID NO: 6349122 - DNA, 22 bp, Homo sapiens
taaagaagagtaacacttgaaa

SEQ ID NO: 6349123 - DNA, 20 bp, Homo sapiens
taaagaagagtgacttattt

SEQ ID NO: 6349124 - DNA, 18 bp, Homo sapiens
taaagaagatgtttaact

SEQ ID NO: 6349125 - DNA, 13 bp, Homo sapiens
taaagaagctgca

SEQ ID NO: 6349126 - DNA, 12 bp, Homo sapiens
taaagaaggggg

SEQ ID NO: 6349127 - DNA, 17 bp, Homo sapiens
taaagaagtaaatttgt

SEQ ID NO: 6349128 - DNA, 18 bp, Homo sapiens
taaagaagtaaatttgtc

SEQ ID NO: 6349129 - DNA, 14 bp, Homo sapiens
taaagaagtatttt

SEQ ID NO: 6349130 - DNA, 18 bp, Homo sapiens
taaagaagtccatgtgat

SEQ ID NO: 6349131 - DNA, 17 bp, Homo sapiens
taaagaagttgaagttt

SEQ ID NO: 6349132 - DNA, 15 bp, Homo sapiens
taaagaataatatgc

SEQ ID NO: 6349133 - DNA, 14 bp, Homo sapiens
taaagaatacttga

SEQ ID NO: 6349134 - DNA, 15 bp, Homo sapiens
taaagaatacttgaa

SEQ ID NO: 6349135 - DNA, 18 bp, Homo sapiens
taaagaatacttgaactt

SEQ ID NO: 6349136 - DNA, 15 bp, Homo sapiens
taaagaataggactt

SEQ ID NO: 6349137 - DNA, 16 bp, Homo sapiens
taaagaatatgacttt

SEQ ID NO: 6349138 - DNA, 15 bp, Homo sapiens
taaagaatcattatt

SEQ ID NO: 6349139 - DNA, 15 bp, Homo sapiens
taaagaatgccattt

SEQ ID NO: 6349140 - DNA, 17 bp, Homo sapiens
taaagaatgctgcaact

SEQ ID NO: 6349141 - DNA, 20 bp, Homo sapiens
taaagaatgctgcaactttt

SEQ ID NO: 6349142 - DNA, 13 bp, Homo sapiens
taaagaattattt

SEQ ID NO: 6349143 - DNA, 20 bp, Homo sapiens
taaagaattggtcttaatgt

SEQ ID NO: 6349144 - DNA, 18 bp, Homo sapiens
taaagaattgtggtttat

SEQ ID NO: 6349145 - DNA, 20 bp, Homo sapiens
taaagaattgtggtttatat

SEQ ID NO: 6349146 - DNA, 18 bp, Homo sapiens
taaagaatttaaaaaagt

SEQ ID NO: 6349147 - DNA, 15 bp, Homo sapiens
taaagaatttaagct

SEQ ID NO: 6349148 - DNA, 18 bp, Homo sapiens
taaagaatttgaaagttt

SEQ ID NO: 6349149 - DNA, 15 bp, Homo sapiens
taaagaattttcatc

SEQ ID NO: 6349150 - DNA, 19 bp, Homo sapiens
taaagacaaaaatccttgt

SEQ ID NO: 6349151 - DNA, 11 bp, Homo sapiens
taaagacaaag

SEQ ID NO: 6349152 - DNA, 15 bp, Homo sapiens
taaagacaaagacat

SEQ ID NO: 6349153 - DNA, 21 bp, Homo sapiens
taaagacaaataaatgattat

SEQ ID NO: 6349154 - DNA, 9 bp, Homo sapiens
taaagacag

SEQ ID NO: 6349155 - DNA, 15 bp, Homo sapiens
taaagacagaggcag

SEQ ID NO: 6349156 - DNA, 16 bp, Homo sapiens
taaagacagctgacag

SEQ ID NO: 6349157 - DNA, 10 bp, Homo sapiens
taaagacagg

SEQ ID NO: 6349158 - DNA, 19 bp, Homo sapiens
taaagacagggtttcacca

SEQ ID NO: 6349159 - DNA, 14 bp, Homo sapiens
taaagacataggaa

SEQ ID NO: 6349160 - DNA, 18 bp, Homo sapiens
taaagacatttaaaatag

SEQ ID NO: 6349161 - DNA, 22 bp, Homo sapiens
taaagacatttaaaatagtttt

SEQ ID NO: 6349162 - DNA, 14 bp, Homo sapiens
gtacatcacccagt

SEQ ID NO: 6349163 - DNA, 23 bp, Homo sapiens
gtacatcccatgtaacagaaagg

SEQ ID NO: 6349164 - DNA, 20 bp, Homo sapiens
gtacatctattttggattgt

SEQ ID NO: 6349165 - DNA, 18 bp, Homo sapiens
gtacatctgcaatatgaa

SEQ ID NO: 6349166 - DNA, 14 bp, Homo sapiens
gtacatctggcctt

SEQ ID NO: 6349167 - DNA, 18 bp, Homo sapiens
gtacatctggcttatttt

SEQ ID NO: 6349168 - DNA, 19 bp, Homo sapiens
gtacatcttgtgcatgcaa

SEQ ID NO: 6349169 - DNA, 11 bp, Homo sapiens
gtacatgaaat

SEQ ID NO: 6349170 - DNA, 19 bp, Homo sapiens
gtacatgaaatttttgtaa

SEQ ID NO: 6349171 - DNA, 13 bp, Homo sapiens
gtacatggaagaa

SEQ ID NO: 6349172 - DNA, 22 bp, Homo sapiens
gtacatggaattttttgaatat

SEQ ID NO: 6349173 - DNA, 17 bp, Homo sapiens
gtacatggagctcaggt

SEQ ID NO: 6349174 - DNA, 16 bp, Homo sapiens
gtacatgtacatagta

SEQ ID NO: 6349175 - DNA, 23 bp, Homo sapiens
gtacatgtacatagtaaagtatt

SEQ ID NO: 6349176 - DNA, 10 bp, Homo sapiens
gtacatgtat

SEQ ID NO: 6349177 - DNA, 16 bp, Homo sapiens
gtacatgtattaaatt

SEQ ID NO: 6349178 - DNA, 13 bp, Homo sapiens
gtacatgtgaggc

SEQ ID NO: 6349179 - DNA, 19 bp, Homo sapiens
gtacatgtgtagcctgtgc

SEQ ID NO: 6349180 - DNA, 23 bp, Homo sapiens
gtacatgtgtgcagagcagacag

SEQ ID NO: 6349181 - DNA, 18 bp, Homo sapiens
gtacatgttcgggtgtgg

SEQ ID NO: 6349182 - DNA, 15 bp, Homo sapiens
gtacattatgaagaa

SEQ ID NO: 6349183 - DNA, 17 bp, Homo sapiens
gtacattcatctggagg

SEQ ID NO: 6349184 - DNA, 23 bp, Homo sapiens
gtacattcctgatactgggtaca

SEQ ID NO: 6349185 - DNA, 17 bp, Homo sapiens
gtacattctaaagagag

SEQ ID NO: 6349186 - DNA, 20 bp, Homo sapiens
gtacattgaaaccctccaaa

SEQ ID NO: 6349187 - DNA, 12 bp, Homo sapiens
gtacattgctta

SEQ ID NO: 6349188 - DNA, 18 bp, Homo sapiens
gtacattgcttaaaatat

SEQ ID NO: 6349189 - DNA, 19 bp, Homo sapiens
gtacattgcttaaaatata

SEQ ID NO: 6349190 - DNA, 14 bp, Homo sapiens
gtacattgtgagct

SEQ ID NO: 6349191 - DNA, 14 bp, Homo sapiens
gtacatttaaattt

SEQ ID NO: 6349192 - DNA, 15 bp, Homo sapiens
gtacatttataattg

SEQ ID NO: 6349193 - DNA, 19 bp, Homo sapiens
gtacatttatgatttaata

SEQ ID NO: 6349194 - DNA, 20 bp, Homo sapiens
gtacatttatgatttaataa

SEQ ID NO: 6349195 - DNA, 18 bp, Homo sapiens
gtacatttcaccatggcc

SEQ ID NO: 6349196 - DNA, 13 bp, Homo sapiens
gtacatttctcag

SEQ ID NO: 6349197 - DNA, 17 bp, Homo sapiens
gtacatttctctgagca

SEQ ID NO: 6349198 - DNA, 17 bp, Homo sapiens
gtacatttctgattctg

SEQ ID NO: 6349199 - DNA, 22 bp, Homo sapiens
gtacatttgatttgatatacag

SEQ ID NO: 6349200 - DNA, 17 bp, Homo sapiens
gtacatttgcaattaga

SEQ ID NO: 6349201 - DNA, 20 bp, Homo sapiens
gtacatttggaacagtgaca

SEQ ID NO: 6349202 - DNA, 21 bp, Homo sapiens
gtacatttggaacagtgacaa

SEQ ID NO: 6349203 - DNA, 15 bp, Homo sapiens
gtacatttggagaca

SEQ ID NO: 6349204 - DNA, 19 bp, Homo sapiens
gtacattttggatttcttt

SEQ ID NO: 6349205 - DNA, 22 bp, Homo sapiens
gtacattttgttgtaaaaagaa

SEQ ID NO: 6349206 - DNA, 23 bp, Homo sapiens
gtacatttttaaattcttactct

SEQ ID NO: 6349207 - DNA, 21 bp, Homo sapiens
gtacatttttcaactttgaat

SEQ ID NO: 6349208 - DNA, 22 bp, Homo sapiens
gtacatttttcaactttgaata

SEQ ID NO: 6349209 - DNA, 23 bp, Homo sapiens
gtacatttttcaactttgaataa

SEQ ID NO: 6349210 - DNA, 16 bp, Homo sapiens
gtacatttttcagcag

SEQ ID NO: 6349211 - DNA, 19 bp, Homo sapiens
gtacatttttcagcagcaa

SEQ ID NO: 6349212 - DNA, 22 bp, Homo sapiens
gtacatttttgatcaaatgtac

SEQ ID NO: 6349213 - DNA, 14 bp, Homo sapiens
gtaccaaaacatcc

SEQ ID NO: 6349214 - DNA, 19 bp, Homo sapiens
gtaccaaagaaacaccact

SEQ ID NO: 6349215 - DNA, 12 bp, Homo sapiens
gtaccaaagctg

SEQ ID NO: 6349216 - DNA, 16 bp, Homo sapiens
gtaccaaatgctttaa

SEQ ID NO: 6349217 - DNA, 17 bp, Homo sapiens
gtaccaaccatccaatt

SEQ ID NO: 6349218 - DNA, 14 bp, Homo sapiens
gtaccaactgagcc

SEQ ID NO: 6349219 - DNA, 20 bp, Homo sapiens
gtaccaagactactagggaa

SEQ ID NO: 6349220 - DNA, 19 bp, Homo sapiens
gtaccaagatcacaaatag

SEQ ID NO: 6349221 - DNA, 20 bp, Homo sapiens
gtaccaagtgcttcctacaa

SEQ ID NO: 6349222 - DNA, 21 bp, Homo sapiens
gtaccaatcattttaattatt

SEQ ID NO: 6349223 - DNA, 14 bp, Homo sapiens
gtaccaatcgtctc

SEQ ID NO: 6349224 - DNA, 22 bp, Homo sapiens
gtaccaatgcagaactcccaag

SEQ ID NO: 6349225 - DNA, 14 bp, Homo sapiens
gtaccaatgctgtt

SEQ ID NO: 6349226 - DNA, 15 bp, Homo sapiens
gtaccaatgctgttg

SEQ ID NO: 6349227 - DNA, 20 bp, Homo sapiens
gtaccacaccctgcctgctg

SEQ ID NO: 6349228 - DNA, 22 bp, Homo sapiens
gtaccacaccctgcctgctgtg

SEQ ID NO: 6349229 - DNA, 23 bp, Homo sapiens
gtaccacaccctgcctgctgtgg

SEQ ID NO: 6349230 - DNA, 22 bp, Homo sapiens
gtaccacagacacaatatgtat

SEQ ID NO: 6349231 - DNA, 19 bp, Homo sapiens
gtaccactgaatctgtaca

SEQ ID NO: 6349232 - DNA, 16 bp, Homo sapiens
gtaccactgctaataa

SEQ ID NO: 6349233 - DNA, 17 bp, Homo sapiens
gtaccactgctaataaa

SEQ ID NO: 6349234 - DNA, 18 bp, Homo sapiens
gtaccactgctaataaat

SEQ ID NO: 6349235 - DNA, 16 bp, Homo sapiens
gtaccacttttgcaaa

SEQ ID NO: 6349236 - DNA, 16 bp, Homo sapiens
gtaccagataaaatta

SEQ ID NO: 6349237 - DNA, 17 bp, Homo sapiens
gtaccagataacttttt

SEQ ID NO: 6349238 - DNA, 16 bp, Homo sapiens
gtaccagcaatatgta

SEQ ID NO: 6349239 - DNA, 13 bp, Homo sapiens
gtaccagcatgtt

SEQ ID NO: 6349240 - DNA, 13 bp, Homo sapiens
gtaccagcccagg

SEQ ID NO: 6349241 - DNA, 16 bp, Homo sapiens
gtaccagcccaggcaa

SEQ ID NO: 6349242 - DNA, 13 bp, Homo sapiens
gtaccagccccac

SEQ ID NO: 6349243 - DNA, 16 bp, Homo sapiens
gtaccagccctggggc

SEQ ID NO: 6349244 - DNA, 14 bp, Homo sapiens
gtaccagcctgact

SEQ ID NO: 6349245 - DNA, 21 bp, Homo sapiens
gtaccagcgctctaaaagcac

SEQ ID NO: 6349246 - DNA, 12 bp, Homo sapiens
gtaccagctcac

SEQ ID NO: 6349247 - DNA, 15 bp, Homo sapiens
gtaccaggcacatgg

SEQ ID NO: 6349248 - DNA, 22 bp, Homo sapiens
gtaccaggcacatggctggggg

SEQ ID NO: 6349249 - DNA, 18 bp, Homo sapiens
gtaccaggccacccactg

SEQ ID NO: 6349250 - DNA, 15 bp, Homo sapiens
gtaccagggctctgt

SEQ ID NO: 6349251 - DNA, 22 bp, Homo sapiens
gtaccaggggctgggctccctg

SEQ ID NO: 6349252 - DNA, 19 bp, Homo sapiens
gtaccagtgtaaattcagt

SEQ ID NO: 6349253 - DNA, 21 bp, Homo sapiens
gtaccagtgttagtgggaaga

SEQ ID NO: 6349254 - DNA, 23 bp, Homo sapiens
gtaccagtgttagtgggaagagc

SEQ ID NO: 6349255 - DNA, 23 bp, Homo sapiens
gtaccagttaatttttccaacta

SEQ ID NO: 6349256 - DNA, 14 bp, Homo sapiens
gtaccataatctta

SEQ ID NO: 6349257 - DNA, 16 bp, Homo sapiens
gtaccataatcttaga

SEQ ID NO: 6349258 - DNA, 16 bp, Homo sapiens
gtaccatcaataaagt

SEQ ID NO: 6349259 - DNA, 19 bp, Homo sapiens
gtaccatcattttattata

SEQ ID NO: 6349260 - DNA, 13 bp, Homo sapiens
gtaccatcccact

SEQ ID NO: 6349261 - DNA, 17 bp, Homo sapiens
gtaccatcccactgata

SEQ ID NO: 6349262 - DNA, 22 bp, Homo sapiens
gtaccatctactcttttgaagt

SEQ ID NO: 6349263 - DNA, 23 bp, Homo sapiens
gtaccatctgtcttgccagccag

SEQ ID NO: 6349264 - DNA, 20 bp, Homo sapiens
gtaccatgaaacaaagctgc

SEQ ID NO: 6349265 - DNA, 16 bp, Homo sapiens
gtaccatgaatattta

SEQ ID NO: 6349266 - DNA, 18 bp, Homo sapiens
gtaccatggttgtgcaca

SEQ ID NO: 6349267 - DNA, 15 bp, Homo sapiens
gtaccattaaaatat

SEQ ID NO: 6349268 - DNA, 19 bp, Homo sapiens
gtaccattccttcaaataa

SEQ ID NO: 6349269 - DNA, 22 bp, Homo sapiens
gtaccattccttcaaataaaga

SEQ ID NO: 6349270 - DNA, 22 bp, Homo sapiens
gtaccatttaatggggaggaca

SEQ ID NO: 6349271 - DNA, 21 bp, Homo sapiens
gtaccatttatacaaattaga

SEQ ID NO: 6349272 - DNA, 20 bp, Homo sapiens
gtaccatttgtgtctcttta

SEQ ID NO: 6349273 - DNA, 23 bp, Homo sapiens
gtacccaaccaaagatgcttaaa

SEQ ID NO: 6349274 - DNA, 15 bp, Homo sapiens
gtacccaaggtcaca

SEQ ID NO: 6349275 - DNA, 22 bp, Homo sapiens
gtacccacaggtgaggggcagg

SEQ ID NO: 6349276 - DNA, 12 bp, Homo sapiens
gtacccacccca

SEQ ID NO: 6349277 - DNA, 15 bp, Homo sapiens
gtacccaccccagca

SEQ ID NO: 6349278 - DNA, 20 bp, Homo sapiens
gtacccaccccagcacagcc

SEQ ID NO: 6349279 - DNA, 19 bp, Homo sapiens
gtacccaccgggccactcc

SEQ ID NO: 6349280 - DNA, 16 bp, Homo sapiens
gtacccacctgagctt

SEQ ID NO: 6349281 - DNA, 15 bp, Homo sapiens
gtacccactgctctg

SEQ ID NO: 6349282 - DNA, 13 bp, Homo sapiens
gtacccagatgcc

SEQ ID NO: 6349283 - DNA, 11 bp, Homo sapiens
gtacccagcaa

SEQ ID NO: 6349284 - DNA, 19 bp, Homo sapiens
gtacccagcaaatgggcat

SEQ ID NO: 6349285 - DNA, 11 bp, Homo sapiens
gtacccagcca

SEQ ID NO: 6349286 - DNA, 15 bp, Homo sapiens
gtacccagccatctg

SEQ ID NO: 6349287 - DNA, 18 bp, Homo sapiens
gtacccagccatgtgttg

SEQ ID NO: 6349288 - DNA, 24 bp, Homo sapiens
gtacccagctccttttgtccccag

SEQ ID NO: 6349289 - DNA, 12 bp, Homo sapiens
gtaccccaccct

SEQ ID NO: 6349290 - DNA, 13 bp, Homo sapiens
gtaccccaccctc

SEQ ID NO: 6349291 - DNA, 19 bp, Homo sapiens
gtaccccaccctcagcacc

SEQ ID NO: 6349292 - DNA, 23 bp, Homo sapiens
gtaccccaccctcagcacccctt

SEQ ID NO: 6349293 - DNA, 15 bp, Homo sapiens
gtaccccatcccttc

SEQ ID NO: 6349294 - DNA, 17 bp, Homo sapiens
gtaccccatcccttcct

SEQ ID NO: 6349295 - DNA, 15 bp, Homo sapiens
gtacccccaggacca

SEQ ID NO: 6349296 - DNA, 13 bp, Homo sapiens
gtacccccgccca

SEQ ID NO: 6349297 - DNA, 20 bp, Homo sapiens
gtacccccgcccaggctggc

SEQ ID NO: 6349298 - DNA, 23 bp, Homo sapiens
gtacccccgcccaggctggccag

SEQ ID NO: 6349299 - DNA, 23 bp, Homo sapiens
gtacccccgtggtctttgaataa

SEQ ID NO: 6349300 - DNA, 22 bp, Homo sapiens
gtaccccctcaaaccctgccct

SEQ ID NO: 6349301 - DNA, 12 bp, Homo sapiens
gtacccccttct

SEQ ID NO: 6349302 - DNA, 15 bp, Homo sapiens
gtacccccttctggg

SEQ ID NO: 6349303 - DNA, 17 bp, Homo sapiens
gtaccccctttcccttc

SEQ ID NO: 6349304 - DNA, 20 bp, Homo sapiens
gtacccgcctgagctcctgc

SEQ ID NO: 6349305 - DNA, 22 bp, Homo sapiens
gtacccgctacaattctgcaga

SEQ ID NO: 6349306 - DNA, 16 bp, Homo sapiens
gtaccctatgttcact

SEQ ID NO: 6349307 - DNA, 21 bp, Homo sapiens
gtaccctcgactggcaataat

SEQ ID NO: 6349308 - DNA, 19 bp, Homo sapiens
gtaccctctcagctccagg

SEQ ID NO: 6349309 - DNA, 16 bp, Homo sapiens
gtaccctctgaaatac

SEQ ID NO: 6349310 - DNA, 15 bp, Homo sapiens
gtaccctctggaggg

SEQ ID NO: 6349311 - DNA, 16 bp, Homo sapiens
gtaccctgcaggccag

SEQ ID NO: 6349312 - DNA, 19 bp, Homo sapiens
gtaccctgcaggccaggcc

SEQ ID NO: 6349313 - DNA, 13 bp, Homo sapiens
gtaccctgcttcc

SEQ ID NO: 6349314 - DNA, 14 bp, Homo sapiens
gtacccttccacct

SEQ ID NO: 6349315 - DNA, 20 bp, Homo sapiens
gtacccttccacctcctaga

SEQ ID NO: 6349316 - DNA, 20 bp, Homo sapiens
gtacccttgttattatctac

SEQ ID NO: 6349317 - DNA, 20 bp, Homo sapiens
gtaccctttaagatatccat

SEQ ID NO: 6349318 - DNA, 22 bp, Homo sapiens
gtaccctttaagatatccatct

SEQ ID NO: 6349319 - DNA, 14 bp, Homo sapiens
gtaccgatttctgc

SEQ ID NO: 6349320 - DNA, 16 bp, Homo sapiens
gtaccgatttctgcta

SEQ ID NO: 6349321 - DNA, 19 bp, Homo sapiens
gtaccgccagcagctgtca

SEQ ID NO: 6349322 - DNA, 18 bp, Homo sapiens
gtaccgcccggcagcccc

SEQ ID NO: 6349323 - DNA, 22 bp, Homo sapiens
gtaccgcccggcagccccttct

SEQ ID NO: 6349324 - DNA, 18 bp, Homo sapiens
gtaccgcgtctaccctgg

SEQ ID NO: 6349325 - DNA, 17 bp, Homo sapiens
gtaccgtcgacaagaat

SEQ ID NO: 6349326 - DNA, 23 bp, Homo sapiens
gtacctaagactaatgctttctg

SEQ ID NO: 6349327 - DNA, 16 bp, Homo sapiens
gtacctatggctgcct

SEQ ID NO: 6349328 - DNA, 18 bp, Homo sapiens
gtacctatgtgacagaca

SEQ ID NO: 6349329 - DNA, 22 bp, Homo sapiens
gtacctatgtgagtttcagaaa

SEQ ID NO: 6349330 - DNA, 16 bp, Homo sapiens
gtacctattaaaagtt

SEQ ID NO: 6349331 - DNA, 17 bp, Homo sapiens
gtacctattccttcaga

SEQ ID NO: 6349332 - DNA, 18 bp, Homo sapiens
gtacctatttggtgctag

SEQ ID NO: 6349333 - DNA, 14 bp, Homo sapiens
gtacctattttcat

SEQ ID NO: 6349334 - DNA, 13 bp, Homo sapiens
gtacctcaaatga

SEQ ID NO: 6349335 - DNA, 16 bp, Homo sapiens
gtacctcaagccccat

SEQ ID NO: 6349336 - DNA, 19 bp, Homo sapiens
gtacctcaagccccatttc

SEQ ID NO: 6349337 - DNA, 14 bp, Homo sapiens
gtacctcactgtcc

SEQ ID NO: 6349338 - DNA, 21 bp, Homo sapiens
gtacctcagtggatcttcaga

SEQ ID NO: 6349339 - DNA, 11 bp, Homo sapiens
taaagaccaaa

SEQ ID NO: 6349340 - DNA, 14 bp, Homo sapiens
taaagaccaaactt

SEQ ID NO: 6349341 - DNA, 21 bp, Homo sapiens
taaagaccaataaacttcctt

SEQ ID NO: 6349342 - DNA, 21 bp, Homo sapiens
taaagaccaatttatgggaga

SEQ ID NO: 6349343 - DNA, 16 bp, Homo sapiens
taaagaccagaaattc

SEQ ID NO: 6349344 - DNA, 15 bp, Homo sapiens
taaagaccatttaat

SEQ ID NO: 6349345 - DNA, 21 bp, Homo sapiens
taaagacccagggggagaatg

SEQ ID NO: 6349346 - DNA, 19 bp, Homo sapiens
taaagaccctcctattcta

SEQ ID NO: 6349347 - DNA, 17 bp, Homo sapiens
taaagactacaataaaa

SEQ ID NO: 6349348 - DNA, 20 bp, Homo sapiens
taaagacttaagattaaatt

SEQ ID NO: 6349349 - DNA, 12 bp, Homo sapiens
taaagacttgat

SEQ ID NO: 6349350 - DNA, 18 bp, Homo sapiens
taaagacttgatgaataa

SEQ ID NO: 6349351 - DNA, 20 bp, Homo sapiens
taaagacttgtgcatccctc

SEQ ID NO: 6349352 - DNA, 16 bp, Homo sapiens
taaagacttttatgat

SEQ ID NO: 6349353 - DNA, 23 bp, Homo sapiens
taaagagaaaagggaaaaaagaa

SEQ ID NO: 6349354 - DNA, 13 bp, Homo sapiens
taaagagaaaatg

SEQ ID NO: 6349355 - DNA, 13 bp, Homo sapiens
taaagagaaaatt

SEQ ID NO: 6349356 - DNA, 11 bp, Homo sapiens
taaagagaaca

SEQ ID NO: 6349357 - DNA, 12 bp, Homo sapiens
taaagagaatga

SEQ ID NO: 6349358 - DNA, 16 bp, Homo sapiens
taaagagacaaatagt

SEQ ID NO: 6349359 - DNA, 17 bp, Homo sapiens
taaagagacaaatagta

SEQ ID NO: 6349360 - DNA, 18 bp, Homo sapiens
taaagagacaaatagtag

SEQ ID NO: 6349361 - DNA, 15 bp, Homo sapiens
taaagagacctacct

SEQ ID NO: 6349362 - DNA, 22 bp, Homo sapiens
taaagagacctacctcaggttg

SEQ ID NO: 6349363 - DNA, 13 bp, Homo sapiens
taaagagacgaat

SEQ ID NO: 6349364 - DNA, 12 bp, Homo sapiens
taaagagagaat

SEQ ID NO: 6349365 - DNA, 16 bp, Homo sapiens
taaagagagtttgcca

SEQ ID NO: 6349366 - DNA, 15 bp, Homo sapiens
taaagagataaagaa

SEQ ID NO: 6349367 - DNA, 11 bp, Homo sapiens
taaagagcatc

SEQ ID NO: 6349368 - DNA, 20 bp, Homo sapiens
taaagagcccctcctaaccc

SEQ ID NO: 6349369 - DNA, 21 bp, Homo sapiens
taaagagcccttgcctcccca

SEQ ID NO: 6349370 - DNA, 17 bp, Homo sapiens
taaagagctaggaaaga

SEQ ID NO: 6349371 - DNA, 18 bp, Homo sapiens
taaagagctaggaaagag

SEQ ID NO: 6349372 - DNA, 18 bp, Homo sapiens
taaagaggagaaggaaaa

SEQ ID NO: 6349373 - DNA, 19 bp, Homo sapiens
taaagaggagaaggaaaac

SEQ ID NO: 6349374 - DNA, 21 bp, Homo sapiens
taaagaggagcctttccagaa

SEQ ID NO: 6349375 - DNA, 21 bp, Homo sapiens
taaagaggagtgttattgcat

SEQ ID NO: 6349376 - DNA, 18 bp, Homo sapiens
taaagaggcatcttttct

SEQ ID NO: 6349377 - DNA, 16 bp, Homo sapiens
taaagaggctgtgtgg

SEQ ID NO: 6349378 - DNA, 22 bp, Homo sapiens
taaagagtacactcagccactg

SEQ ID NO: 6349379 - DNA, 16 bp, Homo sapiens
taaagagtatttacaa

SEQ ID NO: 6349380 - DNA, 23 bp, Homo sapiens
taaagagtctagattcaaaggtt

SEQ ID NO: 6349381 - DNA, 16 bp, Homo sapiens
taaagagtgaatgcca

SEQ ID NO: 6349382 - DNA, 14 bp, Homo sapiens
taaagagtgtggca

SEQ ID NO: 6349383 - DNA, 18 bp, Homo sapiens
taaagagttagtttgagt

SEQ ID NO: 6349384 - DNA, 15 bp, Homo sapiens
taaagagttctcctt

SEQ ID NO: 6349385 - DNA, 20 bp, Homo sapiens
taaagataaaaggataggaa

SEQ ID NO: 6349386 - DNA, 22 bp, Homo sapiens
taaagataaaaggataggaaaa

SEQ ID NO: 6349387 - DNA, 16 bp, Homo sapiens
taaagatacaaaatgt

SEQ ID NO: 6349388 - DNA, 17 bp, Homo sapiens
taaagatacaaaatgtt

SEQ ID NO: 6349389 - DNA, 14 bp, Homo sapiens
taaagatacatgat

SEQ ID NO: 6349390 - DNA, 18 bp, Homo sapiens
taaagatacatgattgaa

SEQ ID NO: 6349391 - DNA, 13 bp, Homo sapiens
taaagataccaaa

SEQ ID NO: 6349392 - DNA, 19 bp, Homo sapiens
taaagatatcaatactaag

SEQ ID NO: 6349393 - DNA, 20 bp, Homo sapiens
taaagatatcagagctctta

SEQ ID NO: 6349394 - DNA, 16 bp, Homo sapiens
taaagatatggagaat

SEQ ID NO: 6349395 - DNA, 15 bp, Homo sapiens
taaagatattgtatc

SEQ ID NO: 6349396 - DNA, 16 bp, Homo sapiens
taaagatattgtatct

SEQ ID NO: 6349397 - DNA, 22 bp, Homo sapiens
taaagatattgtatctccttta

SEQ ID NO: 6349398 - DNA, 24 bp, Homo sapiens
taaagatattgtatctcctttaat

SEQ ID NO: 6349399 - DNA, 15 bp, Homo sapiens
taaagatatttcttt

SEQ ID NO: 6349400 - DNA, 21 bp, Homo sapiens
taaagatatttttatctttat

SEQ ID NO: 6349401 - DNA, 18 bp, Homo sapiens
taaagatatttttattca

SEQ ID NO: 6349402 - DNA, 18 bp, Homo sapiens
taaagatcaagtgggcct

SEQ ID NO: 6349403 - DNA, 18 bp, Homo sapiens
taaagatctcaacatgga

SEQ ID NO: 6349404 - DNA, 14 bp, Homo sapiens
taaagatctccagt

SEQ ID NO: 6349405 - DNA, 20 bp, Homo sapiens
taaagatctttttttaagtg

SEQ ID NO: 6349406 - DNA, 14 bp, Homo sapiens
taaagatgaatgtc

SEQ ID NO: 6349407 - DNA, 19 bp, Homo sapiens
taaagatgagctttgtcta

SEQ ID NO: 6349408 - DNA, 18 bp, Homo sapiens
taaagatgatattaagaa

SEQ ID NO: 6349409 - DNA, 11 bp, Homo sapiens
taaagatgatc

SEQ ID NO: 6349410 - DNA, 23 bp, Homo sapiens
taaagatgattgttcttttgttt

SEQ ID NO: 6349411 - DNA, 22 bp, Homo sapiens
taaagatgcaaggaccaggact

SEQ ID NO: 6349412 - DNA, 19 bp, Homo sapiens
taaagatgccatagcataa

SEQ ID NO: 6349413 - DNA, 13 bp, Homo sapiens
taaagatggcttt

SEQ ID NO: 6349414 - DNA, 20 bp, Homo sapiens
taaagatgtagcaaaccctg

SEQ ID NO: 6349415 - DNA, 22 bp, Homo sapiens
taaagatgtcaaatatctcaga

SEQ ID NO: 6349416 - DNA, 14 bp, Homo sapiens
taaagatgtgaaaa

SEQ ID NO: 6349417 - DNA, 11 bp, Homo sapiens
taaagatgtgt

SEQ ID NO: 6349418 - DNA, 15 bp, Homo sapiens
taaagattagggaaa

SEQ ID NO: 6349419 - DNA, 20 bp, Homo sapiens
taaagattagggaaaatgga

SEQ ID NO: 6349420 - DNA, 19 bp, Homo sapiens
taaagattctatagttcta

SEQ ID NO: 6349421 - DNA, 24 bp, Homo sapiens
taaagattctatagttctagacat

SEQ ID NO: 6349422 - DNA, 19 bp, Homo sapiens
taaagattctctttaaaaa

SEQ ID NO: 6349423 - DNA, 13 bp, Homo sapiens
taaagattgtgtg

SEQ ID NO: 6349424 - DNA, 14 bp, Homo sapiens
taaagattgttaaa

SEQ ID NO: 6349425 - DNA, 20 bp, Homo sapiens
taaagatttatacagttgaa

SEQ ID NO: 6349426 - DNA, 18 bp, Homo sapiens
taaagatttatttagcta

SEQ ID NO: 6349427 - DNA, 17 bp, Homo sapiens
taaagatttctagtagg

SEQ ID NO: 6349428 - DNA, 19 bp, Homo sapiens
taaagattttgatctcaca

SEQ ID NO: 6349429 - DNA, 17 bp, Homo sapiens
taaagattttttaataa

SEQ ID NO: 6349430 - DNA, 13 bp, Homo sapiens
taaagcaaaatat

SEQ ID NO: 6349431 - DNA, 16 bp, Homo sapiens
taaagcaaaatatttg

SEQ ID NO: 6349432 - DNA, 18 bp, Homo sapiens
taaagcaaaccagcctca

SEQ ID NO: 6349433 - DNA, 22 bp, Homo sapiens
taaagcaaagcgctaagtaaaa

SEQ ID NO: 6349434 - DNA, 15 bp, Homo sapiens
taaagcaaattgttt

SEQ ID NO: 6349435 - DNA, 12 bp, Homo sapiens
taaagcaacatt

SEQ ID NO: 6349436 - DNA, 21 bp, Homo sapiens
taaagcaaccaaaaagaaaaa

SEQ ID NO: 6349437 - DNA, 16 bp, Homo sapiens
taaagcaactgtctat

SEQ ID NO: 6349438 - DNA, 13 bp, Homo sapiens
taaagcaatagaa

SEQ ID NO: 6349439 - DNA, 22 bp, Homo sapiens
taaagcaatctgattcagcatc

SEQ ID NO: 6349440 - DNA, 14 bp, Homo sapiens
taaagcaattgcat

SEQ ID NO: 6349441 - DNA, 11 bp, Homo sapiens
taaagcaattt

SEQ ID NO: 6349442 - DNA, 12 bp, Homo sapiens
taaagcaatttt

SEQ ID NO: 6349443 - DNA, 15 bp, Homo sapiens
taaagcaattttcct

SEQ ID NO: 6349444 - DNA, 21 bp, Homo sapiens
taaagcaattttccttgaagc

SEQ ID NO: 6349445 - DNA, 22 bp, Homo sapiens
taaagcacagtctgatgacaca

SEQ ID NO: 6349446 - DNA, 15 bp, Homo sapiens
taaagcacattttaa

SEQ ID NO: 6349447 - DNA, 19 bp, Homo sapiens
taaagcaccagcagtgttt

SEQ ID NO: 6349448 - DNA, 19 bp, Homo sapiens
taaagcacgcagttatgtt

SEQ ID NO: 6349449 - DNA, 18 bp, Homo sapiens
taaagcacgtgcaaggac

SEQ ID NO: 6349450 - DNA, 15 bp, Homo sapiens
taaagcagaagcccc

SEQ ID NO: 6349451 - DNA, 18 bp, Homo sapiens
taaagcagagccaaggcc

SEQ ID NO: 6349452 - DNA, 20 bp, Homo sapiens
taaagcagagggactttgta

SEQ ID NO: 6349453 - DNA, 10 bp, Homo sapiens
taaagcagcc

SEQ ID NO: 6349454 - DNA, 13 bp, Homo sapiens
taaagcagcctga

SEQ ID NO: 6349455 - DNA, 19 bp, Homo sapiens
taaagcagcgtttctatga

SEQ ID NO: 6349456 - DNA, 11 bp, Homo sapiens
taaagcaggga

SEQ ID NO: 6349457 - DNA, 15 bp, Homo sapiens
taaagcagtaaaata

SEQ ID NO: 6349458 - DNA, 16 bp, Homo sapiens
taaagcagtgttttca

SEQ ID NO: 6349459 - DNA, 18 bp, Homo sapiens
taaagcagttaatttata

SEQ ID NO: 6349460 - DNA, 22 bp, Homo sapiens
taaagcagtttattataatggt

SEQ ID NO: 6349461 - DNA, 12 bp, Homo sapiens
taaagcatatag

SEQ ID NO: 6349462 - DNA, 13 bp, Homo sapiens
taaagcatcctcc

SEQ ID NO: 6349463 - DNA, 16 bp, Homo sapiens
taaagcatcctcctcc

SEQ ID NO: 6349464 - DNA, 16 bp, Homo sapiens
taaagcatctgtaaat

SEQ ID NO: 6349465 - DNA, 17 bp, Homo sapiens
taaagcatgaaatgtga

SEQ ID NO: 6349466 - DNA, 18 bp, Homo sapiens
taaagcatgaaatgtgaa

SEQ ID NO: 6349467 - DNA, 20 bp, Homo sapiens
taaagcatgaaatgtgaatt

SEQ ID NO: 6349468 - DNA, 22 bp, Homo sapiens
taaagcatgaatggtatggaac

SEQ ID NO: 6349469 - DNA, 12 bp, Homo sapiens
taaagcattcca

SEQ ID NO: 6349470 - DNA, 15 bp, Homo sapiens
taaagcattctttaa

SEQ ID NO: 6349471 - DNA, 12 bp, Homo sapiens
taaagcattgct

SEQ ID NO: 6349472 - DNA, 15 bp, Homo sapiens
taaagcattgctgtt

SEQ ID NO: 6349473 - DNA, 21 bp, Homo sapiens
taaagcattgctgttatgtct

SEQ ID NO: 6349474 - DNA, 23 bp, Homo sapiens
taaagcattgctgttatgtctgt

SEQ ID NO: 6349475 - DNA, 13 bp, Homo sapiens
taaagcattgctt

SEQ ID NO: 6349476 - DNA, 21 bp, Homo sapiens
taaagcattgcttttattttg

SEQ ID NO: 6349477 - DNA, 18 bp, Homo sapiens
taaagccaaaggtctaga

SEQ ID NO: 6349478 - DNA, 16 bp, Homo sapiens
taaagccaaagtttct

SEQ ID NO: 6349479 - DNA, 22 bp, Homo sapiens
taaagccaaagtttctgttgaa

SEQ ID NO: 6349480 - DNA, 13 bp, Homo sapiens
taaagccaaatgt

SEQ ID NO: 6349481 - DNA, 12 bp, Homo sapiens
taaagccaagaa

SEQ ID NO: 6349482 - DNA, 18 bp, Homo sapiens
taaagccaagaagaattt

SEQ ID NO: 6349483 - DNA, 13 bp, Homo sapiens
taaagccaagaat

SEQ ID NO: 6349484 - DNA, 23 bp, Homo sapiens
taaagccagcatttcctcagtct

SEQ ID NO: 6349485 - DNA, 17 bp, Homo sapiens
taaagccagcctgacct

SEQ ID NO: 6349486 - DNA, 13 bp, Homo sapiens
taaagccaggaac

SEQ ID NO: 6349487 - DNA, 18 bp, Homo sapiens
taaagccaggctcaggag

SEQ ID NO: 6349488 - DNA, 15 bp, Homo sapiens
taaagccagtcatca

SEQ ID NO: 6349489 - DNA, 18 bp, Homo sapiens
taaagccatcatgccttg

SEQ ID NO: 6349490 - DNA, 15 bp, Homo sapiens
taaagccatgctgga

SEQ ID NO: 6349491 - DNA, 15 bp, Homo sapiens
taaagccatgttaaa

SEQ ID NO: 6349492 - DNA, 20 bp, Homo sapiens
taaagccatttggtcttaat

SEQ ID NO: 6349493 - DNA, 23 bp, Homo sapiens
taaagcccgcctgacagaaacca

SEQ ID NO: 6349494 - DNA, 21 bp, Homo sapiens
taaagccctcagatcccaggg

SEQ ID NO: 6349495 - DNA, 22 bp, Homo sapiens
taaagccctcagatcccagggt

SEQ ID NO: 6349496 - DNA, 12 bp, Homo sapiens
taaagccctctt

SEQ ID NO: 6349497 - DNA, 18 bp, Homo sapiens
taaagccgtgctctttta

SEQ ID NO: 6349498 - DNA, 13 bp, Homo sapiens
taaagcctgaaaa

SEQ ID NO: 6349499 - DNA, 15 bp, Homo sapiens
taaagcctgaaaatt

SEQ ID NO: 6349500 - DNA, 19 bp, Homo sapiens
taaagcctgaaaattccaa

SEQ ID NO: 6349501 - DNA, 20 bp, Homo sapiens
taaagcctgaaaattccaat

SEQ ID NO: 6349502 - DNA, 16 bp, Homo sapiens
taaagcctgcttttta

SEQ ID NO: 6349503 - DNA, 14 bp, Homo sapiens
taaagcctggcttc

SEQ ID NO: 6349504 - DNA, 21 bp, Homo sapiens
taaagcctggcttcttatcct

SEQ ID NO: 6349505 - DNA, 20 bp, Homo sapiens
taaagccttaactaagactc

SEQ ID NO: 6349506 - DNA, 14 bp, Homo sapiens
taaagccttaagca

SEQ ID NO: 6349507 - DNA, 11 bp, Homo sapiens
taaagccttta

SEQ ID NO: 6349508 - DNA, 19 bp, Homo sapiens
taaagcctttaaaaccagt

SEQ ID NO: 6349509 - DNA, 18 bp, Homo sapiens
taaagccttttgctttat

SEQ ID NO: 6349510 - DNA, 17 bp, Homo sapiens
taaagcgaaaaactcaa

SEQ ID NO: 6349511 - DNA, 18 bp, Homo sapiens
taaagcgatatacagatg

SEQ ID NO: 6349512 - DNA, 17 bp, Homo sapiens
taaagcgggaaggacat

SEQ ID NO: 6349513 - DNA, 20 bp, Homo sapiens
taaagcgtagacatatattt

SEQ ID NO: 6349514 - DNA, 15 bp, Homo sapiens
taaagcgtttgcaca

SEQ ID NO: 6349515 - DNA, 16 bp, Homo sapiens
taaagctaaaaatatt

SEQ ID NO: 6349516 - DNA, 15 bp, Homo sapiens
taaagctaaaataac

SEQ ID NO: 6349517 - DNA, 16 bp, Homo sapiens
taaagctaaattttgt

SEQ ID NO: 6349518 - DNA, 16 bp, Homo sapiens
taaagctactgaattt

SEQ ID NO: 6349519 - DNA, 11 bp, Homo sapiens
gtacctcagtt

SEQ ID NO: 6349520 - DNA, 18 bp, Homo sapiens
gtacctccattggcttcc

SEQ ID NO: 6349521 - DNA, 23 bp, Homo sapiens
gtacctcccctccccgccccctg

SEQ ID NO: 6349522 - DNA, 15 bp, Homo sapiens
gtacctcccctgcct

SEQ ID NO: 6349523 - DNA, 18 bp, Homo sapiens
gtacctcccctgccttgc

SEQ ID NO: 6349524 - DNA, 20 bp, Homo sapiens
gtacctcccctgccttgctg

SEQ ID NO: 6349525 - DNA, 13 bp, Homo sapiens
gtacctcgggtgg

SEQ ID NO: 6349526 - DNA, 18 bp, Homo sapiens
gtacctctagctgttctt

SEQ ID NO: 6349527 - DNA, 16 bp, Homo sapiens
gtacctctctctgctc

SEQ ID NO: 6349528 - DNA, 14 bp, Homo sapiens
gtacctctggctga

SEQ ID NO: 6349529 - DNA, 18 bp, Homo sapiens
gtacctctgtatagaaat

SEQ ID NO: 6349530 - DNA, 13 bp, Homo sapiens
gtacctcttgagc

SEQ ID NO: 6349531 - DNA, 23 bp, Homo sapiens
gtacctgaaaagtaacttggctt

SEQ ID NO: 6349532 - DNA, 16 bp, Homo sapiens
gtacctgcaaaaatga

SEQ ID NO: 6349533 - DNA, 19 bp, Homo sapiens
gtacctgcccccactcagc

SEQ ID NO: 6349534 - DNA, 21 bp, Homo sapiens
gtacctgcccccactcagcat

SEQ ID NO: 6349535 - DNA, 14 bp, Homo sapiens
gtacctgccctcta

SEQ ID NO: 6349536 - DNA, 19 bp, Homo sapiens
gtacctgctgccccagctg

SEQ ID NO: 6349537 - DNA, 15 bp, Homo sapiens
gtacctggaggagga

SEQ ID NO: 6349538 - DNA, 18 bp, Homo sapiens
gtacctgggaaaggaccc

SEQ ID NO: 6349539 - DNA, 19 bp, Homo sapiens
gtacctgggaaaggaccca

SEQ ID NO: 6349540 - DNA, 21 bp, Homo sapiens
gtacctgggaaaggacccacc

SEQ ID NO: 6349541 - DNA, 16 bp, Homo sapiens
gtacctggtccccact

SEQ ID NO: 6349542 - DNA, 17 bp, Homo sapiens
gtacctggtccccactg

SEQ ID NO: 6349543 - DNA, 15 bp, Homo sapiens
gtacctgtaggaaac

SEQ ID NO: 6349544 - DNA, 18 bp, Homo sapiens
gtacctgtaggaaacaga

SEQ ID NO: 6349545 - DNA, 23 bp, Homo sapiens
gtacctgtaggaaacagaaaaga

SEQ ID NO: 6349546 - DNA, 21 bp, Homo sapiens
gtacctgtagtgagaaactga

SEQ ID NO: 6349547 - DNA, 21 bp, Homo sapiens
gtacctgtcaaaaattttgaa

SEQ ID NO: 6349548 - DNA, 15 bp, Homo sapiens
gtacctgtccctcca

SEQ ID NO: 6349549 - DNA, 12 bp, Homo sapiens
gtacctgtgcct

SEQ ID NO: 6349550 - DNA, 11 bp, Homo sapiens
gtacctgtggc

SEQ ID NO: 6349551 - DNA, 19 bp, Homo sapiens
gtacctgtgggttagcatc

SEQ ID NO: 6349552 - DNA, 19 bp, Homo sapiens
gtacctgttccttagacct

SEQ ID NO: 6349553 - DNA, 21 bp, Homo sapiens
gtaccttaggttctttctgaa

SEQ ID NO: 6349554 - DNA, 21 bp, Homo sapiens
gtaccttcagaataagcttcc

SEQ ID NO: 6349555 - DNA, 12 bp, Homo sapiens
gtaccttcagcc

SEQ ID NO: 6349556 - DNA, 18 bp, Homo sapiens
gtaccttcagccctggcc

SEQ ID NO: 6349557 - DNA, 12 bp, Homo sapiens
gtaccttcccac

SEQ ID NO: 6349558 - DNA, 23 bp, Homo sapiens
gtaccttgaacactgggggaggg

SEQ ID NO: 6349559 - DNA, 18 bp, Homo sapiens
gtaccttgacctttgtac

SEQ ID NO: 6349560 - DNA, 19 bp, Homo sapiens
gtaccttgacctttgtaca

SEQ ID NO: 6349561 - DNA, 20 bp, Homo sapiens
gtaccttgacctttgtacag

SEQ ID NO: 6349562 - DNA, 14 bp, Homo sapiens
gtaccttgactttg

SEQ ID NO: 6349563 - DNA, 15 bp, Homo sapiens
gtaccttgactttgt

SEQ ID NO: 6349564 - DNA, 23 bp, Homo sapiens
gtaccttgcacacatcatctgta

SEQ ID NO: 6349565 - DNA, 16 bp, Homo sapiens
gtaccttgtgcccagg

SEQ ID NO: 6349566 - DNA, 17 bp, Homo sapiens
gtaccttgttgcagatg

SEQ ID NO: 6349567 - DNA, 14 bp, Homo sapiens
gtacctttccaccc

SEQ ID NO: 6349568 - DNA, 16 bp, Homo sapiens
gtacctttccacccag

SEQ ID NO: 6349569 - DNA, 18 bp, Homo sapiens
gtacctttccacccagac

SEQ ID NO: 6349570 - DNA, 19 bp, Homo sapiens
gtacctttcctacattttc

SEQ ID NO: 6349571 - DNA, 15 bp, Homo sapiens
gtacctttctagcct

SEQ ID NO: 6349572 - DNA, 22 bp, Homo sapiens
gtacctttctgacaataaataa

SEQ ID NO: 6349573 - DNA, 16 bp, Homo sapiens
gtacctttcttcactg

SEQ ID NO: 6349574 - DNA, 23 bp, Homo sapiens
gtaccttttgaggagccccagct

SEQ ID NO: 6349575 - DNA, 19 bp, Homo sapiens
gtacgaacccctcccctcc

SEQ ID NO: 6349576 - DNA, 19 bp, Homo sapiens
gtacgacgtcagatgttta

SEQ ID NO: 6349577 - DNA, 21 bp, Homo sapiens
gtacgagtagaggtttaaaga

SEQ ID NO: 6349578 - DNA, 22 bp, Homo sapiens
gtacgatcaagttgttgactgt

SEQ ID NO: 6349579 - DNA, 15 bp, Homo sapiens
gtacgatgacagtgt

SEQ ID NO: 6349580 - DNA, 13 bp, Homo sapiens
gtacgcaattctc

SEQ ID NO: 6349581 - DNA, 14 bp, Homo sapiens
gtacgcccaggaca

SEQ ID NO: 6349582 - DNA, 13 bp, Homo sapiens
gtacgctagagca

SEQ ID NO: 6349583 - DNA, 17 bp, Homo sapiens
gtacgctgcgtgccatg

SEQ ID NO: 6349584 - DNA, 15 bp, Homo sapiens
gtacggctgctgcac

SEQ ID NO: 6349585 - DNA, 16 bp, Homo sapiens
gtacgtactgcatttg

SEQ ID NO: 6349586 - DNA, 14 bp, Homo sapiens
gtacgtagccacag

SEQ ID NO: 6349587 - DNA, 12 bp, Homo sapiens
gtacgtcccagc

SEQ ID NO: 6349588 - DNA, 15 bp, Homo sapiens
gtacgtcccagcggc

SEQ ID NO: 6349589 - DNA, 15 bp, Homo sapiens
gtacgtcctgcctgg

SEQ ID NO: 6349590 - DNA, 17 bp, Homo sapiens
gtacgtcctgcctggca

SEQ ID NO: 6349591 - DNA, 16 bp, Homo sapiens
gtacgtgggagaggca

SEQ ID NO: 6349592 - DNA, 22 bp, Homo sapiens
gtacgtgggtacccaggctggt

SEQ ID NO: 6349593 - DNA, 16 bp, Homo sapiens
gtacgttaattaaaca

SEQ ID NO: 6349594 - DNA, 15 bp, Homo sapiens
gtacgttgtgcattt

SEQ ID NO: 6349595 - DNA, 15 bp, Homo sapiens
gtacgttttgcacat

SEQ ID NO: 6349596 - DNA, 14 bp, Homo sapiens
gtacgtttttgcat

SEQ ID NO: 6349597 - DNA, 21 bp, Homo sapiens
gtactaaaagaaactatgatg

SEQ ID NO: 6349598 - DNA, 13 bp, Homo sapiens
gtactaaatttaa

SEQ ID NO: 6349599 - DNA, 13 bp, Homo sapiens
gtactaacccagt

SEQ ID NO: 6349600 - DNA, 20 bp, Homo sapiens
gtactaacccagtctttctt

SEQ ID NO: 6349601 - DNA, 22 bp, Homo sapiens
gtactaactcctaggaaaatac

SEQ ID NO: 6349602 - DNA, 16 bp, Homo sapiens
gtactaagccaggagg

SEQ ID NO: 6349603 - DNA, 17 bp, Homo sapiens
gtactaatatttctgta

SEQ ID NO: 6349604 - DNA, 12 bp, Homo sapiens
gtactacaattt

SEQ ID NO: 6349605 - DNA, 19 bp, Homo sapiens
gtactacagtcctcccatc

SEQ ID NO: 6349606 - DNA, 14 bp, Homo sapiens
gtactacatttgca

SEQ ID NO: 6349607 - DNA, 15 bp, Homo sapiens
gtactacattttctt

SEQ ID NO: 6349608 - DNA, 15 bp, Homo sapiens
gtactacccagctct

SEQ ID NO: 6349609 - DNA, 16 bp, Homo sapiens
gtactacccagctctg

SEQ ID NO: 6349610 - DNA, 17 bp, Homo sapiens
gtactacccagctctgt

SEQ ID NO: 6349611 - DNA, 22 bp, Homo sapiens
gtactaccccaggatgcatgca

SEQ ID NO: 6349612 - DNA, 15 bp, Homo sapiens
gtactactagatgtc

SEQ ID NO: 6349613 - DNA, 22 bp, Homo sapiens
gtactactgctgcaaagtgcaa

SEQ ID NO: 6349614 - DNA, 13 bp, Homo sapiens
gtactactgtaga

SEQ ID NO: 6349615 - DNA, 13 bp, Homo sapiens
gtactagaaaaat

SEQ ID NO: 6349616 - DNA, 19 bp, Homo sapiens
gtactagaatttgtatttt

SEQ ID NO: 6349617 - DNA, 14 bp, Homo sapiens
gtactagagatatt

SEQ ID NO: 6349618 - DNA, 18 bp, Homo sapiens
gtactagcattttccacg

SEQ ID NO: 6349619 - DNA, 21 bp, Homo sapiens
gtactagcattttccacgctg

SEQ ID NO: 6349620 - DNA, 22 bp, Homo sapiens
gtactagggggaagtgacaagg

SEQ ID NO: 6349621 - DNA, 21 bp, Homo sapiens
gtactaggttggacagccccc

SEQ ID NO: 6349622 - DNA, 19 bp, Homo sapiens
gtactagtggcatggagaa

SEQ ID NO: 6349623 - DNA, 16 bp, Homo sapiens
gtactagttacacatc

SEQ ID NO: 6349624 - DNA, 13 bp, Homo sapiens
gtactagttttag

SEQ ID NO: 6349625 - DNA, 19 bp, Homo sapiens
gtactataagtagttggtt

SEQ ID NO: 6349626 - DNA, 20 bp, Homo sapiens
gtactataagtagttggttt

SEQ ID NO: 6349627 - DNA, 16 bp, Homo sapiens
gtactatatctgtttt

SEQ ID NO: 6349628 - DNA, 14 bp, Homo sapiens
gtactatctgtgaa

SEQ ID NO: 6349629 - DNA, 21 bp, Homo sapiens
gtactatctgtgcgtagaagt

SEQ ID NO: 6349630 - DNA, 12 bp, Homo sapiens
gtactatctttg

SEQ ID NO: 6349631 - DNA, 18 bp, Homo sapiens
gtactatctttgtctaaa

SEQ ID NO: 6349632 - DNA, 21 bp, Homo sapiens
gtactatgatgggcttctgtt

SEQ ID NO: 6349633 - DNA, 15 bp, Homo sapiens
gtactatgtatcaat

SEQ ID NO: 6349634 - DNA, 17 bp, Homo sapiens
gtactatgtatcaatga

SEQ ID NO: 6349635 - DNA, 16 bp, Homo sapiens
gtactatgttaataac

SEQ ID NO: 6349636 - DNA, 20 bp, Homo sapiens
gtactattgtttaaaaacag

SEQ ID NO: 6349637 - DNA, 16 bp, Homo sapiens
gtactcaaagcccaga

SEQ ID NO: 6349638 - DNA, 18 bp, Homo sapiens
gtactcaaattcaatgat

SEQ ID NO: 6349639 - DNA, 19 bp, Homo sapiens
gtactcaagccagcctgta

SEQ ID NO: 6349640 - DNA, 16 bp, Homo sapiens
gtactcacatataaca

SEQ ID NO: 6349641 - DNA, 14 bp, Homo sapiens
gtactcacttttca

SEQ ID NO: 6349642 - DNA, 17 bp, Homo sapiens
gtactcacttttcactt

SEQ ID NO: 6349643 - DNA, 13 bp, Homo sapiens
gtactcagagcag

SEQ ID NO: 6349644 - DNA, 15 bp, Homo sapiens
gtactcagagcagag

SEQ ID NO: 6349645 - DNA, 23 bp, Homo sapiens
gtactcaggaggctgaggggagg

SEQ ID NO: 6349646 - DNA, 11 bp, Homo sapiens
gtactcagggc

SEQ ID NO: 6349647 - DNA, 21 bp, Homo sapiens
gtactcagtatagcattgaac

SEQ ID NO: 6349648 - DNA, 19 bp, Homo sapiens
gtactccacactgcacaat

SEQ ID NO: 6349649 - DNA, 21 bp, Homo sapiens
gtactccacactgcacaataa

SEQ ID NO: 6349650 - DNA, 19 bp, Homo sapiens
gtactccacatatttcagt

SEQ ID NO: 6349651 - DNA, 14 bp, Homo sapiens
gtactccagcaggt

SEQ ID NO: 6349652 - DNA, 24 bp, Homo sapiens
gtactccagcccggcactccagcc

SEQ ID NO: 6349653 - DNA, 12 bp, Homo sapiens
gtactccagcct

SEQ ID NO: 6349654 - DNA, 13 bp, Homo sapiens
gtactcccaaact

SEQ ID NO: 6349655 - DNA, 19 bp, Homo sapiens
gtactcccaaactgacaat

SEQ ID NO: 6349656 - DNA, 21 bp, Homo sapiens
gtactcccaaactgacaattt

SEQ ID NO: 6349657 - DNA, 15 bp, Homo sapiens
gtactccctctcagg

SEQ ID NO: 6349658 - DNA, 18 bp, Homo sapiens
gtactccctgcaccgtct

SEQ ID NO: 6349659 - DNA, 18 bp, Homo sapiens
gtactcctcacttttcaa

SEQ ID NO: 6349660 - DNA, 21 bp, Homo sapiens
gtactcctcacttttcaattt

SEQ ID NO: 6349661 - DNA, 15 bp, Homo sapiens
gtactcctgcaaaat

SEQ ID NO: 6349662 - DNA, 15 bp, Homo sapiens
gtactcctgccaggg

SEQ ID NO: 6349663 - DNA, 21 bp, Homo sapiens
gtactcgcacctcttggcttt

SEQ ID NO: 6349664 - DNA, 17 bp, Homo sapiens
gtactcgcttgtgcaga

SEQ ID NO: 6349665 - DNA, 15 bp, Homo sapiens
gtactcggcttcctg

SEQ ID NO: 6349666 - DNA, 16 bp, Homo sapiens
gtactcggcttcctgt

SEQ ID NO: 6349667 - DNA, 17 bp, Homo sapiens
gtactcggcttcctgtg

SEQ ID NO: 6349668 - DNA, 19 bp, Homo sapiens
gtactcgttggatgtctgt

SEQ ID NO: 6349669 - DNA, 22 bp, Homo sapiens
gtactctacaattcctctgata

SEQ ID NO: 6349670 - DNA, 17 bp, Homo sapiens
gtactctacgccaaagt

SEQ ID NO: 6349671 - DNA, 18 bp, Homo sapiens
gtactctacgccaaagtg

SEQ ID NO: 6349672 - DNA, 11 bp, Homo sapiens
gtactctagga

SEQ ID NO: 6349673 - DNA, 16 bp, Homo sapiens
gtactctcacatgtgg

SEQ ID NO: 6349674 - DNA, 15 bp, Homo sapiens
gtactctctctcttt

SEQ ID NO: 6349675 - DNA, 15 bp, Homo sapiens
gtactctctgctcta

SEQ ID NO: 6349676 - DNA, 17 bp, Homo sapiens
gtactctctgctctagc

SEQ ID NO: 6349677 - DNA, 21 bp, Homo sapiens
gtactctgccactttatttct

SEQ ID NO: 6349678 - DNA, 21 bp, Homo sapiens
gtactctgtgaaagaagagaa

SEQ ID NO: 6349679 - DNA, 22 bp, Homo sapiens
gtactctgtgaaagaagagaaa

SEQ ID NO: 6349680 - DNA, 18 bp, Homo sapiens
gtactctgtgtctggcag

SEQ ID NO: 6349681 - DNA, 19 bp, Homo sapiens
gtactctgtgtctggcagg

SEQ ID NO: 6349682 - DNA, 20 bp, Homo sapiens
gtactctgtgtctggcaggc

SEQ ID NO: 6349683 - DNA, 20 bp, Homo sapiens
gtactctgtgtgtgtatgag

SEQ ID NO: 6349684 - DNA, 16 bp, Homo sapiens
gtactcttaggatatt

SEQ ID NO: 6349685 - DNA, 20 bp, Homo sapiens
gtactcttaggatatttgag

SEQ ID NO: 6349686 - DNA, 14 bp, Homo sapiens
gtactctttaacat

SEQ ID NO: 6349687 - DNA, 15 bp, Homo sapiens
gtactctttatttct

SEQ ID NO: 6349688 - DNA, 23 bp, Homo sapiens
gtactctttatttctagcagagt

SEQ ID NO: 6349689 - DNA, 16 bp, Homo sapiens
gtactctttctctccc

SEQ ID NO: 6349690 - DNA, 14 bp, Homo sapiens
gtactgaaagcctt

SEQ ID NO: 6349691 - DNA, 20 bp, Homo sapiens
gtactgaagaaaaggggagc

SEQ ID NO: 6349692 - DNA, 19 bp, Homo sapiens
gtactgaagactctgcagc

SEQ ID NO: 6349693 - DNA, 23 bp, Homo sapiens
gtactgaagactctgcagccctc

SEQ ID NO: 6349694 - DNA, 19 bp, Homo sapiens
gtactgaagccaaatgaaa

SEQ ID NO: 6349695 - DNA, 16 bp, Homo sapiens
gtactgaaggcttctg

SEQ ID NO: 6349696 - DNA, 22 bp, Homo sapiens
gtactgaatttttttgtaataa

SEQ ID NO: 6349697 - DNA, 16 bp, Homo sapiens
gtactgacccaggacc

SEQ ID NO: 6349698 - DNA, 19 bp, Homo sapiens
taaagctactgtagaaaca

SEQ ID NO: 6349699 - DNA, 17 bp, Homo sapiens
taaagctcaaatgaaat

SEQ ID NO: 6349700 - DNA, 19 bp, Homo sapiens
taaagctcaaatgaaatgt

SEQ ID NO: 6349701 - DNA, 23 bp, Homo sapiens
taaagctccattgggactgattt

SEQ ID NO: 6349702 - DNA, 14 bp, Homo sapiens
taaagctcttcatt

SEQ ID NO: 6349703 - DNA, 14 bp, Homo sapiens
taaagctgaaaact

SEQ ID NO: 6349704 - DNA, 23 bp, Homo sapiens
taaagctgcctgtagttaggaaa

SEQ ID NO: 6349705 - DNA, 13 bp, Homo sapiens
taaagctggccct

SEQ ID NO: 6349706 - DNA, 22 bp, Homo sapiens
taaagctggccctgcctcctgg

SEQ ID NO: 6349707 - DNA, 23 bp, Homo sapiens
taaagctggccctgcctcctggg

SEQ ID NO: 6349708 - DNA, 19 bp, Homo sapiens
taaagctgtgcttggggtc

SEQ ID NO: 6349709 - DNA, 21 bp, Homo sapiens
taaagctgttaaaatacataa

SEQ ID NO: 6349710 - DNA, 16 bp, Homo sapiens
taaagctgttattctt

SEQ ID NO: 6349711 - DNA, 14 bp, Homo sapiens
taaagctgttctca

SEQ ID NO: 6349712 - DNA, 17 bp, Homo sapiens
taaagctgttcttgaaa

SEQ ID NO: 6349713 - DNA, 16 bp, Homo sapiens
taaagcttaaactgaa

SEQ ID NO: 6349714 - DNA, 17 bp, Homo sapiens
taaagcttacatagttt

SEQ ID NO: 6349715 - DNA, 19 bp, Homo sapiens
taaagcttacccttggttt

SEQ ID NO: 6349716 - DNA, 19 bp, Homo sapiens
taaagcttctctctgagct

SEQ ID NO: 6349717 - DNA, 23 bp, Homo sapiens
taaagcttgatttgatctttgtt

SEQ ID NO: 6349718 - DNA, 23 bp, Homo sapiens
taaagcttgtggccccttttact

SEQ ID NO: 6349719 - DNA, 15 bp, Homo sapiens
taaagctttatcttt

SEQ ID NO: 6349720 - DNA, 16 bp, Homo sapiens
taaagctttatctttg

SEQ ID NO: 6349721 - DNA, 19 bp, Homo sapiens
taaagctttatctttgtgt

SEQ ID NO: 6349722 - DNA, 21 bp, Homo sapiens
taaagctttatctttgtgtaa

SEQ ID NO: 6349723 - DNA, 19 bp, Homo sapiens
taaagctttcaacatgtac

SEQ ID NO: 6349724 - DNA, 19 bp, Homo sapiens
taaagctttcagaatatgt

SEQ ID NO: 6349725 - DNA, 15 bp, Homo sapiens
taaagcttttattcg

SEQ ID NO: 6349726 - DNA, 14 bp, Homo sapiens
taaagcttttgcat

SEQ ID NO: 6349727 - DNA, 16 bp, Homo sapiens
taaagcttttgcatag

SEQ ID NO: 6349728 - DNA, 17 bp, Homo sapiens
taaagcttttggaagcc

SEQ ID NO: 6349729 - DNA, 13 bp, Homo sapiens
taaaggaaaacaa

SEQ ID NO: 6349730 - DNA, 16 bp, Homo sapiens
taaaggaaaagacaca

SEQ ID NO: 6349731 - DNA, 17 bp, Homo sapiens
taaaggaaaataatgtt

SEQ ID NO: 6349732 - DNA, 20 bp, Homo sapiens
taaaggaaaataatgtttga

SEQ ID NO: 6349733 - DNA, 21 bp, Homo sapiens
taaaggaaaataatgtttgat

SEQ ID NO: 6349734 - DNA, 21 bp, Homo sapiens
taaaggaaacactaaggctgc

SEQ ID NO: 6349735 - DNA, 19 bp, Homo sapiens
taaaggaaaggccctgcac

SEQ ID NO: 6349736 - DNA, 18 bp, Homo sapiens
taaaggaaagttctatta

SEQ ID NO: 6349737 - DNA, 10 bp, Homo sapiens
taaaggaaat

SEQ ID NO: 6349738 - DNA, 13 bp, Homo sapiens
taaaggaaatgat

SEQ ID NO: 6349739 - DNA, 14 bp, Homo sapiens
taaaggaaggaaaa

SEQ ID NO: 6349740 - DNA, 16 bp, Homo sapiens
taaaggaagtcaccaa

SEQ ID NO: 6349741 - DNA, 18 bp, Homo sapiens
taaaggaatgtgaaattt

SEQ ID NO: 6349742 - DNA, 14 bp, Homo sapiens
taaaggacaaacag

SEQ ID NO: 6349743 - DNA, 16 bp, Homo sapiens
taaaggacaaacagtg

SEQ ID NO: 6349744 - DNA, 17 bp, Homo sapiens
taaaggacaaacagtga

SEQ ID NO: 6349745 - DNA, 21 bp, Homo sapiens
taaaggacaaacagtgaattt

SEQ ID NO: 6349746 - DNA, 24 bp, Homo sapiens
taaaggaccctgtttctgtagaaa

SEQ ID NO: 6349747 - DNA, 14 bp, Homo sapiens
taaaggactattta

SEQ ID NO: 6349748 - DNA, 16 bp, Homo sapiens
taaaggactatttata

SEQ ID NO: 6349749 - DNA, 17 bp, Homo sapiens
taaaggagaaggcatga

SEQ ID NO: 6349750 - DNA, 20 bp, Homo sapiens
taaaggagcagctagctgct

SEQ ID NO: 6349751 - DNA, 16 bp, Homo sapiens
taaaggagttaagagt

SEQ ID NO: 6349752 - DNA, 16 bp, Homo sapiens
taaaggagtttatgtt

SEQ ID NO: 6349753 - DNA, 15 bp, Homo sapiens
taaaggatatttcaa

SEQ ID NO: 6349754 - DNA, 21 bp, Homo sapiens
taaaggatgagatttttcatg

SEQ ID NO: 6349755 - DNA, 23 bp, Homo sapiens
taaaggatgagatttttcatgta

SEQ ID NO: 6349756 - DNA, 13 bp, Homo sapiens
taaaggatgaggg

SEQ ID NO: 6349757 - DNA, 14 bp, Homo sapiens
taaaggatgagggt

SEQ ID NO: 6349758 - DNA, 14 bp, Homo sapiens
taaaggatggaaaa

SEQ ID NO: 6349759 - DNA, 21 bp, Homo sapiens
taaaggcaaaaccgtgctctt

SEQ ID NO: 6349760 - DNA, 16 bp, Homo sapiens
taaaggcaaggaaatt

SEQ ID NO: 6349761 - DNA, 11 bp, Homo sapiens
taaaggcagct

SEQ ID NO: 6349762 - DNA, 15 bp, Homo sapiens
taaaggcagtccaga

SEQ ID NO: 6349763 - DNA, 15 bp, Homo sapiens
taaaggcattccaca

SEQ ID NO: 6349764 - DNA, 16 bp, Homo sapiens
taaaggcattccacag

SEQ ID NO: 6349765 - DNA, 17 bp, Homo sapiens
taaaggcattccacagg

SEQ ID NO: 6349766 - DNA, 14 bp, Homo sapiens
taaaggccacagga

SEQ ID NO: 6349767 - DNA, 21 bp, Homo sapiens
taaaggccctatctgtttaca

SEQ ID NO: 6349768 - DNA, 18 bp, Homo sapiens
taaaggccgtcatttcat

SEQ ID NO: 6349769 - DNA, 20 bp, Homo sapiens
taaaggcctctgcctcacaa

SEQ ID NO: 6349770 - DNA, 23 bp, Homo sapiens
taaaggcctggaaccagggagga

SEQ ID NO: 6349771 - DNA, 17 bp, Homo sapiens
taaaggcgctaatttat

SEQ ID NO: 6349772 - DNA, 18 bp, Homo sapiens
taaaggctcgattttgta

SEQ ID NO: 6349773 - DNA, 22 bp, Homo sapiens
taaaggctcgattttgtatctg

SEQ ID NO: 6349774 - DNA, 17 bp, Homo sapiens
taaaggctctgtgcttg

SEQ ID NO: 6349775 - DNA, 16 bp, Homo sapiens
taaaggctttgaaccc

SEQ ID NO: 6349776 - DNA, 22 bp, Homo sapiens
taaaggcttttggcagcaaagt

SEQ ID NO: 6349777 - DNA, 23 bp, Homo sapiens
taaagggaccatctgctgcagtt

SEQ ID NO: 6349778 - DNA, 14 bp, Homo sapiens
taaagggagaagga

SEQ ID NO: 6349779 - DNA, 15 bp, Homo sapiens
taaagggataaagaa

SEQ ID NO: 6349780 - DNA, 17 bp, Homo sapiens
taaagggcaaataatga

SEQ ID NO: 6349781 - DNA, 13 bp, Homo sapiens
taaagggcagggc

SEQ ID NO: 6349782 - DNA, 21 bp, Homo sapiens
taaagggcagggcccacgtgt

SEQ ID NO: 6349783 - DNA, 18 bp, Homo sapiens
taaagggcccaatgaatt

SEQ ID NO: 6349784 - DNA, 21 bp, Homo sapiens
taaagggcccaatgaattatt

SEQ ID NO: 6349785 - DNA, 20 bp, Homo sapiens
taaagggcgcaaagggcatg

SEQ ID NO: 6349786 - DNA, 21 bp, Homo sapiens
taaaggggacagatcttgagc

SEQ ID NO: 6349787 - DNA, 15 bp, Homo sapiens
taaaggggcctgcgc

SEQ ID NO: 6349788 - DNA, 14 bp, Homo sapiens
taaaggggggaggg

SEQ ID NO: 6349789 - DNA, 17 bp, Homo sapiens
taaagggtatgagctgg

SEQ ID NO: 6349790 - DNA, 20 bp, Homo sapiens
taaagggtgcccatttgtga

SEQ ID NO: 6349791 - DNA, 18 bp, Homo sapiens
taaagggtgtacttatat

SEQ ID NO: 6349792 - DNA, 19 bp, Homo sapiens
taaagggttaatagccaga

SEQ ID NO: 6349793 - DNA, 21 bp, Homo sapiens
taaaggtaaaatcacttcaga

SEQ ID NO: 6349794 - DNA, 14 bp, Homo sapiens
taaaggtacacatg

SEQ ID NO: 6349795 - DNA, 22 bp, Homo sapiens
taaaggtaccaaacaaggaagc

SEQ ID NO: 6349796 - DNA, 21 bp, Homo sapiens
taaaggtacgattatacttga

SEQ ID NO: 6349797 - DNA, 20 bp, Homo sapiens
taaaggtattccttgttctt

SEQ ID NO: 6349798 - DNA, 21 bp, Homo sapiens
taaaggtattccttgttcttc

SEQ ID NO: 6349799 - DNA, 17 bp, Homo sapiens
taaaggtcaacaataaa

SEQ ID NO: 6349800 - DNA, 23 bp, Homo sapiens
taaaggtcacttttcacatcctt

SEQ ID NO: 6349801 - DNA, 21 bp, Homo sapiens
taaaggtccacaggtctagac

SEQ ID NO: 6349802 - DNA, 14 bp, Homo sapiens
taaaggtctgcact

SEQ ID NO: 6349803 - DNA, 20 bp, Homo sapiens
taaaggtgaaaaaagctttt

SEQ ID NO: 6349804 - DNA, 22 bp, Homo sapiens
taaaggtgaccctgatgaaacc

SEQ ID NO: 6349805 - DNA, 17 bp, Homo sapiens
taaaggtgatgaattta

SEQ ID NO: 6349806 - DNA, 19 bp, Homo sapiens
taaaggtgatgaatttacc

SEQ ID NO: 6349807 - DNA, 13 bp, Homo sapiens
taaaggtggaaaa

SEQ ID NO: 6349808 - DNA, 20 bp, Homo sapiens
taaaggtggtgaggcaataa

SEQ ID NO: 6349809 - DNA, 17 bp, Homo sapiens
taaaggtggttttattt

SEQ ID NO: 6349810 - DNA, 16 bp, Homo sapiens
taaaggtgtaagactt

SEQ ID NO: 6349811 - DNA, 14 bp, Homo sapiens
taaaggtgtattta

SEQ ID NO: 6349812 - DNA, 18 bp, Homo sapiens
taaaggttaaattgcttt

SEQ ID NO: 6349813 - DNA, 18 bp, Homo sapiens
taaaggttactgttttta

SEQ ID NO: 6349814 - DNA, 16 bp, Homo sapiens
taaaggttcctttgtt

SEQ ID NO: 6349815 - DNA, 20 bp, Homo sapiens
taaaggttcctttgttccct

SEQ ID NO: 6349816 - DNA, 13 bp, Homo sapiens
taaaggttctatg

SEQ ID NO: 6349817 - DNA, 15 bp, Homo sapiens
taaaggttctatgat

SEQ ID NO: 6349818 - DNA, 17 bp, Homo sapiens
taaaggttgccagcatg

SEQ ID NO: 6349819 - DNA, 17 bp, Homo sapiens
taaaggttggaatcttt

SEQ ID NO: 6349820 - DNA, 21 bp, Homo sapiens
taaaggtttctattttctctg

SEQ ID NO: 6349821 - DNA, 17 bp, Homo sapiens
taaaggtttttaaattg

SEQ ID NO: 6349822 - DNA, 16 bp, Homo sapiens
taaagtaaaaaagtta

SEQ ID NO: 6349823 - DNA, 13 bp, Homo sapiens
taaagtaaagcta

SEQ ID NO: 6349824 - DNA, 13 bp, Homo sapiens
taaagtaaatgaa

SEQ ID NO: 6349825 - DNA, 15 bp, Homo sapiens
taaagtaaattgaaa

SEQ ID NO: 6349826 - DNA, 16 bp, Homo sapiens
taaagtaaattgaaat

SEQ ID NO: 6349827 - DNA, 16 bp, Homo sapiens
taaagtaacagtatgt

SEQ ID NO: 6349828 - DNA, 17 bp, Homo sapiens
taaagtaacatttaagc

SEQ ID NO: 6349829 - DNA, 19 bp, Homo sapiens
taaagtaacatttaagcct

SEQ ID NO: 6349830 - DNA, 20 bp, Homo sapiens
taaagtaataactgttagaa

SEQ ID NO: 6349831 - DNA, 19 bp, Homo sapiens
taaagtaataatgtgcaaa

SEQ ID NO: 6349832 - DNA, 15 bp, Homo sapiens
taaagtaatgcattt

SEQ ID NO: 6349833 - DNA, 17 bp, Homo sapiens
taaagtaattgttccag

SEQ ID NO: 6349834 - DNA, 14 bp, Homo sapiens
taaagtaatttaca

SEQ ID NO: 6349835 - DNA, 12 bp, Homo sapiens
taaagtacaaat

SEQ ID NO: 6349836 - DNA, 15 bp, Homo sapiens
taaagtacaaatgaa

SEQ ID NO: 6349837 - DNA, 18 bp, Homo sapiens
taaagtacaaatgaagaa

SEQ ID NO: 6349838 - DNA, 21 bp, Homo sapiens
taaagtacaaatgaagaaagt

SEQ ID NO: 6349839 - DNA, 12 bp, Homo sapiens
taaagtaccaga

SEQ ID NO: 6349840 - DNA, 18 bp, Homo sapiens
taaagtaccttgactttg

SEQ ID NO: 6349841 - DNA, 15 bp, Homo sapiens
taaagtactactgta

SEQ ID NO: 6349842 - DNA, 14 bp, Homo sapiens
taaagtactgcaaa

SEQ ID NO: 6349843 - DNA, 14 bp, Homo sapiens
taaagtacttgaaa

SEQ ID NO: 6349844 - DNA, 15 bp, Homo sapiens
taaagtacttgagtg

SEQ ID NO: 6349845 - DNA, 21 bp, Homo sapiens
taaagtagattagatctttta

SEQ ID NO: 6349846 - DNA, 14 bp, Homo sapiens
taaagtaggaaaga

SEQ ID NO: 6349847 - DNA, 15 bp, Homo sapiens
taaagtaggaaagaa

SEQ ID NO: 6349848 - DNA, 16 bp, Homo sapiens
taaagtaggaaagaat

SEQ ID NO: 6349849 - DNA, 18 bp, Homo sapiens
taaagtaggaaagaattt

SEQ ID NO: 6349850 - DNA, 19 bp, Homo sapiens
taaagtagggaagttttat

SEQ ID NO: 6349851 - DNA, 21 bp, Homo sapiens
taaagtagtaaaagaagaaat

SEQ ID NO: 6349852 - DNA, 13 bp, Homo sapiens
taaagtataatgt

SEQ ID NO: 6349853 - DNA, 19 bp, Homo sapiens
taaagtatatatagaatct

SEQ ID NO: 6349854 - DNA, 17 bp, Homo sapiens
taaagtatatgtgcagt

SEQ ID NO: 6349855 - DNA, 14 bp, Homo sapiens
taaagtatattgaa

SEQ ID NO: 6349856 - DNA, 16 bp, Homo sapiens
taaagtatgaatattt

SEQ ID NO: 6349857 - DNA, 15 bp, Homo sapiens
taaagtatgaatcta

SEQ ID NO: 6349858 - DNA, 16 bp, Homo sapiens
taaagtatgaatctat

SEQ ID NO: 6349859 - DNA, 22 bp, Homo sapiens
taaagtatgtaaagtatgtaaa

SEQ ID NO: 6349860 - DNA, 21 bp, Homo sapiens
taaagtatgtttttacattat

SEQ ID NO: 6349861 - DNA, 22 bp, Homo sapiens
taaagtattcaacaatttcaat

SEQ ID NO: 6349862 - DNA, 15 bp, Homo sapiens
taaagtattggattt

SEQ ID NO: 6349863 - DNA, 15 bp, Homo sapiens
taaagtatttataaa

SEQ ID NO: 6349864 - DNA, 18 bp, Homo sapiens
taaagtatttgatgtaca

SEQ ID NO: 6349865 - DNA, 20 bp, Homo sapiens
taaagtatttgatgtacatt

SEQ ID NO: 6349866 - DNA, 15 bp, Homo sapiens
taaagtattttaatt

SEQ ID NO: 6349867 - DNA, 21 bp, Homo sapiens
taaagtatttttataaatata

SEQ ID NO: 6349868 - DNA, 18 bp, Homo sapiens
taaagtcacacatttcta

SEQ ID NO: 6349869 - DNA, 18 bp, Homo sapiens
taaagtcacttccagtgt

SEQ ID NO: 6349870 - DNA, 16 bp, Homo sapiens
taaagtcagatttgta

SEQ ID NO: 6349871 - DNA, 15 bp, Homo sapiens
taaagtcatcaaagt

SEQ ID NO: 6349872 - DNA, 21 bp, Homo sapiens
taaagtcatcatgaactggct

SEQ ID NO: 6349873 - DNA, 20 bp, Homo sapiens
taaagtcattattaggaagt

SEQ ID NO: 6349874 - DNA, 15 bp, Homo sapiens
taaagtccaaagtca

SEQ ID NO: 6349875 - DNA, 21 bp, Homo sapiens
taaagtcctgaacctttcaaa

SEQ ID NO: 6349876 - DNA, 20 bp, Homo sapiens
gtactgactgagataagaaa

SEQ ID NO: 6349877 - DNA, 21 bp, Homo sapiens
gtactgactgagataagaaaa

SEQ ID NO: 6349878 - DNA, 20 bp, Homo sapiens
gtactgactttctgattact

SEQ ID NO: 6349879 - DNA, 17 bp, Homo sapiens
gtactgactttgcttgc

SEQ ID NO: 6349880 - DNA, 17 bp, Homo sapiens
gtactgagacagggtgc

SEQ ID NO: 6349881 - DNA, 23 bp, Homo sapiens
gtactgaggtgctatgaagccaa

SEQ ID NO: 6349882 - DNA, 17 bp, Homo sapiens
gtactgaggtggtggac

SEQ ID NO: 6349883 - DNA, 16 bp, Homo sapiens
gtactgagtggggagt

SEQ ID NO: 6349884 - DNA, 16 bp, Homo sapiens
gtactgattattcttc

SEQ ID NO: 6349885 - DNA, 18 bp, Homo sapiens
gtactgattattcttctt

SEQ ID NO: 6349886 - DNA, 16 bp, Homo sapiens
gtactgattcaatttg

SEQ ID NO: 6349887 - DNA, 14 bp, Homo sapiens
gtactgatttcagt

SEQ ID NO: 6349888 - DNA, 20 bp, Homo sapiens
gtactgatttcagtaagtct

SEQ ID NO: 6349889 - DNA, 16 bp, Homo sapiens
gtactgatttttgtaa

SEQ ID NO: 6349890 - DNA, 13 bp, Homo sapiens
gtactgcattatt

SEQ ID NO: 6349891 - DNA, 18 bp, Homo sapiens
gtactgcattctctccca

SEQ ID NO: 6349892 - DNA, 21 bp, Homo sapiens
gtactgcattttttacttttt

SEQ ID NO: 6349893 - DNA, 15 bp, Homo sapiens
gtactgccaaggtac

SEQ ID NO: 6349894 - DNA, 13 bp, Homo sapiens
gtactgcctgctt

SEQ ID NO: 6349895 - DNA, 20 bp, Homo sapiens
gtactgctcaggctgcagct

SEQ ID NO: 6349896 - DNA, 22 bp, Homo sapiens
gtactgctcaggctgcagctgg

SEQ ID NO: 6349897 - DNA, 20 bp, Homo sapiens
gtactgctgaggtcccgggc

SEQ ID NO: 6349898 - DNA, 17 bp, Homo sapiens
gtactgctttcaactta

SEQ ID NO: 6349899 - DNA, 12 bp, Homo sapiens
gtactggaataa

SEQ ID NO: 6349900 - DNA, 16 bp, Homo sapiens
gtactggaataaacag

SEQ ID NO: 6349901 - DNA, 18 bp, Homo sapiens
gtactggaataaacagtg

SEQ ID NO: 6349902 - DNA, 20 bp, Homo sapiens
gtactggcaataagatacac

SEQ ID NO: 6349903 - DNA, 12 bp, Homo sapiens
gtactggcacaa

SEQ ID NO: 6349904 - DNA, 14 bp, Homo sapiens
gtactggcatggta

SEQ ID NO: 6349905 - DNA, 19 bp, Homo sapiens
gtactggccagtgtcattt

SEQ ID NO: 6349906 - DNA, 15 bp, Homo sapiens
gtactggtaattgta

SEQ ID NO: 6349907 - DNA, 17 bp, Homo sapiens
gtactggtaattgtaca

SEQ ID NO: 6349908 - DNA, 19 bp, Homo sapiens
gtactggtaattgtacaat

SEQ ID NO: 6349909 - DNA, 16 bp, Homo sapiens
gtactggtcccttcct

SEQ ID NO: 6349910 - DNA, 17 bp, Homo sapiens
gtactgtaaacagttct

SEQ ID NO: 6349911 - DNA, 17 bp, Homo sapiens
gtactgtaactgctcag

SEQ ID NO: 6349912 - DNA, 17 bp, Homo sapiens
gtactgtaataatacct

SEQ ID NO: 6349913 - DNA, 20 bp, Homo sapiens
gtactgtaataatacctcaa

SEQ ID NO: 6349914 - DNA, 12 bp, Homo sapiens
gtactgtactaa

SEQ ID NO: 6349915 - DNA, 16 bp, Homo sapiens
gtactgtactgaagaa

SEQ ID NO: 6349916 - DNA, 20 bp, Homo sapiens
gtactgtactttcccaggtt

SEQ ID NO: 6349917 - DNA, 14 bp, Homo sapiens
gtactgtagcaggg

SEQ ID NO: 6349918 - DNA, 12 bp, Homo sapiens
gtactgtatcta

SEQ ID NO: 6349919 - DNA, 16 bp, Homo sapiens
gtactgtatgcagttt

SEQ ID NO: 6349920 - DNA, 15 bp, Homo sapiens
gtactgtatgtgatg

SEQ ID NO: 6349921 - DNA, 19 bp, Homo sapiens
gtactgtattgggcttctt

SEQ ID NO: 6349922 - DNA, 18 bp, Homo sapiens
gtactgtctcggcagagg

SEQ ID NO: 6349923 - DNA, 21 bp, Homo sapiens
gtactgtctcggcagaggtgg

SEQ ID NO: 6349924 - DNA, 17 bp, Homo sapiens
gtactgtctgattggct

SEQ ID NO: 6349925 - DNA, 18 bp, Homo sapiens
gtactgtctgattggctt

SEQ ID NO: 6349926 - DNA, 16 bp, Homo sapiens
gtactgtctgtgtcct

SEQ ID NO: 6349927 - DNA, 14 bp, Homo sapiens
gtactgtgcctggt

SEQ ID NO: 6349928 - DNA, 23 bp, Homo sapiens
gtactgtgtacagaattctgcta

SEQ ID NO: 6349929 - DNA, 13 bp, Homo sapiens
gtactgtgttttt

SEQ ID NO: 6349930 - DNA, 18 bp, Homo sapiens
gtactgttactgggccct

SEQ ID NO: 6349931 - DNA, 17 bp, Homo sapiens
gtactgttcatacagtt

SEQ ID NO: 6349932 - DNA, 19 bp, Homo sapiens
gtactgttcccaactcagc

SEQ ID NO: 6349933 - DNA, 17 bp, Homo sapiens
gtactgttcggaagggg

SEQ ID NO: 6349934 - DNA, 23 bp, Homo sapiens
gtactgttctcttcttgaacact

SEQ ID NO: 6349935 - DNA, 17 bp, Homo sapiens
gtactgttctgtgtctt

SEQ ID NO: 6349936 - DNA, 13 bp, Homo sapiens
gtactgttgaaaa

SEQ ID NO: 6349937 - DNA, 19 bp, Homo sapiens
gtactgtttaatgttctgt

SEQ ID NO: 6349938 - DNA, 20 bp, Homo sapiens
gtactgtttaccatttttca

SEQ ID NO: 6349939 - DNA, 13 bp, Homo sapiens
gtacttaaatgag

SEQ ID NO: 6349940 - DNA, 19 bp, Homo sapiens
gtacttaaatgagttactt

SEQ ID NO: 6349941 - DNA, 20 bp, Homo sapiens
gtacttaagctcccctgcct

SEQ ID NO: 6349942 - DNA, 22 bp, Homo sapiens
gtacttaccagtcaatgcattg

SEQ ID NO: 6349943 - DNA, 20 bp, Homo sapiens
gtacttagagtttctgtttg

SEQ ID NO: 6349944 - DNA, 17 bp, Homo sapiens
gtacttattacagtctt

SEQ ID NO: 6349945 - DNA, 15 bp, Homo sapiens
gtacttattactgct

SEQ ID NO: 6349946 - DNA, 18 bp, Homo sapiens
gtacttattactgctaag

SEQ ID NO: 6349947 - DNA, 18 bp, Homo sapiens
gtacttatttctcagctg

SEQ ID NO: 6349948 - DNA, 19 bp, Homo sapiens
gtacttatttctcagctgt

SEQ ID NO: 6349949 - DNA, 20 bp, Homo sapiens
gtacttatttctcagctgtg

SEQ ID NO: 6349950 - DNA, 22 bp, Homo sapiens
gtacttcaaatccttgaagatt

SEQ ID NO: 6349951 - DNA, 18 bp, Homo sapiens
gtacttcagcaagagaga

SEQ ID NO: 6349952 - DNA, 21 bp, Homo sapiens
gtacttcagcaagagagaacc

SEQ ID NO: 6349953 - DNA, 23 bp, Homo sapiens
gtacttcagcaagagagaaccta

SEQ ID NO: 6349954 - DNA, 18 bp, Homo sapiens
gtacttcaggggcacttc

SEQ ID NO: 6349955 - DNA, 14 bp, Homo sapiens
gtacttcagtcttg

SEQ ID NO: 6349956 - DNA, 17 bp, Homo sapiens
gtacttcagttctcatc

SEQ ID NO: 6349957 - DNA, 15 bp, Homo sapiens
gtacttcatgctgtc

SEQ ID NO: 6349958 - DNA, 13 bp, Homo sapiens
gtacttccagatg

SEQ ID NO: 6349959 - DNA, 20 bp, Homo sapiens
gtacttcccaattgccacat

SEQ ID NO: 6349960 - DNA, 14 bp, Homo sapiens
gtacttcctcctga

SEQ ID NO: 6349961 - DNA, 21 bp, Homo sapiens
gtacttcctcctgatggccaa

SEQ ID NO: 6349962 - DNA, 15 bp, Homo sapiens
gtacttcctctgtga

SEQ ID NO: 6349963 - DNA, 19 bp, Homo sapiens
gtacttcctctgtgaactg

SEQ ID NO: 6349964 - DNA, 19 bp, Homo sapiens
gtacttctccaccctgctc

SEQ ID NO: 6349965 - DNA, 20 bp, Homo sapiens
gtacttctccaccctgctct

SEQ ID NO: 6349966 - DNA, 17 bp, Homo sapiens
gtacttctgtgttcatt

SEQ ID NO: 6349967 - DNA, 21 bp, Homo sapiens
gtacttcttcatccatagaca

SEQ ID NO: 6349968 - DNA, 22 bp, Homo sapiens
gtacttcttcatccatagacac

SEQ ID NO: 6349969 - DNA, 20 bp, Homo sapiens
gtacttcttgaatataaaaa

SEQ ID NO: 6349970 - DNA, 23 bp, Homo sapiens
gtacttgaaaaatgtttttattt

SEQ ID NO: 6349971 - DNA, 22 bp, Homo sapiens
gtacttgaaatctaggattatt

SEQ ID NO: 6349972 - DNA, 15 bp, Homo sapiens
gtacttgaaggatgg

SEQ ID NO: 6349973 - DNA, 22 bp, Homo sapiens
gtacttgccttattagagtgtc

SEQ ID NO: 6349974 - DNA, 21 bp, Homo sapiens
gtacttgctcaataaaggtca

SEQ ID NO: 6349975 - DNA, 22 bp, Homo sapiens
gtacttgctctctgagagcaca

SEQ ID NO: 6349976 - DNA, 15 bp, Homo sapiens
gtacttgctcttgat

SEQ ID NO: 6349977 - DNA, 16 bp, Homo sapiens
gtacttgctcttgatg

SEQ ID NO: 6349978 - DNA, 21 bp, Homo sapiens
gtacttgctgctattttactg

SEQ ID NO: 6349979 - DNA, 20 bp, Homo sapiens
gtacttgcttgtattgtaaa

SEQ ID NO: 6349980 - DNA, 22 bp, Homo sapiens
gtacttgcttgtattgtaaatg

SEQ ID NO: 6349981 - DNA, 15 bp, Homo sapiens
gtacttggcaccaat

SEQ ID NO: 6349982 - DNA, 20 bp, Homo sapiens
gtacttggcccccttcagga

SEQ ID NO: 6349983 - DNA, 22 bp, Homo sapiens
gtacttggtccaactgcaactc

SEQ ID NO: 6349984 - DNA, 15 bp, Homo sapiens
gtacttgtcaaagaa

SEQ ID NO: 6349985 - DNA, 16 bp, Homo sapiens
gtacttgtcctcagct

SEQ ID NO: 6349986 - DNA, 22 bp, Homo sapiens
gtacttgtgaaacacagctgtt

SEQ ID NO: 6349987 - DNA, 16 bp, Homo sapiens
gtacttgtggttctct

SEQ ID NO: 6349988 - DNA, 15 bp, Homo sapiens
gtacttgtttcatct

SEQ ID NO: 6349989 - DNA, 19 bp, Homo sapiens
gtacttgtttcatctggtt

SEQ ID NO: 6349990 - DNA, 12 bp, Homo sapiens
gtacttgtttgc

SEQ ID NO: 6349991 - DNA, 17 bp, Homo sapiens
gtactttaaaaaggaaa

SEQ ID NO: 6349992 - DNA, 22 bp, Homo sapiens
gtactttatagaagaatgcatg

SEQ ID NO: 6349993 - DNA, 14 bp, Homo sapiens
gtactttatatctt

SEQ ID NO: 6349994 - DNA, 22 bp, Homo sapiens
gtactttattgcaactctttta

SEQ ID NO: 6349995 - DNA, 23 bp, Homo sapiens
gtactttattttctataatttaa

SEQ ID NO: 6349996 - DNA, 14 bp, Homo sapiens
gtactttcacatct

SEQ ID NO: 6349997 - DNA, 17 bp, Homo sapiens
gtactttctattttaat

SEQ ID NO: 6349998 - DNA, 20 bp, Homo sapiens
gtactttctgaaaatttata

SEQ ID NO: 6349999 - DNA, 19 bp, Homo sapiens
gtactttctgttaaaatgc

SEQ ID NO: 6350000 - DNA, 21 bp, Homo sapiens
gtactttctgttatgggcttt

SEQ ID NO: 6350001 - DNA, 13 bp, Homo sapiens
gtactttgattca

SEQ ID NO: 6350002 - DNA, 21 bp, Homo sapiens
gtactttgattcacatgtttt

SEQ ID NO: 6350003 - DNA, 23 bp, Homo sapiens
gtactttgatttacagtgcctgt

SEQ ID NO: 6350004 - DNA, 14 bp, Homo sapiens
gtactttggaggcc

SEQ ID NO: 6350005 - DNA, 21 bp, Homo sapiens
gtactttggatgcaattaaaa

SEQ ID NO: 6350006 - DNA, 20 bp, Homo sapiens
gtactttgtcccgtggcatt

SEQ ID NO: 6350007 - DNA, 20 bp, Homo sapiens
gtactttgtctaagaaacat

SEQ ID NO: 6350008 - DNA, 10 bp, Homo sapiens
gtactttgtg

SEQ ID NO: 6350009 - DNA, 17 bp, Homo sapiens
gtactttgtttttccat

SEQ ID NO: 6350010 - DNA, 14 bp, Homo sapiens
gtacttttaagact

SEQ ID NO: 6350011 - DNA, 17 bp, Homo sapiens
gtacttttagtagagac

SEQ ID NO: 6350012 - DNA, 22 bp, Homo sapiens
gtacttttatgatgtatattta

SEQ ID NO: 6350013 - DNA, 18 bp, Homo sapiens
gtacttttcattctcttt

SEQ ID NO: 6350014 - DNA, 21 bp, Homo sapiens
gtacttttcattctcttttaa

SEQ ID NO: 6350015 - DNA, 19 bp, Homo sapiens
gtacttttcctttgctagt

SEQ ID NO: 6350016 - DNA, 24 bp, Homo sapiens
gtacttttgagtgtgtgtgtgcat

SEQ ID NO: 6350017 - DNA, 16 bp, Homo sapiens
gtacttttgtgttact

SEQ ID NO: 6350018 - DNA, 23 bp, Homo sapiens
gtactttttaatgttatttggaa

SEQ ID NO: 6350019 - DNA, 16 bp, Homo sapiens
gtactttttattcaat

SEQ ID NO: 6350020 - DNA, 23 bp, Homo sapiens
gtactttttattcaattctgtat

SEQ ID NO: 6350021 - DNA, 16 bp, Homo sapiens
gtactttttattgcat

SEQ ID NO: 6350022 - DNA, 18 bp, Homo sapiens
gtactttttattgcatgg

SEQ ID NO: 6350023 - DNA, 23 bp, Homo sapiens
gtactttttattgcatggtgtga

SEQ ID NO: 6350024 - DNA, 14 bp, Homo sapiens
gtactttttgtgaa

SEQ ID NO: 6350025 - DNA, 20 bp, Homo sapiens
gtactttttgttccagagct

SEQ ID NO: 6350026 - DNA, 20 bp, Homo sapiens
gtacttttttatttaaaaaa

SEQ ID NO: 6350027 - DNA, 17 bp, Homo sapiens
gtacttttttcaaatat

SEQ ID NO: 6350028 - DNA, 22 bp, Homo sapiens
gtacttttttcaaatattgaat

SEQ ID NO: 6350029 - DNA, 16 bp, Homo sapiens
gtagaaaaaaaaataa

SEQ ID NO: 6350030 - DNA, 12 bp, Homo sapiens
gtagaaaaacat

SEQ ID NO: 6350031 - DNA, 19 bp, Homo sapiens
gtagaaaaataaagatgcc

SEQ ID NO: 6350032 - DNA, 12 bp, Homo sapiens
gtagaaaaattt

SEQ ID NO: 6350033 - DNA, 23 bp, Homo sapiens
gtagaaaagaaaacatttaacat

SEQ ID NO: 6350034 - DNA, 20 bp, Homo sapiens
gtagaaaagagacttctctg

SEQ ID NO: 6350035 - DNA, 17 bp, Homo sapiens
gtagaaaatatgtccca

SEQ ID NO: 6350036 - DNA, 14 bp, Homo sapiens
gtagaaaatgagga

SEQ ID NO: 6350037 - DNA, 15 bp, Homo sapiens
gtagaaaatgtgacc

SEQ ID NO: 6350038 - DNA, 14 bp, Homo sapiens
gtagaaacatttag

SEQ ID NO: 6350039 - DNA, 20 bp, Homo sapiens
gtagaaactttggaagtttt

SEQ ID NO: 6350040 - DNA, 18 bp, Homo sapiens
gtagaaagacagagctgg

SEQ ID NO: 6350041 - DNA, 23 bp, Homo sapiens
gtagaaagcaaacaaaattgttc

SEQ ID NO: 6350042 - DNA, 16 bp, Homo sapiens
gtagaaagctaataca

SEQ ID NO: 6350043 - DNA, 22 bp, Homo sapiens
gtagaaagctaatacaaaacta

SEQ ID NO: 6350044 - DNA, 13 bp, Homo sapiens
gtagaaaggaaat

SEQ ID NO: 6350045 - DNA, 21 bp, Homo sapiens
gtagaaaggcctttaaaattt

SEQ ID NO: 6350046 - DNA, 14 bp, Homo sapiens
gtagaaagttttag

SEQ ID NO: 6350047 - DNA, 20 bp, Homo sapiens
gtagaaatatctgaaaatgt

SEQ ID NO: 6350048 - DNA, 20 bp, Homo sapiens
gtagaaatccccctttctct

SEQ ID NO: 6350049 - DNA, 14 bp, Homo sapiens
gtagaaatgattca

SEQ ID NO: 6350050 - DNA, 22 bp, Homo sapiens
gtagaaatgcaagggggacaca

SEQ ID NO: 6350051 - DNA, 19 bp, Homo sapiens
gtagaaatgccagaaacag

SEQ ID NO: 6350052 - DNA, 19 bp, Homo sapiens
taaagtccttttcttgctt

SEQ ID NO: 6350053 - DNA, 20 bp, Homo sapiens
taaagtcgagcttttctaaa

SEQ ID NO: 6350054 - DNA, 17 bp, Homo sapiens
taaagtctaagcaagat

SEQ ID NO: 6350055 - DNA, 16 bp, Homo sapiens
taaagtctacactgcc

SEQ ID NO: 6350056 - DNA, 16 bp, Homo sapiens
taaagtctagaaaata

SEQ ID NO: 6350057 - DNA, 15 bp, Homo sapiens
taaagtctattcaaa

SEQ ID NO: 6350058 - DNA, 16 bp, Homo sapiens
taaagtctgagaaata

SEQ ID NO: 6350059 - DNA, 16 bp, Homo sapiens
taaagtctgagaaatt

SEQ ID NO: 6350060 - DNA, 19 bp, Homo sapiens
taaagtcttgctgtggtct

SEQ ID NO: 6350061 - DNA, 13 bp, Homo sapiens
taaagtgaagaat

SEQ ID NO: 6350062 - DNA, 16 bp, Homo sapiens
taaagtgaagaatcct

SEQ ID NO: 6350063 - DNA, 18 bp, Homo sapiens
taaagtgaagaatttatc

SEQ ID NO: 6350064 - DNA, 13 bp, Homo sapiens
taaagtgaaggaa

SEQ ID NO: 6350065 - DNA, 17 bp, Homo sapiens
taaagtgaaggaaataa

SEQ ID NO: 6350066 - DNA, 18 bp, Homo sapiens
taaagtgaaggaaataaa

SEQ ID NO: 6350067 - DNA, 21 bp, Homo sapiens
taaagtgaaggaaataaaggt

SEQ ID NO: 6350068 - DNA, 11 bp, Homo sapiens
taaagtgaatt

SEQ ID NO: 6350069 - DNA, 19 bp, Homo sapiens
taaagtgacaaaagctcat

SEQ ID NO: 6350070 - DNA, 20 bp, Homo sapiens
taaagtgaccctgctctcac

SEQ ID NO: 6350071 - DNA, 17 bp, Homo sapiens
taaagtgagaaaactgt

SEQ ID NO: 6350072 - DNA, 23 bp, Homo sapiens
taaagtgaggccactgaagagga

SEQ ID NO: 6350073 - DNA, 16 bp, Homo sapiens
taaagtgagtactgtt

SEQ ID NO: 6350074 - DNA, 17 bp, Homo sapiens
taaagtgagtactgtta

SEQ ID NO: 6350075 - DNA, 15 bp, Homo sapiens
taaagtgatatttcc

SEQ ID NO: 6350076 - DNA, 13 bp, Homo sapiens
taaagtgatgttt

SEQ ID NO: 6350077 - DNA, 11 bp, Homo sapiens
taaagtgatta

SEQ ID NO: 6350078 - DNA, 23 bp, Homo sapiens
taaagtgcaatgggtaagggagg

SEQ ID NO: 6350079 - DNA, 18 bp, Homo sapiens
taaagtgcattattttat

SEQ ID NO: 6350080 - DNA, 22 bp, Homo sapiens
taaagtgccttataggaatttg

SEQ ID NO: 6350081 - DNA, 18 bp, Homo sapiens
taaagtgctaaggttcta

SEQ ID NO: 6350082 - DNA, 19 bp, Homo sapiens
taaagtgctaaggttctaa

SEQ ID NO: 6350083 - DNA, 21 bp, Homo sapiens
taaagtgctaaggttctaagg

SEQ ID NO: 6350084 - DNA, 15 bp, Homo sapiens
taaagtgctgtttag

SEQ ID NO: 6350085 - DNA, 11 bp, Homo sapiens
taaagtgcttg

SEQ ID NO: 6350086 - DNA, 15 bp, Homo sapiens
taaagtgcttgcttt

SEQ ID NO: 6350087 - DNA, 16 bp, Homo sapiens
taaagtggacttctga

SEQ ID NO: 6350088 - DNA, 21 bp, Homo sapiens
taaagtggcaatttctttaga

SEQ ID NO: 6350089 - DNA, 16 bp, Homo sapiens
taaagtggcatttctt

SEQ ID NO: 6350090 - DNA, 20 bp, Homo sapiens
taaagtggttctctgccttt

SEQ ID NO: 6350091 - DNA, 16 bp, Homo sapiens
taaagtgtaaatcctt

SEQ ID NO: 6350092 - DNA, 18 bp, Homo sapiens
taaagtgtaagttcacaa

SEQ ID NO: 6350093 - DNA, 12 bp, Homo sapiens
taaagtgtaata

SEQ ID NO: 6350094 - DNA, 18 bp, Homo sapiens
taaagtgtaataatatga

SEQ ID NO: 6350095 - DNA, 13 bp, Homo sapiens
taaagtgtattat

SEQ ID NO: 6350096 - DNA, 18 bp, Homo sapiens
taaagtgtattataacag

SEQ ID NO: 6350097 - DNA, 15 bp, Homo sapiens
taaagtgtatttttt

SEQ ID NO: 6350098 - DNA, 20 bp, Homo sapiens
taaagtgtccattgacatgt

SEQ ID NO: 6350099 - DNA, 16 bp, Homo sapiens
taaagtgtgctttata

SEQ ID NO: 6350100 - DNA, 13 bp, Homo sapiens
taaagtgtggaaa

SEQ ID NO: 6350101 - DNA, 13 bp, Homo sapiens
taaagtgtgtgat

SEQ ID NO: 6350102 - DNA, 15 bp, Homo sapiens
taaagtgtgtgtgca

SEQ ID NO: 6350103 - DNA, 16 bp, Homo sapiens
taaagtgttggtcttt

SEQ ID NO: 6350104 - DNA, 19 bp, Homo sapiens
taaagtgttggtctttcta

SEQ ID NO: 6350105 - DNA, 12 bp, Homo sapiens
taaagtgtttca

SEQ ID NO: 6350106 - DNA, 15 bp, Homo sapiens
taaagtgtttcagct

SEQ ID NO: 6350107 - DNA, 14 bp, Homo sapiens
taaagtgttttcag

SEQ ID NO: 6350108 - DNA, 16 bp, Homo sapiens
taaagttaattcatta

SEQ ID NO: 6350109 - DNA, 17 bp, Homo sapiens
taaagttacactgttca

SEQ ID NO: 6350110 - DNA, 12 bp, Homo sapiens
taaagttacagt

SEQ ID NO: 6350111 - DNA, 19 bp, Homo sapiens
taaagttactactgatttt

SEQ ID NO: 6350112 - DNA, 17 bp, Homo sapiens
taaagttacttgaattt

SEQ ID NO: 6350113 - DNA, 14 bp, Homo sapiens
taaagttagaatct

SEQ ID NO: 6350114 - DNA, 16 bp, Homo sapiens
taaagttagaatctat

SEQ ID NO: 6350115 - DNA, 22 bp, Homo sapiens
taaagttagaatctattttcta

SEQ ID NO: 6350116 - DNA, 22 bp, Homo sapiens
taaagttagggcatttttcttg

SEQ ID NO: 6350117 - DNA, 15 bp, Homo sapiens
taaagttagtaaaga

SEQ ID NO: 6350118 - DNA, 16 bp, Homo sapiens
taaagttagtctactc

SEQ ID NO: 6350119 - DNA, 20 bp, Homo sapiens
taaagttagtctactcttaa

SEQ ID NO: 6350120 - DNA, 13 bp, Homo sapiens
taaagttattctt

SEQ ID NO: 6350121 - DNA, 14 bp, Homo sapiens
taaagttattcttg

SEQ ID NO: 6350122 - DNA, 19 bp, Homo sapiens
taaagttattcttgaagtc

SEQ ID NO: 6350123 - DNA, 18 bp, Homo sapiens
taaagttcaacatgttat

SEQ ID NO: 6350124 - DNA, 22 bp, Homo sapiens
taaagttccacttagagaacaa

SEQ ID NO: 6350125 - DNA, 12 bp, Homo sapiens
taaagttctaag

SEQ ID NO: 6350126 - DNA, 13 bp, Homo sapiens
taaagttctaaga

SEQ ID NO: 6350127 - DNA, 14 bp, Homo sapiens
taaagttctaagat

SEQ ID NO: 6350128 - DNA, 16 bp, Homo sapiens
taaagttctaagattc

SEQ ID NO: 6350129 - DNA, 19 bp, Homo sapiens
taaagttctaagattctga

SEQ ID NO: 6350130 - DNA, 17 bp, Homo sapiens
taaagttctctgtaatt

SEQ ID NO: 6350131 - DNA, 19 bp, Homo sapiens
taaagttctgcaaaataca

SEQ ID NO: 6350132 - DNA, 14 bp, Homo sapiens
taaagttctgtgta

SEQ ID NO: 6350133 - DNA, 23 bp, Homo sapiens
taaagttctgtgtatttaattgt

SEQ ID NO: 6350134 - DNA, 16 bp, Homo sapiens
taaagttgaaaataca

SEQ ID NO: 6350135 - DNA, 12 bp, Homo sapiens
taaagttgaata

SEQ ID NO: 6350136 - DNA, 15 bp, Homo sapiens
taaagttgaatttat

SEQ ID NO: 6350137 - DNA, 21 bp, Homo sapiens
taaagttgaatttattggctt

SEQ ID NO: 6350138 - DNA, 16 bp, Homo sapiens
taaagttggtaaacct

SEQ ID NO: 6350139 - DNA, 17 bp, Homo sapiens
taaagttggtaaacctt

SEQ ID NO: 6350140 - DNA, 19 bp, Homo sapiens
taaagttggtattaataaa

SEQ ID NO: 6350141 - DNA, 13 bp, Homo sapiens
taaagttgtaaat

SEQ ID NO: 6350142 - DNA, 14 bp, Homo sapiens
taaagttgtaaata

SEQ ID NO: 6350143 - DNA, 13 bp, Homo sapiens
taaagttgtattg

SEQ ID NO: 6350144 - DNA, 20 bp, Homo sapiens
taaagttgtatttcaaatat

SEQ ID NO: 6350145 - DNA, 17 bp, Homo sapiens
taaagttgtcttttaaa

SEQ ID NO: 6350146 - DNA, 14 bp, Homo sapiens
taaagttgttgcat

SEQ ID NO: 6350147 - DNA, 16 bp, Homo sapiens
taaagttgttgcattc

SEQ ID NO: 6350148 - DNA, 17 bp, Homo sapiens
taaagttgttgcattcc

SEQ ID NO: 6350149 - DNA, 16 bp, Homo sapiens
taaagttgtttcccac

SEQ ID NO: 6350150 - DNA, 13 bp, Homo sapiens
taaagttgtttta

SEQ ID NO: 6350151 - DNA, 13 bp, Homo sapiens
taaagtttaaaaa

SEQ ID NO: 6350152 - DNA, 18 bp, Homo sapiens
taaagtttaaaaaataca

SEQ ID NO: 6350153 - DNA, 16 bp, Homo sapiens
taaagtttaaatacca

SEQ ID NO: 6350154 - DNA, 17 bp, Homo sapiens
taaagtttaaataccag

SEQ ID NO: 6350155 - DNA, 23 bp, Homo sapiens
taaagtttaaataccagtacttg

SEQ ID NO: 6350156 - DNA, 11 bp, Homo sapiens
taaagtttaca

SEQ ID NO: 6350157 - DNA, 14 bp, Homo sapiens
taaagtttacaagc

SEQ ID NO: 6350158 - DNA, 17 bp, Homo sapiens
taaagtttcaaaaatct

SEQ ID NO: 6350159 - DNA, 20 bp, Homo sapiens
taaagtttcaaaaatctgaa

SEQ ID NO: 6350160 - DNA, 23 bp, Homo sapiens
taaagtttcattagtcatatttt

SEQ ID NO: 6350161 - DNA, 14 bp, Homo sapiens
taaagtttccatta

SEQ ID NO: 6350162 - DNA, 14 bp, Homo sapiens
taaagtttctcaga

SEQ ID NO: 6350163 - DNA, 13 bp, Homo sapiens
taaagtttctgtt

SEQ ID NO: 6350164 - DNA, 12 bp, Homo sapiens
taaagtttgatc

SEQ ID NO: 6350165 - DNA, 14 bp, Homo sapiens
taaagtttgcttag

SEQ ID NO: 6350166 - DNA, 17 bp, Homo sapiens
taaagtttgcttagaaa

SEQ ID NO: 6350167 - DNA, 21 bp, Homo sapiens
taaagtttgcttgtttcttgg

SEQ ID NO: 6350168 - DNA, 14 bp, Homo sapiens
taaagtttgttcac

SEQ ID NO: 6350169 - DNA, 16 bp, Homo sapiens
taaagtttgttcactt

SEQ ID NO: 6350170 - DNA, 14 bp, Homo sapiens
taaagttttagggt

SEQ ID NO: 6350171 - DNA, 17 bp, Homo sapiens
taaagttttatatatta

SEQ ID NO: 6350172 - DNA, 23 bp, Homo sapiens
taaagttttatatattatatgga

SEQ ID NO: 6350173 - DNA, 16 bp, Homo sapiens
taaagttttgcaacaa

SEQ ID NO: 6350174 - DNA, 14 bp, Homo sapiens
taaagttttgtaca

SEQ ID NO: 6350175 - DNA, 15 bp, Homo sapiens
taaagttttgttttg

SEQ ID NO: 6350176 - DNA, 20 bp, Homo sapiens
taaagtttttttatttcttt

SEQ ID NO: 6350177 - DNA, 17 bp, Homo sapiens
taaataaaaaaagacaa

SEQ ID NO: 6350178 - DNA, 17 bp, Homo sapiens
taaataaaaacaaagtt

SEQ ID NO: 6350179 - DNA, 21 bp, Homo sapiens
taaataaaaacacaccttaaa

SEQ ID NO: 6350180 - DNA, 16 bp, Homo sapiens
taaataaaaagaaagg

SEQ ID NO: 6350181 - DNA, 13 bp, Homo sapiens
taaataaaaatag

SEQ ID NO: 6350182 - DNA, 15 bp, Homo sapiens
taaataaaaatagct

SEQ ID NO: 6350183 - DNA, 15 bp, Homo sapiens
taaataaaaatatgt

SEQ ID NO: 6350184 - DNA, 17 bp, Homo sapiens
taaataaaaatatgtaa

SEQ ID NO: 6350185 - DNA, 19 bp, Homo sapiens
taaataaaaatatgtaatt

SEQ ID NO: 6350186 - DNA, 16 bp, Homo sapiens
taaataaaaatattct

SEQ ID NO: 6350187 - DNA, 18 bp, Homo sapiens
taaataaaaatttataag

SEQ ID NO: 6350188 - DNA, 21 bp, Homo sapiens
taaataaaacattttcacaca

SEQ ID NO: 6350189 - DNA, 22 bp, Homo sapiens
taaataaaacattttcacacaa

SEQ ID NO: 6350190 - DNA, 14 bp, Homo sapiens
taaataaaactatt

SEQ ID NO: 6350191 - DNA, 15 bp, Homo sapiens
taaataaaactattt

SEQ ID NO: 6350192 - DNA, 15 bp, Homo sapiens
taaataaaactgaat

SEQ ID NO: 6350193 - DNA, 21 bp, Homo sapiens
taaataaaagaaaaaatatct

SEQ ID NO: 6350194 - DNA, 21 bp, Homo sapiens
taaataaaagaaatgcacaat

SEQ ID NO: 6350195 - DNA, 14 bp, Homo sapiens
taaataaaagatag

SEQ ID NO: 6350196 - DNA, 14 bp, Homo sapiens
taaataaaagcaca

SEQ ID NO: 6350197 - DNA, 22 bp, Homo sapiens
taaataaaagcacaagtacttt

SEQ ID NO: 6350198 - DNA, 15 bp, Homo sapiens
taaataaaagcagca

SEQ ID NO: 6350199 - DNA, 20 bp, Homo sapiens
taaataaaagcagcatctgc

SEQ ID NO: 6350200 - DNA, 13 bp, Homo sapiens
taaataaaagtac

SEQ ID NO: 6350201 - DNA, 14 bp, Homo sapiens
taaataaaagtaca

SEQ ID NO: 6350202 - DNA, 11 bp, Homo sapiens
taaataaaata

SEQ ID NO: 6350203 - DNA, 12 bp, Homo sapiens
taaataaaatca

SEQ ID NO: 6350204 - DNA, 21 bp, Homo sapiens
taaataaaatgctaggttcta

SEQ ID NO: 6350205 - DNA, 22 bp, Homo sapiens
taaataaaatgctaggttctac

SEQ ID NO: 6350206 - DNA, 17 bp, Homo sapiens
taaataaaatgtgtaca

SEQ ID NO: 6350207 - DNA, 20 bp, Homo sapiens
taaataaaatgtgtacagtg

SEQ ID NO: 6350208 - DNA, 12 bp, Homo sapiens
taaataaaattg

SEQ ID NO: 6350209 - DNA, 20 bp, Homo sapiens
taaataaaatttgttgcata

SEQ ID NO: 6350210 - DNA, 19 bp, Homo sapiens
taaataaacagatgtatta

SEQ ID NO: 6350211 - DNA, 20 bp, Homo sapiens
taaataaacagatgtattat

SEQ ID NO: 6350212 - DNA, 17 bp, Homo sapiens
taaataaacatctgatc

SEQ ID NO: 6350213 - DNA, 22 bp, Homo sapiens
taaataaactatttatatcaca

SEQ ID NO: 6350214 - DNA, 20 bp, Homo sapiens
taaataaactcttcaaggcc

SEQ ID NO: 6350215 - DNA, 13 bp, Homo sapiens
taaataaactgtt

SEQ ID NO: 6350216 - DNA, 16 bp, Homo sapiens
taaataaactgtttat

SEQ ID NO: 6350217 - DNA, 18 bp, Homo sapiens
taaataaactttttttca

SEQ ID NO: 6350218 - DNA, 20 bp, Homo sapiens
taaataaactttttttcaat

SEQ ID NO: 6350219 - DNA, 21 bp, Homo sapiens
taaataaactttttttcaatg

SEQ ID NO: 6350220 - DNA, 15 bp, Homo sapiens
taaataaagaagaaa

SEQ ID NO: 6350221 - DNA, 20 bp, Homo sapiens
taaataaagtatcatgcatt

SEQ ID NO: 6350222 - DNA, 22 bp, Homo sapiens
taaataaagtctcctggattta

SEQ ID NO: 6350223 - DNA, 21 bp, Homo sapiens
taaataaagtttgttgaaaca

SEQ ID NO: 6350224 - DNA, 16 bp, Homo sapiens
taaataaataaaaata

SEQ ID NO: 6350225 - DNA, 14 bp, Homo sapiens
taaataaataatcg

SEQ ID NO: 6350226 - DNA, 14 bp, Homo sapiens
taaataaatagatt

SEQ ID NO: 6350227 - DNA, 15 bp, Homo sapiens
taaataaatagattt

SEQ ID NO: 6350228 - DNA, 14 bp, Homo sapiens
taaataaatagcta

SEQ ID NO: 6350229 - DNA, 13 bp, Homo sapiens
taaataaatatat

SEQ ID NO: 6350230 - DNA, 15 bp, Homo sapiens
taaataaatatatat

SEQ ID NO: 6350231 - DNA, 15 bp, Homo sapiens
taaataaatatttta

SEQ ID NO: 6350232 - DNA, 19 bp, Homo sapiens
taaataaatcaagaatcat

SEQ ID NO: 6350233 - DNA, 20 bp, Homo sapiens
taaataaatgaataaatcca

SEQ ID NO: 6350234 - DNA, 17 bp, Homo sapiens
gtagaaatggttgtatt

SEQ ID NO: 6350235 - DNA, 18 bp, Homo sapiens
gtagaaatggttgtatta

SEQ ID NO: 6350236 - DNA, 12 bp, Homo sapiens
gtagaaattcta

SEQ ID NO: 6350237 - DNA, 14 bp, Homo sapiens
gtagaaattcttaa

SEQ ID NO: 6350238 - DNA, 21 bp, Homo sapiens
gtagaaattcttaatttggat

SEQ ID NO: 6350239 - DNA, 17 bp, Homo sapiens
gtagaaattcttcatga

SEQ ID NO: 6350240 - DNA, 22 bp, Homo sapiens
gtagaacaagcaacataaaaca

SEQ ID NO: 6350241 - DNA, 14 bp, Homo sapiens
gtagaacctcacct

SEQ ID NO: 6350242 - DNA, 19 bp, Homo sapiens
gtagaacgtaaccacggaa

SEQ ID NO: 6350243 - DNA, 18 bp, Homo sapiens
gtagaactcactctgggc

SEQ ID NO: 6350244 - DNA, 22 bp, Homo sapiens
gtagaactcactctgggctgta

SEQ ID NO: 6350245 - DNA, 21 bp, Homo sapiens
gtagaactcttaaatactttt

SEQ ID NO: 6350246 - DNA, 16 bp, Homo sapiens
gtagaactgcccattt

SEQ ID NO: 6350247 - DNA, 16 bp, Homo sapiens
gtagaactgtctgtga

SEQ ID NO: 6350248 - DNA, 14 bp, Homo sapiens
gtagaactgttcat

SEQ ID NO: 6350249 - DNA, 13 bp, Homo sapiens
gtagaactttgta

SEQ ID NO: 6350250 - DNA, 21 bp, Homo sapiens
gtagaactttgtatagttatg

SEQ ID NO: 6350251 - DNA, 15 bp, Homo sapiens
gtagaagaaaattta

SEQ ID NO: 6350252 - DNA, 18 bp, Homo sapiens
gtagaagaaaatttaatt

SEQ ID NO: 6350253 - DNA, 13 bp, Homo sapiens
gtagaagatgacc

SEQ ID NO: 6350254 - DNA, 18 bp, Homo sapiens
gtagaagcattccttctt

SEQ ID NO: 6350255 - DNA, 21 bp, Homo sapiens
gtagaagcattccttctttga

SEQ ID NO: 6350256 - DNA, 22 bp, Homo sapiens
gtagaagcattccttctttgat

SEQ ID NO: 6350257 - DNA, 22 bp, Homo sapiens
gtagaagccacccttccctgcc

SEQ ID NO: 6350258 - DNA, 23 bp, Homo sapiens
gtagaagccacccttccctgcct

SEQ ID NO: 6350259 - DNA, 11 bp, Homo sapiens
gtagaagccag

SEQ ID NO: 6350260 - DNA, 21 bp, Homo sapiens
gtagaagccttatgaaaatta

SEQ ID NO: 6350261 - DNA, 15 bp, Homo sapiens
gtagaaggagacaga

SEQ ID NO: 6350262 - DNA, 18 bp, Homo sapiens
gtagaagggaaagcccat

SEQ ID NO: 6350263 - DNA, 19 bp, Homo sapiens
gtagaagggttatatttta

SEQ ID NO: 6350264 - DNA, 21 bp, Homo sapiens
gtagaagtaatatgctctcat

SEQ ID NO: 6350265 - DNA, 20 bp, Homo sapiens
gtagaagtaggaggaaacag

SEQ ID NO: 6350266 - DNA, 13 bp, Homo sapiens
gtagaagtagttt

SEQ ID NO: 6350267 - DNA, 18 bp, Homo sapiens
gtagaagttctagtgttt

SEQ ID NO: 6350268 - DNA, 19 bp, Homo sapiens
gtagaagttctagtgtttt

SEQ ID NO: 6350269 - DNA, 17 bp, Homo sapiens
gtagaataaagaaaaac

SEQ ID NO: 6350270 - DNA, 19 bp, Homo sapiens
gtagaataaatgaagaaag

SEQ ID NO: 6350271 - DNA, 19 bp, Homo sapiens
gtagaataacctttcagaa

SEQ ID NO: 6350272 - DNA, 18 bp, Homo sapiens
gtagaatacgcagaacta

SEQ ID NO: 6350273 - DNA, 16 bp, Homo sapiens
gtagaatcttgttaat

SEQ ID NO: 6350274 - DNA, 18 bp, Homo sapiens
gtagaatgaccttgtaat

SEQ ID NO: 6350275 - DNA, 23 bp, Homo sapiens
gtagaatgaccttgtaatgtaac

SEQ ID NO: 6350276 - DNA, 19 bp, Homo sapiens
gtagaatgattaatcaaag

SEQ ID NO: 6350277 - DNA, 18 bp, Homo sapiens
gtagaatgatttttgcta

SEQ ID NO: 6350278 - DNA, 13 bp, Homo sapiens
gtagaatgctgta

SEQ ID NO: 6350279 - DNA, 18 bp, Homo sapiens
gtagaatgtattgtacct

SEQ ID NO: 6350280 - DNA, 20 bp, Homo sapiens
gtagaatgtattgtaccttt

SEQ ID NO: 6350281 - DNA, 23 bp, Homo sapiens
gtagaatgtattgtaccttttaa

SEQ ID NO: 6350282 - DNA, 17 bp, Homo sapiens
gtagaattatatctaat

SEQ ID NO: 6350283 - DNA, 19 bp, Homo sapiens
gtagaattatatctaattt

SEQ ID NO: 6350284 - DNA, 14 bp, Homo sapiens
gtagaattgcattg

SEQ ID NO: 6350285 - DNA, 11 bp, Homo sapiens
gtagacaaaac

SEQ ID NO: 6350286 - DNA, 13 bp, Homo sapiens
gtagacaaaactt

SEQ ID NO: 6350287 - DNA, 23 bp, Homo sapiens
gtagacaatttgccttaggaagt

SEQ ID NO: 6350288 - DNA, 19 bp, Homo sapiens
gtagacacgctcttctatt

SEQ ID NO: 6350289 - DNA, 13 bp, Homo sapiens
gtagacacttact

SEQ ID NO: 6350290 - DNA, 18 bp, Homo sapiens
gtagacagatatttcaaa

SEQ ID NO: 6350291 - DNA, 22 bp, Homo sapiens
gtagacagatatttcaaacatc

SEQ ID NO: 6350292 - DNA, 19 bp, Homo sapiens
gtagacagccttccagtgg

SEQ ID NO: 6350293 - DNA, 16 bp, Homo sapiens
gtagacattgtaaata

SEQ ID NO: 6350294 - DNA, 15 bp, Homo sapiens
gtagacatttctctt

SEQ ID NO: 6350295 - DNA, 12 bp, Homo sapiens
gtagacatttta

SEQ ID NO: 6350296 - DNA, 14 bp, Homo sapiens
gtagacattttgaa

SEQ ID NO: 6350297 - DNA, 16 bp, Homo sapiens
gtagacccctggctgg

SEQ ID NO: 6350298 - DNA, 17 bp, Homo sapiens
gtagacccctggctggt

SEQ ID NO: 6350299 - DNA, 15 bp, Homo sapiens
gtagacctctttttc

SEQ ID NO: 6350300 - DNA, 14 bp, Homo sapiens
gtagacctgagctg

SEQ ID NO: 6350301 - DNA, 19 bp, Homo sapiens
gtagacctgtctcctggcg

SEQ ID NO: 6350302 - DNA, 21 bp, Homo sapiens
gtagacctgtctcctggcggt

SEQ ID NO: 6350303 - DNA, 21 bp, Homo sapiens
gtagaccttgagggtgggcca

SEQ ID NO: 6350304 - DNA, 22 bp, Homo sapiens
gtagaccttgttacttctgagg

SEQ ID NO: 6350305 - DNA, 18 bp, Homo sapiens
gtagacgaacagctgaca

SEQ ID NO: 6350306 - DNA, 13 bp, Homo sapiens
gtagacgatatac

SEQ ID NO: 6350307 - DNA, 16 bp, Homo sapiens
gtagactatatacatg

SEQ ID NO: 6350308 - DNA, 23 bp, Homo sapiens
gtagactatggaatgtcagtgtt

SEQ ID NO: 6350309 - DNA, 17 bp, Homo sapiens
gtagactcacggctgca

SEQ ID NO: 6350310 - DNA, 16 bp, Homo sapiens
gtagactcctgcttct

SEQ ID NO: 6350311 - DNA, 19 bp, Homo sapiens
gtagactctaagatacact

SEQ ID NO: 6350312 - DNA, 22 bp, Homo sapiens
gtagactgagggattttagcct

SEQ ID NO: 6350313 - DNA, 15 bp, Homo sapiens
gtagactgtgccaga

SEQ ID NO: 6350314 - DNA, 17 bp, Homo sapiens
gtagactgtgccagagg

SEQ ID NO: 6350315 - DNA, 20 bp, Homo sapiens
gtagacttcctttataatat

SEQ ID NO: 6350316 - DNA, 19 bp, Homo sapiens
gtagagaaaaaaaaatatg

SEQ ID NO: 6350317 - DNA, 23 bp, Homo sapiens
gtagagacagggtctcactgtgt

SEQ ID NO: 6350318 - DNA, 15 bp, Homo sapiens
gtagagacagggttt

SEQ ID NO: 6350319 - DNA, 15 bp, Homo sapiens
gtagagacccccagg

SEQ ID NO: 6350320 - DNA, 14 bp, Homo sapiens
gtagagacgaggtc

SEQ ID NO: 6350321 - DNA, 11 bp, Homo sapiens
gtagagaggac

SEQ ID NO: 6350322 - DNA, 13 bp, Homo sapiens
gtagagaggcccg

SEQ ID NO: 6350323 - DNA, 13 bp, Homo sapiens
gtagagagtgccc

SEQ ID NO: 6350324 - DNA, 15 bp, Homo sapiens
gtagagatgaagtta

SEQ ID NO: 6350325 - DNA, 12 bp, Homo sapiens
gtagagatgtgt

SEQ ID NO: 6350326 - DNA, 13 bp, Homo sapiens
gtagagatgtgtg

SEQ ID NO: 6350327 - DNA, 18 bp, Homo sapiens
gtagagatttttatgtgt

SEQ ID NO: 6350328 - DNA, 17 bp, Homo sapiens
gtagagcatgacttatt

SEQ ID NO: 6350329 - DNA, 20 bp, Homo sapiens
gtagagcatggttccagtga

SEQ ID NO: 6350330 - DNA, 14 bp, Homo sapiens
gtagagccaattag

SEQ ID NO: 6350331 - DNA, 11 bp, Homo sapiens
gtagagccagg

SEQ ID NO: 6350332 - DNA, 19 bp, Homo sapiens
gtagagcccctactgtggg

SEQ ID NO: 6350333 - DNA, 12 bp, Homo sapiens
gtagagccctca

SEQ ID NO: 6350334 - DNA, 13 bp, Homo sapiens
gtagaggaagacg

SEQ ID NO: 6350335 - DNA, 21 bp, Homo sapiens
gtagaggcatttgtcttagag

SEQ ID NO: 6350336 - DNA, 15 bp, Homo sapiens
gtagaggcttgttta

SEQ ID NO: 6350337 - DNA, 20 bp, Homo sapiens
gtagaggggtgctttgcctg

SEQ ID NO: 6350338 - DNA, 16 bp, Homo sapiens
gtagagggtgctgccc

SEQ ID NO: 6350339 - DNA, 19 bp, Homo sapiens
gtagaggtacacttgtgaa

SEQ ID NO: 6350340 - DNA, 16 bp, Homo sapiens
gtagaggtataattgt

SEQ ID NO: 6350341 - DNA, 21 bp, Homo sapiens
gtagagtagggtagaaggaaa

SEQ ID NO: 6350342 - DNA, 21 bp, Homo sapiens
gtagagtatattgaaaagaaa

SEQ ID NO: 6350343 - DNA, 15 bp, Homo sapiens
gtagagtcaggagaa

SEQ ID NO: 6350344 - DNA, 16 bp, Homo sapiens
gtagagtcaggagaaa

SEQ ID NO: 6350345 - DNA, 15 bp, Homo sapiens
gtagagtcatctcca

SEQ ID NO: 6350346 - DNA, 21 bp, Homo sapiens
gtagagtctgagggcttgtag

SEQ ID NO: 6350347 - DNA, 16 bp, Homo sapiens
gtagagtgcccatggg

SEQ ID NO: 6350348 - DNA, 21 bp, Homo sapiens
gtagagtggcccagaattgca

SEQ ID NO: 6350349 - DNA, 15 bp, Homo sapiens
gtagagtgtgcctga

SEQ ID NO: 6350350 - DNA, 17 bp, Homo sapiens
gtagagtgtttgtgagc

SEQ ID NO: 6350351 - DNA, 16 bp, Homo sapiens
gtagagttaagaagct

SEQ ID NO: 6350352 - DNA, 17 bp, Homo sapiens
gtagagttaagaagctg

SEQ ID NO: 6350353 - DNA, 16 bp, Homo sapiens
gtagagttcactgttg

SEQ ID NO: 6350354 - DNA, 23 bp, Homo sapiens
gtagagttgctgagagggctcga

SEQ ID NO: 6350355 - DNA, 14 bp, Homo sapiens
gtagataaagcact

SEQ ID NO: 6350356 - DNA, 15 bp, Homo sapiens
gtagataaataatgt

SEQ ID NO: 6350357 - DNA, 16 bp, Homo sapiens
gtagataatttcaggg

SEQ ID NO: 6350358 - DNA, 17 bp, Homo sapiens
gtagataatttcagggt

SEQ ID NO: 6350359 - DNA, 18 bp, Homo sapiens
gtagataatttcagggtg

SEQ ID NO: 6350360 - DNA, 23 bp, Homo sapiens
gtagatacaggggcaaaagtcat

SEQ ID NO: 6350361 - DNA, 17 bp, Homo sapiens
gtagatagaaagcaata

SEQ ID NO: 6350362 - DNA, 12 bp, Homo sapiens
gtagatagaaat

SEQ ID NO: 6350363 - DNA, 23 bp, Homo sapiens
gtagatagtatgcactatataca

SEQ ID NO: 6350364 - DNA, 14 bp, Homo sapiens
gtagatatatattt

SEQ ID NO: 6350365 - DNA, 17 bp, Homo sapiens
gtagatattactttatc

SEQ ID NO: 6350366 - DNA, 19 bp, Homo sapiens
gtagatattatgtatagaa

SEQ ID NO: 6350367 - DNA, 20 bp, Homo sapiens
gtagatattatgtatagaaa

SEQ ID NO: 6350368 - DNA, 14 bp, Homo sapiens
gtagatatttggct

SEQ ID NO: 6350369 - DNA, 19 bp, Homo sapiens
gtagatattttttctgaat

SEQ ID NO: 6350370 - DNA, 19 bp, Homo sapiens
gtagatcatccccgagggc

SEQ ID NO: 6350371 - DNA, 15 bp, Homo sapiens
gtagatcatcttgaa

SEQ ID NO: 6350372 - DNA, 19 bp, Homo sapiens
gtagatcatggcagcatga

SEQ ID NO: 6350373 - DNA, 15 bp, Homo sapiens
gtagatcattttttg

SEQ ID NO: 6350374 - DNA, 17 bp, Homo sapiens
gtagatctgctttctgt

SEQ ID NO: 6350375 - DNA, 18 bp, Homo sapiens
gtagatctgctttctgtt

SEQ ID NO: 6350376 - DNA, 20 bp, Homo sapiens
gtagatctgctttctgttca

SEQ ID NO: 6350377 - DNA, 18 bp, Homo sapiens
gtagatcttcaatttgga

SEQ ID NO: 6350378 - DNA, 22 bp, Homo sapiens
gtagatgaaaaagcatgtacag

SEQ ID NO: 6350379 - DNA, 14 bp, Homo sapiens
gtagatgaacttga

SEQ ID NO: 6350380 - DNA, 14 bp, Homo sapiens
gtagatgacaaata

SEQ ID NO: 6350381 - DNA, 15 bp, Homo sapiens
gtagatgcgcagccc

SEQ ID NO: 6350382 - DNA, 16 bp, Homo sapiens
gtagatgctgaggccc

SEQ ID NO: 6350383 - DNA, 13 bp, Homo sapiens
gtagatgctgcct

SEQ ID NO: 6350384 - DNA, 15 bp, Homo sapiens
gtagatgcttgctct

SEQ ID NO: 6350385 - DNA, 17 bp, Homo sapiens
gtagatggagtttcact

SEQ ID NO: 6350386 - DNA, 21 bp, Homo sapiens
gtagatgggagggaggctcag

SEQ ID NO: 6350387 - DNA, 14 bp, Homo sapiens
gtagatgggcattt

SEQ ID NO: 6350388 - DNA, 17 bp, Homo sapiens
gtagatggtgacctggg

SEQ ID NO: 6350389 - DNA, 20 bp, Homo sapiens
gtagatgtgcaatagaaata

SEQ ID NO: 6350390 - DNA, 23 bp, Homo sapiens
gtagatgttcagattgctttgat

SEQ ID NO: 6350391 - DNA, 15 bp, Homo sapiens
gtagatgttctagga

SEQ ID NO: 6350392 - DNA, 14 bp, Homo sapiens
gtagatgttctttt

SEQ ID NO: 6350393 - DNA, 21 bp, Homo sapiens
gtagatgttcttttctattta

SEQ ID NO: 6350394 - DNA, 18 bp, Homo sapiens
gtagattaaaatatttgc

SEQ ID NO: 6350395 - DNA, 14 bp, Homo sapiens
gtagattcatgaaa

SEQ ID NO: 6350396 - DNA, 16 bp, Homo sapiens
gtagattctgtggaac

SEQ ID NO: 6350397 - DNA, 21 bp, Homo sapiens
gtagattgatctaaggcatgc

SEQ ID NO: 6350398 - DNA, 13 bp, Homo sapiens
gtagattgcagaa

SEQ ID NO: 6350399 - DNA, 14 bp, Homo sapiens
gtagattgcgtgga

SEQ ID NO: 6350400 - DNA, 17 bp, Homo sapiens
gtagattgtgtaaattc

SEQ ID NO: 6350401 - DNA, 21 bp, Homo sapiens
gtagattgtgtaaattcctgt

SEQ ID NO: 6350402 - DNA, 12 bp, Homo sapiens
gtagatttattt

SEQ ID NO: 6350403 - DNA, 19 bp, Homo sapiens
gtagatttatttcatcata

SEQ ID NO: 6350404 - DNA, 20 bp, Homo sapiens
gtagatttcagtagtttcta

SEQ ID NO: 6350405 - DNA, 21 bp, Homo sapiens
gtagatttcagtagtttctaa

SEQ ID NO: 6350406 - DNA, 13 bp, Homo sapiens
gtagatttcctcc

SEQ ID NO: 6350407 - DNA, 17 bp, Homo sapiens
gtagatttcctcctccc

SEQ ID NO: 6350408 - DNA, 13 bp, Homo sapiens
gtagatttctctt

SEQ ID NO: 6350409 - DNA, 22 bp, Homo sapiens
gtagatttctcttgggcaggca

SEQ ID NO: 6350410 - DNA, 14 bp, Homo sapiens
gtagatttgaaaat

SEQ ID NO: 6350411 - DNA, 16 bp, Homo sapiens
gtagatttgttttgtg

SEQ ID NO: 6350412 - DNA, 21 bp, Homo sapiens
gtagattttaaaagttattaa

SEQ ID NO: 6350413 - DNA, 21 bp, Homo sapiens
taaataaatgagctgttggaa

SEQ ID NO: 6350414 - DNA, 13 bp, Homo sapiens
taaataaatgcca

SEQ ID NO: 6350415 - DNA, 12 bp, Homo sapiens
taaataaatgct

SEQ ID NO: 6350416 - DNA, 11 bp, Homo sapiens
taaataaatgt

SEQ ID NO: 6350417 - DNA, 12 bp, Homo sapiens
taaataaatgtt

SEQ ID NO: 6350418 - DNA, 13 bp, Homo sapiens
taaataaattatg

SEQ ID NO: 6350419 - DNA, 23 bp, Homo sapiens
taaataaattgcctcccttcctc

SEQ ID NO: 6350420 - DNA, 16 bp, Homo sapiens
taaataaattgtatat

SEQ ID NO: 6350421 - DNA, 18 bp, Homo sapiens
taaataaattgtatattc

SEQ ID NO: 6350422 - DNA, 12 bp, Homo sapiens
taaataaatttc

SEQ ID NO: 6350423 - DNA, 15 bp, Homo sapiens
taaataaatttccca

SEQ ID NO: 6350424 - DNA, 16 bp, Homo sapiens
taaataaatttgcttt

SEQ ID NO: 6350425 - DNA, 16 bp, Homo sapiens
taaataaattttaatt

SEQ ID NO: 6350426 - DNA, 12 bp, Homo sapiens
taaataacactt

SEQ ID NO: 6350427 - DNA, 15 bp, Homo sapiens
taaataacacttgtc

SEQ ID NO: 6350428 - DNA, 19 bp, Homo sapiens
taaataaccccattctttg

SEQ ID NO: 6350429 - DNA, 21 bp, Homo sapiens
taaataaccccattctttgct

SEQ ID NO: 6350430 - DNA, 14 bp, Homo sapiens
taaataacctctgg

SEQ ID NO: 6350431 - DNA, 15 bp, Homo sapiens
taaataactatataa

SEQ ID NO: 6350432 - DNA, 12 bp, Homo sapiens
taaataactgtg

SEQ ID NO: 6350433 - DNA, 19 bp, Homo sapiens
taaataacttgccatttct

SEQ ID NO: 6350434 - DNA, 20 bp, Homo sapiens
taaataacttgccatttctt

SEQ ID NO: 6350435 - DNA, 22 bp, Homo sapiens
taaataacttgccatttcttta

SEQ ID NO: 6350436 - DNA, 11 bp, Homo sapiens
taaataagaaa

SEQ ID NO: 6350437 - DNA, 16 bp, Homo sapiens
taaataagaaactttt

SEQ ID NO: 6350438 - DNA, 15 bp, Homo sapiens
taaataagagatttg

SEQ ID NO: 6350439 - DNA, 16 bp, Homo sapiens
taaataagatgattta

SEQ ID NO: 6350440 - DNA, 13 bp, Homo sapiens
taaataagattct

SEQ ID NO: 6350441 - DNA, 15 bp, Homo sapiens
taaataagattctaa

SEQ ID NO: 6350442 - DNA, 18 bp, Homo sapiens
taaataagattctaacgg

SEQ ID NO: 6350443 - DNA, 14 bp, Homo sapiens
taaataagattgct

SEQ ID NO: 6350444 - DNA, 16 bp, Homo sapiens
taaataagcccagtgc

SEQ ID NO: 6350445 - DNA, 19 bp, Homo sapiens
taaataaggccatgtctga

SEQ ID NO: 6350446 - DNA, 15 bp, Homo sapiens
taaataataaataaa

SEQ ID NO: 6350447 - DNA, 21 bp, Homo sapiens
taaataatactttaggaaata

SEQ ID NO: 6350448 - DNA, 14 bp, Homo sapiens
taaataatataaaa

SEQ ID NO: 6350449 - DNA, 23 bp, Homo sapiens
taaataatattatattgtattta

SEQ ID NO: 6350450 - DNA, 17 bp, Homo sapiens
taaataatcacacacac

SEQ ID NO: 6350451 - DNA, 14 bp, Homo sapiens
taaataatctacat

SEQ ID NO: 6350452 - DNA, 14 bp, Homo sapiens
taaataatctcatc

SEQ ID NO: 6350453 - DNA, 13 bp, Homo sapiens
taaataatgaaaa

SEQ ID NO: 6350454 - DNA, 18 bp, Homo sapiens
taaataatgaataaactg

SEQ ID NO: 6350455 - DNA, 19 bp, Homo sapiens
taaataatgaataaactga

SEQ ID NO: 6350456 - DNA, 20 bp, Homo sapiens
taaataatgatcttccaaat

SEQ ID NO: 6350457 - DNA, 14 bp, Homo sapiens
taaataatgcttaa

SEQ ID NO: 6350458 - DNA, 12 bp, Homo sapiens
taaataattctt

SEQ ID NO: 6350459 - DNA, 21 bp, Homo sapiens
taaataattgcatcagttcat

SEQ ID NO: 6350460 - DNA, 15 bp, Homo sapiens
taaataattggaaaa

SEQ ID NO: 6350461 - DNA, 10 bp, Homo sapiens
taaataattt

SEQ ID NO: 6350462 - DNA, 17 bp, Homo sapiens
taaataatttattacaa

SEQ ID NO: 6350463 - DNA, 14 bp, Homo sapiens
taaataatttctac

SEQ ID NO: 6350464 - DNA, 14 bp, Homo sapiens
taaataattttaat

SEQ ID NO: 6350465 - DNA, 23 bp, Homo sapiens
taaataattttctaagacagttt

SEQ ID NO: 6350466 - DNA, 22 bp, Homo sapiens
taaataattttgttttaatctt

SEQ ID NO: 6350467 - DNA, 17 bp, Homo sapiens
taaatacaaaacttcca

SEQ ID NO: 6350468 - DNA, 18 bp, Homo sapiens
taaatacaaaataaaatt

SEQ ID NO: 6350469 - DNA, 14 bp, Homo sapiens
taaatacaaatctg

SEQ ID NO: 6350470 - DNA, 20 bp, Homo sapiens
taaatacaaatctgtataaa

SEQ ID NO: 6350471 - DNA, 14 bp, Homo sapiens
taaatacaacacat

SEQ ID NO: 6350472 - DNA, 16 bp, Homo sapiens
taaatacaacacatct

SEQ ID NO: 6350473 - DNA, 23 bp, Homo sapiens
taaatacaagactgttgtgatct

SEQ ID NO: 6350474 - DNA, 15 bp, Homo sapiens
taaatacaatattgc

SEQ ID NO: 6350475 - DNA, 12 bp, Homo sapiens
taaatacaatgg

SEQ ID NO: 6350476 - DNA, 22 bp, Homo sapiens
taaatacaattttgtttctgta

SEQ ID NO: 6350477 - DNA, 21 bp, Homo sapiens
taaatacacttcctgcttaaa

SEQ ID NO: 6350478 - DNA, 16 bp, Homo sapiens
taaatacagacactaa

SEQ ID NO: 6350479 - DNA, 19 bp, Homo sapiens
taaatacagacactaagtt

SEQ ID NO: 6350480 - DNA, 13 bp, Homo sapiens
taaatacagcaat

SEQ ID NO: 6350481 - DNA, 17 bp, Homo sapiens
taaatacagcatacttc

SEQ ID NO: 6350482 - DNA, 13 bp, Homo sapiens
taaatacaggaaa

SEQ ID NO: 6350483 - DNA, 18 bp, Homo sapiens
taaatacaggaaacagtt

SEQ ID NO: 6350484 - DNA, 15 bp, Homo sapiens
taaatacaggaagaa

SEQ ID NO: 6350485 - DNA, 20 bp, Homo sapiens
taaatacagtcttccatttg

SEQ ID NO: 6350486 - DNA, 21 bp, Homo sapiens
taaatacataaatagtagaaa

SEQ ID NO: 6350487 - DNA, 21 bp, Homo sapiens
taaatacatacggtcaggttt

SEQ ID NO: 6350488 - DNA, 16 bp, Homo sapiens
taaatacatatggatg

SEQ ID NO: 6350489 - DNA, 16 bp, Homo sapiens
taaatacatccttttt

SEQ ID NO: 6350490 - DNA, 16 bp, Homo sapiens
taaatacatgcatata

SEQ ID NO: 6350491 - DNA, 21 bp, Homo sapiens
taaatacatgcatataatgaa

SEQ ID NO: 6350492 - DNA, 22 bp, Homo sapiens
taaatacatgtatttaaaaaaa

SEQ ID NO: 6350493 - DNA, 17 bp, Homo sapiens
taaatacatgtgtggat

SEQ ID NO: 6350494 - DNA, 14 bp, Homo sapiens
taaatacatttata

SEQ ID NO: 6350495 - DNA, 18 bp, Homo sapiens
taaataccaagagcaatt

SEQ ID NO: 6350496 - DNA, 18 bp, Homo sapiens
taaataccaattatggaa

SEQ ID NO: 6350497 - DNA, 12 bp, Homo sapiens
taaataccagga

SEQ ID NO: 6350498 - DNA, 14 bp, Homo sapiens
taaataccaggatt

SEQ ID NO: 6350499 - DNA, 17 bp, Homo sapiens
taaataccagtacttga

SEQ ID NO: 6350500 - DNA, 17 bp, Homo sapiens
taaataccattgacaca

SEQ ID NO: 6350501 - DNA, 21 bp, Homo sapiens
taaatacctctggcttagaaa

SEQ ID NO: 6350502 - DNA, 13 bp, Homo sapiens
taaatacctctta

SEQ ID NO: 6350503 - DNA, 16 bp, Homo sapiens
taaatactaaatatga

SEQ ID NO: 6350504 - DNA, 18 bp, Homo sapiens
taaatactaactgctgat

SEQ ID NO: 6350505 - DNA, 20 bp, Homo sapiens
taaatactaactgctgattt

SEQ ID NO: 6350506 - DNA, 16 bp, Homo sapiens
taaatactcatgaatg

SEQ ID NO: 6350507 - DNA, 21 bp, Homo sapiens
taaatactccattattttatt

SEQ ID NO: 6350508 - DNA, 18 bp, Homo sapiens
taaatactgacaatgtat

SEQ ID NO: 6350509 - DNA, 20 bp, Homo sapiens
taaatactgagaaaacctgt

SEQ ID NO: 6350510 - DNA, 17 bp, Homo sapiens
taaatactgcaaatcag

SEQ ID NO: 6350511 - DNA, 22 bp, Homo sapiens
taaatactggtaccttccccca

SEQ ID NO: 6350512 - DNA, 20 bp, Homo sapiens
taaatactggtgcacttctt

SEQ ID NO: 6350513 - DNA, 14 bp, Homo sapiens
taaatactgtacat

SEQ ID NO: 6350514 - DNA, 15 bp, Homo sapiens
taaatactgtacata

SEQ ID NO: 6350515 - DNA, 16 bp, Homo sapiens
taaatactgtacatag

SEQ ID NO: 6350516 - DNA, 17 bp, Homo sapiens
taaatactgtgaaatac

SEQ ID NO: 6350517 - DNA, 15 bp, Homo sapiens
taaatactgtgcaga

SEQ ID NO: 6350518 - DNA, 15 bp, Homo sapiens
taaatacttgcagtt

SEQ ID NO: 6350519 - DNA, 18 bp, Homo sapiens
taaatacttttttctatt

SEQ ID NO: 6350520 - DNA, 21 bp, Homo sapiens
taaatagaaagagttctatgg

SEQ ID NO: 6350521 - DNA, 16 bp, Homo sapiens
taaatagaaattttca

SEQ ID NO: 6350522 - DNA, 20 bp, Homo sapiens
taaatagaactatctgcatt

SEQ ID NO: 6350523 - DNA, 13 bp, Homo sapiens
taaatagaacttg

SEQ ID NO: 6350524 - DNA, 18 bp, Homo sapiens
taaatagaagagtttaaa

SEQ ID NO: 6350525 - DNA, 22 bp, Homo sapiens
taaatagaagagtttaaaagca

SEQ ID NO: 6350526 - DNA, 13 bp, Homo sapiens
taaatagaatgta

SEQ ID NO: 6350527 - DNA, 18 bp, Homo sapiens
taaatagaatgtaaatgt

SEQ ID NO: 6350528 - DNA, 18 bp, Homo sapiens
taaatagagtatatgcac

SEQ ID NO: 6350529 - DNA, 18 bp, Homo sapiens
taaatagagtttgctatt

SEQ ID NO: 6350530 - DNA, 20 bp, Homo sapiens
taaatagatgatttcaatag

SEQ ID NO: 6350531 - DNA, 16 bp, Homo sapiens
taaatagcataaaatg

SEQ ID NO: 6350532 - DNA, 17 bp, Homo sapiens
taaatagcatctgctct

SEQ ID NO: 6350533 - DNA, 15 bp, Homo sapiens
taaatagcatgtatt

SEQ ID NO: 6350534 - DNA, 21 bp, Homo sapiens
taaatagcatgtattgtgtct

SEQ ID NO: 6350535 - DNA, 16 bp, Homo sapiens
taaatagcattatctt

SEQ ID NO: 6350536 - DNA, 15 bp, Homo sapiens
taaatagctatatcc

SEQ ID NO: 6350537 - DNA, 18 bp, Homo sapiens
taaatagctatatccatg

SEQ ID NO: 6350538 - DNA, 16 bp, Homo sapiens
taaatagctgaaaact

SEQ ID NO: 6350539 - DNA, 21 bp, Homo sapiens
taaatagctgaaaactaatgt

SEQ ID NO: 6350540 - DNA, 17 bp, Homo sapiens
taaatagctttgagatt

SEQ ID NO: 6350541 - DNA, 21 bp, Homo sapiens
taaataggaatcattcagaaa

SEQ ID NO: 6350542 - DNA, 16 bp, Homo sapiens
taaataggagaggatg

SEQ ID NO: 6350543 - DNA, 17 bp, Homo sapiens
taaataggatcctggag

SEQ ID NO: 6350544 - DNA, 13 bp, Homo sapiens
taaatagggaaaa

SEQ ID NO: 6350545 - DNA, 18 bp, Homo sapiens
taaataggttcagatttt

SEQ ID NO: 6350546 - DNA, 21 bp, Homo sapiens
taaataggtttttcttgctat

SEQ ID NO: 6350547 - DNA, 16 bp, Homo sapiens
taaatagtagaaaaat

SEQ ID NO: 6350548 - DNA, 21 bp, Homo sapiens
taaatagtaggaccaatgttg

SEQ ID NO: 6350549 - DNA, 18 bp, Homo sapiens
taaatagtgtcatataaa

SEQ ID NO: 6350550 - DNA, 21 bp, Homo sapiens
taaatagtgtcatataaactc

SEQ ID NO: 6350551 - DNA, 16 bp, Homo sapiens
taaatagtgttattga

SEQ ID NO: 6350552 - DNA, 19 bp, Homo sapiens
taaatagtgttattgagag

SEQ ID NO: 6350553 - DNA, 15 bp, Homo sapiens
taaatagttaatata

SEQ ID NO: 6350554 - DNA, 16 bp, Homo sapiens
taaatagtttaacact

SEQ ID NO: 6350555 - DNA, 20 bp, Homo sapiens
taaatagtttacttcacttt

SEQ ID NO: 6350556 - DNA, 22 bp, Homo sapiens
taaatagtttacttcactttca

SEQ ID NO: 6350557 - DNA, 15 bp, Homo sapiens
taaatagttttaaat

SEQ ID NO: 6350558 - DNA, 12 bp, Homo sapiens
taaatataaaaa

SEQ ID NO: 6350559 - DNA, 23 bp, Homo sapiens
taaatataaaccagctacttgat

SEQ ID NO: 6350560 - DNA, 12 bp, Homo sapiens
taaatataaaga

SEQ ID NO: 6350561 - DNA, 14 bp, Homo sapiens
taaatataaagacg

SEQ ID NO: 6350562 - DNA, 13 bp, Homo sapiens
taaatataattct

SEQ ID NO: 6350563 - DNA, 16 bp, Homo sapiens
taaatataattctgta

SEQ ID NO: 6350564 - DNA, 13 bp, Homo sapiens
taaatataattta

SEQ ID NO: 6350565 - DNA, 14 bp, Homo sapiens
taaatataatttat

SEQ ID NO: 6350566 - DNA, 21 bp, Homo sapiens
taaatataatttataagcatt

SEQ ID NO: 6350567 - DNA, 19 bp, Homo sapiens
taaatatacatctgtgtat

SEQ ID NO: 6350568 - DNA, 17 bp, Homo sapiens
taaatataccactcttt

SEQ ID NO: 6350569 - DNA, 21 bp, Homo sapiens
taaatataccactctttacct

SEQ ID NO: 6350570 - DNA, 15 bp, Homo sapiens
taaatatactaataa

SEQ ID NO: 6350571 - DNA, 22 bp, Homo sapiens
taaatatagatgtaatttttca

SEQ ID NO: 6350572 - DNA, 16 bp, Homo sapiens
taaatatagattagaa

SEQ ID NO: 6350573 - DNA, 23 bp, Homo sapiens
taaatatagtgaagcaatttgaa

SEQ ID NO: 6350574 - DNA, 15 bp, Homo sapiens
taaatatagttccta

SEQ ID NO: 6350575 - DNA, 20 bp, Homo sapiens
taaatatagttgtctttctt

SEQ ID NO: 6350576 - DNA, 22 bp, Homo sapiens
taaatatagttgtctttctttg

SEQ ID NO: 6350577 - DNA, 16 bp, Homo sapiens
taaatatataaacaaa

SEQ ID NO: 6350578 - DNA, 17 bp, Homo sapiens
taaatatataaatatat

SEQ ID NO: 6350579 - DNA, 14 bp, Homo sapiens
taaatatatataaa

SEQ ID NO: 6350580 - DNA, 15 bp, Homo sapiens
taaatatatataaac

SEQ ID NO: 6350581 - DNA, 19 bp, Homo sapiens
taaatatatataaacctaa

SEQ ID NO: 6350582 - DNA, 18 bp, Homo sapiens
taaatatatataaatata

SEQ ID NO: 6350583 - DNA, 20 bp, Homo sapiens
taaatatatatatatttctc

SEQ ID NO: 6350584 - DNA, 14 bp, Homo sapiens
taaatatatatgat

SEQ ID NO: 6350585 - DNA, 16 bp, Homo sapiens
taaatatatattattc

SEQ ID NO: 6350586 - DNA, 21 bp, Homo sapiens
taaatatatattattctcatt

SEQ ID NO: 6350587 - DNA, 23 bp, Homo sapiens
taaatatatattattctcattta

SEQ ID NO: 6350588 - DNA, 16 bp, Homo sapiens
taaatatatatttatc

SEQ ID NO: 6350589 - DNA, 19 bp, Homo sapiens
taaatatatatttttcaaa

SEQ ID NO: 6350590 - DNA, 20 bp, Homo sapiens
taaatatatctaccccagac

SEQ ID NO: 6350591 - DNA, 18 bp, Homo sapiens
taaatatatctttgtaaa

SEQ ID NO: 6350592 - DNA, 11 bp, Homo sapiens
taaatatatgt

SEQ ID NO: 6350593 - DNA, 14 bp, Homo sapiens
gtagattttccaaa

SEQ ID NO: 6350594 - DNA, 15 bp, Homo sapiens
gtagattttctttaa

SEQ ID NO: 6350595 - DNA, 15 bp, Homo sapiens
gtagatttttaacaa

SEQ ID NO: 6350596 - DNA, 18 bp, Homo sapiens
gtagatttttaacaaaaa

SEQ ID NO: 6350597 - DNA, 17 bp, Homo sapiens
gtagcaaaacaaattca

SEQ ID NO: 6350598 - DNA, 20 bp, Homo sapiens
gtagcaaaccctgtcaaaca

SEQ ID NO: 6350599 - DNA, 17 bp, Homo sapiens
gtagcaaatgagacagc

SEQ ID NO: 6350600 - DNA, 15 bp, Homo sapiens
gtagcaaatgtttac

SEQ ID NO: 6350601 - DNA, 23 bp, Homo sapiens
gtagcaaattttggacctaaaca

SEQ ID NO: 6350602 - DNA, 22 bp, Homo sapiens
gtagcaaccatttgtaaaacat

SEQ ID NO: 6350603 - DNA, 16 bp, Homo sapiens
gtagcaaccctgtgat

SEQ ID NO: 6350604 - DNA, 18 bp, Homo sapiens
gtagcaaccttcatttta

SEQ ID NO: 6350605 - DNA, 21 bp, Homo sapiens
gtagcaaccttcattttacat

SEQ ID NO: 6350606 - DNA, 22 bp, Homo sapiens
gtagcaaccttcattttacatt

SEQ ID NO: 6350607 - DNA, 15 bp, Homo sapiens
gtagcaactgctggt

SEQ ID NO: 6350608 - DNA, 16 bp, Homo sapiens
gtagcaagatctttac

SEQ ID NO: 6350609 - DNA, 13 bp, Homo sapiens
gtagcaagatgca

SEQ ID NO: 6350610 - DNA, 20 bp, Homo sapiens
gtagcaagttctagagaaga

SEQ ID NO: 6350611 - DNA, 18 bp, Homo sapiens
gtagcaataggctgtaat

SEQ ID NO: 6350612 - DNA, 12 bp, Homo sapiens
gtagcaatgtgc

SEQ ID NO: 6350613 - DNA, 18 bp, Homo sapiens
gtagcacagattttgaat

SEQ ID NO: 6350614 - DNA, 15 bp, Homo sapiens
gtagcactctcagag

SEQ ID NO: 6350615 - DNA, 14 bp, Homo sapiens
gtagcactgacaga

SEQ ID NO: 6350616 - DNA, 15 bp, Homo sapiens
gtagcactgacagat

SEQ ID NO: 6350617 - DNA, 11 bp, Homo sapiens
gtagcactgag

SEQ ID NO: 6350618 - DNA, 15 bp, Homo sapiens
gtagcagagttaaat

SEQ ID NO: 6350619 - DNA, 17 bp, Homo sapiens
gtagcagcaggctcagg

SEQ ID NO: 6350620 - DNA, 11 bp, Homo sapiens
gtagcagctgg

SEQ ID NO: 6350621 - DNA, 12 bp, Homo sapiens
gtagcagctgga

SEQ ID NO: 6350622 - DNA, 18 bp, Homo sapiens
gtagcaggaaaaggtcct

SEQ ID NO: 6350623 - DNA, 15 bp, Homo sapiens
gtagcaggacctgcc

SEQ ID NO: 6350624 - DNA, 21 bp, Homo sapiens
gtagcaggacctgccaagaag

SEQ ID NO: 6350625 - DNA, 17 bp, Homo sapiens
gtagcaggactaggcat

SEQ ID NO: 6350626 - DNA, 18 bp, Homo sapiens
gtagcaggactaggcatg

SEQ ID NO: 6350627 - DNA, 12 bp, Homo sapiens
gtagcaggggaa

SEQ ID NO: 6350628 - DNA, 19 bp, Homo sapiens
gtagcagggtcgggaaagg

SEQ ID NO: 6350629 - DNA, 15 bp, Homo sapiens
gtagcagtagatgca

SEQ ID NO: 6350630 - DNA, 11 bp, Homo sapiens
gtagcagtgta

SEQ ID NO: 6350631 - DNA, 15 bp, Homo sapiens
gtagcagtgtaccca

SEQ ID NO: 6350632 - DNA, 23 bp, Homo sapiens
gtagcagtgtgaagtacaataat

SEQ ID NO: 6350633 - DNA, 19 bp, Homo sapiens
gtagcagttttgaaacctt

SEQ ID NO: 6350634 - DNA, 20 bp, Homo sapiens
gtagcataaataaaactgaa

SEQ ID NO: 6350635 - DNA, 13 bp, Homo sapiens
gtagcataactgt

SEQ ID NO: 6350636 - DNA, 14 bp, Homo sapiens
gtagcataactgta

SEQ ID NO: 6350637 - DNA, 14 bp, Homo sapiens
gtagcatataaatg

SEQ ID NO: 6350638 - DNA, 13 bp, Homo sapiens
gtagcatatataa

SEQ ID NO: 6350639 - DNA, 15 bp, Homo sapiens
gtagcatctcagtgg

SEQ ID NO: 6350640 - DNA, 15 bp, Homo sapiens
gtagcatcttcctct

SEQ ID NO: 6350641 - DNA, 16 bp, Homo sapiens
gtagcatcttcctctg

SEQ ID NO: 6350642 - DNA, 17 bp, Homo sapiens
gtagcatcttcctctgc

SEQ ID NO: 6350643 - DNA, 16 bp, Homo sapiens
gtagcatcttctggag

SEQ ID NO: 6350644 - DNA, 23 bp, Homo sapiens
gtagcatgttctatgtgttttta

SEQ ID NO: 6350645 - DNA, 14 bp, Homo sapiens
gtagcattaaatat

SEQ ID NO: 6350646 - DNA, 15 bp, Homo sapiens
gtagcattgaaaaat

SEQ ID NO: 6350647 - DNA, 21 bp, Homo sapiens
gtagcatttgtgttgaagagg

SEQ ID NO: 6350648 - DNA, 13 bp, Homo sapiens
gtagcattttaaa

SEQ ID NO: 6350649 - DNA, 15 bp, Homo sapiens
gtagcattttaaaca

SEQ ID NO: 6350650 - DNA, 14 bp, Homo sapiens
gtagcattttcctg

SEQ ID NO: 6350651 - DNA, 15 bp, Homo sapiens
gtagccacaccagga

SEQ ID NO: 6350652 - DNA, 21 bp, Homo sapiens
gtagccacagctgctgttctc

SEQ ID NO: 6350653 - DNA, 15 bp, Homo sapiens
gtagccacaggagcc

SEQ ID NO: 6350654 - DNA, 21 bp, Homo sapiens
gtagccaccaccggggcactg

SEQ ID NO: 6350655 - DNA, 18 bp, Homo sapiens
gtagccacctccttggca

SEQ ID NO: 6350656 - DNA, 21 bp, Homo sapiens
gtagccacctccttggcaccg

SEQ ID NO: 6350657 - DNA, 16 bp, Homo sapiens
gtagccactctctgcc

SEQ ID NO: 6350658 - DNA, 12 bp, Homo sapiens
gtagccactggc

SEQ ID NO: 6350659 - DNA, 22 bp, Homo sapiens
gtagccagagttgttctcaggg

SEQ ID NO: 6350660 - DNA, 18 bp, Homo sapiens
gtagccagcacacagggc

SEQ ID NO: 6350661 - DNA, 22 bp, Homo sapiens
gtagccagggggactagcccct

SEQ ID NO: 6350662 - DNA, 18 bp, Homo sapiens
gtagccaggtatggctct

SEQ ID NO: 6350663 - DNA, 20 bp, Homo sapiens
gtagccagttaaggaaagaa

SEQ ID NO: 6350664 - DNA, 21 bp, Homo sapiens
gtagccatcaagcacttccca

SEQ ID NO: 6350665 - DNA, 17 bp, Homo sapiens
gtagccatctccgtggc

SEQ ID NO: 6350666 - DNA, 22 bp, Homo sapiens
gtagccatgatttgtcccagcc

SEQ ID NO: 6350667 - DNA, 13 bp, Homo sapiens
gtagccatggctg

SEQ ID NO: 6350668 - DNA, 15 bp, Homo sapiens
gtagccatggctggg

SEQ ID NO: 6350669 - DNA, 15 bp, Homo sapiens
gtagccatgggacca

SEQ ID NO: 6350670 - DNA, 18 bp, Homo sapiens
gtagccattttgtaactg

SEQ ID NO: 6350671 - DNA, 14 bp, Homo sapiens
gtagcccaggctgg

SEQ ID NO: 6350672 - DNA, 17 bp, Homo sapiens
gtagcccatcaaaatgt

SEQ ID NO: 6350673 - DNA, 23 bp, Homo sapiens
gtagccccagtcagaagttctgg

SEQ ID NO: 6350674 - DNA, 19 bp, Homo sapiens
gtagccccagtgacagcta

SEQ ID NO: 6350675 - DNA, 13 bp, Homo sapiens
gtagcccccgagg

SEQ ID NO: 6350676 - DNA, 22 bp, Homo sapiens
gtagccccctaaatgggcaagc

SEQ ID NO: 6350677 - DNA, 19 bp, Homo sapiens
gtagccccctcttccctgg

SEQ ID NO: 6350678 - DNA, 16 bp, Homo sapiens
gtagccccctggcctc

SEQ ID NO: 6350679 - DNA, 18 bp, Homo sapiens
gtagccccttttctttgg

SEQ ID NO: 6350680 - DNA, 15 bp, Homo sapiens
gtagcccgcctgcca

SEQ ID NO: 6350681 - DNA, 23 bp, Homo sapiens
gtagccctctcatcgtcttttag

SEQ ID NO: 6350682 - DNA, 19 bp, Homo sapiens
gtagccctggatggcctct

SEQ ID NO: 6350683 - DNA, 17 bp, Homo sapiens
gtagccctggccagagg

SEQ ID NO: 6350684 - DNA, 22 bp, Homo sapiens
gtagccgagtcacacccggtgg

SEQ ID NO: 6350685 - DNA, 15 bp, Homo sapiens
gtagccgccctgaga

SEQ ID NO: 6350686 - DNA, 15 bp, Homo sapiens
gtagccgggctctgc

SEQ ID NO: 6350687 - DNA, 18 bp, Homo sapiens
gtagccgggctctgcacc

SEQ ID NO: 6350688 - DNA, 15 bp, Homo sapiens
gtagcctaaagggca

SEQ ID NO: 6350689 - DNA, 17 bp, Homo sapiens
gtagcctaaagggcagg

SEQ ID NO: 6350690 - DNA, 20 bp, Homo sapiens
gtagcctaaagggcagggcc

SEQ ID NO: 6350691 - DNA, 21 bp, Homo sapiens
gtagcctcaatcgagtgagac

SEQ ID NO: 6350692 - DNA, 21 bp, Homo sapiens
gtagcctccgtttatgggcct

SEQ ID NO: 6350693 - DNA, 22 bp, Homo sapiens
gtagcctccgtttatgggcctt

SEQ ID NO: 6350694 - DNA, 20 bp, Homo sapiens
gtagcctcctcctgggctcc

SEQ ID NO: 6350695 - DNA, 13 bp, Homo sapiens
gtagcctgctgtg

SEQ ID NO: 6350696 - DNA, 22 bp, Homo sapiens
gtagcctggactgtttcatagt

SEQ ID NO: 6350697 - DNA, 17 bp, Homo sapiens
gtagcctgggctcactg

SEQ ID NO: 6350698 - DNA, 20 bp, Homo sapiens
gtagcctgggctcactgtgc

SEQ ID NO: 6350699 - DNA, 19 bp, Homo sapiens
gtagcctggtctgtgcatt

SEQ ID NO: 6350700 - DNA, 14 bp, Homo sapiens
gtagccttcctcca

SEQ ID NO: 6350701 - DNA, 12 bp, Homo sapiens
gtagccttctcc

SEQ ID NO: 6350702 - DNA, 11 bp, Homo sapiens
gtagccttttt

SEQ ID NO: 6350703 - DNA, 14 bp, Homo sapiens
gtagcgaccccaga

SEQ ID NO: 6350704 - DNA, 17 bp, Homo sapiens
gtagcgaccccagactg

SEQ ID NO: 6350705 - DNA, 22 bp, Homo sapiens
gtagcgaccccagactgtagag

SEQ ID NO: 6350706 - DNA, 21 bp, Homo sapiens
gtagcgtacgggttgttttgg

SEQ ID NO: 6350707 - DNA, 15 bp, Homo sapiens
gtagcgtcctgagga

SEQ ID NO: 6350708 - DNA, 13 bp, Homo sapiens
gtagcgtttttta

SEQ ID NO: 6350709 - DNA, 18 bp, Homo sapiens
gtagctaacagtgaagat

SEQ ID NO: 6350710 - DNA, 22 bp, Homo sapiens
gtagctacactgtataactgtt

SEQ ID NO: 6350711 - DNA, 16 bp, Homo sapiens
gtagctacagagaaac

SEQ ID NO: 6350712 - DNA, 18 bp, Homo sapiens
gtagctacagagaaacca

SEQ ID NO: 6350713 - DNA, 23 bp, Homo sapiens
gtagctacagagaaaccagcttc

SEQ ID NO: 6350714 - DNA, 12 bp, Homo sapiens
gtagctacattt

SEQ ID NO: 6350715 - DNA, 16 bp, Homo sapiens
gtagctacggttccct

SEQ ID NO: 6350716 - DNA, 15 bp, Homo sapiens
gtagctagaggaacc

SEQ ID NO: 6350717 - DNA, 18 bp, Homo sapiens
gtagctagcgtgtgccag

SEQ ID NO: 6350718 - DNA, 21 bp, Homo sapiens
gtagctagcgtgtgccaggca

SEQ ID NO: 6350719 - DNA, 21 bp, Homo sapiens
gtagctagtgatttacacagg

SEQ ID NO: 6350720 - DNA, 17 bp, Homo sapiens
gtagctagtttaaaatt

SEQ ID NO: 6350721 - DNA, 16 bp, Homo sapiens
gtagctatatctatat

SEQ ID NO: 6350722 - DNA, 21 bp, Homo sapiens
gtagctattagcggctcctcg

SEQ ID NO: 6350723 - DNA, 22 bp, Homo sapiens
gtagctatttgtttacatgcag

SEQ ID NO: 6350724 - DNA, 23 bp, Homo sapiens
gtagctatttttatacactgtaa

SEQ ID NO: 6350725 - DNA, 13 bp, Homo sapiens
gtagctcaaaaat

SEQ ID NO: 6350726 - DNA, 17 bp, Homo sapiens
gtagctcaagtttaaaa

SEQ ID NO: 6350727 - DNA, 11 bp, Homo sapiens
gtagctcaggt

SEQ ID NO: 6350728 - DNA, 21 bp, Homo sapiens
gtagctccacaagagagatga

SEQ ID NO: 6350729 - DNA, 13 bp, Homo sapiens
gtagctcccagca

SEQ ID NO: 6350730 - DNA, 14 bp, Homo sapiens
gtagctcccctggc

SEQ ID NO: 6350731 - DNA, 15 bp, Homo sapiens
gtagctcccctggct

SEQ ID NO: 6350732 - DNA, 21 bp, Homo sapiens
gtagctccgcgtgtctcattt

SEQ ID NO: 6350733 - DNA, 10 bp, Homo sapiens
gtagctcctc

SEQ ID NO: 6350734 - DNA, 16 bp, Homo sapiens
gtagctcctctgctgc

SEQ ID NO: 6350735 - DNA, 22 bp, Homo sapiens
gtagctctaggagggctggcaa

SEQ ID NO: 6350736 - DNA, 14 bp, Homo sapiens
gtagctctgcctcc

SEQ ID NO: 6350737 - DNA, 18 bp, Homo sapiens
gtagctctgtccactctg

SEQ ID NO: 6350738 - DNA, 22 bp, Homo sapiens
gtagctcttagtcctccctgct

SEQ ID NO: 6350739 - DNA, 14 bp, Homo sapiens
gtagctgaaatgca

SEQ ID NO: 6350740 - DNA, 16 bp, Homo sapiens
gtagctgaacctgtct

SEQ ID NO: 6350741 - DNA, 17 bp, Homo sapiens
gtagctgagaggaagat

SEQ ID NO: 6350742 - DNA, 12 bp, Homo sapiens
gtagctgagctc

SEQ ID NO: 6350743 - DNA, 13 bp, Homo sapiens
gtagctgagggga

SEQ ID NO: 6350744 - DNA, 17 bp, Homo sapiens
gtagctgctaccttctt

SEQ ID NO: 6350745 - DNA, 12 bp, Homo sapiens
gtagctgctagt

SEQ ID NO: 6350746 - DNA, 17 bp, Homo sapiens
gtagctggcaagctgca

SEQ ID NO: 6350747 - DNA, 17 bp, Homo sapiens
gtagctgggactacagg

SEQ ID NO: 6350748 - DNA, 21 bp, Homo sapiens
gtagctgggactacaggcacc

SEQ ID NO: 6350749 - DNA, 21 bp, Homo sapiens
gtagctgggactacaggcgcc

SEQ ID NO: 6350750 - DNA, 18 bp, Homo sapiens
gtagctgggatgacaggc

SEQ ID NO: 6350751 - DNA, 21 bp, Homo sapiens
gtagctgggattacaggtgtg

SEQ ID NO: 6350752 - DNA, 22 bp, Homo sapiens
gtagctgggattttaaactaga

SEQ ID NO: 6350753 - DNA, 13 bp, Homo sapiens
gtagctgggcctg

SEQ ID NO: 6350754 - DNA, 16 bp, Homo sapiens
gtagctgggcctgtgc

SEQ ID NO: 6350755 - DNA, 22 bp, Homo sapiens
gtagctggtggttgtgcctttt

SEQ ID NO: 6350756 - DNA, 12 bp, Homo sapiens
gtagctgtgaaa

SEQ ID NO: 6350757 - DNA, 17 bp, Homo sapiens
gtagctgtgacctgctg

SEQ ID NO: 6350758 - DNA, 19 bp, Homo sapiens
gtagctgtgacctgctgag

SEQ ID NO: 6350759 - DNA, 14 bp, Homo sapiens
gtagctgtggggag

SEQ ID NO: 6350760 - DNA, 15 bp, Homo sapiens
gtagctgtggggagc

SEQ ID NO: 6350761 - DNA, 16 bp, Homo sapiens
gtagctgtggggagct

SEQ ID NO: 6350762 - DNA, 19 bp, Homo sapiens
gtagcttaaaaaaaggaaa

SEQ ID NO: 6350763 - DNA, 19 bp, Homo sapiens
gtagcttacctgacacaag

SEQ ID NO: 6350764 - DNA, 15 bp, Homo sapiens
gtagcttatctgccc

SEQ ID NO: 6350765 - DNA, 23 bp, Homo sapiens
gtagcttatctgcccctccccca

SEQ ID NO: 6350766 - DNA, 17 bp, Homo sapiens
gtagcttccacctcatg

SEQ ID NO: 6350767 - DNA, 16 bp, Homo sapiens
gtagcttcttctgaaa

SEQ ID NO: 6350768 - DNA, 21 bp, Homo sapiens
gtagctttaaaaccacagctg

SEQ ID NO: 6350769 - DNA, 23 bp, Homo sapiens
gtagctttaacttgtaaaccaca

SEQ ID NO: 6350770 - DNA, 17 bp, Homo sapiens
gtagctttcccaaataa

SEQ ID NO: 6350771 - DNA, 13 bp, Homo sapiens
gtagctttcctgg

SEQ ID NO: 6350772 - DNA, 17 bp, Homo sapiens
gtagctttcctggaagt

SEQ ID NO: 6350773 - DNA, 13 bp, Homo sapiens
taaatatatgtat

SEQ ID NO: 6350774 - DNA, 17 bp, Homo sapiens
taaatatatgtatacat

SEQ ID NO: 6350775 - DNA, 16 bp, Homo sapiens
taaatatatgtctgat

SEQ ID NO: 6350776 - DNA, 14 bp, Homo sapiens
taaatatatgtttt

SEQ ID NO: 6350777 - DNA, 17 bp, Homo sapiens
taaatatatgttttgag

SEQ ID NO: 6350778 - DNA, 19 bp, Homo sapiens
taaatatatgttttgagaa

SEQ ID NO: 6350779 - DNA, 20 bp, Homo sapiens
taaatatatgttttgagaaa

SEQ ID NO: 6350780 - DNA, 14 bp, Homo sapiens
taaatatattgtat

SEQ ID NO: 6350781 - DNA, 11 bp, Homo sapiens
taaatatattt

SEQ ID NO: 6350782 - DNA, 14 bp, Homo sapiens
taaatatcaatcat

SEQ ID NO: 6350783 - DNA, 15 bp, Homo sapiens
taaatatcacaaagt

SEQ ID NO: 6350784 - DNA, 16 bp, Homo sapiens
taaatatcacaaagtt

SEQ ID NO: 6350785 - DNA, 20 bp, Homo sapiens
taaatatcacagtattatct

SEQ ID NO: 6350786 - DNA, 23 bp, Homo sapiens
taaatatcattctttgtatctta

SEQ ID NO: 6350787 - DNA, 21 bp, Homo sapiens
taaatatccaaagactgtact

SEQ ID NO: 6350788 - DNA, 13 bp, Homo sapiens
taaatatccacag

SEQ ID NO: 6350789 - DNA, 22 bp, Homo sapiens
taaatatccacagactccctcc

SEQ ID NO: 6350790 - DNA, 19 bp, Homo sapiens
taaatatccatttatcttt

SEQ ID NO: 6350791 - DNA, 22 bp, Homo sapiens
taaatatcccttggacatttta

SEQ ID NO: 6350792 - DNA, 21 bp, Homo sapiens
taaatatctagtgctaaacct

SEQ ID NO: 6350793 - DNA, 23 bp, Homo sapiens
taaatatctagtgctaaacctat

SEQ ID NO: 6350794 - DNA, 14 bp, Homo sapiens
taaatatcttttat

SEQ ID NO: 6350795 - DNA, 18 bp, Homo sapiens
taaatatcttttatgttt

SEQ ID NO: 6350796 - DNA, 20 bp, Homo sapiens
taaatatcttttatgtttga

SEQ ID NO: 6350797 - DNA, 12 bp, Homo sapiens
taaatatgaatt

SEQ ID NO: 6350798 - DNA, 22 bp, Homo sapiens
taaatatgcaatatatgttcat

SEQ ID NO: 6350799 - DNA, 17 bp, Homo sapiens
taaatatgcagtgatat

SEQ ID NO: 6350800 - DNA, 19 bp, Homo sapiens
taaatatgcctctcctttg

SEQ ID NO: 6350801 - DNA, 23 bp, Homo sapiens
taaatatgcctctcctttgtata

SEQ ID NO: 6350802 - DNA, 13 bp, Homo sapiens
taaatatgtaata

SEQ ID NO: 6350803 - DNA, 15 bp, Homo sapiens
taaatatgtaatata

SEQ ID NO: 6350804 - DNA, 19 bp, Homo sapiens
taaatatgtacatttctca

SEQ ID NO: 6350805 - DNA, 14 bp, Homo sapiens
taaatatgtagatc

SEQ ID NO: 6350806 - DNA, 13 bp, Homo sapiens
taaatatgtgaaa

SEQ ID NO: 6350807 - DNA, 18 bp, Homo sapiens
taaatatgtgaaaatgat

SEQ ID NO: 6350808 - DNA, 15 bp, Homo sapiens
taaatatgtgaagaa

SEQ ID NO: 6350809 - DNA, 16 bp, Homo sapiens
taaatatgtgaagaaa

SEQ ID NO: 6350810 - DNA, 15 bp, Homo sapiens
taaatatgtgattat

SEQ ID NO: 6350811 - DNA, 21 bp, Homo sapiens
taaatatgtgattatcattta

SEQ ID NO: 6350812 - DNA, 14 bp, Homo sapiens
taaatattaagcat

SEQ ID NO: 6350813 - DNA, 17 bp, Homo sapiens
taaatattagtgcagtt

SEQ ID NO: 6350814 - DNA, 18 bp, Homo sapiens
taaatattagtgcagtta

SEQ ID NO: 6350815 - DNA, 19 bp, Homo sapiens
taaatattagttaatggat

SEQ ID NO: 6350816 - DNA, 20 bp, Homo sapiens
taaatattagttaatggatt

SEQ ID NO: 6350817 - DNA, 21 bp, Homo sapiens
taaatattagttaatggatta

SEQ ID NO: 6350818 - DNA, 18 bp, Homo sapiens
taaatattatgattttat

SEQ ID NO: 6350819 - DNA, 19 bp, Homo sapiens
taaatattatgctgcttta

SEQ ID NO: 6350820 - DNA, 18 bp, Homo sapiens
taaatattcacacttgaa

SEQ ID NO: 6350821 - DNA, 11 bp, Homo sapiens
taaatattcat

SEQ ID NO: 6350822 - DNA, 18 bp, Homo sapiens
taaatattccttatttaa

SEQ ID NO: 6350823 - DNA, 13 bp, Homo sapiens
taaatattctata

SEQ ID NO: 6350824 - DNA, 14 bp, Homo sapiens
taaatattctgcat

SEQ ID NO: 6350825 - DNA, 18 bp, Homo sapiens
taaatattctgtacattt

SEQ ID NO: 6350826 - DNA, 21 bp, Homo sapiens
taaatattcttgtccacattc

SEQ ID NO: 6350827 - DNA, 22 bp, Homo sapiens
taaatattcttgtccacattct

SEQ ID NO: 6350828 - DNA, 20 bp, Homo sapiens
taaatattgacttctcttga

SEQ ID NO: 6350829 - DNA, 12 bp, Homo sapiens
taaatattgagg

SEQ ID NO: 6350830 - DNA, 21 bp, Homo sapiens
taaatattgaggctttgtgtt

SEQ ID NO: 6350831 - DNA, 21 bp, Homo sapiens
taaatattgctaaaagcatgt

SEQ ID NO: 6350832 - DNA, 17 bp, Homo sapiens
taaatattgctctatgt

SEQ ID NO: 6350833 - DNA, 14 bp, Homo sapiens
taaatattgctgtc

SEQ ID NO: 6350834 - DNA, 15 bp, Homo sapiens
taaatattgctgtct

SEQ ID NO: 6350835 - DNA, 20 bp, Homo sapiens
taaatattgctgtctgaaaa

SEQ ID NO: 6350836 - DNA, 21 bp, Homo sapiens
taaatattgctgtctgaaaaa

SEQ ID NO: 6350837 - DNA, 22 bp, Homo sapiens
taaatattggttgggatgactt

SEQ ID NO: 6350838 - DNA, 21 bp, Homo sapiens
taaatattggtttgttattct

SEQ ID NO: 6350839 - DNA, 22 bp, Homo sapiens
taaatattggtttgttattctt

SEQ ID NO: 6350840 - DNA, 18 bp, Homo sapiens
taaatattgtaatatgac

SEQ ID NO: 6350841 - DNA, 21 bp, Homo sapiens
taaatattgtaatatgacaga

SEQ ID NO: 6350842 - DNA, 22 bp, Homo sapiens
taaatattgtaatatgacagat

SEQ ID NO: 6350843 - DNA, 15 bp, Homo sapiens
taaatattgtctttt

SEQ ID NO: 6350844 - DNA, 17 bp, Homo sapiens
taaatattgtctttttg

SEQ ID NO: 6350845 - DNA, 11 bp, Homo sapiens
taaatatttaa

SEQ ID NO: 6350846 - DNA, 13 bp, Homo sapiens
taaatatttaatg

SEQ ID NO: 6350847 - DNA, 11 bp, Homo sapiens
taaatatttac

SEQ ID NO: 6350848 - DNA, 17 bp, Homo sapiens
taaatatttacatatga

SEQ ID NO: 6350849 - DNA, 18 bp, Homo sapiens
taaatatttaccttgaaa

SEQ ID NO: 6350850 - DNA, 13 bp, Homo sapiens
taaatatttactc

SEQ ID NO: 6350851 - DNA, 20 bp, Homo sapiens
taaatatttactctttgcaa

SEQ ID NO: 6350852 - DNA, 21 bp, Homo sapiens
taaatatttactctttgcaaa

SEQ ID NO: 6350853 - DNA, 16 bp, Homo sapiens
taaatatttatgcaga

SEQ ID NO: 6350854 - DNA, 17 bp, Homo sapiens
taaatatttatgtagat

SEQ ID NO: 6350855 - DNA, 13 bp, Homo sapiens
taaatatttcata

SEQ ID NO: 6350856 - DNA, 14 bp, Homo sapiens
taaatatttcttaa

SEQ ID NO: 6350857 - DNA, 18 bp, Homo sapiens
taaatatttgacttgcat

SEQ ID NO: 6350858 - DNA, 22 bp, Homo sapiens
taaatatttggtctctatttca

SEQ ID NO: 6350859 - DNA, 20 bp, Homo sapiens
taaatatttgtccttaaagg

SEQ ID NO: 6350860 - DNA, 19 bp, Homo sapiens
taaatatttgtgactcttt

SEQ ID NO: 6350861 - DNA, 12 bp, Homo sapiens
taaatatttgtt

SEQ ID NO: 6350862 - DNA, 15 bp, Homo sapiens
taaatatttgttctt

SEQ ID NO: 6350863 - DNA, 14 bp, Homo sapiens
taaatattttaaag

SEQ ID NO: 6350864 - DNA, 19 bp, Homo sapiens
taaatattttcaagaaaag

SEQ ID NO: 6350865 - DNA, 13 bp, Homo sapiens
taaatattttccg

SEQ ID NO: 6350866 - DNA, 14 bp, Homo sapiens
taaatattttctat

SEQ ID NO: 6350867 - DNA, 17 bp, Homo sapiens
taaatattttctatttt

SEQ ID NO: 6350868 - DNA, 18 bp, Homo sapiens
taaatattttgacttgtt

SEQ ID NO: 6350869 - DNA, 19 bp, Homo sapiens
taaatattttgatacaaat

SEQ ID NO: 6350870 - DNA, 12 bp, Homo sapiens
taaatatttttg

SEQ ID NO: 6350871 - DNA, 17 bp, Homo sapiens
taaatatttttttaacc

SEQ ID NO: 6350872 - DNA, 22 bp, Homo sapiens
taaatatttttttctttctttg

SEQ ID NO: 6350873 - DNA, 17 bp, Homo sapiens
taaatcaaaaacttttc

SEQ ID NO: 6350874 - DNA, 22 bp, Homo sapiens
taaatcaaccacctatttttga

SEQ ID NO: 6350875 - DNA, 17 bp, Homo sapiens
taaatcaagaccaaaga

SEQ ID NO: 6350876 - DNA, 18 bp, Homo sapiens
taaatcaagaccaaagag

SEQ ID NO: 6350877 - DNA, 22 bp, Homo sapiens
taaatcaagtcccaaattcatt

SEQ ID NO: 6350878 - DNA, 17 bp, Homo sapiens
taaatcaatcttattac

SEQ ID NO: 6350879 - DNA, 14 bp, Homo sapiens
taaatcaatgtcac

SEQ ID NO: 6350880 - DNA, 23 bp, Homo sapiens
taaatcaatgtcacttaaaggct

SEQ ID NO: 6350881 - DNA, 16 bp, Homo sapiens
taaatcaattcattgt

SEQ ID NO: 6350882 - DNA, 17 bp, Homo sapiens
taaatcaattcattgtg

SEQ ID NO: 6350883 - DNA, 17 bp, Homo sapiens
taaatcacactcaaact

SEQ ID NO: 6350884 - DNA, 19 bp, Homo sapiens
taaatcacactcaaacttt

SEQ ID NO: 6350885 - DNA, 16 bp, Homo sapiens
taaatcacagaaaatt

SEQ ID NO: 6350886 - DNA, 18 bp, Homo sapiens
taaatcacagaaaattta

SEQ ID NO: 6350887 - DNA, 13 bp, Homo sapiens
taaatcacagatt

SEQ ID NO: 6350888 - DNA, 14 bp, Homo sapiens
taaatcacatcctt

SEQ ID NO: 6350889 - DNA, 19 bp, Homo sapiens
taaatcacgctttttgaaa

SEQ ID NO: 6350890 - DNA, 21 bp, Homo sapiens
taaatcacgctttttgaaaaa

SEQ ID NO: 6350891 - DNA, 22 bp, Homo sapiens
taaatcacgctttttgaaaaag

SEQ ID NO: 6350892 - DNA, 16 bp, Homo sapiens
taaatcacttgtaaat

SEQ ID NO: 6350893 - DNA, 14 bp, Homo sapiens
taaatcagaaagta

SEQ ID NO: 6350894 - DNA, 19 bp, Homo sapiens
taaatcagaaagtaacaat

SEQ ID NO: 6350895 - DNA, 16 bp, Homo sapiens
taaatcagaaatagga

SEQ ID NO: 6350896 - DNA, 13 bp, Homo sapiens
taaatcagaatct

SEQ ID NO: 6350897 - DNA, 12 bp, Homo sapiens
taaatcagacca

SEQ ID NO: 6350898 - DNA, 16 bp, Homo sapiens
taaatcagactagaga

SEQ ID NO: 6350899 - DNA, 16 bp, Homo sapiens
taaatcagatgttgaa

SEQ ID NO: 6350900 - DNA, 23 bp, Homo sapiens
taaatcagctgcaatccatttat

SEQ ID NO: 6350901 - DNA, 17 bp, Homo sapiens
taaatcagtaagaggtg

SEQ ID NO: 6350902 - DNA, 12 bp, Homo sapiens
taaatcagtaat

SEQ ID NO: 6350903 - DNA, 22 bp, Homo sapiens
taaatcagtatgtttttacata

SEQ ID NO: 6350904 - DNA, 20 bp, Homo sapiens
taaatcagtgcctggtgttc

SEQ ID NO: 6350905 - DNA, 16 bp, Homo sapiens
taaatcagttctcaat

SEQ ID NO: 6350906 - DNA, 14 bp, Homo sapiens
taaatcagttggag

SEQ ID NO: 6350907 - DNA, 17 bp, Homo sapiens
taaatcataatgtaact

SEQ ID NO: 6350908 - DNA, 14 bp, Homo sapiens
taaatcatattgat

SEQ ID NO: 6350909 - DNA, 22 bp, Homo sapiens
taaatcatctttattaagtaga

SEQ ID NO: 6350910 - DNA, 15 bp, Homo sapiens
taaatcatgggcatt

SEQ ID NO: 6350911 - DNA, 17 bp, Homo sapiens
taaatcatgggcattgc

SEQ ID NO: 6350912 - DNA, 12 bp, Homo sapiens
taaatcatgtat

SEQ ID NO: 6350913 - DNA, 15 bp, Homo sapiens
taaatcatgtatgtt

SEQ ID NO: 6350914 - DNA, 13 bp, Homo sapiens
taaatcatttcat

SEQ ID NO: 6350915 - DNA, 15 bp, Homo sapiens
taaatcatttggtta

SEQ ID NO: 6350916 - DNA, 13 bp, Homo sapiens
taaatccaatatc

SEQ ID NO: 6350917 - DNA, 14 bp, Homo sapiens
taaatccacaggct

SEQ ID NO: 6350918 - DNA, 20 bp, Homo sapiens
taaatccaccaccaaaatta

SEQ ID NO: 6350919 - DNA, 16 bp, Homo sapiens
taaatccattatgact

SEQ ID NO: 6350920 - DNA, 19 bp, Homo sapiens
taaatccatttggaaatct

SEQ ID NO: 6350921 - DNA, 14 bp, Homo sapiens
taaatccattttct

SEQ ID NO: 6350922 - DNA, 18 bp, Homo sapiens
taaatccattttctaaac

SEQ ID NO: 6350923 - DNA, 19 bp, Homo sapiens
taaatccattttctaaact

SEQ ID NO: 6350924 - DNA, 21 bp, Homo sapiens
taaatccattttctaaactgt

SEQ ID NO: 6350925 - DNA, 19 bp, Homo sapiens
taaatcccattattcaaag

SEQ ID NO: 6350926 - DNA, 23 bp, Homo sapiens
taaatcccattcataactttcat

SEQ ID NO: 6350927 - DNA, 21 bp, Homo sapiens
taaatccgacttgaatattcc

SEQ ID NO: 6350928 - DNA, 16 bp, Homo sapiens
taaatcctaccaaagt

SEQ ID NO: 6350929 - DNA, 23 bp, Homo sapiens
taaatcctgttgaaaagccatgt

SEQ ID NO: 6350930 - DNA, 15 bp, Homo sapiens
taaatccttaacatt

SEQ ID NO: 6350931 - DNA, 13 bp, Homo sapiens
taaatccttattt

SEQ ID NO: 6350932 - DNA, 22 bp, Homo sapiens
taaatcctttacaagatggaga

SEQ ID NO: 6350933 - DNA, 21 bp, Homo sapiens
taaatccttttcccataaata

SEQ ID NO: 6350934 - DNA, 21 bp, Homo sapiens
taaatcgcatcatgccaactt

SEQ ID NO: 6350935 - DNA, 18 bp, Homo sapiens
taaatcgcttttgataat

SEQ ID NO: 6350936 - DNA, 16 bp, Homo sapiens
taaatcgtttaatgtt

SEQ ID NO: 6350937 - DNA, 13 bp, Homo sapiens
taaatctaaatat

SEQ ID NO: 6350938 - DNA, 14 bp, Homo sapiens
taaatctaaatata

SEQ ID NO: 6350939 - DNA, 15 bp, Homo sapiens
taaatctaaatctat

SEQ ID NO: 6350940 - DNA, 14 bp, Homo sapiens
taaatctaaatgat

SEQ ID NO: 6350941 - DNA, 13 bp, Homo sapiens
taaatctaacatt

SEQ ID NO: 6350942 - DNA, 21 bp, Homo sapiens
taaatctacaaacttttataa

SEQ ID NO: 6350943 - DNA, 15 bp, Homo sapiens
taaatctagactcaa

SEQ ID NO: 6350944 - DNA, 19 bp, Homo sapiens
taaatctagtatacattgt

SEQ ID NO: 6350945 - DNA, 19 bp, Homo sapiens
taaatctatatttttgtga

SEQ ID NO: 6350946 - DNA, 21 bp, Homo sapiens
taaatctatctctatataaaa

SEQ ID NO: 6350947 - DNA, 21 bp, Homo sapiens
taaatctatgaagtatataat

SEQ ID NO: 6350948 - DNA, 12 bp, Homo sapiens
taaatctatgat

SEQ ID NO: 6350949 - DNA, 16 bp, Homo sapiens
taaatctatttattaa

SEQ ID NO: 6350950 - DNA, 18 bp, Homo sapiens
taaatctatttattaata

SEQ ID NO: 6350951 - DNA, 14 bp, Homo sapiens
taaatctcctgtgg

SEQ ID NO: 6350952 - DNA, 14 bp, Homo sapiens
gtagctttcctggt

SEQ ID NO: 6350953 - DNA, 13 bp, Homo sapiens
gtagctttgcact

SEQ ID NO: 6350954 - DNA, 23 bp, Homo sapiens
gtaggaaaattagaagcaagctg

SEQ ID NO: 6350955 - DNA, 19 bp, Homo sapiens
gtaggaaacagaaaagaga

SEQ ID NO: 6350956 - DNA, 18 bp, Homo sapiens
gtaggaaatctgaagcct

SEQ ID NO: 6350957 - DNA, 15 bp, Homo sapiens
gtaggaacccagctc

SEQ ID NO: 6350958 - DNA, 23 bp, Homo sapiens
gtaggaacccagctctcagggct

SEQ ID NO: 6350959 - DNA, 16 bp, Homo sapiens
gtaggaaccgatctgc

SEQ ID NO: 6350960 - DNA, 22 bp, Homo sapiens
gtaggaactcttaagcaatggt

SEQ ID NO: 6350961 - DNA, 21 bp, Homo sapiens
gtaggaagaggccgctgcagg

SEQ ID NO: 6350962 - DNA, 13 bp, Homo sapiens
gtaggaagcaaca

SEQ ID NO: 6350963 - DNA, 15 bp, Homo sapiens
gtaggaaggaaaaaa

SEQ ID NO: 6350964 - DNA, 14 bp, Homo sapiens
gtaggaaggggagg

SEQ ID NO: 6350965 - DNA, 22 bp, Homo sapiens
gtaggaaggtactgtatgatca

SEQ ID NO: 6350966 - DNA, 15 bp, Homo sapiens
gtaggaagtaggaag

SEQ ID NO: 6350967 - DNA, 15 bp, Homo sapiens
gtaggaatcctttga

SEQ ID NO: 6350968 - DNA, 21 bp, Homo sapiens
gtaggaatcctttgagaatgt

SEQ ID NO: 6350969 - DNA, 22 bp, Homo sapiens
gtaggaatcgtttttgctgcag

SEQ ID NO: 6350970 - DNA, 15 bp, Homo sapiens
gtaggaatctgcctt

SEQ ID NO: 6350971 - DNA, 18 bp, Homo sapiens
gtaggaatctgccttcca

SEQ ID NO: 6350972 - DNA, 20 bp, Homo sapiens
gtaggacaaggtgcaggcag

SEQ ID NO: 6350973 - DNA, 14 bp, Homo sapiens
gtaggacaagtttt

SEQ ID NO: 6350974 - DNA, 14 bp, Homo sapiens
gtaggaccaggcca

SEQ ID NO: 6350975 - DNA, 18 bp, Homo sapiens
gtaggacccaagcagaga

SEQ ID NO: 6350976 - DNA, 16 bp, Homo sapiens
gtaggaccctcgagag

SEQ ID NO: 6350977 - DNA, 16 bp, Homo sapiens
gtaggacgcatgaagg

SEQ ID NO: 6350978 - DNA, 14 bp, Homo sapiens
gtaggacggagatg

SEQ ID NO: 6350979 - DNA, 16 bp, Homo sapiens
gtaggactatataaag

SEQ ID NO: 6350980 - DNA, 15 bp, Homo sapiens
gtaggactccttatt

SEQ ID NO: 6350981 - DNA, 22 bp, Homo sapiens
gtaggactttggtggtttaaaa

SEQ ID NO: 6350982 - DNA, 14 bp, Homo sapiens
gtaggacttttaaa

SEQ ID NO: 6350983 - DNA, 14 bp, Homo sapiens
gtaggagagcactg

SEQ ID NO: 6350984 - DNA, 13 bp, Homo sapiens
gtaggagaggaga

SEQ ID NO: 6350985 - DNA, 18 bp, Homo sapiens
gtaggagaggagaaaaaa

SEQ ID NO: 6350986 - DNA, 22 bp, Homo sapiens
gtaggagaggcgggagaactga

SEQ ID NO: 6350987 - DNA, 22 bp, Homo sapiens
gtaggagagtcggtctgctttg

SEQ ID NO: 6350988 - DNA, 14 bp, Homo sapiens
gtaggagcaagaga

SEQ ID NO: 6350989 - DNA, 22 bp, Homo sapiens
gtaggagcccttctctttgact

SEQ ID NO: 6350990 - DNA, 23 bp, Homo sapiens
gtaggagctgccttggctcagac

SEQ ID NO: 6350991 - DNA, 12 bp, Homo sapiens
gtaggaggaggc

SEQ ID NO: 6350992 - DNA, 15 bp, Homo sapiens
gtaggaggaggcatg

SEQ ID NO: 6350993 - DNA, 12 bp, Homo sapiens
gtaggaggggct

SEQ ID NO: 6350994 - DNA, 17 bp, Homo sapiens
gtaggagggtgggaagg

SEQ ID NO: 6350995 - DNA, 14 bp, Homo sapiens
gtaggaggtttgga

SEQ ID NO: 6350996 - DNA, 18 bp, Homo sapiens
gtaggagtaaagataaaa

SEQ ID NO: 6350997 - DNA, 22 bp, Homo sapiens
gtaggatatgcctgctctttgg

SEQ ID NO: 6350998 - DNA, 20 bp, Homo sapiens
gtaggatattttgtcaccag

SEQ ID NO: 6350999 - DNA, 15 bp, Homo sapiens
gtaggatctaaggct

SEQ ID NO: 6351000 - DNA, 23 bp, Homo sapiens
gtaggatgttgcttctgaatcac

SEQ ID NO: 6351001 - DNA, 16 bp, Homo sapiens
gtaggattaatttatt

SEQ ID NO: 6351002 - DNA, 17 bp, Homo sapiens
gtaggattcaagtctgc

SEQ ID NO: 6351003 - DNA, 12 bp, Homo sapiens
gtaggattgctg

SEQ ID NO: 6351004 - DNA, 22 bp, Homo sapiens
gtaggatttatgtattttgaaa

SEQ ID NO: 6351005 - DNA, 18 bp, Homo sapiens
gtaggatttttttcctcc

SEQ ID NO: 6351006 - DNA, 16 bp, Homo sapiens
gtaggcaaatctcttt

SEQ ID NO: 6351007 - DNA, 17 bp, Homo sapiens
gtaggcaaggctgccgg

SEQ ID NO: 6351008 - DNA, 22 bp, Homo sapiens
gtaggcaaggctgccggctgca

SEQ ID NO: 6351009 - DNA, 11 bp, Homo sapiens
gtaggcagaca

SEQ ID NO: 6351010 - DNA, 13 bp, Homo sapiens
gtaggcagagcct

SEQ ID NO: 6351011 - DNA, 15 bp, Homo sapiens
gtaggcagccacggc

SEQ ID NO: 6351012 - DNA, 18 bp, Homo sapiens
gtaggcagggaaccttaa

SEQ ID NO: 6351013 - DNA, 15 bp, Homo sapiens
gtaggcatctaaaga

SEQ ID NO: 6351014 - DNA, 13 bp, Homo sapiens
gtaggccaagctg

SEQ ID NO: 6351015 - DNA, 18 bp, Homo sapiens
gtaggccaaggtgtccta

SEQ ID NO: 6351016 - DNA, 19 bp, Homo sapiens
gtaggccccacaaggcctg

SEQ ID NO: 6351017 - DNA, 21 bp, Homo sapiens
gtaggccccacaaggcctggt

SEQ ID NO: 6351018 - DNA, 21 bp, Homo sapiens
gtaggcccctggtctgccctg

SEQ ID NO: 6351019 - DNA, 22 bp, Homo sapiens
gtaggcccggtgtggtggctca

SEQ ID NO: 6351020 - DNA, 19 bp, Homo sapiens
gtaggccctggttcctgct

SEQ ID NO: 6351021 - DNA, 20 bp, Homo sapiens
gtaggcccttgtcctgccag

SEQ ID NO: 6351022 - DNA, 18 bp, Homo sapiens
gtaggccttttaacattt

SEQ ID NO: 6351023 - DNA, 16 bp, Homo sapiens
gtaggcgcccctgggg

SEQ ID NO: 6351024 - DNA, 17 bp, Homo sapiens
gtaggcggcgatttttg

SEQ ID NO: 6351025 - DNA, 14 bp, Homo sapiens
gtaggctaaaaaca

SEQ ID NO: 6351026 - DNA, 22 bp, Homo sapiens
gtaggctaaaaacattttaaaa

SEQ ID NO: 6351027 - DNA, 13 bp, Homo sapiens
gtaggctacagag

SEQ ID NO: 6351028 - DNA, 14 bp, Homo sapiens
gtaggctacagaga

SEQ ID NO: 6351029 - DNA, 17 bp, Homo sapiens
gtaggctacagagaagc

SEQ ID NO: 6351030 - DNA, 18 bp, Homo sapiens
gtaggctacagagaagcc

SEQ ID NO: 6351031 - DNA, 19 bp, Homo sapiens
gtaggctacagagaagcct

SEQ ID NO: 6351032 - DNA, 20 bp, Homo sapiens
gtaggctacagagaagcctt

SEQ ID NO: 6351033 - DNA, 13 bp, Homo sapiens
gtaggctccacct

SEQ ID NO: 6351034 - DNA, 14 bp, Homo sapiens
gtaggctccagaca

SEQ ID NO: 6351035 - DNA, 16 bp, Homo sapiens
gtaggctccagacagg

SEQ ID NO: 6351036 - DNA, 23 bp, Homo sapiens
gtaggctcctgccagtgtggaac

SEQ ID NO: 6351037 - DNA, 12 bp, Homo sapiens
gtaggctgctgg

SEQ ID NO: 6351038 - DNA, 15 bp, Homo sapiens
gtaggctgctggcgc

SEQ ID NO: 6351039 - DNA, 17 bp, Homo sapiens
gtaggctgctggcgcct

SEQ ID NO: 6351040 - DNA, 20 bp, Homo sapiens
gtaggctgctggcgcctagg

SEQ ID NO: 6351041 - DNA, 13 bp, Homo sapiens
gtaggctggggcg

SEQ ID NO: 6351042 - DNA, 20 bp, Homo sapiens
gtaggctggggcggggccca

SEQ ID NO: 6351043 - DNA, 13 bp, Homo sapiens
gtaggctggttta

SEQ ID NO: 6351044 - DNA, 15 bp, Homo sapiens
gtaggctgtattttc

SEQ ID NO: 6351045 - DNA, 17 bp, Homo sapiens
gtaggctgtattttctt

SEQ ID NO: 6351046 - DNA, 19 bp, Homo sapiens
gtaggctgtggggtctggc

SEQ ID NO: 6351047 - DNA, 20 bp, Homo sapiens
gtaggctgtggggtctggct

SEQ ID NO: 6351048 - DNA, 16 bp, Homo sapiens
gtaggctgttcccttt

SEQ ID NO: 6351049 - DNA, 16 bp, Homo sapiens
gtaggcttctacctgc

SEQ ID NO: 6351050 - DNA, 16 bp, Homo sapiens
gtaggctttatgctgt

SEQ ID NO: 6351051 - DNA, 21 bp, Homo sapiens
gtagggaaaaaaatgcttctt

SEQ ID NO: 6351052 - DNA, 16 bp, Homo sapiens
gtagggaggaccacag

SEQ ID NO: 6351053 - DNA, 15 bp, Homo sapiens
gtagggaggtcagtg

SEQ ID NO: 6351054 - DNA, 22 bp, Homo sapiens
gtagggatatggcaggactcct

SEQ ID NO: 6351055 - DNA, 21 bp, Homo sapiens
gtagggatgaggtctgataag

SEQ ID NO: 6351056 - DNA, 22 bp, Homo sapiens
gtagggatgcggatcctgctgg

SEQ ID NO: 6351057 - DNA, 15 bp, Homo sapiens
gtagggcaagaggat

SEQ ID NO: 6351058 - DNA, 19 bp, Homo sapiens
gtagggcaagggtgcctca

SEQ ID NO: 6351059 - DNA, 12 bp, Homo sapiens
gtagggcagaca

SEQ ID NO: 6351060 - DNA, 16 bp, Homo sapiens
gtagggccagggctct

SEQ ID NO: 6351061 - DNA, 16 bp, Homo sapiens
gtagggcgggaggatg

SEQ ID NO: 6351062 - DNA, 12 bp, Homo sapiens
gtagggctgact

SEQ ID NO: 6351063 - DNA, 15 bp, Homo sapiens
gtagggctggctgga

SEQ ID NO: 6351064 - DNA, 20 bp, Homo sapiens
gtaggggagggcaggcttgg

SEQ ID NO: 6351065 - DNA, 22 bp, Homo sapiens
gtaggggagggcaggcttgggg

SEQ ID NO: 6351066 - DNA, 15 bp, Homo sapiens
gtaggggagggtggg

SEQ ID NO: 6351067 - DNA, 21 bp, Homo sapiens
gtaggggagggtggggcaatg

SEQ ID NO: 6351068 - DNA, 17 bp, Homo sapiens
gtaggggagtgtgggtg

SEQ ID NO: 6351069 - DNA, 17 bp, Homo sapiens
gtaggggatgtggagtg

SEQ ID NO: 6351070 - DNA, 14 bp, Homo sapiens
gtaggggcagggag

SEQ ID NO: 6351071 - DNA, 15 bp, Homo sapiens
gtaggggccacctcc

SEQ ID NO: 6351072 - DNA, 18 bp, Homo sapiens
gtaggggccacctcctcc

SEQ ID NO: 6351073 - DNA, 20 bp, Homo sapiens
gtaggggccacctcctcccc

SEQ ID NO: 6351074 - DNA, 14 bp, Homo sapiens
gtaggggctcctga

SEQ ID NO: 6351075 - DNA, 15 bp, Homo sapiens
gtaggggctgcaggg

SEQ ID NO: 6351076 - DNA, 17 bp, Homo sapiens
gtaggggctgggaacag

SEQ ID NO: 6351077 - DNA, 13 bp, Homo sapiens
gtagggggccttg

SEQ ID NO: 6351078 - DNA, 13 bp, Homo sapiens
gtagggggctctg

SEQ ID NO: 6351079 - DNA, 17 bp, Homo sapiens
gtagggggctggaggag

SEQ ID NO: 6351080 - DNA, 20 bp, Homo sapiens
gtaggggggtttcagggctg

SEQ ID NO: 6351081 - DNA, 23 bp, Homo sapiens
gtaggggttaacttggtcagagc

SEQ ID NO: 6351082 - DNA, 17 bp, Homo sapiens
gtagggtagaaggaaag

SEQ ID NO: 6351083 - DNA, 21 bp, Homo sapiens
gtagggtcaggccacggcagc

SEQ ID NO: 6351084 - DNA, 14 bp, Homo sapiens
gtagggtctttctt

SEQ ID NO: 6351085 - DNA, 19 bp, Homo sapiens
gtagggtgagggaggacag

SEQ ID NO: 6351086 - DNA, 13 bp, Homo sapiens
gtagggtggcact

SEQ ID NO: 6351087 - DNA, 16 bp, Homo sapiens
gtagggttataataat

SEQ ID NO: 6351088 - DNA, 17 bp, Homo sapiens
gtagggttgccagtcct

SEQ ID NO: 6351089 - DNA, 12 bp, Homo sapiens
gtagggtttcta

SEQ ID NO: 6351090 - DNA, 20 bp, Homo sapiens
gtaggtaaaagtagaagcat

SEQ ID NO: 6351091 - DNA, 14 bp, Homo sapiens
gtaggtaaaatgta

SEQ ID NO: 6351092 - DNA, 18 bp, Homo sapiens
gtaggtaaaatgtatttt

SEQ ID NO: 6351093 - DNA, 20 bp, Homo sapiens
gtaggtaaaatgtatttttc

SEQ ID NO: 6351094 - DNA, 19 bp, Homo sapiens
gtaggtaaagaggaaaagg

SEQ ID NO: 6351095 - DNA, 15 bp, Homo sapiens
gtaggtaccatttgt

SEQ ID NO: 6351096 - DNA, 13 bp, Homo sapiens
gtaggtacttttg

SEQ ID NO: 6351097 - DNA, 19 bp, Homo sapiens
gtaggtattaaagatgtgt

SEQ ID NO: 6351098 - DNA, 19 bp, Homo sapiens
gtaggtattacatccctgg

SEQ ID NO: 6351099 - DNA, 19 bp, Homo sapiens
gtaggtcagatatttgaga

SEQ ID NO: 6351100 - DNA, 19 bp, Homo sapiens
gtaggtcaggaccatcaga

SEQ ID NO: 6351101 - DNA, 14 bp, Homo sapiens
gtaggtcccggcca

SEQ ID NO: 6351102 - DNA, 21 bp, Homo sapiens
gtaggtcccggccagctctgg

SEQ ID NO: 6351103 - DNA, 19 bp, Homo sapiens
gtaggtctgaaggcctcca

SEQ ID NO: 6351104 - DNA, 17 bp, Homo sapiens
gtaggtctgcacacata

SEQ ID NO: 6351105 - DNA, 16 bp, Homo sapiens
gtaggtgagcctgggc

SEQ ID NO: 6351106 - DNA, 20 bp, Homo sapiens
gtaggtgagcctgggcagct

SEQ ID NO: 6351107 - DNA, 22 bp, Homo sapiens
gtaggtgagctatagtgaagaa

SEQ ID NO: 6351108 - DNA, 21 bp, Homo sapiens
gtaggtgatgtttccagctgc

SEQ ID NO: 6351109 - DNA, 15 bp, Homo sapiens
gtaggtgctggcctc

SEQ ID NO: 6351110 - DNA, 16 bp, Homo sapiens
gtaggtgctggcctca

SEQ ID NO: 6351111 - DNA, 24 bp, Homo sapiens
gtaggtggaagctagacacatgaa

SEQ ID NO: 6351112 - DNA, 20 bp, Homo sapiens
gtaggtggttcgtgctgtgc

SEQ ID NO: 6351113 - DNA, 13 bp, Homo sapiens
gtaggtgtctctg

SEQ ID NO: 6351114 - DNA, 15 bp, Homo sapiens
gtaggtgtctctggg

SEQ ID NO: 6351115 - DNA, 17 bp, Homo sapiens
gtaggtgtctctgggcc

SEQ ID NO: 6351116 - DNA, 16 bp, Homo sapiens
gtaggttagatgctat

SEQ ID NO: 6351117 - DNA, 16 bp, Homo sapiens
gtaggttcagccaagg

SEQ ID NO: 6351118 - DNA, 21 bp, Homo sapiens
gtaggttccccagagagcagg

SEQ ID NO: 6351119 - DNA, 22 bp, Homo sapiens
gtaggttccccagagagcaggc

SEQ ID NO: 6351120 - DNA, 15 bp, Homo sapiens
gtaggttctgtctgt

SEQ ID NO: 6351121 - DNA, 13 bp, Homo sapiens
gtaggttctgttt

SEQ ID NO: 6351122 - DNA, 16 bp, Homo sapiens
gtaggttgaggacagg

SEQ ID NO: 6351123 - DNA, 20 bp, Homo sapiens
gtaggttggaagctagctcc

SEQ ID NO: 6351124 - DNA, 19 bp, Homo sapiens
gtaggttgtgatgatagca

SEQ ID NO: 6351125 - DNA, 22 bp, Homo sapiens
gtaggtttctctgcctccaggt

SEQ ID NO: 6351126 - DNA, 21 bp, Homo sapiens
gtaggttttaaaaataagttt

SEQ ID NO: 6351127 - DNA, 16 bp, Homo sapiens
gtaggtttttttaaaa

SEQ ID NO: 6351128 - DNA, 17 bp, Homo sapiens
gtaggttttttttattt

SEQ ID NO: 6351129 - DNA, 19 bp, Homo sapiens
gtagtaaaaattaaaaaaa

SEQ ID NO: 6351130 - DNA, 15 bp, Homo sapiens
gtagtaaaacacaga

SEQ ID NO: 6351131 - DNA, 18 bp, Homo sapiens
taaatctctaatatggca

SEQ ID NO: 6351132 - DNA, 20 bp, Homo sapiens
taaatctctatctctttata

SEQ ID NO: 6351133 - DNA, 14 bp, Homo sapiens
taaatctcttaaac

SEQ ID NO: 6351134 - DNA, 15 bp, Homo sapiens
taaatctcttctttg

SEQ ID NO: 6351135 - DNA, 15 bp, Homo sapiens
taaatctgaagaaag

SEQ ID NO: 6351136 - DNA, 16 bp, Homo sapiens
taaatctgacccagtg

SEQ ID NO: 6351137 - DNA, 22 bp, Homo sapiens
taaatctgagatctccctccag

SEQ ID NO: 6351138 - DNA, 17 bp, Homo sapiens
taaatctgcagcacatt

SEQ ID NO: 6351139 - DNA, 16 bp, Homo sapiens
taaatctgccatttca

SEQ ID NO: 6351140 - DNA, 15 bp, Homo sapiens
taaatctggggaaga

SEQ ID NO: 6351141 - DNA, 16 bp, Homo sapiens
taaatctgtaagctct

SEQ ID NO: 6351142 - DNA, 13 bp, Homo sapiens
taaatctgtactt

SEQ ID NO: 6351143 - DNA, 16 bp, Homo sapiens
taaatctgtacttttt

SEQ ID NO: 6351144 - DNA, 21 bp, Homo sapiens
taaatctgtccaactgagaag

SEQ ID NO: 6351145 - DNA, 15 bp, Homo sapiens
taaatctgtctgatt

SEQ ID NO: 6351146 - DNA, 16 bp, Homo sapiens
taaatctgtctgattc

SEQ ID NO: 6351147 - DNA, 17 bp, Homo sapiens
taaatctgtctgattct

SEQ ID NO: 6351148 - DNA, 18 bp, Homo sapiens
taaatctgtgaacttgaa

SEQ ID NO: 6351149 - DNA, 12 bp, Homo sapiens
taaatctgtgat

SEQ ID NO: 6351150 - DNA, 13 bp, Homo sapiens
taaatctgtgatg

SEQ ID NO: 6351151 - DNA, 19 bp, Homo sapiens
taaatcttaaaaagttgtt

SEQ ID NO: 6351152 - DNA, 16 bp, Homo sapiens
taaatcttaaacaatg

SEQ ID NO: 6351153 - DNA, 22 bp, Homo sapiens
taaatcttaaacaatgtataaa

SEQ ID NO: 6351154 - DNA, 21 bp, Homo sapiens
taaatctttcagcctgcttct

SEQ ID NO: 6351155 - DNA, 18 bp, Homo sapiens
taaatctttgtgaacatt

SEQ ID NO: 6351156 - DNA, 19 bp, Homo sapiens
taaatctttgtgaacattc

SEQ ID NO: 6351157 - DNA, 15 bp, Homo sapiens
taaatctttgttaaa

SEQ ID NO: 6351158 - DNA, 15 bp, Homo sapiens
taaatcttttcttca

SEQ ID NO: 6351159 - DNA, 17 bp, Homo sapiens
taaatcttttcttcaac

SEQ ID NO: 6351160 - DNA, 14 bp, Homo sapiens
taaatcttttgggg

SEQ ID NO: 6351161 - DNA, 21 bp, Homo sapiens
taaatctttttgcttctactt

SEQ ID NO: 6351162 - DNA, 24 bp, Homo sapiens
taaatctttttgcttctactttca

SEQ ID NO: 6351163 - DNA, 22 bp, Homo sapiens
taaatgaaaagagaattactta

SEQ ID NO: 6351164 - DNA, 18 bp, Homo sapiens
taaatgaaaatcgtgaca

SEQ ID NO: 6351165 - DNA, 21 bp, Homo sapiens
taaatgaaacttaagaattga

SEQ ID NO: 6351166 - DNA, 13 bp, Homo sapiens
taaatgaaatact

SEQ ID NO: 6351167 - DNA, 15 bp, Homo sapiens
taaatgaaatacttg

SEQ ID NO: 6351168 - DNA, 19 bp, Homo sapiens
taaatgaacacatggcaga

SEQ ID NO: 6351169 - DNA, 18 bp, Homo sapiens
taaatgaactactgctat

SEQ ID NO: 6351170 - DNA, 19 bp, Homo sapiens
taaatgaagagacttaaga

SEQ ID NO: 6351171 - DNA, 20 bp, Homo sapiens
taaatgaagagacttaagaa

SEQ ID NO: 6351172 - DNA, 23 bp, Homo sapiens
taaatgaagcagctttaaacaaa

SEQ ID NO: 6351173 - DNA, 21 bp, Homo sapiens
taaatgaagggtcatttctct

SEQ ID NO: 6351174 - DNA, 21 bp, Homo sapiens
taaatgaagtaacttgtctta

SEQ ID NO: 6351175 - DNA, 22 bp, Homo sapiens
taaatgaagtaacttgtcttaa

SEQ ID NO: 6351176 - DNA, 12 bp, Homo sapiens
taaatgaatgaa

SEQ ID NO: 6351177 - DNA, 15 bp, Homo sapiens
taaatgaatgaaata

SEQ ID NO: 6351178 - DNA, 17 bp, Homo sapiens
taaatgaatgaaatata

SEQ ID NO: 6351179 - DNA, 14 bp, Homo sapiens
taaatgaatgaata

SEQ ID NO: 6351180 - DNA, 12 bp, Homo sapiens
taaatgaatgtt

SEQ ID NO: 6351181 - DNA, 17 bp, Homo sapiens
taaatgacagatctcaa

SEQ ID NO: 6351182 - DNA, 17 bp, Homo sapiens
taaatgacagtaatatt

SEQ ID NO: 6351183 - DNA, 17 bp, Homo sapiens
taaatgaccagtttacc

SEQ ID NO: 6351184 - DNA, 21 bp, Homo sapiens
taaatgaccatccagtagaga

SEQ ID NO: 6351185 - DNA, 24 bp, Homo sapiens
taaatgaccatccagtagagattt

SEQ ID NO: 6351186 - DNA, 19 bp, Homo sapiens
taaatgacctcagatcttt

SEQ ID NO: 6351187 - DNA, 19 bp, Homo sapiens
taaatgacctcagcaaatc

SEQ ID NO: 6351188 - DNA, 15 bp, Homo sapiens
taaatgactattgta

SEQ ID NO: 6351189 - DNA, 18 bp, Homo sapiens
taaatgactattgtaatg

SEQ ID NO: 6351190 - DNA, 13 bp, Homo sapiens
taaatgacttttt

SEQ ID NO: 6351191 - DNA, 21 bp, Homo sapiens
taaatgactttttgaatgtca

SEQ ID NO: 6351192 - DNA, 16 bp, Homo sapiens
taaatgagacacatac

SEQ ID NO: 6351193 - DNA, 16 bp, Homo sapiens
taaatgagctatgtat

SEQ ID NO: 6351194 - DNA, 18 bp, Homo sapiens
taaatgagctatgtatta

SEQ ID NO: 6351195 - DNA, 13 bp, Homo sapiens
taaatgagctttc

SEQ ID NO: 6351196 - DNA, 22 bp, Homo sapiens
taaatgataaggtttagaatga

SEQ ID NO: 6351197 - DNA, 13 bp, Homo sapiens
taaatgatattta

SEQ ID NO: 6351198 - DNA, 15 bp, Homo sapiens
taaatgatggtgctt

SEQ ID NO: 6351199 - DNA, 14 bp, Homo sapiens
taaatgatgtgttg

SEQ ID NO: 6351200 - DNA, 14 bp, Homo sapiens
taaatgatgttgaa

SEQ ID NO: 6351201 - DNA, 16 bp, Homo sapiens
taaatgattatattca

SEQ ID NO: 6351202 - DNA, 14 bp, Homo sapiens
taaatgattatctt

SEQ ID NO: 6351203 - DNA, 14 bp, Homo sapiens
taaatgattcaaaa

SEQ ID NO: 6351204 - DNA, 15 bp, Homo sapiens
taaatgatttaaatt

SEQ ID NO: 6351205 - DNA, 17 bp, Homo sapiens
taaatgatttcattcaa

SEQ ID NO: 6351206 - DNA, 12 bp, Homo sapiens
taaatgatttta

SEQ ID NO: 6351207 - DNA, 15 bp, Homo sapiens
taaatgcaaaaatat

SEQ ID NO: 6351208 - DNA, 16 bp, Homo sapiens
taaatgcaaacactgt

SEQ ID NO: 6351209 - DNA, 18 bp, Homo sapiens
taaatgcaaacactgtgt

SEQ ID NO: 6351210 - DNA, 21 bp, Homo sapiens
taaatgcaaagttctgtgttt

SEQ ID NO: 6351211 - DNA, 15 bp, Homo sapiens
taaatgcaaataaca

SEQ ID NO: 6351212 - DNA, 17 bp, Homo sapiens
taaatgcaaataacaaa

SEQ ID NO: 6351213 - DNA, 14 bp, Homo sapiens
taaatgcaataaga

SEQ ID NO: 6351214 - DNA, 14 bp, Homo sapiens
taaatgcaataatt

SEQ ID NO: 6351215 - DNA, 14 bp, Homo sapiens
taaatgcaatatgt

SEQ ID NO: 6351216 - DNA, 18 bp, Homo sapiens
taaatgcaatatgtatta

SEQ ID NO: 6351217 - DNA, 21 bp, Homo sapiens
taaatgcaccaagaaagcttc

SEQ ID NO: 6351218 - DNA, 22 bp, Homo sapiens
taaatgcactgtaatatgtaca

SEQ ID NO: 6351219 - DNA, 22 bp, Homo sapiens
taaatgcagacaacaccttcct

SEQ ID NO: 6351220 - DNA, 12 bp, Homo sapiens
taaatgcagccc

SEQ ID NO: 6351221 - DNA, 13 bp, Homo sapiens
taaatgcagccca

SEQ ID NO: 6351222 - DNA, 19 bp, Homo sapiens
taaatgcagcccatttctc

SEQ ID NO: 6351223 - DNA, 21 bp, Homo sapiens
taaatgcagcccatttctcca

SEQ ID NO: 6351224 - DNA, 23 bp, Homo sapiens
taaatgcagcccatttctccaga

SEQ ID NO: 6351225 - DNA, 23 bp, Homo sapiens
taaatgcagtcagtcacaaacca

SEQ ID NO: 6351226 - DNA, 21 bp, Homo sapiens
taaatgcagttacaaattata

SEQ ID NO: 6351227 - DNA, 16 bp, Homo sapiens
taaatgcagttttaag

SEQ ID NO: 6351228 - DNA, 20 bp, Homo sapiens
taaatgcataatttatggtc

SEQ ID NO: 6351229 - DNA, 15 bp, Homo sapiens
taaatgcatagagca

SEQ ID NO: 6351230 - DNA, 19 bp, Homo sapiens
taaatgcatagagcaatta

SEQ ID NO: 6351231 - DNA, 20 bp, Homo sapiens
taaatgcatatcctgagcca

SEQ ID NO: 6351232 - DNA, 16 bp, Homo sapiens
taaatgcatattaaat

SEQ ID NO: 6351233 - DNA, 14 bp, Homo sapiens
taaatgcatgattt

SEQ ID NO: 6351234 - DNA, 20 bp, Homo sapiens
taaatgcatgattttataca

SEQ ID NO: 6351235 - DNA, 12 bp, Homo sapiens
taaatgcatgtc

SEQ ID NO: 6351236 - DNA, 14 bp, Homo sapiens
taaatgcatgtctt

SEQ ID NO: 6351237 - DNA, 20 bp, Homo sapiens
taaatgccaaaatgtactta

SEQ ID NO: 6351238 - DNA, 19 bp, Homo sapiens
taaatgccaacataccctt

SEQ ID NO: 6351239 - DNA, 18 bp, Homo sapiens
taaatgccacaagacata

SEQ ID NO: 6351240 - DNA, 12 bp, Homo sapiens
taaatgccacac

SEQ ID NO: 6351241 - DNA, 22 bp, Homo sapiens
taaatgccagagccaacctgga

SEQ ID NO: 6351242 - DNA, 16 bp, Homo sapiens
taaatgccatgtttat

SEQ ID NO: 6351243 - DNA, 16 bp, Homo sapiens
taaatgcccagcccct

SEQ ID NO: 6351244 - DNA, 12 bp, Homo sapiens
taaatgccctgc

SEQ ID NO: 6351245 - DNA, 17 bp, Homo sapiens
taaatgcctagttttta

SEQ ID NO: 6351246 - DNA, 15 bp, Homo sapiens
taaatgcctcttaaa

SEQ ID NO: 6351247 - DNA, 19 bp, Homo sapiens
taaatgcctcttaaattat

SEQ ID NO: 6351248 - DNA, 23 bp, Homo sapiens
taaatgccttgcttgtatgatcg

SEQ ID NO: 6351249 - DNA, 20 bp, Homo sapiens
taaatgccttggtttgattt

SEQ ID NO: 6351250 - DNA, 21 bp, Homo sapiens
taaatgctacctctgatcaaa

SEQ ID NO: 6351251 - DNA, 19 bp, Homo sapiens
taaatgctatggaaataca

SEQ ID NO: 6351252 - DNA, 18 bp, Homo sapiens
taaatgctattatactgt

SEQ ID NO: 6351253 - DNA, 19 bp, Homo sapiens
taaatgctattatactgtt

SEQ ID NO: 6351254 - DNA, 14 bp, Homo sapiens
taaatgctattttt

SEQ ID NO: 6351255 - DNA, 16 bp, Homo sapiens
taaatgctcataaaga

SEQ ID NO: 6351256 - DNA, 23 bp, Homo sapiens
taaatgctcataaagatgttaaa

SEQ ID NO: 6351257 - DNA, 20 bp, Homo sapiens
taaatgctcattttctggtt

SEQ ID NO: 6351258 - DNA, 17 bp, Homo sapiens
taaatgctccagcactc

SEQ ID NO: 6351259 - DNA, 23 bp, Homo sapiens
taaatgctctaactggacatgaa

SEQ ID NO: 6351260 - DNA, 15 bp, Homo sapiens
taaatgctgaaataa

SEQ ID NO: 6351261 - DNA, 19 bp, Homo sapiens
taaatgctgaaataaaatg

SEQ ID NO: 6351262 - DNA, 11 bp, Homo sapiens
taaatgctgct

SEQ ID NO: 6351263 - DNA, 18 bp, Homo sapiens
taaatgctgctttgggga

SEQ ID NO: 6351264 - DNA, 14 bp, Homo sapiens
taaatgctgtaaat

SEQ ID NO: 6351265 - DNA, 16 bp, Homo sapiens
taaatgctgtaaatat

SEQ ID NO: 6351266 - DNA, 16 bp, Homo sapiens
taaatgctgtgtacaa

SEQ ID NO: 6351267 - DNA, 19 bp, Homo sapiens
taaatgcttcattgaaagc

SEQ ID NO: 6351268 - DNA, 18 bp, Homo sapiens
taaatgcttcttaaagtt

SEQ ID NO: 6351269 - DNA, 15 bp, Homo sapiens
taaatgcttgatgga

SEQ ID NO: 6351270 - DNA, 14 bp, Homo sapiens
taaatgctttaaat

SEQ ID NO: 6351271 - DNA, 22 bp, Homo sapiens
taaatgcttttaaatgctctct

SEQ ID NO: 6351272 - DNA, 11 bp, Homo sapiens
taaatggaaac

SEQ ID NO: 6351273 - DNA, 16 bp, Homo sapiens
taaatggaaactgaaa

SEQ ID NO: 6351274 - DNA, 18 bp, Homo sapiens
taaatggaaactgaaact

SEQ ID NO: 6351275 - DNA, 14 bp, Homo sapiens
taaatggaatcaca

SEQ ID NO: 6351276 - DNA, 22 bp, Homo sapiens
taaatggaattattttgaatgt

SEQ ID NO: 6351277 - DNA, 21 bp, Homo sapiens
taaatggaattcgtgttatga

SEQ ID NO: 6351278 - DNA, 17 bp, Homo sapiens
taaatggacttgcttct

SEQ ID NO: 6351279 - DNA, 15 bp, Homo sapiens
taaatggagcttgta

SEQ ID NO: 6351280 - DNA, 21 bp, Homo sapiens
taaatggagcttgtacatatt

SEQ ID NO: 6351281 - DNA, 15 bp, Homo sapiens
taaatggcacctgta

SEQ ID NO: 6351282 - DNA, 16 bp, Homo sapiens
taaatggcacctgtat

SEQ ID NO: 6351283 - DNA, 15 bp, Homo sapiens
taaatggcagtattt

SEQ ID NO: 6351284 - DNA, 22 bp, Homo sapiens
taaatggcatcagcactttaac

SEQ ID NO: 6351285 - DNA, 12 bp, Homo sapiens
taaatggccagt

SEQ ID NO: 6351286 - DNA, 16 bp, Homo sapiens
taaatggccagtgctg

SEQ ID NO: 6351287 - DNA, 20 bp, Homo sapiens
taaatggccagtgctgcttc

SEQ ID NO: 6351288 - DNA, 21 bp, Homo sapiens
taaatggccagtgctgcttct

SEQ ID NO: 6351289 - DNA, 12 bp, Homo sapiens
taaatggcctca

SEQ ID NO: 6351290 - DNA, 22 bp, Homo sapiens
taaatggcctcatgtggctgga

SEQ ID NO: 6351291 - DNA, 23 bp, Homo sapiens
taaatggcctcatgtggctggaa

SEQ ID NO: 6351292 - DNA, 23 bp, Homo sapiens
taaatggctcgtgggctctggct

SEQ ID NO: 6351293 - DNA, 16 bp, Homo sapiens
taaatggcttcttgcc

SEQ ID NO: 6351294 - DNA, 15 bp, Homo sapiens
taaatgggaacattt

SEQ ID NO: 6351295 - DNA, 16 bp, Homo sapiens
taaatgggaattctca

SEQ ID NO: 6351296 - DNA, 16 bp, Homo sapiens
taaatggggacgcaga

SEQ ID NO: 6351297 - DNA, 14 bp, Homo sapiens
taaatggggcccat

SEQ ID NO: 6351298 - DNA, 19 bp, Homo sapiens
taaatggtaataagcactg

SEQ ID NO: 6351299 - DNA, 17 bp, Homo sapiens
taaatggtcgcccagga

SEQ ID NO: 6351300 - DNA, 15 bp, Homo sapiens
taaatggtgagaatt

SEQ ID NO: 6351301 - DNA, 16 bp, Homo sapiens
taaatggtgttacatt

SEQ ID NO: 6351302 - DNA, 16 bp, Homo sapiens
taaatggttctgtgct

SEQ ID NO: 6351303 - DNA, 21 bp, Homo sapiens
taaatggttgtctgggtcaat

SEQ ID NO: 6351304 - DNA, 18 bp, Homo sapiens
taaatggtttctgaaaat

SEQ ID NO: 6351305 - DNA, 21 bp, Homo sapiens
taaatggtttctgaaaatgtt

SEQ ID NO: 6351306 - DNA, 21 bp, Homo sapiens
taaatggtttggtgcttttta

SEQ ID NO: 6351307 - DNA, 18 bp, Homo sapiens
taaatggttttcaacaag

SEQ ID NO: 6351308 - DNA, 14 bp, Homo sapiens
taaatgtaaactca

SEQ ID NO: 6351309 - DNA, 16 bp, Homo sapiens
taaatgtaaagatatt

SEQ ID NO: 6351310 - DNA, 17 bp, Homo sapiens
gtagtaaaacacagagg

SEQ ID NO: 6351311 - DNA, 19 bp, Homo sapiens
gtagtaaaagtcataaatg

SEQ ID NO: 6351312 - DNA, 14 bp, Homo sapiens
gtagtaacactaat

SEQ ID NO: 6351313 - DNA, 16 bp, Homo sapiens
gtagtaatgtttttta

SEQ ID NO: 6351314 - DNA, 15 bp, Homo sapiens
gtagtaccaaaataa

SEQ ID NO: 6351315 - DNA, 13 bp, Homo sapiens
gtagtaccttgtt

SEQ ID NO: 6351316 - DNA, 20 bp, Homo sapiens
gtagtactccttaagaacac

SEQ ID NO: 6351317 - DNA, 19 bp, Homo sapiens
gtagtacttcttctgtaat

SEQ ID NO: 6351318 - DNA, 21 bp, Homo sapiens
gtagtacttcttctgtaatat

SEQ ID NO: 6351319 - DNA, 18 bp, Homo sapiens
gtagtagcctttcctgat

SEQ ID NO: 6351320 - DNA, 18 bp, Homo sapiens
gtagtagggtcaggccac

SEQ ID NO: 6351321 - DNA, 22 bp, Homo sapiens
gtagtagtctcattacttttga

SEQ ID NO: 6351322 - DNA, 14 bp, Homo sapiens
gtagtagtgtcttc

SEQ ID NO: 6351323 - DNA, 17 bp, Homo sapiens
gtagtagttgatgacca

SEQ ID NO: 6351324 - DNA, 19 bp, Homo sapiens
gtagtagttgatgaccaat

SEQ ID NO: 6351325 - DNA, 20 bp, Homo sapiens
gtagtataatgtatgaattt

SEQ ID NO: 6351326 - DNA, 14 bp, Homo sapiens
gtagtatcaaatat

SEQ ID NO: 6351327 - DNA, 14 bp, Homo sapiens
gtagtatctgctta

SEQ ID NO: 6351328 - DNA, 22 bp, Homo sapiens
gtagtatggcctgacagctctg

SEQ ID NO: 6351329 - DNA, 20 bp, Homo sapiens
gtagtatggcctgtgtcact

SEQ ID NO: 6351330 - DNA, 13 bp, Homo sapiens
gtagtatttttta

SEQ ID NO: 6351331 - DNA, 19 bp, Homo sapiens
gtagtattttttgtataat

SEQ ID NO: 6351332 - DNA, 14 bp, Homo sapiens
gtagtcaaaaacaa

SEQ ID NO: 6351333 - DNA, 14 bp, Homo sapiens
gtagtcaataaaac

SEQ ID NO: 6351334 - DNA, 21 bp, Homo sapiens
gtagtcagaattagctgcttc

SEQ ID NO: 6351335 - DNA, 16 bp, Homo sapiens
gtagtcaggtgctcaa

SEQ ID NO: 6351336 - DNA, 17 bp, Homo sapiens
gtagtcaggttcaggag

SEQ ID NO: 6351337 - DNA, 14 bp, Homo sapiens
gtagtcataataaa

SEQ ID NO: 6351338 - DNA, 19 bp, Homo sapiens
gtagtcatgctgtgcattt

SEQ ID NO: 6351339 - DNA, 17 bp, Homo sapiens
gtagtcatttactaaac

SEQ ID NO: 6351340 - DNA, 14 bp, Homo sapiens
gtagtccaggctgt

SEQ ID NO: 6351341 - DNA, 12 bp, Homo sapiens
gtagtccatcac

SEQ ID NO: 6351342 - DNA, 20 bp, Homo sapiens
gtagtcccagctactcggga

SEQ ID NO: 6351343 - DNA, 23 bp, Homo sapiens
gtagtcccctgttgattatcttc

SEQ ID NO: 6351344 - DNA, 22 bp, Homo sapiens
gtagtcccggaggccttccctt

SEQ ID NO: 6351345 - DNA, 22 bp, Homo sapiens
gtagtccgtgctgacagctgct

SEQ ID NO: 6351346 - DNA, 11 bp, Homo sapiens
gtagtcctttc

SEQ ID NO: 6351347 - DNA, 15 bp, Homo sapiens
gtagtcctttctgcc

SEQ ID NO: 6351348 - DNA, 19 bp, Homo sapiens
gtagtctcactgcttgaac

SEQ ID NO: 6351349 - DNA, 16 bp, Homo sapiens
gtagtctcatatcagg

SEQ ID NO: 6351350 - DNA, 13 bp, Homo sapiens
gtagtctcctggg

SEQ ID NO: 6351351 - DNA, 14 bp, Homo sapiens
gtagtctgagtaat

SEQ ID NO: 6351352 - DNA, 20 bp, Homo sapiens
gtagtcttggctaaggaaat

SEQ ID NO: 6351353 - DNA, 18 bp, Homo sapiens
gtagtgaagctctcaccc

SEQ ID NO: 6351354 - DNA, 11 bp, Homo sapiens
gtagtgaccaa

SEQ ID NO: 6351355 - DNA, 13 bp, Homo sapiens
gtagtgagccgag

SEQ ID NO: 6351356 - DNA, 16 bp, Homo sapiens
gtagtgattaaatata

SEQ ID NO: 6351357 - DNA, 19 bp, Homo sapiens
gtagtgatttttatgccac

SEQ ID NO: 6351358 - DNA, 20 bp, Homo sapiens
gtagtgcatttttaaacttg

SEQ ID NO: 6351359 - DNA, 15 bp, Homo sapiens
gtagtgccgcagtgg

SEQ ID NO: 6351360 - DNA, 16 bp, Homo sapiens
gtagtgccgcagtggg

SEQ ID NO: 6351361 - DNA, 20 bp, Homo sapiens
gtagtgcttttaaaaatttt

SEQ ID NO: 6351362 - DNA, 16 bp, Homo sapiens
gtagtggaagagcagc

SEQ ID NO: 6351363 - DNA, 17 bp, Homo sapiens
gtagtggaagagcagcc

SEQ ID NO: 6351364 - DNA, 18 bp, Homo sapiens
gtagtggaagagcagcct

SEQ ID NO: 6351365 - DNA, 21 bp, Homo sapiens
gtagtggaagagcagcctgat

SEQ ID NO: 6351366 - DNA, 20 bp, Homo sapiens
gtagtggcaaaaaagaacag

SEQ ID NO: 6351367 - DNA, 22 bp, Homo sapiens
gtagtggcttcttttgaactgt

SEQ ID NO: 6351368 - DNA, 16 bp, Homo sapiens
gtagtgggaaagatac

SEQ ID NO: 6351369 - DNA, 15 bp, Homo sapiens
gtagtgggtgaatgt

SEQ ID NO: 6351370 - DNA, 23 bp, Homo sapiens
gtagtgtcagtactaaggtgact

SEQ ID NO: 6351371 - DNA, 16 bp, Homo sapiens
gtagtgtcatcactct

SEQ ID NO: 6351372 - DNA, 12 bp, Homo sapiens
gtagtgtcattc

SEQ ID NO: 6351373 - DNA, 23 bp, Homo sapiens
gtagtgtccattttgtgaagccc

SEQ ID NO: 6351374 - DNA, 16 bp, Homo sapiens
gtagtgtccccagcct

SEQ ID NO: 6351375 - DNA, 11 bp, Homo sapiens
gtagtgtcttc

SEQ ID NO: 6351376 - DNA, 12 bp, Homo sapiens
gtagtgtggcct

SEQ ID NO: 6351377 - DNA, 21 bp, Homo sapiens
gtagtgttattgccaggaaag

SEQ ID NO: 6351378 - DNA, 17 bp, Homo sapiens
gtagtgttcagaaaaaa

SEQ ID NO: 6351379 - DNA, 14 bp, Homo sapiens
gtagtgtttctttt

SEQ ID NO: 6351380 - DNA, 19 bp, Homo sapiens
gtagttaatataaatgttg

SEQ ID NO: 6351381 - DNA, 14 bp, Homo sapiens
gtagttaggcctgg

SEQ ID NO: 6351382 - DNA, 15 bp, Homo sapiens
gtagttaggcctggc

SEQ ID NO: 6351383 - DNA, 18 bp, Homo sapiens
gtagttaggcctggctca

SEQ ID NO: 6351384 - DNA, 22 bp, Homo sapiens
gtagttaggcctggctcattct

SEQ ID NO: 6351385 - DNA, 15 bp, Homo sapiens
gtagttatcatgtta

SEQ ID NO: 6351386 - DNA, 14 bp, Homo sapiens
gtagttattttgca

SEQ ID NO: 6351387 - DNA, 15 bp, Homo sapiens
gtagttcaagaaatg

SEQ ID NO: 6351388 - DNA, 23 bp, Homo sapiens
gtagttccacttatagcctctgt

SEQ ID NO: 6351389 - DNA, 17 bp, Homo sapiens
gtagttccctgaaaacc

SEQ ID NO: 6351390 - DNA, 16 bp, Homo sapiens
gtagttctgctccaga

SEQ ID NO: 6351391 - DNA, 16 bp, Homo sapiens
gtagttctgtatttga

SEQ ID NO: 6351392 - DNA, 20 bp, Homo sapiens
gtagttctgtatttgaaagt

SEQ ID NO: 6351393 - DNA, 17 bp, Homo sapiens
gtagttctgtgcctccc

SEQ ID NO: 6351394 - DNA, 15 bp, Homo sapiens
gtagttcttagtccc

SEQ ID NO: 6351395 - DNA, 14 bp, Homo sapiens
gtagttctttaaac

SEQ ID NO: 6351396 - DNA, 20 bp, Homo sapiens
gtagttctttgttcctgctt

SEQ ID NO: 6351397 - DNA, 14 bp, Homo sapiens
gtagttgaatattg

SEQ ID NO: 6351398 - DNA, 18 bp, Homo sapiens
gtagttgacaattctgca

SEQ ID NO: 6351399 - DNA, 18 bp, Homo sapiens
gtagttgatgaccaatct

SEQ ID NO: 6351400 - DNA, 20 bp, Homo sapiens
gtagttgatgaccaatctct

SEQ ID NO: 6351401 - DNA, 18 bp, Homo sapiens
gtagttgcaatagaacag

SEQ ID NO: 6351402 - DNA, 11 bp, Homo sapiens
gtagttgcagc

SEQ ID NO: 6351403 - DNA, 17 bp, Homo sapiens
gtagttgctttgcggca

SEQ ID NO: 6351404 - DNA, 21 bp, Homo sapiens
gtagttggaactttctgttcc

SEQ ID NO: 6351405 - DNA, 19 bp, Homo sapiens
gtagttgggtagaaaaatt

SEQ ID NO: 6351406 - DNA, 15 bp, Homo sapiens
gtagttggtttgtat

SEQ ID NO: 6351407 - DNA, 12 bp, Homo sapiens
gtagttgtcttt

SEQ ID NO: 6351408 - DNA, 17 bp, Homo sapiens
gtagtttagttctgttg

SEQ ID NO: 6351409 - DNA, 18 bp, Homo sapiens
gtagtttagttctgttga

SEQ ID NO: 6351410 - DNA, 19 bp, Homo sapiens
gtagtttatggcagaaggg

SEQ ID NO: 6351411 - DNA, 20 bp, Homo sapiens
gtagtttgaaagttgtacat

SEQ ID NO: 6351412 - DNA, 20 bp, Homo sapiens
gtagtttggatatttttgta

SEQ ID NO: 6351413 - DNA, 16 bp, Homo sapiens
gtagtttgtattaaac

SEQ ID NO: 6351414 - DNA, 22 bp, Homo sapiens
gtagttttaaataaagtttgga

SEQ ID NO: 6351415 - DNA, 15 bp, Homo sapiens
gtagttttaacagaa

SEQ ID NO: 6351416 - DNA, 16 bp, Homo sapiens
gtagttttggttttta

SEQ ID NO: 6351417 - DNA, 19 bp, Homo sapiens
gtagttttgtgatgcattt

SEQ ID NO: 6351418 - DNA, 13 bp, Homo sapiens
gtagtttttacaa

SEQ ID NO: 6351419 - DNA, 11 bp, Homo sapiens
gtagtttttca

SEQ ID NO: 6351420 - DNA, 17 bp, Homo sapiens
gtagtttttcttcaaca

SEQ ID NO: 6351421 - DNA, 17 bp, Homo sapiens
gtagttttttcatcttc

SEQ ID NO: 6351422 - DNA, 23 bp, Homo sapiens
gtagttttttggttttgtttctg

SEQ ID NO: 6351423 - DNA, 13 bp, Homo sapiens
gtataaaaaataa

SEQ ID NO: 6351424 - DNA, 15 bp, Homo sapiens
gtataaaaaataagt

SEQ ID NO: 6351425 - DNA, 16 bp, Homo sapiens
gtataaaaaataagta

SEQ ID NO: 6351426 - DNA, 18 bp, Homo sapiens
gtataaaaacatgagtta

SEQ ID NO: 6351427 - DNA, 13 bp, Homo sapiens
gtataaaaaggaa

SEQ ID NO: 6351428 - DNA, 15 bp, Homo sapiens
gtataaaaaggaaat

SEQ ID NO: 6351429 - DNA, 15 bp, Homo sapiens
gtataaaacattaat

SEQ ID NO: 6351430 - DNA, 14 bp, Homo sapiens
gtataaaagacaaa

SEQ ID NO: 6351431 - DNA, 21 bp, Homo sapiens
gtataaaagcctgtttaagag

SEQ ID NO: 6351432 - DNA, 18 bp, Homo sapiens
gtataaaataaagcaaat

SEQ ID NO: 6351433 - DNA, 15 bp, Homo sapiens
gtataaaataatttt

SEQ ID NO: 6351434 - DNA, 18 bp, Homo sapiens
gtataaaatacatagtga

SEQ ID NO: 6351435 - DNA, 16 bp, Homo sapiens
gtataaaatccataga

SEQ ID NO: 6351436 - DNA, 23 bp, Homo sapiens
gtataaaatccatagatttattt

SEQ ID NO: 6351437 - DNA, 15 bp, Homo sapiens
gtataaaatctgaat

SEQ ID NO: 6351438 - DNA, 21 bp, Homo sapiens
gtataaaatctgaattttgca

SEQ ID NO: 6351439 - DNA, 22 bp, Homo sapiens
gtataaaatctgaattttgcaa

SEQ ID NO: 6351440 - DNA, 19 bp, Homo sapiens
gtataaaatggtgttttca

SEQ ID NO: 6351441 - DNA, 20 bp, Homo sapiens
gtataaaatgtaacactgat

SEQ ID NO: 6351442 - DNA, 23 bp, Homo sapiens
gtataaacaagaaaaataaagaa

SEQ ID NO: 6351443 - DNA, 18 bp, Homo sapiens
gtataaacataagttgca

SEQ ID NO: 6351444 - DNA, 19 bp, Homo sapiens
gtataaacataagttgcat

SEQ ID NO: 6351445 - DNA, 21 bp, Homo sapiens
gtataaacataagttgcattt

SEQ ID NO: 6351446 - DNA, 22 bp, Homo sapiens
gtataaacataagttgcattta

SEQ ID NO: 6351447 - DNA, 20 bp, Homo sapiens
gtataaacatgaccctgggc

SEQ ID NO: 6351448 - DNA, 16 bp, Homo sapiens
gtataaactgatggat

SEQ ID NO: 6351449 - DNA, 20 bp, Homo sapiens
gtataaagcaactgttatga

SEQ ID NO: 6351450 - DNA, 21 bp, Homo sapiens
gtataaagcaactgttatgaa

SEQ ID NO: 6351451 - DNA, 23 bp, Homo sapiens
gtataaagcaactgttatgaaat

SEQ ID NO: 6351452 - DNA, 19 bp, Homo sapiens
gtataaataataaagaact

SEQ ID NO: 6351453 - DNA, 13 bp, Homo sapiens
gtataaataggag

SEQ ID NO: 6351454 - DNA, 17 bp, Homo sapiens
gtataaatatcagtatt

SEQ ID NO: 6351455 - DNA, 12 bp, Homo sapiens
gtataaatggtt

SEQ ID NO: 6351456 - DNA, 17 bp, Homo sapiens
gtataaatggttgtctg

SEQ ID NO: 6351457 - DNA, 23 bp, Homo sapiens
gtataaatgtacatttccaaatg

SEQ ID NO: 6351458 - DNA, 14 bp, Homo sapiens
gtataaatgtatat

SEQ ID NO: 6351459 - DNA, 16 bp, Homo sapiens
gtataaatgtatatac

SEQ ID NO: 6351460 - DNA, 18 bp, Homo sapiens
gtataaatgtatatacac

SEQ ID NO: 6351461 - DNA, 22 bp, Homo sapiens
gtataaatgtatatacacatat

SEQ ID NO: 6351462 - DNA, 16 bp, Homo sapiens
gtataaatgtctttaa

SEQ ID NO: 6351463 - DNA, 12 bp, Homo sapiens
gtataaattaat

SEQ ID NO: 6351464 - DNA, 13 bp, Homo sapiens
gtataaattacat

SEQ ID NO: 6351465 - DNA, 17 bp, Homo sapiens
gtataaattacatgcat

SEQ ID NO: 6351466 - DNA, 12 bp, Homo sapiens
gtataaatttat

SEQ ID NO: 6351467 - DNA, 12 bp, Homo sapiens
gtataaattttt

SEQ ID NO: 6351468 - DNA, 16 bp, Homo sapiens
gtataaatttttaagt

SEQ ID NO: 6351469 - DNA, 17 bp, Homo sapiens
gtataaatttttaagtg

SEQ ID NO: 6351470 - DNA, 20 bp, Homo sapiens
gtataacaagccaaacattc

SEQ ID NO: 6351471 - DNA, 21 bp, Homo sapiens
gtataacaagccaaacattct

SEQ ID NO: 6351472 - DNA, 16 bp, Homo sapiens
gtataacagcaaataa

SEQ ID NO: 6351473 - DNA, 22 bp, Homo sapiens
gtataacagccttttccttctg

SEQ ID NO: 6351474 - DNA, 13 bp, Homo sapiens
gtataacaggtta

SEQ ID NO: 6351475 - DNA, 15 bp, Homo sapiens
gtataaccaagtgtg

SEQ ID NO: 6351476 - DNA, 20 bp, Homo sapiens
gtataaccaagtgtgctctt

SEQ ID NO: 6351477 - DNA, 20 bp, Homo sapiens
gtataaccccaccttgccaa

SEQ ID NO: 6351478 - DNA, 21 bp, Homo sapiens
gtataactttaacttctgttt

SEQ ID NO: 6351479 - DNA, 23 bp, Homo sapiens
gtataactttaacttctgtttta

SEQ ID NO: 6351480 - DNA, 17 bp, Homo sapiens
gtataagaaatgcatat

SEQ ID NO: 6351481 - DNA, 15 bp, Homo sapiens
gtataagataaaata

SEQ ID NO: 6351482 - DNA, 16 bp, Homo sapiens
gtataagatttttgaa

SEQ ID NO: 6351483 - DNA, 15 bp, Homo sapiens
gtataagcatgcttt

SEQ ID NO: 6351484 - DNA, 13 bp, Homo sapiens
gtataagctgtaa

SEQ ID NO: 6351485 - DNA, 16 bp, Homo sapiens
gtataagctgtaatat

SEQ ID NO: 6351486 - DNA, 16 bp, Homo sapiens
gtataagctgtctgaa

SEQ ID NO: 6351487 - DNA, 23 bp, Homo sapiens
gtataaggaaatatcataatgta

SEQ ID NO: 6351488 - DNA, 20 bp, Homo sapiens
gtataaggatcttttgtaaa

SEQ ID NO: 6351489 - DNA, 17 bp, Homo sapiens
taaatgtaaagatattt

SEQ ID NO: 6351490 - DNA, 13 bp, Homo sapiens
taaatgtaacagt

SEQ ID NO: 6351491 - DNA, 14 bp, Homo sapiens
taaatgtaagaaag

SEQ ID NO: 6351492 - DNA, 20 bp, Homo sapiens
taaatgtaagttgagaaaaa

SEQ ID NO: 6351493 - DNA, 13 bp, Homo sapiens
taaatgtacaaat

SEQ ID NO: 6351494 - DNA, 18 bp, Homo sapiens
taaatgtacagacatatt

SEQ ID NO: 6351495 - DNA, 14 bp, Homo sapiens
taaatgtactacat

SEQ ID NO: 6351496 - DNA, 21 bp, Homo sapiens
taaatgtactacatttgcatg

SEQ ID NO: 6351497 - DNA, 12 bp, Homo sapiens
taaatgtactgg

SEQ ID NO: 6351498 - DNA, 22 bp, Homo sapiens
taaatgtactggtaattgtaca

SEQ ID NO: 6351499 - DNA, 15 bp, Homo sapiens
taaatgtagaaagtg

SEQ ID NO: 6351500 - DNA, 19 bp, Homo sapiens
taaatgtagacagatattt

SEQ ID NO: 6351501 - DNA, 13 bp, Homo sapiens
taaatgtatacct

SEQ ID NO: 6351502 - DNA, 13 bp, Homo sapiens
taaatgtatatac

SEQ ID NO: 6351503 - DNA, 15 bp, Homo sapiens
taaatgtatatacac

SEQ ID NO: 6351504 - DNA, 18 bp, Homo sapiens
taaatgtatgattatata

SEQ ID NO: 6351505 - DNA, 16 bp, Homo sapiens
taaatgtattaactga

SEQ ID NO: 6351506 - DNA, 18 bp, Homo sapiens
taaatgtattttaaaata

SEQ ID NO: 6351507 - DNA, 20 bp, Homo sapiens
taaatgtattttaaaataaa

SEQ ID NO: 6351508 - DNA, 15 bp, Homo sapiens
taaatgtattttaca

SEQ ID NO: 6351509 - DNA, 15 bp, Homo sapiens
taaatgtcactgcca

SEQ ID NO: 6351510 - DNA, 22 bp, Homo sapiens
taaatgtcactttttgaggcaa

SEQ ID NO: 6351511 - DNA, 16 bp, Homo sapiens
taaatgtcagttgaaa

SEQ ID NO: 6351512 - DNA, 20 bp, Homo sapiens
taaatgtccacttaaaatac

SEQ ID NO: 6351513 - DNA, 15 bp, Homo sapiens
taaatgtctattatt

SEQ ID NO: 6351514 - DNA, 15 bp, Homo sapiens
taaatgtctcactga

SEQ ID NO: 6351515 - DNA, 15 bp, Homo sapiens
taaatgtctgacaca

SEQ ID NO: 6351516 - DNA, 16 bp, Homo sapiens
taaatgtctgcactga

SEQ ID NO: 6351517 - DNA, 13 bp, Homo sapiens
taaatgtcttata

SEQ ID NO: 6351518 - DNA, 15 bp, Homo sapiens
taaatgtcttcatgt

SEQ ID NO: 6351519 - DNA, 18 bp, Homo sapiens
taaatgtctttaatgcaa

SEQ ID NO: 6351520 - DNA, 14 bp, Homo sapiens
taaatgtctttgta

SEQ ID NO: 6351521 - DNA, 15 bp, Homo sapiens
taaatgtctttgtaa

SEQ ID NO: 6351522 - DNA, 19 bp, Homo sapiens
taaatgtcttttcaaaagg

SEQ ID NO: 6351523 - DNA, 21 bp, Homo sapiens
taaatgtcttttttttaatgt

SEQ ID NO: 6351524 - DNA, 23 bp, Homo sapiens
taaatgtgaatggaaacttggaa

SEQ ID NO: 6351525 - DNA, 19 bp, Homo sapiens
taaatgtgaatttcaactt

SEQ ID NO: 6351526 - DNA, 21 bp, Homo sapiens
taaatgtgaatttcaactttt

SEQ ID NO: 6351527 - DNA, 23 bp, Homo sapiens
taaatgtgcattcttttaaaaga

SEQ ID NO: 6351528 - DNA, 17 bp, Homo sapiens
taaatgtgcttcattgt

SEQ ID NO: 6351529 - DNA, 21 bp, Homo sapiens
taaatgtggaatgatgtatat

SEQ ID NO: 6351530 - DNA, 16 bp, Homo sapiens
taaatgtggtgagaat

SEQ ID NO: 6351531 - DNA, 13 bp, Homo sapiens
taaatgtgtaaat

SEQ ID NO: 6351532 - DNA, 14 bp, Homo sapiens
taaatgtgtaaatg

SEQ ID NO: 6351533 - DNA, 13 bp, Homo sapiens
taaatgtgtacac

SEQ ID NO: 6351534 - DNA, 12 bp, Homo sapiens
taaatgtgtatt

SEQ ID NO: 6351535 - DNA, 18 bp, Homo sapiens
taaatgtgtattctggct

SEQ ID NO: 6351536 - DNA, 13 bp, Homo sapiens
taaatgtgtgtaa

SEQ ID NO: 6351537 - DNA, 15 bp, Homo sapiens
taaatgtgtgtaaaa

SEQ ID NO: 6351538 - DNA, 13 bp, Homo sapiens
taaatgtgtgtat

SEQ ID NO: 6351539 - DNA, 11 bp, Homo sapiens
taaatgtgttg

SEQ ID NO: 6351540 - DNA, 19 bp, Homo sapiens
taaatgtgtttcttgctgc

SEQ ID NO: 6351541 - DNA, 16 bp, Homo sapiens
taaatgttaaagatgt

SEQ ID NO: 6351542 - DNA, 17 bp, Homo sapiens
taaatgttaaagccaga

SEQ ID NO: 6351543 - DNA, 23 bp, Homo sapiens
taaatgttaatggatttcagaag

SEQ ID NO: 6351544 - DNA, 15 bp, Homo sapiens
taaatgttacctaat

SEQ ID NO: 6351545 - DNA, 19 bp, Homo sapiens
taaatgttacctaattatt

SEQ ID NO: 6351546 - DNA, 16 bp, Homo sapiens
taaatgttacctctga

SEQ ID NO: 6351547 - DNA, 21 bp, Homo sapiens
taaatgttagtttcttggtaa

SEQ ID NO: 6351548 - DNA, 15 bp, Homo sapiens
taaatgttattactt

SEQ ID NO: 6351549 - DNA, 20 bp, Homo sapiens
taaatgttattattcttgag

SEQ ID NO: 6351550 - DNA, 22 bp, Homo sapiens
taaatgttattattcttgagtt

SEQ ID NO: 6351551 - DNA, 16 bp, Homo sapiens
taaatgttatttctgc

SEQ ID NO: 6351552 - DNA, 21 bp, Homo sapiens
taaatgttatttctgcaaaca

SEQ ID NO: 6351553 - DNA, 13 bp, Homo sapiens
taaatgttctatg

SEQ ID NO: 6351554 - DNA, 22 bp, Homo sapiens
taaatgttctatggttatgaaa

SEQ ID NO: 6351555 - DNA, 24 bp, Homo sapiens
taaatgttgcacatcattcattca

SEQ ID NO: 6351556 - DNA, 17 bp, Homo sapiens
taaatgttggaatgtta

SEQ ID NO: 6351557 - DNA, 20 bp, Homo sapiens
taaatgttggaattttcaaa

SEQ ID NO: 6351558 - DNA, 12 bp, Homo sapiens
taaatgtttaaa

SEQ ID NO: 6351559 - DNA, 11 bp, Homo sapiens
taaatgtttac

SEQ ID NO: 6351560 - DNA, 19 bp, Homo sapiens
taaatgtttatactgtatt

SEQ ID NO: 6351561 - DNA, 20 bp, Homo sapiens
taaatgtttcaaaatagaca

SEQ ID NO: 6351562 - DNA, 22 bp, Homo sapiens
taaatgtttcaaaatagacaag

SEQ ID NO: 6351563 - DNA, 14 bp, Homo sapiens
taaatgtttccccc

SEQ ID NO: 6351564 - DNA, 19 bp, Homo sapiens
taaatgtttcccccactcc

SEQ ID NO: 6351565 - DNA, 18 bp, Homo sapiens
taaatgtttcttttccct

SEQ ID NO: 6351566 - DNA, 19 bp, Homo sapiens
taaatgtttcttttccctt

SEQ ID NO: 6351567 - DNA, 17 bp, Homo sapiens
taaatgtttgacacaat

SEQ ID NO: 6351568 - DNA, 22 bp, Homo sapiens
taaatgtttgacacaattggaa

SEQ ID NO: 6351569 - DNA, 14 bp, Homo sapiens
taaatgtttgttga

SEQ ID NO: 6351570 - DNA, 15 bp, Homo sapiens
taaatgtttgttgaa

SEQ ID NO: 6351571 - DNA, 15 bp, Homo sapiens
taaatgttttacaac

SEQ ID NO: 6351572 - DNA, 21 bp, Homo sapiens
taaatgttttacaagaattgt

SEQ ID NO: 6351573 - DNA, 16 bp, Homo sapiens
taaatgttttataagt

SEQ ID NO: 6351574 - DNA, 19 bp, Homo sapiens
taaatgttttataagttca

SEQ ID NO: 6351575 - DNA, 13 bp, Homo sapiens
taaatgttttcat

SEQ ID NO: 6351576 - DNA, 14 bp, Homo sapiens
taaatgttttcatt

SEQ ID NO: 6351577 - DNA, 11 bp, Homo sapiens
taaatgttttg

SEQ ID NO: 6351578 - DNA, 20 bp, Homo sapiens
taaatgttttgccagccact

SEQ ID NO: 6351579 - DNA, 13 bp, Homo sapiens
taaatgttttgga

SEQ ID NO: 6351580 - DNA, 21 bp, Homo sapiens
taaatgttttggaattcaatg

SEQ ID NO: 6351581 - DNA, 20 bp, Homo sapiens
taaatgtttttattaacaat

SEQ ID NO: 6351582 - DNA, 23 bp, Homo sapiens
taaatgtttttttttaaagactt

SEQ ID NO: 6351583 - DNA, 20 bp, Homo sapiens
taaattaaaaaggaaagaaa

SEQ ID NO: 6351584 - DNA, 12 bp, Homo sapiens
taaattaaacaa

SEQ ID NO: 6351585 - DNA, 14 bp, Homo sapiens
taaattaaacaatt

SEQ ID NO: 6351586 - DNA, 18 bp, Homo sapiens
taaattaaacatgctgtt

SEQ ID NO: 6351587 - DNA, 17 bp, Homo sapiens
taaattaaataaactgt

SEQ ID NO: 6351588 - DNA, 14 bp, Homo sapiens
taaattaaatatat

SEQ ID NO: 6351589 - DNA, 21 bp, Homo sapiens
taaattaaatatatgtatgta

SEQ ID NO: 6351590 - DNA, 16 bp, Homo sapiens
taaattaacaaattca

SEQ ID NO: 6351591 - DNA, 19 bp, Homo sapiens
taaattaacaaattcagtg

SEQ ID NO: 6351592 - DNA, 21 bp, Homo sapiens
taaattaactcaccagattta

SEQ ID NO: 6351593 - DNA, 20 bp, Homo sapiens
taaattaacttttataaact

SEQ ID NO: 6351594 - DNA, 22 bp, Homo sapiens
taaattaacttttataaacttt

SEQ ID NO: 6351595 - DNA, 12 bp, Homo sapiens
taaattaagaca

SEQ ID NO: 6351596 - DNA, 14 bp, Homo sapiens
taaattaagacttt

SEQ ID NO: 6351597 - DNA, 17 bp, Homo sapiens
taaattaagactttaaa

SEQ ID NO: 6351598 - DNA, 15 bp, Homo sapiens
taaattaatacataa

SEQ ID NO: 6351599 - DNA, 11 bp, Homo sapiens
taaattaatat

SEQ ID NO: 6351600 - DNA, 16 bp, Homo sapiens
taaattaatgattctg

SEQ ID NO: 6351601 - DNA, 18 bp, Homo sapiens
taaattaatttttcaatt

SEQ ID NO: 6351602 - DNA, 19 bp, Homo sapiens
taaattaatttttcaattt

SEQ ID NO: 6351603 - DNA, 19 bp, Homo sapiens
taaattacaattgtcattt

SEQ ID NO: 6351604 - DNA, 23 bp, Homo sapiens
taaattacaattttatctgtttc

SEQ ID NO: 6351605 - DNA, 19 bp, Homo sapiens
taaattacacaataaagca

SEQ ID NO: 6351606 - DNA, 16 bp, Homo sapiens
taaattacagaaattt

SEQ ID NO: 6351607 - DNA, 18 bp, Homo sapiens
taaattacagcttttatg

SEQ ID NO: 6351608 - DNA, 14 bp, Homo sapiens
taaattacatgcat

SEQ ID NO: 6351609 - DNA, 15 bp, Homo sapiens
taaattacatgcatg

SEQ ID NO: 6351610 - DNA, 13 bp, Homo sapiens
taaattacattaa

SEQ ID NO: 6351611 - DNA, 15 bp, Homo sapiens
taaattacatttgta

SEQ ID NO: 6351612 - DNA, 18 bp, Homo sapiens
taaattacctttacatat

SEQ ID NO: 6351613 - DNA, 21 bp, Homo sapiens
taaattacgtaggtttaagac

SEQ ID NO: 6351614 - DNA, 16 bp, Homo sapiens
taaattacgtatgcaa

SEQ ID NO: 6351615 - DNA, 21 bp, Homo sapiens
taaattacgtatgcaagtctg

SEQ ID NO: 6351616 - DNA, 19 bp, Homo sapiens
taaattactatctgttgaa

SEQ ID NO: 6351617 - DNA, 14 bp, Homo sapiens
taaattactgtttt

SEQ ID NO: 6351618 - DNA, 12 bp, Homo sapiens
taaattacttaa

SEQ ID NO: 6351619 - DNA, 18 bp, Homo sapiens
taaattagaaaatattct

SEQ ID NO: 6351620 - DNA, 14 bp, Homo sapiens
taaattaggaataa

SEQ ID NO: 6351621 - DNA, 21 bp, Homo sapiens
taaattaggaataaataaaaa

SEQ ID NO: 6351622 - DNA, 17 bp, Homo sapiens
taaattagtaatgtact

SEQ ID NO: 6351623 - DNA, 18 bp, Homo sapiens
taaattagttcagccatt

SEQ ID NO: 6351624 - DNA, 17 bp, Homo sapiens
taaattagtttaaaatg

SEQ ID NO: 6351625 - DNA, 13 bp, Homo sapiens
taaattataaatg

SEQ ID NO: 6351626 - DNA, 21 bp, Homo sapiens
taaattataaatgtttcatga

SEQ ID NO: 6351627 - DNA, 22 bp, Homo sapiens
taaattataaatgtttcatgaa

SEQ ID NO: 6351628 - DNA, 22 bp, Homo sapiens
taaattataacttaaaatattt

SEQ ID NO: 6351629 - DNA, 16 bp, Homo sapiens
taaattatactggaga

SEQ ID NO: 6351630 - DNA, 19 bp, Homo sapiens
taaattatagtgtagaaaa

SEQ ID NO: 6351631 - DNA, 14 bp, Homo sapiens
taaattatatattt

SEQ ID NO: 6351632 - DNA, 22 bp, Homo sapiens
taaattatatgatatgcatgta

SEQ ID NO: 6351633 - DNA, 17 bp, Homo sapiens
taaattatatttgtgct

SEQ ID NO: 6351634 - DNA, 17 bp, Homo sapiens
taaattatcttatgaaa

SEQ ID NO: 6351635 - DNA, 18 bp, Homo sapiens
taaattatcttatgaaaa

SEQ ID NO: 6351636 - DNA, 14 bp, Homo sapiens
taaattatgaagga

SEQ ID NO: 6351637 - DNA, 16 bp, Homo sapiens
taaattatgaaggacc

SEQ ID NO: 6351638 - DNA, 13 bp, Homo sapiens
taaattatgaatg

SEQ ID NO: 6351639 - DNA, 14 bp, Homo sapiens
taaattatgaatga

SEQ ID NO: 6351640 - DNA, 14 bp, Homo sapiens
taaattatgagatt

SEQ ID NO: 6351641 - DNA, 23 bp, Homo sapiens
taaattatgagctatcctttcaa

SEQ ID NO: 6351642 - DNA, 20 bp, Homo sapiens
taaattatgggaatcaagat

SEQ ID NO: 6351643 - DNA, 17 bp, Homo sapiens
taaattatgtaatgcaa

SEQ ID NO: 6351644 - DNA, 19 bp, Homo sapiens
taaattatgtaatgcaaaa

SEQ ID NO: 6351645 - DNA, 15 bp, Homo sapiens
taaattatgtttata

SEQ ID NO: 6351646 - DNA, 20 bp, Homo sapiens
taaattatgtttatataaat

SEQ ID NO: 6351647 - DNA, 21 bp, Homo sapiens
taaattatgtttgtactagtt

SEQ ID NO: 6351648 - DNA, 14 bp, Homo sapiens
taaattattaagca

SEQ ID NO: 6351649 - DNA, 23 bp, Homo sapiens
taaattattagagattttctctt

SEQ ID NO: 6351650 - DNA, 22 bp, Homo sapiens
taaattattagcatttgtttta

SEQ ID NO: 6351651 - DNA, 22 bp, Homo sapiens
taaattattatcttcttaacag

SEQ ID NO: 6351652 - DNA, 17 bp, Homo sapiens
taaattattcagttaag

SEQ ID NO: 6351653 - DNA, 23 bp, Homo sapiens
taaattattgaggggactaggct

SEQ ID NO: 6351654 - DNA, 14 bp, Homo sapiens
taaattattgatga

SEQ ID NO: 6351655 - DNA, 17 bp, Homo sapiens
taaattattgatgaaaa

SEQ ID NO: 6351656 - DNA, 13 bp, Homo sapiens
taaattattgtaa

SEQ ID NO: 6351657 - DNA, 14 bp, Homo sapiens
taaattattgtaaa

SEQ ID NO: 6351658 - DNA, 16 bp, Homo sapiens
taaattattgtaaact

SEQ ID NO: 6351659 - DNA, 13 bp, Homo sapiens
taaattatttatg

SEQ ID NO: 6351660 - DNA, 14 bp, Homo sapiens
taaattatttcata

SEQ ID NO: 6351661 - DNA, 15 bp, Homo sapiens
taaattatttctaaa

SEQ ID NO: 6351662 - DNA, 20 bp, Homo sapiens
taaattatttgattatttaa

SEQ ID NO: 6351663 - DNA, 20 bp, Homo sapiens
taaattatttgctaagcata

SEQ ID NO: 6351664 - DNA, 21 bp, Homo sapiens
taaattatttgctaagcatat

SEQ ID NO: 6351665 - DNA, 16 bp, Homo sapiens
taaattattttaaatt

SEQ ID NO: 6351666 - DNA, 19 bp, Homo sapiens
taaattattttatatcata

SEQ ID NO: 6351667 - DNA, 14 bp, Homo sapiens
taaattattttatg

SEQ ID NO: 6351668 - DNA, 21 bp, Homo sapiens
taaattcaacacttattttct

SEQ ID NO: 6351669 - DNA, 20 bp, Homo sapiens
taaattcaaccactgtaaaa

SEQ ID NO: 6351670 - DNA, 23 bp, Homo sapiens
taaattcaaccactgtaaaatga

SEQ ID NO: 6351671 - DNA, 16 bp, Homo sapiens
taaattcactgttgaa

SEQ ID NO: 6351672 - DNA, 12 bp, Homo sapiens
taaattcagaca

SEQ ID NO: 6351673 - DNA, 22 bp, Homo sapiens
taaattcagacaacattatgat

SEQ ID NO: 6351674 - DNA, 18 bp, Homo sapiens
taaattcagatatatttt

SEQ ID NO: 6351675 - DNA, 15 bp, Homo sapiens
taaattcatcagaat

SEQ ID NO: 6351676 - DNA, 21 bp, Homo sapiens
taaattcatttctagactcaa

SEQ ID NO: 6351677 - DNA, 13 bp, Homo sapiens
taaattcatttta

SEQ ID NO: 6351678 - DNA, 16 bp, Homo sapiens
taaattccaaagatct

SEQ ID NO: 6351679 - DNA, 20 bp, Homo sapiens
taaattccaaagatctgaat

SEQ ID NO: 6351680 - DNA, 19 bp, Homo sapiens
taaattccaatacaagtta

SEQ ID NO: 6351681 - DNA, 15 bp, Homo sapiens
taaattccactgaaa

SEQ ID NO: 6351682 - DNA, 17 bp, Homo sapiens
taaattccactgaaaat

SEQ ID NO: 6351683 - DNA, 18 bp, Homo sapiens
taaattccactgaaaatt

SEQ ID NO: 6351684 - DNA, 13 bp, Homo sapiens
taaattccactgg

SEQ ID NO: 6351685 - DNA, 16 bp, Homo sapiens
taaattccactggact

SEQ ID NO: 6351686 - DNA, 22 bp, Homo sapiens
taaattccagaggactctgctt

SEQ ID NO: 6351687 - DNA, 18 bp, Homo sapiens
taaattcccaaatcctag

SEQ ID NO: 6351688 - DNA, 19 bp, Homo sapiens
taaattcctaattctatga

SEQ ID NO: 6351689 - DNA, 20 bp, Homo sapiens
taaattcctctttgctttgc

SEQ ID NO: 6351690 - DNA, 13 bp, Homo sapiens
taaattctaaatt

SEQ ID NO: 6351691 - DNA, 19 bp, Homo sapiens
taaattctactaagttatt

SEQ ID NO: 6351692 - DNA, 19 bp, Homo sapiens
taaattctatgttaaatac

SEQ ID NO: 6351693 - DNA, 20 bp, Homo sapiens
taaattctatgttaaatact

SEQ ID NO: 6351694 - DNA, 22 bp, Homo sapiens
taaattctctctcttgcaggaa

SEQ ID NO: 6351695 - DNA, 14 bp, Homo sapiens
taaattctctttca

SEQ ID NO: 6351696 - DNA, 17 bp, Homo sapiens
taaattctgagcctgat

SEQ ID NO: 6351697 - DNA, 11 bp, Homo sapiens
taaattctgat

SEQ ID NO: 6351698 - DNA, 16 bp, Homo sapiens
taaattctgattcttc

SEQ ID NO: 6351699 - DNA, 15 bp, Homo sapiens
taaattctgctcctg

SEQ ID NO: 6351700 - DNA, 20 bp, Homo sapiens
taaattctggaaatgtcttt

SEQ ID NO: 6351701 - DNA, 17 bp, Homo sapiens
taaattctggtatacat

SEQ ID NO: 6351702 - DNA, 20 bp, Homo sapiens
taaattctgttagctgctca

SEQ ID NO: 6351703 - DNA, 21 bp, Homo sapiens
taaattctgttagctgctcac

SEQ ID NO: 6351704 - DNA, 14 bp, Homo sapiens
taaattctgttgaa

SEQ ID NO: 6351705 - DNA, 22 bp, Homo sapiens
taaattcttaaaactttctaaa

SEQ ID NO: 6351706 - DNA, 22 bp, Homo sapiens
taaattcttgcaaagtatccct

SEQ ID NO: 6351707 - DNA, 13 bp, Homo sapiens
taaattctttatt

SEQ ID NO: 6351708 - DNA, 15 bp, Homo sapiens
taaattgaagaaagt

SEQ ID NO: 6351709 - DNA, 22 bp, Homo sapiens
taaattgaatcagtataaacaa

SEQ ID NO: 6351710 - DNA, 23 bp, Homo sapiens
taaattgacacttaaaaatggtt

SEQ ID NO: 6351711 - DNA, 12 bp, Homo sapiens
taaattgactgt

SEQ ID NO: 6351712 - DNA, 12 bp, Homo sapiens
taaattgatgtt

SEQ ID NO: 6351713 - DNA, 13 bp, Homo sapiens
taaattgatgttg

SEQ ID NO: 6351714 - DNA, 19 bp, Homo sapiens
taaattgatgttgatgcaa

SEQ ID NO: 6351715 - DNA, 20 bp, Homo sapiens
taaattgatgttgatgcaat

SEQ ID NO: 6351716 - DNA, 16 bp, Homo sapiens
taaattgattgaatta

SEQ ID NO: 6351717 - DNA, 22 bp, Homo sapiens
taaattgatttttataaatact

SEQ ID NO: 6351718 - DNA, 17 bp, Homo sapiens
taaattgcacgtgcaat

SEQ ID NO: 6351719 - DNA, 19 bp, Homo sapiens
taaattgcagaattcaaaa

SEQ ID NO: 6351720 - DNA, 19 bp, Homo sapiens
taaattgcatcactgtatc

SEQ ID NO: 6351721 - DNA, 22 bp, Homo sapiens
taaattgccataatatgatgca

SEQ ID NO: 6351722 - DNA, 15 bp, Homo sapiens
taaattgcctccctt

SEQ ID NO: 6351723 - DNA, 17 bp, Homo sapiens
taaattgcctcccttcc

SEQ ID NO: 6351724 - DNA, 24 bp, Homo sapiens
taaattgctcacagttattacata

SEQ ID NO: 6351725 - DNA, 17 bp, Homo sapiens
taaattgctttctatat

SEQ ID NO: 6351726 - DNA, 23 bp, Homo sapiens
taaattgcttttgttgtgacttt

SEQ ID NO: 6351727 - DNA, 15 bp, Homo sapiens
taaattggaaacatt

SEQ ID NO: 6351728 - DNA, 19 bp, Homo sapiens
taaattggaatttaaaaat

SEQ ID NO: 6351729 - DNA, 13 bp, Homo sapiens
taaattggagaaa

SEQ ID NO: 6351730 - DNA, 20 bp, Homo sapiens
taaattggagaaaagcactt

SEQ ID NO: 6351731 - DNA, 21 bp, Homo sapiens
taaattggagttttaaaaatg

SEQ ID NO: 6351732 - DNA, 16 bp, Homo sapiens
taaattggattatttt

SEQ ID NO: 6351733 - DNA, 21 bp, Homo sapiens
taaattggcatggaaatttaa

SEQ ID NO: 6351734 - DNA, 14 bp, Homo sapiens
taaattggctcctt

SEQ ID NO: 6351735 - DNA, 19 bp, Homo sapiens
taaattggctcctttccca

SEQ ID NO: 6351736 - DNA, 20 bp, Homo sapiens
taaattgggcttcaatcact

SEQ ID NO: 6351737 - DNA, 21 bp, Homo sapiens
taaattgggttcatgatgcag

SEQ ID NO: 6351738 - DNA, 17 bp, Homo sapiens
taaattggtattaacta

SEQ ID NO: 6351739 - DNA, 21 bp, Homo sapiens
taaattggtgataagtggaaa

SEQ ID NO: 6351740 - DNA, 17 bp, Homo sapiens
taaattgtaaattttag

SEQ ID NO: 6351741 - DNA, 13 bp, Homo sapiens
taaattgtaattt

SEQ ID NO: 6351742 - DNA, 21 bp, Homo sapiens
taaattgtaatttgggaacat

SEQ ID NO: 6351743 - DNA, 13 bp, Homo sapiens
taaattgtacatt

SEQ ID NO: 6351744 - DNA, 21 bp, Homo sapiens
taaattgtacattttgtaaaa

SEQ ID NO: 6351745 - DNA, 20 bp, Homo sapiens
taaattgtaccatcatttta

SEQ ID NO: 6351746 - DNA, 17 bp, Homo sapiens
taaattgtatattcact

SEQ ID NO: 6351747 - DNA, 18 bp, Homo sapiens
taaattgtattctcataa

SEQ ID NO: 6351748 - DNA, 20 bp, Homo sapiens
taaattgtattctcataata

SEQ ID NO: 6351749 - DNA, 23 bp, Homo sapiens
taaattgtccgtgttcatacatt

SEQ ID NO: 6351750 - DNA, 15 bp, Homo sapiens
taaattgtctttaaa

SEQ ID NO: 6351751 - DNA, 16 bp, Homo sapiens
taaattgtctttaaaa

SEQ ID NO: 6351752 - DNA, 12 bp, Homo sapiens
taaattgtggat

SEQ ID NO: 6351753 - DNA, 18 bp, Homo sapiens
taaattgttgtaattgca

SEQ ID NO: 6351754 - DNA, 20 bp, Homo sapiens
taaattgtttagtggaaaat

SEQ ID NO: 6351755 - DNA, 16 bp, Homo sapiens
taaatttaaaacaatg

SEQ ID NO: 6351756 - DNA, 21 bp, Homo sapiens
taaatttaaaacacagtattg

SEQ ID NO: 6351757 - DNA, 18 bp, Homo sapiens
taaatttaaacttacaaa

SEQ ID NO: 6351758 - DNA, 20 bp, Homo sapiens
taaatttaaagatattgttc

SEQ ID NO: 6351759 - DNA, 13 bp, Homo sapiens
taaatttaaattt

SEQ ID NO: 6351760 - DNA, 13 bp, Homo sapiens
taaatttaagaaa

SEQ ID NO: 6351761 - DNA, 23 bp, Homo sapiens
taaatttaagaaaacaagtatat

SEQ ID NO: 6351762 - DNA, 13 bp, Homo sapiens
taaatttaatgta

SEQ ID NO: 6351763 - DNA, 16 bp, Homo sapiens
taaatttacgtatatt

SEQ ID NO: 6351764 - DNA, 19 bp, Homo sapiens
taaatttacgtatatttca

SEQ ID NO: 6351765 - DNA, 18 bp, Homo sapiens
taaatttactctgttgaa

SEQ ID NO: 6351766 - DNA, 20 bp, Homo sapiens
taaatttaggtaaataaagc

SEQ ID NO: 6351767 - DNA, 22 bp, Homo sapiens
taaatttaggtaaataaagctc

SEQ ID NO: 6351768 - DNA, 19 bp, Homo sapiens
taaatttatatactttttg

SEQ ID NO: 6351769 - DNA, 20 bp, Homo sapiens
taaatttatattcataaagt

SEQ ID NO: 6351770 - DNA, 13 bp, Homo sapiens
taaatttatcaac

SEQ ID NO: 6351771 - DNA, 18 bp, Homo sapiens
taaatttatgacctgctg

SEQ ID NO: 6351772 - DNA, 16 bp, Homo sapiens
taaatttattaaataa

SEQ ID NO: 6351773 - DNA, 16 bp, Homo sapiens
taaatttattaaatgt

SEQ ID NO: 6351774 - DNA, 15 bp, Homo sapiens
taaatttatttactg

SEQ ID NO: 6351775 - DNA, 16 bp, Homo sapiens
taaatttatttgaaaa

SEQ ID NO: 6351776 - DNA, 14 bp, Homo sapiens
taaatttcaaatgc

SEQ ID NO: 6351777 - DNA, 15 bp, Homo sapiens
taaatttcaaatgca

SEQ ID NO: 6351778 - DNA, 21 bp, Homo sapiens
taaatttcaattagatttaaa

SEQ ID NO: 6351779 - DNA, 18 bp, Homo sapiens
taaatttcacaatataaa

SEQ ID NO: 6351780 - DNA, 16 bp, Homo sapiens
taaatttcagctttgg

SEQ ID NO: 6351781 - DNA, 23 bp, Homo sapiens
taaatttccacccaatttccaag

SEQ ID NO: 6351782 - DNA, 21 bp, Homo sapiens
taaatttccatatccttctgg

SEQ ID NO: 6351783 - DNA, 17 bp, Homo sapiens
taaatttccccaacagt

SEQ ID NO: 6351784 - DNA, 22 bp, Homo sapiens
taaatttccccaacagtgtgaa

SEQ ID NO: 6351785 - DNA, 13 bp, Homo sapiens
taaatttctcagt

SEQ ID NO: 6351786 - DNA, 21 bp, Homo sapiens
taaatttctctttttgaaaaa

SEQ ID NO: 6351787 - DNA, 15 bp, Homo sapiens
taaatttctgccaag

SEQ ID NO: 6351788 - DNA, 11 bp, Homo sapiens
taaatttctgg

SEQ ID NO: 6351789 - DNA, 14 bp, Homo sapiens
taaatttctgggat

SEQ ID NO: 6351790 - DNA, 16 bp, Homo sapiens
taaatttcttatgtga

SEQ ID NO: 6351791 - DNA, 11 bp, Homo sapiens
taaatttcttt

SEQ ID NO: 6351792 - DNA, 19 bp, Homo sapiens
taaatttcttttattaata

SEQ ID NO: 6351793 - DNA, 20 bp, Homo sapiens
taaatttcttttattaatac

SEQ ID NO: 6351794 - DNA, 16 bp, Homo sapiens
taaatttgaactccat

SEQ ID NO: 6351795 - DNA, 21 bp, Homo sapiens
taaatttgaactccatgggat

SEQ ID NO: 6351796 - DNA, 14 bp, Homo sapiens
taaatttgaatgtt

SEQ ID NO: 6351797 - DNA, 18 bp, Homo sapiens
taaatttgatacttatat

SEQ ID NO: 6351798 - DNA, 16 bp, Homo sapiens
taaatttgatggttga

SEQ ID NO: 6351799 - DNA, 17 bp, Homo sapiens
taaatttgatggttgaa

SEQ ID NO: 6351800 - DNA, 14 bp, Homo sapiens
taaatttgatttcc

SEQ ID NO: 6351801 - DNA, 23 bp, Homo sapiens
taaatttgccagttttattttct

SEQ ID NO: 6351802 - DNA, 14 bp, Homo sapiens
taaatttggcttct

SEQ ID NO: 6351803 - DNA, 17 bp, Homo sapiens
taaatttggcttctgtt

SEQ ID NO: 6351804 - DNA, 20 bp, Homo sapiens
taaatttggggacagattca

SEQ ID NO: 6351805 - DNA, 13 bp, Homo sapiens
taaatttgtaagt

SEQ ID NO: 6351806 - DNA, 16 bp, Homo sapiens
taaatttgtaagtttc

SEQ ID NO: 6351807 - DNA, 17 bp, Homo sapiens
taaatttgtaagtttca

SEQ ID NO: 6351808 - DNA, 15 bp, Homo sapiens
taaatttgtaatata

SEQ ID NO: 6351809 - DNA, 14 bp, Homo sapiens
taaatttgtactat

SEQ ID NO: 6351810 - DNA, 23 bp, Homo sapiens
taaatttgtccaatggctgtaaa

SEQ ID NO: 6351811 - DNA, 16 bp, Homo sapiens
taaatttgtctttcaa

SEQ ID NO: 6351812 - DNA, 17 bp, Homo sapiens
taaatttgtctttcaag

SEQ ID NO: 6351813 - DNA, 23 bp, Homo sapiens
taaatttgtgtaatattacttta

SEQ ID NO: 6351814 - DNA, 20 bp, Homo sapiens
taaatttgttctttgtttag

SEQ ID NO: 6351815 - DNA, 23 bp, Homo sapiens
taaatttgttgtcatgtgtatga

SEQ ID NO: 6351816 - DNA, 12 bp, Homo sapiens
taaattttaaag

SEQ ID NO: 6351817 - DNA, 16 bp, Homo sapiens
taaattttaaagccat

SEQ ID NO: 6351818 - DNA, 11 bp, Homo sapiens
taaattttaat

SEQ ID NO: 6351819 - DNA, 15 bp, Homo sapiens
taaattttaatgtta

SEQ ID NO: 6351820 - DNA, 20 bp, Homo sapiens
taaattttaatgttaacttt

SEQ ID NO: 6351821 - DNA, 17 bp, Homo sapiens
taaattttaattcaaga

SEQ ID NO: 6351822 - DNA, 15 bp, Homo sapiens
taaattttaatttat

SEQ ID NO: 6351823 - DNA, 18 bp, Homo sapiens
taaattttaccctttaga

SEQ ID NO: 6351824 - DNA, 19 bp, Homo sapiens
taaattttataatgtcata

SEQ ID NO: 6351825 - DNA, 15 bp, Homo sapiens
taaattttatatcat

SEQ ID NO: 6351826 - DNA, 21 bp, Homo sapiens
taaattttatatcattttaaa

SEQ ID NO: 6351827 - DNA, 19 bp, Homo sapiens
taaattttattaaacaatt

SEQ ID NO: 6351828 - DNA, 11 bp, Homo sapiens
taaattttcac

SEQ ID NO: 6351829 - DNA, 15 bp, Homo sapiens
taaattttcagaaag

SEQ ID NO: 6351830 - DNA, 18 bp, Homo sapiens
taaattttcatgaatgtg

SEQ ID NO: 6351831 - DNA, 23 bp, Homo sapiens
taaattttcctgtcctctttcag

SEQ ID NO: 6351832 - DNA, 24 bp, Homo sapiens
taaattttcctgtcctctttcagc

SEQ ID NO: 6351833 - DNA, 12 bp, Homo sapiens
taaattttctaa

SEQ ID NO: 6351834 - DNA, 14 bp, Homo sapiens
taaattttctaaat

SEQ ID NO: 6351835 - DNA, 11 bp, Homo sapiens
taaattttctc

SEQ ID NO: 6351836 - DNA, 14 bp, Homo sapiens
taaattttctccag

SEQ ID NO: 6351837 - DNA, 19 bp, Homo sapiens
taaattttctctaaactgt

SEQ ID NO: 6351838 - DNA, 21 bp, Homo sapiens
taaattttctctaaactgttt

SEQ ID NO: 6351839 - DNA, 22 bp, Homo sapiens
taaattttctctaaactgtttc

SEQ ID NO: 6351840 - DNA, 16 bp, Homo sapiens
taaattttcttcagtt

SEQ ID NO: 6351841 - DNA, 18 bp, Homo sapiens
taaattttcttcagttgg

SEQ ID NO: 6351842 - DNA, 19 bp, Homo sapiens
taaattttcttttaagcat

SEQ ID NO: 6351843 - DNA, 15 bp, Homo sapiens
taaattttgaatgtt

SEQ ID NO: 6351844 - DNA, 19 bp, Homo sapiens
taaattttgagttctacat

SEQ ID NO: 6351845 - DNA, 13 bp, Homo sapiens
taaattttggaag

SEQ ID NO: 6351846 - DNA, 22 bp, Homo sapiens
taaattttggaagaattcatga

SEQ ID NO: 6351847 - DNA, 17 bp, Homo sapiens
gtataagtaagaaaata

SEQ ID NO: 6351848 - DNA, 23 bp, Homo sapiens
gtataagtagatctgctttctgt

SEQ ID NO: 6351849 - DNA, 17 bp, Homo sapiens
gtataagtcaagcacat

SEQ ID NO: 6351850 - DNA, 21 bp, Homo sapiens
gtataagtccatgaatgttca

SEQ ID NO: 6351851 - DNA, 22 bp, Homo sapiens
gtataagtccatgaatgttcat

SEQ ID NO: 6351852 - DNA, 15 bp, Homo sapiens
gtataagtggtgtgt

SEQ ID NO: 6351853 - DNA, 16 bp, Homo sapiens
gtataagttgaaggaa

SEQ ID NO: 6351854 - DNA, 16 bp, Homo sapiens
gtataagttgctgtaa

SEQ ID NO: 6351855 - DNA, 21 bp, Homo sapiens
gtataagttgctgtaaaattt

SEQ ID NO: 6351856 - DNA, 13 bp, Homo sapiens
gtataagttgtat

SEQ ID NO: 6351857 - DNA, 19 bp, Homo sapiens
gtataatacattacatgta

SEQ ID NO: 6351858 - DNA, 20 bp, Homo sapiens
gtataatacattacatgtaa

SEQ ID NO: 6351859 - DNA, 22 bp, Homo sapiens
gtataatactttgtatacaagt

SEQ ID NO: 6351860 - DNA, 17 bp, Homo sapiens
gtataatagagataagt

SEQ ID NO: 6351861 - DNA, 12 bp, Homo sapiens
gtataatataaa

SEQ ID NO: 6351862 - DNA, 18 bp, Homo sapiens
gtataatcccacccacct

SEQ ID NO: 6351863 - DNA, 19 bp, Homo sapiens
gtataatctcctctgctca

SEQ ID NO: 6351864 - DNA, 21 bp, Homo sapiens
gtataatctcctctgctcatt

SEQ ID NO: 6351865 - DNA, 17 bp, Homo sapiens
gtataatcttgtagaca

SEQ ID NO: 6351866 - DNA, 18 bp, Homo sapiens
gtataatcttgtagacac

SEQ ID NO: 6351867 - DNA, 22 bp, Homo sapiens
gtataatcttgtagacacttac

SEQ ID NO: 6351868 - DNA, 15 bp, Homo sapiens
gtataatgaacactc

SEQ ID NO: 6351869 - DNA, 20 bp, Homo sapiens
gtataatgacttttaaaatt

SEQ ID NO: 6351870 - DNA, 19 bp, Homo sapiens
gtataatgtaatgttttta

SEQ ID NO: 6351871 - DNA, 15 bp, Homo sapiens
gtataatgtgtctgt

SEQ ID NO: 6351872 - DNA, 18 bp, Homo sapiens
gtataatgtttaaatcat

SEQ ID NO: 6351873 - DNA, 18 bp, Homo sapiens
gtataatgtttattaaat

SEQ ID NO: 6351874 - DNA, 14 bp, Homo sapiens
gtataattaacatg

SEQ ID NO: 6351875 - DNA, 15 bp, Homo sapiens
gtataattaacatgt

SEQ ID NO: 6351876 - DNA, 17 bp, Homo sapiens
gtataattaacatgtta

SEQ ID NO: 6351877 - DNA, 22 bp, Homo sapiens
gtataattaacatgttaaacca

SEQ ID NO: 6351878 - DNA, 15 bp, Homo sapiens
gtataattaacttaa

SEQ ID NO: 6351879 - DNA, 13 bp, Homo sapiens
gtataattatgaa

SEQ ID NO: 6351880 - DNA, 18 bp, Homo sapiens
gtataattggatttccta

SEQ ID NO: 6351881 - DNA, 19 bp, Homo sapiens
gtataattggatttcctaa

SEQ ID NO: 6351882 - DNA, 14 bp, Homo sapiens
gtataattgtgtga

SEQ ID NO: 6351883 - DNA, 21 bp, Homo sapiens
gtataattgtgtgatatttca

SEQ ID NO: 6351884 - DNA, 22 bp, Homo sapiens
gtataatttgaggtgaaattca

SEQ ID NO: 6351885 - DNA, 19 bp, Homo sapiens
gtataattttaaagtaatt

SEQ ID NO: 6351886 - DNA, 22 bp, Homo sapiens
gtataattttttaaagttactt

SEQ ID NO: 6351887 - DNA, 19 bp, Homo sapiens
gtatacaacaggagagaga

SEQ ID NO: 6351888 - DNA, 18 bp, Homo sapiens
gtatacaacatgatttta

SEQ ID NO: 6351889 - DNA, 17 bp, Homo sapiens
gtatacaactgcctggg

SEQ ID NO: 6351890 - DNA, 18 bp, Homo sapiens
gtatacaagataagcttc

SEQ ID NO: 6351891 - DNA, 15 bp, Homo sapiens
gtatacaatatataa

SEQ ID NO: 6351892 - DNA, 17 bp, Homo sapiens
gtatacaatatataaaa

SEQ ID NO: 6351893 - DNA, 22 bp, Homo sapiens
gtatacaatatataaaaatata

SEQ ID NO: 6351894 - DNA, 14 bp, Homo sapiens
gtatacacacatat

SEQ ID NO: 6351895 - DNA, 15 bp, Homo sapiens
gtatacatatgtatg

SEQ ID NO: 6351896 - DNA, 18 bp, Homo sapiens
gtatacatcctgggtaat

SEQ ID NO: 6351897 - DNA, 19 bp, Homo sapiens
gtatacatgtgtacatata

SEQ ID NO: 6351898 - DNA, 18 bp, Homo sapiens
gtatacattgaattcatt

SEQ ID NO: 6351899 - DNA, 14 bp, Homo sapiens
gtataccaatgtgt

SEQ ID NO: 6351900 - DNA, 22 bp, Homo sapiens
gtataccaatgtgttttctgta

SEQ ID NO: 6351901 - DNA, 14 bp, Homo sapiens
gtataccacctgta

SEQ ID NO: 6351902 - DNA, 14 bp, Homo sapiens
gtataccatacatt

SEQ ID NO: 6351903 - DNA, 15 bp, Homo sapiens
gtataccgtgtgctc

SEQ ID NO: 6351904 - DNA, 15 bp, Homo sapiens
gtatacctcctatat

SEQ ID NO: 6351905 - DNA, 14 bp, Homo sapiens
gtatacgtataaat

SEQ ID NO: 6351906 - DNA, 19 bp, Homo sapiens
gtatactccatagaaacta

SEQ ID NO: 6351907 - DNA, 18 bp, Homo sapiens
gtatactgggggcaaaat

SEQ ID NO: 6351908 - DNA, 17 bp, Homo sapiens
gtatactgtaaaagtta

SEQ ID NO: 6351909 - DNA, 23 bp, Homo sapiens
gtatactgtaaaagttataataa

SEQ ID NO: 6351910 - DNA, 18 bp, Homo sapiens
gtatacttaaaatgacaa

SEQ ID NO: 6351911 - DNA, 16 bp, Homo sapiens
gtatacttaatactga

SEQ ID NO: 6351912 - DNA, 12 bp, Homo sapiens
gtatacttgaaa

SEQ ID NO: 6351913 - DNA, 13 bp, Homo sapiens
gtatactttaaat

SEQ ID NO: 6351914 - DNA, 22 bp, Homo sapiens
gtatactttaaataatttaact

SEQ ID NO: 6351915 - DNA, 16 bp, Homo sapiens
gtatacttttgtttca

SEQ ID NO: 6351916 - DNA, 19 bp, Homo sapiens
gtatagaaaaagcacagct

SEQ ID NO: 6351917 - DNA, 11 bp, Homo sapiens
gtatagaaaat

SEQ ID NO: 6351918 - DNA, 18 bp, Homo sapiens
gtatagaaaattcttgag

SEQ ID NO: 6351919 - DNA, 20 bp, Homo sapiens
gtatagaaaattcttgagaa

SEQ ID NO: 6351920 - DNA, 22 bp, Homo sapiens
gtatagaaatgctggtttttca

SEQ ID NO: 6351921 - DNA, 18 bp, Homo sapiens
gtatagaagtcttcatga

SEQ ID NO: 6351922 - DNA, 21 bp, Homo sapiens
gtatagaagtcttcatgaaat

SEQ ID NO: 6351923 - DNA, 23 bp, Homo sapiens
gtatagaagtcttcatgaaatgc

SEQ ID NO: 6351924 - DNA, 15 bp, Homo sapiens
gtatagaataggcac

SEQ ID NO: 6351925 - DNA, 21 bp, Homo sapiens
gtatagacaggagaagaaaga

SEQ ID NO: 6351926 - DNA, 17 bp, Homo sapiens
gtatagacagtttgtaa

SEQ ID NO: 6351927 - DNA, 19 bp, Homo sapiens
gtatagacagtttgtaaat

SEQ ID NO: 6351928 - DNA, 22 bp, Homo sapiens
gtatagacagtttgtaaatgtt

SEQ ID NO: 6351929 - DNA, 22 bp, Homo sapiens
gtatagaccaaagcaaagaaaa

SEQ ID NO: 6351930 - DNA, 18 bp, Homo sapiens
gtatagatgcaagatatt

SEQ ID NO: 6351931 - DNA, 15 bp, Homo sapiens
gtatagatggccaaa

SEQ ID NO: 6351932 - DNA, 20 bp, Homo sapiens
gtatagcaacctatttgact

SEQ ID NO: 6351933 - DNA, 19 bp, Homo sapiens
gtatagcaatatcaaaagg

SEQ ID NO: 6351934 - DNA, 14 bp, Homo sapiens
gtatagctgtattg

SEQ ID NO: 6351935 - DNA, 15 bp, Homo sapiens
gtatagctgtattga

SEQ ID NO: 6351936 - DNA, 16 bp, Homo sapiens
gtatagctgtattgaa

SEQ ID NO: 6351937 - DNA, 17 bp, Homo sapiens
gtatagctgtattgaat

SEQ ID NO: 6351938 - DNA, 14 bp, Homo sapiens
gtatagcttaagat

SEQ ID NO: 6351939 - DNA, 15 bp, Homo sapiens
gtatagcttacctga

SEQ ID NO: 6351940 - DNA, 15 bp, Homo sapiens
gtataggaatttgta

SEQ ID NO: 6351941 - DNA, 16 bp, Homo sapiens
gtataggacaaggggt

SEQ ID NO: 6351942 - DNA, 17 bp, Homo sapiens
gtataggagccccaggc

SEQ ID NO: 6351943 - DNA, 15 bp, Homo sapiens
gtataggatgtcaga

SEQ ID NO: 6351944 - DNA, 15 bp, Homo sapiens
gtataggccatctgt

SEQ ID NO: 6351945 - DNA, 17 bp, Homo sapiens
gtataggccatctgtaa

SEQ ID NO: 6351946 - DNA, 22 bp, Homo sapiens
gtataggccatctgtaaatatc

SEQ ID NO: 6351947 - DNA, 21 bp, Homo sapiens
gtatagtattggaaaataaaa

SEQ ID NO: 6351948 - DNA, 13 bp, Homo sapiens
gtatagtatttga

SEQ ID NO: 6351949 - DNA, 18 bp, Homo sapiens
gtatagtatttgaaaaca

SEQ ID NO: 6351950 - DNA, 21 bp, Homo sapiens
gtatagtctcccttttataat

SEQ ID NO: 6351951 - DNA, 14 bp, Homo sapiens
gtatagtgtaaaat

SEQ ID NO: 6351952 - DNA, 15 bp, Homo sapiens
gtatagtgtaaaata

SEQ ID NO: 6351953 - DNA, 19 bp, Homo sapiens
gtatagttaggatagcatt

SEQ ID NO: 6351954 - DNA, 22 bp, Homo sapiens
gtatagttatatgtacagttta

SEQ ID NO: 6351955 - DNA, 16 bp, Homo sapiens
gtatagttcacttact

SEQ ID NO: 6351956 - DNA, 23 bp, Homo sapiens
gtatagttcacttactcttacac

SEQ ID NO: 6351957 - DNA, 12 bp, Homo sapiens
gtatagttgctt

SEQ ID NO: 6351958 - DNA, 16 bp, Homo sapiens
gtatagttgcttgcct

SEQ ID NO: 6351959 - DNA, 17 bp, Homo sapiens
gtatagttgcttgcctg

SEQ ID NO: 6351960 - DNA, 23 bp, Homo sapiens
gtatagtttaaaaatctgccacc

SEQ ID NO: 6351961 - DNA, 17 bp, Homo sapiens
gtatagtttaaagggag

SEQ ID NO: 6351962 - DNA, 14 bp, Homo sapiens
gtatataaaaatgg

SEQ ID NO: 6351963 - DNA, 14 bp, Homo sapiens
gtatataaaatgtg

SEQ ID NO: 6351964 - DNA, 22 bp, Homo sapiens
gtatataaaggaaaaaagagaa

SEQ ID NO: 6351965 - DNA, 15 bp, Homo sapiens
gtatataaagttaca

SEQ ID NO: 6351966 - DNA, 21 bp, Homo sapiens
gtatataaatgggaacattta

SEQ ID NO: 6351967 - DNA, 15 bp, Homo sapiens
gtatataacttattt

SEQ ID NO: 6351968 - DNA, 16 bp, Homo sapiens
gtatataagctgttta

SEQ ID NO: 6351969 - DNA, 21 bp, Homo sapiens
gtatataagtactgaccactg

SEQ ID NO: 6351970 - DNA, 13 bp, Homo sapiens
gtatataataact

SEQ ID NO: 6351971 - DNA, 17 bp, Homo sapiens
gtatataataactttat

SEQ ID NO: 6351972 - DNA, 15 bp, Homo sapiens
gtatataatatgtca

SEQ ID NO: 6351973 - DNA, 20 bp, Homo sapiens
gtatataatggtttcaaaga

SEQ ID NO: 6351974 - DNA, 12 bp, Homo sapiens
gtatatacacat

SEQ ID NO: 6351975 - DNA, 18 bp, Homo sapiens
gtatatacagagcctgtt

SEQ ID NO: 6351976 - DNA, 14 bp, Homo sapiens
gtatatacatatta

SEQ ID NO: 6351977 - DNA, 11 bp, Homo sapiens
gtatatacatt

SEQ ID NO: 6351978 - DNA, 23 bp, Homo sapiens
gtatatactttgaaaggagatgt

SEQ ID NO: 6351979 - DNA, 12 bp, Homo sapiens
gtatatactttt

SEQ ID NO: 6351980 - DNA, 19 bp, Homo sapiens
gtatatacttttaaattat

SEQ ID NO: 6351981 - DNA, 13 bp, Homo sapiens
gtatatacttttt

SEQ ID NO: 6351982 - DNA, 19 bp, Homo sapiens
gtatatagatgtctgtgta

SEQ ID NO: 6351983 - DNA, 14 bp, Homo sapiens
gtatatagtatatt

SEQ ID NO: 6351984 - DNA, 18 bp, Homo sapiens
gtatatagtatatttata

SEQ ID NO: 6351985 - DNA, 15 bp, Homo sapiens
gtatatataagaaag

SEQ ID NO: 6351986 - DNA, 15 bp, Homo sapiens
gtatatatatatagt

SEQ ID NO: 6351987 - DNA, 21 bp, Homo sapiens
gtatatatatatagtaactac

SEQ ID NO: 6351988 - DNA, 23 bp, Homo sapiens
gtatatatatatatatgtacagt

SEQ ID NO: 6351989 - DNA, 19 bp, Homo sapiens
gtatatatatatatattga

SEQ ID NO: 6351990 - DNA, 14 bp, Homo sapiens
gtatatatatatgt

SEQ ID NO: 6351991 - DNA, 20 bp, Homo sapiens
gtatatatatgccatgatgg

SEQ ID NO: 6351992 - DNA, 12 bp, Homo sapiens
gtatatatattc

SEQ ID NO: 6351993 - DNA, 13 bp, Homo sapiens
gtatatatattca

SEQ ID NO: 6351994 - DNA, 20 bp, Homo sapiens
gtatatatatttatatatat

SEQ ID NO: 6351995 - DNA, 22 bp, Homo sapiens
gtatatatatttatatatatga

SEQ ID NO: 6351996 - DNA, 11 bp, Homo sapiens
gtatatatctt

SEQ ID NO: 6351997 - DNA, 15 bp, Homo sapiens
gtatatatgtacagt

SEQ ID NO: 6351998 - DNA, 16 bp, Homo sapiens
gtatatatgtgtgttt

SEQ ID NO: 6351999 - DNA, 18 bp, Homo sapiens
gtatatatgtgtgtttaa

SEQ ID NO: 6352000 - DNA, 20 bp, Homo sapiens
gtatatatgtgtgtttaaat

SEQ ID NO: 6352001 - DNA, 23 bp, Homo sapiens
gtatatattcccctaagatttga

SEQ ID NO: 6352002 - DNA, 14 bp, Homo sapiens
gtatatatttaaaa

SEQ ID NO: 6352003 - DNA, 21 bp, Homo sapiens
gtatatattttatatgttcat

SEQ ID NO: 6352004 - DNA, 17 bp, Homo sapiens
gtatatatttttcttat

SEQ ID NO: 6352005 - DNA, 21 bp, Homo sapiens
gtatatcactaaaagcatgaa

SEQ ID NO: 6352006 - DNA, 19 bp, Homo sapiens
gtatatcagaaaagggaag

SEQ ID NO: 6352007 - DNA, 14 bp, Homo sapiens
gtatatcagctcta

SEQ ID NO: 6352008 - DNA, 22 bp, Homo sapiens
gtatatcagctctaaagcagag

SEQ ID NO: 6352009 - DNA, 14 bp, Homo sapiens
gtatatcagggttt

SEQ ID NO: 6352010 - DNA, 21 bp, Homo sapiens
gtatatcattctacagaataa

SEQ ID NO: 6352011 - DNA, 22 bp, Homo sapiens
gtatatcattctacagaataat

SEQ ID NO: 6352012 - DNA, 19 bp, Homo sapiens
gtatatctcaacagaatta

SEQ ID NO: 6352013 - DNA, 13 bp, Homo sapiens
gtatatctctgta

SEQ ID NO: 6352014 - DNA, 12 bp, Homo sapiens
gtatatgaaaac

SEQ ID NO: 6352015 - DNA, 14 bp, Homo sapiens
gtatatgaaaacaa

SEQ ID NO: 6352016 - DNA, 20 bp, Homo sapiens
gtatatgattataatgctat

SEQ ID NO: 6352017 - DNA, 17 bp, Homo sapiens
gtatatgattctctgtg

SEQ ID NO: 6352018 - DNA, 17 bp, Homo sapiens
gtatatgcacaaaacta

SEQ ID NO: 6352019 - DNA, 13 bp, Homo sapiens
gtatatgctgcat

SEQ ID NO: 6352020 - DNA, 15 bp, Homo sapiens
gtatatgctgcattg

SEQ ID NO: 6352021 - DNA, 23 bp, Homo sapiens
gtatatgtagatgtatgcacaca

SEQ ID NO: 6352022 - DNA, 12 bp, Homo sapiens
gtatatgtatat

SEQ ID NO: 6352023 - DNA, 18 bp, Homo sapiens
gtatatgtatatctatat

SEQ ID NO: 6352024 - DNA, 12 bp, Homo sapiens
gtatatgtatta

SEQ ID NO: 6352025 - DNA, 15 bp, Homo sapiens
gtatatgtattccct

SEQ ID NO: 6352026 - DNA, 20 bp, Homo sapiens
taaattttgtacatttttga

SEQ ID NO: 6352027 - DNA, 21 bp, Homo sapiens
taaattttgtacatttttgat

SEQ ID NO: 6352028 - DNA, 17 bp, Homo sapiens
taaattttgtatgaaaa

SEQ ID NO: 6352029 - DNA, 13 bp, Homo sapiens
taaattttgtgat

SEQ ID NO: 6352030 - DNA, 22 bp, Homo sapiens
taaattttgtgatgaataaaat

SEQ ID NO: 6352031 - DNA, 15 bp, Homo sapiens
taaattttgtgtctc

SEQ ID NO: 6352032 - DNA, 13 bp, Homo sapiens
taaatttttactt

SEQ ID NO: 6352033 - DNA, 20 bp, Homo sapiens
taaatttttagccatttctc

SEQ ID NO: 6352034 - DNA, 13 bp, Homo sapiens
taaatttttgaaa

SEQ ID NO: 6352035 - DNA, 15 bp, Homo sapiens
taaatttttgaaaaa

SEQ ID NO: 6352036 - DNA, 16 bp, Homo sapiens
taaatttttgaaaaat

SEQ ID NO: 6352037 - DNA, 17 bp, Homo sapiens
taaatttttgaaaaata

SEQ ID NO: 6352038 - DNA, 18 bp, Homo sapiens
taaatttttgaaaaatat

SEQ ID NO: 6352039 - DNA, 13 bp, Homo sapiens
taaatttttgtca

SEQ ID NO: 6352040 - DNA, 15 bp, Homo sapiens
taaatttttgtcatt

SEQ ID NO: 6352041 - DNA, 18 bp, Homo sapiens
taaatttttgtcatttta

SEQ ID NO: 6352042 - DNA, 21 bp, Homo sapiens
taaattttttacgtagctatt

SEQ ID NO: 6352043 - DNA, 22 bp, Homo sapiens
taaattttttacgtagctattt

SEQ ID NO: 6352044 - DNA, 15 bp, Homo sapiens
taaattttttgaaac

SEQ ID NO: 6352045 - DNA, 16 bp, Homo sapiens
taaattttttgaaaca

SEQ ID NO: 6352046 - DNA, 16 bp, Homo sapiens
taaattttttgttgac

SEQ ID NO: 6352047 - DNA, 18 bp, Homo sapiens
taaattttttgttgacat

SEQ ID NO: 6352048 - DNA, 14 bp, Homo sapiens
taaatttttttcct

SEQ ID NO: 6352049 - DNA, 15 bp, Homo sapiens
taaatttttttgtat

SEQ ID NO: 6352050 - DNA, 17 bp, Homo sapiens
taaatttttttgtatga

SEQ ID NO: 6352051 - DNA, 18 bp, Homo sapiens
taaatttttttgtatgaa

SEQ ID NO: 6352052 - DNA, 22 bp, Homo sapiens
taaatttttttgtatgaaaaca

SEQ ID NO: 6352053 - DNA, 21 bp, Homo sapiens
taaattttttttggtcaaatt

SEQ ID NO: 6352054 - DNA, 23 bp, Homo sapiens
taacaaaaaaatatatttaatga

SEQ ID NO: 6352055 - DNA, 17 bp, Homo sapiens
taacaaaaaagagaaac

SEQ ID NO: 6352056 - DNA, 14 bp, Homo sapiens
taacaaaaaaggtt

SEQ ID NO: 6352057 - DNA, 17 bp, Homo sapiens
taacaaaaaataaagaa

SEQ ID NO: 6352058 - DNA, 17 bp, Homo sapiens
taacaaaacaagaaaga

SEQ ID NO: 6352059 - DNA, 18 bp, Homo sapiens
taacaaaacaagaaagaa

SEQ ID NO: 6352060 - DNA, 13 bp, Homo sapiens
taacaaaagaact

SEQ ID NO: 6352061 - DNA, 14 bp, Homo sapiens
taacaaaagatgaa

SEQ ID NO: 6352062 - DNA, 13 bp, Homo sapiens
taacaaaagattt

SEQ ID NO: 6352063 - DNA, 22 bp, Homo sapiens
taacaaaagatttgtttttgta

SEQ ID NO: 6352064 - DNA, 22 bp, Homo sapiens
taacaaaagcacacaacgatta

SEQ ID NO: 6352065 - DNA, 24 bp, Homo sapiens
taacaaaataaggttatatgagta

SEQ ID NO: 6352066 - DNA, 14 bp, Homo sapiens
taacaaaatgagat

SEQ ID NO: 6352067 - DNA, 11 bp, Homo sapiens
taacaaaatgg

SEQ ID NO: 6352068 - DNA, 13 bp, Homo sapiens
taacaaaatggac

SEQ ID NO: 6352069 - DNA, 15 bp, Homo sapiens
taacaaaatgtatgt

SEQ ID NO: 6352070 - DNA, 19 bp, Homo sapiens
taacaaaattgacagcttt

SEQ ID NO: 6352071 - DNA, 22 bp, Homo sapiens
taacaaaattgacagctttcta

SEQ ID NO: 6352072 - DNA, 16 bp, Homo sapiens
taacaaaatttgaata

SEQ ID NO: 6352073 - DNA, 13 bp, Homo sapiens
taacaaaattttt

SEQ ID NO: 6352074 - DNA, 19 bp, Homo sapiens
taacaaacaagaaagctat

SEQ ID NO: 6352075 - DNA, 21 bp, Homo sapiens
taacaaaccatctggtgcctt

SEQ ID NO: 6352076 - DNA, 23 bp, Homo sapiens
taacaaaccatctggtgcctttc

SEQ ID NO: 6352077 - DNA, 22 bp, Homo sapiens
taacaaacgtaatttgttatat

SEQ ID NO: 6352078 - DNA, 14 bp, Homo sapiens
taacaaagcacata

SEQ ID NO: 6352079 - DNA, 17 bp, Homo sapiens
taacaaaggatacttat

SEQ ID NO: 6352080 - DNA, 21 bp, Homo sapiens
taacaaaggatacttatttaa

SEQ ID NO: 6352081 - DNA, 13 bp, Homo sapiens
taacaaagtgaga

SEQ ID NO: 6352082 - DNA, 18 bp, Homo sapiens
taacaaatctaatctctt

SEQ ID NO: 6352083 - DNA, 15 bp, Homo sapiens
taacaaatgtaaaat

SEQ ID NO: 6352084 - DNA, 22 bp, Homo sapiens
taacaaattgggatctgtcttg

SEQ ID NO: 6352085 - DNA, 17 bp, Homo sapiens
taacaaattttaagtgc

SEQ ID NO: 6352086 - DNA, 14 bp, Homo sapiens
taacaacaacagtt

SEQ ID NO: 6352087 - DNA, 17 bp, Homo sapiens
taacaacaataataatt

SEQ ID NO: 6352088 - DNA, 11 bp, Homo sapiens
taacaacaatt

SEQ ID NO: 6352089 - DNA, 22 bp, Homo sapiens
taacaacaatttaggaatgctc

SEQ ID NO: 6352090 - DNA, 23 bp, Homo sapiens
taacaacaatttaggaatgctca

SEQ ID NO: 6352091 - DNA, 14 bp, Homo sapiens
taacaacatgtttc

SEQ ID NO: 6352092 - DNA, 17 bp, Homo sapiens
taacaaccaaccaacca

SEQ ID NO: 6352093 - DNA, 16 bp, Homo sapiens
taacaaccctgttgag

SEQ ID NO: 6352094 - DNA, 13 bp, Homo sapiens
taacaacctggcc

SEQ ID NO: 6352095 - DNA, 22 bp, Homo sapiens
taacaacctttcccatttcgtg

SEQ ID NO: 6352096 - DNA, 17 bp, Homo sapiens
taacaaccttttacatt

SEQ ID NO: 6352097 - DNA, 22 bp, Homo sapiens
taacaactatgatttggaaaat

SEQ ID NO: 6352098 - DNA, 14 bp, Homo sapiens
taacaactccctga

SEQ ID NO: 6352099 - DNA, 12 bp, Homo sapiens
taacaactgtga

SEQ ID NO: 6352100 - DNA, 13 bp, Homo sapiens
taacaactgtgaa

SEQ ID NO: 6352101 - DNA, 22 bp, Homo sapiens
taacaactgtgaatatgagaaa

SEQ ID NO: 6352102 - DNA, 23 bp, Homo sapiens
taacaactgtgaatatgagaaat

SEQ ID NO: 6352103 - DNA, 15 bp, Homo sapiens
taacaagaaaacata

SEQ ID NO: 6352104 - DNA, 14 bp, Homo sapiens
taacaagaaaatga

SEQ ID NO: 6352105 - DNA, 13 bp, Homo sapiens
taacaagaaagga

SEQ ID NO: 6352106 - DNA, 13 bp, Homo sapiens
taacaagaagatg

SEQ ID NO: 6352107 - DNA, 15 bp, Homo sapiens
taacaagagtatgtg

SEQ ID NO: 6352108 - DNA, 19 bp, Homo sapiens
taacaagagtgattcttgc

SEQ ID NO: 6352109 - DNA, 15 bp, Homo sapiens
taacaagatatttat

SEQ ID NO: 6352110 - DNA, 23 bp, Homo sapiens
taacaagatatttatatgttatt

SEQ ID NO: 6352111 - DNA, 12 bp, Homo sapiens
taacaagatgtt

SEQ ID NO: 6352112 - DNA, 22 bp, Homo sapiens
taacaagcaaggatatcagagc

SEQ ID NO: 6352113 - DNA, 21 bp, Homo sapiens
taacaagcatgcataaatcaa

SEQ ID NO: 6352114 - DNA, 13 bp, Homo sapiens
taacaagccaccc

SEQ ID NO: 6352115 - DNA, 20 bp, Homo sapiens
taacaagctcagctctgctt

SEQ ID NO: 6352116 - DNA, 12 bp, Homo sapiens
taacaaggaatg

SEQ ID NO: 6352117 - DNA, 22 bp, Homo sapiens
taacaaggaatgcctgtgccaa

SEQ ID NO: 6352118 - DNA, 23 bp, Homo sapiens
taacaaggagctcaccctgcccg

SEQ ID NO: 6352119 - DNA, 20 bp, Homo sapiens
taacaagtcgatgaactatt

SEQ ID NO: 6352120 - DNA, 13 bp, Homo sapiens
taacaataaagca

SEQ ID NO: 6352121 - DNA, 18 bp, Homo sapiens
taacaataaagtgacaaa

SEQ ID NO: 6352122 - DNA, 17 bp, Homo sapiens
taacaataactactgtg

SEQ ID NO: 6352123 - DNA, 18 bp, Homo sapiens
taacaataactactgtgt

SEQ ID NO: 6352124 - DNA, 21 bp, Homo sapiens
taacaataactactgtgttcc

SEQ ID NO: 6352125 - DNA, 12 bp, Homo sapiens
taacaataataa

SEQ ID NO: 6352126 - DNA, 16 bp, Homo sapiens
taacaatacaaatgga

SEQ ID NO: 6352127 - DNA, 20 bp, Homo sapiens
taacaatacaaatggatttt

SEQ ID NO: 6352128 - DNA, 19 bp, Homo sapiens
taacaatacatgagaaaga

SEQ ID NO: 6352129 - DNA, 22 bp, Homo sapiens
taacaatagataaggtttcctg

SEQ ID NO: 6352130 - DNA, 23 bp, Homo sapiens
taacaatagataaggtttcctgc

SEQ ID NO: 6352131 - DNA, 14 bp, Homo sapiens
taacaatagttctt

SEQ ID NO: 6352132 - DNA, 15 bp, Homo sapiens
taacaatatatagaa

SEQ ID NO: 6352133 - DNA, 22 bp, Homo sapiens
taacaatatatagaattgtaga

SEQ ID NO: 6352134 - DNA, 13 bp, Homo sapiens
taacaatatatga

SEQ ID NO: 6352135 - DNA, 21 bp, Homo sapiens
taacaatatatgatatataaa

SEQ ID NO: 6352136 - DNA, 19 bp, Homo sapiens
taacaatattaattcaggt

SEQ ID NO: 6352137 - DNA, 17 bp, Homo sapiens
taacaatccattcacaa

SEQ ID NO: 6352138 - DNA, 15 bp, Homo sapiens
taacaatctaacaat

SEQ ID NO: 6352139 - DNA, 21 bp, Homo sapiens
taacaatgacactagaaaact

SEQ ID NO: 6352140 - DNA, 13 bp, Homo sapiens
taacaatgatata

SEQ ID NO: 6352141 - DNA, 23 bp, Homo sapiens
taacaatgcaacttttaattact

SEQ ID NO: 6352142 - DNA, 18 bp, Homo sapiens
taacaatgcctattgtaa

SEQ ID NO: 6352143 - DNA, 12 bp, Homo sapiens
taacaatgcctt

SEQ ID NO: 6352144 - DNA, 18 bp, Homo sapiens
taacaatgccttgttgta

SEQ ID NO: 6352145 - DNA, 19 bp, Homo sapiens
taacaatgccttgttgtat

SEQ ID NO: 6352146 - DNA, 15 bp, Homo sapiens
taacaatgctgtatt

SEQ ID NO: 6352147 - DNA, 16 bp, Homo sapiens
taacaatgtattttct

SEQ ID NO: 6352148 - DNA, 12 bp, Homo sapiens
taacaatgtctt

SEQ ID NO: 6352149 - DNA, 13 bp, Homo sapiens
taacaatgttaag

SEQ ID NO: 6352150 - DNA, 14 bp, Homo sapiens
taacaatgttaagg

SEQ ID NO: 6352151 - DNA, 15 bp, Homo sapiens
taacaatgttaagga

SEQ ID NO: 6352152 - DNA, 14 bp, Homo sapiens
taacaattaattgt

SEQ ID NO: 6352153 - DNA, 17 bp, Homo sapiens
taacaattaattgtctt

SEQ ID NO: 6352154 - DNA, 20 bp, Homo sapiens
taacaattaattgtcttgca

SEQ ID NO: 6352155 - DNA, 20 bp, Homo sapiens
taacaattcagtaacaaagg

SEQ ID NO: 6352156 - DNA, 21 bp, Homo sapiens
taacaattgtcttaaaaccag

SEQ ID NO: 6352157 - DNA, 13 bp, Homo sapiens
taacaatttcctt

SEQ ID NO: 6352158 - DNA, 16 bp, Homo sapiens
taacaatttctgtcct

SEQ ID NO: 6352159 - DNA, 18 bp, Homo sapiens
taacaattttaatgctat

SEQ ID NO: 6352160 - DNA, 12 bp, Homo sapiens
taacacaaaatc

SEQ ID NO: 6352161 - DNA, 13 bp, Homo sapiens
taacacaaaggaa

SEQ ID NO: 6352162 - DNA, 18 bp, Homo sapiens
taacacaaatgctcaaag

SEQ ID NO: 6352163 - DNA, 22 bp, Homo sapiens
taacacaatatgagtaatgttt

SEQ ID NO: 6352164 - DNA, 13 bp, Homo sapiens
taacacacagcta

SEQ ID NO: 6352165 - DNA, 17 bp, Homo sapiens
taacacacagctcccat

SEQ ID NO: 6352166 - DNA, 16 bp, Homo sapiens
taacacacataaagga

SEQ ID NO: 6352167 - DNA, 17 bp, Homo sapiens
taacacaccaagtggag

SEQ ID NO: 6352168 - DNA, 21 bp, Homo sapiens
taacacactaccgaatgtgtc

SEQ ID NO: 6352169 - DNA, 12 bp, Homo sapiens
taacacagatat

SEQ ID NO: 6352170 - DNA, 21 bp, Homo sapiens
taacacagcattgtatatgtg

SEQ ID NO: 6352171 - DNA, 14 bp, Homo sapiens
taacacagccttcc

SEQ ID NO: 6352172 - DNA, 16 bp, Homo sapiens
taacacagccttcctt

SEQ ID NO: 6352173 - DNA, 18 bp, Homo sapiens
taacacagccttccttct

SEQ ID NO: 6352174 - DNA, 18 bp, Homo sapiens
taacacaggataaagtta

SEQ ID NO: 6352175 - DNA, 13 bp, Homo sapiens
taacacagtgtct

SEQ ID NO: 6352176 - DNA, 14 bp, Homo sapiens
taacacagtgtctg

SEQ ID NO: 6352177 - DNA, 12 bp, Homo sapiens
taacacagttga

SEQ ID NO: 6352178 - DNA, 17 bp, Homo sapiens
taacacataaacaattc

SEQ ID NO: 6352179 - DNA, 16 bp, Homo sapiens
taacacataaagtaaa

SEQ ID NO: 6352180 - DNA, 21 bp, Homo sapiens
taacacataaagtaaatgcta

SEQ ID NO: 6352181 - DNA, 18 bp, Homo sapiens
taacacataactagaaac

SEQ ID NO: 6352182 - DNA, 22 bp, Homo sapiens
taacacatagcgccgtgctgta

SEQ ID NO: 6352183 - DNA, 23 bp, Homo sapiens
taacacatagcgccgtgctgtaa

SEQ ID NO: 6352184 - DNA, 18 bp, Homo sapiens
taacacatgaatttctgc

SEQ ID NO: 6352185 - DNA, 16 bp, Homo sapiens
taacacattctttata

SEQ ID NO: 6352186 - DNA, 18 bp, Homo sapiens
taacacattgttatttct

SEQ ID NO: 6352187 - DNA, 11 bp, Homo sapiens
taacacatttc

SEQ ID NO: 6352188 - DNA, 17 bp, Homo sapiens
taacacatttgattctg

SEQ ID NO: 6352189 - DNA, 18 bp, Homo sapiens
taacacattttgtataat

SEQ ID NO: 6352190 - DNA, 23 bp, Homo sapiens
taacacattttgtataattgtat

SEQ ID NO: 6352191 - DNA, 23 bp, Homo sapiens
taacacatttttaaagctttccc

SEQ ID NO: 6352192 - DNA, 20 bp, Homo sapiens
taacacatttttttgcatgc

SEQ ID NO: 6352193 - DNA, 20 bp, Homo sapiens
taacaccaacactgtaacat

SEQ ID NO: 6352194 - DNA, 22 bp, Homo sapiens
taacaccaagagtagcaccttc

SEQ ID NO: 6352195 - DNA, 23 bp, Homo sapiens
taacaccaagagtagcaccttca

SEQ ID NO: 6352196 - DNA, 22 bp, Homo sapiens
taacaccaagcacgtatttatt

SEQ ID NO: 6352197 - DNA, 20 bp, Homo sapiens
taacaccaatcccagggctg

SEQ ID NO: 6352198 - DNA, 14 bp, Homo sapiens
taacaccagcattg

SEQ ID NO: 6352199 - DNA, 16 bp, Homo sapiens
taacacctgatgtgta

SEQ ID NO: 6352200 - DNA, 19 bp, Homo sapiens
taacacctgattaactgag

SEQ ID NO: 6352201 - DNA, 15 bp, Homo sapiens
taacacgctgcctgg

SEQ ID NO: 6352202 - DNA, 16 bp, Homo sapiens
taacacgtgatgtgat

SEQ ID NO: 6352203 - DNA, 18 bp, Homo sapiens
taacactaaaattttagg

SEQ ID NO: 6352204 - DNA, 14 bp, Homo sapiens
taacactaaatgct

SEQ ID NO: 6352205 - DNA, 16 bp, Homo sapiens
gtatatgtattccctt

SEQ ID NO: 6352206 - DNA, 12 bp, Homo sapiens
gtatatgtattt

SEQ ID NO: 6352207 - DNA, 13 bp, Homo sapiens
gtatatgtattta

SEQ ID NO: 6352208 - DNA, 17 bp, Homo sapiens
gtatatgtcaaaaatat

SEQ ID NO: 6352209 - DNA, 19 bp, Homo sapiens
gtatatgtgaaaaaaatga

SEQ ID NO: 6352210 - DNA, 13 bp, Homo sapiens
gtatatgtgcagt

SEQ ID NO: 6352211 - DNA, 13 bp, Homo sapiens
gtatatgttggtt

SEQ ID NO: 6352212 - DNA, 13 bp, Homo sapiens
gtatatgttgtaa

SEQ ID NO: 6352213 - DNA, 14 bp, Homo sapiens
gtatatgtttatac

SEQ ID NO: 6352214 - DNA, 16 bp, Homo sapiens
gtatatgtttatacac

SEQ ID NO: 6352215 - DNA, 17 bp, Homo sapiens
gtatatgtttatatact

SEQ ID NO: 6352216 - DNA, 13 bp, Homo sapiens
gtatatgttttat

SEQ ID NO: 6352217 - DNA, 11 bp, Homo sapiens
gtatattaaac

SEQ ID NO: 6352218 - DNA, 13 bp, Homo sapiens
gtatattaacaaa

SEQ ID NO: 6352219 - DNA, 18 bp, Homo sapiens
gtatattacccaatggaa

SEQ ID NO: 6352220 - DNA, 15 bp, Homo sapiens
gtatattacctcaaa

SEQ ID NO: 6352221 - DNA, 21 bp, Homo sapiens
gtatattatatggcaggagct

SEQ ID NO: 6352222 - DNA, 21 bp, Homo sapiens
gtatattatgtatttatattt

SEQ ID NO: 6352223 - DNA, 19 bp, Homo sapiens
gtatattatgtttatttca

SEQ ID NO: 6352224 - DNA, 16 bp, Homo sapiens
gtatattattgctata

SEQ ID NO: 6352225 - DNA, 22 bp, Homo sapiens
gtatattatttctaggaagaat

SEQ ID NO: 6352226 - DNA, 16 bp, Homo sapiens
gtatattcaaaaatta

SEQ ID NO: 6352227 - DNA, 17 bp, Homo sapiens
gtatattccatgtataa

SEQ ID NO: 6352228 - DNA, 19 bp, Homo sapiens
gtatattccttttaaagaa

SEQ ID NO: 6352229 - DNA, 17 bp, Homo sapiens
gtatattctattttaca

SEQ ID NO: 6352230 - DNA, 22 bp, Homo sapiens
gtatattctttggttgtgaatc

SEQ ID NO: 6352231 - DNA, 15 bp, Homo sapiens
gtatattgaaaagaa

SEQ ID NO: 6352232 - DNA, 14 bp, Homo sapiens
gtatattgataaat

SEQ ID NO: 6352233 - DNA, 19 bp, Homo sapiens
gtatattgcacaattataa

SEQ ID NO: 6352234 - DNA, 12 bp, Homo sapiens
gtatattgctaa

SEQ ID NO: 6352235 - DNA, 12 bp, Homo sapiens
gtatattggaag

SEQ ID NO: 6352236 - DNA, 13 bp, Homo sapiens
gtatattggtttt

SEQ ID NO: 6352237 - DNA, 19 bp, Homo sapiens
gtatattggttttatgatg

SEQ ID NO: 6352238 - DNA, 22 bp, Homo sapiens
gtatattgtaggaatcctttga

SEQ ID NO: 6352239 - DNA, 17 bp, Homo sapiens
gtatattgtgttgcaaa

SEQ ID NO: 6352240 - DNA, 20 bp, Homo sapiens
gtatattgtgtttgtgtatt

SEQ ID NO: 6352241 - DNA, 21 bp, Homo sapiens
gtatattgtttaatcagttct

SEQ ID NO: 6352242 - DNA, 15 bp, Homo sapiens
gtatatttatactct

SEQ ID NO: 6352243 - DNA, 13 bp, Homo sapiens
gtatatttatagt

SEQ ID NO: 6352244 - DNA, 22 bp, Homo sapiens
gtatatttatagtcacaagagc

SEQ ID NO: 6352245 - DNA, 17 bp, Homo sapiens
gtatatttatataatta

SEQ ID NO: 6352246 - DNA, 19 bp, Homo sapiens
gtatatttatataattatg

SEQ ID NO: 6352247 - DNA, 14 bp, Homo sapiens
gtatatttattcat

SEQ ID NO: 6352248 - DNA, 18 bp, Homo sapiens
gtatatttcattgaatac

SEQ ID NO: 6352249 - DNA, 22 bp, Homo sapiens
gtatatttcattgaatacttta

SEQ ID NO: 6352250 - DNA, 16 bp, Homo sapiens
gtatatttccgcactt

SEQ ID NO: 6352251 - DNA, 14 bp, Homo sapiens
gtatatttctcata

SEQ ID NO: 6352252 - DNA, 19 bp, Homo sapiens
gtatatttctcataatgtg

SEQ ID NO: 6352253 - DNA, 17 bp, Homo sapiens
gtatatttgaaactgct

SEQ ID NO: 6352254 - DNA, 17 bp, Homo sapiens
gtatatttgatttatta

SEQ ID NO: 6352255 - DNA, 21 bp, Homo sapiens
gtatatttgcaaaccctttgt

SEQ ID NO: 6352256 - DNA, 13 bp, Homo sapiens
gtatatttgtaaa

SEQ ID NO: 6352257 - DNA, 15 bp, Homo sapiens
gtatatttgtaaaag

SEQ ID NO: 6352258 - DNA, 19 bp, Homo sapiens
gtatatttgtaaaagctaa

SEQ ID NO: 6352259 - DNA, 14 bp, Homo sapiens
gtatatttgtacaa

SEQ ID NO: 6352260 - DNA, 13 bp, Homo sapiens
gtatatttgtcat

SEQ ID NO: 6352261 - DNA, 20 bp, Homo sapiens
gtatatttgtgatagcactt

SEQ ID NO: 6352262 - DNA, 18 bp, Homo sapiens
gtatatttgtgtatgtgt

SEQ ID NO: 6352263 - DNA, 15 bp, Homo sapiens
gtatattttcctata

SEQ ID NO: 6352264 - DNA, 22 bp, Homo sapiens
gtatatttttatctatataaaa

SEQ ID NO: 6352265 - DNA, 19 bp, Homo sapiens
gtatatttttgatctttga

SEQ ID NO: 6352266 - DNA, 22 bp, Homo sapiens
gtatatttttgatctttgagtg

SEQ ID NO: 6352267 - DNA, 21 bp, Homo sapiens
gtatatttttttctaagagaa

SEQ ID NO: 6352268 - DNA, 13 bp, Homo sapiens
gtatcaaaatgct

SEQ ID NO: 6352269 - DNA, 14 bp, Homo sapiens
gtatcaaaatgctc

SEQ ID NO: 6352270 - DNA, 15 bp, Homo sapiens
gtatcaaaattacat

SEQ ID NO: 6352271 - DNA, 22 bp, Homo sapiens
gtatcaaactcgtctgatgttt

SEQ ID NO: 6352272 - DNA, 17 bp, Homo sapiens
gtatcaaagaaaaacaa

SEQ ID NO: 6352273 - DNA, 13 bp, Homo sapiens
gtatcaaaggcag

SEQ ID NO: 6352274 - DNA, 21 bp, Homo sapiens
gtatcaaatattagatgtgat

SEQ ID NO: 6352275 - DNA, 24 bp, Homo sapiens
gtatcaaatattagatgtgattta

SEQ ID NO: 6352276 - DNA, 17 bp, Homo sapiens
gtatcaacccagaaaca

SEQ ID NO: 6352277 - DNA, 21 bp, Homo sapiens
gtatcaagacgtttaactgca

SEQ ID NO: 6352278 - DNA, 13 bp, Homo sapiens
gtatcaaggctgc

SEQ ID NO: 6352279 - DNA, 17 bp, Homo sapiens
gtatcaaggctgcctgg

SEQ ID NO: 6352280 - DNA, 14 bp, Homo sapiens
gtatcaagtgttct

SEQ ID NO: 6352281 - DNA, 19 bp, Homo sapiens
gtatcaataaaattctgta

SEQ ID NO: 6352282 - DNA, 16 bp, Homo sapiens
gtatcaatacagttta

SEQ ID NO: 6352283 - DNA, 19 bp, Homo sapiens
gtatcaataccaaatagct

SEQ ID NO: 6352284 - DNA, 21 bp, Homo sapiens
gtatcaatttctaatgtttac

SEQ ID NO: 6352285 - DNA, 17 bp, Homo sapiens
gtatcacaggccagatg

SEQ ID NO: 6352286 - DNA, 15 bp, Homo sapiens
gtatcacctttccca

SEQ ID NO: 6352287 - DNA, 21 bp, Homo sapiens
gtatcactctgtgtctgagtg

SEQ ID NO: 6352288 - DNA, 20 bp, Homo sapiens
gtatcactgtctttcctaga

SEQ ID NO: 6352289 - DNA, 14 bp, Homo sapiens
gtatcacttttctg

SEQ ID NO: 6352290 - DNA, 18 bp, Homo sapiens
gtatcagaagagagggga

SEQ ID NO: 6352291 - DNA, 19 bp, Homo sapiens
gtatcagaattgaaacact

SEQ ID NO: 6352292 - DNA, 14 bp, Homo sapiens
gtatcagaggccta

SEQ ID NO: 6352293 - DNA, 15 bp, Homo sapiens
gtatcagaggcctat

SEQ ID NO: 6352294 - DNA, 13 bp, Homo sapiens
gtatcagatgtga

SEQ ID NO: 6352295 - DNA, 16 bp, Homo sapiens
gtatcagctacaattg

SEQ ID NO: 6352296 - DNA, 12 bp, Homo sapiens
gtatcagctctc

SEQ ID NO: 6352297 - DNA, 18 bp, Homo sapiens
gtatcaggaatataaata

SEQ ID NO: 6352298 - DNA, 19 bp, Homo sapiens
gtatcaggaatataaatat

SEQ ID NO: 6352299 - DNA, 14 bp, Homo sapiens
gtatcaggacccag

SEQ ID NO: 6352300 - DNA, 18 bp, Homo sapiens
gtatcaggacccagagga

SEQ ID NO: 6352301 - DNA, 22 bp, Homo sapiens
gtatcaggactgtgaccaaagc

SEQ ID NO: 6352302 - DNA, 23 bp, Homo sapiens
gtatcaggactgtgaccaaagca

SEQ ID NO: 6352303 - DNA, 22 bp, Homo sapiens
gtatcaggtgctgccatccagg

SEQ ID NO: 6352304 - DNA, 21 bp, Homo sapiens
gtatcagtggatttcccatcc

SEQ ID NO: 6352305 - DNA, 14 bp, Homo sapiens
gtatcagtgtcctt

SEQ ID NO: 6352306 - DNA, 19 bp, Homo sapiens
gtatcagtgtttatgtgct

SEQ ID NO: 6352307 - DNA, 16 bp, Homo sapiens
gtatcataaaaataaa

SEQ ID NO: 6352308 - DNA, 19 bp, Homo sapiens
gtatcataattaccaagtg

SEQ ID NO: 6352309 - DNA, 15 bp, Homo sapiens
gtatcatagaaatgt

SEQ ID NO: 6352310 - DNA, 14 bp, Homo sapiens
gtatcatatattta

SEQ ID NO: 6352311 - DNA, 13 bp, Homo sapiens
gtatcatcagtgt

SEQ ID NO: 6352312 - DNA, 19 bp, Homo sapiens
gtatcatctaaatattatg

SEQ ID NO: 6352313 - DNA, 13 bp, Homo sapiens
gtatcatgaagaa

SEQ ID NO: 6352314 - DNA, 19 bp, Homo sapiens
gtatcatgaagaaaactga

SEQ ID NO: 6352315 - DNA, 22 bp, Homo sapiens
gtatcattaaaatatatgttct

SEQ ID NO: 6352316 - DNA, 22 bp, Homo sapiens
gtatcattacaattttctgtaa

SEQ ID NO: 6352317 - DNA, 16 bp, Homo sapiens
gtatcattcaactctc

SEQ ID NO: 6352318 - DNA, 22 bp, Homo sapiens
gtatcattgttgtttgatttct

SEQ ID NO: 6352319 - DNA, 15 bp, Homo sapiens
gtatcatttctaatt

SEQ ID NO: 6352320 - DNA, 18 bp, Homo sapiens
gtatcatttttgtgcaca

SEQ ID NO: 6352321 - DNA, 18 bp, Homo sapiens
gtatccactgtttattca

SEQ ID NO: 6352322 - DNA, 14 bp, Homo sapiens
gtatccactttgca

SEQ ID NO: 6352323 - DNA, 15 bp, Homo sapiens
gtatccagaatggaa

SEQ ID NO: 6352324 - DNA, 13 bp, Homo sapiens
gtatccagaggtg

SEQ ID NO: 6352325 - DNA, 14 bp, Homo sapiens
gtatccagaggtga

SEQ ID NO: 6352326 - DNA, 18 bp, Homo sapiens
gtatccagtacatttaat

SEQ ID NO: 6352327 - DNA, 11 bp, Homo sapiens
gtatccagtca

SEQ ID NO: 6352328 - DNA, 22 bp, Homo sapiens
gtatccagtgatgtgctggagc

SEQ ID NO: 6352329 - DNA, 20 bp, Homo sapiens
gtatccatattttattactg

SEQ ID NO: 6352330 - DNA, 21 bp, Homo sapiens
gtatccatattttattactgt

SEQ ID NO: 6352331 - DNA, 16 bp, Homo sapiens
gtatccatgcatgtgc

SEQ ID NO: 6352332 - DNA, 20 bp, Homo sapiens
gtatccatgggggcagggca

SEQ ID NO: 6352333 - DNA, 17 bp, Homo sapiens
gtatccattatcatgtg

SEQ ID NO: 6352334 - DNA, 18 bp, Homo sapiens
gtatccattatcatgtgt

SEQ ID NO: 6352335 - DNA, 21 bp, Homo sapiens
gtatccattatcatgtgtaat

SEQ ID NO: 6352336 - DNA, 12 bp, Homo sapiens
gtatcccacctc

SEQ ID NO: 6352337 - DNA, 13 bp, Homo sapiens
gtatcccacctcc

SEQ ID NO: 6352338 - DNA, 14 bp, Homo sapiens
gtatccccccatct

SEQ ID NO: 6352339 - DNA, 18 bp, Homo sapiens
gtatccccccatcttgct

SEQ ID NO: 6352340 - DNA, 20 bp, Homo sapiens
gtatcccccccctgtatagt

SEQ ID NO: 6352341 - DNA, 13 bp, Homo sapiens
gtatcccctgcag

SEQ ID NO: 6352342 - DNA, 18 bp, Homo sapiens
gtatcccgagtctgggac

SEQ ID NO: 6352343 - DNA, 15 bp, Homo sapiens
gtatccctactgtaa

SEQ ID NO: 6352344 - DNA, 21 bp, Homo sapiens
gtatccgtgaattgctttatg

SEQ ID NO: 6352345 - DNA, 13 bp, Homo sapiens
gtatcctaaactt

SEQ ID NO: 6352346 - DNA, 16 bp, Homo sapiens
gtatcctaaactttag

SEQ ID NO: 6352347 - DNA, 13 bp, Homo sapiens
gtatcctccaggt

SEQ ID NO: 6352348 - DNA, 14 bp, Homo sapiens
gtatcctccaggtt

SEQ ID NO: 6352349 - DNA, 15 bp, Homo sapiens
gtatcctccaggttt

SEQ ID NO: 6352350 - DNA, 16 bp, Homo sapiens
gtatcctccaggtttt

SEQ ID NO: 6352351 - DNA, 14 bp, Homo sapiens
gtatcctccctgcc

SEQ ID NO: 6352352 - DNA, 16 bp, Homo sapiens
gtatcctccctgccca

SEQ ID NO: 6352353 - DNA, 19 bp, Homo sapiens
gtatcctccctggcagaca

SEQ ID NO: 6352354 - DNA, 20 bp, Homo sapiens
gtatcctccctggcagacac

SEQ ID NO: 6352355 - DNA, 20 bp, Homo sapiens
gtatcctgataaacattaaa

SEQ ID NO: 6352356 - DNA, 15 bp, Homo sapiens
gtatcctggattcct

SEQ ID NO: 6352357 - DNA, 19 bp, Homo sapiens
gtatcctggcaaataatac

SEQ ID NO: 6352358 - DNA, 17 bp, Homo sapiens
gtatcctggccctgggg

SEQ ID NO: 6352359 - DNA, 18 bp, Homo sapiens
gtatcctgggggacccaa

SEQ ID NO: 6352360 - DNA, 19 bp, Homo sapiens
gtatccttaaccaccgcat

SEQ ID NO: 6352361 - DNA, 17 bp, Homo sapiens
gtatcggagacagtgat

SEQ ID NO: 6352362 - DNA, 16 bp, Homo sapiens
gtatcggcactgtaca

SEQ ID NO: 6352363 - DNA, 18 bp, Homo sapiens
gtatcggcactgtacaaa

SEQ ID NO: 6352364 - DNA, 15 bp, Homo sapiens
gtatcgtatagctgt

SEQ ID NO: 6352365 - DNA, 21 bp, Homo sapiens
gtatctaagaataataaaatc

SEQ ID NO: 6352366 - DNA, 20 bp, Homo sapiens
gtatctaatcctttaatgat

SEQ ID NO: 6352367 - DNA, 20 bp, Homo sapiens
gtatctacattaaaatgaca

SEQ ID NO: 6352368 - DNA, 20 bp, Homo sapiens
gtatctagacccatcttctt

SEQ ID NO: 6352369 - DNA, 18 bp, Homo sapiens
gtatctaggcaacatagt

SEQ ID NO: 6352370 - DNA, 13 bp, Homo sapiens
gtatctagtgcag

SEQ ID NO: 6352371 - DNA, 18 bp, Homo sapiens
gtatctatgcaaagcact

SEQ ID NO: 6352372 - DNA, 15 bp, Homo sapiens
gtatctatttgtaca

SEQ ID NO: 6352373 - DNA, 19 bp, Homo sapiens
gtatctatttgtacaattt

SEQ ID NO: 6352374 - DNA, 21 bp, Homo sapiens
gtatctcaaatctgctttcat

SEQ ID NO: 6352375 - DNA, 20 bp, Homo sapiens
gtatctcaagatattcaggt

SEQ ID NO: 6352376 - DNA, 14 bp, Homo sapiens
gtatctcagaaagt

SEQ ID NO: 6352377 - DNA, 18 bp, Homo sapiens
gtatctcagaaagtgcct

SEQ ID NO: 6352378 - DNA, 20 bp, Homo sapiens
gtatctcagaaagtgcctga

SEQ ID NO: 6352379 - DNA, 14 bp, Homo sapiens
gtatctcaggtctg

SEQ ID NO: 6352380 - DNA, 16 bp, Homo sapiens
gtatctcaggtctgaa

SEQ ID NO: 6352381 - DNA, 16 bp, Homo sapiens
gtatctcatactgtct

SEQ ID NO: 6352382 - DNA, 18 bp, Homo sapiens
gtatctccctggagaagc

SEQ ID NO: 6352383 - DNA, 16 bp, Homo sapiens
gtatctccggctccca

SEQ ID NO: 6352384 - DNA, 18 bp, Homo sapiens
gtatctccggctcccagc

SEQ ID NO: 6352385 - DNA, 20 bp, Homo sapiens
gtatctccggctcccagcct

SEQ ID NO: 6352386 - DNA, 16 bp, Homo sapiens
gtatctcctttaatat

SEQ ID NO: 6352387 - DNA, 15 bp, Homo sapiens
gtatctctctgccta

SEQ ID NO: 6352388 - DNA, 12 bp, Homo sapiens
gtatctcttcag

SEQ ID NO: 6352389 - DNA, 20 bp, Homo sapiens
gtatctcttggtatgcatct

SEQ ID NO: 6352390 - DNA, 20 bp, Homo sapiens
gtatctctttcacattgttt

SEQ ID NO: 6352391 - DNA, 22 bp, Homo sapiens
gtatctgacatatttcataagc

SEQ ID NO: 6352392 - DNA, 20 bp, Homo sapiens
gtatctgatgtttgttttcg

SEQ ID NO: 6352393 - DNA, 18 bp, Homo sapiens
gtatctgcaggcagacac

SEQ ID NO: 6352394 - DNA, 19 bp, Homo sapiens
gtatctgcaggcagacacg

SEQ ID NO: 6352395 - DNA, 19 bp, Homo sapiens
gtatctgcatgtaaaatct

SEQ ID NO: 6352396 - DNA, 20 bp, Homo sapiens
gtatctgcatgtaaaatctt

SEQ ID NO: 6352397 - DNA, 11 bp, Homo sapiens
gtatctgccct

SEQ ID NO: 6352398 - DNA, 19 bp, Homo sapiens
gtatctgctgcctctgaaa

SEQ ID NO: 6352399 - DNA, 21 bp, Homo sapiens
gtatctgctgcctctgaaaat

SEQ ID NO: 6352400 - DNA, 13 bp, Homo sapiens
gtatctgctgttc

SEQ ID NO: 6352401 - DNA, 12 bp, Homo sapiens
gtatctggctgg

SEQ ID NO: 6352402 - DNA, 13 bp, Homo sapiens
gtatctggcttcc

SEQ ID NO: 6352403 - DNA, 15 bp, Homo sapiens
gtatctggcttccct

SEQ ID NO: 6352404 - DNA, 17 bp, Homo sapiens
gtatctggcttccctgg

SEQ ID NO: 6352405 - DNA, 21 bp, Homo sapiens
gtatctggcttccctggaagc

SEQ ID NO: 6352406 - DNA, 17 bp, Homo sapiens
gtatctgggattattct

SEQ ID NO: 6352407 - DNA, 18 bp, Homo sapiens
gtatctgggctgattttt

SEQ ID NO: 6352408 - DNA, 19 bp, Homo sapiens
gtatctggtgactttcctc

SEQ ID NO: 6352409 - DNA, 17 bp, Homo sapiens
gtatctgtcacaataaa

SEQ ID NO: 6352410 - DNA, 11 bp, Homo sapiens
gtatctgtcta

SEQ ID NO: 6352411 - DNA, 13 bp, Homo sapiens
gtatctgtctact

SEQ ID NO: 6352412 - DNA, 18 bp, Homo sapiens
gtatctgtctactttctc

SEQ ID NO: 6352413 - DNA, 20 bp, Homo sapiens
gtatctgtctactttctctt

SEQ ID NO: 6352414 - DNA, 13 bp, Homo sapiens
gtatctgtctttc

SEQ ID NO: 6352415 - DNA, 15 bp, Homo sapiens
gtatctgtctttcca

SEQ ID NO: 6352416 - DNA, 20 bp, Homo sapiens
gtatctgtgaagtagttctg

SEQ ID NO: 6352417 - DNA, 18 bp, Homo sapiens
gtatctgtgcttctaata

SEQ ID NO: 6352418 - DNA, 13 bp, Homo sapiens
gtatctgttactc

SEQ ID NO: 6352419 - DNA, 21 bp, Homo sapiens
gtatctgtttacatccagagt

SEQ ID NO: 6352420 - DNA, 17 bp, Homo sapiens
gtatcttactttcctct

SEQ ID NO: 6352421 - DNA, 15 bp, Homo sapiens
gtatcttatttatat

SEQ ID NO: 6352422 - DNA, 18 bp, Homo sapiens
gtatcttatttatatatg

SEQ ID NO: 6352423 - DNA, 16 bp, Homo sapiens
gtatcttcaaaaatac

SEQ ID NO: 6352424 - DNA, 17 bp, Homo sapiens
gtatcttccatatttgg

SEQ ID NO: 6352425 - DNA, 19 bp, Homo sapiens
gtatcttccatatttggaa

SEQ ID NO: 6352426 - DNA, 22 bp, Homo sapiens
gtatcttccatatttggaagaa

SEQ ID NO: 6352427 - DNA, 22 bp, Homo sapiens
gtatcttgatgtttagaaaagt

SEQ ID NO: 6352428 - DNA, 17 bp, Homo sapiens
gtatcttgattaatgta

SEQ ID NO: 6352429 - DNA, 14 bp, Homo sapiens
gtatcttgcagtat

SEQ ID NO: 6352430 - DNA, 16 bp, Homo sapiens
gtatcttgtgcttctt

SEQ ID NO: 6352431 - DNA, 23 bp, Homo sapiens
gtatctttaaaaaaaaatcttgt

SEQ ID NO: 6352432 - DNA, 17 bp, Homo sapiens
gtatctttaaagacttg

SEQ ID NO: 6352433 - DNA, 19 bp, Homo sapiens
gtatctttaaagacttgat

SEQ ID NO: 6352434 - DNA, 13 bp, Homo sapiens
gtatctttaacaa

SEQ ID NO: 6352435 - DNA, 14 bp, Homo sapiens
gtatctttaacaat

SEQ ID NO: 6352436 - DNA, 15 bp, Homo sapiens
gtatctttatgctgt

SEQ ID NO: 6352437 - DNA, 16 bp, Homo sapiens
gtatctttatgctgta

SEQ ID NO: 6352438 - DNA, 13 bp, Homo sapiens
gtatctttattaa

SEQ ID NO: 6352439 - DNA, 17 bp, Homo sapiens
gtatctttattaaaaca

SEQ ID NO: 6352440 - DNA, 17 bp, Homo sapiens
gtatcttttatcctggg

SEQ ID NO: 6352441 - DNA, 21 bp, Homo sapiens
gtatcttttttaaactgtaaa

SEQ ID NO: 6352442 - DNA, 16 bp, Homo sapiens
gtatcttttttaaatg

SEQ ID NO: 6352443 - DNA, 13 bp, Homo sapiens
gtatgaaaacatg

SEQ ID NO: 6352444 - DNA, 14 bp, Homo sapiens
gtatgaaaatgagt

SEQ ID NO: 6352445 - DNA, 14 bp, Homo sapiens
gtatgaaagattgt

SEQ ID NO: 6352446 - DNA, 16 bp, Homo sapiens
gtatgaaatatatgtg

SEQ ID NO: 6352447 - DNA, 23 bp, Homo sapiens
gtatgaaattatataagtattct

SEQ ID NO: 6352448 - DNA, 15 bp, Homo sapiens
gtatgaacttgagga

SEQ ID NO: 6352449 - DNA, 20 bp, Homo sapiens
gtatgaagagctgtcttccc

SEQ ID NO: 6352450 - DNA, 16 bp, Homo sapiens
gtatgaagagtgttat

SEQ ID NO: 6352451 - DNA, 13 bp, Homo sapiens
gtatgaagtactt

SEQ ID NO: 6352452 - DNA, 15 bp, Homo sapiens
gtatgaatctatgcc

SEQ ID NO: 6352453 - DNA, 15 bp, Homo sapiens
gtatgaatctatttg

SEQ ID NO: 6352454 - DNA, 22 bp, Homo sapiens
gtatgaatggtctagaaacatt

SEQ ID NO: 6352455 - DNA, 22 bp, Homo sapiens
gtatgacccctggccacagcct

SEQ ID NO: 6352456 - DNA, 18 bp, Homo sapiens
gtatgactaaagagagaa

SEQ ID NO: 6352457 - DNA, 20 bp, Homo sapiens
gtatgactaaagagagaatg

SEQ ID NO: 6352458 - DNA, 18 bp, Homo sapiens
gtatgacttaattttaga

SEQ ID NO: 6352459 - DNA, 12 bp, Homo sapiens
gtatgagaaata

SEQ ID NO: 6352460 - DNA, 17 bp, Homo sapiens
gtatgagatggttaaaa

SEQ ID NO: 6352461 - DNA, 17 bp, Homo sapiens
gtatgagcgaaattgtc

SEQ ID NO: 6352462 - DNA, 13 bp, Homo sapiens
gtatgaggcattt

SEQ ID NO: 6352463 - DNA, 17 bp, Homo sapiens
gtatgaggtcctcaggt

SEQ ID NO: 6352464 - DNA, 21 bp, Homo sapiens
gtatgaggtcctcaggtcagc

SEQ ID NO: 6352465 - DNA, 20 bp, Homo sapiens
gtatgagtgcaagcaaagca

SEQ ID NO: 6352466 - DNA, 15 bp, Homo sapiens
gtatgatactaaaga

SEQ ID NO: 6352467 - DNA, 16 bp, Homo sapiens
gtatgatacttcgaca

SEQ ID NO: 6352468 - DNA, 14 bp, Homo sapiens
gtatgatcaaatgt

SEQ ID NO: 6352469 - DNA, 15 bp, Homo sapiens
gtatgatcaaatgtt

SEQ ID NO: 6352470 - DNA, 17 bp, Homo sapiens
gtatgatcaaatgttta

SEQ ID NO: 6352471 - DNA, 22 bp, Homo sapiens
gtatgatcaaatgtttaatcat

SEQ ID NO: 6352472 - DNA, 20 bp, Homo sapiens
gtatgatctccgtatgatgt

SEQ ID NO: 6352473 - DNA, 20 bp, Homo sapiens
gtatgatctctctagctttg

SEQ ID NO: 6352474 - DNA, 21 bp, Homo sapiens
gtatgatctctctagctttgt

SEQ ID NO: 6352475 - DNA, 23 bp, Homo sapiens
gtatgatcttagggaactttgat

SEQ ID NO: 6352476 - DNA, 23 bp, Homo sapiens
gtatgatgctgccggcacagctg

SEQ ID NO: 6352477 - DNA, 22 bp, Homo sapiens
gtatgatgtgctgctgggaatg

SEQ ID NO: 6352478 - DNA, 23 bp, Homo sapiens
gtatgatttgttttgaattttgt

SEQ ID NO: 6352479 - DNA, 19 bp, Homo sapiens
gtatgattttgatgcacaa

SEQ ID NO: 6352480 - DNA, 16 bp, Homo sapiens
gtatgcaaaataaaga

SEQ ID NO: 6352481 - DNA, 14 bp, Homo sapiens
gtatgcacacacat

SEQ ID NO: 6352482 - DNA, 22 bp, Homo sapiens
gtatgcactaatcaatactttg

SEQ ID NO: 6352483 - DNA, 18 bp, Homo sapiens
gtatgcactcccttgagg

SEQ ID NO: 6352484 - DNA, 15 bp, Homo sapiens
gtatgcagggagctg

SEQ ID NO: 6352485 - DNA, 15 bp, Homo sapiens
gtatgcagtgtagat

SEQ ID NO: 6352486 - DNA, 17 bp, Homo sapiens
gtatgcagttgataaga

SEQ ID NO: 6352487 - DNA, 15 bp, Homo sapiens
gtatgcatgtgaaga

SEQ ID NO: 6352488 - DNA, 16 bp, Homo sapiens
gtatgcatgtgaagaa

SEQ ID NO: 6352489 - DNA, 18 bp, Homo sapiens
gtatgcatgtgaagaaag

SEQ ID NO: 6352490 - DNA, 18 bp, Homo sapiens
gtatgcattattaaattg

SEQ ID NO: 6352491 - DNA, 16 bp, Homo sapiens
gtatgcatttttttag

SEQ ID NO: 6352492 - DNA, 20 bp, Homo sapiens
gtatgccacacctggcctta

SEQ ID NO: 6352493 - DNA, 16 bp, Homo sapiens
gtatgccttaagcaga

SEQ ID NO: 6352494 - DNA, 18 bp, Homo sapiens
gtatgccttcctgtttaa

SEQ ID NO: 6352495 - DNA, 13 bp, Homo sapiens
gtatgctctgagt

SEQ ID NO: 6352496 - DNA, 12 bp, Homo sapiens
gtatgctgcttt

SEQ ID NO: 6352497 - DNA, 13 bp, Homo sapiens
gtatgctggccag

SEQ ID NO: 6352498 - DNA, 18 bp, Homo sapiens
gtatgctggccagcaccc

SEQ ID NO: 6352499 - DNA, 18 bp, Homo sapiens
gtatgctgttttaataat

SEQ ID NO: 6352500 - DNA, 12 bp, Homo sapiens
gtatgcttcata

SEQ ID NO: 6352501 - DNA, 14 bp, Homo sapiens
gtatgcttcataca

SEQ ID NO: 6352502 - DNA, 17 bp, Homo sapiens
gtatgctttccctgagg

SEQ ID NO: 6352503 - DNA, 19 bp, Homo sapiens
gtatgctttccctgaggaa

SEQ ID NO: 6352504 - DNA, 22 bp, Homo sapiens
gtatgctttccctgaggaatga

SEQ ID NO: 6352505 - DNA, 17 bp, Homo sapiens
gtatggaaatgcaccct

SEQ ID NO: 6352506 - DNA, 14 bp, Homo sapiens
gtatggaagggagg

SEQ ID NO: 6352507 - DNA, 18 bp, Homo sapiens
gtatggaagggaggggtc

SEQ ID NO: 6352508 - DNA, 15 bp, Homo sapiens
gtatggaatattcat

SEQ ID NO: 6352509 - DNA, 16 bp, Homo sapiens
gtatggaatattcatt

SEQ ID NO: 6352510 - DNA, 12 bp, Homo sapiens
gtatggaatcaa

SEQ ID NO: 6352511 - DNA, 18 bp, Homo sapiens
gtatggagagaaaacaga

SEQ ID NO: 6352512 - DNA, 14 bp, Homo sapiens
gtatggccatgccc

SEQ ID NO: 6352513 - DNA, 13 bp, Homo sapiens
gtatggcccaggc

SEQ ID NO: 6352514 - DNA, 19 bp, Homo sapiens
gtatggcctgacagctctg

SEQ ID NO: 6352515 - DNA, 23 bp, Homo sapiens
gtatggcgtaagtacagagaagc

SEQ ID NO: 6352516 - DNA, 21 bp, Homo sapiens
gtatggctctcaagtgaaaga

SEQ ID NO: 6352517 - DNA, 21 bp, Homo sapiens
gtatggctctgcacccctctg

SEQ ID NO: 6352518 - DNA, 20 bp, Homo sapiens
gtatgggaaaaaaactgaag

SEQ ID NO: 6352519 - DNA, 15 bp, Homo sapiens
gtatgggacctgcta

SEQ ID NO: 6352520 - DNA, 16 bp, Homo sapiens
gtatgggactggcctc

SEQ ID NO: 6352521 - DNA, 14 bp, Homo sapiens
gtatgggcaaaaaa

SEQ ID NO: 6352522 - DNA, 21 bp, Homo sapiens
gtatgggctgggggctatgta

SEQ ID NO: 6352523 - DNA, 22 bp, Homo sapiens
gtatgggctgggggctatgtat

SEQ ID NO: 6352524 - DNA, 19 bp, Homo sapiens
gtatgggttaaatcaaaga

SEQ ID NO: 6352525 - DNA, 21 bp, Homo sapiens
gtatgggttagggaaaacatt

SEQ ID NO: 6352526 - DNA, 15 bp, Homo sapiens
gtatggtgtgttcac

SEQ ID NO: 6352527 - DNA, 14 bp, Homo sapiens
gtatggttctcaga

SEQ ID NO: 6352528 - DNA, 16 bp, Homo sapiens
gtatggttttgtggat

SEQ ID NO: 6352529 - DNA, 11 bp, Homo sapiens
gtatgtaaaaa

SEQ ID NO: 6352530 - DNA, 14 bp, Homo sapiens
gtatgtaaagttaa

SEQ ID NO: 6352531 - DNA, 15 bp, Homo sapiens
gtatgtaaagttaaa

SEQ ID NO: 6352532 - DNA, 12 bp, Homo sapiens
gtatgtaaatgt

SEQ ID NO: 6352533 - DNA, 13 bp, Homo sapiens
gtatgtaaatgtg

SEQ ID NO: 6352534 - DNA, 12 bp, Homo sapiens
gtatgtaacatg

SEQ ID NO: 6352535 - DNA, 23 bp, Homo sapiens
gtatgtaatgtgtggtggcctca

SEQ ID NO: 6352536 - DNA, 11 bp, Homo sapiens
gtatgtacaat

SEQ ID NO: 6352537 - DNA, 19 bp, Homo sapiens
gtatgtacaatacaatgta

SEQ ID NO: 6352538 - DNA, 16 bp, Homo sapiens
gtatgtacaggctgag

SEQ ID NO: 6352539 - DNA, 15 bp, Homo sapiens
gtatgtacagttcat

SEQ ID NO: 6352540 - DNA, 17 bp, Homo sapiens
gtatgtaggagctgcag

SEQ ID NO: 6352541 - DNA, 9 bp, Homo sapiens
gtatgtata

SEQ ID NO: 6352542 - DNA, 21 bp, Homo sapiens
gtatgtataaattatgaagga

SEQ ID NO: 6352543 - DNA, 15 bp, Homo sapiens
gtatgtataattcaa

SEQ ID NO: 6352544 - DNA, 13 bp, Homo sapiens
gtatgtatacaca

SEQ ID NO: 6352545 - DNA, 16 bp, Homo sapiens
gtatgtatacacacac

SEQ ID NO: 6352546 - DNA, 23 bp, Homo sapiens
gtatgtatattaaaaaagagaca

SEQ ID NO: 6352547 - DNA, 15 bp, Homo sapiens
gtatgtatattttca

SEQ ID NO: 6352548 - DNA, 13 bp, Homo sapiens
gtatgtatctatt

SEQ ID NO: 6352549 - DNA, 14 bp, Homo sapiens
gtatgtattaaact

SEQ ID NO: 6352550 - DNA, 13 bp, Homo sapiens
gtatgtcaaagct

SEQ ID NO: 6352551 - DNA, 18 bp, Homo sapiens
gtatgtcaactttatgca

SEQ ID NO: 6352552 - DNA, 18 bp, Homo sapiens
gtatgtcacaaagagctg

SEQ ID NO: 6352553 - DNA, 16 bp, Homo sapiens
gtatgtcactcagaaa

SEQ ID NO: 6352554 - DNA, 23 bp, Homo sapiens
gtatgtcagtgctataaatgcca

SEQ ID NO: 6352555 - DNA, 14 bp, Homo sapiens
gtatgtcagtggtt

SEQ ID NO: 6352556 - DNA, 23 bp, Homo sapiens
gtatgtccacgtactagaaaaat

SEQ ID NO: 6352557 - DNA, 21 bp, Homo sapiens
gtatgtccagaacaaaagata

SEQ ID NO: 6352558 - DNA, 23 bp, Homo sapiens
gtatgtccccataagacaaacac

SEQ ID NO: 6352559 - DNA, 20 bp, Homo sapiens
gtatgtctatgtgtatatat

SEQ ID NO: 6352560 - DNA, 13 bp, Homo sapiens
gtatgtctccagt

SEQ ID NO: 6352561 - DNA, 22 bp, Homo sapiens
gtatgtctctttaagttttgat

SEQ ID NO: 6352562 - DNA, 18 bp, Homo sapiens
gtatgtctgacagtcttt

SEQ ID NO: 6352563 - DNA, 11 bp, Homo sapiens
gtatgtctgcc

SEQ ID NO: 6352564 - DNA, 13 bp, Homo sapiens
gtatgtctgccat

SEQ ID NO: 6352565 - DNA, 11 bp, Homo sapiens
gtatgtctgtc

SEQ ID NO: 6352566 - DNA, 14 bp, Homo sapiens
aaccagaaggaagc

SEQ ID NO: 6352567 - DNA, 15 bp, Homo sapiens
aaccagaataaaata

SEQ ID NO: 6352568 - DNA, 15 bp, Homo sapiens
aaccagaatcataat

SEQ ID NO: 6352569 - DNA, 16 bp, Homo sapiens
aaccagacaaggaaat

SEQ ID NO: 6352570 - DNA, 13 bp, Homo sapiens
aaccagacagagg

SEQ ID NO: 6352571 - DNA, 21 bp, Homo sapiens
aaccagacagatagtgaaaca

SEQ ID NO: 6352572 - DNA, 16 bp, Homo sapiens
aaccagacagcacagg

SEQ ID NO: 6352573 - DNA, 15 bp, Homo sapiens
aaccagacctggaag

SEQ ID NO: 6352574 - DNA, 15 bp, Homo sapiens
aaccagactttgaaa

SEQ ID NO: 6352575 - DNA, 21 bp, Homo sapiens
aaccagactttgaaaaattgt

SEQ ID NO: 6352576 - DNA, 23 bp, Homo sapiens
aaccagactttgaaaaattgttc

SEQ ID NO: 6352577 - DNA, 17 bp, Homo sapiens
aaccagactttgagcct

SEQ ID NO: 6352578 - DNA, 15 bp, Homo sapiens
aaccagagaatctta

SEQ ID NO: 6352579 - DNA, 16 bp, Homo sapiens
aaccagagcaagcttt

SEQ ID NO: 6352580 - DNA, 18 bp, Homo sapiens
aaccagagcactgtatac

SEQ ID NO: 6352581 - DNA, 20 bp, Homo sapiens
aaccagagccccccacaatg

SEQ ID NO: 6352582 - DNA, 14 bp, Homo sapiens
aaccagagctggaa

SEQ ID NO: 6352583 - DNA, 14 bp, Homo sapiens
aaccagaggcagct

SEQ ID NO: 6352584 - DNA, 13 bp, Homo sapiens
aaccagagggcag

SEQ ID NO: 6352585 - DNA, 12 bp, Homo sapiens
aaccagatcatt

SEQ ID NO: 6352586 - DNA, 23 bp, Homo sapiens
aaccagatctagtcaatcaagtc

SEQ ID NO: 6352587 - DNA, 22 bp, Homo sapiens
aaccagatggaacactggaaca

SEQ ID NO: 6352588 - DNA, 19 bp, Homo sapiens
aaccagcaagtcccagaca

SEQ ID NO: 6352589 - DNA, 23 bp, Homo sapiens
aaccagcaagtcccagacaagga

SEQ ID NO: 6352590 - DNA, 17 bp, Homo sapiens
aaccagcacatttctcc

SEQ ID NO: 6352591 - DNA, 13 bp, Homo sapiens
aaccagcactcca

SEQ ID NO: 6352592 - DNA, 16 bp, Homo sapiens
aaccagcactcccagg

SEQ ID NO: 6352593 - DNA, 12 bp, Homo sapiens
aaccagcagaaa

SEQ ID NO: 6352594 - DNA, 15 bp, Homo sapiens
aaccagcagaaaagt

SEQ ID NO: 6352595 - DNA, 16 bp, Homo sapiens
aaccagcagaaaagtg

SEQ ID NO: 6352596 - DNA, 11 bp, Homo sapiens
aaccagcaggt

SEQ ID NO: 6352597 - DNA, 19 bp, Homo sapiens
aaccagcatctcagcgcca

SEQ ID NO: 6352598 - DNA, 12 bp, Homo sapiens
aaccagcattca

SEQ ID NO: 6352599 - DNA, 15 bp, Homo sapiens
aaccagcattttact

SEQ ID NO: 6352600 - DNA, 12 bp, Homo sapiens
aaccagccaggc

SEQ ID NO: 6352601 - DNA, 16 bp, Homo sapiens
aaccagccaggcagag

SEQ ID NO: 6352602 - DNA, 14 bp, Homo sapiens
aaccagcccagcct

SEQ ID NO: 6352603 - DNA, 15 bp, Homo sapiens
aaccagcccagcctg

SEQ ID NO: 6352604 - DNA, 14 bp, Homo sapiens
aaccagccctccag

SEQ ID NO: 6352605 - DNA, 20 bp, Homo sapiens
aaccagcctcatgctctgat

SEQ ID NO: 6352606 - DNA, 14 bp, Homo sapiens
aaccagctaagaaa

SEQ ID NO: 6352607 - DNA, 16 bp, Homo sapiens
aaccagctaagaaaag

SEQ ID NO: 6352608 - DNA, 21 bp, Homo sapiens
aaccagctaagaaaagatttt

SEQ ID NO: 6352609 - DNA, 18 bp, Homo sapiens
aaccagctattggaacag

SEQ ID NO: 6352610 - DNA, 22 bp, Homo sapiens
aaccagctcagcactgcctgct

SEQ ID NO: 6352611 - DNA, 19 bp, Homo sapiens
aaccagctcagtgttttgg

SEQ ID NO: 6352612 - DNA, 19 bp, Homo sapiens
aaccagcttccttcagaga

SEQ ID NO: 6352613 - DNA, 13 bp, Homo sapiens
aaccaggaaaagg

SEQ ID NO: 6352614 - DNA, 16 bp, Homo sapiens
aaccaggactctgccc

SEQ ID NO: 6352615 - DNA, 17 bp, Homo sapiens
aaccaggagctgctcac

SEQ ID NO: 6352616 - DNA, 20 bp, Homo sapiens
aaccaggaggggtctgcctc

SEQ ID NO: 6352617 - DNA, 21 bp, Homo sapiens
aaccaggagggtaacagaaga

SEQ ID NO: 6352618 - DNA, 18 bp, Homo sapiens
aaccaggcacctcttcct

SEQ ID NO: 6352619 - DNA, 14 bp, Homo sapiens
aaccaggcagctga

SEQ ID NO: 6352620 - DNA, 18 bp, Homo sapiens
aaccaggccccagcctcc

SEQ ID NO: 6352621 - DNA, 15 bp, Homo sapiens
aaccaggcctctgct

SEQ ID NO: 6352622 - DNA, 18 bp, Homo sapiens
aaccagggaagctgtccc

SEQ ID NO: 6352623 - DNA, 19 bp, Homo sapiens
aaccagggaagctgtccct

SEQ ID NO: 6352624 - DNA, 18 bp, Homo sapiens
aaccagggaagctgtcct

SEQ ID NO: 6352625 - DNA, 17 bp, Homo sapiens
aaccagggaggagagga

SEQ ID NO: 6352626 - DNA, 14 bp, Homo sapiens
aaccagggatgtct

SEQ ID NO: 6352627 - DNA, 19 bp, Homo sapiens
aaccagggattgtttctgt

SEQ ID NO: 6352628 - DNA, 22 bp, Homo sapiens
aaccagggcaccaagcccacag

SEQ ID NO: 6352629 - DNA, 21 bp, Homo sapiens
aaccagggccccggggcctgt

SEQ ID NO: 6352630 - DNA, 11 bp, Homo sapiens
aaccagggcct

SEQ ID NO: 6352631 - DNA, 16 bp, Homo sapiens
aaccagggggaagcac

SEQ ID NO: 6352632 - DNA, 21 bp, Homo sapiens
aaccaggtttagacagtatga

SEQ ID NO: 6352633 - DNA, 20 bp, Homo sapiens
aaccagtaagtatgggagtc

SEQ ID NO: 6352634 - DNA, 15 bp, Homo sapiens
aaccagtacttctaa

SEQ ID NO: 6352635 - DNA, 16 bp, Homo sapiens
aaccagtatacaagat

SEQ ID NO: 6352636 - DNA, 17 bp, Homo sapiens
aaccagtatacaagata

SEQ ID NO: 6352637 - DNA, 21 bp, Homo sapiens
aaccagtatggaagggagggg

SEQ ID NO: 6352638 - DNA, 11 bp, Homo sapiens
aaccagtattg

SEQ ID NO: 6352639 - DNA, 20 bp, Homo sapiens
aaccagtattgtacaaagta

SEQ ID NO: 6352640 - DNA, 14 bp, Homo sapiens
aaccagtatttaag

SEQ ID NO: 6352641 - DNA, 16 bp, Homo sapiens
aaccagtatttttgct

SEQ ID NO: 6352642 - DNA, 16 bp, Homo sapiens
aaccagtccctctgag

SEQ ID NO: 6352643 - DNA, 15 bp, Homo sapiens
aaccagtcctgctgc

SEQ ID NO: 6352644 - DNA, 22 bp, Homo sapiens
aaccagtctgaagtttcattta

SEQ ID NO: 6352645 - DNA, 22 bp, Homo sapiens
aaccagtctgtgtttacagaca

SEQ ID NO: 6352646 - DNA, 23 bp, Homo sapiens
aaccagtctgtgtttacagacag

SEQ ID NO: 6352647 - DNA, 17 bp, Homo sapiens
aaccagtgaagtgccac

SEQ ID NO: 6352648 - DNA, 16 bp, Homo sapiens
aaccagtgtaactggc

SEQ ID NO: 6352649 - DNA, 18 bp, Homo sapiens
aaccagtgtaactggctg

SEQ ID NO: 6352650 - DNA, 14 bp, Homo sapiens
aaccagtgtagcct

SEQ ID NO: 6352651 - DNA, 11 bp, Homo sapiens
aaccagtgtga

SEQ ID NO: 6352652 - DNA, 13 bp, Homo sapiens
aaccagtgtgaac

SEQ ID NO: 6352653 - DNA, 13 bp, Homo sapiens
aaccagttaaagc

SEQ ID NO: 6352654 - DNA, 14 bp, Homo sapiens
aaccagttattttt

SEQ ID NO: 6352655 - DNA, 23 bp, Homo sapiens
aaccagttatttttattattgag

SEQ ID NO: 6352656 - DNA, 12 bp, Homo sapiens
aaccagttgtgg

SEQ ID NO: 6352657 - DNA, 19 bp, Homo sapiens
aaccagttgtggtgtgagt

SEQ ID NO: 6352658 - DNA, 21 bp, Homo sapiens
aaccagttgtggtgtgagtat

SEQ ID NO: 6352659 - DNA, 15 bp, Homo sapiens
aaccagtttaaattg

SEQ ID NO: 6352660 - DNA, 22 bp, Homo sapiens
aaccagtttagctttttcctta

SEQ ID NO: 6352661 - DNA, 14 bp, Homo sapiens
aaccagtttcacat

SEQ ID NO: 6352662 - DNA, 15 bp, Homo sapiens
aaccagttttgctgc

SEQ ID NO: 6352663 - DNA, 21 bp, Homo sapiens
aaccagttttttcacctccat

SEQ ID NO: 6352664 - DNA, 15 bp, Homo sapiens
aaccataaaataaat

SEQ ID NO: 6352665 - DNA, 18 bp, Homo sapiens
aaccataaaataaataat

SEQ ID NO: 6352666 - DNA, 18 bp, Homo sapiens
aaccataaacatttgcac

SEQ ID NO: 6352667 - DNA, 13 bp, Homo sapiens
aaccataaacttc

SEQ ID NO: 6352668 - DNA, 14 bp, Homo sapiens
aaccataaattcaa

SEQ ID NO: 6352669 - DNA, 19 bp, Homo sapiens
aaccataactgacaagaga

SEQ ID NO: 6352670 - DNA, 14 bp, Homo sapiens
aaccatactttata

SEQ ID NO: 6352671 - DNA, 16 bp, Homo sapiens
aaccatagaactgtcc

SEQ ID NO: 6352672 - DNA, 20 bp, Homo sapiens
aaccataggactgtggcaaa

SEQ ID NO: 6352673 - DNA, 16 bp, Homo sapiens
aaccatagttactgta

SEQ ID NO: 6352674 - DNA, 17 bp, Homo sapiens
aaccatagttactgtaa

SEQ ID NO: 6352675 - DNA, 14 bp, Homo sapiens
aaccatatgatact

SEQ ID NO: 6352676 - DNA, 18 bp, Homo sapiens
aaccatatgattgaaaag

SEQ ID NO: 6352677 - DNA, 21 bp, Homo sapiens
aaccatatgattgaaaagaag

SEQ ID NO: 6352678 - DNA, 12 bp, Homo sapiens
aaccatatgccc

SEQ ID NO: 6352679 - DNA, 16 bp, Homo sapiens
aaccatcagaattcag

SEQ ID NO: 6352680 - DNA, 12 bp, Homo sapiens
aaccatcattga

SEQ ID NO: 6352681 - DNA, 21 bp, Homo sapiens
aaccatcattgaaatcttttt

SEQ ID NO: 6352682 - DNA, 13 bp, Homo sapiens
aaccatccatccc

SEQ ID NO: 6352683 - DNA, 20 bp, Homo sapiens
aaccatccatccctagaaga

SEQ ID NO: 6352684 - DNA, 19 bp, Homo sapiens
aaccatcccctccgtggca

SEQ ID NO: 6352685 - DNA, 17 bp, Homo sapiens
aaccatccttaaattat

SEQ ID NO: 6352686 - DNA, 12 bp, Homo sapiens
aaccatctcaga

SEQ ID NO: 6352687 - DNA, 20 bp, Homo sapiens
aaccatctcagacctttact

SEQ ID NO: 6352688 - DNA, 13 bp, Homo sapiens
aaccatctccctg

SEQ ID NO: 6352689 - DNA, 19 bp, Homo sapiens
aaccatctgaagaaacttc

SEQ ID NO: 6352690 - DNA, 15 bp, Homo sapiens
aaccatctggcctgg

SEQ ID NO: 6352691 - DNA, 16 bp, Homo sapiens
aaccatctggtgcctt

SEQ ID NO: 6352692 - DNA, 18 bp, Homo sapiens
aaccatcttcactggctt

SEQ ID NO: 6352693 - DNA, 14 bp, Homo sapiens
aaccatgaaaaaat

SEQ ID NO: 6352694 - DNA, 16 bp, Homo sapiens
aaccatgaaaagtttt

SEQ ID NO: 6352695 - DNA, 21 bp, Homo sapiens
aaccatgaagagatttttcat

SEQ ID NO: 6352696 - DNA, 24 bp, Homo sapiens
aaccatgaagagatttttcatgat

SEQ ID NO: 6352697 - DNA, 12 bp, Homo sapiens
aaccatgacaaa

SEQ ID NO: 6352698 - DNA, 19 bp, Homo sapiens
aaccatgattgaaggagaa

SEQ ID NO: 6352699 - DNA, 20 bp, Homo sapiens
aaccatgcagcttcatcaat

SEQ ID NO: 6352700 - DNA, 22 bp, Homo sapiens
aaccatgcagcttcatcaattt

SEQ ID NO: 6352701 - DNA, 23 bp, Homo sapiens
aaccatgcagcttcatcaatttt

SEQ ID NO: 6352702 - DNA, 18 bp, Homo sapiens
aaccatgcaggaaggaaa

SEQ ID NO: 6352703 - DNA, 20 bp, Homo sapiens
aaccatgcctggtattttca

SEQ ID NO: 6352704 - DNA, 23 bp, Homo sapiens
aaccatgctggtatatggcttca

SEQ ID NO: 6352705 - DNA, 14 bp, Homo sapiens
aaccatggcaaagt

SEQ ID NO: 6352706 - DNA, 15 bp, Homo sapiens
aaccatgggataaat

SEQ ID NO: 6352707 - DNA, 20 bp, Homo sapiens
aaccatgggataaatgccat

SEQ ID NO: 6352708 - DNA, 21 bp, Homo sapiens
aaccatgggataaatgccatc

SEQ ID NO: 6352709 - DNA, 18 bp, Homo sapiens
aaccatgggctcagggcc

SEQ ID NO: 6352710 - DNA, 22 bp, Homo sapiens
aaccatgtagcagtgagtcata

SEQ ID NO: 6352711 - DNA, 12 bp, Homo sapiens
aaccatgtagtt

SEQ ID NO: 6352712 - DNA, 21 bp, Homo sapiens
aaccatgtatgtggtatgtat

SEQ ID NO: 6352713 - DNA, 17 bp, Homo sapiens
aaccatgtcagcaaaaa

SEQ ID NO: 6352714 - DNA, 21 bp, Homo sapiens
aaccatgtcagcaaaaagcaa

SEQ ID NO: 6352715 - DNA, 17 bp, Homo sapiens
aaccatgtcatttcaga

SEQ ID NO: 6352716 - DNA, 14 bp, Homo sapiens
aaccatgttcttga

SEQ ID NO: 6352717 - DNA, 21 bp, Homo sapiens
aaccattaatgaaaacttttt

SEQ ID NO: 6352718 - DNA, 20 bp, Homo sapiens
aaccattacatgtttaaatt

SEQ ID NO: 6352719 - DNA, 13 bp, Homo sapiens
aaccattactgta

SEQ ID NO: 6352720 - DNA, 16 bp, Homo sapiens
aaccattcgacctata

SEQ ID NO: 6352721 - DNA, 20 bp, Homo sapiens
aaccattcttgggaggacac

SEQ ID NO: 6352722 - DNA, 20 bp, Homo sapiens
aaccattgctaatttaaagg

SEQ ID NO: 6352723 - DNA, 13 bp, Homo sapiens
aaccattgcttca

SEQ ID NO: 6352724 - DNA, 16 bp, Homo sapiens
aaccattgcttcacta

SEQ ID NO: 6352725 - DNA, 13 bp, Homo sapiens
aaccattggacag

SEQ ID NO: 6352726 - DNA, 16 bp, Homo sapiens
aaccattggacagatt

SEQ ID NO: 6352727 - DNA, 17 bp, Homo sapiens
aaccattggggaggact

SEQ ID NO: 6352728 - DNA, 15 bp, Homo sapiens
aaccattgtcttgtt

SEQ ID NO: 6352729 - DNA, 13 bp, Homo sapiens
aaccattgtgcat

SEQ ID NO: 6352730 - DNA, 16 bp, Homo sapiens
aaccattgtgcattct

SEQ ID NO: 6352731 - DNA, 18 bp, Homo sapiens
aaccatttaattcataat

SEQ ID NO: 6352732 - DNA, 20 bp, Homo sapiens
aaccatttaattcataatta

SEQ ID NO: 6352733 - DNA, 21 bp, Homo sapiens
aaccatttaattcataattag

SEQ ID NO: 6352734 - DNA, 13 bp, Homo sapiens
aaccatttatctt

SEQ ID NO: 6352735 - DNA, 17 bp, Homo sapiens
aaccatttcaagacaga

SEQ ID NO: 6352736 - DNA, 13 bp, Homo sapiens
aaccatttccaac

SEQ ID NO: 6352737 - DNA, 21 bp, Homo sapiens
aaccatttccaacagcaacac

SEQ ID NO: 6352738 - DNA, 13 bp, Homo sapiens
aaccatttcttat

SEQ ID NO: 6352739 - DNA, 18 bp, Homo sapiens
aaccattttattttttgg

SEQ ID NO: 6352740 - DNA, 20 bp, Homo sapiens
aaccattttattttttgggc

SEQ ID NO: 6352741 - DNA, 14 bp, Homo sapiens
aaccattttcatta

SEQ ID NO: 6352742 - DNA, 12 bp, Homo sapiens
aaccattttcct

SEQ ID NO: 6352743 - DNA, 12 bp, Homo sapiens
aaccatttttga

SEQ ID NO: 6352744 - DNA, 17 bp, Homo sapiens
aaccatttttgaacctt

SEQ ID NO: 6352745 - DNA, 13 bp, Homo sapiens
aaccatttttgct

SEQ ID NO: 6352746 - DNA, 22 bp, Homo sapiens
aacccaaaaaagaacaagctca

SEQ ID NO: 6352747 - DNA, 14 bp, Homo sapiens
gtatgtctgtgcca

SEQ ID NO: 6352748 - DNA, 12 bp, Homo sapiens
gtatgtctgtgt

SEQ ID NO: 6352749 - DNA, 12 bp, Homo sapiens
gtatgtctgttt

SEQ ID NO: 6352750 - DNA, 23 bp, Homo sapiens
gtatgtgaattgaagtcatcata

SEQ ID NO: 6352751 - DNA, 13 bp, Homo sapiens
gtatgtgagctgt

SEQ ID NO: 6352752 - DNA, 17 bp, Homo sapiens
gtatgtgcacatgtgtc

SEQ ID NO: 6352753 - DNA, 16 bp, Homo sapiens
gtatgtgcccctcctg

SEQ ID NO: 6352754 - DNA, 21 bp, Homo sapiens
gtatgtgcccctcctgggtgc

SEQ ID NO: 6352755 - DNA, 20 bp, Homo sapiens
gtatgtgctatacacacaca

SEQ ID NO: 6352756 - DNA, 16 bp, Homo sapiens
gtatgtgctgtaattt

SEQ ID NO: 6352757 - DNA, 12 bp, Homo sapiens
gtatgtggaagg

SEQ ID NO: 6352758 - DNA, 15 bp, Homo sapiens
gtatgtggaagtgtg

SEQ ID NO: 6352759 - DNA, 21 bp, Homo sapiens
gtatgtggaagtgtgggtctg

SEQ ID NO: 6352760 - DNA, 21 bp, Homo sapiens
gtatgtggatacagtcattat

SEQ ID NO: 6352761 - DNA, 17 bp, Homo sapiens
gtatgtggcaaaacata

SEQ ID NO: 6352762 - DNA, 15 bp, Homo sapiens
gtatgtggcaaaatg

SEQ ID NO: 6352763 - DNA, 17 bp, Homo sapiens
gtatgtggccatattta

SEQ ID NO: 6352764 - DNA, 15 bp, Homo sapiens
gtatgtgggatattg

SEQ ID NO: 6352765 - DNA, 19 bp, Homo sapiens
gtatgtgggggtctgtgtg

SEQ ID NO: 6352766 - DNA, 11 bp, Homo sapiens
gtatgtgtata

SEQ ID NO: 6352767 - DNA, 12 bp, Homo sapiens
gtatgtgtatat

SEQ ID NO: 6352768 - DNA, 16 bp, Homo sapiens
gtatgtgtatatgttt

SEQ ID NO: 6352769 - DNA, 18 bp, Homo sapiens
gtatgtgtcaactgagag

SEQ ID NO: 6352770 - DNA, 17 bp, Homo sapiens
gtatgtgtgaagtgagt

SEQ ID NO: 6352771 - DNA, 20 bp, Homo sapiens
gtatgtgtgagtgtatgtat

SEQ ID NO: 6352772 - DNA, 16 bp, Homo sapiens
gtatgtgtggctgtgg

SEQ ID NO: 6352773 - DNA, 11 bp, Homo sapiens
gtatgtgtggg

SEQ ID NO: 6352774 - DNA, 16 bp, Homo sapiens
gtatgtgtgtaggtta

SEQ ID NO: 6352775 - DNA, 14 bp, Homo sapiens
gtatgtgtgtgagt

SEQ ID NO: 6352776 - DNA, 16 bp, Homo sapiens
gtatgtgtgtgtatgc

SEQ ID NO: 6352777 - DNA, 18 bp, Homo sapiens
gtatgtgtgtgtatgcta

SEQ ID NO: 6352778 - DNA, 17 bp, Homo sapiens
gtatgtgtgtgtgtatg

SEQ ID NO: 6352779 - DNA, 16 bp, Homo sapiens
gtatgtgttgccaaag

SEQ ID NO: 6352780 - DNA, 16 bp, Homo sapiens
gtatgtgtttgtgtgt

SEQ ID NO: 6352781 - DNA, 20 bp, Homo sapiens
gtatgttaacctaggcagtg

SEQ ID NO: 6352782 - DNA, 16 bp, Homo sapiens
gtatgttattcctggt

SEQ ID NO: 6352783 - DNA, 21 bp, Homo sapiens
gtatgttccaaaccctcctgg

SEQ ID NO: 6352784 - DNA, 18 bp, Homo sapiens
gtatgttgaggatctatt

SEQ ID NO: 6352785 - DNA, 13 bp, Homo sapiens
gtatgttgcatga

SEQ ID NO: 6352786 - DNA, 16 bp, Homo sapiens
gtatgttgtacatact

SEQ ID NO: 6352787 - DNA, 14 bp, Homo sapiens
gtatgttgtcataa

SEQ ID NO: 6352788 - DNA, 11 bp, Homo sapiens
gtatgttgtcc

SEQ ID NO: 6352789 - DNA, 19 bp, Homo sapiens
gtatgtttaatctgttatg

SEQ ID NO: 6352790 - DNA, 14 bp, Homo sapiens
gtatgtttacactg

SEQ ID NO: 6352791 - DNA, 17 bp, Homo sapiens
gtatgtttacactgtca

SEQ ID NO: 6352792 - DNA, 21 bp, Homo sapiens
gtatgtttatcaaagagcact

SEQ ID NO: 6352793 - DNA, 17 bp, Homo sapiens
gtatgtttctctttgat

SEQ ID NO: 6352794 - DNA, 20 bp, Homo sapiens
gtatgtttgctgattattta

SEQ ID NO: 6352795 - DNA, 22 bp, Homo sapiens
gtatgtttgtaactttttacat

SEQ ID NO: 6352796 - DNA, 16 bp, Homo sapiens
gtatgttttagcatgt

SEQ ID NO: 6352797 - DNA, 18 bp, Homo sapiens
gtatgttttattgtaatc

SEQ ID NO: 6352798 - DNA, 14 bp, Homo sapiens
gtatgtttttcagt

SEQ ID NO: 6352799 - DNA, 20 bp, Homo sapiens
gtatgtttttcagttcaaag

SEQ ID NO: 6352800 - DNA, 23 bp, Homo sapiens
gtatgtttttgtgtatttgttaa

SEQ ID NO: 6352801 - DNA, 13 bp, Homo sapiens
gtattaaaacatt

SEQ ID NO: 6352802 - DNA, 15 bp, Homo sapiens
gtattaaaacattgg

SEQ ID NO: 6352803 - DNA, 23 bp, Homo sapiens
gtattaaaacattggattatcct

SEQ ID NO: 6352804 - DNA, 20 bp, Homo sapiens
gtattaaaactaaatttcac

SEQ ID NO: 6352805 - DNA, 15 bp, Homo sapiens
gtattaaaatctaca

SEQ ID NO: 6352806 - DNA, 17 bp, Homo sapiens
gtattaaacctttccat

SEQ ID NO: 6352807 - DNA, 16 bp, Homo sapiens
gtattaaactgtaaat

SEQ ID NO: 6352808 - DNA, 20 bp, Homo sapiens
gtattaaactgtaaatcata

SEQ ID NO: 6352809 - DNA, 15 bp, Homo sapiens
gtattaaagaaaaat

SEQ ID NO: 6352810 - DNA, 18 bp, Homo sapiens
gtattaaagaatgctgca

SEQ ID NO: 6352811 - DNA, 17 bp, Homo sapiens
gtattaaagatgcaggt

SEQ ID NO: 6352812 - DNA, 14 bp, Homo sapiens
gtattaaagatgtg

SEQ ID NO: 6352813 - DNA, 19 bp, Homo sapiens
gtattaaaggggggagggg

SEQ ID NO: 6352814 - DNA, 20 bp, Homo sapiens
gtattaaatcagttctcaat

SEQ ID NO: 6352815 - DNA, 15 bp, Homo sapiens
gtattaaatcttaaa

SEQ ID NO: 6352816 - DNA, 22 bp, Homo sapiens
gtattaaatcttaaacaatgta

SEQ ID NO: 6352817 - DNA, 13 bp, Homo sapiens
gtattaaatggtt

SEQ ID NO: 6352818 - DNA, 21 bp, Homo sapiens
gtattaaattacatttgtaat

SEQ ID NO: 6352819 - DNA, 22 bp, Homo sapiens
gtattaacactaaattgcagtt

SEQ ID NO: 6352820 - DNA, 16 bp, Homo sapiens
gtattaacctacctgt

SEQ ID NO: 6352821 - DNA, 19 bp, Homo sapiens
gtattaagggcattttaaa

SEQ ID NO: 6352822 - DNA, 15 bp, Homo sapiens
gtattaagtgaaatt

SEQ ID NO: 6352823 - DNA, 13 bp, Homo sapiens
gtattaataaaaa

SEQ ID NO: 6352824 - DNA, 14 bp, Homo sapiens
gtattaataaaaag

SEQ ID NO: 6352825 - DNA, 12 bp, Homo sapiens
gtattaataaag

SEQ ID NO: 6352826 - DNA, 15 bp, Homo sapiens
gtattaataaagcat

SEQ ID NO: 6352827 - DNA, 18 bp, Homo sapiens
gtattaataaatagagca

SEQ ID NO: 6352828 - DNA, 19 bp, Homo sapiens
gtattaataaatagagcaa

SEQ ID NO: 6352829 - DNA, 19 bp, Homo sapiens
gtattaatactaaaatatg

SEQ ID NO: 6352830 - DNA, 21 bp, Homo sapiens
gtattaatactaaaatatgtc

SEQ ID NO: 6352831 - DNA, 14 bp, Homo sapiens
gtattaatatatag

SEQ ID NO: 6352832 - DNA, 16 bp, Homo sapiens
gtattaatatctccat

SEQ ID NO: 6352833 - DNA, 20 bp, Homo sapiens
gtattaatccccatcattac

SEQ ID NO: 6352834 - DNA, 23 bp, Homo sapiens
gtattaatctgtttgtgcaaaca

SEQ ID NO: 6352835 - DNA, 13 bp, Homo sapiens
gtattaatcttgt

SEQ ID NO: 6352836 - DNA, 21 bp, Homo sapiens
gtattaatgtatgtaggagct

SEQ ID NO: 6352837 - DNA, 15 bp, Homo sapiens
gtattaattctcttt

SEQ ID NO: 6352838 - DNA, 14 bp, Homo sapiens
gtattaatttagaa

SEQ ID NO: 6352839 - DNA, 16 bp, Homo sapiens
gtattaatttagaatg

SEQ ID NO: 6352840 - DNA, 15 bp, Homo sapiens
gtattacacattaaa

SEQ ID NO: 6352841 - DNA, 22 bp, Homo sapiens
gtattacagtggggaatgaaga

SEQ ID NO: 6352842 - DNA, 15 bp, Homo sapiens
gtattacataaataa

SEQ ID NO: 6352843 - DNA, 20 bp, Homo sapiens
gtattacatgactgtttctt

SEQ ID NO: 6352844 - DNA, 20 bp, Homo sapiens
gtattaccaccctttcacaa

SEQ ID NO: 6352845 - DNA, 17 bp, Homo sapiens
gtattaccatgtaaata

SEQ ID NO: 6352846 - DNA, 20 bp, Homo sapiens
gtattaccatgtaaataatc

SEQ ID NO: 6352847 - DNA, 14 bp, Homo sapiens
gtattaccattact

SEQ ID NO: 6352848 - DNA, 21 bp, Homo sapiens
gtattactagaagatgaatac

SEQ ID NO: 6352849 - DNA, 19 bp, Homo sapiens
gtattactgctgctgtgct

SEQ ID NO: 6352850 - DNA, 18 bp, Homo sapiens
gtattacttaggttattt

SEQ ID NO: 6352851 - DNA, 20 bp, Homo sapiens
gtattacttaggttattttg

SEQ ID NO: 6352852 - DNA, 23 bp, Homo sapiens
gtattacttaggttattttgctt

SEQ ID NO: 6352853 - DNA, 14 bp, Homo sapiens
gtattacttctgct

SEQ ID NO: 6352854 - DNA, 19 bp, Homo sapiens
gtattactttctctgtagt

SEQ ID NO: 6352855 - DNA, 17 bp, Homo sapiens
gtattactttctgccgc

SEQ ID NO: 6352856 - DNA, 20 bp, Homo sapiens
gtattacttttctgcaatgt

SEQ ID NO: 6352857 - DNA, 18 bp, Homo sapiens
gtattagagcgccagctc

SEQ ID NO: 6352858 - DNA, 13 bp, Homo sapiens
gtattagatatca

SEQ ID NO: 6352859 - DNA, 22 bp, Homo sapiens
gtattagcatgagctttccagt

SEQ ID NO: 6352860 - DNA, 13 bp, Homo sapiens
gtattagccagga

SEQ ID NO: 6352861 - DNA, 15 bp, Homo sapiens
gtattagccagtcat

SEQ ID NO: 6352862 - DNA, 20 bp, Homo sapiens
gtattagccagtcattgtaa

SEQ ID NO: 6352863 - DNA, 22 bp, Homo sapiens
gtattagctgtattatccattt

SEQ ID NO: 6352864 - DNA, 17 bp, Homo sapiens
gtattagtaataaaaca

SEQ ID NO: 6352865 - DNA, 16 bp, Homo sapiens
gtattagtgctagtct

SEQ ID NO: 6352866 - DNA, 23 bp, Homo sapiens
gtattagtggaaagtgatttgta

SEQ ID NO: 6352867 - DNA, 15 bp, Homo sapiens
gtattagttgccaat

SEQ ID NO: 6352868 - DNA, 14 bp, Homo sapiens
gtattagtttttga

SEQ ID NO: 6352869 - DNA, 22 bp, Homo sapiens
gtattataataagcaaaaagat

SEQ ID NO: 6352870 - DNA, 22 bp, Homo sapiens
gtattatacatgtgatacattt

SEQ ID NO: 6352871 - DNA, 13 bp, Homo sapiens
gtattatatgtac

SEQ ID NO: 6352872 - DNA, 20 bp, Homo sapiens
gtattatatttaaaaaaaac

SEQ ID NO: 6352873 - DNA, 20 bp, Homo sapiens
gtattatattttatttatct

SEQ ID NO: 6352874 - DNA, 16 bp, Homo sapiens
gtattatcaaagggat

SEQ ID NO: 6352875 - DNA, 18 bp, Homo sapiens
gtattatcacatcaagca

SEQ ID NO: 6352876 - DNA, 12 bp, Homo sapiens
gtattatcataa

SEQ ID NO: 6352877 - DNA, 13 bp, Homo sapiens
gtattatcatata

SEQ ID NO: 6352878 - DNA, 19 bp, Homo sapiens
gtattatcattgctcccct

SEQ ID NO: 6352879 - DNA, 16 bp, Homo sapiens
gtattatctaaatgaa

SEQ ID NO: 6352880 - DNA, 16 bp, Homo sapiens
gtattatctgtaaaaa

SEQ ID NO: 6352881 - DNA, 17 bp, Homo sapiens
gtattatctgttgcctt

SEQ ID NO: 6352882 - DNA, 21 bp, Homo sapiens
gtattatgcctgagttataaa

SEQ ID NO: 6352883 - DNA, 12 bp, Homo sapiens
gtattatgctgt

SEQ ID NO: 6352884 - DNA, 17 bp, Homo sapiens
gtattatgcttcttgga

SEQ ID NO: 6352885 - DNA, 23 bp, Homo sapiens
gtattatgtcctgtgagatgtgt

SEQ ID NO: 6352886 - DNA, 15 bp, Homo sapiens
gtattatgtgtgttt

SEQ ID NO: 6352887 - DNA, 19 bp, Homo sapiens
gtattattaacactaataa

SEQ ID NO: 6352888 - DNA, 14 bp, Homo sapiens
gtattattctacta

SEQ ID NO: 6352889 - DNA, 16 bp, Homo sapiens
gtattattctgcagca

SEQ ID NO: 6352890 - DNA, 15 bp, Homo sapiens
gtattattgaagatg

SEQ ID NO: 6352891 - DNA, 12 bp, Homo sapiens
gtattattgctg

SEQ ID NO: 6352892 - DNA, 14 bp, Homo sapiens
gtattattgtaaag

SEQ ID NO: 6352893 - DNA, 16 bp, Homo sapiens
gtattatttacattta

SEQ ID NO: 6352894 - DNA, 18 bp, Homo sapiens
gtattatttagtaaaatt

SEQ ID NO: 6352895 - DNA, 20 bp, Homo sapiens
gtattatttctccatcccct

SEQ ID NO: 6352896 - DNA, 16 bp, Homo sapiens
gtattcaaatttgtgt

SEQ ID NO: 6352897 - DNA, 18 bp, Homo sapiens
gtattcaacaatttcaat

SEQ ID NO: 6352898 - DNA, 20 bp, Homo sapiens
gtattcaacagaaggactgt

SEQ ID NO: 6352899 - DNA, 18 bp, Homo sapiens
gtattcaataccgctcag

SEQ ID NO: 6352900 - DNA, 21 bp, Homo sapiens
gtattcaataccgctcagtat

SEQ ID NO: 6352901 - DNA, 15 bp, Homo sapiens
gtattcaccaccctg

SEQ ID NO: 6352902 - DNA, 23 bp, Homo sapiens
gtattcaccccacacccagggct

SEQ ID NO: 6352903 - DNA, 15 bp, Homo sapiens
gtattcagaaattaa

SEQ ID NO: 6352904 - DNA, 10 bp, Homo sapiens
gtattcagat

SEQ ID NO: 6352905 - DNA, 19 bp, Homo sapiens
gtattcagatcgtattaat

SEQ ID NO: 6352906 - DNA, 21 bp, Homo sapiens
gtattcaggaccccatctgct

SEQ ID NO: 6352907 - DNA, 14 bp, Homo sapiens
gtattcaggcactg

SEQ ID NO: 6352908 - DNA, 15 bp, Homo sapiens
gtattcaggcactga

SEQ ID NO: 6352909 - DNA, 13 bp, Homo sapiens
gtattcatatatt

SEQ ID NO: 6352910 - DNA, 16 bp, Homo sapiens
gtattcatatattgca

SEQ ID NO: 6352911 - DNA, 23 bp, Homo sapiens
gtattcatattaccagaaaatga

SEQ ID NO: 6352912 - DNA, 14 bp, Homo sapiens
gtattcatatttgt

SEQ ID NO: 6352913 - DNA, 23 bp, Homo sapiens
gtattcatatttgtactttctgt

SEQ ID NO: 6352914 - DNA, 15 bp, Homo sapiens
gtattccaccttaaa

SEQ ID NO: 6352915 - DNA, 19 bp, Homo sapiens
gtattccagacctgaagaa

SEQ ID NO: 6352916 - DNA, 15 bp, Homo sapiens
gtattccagtttgtt

SEQ ID NO: 6352917 - DNA, 18 bp, Homo sapiens
gtattccagtttgtttat

SEQ ID NO: 6352918 - DNA, 16 bp, Homo sapiens
gtattccatgggatgt

SEQ ID NO: 6352919 - DNA, 18 bp, Homo sapiens
gtattccatgggatgtta

SEQ ID NO: 6352920 - DNA, 20 bp, Homo sapiens
gtattcccactcaccagccc

SEQ ID NO: 6352921 - DNA, 23 bp, Homo sapiens
gtattcctagcaaatttctctct

SEQ ID NO: 6352922 - DNA, 11 bp, Homo sapiens
gtattcctctc

SEQ ID NO: 6352923 - DNA, 13 bp, Homo sapiens
gtattcctgaaaa

SEQ ID NO: 6352924 - DNA, 15 bp, Homo sapiens
gtattcctgcctttg

SEQ ID NO: 6352925 - DNA, 12 bp, Homo sapiens
gtattcctgttg

SEQ ID NO: 6352926 - DNA, 18 bp, Homo sapiens
gtattccttaaataaact

SEQ ID NO: 6352927 - DNA, 23 bp, Homo sapiens
aacccaaaaagagacccacaata

SEQ ID NO: 6352928 - DNA, 13 bp, Homo sapiens
aacccaaacctgg

SEQ ID NO: 6352929 - DNA, 15 bp, Homo sapiens
aacccaaacctggag

SEQ ID NO: 6352930 - DNA, 17 bp, Homo sapiens
aacccaaacctggagat

SEQ ID NO: 6352931 - DNA, 12 bp, Homo sapiens
aacccaaagatg

SEQ ID NO: 6352932 - DNA, 17 bp, Homo sapiens
aacccaaagatgttaac

SEQ ID NO: 6352933 - DNA, 18 bp, Homo sapiens
aacccaaagatgttaaca

SEQ ID NO: 6352934 - DNA, 22 bp, Homo sapiens
aacccaaaggtggcagcttgtg

SEQ ID NO: 6352935 - DNA, 22 bp, Homo sapiens
aacccaaataaatgtgtaaatg

SEQ ID NO: 6352936 - DNA, 19 bp, Homo sapiens
aacccaaatcttgtttaca

SEQ ID NO: 6352937 - DNA, 20 bp, Homo sapiens
aacccaactgacttctgcta

SEQ ID NO: 6352938 - DNA, 21 bp, Homo sapiens
aacccaagatgcaagaaggag

SEQ ID NO: 6352939 - DNA, 15 bp, Homo sapiens
aacccaagctctggg

SEQ ID NO: 6352940 - DNA, 15 bp, Homo sapiens
aacccaagcttagaa

SEQ ID NO: 6352941 - DNA, 22 bp, Homo sapiens
aacccaaggagcacaggtccca

SEQ ID NO: 6352942 - DNA, 15 bp, Homo sapiens
aacccaaggcaatga

SEQ ID NO: 6352943 - DNA, 23 bp, Homo sapiens
aacccaaggcatcacagttcaca

SEQ ID NO: 6352944 - DNA, 19 bp, Homo sapiens
aacccaaggtaccatccta

SEQ ID NO: 6352945 - DNA, 16 bp, Homo sapiens
aacccaaggtgaggtg

SEQ ID NO: 6352946 - DNA, 18 bp, Homo sapiens
aacccaagtccaagcata

SEQ ID NO: 6352947 - DNA, 19 bp, Homo sapiens
aacccaagtgctgcacaaa

SEQ ID NO: 6352948 - DNA, 12 bp, Homo sapiens
aacccaattttc

SEQ ID NO: 6352949 - DNA, 22 bp, Homo sapiens
aacccacaagctgcctctgaca

SEQ ID NO: 6352950 - DNA, 18 bp, Homo sapiens
aacccacaccgtcttcct

SEQ ID NO: 6352951 - DNA, 19 bp, Homo sapiens
aacccacaccgtcttcctt

SEQ ID NO: 6352952 - DNA, 14 bp, Homo sapiens
aacccacacctggg

SEQ ID NO: 6352953 - DNA, 11 bp, Homo sapiens
aacccacagct

SEQ ID NO: 6352954 - DNA, 14 bp, Homo sapiens
aacccacagctcag

SEQ ID NO: 6352955 - DNA, 20 bp, Homo sapiens
aacccacagctcagctgccc

SEQ ID NO: 6352956 - DNA, 11 bp, Homo sapiens
aacccacagtt

SEQ ID NO: 6352957 - DNA, 21 bp, Homo sapiens
aacccacataaaagccccagc

SEQ ID NO: 6352958 - DNA, 22 bp, Homo sapiens
aacccacataaaagccccagct

SEQ ID NO: 6352959 - DNA, 16 bp, Homo sapiens
aacccacataaacact

SEQ ID NO: 6352960 - DNA, 15 bp, Homo sapiens
aacccaccctttcta

SEQ ID NO: 6352961 - DNA, 21 bp, Homo sapiens
aacccacctctcctgccctgt

SEQ ID NO: 6352962 - DNA, 20 bp, Homo sapiens
aacccacctctggccctgtg

SEQ ID NO: 6352963 - DNA, 21 bp, Homo sapiens
aacccactcatgactgcatga

SEQ ID NO: 6352964 - DNA, 11 bp, Homo sapiens
aacccactccg

SEQ ID NO: 6352965 - DNA, 17 bp, Homo sapiens
aacccactccggttccc

SEQ ID NO: 6352966 - DNA, 16 bp, Homo sapiens
aacccactgcatgcag

SEQ ID NO: 6352967 - DNA, 20 bp, Homo sapiens
aacccacttctggcctccag

SEQ ID NO: 6352968 - DNA, 23 bp, Homo sapiens
aacccacttctggcctccagcct

SEQ ID NO: 6352969 - DNA, 23 bp, Homo sapiens
aacccactttaaaatatctacat

SEQ ID NO: 6352970 - DNA, 13 bp, Homo sapiens
aacccagaaacac

SEQ ID NO: 6352971 - DNA, 18 bp, Homo sapiens
aacccagaactggacgcc

SEQ ID NO: 6352972 - DNA, 18 bp, Homo sapiens
aacccagaatgtaaaaaa

SEQ ID NO: 6352973 - DNA, 21 bp, Homo sapiens
aacccagacggctccactagg

SEQ ID NO: 6352974 - DNA, 14 bp, Homo sapiens
aacccagactcaga

SEQ ID NO: 6352975 - DNA, 15 bp, Homo sapiens
aacccagactcagac

SEQ ID NO: 6352976 - DNA, 11 bp, Homo sapiens
aacccagagag

SEQ ID NO: 6352977 - DNA, 12 bp, Homo sapiens
aacccagagagg

SEQ ID NO: 6352978 - DNA, 22 bp, Homo sapiens
aacccagagggttgctggtcct

SEQ ID NO: 6352979 - DNA, 14 bp, Homo sapiens
aacccagataaagg

SEQ ID NO: 6352980 - DNA, 19 bp, Homo sapiens
aacccagatcgctgtgtta

SEQ ID NO: 6352981 - DNA, 21 bp, Homo sapiens
aacccagcagttctctgccaa

SEQ ID NO: 6352982 - DNA, 17 bp, Homo sapiens
aacccagcagttctgtt

SEQ ID NO: 6352983 - DNA, 21 bp, Homo sapiens
aacccagccagagtttgcctc

SEQ ID NO: 6352984 - DNA, 14 bp, Homo sapiens
aacccagccgctgc

SEQ ID NO: 6352985 - DNA, 22 bp, Homo sapiens
aacccagcgttcttcaggagat

SEQ ID NO: 6352986 - DNA, 10 bp, Homo sapiens
aacccagctc

SEQ ID NO: 6352987 - DNA, 14 bp, Homo sapiens
aacccagctctggt

SEQ ID NO: 6352988 - DNA, 11 bp, Homo sapiens
aacccagctgc

SEQ ID NO: 6352989 - DNA, 15 bp, Homo sapiens
aacccagctgcaccc

SEQ ID NO: 6352990 - DNA, 23 bp, Homo sapiens
aacccagctgcaccccttcctgg

SEQ ID NO: 6352991 - DNA, 12 bp, Homo sapiens
aacccaggaggt

SEQ ID NO: 6352992 - DNA, 16 bp, Homo sapiens
aacccaggattcaaca

SEQ ID NO: 6352993 - DNA, 13 bp, Homo sapiens
aacccaggcagct

SEQ ID NO: 6352994 - DNA, 14 bp, Homo sapiens
aacccaggcagctg

SEQ ID NO: 6352995 - DNA, 16 bp, Homo sapiens
aacccaggcagctggc

SEQ ID NO: 6352996 - DNA, 19 bp, Homo sapiens
aacccaggcagctggcagg

SEQ ID NO: 6352997 - DNA, 17 bp, Homo sapiens
aacccagggctctgccc

SEQ ID NO: 6352998 - DNA, 16 bp, Homo sapiens
aacccaggtctgatgc

SEQ ID NO: 6352999 - DNA, 18 bp, Homo sapiens
aacccaggtctgatgcca

SEQ ID NO: 6353000 - DNA, 23 bp, Homo sapiens
aacccaggtctgatgccaaagct

SEQ ID NO: 6353001 - DNA, 18 bp, Homo sapiens
aacccaggttcatgaata

SEQ ID NO: 6353002 - DNA, 20 bp, Homo sapiens
aacccaggttggcgactgca

SEQ ID NO: 6353003 - DNA, 14 bp, Homo sapiens
aacccagtctttct

SEQ ID NO: 6353004 - DNA, 13 bp, Homo sapiens
aacccagtggctg

SEQ ID NO: 6353005 - DNA, 11 bp, Homo sapiens
aacccagtgtt

SEQ ID NO: 6353006 - DNA, 12 bp, Homo sapiens
aacccagtgttc

SEQ ID NO: 6353007 - DNA, 12 bp, Homo sapiens
aacccagttact

SEQ ID NO: 6353008 - DNA, 13 bp, Homo sapiens
aacccagttactt

SEQ ID NO: 6353009 - DNA, 14 bp, Homo sapiens
aacccagttacttt

SEQ ID NO: 6353010 - DNA, 19 bp, Homo sapiens
aacccataatcatgtaaat

SEQ ID NO: 6353011 - DNA, 22 bp, Homo sapiens
aacccatacaatgtatgtacaa

SEQ ID NO: 6353012 - DNA, 22 bp, Homo sapiens
aacccataggcccacacacagg

SEQ ID NO: 6353013 - DNA, 23 bp, Homo sapiens
aacccataggcccacacacaggt

SEQ ID NO: 6353014 - DNA, 14 bp, Homo sapiens
aacccatattttaa

SEQ ID NO: 6353015 - DNA, 15 bp, Homo sapiens
aacccatcactgtgt

SEQ ID NO: 6353016 - DNA, 15 bp, Homo sapiens
aacccatcagaagga

SEQ ID NO: 6353017 - DNA, 15 bp, Homo sapiens
aacccatcagacagg

SEQ ID NO: 6353018 - DNA, 14 bp, Homo sapiens
aacccatctaaacc

SEQ ID NO: 6353019 - DNA, 19 bp, Homo sapiens
aacccatctaaaccagaag

SEQ ID NO: 6353020 - DNA, 21 bp, Homo sapiens
aacccatctaaaccagaagga

SEQ ID NO: 6353021 - DNA, 15 bp, Homo sapiens
aacccatctctgaac

SEQ ID NO: 6353022 - DNA, 17 bp, Homo sapiens
aacccatgaagctggcc

SEQ ID NO: 6353023 - DNA, 13 bp, Homo sapiens
aacccatggctct

SEQ ID NO: 6353024 - DNA, 17 bp, Homo sapiens
aacccatggctctattt

SEQ ID NO: 6353025 - DNA, 21 bp, Homo sapiens
aacccatggctctatttcttc

SEQ ID NO: 6353026 - DNA, 17 bp, Homo sapiens
aacccattaatcttttg

SEQ ID NO: 6353027 - DNA, 14 bp, Homo sapiens
aacccattattcct

SEQ ID NO: 6353028 - DNA, 17 bp, Homo sapiens
aacccatttttgagcca

SEQ ID NO: 6353029 - DNA, 15 bp, Homo sapiens
aaccccaacgcacag

SEQ ID NO: 6353030 - DNA, 17 bp, Homo sapiens
aaccccaacgcacagga

SEQ ID NO: 6353031 - DNA, 19 bp, Homo sapiens
aaccccaacgcacaggaaa

SEQ ID NO: 6353032 - DNA, 18 bp, Homo sapiens
aaccccaactcccagcct

SEQ ID NO: 6353033 - DNA, 14 bp, Homo sapiens
aaccccaagacagt

SEQ ID NO: 6353034 - DNA, 14 bp, Homo sapiens
aaccccaagcagca

SEQ ID NO: 6353035 - DNA, 19 bp, Homo sapiens
aaccccaaggactgagggc

SEQ ID NO: 6353036 - DNA, 22 bp, Homo sapiens
aaccccagacccaacccatgcc

SEQ ID NO: 6353037 - DNA, 13 bp, Homo sapiens
aaccccagactca

SEQ ID NO: 6353038 - DNA, 17 bp, Homo sapiens
aaccccagcagtcctgg

SEQ ID NO: 6353039 - DNA, 19 bp, Homo sapiens
aaccccagcagtcctgggc

SEQ ID NO: 6353040 - DNA, 21 bp, Homo sapiens
aaccccagcctgacctgagac

SEQ ID NO: 6353041 - DNA, 23 bp, Homo sapiens
aaccccagcggcagatgggcctg

SEQ ID NO: 6353042 - DNA, 21 bp, Homo sapiens
aaccccagctgccggcagtgc

SEQ ID NO: 6353043 - DNA, 16 bp, Homo sapiens
aaccccagctggcctc

SEQ ID NO: 6353044 - DNA, 18 bp, Homo sapiens
aaccccaggcatcccatc

SEQ ID NO: 6353045 - DNA, 17 bp, Homo sapiens
aaccccagggcccccac

SEQ ID NO: 6353046 - DNA, 20 bp, Homo sapiens
aaccccagggcccccacagg

SEQ ID NO: 6353047 - DNA, 13 bp, Homo sapiens
aaccccagttctg

SEQ ID NO: 6353048 - DNA, 16 bp, Homo sapiens
aaccccagttctgctc

SEQ ID NO: 6353049 - DNA, 19 bp, Homo sapiens
aaccccagttctgctcctc

SEQ ID NO: 6353050 - DNA, 22 bp, Homo sapiens
aaccccagttctgctcctctcc

SEQ ID NO: 6353051 - DNA, 13 bp, Homo sapiens
aaccccatgggct

SEQ ID NO: 6353052 - DNA, 18 bp, Homo sapiens
aaccccatgtcctcagca

SEQ ID NO: 6353053 - DNA, 12 bp, Homo sapiens
aacccccacaca

SEQ ID NO: 6353054 - DNA, 13 bp, Homo sapiens
aacccccacacac

SEQ ID NO: 6353055 - DNA, 15 bp, Homo sapiens
aacccccaccccaca

SEQ ID NO: 6353056 - DNA, 18 bp, Homo sapiens
aacccccaccccacactt

SEQ ID NO: 6353057 - DNA, 11 bp, Homo sapiens
aacccccaccg

SEQ ID NO: 6353058 - DNA, 16 bp, Homo sapiens
aacccccacctcccgg

SEQ ID NO: 6353059 - DNA, 16 bp, Homo sapiens
aacccccactggactg

SEQ ID NO: 6353060 - DNA, 11 bp, Homo sapiens
aacccccagag

SEQ ID NO: 6353061 - DNA, 14 bp, Homo sapiens
aacccccagccccc

SEQ ID NO: 6353062 - DNA, 16 bp, Homo sapiens
aacccccagcccctcc

SEQ ID NO: 6353063 - DNA, 12 bp, Homo sapiens
aacccccagctc

SEQ ID NO: 6353064 - DNA, 15 bp, Homo sapiens
aacccccagctgggt

SEQ ID NO: 6353065 - DNA, 14 bp, Homo sapiens
aacccccaggagga

SEQ ID NO: 6353066 - DNA, 20 bp, Homo sapiens
aacccccagtgccacagaga

SEQ ID NO: 6353067 - DNA, 16 bp, Homo sapiens
aacccccatttttgta

SEQ ID NO: 6353068 - DNA, 20 bp, Homo sapiens
aaccccccgcccatgctgtc

SEQ ID NO: 6353069 - DNA, 23 bp, Homo sapiens
aacccccctcccagacaggccct

SEQ ID NO: 6353070 - DNA, 12 bp, Homo sapiens
aacccccctccg

SEQ ID NO: 6353071 - DNA, 13 bp, Homo sapiens
aacccccctcctg

SEQ ID NO: 6353072 - DNA, 20 bp, Homo sapiens
aacccccctcctgctcctcc

SEQ ID NO: 6353073 - DNA, 18 bp, Homo sapiens
aacccccgccacctcagg

SEQ ID NO: 6353074 - DNA, 20 bp, Homo sapiens
aacccccgccacctcagggc

SEQ ID NO: 6353075 - DNA, 15 bp, Homo sapiens
aacccccgctccaga

SEQ ID NO: 6353076 - DNA, 16 bp, Homo sapiens
aaccccctcggagcct

SEQ ID NO: 6353077 - DNA, 21 bp, Homo sapiens
aaccccctcggagcctgtgtt

SEQ ID NO: 6353078 - DNA, 18 bp, Homo sapiens
aaccccctttgtgctgtg

SEQ ID NO: 6353079 - DNA, 13 bp, Homo sapiens
aacccccttttcc

SEQ ID NO: 6353080 - DNA, 20 bp, Homo sapiens
aaccccgaggggcttgcagg

SEQ ID NO: 6353081 - DNA, 19 bp, Homo sapiens
aaccccgcggtgctctggc

SEQ ID NO: 6353082 - DNA, 21 bp, Homo sapiens
aaccccgcggtgctctggcgg

SEQ ID NO: 6353083 - DNA, 14 bp, Homo sapiens
aaccccgggcccgg

SEQ ID NO: 6353084 - DNA, 20 bp, Homo sapiens
aaccccgtctgctcctccct

SEQ ID NO: 6353085 - DNA, 23 bp, Homo sapiens
aacccctaagactgccttcagta

SEQ ID NO: 6353086 - DNA, 19 bp, Homo sapiens
aacccctagaaaggagaga

SEQ ID NO: 6353087 - DNA, 23 bp, Homo sapiens
aacccctcccctccatccctggc

SEQ ID NO: 6353088 - DNA, 19 bp, Homo sapiens
aacccctcctccctcagac

SEQ ID NO: 6353089 - DNA, 20 bp, Homo sapiens
aacccctcctccctcagact

SEQ ID NO: 6353090 - DNA, 16 bp, Homo sapiens
aacccctcctggcctg

SEQ ID NO: 6353091 - DNA, 20 bp, Homo sapiens
aacccctccttccccagacc

SEQ ID NO: 6353092 - DNA, 17 bp, Homo sapiens
aacccctctccaggcct

SEQ ID NO: 6353093 - DNA, 19 bp, Homo sapiens
aacccctctccaggcctgt

SEQ ID NO: 6353094 - DNA, 14 bp, Homo sapiens
aacccctctcttag

SEQ ID NO: 6353095 - DNA, 23 bp, Homo sapiens
aacccctgcagctcctctgcctt

SEQ ID NO: 6353096 - DNA, 12 bp, Homo sapiens
aacccctgcctg

SEQ ID NO: 6353097 - DNA, 14 bp, Homo sapiens
aacccctgcctgga

SEQ ID NO: 6353098 - DNA, 21 bp, Homo sapiens
aacccctggccagctctgagg

SEQ ID NO: 6353099 - DNA, 12 bp, Homo sapiens
aacccctgggta

SEQ ID NO: 6353100 - DNA, 17 bp, Homo sapiens
aacccctgtacccagct

SEQ ID NO: 6353101 - DNA, 11 bp, Homo sapiens
aacccctgtgt

SEQ ID NO: 6353102 - DNA, 20 bp, Homo sapiens
aaccccttaagccctggccc

SEQ ID NO: 6353103 - DNA, 21 bp, Homo sapiens
aaccccttcccacgacaaaaa

SEQ ID NO: 6353104 - DNA, 17 bp, Homo sapiens
aacccgacagagggaag

SEQ ID NO: 6353105 - DNA, 22 bp, Homo sapiens
aacccgaggctgagaatcagac

SEQ ID NO: 6353106 - DNA, 13 bp, Homo sapiens
aacccgaggggcc

SEQ ID NO: 6353107 - DNA, 20 bp, Homo sapiens
gtattccttggcccagcagc

SEQ ID NO: 6353108 - DNA, 17 bp, Homo sapiens
gtattcctttaaaatat

SEQ ID NO: 6353109 - DNA, 15 bp, Homo sapiens
gtattcgaaacctgt

SEQ ID NO: 6353110 - DNA, 19 bp, Homo sapiens
gtattctaaagctttctga

SEQ ID NO: 6353111 - DNA, 22 bp, Homo sapiens
gtattctaataagctagttgaa

SEQ ID NO: 6353112 - DNA, 18 bp, Homo sapiens
gtattctaattcttcatt

SEQ ID NO: 6353113 - DNA, 18 bp, Homo sapiens
gtattctagtggctgttc

SEQ ID NO: 6353114 - DNA, 18 bp, Homo sapiens
gtattctagttttgtcaa

SEQ ID NO: 6353115 - DNA, 13 bp, Homo sapiens
gtattctcaaaga

SEQ ID NO: 6353116 - DNA, 14 bp, Homo sapiens
gtattctcattctt

SEQ ID NO: 6353117 - DNA, 21 bp, Homo sapiens
gtattctcattggggttgcaa

SEQ ID NO: 6353118 - DNA, 21 bp, Homo sapiens
gtattctctcctgtacctctt

SEQ ID NO: 6353119 - DNA, 18 bp, Homo sapiens
gtattctctgtccagggc

SEQ ID NO: 6353120 - DNA, 20 bp, Homo sapiens
gtattctctgtccagggctt

SEQ ID NO: 6353121 - DNA, 14 bp, Homo sapiens
gtattctgacatgt

SEQ ID NO: 6353122 - DNA, 17 bp, Homo sapiens
gtattctgcttccacat

SEQ ID NO: 6353123 - DNA, 18 bp, Homo sapiens
gtattctggggtatggcg

SEQ ID NO: 6353124 - DNA, 15 bp, Homo sapiens
gtattctgtcttcat

SEQ ID NO: 6353125 - DNA, 18 bp, Homo sapiens
gtattctgtggattctat

SEQ ID NO: 6353126 - DNA, 21 bp, Homo sapiens
gtattctgtggattctatatt

SEQ ID NO: 6353127 - DNA, 15 bp, Homo sapiens
gtattcttaaaatgc

SEQ ID NO: 6353128 - DNA, 19 bp, Homo sapiens
gtattcttaaaatgcaata

SEQ ID NO: 6353129 - DNA, 14 bp, Homo sapiens
gtattcttcatgaa

SEQ ID NO: 6353130 - DNA, 15 bp, Homo sapiens
gtattcttcatgaaa

SEQ ID NO: 6353131 - DNA, 18 bp, Homo sapiens
gtattcttcatgaaatgt

SEQ ID NO: 6353132 - DNA, 18 bp, Homo sapiens
gtattcttctgtatttct

SEQ ID NO: 6353133 - DNA, 18 bp, Homo sapiens
gtattcttgaaagtattg

SEQ ID NO: 6353134 - DNA, 23 bp, Homo sapiens
gtattctttattatttttctctc

SEQ ID NO: 6353135 - DNA, 16 bp, Homo sapiens
gtattctttctgcctt

SEQ ID NO: 6353136 - DNA, 16 bp, Homo sapiens
gtattctttgatgtta

SEQ ID NO: 6353137 - DNA, 18 bp, Homo sapiens
gtattctttgatgttaac

SEQ ID NO: 6353138 - DNA, 12 bp, Homo sapiens
gtattcttttat

SEQ ID NO: 6353139 - DNA, 19 bp, Homo sapiens
gtattcttttcaattatat

SEQ ID NO: 6353140 - DNA, 11 bp, Homo sapiens
gtattcttttt

SEQ ID NO: 6353141 - DNA, 15 bp, Homo sapiens
gtattgaaaacactt

SEQ ID NO: 6353142 - DNA, 16 bp, Homo sapiens
gtattgaaaacttcaa

SEQ ID NO: 6353143 - DNA, 19 bp, Homo sapiens
gtattgaaaacttcaaagc

SEQ ID NO: 6353144 - DNA, 22 bp, Homo sapiens
gtattgaagcattttataaatc

SEQ ID NO: 6353145 - DNA, 18 bp, Homo sapiens
gtattgacaaaatgttat

SEQ ID NO: 6353146 - DNA, 22 bp, Homo sapiens
gtattgacaactgcacatgaaa

SEQ ID NO: 6353147 - DNA, 18 bp, Homo sapiens
gtattgacaataagaaac

SEQ ID NO: 6353148 - DNA, 15 bp, Homo sapiens
gtattgactgtacca

SEQ ID NO: 6353149 - DNA, 18 bp, Homo sapiens
gtattgactttatgttgt

SEQ ID NO: 6353150 - DNA, 19 bp, Homo sapiens
gtattgagacactgtcaag

SEQ ID NO: 6353151 - DNA, 22 bp, Homo sapiens
gtattgagacactgtcaagatt

SEQ ID NO: 6353152 - DNA, 19 bp, Homo sapiens
gtattgagggccagtgatg

SEQ ID NO: 6353153 - DNA, 20 bp, Homo sapiens
gtattgagggccagtgatga

SEQ ID NO: 6353154 - DNA, 21 bp, Homo sapiens
gtattgagggccagtgatgat

SEQ ID NO: 6353155 - DNA, 21 bp, Homo sapiens
gtattgagtcttaactgtatt

SEQ ID NO: 6353156 - DNA, 21 bp, Homo sapiens
gtattgatactggtcccactt

SEQ ID NO: 6353157 - DNA, 18 bp, Homo sapiens
gtattgatgcaatataag

SEQ ID NO: 6353158 - DNA, 20 bp, Homo sapiens
gtattgattacaaataaaca

SEQ ID NO: 6353159 - DNA, 21 bp, Homo sapiens
gtattgcacattgtaaaaagt

SEQ ID NO: 6353160 - DNA, 20 bp, Homo sapiens
gtattgcagctaagctcaaa

SEQ ID NO: 6353161 - DNA, 15 bp, Homo sapiens
gtattgccaaacatt

SEQ ID NO: 6353162 - DNA, 19 bp, Homo sapiens
gtattgccacctctggcca

SEQ ID NO: 6353163 - DNA, 19 bp, Homo sapiens
gtattgccatcgggtgcca

SEQ ID NO: 6353164 - DNA, 20 bp, Homo sapiens
gtattgccatcgggtgccaa

SEQ ID NO: 6353165 - DNA, 14 bp, Homo sapiens
gtattgccccctct

SEQ ID NO: 6353166 - DNA, 15 bp, Homo sapiens
gtattgctgctgtgc

SEQ ID NO: 6353167 - DNA, 17 bp, Homo sapiens
gtattgcttattttatt

SEQ ID NO: 6353168 - DNA, 13 bp, Homo sapiens
gtattgcttcctg

SEQ ID NO: 6353169 - DNA, 20 bp, Homo sapiens
gtattgctttagtatgctgg

SEQ ID NO: 6353170 - DNA, 16 bp, Homo sapiens
gtattggaagacttgg

SEQ ID NO: 6353171 - DNA, 20 bp, Homo sapiens
gtattggagcacatgttact

SEQ ID NO: 6353172 - DNA, 12 bp, Homo sapiens
gtattggcaaag

SEQ ID NO: 6353173 - DNA, 13 bp, Homo sapiens
gtattggcaaaga

SEQ ID NO: 6353174 - DNA, 13 bp, Homo sapiens
gtattggcagcac

SEQ ID NO: 6353175 - DNA, 16 bp, Homo sapiens
gtattggcagcacagc

SEQ ID NO: 6353176 - DNA, 20 bp, Homo sapiens
gtattggcatttatttatgt

SEQ ID NO: 6353177 - DNA, 17 bp, Homo sapiens
gtattggctatgatggt

SEQ ID NO: 6353178 - DNA, 20 bp, Homo sapiens
gtattggtgctttgtgtcta

SEQ ID NO: 6353179 - DNA, 17 bp, Homo sapiens
gtattggtggctttcct

SEQ ID NO: 6353180 - DNA, 18 bp, Homo sapiens
gtattggtgttgcagccg

SEQ ID NO: 6353181 - DNA, 20 bp, Homo sapiens
gtattgtaaaaaattcacat

SEQ ID NO: 6353182 - DNA, 15 bp, Homo sapiens
gtattgtaaaacatt

SEQ ID NO: 6353183 - DNA, 16 bp, Homo sapiens
gtattgtaaaacattc

SEQ ID NO: 6353184 - DNA, 19 bp, Homo sapiens
gtattgtaaaacattcaca

SEQ ID NO: 6353185 - DNA, 19 bp, Homo sapiens
gtattgtaaattatatttg

SEQ ID NO: 6353186 - DNA, 18 bp, Homo sapiens
gtattgtaagtggaaaat

SEQ ID NO: 6353187 - DNA, 21 bp, Homo sapiens
gtattgtaagtggaaaatgca

SEQ ID NO: 6353188 - DNA, 13 bp, Homo sapiens
gtattgtaatctt

SEQ ID NO: 6353189 - DNA, 19 bp, Homo sapiens
gtattgtacaaagtattaa

SEQ ID NO: 6353190 - DNA, 23 bp, Homo sapiens
gtattgtacaaagtattaagcat

SEQ ID NO: 6353191 - DNA, 17 bp, Homo sapiens
gtattgtaggtggtgtt

SEQ ID NO: 6353192 - DNA, 13 bp, Homo sapiens
gtattgtatttat

SEQ ID NO: 6353193 - DNA, 17 bp, Homo sapiens
gtattgtatttattcaa

SEQ ID NO: 6353194 - DNA, 14 bp, Homo sapiens
gtattgtcagccat

SEQ ID NO: 6353195 - DNA, 23 bp, Homo sapiens
gtattgtccatatcagacctctg

SEQ ID NO: 6353196 - DNA, 19 bp, Homo sapiens
gtattgtctattatttaga

SEQ ID NO: 6353197 - DNA, 20 bp, Homo sapiens
gtattgtcttaaataaatca

SEQ ID NO: 6353198 - DNA, 22 bp, Homo sapiens
gtattgtcttaaataaatcaag

SEQ ID NO: 6353199 - DNA, 15 bp, Homo sapiens
gtattgtgaaatttg

SEQ ID NO: 6353200 - DNA, 14 bp, Homo sapiens
gtattgtgcaatgt

SEQ ID NO: 6353201 - DNA, 23 bp, Homo sapiens
gtattgtgcaatgtgtataaaca

SEQ ID NO: 6353202 - DNA, 12 bp, Homo sapiens
gtattgtggtat

SEQ ID NO: 6353203 - DNA, 12 bp, Homo sapiens
gtattgtggttt

SEQ ID NO: 6353204 - DNA, 17 bp, Homo sapiens
gtattgtgtcttttgca

SEQ ID NO: 6353205 - DNA, 18 bp, Homo sapiens
gtattgtgtcttttgcat

SEQ ID NO: 6353206 - DNA, 16 bp, Homo sapiens
gtattgttagatgttt

SEQ ID NO: 6353207 - DNA, 11 bp, Homo sapiens
gtattgttccc

SEQ ID NO: 6353208 - DNA, 19 bp, Homo sapiens
gtattgttctcatgtaaga

SEQ ID NO: 6353209 - DNA, 21 bp, Homo sapiens
gtattgttcttgtaaaactgt

SEQ ID NO: 6353210 - DNA, 15 bp, Homo sapiens
gtattgtttctacaa

SEQ ID NO: 6353211 - DNA, 18 bp, Homo sapiens
gtatttaaaaaaaagaaa

SEQ ID NO: 6353212 - DNA, 22 bp, Homo sapiens
gtatttaaaaaaaagaaacttt

SEQ ID NO: 6353213 - DNA, 19 bp, Homo sapiens
gtatttaaaaatagaaaca

SEQ ID NO: 6353214 - DNA, 21 bp, Homo sapiens
gtatttaaaaccttgatttaa

SEQ ID NO: 6353215 - DNA, 17 bp, Homo sapiens
gtatttaaagaacactg

SEQ ID NO: 6353216 - DNA, 20 bp, Homo sapiens
gtatttaacaaaaagtgctt

SEQ ID NO: 6353217 - DNA, 21 bp, Homo sapiens
gtatttaactacatctgcctc

SEQ ID NO: 6353218 - DNA, 14 bp, Homo sapiens
gtatttaagacata

SEQ ID NO: 6353219 - DNA, 14 bp, Homo sapiens
gtatttaagactga

SEQ ID NO: 6353220 - DNA, 17 bp, Homo sapiens
gtatttaagatgtacat

SEQ ID NO: 6353221 - DNA, 21 bp, Homo sapiens
gtatttaagatgtacatttaa

SEQ ID NO: 6353222 - DNA, 22 bp, Homo sapiens
gtatttaagatgtacatttaat

SEQ ID NO: 6353223 - DNA, 12 bp, Homo sapiens
gtatttaagatt

SEQ ID NO: 6353224 - DNA, 14 bp, Homo sapiens
gtatttaagcaaat

SEQ ID NO: 6353225 - DNA, 12 bp, Homo sapiens
gtatttaagcct

SEQ ID NO: 6353226 - DNA, 17 bp, Homo sapiens
gtatttaagcctaaaga

SEQ ID NO: 6353227 - DNA, 19 bp, Homo sapiens
gtatttaagcctaaagatt

SEQ ID NO: 6353228 - DNA, 21 bp, Homo sapiens
gtatttaagctttaaatgaca

SEQ ID NO: 6353229 - DNA, 23 bp, Homo sapiens
gtatttaagctttaaatgacagt

SEQ ID NO: 6353230 - DNA, 22 bp, Homo sapiens
gtatttaatgtttgtaagcaat

SEQ ID NO: 6353231 - DNA, 18 bp, Homo sapiens
gtatttaattagtgctaa

SEQ ID NO: 6353232 - DNA, 19 bp, Homo sapiens
gtatttaattgtaaactgt

SEQ ID NO: 6353233 - DNA, 22 bp, Homo sapiens
gtatttaattgtaaactgtact

SEQ ID NO: 6353234 - DNA, 23 bp, Homo sapiens
gtatttacactatgataaagttg

SEQ ID NO: 6353235 - DNA, 15 bp, Homo sapiens
gtatttaccaaaaat

SEQ ID NO: 6353236 - DNA, 20 bp, Homo sapiens
gtatttaccaaaaattttgt

SEQ ID NO: 6353237 - DNA, 19 bp, Homo sapiens
gtatttacgctttgattca

SEQ ID NO: 6353238 - DNA, 18 bp, Homo sapiens
gtatttagtaaaaataaa

SEQ ID NO: 6353239 - DNA, 21 bp, Homo sapiens
gtatttagtgacaaaaataaa

SEQ ID NO: 6353240 - DNA, 18 bp, Homo sapiens
gtatttataaaaatataa

SEQ ID NO: 6353241 - DNA, 20 bp, Homo sapiens
gtatttataaaaatataaat

SEQ ID NO: 6353242 - DNA, 21 bp, Homo sapiens
gtatttataaaaatataaatt

SEQ ID NO: 6353243 - DNA, 13 bp, Homo sapiens
gtatttataaata

SEQ ID NO: 6353244 - DNA, 14 bp, Homo sapiens
gtatttataattta

SEQ ID NO: 6353245 - DNA, 18 bp, Homo sapiens
gtatttataatttaaatg

SEQ ID NO: 6353246 - DNA, 19 bp, Homo sapiens
gtatttatagtaaccattt

SEQ ID NO: 6353247 - DNA, 13 bp, Homo sapiens
gtatttatatatt

SEQ ID NO: 6353248 - DNA, 17 bp, Homo sapiens
gtatttatatatttata

SEQ ID NO: 6353249 - DNA, 13 bp, Homo sapiens
gtatttatattag

SEQ ID NO: 6353250 - DNA, 19 bp, Homo sapiens
gtatttatatttggaaaga

SEQ ID NO: 6353251 - DNA, 23 bp, Homo sapiens
gtatttatatttggaaagagacc

SEQ ID NO: 6353252 - DNA, 19 bp, Homo sapiens
gtatttatctattgtaaga

SEQ ID NO: 6353253 - DNA, 14 bp, Homo sapiens
gtatttatggaaga

SEQ ID NO: 6353254 - DNA, 20 bp, Homo sapiens
gtatttatggattaaaaact

SEQ ID NO: 6353255 - DNA, 22 bp, Homo sapiens
gtatttatgtaatgaagtaaag

SEQ ID NO: 6353256 - DNA, 19 bp, Homo sapiens
gtatttatgtaatttgtac

SEQ ID NO: 6353257 - DNA, 16 bp, Homo sapiens
gtatttattaatttga

SEQ ID NO: 6353258 - DNA, 17 bp, Homo sapiens
gtatttattaatttgaa

SEQ ID NO: 6353259 - DNA, 19 bp, Homo sapiens
gtatttattcaataaagta

SEQ ID NO: 6353260 - DNA, 22 bp, Homo sapiens
gtatttattccatattcatgta

SEQ ID NO: 6353261 - DNA, 19 bp, Homo sapiens
gtatttattcctctgtcct

SEQ ID NO: 6353262 - DNA, 15 bp, Homo sapiens
gtatttattctctat

SEQ ID NO: 6353263 - DNA, 22 bp, Homo sapiens
gtatttattctctatttattgg

SEQ ID NO: 6353264 - DNA, 18 bp, Homo sapiens
gtatttattgaagaaaca

SEQ ID NO: 6353265 - DNA, 11 bp, Homo sapiens
gtatttattgg

SEQ ID NO: 6353266 - DNA, 12 bp, Homo sapiens
gtatttattggt

SEQ ID NO: 6353267 - DNA, 15 bp, Homo sapiens
gtatttattggtggg

SEQ ID NO: 6353268 - DNA, 13 bp, Homo sapiens
gtatttatttaaa

SEQ ID NO: 6353269 - DNA, 17 bp, Homo sapiens
gtatttatttaaaactc

SEQ ID NO: 6353270 - DNA, 18 bp, Homo sapiens
gtatttatttaaaagatt

SEQ ID NO: 6353271 - DNA, 21 bp, Homo sapiens
gtatttatttaaaagattcat

SEQ ID NO: 6353272 - DNA, 19 bp, Homo sapiens
gtatttatttagtatttat

SEQ ID NO: 6353273 - DNA, 17 bp, Homo sapiens
gtatttattttcctccc

SEQ ID NO: 6353274 - DNA, 18 bp, Homo sapiens
gtatttattttcctcccc

SEQ ID NO: 6353275 - DNA, 13 bp, Homo sapiens
gtatttattttgt

SEQ ID NO: 6353276 - DNA, 17 bp, Homo sapiens
gtatttattttgtaatt

SEQ ID NO: 6353277 - DNA, 18 bp, Homo sapiens
gtatttattttttcaaaa

SEQ ID NO: 6353278 - DNA, 19 bp, Homo sapiens
gtatttattttttcttttc

SEQ ID NO: 6353279 - DNA, 19 bp, Homo sapiens
gtatttcaaatatctaagc

SEQ ID NO: 6353280 - DNA, 14 bp, Homo sapiens
gtatttcaactgct

SEQ ID NO: 6353281 - DNA, 16 bp, Homo sapiens
gtatttcaactgctgt

SEQ ID NO: 6353282 - DNA, 21 bp, Homo sapiens
gtatttcaactgctgtaaaat

SEQ ID NO: 6353283 - DNA, 22 bp, Homo sapiens
gtatttcaactgctgtaaaatt

SEQ ID NO: 6353284 - DNA, 17 bp, Homo sapiens
aacccgccctcaggggc

SEQ ID NO: 6353285 - DNA, 23 bp, Homo sapiens
aacccgccctcaggggcctctct

SEQ ID NO: 6353286 - DNA, 13 bp, Homo sapiens
aacccgctggagc

SEQ ID NO: 6353287 - DNA, 20 bp, Homo sapiens
aacccgctggagcccacagc

SEQ ID NO: 6353288 - DNA, 13 bp, Homo sapiens
aacccggaaacag

SEQ ID NO: 6353289 - DNA, 21 bp, Homo sapiens
aacccggcccaacccagccca

SEQ ID NO: 6353290 - DNA, 16 bp, Homo sapiens
aacccggtgcatctgg

SEQ ID NO: 6353291 - DNA, 18 bp, Homo sapiens
aacccggtgcatctggca

SEQ ID NO: 6353292 - DNA, 17 bp, Homo sapiens
aacccgtccattcagaa

SEQ ID NO: 6353293 - DNA, 19 bp, Homo sapiens
aacccgtccattcagaaag

SEQ ID NO: 6353294 - DNA, 17 bp, Homo sapiens
aacccgtgcccctggga

SEQ ID NO: 6353295 - DNA, 15 bp, Homo sapiens
aacccgtggaggctg

SEQ ID NO: 6353296 - DNA, 21 bp, Homo sapiens
aaccctaaggaagttgctaac

SEQ ID NO: 6353297 - DNA, 22 bp, Homo sapiens
aaccctaatctttcacttgaaa

SEQ ID NO: 6353298 - DNA, 17 bp, Homo sapiens
aaccctacacccagacc

SEQ ID NO: 6353299 - DNA, 15 bp, Homo sapiens
aaccctacagtatat

SEQ ID NO: 6353300 - DNA, 13 bp, Homo sapiens
aaccctaccctgg

SEQ ID NO: 6353301 - DNA, 20 bp, Homo sapiens
aaccctagaaatatatcctg

SEQ ID NO: 6353302 - DNA, 23 bp, Homo sapiens
aaccctagaaatatatcctgtgt

SEQ ID NO: 6353303 - DNA, 13 bp, Homo sapiens
aaccctagccttg

SEQ ID NO: 6353304 - DNA, 19 bp, Homo sapiens
aaccctagccttgcttgtt

SEQ ID NO: 6353305 - DNA, 20 bp, Homo sapiens
aaccctaggttcccggtccc

SEQ ID NO: 6353306 - DNA, 17 bp, Homo sapiens
aaccctatacaagttgt

SEQ ID NO: 6353307 - DNA, 13 bp, Homo sapiens
aaccctatatgct

SEQ ID NO: 6353308 - DNA, 19 bp, Homo sapiens
aaccctatcctaattgtcc

SEQ ID NO: 6353309 - DNA, 18 bp, Homo sapiens
aaccctatgccttttgta

SEQ ID NO: 6353310 - DNA, 15 bp, Homo sapiens
aaccctattggtaaa

SEQ ID NO: 6353311 - DNA, 15 bp, Homo sapiens
aaccctcagacagac

SEQ ID NO: 6353312 - DNA, 19 bp, Homo sapiens
aaccctcagagccacccct

SEQ ID NO: 6353313 - DNA, 15 bp, Homo sapiens
aaccctcagccttga

SEQ ID NO: 6353314 - DNA, 20 bp, Homo sapiens
aaccctcaggccaccctcca

SEQ ID NO: 6353315 - DNA, 21 bp, Homo sapiens
aaccctcaggccaccctccac

SEQ ID NO: 6353316 - DNA, 17 bp, Homo sapiens
aaccctcaggggaaaac

SEQ ID NO: 6353317 - DNA, 16 bp, Homo sapiens
aaccctcattgctgtc

SEQ ID NO: 6353318 - DNA, 23 bp, Homo sapiens
aaccctccaaaggaactctagag

SEQ ID NO: 6353319 - DNA, 16 bp, Homo sapiens
aaccctcccagaaaca

SEQ ID NO: 6353320 - DNA, 17 bp, Homo sapiens
aaccctccctcagcccc

SEQ ID NO: 6353321 - DNA, 21 bp, Homo sapiens
aaccctccctcagcccctctt

SEQ ID NO: 6353322 - DNA, 19 bp, Homo sapiens
aaccctcctatcacctccc

SEQ ID NO: 6353323 - DNA, 12 bp, Homo sapiens
aaccctcctcct

SEQ ID NO: 6353324 - DNA, 13 bp, Homo sapiens
aaccctcctcctt

SEQ ID NO: 6353325 - DNA, 12 bp, Homo sapiens
aaccctcctggg

SEQ ID NO: 6353326 - DNA, 23 bp, Homo sapiens
aaccctcctgggaaggccacctc

SEQ ID NO: 6353327 - DNA, 19 bp, Homo sapiens
aaccctccttggtgcctct

SEQ ID NO: 6353328 - DNA, 19 bp, Homo sapiens
aaccctcgatgttcatgga

SEQ ID NO: 6353329 - DNA, 22 bp, Homo sapiens
aaccctcgccctgtccctccca

SEQ ID NO: 6353330 - DNA, 12 bp, Homo sapiens
aaccctctgtga

SEQ ID NO: 6353331 - DNA, 19 bp, Homo sapiens
aaccctcttgccatcctga

SEQ ID NO: 6353332 - DNA, 13 bp, Homo sapiens
aaccctgaagcca

SEQ ID NO: 6353333 - DNA, 15 bp, Homo sapiens
aaccctgaatcagag

SEQ ID NO: 6353334 - DNA, 19 bp, Homo sapiens
aaccctgatctctcagccc

SEQ ID NO: 6353335 - DNA, 21 bp, Homo sapiens
aaccctgattcatactccttt

SEQ ID NO: 6353336 - DNA, 17 bp, Homo sapiens
aaccctgcaaaggactg

SEQ ID NO: 6353337 - DNA, 17 bp, Homo sapiens
aaccctgcaatcacttt

SEQ ID NO: 6353338 - DNA, 22 bp, Homo sapiens
aaccctgcccacttcagcccag

SEQ ID NO: 6353339 - DNA, 14 bp, Homo sapiens
aaccctgcccagcc

SEQ ID NO: 6353340 - DNA, 19 bp, Homo sapiens
aaccctgcccctgccccgt

SEQ ID NO: 6353341 - DNA, 14 bp, Homo sapiens
aaccctgccctgca

SEQ ID NO: 6353342 - DNA, 20 bp, Homo sapiens
aaccctgccgtcaccaccac

SEQ ID NO: 6353343 - DNA, 19 bp, Homo sapiens
aaccctgcctcttgtgtcc

SEQ ID NO: 6353344 - DNA, 16 bp, Homo sapiens
aaccctgcctgtcacc

SEQ ID NO: 6353345 - DNA, 22 bp, Homo sapiens
aaccctgcctgtcacctgggag

SEQ ID NO: 6353346 - DNA, 16 bp, Homo sapiens
aaccctgcgtggggac

SEQ ID NO: 6353347 - DNA, 16 bp, Homo sapiens
aaccctggagccatcc

SEQ ID NO: 6353348 - DNA, 11 bp, Homo sapiens
aaccctggagg

SEQ ID NO: 6353349 - DNA, 14 bp, Homo sapiens
aaccctggcatttg

SEQ ID NO: 6353350 - DNA, 13 bp, Homo sapiens
aaccctggcctca

SEQ ID NO: 6353351 - DNA, 11 bp, Homo sapiens
aaccctgggac

SEQ ID NO: 6353352 - DNA, 14 bp, Homo sapiens
aaccctgggaccta

SEQ ID NO: 6353353 - DNA, 16 bp, Homo sapiens
aaccctgggctgtcca

SEQ ID NO: 6353354 - DNA, 21 bp, Homo sapiens
aaccctggggaaggagccagt

SEQ ID NO: 6353355 - DNA, 18 bp, Homo sapiens
aaccctgtaagttacagt

SEQ ID NO: 6353356 - DNA, 17 bp, Homo sapiens
aaccctgtcaaacatta

SEQ ID NO: 6353357 - DNA, 14 bp, Homo sapiens
aaccctgtcaccca

SEQ ID NO: 6353358 - DNA, 17 bp, Homo sapiens
aaccctgtcacccacag

SEQ ID NO: 6353359 - DNA, 22 bp, Homo sapiens
aaccctgtctggatcctatcct

SEQ ID NO: 6353360 - DNA, 14 bp, Homo sapiens
aaccctgtgctggt

SEQ ID NO: 6353361 - DNA, 19 bp, Homo sapiens
aaccctgtgctggtgtcct

SEQ ID NO: 6353362 - DNA, 14 bp, Homo sapiens
aaccctgtgctgtc

SEQ ID NO: 6353363 - DNA, 21 bp, Homo sapiens
aaccctgtggaagcatggctg

SEQ ID NO: 6353364 - DNA, 23 bp, Homo sapiens
aaccctgtgggcttatgtctctg

SEQ ID NO: 6353365 - DNA, 15 bp, Homo sapiens
aaccctgttttatac

SEQ ID NO: 6353366 - DNA, 23 bp, Homo sapiens
aacccttaaacagttgcacagca

SEQ ID NO: 6353367 - DNA, 21 bp, Homo sapiens
aacccttagcttttagcctgg

SEQ ID NO: 6353368 - DNA, 22 bp, Homo sapiens
aacccttcagtgctacattttg

SEQ ID NO: 6353369 - DNA, 22 bp, Homo sapiens
aacccttcatcttcctgtgtcc

SEQ ID NO: 6353370 - DNA, 20 bp, Homo sapiens
aacccttccccactgcacac

SEQ ID NO: 6353371 - DNA, 11 bp, Homo sapiens
aacccttctcc

SEQ ID NO: 6353372 - DNA, 23 bp, Homo sapiens
aacccttctccatacccacaatc

SEQ ID NO: 6353373 - DNA, 20 bp, Homo sapiens
aacccttctcctcttgtaaa

SEQ ID NO: 6353374 - DNA, 17 bp, Homo sapiens
aacccttctctgttggt

SEQ ID NO: 6353375 - DNA, 14 bp, Homo sapiens
aacccttctgcttt

SEQ ID NO: 6353376 - DNA, 13 bp, Homo sapiens
aacccttctttta

SEQ ID NO: 6353377 - DNA, 14 bp, Homo sapiens
aacccttcttttaa

SEQ ID NO: 6353378 - DNA, 14 bp, Homo sapiens
aacccttgctgctg

SEQ ID NO: 6353379 - DNA, 16 bp, Homo sapiens
aacccttgctgcttta

SEQ ID NO: 6353380 - DNA, 20 bp, Homo sapiens
aacccttgggccagaagtac

SEQ ID NO: 6353381 - DNA, 22 bp, Homo sapiens
aacccttgtgcctctcatcttt

SEQ ID NO: 6353382 - DNA, 19 bp, Homo sapiens
aaccctttaaatgtaaaat

SEQ ID NO: 6353383 - DNA, 23 bp, Homo sapiens
aaccctttccaacccctttgctg

SEQ ID NO: 6353384 - DNA, 20 bp, Homo sapiens
aaccctttgtgtgctctcca

SEQ ID NO: 6353385 - DNA, 18 bp, Homo sapiens
aacccttttaaagttgat

SEQ ID NO: 6353386 - DNA, 16 bp, Homo sapiens
aacccttttcctccag

SEQ ID NO: 6353387 - DNA, 17 bp, Homo sapiens
aaccgaacatatcattt

SEQ ID NO: 6353388 - DNA, 22 bp, Homo sapiens
aaccgaacatatcatttgtgaa

SEQ ID NO: 6353389 - DNA, 17 bp, Homo sapiens
aaccgaacatgaccaaa

SEQ ID NO: 6353390 - DNA, 19 bp, Homo sapiens
aaccgagataggggagggg

SEQ ID NO: 6353391 - DNA, 17 bp, Homo sapiens
aaccgagcaaagatcaa

SEQ ID NO: 6353392 - DNA, 22 bp, Homo sapiens
aaccgagcaaagatcaaaataa

SEQ ID NO: 6353393 - DNA, 15 bp, Homo sapiens
aaccgagccagcagc

SEQ ID NO: 6353394 - DNA, 23 bp, Homo sapiens
aaccgagccagcagctgaagtct

SEQ ID NO: 6353395 - DNA, 16 bp, Homo sapiens
aaccgaggacccatga

SEQ ID NO: 6353396 - DNA, 20 bp, Homo sapiens
aaccgaggggctcaggaaaa

SEQ ID NO: 6353397 - DNA, 16 bp, Homo sapiens
aaccgataatgcatga

SEQ ID NO: 6353398 - DNA, 17 bp, Homo sapiens
aaccgataatgcatgaa

SEQ ID NO: 6353399 - DNA, 13 bp, Homo sapiens
aaccgatgctcca

SEQ ID NO: 6353400 - DNA, 15 bp, Homo sapiens
aaccgatgctccagc

SEQ ID NO: 6353401 - DNA, 12 bp, Homo sapiens
aaccgcacagct

SEQ ID NO: 6353402 - DNA, 13 bp, Homo sapiens
aaccgcacagctc

SEQ ID NO: 6353403 - DNA, 14 bp, Homo sapiens
aaccgcacagctca

SEQ ID NO: 6353404 - DNA, 15 bp, Homo sapiens
aaccgcaggaagctg

SEQ ID NO: 6353405 - DNA, 19 bp, Homo sapiens
aaccgcccagtgcaggtat

SEQ ID NO: 6353406 - DNA, 15 bp, Homo sapiens
aaccgccctcctgat

SEQ ID NO: 6353407 - DNA, 19 bp, Homo sapiens
aaccgccctgcagcatccc

SEQ ID NO: 6353408 - DNA, 20 bp, Homo sapiens
aaccgccggttcattttgca

SEQ ID NO: 6353409 - DNA, 21 bp, Homo sapiens
aaccgccggttcattttgcac

SEQ ID NO: 6353410 - DNA, 16 bp, Homo sapiens
aaccgcctcaaaatgt

SEQ ID NO: 6353411 - DNA, 20 bp, Homo sapiens
aaccgctacaagagggcaaa

SEQ ID NO: 6353412 - DNA, 12 bp, Homo sapiens
aaccgctcacct

SEQ ID NO: 6353413 - DNA, 14 bp, Homo sapiens
aaccgctgaatatg

SEQ ID NO: 6353414 - DNA, 16 bp, Homo sapiens
aaccgctttggcctga

SEQ ID NO: 6353415 - DNA, 18 bp, Homo sapiens
aaccgctttggcctgagt

SEQ ID NO: 6353416 - DNA, 12 bp, Homo sapiens
aaccggatgcca

SEQ ID NO: 6353417 - DNA, 16 bp, Homo sapiens
aaccgggaagggtggc

SEQ ID NO: 6353418 - DNA, 15 bp, Homo sapiens
aaccgggactacaga

SEQ ID NO: 6353419 - DNA, 18 bp, Homo sapiens
aaccgggactacagaagt

SEQ ID NO: 6353420 - DNA, 22 bp, Homo sapiens
aaccggtcccagcctgggctcc

SEQ ID NO: 6353421 - DNA, 14 bp, Homo sapiens
aaccggttatcagt

SEQ ID NO: 6353422 - DNA, 19 bp, Homo sapiens
aaccgtaacccacccccaa

SEQ ID NO: 6353423 - DNA, 17 bp, Homo sapiens
aaccgtagatgatttca

SEQ ID NO: 6353424 - DNA, 17 bp, Homo sapiens
aaccgtcaatgtgaaat

SEQ ID NO: 6353425 - DNA, 20 bp, Homo sapiens
aaccgtccccggcccctgcc

SEQ ID NO: 6353426 - DNA, 21 bp, Homo sapiens
aaccgtccccggcccctgccc

SEQ ID NO: 6353427 - DNA, 13 bp, Homo sapiens
aaccgtcctcttt

SEQ ID NO: 6353428 - DNA, 19 bp, Homo sapiens
aaccgtcctgctgtccctg

SEQ ID NO: 6353429 - DNA, 23 bp, Homo sapiens
aaccgtgagcaggaaggcctggg

SEQ ID NO: 6353430 - DNA, 18 bp, Homo sapiens
aaccgtggcccttcctgg

SEQ ID NO: 6353431 - DNA, 18 bp, Homo sapiens
aaccgtggtatgtctgcc

SEQ ID NO: 6353432 - DNA, 17 bp, Homo sapiens
aaccgtgtgtccagcat

SEQ ID NO: 6353433 - DNA, 14 bp, Homo sapiens
aaccgttaggaaaa

SEQ ID NO: 6353434 - DNA, 16 bp, Homo sapiens
aaccgttaggaaaacc

SEQ ID NO: 6353435 - DNA, 22 bp, Homo sapiens
aaccgttattataattgtatca

SEQ ID NO: 6353436 - DNA, 13 bp, Homo sapiens
aaccgtttttcaa

SEQ ID NO: 6353437 - DNA, 13 bp, Homo sapiens
aacctaaaaaaga

SEQ ID NO: 6353438 - DNA, 14 bp, Homo sapiens
aacctaaaaaagat

SEQ ID NO: 6353439 - DNA, 16 bp, Homo sapiens
aacctaaaaaagatat

SEQ ID NO: 6353440 - DNA, 17 bp, Homo sapiens
aacctaaaatttcaagt

SEQ ID NO: 6353441 - DNA, 22 bp, Homo sapiens
aacctaaataaacacatagatt

SEQ ID NO: 6353442 - DNA, 21 bp, Homo sapiens
aacctaaatgatgttatagaa

SEQ ID NO: 6353443 - DNA, 22 bp, Homo sapiens
aacctaaatggagaaagctgtg

SEQ ID NO: 6353444 - DNA, 11 bp, Homo sapiens
aacctaacctg

SEQ ID NO: 6353445 - DNA, 15 bp, Homo sapiens
aacctaacctgtgtc

SEQ ID NO: 6353446 - DNA, 16 bp, Homo sapiens
aacctaacctgtgtct

SEQ ID NO: 6353447 - DNA, 18 bp, Homo sapiens
aacctaacctgtgtctgc

SEQ ID NO: 6353448 - DNA, 15 bp, Homo sapiens
aacctaactgcaatg

SEQ ID NO: 6353449 - DNA, 15 bp, Homo sapiens
aacctaactgtatct

SEQ ID NO: 6353450 - DNA, 15 bp, Homo sapiens
aacctaataattgta

SEQ ID NO: 6353451 - DNA, 16 bp, Homo sapiens
aacctaataattgtat

SEQ ID NO: 6353452 - DNA, 20 bp, Homo sapiens
aacctaataattgtatctac

SEQ ID NO: 6353453 - DNA, 18 bp, Homo sapiens
aacctaatatcacttaaa

SEQ ID NO: 6353454 - DNA, 21 bp, Homo sapiens
aacctaatgggaatcattcca

SEQ ID NO: 6353455 - DNA, 13 bp, Homo sapiens
aacctaattgaaa

SEQ ID NO: 6353456 - DNA, 15 bp, Homo sapiens
aacctacaaaagctt

SEQ ID NO: 6353457 - DNA, 15 bp, Homo sapiens
aacctacacacaagg

SEQ ID NO: 6353458 - DNA, 20 bp, Homo sapiens
aacctacacagctgtttcct

SEQ ID NO: 6353459 - DNA, 15 bp, Homo sapiens
aacctacagtggagg

SEQ ID NO: 6353460 - DNA, 13 bp, Homo sapiens
aacctacattcca

SEQ ID NO: 6353461 - DNA, 21 bp, Homo sapiens
aacctacattccaccctgtta

SEQ ID NO: 6353462 - DNA, 18 bp, Homo sapiens
aacctaccaccccttcct

SEQ ID NO: 6353463 - DNA, 15 bp, Homo sapiens
gtatttcagaaggag

SEQ ID NO: 6353464 - DNA, 11 bp, Homo sapiens
gtatttcagac

SEQ ID NO: 6353465 - DNA, 17 bp, Homo sapiens
gtatttcatgtggctgt

SEQ ID NO: 6353466 - DNA, 18 bp, Homo sapiens
gtatttcatgtggctgta

SEQ ID NO: 6353467 - DNA, 15 bp, Homo sapiens
gtatttccaacaaac

SEQ ID NO: 6353468 - DNA, 22 bp, Homo sapiens
gtatttccaacaaacttactgt

SEQ ID NO: 6353469 - DNA, 15 bp, Homo sapiens
gtatttcccctgtca

SEQ ID NO: 6353470 - DNA, 18 bp, Homo sapiens
gtatttcccttccaaaga

SEQ ID NO: 6353471 - DNA, 20 bp, Homo sapiens
gtatttcctgaaataaatgt

SEQ ID NO: 6353472 - DNA, 13 bp, Homo sapiens
gtatttcctgcta

SEQ ID NO: 6353473 - DNA, 19 bp, Homo sapiens
gtatttccttccactgtag

SEQ ID NO: 6353474 - DNA, 16 bp, Homo sapiens
gtatttcgaaactgcc

SEQ ID NO: 6353475 - DNA, 17 bp, Homo sapiens
gtatttcggctatgtct

SEQ ID NO: 6353476 - DNA, 18 bp, Homo sapiens
gtatttcggctatgtctc

SEQ ID NO: 6353477 - DNA, 15 bp, Homo sapiens
gtatttctaaatgtt

SEQ ID NO: 6353478 - DNA, 17 bp, Homo sapiens
gtatttctatacagtag

SEQ ID NO: 6353479 - DNA, 23 bp, Homo sapiens
gtatttctatatagacttggaga

SEQ ID NO: 6353480 - DNA, 21 bp, Homo sapiens
gtatttctcctttgcaatagc

SEQ ID NO: 6353481 - DNA, 21 bp, Homo sapiens
gtatttctctattttcataat

SEQ ID NO: 6353482 - DNA, 12 bp, Homo sapiens
gtatttctctgt

SEQ ID NO: 6353483 - DNA, 15 bp, Homo sapiens
gtatttctgattttg

SEQ ID NO: 6353484 - DNA, 12 bp, Homo sapiens
gtatttctgtag

SEQ ID NO: 6353485 - DNA, 15 bp, Homo sapiens
gtatttctgtggaaa

SEQ ID NO: 6353486 - DNA, 9 bp, Homo sapiens
gtatttctt

SEQ ID NO: 6353487 - DNA, 15 bp, Homo sapiens
gtatttcttaagaat

SEQ ID NO: 6353488 - DNA, 22 bp, Homo sapiens
gtatttcttatacgcttttctt

SEQ ID NO: 6353489 - DNA, 13 bp, Homo sapiens
gtatttcttattt

SEQ ID NO: 6353490 - DNA, 10 bp, Homo sapiens
gtatttcttt

SEQ ID NO: 6353491 - DNA, 13 bp, Homo sapiens
gtatttcttttat

SEQ ID NO: 6353492 - DNA, 16 bp, Homo sapiens
gtatttcttttatata

SEQ ID NO: 6353493 - DNA, 19 bp, Homo sapiens
gtatttcttttatatataa

SEQ ID NO: 6353494 - DNA, 20 bp, Homo sapiens
gtatttcttttatatataaa

SEQ ID NO: 6353495 - DNA, 22 bp, Homo sapiens
gtatttcttttatatataaaat

SEQ ID NO: 6353496 - DNA, 20 bp, Homo sapiens
gtatttcttttttttaataa

SEQ ID NO: 6353497 - DNA, 19 bp, Homo sapiens
gtatttgaaaacagaaatt

SEQ ID NO: 6353498 - DNA, 20 bp, Homo sapiens
gtatttgaaaacagaaattg

SEQ ID NO: 6353499 - DNA, 14 bp, Homo sapiens
gtatttgaaactga

SEQ ID NO: 6353500 - DNA, 17 bp, Homo sapiens
gtatttgagacattcca

SEQ ID NO: 6353501 - DNA, 16 bp, Homo sapiens
gtatttgagagaatct

SEQ ID NO: 6353502 - DNA, 20 bp, Homo sapiens
gtatttgagttggctttgct

SEQ ID NO: 6353503 - DNA, 16 bp, Homo sapiens
gtatttgatgtacatt

SEQ ID NO: 6353504 - DNA, 17 bp, Homo sapiens
gtatttgatgtacatta

SEQ ID NO: 6353505 - DNA, 21 bp, Homo sapiens
gtatttgatgtacattacaga

SEQ ID NO: 6353506 - DNA, 18 bp, Homo sapiens
gtatttgatgtattctgt

SEQ ID NO: 6353507 - DNA, 13 bp, Homo sapiens
gtatttgcagttc

SEQ ID NO: 6353508 - DNA, 19 bp, Homo sapiens
gtatttgctgccagacact

SEQ ID NO: 6353509 - DNA, 12 bp, Homo sapiens
gtatttgctgtt

SEQ ID NO: 6353510 - DNA, 19 bp, Homo sapiens
gtatttggaaataaagtca

SEQ ID NO: 6353511 - DNA, 18 bp, Homo sapiens
gtatttggaatatttgaa

SEQ ID NO: 6353512 - DNA, 19 bp, Homo sapiens
gtatttggaatatttgaat

SEQ ID NO: 6353513 - DNA, 17 bp, Homo sapiens
gtatttggaattagaac

SEQ ID NO: 6353514 - DNA, 22 bp, Homo sapiens
gtatttggctatggatctgatt

SEQ ID NO: 6353515 - DNA, 23 bp, Homo sapiens
gtatttggctattaactgccaaa

SEQ ID NO: 6353516 - DNA, 20 bp, Homo sapiens
gtatttgggaagtgaagact

SEQ ID NO: 6353517 - DNA, 22 bp, Homo sapiens
gtatttggttaaaggtctccca

SEQ ID NO: 6353518 - DNA, 13 bp, Homo sapiens
gtatttgtaatta

SEQ ID NO: 6353519 - DNA, 15 bp, Homo sapiens
gtatttgtagccagt

SEQ ID NO: 6353520 - DNA, 17 bp, Homo sapiens
gtatttgtatgtactgt

SEQ ID NO: 6353521 - DNA, 19 bp, Homo sapiens
gtatttgtattaataaagc

SEQ ID NO: 6353522 - DNA, 22 bp, Homo sapiens
gtatttgtattaataaagcatt

SEQ ID NO: 6353523 - DNA, 11 bp, Homo sapiens
gtatttgtgac

SEQ ID NO: 6353524 - DNA, 18 bp, Homo sapiens
gtatttgtgactaattgt

SEQ ID NO: 6353525 - DNA, 14 bp, Homo sapiens
gtatttgttaatgg

SEQ ID NO: 6353526 - DNA, 17 bp, Homo sapiens
gtatttgttaatttaga

SEQ ID NO: 6353527 - DNA, 23 bp, Homo sapiens
gtatttgttaatttagaaaactt

SEQ ID NO: 6353528 - DNA, 15 bp, Homo sapiens
gtatttgttatatat

SEQ ID NO: 6353529 - DNA, 12 bp, Homo sapiens
gtatttgtttgc

SEQ ID NO: 6353530 - DNA, 18 bp, Homo sapiens
gtattttaacactttgta

SEQ ID NO: 6353531 - DNA, 22 bp, Homo sapiens
gtattttaagatccagaaatac

SEQ ID NO: 6353532 - DNA, 20 bp, Homo sapiens
gtattttaagtctacaaaaa

SEQ ID NO: 6353533 - DNA, 23 bp, Homo sapiens
gtattttaataaactttgaataa

SEQ ID NO: 6353534 - DNA, 15 bp, Homo sapiens
gtattttaataaaga

SEQ ID NO: 6353535 - DNA, 11 bp, Homo sapiens
gtattttacac

SEQ ID NO: 6353536 - DNA, 12 bp, Homo sapiens
gtattttacatg

SEQ ID NO: 6353537 - DNA, 19 bp, Homo sapiens
gtattttacatgggccagt

SEQ ID NO: 6353538 - DNA, 17 bp, Homo sapiens
gtattttagaataaaat

SEQ ID NO: 6353539 - DNA, 22 bp, Homo sapiens
gtattttatctgtgttgtctct

SEQ ID NO: 6353540 - DNA, 23 bp, Homo sapiens
gtattttatctttgattctcctt

SEQ ID NO: 6353541 - DNA, 21 bp, Homo sapiens
gtattttatgatacttgaatt

SEQ ID NO: 6353542 - DNA, 16 bp, Homo sapiens
gtattttatgttatat

SEQ ID NO: 6353543 - DNA, 22 bp, Homo sapiens
gtattttatgttatatataaat

SEQ ID NO: 6353544 - DNA, 18 bp, Homo sapiens
gtattttattattttctt

SEQ ID NO: 6353545 - DNA, 12 bp, Homo sapiens
gtattttcaaag

SEQ ID NO: 6353546 - DNA, 19 bp, Homo sapiens
gtattttcaaatgtaaact

SEQ ID NO: 6353547 - DNA, 16 bp, Homo sapiens
gtattttcaataaaga

SEQ ID NO: 6353548 - DNA, 17 bp, Homo sapiens
gtattttcatttaacta

SEQ ID NO: 6353549 - DNA, 17 bp, Homo sapiens
gtattttccaagtgtgc

SEQ ID NO: 6353550 - DNA, 20 bp, Homo sapiens
gtattttccaagtgtgcata

SEQ ID NO: 6353551 - DNA, 11 bp, Homo sapiens
gtattttcctg

SEQ ID NO: 6353552 - DNA, 19 bp, Homo sapiens
gtattttcgggattctttg

SEQ ID NO: 6353553 - DNA, 18 bp, Homo sapiens
gtattttctagactgtga

SEQ ID NO: 6353554 - DNA, 22 bp, Homo sapiens
gtattttctccaaatgttcact

SEQ ID NO: 6353555 - DNA, 23 bp, Homo sapiens
gtattttctgtcactgtaggtat

SEQ ID NO: 6353556 - DNA, 20 bp, Homo sapiens
gtattttcttcacctctgct

SEQ ID NO: 6353557 - DNA, 16 bp, Homo sapiens
gtattttcttcccatt

SEQ ID NO: 6353558 - DNA, 20 bp, Homo sapiens
gtattttcttcccatttgta

SEQ ID NO: 6353559 - DNA, 22 bp, Homo sapiens
gtattttcttttatatctgtaa

SEQ ID NO: 6353560 - DNA, 18 bp, Homo sapiens
gtattttgaaaacactta

SEQ ID NO: 6353561 - DNA, 13 bp, Homo sapiens
gtattttgaaaat

SEQ ID NO: 6353562 - DNA, 13 bp, Homo sapiens
gtattttgaaatt

SEQ ID NO: 6353563 - DNA, 19 bp, Homo sapiens
gtattttgaaccaaaacat

SEQ ID NO: 6353564 - DNA, 13 bp, Homo sapiens
gtattttgaagtt

SEQ ID NO: 6353565 - DNA, 14 bp, Homo sapiens
gtattttgaagttt

SEQ ID NO: 6353566 - DNA, 13 bp, Homo sapiens
gtattttgacaaa

SEQ ID NO: 6353567 - DNA, 13 bp, Homo sapiens
gtattttgacact

SEQ ID NO: 6353568 - DNA, 10 bp, Homo sapiens
gtattttgag

SEQ ID NO: 6353569 - DNA, 22 bp, Homo sapiens
gtattttgatataattgtactg

SEQ ID NO: 6353570 - DNA, 16 bp, Homo sapiens
gtattttgatcagtgt

SEQ ID NO: 6353571 - DNA, 14 bp, Homo sapiens
gtattttgcatact

SEQ ID NO: 6353572 - DNA, 13 bp, Homo sapiens
gtattttggaaga

SEQ ID NO: 6353573 - DNA, 14 bp, Homo sapiens
gtattttggagaaa

SEQ ID NO: 6353574 - DNA, 17 bp, Homo sapiens
gtattttggagaaatta

SEQ ID NO: 6353575 - DNA, 19 bp, Homo sapiens
gtattttggctttctccct

SEQ ID NO: 6353576 - DNA, 13 bp, Homo sapiens
gtattttgtaaac

SEQ ID NO: 6353577 - DNA, 14 bp, Homo sapiens
gtattttgtaaact

SEQ ID NO: 6353578 - DNA, 15 bp, Homo sapiens
gtattttgtgtcctc

SEQ ID NO: 6353579 - DNA, 18 bp, Homo sapiens
gtattttgtgtgaccaac

SEQ ID NO: 6353580 - DNA, 19 bp, Homo sapiens
gtattttgtttttgtctta

SEQ ID NO: 6353581 - DNA, 22 bp, Homo sapiens
gtatttttaaaaaacaattggt

SEQ ID NO: 6353582 - DNA, 19 bp, Homo sapiens
gtatttttaattaactttg

SEQ ID NO: 6353583 - DNA, 22 bp, Homo sapiens
gtatttttagaataagaatttg

SEQ ID NO: 6353584 - DNA, 13 bp, Homo sapiens
gtatttttagaga

SEQ ID NO: 6353585 - DNA, 14 bp, Homo sapiens
gtatttttataatg

SEQ ID NO: 6353586 - DNA, 23 bp, Homo sapiens
gtatttttataatgactggtctt

SEQ ID NO: 6353587 - DNA, 22 bp, Homo sapiens
gtatttttattttcctgtgact

SEQ ID NO: 6353588 - DNA, 16 bp, Homo sapiens
gtatttttcaaggcat

SEQ ID NO: 6353589 - DNA, 18 bp, Homo sapiens
gtatttttcaataaagca

SEQ ID NO: 6353590 - DNA, 21 bp, Homo sapiens
gtatttttcaataaagcattt

SEQ ID NO: 6353591 - DNA, 21 bp, Homo sapiens
gtatttttcaggtaggccctt

SEQ ID NO: 6353592 - DNA, 20 bp, Homo sapiens
gtatttttcatctttaagaa

SEQ ID NO: 6353593 - DNA, 17 bp, Homo sapiens
gtatttttccaatcaca

SEQ ID NO: 6353594 - DNA, 14 bp, Homo sapiens
gtatttttcttgct

SEQ ID NO: 6353595 - DNA, 20 bp, Homo sapiens
gtatttttgacagaatatgt

SEQ ID NO: 6353596 - DNA, 19 bp, Homo sapiens
gtatttttgatgtatatat

SEQ ID NO: 6353597 - DNA, 21 bp, Homo sapiens
gtatttttgattgttatgtaa

SEQ ID NO: 6353598 - DNA, 17 bp, Homo sapiens
gtatttttgctgcttct

SEQ ID NO: 6353599 - DNA, 20 bp, Homo sapiens
gtatttttgtaattcctcta

SEQ ID NO: 6353600 - DNA, 13 bp, Homo sapiens
gtatttttgttag

SEQ ID NO: 6353601 - DNA, 17 bp, Homo sapiens
gtattttttaatgctaa

SEQ ID NO: 6353602 - DNA, 13 bp, Homo sapiens
gtattttttcata

SEQ ID NO: 6353603 - DNA, 15 bp, Homo sapiens
gtattttttcttgca

SEQ ID NO: 6353604 - DNA, 14 bp, Homo sapiens
gtattttttgtgaa

SEQ ID NO: 6353605 - DNA, 14 bp, Homo sapiens
gtattttttgtttg

SEQ ID NO: 6353606 - DNA, 17 bp, Homo sapiens
gtatttttttaaatcaa

SEQ ID NO: 6353607 - DNA, 14 bp, Homo sapiens
gtatttttttacta

SEQ ID NO: 6353608 - DNA, 17 bp, Homo sapiens
gtatttttttactaata

SEQ ID NO: 6353609 - DNA, 21 bp, Homo sapiens
gtatttttttactaatagaca

SEQ ID NO: 6353610 - DNA, 14 bp, Homo sapiens
gtatttttttgcaa

SEQ ID NO: 6353611 - DNA, 23 bp, Homo sapiens
gtattttttttactgtgcataca

SEQ ID NO: 6353612 - DNA, 16 bp, Homo sapiens
gtatttttttttctaa

SEQ ID NO: 6353613 - DNA, 18 bp, Homo sapiens
gtatttttttttctaaga

SEQ ID NO: 6353614 - DNA, 17 bp, Homo sapiens
gtcaaaaaagaatctgt

SEQ ID NO: 6353615 - DNA, 20 bp, Homo sapiens
gtcaaaaatatttttatgtg

SEQ ID NO: 6353616 - DNA, 16 bp, Homo sapiens
gtcaaaacactgtgga

SEQ ID NO: 6353617 - DNA, 14 bp, Homo sapiens
gtcaaaactttaaa

SEQ ID NO: 6353618 - DNA, 18 bp, Homo sapiens
gtcaaaagagccctggct

SEQ ID NO: 6353619 - DNA, 13 bp, Homo sapiens
gtcaaaagcctgg

SEQ ID NO: 6353620 - DNA, 14 bp, Homo sapiens
gtcaaaaggtgcct

SEQ ID NO: 6353621 - DNA, 15 bp, Homo sapiens
gtcaaaaggtgcctg

SEQ ID NO: 6353622 - DNA, 16 bp, Homo sapiens
gtcaaaaggtgcctgt

SEQ ID NO: 6353623 - DNA, 12 bp, Homo sapiens
gtcaaaattaat

SEQ ID NO: 6353624 - DNA, 19 bp, Homo sapiens
gtcaaaattaatatgatta

SEQ ID NO: 6353625 - DNA, 20 bp, Homo sapiens
gtcaaacaaactctctgaac

SEQ ID NO: 6353626 - DNA, 15 bp, Homo sapiens
gtcaaacaaagccag

SEQ ID NO: 6353627 - DNA, 12 bp, Homo sapiens
gtcaaacaagtt

SEQ ID NO: 6353628 - DNA, 19 bp, Homo sapiens
gtcaaacagtgccaaatgc

SEQ ID NO: 6353629 - DNA, 15 bp, Homo sapiens
gtcaaacatgaagtg

SEQ ID NO: 6353630 - DNA, 17 bp, Homo sapiens
gtcaaacattagtactt

SEQ ID NO: 6353631 - DNA, 17 bp, Homo sapiens
gtcaaacattcgtgagc

SEQ ID NO: 6353632 - DNA, 21 bp, Homo sapiens
gtcaaaccgcactcacccatg

SEQ ID NO: 6353633 - DNA, 17 bp, Homo sapiens
gtcaaacgtgaaaatgc

SEQ ID NO: 6353634 - DNA, 20 bp, Homo sapiens
gtcaaactgtagaaatgatg

SEQ ID NO: 6353635 - DNA, 23 bp, Homo sapiens
gtcaaactttcacctcagatttt

SEQ ID NO: 6353636 - DNA, 16 bp, Homo sapiens
gtcaaactttggagag

SEQ ID NO: 6353637 - DNA, 14 bp, Homo sapiens
gtcaaactttttcc

SEQ ID NO: 6353638 - DNA, 12 bp, Homo sapiens
gtcaaagaaatg

SEQ ID NO: 6353639 - DNA, 15 bp, Homo sapiens
gtcaaagaagcttcc

SEQ ID NO: 6353640 - DNA, 11 bp, Homo sapiens
gtcaaagaagg

SEQ ID NO: 6353641 - DNA, 14 bp, Homo sapiens
gtcaaagatgcccc

SEQ ID NO: 6353642 - DNA, 23 bp, Homo sapiens
gtcaaagcaggggagtatgcaaa

SEQ ID NO: 6353643 - DNA, 15 bp, Homo sapiens
aacctaccagccaga

SEQ ID NO: 6353644 - DNA, 18 bp, Homo sapiens
aacctaccttatagagca

SEQ ID NO: 6353645 - DNA, 21 bp, Homo sapiens
aacctaccttcatttcaggag

SEQ ID NO: 6353646 - DNA, 23 bp, Homo sapiens
aacctacgagggaggaacacctg

SEQ ID NO: 6353647 - DNA, 21 bp, Homo sapiens
aacctacgcacataccttcat

SEQ ID NO: 6353648 - DNA, 13 bp, Homo sapiens
aacctactgccca

SEQ ID NO: 6353649 - DNA, 14 bp, Homo sapiens
aacctactgcccac

SEQ ID NO: 6353650 - DNA, 19 bp, Homo sapiens
aacctactgcccacatttg

SEQ ID NO: 6353651 - DNA, 16 bp, Homo sapiens
aacctactgtctaagc

SEQ ID NO: 6353652 - DNA, 18 bp, Homo sapiens
aacctactgttcctttca

SEQ ID NO: 6353653 - DNA, 21 bp, Homo sapiens
aacctacttgtaaacttgaaa

SEQ ID NO: 6353654 - DNA, 23 bp, Homo sapiens
aacctagaaacctttatccctgc

SEQ ID NO: 6353655 - DNA, 19 bp, Homo sapiens
aacctagaacttcaaaatg

SEQ ID NO: 6353656 - DNA, 20 bp, Homo sapiens
aacctagaacttcaaaatgt

SEQ ID NO: 6353657 - DNA, 17 bp, Homo sapiens
aacctagctacactgag

SEQ ID NO: 6353658 - DNA, 13 bp, Homo sapiens
aacctaggcagtg

SEQ ID NO: 6353659 - DNA, 17 bp, Homo sapiens
aacctagggtgatatta

SEQ ID NO: 6353660 - DNA, 20 bp, Homo sapiens
aacctagggtgatattaacc

SEQ ID NO: 6353661 - DNA, 16 bp, Homo sapiens
aacctagtaaaacctt

SEQ ID NO: 6353662 - DNA, 21 bp, Homo sapiens
aacctagtaaaaccttgttct

SEQ ID NO: 6353663 - DNA, 20 bp, Homo sapiens
aacctagtactctctgctct

SEQ ID NO: 6353664 - DNA, 18 bp, Homo sapiens
aacctagtactttattag

SEQ ID NO: 6353665 - DNA, 18 bp, Homo sapiens
aacctagtccgctgaaga

SEQ ID NO: 6353666 - DNA, 21 bp, Homo sapiens
aacctatctatgaacaacagt

SEQ ID NO: 6353667 - DNA, 13 bp, Homo sapiens
aacctatctcagg

SEQ ID NO: 6353668 - DNA, 18 bp, Homo sapiens
aacctatctcagggaggg

SEQ ID NO: 6353669 - DNA, 16 bp, Homo sapiens
aacctatctgtattgg

SEQ ID NO: 6353670 - DNA, 18 bp, Homo sapiens
aacctatctgtattggca

SEQ ID NO: 6353671 - DNA, 21 bp, Homo sapiens
aacctatctgtattggcagca

SEQ ID NO: 6353672 - DNA, 22 bp, Homo sapiens
aacctatctgtattggcagcac

SEQ ID NO: 6353673 - DNA, 16 bp, Homo sapiens
aacctatgataattat

SEQ ID NO: 6353674 - DNA, 22 bp, Homo sapiens
aacctatgatattttctgtgcc

SEQ ID NO: 6353675 - DNA, 22 bp, Homo sapiens
aacctattctctttttaacaaa

SEQ ID NO: 6353676 - DNA, 22 bp, Homo sapiens
aacctatttccacattctctct

SEQ ID NO: 6353677 - DNA, 15 bp, Homo sapiens
aacctatttctcttt

SEQ ID NO: 6353678 - DNA, 18 bp, Homo sapiens
aacctatttctctttctt

SEQ ID NO: 6353679 - DNA, 17 bp, Homo sapiens
aacctattttcatttgt

SEQ ID NO: 6353680 - DNA, 18 bp, Homo sapiens
aacctattttcatttgta

SEQ ID NO: 6353681 - DNA, 16 bp, Homo sapiens
aacctattttgaaaaa

SEQ ID NO: 6353682 - DNA, 22 bp, Homo sapiens
aacctattttgaaaaattccta

SEQ ID NO: 6353683 - DNA, 17 bp, Homo sapiens
aacctattttgaaaggt

SEQ ID NO: 6353684 - DNA, 22 bp, Homo sapiens
aacctcaaaatattttttttaa

SEQ ID NO: 6353685 - DNA, 11 bp, Homo sapiens
aacctcaaact

SEQ ID NO: 6353686 - DNA, 13 bp, Homo sapiens
aacctcaaactgg

SEQ ID NO: 6353687 - DNA, 16 bp, Homo sapiens
aacctcaaatatagta

SEQ ID NO: 6353688 - DNA, 17 bp, Homo sapiens
aacctcaactgcctact

SEQ ID NO: 6353689 - DNA, 20 bp, Homo sapiens
aacctcaagggctttcccac

SEQ ID NO: 6353690 - DNA, 18 bp, Homo sapiens
aacctcacactactgtat

SEQ ID NO: 6353691 - DNA, 17 bp, Homo sapiens
aacctcaccaaactagt

SEQ ID NO: 6353692 - DNA, 22 bp, Homo sapiens
aacctcaccccgaggccctgca

SEQ ID NO: 6353693 - DNA, 19 bp, Homo sapiens
aacctcacgcacctcccat

SEQ ID NO: 6353694 - DNA, 12 bp, Homo sapiens
aacctcactctt

SEQ ID NO: 6353695 - DNA, 23 bp, Homo sapiens
aacctcactgggcctttccagag

SEQ ID NO: 6353696 - DNA, 13 bp, Homo sapiens
aacctcacttccc

SEQ ID NO: 6353697 - DNA, 20 bp, Homo sapiens
aacctcagagggataaggca

SEQ ID NO: 6353698 - DNA, 19 bp, Homo sapiens
aacctcagagtatctttac

SEQ ID NO: 6353699 - DNA, 18 bp, Homo sapiens
aacctcagcatttacttt

SEQ ID NO: 6353700 - DNA, 23 bp, Homo sapiens
aacctcagcatttccttccagcc

SEQ ID NO: 6353701 - DNA, 17 bp, Homo sapiens
aacctcagccaaacaca

SEQ ID NO: 6353702 - DNA, 11 bp, Homo sapiens
aacctcagcct

SEQ ID NO: 6353703 - DNA, 16 bp, Homo sapiens
aacctcagcctggcca

SEQ ID NO: 6353704 - DNA, 11 bp, Homo sapiens
aacctcagcta

SEQ ID NO: 6353705 - DNA, 16 bp, Homo sapiens
aacctcagctctggga

SEQ ID NO: 6353706 - DNA, 14 bp, Homo sapiens
aacctcagggacaa

SEQ ID NO: 6353707 - DNA, 16 bp, Homo sapiens
aacctcaggttccaaa

SEQ ID NO: 6353708 - DNA, 20 bp, Homo sapiens
aacctcagtatttatgtaat

SEQ ID NO: 6353709 - DNA, 22 bp, Homo sapiens
aacctcagttggcctctgcccc

SEQ ID NO: 6353710 - DNA, 14 bp, Homo sapiens
aacctcagtttcct

SEQ ID NO: 6353711 - DNA, 16 bp, Homo sapiens
aacctcagtttcctca

SEQ ID NO: 6353712 - DNA, 17 bp, Homo sapiens
aacctcagtttcctcat

SEQ ID NO: 6353713 - DNA, 20 bp, Homo sapiens
aacctcatcctccttcttca

SEQ ID NO: 6353714 - DNA, 11 bp, Homo sapiens
aacctcattaa

SEQ ID NO: 6353715 - DNA, 16 bp, Homo sapiens
aacctcattggccagc

SEQ ID NO: 6353716 - DNA, 13 bp, Homo sapiens
aacctccacctcc

SEQ ID NO: 6353717 - DNA, 12 bp, Homo sapiens
aacctccagact

SEQ ID NO: 6353718 - DNA, 13 bp, Homo sapiens
aacctccatctcc

SEQ ID NO: 6353719 - DNA, 15 bp, Homo sapiens
aacctcccaacccag

SEQ ID NO: 6353720 - DNA, 22 bp, Homo sapiens
aacctcccactttgtctgtaca

SEQ ID NO: 6353721 - DNA, 23 bp, Homo sapiens
aacctcccactttgtctgtacat

SEQ ID NO: 6353722 - DNA, 11 bp, Homo sapiens
aacctcccaga

SEQ ID NO: 6353723 - DNA, 17 bp, Homo sapiens
aacctcccatcccaccc

SEQ ID NO: 6353724 - DNA, 16 bp, Homo sapiens
aacctccccagcctgc

SEQ ID NO: 6353725 - DNA, 23 bp, Homo sapiens
aacctccccagcctgcgcctgct

SEQ ID NO: 6353726 - DNA, 13 bp, Homo sapiens
aacctcccctctc

SEQ ID NO: 6353727 - DNA, 14 bp, Homo sapiens
aacctcccctctcc

SEQ ID NO: 6353728 - DNA, 16 bp, Homo sapiens
aacctcccctctcccc

SEQ ID NO: 6353729 - DNA, 18 bp, Homo sapiens
aacctcccctggtcctgc

SEQ ID NO: 6353730 - DNA, 16 bp, Homo sapiens
aacctccctcaacaag

SEQ ID NO: 6353731 - DNA, 18 bp, Homo sapiens
aacctccctcaacaaggt

SEQ ID NO: 6353732 - DNA, 16 bp, Homo sapiens
aacctccctcttgttt

SEQ ID NO: 6353733 - DNA, 20 bp, Homo sapiens
aacctccctcttgttttgtt

SEQ ID NO: 6353734 - DNA, 17 bp, Homo sapiens
aacctccgcctcttggg

SEQ ID NO: 6353735 - DNA, 15 bp, Homo sapiens
aacctcctctgtgaa

SEQ ID NO: 6353736 - DNA, 13 bp, Homo sapiens
aacctcctgctct

SEQ ID NO: 6353737 - DNA, 14 bp, Homo sapiens
aacctcctgctctg

SEQ ID NO: 6353738 - DNA, 15 bp, Homo sapiens
aacctcctgctgtgc

SEQ ID NO: 6353739 - DNA, 19 bp, Homo sapiens
aacctcctttaccctcatc

SEQ ID NO: 6353740 - DNA, 16 bp, Homo sapiens
aacctcgagtactgtg

SEQ ID NO: 6353741 - DNA, 14 bp, Homo sapiens
aacctcgccctctc

SEQ ID NO: 6353742 - DNA, 17 bp, Homo sapiens
aacctcgccctctcctt

SEQ ID NO: 6353743 - DNA, 19 bp, Homo sapiens
aacctcgcgcttgctggcc

SEQ ID NO: 6353744 - DNA, 22 bp, Homo sapiens
aacctcggagacgggaccctgc

SEQ ID NO: 6353745 - DNA, 19 bp, Homo sapiens
aacctcggcttgtgggctg

SEQ ID NO: 6353746 - DNA, 21 bp, Homo sapiens
aacctcggcttgtgggctggt

SEQ ID NO: 6353747 - DNA, 16 bp, Homo sapiens
aacctcgggcctgctg

SEQ ID NO: 6353748 - DNA, 17 bp, Homo sapiens
aacctcgttgacatgca

SEQ ID NO: 6353749 - DNA, 24 bp, Homo sapiens
aacctctaaattctttcattttag

SEQ ID NO: 6353750 - DNA, 23 bp, Homo sapiens
aacctctaagtgctgctgtggag

SEQ ID NO: 6353751 - DNA, 20 bp, Homo sapiens
aacctctaatttattttgtc

SEQ ID NO: 6353752 - DNA, 21 bp, Homo sapiens
aacctctaatttattttgtcg

SEQ ID NO: 6353753 - DNA, 14 bp, Homo sapiens
aacctctcacagtt

SEQ ID NO: 6353754 - DNA, 18 bp, Homo sapiens
aacctctcacttcaccct

SEQ ID NO: 6353755 - DNA, 14 bp, Homo sapiens
aacctctcctgacc

SEQ ID NO: 6353756 - DNA, 15 bp, Homo sapiens
aacctctcctgaccc

SEQ ID NO: 6353757 - DNA, 21 bp, Homo sapiens
aacctctcctgacccctgcct

SEQ ID NO: 6353758 - DNA, 17 bp, Homo sapiens
aacctctcctttctgtg

SEQ ID NO: 6353759 - DNA, 19 bp, Homo sapiens
aacctctcgccatgatcag

SEQ ID NO: 6353760 - DNA, 22 bp, Homo sapiens
aacctctcgccatgatcagaca

SEQ ID NO: 6353761 - DNA, 14 bp, Homo sapiens
aacctctctatttt

SEQ ID NO: 6353762 - DNA, 22 bp, Homo sapiens
aacctctctgaactgcaacact

SEQ ID NO: 6353763 - DNA, 12 bp, Homo sapiens
aacctctgcctc

SEQ ID NO: 6353764 - DNA, 20 bp, Homo sapiens
aacctctgcctcccgggttc

SEQ ID NO: 6353765 - DNA, 15 bp, Homo sapiens
aacctctgcctcctg

SEQ ID NO: 6353766 - DNA, 18 bp, Homo sapiens
aacctctgcctcctgggt

SEQ ID NO: 6353767 - DNA, 12 bp, Homo sapiens
aacctctgcctt

SEQ ID NO: 6353768 - DNA, 10 bp, Homo sapiens
aacctctggc

SEQ ID NO: 6353769 - DNA, 12 bp, Homo sapiens
aacctctggccc

SEQ ID NO: 6353770 - DNA, 14 bp, Homo sapiens
aacctctggccctt

SEQ ID NO: 6353771 - DNA, 13 bp, Homo sapiens
aacctctgtctca

SEQ ID NO: 6353772 - DNA, 20 bp, Homo sapiens
aacctctgtggtcacccatg

SEQ ID NO: 6353773 - DNA, 11 bp, Homo sapiens
aacctctgttc

SEQ ID NO: 6353774 - DNA, 16 bp, Homo sapiens
aacctctgttcagtgt

SEQ ID NO: 6353775 - DNA, 22 bp, Homo sapiens
aacctcttaataatctcatgct

SEQ ID NO: 6353776 - DNA, 21 bp, Homo sapiens
aacctcttatcactaagaaag

SEQ ID NO: 6353777 - DNA, 15 bp, Homo sapiens
aacctcttcagctgg

SEQ ID NO: 6353778 - DNA, 12 bp, Homo sapiens
aacctcttcccc

SEQ ID NO: 6353779 - DNA, 15 bp, Homo sapiens
aacctcttcctcctg

SEQ ID NO: 6353780 - DNA, 11 bp, Homo sapiens
aacctcttttt

SEQ ID NO: 6353781 - DNA, 12 bp, Homo sapiens
aacctcttttta

SEQ ID NO: 6353782 - DNA, 15 bp, Homo sapiens
aacctgaagatgtct

SEQ ID NO: 6353783 - DNA, 21 bp, Homo sapiens
aacctgaagatgtctcctcaa

SEQ ID NO: 6353784 - DNA, 16 bp, Homo sapiens
aacctgaattaaagtc

SEQ ID NO: 6353785 - DNA, 18 bp, Homo sapiens
aacctgaattaaagtcta

SEQ ID NO: 6353786 - DNA, 13 bp, Homo sapiens
aacctgacaaaaa

SEQ ID NO: 6353787 - DNA, 19 bp, Homo sapiens
aacctgacagcaaacacag

SEQ ID NO: 6353788 - DNA, 21 bp, Homo sapiens
aacctgacagcaaacacagtc

SEQ ID NO: 6353789 - DNA, 20 bp, Homo sapiens
aacctgaccgtgggcggggc

SEQ ID NO: 6353790 - DNA, 20 bp, Homo sapiens
aacctgacttcagtgaatat

SEQ ID NO: 6353791 - DNA, 20 bp, Homo sapiens
aacctgagatggccctctgg

SEQ ID NO: 6353792 - DNA, 15 bp, Homo sapiens
aacctgagatttatt

SEQ ID NO: 6353793 - DNA, 20 bp, Homo sapiens
aacctgagatttattaaaga

SEQ ID NO: 6353794 - DNA, 22 bp, Homo sapiens
aacctgagatttattaaagaaa

SEQ ID NO: 6353795 - DNA, 17 bp, Homo sapiens
aacctgaggattctatt

SEQ ID NO: 6353796 - DNA, 14 bp, Homo sapiens
aacctgaggccaaa

SEQ ID NO: 6353797 - DNA, 20 bp, Homo sapiens
aacctgaggccaaatattga

SEQ ID NO: 6353798 - DNA, 18 bp, Homo sapiens
aacctgaggtctcattca

SEQ ID NO: 6353799 - DNA, 22 bp, Homo sapiens
aacctgatgaaaataaagaatg

SEQ ID NO: 6353800 - DNA, 17 bp, Homo sapiens
aacctgatgagcaagaa

SEQ ID NO: 6353801 - DNA, 19 bp, Homo sapiens
aacctgatgctaattttca

SEQ ID NO: 6353802 - DNA, 18 bp, Homo sapiens
aacctgattgtgtctctt

SEQ ID NO: 6353803 - DNA, 19 bp, Homo sapiens
aacctgattgtgtctcttg

SEQ ID NO: 6353804 - DNA, 14 bp, Homo sapiens
aacctgcaaaaaat

SEQ ID NO: 6353805 - DNA, 16 bp, Homo sapiens
aacctgcaaaatctgt

SEQ ID NO: 6353806 - DNA, 13 bp, Homo sapiens
aacctgcactgaa

SEQ ID NO: 6353807 - DNA, 22 bp, Homo sapiens
aacctgcactgaaacctgagat

SEQ ID NO: 6353808 - DNA, 17 bp, Homo sapiens
aacctgcacttcatatc

SEQ ID NO: 6353809 - DNA, 14 bp, Homo sapiens
aacctgcagaaaca

SEQ ID NO: 6353810 - DNA, 17 bp, Homo sapiens
aacctgcatgaaagcat

SEQ ID NO: 6353811 - DNA, 11 bp, Homo sapiens
aacctgcattt

SEQ ID NO: 6353812 - DNA, 15 bp, Homo sapiens
aacctgccaaggagc

SEQ ID NO: 6353813 - DNA, 19 bp, Homo sapiens
aacctgccaaggagcatcc

SEQ ID NO: 6353814 - DNA, 17 bp, Homo sapiens
aacctgccacaatgtga

SEQ ID NO: 6353815 - DNA, 19 bp, Homo sapiens
aacctgccacaatgtgata

SEQ ID NO: 6353816 - DNA, 20 bp, Homo sapiens
aacctgccacaatgtgatat

SEQ ID NO: 6353817 - DNA, 10 bp, Homo sapiens
aacctgccct

SEQ ID NO: 6353818 - DNA, 19 bp, Homo sapiens
aacctgccctgcctgaggg

SEQ ID NO: 6353819 - DNA, 19 bp, Homo sapiens
aacctgcctgacatttgga

SEQ ID NO: 6353820 - DNA, 19 bp, Homo sapiens
aacctgcctgtgcatgacc

SEQ ID NO: 6353821 - DNA, 14 bp, Homo sapiens
aacctgcgcacccc

SEQ ID NO: 6353822 - DNA, 11 bp, Homo sapiens
gtcaaagcttt

SEQ ID NO: 6353823 - DNA, 22 bp, Homo sapiens
gtcaaagctttgactctataag

SEQ ID NO: 6353824 - DNA, 13 bp, Homo sapiens
gtcaaagtaaaac

SEQ ID NO: 6353825 - DNA, 15 bp, Homo sapiens
gtcaaagtagttagt

SEQ ID NO: 6353826 - DNA, 19 bp, Homo sapiens
gtcaaagtgttgctgtggc

SEQ ID NO: 6353827 - DNA, 12 bp, Homo sapiens
gtcaaataaaca

SEQ ID NO: 6353828 - DNA, 15 bp, Homo sapiens
gtcaaataaagcaaa

SEQ ID NO: 6353829 - DNA, 16 bp, Homo sapiens
gtcaaataaatgtttc

SEQ ID NO: 6353830 - DNA, 21 bp, Homo sapiens
gtcaaataaatgtttccccca

SEQ ID NO: 6353831 - DNA, 15 bp, Homo sapiens
gtcaaatcaaggcaa

SEQ ID NO: 6353832 - DNA, 16 bp, Homo sapiens
gtcaaatccagtggtg

SEQ ID NO: 6353833 - DNA, 19 bp, Homo sapiens
gtcaaatccagtggtgggt

SEQ ID NO: 6353834 - DNA, 21 bp, Homo sapiens
gtcaaatccagtggtgggtaa

SEQ ID NO: 6353835 - DNA, 15 bp, Homo sapiens
gtcaaatccatgtgt

SEQ ID NO: 6353836 - DNA, 21 bp, Homo sapiens
gtcaaatcccaaaccattact

SEQ ID NO: 6353837 - DNA, 16 bp, Homo sapiens
gtcaaatctgggctca

SEQ ID NO: 6353838 - DNA, 14 bp, Homo sapiens
gtcaaatgaacttt

SEQ ID NO: 6353839 - DNA, 18 bp, Homo sapiens
gtcaaatgaacttttaca

SEQ ID NO: 6353840 - DNA, 20 bp, Homo sapiens
gtcaaatgaacttttacaga

SEQ ID NO: 6353841 - DNA, 22 bp, Homo sapiens
gtcaaatgcatacaagtttcat

SEQ ID NO: 6353842 - DNA, 14 bp, Homo sapiens
gtcaaatgccaaac

SEQ ID NO: 6353843 - DNA, 20 bp, Homo sapiens
gtcaaatggatgtaatatag

SEQ ID NO: 6353844 - DNA, 18 bp, Homo sapiens
gtcaaatgggaaaaaaac

SEQ ID NO: 6353845 - DNA, 22 bp, Homo sapiens
gtcaaatggtaggcatttccta

SEQ ID NO: 6353846 - DNA, 13 bp, Homo sapiens
gtcaaatggtatt

SEQ ID NO: 6353847 - DNA, 14 bp, Homo sapiens
gtcaaatggtattt

SEQ ID NO: 6353848 - DNA, 21 bp, Homo sapiens
gtcaaatggtattttttgtga

SEQ ID NO: 6353849 - DNA, 14 bp, Homo sapiens
gtcaaatgtttcct

SEQ ID NO: 6353850 - DNA, 16 bp, Homo sapiens
gtcaaatgtttcctta

SEQ ID NO: 6353851 - DNA, 20 bp, Homo sapiens
gtcaaatgtttccttaaaca

SEQ ID NO: 6353852 - DNA, 16 bp, Homo sapiens
gtcaaatttactttaa

SEQ ID NO: 6353853 - DNA, 19 bp, Homo sapiens
gtcaacaaaaagacatgga

SEQ ID NO: 6353854 - DNA, 11 bp, Homo sapiens
gtcaacaaact

SEQ ID NO: 6353855 - DNA, 12 bp, Homo sapiens
gtcaacaaatct

SEQ ID NO: 6353856 - DNA, 15 bp, Homo sapiens
gtcaacaaattaaat

SEQ ID NO: 6353857 - DNA, 18 bp, Homo sapiens
gtcaacaaattaaataaa

SEQ ID NO: 6353858 - DNA, 20 bp, Homo sapiens
gtcaacaaattaaataaatt

SEQ ID NO: 6353859 - DNA, 17 bp, Homo sapiens
gtcaacacaaactggct

SEQ ID NO: 6353860 - DNA, 23 bp, Homo sapiens
gtcaacacaaagacacaggaaga

SEQ ID NO: 6353861 - DNA, 22 bp, Homo sapiens
gtcaacacaaagacatggaaga

SEQ ID NO: 6353862 - DNA, 21 bp, Homo sapiens
gtcaacactatataaataagc

SEQ ID NO: 6353863 - DNA, 14 bp, Homo sapiens
gtcaacactcttct

SEQ ID NO: 6353864 - DNA, 16 bp, Homo sapiens
gtcaacagaatgaaaa

SEQ ID NO: 6353865 - DNA, 17 bp, Homo sapiens
gtcaacagttcaaagaa

SEQ ID NO: 6353866 - DNA, 21 bp, Homo sapiens
gtcaacagttttcctatgctt

SEQ ID NO: 6353867 - DNA, 14 bp, Homo sapiens
gtcaacatcttctc

SEQ ID NO: 6353868 - DNA, 16 bp, Homo sapiens
gtcaacatgaaacacc

SEQ ID NO: 6353869 - DNA, 12 bp, Homo sapiens
gtcaacattgtg

SEQ ID NO: 6353870 - DNA, 17 bp, Homo sapiens
gtcaacatttctcatgt

SEQ ID NO: 6353871 - DNA, 18 bp, Homo sapiens
gtcaacatttctcatgtt

SEQ ID NO: 6353872 - DNA, 12 bp, Homo sapiens
gtcaacattttt

SEQ ID NO: 6353873 - DNA, 13 bp, Homo sapiens
gtcaaccagacag

SEQ ID NO: 6353874 - DNA, 14 bp, Homo sapiens
gtcaaccagacaga

SEQ ID NO: 6353875 - DNA, 14 bp, Homo sapiens
gtcaaccaggaaca

SEQ ID NO: 6353876 - DNA, 16 bp, Homo sapiens
gtcaacccgctgcttc

SEQ ID NO: 6353877 - DNA, 13 bp, Homo sapiens
gtcaacctcctgg

SEQ ID NO: 6353878 - DNA, 14 bp, Homo sapiens
gtcaacctgaatta

SEQ ID NO: 6353879 - DNA, 16 bp, Homo sapiens
gtcaacctgaattaaa

SEQ ID NO: 6353880 - DNA, 14 bp, Homo sapiens
gtcaacctgggcaa

SEQ ID NO: 6353881 - DNA, 21 bp, Homo sapiens
gtcaacgagacgtttcctacc

SEQ ID NO: 6353882 - DNA, 15 bp, Homo sapiens
gtcaacggccctgtt

SEQ ID NO: 6353883 - DNA, 17 bp, Homo sapiens
gtcaacggccctgttta

SEQ ID NO: 6353884 - DNA, 19 bp, Homo sapiens
gtcaacggccctgtttata

SEQ ID NO: 6353885 - DNA, 18 bp, Homo sapiens
gtcaacggggggctcctg

SEQ ID NO: 6353886 - DNA, 15 bp, Homo sapiens
gtcaactccaaggca

SEQ ID NO: 6353887 - DNA, 17 bp, Homo sapiens
gtcaactccaaggcaaa

SEQ ID NO: 6353888 - DNA, 22 bp, Homo sapiens
gtcaactccaggacttgcttcc

SEQ ID NO: 6353889 - DNA, 16 bp, Homo sapiens
gtcaactgctgtttta

SEQ ID NO: 6353890 - DNA, 17 bp, Homo sapiens
gtcaactggagcaagaa

SEQ ID NO: 6353891 - DNA, 20 bp, Homo sapiens
gtcaactggcgaagcctgag

SEQ ID NO: 6353892 - DNA, 13 bp, Homo sapiens
gtcaactggctgg

SEQ ID NO: 6353893 - DNA, 15 bp, Homo sapiens
gtcaactggctggcc

SEQ ID NO: 6353894 - DNA, 18 bp, Homo sapiens
gtcaactgtatgtacata

SEQ ID NO: 6353895 - DNA, 12 bp, Homo sapiens
gtcaacttctgg

SEQ ID NO: 6353896 - DNA, 15 bp, Homo sapiens
gtcaactttcatttg

SEQ ID NO: 6353897 - DNA, 23 bp, Homo sapiens
gtcaagaaaaatataaaaacaac

SEQ ID NO: 6353898 - DNA, 20 bp, Homo sapiens
gtcaagaaaggaggggagaa

SEQ ID NO: 6353899 - DNA, 20 bp, Homo sapiens
gtcaagaaatgtgacttggc

SEQ ID NO: 6353900 - DNA, 12 bp, Homo sapiens
gtcaagaagaaa

SEQ ID NO: 6353901 - DNA, 12 bp, Homo sapiens
gtcaagaagaat

SEQ ID NO: 6353902 - DNA, 16 bp, Homo sapiens
gtcaagaagaatgaac

SEQ ID NO: 6353903 - DNA, 21 bp, Homo sapiens
gtcaagaatagcattgtaaaa

SEQ ID NO: 6353904 - DNA, 15 bp, Homo sapiens
gtcaagacatttgct

SEQ ID NO: 6353905 - DNA, 16 bp, Homo sapiens
gtcaagaccagcctgg

SEQ ID NO: 6353906 - DNA, 14 bp, Homo sapiens
gtcaagactgatca

SEQ ID NO: 6353907 - DNA, 22 bp, Homo sapiens
gtcaagagccaagacacaggta

SEQ ID NO: 6353908 - DNA, 13 bp, Homo sapiens
gtcaagatacata

SEQ ID NO: 6353909 - DNA, 14 bp, Homo sapiens
gtcaagattttgaa

SEQ ID NO: 6353910 - DNA, 18 bp, Homo sapiens
gtcaagattttttttgta

SEQ ID NO: 6353911 - DNA, 11 bp, Homo sapiens
gtcaagcactc

SEQ ID NO: 6353912 - DNA, 14 bp, Homo sapiens
gtcaagcccaggag

SEQ ID NO: 6353913 - DNA, 16 bp, Homo sapiens
gtcaagcctagcctga

SEQ ID NO: 6353914 - DNA, 18 bp, Homo sapiens
gtcaagcctgcagcgagc

SEQ ID NO: 6353915 - DNA, 22 bp, Homo sapiens
gtcaagcctgcagcgagctgag

SEQ ID NO: 6353916 - DNA, 15 bp, Homo sapiens
gtcaagctcctcctc

SEQ ID NO: 6353917 - DNA, 21 bp, Homo sapiens
gtcaagctcctcctccctgca

SEQ ID NO: 6353918 - DNA, 22 bp, Homo sapiens
gtcaagctgagtattaaaatgt

SEQ ID NO: 6353919 - DNA, 17 bp, Homo sapiens
gtcaagctgctctgagc

SEQ ID NO: 6353920 - DNA, 18 bp, Homo sapiens
gtcaagctgctctgagcc

SEQ ID NO: 6353921 - DNA, 19 bp, Homo sapiens
gtcaagctgctctgagcca

SEQ ID NO: 6353922 - DNA, 24 bp, Homo sapiens
gtcaagctggaaaggccagcagcc

SEQ ID NO: 6353923 - DNA, 13 bp, Homo sapiens
gtcaagcttctct

SEQ ID NO: 6353924 - DNA, 14 bp, Homo sapiens
gtcaaggaaggaaa

SEQ ID NO: 6353925 - DNA, 15 bp, Homo sapiens
gtcaaggaaggaaaa

SEQ ID NO: 6353926 - DNA, 23 bp, Homo sapiens
gtcaaggaaggaaaatactacct

SEQ ID NO: 6353927 - DNA, 19 bp, Homo sapiens
gtcaaggagatgagcgtcc

SEQ ID NO: 6353928 - DNA, 20 bp, Homo sapiens
gtcaaggccacctctgcctc

SEQ ID NO: 6353929 - DNA, 22 bp, Homo sapiens
gtcaaggccacctctgcctcta

SEQ ID NO: 6353930 - DNA, 24 bp, Homo sapiens
gtcaaggccacctctgcctctagt

SEQ ID NO: 6353931 - DNA, 12 bp, Homo sapiens
gtcaaggccagc

SEQ ID NO: 6353932 - DNA, 21 bp, Homo sapiens
gtcaaggccgagggccaggca

SEQ ID NO: 6353933 - DNA, 22 bp, Homo sapiens
gtcaaggccgagggccaggcag

SEQ ID NO: 6353934 - DNA, 23 bp, Homo sapiens
gtcaaggccgagggccaggcaga

SEQ ID NO: 6353935 - DNA, 16 bp, Homo sapiens
gtcaaggcctgctccc

SEQ ID NO: 6353936 - DNA, 12 bp, Homo sapiens
gtcaaggcctgt

SEQ ID NO: 6353937 - DNA, 20 bp, Homo sapiens
gtcaagggcttactatttct

SEQ ID NO: 6353938 - DNA, 16 bp, Homo sapiens
gtcaaggtgatatata

SEQ ID NO: 6353939 - DNA, 15 bp, Homo sapiens
gtcaaggtgctgttg

SEQ ID NO: 6353940 - DNA, 15 bp, Homo sapiens
gtcaagtaataaaaa

SEQ ID NO: 6353941 - DNA, 16 bp, Homo sapiens
gtcaagtataaagtca

SEQ ID NO: 6353942 - DNA, 16 bp, Homo sapiens
gtcaagtgcctgcacc

SEQ ID NO: 6353943 - DNA, 17 bp, Homo sapiens
gtcaagtgcgtccacga

SEQ ID NO: 6353944 - DNA, 14 bp, Homo sapiens
gtcaagtggcaaag

SEQ ID NO: 6353945 - DNA, 16 bp, Homo sapiens
gtcaagtgggatctgt

SEQ ID NO: 6353946 - DNA, 18 bp, Homo sapiens
gtcaagttaacaaggaat

SEQ ID NO: 6353947 - DNA, 18 bp, Homo sapiens
gtcaagttattaatttct

SEQ ID NO: 6353948 - DNA, 22 bp, Homo sapiens
gtcaagttcatagtttctgtaa

SEQ ID NO: 6353949 - DNA, 13 bp, Homo sapiens
gtcaagttcccaa

SEQ ID NO: 6353950 - DNA, 20 bp, Homo sapiens
gtcaagttccctcctgcagc

SEQ ID NO: 6353951 - DNA, 22 bp, Homo sapiens
gtcaagttccgtctcctctcca

SEQ ID NO: 6353952 - DNA, 18 bp, Homo sapiens
gtcaagttgtgcttgttt

SEQ ID NO: 6353953 - DNA, 15 bp, Homo sapiens
gtcaagtttttatac

SEQ ID NO: 6353954 - DNA, 16 bp, Homo sapiens
gtcaagtttttatacc

SEQ ID NO: 6353955 - DNA, 17 bp, Homo sapiens
gtcaataaaaataaatc

SEQ ID NO: 6353956 - DNA, 17 bp, Homo sapiens
gtcaataaaagagctgt

SEQ ID NO: 6353957 - DNA, 20 bp, Homo sapiens
gtcaataaaagagctgtctg

SEQ ID NO: 6353958 - DNA, 21 bp, Homo sapiens
gtcaataaaagagctgtctga

SEQ ID NO: 6353959 - DNA, 21 bp, Homo sapiens
gtcaataaaatccatacattt

SEQ ID NO: 6353960 - DNA, 17 bp, Homo sapiens
gtcaataaacaacagct

SEQ ID NO: 6353961 - DNA, 16 bp, Homo sapiens
gtcaataaaccactgt

SEQ ID NO: 6353962 - DNA, 17 bp, Homo sapiens
gtcaataaacctgtcat

SEQ ID NO: 6353963 - DNA, 21 bp, Homo sapiens
gtcaataaacttagaggaaaa

SEQ ID NO: 6353964 - DNA, 22 bp, Homo sapiens
gtcaataaacttagaggaaaat

SEQ ID NO: 6353965 - DNA, 13 bp, Homo sapiens
gtcaataaagcag

SEQ ID NO: 6353966 - DNA, 14 bp, Homo sapiens
gtcaataaagcaga

SEQ ID NO: 6353967 - DNA, 19 bp, Homo sapiens
gtcaataaagcagagccaa

SEQ ID NO: 6353968 - DNA, 22 bp, Homo sapiens
gtcaataaagcagagccaaggc

SEQ ID NO: 6353969 - DNA, 21 bp, Homo sapiens
gtcaataaatgacacccagac

SEQ ID NO: 6353970 - DNA, 21 bp, Homo sapiens
gtcaataattatttgtctcag

SEQ ID NO: 6353971 - DNA, 18 bp, Homo sapiens
gtcaataattgtggagag

SEQ ID NO: 6353972 - DNA, 19 bp, Homo sapiens
gtcaatacagtacaggcag

SEQ ID NO: 6353973 - DNA, 20 bp, Homo sapiens
gtcaatacagtacaggcagc

SEQ ID NO: 6353974 - DNA, 21 bp, Homo sapiens
gtcaatacagtacaggcagca

SEQ ID NO: 6353975 - DNA, 17 bp, Homo sapiens
gtcaatagcaaatgaag

SEQ ID NO: 6353976 - DNA, 20 bp, Homo sapiens
gtcaatagcattgtttttgt

SEQ ID NO: 6353977 - DNA, 16 bp, Homo sapiens
gtcaatatatagagac

SEQ ID NO: 6353978 - DNA, 21 bp, Homo sapiens
gtcaatatcgtacctgtccct

SEQ ID NO: 6353979 - DNA, 14 bp, Homo sapiens
gtcaatattaaata

SEQ ID NO: 6353980 - DNA, 22 bp, Homo sapiens
gtcaatattaaatacagacact

SEQ ID NO: 6353981 - DNA, 12 bp, Homo sapiens
gtcaatatttaa

SEQ ID NO: 6353982 - DNA, 15 bp, Homo sapiens
gtcaatcaaacaggg

SEQ ID NO: 6353983 - DNA, 14 bp, Homo sapiens
gtcaatcatttctc

SEQ ID NO: 6353984 - DNA, 22 bp, Homo sapiens
gtcaatccagatggtgggatgt

SEQ ID NO: 6353985 - DNA, 16 bp, Homo sapiens
gtcaatcctgtgggtg

SEQ ID NO: 6353986 - DNA, 13 bp, Homo sapiens
gtcaatgaaaagc

SEQ ID NO: 6353987 - DNA, 17 bp, Homo sapiens
gtcaatgaaatatttgc

SEQ ID NO: 6353988 - DNA, 20 bp, Homo sapiens
gtcaatgaaatatttgctta

SEQ ID NO: 6353989 - DNA, 16 bp, Homo sapiens
gtcaatgacatgaatt

SEQ ID NO: 6353990 - DNA, 15 bp, Homo sapiens
gtcaatgcagccccc

SEQ ID NO: 6353991 - DNA, 22 bp, Homo sapiens
gtcaatgcagttgtctctgttt

SEQ ID NO: 6353992 - DNA, 12 bp, Homo sapiens
gtcaatgcattg

SEQ ID NO: 6353993 - DNA, 22 bp, Homo sapiens
gtcaatgctatggactgcacaa

SEQ ID NO: 6353994 - DNA, 19 bp, Homo sapiens
gtcaatgtgaaataaagag

SEQ ID NO: 6353995 - DNA, 14 bp, Homo sapiens
gtcaatgtgcagtg

SEQ ID NO: 6353996 - DNA, 16 bp, Homo sapiens
gtcaatgtttgcttta

SEQ ID NO: 6353997 - DNA, 16 bp, Homo sapiens
gtcaattaaacagctg

SEQ ID NO: 6353998 - DNA, 19 bp, Homo sapiens
gtcaattaaacagctggtc

SEQ ID NO: 6353999 - DNA, 13 bp, Homo sapiens
gtcaattacagga

SEQ ID NO: 6354000 - DNA, 15 bp, Homo sapiens
gtcaattacaggaag

SEQ ID NO: 6354001 - DNA, 15 bp, Homo sapiens
gtcaattcagtgatg

SEQ ID NO: 6354002 - DNA, 18 bp, Homo sapiens
gtcaattcataaaaacaa

SEQ ID NO: 6354003 - DNA, 19 bp, Homo sapiens
gtcaattcattaataaaat

SEQ ID NO: 6354004 - DNA, 17 bp, Homo sapiens
gtcaattgcttgagcat

SEQ ID NO: 6354005 - DNA, 20 bp, Homo sapiens
gtcaattgcttgagcatgcc

SEQ ID NO: 6354006 - DNA, 12 bp, Homo sapiens
gtcaattgtacg

SEQ ID NO: 6354007 - DNA, 17 bp, Homo sapiens
gtcaatttatgaatata

SEQ ID NO: 6354008 - DNA, 14 bp, Homo sapiens
gtcaatttccctca

SEQ ID NO: 6354009 - DNA, 22 bp, Homo sapiens
gtcaatttccctgactcctcta

SEQ ID NO: 6354010 - DNA, 21 bp, Homo sapiens
gtcaatttgctgaaaacatta

SEQ ID NO: 6354011 - DNA, 21 bp, Homo sapiens
gtcaatttgtatatcatgaaa

SEQ ID NO: 6354012 - DNA, 17 bp, Homo sapiens
gtcacaaaccagcctgg

SEQ ID NO: 6354013 - DNA, 23 bp, Homo sapiens
gtcacaaagaacatgtagaaaac

SEQ ID NO: 6354014 - DNA, 20 bp, Homo sapiens
gtcacaaagagatgtccttg

SEQ ID NO: 6354015 - DNA, 17 bp, Homo sapiens
gtcacaacaaaaggaag

SEQ ID NO: 6354016 - DNA, 14 bp, Homo sapiens
gtcacaacagagtg

SEQ ID NO: 6354017 - DNA, 19 bp, Homo sapiens
gtcacaacccttctctgtt

SEQ ID NO: 6354018 - DNA, 18 bp, Homo sapiens
gtcacaagtaggagacac

SEQ ID NO: 6354019 - DNA, 16 bp, Homo sapiens
gtcacaataaagttta

SEQ ID NO: 6354020 - DNA, 22 bp, Homo sapiens
gtcacaataaatggccagtgct

SEQ ID NO: 6354021 - DNA, 23 bp, Homo sapiens
gtcacaataaatggccagtgctg

SEQ ID NO: 6354022 - DNA, 17 bp, Homo sapiens
gtcacaattatgtgcaa

SEQ ID NO: 6354023 - DNA, 14 bp, Homo sapiens
gtcacaatttcaga

SEQ ID NO: 6354024 - DNA, 19 bp, Homo sapiens
gtcacacaaaggcatgctg

SEQ ID NO: 6354025 - DNA, 18 bp, Homo sapiens
gtcacacaagggaagtgg

SEQ ID NO: 6354026 - DNA, 14 bp, Homo sapiens
gtcacacactggac

SEQ ID NO: 6354027 - DNA, 15 bp, Homo sapiens
gtcacacactggacc

SEQ ID NO: 6354028 - DNA, 23 bp, Homo sapiens
gtcacacactggaccccactggc

SEQ ID NO: 6354029 - DNA, 13 bp, Homo sapiens
gtcacacagagcg

SEQ ID NO: 6354030 - DNA, 16 bp, Homo sapiens
gtcacacagagcgcct

SEQ ID NO: 6354031 - DNA, 13 bp, Homo sapiens
gtcacacagcctg

SEQ ID NO: 6354032 - DNA, 20 bp, Homo sapiens
gtcacacagtgttggaggtt

SEQ ID NO: 6354033 - DNA, 14 bp, Homo sapiens
gtcacacatttcta

SEQ ID NO: 6354034 - DNA, 20 bp, Homo sapiens
gtcacacccaccccctgcct

SEQ ID NO: 6354035 - DNA, 21 bp, Homo sapiens
gtcacacccatggcctcagcc

SEQ ID NO: 6354036 - DNA, 18 bp, Homo sapiens
gtcacacctgacaaatgg

SEQ ID NO: 6354037 - DNA, 18 bp, Homo sapiens
gtcacacgcttttgaatt

SEQ ID NO: 6354038 - DNA, 22 bp, Homo sapiens
gtcacactctacacggactgag

SEQ ID NO: 6354039 - DNA, 16 bp, Homo sapiens
gtcacactgagctggg

SEQ ID NO: 6354040 - DNA, 18 bp, Homo sapiens
gtcacactgagctgggca

SEQ ID NO: 6354041 - DNA, 12 bp, Homo sapiens
gtcacagacccc

SEQ ID NO: 6354042 - DNA, 15 bp, Homo sapiens
gtcacagacccctgg

SEQ ID NO: 6354043 - DNA, 19 bp, Homo sapiens
gtcacagacccctggggga

SEQ ID NO: 6354044 - DNA, 12 bp, Homo sapiens
gtcacagagaac

SEQ ID NO: 6354045 - DNA, 12 bp, Homo sapiens
gtcacagaggca

SEQ ID NO: 6354046 - DNA, 17 bp, Homo sapiens
gtcacagaggcagtggc

SEQ ID NO: 6354047 - DNA, 15 bp, Homo sapiens
gtcacagaggcatag

SEQ ID NO: 6354048 - DNA, 12 bp, Homo sapiens
gtcacagagtga

SEQ ID NO: 6354049 - DNA, 12 bp, Homo sapiens
gtcacagattct

SEQ ID NO: 6354050 - DNA, 15 bp, Homo sapiens
gtcacagattctttt

SEQ ID NO: 6354051 - DNA, 11 bp, Homo sapiens
gtcacagccat

SEQ ID NO: 6354052 - DNA, 12 bp, Homo sapiens
gtcacagctctg

SEQ ID NO: 6354053 - DNA, 16 bp, Homo sapiens
gtcacagctcttgttt

SEQ ID NO: 6354054 - DNA, 12 bp, Homo sapiens
gtcacagctgga

SEQ ID NO: 6354055 - DNA, 15 bp, Homo sapiens
gtcacaggaaaaagt

SEQ ID NO: 6354056 - DNA, 15 bp, Homo sapiens
gtcacaggaaggaaa

SEQ ID NO: 6354057 - DNA, 20 bp, Homo sapiens
gtcacaggaagtagaggagg

SEQ ID NO: 6354058 - DNA, 18 bp, Homo sapiens
gtcacaggactctgcctc

SEQ ID NO: 6354059 - DNA, 11 bp, Homo sapiens
gtcacaggccc

SEQ ID NO: 6354060 - DNA, 15 bp, Homo sapiens
gtcacaggcccagaa

SEQ ID NO: 6354061 - DNA, 14 bp, Homo sapiens
gtcacaggcccagg

SEQ ID NO: 6354062 - DNA, 16 bp, Homo sapiens
gtcacaggcccaggaa

SEQ ID NO: 6354063 - DNA, 21 bp, Homo sapiens
gtcacaggctgggtcaaaaga

SEQ ID NO: 6354064 - DNA, 15 bp, Homo sapiens
gtcacaggctgtgcc

SEQ ID NO: 6354065 - DNA, 17 bp, Homo sapiens
gtcacagggcagtacct

SEQ ID NO: 6354066 - DNA, 12 bp, Homo sapiens
gtcacagggcca

SEQ ID NO: 6354067 - DNA, 14 bp, Homo sapiens
gtcacaggtgtggg

SEQ ID NO: 6354068 - DNA, 17 bp, Homo sapiens
gtcacaggttggccaga

SEQ ID NO: 6354069 - DNA, 16 bp, Homo sapiens
gtcacagtaaaaataa

SEQ ID NO: 6354070 - DNA, 23 bp, Homo sapiens
gtcacagtaaagagtacactcag

SEQ ID NO: 6354071 - DNA, 21 bp, Homo sapiens
gtcacagtccaaccagaaaca

SEQ ID NO: 6354072 - DNA, 19 bp, Homo sapiens
gtcacagtgataccagttc

SEQ ID NO: 6354073 - DNA, 22 bp, Homo sapiens
gtcacagtttgttcagtgaggt

SEQ ID NO: 6354074 - DNA, 14 bp, Homo sapiens
gtcacataaaactt

SEQ ID NO: 6354075 - DNA, 15 bp, Homo sapiens
gtcacatagctggga

SEQ ID NO: 6354076 - DNA, 19 bp, Homo sapiens
gtcacatatacaaaagcaa

SEQ ID NO: 6354077 - DNA, 20 bp, Homo sapiens
gtcacatatcaagtcccgag

SEQ ID NO: 6354078 - DNA, 23 bp, Homo sapiens
gtcacatcacaatattcagtggt

SEQ ID NO: 6354079 - DNA, 19 bp, Homo sapiens
gtcacatcacgaaggaaaa

SEQ ID NO: 6354080 - DNA, 17 bp, Homo sapiens
gtcacatcagataagac

SEQ ID NO: 6354081 - DNA, 15 bp, Homo sapiens
gtcacatccatccct

SEQ ID NO: 6354082 - DNA, 22 bp, Homo sapiens
gtcacatcctaatagaaagaaa

SEQ ID NO: 6354083 - DNA, 16 bp, Homo sapiens
gtcacatctcagggaa

SEQ ID NO: 6354084 - DNA, 13 bp, Homo sapiens
gtcacatgactct

SEQ ID NO: 6354085 - DNA, 13 bp, Homo sapiens
gtcacatggagct

SEQ ID NO: 6354086 - DNA, 15 bp, Homo sapiens
gtcacatggagctct

SEQ ID NO: 6354087 - DNA, 21 bp, Homo sapiens
gtcacatggcctatgcacata

SEQ ID NO: 6354088 - DNA, 13 bp, Homo sapiens
gtcacatgtgctc

SEQ ID NO: 6354089 - DNA, 16 bp, Homo sapiens
gtcacattcaggaaga

SEQ ID NO: 6354090 - DNA, 23 bp, Homo sapiens
gtcacatttgttagccacggaaa

SEQ ID NO: 6354091 - DNA, 22 bp, Homo sapiens
gtcaccaaaagacactgcagaa

SEQ ID NO: 6354092 - DNA, 15 bp, Homo sapiens
gtcaccaaactagta

SEQ ID NO: 6354093 - DNA, 23 bp, Homo sapiens
gtcaccaagaaggggctcgagtg

SEQ ID NO: 6354094 - DNA, 17 bp, Homo sapiens
gtcaccaagcagtggcc

SEQ ID NO: 6354095 - DNA, 12 bp, Homo sapiens
gtcaccaagccc

SEQ ID NO: 6354096 - DNA, 19 bp, Homo sapiens
gtcaccaaggcagtgcatg

SEQ ID NO: 6354097 - DNA, 19 bp, Homo sapiens
gtcaccaatgtacccaccg

SEQ ID NO: 6354098 - DNA, 15 bp, Homo sapiens
gtcaccaccacccct

SEQ ID NO: 6354099 - DNA, 19 bp, Homo sapiens
gtcaccaccacccctacca

SEQ ID NO: 6354100 - DNA, 20 bp, Homo sapiens
gtcaccacccagcccttcct

SEQ ID NO: 6354101 - DNA, 22 bp, Homo sapiens
gtcaccacccagcccttccttg

SEQ ID NO: 6354102 - DNA, 11 bp, Homo sapiens
gtcaccacctt

SEQ ID NO: 6354103 - DNA, 19 bp, Homo sapiens
gtcaccacgactggccagg

SEQ ID NO: 6354104 - DNA, 14 bp, Homo sapiens
gtcaccacgtgcag

SEQ ID NO: 6354105 - DNA, 17 bp, Homo sapiens
gtcaccacgtgcagtat

SEQ ID NO: 6354106 - DNA, 18 bp, Homo sapiens
gtcaccactccattccca

SEQ ID NO: 6354107 - DNA, 15 bp, Homo sapiens
gtcaccacttcctct

SEQ ID NO: 6354108 - DNA, 16 bp, Homo sapiens
gtcaccagagcttctc

SEQ ID NO: 6354109 - DNA, 22 bp, Homo sapiens
gtcaccagagcttctctgggct

SEQ ID NO: 6354110 - DNA, 23 bp, Homo sapiens
gtcaccagagcttctctgggctg

SEQ ID NO: 6354111 - DNA, 13 bp, Homo sapiens
gtcaccagcctga

SEQ ID NO: 6354112 - DNA, 17 bp, Homo sapiens
gtcaccagctgctgtgc

SEQ ID NO: 6354113 - DNA, 21 bp, Homo sapiens
gtcaccagctgctgtgcccca

SEQ ID NO: 6354114 - DNA, 18 bp, Homo sapiens
gtcaccaggaatgttaaa

SEQ ID NO: 6354115 - DNA, 19 bp, Homo sapiens
gtcaccaggctggagtgca

SEQ ID NO: 6354116 - DNA, 17 bp, Homo sapiens
gtcaccaggggaggagc

SEQ ID NO: 6354117 - DNA, 22 bp, Homo sapiens
gtcaccaggggaggagcctgtg

SEQ ID NO: 6354118 - DNA, 17 bp, Homo sapiens
gtcaccagggggagctg

SEQ ID NO: 6354119 - DNA, 13 bp, Homo sapiens
gtcaccaggtact

SEQ ID NO: 6354120 - DNA, 18 bp, Homo sapiens
gtcaccatcctcagaggc

SEQ ID NO: 6354121 - DNA, 19 bp, Homo sapiens
gtcaccatcctcagaggct

SEQ ID NO: 6354122 - DNA, 20 bp, Homo sapiens
gtcaccatctcaggccacct

SEQ ID NO: 6354123 - DNA, 21 bp, Homo sapiens
gtcaccatctcaggccacctg

SEQ ID NO: 6354124 - DNA, 14 bp, Homo sapiens
gtcaccattctgca

SEQ ID NO: 6354125 - DNA, 18 bp, Homo sapiens
gtcaccattctgcattta

SEQ ID NO: 6354126 - DNA, 24 bp, Homo sapiens
gtcaccattctgcatttagctgta

SEQ ID NO: 6354127 - DNA, 17 bp, Homo sapiens
gtcacccaaagcctgtc

SEQ ID NO: 6354128 - DNA, 23 bp, Homo sapiens
gtcacccaaagcctgtcccagga

SEQ ID NO: 6354129 - DNA, 20 bp, Homo sapiens
gtcacccagactggagtgca

SEQ ID NO: 6354130 - DNA, 14 bp, Homo sapiens
gtcacccagagcac

SEQ ID NO: 6354131 - DNA, 17 bp, Homo sapiens
gtcacccagcaaggcac

SEQ ID NO: 6354132 - DNA, 21 bp, Homo sapiens
gtcacccagcaaggcacaggc

SEQ ID NO: 6354133 - DNA, 21 bp, Homo sapiens
gtcacccaggctctggagcca

SEQ ID NO: 6354134 - DNA, 13 bp, Homo sapiens
gtcacccaggctg

SEQ ID NO: 6354135 - DNA, 20 bp, Homo sapiens
gtcacccaggctgcagtgca

SEQ ID NO: 6354136 - DNA, 20 bp, Homo sapiens
gtcacccaggctggagtaca

SEQ ID NO: 6354137 - DNA, 20 bp, Homo sapiens
gtcacccaggctggagtgca

SEQ ID NO: 6354138 - DNA, 13 bp, Homo sapiens
gtcacccagggac

SEQ ID NO: 6354139 - DNA, 19 bp, Homo sapiens
gtcacccagggacactcca

SEQ ID NO: 6354140 - DNA, 20 bp, Homo sapiens
gtcacccaggttggagtgca

SEQ ID NO: 6354141 - DNA, 14 bp, Homo sapiens
gtcacccatgacag

SEQ ID NO: 6354142 - DNA, 20 bp, Homo sapiens
gtcaccccagagccacacat

SEQ ID NO: 6354143 - DNA, 13 bp, Homo sapiens
gtcaccccagtca

SEQ ID NO: 6354144 - DNA, 17 bp, Homo sapiens
gtcacccccacttccca

SEQ ID NO: 6354145 - DNA, 19 bp, Homo sapiens
gtcacccccacttcccact

SEQ ID NO: 6354146 - DNA, 15 bp, Homo sapiens
gtcacccccccaggc

SEQ ID NO: 6354147 - DNA, 13 bp, Homo sapiens
gtcaccccgccag

SEQ ID NO: 6354148 - DNA, 16 bp, Homo sapiens
gtcaccccgccagcct

SEQ ID NO: 6354149 - DNA, 17 bp, Homo sapiens
gtcaccccggccacctg

SEQ ID NO: 6354150 - DNA, 18 bp, Homo sapiens
gtcaccccggccacctgc

SEQ ID NO: 6354151 - DNA, 15 bp, Homo sapiens
gtcacccctccagga

SEQ ID NO: 6354152 - DNA, 20 bp, Homo sapiens
gtcacccctccaggaatgat

SEQ ID NO: 6354153 - DNA, 13 bp, Homo sapiens
gtcacccctccct

SEQ ID NO: 6354154 - DNA, 19 bp, Homo sapiens
gtcacccctgcctaaagat

SEQ ID NO: 6354155 - DNA, 20 bp, Homo sapiens
gtcacccctttctgtcccac

SEQ ID NO: 6354156 - DNA, 12 bp, Homo sapiens
gtcaccctcagg

SEQ ID NO: 6354157 - DNA, 23 bp, Homo sapiens
gtcaccctcctcacagacctctg

SEQ ID NO: 6354158 - DNA, 16 bp, Homo sapiens
gtcaccctcctgagcc

SEQ ID NO: 6354159 - DNA, 19 bp, Homo sapiens
gtcaccctcctgagcctca

SEQ ID NO: 6354160 - DNA, 20 bp, Homo sapiens
gtcaccctcctgagcctcac

SEQ ID NO: 6354161 - DNA, 12 bp, Homo sapiens
gtcaccctggcc

SEQ ID NO: 6354162 - DNA, 16 bp, Homo sapiens
gtcaccctggccacca

SEQ ID NO: 6354163 - DNA, 13 bp, Homo sapiens
gtcaccctgggag

SEQ ID NO: 6354164 - DNA, 15 bp, Homo sapiens
gtcaccctggggctg

SEQ ID NO: 6354165 - DNA, 19 bp, Homo sapiens
gtcaccctgtgaccctctc

SEQ ID NO: 6354166 - DNA, 21 bp, Homo sapiens
gtcaccctgtgggtgtctccc

SEQ ID NO: 6354167 - DNA, 22 bp, Homo sapiens
gtcaccctgtgggtgtctccct

SEQ ID NO: 6354168 - DNA, 14 bp, Homo sapiens
gtcacccttctggg

SEQ ID NO: 6354169 - DNA, 17 bp, Homo sapiens
gtcacccttctgggcaa

SEQ ID NO: 6354170 - DNA, 21 bp, Homo sapiens
gtcaccgacagcggccttgaa

SEQ ID NO: 6354171 - DNA, 22 bp, Homo sapiens
gtcaccgagactcagcctctgc

SEQ ID NO: 6354172 - DNA, 22 bp, Homo sapiens
gtcaccgcggacgtgctggcct

SEQ ID NO: 6354173 - DNA, 16 bp, Homo sapiens
gtcaccggtcagtgcc

SEQ ID NO: 6354174 - DNA, 19 bp, Homo sapiens
gtcacctaaccctctgtca

SEQ ID NO: 6354175 - DNA, 20 bp, Homo sapiens
gtcacctaaccctctgtcac

SEQ ID NO: 6354176 - DNA, 13 bp, Homo sapiens
gtcacctacagga

SEQ ID NO: 6354177 - DNA, 15 bp, Homo sapiens
gtcacctacaggact

SEQ ID NO: 6354178 - DNA, 16 bp, Homo sapiens
gtcacctacaggactg

SEQ ID NO: 6354179 - DNA, 16 bp, Homo sapiens
gtcacctacatatgct

SEQ ID NO: 6354180 - DNA, 24 bp, Homo sapiens
gtcacctcaaatttaagtcgggaa

SEQ ID NO: 6354181 - DNA, 18 bp, Homo sapiens
taacactaaattgcagtt

SEQ ID NO: 6354182 - DNA, 19 bp, Homo sapiens
taacactaaattgcagttt

SEQ ID NO: 6354183 - DNA, 14 bp, Homo sapiens
taacactacagagt

SEQ ID NO: 6354184 - DNA, 19 bp, Homo sapiens
taacactactcaaagcaaa

SEQ ID NO: 6354185 - DNA, 17 bp, Homo sapiens
taacactagtagctgtt

SEQ ID NO: 6354186 - DNA, 18 bp, Homo sapiens
taacactagtctgtgtgc

SEQ ID NO: 6354187 - DNA, 23 bp, Homo sapiens
taacactagtctgtgtgctgtgg

SEQ ID NO: 6354188 - DNA, 15 bp, Homo sapiens
taacactatcatagt

SEQ ID NO: 6354189 - DNA, 14 bp, Homo sapiens
taacactattttat

SEQ ID NO: 6354190 - DNA, 20 bp, Homo sapiens
taacactcagaagcctgggg

SEQ ID NO: 6354191 - DNA, 14 bp, Homo sapiens
taacactgagtgaa

SEQ ID NO: 6354192 - DNA, 17 bp, Homo sapiens
taacactgagtgaaata

SEQ ID NO: 6354193 - DNA, 19 bp, Homo sapiens
taacactgcagccctctcc

SEQ ID NO: 6354194 - DNA, 18 bp, Homo sapiens
taacactggttaaattaa

SEQ ID NO: 6354195 - DNA, 14 bp, Homo sapiens
taacactgtaatat

SEQ ID NO: 6354196 - DNA, 12 bp, Homo sapiens
taacactgttgg

SEQ ID NO: 6354197 - DNA, 13 bp, Homo sapiens
taacactgtttat

SEQ ID NO: 6354198 - DNA, 16 bp, Homo sapiens
taacacttctgtatgc

SEQ ID NO: 6354199 - DNA, 19 bp, Homo sapiens
taacacttctgtatgcatc

SEQ ID NO: 6354200 - DNA, 15 bp, Homo sapiens
taacacttgaaaagt

SEQ ID NO: 6354201 - DNA, 15 bp, Homo sapiens
taacactttacaatg

SEQ ID NO: 6354202 - DNA, 13 bp, Homo sapiens
taacactttgctt

SEQ ID NO: 6354203 - DNA, 13 bp, Homo sapiens
taacactttttaa

SEQ ID NO: 6354204 - DNA, 23 bp, Homo sapiens
taacagaaaaatgaaatttaagc

SEQ ID NO: 6354205 - DNA, 11 bp, Homo sapiens
taacagaaagg

SEQ ID NO: 6354206 - DNA, 13 bp, Homo sapiens
taacagaaatgta

SEQ ID NO: 6354207 - DNA, 22 bp, Homo sapiens
taacagaaatgtttctgtgtca

SEQ ID NO: 6354208 - DNA, 13 bp, Homo sapiens
taacagaaattgt

SEQ ID NO: 6354209 - DNA, 22 bp, Homo sapiens
taacagaaattgtatattgtaa

SEQ ID NO: 6354210 - DNA, 20 bp, Homo sapiens
taacagaacagcttcaggtt

SEQ ID NO: 6354211 - DNA, 14 bp, Homo sapiens
taacagaagaaaat

SEQ ID NO: 6354212 - DNA, 19 bp, Homo sapiens
taacagaagaaaatagaat

SEQ ID NO: 6354213 - DNA, 19 bp, Homo sapiens
taacagaagggagggcaga

SEQ ID NO: 6354214 - DNA, 13 bp, Homo sapiens
taacagacactgt

SEQ ID NO: 6354215 - DNA, 16 bp, Homo sapiens
taacagacatgtatac

SEQ ID NO: 6354216 - DNA, 14 bp, Homo sapiens
taacagacattgtt

SEQ ID NO: 6354217 - DNA, 13 bp, Homo sapiens
taacagagaaata

SEQ ID NO: 6354218 - DNA, 21 bp, Homo sapiens
taacagagtagttttggtttt

SEQ ID NO: 6354219 - DNA, 22 bp, Homo sapiens
taacagagttgaggttgttaaa

SEQ ID NO: 6354220 - DNA, 23 bp, Homo sapiens
taacagagtttgatatgggcttt

SEQ ID NO: 6354221 - DNA, 13 bp, Homo sapiens
taacagatattta

SEQ ID NO: 6354222 - DNA, 19 bp, Homo sapiens
taacagatatttaaattta

SEQ ID NO: 6354223 - DNA, 17 bp, Homo sapiens
taacagatcctttcaaa

SEQ ID NO: 6354224 - DNA, 16 bp, Homo sapiens
taacagattatgtatt

SEQ ID NO: 6354225 - DNA, 14 bp, Homo sapiens
taacagcaaatgaa

SEQ ID NO: 6354226 - DNA, 18 bp, Homo sapiens
taacagcaacacaaagct

SEQ ID NO: 6354227 - DNA, 15 bp, Homo sapiens
taacagcaagagatg

SEQ ID NO: 6354228 - DNA, 15 bp, Homo sapiens
taacagcaccaaatc

SEQ ID NO: 6354229 - DNA, 15 bp, Homo sapiens
taacagcaccccata

SEQ ID NO: 6354230 - DNA, 14 bp, Homo sapiens
taacagcatgacaa

SEQ ID NO: 6354231 - DNA, 18 bp, Homo sapiens
taacagcatgacaaaaat

SEQ ID NO: 6354232 - DNA, 22 bp, Homo sapiens
taacagcattcttgtcacaata

SEQ ID NO: 6354233 - DNA, 23 bp, Homo sapiens
taacagcgtgtcaactttcattt

SEQ ID NO: 6354234 - DNA, 22 bp, Homo sapiens
taacagctaatctttaatataa

SEQ ID NO: 6354235 - DNA, 13 bp, Homo sapiens
taacagctcagga

SEQ ID NO: 6354236 - DNA, 20 bp, Homo sapiens
taacagctccatacttcttt

SEQ ID NO: 6354237 - DNA, 11 bp, Homo sapiens
taacagctcct

SEQ ID NO: 6354238 - DNA, 12 bp, Homo sapiens
taacagctcctt

SEQ ID NO: 6354239 - DNA, 12 bp, Homo sapiens
taacagctgaat

SEQ ID NO: 6354240 - DNA, 19 bp, Homo sapiens
taacagctgaattatctat

SEQ ID NO: 6354241 - DNA, 15 bp, Homo sapiens
taacagctgaggtct

SEQ ID NO: 6354242 - DNA, 12 bp, Homo sapiens
taacagctgtgg

SEQ ID NO: 6354243 - DNA, 17 bp, Homo sapiens
taacagctttctccaga

SEQ ID NO: 6354244 - DNA, 11 bp, Homo sapiens
taacaggacag

SEQ ID NO: 6354245 - DNA, 16 bp, Homo sapiens
taacaggacgagatga

SEQ ID NO: 6354246 - DNA, 22 bp, Homo sapiens
taacaggacttgaattcaaagc

SEQ ID NO: 6354247 - DNA, 16 bp, Homo sapiens
taacaggcactttgag

SEQ ID NO: 6354248 - DNA, 17 bp, Homo sapiens
taacaggcactttgaga

SEQ ID NO: 6354249 - DNA, 19 bp, Homo sapiens
taacaggcagatacaggaa

SEQ ID NO: 6354250 - DNA, 16 bp, Homo sapiens
taacaggccttgagca

SEQ ID NO: 6354251 - DNA, 18 bp, Homo sapiens
taacaggccttgagcaca

SEQ ID NO: 6354252 - DNA, 22 bp, Homo sapiens
taacaggctcaatattcctgaa

SEQ ID NO: 6354253 - DNA, 17 bp, Homo sapiens
taacaggctgatttgga

SEQ ID NO: 6354254 - DNA, 14 bp, Homo sapiens
taacagggaaggca

SEQ ID NO: 6354255 - DNA, 16 bp, Homo sapiens
taacagggaaggcagg

SEQ ID NO: 6354256 - DNA, 17 bp, Homo sapiens
taacagggaaggcaggc

SEQ ID NO: 6354257 - DNA, 20 bp, Homo sapiens
taacagggagaagtagctag

SEQ ID NO: 6354258 - DNA, 17 bp, Homo sapiens
taacagggattgatttt

SEQ ID NO: 6354259 - DNA, 18 bp, Homo sapiens
taacagggattgatttta

SEQ ID NO: 6354260 - DNA, 15 bp, Homo sapiens
taacagggcagaaat

SEQ ID NO: 6354261 - DNA, 19 bp, Homo sapiens
taacagggtaaattattca

SEQ ID NO: 6354262 - DNA, 14 bp, Homo sapiens
taacaggtaaccac

SEQ ID NO: 6354263 - DNA, 20 bp, Homo sapiens
taacaggtattttgtttctt

SEQ ID NO: 6354264 - DNA, 14 bp, Homo sapiens
taacaggtctcctc

SEQ ID NO: 6354265 - DNA, 19 bp, Homo sapiens
taacaggtctcctcttaaa

SEQ ID NO: 6354266 - DNA, 16 bp, Homo sapiens
taacaggttattttag

SEQ ID NO: 6354267 - DNA, 21 bp, Homo sapiens
taacaggttattttagtttct

SEQ ID NO: 6354268 - DNA, 23 bp, Homo sapiens
taacaggttattttagtttctgt

SEQ ID NO: 6354269 - DNA, 14 bp, Homo sapiens
taacagtaaatata

SEQ ID NO: 6354270 - DNA, 17 bp, Homo sapiens
taacagtacctgtgcct

SEQ ID NO: 6354271 - DNA, 21 bp, Homo sapiens
taacagtacctgtgcctgaga

SEQ ID NO: 6354272 - DNA, 19 bp, Homo sapiens
taacagtatttgtacaaat

SEQ ID NO: 6354273 - DNA, 14 bp, Homo sapiens
taacagtcatcatt

SEQ ID NO: 6354274 - DNA, 17 bp, Homo sapiens
taacagtcatcatttat

SEQ ID NO: 6354275 - DNA, 14 bp, Homo sapiens
taacagtcatttaa

SEQ ID NO: 6354276 - DNA, 21 bp, Homo sapiens
taacagtcctaactggtatag

SEQ ID NO: 6354277 - DNA, 18 bp, Homo sapiens
taacagtctaaaaattga

SEQ ID NO: 6354278 - DNA, 15 bp, Homo sapiens
taacagtcttactgc

SEQ ID NO: 6354279 - DNA, 17 bp, Homo sapiens
taacagtgaggctggga

SEQ ID NO: 6354280 - DNA, 14 bp, Homo sapiens
taacagtgccattg

SEQ ID NO: 6354281 - DNA, 21 bp, Homo sapiens
taacagtgccattgtctttat

SEQ ID NO: 6354282 - DNA, 22 bp, Homo sapiens
taacagtgccattgtctttata

SEQ ID NO: 6354283 - DNA, 23 bp, Homo sapiens
taacagtgccattgtctttatat

SEQ ID NO: 6354284 - DNA, 17 bp, Homo sapiens
taacagtggacaaagtt

SEQ ID NO: 6354285 - DNA, 20 bp, Homo sapiens
taacagtgtctttctagcca

SEQ ID NO: 6354286 - DNA, 17 bp, Homo sapiens
taacagttataaagaaa

SEQ ID NO: 6354287 - DNA, 15 bp, Homo sapiens
taacagttatatttt

SEQ ID NO: 6354288 - DNA, 16 bp, Homo sapiens
taacagttatattttt

SEQ ID NO: 6354289 - DNA, 18 bp, Homo sapiens
taacagttatatttttgt

SEQ ID NO: 6354290 - DNA, 22 bp, Homo sapiens
taacagttatatttttgtgttt

SEQ ID NO: 6354291 - DNA, 15 bp, Homo sapiens
taacagttgaagaaa

SEQ ID NO: 6354292 - DNA, 23 bp, Homo sapiens
taacagttgaagaaaaaatggca

SEQ ID NO: 6354293 - DNA, 16 bp, Homo sapiens
taacagttgccacatc

SEQ ID NO: 6354294 - DNA, 15 bp, Homo sapiens
taacagttgtgtcat

SEQ ID NO: 6354295 - DNA, 16 bp, Homo sapiens
taacagttgtgtcata

SEQ ID NO: 6354296 - DNA, 21 bp, Homo sapiens
taacagttgtgtcataaatta

SEQ ID NO: 6354297 - DNA, 22 bp, Homo sapiens
taacagttgtgtcataaattac

SEQ ID NO: 6354298 - DNA, 22 bp, Homo sapiens
taacagtttaaaaaaaaagttg

SEQ ID NO: 6354299 - DNA, 14 bp, Homo sapiens
taacagtttgcctg

SEQ ID NO: 6354300 - DNA, 16 bp, Homo sapiens
taacagtttgcctgct

SEQ ID NO: 6354301 - DNA, 20 bp, Homo sapiens
taacagttttagaatacatt

SEQ ID NO: 6354302 - DNA, 13 bp, Homo sapiens
taacagttttcca

SEQ ID NO: 6354303 - DNA, 14 bp, Homo sapiens
taacagttttccat

SEQ ID NO: 6354304 - DNA, 16 bp, Homo sapiens
taacagttttccatga

SEQ ID NO: 6354305 - DNA, 21 bp, Homo sapiens
taacataaaatccaatattgt

SEQ ID NO: 6354306 - DNA, 14 bp, Homo sapiens
taacataaacttgt

SEQ ID NO: 6354307 - DNA, 18 bp, Homo sapiens
taacataaacttgtactt

SEQ ID NO: 6354308 - DNA, 12 bp, Homo sapiens
taacataaattt

SEQ ID NO: 6354309 - DNA, 15 bp, Homo sapiens
taacataacaacctt

SEQ ID NO: 6354310 - DNA, 19 bp, Homo sapiens
taacataatggttgtgaaa

SEQ ID NO: 6354311 - DNA, 21 bp, Homo sapiens
taacataatggttgtgaaatg

SEQ ID NO: 6354312 - DNA, 23 bp, Homo sapiens
taacatacaagaaaatgtatcca

SEQ ID NO: 6354313 - DNA, 18 bp, Homo sapiens
taacatacacgttaactg

SEQ ID NO: 6354314 - DNA, 20 bp, Homo sapiens
taacatacatctaagtcagt

SEQ ID NO: 6354315 - DNA, 23 bp, Homo sapiens
taacatagaattgcaatctataa

SEQ ID NO: 6354316 - DNA, 19 bp, Homo sapiens
taacatagatgcctgggcc

SEQ ID NO: 6354317 - DNA, 22 bp, Homo sapiens
taacatagatgcctgggcctga

SEQ ID NO: 6354318 - DNA, 16 bp, Homo sapiens
taacatagatttatgt

SEQ ID NO: 6354319 - DNA, 19 bp, Homo sapiens
taacatagccaaaatgtga

SEQ ID NO: 6354320 - DNA, 23 bp, Homo sapiens
taacatagctgaggtaaaaactg

SEQ ID NO: 6354321 - DNA, 14 bp, Homo sapiens
taacataggcaaga

SEQ ID NO: 6354322 - DNA, 15 bp, Homo sapiens
taacataggcaagag

SEQ ID NO: 6354323 - DNA, 19 bp, Homo sapiens
taacataggcaagaggagt

SEQ ID NO: 6354324 - DNA, 15 bp, Homo sapiens
taacataggttttga

SEQ ID NO: 6354325 - DNA, 22 bp, Homo sapiens
taacataggttttgatttatat

SEQ ID NO: 6354326 - DNA, 19 bp, Homo sapiens
taacatagtaagttcagca

SEQ ID NO: 6354327 - DNA, 22 bp, Homo sapiens
taacatataaattaatacataa

SEQ ID NO: 6354328 - DNA, 20 bp, Homo sapiens
taacatataatatatgtttt

SEQ ID NO: 6354329 - DNA, 14 bp, Homo sapiens
taacatataatgtt

SEQ ID NO: 6354330 - DNA, 16 bp, Homo sapiens
taacatatattgttat

SEQ ID NO: 6354331 - DNA, 18 bp, Homo sapiens
taacatatcattcagaat

SEQ ID NO: 6354332 - DNA, 15 bp, Homo sapiens
taacatatctgatat

SEQ ID NO: 6354333 - DNA, 21 bp, Homo sapiens
taacatatgcagtgttctaca

SEQ ID NO: 6354334 - DNA, 14 bp, Homo sapiens
taacatatgtatta

SEQ ID NO: 6354335 - DNA, 17 bp, Homo sapiens
taacatattcttgcttt

SEQ ID NO: 6354336 - DNA, 22 bp, Homo sapiens
taacatatttactaagccacaa

SEQ ID NO: 6354337 - DNA, 19 bp, Homo sapiens
taacatcaatggctttgta

SEQ ID NO: 6354338 - DNA, 18 bp, Homo sapiens
taacatcataattacatt

SEQ ID NO: 6354339 - DNA, 17 bp, Homo sapiens
taacatcatcacttttt

SEQ ID NO: 6354340 - DNA, 23 bp, Homo sapiens
taacatcatcaggcttggaatga

SEQ ID NO: 6354341 - DNA, 16 bp, Homo sapiens
taacatcatgcattca

SEQ ID NO: 6354342 - DNA, 13 bp, Homo sapiens
taacatcattgta

SEQ ID NO: 6354343 - DNA, 20 bp, Homo sapiens
taacatcattttgttttcca

SEQ ID NO: 6354344 - DNA, 23 bp, Homo sapiens
taacatccaataggaatgctaac

SEQ ID NO: 6354345 - DNA, 22 bp, Homo sapiens
taacatctacaatcagttgact

SEQ ID NO: 6354346 - DNA, 17 bp, Homo sapiens
taacatctctttcatct

SEQ ID NO: 6354347 - DNA, 16 bp, Homo sapiens
taacatctgaaaagaa

SEQ ID NO: 6354348 - DNA, 13 bp, Homo sapiens
taacatctgagaa

SEQ ID NO: 6354349 - DNA, 23 bp, Homo sapiens
taacatctgcagtgttctgtgaa

SEQ ID NO: 6354350 - DNA, 21 bp, Homo sapiens
taacatctttacgtactgtaa

SEQ ID NO: 6354351 - DNA, 20 bp, Homo sapiens
taacatctttattgaaattc

SEQ ID NO: 6354352 - DNA, 13 bp, Homo sapiens
taacatctttgtt

SEQ ID NO: 6354353 - DNA, 11 bp, Homo sapiens
taacatctttt

SEQ ID NO: 6354354 - DNA, 23 bp, Homo sapiens
taacatgaaaaacacggcagctg

SEQ ID NO: 6354355 - DNA, 20 bp, Homo sapiens
taacatgaaagtcaagtcta

SEQ ID NO: 6354356 - DNA, 17 bp, Homo sapiens
taacatgaagcaaacta

SEQ ID NO: 6354357 - DNA, 19 bp, Homo sapiens
taacatgaatatttagtgt

SEQ ID NO: 6354358 - DNA, 20 bp, Homo sapiens
taacatgaatatttagtgtt

SEQ ID NO: 6354359 - DNA, 15 bp, Homo sapiens
gtcacctcacaaacc

SEQ ID NO: 6354360 - DNA, 13 bp, Homo sapiens
gtcacctcactca

SEQ ID NO: 6354361 - DNA, 16 bp, Homo sapiens
gtcacctcactcagca

SEQ ID NO: 6354362 - DNA, 15 bp, Homo sapiens
gtcacctcagcactg

SEQ ID NO: 6354363 - DNA, 14 bp, Homo sapiens
gtcacctcagctga

SEQ ID NO: 6354364 - DNA, 13 bp, Homo sapiens
gtcacctcccatc

SEQ ID NO: 6354365 - DNA, 14 bp, Homo sapiens
gtcacctccccaca

SEQ ID NO: 6354366 - DNA, 14 bp, Homo sapiens
gtcacctcctccac

SEQ ID NO: 6354367 - DNA, 15 bp, Homo sapiens
gtcacctcctccact

SEQ ID NO: 6354368 - DNA, 15 bp, Homo sapiens
gtcacctcctgctcc

SEQ ID NO: 6354369 - DNA, 18 bp, Homo sapiens
gtcacctcgctgggctct

SEQ ID NO: 6354370 - DNA, 16 bp, Homo sapiens
gtcacctcgtctccct

SEQ ID NO: 6354371 - DNA, 17 bp, Homo sapiens
gtcacctctcagctgct

SEQ ID NO: 6354372 - DNA, 22 bp, Homo sapiens
gtcacctctgtgacccctcctt

SEQ ID NO: 6354373 - DNA, 23 bp, Homo sapiens
gtcacctgacctctgaagagctg

SEQ ID NO: 6354374 - DNA, 14 bp, Homo sapiens
gtcacctgcaagcc

SEQ ID NO: 6354375 - DNA, 22 bp, Homo sapiens
gtcacctgcaagccccagggcc

SEQ ID NO: 6354376 - DNA, 19 bp, Homo sapiens
gtcacctgcacagggccct

SEQ ID NO: 6354377 - DNA, 22 bp, Homo sapiens
gtcacctgccccgtagagaatg

SEQ ID NO: 6354378 - DNA, 23 bp, Homo sapiens
gtcacctgccccgtagagaatgt

SEQ ID NO: 6354379 - DNA, 15 bp, Homo sapiens
gtcacctgctcacag

SEQ ID NO: 6354380 - DNA, 14 bp, Homo sapiens
gtcacctgcttctc

SEQ ID NO: 6354381 - DNA, 21 bp, Homo sapiens
gtcacctggctgctaggccag

SEQ ID NO: 6354382 - DNA, 22 bp, Homo sapiens
gtcacctggctgctaggccaga

SEQ ID NO: 6354383 - DNA, 12 bp, Homo sapiens
gtcacctgggag

SEQ ID NO: 6354384 - DNA, 14 bp, Homo sapiens
gtcacctgtgctac

SEQ ID NO: 6354385 - DNA, 19 bp, Homo sapiens
gtcacctgtgctacctcta

SEQ ID NO: 6354386 - DNA, 13 bp, Homo sapiens
gtcaccttccctt

SEQ ID NO: 6354387 - DNA, 17 bp, Homo sapiens
gtcaccttcccttgcca

SEQ ID NO: 6354388 - DNA, 12 bp, Homo sapiens
gtcaccttcctc

SEQ ID NO: 6354389 - DNA, 14 bp, Homo sapiens
gtcaccttcctcag

SEQ ID NO: 6354390 - DNA, 16 bp, Homo sapiens
gtcacctttctgggct

SEQ ID NO: 6354391 - DNA, 18 bp, Homo sapiens
gtcacctttctgggcttt

SEQ ID NO: 6354392 - DNA, 17 bp, Homo sapiens
gtcaccttttaaatcct

SEQ ID NO: 6354393 - DNA, 19 bp, Homo sapiens
gtcaccttttaaatcctgt

SEQ ID NO: 6354394 - DNA, 13 bp, Homo sapiens
gtcacgcctgaaa

SEQ ID NO: 6354395 - DNA, 15 bp, Homo sapiens
gtcacgctccctgac

SEQ ID NO: 6354396 - DNA, 13 bp, Homo sapiens
gtcacgctttcat

SEQ ID NO: 6354397 - DNA, 16 bp, Homo sapiens
gtcacggccaggcaga

SEQ ID NO: 6354398 - DNA, 20 bp, Homo sapiens
gtcacggctgcgcactgtgt

SEQ ID NO: 6354399 - DNA, 16 bp, Homo sapiens
gtcacgtactgtctga

SEQ ID NO: 6354400 - DNA, 17 bp, Homo sapiens
gtcacgtgaggcccctg

SEQ ID NO: 6354401 - DNA, 21 bp, Homo sapiens
gtcacgtgaggcccctgtgca

SEQ ID NO: 6354402 - DNA, 22 bp, Homo sapiens
gtcacgtgaggcccctgtgcag

SEQ ID NO: 6354403 - DNA, 23 bp, Homo sapiens
gtcacgtgcgctgggcacttccc

SEQ ID NO: 6354404 - DNA, 22 bp, Homo sapiens
gtcacgtggaggagcagtgcag

SEQ ID NO: 6354405 - DNA, 16 bp, Homo sapiens
gtcacgtgtattttca

SEQ ID NO: 6354406 - DNA, 23 bp, Homo sapiens
gtcacgttttgcctcatgaacac

SEQ ID NO: 6354407 - DNA, 18 bp, Homo sapiens
gtcactaaatttctcagt

SEQ ID NO: 6354408 - DNA, 19 bp, Homo sapiens
gtcactaagaatataaata

SEQ ID NO: 6354409 - DNA, 13 bp, Homo sapiens
gtcactaagactt

SEQ ID NO: 6354410 - DNA, 14 bp, Homo sapiens
gtcactaatacaca

SEQ ID NO: 6354411 - DNA, 17 bp, Homo sapiens
gtcactacctggctgcg

SEQ ID NO: 6354412 - DNA, 23 bp, Homo sapiens
gtcactagcagctgcagtcaaca

SEQ ID NO: 6354413 - DNA, 13 bp, Homo sapiens
gtcactatatctt

SEQ ID NO: 6354414 - DNA, 14 bp, Homo sapiens
gtcactattcatca

SEQ ID NO: 6354415 - DNA, 21 bp, Homo sapiens
gtcactattttcactagggct

SEQ ID NO: 6354416 - DNA, 23 bp, Homo sapiens
gtcactattttcactagggctga

SEQ ID NO: 6354417 - DNA, 15 bp, Homo sapiens
gtcactcaaatgaat

SEQ ID NO: 6354418 - DNA, 18 bp, Homo sapiens
gtcactcacactggccac

SEQ ID NO: 6354419 - DNA, 14 bp, Homo sapiens
gtcactcactgagg

SEQ ID NO: 6354420 - DNA, 17 bp, Homo sapiens
gtcactcactgaggcca

SEQ ID NO: 6354421 - DNA, 23 bp, Homo sapiens
gtcactcagctgagaaggccagc

SEQ ID NO: 6354422 - DNA, 16 bp, Homo sapiens
gtcactcatgtactta

SEQ ID NO: 6354423 - DNA, 19 bp, Homo sapiens
gtcactcattgctgagcct

SEQ ID NO: 6354424 - DNA, 16 bp, Homo sapiens
gtcactccaaggatca

SEQ ID NO: 6354425 - DNA, 21 bp, Homo sapiens
gtcactccaaggatcagaagt

SEQ ID NO: 6354426 - DNA, 19 bp, Homo sapiens
gtcactccaccatccccac

SEQ ID NO: 6354427 - DNA, 14 bp, Homo sapiens
gtcactccagtgct

SEQ ID NO: 6354428 - DNA, 15 bp, Homo sapiens
gtcactccagtgctc

SEQ ID NO: 6354429 - DNA, 11 bp, Homo sapiens
gtcactcccaa

SEQ ID NO: 6354430 - DNA, 12 bp, Homo sapiens
gtcactcctggg

SEQ ID NO: 6354431 - DNA, 19 bp, Homo sapiens
gtcactctagtcaatgaca

SEQ ID NO: 6354432 - DNA, 16 bp, Homo sapiens
gtcactctgccctctg

SEQ ID NO: 6354433 - DNA, 19 bp, Homo sapiens
gtcactctgccctctgctg

SEQ ID NO: 6354434 - DNA, 20 bp, Homo sapiens
gtcactctgccctctgctgc

SEQ ID NO: 6354435 - DNA, 13 bp, Homo sapiens
gtcactctggcag

SEQ ID NO: 6354436 - DNA, 14 bp, Homo sapiens
gtcactctggcagc

SEQ ID NO: 6354437 - DNA, 17 bp, Homo sapiens
gtcactctggcagctca

SEQ ID NO: 6354438 - DNA, 19 bp, Homo sapiens
gtcactcttcctgcaagga

SEQ ID NO: 6354439 - DNA, 20 bp, Homo sapiens
gtcactcttcctgcaaggac

SEQ ID NO: 6354440 - DNA, 17 bp, Homo sapiens
gtcactcttggtccctg

SEQ ID NO: 6354441 - DNA, 15 bp, Homo sapiens
gtcactgaaggcctg

SEQ ID NO: 6354442 - DNA, 19 bp, Homo sapiens
gtcactgaagtgattgaaa

SEQ ID NO: 6354443 - DNA, 19 bp, Homo sapiens
gtcactgacatcagcactg

SEQ ID NO: 6354444 - DNA, 14 bp, Homo sapiens
gtcactgagacagc

SEQ ID NO: 6354445 - DNA, 15 bp, Homo sapiens
gtcactgagacagcc

SEQ ID NO: 6354446 - DNA, 23 bp, Homo sapiens
gtcactgagacagcccgggctct

SEQ ID NO: 6354447 - DNA, 12 bp, Homo sapiens
gtcactgagacc

SEQ ID NO: 6354448 - DNA, 18 bp, Homo sapiens
gtcactgagcacagtcag

SEQ ID NO: 6354449 - DNA, 14 bp, Homo sapiens
gtcactgcaggcac

SEQ ID NO: 6354450 - DNA, 20 bp, Homo sapiens
gtcactgcatggcttctgaa

SEQ ID NO: 6354451 - DNA, 17 bp, Homo sapiens
gtcactgcatttgcctg

SEQ ID NO: 6354452 - DNA, 12 bp, Homo sapiens
gtcactgccaac

SEQ ID NO: 6354453 - DNA, 17 bp, Homo sapiens
gtcactgccactttgca

SEQ ID NO: 6354454 - DNA, 20 bp, Homo sapiens
gtcactgccatggaggcaca

SEQ ID NO: 6354455 - DNA, 17 bp, Homo sapiens
gtcactgcccaccaaag

SEQ ID NO: 6354456 - DNA, 18 bp, Homo sapiens
gtcactgcccaccaaagg

SEQ ID NO: 6354457 - DNA, 12 bp, Homo sapiens
gtcactgcctct

SEQ ID NO: 6354458 - DNA, 18 bp, Homo sapiens
gtcactgctgctactgcc

SEQ ID NO: 6354459 - DNA, 15 bp, Homo sapiens
gtcactgcttaactt

SEQ ID NO: 6354460 - DNA, 12 bp, Homo sapiens
gtcactggaaag

SEQ ID NO: 6354461 - DNA, 23 bp, Homo sapiens
gtcactggaaaggggagagcctg

SEQ ID NO: 6354462 - DNA, 20 bp, Homo sapiens
gtcactggaacctccctggg

SEQ ID NO: 6354463 - DNA, 18 bp, Homo sapiens
gtcactggaggttgaagc

SEQ ID NO: 6354464 - DNA, 20 bp, Homo sapiens
gtcactggaggttgaagcca

SEQ ID NO: 6354465 - DNA, 20 bp, Homo sapiens
gtcactggcagagcacagcc

SEQ ID NO: 6354466 - DNA, 15 bp, Homo sapiens
gtcactggcagcctg

SEQ ID NO: 6354467 - DNA, 13 bp, Homo sapiens
gtcactggcctct

SEQ ID NO: 6354468 - DNA, 21 bp, Homo sapiens
gtcactggcctctccccagga

SEQ ID NO: 6354469 - DNA, 20 bp, Homo sapiens
gtcactggctctccaagtgc

SEQ ID NO: 6354470 - DNA, 21 bp, Homo sapiens
gtcactggctctccaagtgcc

SEQ ID NO: 6354471 - DNA, 20 bp, Homo sapiens
gtcactggctgcctccactc

SEQ ID NO: 6354472 - DNA, 21 bp, Homo sapiens
gtcactggctgcctccactcc

SEQ ID NO: 6354473 - DNA, 15 bp, Homo sapiens
gtcactggctggctc

SEQ ID NO: 6354474 - DNA, 16 bp, Homo sapiens
gtcactggctggctcc

SEQ ID NO: 6354475 - DNA, 17 bp, Homo sapiens
gtcactggctggctcct

SEQ ID NO: 6354476 - DNA, 17 bp, Homo sapiens
gtcactggggcccaaga

SEQ ID NO: 6354477 - DNA, 23 bp, Homo sapiens
gtcactgggggacactgtggcag

SEQ ID NO: 6354478 - DNA, 15 bp, Homo sapiens
gtcactggtcagggc

SEQ ID NO: 6354479 - DNA, 17 bp, Homo sapiens
gtcactggtcagggcag

SEQ ID NO: 6354480 - DNA, 13 bp, Homo sapiens
gtcactgtccaga

SEQ ID NO: 6354481 - DNA, 19 bp, Homo sapiens
gtcactgtccagagtctct

SEQ ID NO: 6354482 - DNA, 15 bp, Homo sapiens
gtcactgtccctcct

SEQ ID NO: 6354483 - DNA, 16 bp, Homo sapiens
gtcactgtccctcctg

SEQ ID NO: 6354484 - DNA, 22 bp, Homo sapiens
gtcactgtccttgaacccaaca

SEQ ID NO: 6354485 - DNA, 18 bp, Homo sapiens
gtcactgtgcactgccct

SEQ ID NO: 6354486 - DNA, 18 bp, Homo sapiens
gtcactgttataaatttt

SEQ ID NO: 6354487 - DNA, 21 bp, Homo sapiens
gtcactgttataaattttgta

SEQ ID NO: 6354488 - DNA, 23 bp, Homo sapiens
gtcactgttataaattttgtaca

SEQ ID NO: 6354489 - DNA, 17 bp, Homo sapiens
gtcactgtttcctgggc

SEQ ID NO: 6354490 - DNA, 15 bp, Homo sapiens
gtcactgtttctctg

SEQ ID NO: 6354491 - DNA, 13 bp, Homo sapiens
gtcacttaaattt

SEQ ID NO: 6354492 - DNA, 20 bp, Homo sapiens
gtcacttaaatttgttcttt

SEQ ID NO: 6354493 - DNA, 21 bp, Homo sapiens
gtcacttaactataaggtgcc

SEQ ID NO: 6354494 - DNA, 23 bp, Homo sapiens
gtcacttcaaacatgccctcagg

SEQ ID NO: 6354495 - DNA, 18 bp, Homo sapiens
gtcacttcgcgtgccctc

SEQ ID NO: 6354496 - DNA, 24 bp, Homo sapiens
gtcacttcgcgtgccctcgctgct

SEQ ID NO: 6354497 - DNA, 12 bp, Homo sapiens
gtcacttctcca

SEQ ID NO: 6354498 - DNA, 21 bp, Homo sapiens
gtcacttctcctgctgctcct

SEQ ID NO: 6354499 - DNA, 12 bp, Homo sapiens
gtcacttctgct

SEQ ID NO: 6354500 - DNA, 19 bp, Homo sapiens
gtcacttctgctgtacaga

SEQ ID NO: 6354501 - DNA, 22 bp, Homo sapiens
gtcacttcttcacctcttccac

SEQ ID NO: 6354502 - DNA, 19 bp, Homo sapiens
gtcacttcttctgtccaag

SEQ ID NO: 6354503 - DNA, 13 bp, Homo sapiens
gtcacttgccaca

SEQ ID NO: 6354504 - DNA, 18 bp, Homo sapiens
gtcacttgtgctttgctc

SEQ ID NO: 6354505 - DNA, 11 bp, Homo sapiens
gtcactttgac

SEQ ID NO: 6354506 - DNA, 11 bp, Homo sapiens
gtcacttttag

SEQ ID NO: 6354507 - DNA, 22 bp, Homo sapiens
gtcacttttccttttcttaaaa

SEQ ID NO: 6354508 - DNA, 17 bp, Homo sapiens
gtcactttttgaggcaa

SEQ ID NO: 6354509 - DNA, 19 bp, Homo sapiens
gtcactttttgaggcaaaa

SEQ ID NO: 6354510 - DNA, 20 bp, Homo sapiens
gtcacttttttcctgtcaat

SEQ ID NO: 6354511 - DNA, 19 bp, Homo sapiens
gtcactttttttctttttc

SEQ ID NO: 6354512 - DNA, 15 bp, Homo sapiens
gtcagaaaacagaga

SEQ ID NO: 6354513 - DNA, 13 bp, Homo sapiens
gtcagaaaccctg

SEQ ID NO: 6354514 - DNA, 16 bp, Homo sapiens
gtcagaaaccctggtc

SEQ ID NO: 6354515 - DNA, 16 bp, Homo sapiens
gtcagaaagtgtaaat

SEQ ID NO: 6354516 - DNA, 18 bp, Homo sapiens
gtcagaaagtgtaaatgt

SEQ ID NO: 6354517 - DNA, 13 bp, Homo sapiens
gtcagaaataaaa

SEQ ID NO: 6354518 - DNA, 21 bp, Homo sapiens
gtcagaacaggtttttttgtt

SEQ ID NO: 6354519 - DNA, 14 bp, Homo sapiens
gtcagaacatgtta

SEQ ID NO: 6354520 - DNA, 20 bp, Homo sapiens
gtcagaacattcgaatctct

SEQ ID NO: 6354521 - DNA, 19 bp, Homo sapiens
gtcagaaccagagggcatg

SEQ ID NO: 6354522 - DNA, 22 bp, Homo sapiens
gtcagaaccagagggcatgctg

SEQ ID NO: 6354523 - DNA, 15 bp, Homo sapiens
gtcagaaccctgcca

SEQ ID NO: 6354524 - DNA, 16 bp, Homo sapiens
gtcagaaccctgccat

SEQ ID NO: 6354525 - DNA, 21 bp, Homo sapiens
gtcagaacctttggacaagag

SEQ ID NO: 6354526 - DNA, 18 bp, Homo sapiens
gtcagaagaagtgggagc

SEQ ID NO: 6354527 - DNA, 23 bp, Homo sapiens
gtcagaagaagtgggagcagctt

SEQ ID NO: 6354528 - DNA, 15 bp, Homo sapiens
gtcagaagatctttc

SEQ ID NO: 6354529 - DNA, 15 bp, Homo sapiens
gtcagaagcaggttc

SEQ ID NO: 6354530 - DNA, 22 bp, Homo sapiens
gtcagaagcaggttcttgatgt

SEQ ID NO: 6354531 - DNA, 18 bp, Homo sapiens
gtcagaataaaaatgtgg

SEQ ID NO: 6354532 - DNA, 16 bp, Homo sapiens
gtcagaatcatgctgt

SEQ ID NO: 6354533 - DNA, 20 bp, Homo sapiens
gtcagaatggaatccatctg

SEQ ID NO: 6354534 - DNA, 15 bp, Homo sapiens
gtcagacacaaacaa

SEQ ID NO: 6354535 - DNA, 20 bp, Homo sapiens
gtcagacacttatttattgg

SEQ ID NO: 6354536 - DNA, 12 bp, Homo sapiens
gtcagacataaa

SEQ ID NO: 6354537 - DNA, 17 bp, Homo sapiens
gtcagacataaagccat

SEQ ID NO: 6354538 - DNA, 19 bp, Homo sapiens
taacatgacttccttattt

SEQ ID NO: 6354539 - DNA, 18 bp, Homo sapiens
taacatgaggggacattt

SEQ ID NO: 6354540 - DNA, 20 bp, Homo sapiens
taacatgaggggacattttg

SEQ ID NO: 6354541 - DNA, 12 bp, Homo sapiens
taacatgatgta

SEQ ID NO: 6354542 - DNA, 13 bp, Homo sapiens
taacatgatgtac

SEQ ID NO: 6354543 - DNA, 16 bp, Homo sapiens
taacatgatgtactaa

SEQ ID NO: 6354544 - DNA, 13 bp, Homo sapiens
taacatgcaacaa

SEQ ID NO: 6354545 - DNA, 18 bp, Homo sapiens
taacatgcaacaaaaatg

SEQ ID NO: 6354546 - DNA, 15 bp, Homo sapiens
taacatgcaccttgc

SEQ ID NO: 6354547 - DNA, 13 bp, Homo sapiens
taacatgccagct

SEQ ID NO: 6354548 - DNA, 20 bp, Homo sapiens
taacatgcccatattttact

SEQ ID NO: 6354549 - DNA, 22 bp, Homo sapiens
taacatgctggtgaatattttc

SEQ ID NO: 6354550 - DNA, 21 bp, Homo sapiens
taacatgctgtgtaagctgtg

SEQ ID NO: 6354551 - DNA, 18 bp, Homo sapiens
taacatggaagggaagaa

SEQ ID NO: 6354552 - DNA, 14 bp, Homo sapiens
taacatggaagtac

SEQ ID NO: 6354553 - DNA, 16 bp, Homo sapiens
taacatggaagtacta

SEQ ID NO: 6354554 - DNA, 23 bp, Homo sapiens
taacatggaatttaatttatgtg

SEQ ID NO: 6354555 - DNA, 23 bp, Homo sapiens
taacatggacatgatcttcttta

SEQ ID NO: 6354556 - DNA, 21 bp, Homo sapiens
taacatgggctcttcactagt

SEQ ID NO: 6354557 - DNA, 18 bp, Homo sapiens
taacatggtgtgcttctt

SEQ ID NO: 6354558 - DNA, 23 bp, Homo sapiens
taacatggttcaggtacacatat

SEQ ID NO: 6354559 - DNA, 16 bp, Homo sapiens
taacatgtctaaagtt

SEQ ID NO: 6354560 - DNA, 19 bp, Homo sapiens
taacatgtggaagaaaaca

SEQ ID NO: 6354561 - DNA, 13 bp, Homo sapiens
taacatgtttctc

SEQ ID NO: 6354562 - DNA, 17 bp, Homo sapiens
taacatgtttctctata

SEQ ID NO: 6354563 - DNA, 21 bp, Homo sapiens
taacatgtttctctataaagt

SEQ ID NO: 6354564 - DNA, 15 bp, Homo sapiens
taacattaacatcta

SEQ ID NO: 6354565 - DNA, 18 bp, Homo sapiens
taacattaattctactaa

SEQ ID NO: 6354566 - DNA, 12 bp, Homo sapiens
taacattacctt

SEQ ID NO: 6354567 - DNA, 15 bp, Homo sapiens
taacattataaatga

SEQ ID NO: 6354568 - DNA, 11 bp, Homo sapiens
taacattatat

SEQ ID NO: 6354569 - DNA, 12 bp, Homo sapiens
taacattattta

SEQ ID NO: 6354570 - DNA, 15 bp, Homo sapiens
taacattatttatat

SEQ ID NO: 6354571 - DNA, 18 bp, Homo sapiens
taacattcagtactttat

SEQ ID NO: 6354572 - DNA, 19 bp, Homo sapiens
taacattcagtactttatg

SEQ ID NO: 6354573 - DNA, 15 bp, Homo sapiens
taacattcagttccc

SEQ ID NO: 6354574 - DNA, 10 bp, Homo sapiens
taacattcct

SEQ ID NO: 6354575 - DNA, 20 bp, Homo sapiens
taacattcctcatgaatgta

SEQ ID NO: 6354576 - DNA, 22 bp, Homo sapiens
taacattcctcatgaatgtaaa

SEQ ID NO: 6354577 - DNA, 16 bp, Homo sapiens
taacattcgatctcat

SEQ ID NO: 6354578 - DNA, 15 bp, Homo sapiens
taacattctatttca

SEQ ID NO: 6354579 - DNA, 13 bp, Homo sapiens
taacattctgaat

SEQ ID NO: 6354580 - DNA, 15 bp, Homo sapiens
taacattcttggtca

SEQ ID NO: 6354581 - DNA, 20 bp, Homo sapiens
taacattcttggtcacaaag

SEQ ID NO: 6354582 - DNA, 15 bp, Homo sapiens
taacattctttttct

SEQ ID NO: 6354583 - DNA, 15 bp, Homo sapiens
taacattgaccaaga

SEQ ID NO: 6354584 - DNA, 20 bp, Homo sapiens
taacattgaccaagaactgc

SEQ ID NO: 6354585 - DNA, 12 bp, Homo sapiens
taacattgcact

SEQ ID NO: 6354586 - DNA, 20 bp, Homo sapiens
taacattgcataaacacttt

SEQ ID NO: 6354587 - DNA, 20 bp, Homo sapiens
taacattgggaaatcttata

SEQ ID NO: 6354588 - DNA, 15 bp, Homo sapiens
taacatttaaattcc

SEQ ID NO: 6354589 - DNA, 15 bp, Homo sapiens
taacatttaatttag

SEQ ID NO: 6354590 - DNA, 18 bp, Homo sapiens
taacatttaatttagata

SEQ ID NO: 6354591 - DNA, 19 bp, Homo sapiens
taacatttaatttagatat

SEQ ID NO: 6354592 - DNA, 21 bp, Homo sapiens
taacatttaatttagatattt

SEQ ID NO: 6354593 - DNA, 22 bp, Homo sapiens
taacatttaatttagatatttt

SEQ ID NO: 6354594 - DNA, 16 bp, Homo sapiens
taacatttaggagaag

SEQ ID NO: 6354595 - DNA, 17 bp, Homo sapiens
taacatttatagaagaa

SEQ ID NO: 6354596 - DNA, 19 bp, Homo sapiens
taacatttatagaagaaat

SEQ ID NO: 6354597 - DNA, 17 bp, Homo sapiens
taacatttatctaaaag

SEQ ID NO: 6354598 - DNA, 20 bp, Homo sapiens
taacatttatctaaaagaat

SEQ ID NO: 6354599 - DNA, 19 bp, Homo sapiens
taacatttcacagtattta

SEQ ID NO: 6354600 - DNA, 12 bp, Homo sapiens
taacatttctgt

SEQ ID NO: 6354601 - DNA, 11 bp, Homo sapiens
taacatttgcc

SEQ ID NO: 6354602 - DNA, 16 bp, Homo sapiens
taacatttgccttgca

SEQ ID NO: 6354603 - DNA, 13 bp, Homo sapiens
taacatttgctgt

SEQ ID NO: 6354604 - DNA, 16 bp, Homo sapiens
taacatttgctgtttt

SEQ ID NO: 6354605 - DNA, 17 bp, Homo sapiens
taacattttacagtaaa

SEQ ID NO: 6354606 - DNA, 21 bp, Homo sapiens
taacattttacagtaaatgtt

SEQ ID NO: 6354607 - DNA, 10 bp, Homo sapiens
taacattttg

SEQ ID NO: 6354608 - DNA, 19 bp, Homo sapiens
taacattttgagctatttc

SEQ ID NO: 6354609 - DNA, 19 bp, Homo sapiens
taacattttggaaattgtt

SEQ ID NO: 6354610 - DNA, 23 bp, Homo sapiens
taacattttggtgacagtttcca

SEQ ID NO: 6354611 - DNA, 19 bp, Homo sapiens
taacattttgtttccaaag

SEQ ID NO: 6354612 - DNA, 15 bp, Homo sapiens
taacatttttcaata

SEQ ID NO: 6354613 - DNA, 18 bp, Homo sapiens
taacatttttgaggaagt

SEQ ID NO: 6354614 - DNA, 23 bp, Homo sapiens
taacatttttgaggaagttttgt

SEQ ID NO: 6354615 - DNA, 15 bp, Homo sapiens
taacattttttaccc

SEQ ID NO: 6354616 - DNA, 20 bp, Homo sapiens
taaccaaaaagaccagacta

SEQ ID NO: 6354617 - DNA, 18 bp, Homo sapiens
taaccaaagagtctctgg

SEQ ID NO: 6354618 - DNA, 20 bp, Homo sapiens
taaccaaagcaattaaatga

SEQ ID NO: 6354619 - DNA, 11 bp, Homo sapiens
taaccaaaggt

SEQ ID NO: 6354620 - DNA, 17 bp, Homo sapiens
taaccaaaggtgaagga

SEQ ID NO: 6354621 - DNA, 21 bp, Homo sapiens
taaccaaatattaaagattct

SEQ ID NO: 6354622 - DNA, 13 bp, Homo sapiens
taaccaaatgcat

SEQ ID NO: 6354623 - DNA, 14 bp, Homo sapiens
taaccaaatgcatc

SEQ ID NO: 6354624 - DNA, 15 bp, Homo sapiens
taaccaaattaacct

SEQ ID NO: 6354625 - DNA, 19 bp, Homo sapiens
taaccaacattaaaactca

SEQ ID NO: 6354626 - DNA, 13 bp, Homo sapiens
taaccaacatttt

SEQ ID NO: 6354627 - DNA, 16 bp, Homo sapiens
taaccaagaggctggt

SEQ ID NO: 6354628 - DNA, 16 bp, Homo sapiens
taaccaagctgagttt

SEQ ID NO: 6354629 - DNA, 20 bp, Homo sapiens
taaccaagctgagtttccta

SEQ ID NO: 6354630 - DNA, 15 bp, Homo sapiens
taaccaaggaaatat

SEQ ID NO: 6354631 - DNA, 17 bp, Homo sapiens
taaccaaggctccaata

SEQ ID NO: 6354632 - DNA, 21 bp, Homo sapiens
taaccaaggtagaatgacctt

SEQ ID NO: 6354633 - DNA, 14 bp, Homo sapiens
taaccaagtttatt

SEQ ID NO: 6354634 - DNA, 16 bp, Homo sapiens
taaccaagtttattca

SEQ ID NO: 6354635 - DNA, 23 bp, Homo sapiens
taaccaagtttattcagtaaaca

SEQ ID NO: 6354636 - DNA, 14 bp, Homo sapiens
taaccaataatggt

SEQ ID NO: 6354637 - DNA, 17 bp, Homo sapiens
taaccaatcgcaaagca

SEQ ID NO: 6354638 - DNA, 14 bp, Homo sapiens
taaccaatctacaa

SEQ ID NO: 6354639 - DNA, 12 bp, Homo sapiens
taaccaatgttt

SEQ ID NO: 6354640 - DNA, 19 bp, Homo sapiens
taaccaattcctcatttgt

SEQ ID NO: 6354641 - DNA, 23 bp, Homo sapiens
taaccaattgtgagaattactgt

SEQ ID NO: 6354642 - DNA, 15 bp, Homo sapiens
taaccaatttgtaat

SEQ ID NO: 6354643 - DNA, 16 bp, Homo sapiens
taaccaatttgtaatg

SEQ ID NO: 6354644 - DNA, 23 bp, Homo sapiens
taaccacaaagcacagtttgaac

SEQ ID NO: 6354645 - DNA, 14 bp, Homo sapiens
taaccacaactttc

SEQ ID NO: 6354646 - DNA, 14 bp, Homo sapiens
taaccacagctcct

SEQ ID NO: 6354647 - DNA, 18 bp, Homo sapiens
taaccacagctccttttc

SEQ ID NO: 6354648 - DNA, 15 bp, Homo sapiens
taaccacattaatta

SEQ ID NO: 6354649 - DNA, 17 bp, Homo sapiens
taaccacattttaggat

SEQ ID NO: 6354650 - DNA, 20 bp, Homo sapiens
taaccaccatttcccctgtg

SEQ ID NO: 6354651 - DNA, 18 bp, Homo sapiens
taaccaccgcatatgcat

SEQ ID NO: 6354652 - DNA, 20 bp, Homo sapiens
taaccaccgcatatgcatgc

SEQ ID NO: 6354653 - DNA, 24 bp, Homo sapiens
taaccaccgcatatgcatgccagg

SEQ ID NO: 6354654 - DNA, 21 bp, Homo sapiens
taaccacctaccttacagtga

SEQ ID NO: 6354655 - DNA, 17 bp, Homo sapiens
taaccacctctctgtct

SEQ ID NO: 6354656 - DNA, 13 bp, Homo sapiens
taaccacggaaaa

SEQ ID NO: 6354657 - DNA, 19 bp, Homo sapiens
taaccacgtctgtcttcac

SEQ ID NO: 6354658 - DNA, 15 bp, Homo sapiens
taaccactaacattg

SEQ ID NO: 6354659 - DNA, 20 bp, Homo sapiens
taaccactaatgttagaatt

SEQ ID NO: 6354660 - DNA, 22 bp, Homo sapiens
taaccactcctcaggaacagaa

SEQ ID NO: 6354661 - DNA, 18 bp, Homo sapiens
taaccactgcaagtcctt

SEQ ID NO: 6354662 - DNA, 19 bp, Homo sapiens
taaccacttaaaaaatgtc

SEQ ID NO: 6354663 - DNA, 13 bp, Homo sapiens
taaccagagcaag

SEQ ID NO: 6354664 - DNA, 22 bp, Homo sapiens
taaccagatctagtcaatcaag

SEQ ID NO: 6354665 - DNA, 19 bp, Homo sapiens
taaccagatggaacactgg

SEQ ID NO: 6354666 - DNA, 23 bp, Homo sapiens
taaccagccctgcacgacccctg

SEQ ID NO: 6354667 - DNA, 19 bp, Homo sapiens
taaccaggccatttttggt

SEQ ID NO: 6354668 - DNA, 12 bp, Homo sapiens
taaccaggccca

SEQ ID NO: 6354669 - DNA, 16 bp, Homo sapiens
taaccaggccccagcc

SEQ ID NO: 6354670 - DNA, 23 bp, Homo sapiens
taaccaggccccagcctccaggc

SEQ ID NO: 6354671 - DNA, 17 bp, Homo sapiens
taaccaggctgggctca

SEQ ID NO: 6354672 - DNA, 21 bp, Homo sapiens
taaccagggcaccaagcccac

SEQ ID NO: 6354673 - DNA, 16 bp, Homo sapiens
taaccagggccagaag

SEQ ID NO: 6354674 - DNA, 21 bp, Homo sapiens
taaccaggggtcctaaccact

SEQ ID NO: 6354675 - DNA, 19 bp, Homo sapiens
taaccagtacctctgtata

SEQ ID NO: 6354676 - DNA, 21 bp, Homo sapiens
taaccagtctgaagtttcatt

SEQ ID NO: 6354677 - DNA, 22 bp, Homo sapiens
taaccagtgcagaaatgaaata

SEQ ID NO: 6354678 - DNA, 14 bp, Homo sapiens
taaccagtggccgg

SEQ ID NO: 6354679 - DNA, 22 bp, Homo sapiens
taaccagttaccacacatctat

SEQ ID NO: 6354680 - DNA, 23 bp, Homo sapiens
taaccagtttagctttttcctta

SEQ ID NO: 6354681 - DNA, 20 bp, Homo sapiens
taaccagttttttcacctcc

SEQ ID NO: 6354682 - DNA, 15 bp, Homo sapiens
taaccataaatcaat

SEQ ID NO: 6354683 - DNA, 14 bp, Homo sapiens
taaccataagattt

SEQ ID NO: 6354684 - DNA, 18 bp, Homo sapiens
taaccataagatttactg

SEQ ID NO: 6354685 - DNA, 13 bp, Homo sapiens
taaccatcagtta

SEQ ID NO: 6354686 - DNA, 17 bp, Homo sapiens
taaccatccccaactcc

SEQ ID NO: 6354687 - DNA, 20 bp, Homo sapiens
taaccatggagtagaggtac

SEQ ID NO: 6354688 - DNA, 15 bp, Homo sapiens
taaccatgggctcag

SEQ ID NO: 6354689 - DNA, 17 bp, Homo sapiens
taaccatgggctcaggg

SEQ ID NO: 6354690 - DNA, 18 bp, Homo sapiens
taaccatgggctcagggc

SEQ ID NO: 6354691 - DNA, 19 bp, Homo sapiens
taaccatgggctcagggcc

SEQ ID NO: 6354692 - DNA, 20 bp, Homo sapiens
taaccatgggctcagggcca

SEQ ID NO: 6354693 - DNA, 21 bp, Homo sapiens
taaccatggtgattaaaatga

SEQ ID NO: 6354694 - DNA, 15 bp, Homo sapiens
taaccattaaaactg

SEQ ID NO: 6354695 - DNA, 18 bp, Homo sapiens
taaccattacatgtttaa

SEQ ID NO: 6354696 - DNA, 20 bp, Homo sapiens
taaccattacatgtttaaat

SEQ ID NO: 6354697 - DNA, 19 bp, Homo sapiens
taaccattccataatcatg

SEQ ID NO: 6354698 - DNA, 19 bp, Homo sapiens
taaccattggttaatctgg

SEQ ID NO: 6354699 - DNA, 19 bp, Homo sapiens
taaccatttaataaagaaa

SEQ ID NO: 6354700 - DNA, 18 bp, Homo sapiens
taaccatttatataaaac

SEQ ID NO: 6354701 - DNA, 21 bp, Homo sapiens
taaccatttctcactagtgtc

SEQ ID NO: 6354702 - DNA, 16 bp, Homo sapiens
taaccatttgttaact

SEQ ID NO: 6354703 - DNA, 10 bp, Homo sapiens
taaccatttt

SEQ ID NO: 6354704 - DNA, 12 bp, Homo sapiens
taacccaaggag

SEQ ID NO: 6354705 - DNA, 14 bp, Homo sapiens
taacccaatgcctg

SEQ ID NO: 6354706 - DNA, 14 bp, Homo sapiens
taacccacctctcc

SEQ ID NO: 6354707 - DNA, 21 bp, Homo sapiens
taacccactgctgaaaaagaa

SEQ ID NO: 6354708 - DNA, 15 bp, Homo sapiens
taacccagattttat

SEQ ID NO: 6354709 - DNA, 17 bp, Homo sapiens
taacccagttaacttac

SEQ ID NO: 6354710 - DNA, 15 bp, Homo sapiens
taacccagttacttt

SEQ ID NO: 6354711 - DNA, 22 bp, Homo sapiens
taacccagttacttttttacac

SEQ ID NO: 6354712 - DNA, 21 bp, Homo sapiens
taacccattccagtacagtat

SEQ ID NO: 6354713 - DNA, 17 bp, Homo sapiens
taaccccaagacagtct

SEQ ID NO: 6354714 - DNA, 23 bp, Homo sapiens
taaccccaagagtttcttctcat

SEQ ID NO: 6354715 - DNA, 19 bp, Homo sapiens
taaccccagctccctagga

SEQ ID NO: 6354716 - DNA, 14 bp, Homo sapiens
taaccccagctgcc

SEQ ID NO: 6354717 - DNA, 18 bp, Homo sapiens
gtcagacatccatgtttg

SEQ ID NO: 6354718 - DNA, 20 bp, Homo sapiens
gtcagacatccatgtttgta

SEQ ID NO: 6354719 - DNA, 18 bp, Homo sapiens
gtcagaccagtactggga

SEQ ID NO: 6354720 - DNA, 17 bp, Homo sapiens
gtcagaccctaggaagc

SEQ ID NO: 6354721 - DNA, 15 bp, Homo sapiens
gtcagaccctggagg

SEQ ID NO: 6354722 - DNA, 16 bp, Homo sapiens
gtcagacgcctgagga

SEQ ID NO: 6354723 - DNA, 18 bp, Homo sapiens
gtcagacgcctgaggaac

SEQ ID NO: 6354724 - DNA, 15 bp, Homo sapiens
gtcagactaagaaat

SEQ ID NO: 6354725 - DNA, 14 bp, Homo sapiens
gtcagactgctggg

SEQ ID NO: 6354726 - DNA, 15 bp, Homo sapiens
gtcagactgctggga

SEQ ID NO: 6354727 - DNA, 16 bp, Homo sapiens
gtcagactgctgggac

SEQ ID NO: 6354728 - DNA, 20 bp, Homo sapiens
gtcagactgctgggactggc

SEQ ID NO: 6354729 - DNA, 24 bp, Homo sapiens
gtcagactgctgggactggccagg

SEQ ID NO: 6354730 - DNA, 14 bp, Homo sapiens
gtcagactggaggt

SEQ ID NO: 6354731 - DNA, 22 bp, Homo sapiens
gtcagactggctggctgcagtg

SEQ ID NO: 6354732 - DNA, 23 bp, Homo sapiens
gtcagacttccaaatcctggaag

SEQ ID NO: 6354733 - DNA, 15 bp, Homo sapiens
gtcagactttaaaga

SEQ ID NO: 6354734 - DNA, 16 bp, Homo sapiens
gtcagagagacctcat

SEQ ID NO: 6354735 - DNA, 20 bp, Homo sapiens
gtcagagagacctcatcctg

SEQ ID NO: 6354736 - DNA, 21 bp, Homo sapiens
gtcagagagacctcatcctgc

SEQ ID NO: 6354737 - DNA, 19 bp, Homo sapiens
gtcagagaggagtcagaga

SEQ ID NO: 6354738 - DNA, 23 bp, Homo sapiens
gtcagagagggaagctgaggccc

SEQ ID NO: 6354739 - DNA, 13 bp, Homo sapiens
gtcagagccactc

SEQ ID NO: 6354740 - DNA, 13 bp, Homo sapiens
gtcagagcccagg

SEQ ID NO: 6354741 - DNA, 14 bp, Homo sapiens
gtcagagcccaggg

SEQ ID NO: 6354742 - DNA, 12 bp, Homo sapiens
gtcagagccctg

SEQ ID NO: 6354743 - DNA, 17 bp, Homo sapiens
gtcagagccctggctgg

SEQ ID NO: 6354744 - DNA, 23 bp, Homo sapiens
gtcagagccctggctgggttcag

SEQ ID NO: 6354745 - DNA, 14 bp, Homo sapiens
gtcagagcctgcag

SEQ ID NO: 6354746 - DNA, 19 bp, Homo sapiens
gtcagagctatgttccctc

SEQ ID NO: 6354747 - DNA, 12 bp, Homo sapiens
gtcagagctggg

SEQ ID NO: 6354748 - DNA, 13 bp, Homo sapiens
gtcagagctggga

SEQ ID NO: 6354749 - DNA, 16 bp, Homo sapiens
gtcagagctgttataa

SEQ ID NO: 6354750 - DNA, 21 bp, Homo sapiens
gtcagagcttgattagaagcc

SEQ ID NO: 6354751 - DNA, 22 bp, Homo sapiens
gtcagagcttgattagaagcca

SEQ ID NO: 6354752 - DNA, 18 bp, Homo sapiens
gtcagaggaccccagggt

SEQ ID NO: 6354753 - DNA, 20 bp, Homo sapiens
gtcagaggaccccagggtgg

SEQ ID NO: 6354754 - DNA, 13 bp, Homo sapiens
gtcagaggagaag

SEQ ID NO: 6354755 - DNA, 13 bp, Homo sapiens
gtcagaggatggc

SEQ ID NO: 6354756 - DNA, 15 bp, Homo sapiens
gtcagaggatggcca

SEQ ID NO: 6354757 - DNA, 20 bp, Homo sapiens
gtcagaggatggccagtgtc

SEQ ID NO: 6354758 - DNA, 21 bp, Homo sapiens
gtcagaggatggccagtgtct

SEQ ID NO: 6354759 - DNA, 21 bp, Homo sapiens
gtcagaggctaattctgcaga

SEQ ID NO: 6354760 - DNA, 15 bp, Homo sapiens
gtcagagggactgtc

SEQ ID NO: 6354761 - DNA, 23 bp, Homo sapiens
gtcagagtaacatgccagcttcc

SEQ ID NO: 6354762 - DNA, 18 bp, Homo sapiens
gtcagagtaagctgcttt

SEQ ID NO: 6354763 - DNA, 13 bp, Homo sapiens
gtcagagtccagt

SEQ ID NO: 6354764 - DNA, 13 bp, Homo sapiens
gtcagagtgccac

SEQ ID NO: 6354765 - DNA, 23 bp, Homo sapiens
gtcagagtttcagctttcttcag

SEQ ID NO: 6354766 - DNA, 19 bp, Homo sapiens
gtcagataagtgtaaatag

SEQ ID NO: 6354767 - DNA, 20 bp, Homo sapiens
gtcagatctgcctaaggact

SEQ ID NO: 6354768 - DNA, 17 bp, Homo sapiens
gtcagatgagcaaggac

SEQ ID NO: 6354769 - DNA, 18 bp, Homo sapiens
gtcagatgagcaaggaca

SEQ ID NO: 6354770 - DNA, 10 bp, Homo sapiens
gtcagatgca

SEQ ID NO: 6354771 - DNA, 22 bp, Homo sapiens
gtcagatgcgtgcccagctctt

SEQ ID NO: 6354772 - DNA, 21 bp, Homo sapiens
gtcagatggaggttctcagag

SEQ ID NO: 6354773 - DNA, 21 bp, Homo sapiens
gtcagatggatgtagatacag

SEQ ID NO: 6354774 - DNA, 18 bp, Homo sapiens
gtcagatgggaagacatg

SEQ ID NO: 6354775 - DNA, 12 bp, Homo sapiens
gtcagatgtggc

SEQ ID NO: 6354776 - DNA, 13 bp, Homo sapiens
gtcagattaaatt

SEQ ID NO: 6354777 - DNA, 13 bp, Homo sapiens
gtcagattcacac

SEQ ID NO: 6354778 - DNA, 14 bp, Homo sapiens
gtcagattcctttc

SEQ ID NO: 6354779 - DNA, 17 bp, Homo sapiens
gtcagattgctgggagg

SEQ ID NO: 6354780 - DNA, 14 bp, Homo sapiens
gtcagatttccagt

SEQ ID NO: 6354781 - DNA, 21 bp, Homo sapiens
gtcagatttccagtctccacc

SEQ ID NO: 6354782 - DNA, 22 bp, Homo sapiens
gtcagatttttaaagttttgta

SEQ ID NO: 6354783 - DNA, 13 bp, Homo sapiens
gtcagatttttat

SEQ ID NO: 6354784 - DNA, 23 bp, Homo sapiens
gtcagcaaaaagcaaaatcattt

SEQ ID NO: 6354785 - DNA, 17 bp, Homo sapiens
gtcagcaaattaattgg

SEQ ID NO: 6354786 - DNA, 13 bp, Homo sapiens
gtcagcacagaga

SEQ ID NO: 6354787 - DNA, 11 bp, Homo sapiens
gtcagcacctt

SEQ ID NO: 6354788 - DNA, 15 bp, Homo sapiens
gtcagcaccttggcc

SEQ ID NO: 6354789 - DNA, 19 bp, Homo sapiens
gtcagcaccttggcccagg

SEQ ID NO: 6354790 - DNA, 20 bp, Homo sapiens
gtcagcaccttggcccagga

SEQ ID NO: 6354791 - DNA, 18 bp, Homo sapiens
gtcagcaggcccaggaga

SEQ ID NO: 6354792 - DNA, 15 bp, Homo sapiens
gtcagcagtcctagc

SEQ ID NO: 6354793 - DNA, 17 bp, Homo sapiens
gtcagcagtcctagccc

SEQ ID NO: 6354794 - DNA, 17 bp, Homo sapiens
gtcagcatcaagcccca

SEQ ID NO: 6354795 - DNA, 18 bp, Homo sapiens
gtcagcatcactgatggg

SEQ ID NO: 6354796 - DNA, 16 bp, Homo sapiens
gtcagcatctggctgt

SEQ ID NO: 6354797 - DNA, 22 bp, Homo sapiens
gtcagcatctttgcccttctgg

SEQ ID NO: 6354798 - DNA, 15 bp, Homo sapiens
gtcagcatgaatttg

SEQ ID NO: 6354799 - DNA, 15 bp, Homo sapiens
gtcagcatgcttccc

SEQ ID NO: 6354800 - DNA, 18 bp, Homo sapiens
gtcagcatgcttcccaga

SEQ ID NO: 6354801 - DNA, 21 bp, Homo sapiens
gtcagcatgcttcccagaggg

SEQ ID NO: 6354802 - DNA, 22 bp, Homo sapiens
gtcagcatgcttcccagaggga

SEQ ID NO: 6354803 - DNA, 15 bp, Homo sapiens
gtcagcatgtctcag

SEQ ID NO: 6354804 - DNA, 23 bp, Homo sapiens
gtcagcatttctagacttccaca

SEQ ID NO: 6354805 - DNA, 15 bp, Homo sapiens
gtcagccaaatgtaa

SEQ ID NO: 6354806 - DNA, 14 bp, Homo sapiens
gtcagccacactgg

SEQ ID NO: 6354807 - DNA, 19 bp, Homo sapiens
gtcagccacactgggcctg

SEQ ID NO: 6354808 - DNA, 20 bp, Homo sapiens
gtcagccacactgggcctgg

SEQ ID NO: 6354809 - DNA, 14 bp, Homo sapiens
gtcagccactgtga

SEQ ID NO: 6354810 - DNA, 21 bp, Homo sapiens
gtcagccagccgccctgggct

SEQ ID NO: 6354811 - DNA, 19 bp, Homo sapiens
gtcagccaggaccataccg

SEQ ID NO: 6354812 - DNA, 13 bp, Homo sapiens
gtcagccagggcc

SEQ ID NO: 6354813 - DNA, 14 bp, Homo sapiens
gtcagccagggcct

SEQ ID NO: 6354814 - DNA, 18 bp, Homo sapiens
gtcagccatcgtcctggg

SEQ ID NO: 6354815 - DNA, 14 bp, Homo sapiens
gtcagccatgggaa

SEQ ID NO: 6354816 - DNA, 12 bp, Homo sapiens
gtcagccatttt

SEQ ID NO: 6354817 - DNA, 22 bp, Homo sapiens
gtcagcccaaaccaccagaagc

SEQ ID NO: 6354818 - DNA, 16 bp, Homo sapiens
gtcagcccacagcagc

SEQ ID NO: 6354819 - DNA, 15 bp, Homo sapiens
gtcagcccagcacct

SEQ ID NO: 6354820 - DNA, 16 bp, Homo sapiens
gtcagcccatggaggc

SEQ ID NO: 6354821 - DNA, 19 bp, Homo sapiens
gtcagcccatggaggcaga

SEQ ID NO: 6354822 - DNA, 15 bp, Homo sapiens
gtcagcccatgtcaa

SEQ ID NO: 6354823 - DNA, 15 bp, Homo sapiens
gtcagccccaagggc

SEQ ID NO: 6354824 - DNA, 20 bp, Homo sapiens
gtcagcccctcttcccttcc

SEQ ID NO: 6354825 - DNA, 13 bp, Homo sapiens
gtcagccctaggg

SEQ ID NO: 6354826 - DNA, 22 bp, Homo sapiens
gtcagccctagggtggagagcc

SEQ ID NO: 6354827 - DNA, 15 bp, Homo sapiens
gtcagccctgtgtct

SEQ ID NO: 6354828 - DNA, 16 bp, Homo sapiens
gtcagccctgtgtctg

SEQ ID NO: 6354829 - DNA, 20 bp, Homo sapiens
gtcagccctgtgtctgtcac

SEQ ID NO: 6354830 - DNA, 10 bp, Homo sapiens
gtcagccctt

SEQ ID NO: 6354831 - DNA, 11 bp, Homo sapiens
gtcagcccttg

SEQ ID NO: 6354832 - DNA, 20 bp, Homo sapiens
gtcagccgagccgggcctgg

SEQ ID NO: 6354833 - DNA, 17 bp, Homo sapiens
gtcagccgggccctgag

SEQ ID NO: 6354834 - DNA, 16 bp, Homo sapiens
gtcagcctccagcctc

SEQ ID NO: 6354835 - DNA, 18 bp, Homo sapiens
gtcagcctccagcctctg

SEQ ID NO: 6354836 - DNA, 14 bp, Homo sapiens
gtcagcctcccaca

SEQ ID NO: 6354837 - DNA, 21 bp, Homo sapiens
gtcagcctctctcccagtcta

SEQ ID NO: 6354838 - DNA, 13 bp, Homo sapiens
gtcagcctggaag

SEQ ID NO: 6354839 - DNA, 21 bp, Homo sapiens
gtcagcctggaagggacagta

SEQ ID NO: 6354840 - DNA, 16 bp, Homo sapiens
gtcagcctggctgggc

SEQ ID NO: 6354841 - DNA, 17 bp, Homo sapiens
gtcagcctggctgggct

SEQ ID NO: 6354842 - DNA, 10 bp, Homo sapiens
gtcagccttg

SEQ ID NO: 6354843 - DNA, 12 bp, Homo sapiens
gtcagccttgac

SEQ ID NO: 6354844 - DNA, 21 bp, Homo sapiens
gtcagcgcaggtttagtttac

SEQ ID NO: 6354845 - DNA, 21 bp, Homo sapiens
gtcagcgcctggcctacccag

SEQ ID NO: 6354846 - DNA, 15 bp, Homo sapiens
gtcagcggcctgggg

SEQ ID NO: 6354847 - DNA, 16 bp, Homo sapiens
gtcagcggcctgggga

SEQ ID NO: 6354848 - DNA, 17 bp, Homo sapiens
gtcagcggcctggggac

SEQ ID NO: 6354849 - DNA, 16 bp, Homo sapiens
gtcagcgggcccaggc

SEQ ID NO: 6354850 - DNA, 19 bp, Homo sapiens
gtcagcggggcagcggggc

SEQ ID NO: 6354851 - DNA, 20 bp, Homo sapiens
gtcagcggggcagcggggct

SEQ ID NO: 6354852 - DNA, 16 bp, Homo sapiens
gtcagcgttgcatgtc

SEQ ID NO: 6354853 - DNA, 19 bp, Homo sapiens
gtcagctactaatgatgtt

SEQ ID NO: 6354854 - DNA, 20 bp, Homo sapiens
gtcagctactctagttctgt

SEQ ID NO: 6354855 - DNA, 13 bp, Homo sapiens
gtcagctcacacc

SEQ ID NO: 6354856 - DNA, 19 bp, Homo sapiens
gtcagctcaggcagctcga

SEQ ID NO: 6354857 - DNA, 22 bp, Homo sapiens
gtcagctcccctcggagaagag

SEQ ID NO: 6354858 - DNA, 23 bp, Homo sapiens
gtcagctcccctcggagaagagc

SEQ ID NO: 6354859 - DNA, 19 bp, Homo sapiens
gtcagctctcatctgaggc

SEQ ID NO: 6354860 - DNA, 15 bp, Homo sapiens
gtcagctctctgccc

SEQ ID NO: 6354861 - DNA, 20 bp, Homo sapiens
gtcagctgaccccctccccc

SEQ ID NO: 6354862 - DNA, 22 bp, Homo sapiens
gtcagctgaccccctcccccca

SEQ ID NO: 6354863 - DNA, 19 bp, Homo sapiens
gtcagctgctgttgaactt

SEQ ID NO: 6354864 - DNA, 13 bp, Homo sapiens
gtcagctgcttct

SEQ ID NO: 6354865 - DNA, 15 bp, Homo sapiens
gtcagctgggagcca

SEQ ID NO: 6354866 - DNA, 16 bp, Homo sapiens
gtcagctgggagccag

SEQ ID NO: 6354867 - DNA, 19 bp, Homo sapiens
gtcagctgggagccagtgt

SEQ ID NO: 6354868 - DNA, 22 bp, Homo sapiens
gtcagctgggagccagtgtgcc

SEQ ID NO: 6354869 - DNA, 20 bp, Homo sapiens
gtcagctggtagctgggggc

SEQ ID NO: 6354870 - DNA, 13 bp, Homo sapiens
gtcagctgtagaa

SEQ ID NO: 6354871 - DNA, 19 bp, Homo sapiens
gtcagctgtgaaggcttca

SEQ ID NO: 6354872 - DNA, 13 bp, Homo sapiens
gtcagctgtgggg

SEQ ID NO: 6354873 - DNA, 23 bp, Homo sapiens
gtcagctgtggggaacacagcta

SEQ ID NO: 6354874 - DNA, 22 bp, Homo sapiens
gtcagctgtttctagagttcct

SEQ ID NO: 6354875 - DNA, 19 bp, Homo sapiens
gtcagcttctcccaagccc

SEQ ID NO: 6354876 - DNA, 15 bp, Homo sapiens
gtcagcttgaatgtc

SEQ ID NO: 6354877 - DNA, 19 bp, Homo sapiens
gtcagctttcagagccagt

SEQ ID NO: 6354878 - DNA, 18 bp, Homo sapiens
gtcagctttgccttccac

SEQ ID NO: 6354879 - DNA, 21 bp, Homo sapiens
gtcagctttggattgctgggg

SEQ ID NO: 6354880 - DNA, 18 bp, Homo sapiens
gtcagcttttgttgttta

SEQ ID NO: 6354881 - DNA, 22 bp, Homo sapiens
gtcaggaaagacaggctgagct

SEQ ID NO: 6354882 - DNA, 13 bp, Homo sapiens
gtcaggaaagaga

SEQ ID NO: 6354883 - DNA, 15 bp, Homo sapiens
gtcaggaacagaagg

SEQ ID NO: 6354884 - DNA, 16 bp, Homo sapiens
gtcaggaacagaagga

SEQ ID NO: 6354885 - DNA, 19 bp, Homo sapiens
gtcaggaacagtggctggg

SEQ ID NO: 6354886 - DNA, 20 bp, Homo sapiens
gtcaggaagcaggggtgggg

SEQ ID NO: 6354887 - DNA, 16 bp, Homo sapiens
gtcaggaccattttag

SEQ ID NO: 6354888 - DNA, 14 bp, Homo sapiens
gtcaggacccaggc

SEQ ID NO: 6354889 - DNA, 15 bp, Homo sapiens
gtcaggacccaggcc

SEQ ID NO: 6354890 - DNA, 15 bp, Homo sapiens
gtcaggacctccggg

SEQ ID NO: 6354891 - DNA, 20 bp, Homo sapiens
gtcaggacctccggggagag

SEQ ID NO: 6354892 - DNA, 12 bp, Homo sapiens
gtcaggagagca

SEQ ID NO: 6354893 - DNA, 20 bp, Homo sapiens
gtcaggagagccctctgctg

SEQ ID NO: 6354894 - DNA, 13 bp, Homo sapiens
gtcaggagcagca

SEQ ID NO: 6354895 - DNA, 16 bp, Homo sapiens
gtcaggagcagcatca

SEQ ID NO: 6354896 - DNA, 17 bp, Homo sapiens
taaccccaggcatccca

SEQ ID NO: 6354897 - DNA, 15 bp, Homo sapiens
taaccccaggccccg

SEQ ID NO: 6354898 - DNA, 21 bp, Homo sapiens
taaccccagggcactgccagc

SEQ ID NO: 6354899 - DNA, 15 bp, Homo sapiens
taaccccattctttg

SEQ ID NO: 6354900 - DNA, 18 bp, Homo sapiens
taacccccagcccacaga

SEQ ID NO: 6354901 - DNA, 22 bp, Homo sapiens
taacccccagcccacagagcct

SEQ ID NO: 6354902 - DNA, 23 bp, Homo sapiens
taaccccgtctgctcctccctcc

SEQ ID NO: 6354903 - DNA, 21 bp, Homo sapiens
taacccctaagactgccttca

SEQ ID NO: 6354904 - DNA, 17 bp, Homo sapiens
taacccctcctggctgt

SEQ ID NO: 6354905 - DNA, 18 bp, Homo sapiens
taacccctcctggctgtg

SEQ ID NO: 6354906 - DNA, 16 bp, Homo sapiens
taaccccttacccatc

SEQ ID NO: 6354907 - DNA, 17 bp, Homo sapiens
taaccccttacccatct

SEQ ID NO: 6354908 - DNA, 13 bp, Homo sapiens
taaccccttgaaa

SEQ ID NO: 6354909 - DNA, 13 bp, Homo sapiens
taacccctttcct

SEQ ID NO: 6354910 - DNA, 14 bp, Homo sapiens
taaccctacaccca

SEQ ID NO: 6354911 - DNA, 20 bp, Homo sapiens
taaccctcacactgctccag

SEQ ID NO: 6354912 - DNA, 16 bp, Homo sapiens
taaccctcactgggac

SEQ ID NO: 6354913 - DNA, 17 bp, Homo sapiens
taaccctcgccctgtcc

SEQ ID NO: 6354914 - DNA, 21 bp, Homo sapiens
taaccctcgccctgtccctcc

SEQ ID NO: 6354915 - DNA, 14 bp, Homo sapiens
taaccctctcttcc

SEQ ID NO: 6354916 - DNA, 15 bp, Homo sapiens
taaccctctcttccc

SEQ ID NO: 6354917 - DNA, 13 bp, Homo sapiens
taaccctgaacaa

SEQ ID NO: 6354918 - DNA, 20 bp, Homo sapiens
taaccctgaatcagaggcag

SEQ ID NO: 6354919 - DNA, 17 bp, Homo sapiens
taaccctggcacttaag

SEQ ID NO: 6354920 - DNA, 16 bp, Homo sapiens
taaccctgtgctgtca

SEQ ID NO: 6354921 - DNA, 13 bp, Homo sapiens
taaccctgtggaa

SEQ ID NO: 6354922 - DNA, 19 bp, Homo sapiens
taaccctgtggaagcatgg

SEQ ID NO: 6354923 - DNA, 14 bp, Homo sapiens
taacccttaatata

SEQ ID NO: 6354924 - DNA, 21 bp, Homo sapiens
taacccttcatcttcctgtgt

SEQ ID NO: 6354925 - DNA, 17 bp, Homo sapiens
taacccttgaatttcta

SEQ ID NO: 6354926 - DNA, 20 bp, Homo sapiens
taaccctttctgggatgcaa

SEQ ID NO: 6354927 - DNA, 21 bp, Homo sapiens
taaccctttcttcaatacaaa

SEQ ID NO: 6354928 - DNA, 20 bp, Homo sapiens
taaccctttggtttttttct

SEQ ID NO: 6354929 - DNA, 21 bp, Homo sapiens
taaccctttgtgtgctctcca

SEQ ID NO: 6354930 - DNA, 22 bp, Homo sapiens
taaccgagatcagtatttaact

SEQ ID NO: 6354931 - DNA, 20 bp, Homo sapiens
taaccgagccagcagctgaa

SEQ ID NO: 6354932 - DNA, 15 bp, Homo sapiens
taaccgatgctttac

SEQ ID NO: 6354933 - DNA, 14 bp, Homo sapiens
taaccgccgcggta

SEQ ID NO: 6354934 - DNA, 21 bp, Homo sapiens
taaccggcatgtttccagcag

SEQ ID NO: 6354935 - DNA, 13 bp, Homo sapiens
taaccgtttttca

SEQ ID NO: 6354936 - DNA, 17 bp, Homo sapiens
taaccgtttttcaagaa

SEQ ID NO: 6354937 - DNA, 18 bp, Homo sapiens
taaccgtttttcaagaaa

SEQ ID NO: 6354938 - DNA, 22 bp, Homo sapiens
taacctaaatgatgttatagaa

SEQ ID NO: 6354939 - DNA, 14 bp, Homo sapiens
taacctaataattg

SEQ ID NO: 6354940 - DNA, 18 bp, Homo sapiens
taacctaataattgtatc

SEQ ID NO: 6354941 - DNA, 22 bp, Homo sapiens
taacctaataattgtatctaca

SEQ ID NO: 6354942 - DNA, 16 bp, Homo sapiens
taacctaatgcagaat

SEQ ID NO: 6354943 - DNA, 22 bp, Homo sapiens
taacctacaaaacgtatttatc

SEQ ID NO: 6354944 - DNA, 15 bp, Homo sapiens
taacctacctgtgaa

SEQ ID NO: 6354945 - DNA, 22 bp, Homo sapiens
taacctacttgtaaacttgaaa

SEQ ID NO: 6354946 - DNA, 17 bp, Homo sapiens
taacctagaagtatttt

SEQ ID NO: 6354947 - DNA, 14 bp, Homo sapiens
taacctaggcagtg

SEQ ID NO: 6354948 - DNA, 22 bp, Homo sapiens
taacctagtttgttactttaaa

SEQ ID NO: 6354949 - DNA, 22 bp, Homo sapiens
taacctatatgatttatagttt

SEQ ID NO: 6354950 - DNA, 15 bp, Homo sapiens
taacctatgataatt

SEQ ID NO: 6354951 - DNA, 22 bp, Homo sapiens
taacctcaagtgatcctcccac

SEQ ID NO: 6354952 - DNA, 20 bp, Homo sapiens
taacctcaatttatgttaac

SEQ ID NO: 6354953 - DNA, 23 bp, Homo sapiens
taacctcaatttatgttaacaga

SEQ ID NO: 6354954 - DNA, 13 bp, Homo sapiens
taacctcagctct

SEQ ID NO: 6354955 - DNA, 19 bp, Homo sapiens
taacctcagctctgggaga

SEQ ID NO: 6354956 - DNA, 23 bp, Homo sapiens
taacctcagtatttatgtaattt

SEQ ID NO: 6354957 - DNA, 17 bp, Homo sapiens
taacctcagtctacccc

SEQ ID NO: 6354958 - DNA, 20 bp, Homo sapiens
taacctcagtgtcatttatg

SEQ ID NO: 6354959 - DNA, 16 bp, Homo sapiens
taacctcccctctccc

SEQ ID NO: 6354960 - DNA, 19 bp, Homo sapiens
taacctccctcaacaaggt

SEQ ID NO: 6354961 - DNA, 22 bp, Homo sapiens
taacctcccttaagcagcaaca

SEQ ID NO: 6354962 - DNA, 11 bp, Homo sapiens
taacctccttt

SEQ ID NO: 6354963 - DNA, 23 bp, Homo sapiens
taacctcggagacgggaccctgc

SEQ ID NO: 6354964 - DNA, 20 bp, Homo sapiens
taacctcgggtgatccaccc

SEQ ID NO: 6354965 - DNA, 15 bp, Homo sapiens
taacctcgtgtctag

SEQ ID NO: 6354966 - DNA, 16 bp, Homo sapiens
taacctctaaattctt

SEQ ID NO: 6354967 - DNA, 18 bp, Homo sapiens
taacctctctaagccaca

SEQ ID NO: 6354968 - DNA, 17 bp, Homo sapiens
taacctctgcttttatc

SEQ ID NO: 6354969 - DNA, 10 bp, Homo sapiens
taacctctgg

SEQ ID NO: 6354970 - DNA, 11 bp, Homo sapiens
taacctctggc

SEQ ID NO: 6354971 - DNA, 13 bp, Homo sapiens
taacctctggccc

SEQ ID NO: 6354972 - DNA, 17 bp, Homo sapiens
taacctctggcccttgg

SEQ ID NO: 6354973 - DNA, 20 bp, Homo sapiens
taacctgaccgtgggcgggg

SEQ ID NO: 6354974 - DNA, 22 bp, Homo sapiens
taacctgagatggccctctggt

SEQ ID NO: 6354975 - DNA, 16 bp, Homo sapiens
taacctgcaaaatctg

SEQ ID NO: 6354976 - DNA, 15 bp, Homo sapiens
taacctgcacaggct

SEQ ID NO: 6354977 - DNA, 19 bp, Homo sapiens
taacctgcacaggcttgct

SEQ ID NO: 6354978 - DNA, 20 bp, Homo sapiens
taacctgcacaggcttgctg

SEQ ID NO: 6354979 - DNA, 17 bp, Homo sapiens
taacctgccagtcccag

SEQ ID NO: 6354980 - DNA, 15 bp, Homo sapiens
taacctggagacagt

SEQ ID NO: 6354981 - DNA, 16 bp, Homo sapiens
taacctggccactgtc

SEQ ID NO: 6354982 - DNA, 19 bp, Homo sapiens
taacctggccactgtccct

SEQ ID NO: 6354983 - DNA, 20 bp, Homo sapiens
taacctggccactgtccctg

SEQ ID NO: 6354984 - DNA, 12 bp, Homo sapiens
taacctgggacc

SEQ ID NO: 6354985 - DNA, 22 bp, Homo sapiens
taacctggtgctggatattttc

SEQ ID NO: 6354986 - DNA, 23 bp, Homo sapiens
taacctggtgctggatattttca

SEQ ID NO: 6354987 - DNA, 12 bp, Homo sapiens
taacctgtgtct

SEQ ID NO: 6354988 - DNA, 22 bp, Homo sapiens
taacctgtgtctgcgaagtcct

SEQ ID NO: 6354989 - DNA, 16 bp, Homo sapiens
taacctgttatttcta

SEQ ID NO: 6354990 - DNA, 15 bp, Homo sapiens
taacctgtttatata

SEQ ID NO: 6354991 - DNA, 17 bp, Homo sapiens
taaccttaaaattgata

SEQ ID NO: 6354992 - DNA, 20 bp, Homo sapiens
taaccttaaaattgatatta

SEQ ID NO: 6354993 - DNA, 14 bp, Homo sapiens
taaccttaaataca

SEQ ID NO: 6354994 - DNA, 15 bp, Homo sapiens
taaccttaaatacac

SEQ ID NO: 6354995 - DNA, 22 bp, Homo sapiens
taaccttatatttacaataaat

SEQ ID NO: 6354996 - DNA, 21 bp, Homo sapiens
taaccttatcctgcattgtta

SEQ ID NO: 6354997 - DNA, 21 bp, Homo sapiens
taaccttcatgcttttttccc

SEQ ID NO: 6354998 - DNA, 18 bp, Homo sapiens
taaccttccaagactgaa

SEQ ID NO: 6354999 - DNA, 18 bp, Homo sapiens
taaccttctattttctat

SEQ ID NO: 6355000 - DNA, 14 bp, Homo sapiens
taaccttgaaatgg

SEQ ID NO: 6355001 - DNA, 19 bp, Homo sapiens
taaccttgaatgctgccag

SEQ ID NO: 6355002 - DNA, 17 bp, Homo sapiens
taaccttgagtcagaaa

SEQ ID NO: 6355003 - DNA, 18 bp, Homo sapiens
taaccttgagtcagaaaa

SEQ ID NO: 6355004 - DNA, 18 bp, Homo sapiens
taacctttaaaaatgtat

SEQ ID NO: 6355005 - DNA, 16 bp, Homo sapiens
taacctttaagtctta

SEQ ID NO: 6355006 - DNA, 14 bp, Homo sapiens
taacctttacatga

SEQ ID NO: 6355007 - DNA, 18 bp, Homo sapiens
taacctttctaaccttca

SEQ ID NO: 6355008 - DNA, 12 bp, Homo sapiens
taacctttctgg

SEQ ID NO: 6355009 - DNA, 16 bp, Homo sapiens
taacctttgctgtagt

SEQ ID NO: 6355010 - DNA, 18 bp, Homo sapiens
taacgaacgttttaaagc

SEQ ID NO: 6355011 - DNA, 20 bp, Homo sapiens
taacgaacgttttaaagctt

SEQ ID NO: 6355012 - DNA, 22 bp, Homo sapiens
taacgaagtgcacttacactta

SEQ ID NO: 6355013 - DNA, 19 bp, Homo sapiens
taacgaagttgggcaatat

SEQ ID NO: 6355014 - DNA, 23 bp, Homo sapiens
taacgaataaaggtcccatgctc

SEQ ID NO: 6355015 - DNA, 19 bp, Homo sapiens
taacgaatttaaaatgtag

SEQ ID NO: 6355016 - DNA, 18 bp, Homo sapiens
taacgacccactctgctt

SEQ ID NO: 6355017 - DNA, 20 bp, Homo sapiens
taacgaccgacgcccctccg

SEQ ID NO: 6355018 - DNA, 12 bp, Homo sapiens
taacgataaaag

SEQ ID NO: 6355019 - DNA, 13 bp, Homo sapiens
taacgatgttgta

SEQ ID NO: 6355020 - DNA, 22 bp, Homo sapiens
taacgattgacaccaaaatgaa

SEQ ID NO: 6355021 - DNA, 23 bp, Homo sapiens
taacgcaccgactagacacacaa

SEQ ID NO: 6355022 - DNA, 14 bp, Homo sapiens
taacgcaggagaat

SEQ ID NO: 6355023 - DNA, 22 bp, Homo sapiens
taacgcgtatctaggctttggt

SEQ ID NO: 6355024 - DNA, 16 bp, Homo sapiens
taacgcgtcttcctga

SEQ ID NO: 6355025 - DNA, 13 bp, Homo sapiens
taacgctgaactg

SEQ ID NO: 6355026 - DNA, 13 bp, Homo sapiens
taacggatcagaa

SEQ ID NO: 6355027 - DNA, 12 bp, Homo sapiens
taacggctccag

SEQ ID NO: 6355028 - DNA, 15 bp, Homo sapiens
taacggctccaggat

SEQ ID NO: 6355029 - DNA, 13 bp, Homo sapiens
taacggctctcca

SEQ ID NO: 6355030 - DNA, 21 bp, Homo sapiens
taacgggacagtaaacactcc

SEQ ID NO: 6355031 - DNA, 16 bp, Homo sapiens
taacgggcatgtatta

SEQ ID NO: 6355032 - DNA, 19 bp, Homo sapiens
taacggtcccccctcactc

SEQ ID NO: 6355033 - DNA, 22 bp, Homo sapiens
taacggtctgttctgtttcaag

SEQ ID NO: 6355034 - DNA, 14 bp, Homo sapiens
taacggtgctaaaa

SEQ ID NO: 6355035 - DNA, 23 bp, Homo sapiens
taacgtatgtatttcattgctgt

SEQ ID NO: 6355036 - DNA, 16 bp, Homo sapiens
taacgtgaaacttata

SEQ ID NO: 6355037 - DNA, 15 bp, Homo sapiens
taacgtgcactgtaa

SEQ ID NO: 6355038 - DNA, 12 bp, Homo sapiens
taacgtggcttg

SEQ ID NO: 6355039 - DNA, 21 bp, Homo sapiens
taacgtgttactggaaaaatt

SEQ ID NO: 6355040 - DNA, 24 bp, Homo sapiens
taacgtgttccagtgtctgtctga

SEQ ID NO: 6355041 - DNA, 17 bp, Homo sapiens
taacgttgctgtgggaa

SEQ ID NO: 6355042 - DNA, 15 bp, Homo sapiens
taacgtttttccttt

SEQ ID NO: 6355043 - DNA, 18 bp, Homo sapiens
taacgtttttcctttaaa

SEQ ID NO: 6355044 - DNA, 19 bp, Homo sapiens
taacgtttttcctttaaaa

SEQ ID NO: 6355045 - DNA, 17 bp, Homo sapiens
taactaaaacaaagcca

SEQ ID NO: 6355046 - DNA, 20 bp, Homo sapiens
taactaaaacaaagccactt

SEQ ID NO: 6355047 - DNA, 19 bp, Homo sapiens
taactaaaataattttgta

SEQ ID NO: 6355048 - DNA, 14 bp, Homo sapiens
taactaaactctct

SEQ ID NO: 6355049 - DNA, 12 bp, Homo sapiens
taactaaagaag

SEQ ID NO: 6355050 - DNA, 13 bp, Homo sapiens
taactaaagaaga

SEQ ID NO: 6355051 - DNA, 14 bp, Homo sapiens
taactaaaggggac

SEQ ID NO: 6355052 - DNA, 15 bp, Homo sapiens
taactaaataaacag

SEQ ID NO: 6355053 - DNA, 13 bp, Homo sapiens
taactaaatgctc

SEQ ID NO: 6355054 - DNA, 18 bp, Homo sapiens
taactaaatttgatactt

SEQ ID NO: 6355055 - DNA, 20 bp, Homo sapiens
taactaaatttgatacttat

SEQ ID NO: 6355056 - DNA, 21 bp, Homo sapiens
taactaaatttgatacttata

SEQ ID NO: 6355057 - DNA, 14 bp, Homo sapiens
taactaaattttaa

SEQ ID NO: 6355058 - DNA, 16 bp, Homo sapiens
taactaacatgtcctg

SEQ ID NO: 6355059 - DNA, 16 bp, Homo sapiens
taactaactaaaacaa

SEQ ID NO: 6355060 - DNA, 18 bp, Homo sapiens
taactaactgcatacact

SEQ ID NO: 6355061 - DNA, 17 bp, Homo sapiens
taactaagactcccgcc

SEQ ID NO: 6355062 - DNA, 13 bp, Homo sapiens
taactaaggaaat

SEQ ID NO: 6355063 - DNA, 18 bp, Homo sapiens
taactaatacaattcatt

SEQ ID NO: 6355064 - DNA, 13 bp, Homo sapiens
taactaatatggt

SEQ ID NO: 6355065 - DNA, 19 bp, Homo sapiens
taactaatctattgggttc

SEQ ID NO: 6355066 - DNA, 17 bp, Homo sapiens
taactaatgtaaatatt

SEQ ID NO: 6355067 - DNA, 15 bp, Homo sapiens
taactaatgttattt

SEQ ID NO: 6355068 - DNA, 12 bp, Homo sapiens
taactaatttaa

SEQ ID NO: 6355069 - DNA, 14 bp, Homo sapiens
taactaatttaaac

SEQ ID NO: 6355070 - DNA, 15 bp, Homo sapiens
taactaatttaaacc

SEQ ID NO: 6355071 - DNA, 14 bp, Homo sapiens
taactaattttgtt

SEQ ID NO: 6355072 - DNA, 16 bp, Homo sapiens
taactacaaagctttg

SEQ ID NO: 6355073 - DNA, 21 bp, Homo sapiens
taactacaaaggtttaaatga

SEQ ID NO: 6355074 - DNA, 23 bp, Homo sapiens
taactacaaaggtttaaatgaac

SEQ ID NO: 6355075 - DNA, 17 bp, Homo sapiens
gtcaggagccagcaggg

SEQ ID NO: 6355076 - DNA, 17 bp, Homo sapiens
gtcaggaggcagaagga

SEQ ID NO: 6355077 - DNA, 16 bp, Homo sapiens
gtcaggagttgtgtct

SEQ ID NO: 6355078 - DNA, 20 bp, Homo sapiens
gtcaggagttttactgcctg

SEQ ID NO: 6355079 - DNA, 18 bp, Homo sapiens
gtcaggatctcatgacat

SEQ ID NO: 6355080 - DNA, 12 bp, Homo sapiens
gtcaggatgacg

SEQ ID NO: 6355081 - DNA, 13 bp, Homo sapiens
gtcaggatgaggc

SEQ ID NO: 6355082 - DNA, 20 bp, Homo sapiens
gtcaggatgcacatttctgg

SEQ ID NO: 6355083 - DNA, 22 bp, Homo sapiens
gtcaggatgcacatttctggat

SEQ ID NO: 6355084 - DNA, 23 bp, Homo sapiens
gtcaggattgcgagagatgtgtg

SEQ ID NO: 6355085 - DNA, 19 bp, Homo sapiens
gtcaggcaatgccctgcgg

SEQ ID NO: 6355086 - DNA, 14 bp, Homo sapiens
gtcaggcagccagt

SEQ ID NO: 6355087 - DNA, 18 bp, Homo sapiens
gtcaggccacagcccctg

SEQ ID NO: 6355088 - DNA, 12 bp, Homo sapiens
gtcaggccacgg

SEQ ID NO: 6355089 - DNA, 17 bp, Homo sapiens
gtcaggccagcctgtcc

SEQ ID NO: 6355090 - DNA, 13 bp, Homo sapiens
gtcaggccaggtg

SEQ ID NO: 6355091 - DNA, 13 bp, Homo sapiens
gtcaggcccggcc

SEQ ID NO: 6355092 - DNA, 16 bp, Homo sapiens
gtcaggcccgtcagca

SEQ ID NO: 6355093 - DNA, 22 bp, Homo sapiens
gtcaggcccgtcagcatcactg

SEQ ID NO: 6355094 - DNA, 18 bp, Homo sapiens
gtcaggcccgtcggagct

SEQ ID NO: 6355095 - DNA, 21 bp, Homo sapiens
gtcaggcccgtcggagctgcc

SEQ ID NO: 6355096 - DNA, 21 bp, Homo sapiens
gtcaggccctctgcctgcact

SEQ ID NO: 6355097 - DNA, 11 bp, Homo sapiens
gtcaggccctg

SEQ ID NO: 6355098 - DNA, 12 bp, Homo sapiens
gtcaggccctgg

SEQ ID NO: 6355099 - DNA, 13 bp, Homo sapiens
gtcaggccctgga

SEQ ID NO: 6355100 - DNA, 14 bp, Homo sapiens
gtcaggccgggcag

SEQ ID NO: 6355101 - DNA, 22 bp, Homo sapiens
gtcaggccgggcagagcacagc

SEQ ID NO: 6355102 - DNA, 17 bp, Homo sapiens
gtcaggcctgggcagga

SEQ ID NO: 6355103 - DNA, 21 bp, Homo sapiens
gtcaggcctgggcaggaccct

SEQ ID NO: 6355104 - DNA, 22 bp, Homo sapiens
gtcaggcctgggcaggaccctg

SEQ ID NO: 6355105 - DNA, 15 bp, Homo sapiens
gtcaggcctgtgtgt

SEQ ID NO: 6355106 - DNA, 18 bp, Homo sapiens
gtcaggcggggtgctgtg

SEQ ID NO: 6355107 - DNA, 16 bp, Homo sapiens
gtcaggctacaaggta

SEQ ID NO: 6355108 - DNA, 18 bp, Homo sapiens
gtcaggctacaggtgccc

SEQ ID NO: 6355109 - DNA, 17 bp, Homo sapiens
gtcaggctccattagga

SEQ ID NO: 6355110 - DNA, 16 bp, Homo sapiens
gtcaggctctctgggc

SEQ ID NO: 6355111 - DNA, 20 bp, Homo sapiens
gtcaggctctctgggctgac

SEQ ID NO: 6355112 - DNA, 13 bp, Homo sapiens
gtcaggctctggc

SEQ ID NO: 6355113 - DNA, 13 bp, Homo sapiens
gtcaggctgctgg

SEQ ID NO: 6355114 - DNA, 16 bp, Homo sapiens
gtcaggctgctggcgc

SEQ ID NO: 6355115 - DNA, 15 bp, Homo sapiens
gtcaggctgggacag

SEQ ID NO: 6355116 - DNA, 14 bp, Homo sapiens
gtcaggctgggcag

SEQ ID NO: 6355117 - DNA, 21 bp, Homo sapiens
gtcaggctgggcagccccaga

SEQ ID NO: 6355118 - DNA, 10 bp, Homo sapiens
gtcagggaca

SEQ ID NO: 6355119 - DNA, 16 bp, Homo sapiens
gtcagggacacatccc

SEQ ID NO: 6355120 - DNA, 18 bp, Homo sapiens
gtcagggacagcagcctc

SEQ ID NO: 6355121 - DNA, 15 bp, Homo sapiens
gtcagggacctgctg

SEQ ID NO: 6355122 - DNA, 20 bp, Homo sapiens
gtcagggacctgctgctcag

SEQ ID NO: 6355123 - DNA, 14 bp, Homo sapiens
gtcagggacttgga

SEQ ID NO: 6355124 - DNA, 17 bp, Homo sapiens
gtcagggacttggacag

SEQ ID NO: 6355125 - DNA, 13 bp, Homo sapiens
gtcagggagaggt

SEQ ID NO: 6355126 - DNA, 15 bp, Homo sapiens
gtcagggagccctgg

SEQ ID NO: 6355127 - DNA, 16 bp, Homo sapiens
gtcagggagccctggg

SEQ ID NO: 6355128 - DNA, 22 bp, Homo sapiens
gtcagggagggccagggaggca

SEQ ID NO: 6355129 - DNA, 22 bp, Homo sapiens
gtcagggatgagttgaggtgat

SEQ ID NO: 6355130 - DNA, 19 bp, Homo sapiens
gtcagggcacagctgccct

SEQ ID NO: 6355131 - DNA, 20 bp, Homo sapiens
gtcagggcacagctgccctg

SEQ ID NO: 6355132 - DNA, 22 bp, Homo sapiens
gtcagggcacagctgccctgct

SEQ ID NO: 6355133 - DNA, 14 bp, Homo sapiens
gtcagggcagggct

SEQ ID NO: 6355134 - DNA, 15 bp, Homo sapiens
gtcagggcagtggcc

SEQ ID NO: 6355135 - DNA, 16 bp, Homo sapiens
gtcagggcagtggcca

SEQ ID NO: 6355136 - DNA, 13 bp, Homo sapiens
gtcagggccagac

SEQ ID NO: 6355137 - DNA, 15 bp, Homo sapiens
gtcagggcccaagtc

SEQ ID NO: 6355138 - DNA, 21 bp, Homo sapiens
gtcagggcccaagtccctgtt

SEQ ID NO: 6355139 - DNA, 16 bp, Homo sapiens
gtcagggcccagaggc

SEQ ID NO: 6355140 - DNA, 19 bp, Homo sapiens
gtcagggcccagaggctga

SEQ ID NO: 6355141 - DNA, 15 bp, Homo sapiens
gtcagggcggggctg

SEQ ID NO: 6355142 - DNA, 11 bp, Homo sapiens
gtcagggctca

SEQ ID NO: 6355143 - DNA, 19 bp, Homo sapiens
gtcaggggagaagctgaag

SEQ ID NO: 6355144 - DNA, 13 bp, Homo sapiens
gtcaggggctctg

SEQ ID NO: 6355145 - DNA, 18 bp, Homo sapiens
gtcaggggctctgtgtta

SEQ ID NO: 6355146 - DNA, 22 bp, Homo sapiens
gtcaggggtcaggtgtcaggcc

SEQ ID NO: 6355147 - DNA, 15 bp, Homo sapiens
gtcaggggtgcacag

SEQ ID NO: 6355148 - DNA, 21 bp, Homo sapiens
gtcaggggtttgcttacagtg

SEQ ID NO: 6355149 - DNA, 17 bp, Homo sapiens
gtcagggtctccttcct

SEQ ID NO: 6355150 - DNA, 18 bp, Homo sapiens
gtcagggtctccttcctt

SEQ ID NO: 6355151 - DNA, 13 bp, Homo sapiens
gtcagggtggctg

SEQ ID NO: 6355152 - DNA, 17 bp, Homo sapiens
gtcagggtgtgaggcca

SEQ ID NO: 6355153 - DNA, 23 bp, Homo sapiens
gtcagggtgtgggatctgaggag

SEQ ID NO: 6355154 - DNA, 18 bp, Homo sapiens
gtcagggttggtgtgctg

SEQ ID NO: 6355155 - DNA, 16 bp, Homo sapiens
gtcagggtttgtcaga

SEQ ID NO: 6355156 - DNA, 22 bp, Homo sapiens
gtcaggtaatatacctggttta

SEQ ID NO: 6355157 - DNA, 15 bp, Homo sapiens
gtcaggtactcctgc

SEQ ID NO: 6355158 - DNA, 15 bp, Homo sapiens
gtcaggtagggggga

SEQ ID NO: 6355159 - DNA, 23 bp, Homo sapiens
gtcaggtcccagcgagccacagg

SEQ ID NO: 6355160 - DNA, 19 bp, Homo sapiens
gtcaggtccccatggcttg

SEQ ID NO: 6355161 - DNA, 21 bp, Homo sapiens
gtcaggtgcctcccagccctg

SEQ ID NO: 6355162 - DNA, 19 bp, Homo sapiens
gtcaggtggactctgggat

SEQ ID NO: 6355163 - DNA, 17 bp, Homo sapiens
gtcaggtggggcagctt

SEQ ID NO: 6355164 - DNA, 15 bp, Homo sapiens
gtcaggttcttgcct

SEQ ID NO: 6355165 - DNA, 18 bp, Homo sapiens
gtcaggttgacaggaggt

SEQ ID NO: 6355166 - DNA, 13 bp, Homo sapiens
gtcaggtttaaca

SEQ ID NO: 6355167 - DNA, 13 bp, Homo sapiens
gtcagtacccacc

SEQ ID NO: 6355168 - DNA, 18 bp, Homo sapiens
gtcagtacccacctgagc

SEQ ID NO: 6355169 - DNA, 19 bp, Homo sapiens
gtcagtacccacctgagct

SEQ ID NO: 6355170 - DNA, 22 bp, Homo sapiens
gtcagtacccctggtaaaccaa

SEQ ID NO: 6355171 - DNA, 22 bp, Homo sapiens
gtcagtaccttcaaactagggc

SEQ ID NO: 6355172 - DNA, 20 bp, Homo sapiens
gtcagtacgatcaagttgtt

SEQ ID NO: 6355173 - DNA, 13 bp, Homo sapiens
gtcagtagccaga

SEQ ID NO: 6355174 - DNA, 15 bp, Homo sapiens
gtcagtagccagagt

SEQ ID NO: 6355175 - DNA, 16 bp, Homo sapiens
gtcagtagccattttt

SEQ ID NO: 6355176 - DNA, 14 bp, Homo sapiens
gtcagtaggagagg

SEQ ID NO: 6355177 - DNA, 17 bp, Homo sapiens
gtcagtaggtccaaggg

SEQ ID NO: 6355178 - DNA, 19 bp, Homo sapiens
gtcagtaggtccaagggcc

SEQ ID NO: 6355179 - DNA, 20 bp, Homo sapiens
gtcagtatctgtatctctct

SEQ ID NO: 6355180 - DNA, 14 bp, Homo sapiens
gtcagtatgacatt

SEQ ID NO: 6355181 - DNA, 20 bp, Homo sapiens
gtcagtattatctaaatgaa

SEQ ID NO: 6355182 - DNA, 16 bp, Homo sapiens
gtcagtatttcaactg

SEQ ID NO: 6355183 - DNA, 18 bp, Homo sapiens
gtcagtatttcaactgct

SEQ ID NO: 6355184 - DNA, 20 bp, Homo sapiens
gtcagtatttcaactgctgt

SEQ ID NO: 6355185 - DNA, 15 bp, Homo sapiens
gtcagtcacaaacca

SEQ ID NO: 6355186 - DNA, 19 bp, Homo sapiens
gtcagtcatgatggcacca

SEQ ID NO: 6355187 - DNA, 22 bp, Homo sapiens
gtcagtcatgatggcaccactg

SEQ ID NO: 6355188 - DNA, 21 bp, Homo sapiens
gtcagtccaaggggtcccctc

SEQ ID NO: 6355189 - DNA, 18 bp, Homo sapiens
gtcagtcccactgcaccc

SEQ ID NO: 6355190 - DNA, 19 bp, Homo sapiens
gtcagtccctacttaggaa

SEQ ID NO: 6355191 - DNA, 12 bp, Homo sapiens
gtcagtctaaca

SEQ ID NO: 6355192 - DNA, 16 bp, Homo sapiens
gtcagtctacaggcct

SEQ ID NO: 6355193 - DNA, 18 bp, Homo sapiens
gtcagtctctctctccct

SEQ ID NO: 6355194 - DNA, 20 bp, Homo sapiens
gtcagtctgcttatccttcc

SEQ ID NO: 6355195 - DNA, 12 bp, Homo sapiens
gtcagtctgtcc

SEQ ID NO: 6355196 - DNA, 21 bp, Homo sapiens
gtcagtgaagcccaggaggac

SEQ ID NO: 6355197 - DNA, 14 bp, Homo sapiens
gtcagtgaggccca

SEQ ID NO: 6355198 - DNA, 16 bp, Homo sapiens
gtcagtgcagcagagg

SEQ ID NO: 6355199 - DNA, 16 bp, Homo sapiens
gtcagtgcagcccgtg

SEQ ID NO: 6355200 - DNA, 19 bp, Homo sapiens
gtcagtgcccatgtgtatg

SEQ ID NO: 6355201 - DNA, 17 bp, Homo sapiens
gtcagtgccgccgcctc

SEQ ID NO: 6355202 - DNA, 23 bp, Homo sapiens
gtcagtgctctcagctggcagtg

SEQ ID NO: 6355203 - DNA, 15 bp, Homo sapiens
gtcagtgctgcctgt

SEQ ID NO: 6355204 - DNA, 16 bp, Homo sapiens
gtcagtgctgcctgtc

SEQ ID NO: 6355205 - DNA, 22 bp, Homo sapiens
gtcagtgctgcctgtccccatg

SEQ ID NO: 6355206 - DNA, 19 bp, Homo sapiens
gtcagtggagagatgtttg

SEQ ID NO: 6355207 - DNA, 16 bp, Homo sapiens
gtcagtggagcctggg

SEQ ID NO: 6355208 - DNA, 16 bp, Homo sapiens
gtcagtggccaggtgc

SEQ ID NO: 6355209 - DNA, 17 bp, Homo sapiens
gtcagtggccaggtgcc

SEQ ID NO: 6355210 - DNA, 16 bp, Homo sapiens
gtcagtgtagacacag

SEQ ID NO: 6355211 - DNA, 20 bp, Homo sapiens
gtcagtgtccaaagcagggt

SEQ ID NO: 6355212 - DNA, 23 bp, Homo sapiens
gtcagtgtccaaagcagggtctg

SEQ ID NO: 6355213 - DNA, 13 bp, Homo sapiens
gtcagtgtcctca

SEQ ID NO: 6355214 - DNA, 15 bp, Homo sapiens
gtcagtgtctggctt

SEQ ID NO: 6355215 - DNA, 21 bp, Homo sapiens
gtcagtgtgccaccctctgca

SEQ ID NO: 6355216 - DNA, 20 bp, Homo sapiens
gtcagtgttgcctcttgcaa

SEQ ID NO: 6355217 - DNA, 14 bp, Homo sapiens
gtcagtgtttcttt

SEQ ID NO: 6355218 - DNA, 23 bp, Homo sapiens
gtcagtgtttcttttaagtatac

SEQ ID NO: 6355219 - DNA, 14 bp, Homo sapiens
gtcagtgtttttga

SEQ ID NO: 6355220 - DNA, 17 bp, Homo sapiens
gtcagttcccggagcac

SEQ ID NO: 6355221 - DNA, 14 bp, Homo sapiens
gtcagttcttggtg

SEQ ID NO: 6355222 - DNA, 18 bp, Homo sapiens
gtcagttggagaaaatga

SEQ ID NO: 6355223 - DNA, 21 bp, Homo sapiens
gtcagttgtaataaatctagg

SEQ ID NO: 6355224 - DNA, 19 bp, Homo sapiens
gtcagttgtgttttttaag

SEQ ID NO: 6355225 - DNA, 14 bp, Homo sapiens
gtcagttgttattt

SEQ ID NO: 6355226 - DNA, 17 bp, Homo sapiens
gtcagttgttatttatt

SEQ ID NO: 6355227 - DNA, 13 bp, Homo sapiens
gtcagtttctaca

SEQ ID NO: 6355228 - DNA, 14 bp, Homo sapiens
gtcagtttggaatg

SEQ ID NO: 6355229 - DNA, 18 bp, Homo sapiens
gtcagttttcacagaggc

SEQ ID NO: 6355230 - DNA, 13 bp, Homo sapiens
gtcagttttcata

SEQ ID NO: 6355231 - DNA, 15 bp, Homo sapiens
gtcagttttgttcac

SEQ ID NO: 6355232 - DNA, 13 bp, Homo sapiens
gtcagtttttcct

SEQ ID NO: 6355233 - DNA, 17 bp, Homo sapiens
gtcagtttttttttgta

SEQ ID NO: 6355234 - DNA, 18 bp, Homo sapiens
gtcagtttttttttgtat

SEQ ID NO: 6355235 - DNA, 18 bp, Homo sapiens
gtcataaaatagaataat

SEQ ID NO: 6355236 - DNA, 14 bp, Homo sapiens
gtcataaaatgcat

SEQ ID NO: 6355237 - DNA, 16 bp, Homo sapiens
gtcataaaatgctatt

SEQ ID NO: 6355238 - DNA, 17 bp, Homo sapiens
gtcataaaatgtctcga

SEQ ID NO: 6355239 - DNA, 19 bp, Homo sapiens
gtcataaattactgttttg

SEQ ID NO: 6355240 - DNA, 22 bp, Homo sapiens
gtcataacatttaaagagattt

SEQ ID NO: 6355241 - DNA, 18 bp, Homo sapiens
gtcataactaaataaagc

SEQ ID NO: 6355242 - DNA, 13 bp, Homo sapiens
gtcataactagaa

SEQ ID NO: 6355243 - DNA, 16 bp, Homo sapiens
gtcataactagagcac

SEQ ID NO: 6355244 - DNA, 18 bp, Homo sapiens
gtcataatctctttccat

SEQ ID NO: 6355245 - DNA, 14 bp, Homo sapiens
gtcataattgcatt

SEQ ID NO: 6355246 - DNA, 19 bp, Homo sapiens
gtcatacaaatttataaag

SEQ ID NO: 6355247 - DNA, 15 bp, Homo sapiens
gtcataccaatgaaa

SEQ ID NO: 6355248 - DNA, 16 bp, Homo sapiens
gtcataccaatgaaaa

SEQ ID NO: 6355249 - DNA, 20 bp, Homo sapiens
gtcatactgtgcaggcctgt

SEQ ID NO: 6355250 - DNA, 12 bp, Homo sapiens
gtcatagaaata

SEQ ID NO: 6355251 - DNA, 13 bp, Homo sapiens
gtcatagaagaac

SEQ ID NO: 6355252 - DNA, 17 bp, Homo sapiens
gtcatagagctgcaggg

SEQ ID NO: 6355253 - DNA, 20 bp, Homo sapiens
gtcatagcaagcttttgctc

SEQ ID NO: 6355254 - DNA, 17 bp, Homo sapiens
gtcatagccaaagccag

SEQ ID NO: 6355255 - DNA, 17 bp, Homo sapiens
taactacaatgatggta

SEQ ID NO: 6355256 - DNA, 12 bp, Homo sapiens
taactacagaaa

SEQ ID NO: 6355257 - DNA, 15 bp, Homo sapiens
taactacatctgcct

SEQ ID NO: 6355258 - DNA, 16 bp, Homo sapiens
taactacatctgcctc

SEQ ID NO: 6355259 - DNA, 19 bp, Homo sapiens
taactacattaaaagcttt

SEQ ID NO: 6355260 - DNA, 14 bp, Homo sapiens
taactacatttatg

SEQ ID NO: 6355261 - DNA, 19 bp, Homo sapiens
taactaccaggaataatga

SEQ ID NO: 6355262 - DNA, 20 bp, Homo sapiens
taactacccttaattactta

SEQ ID NO: 6355263 - DNA, 22 bp, Homo sapiens
taactacccttaattacttaaa

SEQ ID NO: 6355264 - DNA, 22 bp, Homo sapiens
taactacctttggcttaattcc

SEQ ID NO: 6355265 - DNA, 15 bp, Homo sapiens
taactactaagaata

SEQ ID NO: 6355266 - DNA, 22 bp, Homo sapiens
taactactaagaataaataaag

SEQ ID NO: 6355267 - DNA, 21 bp, Homo sapiens
taactactccggagacagggt

SEQ ID NO: 6355268 - DNA, 19 bp, Homo sapiens
taactactgacgaaagagt

SEQ ID NO: 6355269 - DNA, 23 bp, Homo sapiens
taactactgctaatgttgatcag

SEQ ID NO: 6355270 - DNA, 13 bp, Homo sapiens
taactactgtatt

SEQ ID NO: 6355271 - DNA, 18 bp, Homo sapiens
taactactttttatactc

SEQ ID NO: 6355272 - DNA, 20 bp, Homo sapiens
taactagaactgaattttgt

SEQ ID NO: 6355273 - DNA, 13 bp, Homo sapiens
taactagaattag

SEQ ID NO: 6355274 - DNA, 15 bp, Homo sapiens
taactagaatttatt

SEQ ID NO: 6355275 - DNA, 17 bp, Homo sapiens
taactagaatttattca

SEQ ID NO: 6355276 - DNA, 20 bp, Homo sapiens
taactagacaccaaagttct

SEQ ID NO: 6355277 - DNA, 15 bp, Homo sapiens
taactagagtatgtg

SEQ ID NO: 6355278 - DNA, 16 bp, Homo sapiens
taactagatctcctgt

SEQ ID NO: 6355279 - DNA, 16 bp, Homo sapiens
taactagatggtgctg

SEQ ID NO: 6355280 - DNA, 21 bp, Homo sapiens
taactagcataagtggttttc

SEQ ID NO: 6355281 - DNA, 15 bp, Homo sapiens
taactaggctcagag

SEQ ID NO: 6355282 - DNA, 16 bp, Homo sapiens
taactaggctcagaga

SEQ ID NO: 6355283 - DNA, 15 bp, Homo sapiens
taactagtaatacca

SEQ ID NO: 6355284 - DNA, 17 bp, Homo sapiens
taactagtgttgcttgg

SEQ ID NO: 6355285 - DNA, 21 bp, Homo sapiens
taactagtgtttctgcagagg

SEQ ID NO: 6355286 - DNA, 23 bp, Homo sapiens
taactagtgtttctgcagaggca

SEQ ID NO: 6355287 - DNA, 15 bp, Homo sapiens
taactataacaatca

SEQ ID NO: 6355288 - DNA, 18 bp, Homo sapiens
taactataacaatcactg

SEQ ID NO: 6355289 - DNA, 16 bp, Homo sapiens
taactataaggtgcct

SEQ ID NO: 6355290 - DNA, 12 bp, Homo sapiens
taactatataaa

SEQ ID NO: 6355291 - DNA, 22 bp, Homo sapiens
taactatataaatgacattatt

SEQ ID NO: 6355292 - DNA, 19 bp, Homo sapiens
taactatatgtacagctct

SEQ ID NO: 6355293 - DNA, 21 bp, Homo sapiens
taactatcactggtttggttc

SEQ ID NO: 6355294 - DNA, 14 bp, Homo sapiens
taactatcaggcag

SEQ ID NO: 6355295 - DNA, 22 bp, Homo sapiens
taactatcaggcagaagaatct

SEQ ID NO: 6355296 - DNA, 16 bp, Homo sapiens
taactatcgaaatgac

SEQ ID NO: 6355297 - DNA, 19 bp, Homo sapiens
taactatctcacttccaga

SEQ ID NO: 6355298 - DNA, 22 bp, Homo sapiens
taactatctttttgaaagcaat

SEQ ID NO: 6355299 - DNA, 15 bp, Homo sapiens
taactatggtaaata

SEQ ID NO: 6355300 - DNA, 14 bp, Homo sapiens
taactattaacctt

SEQ ID NO: 6355301 - DNA, 15 bp, Homo sapiens
taactattaaccttt

SEQ ID NO: 6355302 - DNA, 17 bp, Homo sapiens
taactattacagtgttg

SEQ ID NO: 6355303 - DNA, 23 bp, Homo sapiens
taactattgcatttatatgtacc

SEQ ID NO: 6355304 - DNA, 13 bp, Homo sapiens
taactatttcaca

SEQ ID NO: 6355305 - DNA, 19 bp, Homo sapiens
taactattttattttctaa

SEQ ID NO: 6355306 - DNA, 17 bp, Homo sapiens
taactattttgttttaa

SEQ ID NO: 6355307 - DNA, 18 bp, Homo sapiens
taactattttgttttaat

SEQ ID NO: 6355308 - DNA, 23 bp, Homo sapiens
taactattttgttttaatctact

SEQ ID NO: 6355309 - DNA, 18 bp, Homo sapiens
taactatttttcctcatt

SEQ ID NO: 6355310 - DNA, 17 bp, Homo sapiens
taactatttttttcaaa

SEQ ID NO: 6355311 - DNA, 15 bp, Homo sapiens
taactcaaatacaca

SEQ ID NO: 6355312 - DNA, 20 bp, Homo sapiens
taactcaaatacacatttgc

SEQ ID NO: 6355313 - DNA, 21 bp, Homo sapiens
taactcaaatacacatttgct

SEQ ID NO: 6355314 - DNA, 23 bp, Homo sapiens
taactcaagatggattaaagact

SEQ ID NO: 6355315 - DNA, 14 bp, Homo sapiens
taactcaatatttt

SEQ ID NO: 6355316 - DNA, 22 bp, Homo sapiens
taactcaatattttccatgaaa

SEQ ID NO: 6355317 - DNA, 19 bp, Homo sapiens
taactcaatcatgaatgaa

SEQ ID NO: 6355318 - DNA, 15 bp, Homo sapiens
taactcaccagcccc

SEQ ID NO: 6355319 - DNA, 21 bp, Homo sapiens
taactcaccagccccactgcc

SEQ ID NO: 6355320 - DNA, 15 bp, Homo sapiens
taactcaccgtgctg

SEQ ID NO: 6355321 - DNA, 14 bp, Homo sapiens
taactcactggaat

SEQ ID NO: 6355322 - DNA, 17 bp, Homo sapiens
taactcagacattccaa

SEQ ID NO: 6355323 - DNA, 13 bp, Homo sapiens
taactcagatcac

SEQ ID NO: 6355324 - DNA, 14 bp, Homo sapiens
taactcagatcact

SEQ ID NO: 6355325 - DNA, 21 bp, Homo sapiens
taactcaggactccagcccat

SEQ ID NO: 6355326 - DNA, 13 bp, Homo sapiens
taactcaggcatt

SEQ ID NO: 6355327 - DNA, 14 bp, Homo sapiens
taactcaggcattt

SEQ ID NO: 6355328 - DNA, 23 bp, Homo sapiens
taactcagtgaaggcccatgaag

SEQ ID NO: 6355329 - DNA, 21 bp, Homo sapiens
taactcataatttttgcagaa

SEQ ID NO: 6355330 - DNA, 16 bp, Homo sapiens
taactcatagtttgtt

SEQ ID NO: 6355331 - DNA, 15 bp, Homo sapiens
taactcatcataaaa

SEQ ID NO: 6355332 - DNA, 17 bp, Homo sapiens
taactcatcataaaata

SEQ ID NO: 6355333 - DNA, 14 bp, Homo sapiens
taactcatctgtta

SEQ ID NO: 6355334 - DNA, 14 bp, Homo sapiens
taactcatgggtac

SEQ ID NO: 6355335 - DNA, 12 bp, Homo sapiens
taactcatttgt

SEQ ID NO: 6355336 - DNA, 16 bp, Homo sapiens
taactccaccaaccca

SEQ ID NO: 6355337 - DNA, 19 bp, Homo sapiens
taactccagatagagaaat

SEQ ID NO: 6355338 - DNA, 14 bp, Homo sapiens
taactccagtgaag

SEQ ID NO: 6355339 - DNA, 14 bp, Homo sapiens
taactcccactcct

SEQ ID NO: 6355340 - DNA, 15 bp, Homo sapiens
taactcccactccta

SEQ ID NO: 6355341 - DNA, 18 bp, Homo sapiens
taactccccctcattcac

SEQ ID NO: 6355342 - DNA, 16 bp, Homo sapiens
taactcccctgtttca

SEQ ID NO: 6355343 - DNA, 23 bp, Homo sapiens
taactcccctgtttcaatcactg

SEQ ID NO: 6355344 - DNA, 23 bp, Homo sapiens
taactccctagttacccacccta

SEQ ID NO: 6355345 - DNA, 17 bp, Homo sapiens
taactccctccaccagc

SEQ ID NO: 6355346 - DNA, 20 bp, Homo sapiens
taactccctccaccagcctg

SEQ ID NO: 6355347 - DNA, 21 bp, Homo sapiens
taactccctccaccagcctgc

SEQ ID NO: 6355348 - DNA, 13 bp, Homo sapiens
taactccctcctc

SEQ ID NO: 6355349 - DNA, 15 bp, Homo sapiens
taactccctcctcac

SEQ ID NO: 6355350 - DNA, 23 bp, Homo sapiens
taactccgagagcagtgggcagg

SEQ ID NO: 6355351 - DNA, 17 bp, Homo sapiens
taactcctaagaggagc

SEQ ID NO: 6355352 - DNA, 17 bp, Homo sapiens
taactcctgtccctttt

SEQ ID NO: 6355353 - DNA, 17 bp, Homo sapiens
taactctaaaagatcct

SEQ ID NO: 6355354 - DNA, 23 bp, Homo sapiens
taactctaaaagatcctttttaa

SEQ ID NO: 6355355 - DNA, 22 bp, Homo sapiens
taactctaattcccattttgca

SEQ ID NO: 6355356 - DNA, 22 bp, Homo sapiens
taactctagggatataaaaaca

SEQ ID NO: 6355357 - DNA, 15 bp, Homo sapiens
taactctattaatga

SEQ ID NO: 6355358 - DNA, 20 bp, Homo sapiens
taactctcaagctaagtaaa

SEQ ID NO: 6355359 - DNA, 19 bp, Homo sapiens
taactctccagccattgta

SEQ ID NO: 6355360 - DNA, 21 bp, Homo sapiens
taactctccagccattgtaat

SEQ ID NO: 6355361 - DNA, 18 bp, Homo sapiens
taactctcgggacctcgt

SEQ ID NO: 6355362 - DNA, 14 bp, Homo sapiens
taactctctttatg

SEQ ID NO: 6355363 - DNA, 15 bp, Homo sapiens
taactctctttcctt

SEQ ID NO: 6355364 - DNA, 12 bp, Homo sapiens
taactctgagag

SEQ ID NO: 6355365 - DNA, 19 bp, Homo sapiens
taactctgatgtaaatgaa

SEQ ID NO: 6355366 - DNA, 22 bp, Homo sapiens
taactctgcatagacaaaggcc

SEQ ID NO: 6355367 - DNA, 18 bp, Homo sapiens
taactctgcccaccctcc

SEQ ID NO: 6355368 - DNA, 20 bp, Homo sapiens
taactctggattttgaatta

SEQ ID NO: 6355369 - DNA, 11 bp, Homo sapiens
taactctggca

SEQ ID NO: 6355370 - DNA, 15 bp, Homo sapiens
taactctgtaagaaa

SEQ ID NO: 6355371 - DNA, 22 bp, Homo sapiens
taactctgtattacagctttca

SEQ ID NO: 6355372 - DNA, 14 bp, Homo sapiens
taactctgtcttca

SEQ ID NO: 6355373 - DNA, 20 bp, Homo sapiens
taactcttaactgaagaaag

SEQ ID NO: 6355374 - DNA, 22 bp, Homo sapiens
taactcttagactgagtaaagt

SEQ ID NO: 6355375 - DNA, 23 bp, Homo sapiens
taactcttctggaaaccaaatag

SEQ ID NO: 6355376 - DNA, 13 bp, Homo sapiens
taactcttgctca

SEQ ID NO: 6355377 - DNA, 22 bp, Homo sapiens
taactcttgctcactccctaaa

SEQ ID NO: 6355378 - DNA, 18 bp, Homo sapiens
taactcttgttttctggt

SEQ ID NO: 6355379 - DNA, 17 bp, Homo sapiens
taactctttgaaactgt

SEQ ID NO: 6355380 - DNA, 16 bp, Homo sapiens
taactctttggctatt

SEQ ID NO: 6355381 - DNA, 16 bp, Homo sapiens
taactcttttctattt

SEQ ID NO: 6355382 - DNA, 14 bp, Homo sapiens
taactgaaaatgaa

SEQ ID NO: 6355383 - DNA, 18 bp, Homo sapiens
taactgaaaatgtaaatt

SEQ ID NO: 6355384 - DNA, 10 bp, Homo sapiens
taactgaaag

SEQ ID NO: 6355385 - DNA, 14 bp, Homo sapiens
taactgaaaggttg

SEQ ID NO: 6355386 - DNA, 16 bp, Homo sapiens
taactgaaataaaaaa

SEQ ID NO: 6355387 - DNA, 15 bp, Homo sapiens
taactgaaatacttt

SEQ ID NO: 6355388 - DNA, 15 bp, Homo sapiens
taactgaaccaaatt

SEQ ID NO: 6355389 - DNA, 20 bp, Homo sapiens
taactgaaccaaattgcact

SEQ ID NO: 6355390 - DNA, 15 bp, Homo sapiens
taactgaactttgaa

SEQ ID NO: 6355391 - DNA, 13 bp, Homo sapiens
taactgaagcaaa

SEQ ID NO: 6355392 - DNA, 15 bp, Homo sapiens
taactgaagcaaata

SEQ ID NO: 6355393 - DNA, 13 bp, Homo sapiens
taactgaagcata

SEQ ID NO: 6355394 - DNA, 18 bp, Homo sapiens
taactgaagcataaacat

SEQ ID NO: 6355395 - DNA, 15 bp, Homo sapiens
taactgaataaaaaa

SEQ ID NO: 6355396 - DNA, 18 bp, Homo sapiens
taactgaataccactctg

SEQ ID NO: 6355397 - DNA, 12 bp, Homo sapiens
taactgacaaat

SEQ ID NO: 6355398 - DNA, 15 bp, Homo sapiens
taactgacaaatcaa

SEQ ID NO: 6355399 - DNA, 18 bp, Homo sapiens
taactgacaaatcaagtt

SEQ ID NO: 6355400 - DNA, 20 bp, Homo sapiens
taactgacaaatcaagtttc

SEQ ID NO: 6355401 - DNA, 17 bp, Homo sapiens
taactgacaagccatct

SEQ ID NO: 6355402 - DNA, 22 bp, Homo sapiens
taactgacaagctccatttaaa

SEQ ID NO: 6355403 - DNA, 20 bp, Homo sapiens
taactgacgaagaagcaact

SEQ ID NO: 6355404 - DNA, 14 bp, Homo sapiens
taactgactattct

SEQ ID NO: 6355405 - DNA, 21 bp, Homo sapiens
taactgactattcttgatgta

SEQ ID NO: 6355406 - DNA, 23 bp, Homo sapiens
taactgactggatggtccagtgt

SEQ ID NO: 6355407 - DNA, 13 bp, Homo sapiens
taactgagagaag

SEQ ID NO: 6355408 - DNA, 17 bp, Homo sapiens
taactgagatattattt

SEQ ID NO: 6355409 - DNA, 20 bp, Homo sapiens
taactgaggcttagaaaggt

SEQ ID NO: 6355410 - DNA, 23 bp, Homo sapiens
taactgagtagctctcctgactt

SEQ ID NO: 6355411 - DNA, 16 bp, Homo sapiens
taactgatctatttat

SEQ ID NO: 6355412 - DNA, 16 bp, Homo sapiens
taactgatgagtaaac

SEQ ID NO: 6355413 - DNA, 17 bp, Homo sapiens
taactgatgagtaaact

SEQ ID NO: 6355414 - DNA, 19 bp, Homo sapiens
taactgattacctgccaat

SEQ ID NO: 6355415 - DNA, 16 bp, Homo sapiens
taactgatttaacact

SEQ ID NO: 6355416 - DNA, 12 bp, Homo sapiens
taactgatttct

SEQ ID NO: 6355417 - DNA, 13 bp, Homo sapiens
taactgatttcta

SEQ ID NO: 6355418 - DNA, 19 bp, Homo sapiens
taactgatttctatggctt

SEQ ID NO: 6355419 - DNA, 23 bp, Homo sapiens
taactgcaaccttgtttattaaa

SEQ ID NO: 6355420 - DNA, 22 bp, Homo sapiens
taactgcacctgggcagctcct

SEQ ID NO: 6355421 - DNA, 17 bp, Homo sapiens
taactgcagaaaaaata

SEQ ID NO: 6355422 - DNA, 16 bp, Homo sapiens
taactgcagttgactt

SEQ ID NO: 6355423 - DNA, 14 bp, Homo sapiens
taactgcatacact

SEQ ID NO: 6355424 - DNA, 14 bp, Homo sapiens
taactgcatataga

SEQ ID NO: 6355425 - DNA, 22 bp, Homo sapiens
taactgcattagaaaccatgaa

SEQ ID NO: 6355426 - DNA, 13 bp, Homo sapiens
taactgcattcta

SEQ ID NO: 6355427 - DNA, 17 bp, Homo sapiens
taactgcattctataat

SEQ ID NO: 6355428 - DNA, 17 bp, Homo sapiens
taactgcattgagaact

SEQ ID NO: 6355429 - DNA, 18 bp, Homo sapiens
taactgcattttacacat

SEQ ID NO: 6355430 - DNA, 23 bp, Homo sapiens
taactgccatcaagatgagagaa

SEQ ID NO: 6355431 - DNA, 16 bp, Homo sapiens
taactgcccagcccct

SEQ ID NO: 6355432 - DNA, 21 bp, Homo sapiens
taactgccctctgaaataatg

SEQ ID NO: 6355433 - DNA, 18 bp, Homo sapiens
gtcatagccttatgagtt

SEQ ID NO: 6355434 - DNA, 16 bp, Homo sapiens
gtcataggaagttagc

SEQ ID NO: 6355435 - DNA, 19 bp, Homo sapiens
gtcatataaacctgatgtt

SEQ ID NO: 6355436 - DNA, 15 bp, Homo sapiens
gtcatatacatattg

SEQ ID NO: 6355437 - DNA, 22 bp, Homo sapiens
gtcatatactgccatgtactag

SEQ ID NO: 6355438 - DNA, 16 bp, Homo sapiens
gtcatatatcaaagca

SEQ ID NO: 6355439 - DNA, 22 bp, Homo sapiens
gtcatatattcatgtaataaat

SEQ ID NO: 6355440 - DNA, 21 bp, Homo sapiens
gtcatatcagctttatccctt

SEQ ID NO: 6355441 - DNA, 14 bp, Homo sapiens
gtcatatgagtcct

SEQ ID NO: 6355442 - DNA, 23 bp, Homo sapiens
gtcatatgctcctagagaggaga

SEQ ID NO: 6355443 - DNA, 12 bp, Homo sapiens
gtcatatgtgtt

SEQ ID NO: 6355444 - DNA, 21 bp, Homo sapiens
gtcatatgtgttgattcttga

SEQ ID NO: 6355445 - DNA, 23 bp, Homo sapiens
gtcatatgtttattcaaaatatt

SEQ ID NO: 6355446 - DNA, 14 bp, Homo sapiens
gtcatattcttatg

SEQ ID NO: 6355447 - DNA, 22 bp, Homo sapiens
gtcatatttcgctatagatttt

SEQ ID NO: 6355448 - DNA, 17 bp, Homo sapiens
gtcatattttcctttat

SEQ ID NO: 6355449 - DNA, 20 bp, Homo sapiens
gtcatattttgattattgta

SEQ ID NO: 6355450 - DNA, 17 bp, Homo sapiens
gtcatcaaaaagagtct

SEQ ID NO: 6355451 - DNA, 17 bp, Homo sapiens
gtcatcaaaacctgcgc

SEQ ID NO: 6355452 - DNA, 13 bp, Homo sapiens
gtcatcaaagcag

SEQ ID NO: 6355453 - DNA, 15 bp, Homo sapiens
gtcatcaaagcagaa

SEQ ID NO: 6355454 - DNA, 19 bp, Homo sapiens
gtcatcaaagcagaagtct

SEQ ID NO: 6355455 - DNA, 23 bp, Homo sapiens
gtcatcaatccaggatgttattc

SEQ ID NO: 6355456 - DNA, 22 bp, Homo sapiens
gtcatcaatgttcagttcaaaa

SEQ ID NO: 6355457 - DNA, 23 bp, Homo sapiens
gtcatcaatttgtaattttagta

SEQ ID NO: 6355458 - DNA, 14 bp, Homo sapiens
gtcatcaccaccct

SEQ ID NO: 6355459 - DNA, 16 bp, Homo sapiens
gtcatcaccacccttc

SEQ ID NO: 6355460 - DNA, 14 bp, Homo sapiens
gtcatcactccctg

SEQ ID NO: 6355461 - DNA, 18 bp, Homo sapiens
gtcatcactccctggatg

SEQ ID NO: 6355462 - DNA, 17 bp, Homo sapiens
gtcatcacttttcagtg

SEQ ID NO: 6355463 - DNA, 19 bp, Homo sapiens
gtcatcagaggggagcagc

SEQ ID NO: 6355464 - DNA, 23 bp, Homo sapiens
gtcatcagaggggagcagcggct

SEQ ID NO: 6355465 - DNA, 23 bp, Homo sapiens
gtcatcagtattgtgtaaaggaa

SEQ ID NO: 6355466 - DNA, 19 bp, Homo sapiens
gtcatcagtcatcaggtgt

SEQ ID NO: 6355467 - DNA, 16 bp, Homo sapiens
gtcatcatcagacttg

SEQ ID NO: 6355468 - DNA, 17 bp, Homo sapiens
gtcatcatcagggcctg

SEQ ID NO: 6355469 - DNA, 20 bp, Homo sapiens
gtcatcatcagggcctgggg

SEQ ID NO: 6355470 - DNA, 18 bp, Homo sapiens
gtcatcatcatggccagc

SEQ ID NO: 6355471 - DNA, 15 bp, Homo sapiens
gtcatcatctccaaa

SEQ ID NO: 6355472 - DNA, 18 bp, Homo sapiens
gtcatcatgaactggctt

SEQ ID NO: 6355473 - DNA, 19 bp, Homo sapiens
gtcatccacacaacaccag

SEQ ID NO: 6355474 - DNA, 21 bp, Homo sapiens
gtcatccacacaacaccagga

SEQ ID NO: 6355475 - DNA, 12 bp, Homo sapiens
gtcatccacagc

SEQ ID NO: 6355476 - DNA, 18 bp, Homo sapiens
gtcatccatgccctccca

SEQ ID NO: 6355477 - DNA, 22 bp, Homo sapiens
gtcatccatgccctcccaggac

SEQ ID NO: 6355478 - DNA, 19 bp, Homo sapiens
gtcatcccagcacctgcca

SEQ ID NO: 6355479 - DNA, 21 bp, Homo sapiens
gtcatcccatcattttccata

SEQ ID NO: 6355480 - DNA, 14 bp, Homo sapiens
gtcatcccattgtc

SEQ ID NO: 6355481 - DNA, 17 bp, Homo sapiens
gtcatcccctctcagga

SEQ ID NO: 6355482 - DNA, 18 bp, Homo sapiens
gtcatcccctctcaggag

SEQ ID NO: 6355483 - DNA, 18 bp, Homo sapiens
gtcatcccgctcctgctg

SEQ ID NO: 6355484 - DNA, 16 bp, Homo sapiens
gtcatcccggggccat

SEQ ID NO: 6355485 - DNA, 14 bp, Homo sapiens
gtcatcccttcctc

SEQ ID NO: 6355486 - DNA, 19 bp, Homo sapiens
gtcatcctcaaagaaagtg

SEQ ID NO: 6355487 - DNA, 22 bp, Homo sapiens
gtcatcctcaaagaaagtgtat

SEQ ID NO: 6355488 - DNA, 13 bp, Homo sapiens
gtcatcctgccct

SEQ ID NO: 6355489 - DNA, 19 bp, Homo sapiens
gtcatcctgccctgcagca

SEQ ID NO: 6355490 - DNA, 12 bp, Homo sapiens
gtcatcctgggc

SEQ ID NO: 6355491 - DNA, 22 bp, Homo sapiens
gtcatccttggtctttgtatct

SEQ ID NO: 6355492 - DNA, 17 bp, Homo sapiens
gtcatcgagatggagct

SEQ ID NO: 6355493 - DNA, 23 bp, Homo sapiens
gtcatcgctcgtgtgttctatcc

SEQ ID NO: 6355494 - DNA, 22 bp, Homo sapiens
gtcatcggaggctgggcccctg

SEQ ID NO: 6355495 - DNA, 19 bp, Homo sapiens
gtcatcgtaggtgatttga

SEQ ID NO: 6355496 - DNA, 18 bp, Homo sapiens
gtcatctaccttttctct

SEQ ID NO: 6355497 - DNA, 21 bp, Homo sapiens
gtcatctagcattaggtatat

SEQ ID NO: 6355498 - DNA, 15 bp, Homo sapiens
gtcatctagcccctt

SEQ ID NO: 6355499 - DNA, 18 bp, Homo sapiens
gtcatctcattccactgt

SEQ ID NO: 6355500 - DNA, 17 bp, Homo sapiens
gtcatctccaaaaacag

SEQ ID NO: 6355501 - DNA, 16 bp, Homo sapiens
gtcatctctcctgtgt

SEQ ID NO: 6355502 - DNA, 17 bp, Homo sapiens
gtcatctctctggggcc

SEQ ID NO: 6355503 - DNA, 23 bp, Homo sapiens
gtcatctgaatttgccctgggaa

SEQ ID NO: 6355504 - DNA, 13 bp, Homo sapiens
gtcatctgagaat

SEQ ID NO: 6355505 - DNA, 21 bp, Homo sapiens
gtcatctgatgagaacaagct

SEQ ID NO: 6355506 - DNA, 13 bp, Homo sapiens
gtcatctggcgga

SEQ ID NO: 6355507 - DNA, 21 bp, Homo sapiens
gtcatctggcggaggtctctg

SEQ ID NO: 6355508 - DNA, 14 bp, Homo sapiens
gtcatctgtaaaat

SEQ ID NO: 6355509 - DNA, 21 bp, Homo sapiens
gtcatctgtaaaatagtctca

SEQ ID NO: 6355510 - DNA, 14 bp, Homo sapiens
gtcatctgtaagag

SEQ ID NO: 6355511 - DNA, 11 bp, Homo sapiens
gtcatctgtca

SEQ ID NO: 6355512 - DNA, 14 bp, Homo sapiens
gtcatcttccctgc

SEQ ID NO: 6355513 - DNA, 15 bp, Homo sapiens
gtcatcttccctgcc

SEQ ID NO: 6355514 - DNA, 19 bp, Homo sapiens
gtcatcttgcacacacttt

SEQ ID NO: 6355515 - DNA, 12 bp, Homo sapiens
gtcatcttgcta

SEQ ID NO: 6355516 - DNA, 14 bp, Homo sapiens
gtcatcttgctacc

SEQ ID NO: 6355517 - DNA, 14 bp, Homo sapiens
gtcatctttttcta

SEQ ID NO: 6355518 - DNA, 16 bp, Homo sapiens
gtcatctttttctaga

SEQ ID NO: 6355519 - DNA, 17 bp, Homo sapiens
gtcatgaaattgttcat

SEQ ID NO: 6355520 - DNA, 18 bp, Homo sapiens
gtcatgaacatggtcaga

SEQ ID NO: 6355521 - DNA, 16 bp, Homo sapiens
gtcatgaagggctgga

SEQ ID NO: 6355522 - DNA, 19 bp, Homo sapiens
gtcatgacagtgcttgcat

SEQ ID NO: 6355523 - DNA, 17 bp, Homo sapiens
gtcatgacatttctcaa

SEQ ID NO: 6355524 - DNA, 19 bp, Homo sapiens
gtcatgactagtgcctaga

SEQ ID NO: 6355525 - DNA, 20 bp, Homo sapiens
gtcatgagaattacagaaaa

SEQ ID NO: 6355526 - DNA, 16 bp, Homo sapiens
gtcatgaggaaagaca

SEQ ID NO: 6355527 - DNA, 14 bp, Homo sapiens
gtcatgatctccct

SEQ ID NO: 6355528 - DNA, 15 bp, Homo sapiens
gtcatgatctccctg

SEQ ID NO: 6355529 - DNA, 20 bp, Homo sapiens
gtcatgatctccctgccgcc

SEQ ID NO: 6355530 - DNA, 19 bp, Homo sapiens
gtcatgatgaatcagtcct

SEQ ID NO: 6355531 - DNA, 19 bp, Homo sapiens
gtcatgatgctctttccca

SEQ ID NO: 6355532 - DNA, 14 bp, Homo sapiens
gtcatgatgtctgc

SEQ ID NO: 6355533 - DNA, 16 bp, Homo sapiens
gtcatgatgtttttaa

SEQ ID NO: 6355534 - DNA, 23 bp, Homo sapiens
gtcatgatgtttttaaaatctta

SEQ ID NO: 6355535 - DNA, 18 bp, Homo sapiens
gtcatgcaaaggctggga

SEQ ID NO: 6355536 - DNA, 21 bp, Homo sapiens
gtcatgcaagtgagaaagaca

SEQ ID NO: 6355537 - DNA, 14 bp, Homo sapiens
gtcatgcactgagg

SEQ ID NO: 6355538 - DNA, 22 bp, Homo sapiens
gtcatgcagagtatttctaaag

SEQ ID NO: 6355539 - DNA, 17 bp, Homo sapiens
gtcatgcagttcctggc

SEQ ID NO: 6355540 - DNA, 17 bp, Homo sapiens
gtcatgcataaatatgc

SEQ ID NO: 6355541 - DNA, 21 bp, Homo sapiens
gtcatgcattgtaatcatcat

SEQ ID NO: 6355542 - DNA, 12 bp, Homo sapiens
gtcatgcccagc

SEQ ID NO: 6355543 - DNA, 16 bp, Homo sapiens
gtcatgccctcctctc

SEQ ID NO: 6355544 - DNA, 19 bp, Homo sapiens
gtcatgcctcactttcttc

SEQ ID NO: 6355545 - DNA, 20 bp, Homo sapiens
gtcatgcgtccactttccct

SEQ ID NO: 6355546 - DNA, 19 bp, Homo sapiens
gtcatgctcacttttgtga

SEQ ID NO: 6355547 - DNA, 21 bp, Homo sapiens
gtcatgctcacttttgtgaaa

SEQ ID NO: 6355548 - DNA, 18 bp, Homo sapiens
gtcatgctcagccttgct

SEQ ID NO: 6355549 - DNA, 17 bp, Homo sapiens
gtcatgctcccctgtgc

SEQ ID NO: 6355550 - DNA, 17 bp, Homo sapiens
gtcatgcttcagttgta

SEQ ID NO: 6355551 - DNA, 12 bp, Homo sapiens
gtcatgcttcat

SEQ ID NO: 6355552 - DNA, 13 bp, Homo sapiens
gtcatgcttttgc

SEQ ID NO: 6355553 - DNA, 18 bp, Homo sapiens
gtcatggaaaagcccagt

SEQ ID NO: 6355554 - DNA, 14 bp, Homo sapiens
gtcatggacagata

SEQ ID NO: 6355555 - DNA, 17 bp, Homo sapiens
gtcatggactgttgcca

SEQ ID NO: 6355556 - DNA, 18 bp, Homo sapiens
gtcatggagaaccaccta

SEQ ID NO: 6355557 - DNA, 13 bp, Homo sapiens
gtcatggagcagc

SEQ ID NO: 6355558 - DNA, 16 bp, Homo sapiens
gtcatggagcagcccc

SEQ ID NO: 6355559 - DNA, 17 bp, Homo sapiens
gtcatggagcagccccc

SEQ ID NO: 6355560 - DNA, 19 bp, Homo sapiens
gtcatggagcagcccccaa

SEQ ID NO: 6355561 - DNA, 22 bp, Homo sapiens
gtcatggccaaatgttcaatat

SEQ ID NO: 6355562 - DNA, 22 bp, Homo sapiens
gtcatggctctgaactgcacaa

SEQ ID NO: 6355563 - DNA, 22 bp, Homo sapiens
gtcatggctgtgccctcttgat

SEQ ID NO: 6355564 - DNA, 15 bp, Homo sapiens
gtcatggcttaatgt

SEQ ID NO: 6355565 - DNA, 15 bp, Homo sapiens
gtcatgggaacgcag

SEQ ID NO: 6355566 - DNA, 18 bp, Homo sapiens
gtcatgggaacgcagcct

SEQ ID NO: 6355567 - DNA, 13 bp, Homo sapiens
gtcatgggagaag

SEQ ID NO: 6355568 - DNA, 23 bp, Homo sapiens
gtcatgggagagtacaccctttc

SEQ ID NO: 6355569 - DNA, 12 bp, Homo sapiens
gtcatgggcctg

SEQ ID NO: 6355570 - DNA, 13 bp, Homo sapiens
gtcatgggcctgt

SEQ ID NO: 6355571 - DNA, 14 bp, Homo sapiens
gtcatggtactacc

SEQ ID NO: 6355572 - DNA, 16 bp, Homo sapiens
gtcatggtagattttt

SEQ ID NO: 6355573 - DNA, 16 bp, Homo sapiens
gtcatggtcacagtaa

SEQ ID NO: 6355574 - DNA, 16 bp, Homo sapiens
gtcatggtcaggggtg

SEQ ID NO: 6355575 - DNA, 21 bp, Homo sapiens
gtcatggtcctttctggaagt

SEQ ID NO: 6355576 - DNA, 20 bp, Homo sapiens
gtcatggtctgagtggggct

SEQ ID NO: 6355577 - DNA, 18 bp, Homo sapiens
gtcatggtgatgcaagtc

SEQ ID NO: 6355578 - DNA, 15 bp, Homo sapiens
gtcatgtaaatactg

SEQ ID NO: 6355579 - DNA, 16 bp, Homo sapiens
gtcatgtaaatactgt

SEQ ID NO: 6355580 - DNA, 16 bp, Homo sapiens
gtcatgtaatactgaa

SEQ ID NO: 6355581 - DNA, 15 bp, Homo sapiens
gtcatgtaccatcaa

SEQ ID NO: 6355582 - DNA, 16 bp, Homo sapiens
gtcatgtaccatcaat

SEQ ID NO: 6355583 - DNA, 15 bp, Homo sapiens
gtcatgtattttatg

SEQ ID NO: 6355584 - DNA, 12 bp, Homo sapiens
gtcatgtctgta

SEQ ID NO: 6355585 - DNA, 16 bp, Homo sapiens
gtcatgtgcatctggt

SEQ ID NO: 6355586 - DNA, 16 bp, Homo sapiens
gtcatgtgcctctgtc

SEQ ID NO: 6355587 - DNA, 18 bp, Homo sapiens
gtcatgtgcctctgtcct

SEQ ID NO: 6355588 - DNA, 19 bp, Homo sapiens
gtcatgtgcgaacacagtg

SEQ ID NO: 6355589 - DNA, 18 bp, Homo sapiens
gtcatgtgggtcttccag

SEQ ID NO: 6355590 - DNA, 20 bp, Homo sapiens
gtcatgtgggtcttccaggg

SEQ ID NO: 6355591 - DNA, 13 bp, Homo sapiens
gtcatgtgtataa

SEQ ID NO: 6355592 - DNA, 13 bp, Homo sapiens
gtcatgtgtgcat

SEQ ID NO: 6355593 - DNA, 14 bp, Homo sapiens
gtcatgtgtgcatg

SEQ ID NO: 6355594 - DNA, 17 bp, Homo sapiens
gtcatgtgtgcatgtga

SEQ ID NO: 6355595 - DNA, 19 bp, Homo sapiens
gtcatgtgtgcatgtgagc

SEQ ID NO: 6355596 - DNA, 15 bp, Homo sapiens
gtcatgtgtgtattt

SEQ ID NO: 6355597 - DNA, 22 bp, Homo sapiens
gtcatgttatgcagtgaactat

SEQ ID NO: 6355598 - DNA, 12 bp, Homo sapiens
gtcatgttctgt

SEQ ID NO: 6355599 - DNA, 14 bp, Homo sapiens
gtcatgttgcttgt

SEQ ID NO: 6355600 - DNA, 18 bp, Homo sapiens
gtcatgttggtaccctgg

SEQ ID NO: 6355601 - DNA, 19 bp, Homo sapiens
gtcatgttggtaccctgga

SEQ ID NO: 6355602 - DNA, 14 bp, Homo sapiens
gtcatgtttattct

SEQ ID NO: 6355603 - DNA, 16 bp, Homo sapiens
gtcatgtttgcagggg

SEQ ID NO: 6355604 - DNA, 23 bp, Homo sapiens
gtcatgtttgcaggggtgacggc

SEQ ID NO: 6355605 - DNA, 16 bp, Homo sapiens
gtcatgttttaaatgt

SEQ ID NO: 6355606 - DNA, 20 bp, Homo sapiens
gtcattaaagtgcactgtgt

SEQ ID NO: 6355607 - DNA, 17 bp, Homo sapiens
gtcattaacacattgtt

SEQ ID NO: 6355608 - DNA, 13 bp, Homo sapiens
gtcattaatgtgt

SEQ ID NO: 6355609 - DNA, 15 bp, Homo sapiens
gtcattaatgttctt

SEQ ID NO: 6355610 - DNA, 21 bp, Homo sapiens
gtcattacttctgagccccag

SEQ ID NO: 6355611 - DNA, 20 bp, Homo sapiens
gtcattagaattgaattatt

SEQ ID NO: 6355612 - DNA, 15 bp, Homo sapiens
taactgccctttccc

SEQ ID NO: 6355613 - DNA, 19 bp, Homo sapiens
taactgcccttttaaatgg

SEQ ID NO: 6355614 - DNA, 11 bp, Homo sapiens
taactgctctt

SEQ ID NO: 6355615 - DNA, 12 bp, Homo sapiens
taactgctcttg

SEQ ID NO: 6355616 - DNA, 16 bp, Homo sapiens
taactgctcttgggca

SEQ ID NO: 6355617 - DNA, 17 bp, Homo sapiens
taactgctcttttacta

SEQ ID NO: 6355618 - DNA, 13 bp, Homo sapiens
taactgctgagcc

SEQ ID NO: 6355619 - DNA, 14 bp, Homo sapiens
taactgctgagcca

SEQ ID NO: 6355620 - DNA, 14 bp, Homo sapiens
taactgctgatttt

SEQ ID NO: 6355621 - DNA, 16 bp, Homo sapiens
taactgcttcaagtgt

SEQ ID NO: 6355622 - DNA, 14 bp, Homo sapiens
taactgctttctgt

SEQ ID NO: 6355623 - DNA, 21 bp, Homo sapiens
taactgctttctgttccaaat

SEQ ID NO: 6355624 - DNA, 15 bp, Homo sapiens
taactggaaaacaga

SEQ ID NO: 6355625 - DNA, 18 bp, Homo sapiens
taactggaaaacagaaca

SEQ ID NO: 6355626 - DNA, 15 bp, Homo sapiens
taactggaaacttca

SEQ ID NO: 6355627 - DNA, 19 bp, Homo sapiens
taactggaacaaattattt

SEQ ID NO: 6355628 - DNA, 22 bp, Homo sapiens
taactggaaggccttccactgt

SEQ ID NO: 6355629 - DNA, 20 bp, Homo sapiens
taactggagaccagaaacct

SEQ ID NO: 6355630 - DNA, 24 bp, Homo sapiens
taactggcagttttccattggttt

SEQ ID NO: 6355631 - DNA, 14 bp, Homo sapiens
taactggcatggat

SEQ ID NO: 6355632 - DNA, 17 bp, Homo sapiens
taactggcatgtcattt

SEQ ID NO: 6355633 - DNA, 13 bp, Homo sapiens
taactggcccaga

SEQ ID NO: 6355634 - DNA, 23 bp, Homo sapiens
taactggctgctccctgctccca

SEQ ID NO: 6355635 - DNA, 21 bp, Homo sapiens
taactggcttctgcttgtcat

SEQ ID NO: 6355636 - DNA, 14 bp, Homo sapiens
taactgggaagaac

SEQ ID NO: 6355637 - DNA, 17 bp, Homo sapiens
taactgggggaaaagat

SEQ ID NO: 6355638 - DNA, 22 bp, Homo sapiens
taactggggtattaactttttt

SEQ ID NO: 6355639 - DNA, 17 bp, Homo sapiens
taactgggtaatgaaac

SEQ ID NO: 6355640 - DNA, 13 bp, Homo sapiens
taactgggttaaa

SEQ ID NO: 6355641 - DNA, 17 bp, Homo sapiens
taactggtgcactttgt

SEQ ID NO: 6355642 - DNA, 19 bp, Homo sapiens
taactgtaaagatgaatgt

SEQ ID NO: 6355643 - DNA, 15 bp, Homo sapiens
taactgtaaagatgt

SEQ ID NO: 6355644 - DNA, 16 bp, Homo sapiens
taactgtaaatcactt

SEQ ID NO: 6355645 - DNA, 17 bp, Homo sapiens
taactgtaaatcacttg

SEQ ID NO: 6355646 - DNA, 19 bp, Homo sapiens
taactgtaaatcacttgta

SEQ ID NO: 6355647 - DNA, 18 bp, Homo sapiens
taactgtaattatttgaa

SEQ ID NO: 6355648 - DNA, 13 bp, Homo sapiens
taactgtacattt

SEQ ID NO: 6355649 - DNA, 14 bp, Homo sapiens
taactgtacatttc

SEQ ID NO: 6355650 - DNA, 18 bp, Homo sapiens
taactgtagctcaagttt

SEQ ID NO: 6355651 - DNA, 21 bp, Homo sapiens
taactgtagctcaagtttaaa

SEQ ID NO: 6355652 - DNA, 21 bp, Homo sapiens
taactgtaggtatgatctctt

SEQ ID NO: 6355653 - DNA, 11 bp, Homo sapiens
taactgtatct

SEQ ID NO: 6355654 - DNA, 17 bp, Homo sapiens
taactgtatttcagtat

SEQ ID NO: 6355655 - DNA, 18 bp, Homo sapiens
taactgtatttcagtatt

SEQ ID NO: 6355656 - DNA, 12 bp, Homo sapiens
taactgtatttt

SEQ ID NO: 6355657 - DNA, 20 bp, Homo sapiens
taactgtattttctttcact

SEQ ID NO: 6355658 - DNA, 18 bp, Homo sapiens
taactgtccagtccagtg

SEQ ID NO: 6355659 - DNA, 15 bp, Homo sapiens
taactgtcctgtcct

SEQ ID NO: 6355660 - DNA, 14 bp, Homo sapiens
taactgtcttctgg

SEQ ID NO: 6355661 - DNA, 16 bp, Homo sapiens
taactgtcttgagaga

SEQ ID NO: 6355662 - DNA, 20 bp, Homo sapiens
taactgtcttgtttcagtga

SEQ ID NO: 6355663 - DNA, 18 bp, Homo sapiens
taactgtgaacaatcaga

SEQ ID NO: 6355664 - DNA, 13 bp, Homo sapiens
taactgtgaagtt

SEQ ID NO: 6355665 - DNA, 17 bp, Homo sapiens
taactgtgaagtttaca

SEQ ID NO: 6355666 - DNA, 12 bp, Homo sapiens
taactgtgataa

SEQ ID NO: 6355667 - DNA, 15 bp, Homo sapiens
taactgtgatgaaat

SEQ ID NO: 6355668 - DNA, 15 bp, Homo sapiens
taactgtgattcttt

SEQ ID NO: 6355669 - DNA, 15 bp, Homo sapiens
taactgtgcactata

SEQ ID NO: 6355670 - DNA, 16 bp, Homo sapiens
taactgtgcagagact

SEQ ID NO: 6355671 - DNA, 14 bp, Homo sapiens
taactgtgcagtga

SEQ ID NO: 6355672 - DNA, 18 bp, Homo sapiens
taactgtgcgttaaataa

SEQ ID NO: 6355673 - DNA, 15 bp, Homo sapiens
taactgtgctgaatg

SEQ ID NO: 6355674 - DNA, 17 bp, Homo sapiens
taactgtgctgtactga

SEQ ID NO: 6355675 - DNA, 17 bp, Homo sapiens
taactgtggaatataaa

SEQ ID NO: 6355676 - DNA, 23 bp, Homo sapiens
taactgtggaatataaatagctg

SEQ ID NO: 6355677 - DNA, 15 bp, Homo sapiens
taactgtgtactgtt

SEQ ID NO: 6355678 - DNA, 11 bp, Homo sapiens
taactgtgtat

SEQ ID NO: 6355679 - DNA, 18 bp, Homo sapiens
taactgtgtatgtacata

SEQ ID NO: 6355680 - DNA, 19 bp, Homo sapiens
taactgtgtatgtacatat

SEQ ID NO: 6355681 - DNA, 15 bp, Homo sapiens
taactgtgtcatttg

SEQ ID NO: 6355682 - DNA, 18 bp, Homo sapiens
taactgtgtgaagaaatg

SEQ ID NO: 6355683 - DNA, 19 bp, Homo sapiens
taactgttaccattggaaa

SEQ ID NO: 6355684 - DNA, 16 bp, Homo sapiens
taactgttatttataa

SEQ ID NO: 6355685 - DNA, 17 bp, Homo sapiens
taactgttatttataat

SEQ ID NO: 6355686 - DNA, 21 bp, Homo sapiens
taactgttatttataatcact

SEQ ID NO: 6355687 - DNA, 15 bp, Homo sapiens
taactgttccccttg

SEQ ID NO: 6355688 - DNA, 16 bp, Homo sapiens
taactgttcccttatc

SEQ ID NO: 6355689 - DNA, 20 bp, Homo sapiens
taactgttcctactttgtat

SEQ ID NO: 6355690 - DNA, 19 bp, Homo sapiens
taactgttctttgcagtga

SEQ ID NO: 6355691 - DNA, 15 bp, Homo sapiens
taactgttgcacttt

SEQ ID NO: 6355692 - DNA, 21 bp, Homo sapiens
taactgttgctcgaagactgt

SEQ ID NO: 6355693 - DNA, 15 bp, Homo sapiens
taactgttgttgaca

SEQ ID NO: 6355694 - DNA, 18 bp, Homo sapiens
taactgttttagaaattg

SEQ ID NO: 6355695 - DNA, 19 bp, Homo sapiens
taactgttttagaaattgg

SEQ ID NO: 6355696 - DNA, 23 bp, Homo sapiens
taactgttttcttcttggtgcta

SEQ ID NO: 6355697 - DNA, 17 bp, Homo sapiens
taacttaaaaatgtaaa

SEQ ID NO: 6355698 - DNA, 20 bp, Homo sapiens
taacttaaaaatgtaaatat

SEQ ID NO: 6355699 - DNA, 14 bp, Homo sapiens
taacttaaaagaac

SEQ ID NO: 6355700 - DNA, 21 bp, Homo sapiens
taacttaaaagaacataggaa

SEQ ID NO: 6355701 - DNA, 14 bp, Homo sapiens
taacttaaataatt

SEQ ID NO: 6355702 - DNA, 14 bp, Homo sapiens
taacttaaatagta

SEQ ID NO: 6355703 - DNA, 18 bp, Homo sapiens
taacttaaatatttgaaa

SEQ ID NO: 6355704 - DNA, 23 bp, Homo sapiens
taacttaacccagattttattta

SEQ ID NO: 6355705 - DNA, 14 bp, Homo sapiens
taacttaactgaag

SEQ ID NO: 6355706 - DNA, 16 bp, Homo sapiens
taacttaactgaagaa

SEQ ID NO: 6355707 - DNA, 17 bp, Homo sapiens
taacttaactgaagaaa

SEQ ID NO: 6355708 - DNA, 13 bp, Homo sapiens
taacttaataatc

SEQ ID NO: 6355709 - DNA, 15 bp, Homo sapiens
taacttaatgaaaac

SEQ ID NO: 6355710 - DNA, 13 bp, Homo sapiens
taacttaatggca

SEQ ID NO: 6355711 - DNA, 14 bp, Homo sapiens
taacttacaaagat

SEQ ID NO: 6355712 - DNA, 17 bp, Homo sapiens
taacttaccctgtatat

SEQ ID NO: 6355713 - DNA, 20 bp, Homo sapiens
taacttacggatttattata

SEQ ID NO: 6355714 - DNA, 12 bp, Homo sapiens
taacttactgtc

SEQ ID NO: 6355715 - DNA, 15 bp, Homo sapiens
taacttagaaaagtg

SEQ ID NO: 6355716 - DNA, 21 bp, Homo sapiens
taacttagactctagtattta

SEQ ID NO: 6355717 - DNA, 13 bp, Homo sapiens
taacttagcttta

SEQ ID NO: 6355718 - DNA, 13 bp, Homo sapiens
taacttagttttt

SEQ ID NO: 6355719 - DNA, 14 bp, Homo sapiens
taacttagttttta

SEQ ID NO: 6355720 - DNA, 23 bp, Homo sapiens
taacttatatcatcagcatacct

SEQ ID NO: 6355721 - DNA, 16 bp, Homo sapiens
taacttatattgaaga

SEQ ID NO: 6355722 - DNA, 20 bp, Homo sapiens
taacttatattgtaagaaat

SEQ ID NO: 6355723 - DNA, 22 bp, Homo sapiens
taacttatctagaaagaaaaga

SEQ ID NO: 6355724 - DNA, 14 bp, Homo sapiens
taacttatctccag

SEQ ID NO: 6355725 - DNA, 18 bp, Homo sapiens
taacttatctccagccaa

SEQ ID NO: 6355726 - DNA, 16 bp, Homo sapiens
taacttatgaagtaaa

SEQ ID NO: 6355727 - DNA, 21 bp, Homo sapiens
taacttatggactgttttgat

SEQ ID NO: 6355728 - DNA, 19 bp, Homo sapiens
taacttatgtacaaggatg

SEQ ID NO: 6355729 - DNA, 22 bp, Homo sapiens
taacttatgtagatatttggct

SEQ ID NO: 6355730 - DNA, 20 bp, Homo sapiens
taacttatgtctcttgttaa

SEQ ID NO: 6355731 - DNA, 14 bp, Homo sapiens
taacttattagcag

SEQ ID NO: 6355732 - DNA, 17 bp, Homo sapiens
taacttattcaaagaga

SEQ ID NO: 6355733 - DNA, 15 bp, Homo sapiens
taacttattgctaga

SEQ ID NO: 6355734 - DNA, 14 bp, Homo sapiens
taacttattgctga

SEQ ID NO: 6355735 - DNA, 16 bp, Homo sapiens
taacttatttagagat

SEQ ID NO: 6355736 - DNA, 14 bp, Homo sapiens
taacttatttataa

SEQ ID NO: 6355737 - DNA, 20 bp, Homo sapiens
taacttatttataaaaagat

SEQ ID NO: 6355738 - DNA, 17 bp, Homo sapiens
taacttatttatatgaa

SEQ ID NO: 6355739 - DNA, 14 bp, Homo sapiens
taacttattttgta

SEQ ID NO: 6355740 - DNA, 21 bp, Homo sapiens
taacttattttgtactagtgt

SEQ ID NO: 6355741 - DNA, 19 bp, Homo sapiens
taacttcagagaagtcagt

SEQ ID NO: 6355742 - DNA, 15 bp, Homo sapiens
taacttcagatgttt

SEQ ID NO: 6355743 - DNA, 20 bp, Homo sapiens
taacttcaggtaaaaacttc

SEQ ID NO: 6355744 - DNA, 22 bp, Homo sapiens
taacttcaggtaaaaacttcat

SEQ ID NO: 6355745 - DNA, 14 bp, Homo sapiens
taacttcagtcact

SEQ ID NO: 6355746 - DNA, 14 bp, Homo sapiens
taacttcatattaa

SEQ ID NO: 6355747 - DNA, 23 bp, Homo sapiens
taacttcatattaatataagttt

SEQ ID NO: 6355748 - DNA, 12 bp, Homo sapiens
taacttcattgt

SEQ ID NO: 6355749 - DNA, 17 bp, Homo sapiens
taacttcattgtttgga

SEQ ID NO: 6355750 - DNA, 13 bp, Homo sapiens
taacttcattttt

SEQ ID NO: 6355751 - DNA, 19 bp, Homo sapiens
taacttccaaataaataat

SEQ ID NO: 6355752 - DNA, 20 bp, Homo sapiens
taacttccacagggtcccac

SEQ ID NO: 6355753 - DNA, 23 bp, Homo sapiens
taacttccacagggtcccacagc

SEQ ID NO: 6355754 - DNA, 17 bp, Homo sapiens
taacttccactttgtat

SEQ ID NO: 6355755 - DNA, 17 bp, Homo sapiens
taacttccatgttctgg

SEQ ID NO: 6355756 - DNA, 18 bp, Homo sapiens
taacttccatgttctggg

SEQ ID NO: 6355757 - DNA, 21 bp, Homo sapiens
taacttccctgaaaaatctaa

SEQ ID NO: 6355758 - DNA, 12 bp, Homo sapiens
taacttcctctt

SEQ ID NO: 6355759 - DNA, 10 bp, Homo sapiens
taacttcctg

SEQ ID NO: 6355760 - DNA, 22 bp, Homo sapiens
taacttcctgctgcaccctgcg

SEQ ID NO: 6355761 - DNA, 13 bp, Homo sapiens
taacttcctggct

SEQ ID NO: 6355762 - DNA, 14 bp, Homo sapiens
taacttccttgccc

SEQ ID NO: 6355763 - DNA, 12 bp, Homo sapiens
taacttctaaaa

SEQ ID NO: 6355764 - DNA, 14 bp, Homo sapiens
taacttctaaaact

SEQ ID NO: 6355765 - DNA, 16 bp, Homo sapiens
taacttctaaaactgt

SEQ ID NO: 6355766 - DNA, 18 bp, Homo sapiens
taacttctaaaactgtac

SEQ ID NO: 6355767 - DNA, 23 bp, Homo sapiens
taacttctaaaactgtactttga

SEQ ID NO: 6355768 - DNA, 18 bp, Homo sapiens
taacttctatattttaat

SEQ ID NO: 6355769 - DNA, 23 bp, Homo sapiens
taacttctatattttaatagaaa

SEQ ID NO: 6355770 - DNA, 17 bp, Homo sapiens
taacttctcatgtatat

SEQ ID NO: 6355771 - DNA, 17 bp, Homo sapiens
taacttcttgaaaaaga

SEQ ID NO: 6355772 - DNA, 21 bp, Homo sapiens
taacttcttgaaaaagatggc

SEQ ID NO: 6355773 - DNA, 12 bp, Homo sapiens
taacttcttgct

SEQ ID NO: 6355774 - DNA, 12 bp, Homo sapiens
taacttctttct

SEQ ID NO: 6355775 - DNA, 17 bp, Homo sapiens
taacttctttgaagtta

SEQ ID NO: 6355776 - DNA, 13 bp, Homo sapiens
taacttgaaaaga

SEQ ID NO: 6355777 - DNA, 17 bp, Homo sapiens
taacttgaaaagaaaac

SEQ ID NO: 6355778 - DNA, 19 bp, Homo sapiens
taacttgaaaagattgcaa

SEQ ID NO: 6355779 - DNA, 22 bp, Homo sapiens
taacttgaacctatgaagcaat

SEQ ID NO: 6355780 - DNA, 22 bp, Homo sapiens
taacttgaatttggtctgtata

SEQ ID NO: 6355781 - DNA, 19 bp, Homo sapiens
taacttgagattcaagaca

SEQ ID NO: 6355782 - DNA, 22 bp, Homo sapiens
taacttgagattcaagacaaga

SEQ ID NO: 6355783 - DNA, 21 bp, Homo sapiens
taacttgagttttatttattt

SEQ ID NO: 6355784 - DNA, 23 bp, Homo sapiens
taacttgatagggtctaccaata

SEQ ID NO: 6355785 - DNA, 19 bp, Homo sapiens
taacttgatccatttctaa

SEQ ID NO: 6355786 - DNA, 14 bp, Homo sapiens
taacttgatcttgt

SEQ ID NO: 6355787 - DNA, 13 bp, Homo sapiens
taacttgatgcat

SEQ ID NO: 6355788 - DNA, 16 bp, Homo sapiens
taacttgatgcatgtg

SEQ ID NO: 6355789 - DNA, 13 bp, Homo sapiens
taacttgcctcca

SEQ ID NO: 6355790 - DNA, 19 bp, Homo sapiens
taacttgcctccatctttt

SEQ ID NO: 6355791 - DNA, 18 bp, Homo sapiens
taacttgctgtgaaatga

SEQ ID NO: 6355792 - DNA, 23 bp, Homo sapiens
taacttggagagggacgaagaaa

SEQ ID NO: 6355793 - DNA, 16 bp, Homo sapiens
gtcattagactcctcc

SEQ ID NO: 6355794 - DNA, 19 bp, Homo sapiens
gtcattagcctgagtagaa

SEQ ID NO: 6355795 - DNA, 20 bp, Homo sapiens
gtcattatattctaattaaa

SEQ ID NO: 6355796 - DNA, 12 bp, Homo sapiens
gtcattatgaca

SEQ ID NO: 6355797 - DNA, 23 bp, Homo sapiens
gtcattatgatttcattatcaca

SEQ ID NO: 6355798 - DNA, 23 bp, Homo sapiens
gtcattatgtagctgtcgtacat

SEQ ID NO: 6355799 - DNA, 20 bp, Homo sapiens
gtcattatttattgttaaat

SEQ ID NO: 6355800 - DNA, 19 bp, Homo sapiens
gtcattatttgataacatt

SEQ ID NO: 6355801 - DNA, 22 bp, Homo sapiens
gtcattatttgataacattttg

SEQ ID NO: 6355802 - DNA, 21 bp, Homo sapiens
gtcattattttgggaagaaaa

SEQ ID NO: 6355803 - DNA, 23 bp, Homo sapiens
gtcattatttttgttagcaaaga

SEQ ID NO: 6355804 - DNA, 15 bp, Homo sapiens
gtcattcaataaatt

SEQ ID NO: 6355805 - DNA, 14 bp, Homo sapiens
gtcattcagaaaaa

SEQ ID NO: 6355806 - DNA, 12 bp, Homo sapiens
gtcattcagttc

SEQ ID NO: 6355807 - DNA, 17 bp, Homo sapiens
gtcattcagttctaggc

SEQ ID NO: 6355808 - DNA, 12 bp, Homo sapiens
gtcattcatatt

SEQ ID NO: 6355809 - DNA, 22 bp, Homo sapiens
gtcattccaagaactataaact

SEQ ID NO: 6355810 - DNA, 18 bp, Homo sapiens
gtcattccacacatttcc

SEQ ID NO: 6355811 - DNA, 17 bp, Homo sapiens
gtcattcctaatgcatt

SEQ ID NO: 6355812 - DNA, 14 bp, Homo sapiens
gtcattcctgtcaa

SEQ ID NO: 6355813 - DNA, 17 bp, Homo sapiens
gtcattccttcttttta

SEQ ID NO: 6355814 - DNA, 21 bp, Homo sapiens
gtcattcgtggttgatttcaa

SEQ ID NO: 6355815 - DNA, 21 bp, Homo sapiens
gtcattctaggatgtggagct

SEQ ID NO: 6355816 - DNA, 12 bp, Homo sapiens
gtcattctgcct

SEQ ID NO: 6355817 - DNA, 13 bp, Homo sapiens
gtcattctgcctg

SEQ ID NO: 6355818 - DNA, 20 bp, Homo sapiens
gtcattctgcctgccctgaa

SEQ ID NO: 6355819 - DNA, 18 bp, Homo sapiens
gtcattctgcctgctcca

SEQ ID NO: 6355820 - DNA, 17 bp, Homo sapiens
gtcattcttttgccaca

SEQ ID NO: 6355821 - DNA, 13 bp, Homo sapiens
gtcattgacctct

SEQ ID NO: 6355822 - DNA, 16 bp, Homo sapiens
gtcattgacctctcag

SEQ ID NO: 6355823 - DNA, 15 bp, Homo sapiens
gtcattgactcttgc

SEQ ID NO: 6355824 - DNA, 21 bp, Homo sapiens
gtcattgactcttgcgtgtca

SEQ ID NO: 6355825 - DNA, 20 bp, Homo sapiens
gtcattgacttcattttata

SEQ ID NO: 6355826 - DNA, 22 bp, Homo sapiens
gtcattgacttcattttatatt

SEQ ID NO: 6355827 - DNA, 23 bp, Homo sapiens
gtcattgataataatatagtttt

SEQ ID NO: 6355828 - DNA, 22 bp, Homo sapiens
gtcattgatgtaatttaaaact

SEQ ID NO: 6355829 - DNA, 18 bp, Homo sapiens
gtcattgcacctatctca

SEQ ID NO: 6355830 - DNA, 22 bp, Homo sapiens
gtcattgcacctatctcagcca

SEQ ID NO: 6355831 - DNA, 23 bp, Homo sapiens
gtcattgcacctatctcagccat

SEQ ID NO: 6355832 - DNA, 15 bp, Homo sapiens
gtcattgcccacttc

SEQ ID NO: 6355833 - DNA, 16 bp, Homo sapiens
gtcattgcccacttct

SEQ ID NO: 6355834 - DNA, 13 bp, Homo sapiens
gtcattgcccctc

SEQ ID NO: 6355835 - DNA, 22 bp, Homo sapiens
gtcattgctgttgtccctctgc

SEQ ID NO: 6355836 - DNA, 12 bp, Homo sapiens
gtcattgcttct

SEQ ID NO: 6355837 - DNA, 22 bp, Homo sapiens
gtcattgcttcttctgaggcct

SEQ ID NO: 6355838 - DNA, 17 bp, Homo sapiens
gtcattggctttatcct

SEQ ID NO: 6355839 - DNA, 17 bp, Homo sapiens
gtcattggttacaaatt

SEQ ID NO: 6355840 - DNA, 18 bp, Homo sapiens
gtcattgtaacctcgtgt

SEQ ID NO: 6355841 - DNA, 21 bp, Homo sapiens
gtcattgtaacctcgtgtcta

SEQ ID NO: 6355842 - DNA, 13 bp, Homo sapiens
gtcattgtaatgt

SEQ ID NO: 6355843 - DNA, 13 bp, Homo sapiens
gtcatttaaatgt

SEQ ID NO: 6355844 - DNA, 23 bp, Homo sapiens
gtcatttaactgaagatgttgag

SEQ ID NO: 6355845 - DNA, 20 bp, Homo sapiens
gtcatttactcaaaatctgt

SEQ ID NO: 6355846 - DNA, 23 bp, Homo sapiens
gtcatttatatagattataactt

SEQ ID NO: 6355847 - DNA, 14 bp, Homo sapiens
gtcatttatgagca

SEQ ID NO: 6355848 - DNA, 21 bp, Homo sapiens
gtcatttattttaaaaaatga

SEQ ID NO: 6355849 - DNA, 12 bp, Homo sapiens
gtcatttcaggc

SEQ ID NO: 6355850 - DNA, 16 bp, Homo sapiens
gtcatttcattccatt

SEQ ID NO: 6355851 - DNA, 20 bp, Homo sapiens
gtcatttcattccattgcct

SEQ ID NO: 6355852 - DNA, 19 bp, Homo sapiens
gtcatttcattgcactgga

SEQ ID NO: 6355853 - DNA, 21 bp, Homo sapiens
gtcatttccaaattcctagaa

SEQ ID NO: 6355854 - DNA, 12 bp, Homo sapiens
gtcatttccaga

SEQ ID NO: 6355855 - DNA, 21 bp, Homo sapiens
gtcatttccatgtatgcataa

SEQ ID NO: 6355856 - DNA, 11 bp, Homo sapiens
gtcatttctct

SEQ ID NO: 6355857 - DNA, 16 bp, Homo sapiens
gtcatttctctttcaa

SEQ ID NO: 6355858 - DNA, 12 bp, Homo sapiens
gtcatttctgat

SEQ ID NO: 6355859 - DNA, 21 bp, Homo sapiens
gtcatttcttctctctgtgct

SEQ ID NO: 6355860 - DNA, 22 bp, Homo sapiens
gtcatttcttctctctgtgctg

SEQ ID NO: 6355861 - DNA, 22 bp, Homo sapiens
gtcatttgactgtctcactttt

SEQ ID NO: 6355862 - DNA, 19 bp, Homo sapiens
gtcatttgagcagggctca

SEQ ID NO: 6355863 - DNA, 21 bp, Homo sapiens
gtcatttgagcagggctcagc

SEQ ID NO: 6355864 - DNA, 17 bp, Homo sapiens
gtcatttgagtctctta

SEQ ID NO: 6355865 - DNA, 21 bp, Homo sapiens
gtcatttgcgcacaacttaaa

SEQ ID NO: 6355866 - DNA, 15 bp, Homo sapiens
gtcatttgctaatga

SEQ ID NO: 6355867 - DNA, 22 bp, Homo sapiens
gtcatttgctaatgaattttaa

SEQ ID NO: 6355868 - DNA, 22 bp, Homo sapiens
gtcatttgctgagcatgtactg

SEQ ID NO: 6355869 - DNA, 15 bp, Homo sapiens
gtcatttgtagatat

SEQ ID NO: 6355870 - DNA, 17 bp, Homo sapiens
gtcatttgtagatatat

SEQ ID NO: 6355871 - DNA, 20 bp, Homo sapiens
gtcattttacaagcattaga

SEQ ID NO: 6355872 - DNA, 15 bp, Homo sapiens
gtcattttagctcaa

SEQ ID NO: 6355873 - DNA, 20 bp, Homo sapiens
gtcattttatgaatatcatt

SEQ ID NO: 6355874 - DNA, 18 bp, Homo sapiens
gtcattttattttgtaat

SEQ ID NO: 6355875 - DNA, 19 bp, Homo sapiens
gtcattttctgttatacac

SEQ ID NO: 6355876 - DNA, 13 bp, Homo sapiens
gtcattttcttga

SEQ ID NO: 6355877 - DNA, 18 bp, Homo sapiens
gtcattttgactggcttg

SEQ ID NO: 6355878 - DNA, 19 bp, Homo sapiens
gtcattttgcagaggctat

SEQ ID NO: 6355879 - DNA, 18 bp, Homo sapiens
gtcattttgcttcatagc

SEQ ID NO: 6355880 - DNA, 17 bp, Homo sapiens
gtcattttggcatctgc

SEQ ID NO: 6355881 - DNA, 21 bp, Homo sapiens
gtcattttggcatctgcaaag

SEQ ID NO: 6355882 - DNA, 14 bp, Homo sapiens
gtcattttgtaata

SEQ ID NO: 6355883 - DNA, 15 bp, Homo sapiens
gtcattttgtaatat

SEQ ID NO: 6355884 - DNA, 18 bp, Homo sapiens
gtcattttgtgttgaaga

SEQ ID NO: 6355885 - DNA, 14 bp, Homo sapiens
gtcatttttaatgt

SEQ ID NO: 6355886 - DNA, 19 bp, Homo sapiens
gtcatttttaatgtatcta

SEQ ID NO: 6355887 - DNA, 17 bp, Homo sapiens
gtcatttttacaatgta

SEQ ID NO: 6355888 - DNA, 16 bp, Homo sapiens
gtcatttttgtatttt

SEQ ID NO: 6355889 - DNA, 14 bp, Homo sapiens
gtcattttttactt

SEQ ID NO: 6355890 - DNA, 15 bp, Homo sapiens
gtccaaaaaaaggaa

SEQ ID NO: 6355891 - DNA, 17 bp, Homo sapiens
gtccaaaaaaaggaaaa

SEQ ID NO: 6355892 - DNA, 21 bp, Homo sapiens
gtccaaaaaaaggaaaaataa

SEQ ID NO: 6355893 - DNA, 17 bp, Homo sapiens
gtccaaaagcgccctca

SEQ ID NO: 6355894 - DNA, 20 bp, Homo sapiens
gtccaaaataaaacctcagc

SEQ ID NO: 6355895 - DNA, 22 bp, Homo sapiens
gtccaaaataaaacctcagcta

SEQ ID NO: 6355896 - DNA, 21 bp, Homo sapiens
gtccaaaatttatattttaga

SEQ ID NO: 6355897 - DNA, 21 bp, Homo sapiens
gtccaaacccttcaactcctg

SEQ ID NO: 6355898 - DNA, 22 bp, Homo sapiens
gtccaaaccttctaccctgggt

SEQ ID NO: 6355899 - DNA, 17 bp, Homo sapiens
gtccaaagcagggtctg

SEQ ID NO: 6355900 - DNA, 17 bp, Homo sapiens
gtccaaagctgaaaatg

SEQ ID NO: 6355901 - DNA, 20 bp, Homo sapiens
gtccaaagctgaaaatgtgt

SEQ ID NO: 6355902 - DNA, 23 bp, Homo sapiens
gtccaaaggagtgcatggccaca

SEQ ID NO: 6355903 - DNA, 15 bp, Homo sapiens
gtccaaaggccagcg

SEQ ID NO: 6355904 - DNA, 20 bp, Homo sapiens
gtccaaagtgcgtgtgtgta

SEQ ID NO: 6355905 - DNA, 22 bp, Homo sapiens
gtccaaagtgcgtgtgtgtatg

SEQ ID NO: 6355906 - DNA, 11 bp, Homo sapiens
gtccaaataaa

SEQ ID NO: 6355907 - DNA, 13 bp, Homo sapiens
gtccaaataaaaa

SEQ ID NO: 6355908 - DNA, 20 bp, Homo sapiens
gtccaaataacaagtaccaa

SEQ ID NO: 6355909 - DNA, 17 bp, Homo sapiens
gtccaaatctccaagtg

SEQ ID NO: 6355910 - DNA, 19 bp, Homo sapiens
gtccaaatgtgatcaactg

SEQ ID NO: 6355911 - DNA, 16 bp, Homo sapiens
gtccaaattgtttgta

SEQ ID NO: 6355912 - DNA, 22 bp, Homo sapiens
gtccaacaagaatgcattccct

SEQ ID NO: 6355913 - DNA, 23 bp, Homo sapiens
gtccaacaataaacaggaatttt

SEQ ID NO: 6355914 - DNA, 15 bp, Homo sapiens
gtccaacagagtgga

SEQ ID NO: 6355915 - DNA, 22 bp, Homo sapiens
gtccaacagtttgatgctgagt

SEQ ID NO: 6355916 - DNA, 13 bp, Homo sapiens
gtccaacatggtg

SEQ ID NO: 6355917 - DNA, 15 bp, Homo sapiens
gtccaacatgtttta

SEQ ID NO: 6355918 - DNA, 16 bp, Homo sapiens
gtccaacatgttttat

SEQ ID NO: 6355919 - DNA, 14 bp, Homo sapiens
gtccaaccagactt

SEQ ID NO: 6355920 - DNA, 20 bp, Homo sapiens
gtccaacccgaggcccgcat

SEQ ID NO: 6355921 - DNA, 14 bp, Homo sapiens
gtccaacctaaccc

SEQ ID NO: 6355922 - DNA, 21 bp, Homo sapiens
gtccaacctaacccctttcct

SEQ ID NO: 6355923 - DNA, 15 bp, Homo sapiens
gtccaacgccgcctt

SEQ ID NO: 6355924 - DNA, 21 bp, Homo sapiens
gtccaacgtggggcagcacag

SEQ ID NO: 6355925 - DNA, 15 bp, Homo sapiens
gtccaactactaaac

SEQ ID NO: 6355926 - DNA, 21 bp, Homo sapiens
gtccaactcttccacctctgg

SEQ ID NO: 6355927 - DNA, 23 bp, Homo sapiens
gtccaactcttccacctctgggg

SEQ ID NO: 6355928 - DNA, 16 bp, Homo sapiens
gtccaagaagcccagg

SEQ ID NO: 6355929 - DNA, 19 bp, Homo sapiens
gtccaagacagggctcatt

SEQ ID NO: 6355930 - DNA, 21 bp, Homo sapiens
gtccaagaccagactcgccaa

SEQ ID NO: 6355931 - DNA, 20 bp, Homo sapiens
gtccaagattccggatccta

SEQ ID NO: 6355932 - DNA, 22 bp, Homo sapiens
gtccaagattccggatcctaag

SEQ ID NO: 6355933 - DNA, 22 bp, Homo sapiens
gtccaagcaacagcctttgaat

SEQ ID NO: 6355934 - DNA, 13 bp, Homo sapiens
gtccaagcagatt

SEQ ID NO: 6355935 - DNA, 20 bp, Homo sapiens
gtccaagccgtaggacccag

SEQ ID NO: 6355936 - DNA, 15 bp, Homo sapiens
gtccaagctgggaga

SEQ ID NO: 6355937 - DNA, 17 bp, Homo sapiens
gtccaaggacaccctcc

SEQ ID NO: 6355938 - DNA, 21 bp, Homo sapiens
gtccaaggcagttctgtgtcc

SEQ ID NO: 6355939 - DNA, 16 bp, Homo sapiens
gtccaaggctggtccc

SEQ ID NO: 6355940 - DNA, 17 bp, Homo sapiens
gtccaaggtggcagatg

SEQ ID NO: 6355941 - DNA, 23 bp, Homo sapiens
gtccaaggtggcagatgtcttcc

SEQ ID NO: 6355942 - DNA, 15 bp, Homo sapiens
gtccaagtgtgtgtg

SEQ ID NO: 6355943 - DNA, 17 bp, Homo sapiens
gtccaagtgtttcttgt

SEQ ID NO: 6355944 - DNA, 19 bp, Homo sapiens
gtccaagttcttcacctct

SEQ ID NO: 6355945 - DNA, 12 bp, Homo sapiens
gtccaataagac

SEQ ID NO: 6355946 - DNA, 14 bp, Homo sapiens
gtccaatatgaaaa

SEQ ID NO: 6355947 - DNA, 13 bp, Homo sapiens
gtccaatccagcc

SEQ ID NO: 6355948 - DNA, 12 bp, Homo sapiens
gtccaatcctat

SEQ ID NO: 6355949 - DNA, 17 bp, Homo sapiens
gtccaatcctatgtttt

SEQ ID NO: 6355950 - DNA, 14 bp, Homo sapiens
gtccaatgaagata

SEQ ID NO: 6355951 - DNA, 15 bp, Homo sapiens
gtccaatgagctttc

SEQ ID NO: 6355952 - DNA, 22 bp, Homo sapiens
gtccaatgccacctagactctc

SEQ ID NO: 6355953 - DNA, 23 bp, Homo sapiens
gtccaatgtacaggaagtagttc

SEQ ID NO: 6355954 - DNA, 16 bp, Homo sapiens
gtccaattagtttcct

SEQ ID NO: 6355955 - DNA, 15 bp, Homo sapiens
gtccaatttaaggaa

SEQ ID NO: 6355956 - DNA, 17 bp, Homo sapiens
gtccaatttctattaaa

SEQ ID NO: 6355957 - DNA, 15 bp, Homo sapiens
gtccaatttgtaagt

SEQ ID NO: 6355958 - DNA, 14 bp, Homo sapiens
gtccaatttttact

SEQ ID NO: 6355959 - DNA, 15 bp, Homo sapiens
gtccaatttttactc

SEQ ID NO: 6355960 - DNA, 14 bp, Homo sapiens
gtccacaaaggtca

SEQ ID NO: 6355961 - DNA, 13 bp, Homo sapiens
gtccacaaatgtc

SEQ ID NO: 6355962 - DNA, 21 bp, Homo sapiens
gtccacaaatgtcctcagagg

SEQ ID NO: 6355963 - DNA, 16 bp, Homo sapiens
gtccacaagcttctgt

SEQ ID NO: 6355964 - DNA, 16 bp, Homo sapiens
gtccacacaaagattt

SEQ ID NO: 6355965 - DNA, 16 bp, Homo sapiens
gtccacagatgcctcc

SEQ ID NO: 6355966 - DNA, 14 bp, Homo sapiens
gtccacagcccctt

SEQ ID NO: 6355967 - DNA, 18 bp, Homo sapiens
gtccacagctgaagagca

SEQ ID NO: 6355968 - DNA, 16 bp, Homo sapiens
gtccacagctggaaag

SEQ ID NO: 6355969 - DNA, 14 bp, Homo sapiens
gtccacagcttcct

SEQ ID NO: 6355970 - DNA, 12 bp, Homo sapiens
taacttggctca

SEQ ID NO: 6355971 - DNA, 12 bp, Homo sapiens
taacttgggagt

SEQ ID NO: 6355972 - DNA, 17 bp, Homo sapiens
taacttgggctgtaaag

SEQ ID NO: 6355973 - DNA, 18 bp, Homo sapiens
taacttgggctgtaaagc

SEQ ID NO: 6355974 - DNA, 17 bp, Homo sapiens
taacttggtcagagcca

SEQ ID NO: 6355975 - DNA, 16 bp, Homo sapiens
taacttggttatacat

SEQ ID NO: 6355976 - DNA, 20 bp, Homo sapiens
taacttggttatacatgaca

SEQ ID NO: 6355977 - DNA, 20 bp, Homo sapiens
taacttggttctcagactct

SEQ ID NO: 6355978 - DNA, 21 bp, Homo sapiens
taacttggttctcagactctt

SEQ ID NO: 6355979 - DNA, 22 bp, Homo sapiens
taacttggttctcagactcttt

SEQ ID NO: 6355980 - DNA, 21 bp, Homo sapiens
taacttgtatattccaccatt

SEQ ID NO: 6355981 - DNA, 19 bp, Homo sapiens
taacttgtcctatgtcaat

SEQ ID NO: 6355982 - DNA, 17 bp, Homo sapiens
taacttgtctaaataag

SEQ ID NO: 6355983 - DNA, 14 bp, Homo sapiens
taacttgtcttaaa

SEQ ID NO: 6355984 - DNA, 18 bp, Homo sapiens
taacttgtcttctagttt

SEQ ID NO: 6355985 - DNA, 13 bp, Homo sapiens
taacttgtttgag

SEQ ID NO: 6355986 - DNA, 16 bp, Homo sapiens
taacttgtttttattg

SEQ ID NO: 6355987 - DNA, 22 bp, Homo sapiens
taacttgtttttattgcatttg

SEQ ID NO: 6355988 - DNA, 14 bp, Homo sapiens
taactttaaacatc

SEQ ID NO: 6355989 - DNA, 17 bp, Homo sapiens
taactttaaacatctag

SEQ ID NO: 6355990 - DNA, 17 bp, Homo sapiens
taactttaccaaatgaa

SEQ ID NO: 6355991 - DNA, 16 bp, Homo sapiens
taactttactctgtgt

SEQ ID NO: 6355992 - DNA, 14 bp, Homo sapiens
taactttagaaata

SEQ ID NO: 6355993 - DNA, 15 bp, Homo sapiens
taactttagaattcc

SEQ ID NO: 6355994 - DNA, 21 bp, Homo sapiens
taactttatcacattatttgc

SEQ ID NO: 6355995 - DNA, 18 bp, Homo sapiens
taactttattcttgaaag

SEQ ID NO: 6355996 - DNA, 23 bp, Homo sapiens
taactttattcttgaaagaagaa

SEQ ID NO: 6355997 - DNA, 14 bp, Homo sapiens
taactttattcttt

SEQ ID NO: 6355998 - DNA, 17 bp, Homo sapiens
taactttattctttgtt

SEQ ID NO: 6355999 - DNA, 11 bp, Homo sapiens
taactttattg

SEQ ID NO: 6356000 - DNA, 23 bp, Homo sapiens
taactttcattaaagcatttact

SEQ ID NO: 6356001 - DNA, 13 bp, Homo sapiens
taactttcccatg

SEQ ID NO: 6356002 - DNA, 15 bp, Homo sapiens
taactttctctgtga

SEQ ID NO: 6356003 - DNA, 21 bp, Homo sapiens
taactttctctgtgaaagctt

SEQ ID NO: 6356004 - DNA, 13 bp, Homo sapiens
taactttctctta

SEQ ID NO: 6356005 - DNA, 13 bp, Homo sapiens
taactttctgggt

SEQ ID NO: 6356006 - DNA, 13 bp, Homo sapiens
taactttctttac

SEQ ID NO: 6356007 - DNA, 20 bp, Homo sapiens
taactttgaaaggtatatga

SEQ ID NO: 6356008 - DNA, 13 bp, Homo sapiens
taactttgaaagt

SEQ ID NO: 6356009 - DNA, 13 bp, Homo sapiens
taactttgcaaaa

SEQ ID NO: 6356010 - DNA, 16 bp, Homo sapiens
taactttgcttgatta

SEQ ID NO: 6356011 - DNA, 23 bp, Homo sapiens
taactttgcttgattaaacagca

SEQ ID NO: 6356012 - DNA, 15 bp, Homo sapiens
taactttggttttct

SEQ ID NO: 6356013 - DNA, 20 bp, Homo sapiens
taactttgtggtaacttctt

SEQ ID NO: 6356014 - DNA, 17 bp, Homo sapiens
taactttgtggtctaaa

SEQ ID NO: 6356015 - DNA, 21 bp, Homo sapiens
taacttttaaaatttgtctta

SEQ ID NO: 6356016 - DNA, 14 bp, Homo sapiens
taacttttaaatgt

SEQ ID NO: 6356017 - DNA, 17 bp, Homo sapiens
taacttttaatggtgat

SEQ ID NO: 6356018 - DNA, 18 bp, Homo sapiens
taacttttaatgtggcaa

SEQ ID NO: 6356019 - DNA, 15 bp, Homo sapiens
taacttttataaact

SEQ ID NO: 6356020 - DNA, 17 bp, Homo sapiens
taacttttataaacttt

SEQ ID NO: 6356021 - DNA, 20 bp, Homo sapiens
taacttttataaactttacc

SEQ ID NO: 6356022 - DNA, 19 bp, Homo sapiens
taacttttctaccatttct

SEQ ID NO: 6356023 - DNA, 17 bp, Homo sapiens
taacttttctttttccc

SEQ ID NO: 6356024 - DNA, 17 bp, Homo sapiens
taacttttgatgacttc

SEQ ID NO: 6356025 - DNA, 14 bp, Homo sapiens
taacttttgggatt

SEQ ID NO: 6356026 - DNA, 22 bp, Homo sapiens
taacttttgggatttgttgaaa

SEQ ID NO: 6356027 - DNA, 21 bp, Homo sapiens
taacttttgtagtcttatgaa

SEQ ID NO: 6356028 - DNA, 24 bp, Homo sapiens
taacttttgtagtcttatgaatag

SEQ ID NO: 6356029 - DNA, 12 bp, Homo sapiens
taacttttgtga

SEQ ID NO: 6356030 - DNA, 21 bp, Homo sapiens
taacttttgtttttttttgtt

SEQ ID NO: 6356031 - DNA, 14 bp, Homo sapiens
taactttttaaaaa

SEQ ID NO: 6356032 - DNA, 22 bp, Homo sapiens
taactttttaaaaaaataaaac

SEQ ID NO: 6356033 - DNA, 13 bp, Homo sapiens
taactttttacat

SEQ ID NO: 6356034 - DNA, 14 bp, Homo sapiens
taactttttatatt

SEQ ID NO: 6356035 - DNA, 19 bp, Homo sapiens
taactttttctaagctgtt

SEQ ID NO: 6356036 - DNA, 18 bp, Homo sapiens
taactttttgtttttatt

SEQ ID NO: 6356037 - DNA, 16 bp, Homo sapiens
taactttttttcagtt

SEQ ID NO: 6356038 - DNA, 19 bp, Homo sapiens
taactttttttgagaagga

SEQ ID NO: 6356039 - DNA, 19 bp, Homo sapiens
taacttttttttctctctt

SEQ ID NO: 6356040 - DNA, 21 bp, Homo sapiens
taacttttttttttttaacat

SEQ ID NO: 6356041 - DNA, 22 bp, Homo sapiens
taacttttttttttttttggtt

SEQ ID NO: 6356042 - DNA, 17 bp, Homo sapiens
taagaaaaaaaatgtac

SEQ ID NO: 6356043 - DNA, 15 bp, Homo sapiens
taagaaaaaaagcaa

SEQ ID NO: 6356044 - DNA, 20 bp, Homo sapiens
taagaaaaaaagcaaaaaca

SEQ ID NO: 6356045 - DNA, 14 bp, Homo sapiens
taagaaaaacaaag

SEQ ID NO: 6356046 - DNA, 15 bp, Homo sapiens
taagaaaaacaataa

SEQ ID NO: 6356047 - DNA, 18 bp, Homo sapiens
taagaaaaacatgtcatg

SEQ ID NO: 6356048 - DNA, 13 bp, Homo sapiens
taagaaaaacttt

SEQ ID NO: 6356049 - DNA, 15 bp, Homo sapiens
taagaaaaacttttt

SEQ ID NO: 6356050 - DNA, 14 bp, Homo sapiens
taagaaaaaggaaa

SEQ ID NO: 6356051 - DNA, 17 bp, Homo sapiens
taagaaaaaggaaattg

SEQ ID NO: 6356052 - DNA, 21 bp, Homo sapiens
taagaaaaataggtcagataa

SEQ ID NO: 6356053 - DNA, 19 bp, Homo sapiens
taagaaaaatgaaaacttt

SEQ ID NO: 6356054 - DNA, 13 bp, Homo sapiens
taagaaaaccaaa

SEQ ID NO: 6356055 - DNA, 18 bp, Homo sapiens
taagaaaaccaaaataaa

SEQ ID NO: 6356056 - DNA, 20 bp, Homo sapiens
taagaaaactacatgtaaaa

SEQ ID NO: 6356057 - DNA, 17 bp, Homo sapiens
taagaaaactattaaga

SEQ ID NO: 6356058 - DNA, 14 bp, Homo sapiens
taagaaaagagata

SEQ ID NO: 6356059 - DNA, 22 bp, Homo sapiens
taagaaaagagatattttaaaa

SEQ ID NO: 6356060 - DNA, 19 bp, Homo sapiens
taagaaaagattttaatca

SEQ ID NO: 6356061 - DNA, 16 bp, Homo sapiens
taagaaaagcactttt

SEQ ID NO: 6356062 - DNA, 17 bp, Homo sapiens
taagaaaagcctgaact

SEQ ID NO: 6356063 - DNA, 14 bp, Homo sapiens
taagaaaaggcatc

SEQ ID NO: 6356064 - DNA, 20 bp, Homo sapiens
taagaaaagtattttgaagt

SEQ ID NO: 6356065 - DNA, 21 bp, Homo sapiens
taagaaaagtattttgaagtt

SEQ ID NO: 6356066 - DNA, 22 bp, Homo sapiens
taagaaaagtattttgaagttt

SEQ ID NO: 6356067 - DNA, 21 bp, Homo sapiens
taagaaaataaaggaaaatga

SEQ ID NO: 6356068 - DNA, 19 bp, Homo sapiens
taagaaaatacaataaact

SEQ ID NO: 6356069 - DNA, 21 bp, Homo sapiens
taagaaaatatcacttgtcaa

SEQ ID NO: 6356070 - DNA, 12 bp, Homo sapiens
taagaaaatatt

SEQ ID NO: 6356071 - DNA, 21 bp, Homo sapiens
taagaaaatattttgtctaaa

SEQ ID NO: 6356072 - DNA, 23 bp, Homo sapiens
taagaaaatgctagaagaaaaca

SEQ ID NO: 6356073 - DNA, 14 bp, Homo sapiens
taagaaaatgcttg

SEQ ID NO: 6356074 - DNA, 14 bp, Homo sapiens
taagaaaatgttac

SEQ ID NO: 6356075 - DNA, 17 bp, Homo sapiens
taagaaaatttaaaaat

SEQ ID NO: 6356076 - DNA, 19 bp, Homo sapiens
taagaaacaaagtaatcta

SEQ ID NO: 6356077 - DNA, 21 bp, Homo sapiens
taagaaacacactgaggcagg

SEQ ID NO: 6356078 - DNA, 12 bp, Homo sapiens
taagaaacagag

SEQ ID NO: 6356079 - DNA, 13 bp, Homo sapiens
taagaaacatcca

SEQ ID NO: 6356080 - DNA, 13 bp, Homo sapiens
taagaaacattgg

SEQ ID NO: 6356081 - DNA, 16 bp, Homo sapiens
taagaaacattggaag

SEQ ID NO: 6356082 - DNA, 21 bp, Homo sapiens
taagaaacattggaagcaggt

SEQ ID NO: 6356083 - DNA, 19 bp, Homo sapiens
taagaaaccaatcaagata

SEQ ID NO: 6356084 - DNA, 19 bp, Homo sapiens
taagaaaccttgctctcct

SEQ ID NO: 6356085 - DNA, 20 bp, Homo sapiens
taagaaaccttgctctcctc

SEQ ID NO: 6356086 - DNA, 24 bp, Homo sapiens
taagaaacttatttctcatatcaa

SEQ ID NO: 6356087 - DNA, 13 bp, Homo sapiens
taagaaacttttt

SEQ ID NO: 6356088 - DNA, 20 bp, Homo sapiens
taagaaacttttttatttaa

SEQ ID NO: 6356089 - DNA, 21 bp, Homo sapiens
taagaaacttttttatttaaa

SEQ ID NO: 6356090 - DNA, 11 bp, Homo sapiens
taagaaagaaa

SEQ ID NO: 6356091 - DNA, 20 bp, Homo sapiens
taagaaagaaaggaaagaag

SEQ ID NO: 6356092 - DNA, 15 bp, Homo sapiens
taagaaagaaatgct

SEQ ID NO: 6356093 - DNA, 16 bp, Homo sapiens
taagaaagagaatgaa

SEQ ID NO: 6356094 - DNA, 20 bp, Homo sapiens
taagaaagagaatgaactgt

SEQ ID NO: 6356095 - DNA, 14 bp, Homo sapiens
taagaaagattaaa

SEQ ID NO: 6356096 - DNA, 13 bp, Homo sapiens
taagaaagcctga

SEQ ID NO: 6356097 - DNA, 12 bp, Homo sapiens
taagaaaggaag

SEQ ID NO: 6356098 - DNA, 13 bp, Homo sapiens
taagaaaggaagc

SEQ ID NO: 6356099 - DNA, 20 bp, Homo sapiens
taagaaaggaagcattgtaa

SEQ ID NO: 6356100 - DNA, 22 bp, Homo sapiens
taagaaaggaagcattgtaaaa

SEQ ID NO: 6356101 - DNA, 23 bp, Homo sapiens
taagaaaggaagcattgtaaaat

SEQ ID NO: 6356102 - DNA, 17 bp, Homo sapiens
taagaaagtaatttaat

SEQ ID NO: 6356103 - DNA, 15 bp, Homo sapiens
taagaaagtgaagca

SEQ ID NO: 6356104 - DNA, 22 bp, Homo sapiens
taagaaagtgaagcaaatcaga

SEQ ID NO: 6356105 - DNA, 19 bp, Homo sapiens
taagaaagtgtctctgttt

SEQ ID NO: 6356106 - DNA, 16 bp, Homo sapiens
taagaaataaggctaa

SEQ ID NO: 6356107 - DNA, 15 bp, Homo sapiens
taagaaataatgcct

SEQ ID NO: 6356108 - DNA, 15 bp, Homo sapiens
taagaaatacagact

SEQ ID NO: 6356109 - DNA, 16 bp, Homo sapiens
taagaaatactgtaca

SEQ ID NO: 6356110 - DNA, 21 bp, Homo sapiens
taagaaataggaaagactttc

SEQ ID NO: 6356111 - DNA, 22 bp, Homo sapiens
taagaaatctcccatgtgcata

SEQ ID NO: 6356112 - DNA, 15 bp, Homo sapiens
taagaaatgaacaaa

SEQ ID NO: 6356113 - DNA, 16 bp, Homo sapiens
taagaaatgaacaaaa

SEQ ID NO: 6356114 - DNA, 15 bp, Homo sapiens
taagaaatgagaaat

SEQ ID NO: 6356115 - DNA, 17 bp, Homo sapiens
taagaaatggctttcca

SEQ ID NO: 6356116 - DNA, 18 bp, Homo sapiens
taagaaatggctttccac

SEQ ID NO: 6356117 - DNA, 18 bp, Homo sapiens
taagaaatgggactctga

SEQ ID NO: 6356118 - DNA, 19 bp, Homo sapiens
taagaaatgggcctcagcc

SEQ ID NO: 6356119 - DNA, 18 bp, Homo sapiens
taagaaatgtataaactt

SEQ ID NO: 6356120 - DNA, 20 bp, Homo sapiens
taagaaatgtattcctgaaa

SEQ ID NO: 6356121 - DNA, 23 bp, Homo sapiens
taagaaattaaggcatttgttta

SEQ ID NO: 6356122 - DNA, 23 bp, Homo sapiens
taagaaattgaatactttgaatg

SEQ ID NO: 6356123 - DNA, 13 bp, Homo sapiens
taagaaattttat

SEQ ID NO: 6356124 - DNA, 17 bp, Homo sapiens
taagaaattttattaga

SEQ ID NO: 6356125 - DNA, 22 bp, Homo sapiens
taagaacaaagagaaaaaatac

SEQ ID NO: 6356126 - DNA, 20 bp, Homo sapiens
taagaacaagttttggcagc

SEQ ID NO: 6356127 - DNA, 21 bp, Homo sapiens
taagaacaagttttggcagcc

SEQ ID NO: 6356128 - DNA, 20 bp, Homo sapiens
taagaacaatgccagggccc

SEQ ID NO: 6356129 - DNA, 12 bp, Homo sapiens
taagaacagatc

SEQ ID NO: 6356130 - DNA, 16 bp, Homo sapiens
taagaacatcataaaa

SEQ ID NO: 6356131 - DNA, 13 bp, Homo sapiens
taagaacatgtta

SEQ ID NO: 6356132 - DNA, 21 bp, Homo sapiens
taagaacattaattatatgta

SEQ ID NO: 6356133 - DNA, 15 bp, Homo sapiens
taagaacattttata

SEQ ID NO: 6356134 - DNA, 22 bp, Homo sapiens
taagaacattttataaaacata

SEQ ID NO: 6356135 - DNA, 14 bp, Homo sapiens
taagaaccacagaa

SEQ ID NO: 6356136 - DNA, 13 bp, Homo sapiens
taagaacccctct

SEQ ID NO: 6356137 - DNA, 23 bp, Homo sapiens
taagaaccttaatgacaacactt

SEQ ID NO: 6356138 - DNA, 12 bp, Homo sapiens
taagaactgctt

SEQ ID NO: 6356139 - DNA, 12 bp, Homo sapiens
taagaactgtac

SEQ ID NO: 6356140 - DNA, 13 bp, Homo sapiens
taagaactgtaca

SEQ ID NO: 6356141 - DNA, 12 bp, Homo sapiens
taagaactgtgg

SEQ ID NO: 6356142 - DNA, 12 bp, Homo sapiens
taagaactgtgt

SEQ ID NO: 6356143 - DNA, 23 bp, Homo sapiens
taagaacttcagtgtagagaaaa

SEQ ID NO: 6356144 - DNA, 21 bp, Homo sapiens
taagaagaaaattgctgtgcc

SEQ ID NO: 6356145 - DNA, 13 bp, Homo sapiens
taagaagaaacta

SEQ ID NO: 6356146 - DNA, 20 bp, Homo sapiens
taagaagaaagatttaaagt

SEQ ID NO: 6356147 - DNA, 22 bp, Homo sapiens
taagaagaaagatttaaagtat

SEQ ID NO: 6356148 - DNA, 13 bp, Homo sapiens
taagaagaaagca

SEQ ID NO: 6356149 - DNA, 16 bp, Homo sapiens
gtccacaggggcaggc

SEQ ID NO: 6356150 - DNA, 18 bp, Homo sapiens
gtccacaggggcaggcct

SEQ ID NO: 6356151 - DNA, 19 bp, Homo sapiens
gtccacaggggcaggcctg

SEQ ID NO: 6356152 - DNA, 21 bp, Homo sapiens
gtccacaggggcaggcctggg

SEQ ID NO: 6356153 - DNA, 23 bp, Homo sapiens
gtccacaggggcaggcctgggac

SEQ ID NO: 6356154 - DNA, 15 bp, Homo sapiens
gtccacaggggccac

SEQ ID NO: 6356155 - DNA, 19 bp, Homo sapiens
gtccacaggggccaccacc

SEQ ID NO: 6356156 - DNA, 19 bp, Homo sapiens
gtccacagtgattagcctc

SEQ ID NO: 6356157 - DNA, 21 bp, Homo sapiens
gtccacagtggaaccagccca

SEQ ID NO: 6356158 - DNA, 13 bp, Homo sapiens
gtccacatacact

SEQ ID NO: 6356159 - DNA, 19 bp, Homo sapiens
gtccacatccccagagccc

SEQ ID NO: 6356160 - DNA, 16 bp, Homo sapiens
gtccacatctaacaaa

SEQ ID NO: 6356161 - DNA, 15 bp, Homo sapiens
gtccacatctgcctc

SEQ ID NO: 6356162 - DNA, 16 bp, Homo sapiens
gtccacatctgcctcc

SEQ ID NO: 6356163 - DNA, 19 bp, Homo sapiens
gtccacatcttctcagtgt

SEQ ID NO: 6356164 - DNA, 16 bp, Homo sapiens
gtccacatgacctcca

SEQ ID NO: 6356165 - DNA, 17 bp, Homo sapiens
gtccacatgacctccat

SEQ ID NO: 6356166 - DNA, 22 bp, Homo sapiens
gtccacatgacctccatttccc

SEQ ID NO: 6356167 - DNA, 12 bp, Homo sapiens
gtccacattcta

SEQ ID NO: 6356168 - DNA, 16 bp, Homo sapiens
gtccaccacttcaggg

SEQ ID NO: 6356169 - DNA, 19 bp, Homo sapiens
gtccaccacttcaggggat

SEQ ID NO: 6356170 - DNA, 20 bp, Homo sapiens
gtccaccagtgtgtggggga

SEQ ID NO: 6356171 - DNA, 15 bp, Homo sapiens
gtccaccagtttata

SEQ ID NO: 6356172 - DNA, 12 bp, Homo sapiens
gtccaccatgaa

SEQ ID NO: 6356173 - DNA, 16 bp, Homo sapiens
gtccaccatgctctct

SEQ ID NO: 6356174 - DNA, 14 bp, Homo sapiens
gtccacccaggagc

SEQ ID NO: 6356175 - DNA, 14 bp, Homo sapiens
gtccacccaggctg

SEQ ID NO: 6356176 - DNA, 19 bp, Homo sapiens
gtccacccaggctgcactg

SEQ ID NO: 6356177 - DNA, 18 bp, Homo sapiens
gtccacccccattgtgaa

SEQ ID NO: 6356178 - DNA, 13 bp, Homo sapiens
gtccaccctagcc

SEQ ID NO: 6356179 - DNA, 18 bp, Homo sapiens
gtccaccctgagctcggg

SEQ ID NO: 6356180 - DNA, 16 bp, Homo sapiens
gtccaccctgcctgcc

SEQ ID NO: 6356181 - DNA, 13 bp, Homo sapiens
gtccacccttcca

SEQ ID NO: 6356182 - DNA, 18 bp, Homo sapiens
gtccacccttccatcagc

SEQ ID NO: 6356183 - DNA, 13 bp, Homo sapiens
gtccacctgtgct

SEQ ID NO: 6356184 - DNA, 16 bp, Homo sapiens
gtccacctgtgctgct

SEQ ID NO: 6356185 - DNA, 18 bp, Homo sapiens
gtccacctgtgctgctgc

SEQ ID NO: 6356186 - DNA, 20 bp, Homo sapiens
gtccaccttctgccaaggcc

SEQ ID NO: 6356187 - DNA, 15 bp, Homo sapiens
gtccacgactgtctc

SEQ ID NO: 6356188 - DNA, 22 bp, Homo sapiens
gtccacgcccaccagccttgct

SEQ ID NO: 6356189 - DNA, 22 bp, Homo sapiens
gtccacgccgggtcgcctgccc

SEQ ID NO: 6356190 - DNA, 22 bp, Homo sapiens
gtccacgcgtgccgtggcacca

SEQ ID NO: 6356191 - DNA, 15 bp, Homo sapiens
gtccacggctctagg

SEQ ID NO: 6356192 - DNA, 19 bp, Homo sapiens
gtccacggggctcactctg

SEQ ID NO: 6356193 - DNA, 16 bp, Homo sapiens
gtccacgtgcgtgttt

SEQ ID NO: 6356194 - DNA, 23 bp, Homo sapiens
gtccacgtgcgtgttttctgact

SEQ ID NO: 6356195 - DNA, 15 bp, Homo sapiens
gtccacgtgtgtgtg

SEQ ID NO: 6356196 - DNA, 19 bp, Homo sapiens
gtccacgtttttggaaaat

SEQ ID NO: 6356197 - DNA, 20 bp, Homo sapiens
gtccactacgctcctgtctc

SEQ ID NO: 6356198 - DNA, 15 bp, Homo sapiens
gtccactcccagtgc

SEQ ID NO: 6356199 - DNA, 13 bp, Homo sapiens
gtccactccctgc

SEQ ID NO: 6356200 - DNA, 16 bp, Homo sapiens
gtccactccctgctcc

SEQ ID NO: 6356201 - DNA, 20 bp, Homo sapiens
gtccactccctgctccacga

SEQ ID NO: 6356202 - DNA, 19 bp, Homo sapiens
gtccactctcggggccctt

SEQ ID NO: 6356203 - DNA, 20 bp, Homo sapiens
gtccactctcggggcccttg

SEQ ID NO: 6356204 - DNA, 17 bp, Homo sapiens
gtccactctgctcaggg

SEQ ID NO: 6356205 - DNA, 22 bp, Homo sapiens
gtccactgagactttcccctct

SEQ ID NO: 6356206 - DNA, 19 bp, Homo sapiens
gtccactgcctccatgatg

SEQ ID NO: 6356207 - DNA, 21 bp, Homo sapiens
gtccactgcctccatgatgca

SEQ ID NO: 6356208 - DNA, 13 bp, Homo sapiens
gtccactggggtg

SEQ ID NO: 6356209 - DNA, 12 bp, Homo sapiens
gtccactgtcac

SEQ ID NO: 6356210 - DNA, 19 bp, Homo sapiens
gtccactgtcctccttggc

SEQ ID NO: 6356211 - DNA, 15 bp, Homo sapiens
gtccactgtgtttag

SEQ ID NO: 6356212 - DNA, 19 bp, Homo sapiens
gtccactgttgagccccag

SEQ ID NO: 6356213 - DNA, 15 bp, Homo sapiens
gtccacttatgtaga

SEQ ID NO: 6356214 - DNA, 14 bp, Homo sapiens
gtccacttcatttt

SEQ ID NO: 6356215 - DNA, 16 bp, Homo sapiens
gtccacttctgacagc

SEQ ID NO: 6356216 - DNA, 20 bp, Homo sapiens
gtccacttgccagggctctg

SEQ ID NO: 6356217 - DNA, 16 bp, Homo sapiens
gtccacttgtgggtcc

SEQ ID NO: 6356218 - DNA, 17 bp, Homo sapiens
gtccacttgtgggtcct

SEQ ID NO: 6356219 - DNA, 18 bp, Homo sapiens
gtccactttcctctctct

SEQ ID NO: 6356220 - DNA, 12 bp, Homo sapiens
gtccacttttcc

SEQ ID NO: 6356221 - DNA, 14 bp, Homo sapiens
gtccacttttccag

SEQ ID NO: 6356222 - DNA, 19 bp, Homo sapiens
gtccacttttccagtattt

SEQ ID NO: 6356223 - DNA, 21 bp, Homo sapiens
gtccacttttccagtatttta

SEQ ID NO: 6356224 - DNA, 22 bp, Homo sapiens
gtccagaaaatagggtggacag

SEQ ID NO: 6356225 - DNA, 15 bp, Homo sapiens
gtccagaaacaaaaa

SEQ ID NO: 6356226 - DNA, 23 bp, Homo sapiens
gtccagaaattgtgtgtgcaaga

SEQ ID NO: 6356227 - DNA, 22 bp, Homo sapiens
gtccagaagaaattatttaata

SEQ ID NO: 6356228 - DNA, 15 bp, Homo sapiens
gtccagaagaatatt

SEQ ID NO: 6356229 - DNA, 17 bp, Homo sapiens
gtccagaagaatattca

SEQ ID NO: 6356230 - DNA, 22 bp, Homo sapiens
gtccagaagaatattcaggact

SEQ ID NO: 6356231 - DNA, 11 bp, Homo sapiens
gtccagaagga

SEQ ID NO: 6356232 - DNA, 16 bp, Homo sapiens
gtccagaaggagacag

SEQ ID NO: 6356233 - DNA, 17 bp, Homo sapiens
gtccagaaggagacagg

SEQ ID NO: 6356234 - DNA, 21 bp, Homo sapiens
gtccagaaggagcaggccctg

SEQ ID NO: 6356235 - DNA, 21 bp, Homo sapiens
gtccagaaggagggggtgacc

SEQ ID NO: 6356236 - DNA, 16 bp, Homo sapiens
gtccagaataagtgct

SEQ ID NO: 6356237 - DNA, 17 bp, Homo sapiens
gtccagacaagccctgc

SEQ ID NO: 6356238 - DNA, 21 bp, Homo sapiens
gtccagaccattgtcttccaa

SEQ ID NO: 6356239 - DNA, 14 bp, Homo sapiens
gtccagacccccca

SEQ ID NO: 6356240 - DNA, 17 bp, Homo sapiens
gtccagaccccccagcc

SEQ ID NO: 6356241 - DNA, 18 bp, Homo sapiens
gtccagaccccccagccc

SEQ ID NO: 6356242 - DNA, 21 bp, Homo sapiens
gtccagaccccccagcccctc

SEQ ID NO: 6356243 - DNA, 14 bp, Homo sapiens
gtccagaccctgaa

SEQ ID NO: 6356244 - DNA, 21 bp, Homo sapiens
gtccagagacatgggcctccc

SEQ ID NO: 6356245 - DNA, 16 bp, Homo sapiens
gtccagagaccacacc

SEQ ID NO: 6356246 - DNA, 20 bp, Homo sapiens
gtccagagagaccgaggagg

SEQ ID NO: 6356247 - DNA, 20 bp, Homo sapiens
gtccagagagagaagtgccc

SEQ ID NO: 6356248 - DNA, 15 bp, Homo sapiens
gtccagagcttttca

SEQ ID NO: 6356249 - DNA, 17 bp, Homo sapiens
gtccagaggaggtgccc

SEQ ID NO: 6356250 - DNA, 22 bp, Homo sapiens
gtccagagggactggacagcca

SEQ ID NO: 6356251 - DNA, 15 bp, Homo sapiens
gtccagagtagtttc

SEQ ID NO: 6356252 - DNA, 11 bp, Homo sapiens
gtccagagtca

SEQ ID NO: 6356253 - DNA, 17 bp, Homo sapiens
gtccagagtcctggccc

SEQ ID NO: 6356254 - DNA, 17 bp, Homo sapiens
gtccagattgaaaagtg

SEQ ID NO: 6356255 - DNA, 19 bp, Homo sapiens
gtccagatttacactggga

SEQ ID NO: 6356256 - DNA, 21 bp, Homo sapiens
gtccagatttacactgggaga

SEQ ID NO: 6356257 - DNA, 15 bp, Homo sapiens
gtccagcacagaagg

SEQ ID NO: 6356258 - DNA, 23 bp, Homo sapiens
gtccagcaccttgtgcctggggt

SEQ ID NO: 6356259 - DNA, 13 bp, Homo sapiens
gtccagcagtctg

SEQ ID NO: 6356260 - DNA, 15 bp, Homo sapiens
gtccagcagtttcca

SEQ ID NO: 6356261 - DNA, 18 bp, Homo sapiens
gtccagcattgctggact

SEQ ID NO: 6356262 - DNA, 21 bp, Homo sapiens
gtccagcattgctggactctg

SEQ ID NO: 6356263 - DNA, 21 bp, Homo sapiens
gtccagccacccccaggcatc

SEQ ID NO: 6356264 - DNA, 12 bp, Homo sapiens
gtccagccagct

SEQ ID NO: 6356265 - DNA, 15 bp, Homo sapiens
gtccagccagctcct

SEQ ID NO: 6356266 - DNA, 16 bp, Homo sapiens
gtccagcccccagtgc

SEQ ID NO: 6356267 - DNA, 19 bp, Homo sapiens
gtccagcccctcctccctc

SEQ ID NO: 6356268 - DNA, 15 bp, Homo sapiens
gtccagccctccgcc

SEQ ID NO: 6356269 - DNA, 22 bp, Homo sapiens
gtccagccctccgccagccctg

SEQ ID NO: 6356270 - DNA, 14 bp, Homo sapiens
gtccagccctggct

SEQ ID NO: 6356271 - DNA, 18 bp, Homo sapiens
gtccagccctggctgaag

SEQ ID NO: 6356272 - DNA, 19 bp, Homo sapiens
gtccagccgtgtgtgcatg

SEQ ID NO: 6356273 - DNA, 21 bp, Homo sapiens
gtccagccgtgtgtgcatgtg

SEQ ID NO: 6356274 - DNA, 23 bp, Homo sapiens
gtccagccgtgtgtgcatgtgcc

SEQ ID NO: 6356275 - DNA, 13 bp, Homo sapiens
gtccagccttcca

SEQ ID NO: 6356276 - DNA, 19 bp, Homo sapiens
gtccagcgtcactccagtg

SEQ ID NO: 6356277 - DNA, 22 bp, Homo sapiens
gtccagcgtcactccagtgctc

SEQ ID NO: 6356278 - DNA, 22 bp, Homo sapiens
gtccagctagccaactcctcct

SEQ ID NO: 6356279 - DNA, 23 bp, Homo sapiens
gtccagctagccaactcctcctt

SEQ ID NO: 6356280 - DNA, 12 bp, Homo sapiens
gtccagctcagc

SEQ ID NO: 6356281 - DNA, 13 bp, Homo sapiens
gtccagctcagcc

SEQ ID NO: 6356282 - DNA, 16 bp, Homo sapiens
gtccagctcagccctg

SEQ ID NO: 6356283 - DNA, 11 bp, Homo sapiens
gtccagctcta

SEQ ID NO: 6356284 - DNA, 13 bp, Homo sapiens
gtccagctctact

SEQ ID NO: 6356285 - DNA, 15 bp, Homo sapiens
gtccagctctcccct

SEQ ID NO: 6356286 - DNA, 20 bp, Homo sapiens
gtccagctctcccctgcgca

SEQ ID NO: 6356287 - DNA, 12 bp, Homo sapiens
gtccagctctga

SEQ ID NO: 6356288 - DNA, 14 bp, Homo sapiens
gtccagctctggag

SEQ ID NO: 6356289 - DNA, 12 bp, Homo sapiens
gtccagctctgt

SEQ ID NO: 6356290 - DNA, 16 bp, Homo sapiens
gtccagctctgtgggc

SEQ ID NO: 6356291 - DNA, 17 bp, Homo sapiens
gtccagctggcctggac

SEQ ID NO: 6356292 - DNA, 11 bp, Homo sapiens
gtccagctggg

SEQ ID NO: 6356293 - DNA, 22 bp, Homo sapiens
gtccagctgggaagcccttttt

SEQ ID NO: 6356294 - DNA, 19 bp, Homo sapiens
gtccagctgggcctcctgc

SEQ ID NO: 6356295 - DNA, 21 bp, Homo sapiens
gtccagctgggcctcctgcct

SEQ ID NO: 6356296 - DNA, 19 bp, Homo sapiens
gtccagctggggccagagg

SEQ ID NO: 6356297 - DNA, 15 bp, Homo sapiens
gtccagcttccaaag

SEQ ID NO: 6356298 - DNA, 19 bp, Homo sapiens
gtccagcttccaaagccta

SEQ ID NO: 6356299 - DNA, 14 bp, Homo sapiens
gtccagcttgctct

SEQ ID NO: 6356300 - DNA, 16 bp, Homo sapiens
gtccagcttgctcttc

SEQ ID NO: 6356301 - DNA, 24 bp, Homo sapiens
gtccagctttactgtggctgtctg

SEQ ID NO: 6356302 - DNA, 13 bp, Homo sapiens
gtccagctttcct

SEQ ID NO: 6356303 - DNA, 17 bp, Homo sapiens
gtccagctttccttctg

SEQ ID NO: 6356304 - DNA, 19 bp, Homo sapiens
gtccagctttccttctgcc

SEQ ID NO: 6356305 - DNA, 22 bp, Homo sapiens
gtccagctttccttctgccctt

SEQ ID NO: 6356306 - DNA, 18 bp, Homo sapiens
gtccaggaaatgtgcaca

SEQ ID NO: 6356307 - DNA, 16 bp, Homo sapiens
gtccaggaaggcagct

SEQ ID NO: 6356308 - DNA, 19 bp, Homo sapiens
gtccaggaaggcagctgct

SEQ ID NO: 6356309 - DNA, 22 bp, Homo sapiens
gtccaggacaggagatgctgtg

SEQ ID NO: 6356310 - DNA, 13 bp, Homo sapiens
gtccaggacatga

SEQ ID NO: 6356311 - DNA, 18 bp, Homo sapiens
gtccaggactgggtctga

SEQ ID NO: 6356312 - DNA, 24 bp, Homo sapiens
gtccaggactgggtctgacctggt

SEQ ID NO: 6356313 - DNA, 21 bp, Homo sapiens
gtccaggagaagtgctccctg

SEQ ID NO: 6356314 - DNA, 22 bp, Homo sapiens
gtccaggagaagtgctccctgg

SEQ ID NO: 6356315 - DNA, 21 bp, Homo sapiens
gtccaggagatgaggctggat

SEQ ID NO: 6356316 - DNA, 17 bp, Homo sapiens
gtccaggagccccagcc

SEQ ID NO: 6356317 - DNA, 22 bp, Homo sapiens
gtccaggagccccagccagccc

SEQ ID NO: 6356318 - DNA, 22 bp, Homo sapiens
gtccaggagccccgccaggtgc

SEQ ID NO: 6356319 - DNA, 12 bp, Homo sapiens
gtccaggagcta

SEQ ID NO: 6356320 - DNA, 16 bp, Homo sapiens
gtccaggatcaaaaga

SEQ ID NO: 6356321 - DNA, 12 bp, Homo sapiens
gtccaggatctc

SEQ ID NO: 6356322 - DNA, 21 bp, Homo sapiens
gtccaggatgctaacatctaa

SEQ ID NO: 6356323 - DNA, 15 bp, Homo sapiens
gtccaggatggaggg

SEQ ID NO: 6356324 - DNA, 17 bp, Homo sapiens
gtccaggattcctcttt

SEQ ID NO: 6356325 - DNA, 11 bp, Homo sapiens
gtccaggcagg

SEQ ID NO: 6356326 - DNA, 18 bp, Homo sapiens
gtccaggcatgggtccct

SEQ ID NO: 6356327 - DNA, 13 bp, Homo sapiens
gtccaggccactg

SEQ ID NO: 6356328 - DNA, 16 bp, Homo sapiens
taagaagaaggccaga

SEQ ID NO: 6356329 - DNA, 19 bp, Homo sapiens
taagaagaaggccagagag

SEQ ID NO: 6356330 - DNA, 20 bp, Homo sapiens
taagaagaatgagaaggcca

SEQ ID NO: 6356331 - DNA, 21 bp, Homo sapiens
taagaagaatgcttaatcaga

SEQ ID NO: 6356332 - DNA, 12 bp, Homo sapiens
taagaagacatt

SEQ ID NO: 6356333 - DNA, 13 bp, Homo sapiens
taagaagacattt

SEQ ID NO: 6356334 - DNA, 22 bp, Homo sapiens
taagaagacattttgttacata

SEQ ID NO: 6356335 - DNA, 12 bp, Homo sapiens
taagaagagact

SEQ ID NO: 6356336 - DNA, 14 bp, Homo sapiens
taagaagagactgg

SEQ ID NO: 6356337 - DNA, 12 bp, Homo sapiens
taagaagaggaa

SEQ ID NO: 6356338 - DNA, 18 bp, Homo sapiens
taagaagaggagcctcag

SEQ ID NO: 6356339 - DNA, 18 bp, Homo sapiens
taagaagatacactgcag

SEQ ID NO: 6356340 - DNA, 14 bp, Homo sapiens
taagaagcaaataa

SEQ ID NO: 6356341 - DNA, 13 bp, Homo sapiens
taagaagcaataa

SEQ ID NO: 6356342 - DNA, 16 bp, Homo sapiens
taagaagcaatctttg

SEQ ID NO: 6356343 - DNA, 19 bp, Homo sapiens
taagaagccctgcagagca

SEQ ID NO: 6356344 - DNA, 22 bp, Homo sapiens
taagaagcctataagaggaatt

SEQ ID NO: 6356345 - DNA, 18 bp, Homo sapiens
taagaagcggcatagcac

SEQ ID NO: 6356346 - DNA, 16 bp, Homo sapiens
taagaagctctggccc

SEQ ID NO: 6356347 - DNA, 16 bp, Homo sapiens
taagaagctgcaataa

SEQ ID NO: 6356348 - DNA, 15 bp, Homo sapiens
taagaagctgttgta

SEQ ID NO: 6356349 - DNA, 16 bp, Homo sapiens
taagaagcttctaata

SEQ ID NO: 6356350 - DNA, 19 bp, Homo sapiens
taagaagcttctaataaat

SEQ ID NO: 6356351 - DNA, 13 bp, Homo sapiens
taagaaggcaaaa

SEQ ID NO: 6356352 - DNA, 17 bp, Homo sapiens
taagaaggcaaaaatgt

SEQ ID NO: 6356353 - DNA, 17 bp, Homo sapiens
taagaaggcaatattaa

SEQ ID NO: 6356354 - DNA, 18 bp, Homo sapiens
taagaagggggagtgaaa

SEQ ID NO: 6356355 - DNA, 20 bp, Homo sapiens
taagaagggggagtgaaaca

SEQ ID NO: 6356356 - DNA, 23 bp, Homo sapiens
taagaagggggagtgaaacagag

SEQ ID NO: 6356357 - DNA, 19 bp, Homo sapiens
taagaagggtgggagtggg

SEQ ID NO: 6356358 - DNA, 21 bp, Homo sapiens
taagaagtacaataagcagag

SEQ ID NO: 6356359 - DNA, 17 bp, Homo sapiens
taagaagtggtgacatt

SEQ ID NO: 6356360 - DNA, 18 bp, Homo sapiens
taagaagtggtgttccat

SEQ ID NO: 6356361 - DNA, 21 bp, Homo sapiens
taagaagttattttcttgttt

SEQ ID NO: 6356362 - DNA, 22 bp, Homo sapiens
taagaagtttgttatagattta

SEQ ID NO: 6356363 - DNA, 19 bp, Homo sapiens
taagaataaaatgttgaaa

SEQ ID NO: 6356364 - DNA, 20 bp, Homo sapiens
taagaataaaatgttgaaaa

SEQ ID NO: 6356365 - DNA, 17 bp, Homo sapiens
taagaataaataaagaa

SEQ ID NO: 6356366 - DNA, 15 bp, Homo sapiens
taagaataacactca

SEQ ID NO: 6356367 - DNA, 13 bp, Homo sapiens
taagaatagacta

SEQ ID NO: 6356368 - DNA, 12 bp, Homo sapiens
taagaatagtct

SEQ ID NO: 6356369 - DNA, 21 bp, Homo sapiens
taagaatagtctctgggttta

SEQ ID NO: 6356370 - DNA, 19 bp, Homo sapiens
taagaatatgtttccttgt

SEQ ID NO: 6356371 - DNA, 21 bp, Homo sapiens
taagaatatgtttccttgttt

SEQ ID NO: 6356372 - DNA, 13 bp, Homo sapiens
taagaatatttga

SEQ ID NO: 6356373 - DNA, 18 bp, Homo sapiens
taagaatcttagataact

SEQ ID NO: 6356374 - DNA, 16 bp, Homo sapiens
taagaatgaagttctg

SEQ ID NO: 6356375 - DNA, 17 bp, Homo sapiens
taagaatgaagttctgc

SEQ ID NO: 6356376 - DNA, 21 bp, Homo sapiens
taagaatgactgatgttgtgt

SEQ ID NO: 6356377 - DNA, 19 bp, Homo sapiens
taagaatgaggaatagttt

SEQ ID NO: 6356378 - DNA, 20 bp, Homo sapiens
taagaatgagtttcttagac

SEQ ID NO: 6356379 - DNA, 15 bp, Homo sapiens
taagaatgctggttt

SEQ ID NO: 6356380 - DNA, 23 bp, Homo sapiens
taagaatgctggttttcctaaat

SEQ ID NO: 6356381 - DNA, 16 bp, Homo sapiens
taagaatgcttaaaaa

SEQ ID NO: 6356382 - DNA, 13 bp, Homo sapiens
taagaatggccaa

SEQ ID NO: 6356383 - DNA, 17 bp, Homo sapiens
taagaatggtctcagtg

SEQ ID NO: 6356384 - DNA, 19 bp, Homo sapiens
taagaatggtttgtaaaat

SEQ ID NO: 6356385 - DNA, 16 bp, Homo sapiens
taagaatgtatatcag

SEQ ID NO: 6356386 - DNA, 20 bp, Homo sapiens
taagaatgtatatcagggtt

SEQ ID NO: 6356387 - DNA, 22 bp, Homo sapiens
taagaatgtcaggaatttaaga

SEQ ID NO: 6356388 - DNA, 17 bp, Homo sapiens
taagaatgtctatttcc

SEQ ID NO: 6356389 - DNA, 21 bp, Homo sapiens
taagaatgtgctagagttaaa

SEQ ID NO: 6356390 - DNA, 12 bp, Homo sapiens
taagaatgttct

SEQ ID NO: 6356391 - DNA, 21 bp, Homo sapiens
taagaattagacatcttcaga

SEQ ID NO: 6356392 - DNA, 17 bp, Homo sapiens
taagaattcaaatttgt

SEQ ID NO: 6356393 - DNA, 16 bp, Homo sapiens
taagaattcagacatc

SEQ ID NO: 6356394 - DNA, 21 bp, Homo sapiens
taagaattcagtagcatttta

SEQ ID NO: 6356395 - DNA, 13 bp, Homo sapiens
taagaattctgat

SEQ ID NO: 6356396 - DNA, 18 bp, Homo sapiens
taagaattctgattgatt

SEQ ID NO: 6356397 - DNA, 19 bp, Homo sapiens
taagaattctgattgattt

SEQ ID NO: 6356398 - DNA, 20 bp, Homo sapiens
taagaattctgattgatttg

SEQ ID NO: 6356399 - DNA, 12 bp, Homo sapiens
taagaattgaag

SEQ ID NO: 6356400 - DNA, 19 bp, Homo sapiens
taagaattgaccatctgct

SEQ ID NO: 6356401 - DNA, 18 bp, Homo sapiens
taagaattgagtaatggt

SEQ ID NO: 6356402 - DNA, 16 bp, Homo sapiens
taagaattgtctctgg

SEQ ID NO: 6356403 - DNA, 13 bp, Homo sapiens
taagaattgtttt

SEQ ID NO: 6356404 - DNA, 21 bp, Homo sapiens
taagaattgtttttgaattta

SEQ ID NO: 6356405 - DNA, 19 bp, Homo sapiens
taagaatttaccagaaata

SEQ ID NO: 6356406 - DNA, 20 bp, Homo sapiens
taagaatttaccagaaatat

SEQ ID NO: 6356407 - DNA, 16 bp, Homo sapiens
taagaatttagggaga

SEQ ID NO: 6356408 - DNA, 17 bp, Homo sapiens
taagaatttattattaa

SEQ ID NO: 6356409 - DNA, 13 bp, Homo sapiens
taagaatttcaat

SEQ ID NO: 6356410 - DNA, 19 bp, Homo sapiens
taagaatttcactgtcttt

SEQ ID NO: 6356411 - DNA, 13 bp, Homo sapiens
taagaatttctgc

SEQ ID NO: 6356412 - DNA, 20 bp, Homo sapiens
taagaatttgaggtctacat

SEQ ID NO: 6356413 - DNA, 12 bp, Homo sapiens
taagaatttgca

SEQ ID NO: 6356414 - DNA, 14 bp, Homo sapiens
taagaatttgcata

SEQ ID NO: 6356415 - DNA, 18 bp, Homo sapiens
taagaattttgttttact

SEQ ID NO: 6356416 - DNA, 22 bp, Homo sapiens
taagaattttgttttacttttt

SEQ ID NO: 6356417 - DNA, 23 bp, Homo sapiens
taagaattttgttttactttttt

SEQ ID NO: 6356418 - DNA, 23 bp, Homo sapiens
taagaattttttattttttggta

SEQ ID NO: 6356419 - DNA, 19 bp, Homo sapiens
taagaatttttttttaaat

SEQ ID NO: 6356420 - DNA, 18 bp, Homo sapiens
taagacaaaaagccttga

SEQ ID NO: 6356421 - DNA, 15 bp, Homo sapiens
taagacaaacactgc

SEQ ID NO: 6356422 - DNA, 13 bp, Homo sapiens
taagacaaatgca

SEQ ID NO: 6356423 - DNA, 24 bp, Homo sapiens
taagacaaatgcagtgtatttaat

SEQ ID NO: 6356424 - DNA, 14 bp, Homo sapiens
taagacaacaggca

SEQ ID NO: 6356425 - DNA, 16 bp, Homo sapiens
taagacaacaggcatt

SEQ ID NO: 6356426 - DNA, 13 bp, Homo sapiens
taagacacacagc

SEQ ID NO: 6356427 - DNA, 20 bp, Homo sapiens
taagacacacagcctttctg

SEQ ID NO: 6356428 - DNA, 23 bp, Homo sapiens
taagacacacagcctttctgtat

SEQ ID NO: 6356429 - DNA, 15 bp, Homo sapiens
taagacactgtgaga

SEQ ID NO: 6356430 - DNA, 19 bp, Homo sapiens
taagacactgtgagagttg

SEQ ID NO: 6356431 - DNA, 14 bp, Homo sapiens
taagacactttttg

SEQ ID NO: 6356432 - DNA, 23 bp, Homo sapiens
taagacagacgcctgcttttgca

SEQ ID NO: 6356433 - DNA, 13 bp, Homo sapiens
taagacagagaag

SEQ ID NO: 6356434 - DNA, 19 bp, Homo sapiens
taagacagggtctcattct

SEQ ID NO: 6356435 - DNA, 11 bp, Homo sapiens
taagacagtgt

SEQ ID NO: 6356436 - DNA, 13 bp, Homo sapiens
taagacagtgtac

SEQ ID NO: 6356437 - DNA, 17 bp, Homo sapiens
taagacataaacaaaga

SEQ ID NO: 6356438 - DNA, 20 bp, Homo sapiens
taagacataaacaaagacat

SEQ ID NO: 6356439 - DNA, 12 bp, Homo sapiens
taagacataacg

SEQ ID NO: 6356440 - DNA, 19 bp, Homo sapiens
taagacatgatttccttga

SEQ ID NO: 6356441 - DNA, 21 bp, Homo sapiens
taagacatgcttactttttaa

SEQ ID NO: 6356442 - DNA, 12 bp, Homo sapiens
taagacatgtga

SEQ ID NO: 6356443 - DNA, 20 bp, Homo sapiens
taagacatgtgaggaggaaa

SEQ ID NO: 6356444 - DNA, 21 bp, Homo sapiens
taagacattaagagaacaaag

SEQ ID NO: 6356445 - DNA, 17 bp, Homo sapiens
taagacatttgtatatt

SEQ ID NO: 6356446 - DNA, 19 bp, Homo sapiens
taagacatttgtttgctgt

SEQ ID NO: 6356447 - DNA, 18 bp, Homo sapiens
taagacattttgttttta

SEQ ID NO: 6356448 - DNA, 20 bp, Homo sapiens
taagacattttgtttttact

SEQ ID NO: 6356449 - DNA, 21 bp, Homo sapiens
taagacattttgtttttactg

SEQ ID NO: 6356450 - DNA, 22 bp, Homo sapiens
taagacattttgtttttactgt

SEQ ID NO: 6356451 - DNA, 16 bp, Homo sapiens
taagacatttttcatt

SEQ ID NO: 6356452 - DNA, 19 bp, Homo sapiens
taagacatttttcattcat

SEQ ID NO: 6356453 - DNA, 23 bp, Homo sapiens
taagacatttttcattcatgaat

SEQ ID NO: 6356454 - DNA, 13 bp, Homo sapiens
taagaccaaagac

SEQ ID NO: 6356455 - DNA, 22 bp, Homo sapiens
taagaccacctcaaatttaaag

SEQ ID NO: 6356456 - DNA, 19 bp, Homo sapiens
taagaccctgtgtcctcca

SEQ ID NO: 6356457 - DNA, 22 bp, Homo sapiens
taagaccgtgtcccaaggagct

SEQ ID NO: 6356458 - DNA, 16 bp, Homo sapiens
taagacctactgttct

SEQ ID NO: 6356459 - DNA, 22 bp, Homo sapiens
taagacctactgttctaaagct

SEQ ID NO: 6356460 - DNA, 13 bp, Homo sapiens
taagacctcccca

SEQ ID NO: 6356461 - DNA, 17 bp, Homo sapiens
taagacctccccacccc

SEQ ID NO: 6356462 - DNA, 17 bp, Homo sapiens
taagacctggcagctct

SEQ ID NO: 6356463 - DNA, 16 bp, Homo sapiens
taagacgacttatata

SEQ ID NO: 6356464 - DNA, 13 bp, Homo sapiens
taagacgtgaatg

SEQ ID NO: 6356465 - DNA, 14 bp, Homo sapiens
taagacgtgaatgt

SEQ ID NO: 6356466 - DNA, 19 bp, Homo sapiens
taagacgtgaatgtctcag

SEQ ID NO: 6356467 - DNA, 14 bp, Homo sapiens
taagacgttggaag

SEQ ID NO: 6356468 - DNA, 17 bp, Homo sapiens
taagactaaatctgtaa

SEQ ID NO: 6356469 - DNA, 23 bp, Homo sapiens
taagactaaatctgtaagctctt

SEQ ID NO: 6356470 - DNA, 15 bp, Homo sapiens
taagactaacaaagg

SEQ ID NO: 6356471 - DNA, 19 bp, Homo sapiens
taagactaacaaaggcagc

SEQ ID NO: 6356472 - DNA, 22 bp, Homo sapiens
taagactaacaaaggcagctgt

SEQ ID NO: 6356473 - DNA, 15 bp, Homo sapiens
taagactataaataa

SEQ ID NO: 6356474 - DNA, 17 bp, Homo sapiens
taagactataaataaaa

SEQ ID NO: 6356475 - DNA, 23 bp, Homo sapiens
taagactatatatataaatgtat

SEQ ID NO: 6356476 - DNA, 21 bp, Homo sapiens
taagactcaaatgttctaagt

SEQ ID NO: 6356477 - DNA, 22 bp, Homo sapiens
taagactcaaatgttctaagtt

SEQ ID NO: 6356478 - DNA, 16 bp, Homo sapiens
taagactcacttacat

SEQ ID NO: 6356479 - DNA, 13 bp, Homo sapiens
taagactcctcgg

SEQ ID NO: 6356480 - DNA, 23 bp, Homo sapiens
taagactcgcggcaggttctctt

SEQ ID NO: 6356481 - DNA, 13 bp, Homo sapiens
taagactgctggt

SEQ ID NO: 6356482 - DNA, 16 bp, Homo sapiens
taagactgtaatgaat

SEQ ID NO: 6356483 - DNA, 21 bp, Homo sapiens
taagactgtttttaagtaact

SEQ ID NO: 6356484 - DNA, 18 bp, Homo sapiens
taagacttaatctttgct

SEQ ID NO: 6356485 - DNA, 19 bp, Homo sapiens
taagacttaatctttgctg

SEQ ID NO: 6356486 - DNA, 18 bp, Homo sapiens
taagacttactctaagat

SEQ ID NO: 6356487 - DNA, 20 bp, Homo sapiens
taagacttactctaagatct

SEQ ID NO: 6356488 - DNA, 16 bp, Homo sapiens
taagacttcagatttc

SEQ ID NO: 6356489 - DNA, 20 bp, Homo sapiens
taagacttcagtcctggtct

SEQ ID NO: 6356490 - DNA, 23 bp, Homo sapiens
taagacttcctctaccaccacac

SEQ ID NO: 6356491 - DNA, 14 bp, Homo sapiens
taagacttgacagt

SEQ ID NO: 6356492 - DNA, 15 bp, Homo sapiens
taagacttgtgcatg

SEQ ID NO: 6356493 - DNA, 17 bp, Homo sapiens
taagacttgtttctttc

SEQ ID NO: 6356494 - DNA, 15 bp, Homo sapiens
taagactttgggata

SEQ ID NO: 6356495 - DNA, 20 bp, Homo sapiens
taagactttgggataggaaa

SEQ ID NO: 6356496 - DNA, 18 bp, Homo sapiens
taagacttttctctactt

SEQ ID NO: 6356497 - DNA, 17 bp, Homo sapiens
taagagaaaatgtaaat

SEQ ID NO: 6356498 - DNA, 15 bp, Homo sapiens
taagagaaacaggcc

SEQ ID NO: 6356499 - DNA, 16 bp, Homo sapiens
taagagaaacctgcca

SEQ ID NO: 6356500 - DNA, 21 bp, Homo sapiens
taagagaaaccttgcaaactc

SEQ ID NO: 6356501 - DNA, 15 bp, Homo sapiens
taagagaaactgtgt

SEQ ID NO: 6356502 - DNA, 17 bp, Homo sapiens
taagagaaactgtgtat

SEQ ID NO: 6356503 - DNA, 20 bp, Homo sapiens
taagagaaactttatacatt

SEQ ID NO: 6356504 - DNA, 21 bp, Homo sapiens
taagagaaactttatacatta

SEQ ID NO: 6356505 - DNA, 23 bp, Homo sapiens
taagagaaactttatacattagt

SEQ ID NO: 6356506 - DNA, 18 bp, Homo sapiens
gtccaggccactgtggcc

SEQ ID NO: 6356507 - DNA, 15 bp, Homo sapiens
gtccaggccaggcct

SEQ ID NO: 6356508 - DNA, 17 bp, Homo sapiens
gtccaggccagtgggcc

SEQ ID NO: 6356509 - DNA, 17 bp, Homo sapiens
gtccaggccccaccggc

SEQ ID NO: 6356510 - DNA, 20 bp, Homo sapiens
gtccaggccccaccggccag

SEQ ID NO: 6356511 - DNA, 14 bp, Homo sapiens
gtccaggcccccaa

SEQ ID NO: 6356512 - DNA, 23 bp, Homo sapiens
gtccaggcccccagcccctcctc

SEQ ID NO: 6356513 - DNA, 20 bp, Homo sapiens
gtccaggcctactcctgtct

SEQ ID NO: 6356514 - DNA, 21 bp, Homo sapiens
gtccaggcctactcctgtctt

SEQ ID NO: 6356515 - DNA, 23 bp, Homo sapiens
gtccaggcctactcctgtcttct

SEQ ID NO: 6356516 - DNA, 24 bp, Homo sapiens
gtccaggcctactcctgtcttctg

SEQ ID NO: 6356517 - DNA, 18 bp, Homo sapiens
gtccaggcctctctctgc

SEQ ID NO: 6356518 - DNA, 16 bp, Homo sapiens
gtccaggctctgggca

SEQ ID NO: 6356519 - DNA, 19 bp, Homo sapiens
gtccaggctctgggcacag

SEQ ID NO: 6356520 - DNA, 13 bp, Homo sapiens
gtccagggaagct

SEQ ID NO: 6356521 - DNA, 20 bp, Homo sapiens
gtccagggaagctggccgag

SEQ ID NO: 6356522 - DNA, 21 bp, Homo sapiens
gtccagggaggggtccctgca

SEQ ID NO: 6356523 - DNA, 14 bp, Homo sapiens
gtccagggccctga

SEQ ID NO: 6356524 - DNA, 14 bp, Homo sapiens
gtccagggcttcag

SEQ ID NO: 6356525 - DNA, 14 bp, Homo sapiens
gtccaggggcccct

SEQ ID NO: 6356526 - DNA, 20 bp, Homo sapiens
gtccaggggcccctccagct

SEQ ID NO: 6356527 - DNA, 21 bp, Homo sapiens
gtccaggggcccctccagctt

SEQ ID NO: 6356528 - DNA, 16 bp, Homo sapiens
gtccaggggtctgtct

SEQ ID NO: 6356529 - DNA, 15 bp, Homo sapiens
gtccagggtccagcc

SEQ ID NO: 6356530 - DNA, 15 bp, Homo sapiens
gtccagggtcctcta

SEQ ID NO: 6356531 - DNA, 17 bp, Homo sapiens
gtccagggtttctctgc

SEQ ID NO: 6356532 - DNA, 17 bp, Homo sapiens
gtccaggtaggaaacaa

SEQ ID NO: 6356533 - DNA, 19 bp, Homo sapiens
gtccaggtcaccagcctga

SEQ ID NO: 6356534 - DNA, 18 bp, Homo sapiens
gtccaggtcccagcccct

SEQ ID NO: 6356535 - DNA, 23 bp, Homo sapiens
gtccaggtccgtagctcccctgg

SEQ ID NO: 6356536 - DNA, 16 bp, Homo sapiens
gtccaggtcctggtgg

SEQ ID NO: 6356537 - DNA, 18 bp, Homo sapiens
gtccaggtcgggctcagc

SEQ ID NO: 6356538 - DNA, 20 bp, Homo sapiens
gtccaggtgagtgtgagggc

SEQ ID NO: 6356539 - DNA, 14 bp, Homo sapiens
gtccagtaagatca

SEQ ID NO: 6356540 - DNA, 19 bp, Homo sapiens
gtccagtaagatcactgtt

SEQ ID NO: 6356541 - DNA, 20 bp, Homo sapiens
gtccagtaagatcactgttt

SEQ ID NO: 6356542 - DNA, 18 bp, Homo sapiens
gtccagtcctatctgggc

SEQ ID NO: 6356543 - DNA, 19 bp, Homo sapiens
gtccagtcctatctgggct

SEQ ID NO: 6356544 - DNA, 15 bp, Homo sapiens
gtccagtcctcacat

SEQ ID NO: 6356545 - DNA, 15 bp, Homo sapiens
gtccagtctgtgatc

SEQ ID NO: 6356546 - DNA, 20 bp, Homo sapiens
gtccagtctgtgatccttgg

SEQ ID NO: 6356547 - DNA, 16 bp, Homo sapiens
gtccagtgaccctgga

SEQ ID NO: 6356548 - DNA, 18 bp, Homo sapiens
gtccagtgaccctggagc

SEQ ID NO: 6356549 - DNA, 18 bp, Homo sapiens
gtccagtgagcagtgttg

SEQ ID NO: 6356550 - DNA, 23 bp, Homo sapiens
gtccagtgcattttgtttctgta

SEQ ID NO: 6356551 - DNA, 14 bp, Homo sapiens
gtccagtgctctgc

SEQ ID NO: 6356552 - DNA, 15 bp, Homo sapiens
gtccagtgctctgcc

SEQ ID NO: 6356553 - DNA, 16 bp, Homo sapiens
gtccagtgctctgcct

SEQ ID NO: 6356554 - DNA, 18 bp, Homo sapiens
gtccagtgctctgcctca

SEQ ID NO: 6356555 - DNA, 21 bp, Homo sapiens
gtccagtggaagttcttcaag

SEQ ID NO: 6356556 - DNA, 22 bp, Homo sapiens
gtccagtgtcacctctctcaga

SEQ ID NO: 6356557 - DNA, 18 bp, Homo sapiens
gtccagttcaggaatttt

SEQ ID NO: 6356558 - DNA, 14 bp, Homo sapiens
gtccagttcccaga

SEQ ID NO: 6356559 - DNA, 17 bp, Homo sapiens
gtccagtttgtgcaaga

SEQ ID NO: 6356560 - DNA, 22 bp, Homo sapiens
gtccagtttgtgcaagacaccc

SEQ ID NO: 6356561 - DNA, 16 bp, Homo sapiens
gtccagttttcttgct

SEQ ID NO: 6356562 - DNA, 21 bp, Homo sapiens
gtccagttttggaggctgagt

SEQ ID NO: 6356563 - DNA, 19 bp, Homo sapiens
gtccatagagatgagccca

SEQ ID NO: 6356564 - DNA, 20 bp, Homo sapiens
gtccatagatataaagccat

SEQ ID NO: 6356565 - DNA, 14 bp, Homo sapiens
gtccatatcacaca

SEQ ID NO: 6356566 - DNA, 19 bp, Homo sapiens
gtccatatcagacctctga

SEQ ID NO: 6356567 - DNA, 18 bp, Homo sapiens
gtccatatttacattcta

SEQ ID NO: 6356568 - DNA, 16 bp, Homo sapiens
gtccatattttcacag

SEQ ID NO: 6356569 - DNA, 15 bp, Homo sapiens
gtccatcagcctcca

SEQ ID NO: 6356570 - DNA, 23 bp, Homo sapiens
gtccatccatatatattcatcag

SEQ ID NO: 6356571 - DNA, 18 bp, Homo sapiens
gtccatcccccttcttcc

SEQ ID NO: 6356572 - DNA, 19 bp, Homo sapiens
gtccatcccccttcttcct

SEQ ID NO: 6356573 - DNA, 20 bp, Homo sapiens
gtccatcccccttcttcctc

SEQ ID NO: 6356574 - DNA, 22 bp, Homo sapiens
gtccatccccttcccccatccc

SEQ ID NO: 6356575 - DNA, 11 bp, Homo sapiens
gtccatccctt

SEQ ID NO: 6356576 - DNA, 16 bp, Homo sapiens
gtccatcccttttcct

SEQ ID NO: 6356577 - DNA, 19 bp, Homo sapiens
gtccatcccttttcctgtc

SEQ ID NO: 6356578 - DNA, 16 bp, Homo sapiens
gtccatcctcctctcc

SEQ ID NO: 6356579 - DNA, 18 bp, Homo sapiens
gtccatcctcctctccat

SEQ ID NO: 6356580 - DNA, 19 bp, Homo sapiens
gtccatcctcctctccatg

SEQ ID NO: 6356581 - DNA, 13 bp, Homo sapiens
gtccatcctgacc

SEQ ID NO: 6356582 - DNA, 14 bp, Homo sapiens
gtccatcctgacct

SEQ ID NO: 6356583 - DNA, 21 bp, Homo sapiens
gtccatctcattgcggcctgt

SEQ ID NO: 6356584 - DNA, 17 bp, Homo sapiens
gtccatctctctccctt

SEQ ID NO: 6356585 - DNA, 22 bp, Homo sapiens
gtccatctgcccgcctgcccac

SEQ ID NO: 6356586 - DNA, 11 bp, Homo sapiens
gtccatcttgt

SEQ ID NO: 6356587 - DNA, 21 bp, Homo sapiens
gtccatcttgtttcatttgct

SEQ ID NO: 6356588 - DNA, 17 bp, Homo sapiens
gtccatgaaaataccat

SEQ ID NO: 6356589 - DNA, 23 bp, Homo sapiens
gtccatgaagatgtagaggagaa

SEQ ID NO: 6356590 - DNA, 21 bp, Homo sapiens
gtccatgcagggggctcctgg

SEQ ID NO: 6356591 - DNA, 19 bp, Homo sapiens
gtccatgcccactgctggt

SEQ ID NO: 6356592 - DNA, 20 bp, Homo sapiens
gtccatgcctacagataatt

SEQ ID NO: 6356593 - DNA, 17 bp, Homo sapiens
gtccatgctccagggtc

SEQ ID NO: 6356594 - DNA, 15 bp, Homo sapiens
gtccatggaatgctt

SEQ ID NO: 6356595 - DNA, 20 bp, Homo sapiens
gtccatggaatgcttgaaaa

SEQ ID NO: 6356596 - DNA, 12 bp, Homo sapiens
gtccatggcacc

SEQ ID NO: 6356597 - DNA, 14 bp, Homo sapiens
gtccatggcaccag

SEQ ID NO: 6356598 - DNA, 19 bp, Homo sapiens
gtccatggcaccagccccc

SEQ ID NO: 6356599 - DNA, 13 bp, Homo sapiens
gtccatgggcaga

SEQ ID NO: 6356600 - DNA, 16 bp, Homo sapiens
gtccatgggcagagcc

SEQ ID NO: 6356601 - DNA, 15 bp, Homo sapiens
gtccatgggtctggc

SEQ ID NO: 6356602 - DNA, 18 bp, Homo sapiens
gtccatgtcctatgcctc

SEQ ID NO: 6356603 - DNA, 18 bp, Homo sapiens
gtccatgtgaaatttaca

SEQ ID NO: 6356604 - DNA, 14 bp, Homo sapiens
gtccatgtgcttcc

SEQ ID NO: 6356605 - DNA, 18 bp, Homo sapiens
gtccatgtggactgtgcc

SEQ ID NO: 6356606 - DNA, 13 bp, Homo sapiens
gtccatgtgtgtg

SEQ ID NO: 6356607 - DNA, 20 bp, Homo sapiens
gtccatgtttattgtttttt

SEQ ID NO: 6356608 - DNA, 13 bp, Homo sapiens
gtccatgtttctc

SEQ ID NO: 6356609 - DNA, 16 bp, Homo sapiens
gtccattcagaaagct

SEQ ID NO: 6356610 - DNA, 17 bp, Homo sapiens
gtccattcatctcatgc

SEQ ID NO: 6356611 - DNA, 22 bp, Homo sapiens
gtccattccattaataactgaa

SEQ ID NO: 6356612 - DNA, 23 bp, Homo sapiens
gtccattgcaaaaggttaagcca

SEQ ID NO: 6356613 - DNA, 16 bp, Homo sapiens
gtccattgccacggcc

SEQ ID NO: 6356614 - DNA, 22 bp, Homo sapiens
gtccattgtaaatctgaagaaa

SEQ ID NO: 6356615 - DNA, 16 bp, Homo sapiens
gtccattgtccaatcc

SEQ ID NO: 6356616 - DNA, 18 bp, Homo sapiens
gtccatttacctggaaac

SEQ ID NO: 6356617 - DNA, 15 bp, Homo sapiens
gtccatttcttattt

SEQ ID NO: 6356618 - DNA, 23 bp, Homo sapiens
gtccatttgggtacgtctgggcc

SEQ ID NO: 6356619 - DNA, 16 bp, Homo sapiens
gtccatttgtaaaact

SEQ ID NO: 6356620 - DNA, 15 bp, Homo sapiens
gtccatttgttcctg

SEQ ID NO: 6356621 - DNA, 13 bp, Homo sapiens
gtccattttctaa

SEQ ID NO: 6356622 - DNA, 17 bp, Homo sapiens
gtcccaaaatcccctca

SEQ ID NO: 6356623 - DNA, 13 bp, Homo sapiens
gtcccaagcagcc

SEQ ID NO: 6356624 - DNA, 18 bp, Homo sapiens
gtcccaagcctgatactt

SEQ ID NO: 6356625 - DNA, 13 bp, Homo sapiens
gtcccaagctggg

SEQ ID NO: 6356626 - DNA, 21 bp, Homo sapiens
gtcccaagctgggccccagcc

SEQ ID NO: 6356627 - DNA, 22 bp, Homo sapiens
gtcccaagctgggccccagccc

SEQ ID NO: 6356628 - DNA, 15 bp, Homo sapiens
gtcccaaggagctga

SEQ ID NO: 6356629 - DNA, 23 bp, Homo sapiens
gtcccaaggagctgatttccagg

SEQ ID NO: 6356630 - DNA, 16 bp, Homo sapiens
gtcccaaggagggggc

SEQ ID NO: 6356631 - DNA, 17 bp, Homo sapiens
gtcccaaggttctgggt

SEQ ID NO: 6356632 - DNA, 13 bp, Homo sapiens
gtcccaagtgcca

SEQ ID NO: 6356633 - DNA, 15 bp, Homo sapiens
gtcccaatgaaatac

SEQ ID NO: 6356634 - DNA, 20 bp, Homo sapiens
gtcccaatggtcctgacttt

SEQ ID NO: 6356635 - DNA, 20 bp, Homo sapiens
gtcccaattcggggcctgct

SEQ ID NO: 6356636 - DNA, 22 bp, Homo sapiens
gtcccaattcggggcctgctgg

SEQ ID NO: 6356637 - DNA, 17 bp, Homo sapiens
gtcccacaaaatatttc

SEQ ID NO: 6356638 - DNA, 17 bp, Homo sapiens
gtcccacaaatgggcgc

SEQ ID NO: 6356639 - DNA, 18 bp, Homo sapiens
gtcccacaaatgggcgcc

SEQ ID NO: 6356640 - DNA, 18 bp, Homo sapiens
gtcccacaccgctggtcc

SEQ ID NO: 6356641 - DNA, 23 bp, Homo sapiens
gtcccacaccgctggtccctgcc

SEQ ID NO: 6356642 - DNA, 15 bp, Homo sapiens
gtcccacactgtggc

SEQ ID NO: 6356643 - DNA, 16 bp, Homo sapiens
gtcccacacttatcag

SEQ ID NO: 6356644 - DNA, 18 bp, Homo sapiens
gtcccacagccctgagat

SEQ ID NO: 6356645 - DNA, 15 bp, Homo sapiens
gtcccacagggacca

SEQ ID NO: 6356646 - DNA, 15 bp, Homo sapiens
gtcccacatccctgg

SEQ ID NO: 6356647 - DNA, 14 bp, Homo sapiens
gtcccacatggcca

SEQ ID NO: 6356648 - DNA, 21 bp, Homo sapiens
gtcccaccaactctgcactcc

SEQ ID NO: 6356649 - DNA, 14 bp, Homo sapiens
gtcccacccacaca

SEQ ID NO: 6356650 - DNA, 19 bp, Homo sapiens
gtcccacccacacagctgc

SEQ ID NO: 6356651 - DNA, 20 bp, Homo sapiens
gtcccacccacacagctgcc

SEQ ID NO: 6356652 - DNA, 13 bp, Homo sapiens
gtcccaccccacc

SEQ ID NO: 6356653 - DNA, 23 bp, Homo sapiens
gtcccacccccaacccccagagg

SEQ ID NO: 6356654 - DNA, 22 bp, Homo sapiens
gtcccacccccacccccagctc

SEQ ID NO: 6356655 - DNA, 23 bp, Homo sapiens
gtcccacccccacccccagctca

SEQ ID NO: 6356656 - DNA, 16 bp, Homo sapiens
gtcccaccctcttccc

SEQ ID NO: 6356657 - DNA, 18 bp, Homo sapiens
gtcccaccgggagcctcc

SEQ ID NO: 6356658 - DNA, 23 bp, Homo sapiens
gtcccaccggttgcttctgggaa

SEQ ID NO: 6356659 - DNA, 17 bp, Homo sapiens
gtcccacctccagcccg

SEQ ID NO: 6356660 - DNA, 21 bp, Homo sapiens
gtcccacctcttctcttcctg

SEQ ID NO: 6356661 - DNA, 22 bp, Homo sapiens
gtcccacctcttctcttcctgt

SEQ ID NO: 6356662 - DNA, 17 bp, Homo sapiens
gtcccacctggctcccc

SEQ ID NO: 6356663 - DNA, 20 bp, Homo sapiens
gtcccaccttggctgcaggg

SEQ ID NO: 6356664 - DNA, 21 bp, Homo sapiens
gtcccaccttggctgcaggga

SEQ ID NO: 6356665 - DNA, 20 bp, Homo sapiens
gtcccacgaatttgctgggg

SEQ ID NO: 6356666 - DNA, 14 bp, Homo sapiens
gtcccacggctctg

SEQ ID NO: 6356667 - DNA, 18 bp, Homo sapiens
gtcccacggctctgtgcc

SEQ ID NO: 6356668 - DNA, 13 bp, Homo sapiens
gtcccacgtgtct

SEQ ID NO: 6356669 - DNA, 18 bp, Homo sapiens
gtcccacgtgtcttccac

SEQ ID NO: 6356670 - DNA, 16 bp, Homo sapiens
gtcccactcaagccaa

SEQ ID NO: 6356671 - DNA, 19 bp, Homo sapiens
gtcccactccaagccagca

SEQ ID NO: 6356672 - DNA, 13 bp, Homo sapiens
gtcccactgcacc

SEQ ID NO: 6356673 - DNA, 11 bp, Homo sapiens
gtcccactgcc

SEQ ID NO: 6356674 - DNA, 13 bp, Homo sapiens
gtcccactgggac

SEQ ID NO: 6356675 - DNA, 16 bp, Homo sapiens
gtcccacttcacagct

SEQ ID NO: 6356676 - DNA, 19 bp, Homo sapiens
gtcccacttccccatctgt

SEQ ID NO: 6356677 - DNA, 21 bp, Homo sapiens
gtcccacttccccatctgtgt

SEQ ID NO: 6356678 - DNA, 17 bp, Homo sapiens
gtcccacttcccctcct

SEQ ID NO: 6356679 - DNA, 21 bp, Homo sapiens
gtcccacttcccctcctaccc

SEQ ID NO: 6356680 - DNA, 19 bp, Homo sapiens
gtcccacttggcatcagct

SEQ ID NO: 6356681 - DNA, 19 bp, Homo sapiens
gtcccagaaccacactgtt

SEQ ID NO: 6356682 - DNA, 14 bp, Homo sapiens
gtcccagacagctg

SEQ ID NO: 6356683 - DNA, 18 bp, Homo sapiens
taagagaaagaaaatgaa

SEQ ID NO: 6356684 - DNA, 15 bp, Homo sapiens
taagagaaatggcaa

SEQ ID NO: 6356685 - DNA, 13 bp, Homo sapiens
taagagaacaaag

SEQ ID NO: 6356686 - DNA, 14 bp, Homo sapiens
taagagaacaaaga

SEQ ID NO: 6356687 - DNA, 22 bp, Homo sapiens
taagagaacaaagagtgaaata

SEQ ID NO: 6356688 - DNA, 20 bp, Homo sapiens
taagagaagacctagctatg

SEQ ID NO: 6356689 - DNA, 21 bp, Homo sapiens
taagagaagacctagctatgt

SEQ ID NO: 6356690 - DNA, 14 bp, Homo sapiens
taagagaatccaca

SEQ ID NO: 6356691 - DNA, 20 bp, Homo sapiens
taagagaatccacataaaag

SEQ ID NO: 6356692 - DNA, 23 bp, Homo sapiens
taagagacagaatgtatctgtga

SEQ ID NO: 6356693 - DNA, 14 bp, Homo sapiens
taagagactcttta

SEQ ID NO: 6356694 - DNA, 14 bp, Homo sapiens
taagagagaatgag

SEQ ID NO: 6356695 - DNA, 16 bp, Homo sapiens
taagagagagagcctt

SEQ ID NO: 6356696 - DNA, 17 bp, Homo sapiens
taagagagtctatttac

SEQ ID NO: 6356697 - DNA, 21 bp, Homo sapiens
taagagatctggtcaaagcaa

SEQ ID NO: 6356698 - DNA, 15 bp, Homo sapiens
taagagatgggacta

SEQ ID NO: 6356699 - DNA, 13 bp, Homo sapiens
taagagattctga

SEQ ID NO: 6356700 - DNA, 15 bp, Homo sapiens
taagagattctgatt

SEQ ID NO: 6356701 - DNA, 11 bp, Homo sapiens
taagagattta

SEQ ID NO: 6356702 - DNA, 17 bp, Homo sapiens
taagagcaaaaagtgta

SEQ ID NO: 6356703 - DNA, 14 bp, Homo sapiens
taagagcaaacttt

SEQ ID NO: 6356704 - DNA, 15 bp, Homo sapiens
taagagcaattctgg

SEQ ID NO: 6356705 - DNA, 15 bp, Homo sapiens
taagagcaccttcct

SEQ ID NO: 6356706 - DNA, 19 bp, Homo sapiens
taagagcaccttcctcact

SEQ ID NO: 6356707 - DNA, 20 bp, Homo sapiens
taagagcaccttcctcactt

SEQ ID NO: 6356708 - DNA, 14 bp, Homo sapiens
taagagcatgattt

SEQ ID NO: 6356709 - DNA, 18 bp, Homo sapiens
taagagctagcgctgccg

SEQ ID NO: 6356710 - DNA, 12 bp, Homo sapiens
taagagctcagg

SEQ ID NO: 6356711 - DNA, 21 bp, Homo sapiens
taagagctgatgtgagtgtgt

SEQ ID NO: 6356712 - DNA, 17 bp, Homo sapiens
taagagctggtgtctga

SEQ ID NO: 6356713 - DNA, 21 bp, Homo sapiens
taagagcttccaattttcctt

SEQ ID NO: 6356714 - DNA, 17 bp, Homo sapiens
taagagcttgctccaga

SEQ ID NO: 6356715 - DNA, 15 bp, Homo sapiens
taagagctttatata

SEQ ID NO: 6356716 - DNA, 15 bp, Homo sapiens
taagaggaggcagga

SEQ ID NO: 6356717 - DNA, 16 bp, Homo sapiens
taagaggattgcttga

SEQ ID NO: 6356718 - DNA, 23 bp, Homo sapiens
taagaggcagaaaattgcacaat

SEQ ID NO: 6356719 - DNA, 15 bp, Homo sapiens
taagaggcccagccc

SEQ ID NO: 6356720 - DNA, 22 bp, Homo sapiens
taagaggcccagccctcagaaa

SEQ ID NO: 6356721 - DNA, 22 bp, Homo sapiens
taagaggctatttaaaagtata

SEQ ID NO: 6356722 - DNA, 15 bp, Homo sapiens
taagagggcagactg

SEQ ID NO: 6356723 - DNA, 20 bp, Homo sapiens
taagagggggaaaaacacat

SEQ ID NO: 6356724 - DNA, 23 bp, Homo sapiens
taagaggtattggattttcacag

SEQ ID NO: 6356725 - DNA, 18 bp, Homo sapiens
taagaggtgttatttgga

SEQ ID NO: 6356726 - DNA, 16 bp, Homo sapiens
taagaggttgattata

SEQ ID NO: 6356727 - DNA, 20 bp, Homo sapiens
taagagtaacagtcatcatt

SEQ ID NO: 6356728 - DNA, 23 bp, Homo sapiens
taagagtattttaagaagacata

SEQ ID NO: 6356729 - DNA, 15 bp, Homo sapiens
taagagtcctgaggc

SEQ ID NO: 6356730 - DNA, 20 bp, Homo sapiens
taagagtctccttctcttct

SEQ ID NO: 6356731 - DNA, 22 bp, Homo sapiens
taagagtctccttctcttctct

SEQ ID NO: 6356732 - DNA, 19 bp, Homo sapiens
taagagtgggggagagcag

SEQ ID NO: 6356733 - DNA, 13 bp, Homo sapiens
taagagtgtttaa

SEQ ID NO: 6356734 - DNA, 21 bp, Homo sapiens
taagagttgctttgccagagc

SEQ ID NO: 6356735 - DNA, 22 bp, Homo sapiens
taagagttgctttgccagagca

SEQ ID NO: 6356736 - DNA, 13 bp, Homo sapiens
taagagtttacaa

SEQ ID NO: 6356737 - DNA, 22 bp, Homo sapiens
taagataaaaataataataaag

SEQ ID NO: 6356738 - DNA, 16 bp, Homo sapiens
taagataaatagagtt

SEQ ID NO: 6356739 - DNA, 19 bp, Homo sapiens
taagataaatagagttcca

SEQ ID NO: 6356740 - DNA, 16 bp, Homo sapiens
taagataaatgtgctg

SEQ ID NO: 6356741 - DNA, 18 bp, Homo sapiens
taagataacttactgtat

SEQ ID NO: 6356742 - DNA, 15 bp, Homo sapiens
taagataataatata

SEQ ID NO: 6356743 - DNA, 18 bp, Homo sapiens
taagataatagtttacat

SEQ ID NO: 6356744 - DNA, 23 bp, Homo sapiens
taagataatagtttacatgtagt

SEQ ID NO: 6356745 - DNA, 14 bp, Homo sapiens
taagataatgatga

SEQ ID NO: 6356746 - DNA, 12 bp, Homo sapiens
taagataattat

SEQ ID NO: 6356747 - DNA, 20 bp, Homo sapiens
taagataattgtactttgaa

SEQ ID NO: 6356748 - DNA, 14 bp, Homo sapiens
taagatacaaataa

SEQ ID NO: 6356749 - DNA, 14 bp, Homo sapiens
taagatacaaatta

SEQ ID NO: 6356750 - DNA, 16 bp, Homo sapiens
taagatacactcctgc

SEQ ID NO: 6356751 - DNA, 21 bp, Homo sapiens
taagatacactcctgctgtgc

SEQ ID NO: 6356752 - DNA, 20 bp, Homo sapiens
taagatacatatactgattc

SEQ ID NO: 6356753 - DNA, 20 bp, Homo sapiens
taagatagaaagctggactg

SEQ ID NO: 6356754 - DNA, 21 bp, Homo sapiens
taagatagaaagctggactga

SEQ ID NO: 6356755 - DNA, 14 bp, Homo sapiens
taagatagaacaca

SEQ ID NO: 6356756 - DNA, 14 bp, Homo sapiens
taagatagacttat

SEQ ID NO: 6356757 - DNA, 18 bp, Homo sapiens
taagataggttctgcttt

SEQ ID NO: 6356758 - DNA, 22 bp, Homo sapiens
taagataggttctgctttctga

SEQ ID NO: 6356759 - DNA, 15 bp, Homo sapiens
taagatagtgtaact

SEQ ID NO: 6356760 - DNA, 20 bp, Homo sapiens
taagatagtgtaacttgctt

SEQ ID NO: 6356761 - DNA, 17 bp, Homo sapiens
taagatatattttgagt

SEQ ID NO: 6356762 - DNA, 16 bp, Homo sapiens
taagatatccatcttt

SEQ ID NO: 6356763 - DNA, 17 bp, Homo sapiens
taagatatccatctttt

SEQ ID NO: 6356764 - DNA, 19 bp, Homo sapiens
taagatatgggacattttt

SEQ ID NO: 6356765 - DNA, 14 bp, Homo sapiens
taagatatgtgaga

SEQ ID NO: 6356766 - DNA, 15 bp, Homo sapiens
taagatatttgcagt

SEQ ID NO: 6356767 - DNA, 22 bp, Homo sapiens
taagatatttgcagtttttcat

SEQ ID NO: 6356768 - DNA, 17 bp, Homo sapiens
taagatatttttcatga

SEQ ID NO: 6356769 - DNA, 18 bp, Homo sapiens
taagatatttttcatgat

SEQ ID NO: 6356770 - DNA, 21 bp, Homo sapiens
taagatcactgccagagataa

SEQ ID NO: 6356771 - DNA, 13 bp, Homo sapiens
taagatcataaca

SEQ ID NO: 6356772 - DNA, 13 bp, Homo sapiens
taagatccagaaa

SEQ ID NO: 6356773 - DNA, 16 bp, Homo sapiens
taagatcctaaactct

SEQ ID NO: 6356774 - DNA, 18 bp, Homo sapiens
taagatcgttctctgcct

SEQ ID NO: 6356775 - DNA, 17 bp, Homo sapiens
taagatctatagcctct

SEQ ID NO: 6356776 - DNA, 14 bp, Homo sapiens
taagatctgactgc

SEQ ID NO: 6356777 - DNA, 17 bp, Homo sapiens
taagatgaaatgcactg

SEQ ID NO: 6356778 - DNA, 21 bp, Homo sapiens
taagatgaaatgcactgtatt

SEQ ID NO: 6356779 - DNA, 16 bp, Homo sapiens
taagatgactctgaga

SEQ ID NO: 6356780 - DNA, 21 bp, Homo sapiens
taagatgagcaaccacattta

SEQ ID NO: 6356781 - DNA, 18 bp, Homo sapiens
taagatgaggaaataatg

SEQ ID NO: 6356782 - DNA, 22 bp, Homo sapiens
taagatgcatgtctgccaaaat

SEQ ID NO: 6356783 - DNA, 17 bp, Homo sapiens
taagatgctaatagaaa

SEQ ID NO: 6356784 - DNA, 12 bp, Homo sapiens
taagatgctggg

SEQ ID NO: 6356785 - DNA, 18 bp, Homo sapiens
taagatggaagcttccag

SEQ ID NO: 6356786 - DNA, 19 bp, Homo sapiens
taagatggaagcttccagt

SEQ ID NO: 6356787 - DNA, 19 bp, Homo sapiens
taagatggataatgtgtat

SEQ ID NO: 6356788 - DNA, 22 bp, Homo sapiens
taagatggattctcagatattt

SEQ ID NO: 6356789 - DNA, 21 bp, Homo sapiens
taagatggctgtggcatttcc

SEQ ID NO: 6356790 - DNA, 18 bp, Homo sapiens
taagatgggcagctagtt

SEQ ID NO: 6356791 - DNA, 18 bp, Homo sapiens
taagatgggcctgtatga

SEQ ID NO: 6356792 - DNA, 22 bp, Homo sapiens
taagatgggcctgtatgagaca

SEQ ID NO: 6356793 - DNA, 19 bp, Homo sapiens
taagatgtaaattgaagaa

SEQ ID NO: 6356794 - DNA, 15 bp, Homo sapiens
taagatgtacattta

SEQ ID NO: 6356795 - DNA, 16 bp, Homo sapiens
taagatgtacatttaa

SEQ ID NO: 6356796 - DNA, 19 bp, Homo sapiens
taagatgtacatttaataa

SEQ ID NO: 6356797 - DNA, 19 bp, Homo sapiens
taagatgtctgtttgctga

SEQ ID NO: 6356798 - DNA, 19 bp, Homo sapiens
taagatgtcttgaaaacat

SEQ ID NO: 6356799 - DNA, 18 bp, Homo sapiens
taagatgtgatattctaa

SEQ ID NO: 6356800 - DNA, 22 bp, Homo sapiens
taagatgtgatattctaagact

SEQ ID NO: 6356801 - DNA, 20 bp, Homo sapiens
taagatgtgtcttcaatttg

SEQ ID NO: 6356802 - DNA, 18 bp, Homo sapiens
taagatgttaatctccca

SEQ ID NO: 6356803 - DNA, 15 bp, Homo sapiens
taagatgttatattt

SEQ ID NO: 6356804 - DNA, 21 bp, Homo sapiens
taagatgttatatttttctta

SEQ ID NO: 6356805 - DNA, 23 bp, Homo sapiens
taagatgtttattaatagaatga

SEQ ID NO: 6356806 - DNA, 18 bp, Homo sapiens
taagattaaaggaaggaa

SEQ ID NO: 6356807 - DNA, 21 bp, Homo sapiens
taagattaatgacctgaattg

SEQ ID NO: 6356808 - DNA, 13 bp, Homo sapiens
taagattagaatg

SEQ ID NO: 6356809 - DNA, 18 bp, Homo sapiens
taagattagaatgaaaat

SEQ ID NO: 6356810 - DNA, 18 bp, Homo sapiens
taagattatagattctaa

SEQ ID NO: 6356811 - DNA, 14 bp, Homo sapiens
taagattcatattt

SEQ ID NO: 6356812 - DNA, 17 bp, Homo sapiens
taagattccaaaaagca

SEQ ID NO: 6356813 - DNA, 16 bp, Homo sapiens
taagattccttttctt

SEQ ID NO: 6356814 - DNA, 10 bp, Homo sapiens
taagattcta

SEQ ID NO: 6356815 - DNA, 13 bp, Homo sapiens
taagattctaaag

SEQ ID NO: 6356816 - DNA, 11 bp, Homo sapiens
taagattctag

SEQ ID NO: 6356817 - DNA, 13 bp, Homo sapiens
taagattctagat

SEQ ID NO: 6356818 - DNA, 21 bp, Homo sapiens
taagattctagatcagatgct

SEQ ID NO: 6356819 - DNA, 13 bp, Homo sapiens
taagattcttggt

SEQ ID NO: 6356820 - DNA, 13 bp, Homo sapiens
taagattgaaatt

SEQ ID NO: 6356821 - DNA, 22 bp, Homo sapiens
taagattgcaaggaaggaaaca

SEQ ID NO: 6356822 - DNA, 14 bp, Homo sapiens
taagattgctttaa

SEQ ID NO: 6356823 - DNA, 18 bp, Homo sapiens
taagattgctttaagaaa

SEQ ID NO: 6356824 - DNA, 13 bp, Homo sapiens
taagattgtaatt

SEQ ID NO: 6356825 - DNA, 17 bp, Homo sapiens
taagattgtaattcaga

SEQ ID NO: 6356826 - DNA, 14 bp, Homo sapiens
taagattgtacata

SEQ ID NO: 6356827 - DNA, 14 bp, Homo sapiens
taagattgtgaagg

SEQ ID NO: 6356828 - DNA, 20 bp, Homo sapiens
taagattgttattaaatgta

SEQ ID NO: 6356829 - DNA, 17 bp, Homo sapiens
taagatttaatttgcca

SEQ ID NO: 6356830 - DNA, 21 bp, Homo sapiens
taagatttaatttgccaaaat

SEQ ID NO: 6356831 - DNA, 13 bp, Homo sapiens
taagatttaccca

SEQ ID NO: 6356832 - DNA, 13 bp, Homo sapiens
taagatttactta

SEQ ID NO: 6356833 - DNA, 19 bp, Homo sapiens
taagatttagagatgaatt

SEQ ID NO: 6356834 - DNA, 21 bp, Homo sapiens
taagatttagttgagttattc

SEQ ID NO: 6356835 - DNA, 15 bp, Homo sapiens
taagatttatctgca

SEQ ID NO: 6356836 - DNA, 23 bp, Homo sapiens
taagatttatctgcaaggatttt

SEQ ID NO: 6356837 - DNA, 14 bp, Homo sapiens
taagatttctttat

SEQ ID NO: 6356838 - DNA, 17 bp, Homo sapiens
taagatttctttatgtg

SEQ ID NO: 6356839 - DNA, 20 bp, Homo sapiens
taagatttgatatatgtatc

SEQ ID NO: 6356840 - DNA, 15 bp, Homo sapiens
taagatttggtttgg

SEQ ID NO: 6356841 - DNA, 12 bp, Homo sapiens
taagattttaca

SEQ ID NO: 6356842 - DNA, 23 bp, Homo sapiens
taagattttattttcaagcaaat

SEQ ID NO: 6356843 - DNA, 22 bp, Homo sapiens
taagattttctgggataacagt

SEQ ID NO: 6356844 - DNA, 21 bp, Homo sapiens
taagatttttatattaaaaat

SEQ ID NO: 6356845 - DNA, 16 bp, Homo sapiens
taagatttttctcaaa

SEQ ID NO: 6356846 - DNA, 18 bp, Homo sapiens
taagatttttctcaaagt

SEQ ID NO: 6356847 - DNA, 15 bp, Homo sapiens
taagatttttgtaaa

SEQ ID NO: 6356848 - DNA, 21 bp, Homo sapiens
taagcaaacaaatattgccaa

SEQ ID NO: 6356849 - DNA, 16 bp, Homo sapiens
taagcaaatacttagc

SEQ ID NO: 6356850 - DNA, 12 bp, Homo sapiens
taagcaaatgca

SEQ ID NO: 6356851 - DNA, 18 bp, Homo sapiens
taagcaaatgttaaaagt

SEQ ID NO: 6356852 - DNA, 19 bp, Homo sapiens
taagcaaatgttaaaagtt

SEQ ID NO: 6356853 - DNA, 21 bp, Homo sapiens
taagcaaatttcaaaagacat

SEQ ID NO: 6356854 - DNA, 18 bp, Homo sapiens
taagcaacacttggaaca

SEQ ID NO: 6356855 - DNA, 14 bp, Homo sapiens
taagcaacatcttt

SEQ ID NO: 6356856 - DNA, 14 bp, Homo sapiens
taagcaacatggct

SEQ ID NO: 6356857 - DNA, 19 bp, Homo sapiens
taagcaaccacactgcttg

SEQ ID NO: 6356858 - DNA, 20 bp, Homo sapiens
taagcaaccacactgcttgg

SEQ ID NO: 6356859 - DNA, 14 bp, Homo sapiens
taagcaagaatgca

SEQ ID NO: 6356860 - DNA, 23 bp, Homo sapiens
taagcaagaatgcagtacagaat

SEQ ID NO: 6356861 - DNA, 17 bp, Homo sapiens
taagcaagccaggagaa

SEQ ID NO: 6356862 - DNA, 15 bp, Homo sapiens
gtcccagacagctgg

SEQ ID NO: 6356863 - DNA, 17 bp, Homo sapiens
gtcccagacatgctgcc

SEQ ID NO: 6356864 - DNA, 21 bp, Homo sapiens
gtcccagacatgctgcccacc

SEQ ID NO: 6356865 - DNA, 18 bp, Homo sapiens
gtcccagagcacctcacc

SEQ ID NO: 6356866 - DNA, 16 bp, Homo sapiens
gtcccagagcaggagg

SEQ ID NO: 6356867 - DNA, 13 bp, Homo sapiens
gtcccagagccct

SEQ ID NO: 6356868 - DNA, 17 bp, Homo sapiens
gtcccagagccctggac

SEQ ID NO: 6356869 - DNA, 17 bp, Homo sapiens
gtcccagagctgcacag

SEQ ID NO: 6356870 - DNA, 22 bp, Homo sapiens
gtcccagagcttattggccact

SEQ ID NO: 6356871 - DNA, 12 bp, Homo sapiens
gtcccagaggcc

SEQ ID NO: 6356872 - DNA, 20 bp, Homo sapiens
gtcccagaggccgctgcccc

SEQ ID NO: 6356873 - DNA, 20 bp, Homo sapiens
gtcccagaggttatctgcct

SEQ ID NO: 6356874 - DNA, 21 bp, Homo sapiens
gtcccagaggttatctgcctg

SEQ ID NO: 6356875 - DNA, 15 bp, Homo sapiens
gtcccagatcgtctc

SEQ ID NO: 6356876 - DNA, 16 bp, Homo sapiens
gtcccagatcgtctcc

SEQ ID NO: 6356877 - DNA, 17 bp, Homo sapiens
gtcccagatgctgtcat

SEQ ID NO: 6356878 - DNA, 17 bp, Homo sapiens
gtcccagattggctcac

SEQ ID NO: 6356879 - DNA, 14 bp, Homo sapiens
gtcccagcacattt

SEQ ID NO: 6356880 - DNA, 20 bp, Homo sapiens
gtcccagcacatttcctctc

SEQ ID NO: 6356881 - DNA, 16 bp, Homo sapiens
gtcccagcaccacacc

SEQ ID NO: 6356882 - DNA, 11 bp, Homo sapiens
gtcccagcagc

SEQ ID NO: 6356883 - DNA, 17 bp, Homo sapiens
gtcccagcatccctgga

SEQ ID NO: 6356884 - DNA, 18 bp, Homo sapiens
gtcccagcatccctggag

SEQ ID NO: 6356885 - DNA, 20 bp, Homo sapiens
gtcccagcatccctggagca

SEQ ID NO: 6356886 - DNA, 21 bp, Homo sapiens
gtcccagccaccccgggctct

SEQ ID NO: 6356887 - DNA, 14 bp, Homo sapiens
gtcccagccacgca

SEQ ID NO: 6356888 - DNA, 20 bp, Homo sapiens
gtcccagccagcagttcaga

SEQ ID NO: 6356889 - DNA, 16 bp, Homo sapiens
gtcccagccccaggcc

SEQ ID NO: 6356890 - DNA, 20 bp, Homo sapiens
gtcccagccccaggcctggc

SEQ ID NO: 6356891 - DNA, 17 bp, Homo sapiens
gtcccagcccctcctcc

SEQ ID NO: 6356892 - DNA, 19 bp, Homo sapiens
gtcccagcccctcctccct

SEQ ID NO: 6356893 - DNA, 15 bp, Homo sapiens
gtcccagccctgggg

SEQ ID NO: 6356894 - DNA, 16 bp, Homo sapiens
gtcccagcctctgggg

SEQ ID NO: 6356895 - DNA, 19 bp, Homo sapiens
gtcccagcctctggggcag

SEQ ID NO: 6356896 - DNA, 13 bp, Homo sapiens
gtcccagcctggg

SEQ ID NO: 6356897 - DNA, 14 bp, Homo sapiens
gtcccagcctgggc

SEQ ID NO: 6356898 - DNA, 15 bp, Homo sapiens
gtcccagcctgggct

SEQ ID NO: 6356899 - DNA, 18 bp, Homo sapiens
gtcccagcctgggctcct

SEQ ID NO: 6356900 - DNA, 19 bp, Homo sapiens
gtcccagcgacatttctcc

SEQ ID NO: 6356901 - DNA, 18 bp, Homo sapiens
gtcccagcgagccacagg

SEQ ID NO: 6356902 - DNA, 19 bp, Homo sapiens
gtcccagcgagccacagga

SEQ ID NO: 6356903 - DNA, 17 bp, Homo sapiens
gtcccagcggcctcagg

SEQ ID NO: 6356904 - DNA, 19 bp, Homo sapiens
gtcccagctaaagaggtgg

SEQ ID NO: 6356905 - DNA, 20 bp, Homo sapiens
gtcccagctaaagaggtggg

SEQ ID NO: 6356906 - DNA, 23 bp, Homo sapiens
gtcccagctacaggggaggctga

SEQ ID NO: 6356907 - DNA, 23 bp, Homo sapiens
gtcccagctacttgggagcctga

SEQ ID NO: 6356908 - DNA, 12 bp, Homo sapiens
gtcccagctccc

SEQ ID NO: 6356909 - DNA, 13 bp, Homo sapiens
gtcccagctcccc

SEQ ID NO: 6356910 - DNA, 14 bp, Homo sapiens
gtcccagctcccct

SEQ ID NO: 6356911 - DNA, 16 bp, Homo sapiens
gtcccagctcccctct

SEQ ID NO: 6356912 - DNA, 21 bp, Homo sapiens
gtcccagctgaaggcagtggc

SEQ ID NO: 6356913 - DNA, 22 bp, Homo sapiens
gtcccagctgaaggcagtggca

SEQ ID NO: 6356914 - DNA, 12 bp, Homo sapiens
gtcccaggaagt

SEQ ID NO: 6356915 - DNA, 19 bp, Homo sapiens
gtcccaggaatcagtttaa

SEQ ID NO: 6356916 - DNA, 15 bp, Homo sapiens
gtcccaggacctgag

SEQ ID NO: 6356917 - DNA, 18 bp, Homo sapiens
gtcccaggacctgagcct

SEQ ID NO: 6356918 - DNA, 21 bp, Homo sapiens
gtcccaggacctgagcctggc

SEQ ID NO: 6356919 - DNA, 23 bp, Homo sapiens
gtcccaggacctgagcctggcca

SEQ ID NO: 6356920 - DNA, 18 bp, Homo sapiens
gtcccaggactcaccctc

SEQ ID NO: 6356921 - DNA, 19 bp, Homo sapiens
gtcccaggagctgcccaga

SEQ ID NO: 6356922 - DNA, 20 bp, Homo sapiens
gtcccaggagctgcccagag

SEQ ID NO: 6356923 - DNA, 19 bp, Homo sapiens
gtcccaggcagcacagtgt

SEQ ID NO: 6356924 - DNA, 15 bp, Homo sapiens
gtcccaggcatgcag

SEQ ID NO: 6356925 - DNA, 19 bp, Homo sapiens
gtcccaggcatgcagctgc

SEQ ID NO: 6356926 - DNA, 20 bp, Homo sapiens
gtcccaggcatgcagctgcc

SEQ ID NO: 6356927 - DNA, 24 bp, Homo sapiens
gtcccaggcatgcagctgcctggg

SEQ ID NO: 6356928 - DNA, 11 bp, Homo sapiens
gtcccaggccg

SEQ ID NO: 6356929 - DNA, 17 bp, Homo sapiens
gtcccaggccggcccag

SEQ ID NO: 6356930 - DNA, 19 bp, Homo sapiens
gtcccaggctgagcctcag

SEQ ID NO: 6356931 - DNA, 24 bp, Homo sapiens
gtcccagggaagaggaatcgcccc

SEQ ID NO: 6356932 - DNA, 20 bp, Homo sapiens
gtcccagggaaggtggggcc

SEQ ID NO: 6356933 - DNA, 19 bp, Homo sapiens
gtcccagggagctctgcat

SEQ ID NO: 6356934 - DNA, 12 bp, Homo sapiens
gtcccagggccc

SEQ ID NO: 6356935 - DNA, 19 bp, Homo sapiens
gtcccagggctctgcaggc

SEQ ID NO: 6356936 - DNA, 15 bp, Homo sapiens
gtcccagggctggcc

SEQ ID NO: 6356937 - DNA, 21 bp, Homo sapiens
gtcccaggggtctccctgagc

SEQ ID NO: 6356938 - DNA, 22 bp, Homo sapiens
gtcccaggttggctctgccagt

SEQ ID NO: 6356939 - DNA, 18 bp, Homo sapiens
gtcccagtattctcagag

SEQ ID NO: 6356940 - DNA, 17 bp, Homo sapiens
gtcccagtccggtgcct

SEQ ID NO: 6356941 - DNA, 20 bp, Homo sapiens
gtcccagtccggtgccttcc

SEQ ID NO: 6356942 - DNA, 18 bp, Homo sapiens
gtcccagtgaactcggcc

SEQ ID NO: 6356943 - DNA, 10 bp, Homo sapiens
gtcccagtgg

SEQ ID NO: 6356944 - DNA, 18 bp, Homo sapiens
gtcccagtgggaggcgcg

SEQ ID NO: 6356945 - DNA, 19 bp, Homo sapiens
gtcccagtgggaggggcag

SEQ ID NO: 6356946 - DNA, 20 bp, Homo sapiens
gtcccagtgggaggggcagg

SEQ ID NO: 6356947 - DNA, 14 bp, Homo sapiens
gtcccagtgtctgg

SEQ ID NO: 6356948 - DNA, 18 bp, Homo sapiens
gtcccagtgtctggccca

SEQ ID NO: 6356949 - DNA, 19 bp, Homo sapiens
gtcccagtgtctggcccag

SEQ ID NO: 6356950 - DNA, 16 bp, Homo sapiens
gtcccagttgctgtca

SEQ ID NO: 6356951 - DNA, 15 bp, Homo sapiens
gtcccagtttcccac

SEQ ID NO: 6356952 - DNA, 18 bp, Homo sapiens
gtcccagtttcccactct

SEQ ID NO: 6356953 - DNA, 17 bp, Homo sapiens
gtcccatagtccctgcc

SEQ ID NO: 6356954 - DNA, 18 bp, Homo sapiens
gtcccatagtccctgcca

SEQ ID NO: 6356955 - DNA, 14 bp, Homo sapiens
gtcccatatcctgc

SEQ ID NO: 6356956 - DNA, 21 bp, Homo sapiens
gtcccatcacgtgtactggct

SEQ ID NO: 6356957 - DNA, 13 bp, Homo sapiens
gtcccatccaggc

SEQ ID NO: 6356958 - DNA, 17 bp, Homo sapiens
gtcccatccaggcagtc

SEQ ID NO: 6356959 - DNA, 13 bp, Homo sapiens
gtcccatccccag

SEQ ID NO: 6356960 - DNA, 16 bp, Homo sapiens
gtcccatctcacctct

SEQ ID NO: 6356961 - DNA, 11 bp, Homo sapiens
gtcccatctct

SEQ ID NO: 6356962 - DNA, 14 bp, Homo sapiens
gtcccatctgctcc

SEQ ID NO: 6356963 - DNA, 16 bp, Homo sapiens
gtcccatctgctcctc

SEQ ID NO: 6356964 - DNA, 20 bp, Homo sapiens
gtcccatctgctcctcccat

SEQ ID NO: 6356965 - DNA, 23 bp, Homo sapiens
gtcccatgaccttgacgtgtgtg

SEQ ID NO: 6356966 - DNA, 17 bp, Homo sapiens
gtcccatgatccctgtg

SEQ ID NO: 6356967 - DNA, 16 bp, Homo sapiens
gtcccatgcaggccct

SEQ ID NO: 6356968 - DNA, 14 bp, Homo sapiens
gtcccatggcctgc

SEQ ID NO: 6356969 - DNA, 20 bp, Homo sapiens
gtcccatggctgaagctgga

SEQ ID NO: 6356970 - DNA, 23 bp, Homo sapiens
gtcccatggctgaagctggagca

SEQ ID NO: 6356971 - DNA, 15 bp, Homo sapiens
gtcccatgggctctg

SEQ ID NO: 6356972 - DNA, 18 bp, Homo sapiens
gtcccatgggctctggcc

SEQ ID NO: 6356973 - DNA, 20 bp, Homo sapiens
gtcccatgtgagctgctgcc

SEQ ID NO: 6356974 - DNA, 16 bp, Homo sapiens
gtcccattagctgagg

SEQ ID NO: 6356975 - DNA, 14 bp, Homo sapiens
gtcccattccctgg

SEQ ID NO: 6356976 - DNA, 17 bp, Homo sapiens
gtcccattccctgggat

SEQ ID NO: 6356977 - DNA, 13 bp, Homo sapiens
gtcccattctaga

SEQ ID NO: 6356978 - DNA, 15 bp, Homo sapiens
gtcccattctagatc

SEQ ID NO: 6356979 - DNA, 20 bp, Homo sapiens
gtcccattctagatcctgca

SEQ ID NO: 6356980 - DNA, 21 bp, Homo sapiens
gtcccattctagatcctgcac

SEQ ID NO: 6356981 - DNA, 22 bp, Homo sapiens
gtcccattggtgttgtcattgt

SEQ ID NO: 6356982 - DNA, 23 bp, Homo sapiens
gtcccattgttggcgctgaggtg

SEQ ID NO: 6356983 - DNA, 17 bp, Homo sapiens
gtcccatttccttggag

SEQ ID NO: 6356984 - DNA, 16 bp, Homo sapiens
gtcccatttctcactg

SEQ ID NO: 6356985 - DNA, 19 bp, Homo sapiens
gtcccattttccccctgtg

SEQ ID NO: 6356986 - DNA, 21 bp, Homo sapiens
gtcccattttccccctgtgtt

SEQ ID NO: 6356987 - DNA, 16 bp, Homo sapiens
gtcccatttttctctt

SEQ ID NO: 6356988 - DNA, 17 bp, Homo sapiens
gtccccaaacaggacag

SEQ ID NO: 6356989 - DNA, 17 bp, Homo sapiens
gtccccaaacctgcaag

SEQ ID NO: 6356990 - DNA, 18 bp, Homo sapiens
gtccccaaacctgcaagg

SEQ ID NO: 6356991 - DNA, 22 bp, Homo sapiens
gtccccaaatccgaacctcctc

SEQ ID NO: 6356992 - DNA, 19 bp, Homo sapiens
gtccccaacagcgcccaaa

SEQ ID NO: 6356993 - DNA, 15 bp, Homo sapiens
gtccccaacaggaat

SEQ ID NO: 6356994 - DNA, 15 bp, Homo sapiens
gtccccaacatggat

SEQ ID NO: 6356995 - DNA, 22 bp, Homo sapiens
gtccccaaccgtgtctgtctgg

SEQ ID NO: 6356996 - DNA, 20 bp, Homo sapiens
gtccccaacgtcccctccgc

SEQ ID NO: 6356997 - DNA, 22 bp, Homo sapiens
gtccccaacgtcccctccgccg

SEQ ID NO: 6356998 - DNA, 21 bp, Homo sapiens
gtccccaaggcctctctctgc

SEQ ID NO: 6356999 - DNA, 16 bp, Homo sapiens
gtccccacacagcctc

SEQ ID NO: 6357000 - DNA, 18 bp, Homo sapiens
gtccccacacagcctcta

SEQ ID NO: 6357001 - DNA, 12 bp, Homo sapiens
gtccccacactc

SEQ ID NO: 6357002 - DNA, 24 bp, Homo sapiens
gtccccacactcctacacctaact

SEQ ID NO: 6357003 - DNA, 23 bp, Homo sapiens
gtccccacagactgccccagcca

SEQ ID NO: 6357004 - DNA, 13 bp, Homo sapiens
gtccccacagcct

SEQ ID NO: 6357005 - DNA, 16 bp, Homo sapiens
gtccccaccatctgct

SEQ ID NO: 6357006 - DNA, 18 bp, Homo sapiens
gtccccaccatctgctgt

SEQ ID NO: 6357007 - DNA, 20 bp, Homo sapiens
gtccccaccatctgctgtct

SEQ ID NO: 6357008 - DNA, 12 bp, Homo sapiens
gtccccacccct

SEQ ID NO: 6357009 - DNA, 14 bp, Homo sapiens
gtccccacccctgc

SEQ ID NO: 6357010 - DNA, 16 bp, Homo sapiens
gtccccacccctgccc

SEQ ID NO: 6357011 - DNA, 17 bp, Homo sapiens
gtccccacccctgcccc

SEQ ID NO: 6357012 - DNA, 15 bp, Homo sapiens
gtccccacccgcctg

SEQ ID NO: 6357013 - DNA, 17 bp, Homo sapiens
gtccccaccctccactc

SEQ ID NO: 6357014 - DNA, 14 bp, Homo sapiens
gtccccacctggga

SEQ ID NO: 6357015 - DNA, 15 bp, Homo sapiens
gtccccactcacccc

SEQ ID NO: 6357016 - DNA, 17 bp, Homo sapiens
gtccccactcaccccct

SEQ ID NO: 6357017 - DNA, 14 bp, Homo sapiens
gtccccagaagcag

SEQ ID NO: 6357018 - DNA, 16 bp, Homo sapiens
gtccccagaccagtag

SEQ ID NO: 6357019 - DNA, 20 bp, Homo sapiens
gtccccagaccagtagtgac

SEQ ID NO: 6357020 - DNA, 21 bp, Homo sapiens
gtccccagaccagtagtgacc

SEQ ID NO: 6357021 - DNA, 21 bp, Homo sapiens
gtccccagacccttcttgcct

SEQ ID NO: 6357022 - DNA, 16 bp, Homo sapiens
gtccccagactcagct

SEQ ID NO: 6357023 - DNA, 13 bp, Homo sapiens
gtccccagcattg

SEQ ID NO: 6357024 - DNA, 11 bp, Homo sapiens
gtccccagccc

SEQ ID NO: 6357025 - DNA, 22 bp, Homo sapiens
gtccccagcccctcaaccctcc

SEQ ID NO: 6357026 - DNA, 15 bp, Homo sapiens
gtccccagccctggg

SEQ ID NO: 6357027 - DNA, 18 bp, Homo sapiens
gtccccagccctgggctt

SEQ ID NO: 6357028 - DNA, 19 bp, Homo sapiens
gtccccagcccttctgcct

SEQ ID NO: 6357029 - DNA, 16 bp, Homo sapiens
gtccccagcctacctc

SEQ ID NO: 6357030 - DNA, 13 bp, Homo sapiens
gtccccagcctgg

SEQ ID NO: 6357031 - DNA, 12 bp, Homo sapiens
gtccccagctcc

SEQ ID NO: 6357032 - DNA, 14 bp, Homo sapiens
gtccccagctcccc

SEQ ID NO: 6357033 - DNA, 15 bp, Homo sapiens
gtccccaggcccagc

SEQ ID NO: 6357034 - DNA, 17 bp, Homo sapiens
gtccccaggcccagccc

SEQ ID NO: 6357035 - DNA, 18 bp, Homo sapiens
gtccccaggcctggctcc

SEQ ID NO: 6357036 - DNA, 22 bp, Homo sapiens
gtccccagggcccctccctctg

SEQ ID NO: 6357037 - DNA, 23 bp, Homo sapiens
gtccccagggctgtcatctgaat

SEQ ID NO: 6357038 - DNA, 23 bp, Homo sapiens
gtccccaggggcacacttcccct

SEQ ID NO: 6357039 - DNA, 18 bp, Homo sapiens
gtccccaggtcctgtctc

SEQ ID NO: 6357040 - DNA, 20 bp, Homo sapiens
taagcaaggtgtccctgcct

SEQ ID NO: 6357041 - DNA, 16 bp, Homo sapiens
taagcaagtgagcaga

SEQ ID NO: 6357042 - DNA, 15 bp, Homo sapiens
taagcaataaaactg

SEQ ID NO: 6357043 - DNA, 19 bp, Homo sapiens
taagcaataaggaaatgta

SEQ ID NO: 6357044 - DNA, 17 bp, Homo sapiens
taagcaatcactgggcc

SEQ ID NO: 6357045 - DNA, 22 bp, Homo sapiens
taagcaatcactgggcccagag

SEQ ID NO: 6357046 - DNA, 15 bp, Homo sapiens
taagcaatcatttta

SEQ ID NO: 6357047 - DNA, 16 bp, Homo sapiens
taagcaatcattttat

SEQ ID NO: 6357048 - DNA, 18 bp, Homo sapiens
taagcaatggtaattgtg

SEQ ID NO: 6357049 - DNA, 18 bp, Homo sapiens
taagcaattctaagtgag

SEQ ID NO: 6357050 - DNA, 18 bp, Homo sapiens
taagcacacttgacatca

SEQ ID NO: 6357051 - DNA, 20 bp, Homo sapiens
taagcacagacaattctaat

SEQ ID NO: 6357052 - DNA, 23 bp, Homo sapiens
taagcaccataaccaagaaatac

SEQ ID NO: 6357053 - DNA, 22 bp, Homo sapiens
taagcacctgtaatgtgcgagg

SEQ ID NO: 6357054 - DNA, 16 bp, Homo sapiens
taagcacctttagaat

SEQ ID NO: 6357055 - DNA, 17 bp, Homo sapiens
taagcactacataaact

SEQ ID NO: 6357056 - DNA, 20 bp, Homo sapiens
taagcactgaaaaacaacaa

SEQ ID NO: 6357057 - DNA, 14 bp, Homo sapiens
taagcactgtgcta

SEQ ID NO: 6357058 - DNA, 15 bp, Homo sapiens
taagcacttgcctgg

SEQ ID NO: 6357059 - DNA, 16 bp, Homo sapiens
taagcacttgcctgga

SEQ ID NO: 6357060 - DNA, 21 bp, Homo sapiens
taagcacttgcctggaataaa

SEQ ID NO: 6357061 - DNA, 18 bp, Homo sapiens
taagcactttaacacagt

SEQ ID NO: 6357062 - DNA, 15 bp, Homo sapiens
taagcactttgaaaa

SEQ ID NO: 6357063 - DNA, 20 bp, Homo sapiens
taagcactttgaaaatattt

SEQ ID NO: 6357064 - DNA, 22 bp, Homo sapiens
taagcactttgaaaatatttct

SEQ ID NO: 6357065 - DNA, 23 bp, Homo sapiens
taagcactttgaaaatatttcta

SEQ ID NO: 6357066 - DNA, 16 bp, Homo sapiens
taagcactttttaaaa

SEQ ID NO: 6357067 - DNA, 13 bp, Homo sapiens
taagcagaaagtg

SEQ ID NO: 6357068 - DNA, 21 bp, Homo sapiens
taagcagaaagtgcctttcag

SEQ ID NO: 6357069 - DNA, 17 bp, Homo sapiens
taagcagaacaaatgtg

SEQ ID NO: 6357070 - DNA, 21 bp, Homo sapiens
taagcagaacaaatgtgtttt

SEQ ID NO: 6357071 - DNA, 18 bp, Homo sapiens
taagcagaagactctcca

SEQ ID NO: 6357072 - DNA, 21 bp, Homo sapiens
taagcagaattggaaaagact

SEQ ID NO: 6357073 - DNA, 23 bp, Homo sapiens
taagcagagataaataaaagata

SEQ ID NO: 6357074 - DNA, 13 bp, Homo sapiens
taagcagaggagg

SEQ ID NO: 6357075 - DNA, 16 bp, Homo sapiens
taagcagaggaggggc

SEQ ID NO: 6357076 - DNA, 17 bp, Homo sapiens
taagcagaggaggggcc

SEQ ID NO: 6357077 - DNA, 17 bp, Homo sapiens
taagcagagttctttgc

SEQ ID NO: 6357078 - DNA, 18 bp, Homo sapiens
taagcagattacaataaa

SEQ ID NO: 6357079 - DNA, 18 bp, Homo sapiens
taagcagattgctttaat

SEQ ID NO: 6357080 - DNA, 16 bp, Homo sapiens
taagcagcatggaaaa

SEQ ID NO: 6357081 - DNA, 19 bp, Homo sapiens
taagcagcatggaaaaatg

SEQ ID NO: 6357082 - DNA, 18 bp, Homo sapiens
taagcagcatttctgaag

SEQ ID NO: 6357083 - DNA, 21 bp, Homo sapiens
taagcagcatttctgaagtgg

SEQ ID NO: 6357084 - DNA, 14 bp, Homo sapiens
taagcagccaggag

SEQ ID NO: 6357085 - DNA, 17 bp, Homo sapiens
taagcagcctttctgtg

SEQ ID NO: 6357086 - DNA, 16 bp, Homo sapiens
taagcagcctttgtgg

SEQ ID NO: 6357087 - DNA, 18 bp, Homo sapiens
taagcagctcttgctaat

SEQ ID NO: 6357088 - DNA, 20 bp, Homo sapiens
taagcagctggtcttttctc

SEQ ID NO: 6357089 - DNA, 23 bp, Homo sapiens
taagcagcttgaatggtttttct

SEQ ID NO: 6357090 - DNA, 21 bp, Homo sapiens
taagcaggaaggatggcaagc

SEQ ID NO: 6357091 - DNA, 21 bp, Homo sapiens
taagcaggagagaaatttctc

SEQ ID NO: 6357092 - DNA, 21 bp, Homo sapiens
taagcaggtggatctatttca

SEQ ID NO: 6357093 - DNA, 19 bp, Homo sapiens
taagcagtacatcttgtgc

SEQ ID NO: 6357094 - DNA, 12 bp, Homo sapiens
taagcagtatat

SEQ ID NO: 6357095 - DNA, 12 bp, Homo sapiens
taagcagtccct

SEQ ID NO: 6357096 - DNA, 18 bp, Homo sapiens
taagcagtgtctgtgttt

SEQ ID NO: 6357097 - DNA, 20 bp, Homo sapiens
taagcagttcattctaccaa

SEQ ID NO: 6357098 - DNA, 17 bp, Homo sapiens
taagcagttgcaatgat

SEQ ID NO: 6357099 - DNA, 19 bp, Homo sapiens
taagcagttttgtaaatgt

SEQ ID NO: 6357100 - DNA, 20 bp, Homo sapiens
taagcagttttgtaaatgta

SEQ ID NO: 6357101 - DNA, 23 bp, Homo sapiens
taagcataaaagatgaaagagca

SEQ ID NO: 6357102 - DNA, 16 bp, Homo sapiens
taagcataagaccaat

SEQ ID NO: 6357103 - DNA, 14 bp, Homo sapiens
taagcataatctga

SEQ ID NO: 6357104 - DNA, 18 bp, Homo sapiens
taagcatactttgtaaat

SEQ ID NO: 6357105 - DNA, 21 bp, Homo sapiens
taagcatatatttttatattt

SEQ ID NO: 6357106 - DNA, 23 bp, Homo sapiens
taagcatatatttttatatttac

SEQ ID NO: 6357107 - DNA, 21 bp, Homo sapiens
taagcatatcgtaaagctgtt

SEQ ID NO: 6357108 - DNA, 15 bp, Homo sapiens
taagcatcaaactct

SEQ ID NO: 6357109 - DNA, 21 bp, Homo sapiens
taagcatcattatttatgtat

SEQ ID NO: 6357110 - DNA, 14 bp, Homo sapiens
taagcatctaagtt

SEQ ID NO: 6357111 - DNA, 17 bp, Homo sapiens
taagcatctacttcagg

SEQ ID NO: 6357112 - DNA, 20 bp, Homo sapiens
taagcatgatcttgttaatg

SEQ ID NO: 6357113 - DNA, 15 bp, Homo sapiens
taagcatgcacaaat

SEQ ID NO: 6357114 - DNA, 17 bp, Homo sapiens
taagcatgtgtcccagg

SEQ ID NO: 6357115 - DNA, 19 bp, Homo sapiens
taagcattaccactcaggc

SEQ ID NO: 6357116 - DNA, 19 bp, Homo sapiens
taagcattactcttgtaag

SEQ ID NO: 6357117 - DNA, 13 bp, Homo sapiens
taagcattagctt

SEQ ID NO: 6357118 - DNA, 20 bp, Homo sapiens
taagcattccaactatctca

SEQ ID NO: 6357119 - DNA, 16 bp, Homo sapiens
taagcattccacactg

SEQ ID NO: 6357120 - DNA, 15 bp, Homo sapiens
taagcattctgagct

SEQ ID NO: 6357121 - DNA, 16 bp, Homo sapiens
taagcattctgagctg

SEQ ID NO: 6357122 - DNA, 16 bp, Homo sapiens
taagcattcttagact

SEQ ID NO: 6357123 - DNA, 23 bp, Homo sapiens
taagcattcttagactagttgaa

SEQ ID NO: 6357124 - DNA, 14 bp, Homo sapiens
taagcattgcctgg

SEQ ID NO: 6357125 - DNA, 15 bp, Homo sapiens
taagcattgtttgct

SEQ ID NO: 6357126 - DNA, 18 bp, Homo sapiens
taagcattgtttgcttat

SEQ ID NO: 6357127 - DNA, 23 bp, Homo sapiens
taagcattgtttgcttattgttc

SEQ ID NO: 6357128 - DNA, 13 bp, Homo sapiens
taagcattttctc

SEQ ID NO: 6357129 - DNA, 17 bp, Homo sapiens
taagcattttgaaacaa

SEQ ID NO: 6357130 - DNA, 21 bp, Homo sapiens
taagcattttgaaacaaagta

SEQ ID NO: 6357131 - DNA, 18 bp, Homo sapiens
taagccaaaactgagcat

SEQ ID NO: 6357132 - DNA, 17 bp, Homo sapiens
taagccaaaattaaggt

SEQ ID NO: 6357133 - DNA, 19 bp, Homo sapiens
taagccaaaattaaggtgt

SEQ ID NO: 6357134 - DNA, 19 bp, Homo sapiens
taagccaaactcaggccca

SEQ ID NO: 6357135 - DNA, 22 bp, Homo sapiens
taagccaaactcaggcccagaa

SEQ ID NO: 6357136 - DNA, 12 bp, Homo sapiens
taagccaaagaa

SEQ ID NO: 6357137 - DNA, 22 bp, Homo sapiens
taagccaaagaaacaagctgtg

SEQ ID NO: 6357138 - DNA, 20 bp, Homo sapiens
taagccaacttgatgtgaaa

SEQ ID NO: 6357139 - DNA, 21 bp, Homo sapiens
taagccaagttttaaatatta

SEQ ID NO: 6357140 - DNA, 15 bp, Homo sapiens
taagccaataaataa

SEQ ID NO: 6357141 - DNA, 12 bp, Homo sapiens
taagccacagct

SEQ ID NO: 6357142 - DNA, 18 bp, Homo sapiens
taagccactgcctctccc

SEQ ID NO: 6357143 - DNA, 19 bp, Homo sapiens
taagccacttaaaatgttc

SEQ ID NO: 6357144 - DNA, 14 bp, Homo sapiens
taagccagagtcaa

SEQ ID NO: 6357145 - DNA, 23 bp, Homo sapiens
taagccagcaccggaccagcctg

SEQ ID NO: 6357146 - DNA, 22 bp, Homo sapiens
taagccagctgcccccagagcc

SEQ ID NO: 6357147 - DNA, 16 bp, Homo sapiens
taagccaggcctggct

SEQ ID NO: 6357148 - DNA, 17 bp, Homo sapiens
taagccaggcctggctg

SEQ ID NO: 6357149 - DNA, 20 bp, Homo sapiens
taagccagggcccctggatc

SEQ ID NO: 6357150 - DNA, 17 bp, Homo sapiens
taagccagttcacttag

SEQ ID NO: 6357151 - DNA, 19 bp, Homo sapiens
taagccagttttcattttg

SEQ ID NO: 6357152 - DNA, 19 bp, Homo sapiens
taagccatagaccctgagg

SEQ ID NO: 6357153 - DNA, 18 bp, Homo sapiens
taagccatagccccaggc

SEQ ID NO: 6357154 - DNA, 16 bp, Homo sapiens
taagccataggcccag

SEQ ID NO: 6357155 - DNA, 16 bp, Homo sapiens
taagccatcagaagtt

SEQ ID NO: 6357156 - DNA, 18 bp, Homo sapiens
taagccatttaactggag

SEQ ID NO: 6357157 - DNA, 14 bp, Homo sapiens
taagcccaaatggc

SEQ ID NO: 6357158 - DNA, 20 bp, Homo sapiens
taagcccccagggcctccag

SEQ ID NO: 6357159 - DNA, 14 bp, Homo sapiens
taagccccgaggcc

SEQ ID NO: 6357160 - DNA, 16 bp, Homo sapiens
taagccccgtctgacc

SEQ ID NO: 6357161 - DNA, 16 bp, Homo sapiens
taagccctaaggtcct

SEQ ID NO: 6357162 - DNA, 18 bp, Homo sapiens
taagccctcgaaccaagg

SEQ ID NO: 6357163 - DNA, 20 bp, Homo sapiens
taagccctcgaaccaaggca

SEQ ID NO: 6357164 - DNA, 19 bp, Homo sapiens
taagccctcttccatcatg

SEQ ID NO: 6357165 - DNA, 12 bp, Homo sapiens
taagccctgaga

SEQ ID NO: 6357166 - DNA, 16 bp, Homo sapiens
taagccctgcataatg

SEQ ID NO: 6357167 - DNA, 17 bp, Homo sapiens
taagccctgctctttct

SEQ ID NO: 6357168 - DNA, 14 bp, Homo sapiens
taagcccttgaaga

SEQ ID NO: 6357169 - DNA, 15 bp, Homo sapiens
taagccctttgctct

SEQ ID NO: 6357170 - DNA, 19 bp, Homo sapiens
taagccctttgctctggag

SEQ ID NO: 6357171 - DNA, 23 bp, Homo sapiens
taagccgatggtcactatagctc

SEQ ID NO: 6357172 - DNA, 19 bp, Homo sapiens
taagccgcagacctggagc

SEQ ID NO: 6357173 - DNA, 17 bp, Homo sapiens
taagcctacctgctctc

SEQ ID NO: 6357174 - DNA, 23 bp, Homo sapiens
taagcctaggtgttgtcagcagg

SEQ ID NO: 6357175 - DNA, 15 bp, Homo sapiens
taagcctcaggcctg

SEQ ID NO: 6357176 - DNA, 20 bp, Homo sapiens
taagcctcatatttaaagac

SEQ ID NO: 6357177 - DNA, 19 bp, Homo sapiens
taagcctcatcatcagagc

SEQ ID NO: 6357178 - DNA, 16 bp, Homo sapiens
taagcctccctcctcg

SEQ ID NO: 6357179 - DNA, 13 bp, Homo sapiens
taagcctctgctt

SEQ ID NO: 6357180 - DNA, 13 bp, Homo sapiens
taagcctgagcct

SEQ ID NO: 6357181 - DNA, 13 bp, Homo sapiens
taagcctgatgat

SEQ ID NO: 6357182 - DNA, 22 bp, Homo sapiens
taagcctgcggcgccagcctca

SEQ ID NO: 6357183 - DNA, 18 bp, Homo sapiens
taagcctggaagccatcc

SEQ ID NO: 6357184 - DNA, 19 bp, Homo sapiens
taagcctggcttagaaggc

SEQ ID NO: 6357185 - DNA, 14 bp, Homo sapiens
taagcctgtcccca

SEQ ID NO: 6357186 - DNA, 20 bp, Homo sapiens
taagcctgtggctgtggaga

SEQ ID NO: 6357187 - DNA, 14 bp, Homo sapiens
taagccttcaaaac

SEQ ID NO: 6357188 - DNA, 14 bp, Homo sapiens
taagccttcatttg

SEQ ID NO: 6357189 - DNA, 19 bp, Homo sapiens
taagccttcatttgcaatt

SEQ ID NO: 6357190 - DNA, 14 bp, Homo sapiens
taagccttgacaca

SEQ ID NO: 6357191 - DNA, 12 bp, Homo sapiens
taagccttgtcg

SEQ ID NO: 6357192 - DNA, 15 bp, Homo sapiens
taagcctttccataa

SEQ ID NO: 6357193 - DNA, 16 bp, Homo sapiens
taagcctttccataag

SEQ ID NO: 6357194 - DNA, 14 bp, Homo sapiens
taagcctttgaagt

SEQ ID NO: 6357195 - DNA, 18 bp, Homo sapiens
taagcctttgagactgtt

SEQ ID NO: 6357196 - DNA, 20 bp, Homo sapiens
taagcctttgagactgttcc

SEQ ID NO: 6357197 - DNA, 17 bp, Homo sapiens
taagcctttggaaacag

SEQ ID NO: 6357198 - DNA, 21 bp, Homo sapiens
taagcgaagtctttgccttct

SEQ ID NO: 6357199 - DNA, 20 bp, Homo sapiens
taagcggctcaagcccagga

SEQ ID NO: 6357200 - DNA, 22 bp, Homo sapiens
taagcgtatggctttatttttt

SEQ ID NO: 6357201 - DNA, 19 bp, Homo sapiens
taagcgttaagggcagagt

SEQ ID NO: 6357202 - DNA, 15 bp, Homo sapiens
taagctaaaatgtta

SEQ ID NO: 6357203 - DNA, 16 bp, Homo sapiens
taagctaccttgtcat

SEQ ID NO: 6357204 - DNA, 15 bp, Homo sapiens
taagctactgccatc

SEQ ID NO: 6357205 - DNA, 17 bp, Homo sapiens
taagctagaagaagtga

SEQ ID NO: 6357206 - DNA, 20 bp, Homo sapiens
taagctaggaaaagaaatct

SEQ ID NO: 6357207 - DNA, 16 bp, Homo sapiens
taagctagttgaatac

SEQ ID NO: 6357208 - DNA, 19 bp, Homo sapiens
taagctagttgaatacttg

SEQ ID NO: 6357209 - DNA, 22 bp, Homo sapiens
taagctagttgaatacttgaac

SEQ ID NO: 6357210 - DNA, 14 bp, Homo sapiens
taagctatcagcaa

SEQ ID NO: 6357211 - DNA, 17 bp, Homo sapiens
taagctatttatgtaaa

SEQ ID NO: 6357212 - DNA, 14 bp, Homo sapiens
taagctatttgatg

SEQ ID NO: 6357213 - DNA, 17 bp, Homo sapiens
taagctatttttctaac

SEQ ID NO: 6357214 - DNA, 19 bp, Homo sapiens
taagctcagtgctctctcc

SEQ ID NO: 6357215 - DNA, 14 bp, Homo sapiens
taagctccagcttt

SEQ ID NO: 6357216 - DNA, 19 bp, Homo sapiens
taagctccaggtgccctgt

SEQ ID NO: 6357217 - DNA, 16 bp, Homo sapiens
gtccccagtccccagc

SEQ ID NO: 6357218 - DNA, 19 bp, Homo sapiens
gtccccagtccccagccct

SEQ ID NO: 6357219 - DNA, 20 bp, Homo sapiens
gtccccagtccccagccctg

SEQ ID NO: 6357220 - DNA, 21 bp, Homo sapiens
gtccccagtccccagccctgg

SEQ ID NO: 6357221 - DNA, 21 bp, Homo sapiens
gtccccagtgtggactctgga

SEQ ID NO: 6357222 - DNA, 18 bp, Homo sapiens
gtccccagtttgcagaaa

SEQ ID NO: 6357223 - DNA, 20 bp, Homo sapiens
gtccccataagacaaacact

SEQ ID NO: 6357224 - DNA, 20 bp, Homo sapiens
gtccccatcatcccagctgc

SEQ ID NO: 6357225 - DNA, 12 bp, Homo sapiens
gtccccatccca

SEQ ID NO: 6357226 - DNA, 23 bp, Homo sapiens
gtccccatcccattttcatcctg

SEQ ID NO: 6357227 - DNA, 12 bp, Homo sapiens
gtccccatcccc

SEQ ID NO: 6357228 - DNA, 13 bp, Homo sapiens
gtccccatcccca

SEQ ID NO: 6357229 - DNA, 15 bp, Homo sapiens
gtccccatccccacc

SEQ ID NO: 6357230 - DNA, 21 bp, Homo sapiens
gtccccatccccaccagctcg

SEQ ID NO: 6357231 - DNA, 23 bp, Homo sapiens
gtccccattctataaattcaaca

SEQ ID NO: 6357232 - DNA, 17 bp, Homo sapiens
gtccccatttctgcctc

SEQ ID NO: 6357233 - DNA, 18 bp, Homo sapiens
gtccccatttctgcctcg

SEQ ID NO: 6357234 - DNA, 16 bp, Homo sapiens
gtcccccaactctgag

SEQ ID NO: 6357235 - DNA, 19 bp, Homo sapiens
gtcccccaactctgagccc

SEQ ID NO: 6357236 - DNA, 20 bp, Homo sapiens
gtcccccacccacctcctgc

SEQ ID NO: 6357237 - DNA, 15 bp, Homo sapiens
gtcccccactctctc

SEQ ID NO: 6357238 - DNA, 18 bp, Homo sapiens
gtcccccactctctcacc

SEQ ID NO: 6357239 - DNA, 23 bp, Homo sapiens
gtcccccactgctaaggctgctg

SEQ ID NO: 6357240 - DNA, 19 bp, Homo sapiens
gtcccccagagcatctgcc

SEQ ID NO: 6357241 - DNA, 11 bp, Homo sapiens
gtcccccagca

SEQ ID NO: 6357242 - DNA, 14 bp, Homo sapiens
gtcccccagccctc

SEQ ID NO: 6357243 - DNA, 19 bp, Homo sapiens
gtcccccagccctcaggcc

SEQ ID NO: 6357244 - DNA, 12 bp, Homo sapiens
gtcccccagctc

SEQ ID NO: 6357245 - DNA, 15 bp, Homo sapiens
gtcccccagctctgg

SEQ ID NO: 6357246 - DNA, 13 bp, Homo sapiens
gtcccccaggctg

SEQ ID NO: 6357247 - DNA, 20 bp, Homo sapiens
gtcccccaggctggagtgca

SEQ ID NO: 6357248 - DNA, 22 bp, Homo sapiens
gtcccccatccccatcctccag

SEQ ID NO: 6357249 - DNA, 23 bp, Homo sapiens
gtccccccaaatctactgagcca

SEQ ID NO: 6357250 - DNA, 23 bp, Homo sapiens
gtccccccacccctccccaccca

SEQ ID NO: 6357251 - DNA, 13 bp, Homo sapiens
gtccccccaccct

SEQ ID NO: 6357252 - DNA, 22 bp, Homo sapiens
gtccccccaggtgctggaggca

SEQ ID NO: 6357253 - DNA, 21 bp, Homo sapiens
gtccccccccaacctttccct

SEQ ID NO: 6357254 - DNA, 17 bp, Homo sapiens
gtcccccctccattccc

SEQ ID NO: 6357255 - DNA, 20 bp, Homo sapiens
gtcccccctgagtgggctgg

SEQ ID NO: 6357256 - DNA, 21 bp, Homo sapiens
gtcccccctgtggtctgtgtg

SEQ ID NO: 6357257 - DNA, 21 bp, Homo sapiens
gtccccccttgaagcaataac

SEQ ID NO: 6357258 - DNA, 18 bp, Homo sapiens
gtcccccgactgcctgtc

SEQ ID NO: 6357259 - DNA, 19 bp, Homo sapiens
gtcccccgactgcctgtct

SEQ ID NO: 6357260 - DNA, 20 bp, Homo sapiens
gtcccccgactgcctgtctc

SEQ ID NO: 6357261 - DNA, 15 bp, Homo sapiens
gtcccccgccgcgcc

SEQ ID NO: 6357262 - DNA, 21 bp, Homo sapiens
gtcccccgccgcgccagtccc

SEQ ID NO: 6357263 - DNA, 22 bp, Homo sapiens
gtcccccgccgcgccagtcccc

SEQ ID NO: 6357264 - DNA, 16 bp, Homo sapiens
gtcccccgttgtgcct

SEQ ID NO: 6357265 - DNA, 19 bp, Homo sapiens
gtcccccgttgtgcctggt

SEQ ID NO: 6357266 - DNA, 15 bp, Homo sapiens
gtccccctacccacc

SEQ ID NO: 6357267 - DNA, 11 bp, Homo sapiens
gtccccctccc

SEQ ID NO: 6357268 - DNA, 13 bp, Homo sapiens
gtccccctccctg

SEQ ID NO: 6357269 - DNA, 16 bp, Homo sapiens
gtccccctccctgccc

SEQ ID NO: 6357270 - DNA, 17 bp, Homo sapiens
gtccccctcctcagcca

SEQ ID NO: 6357271 - DNA, 19 bp, Homo sapiens
gtccccctcctcagccagc

SEQ ID NO: 6357272 - DNA, 13 bp, Homo sapiens
gtccccctcctgc

SEQ ID NO: 6357273 - DNA, 14 bp, Homo sapiens
gtccccctcctgca

SEQ ID NO: 6357274 - DNA, 14 bp, Homo sapiens
gtccccctctggct

SEQ ID NO: 6357275 - DNA, 18 bp, Homo sapiens
gtccccctgacaacactc

SEQ ID NO: 6357276 - DNA, 14 bp, Homo sapiens
gtcccccttccatg

SEQ ID NO: 6357277 - DNA, 18 bp, Homo sapiens
gtcccccttccatggact

SEQ ID NO: 6357278 - DNA, 17 bp, Homo sapiens
gtccccgaggagctggg

SEQ ID NO: 6357279 - DNA, 21 bp, Homo sapiens
gtccccgagggcgaaggccat

SEQ ID NO: 6357280 - DNA, 17 bp, Homo sapiens
gtccccgagtgcctagg

SEQ ID NO: 6357281 - DNA, 17 bp, Homo sapiens
gtccccgatgctgacct

SEQ ID NO: 6357282 - DNA, 16 bp, Homo sapiens
gtccccgcactgggct

SEQ ID NO: 6357283 - DNA, 17 bp, Homo sapiens
gtccccgccttccctca

SEQ ID NO: 6357284 - DNA, 14 bp, Homo sapiens
gtccccgctgctgt

SEQ ID NO: 6357285 - DNA, 15 bp, Homo sapiens
gtccccgctgctgtg

SEQ ID NO: 6357286 - DNA, 13 bp, Homo sapiens
gtccccgctggct

SEQ ID NO: 6357287 - DNA, 16 bp, Homo sapiens
gtccccggacgctggc

SEQ ID NO: 6357288 - DNA, 17 bp, Homo sapiens
gtccccggacgctggct

SEQ ID NO: 6357289 - DNA, 23 bp, Homo sapiens
gtccccggcggggtgcctgctgt

SEQ ID NO: 6357290 - DNA, 19 bp, Homo sapiens
gtccccgggagcacacgaa

SEQ ID NO: 6357291 - DNA, 22 bp, Homo sapiens
gtccccggggttccccacacag

SEQ ID NO: 6357292 - DNA, 17 bp, Homo sapiens
gtccccgtagccccggc

SEQ ID NO: 6357293 - DNA, 22 bp, Homo sapiens
gtccccgtgccccgcctccccg

SEQ ID NO: 6357294 - DNA, 22 bp, Homo sapiens
gtccccgtggatggtctccacc

SEQ ID NO: 6357295 - DNA, 18 bp, Homo sapiens
gtccccgtgtgccccaag

SEQ ID NO: 6357296 - DNA, 11 bp, Homo sapiens
gtcccctactc

SEQ ID NO: 6357297 - DNA, 16 bp, Homo sapiens
gtcccctactccctct

SEQ ID NO: 6357298 - DNA, 15 bp, Homo sapiens
gtcccctatcctccc

SEQ ID NO: 6357299 - DNA, 23 bp, Homo sapiens
gtcccctcaagccccttctctca

SEQ ID NO: 6357300 - DNA, 23 bp, Homo sapiens
gtcccctcacagactcttccacc

SEQ ID NO: 6357301 - DNA, 17 bp, Homo sapiens
gtcccctcacctccacc

SEQ ID NO: 6357302 - DNA, 13 bp, Homo sapiens
gtcccctcactct

SEQ ID NO: 6357303 - DNA, 18 bp, Homo sapiens
gtcccctcactctgtcag

SEQ ID NO: 6357304 - DNA, 19 bp, Homo sapiens
gtcccctcactctgtcagc

SEQ ID NO: 6357305 - DNA, 12 bp, Homo sapiens
gtcccctcagcg

SEQ ID NO: 6357306 - DNA, 13 bp, Homo sapiens
gtcccctcagctc

SEQ ID NO: 6357307 - DNA, 15 bp, Homo sapiens
gtcccctccaggaag

SEQ ID NO: 6357308 - DNA, 16 bp, Homo sapiens
gtcccctccaggaaga

SEQ ID NO: 6357309 - DNA, 18 bp, Homo sapiens
gtcccctccatctgggga

SEQ ID NO: 6357310 - DNA, 12 bp, Homo sapiens
gtcccctcccat

SEQ ID NO: 6357311 - DNA, 15 bp, Homo sapiens
gtcccctcccatctg

SEQ ID NO: 6357312 - DNA, 16 bp, Homo sapiens
gtcccctcccatctgg

SEQ ID NO: 6357313 - DNA, 19 bp, Homo sapiens
gtcccctcccatctgggag

SEQ ID NO: 6357314 - DNA, 20 bp, Homo sapiens
gtcccctccccagctccctt

SEQ ID NO: 6357315 - DNA, 12 bp, Homo sapiens
gtcccctccccc

SEQ ID NO: 6357316 - DNA, 22 bp, Homo sapiens
gtcccctccccggccctaccag

SEQ ID NO: 6357317 - DNA, 17 bp, Homo sapiens
gtcccctccctcgtggg

SEQ ID NO: 6357318 - DNA, 13 bp, Homo sapiens
gtcccctccgcca

SEQ ID NO: 6357319 - DNA, 14 bp, Homo sapiens
gtcccctccgtagg

SEQ ID NO: 6357320 - DNA, 14 bp, Homo sapiens
gtcccctcctcagt

SEQ ID NO: 6357321 - DNA, 14 bp, Homo sapiens
gtcccctccttccc

SEQ ID NO: 6357322 - DNA, 22 bp, Homo sapiens
gtcccctccttccctcaccccc

SEQ ID NO: 6357323 - DNA, 23 bp, Homo sapiens
gtcccctccttccctcaccccca

SEQ ID NO: 6357324 - DNA, 18 bp, Homo sapiens
gtcccctcgtcccatcca

SEQ ID NO: 6357325 - DNA, 15 bp, Homo sapiens
gtcccctctcccctt

SEQ ID NO: 6357326 - DNA, 15 bp, Homo sapiens
gtcccctctctctgg

SEQ ID NO: 6357327 - DNA, 18 bp, Homo sapiens
gtcccctctgccccaccc

SEQ ID NO: 6357328 - DNA, 11 bp, Homo sapiens
gtcccctctgt

SEQ ID NO: 6357329 - DNA, 21 bp, Homo sapiens
gtcccctctgtcatcactccc

SEQ ID NO: 6357330 - DNA, 15 bp, Homo sapiens
gtcccctcttgcccc

SEQ ID NO: 6357331 - DNA, 23 bp, Homo sapiens
gtcccctcttgccccaaccccca

SEQ ID NO: 6357332 - DNA, 17 bp, Homo sapiens
gtcccctgacctgtcca

SEQ ID NO: 6357333 - DNA, 12 bp, Homo sapiens
gtcccctgaggt

SEQ ID NO: 6357334 - DNA, 17 bp, Homo sapiens
gtcccctgcagcctggg

SEQ ID NO: 6357335 - DNA, 19 bp, Homo sapiens
gtcccctgccccagaggtc

SEQ ID NO: 6357336 - DNA, 18 bp, Homo sapiens
gtcccctgctacacctat

SEQ ID NO: 6357337 - DNA, 13 bp, Homo sapiens
gtcccctggagtg

SEQ ID NO: 6357338 - DNA, 18 bp, Homo sapiens
gtcccctgggccaccctt

SEQ ID NO: 6357339 - DNA, 16 bp, Homo sapiens
gtcccctggggctggt

SEQ ID NO: 6357340 - DNA, 15 bp, Homo sapiens
gtccccttcccctgc

SEQ ID NO: 6357341 - DNA, 12 bp, Homo sapiens
gtccccttcccg

SEQ ID NO: 6357342 - DNA, 14 bp, Homo sapiens
gtccccttcccttt

SEQ ID NO: 6357343 - DNA, 20 bp, Homo sapiens
gtccccttcctgttcttcct

SEQ ID NO: 6357344 - DNA, 12 bp, Homo sapiens
gtccccttctct

SEQ ID NO: 6357345 - DNA, 13 bp, Homo sapiens
gtccccttctgtg

SEQ ID NO: 6357346 - DNA, 14 bp, Homo sapiens
gtccccttctgtgt

SEQ ID NO: 6357347 - DNA, 23 bp, Homo sapiens
gtccccttctgtgtttctggagt

SEQ ID NO: 6357348 - DNA, 23 bp, Homo sapiens
gtccccttttcttttctacccta

SEQ ID NO: 6357349 - DNA, 15 bp, Homo sapiens
gtcccgaatccacag

SEQ ID NO: 6357350 - DNA, 14 bp, Homo sapiens
gtcccgagccccct

SEQ ID NO: 6357351 - DNA, 20 bp, Homo sapiens
gtcccgagccccctgtcctt

SEQ ID NO: 6357352 - DNA, 22 bp, Homo sapiens
gtcccgagccctcacaccctgg

SEQ ID NO: 6357353 - DNA, 14 bp, Homo sapiens
gtcccgaggcagca

SEQ ID NO: 6357354 - DNA, 19 bp, Homo sapiens
gtcccgatagggtatttga

SEQ ID NO: 6357355 - DNA, 18 bp, Homo sapiens
gtcccgccctggctcttt

SEQ ID NO: 6357356 - DNA, 24 bp, Homo sapiens
gtcccgcgaaacccggtgcatctg

SEQ ID NO: 6357357 - DNA, 16 bp, Homo sapiens
gtcccgctgcctcctg

SEQ ID NO: 6357358 - DNA, 18 bp, Homo sapiens
gtcccgctgcctcctgct

SEQ ID NO: 6357359 - DNA, 20 bp, Homo sapiens
gtcccgctgctgtgctctgg

SEQ ID NO: 6357360 - DNA, 23 bp, Homo sapiens
gtcccgcttattctcctccctgt

SEQ ID NO: 6357361 - DNA, 19 bp, Homo sapiens
gtcccggagctcaggccct

SEQ ID NO: 6357362 - DNA, 18 bp, Homo sapiens
gtcccggaggcggtgggc

SEQ ID NO: 6357363 - DNA, 20 bp, Homo sapiens
gtcccggagtgcccgtgaag

SEQ ID NO: 6357364 - DNA, 23 bp, Homo sapiens
gtcccgggaatgaccgctctccc

SEQ ID NO: 6357365 - DNA, 17 bp, Homo sapiens
gtcccggggccagcact

SEQ ID NO: 6357366 - DNA, 16 bp, Homo sapiens
gtcccggggtcctgtg

SEQ ID NO: 6357367 - DNA, 21 bp, Homo sapiens
gtcccggggtcctgtggcagg

SEQ ID NO: 6357368 - DNA, 19 bp, Homo sapiens
gtcccgggtactcagtcag

SEQ ID NO: 6357369 - DNA, 23 bp, Homo sapiens
gtcccgggtgccccccatgccct

SEQ ID NO: 6357370 - DNA, 16 bp, Homo sapiens
gtcccggtgtatcctg

SEQ ID NO: 6357371 - DNA, 22 bp, Homo sapiens
gtcccggttcagacccctgcct

SEQ ID NO: 6357372 - DNA, 18 bp, Homo sapiens
gtcccgtcgtgcagtcag

SEQ ID NO: 6357373 - DNA, 15 bp, Homo sapiens
gtccctaaagaaaaa

SEQ ID NO: 6357374 - DNA, 17 bp, Homo sapiens
gtccctaaagaaaaaaa

SEQ ID NO: 6357375 - DNA, 20 bp, Homo sapiens
gtccctaagcacaataaaag

SEQ ID NO: 6357376 - DNA, 22 bp, Homo sapiens
gtccctaagtaagtttcttcct

SEQ ID NO: 6357377 - DNA, 15 bp, Homo sapiens
gtccctaataaagct

SEQ ID NO: 6357378 - DNA, 16 bp, Homo sapiens
gtccctaataaagctg

SEQ ID NO: 6357379 - DNA, 14 bp, Homo sapiens
gtccctaccactga

SEQ ID NO: 6357380 - DNA, 18 bp, Homo sapiens
gtccctaccactgagccc

SEQ ID NO: 6357381 - DNA, 19 bp, Homo sapiens
gtccctaccactgagccct

SEQ ID NO: 6357382 - DNA, 13 bp, Homo sapiens
gtccctacccact

SEQ ID NO: 6357383 - DNA, 20 bp, Homo sapiens
gtccctacccactctttgct

SEQ ID NO: 6357384 - DNA, 23 bp, Homo sapiens
gtccctacccactctttgctaca

SEQ ID NO: 6357385 - DNA, 16 bp, Homo sapiens
gtccctacttaggaaa

SEQ ID NO: 6357386 - DNA, 21 bp, Homo sapiens
gtccctaggagggaaggagct

SEQ ID NO: 6357387 - DNA, 17 bp, Homo sapiens
gtccctagggctctcca

SEQ ID NO: 6357388 - DNA, 21 bp, Homo sapiens
gtccctataataaaggctgag

SEQ ID NO: 6357389 - DNA, 22 bp, Homo sapiens
gtccctatatcagggcctgagt

SEQ ID NO: 6357390 - DNA, 23 bp, Homo sapiens
gtccctatctattaaagtgactt

SEQ ID NO: 6357391 - DNA, 22 bp, Homo sapiens
gtccctatgtatttgcagttca

SEQ ID NO: 6357392 - DNA, 13 bp, Homo sapiens
gtccctattctgc

SEQ ID NO: 6357393 - DNA, 15 bp, Homo sapiens
gtccctattctgcca

SEQ ID NO: 6357394 - DNA, 21 bp, Homo sapiens
gtccctcacgtttcttcccca

SEQ ID NO: 6357395 - DNA, 22 bp, Homo sapiens
taagctccaggtgccctgtggg

SEQ ID NO: 6357396 - DNA, 19 bp, Homo sapiens
taagctccagttttcgtat

SEQ ID NO: 6357397 - DNA, 21 bp, Homo sapiens
taagctccatgtgcatataaa

SEQ ID NO: 6357398 - DNA, 22 bp, Homo sapiens
taagctccatgtgcatataaag

SEQ ID NO: 6357399 - DNA, 15 bp, Homo sapiens
taagctcccctgcct

SEQ ID NO: 6357400 - DNA, 20 bp, Homo sapiens
taagctccttgagtaaaaag

SEQ ID NO: 6357401 - DNA, 20 bp, Homo sapiens
taagctctattatattcggt

SEQ ID NO: 6357402 - DNA, 15 bp, Homo sapiens
taagctctctgggcc

SEQ ID NO: 6357403 - DNA, 21 bp, Homo sapiens
taagctctctgggcctgggtt

SEQ ID NO: 6357404 - DNA, 12 bp, Homo sapiens
taagctctgagc

SEQ ID NO: 6357405 - DNA, 18 bp, Homo sapiens
taagctctgccccttccc

SEQ ID NO: 6357406 - DNA, 19 bp, Homo sapiens
taagctctgccccttcccc

SEQ ID NO: 6357407 - DNA, 13 bp, Homo sapiens
taagctctggctt

SEQ ID NO: 6357408 - DNA, 14 bp, Homo sapiens
taagctctttgaaa

SEQ ID NO: 6357409 - DNA, 21 bp, Homo sapiens
taagctctttgaaacaacttt

SEQ ID NO: 6357410 - DNA, 15 bp, Homo sapiens
taagctctttgagaa

SEQ ID NO: 6357411 - DNA, 16 bp, Homo sapiens
taagctctttgagaac

SEQ ID NO: 6357412 - DNA, 15 bp, Homo sapiens
taagctgaataaagt

SEQ ID NO: 6357413 - DNA, 20 bp, Homo sapiens
taagctgatattatttcttc

SEQ ID NO: 6357414 - DNA, 21 bp, Homo sapiens
taagctgatattatttcttct

SEQ ID NO: 6357415 - DNA, 18 bp, Homo sapiens
taagctgcacatgactac

SEQ ID NO: 6357416 - DNA, 18 bp, Homo sapiens
taagctgcagcttcctgt

SEQ ID NO: 6357417 - DNA, 18 bp, Homo sapiens
taagctgccagccttccc

SEQ ID NO: 6357418 - DNA, 16 bp, Homo sapiens
taagctggagctcttg

SEQ ID NO: 6357419 - DNA, 19 bp, Homo sapiens
taagctggagctcttggaa

SEQ ID NO: 6357420 - DNA, 18 bp, Homo sapiens
taagctggctctgtttga

SEQ ID NO: 6357421 - DNA, 18 bp, Homo sapiens
taagctggtgttataata

SEQ ID NO: 6357422 - DNA, 15 bp, Homo sapiens
taagctgtaaaaaga

SEQ ID NO: 6357423 - DNA, 14 bp, Homo sapiens
taagctgtagaact

SEQ ID NO: 6357424 - DNA, 22 bp, Homo sapiens
taagctgtgtctgcccaatgaa

SEQ ID NO: 6357425 - DNA, 12 bp, Homo sapiens
taagctgtgtgc

SEQ ID NO: 6357426 - DNA, 22 bp, Homo sapiens
taagctgttcctgttcagtaat

SEQ ID NO: 6357427 - DNA, 22 bp, Homo sapiens
taagctgtttggttttaaaata

SEQ ID NO: 6357428 - DNA, 23 bp, Homo sapiens
taagcttaaaaaagaaagatttt

SEQ ID NO: 6357429 - DNA, 15 bp, Homo sapiens
taagcttaaaataag

SEQ ID NO: 6357430 - DNA, 19 bp, Homo sapiens
taagcttagattttctgta

SEQ ID NO: 6357431 - DNA, 22 bp, Homo sapiens
taagcttccaggaaaaaggaca

SEQ ID NO: 6357432 - DNA, 22 bp, Homo sapiens
taagcttccaggctgcatagaa

SEQ ID NO: 6357433 - DNA, 14 bp, Homo sapiens
taagctttaaatga

SEQ ID NO: 6357434 - DNA, 14 bp, Homo sapiens
taagctttctcaga

SEQ ID NO: 6357435 - DNA, 14 bp, Homo sapiens
taagctttctcctt

SEQ ID NO: 6357436 - DNA, 19 bp, Homo sapiens
taagctttctctcagaaat

SEQ ID NO: 6357437 - DNA, 15 bp, Homo sapiens
taagctttgacactg

SEQ ID NO: 6357438 - DNA, 17 bp, Homo sapiens
taagctttgccagctgc

SEQ ID NO: 6357439 - DNA, 21 bp, Homo sapiens
taagctttggacccaaggaaa

SEQ ID NO: 6357440 - DNA, 12 bp, Homo sapiens
taagcttttatt

SEQ ID NO: 6357441 - DNA, 17 bp, Homo sapiens
taagcttttcattttaa

SEQ ID NO: 6357442 - DNA, 15 bp, Homo sapiens
taagctttttggaat

SEQ ID NO: 6357443 - DNA, 14 bp, Homo sapiens
taaggaaaaaaaac

SEQ ID NO: 6357444 - DNA, 14 bp, Homo sapiens
taaggaaaaaataa

SEQ ID NO: 6357445 - DNA, 18 bp, Homo sapiens
taaggaaaactacctgta

SEQ ID NO: 6357446 - DNA, 22 bp, Homo sapiens
taaggaaaactacctgtattta

SEQ ID NO: 6357447 - DNA, 17 bp, Homo sapiens
taaggaaaagagaaaca

SEQ ID NO: 6357448 - DNA, 16 bp, Homo sapiens
taaggaaaagtttaat

SEQ ID NO: 6357449 - DNA, 17 bp, Homo sapiens
taaggaaaagtttaata

SEQ ID NO: 6357450 - DNA, 21 bp, Homo sapiens
taaggaaaagtttaatattaa

SEQ ID NO: 6357451 - DNA, 13 bp, Homo sapiens
taaggaaacattg

SEQ ID NO: 6357452 - DNA, 15 bp, Homo sapiens
taaggaaactcttat

SEQ ID NO: 6357453 - DNA, 14 bp, Homo sapiens
taaggaaactgggt

SEQ ID NO: 6357454 - DNA, 22 bp, Homo sapiens
taaggaaacttctgatgtttat

SEQ ID NO: 6357455 - DNA, 19 bp, Homo sapiens
taaggaaactttatttaaa

SEQ ID NO: 6357456 - DNA, 22 bp, Homo sapiens
taaggaaactttatttaaatgc

SEQ ID NO: 6357457 - DNA, 16 bp, Homo sapiens
taaggaaagcaataaa

SEQ ID NO: 6357458 - DNA, 18 bp, Homo sapiens
taaggaaagcaataaatg

SEQ ID NO: 6357459 - DNA, 14 bp, Homo sapiens
taaggaaatacttt

SEQ ID NO: 6357460 - DNA, 20 bp, Homo sapiens
taaggaaatattaagagcta

SEQ ID NO: 6357461 - DNA, 14 bp, Homo sapiens
taaggaaattctaa

SEQ ID NO: 6357462 - DNA, 17 bp, Homo sapiens
taaggaaccaacaatct

SEQ ID NO: 6357463 - DNA, 18 bp, Homo sapiens
taaggaaccctggaaact

SEQ ID NO: 6357464 - DNA, 15 bp, Homo sapiens
taaggaagaataaaa

SEQ ID NO: 6357465 - DNA, 22 bp, Homo sapiens
taaggaagccagtcaccttctg

SEQ ID NO: 6357466 - DNA, 19 bp, Homo sapiens
taaggaagtatcagcacta

SEQ ID NO: 6357467 - DNA, 15 bp, Homo sapiens
taaggaagttattaa

SEQ ID NO: 6357468 - DNA, 17 bp, Homo sapiens
taaggaatacctgtccc

SEQ ID NO: 6357469 - DNA, 20 bp, Homo sapiens
taaggaatatgggagaaata

SEQ ID NO: 6357470 - DNA, 22 bp, Homo sapiens
taaggaatctgaaagtatattt

SEQ ID NO: 6357471 - DNA, 17 bp, Homo sapiens
taaggaattttgtctca

SEQ ID NO: 6357472 - DNA, 19 bp, Homo sapiens
taaggacaaagaaggaaat

SEQ ID NO: 6357473 - DNA, 16 bp, Homo sapiens
taaggacaaagtgcca

SEQ ID NO: 6357474 - DNA, 16 bp, Homo sapiens
taaggacaaattagca

SEQ ID NO: 6357475 - DNA, 15 bp, Homo sapiens
taaggacacactaat

SEQ ID NO: 6357476 - DNA, 17 bp, Homo sapiens
taaggacactggggtct

SEQ ID NO: 6357477 - DNA, 17 bp, Homo sapiens
taaggacagcagctggt

SEQ ID NO: 6357478 - DNA, 22 bp, Homo sapiens
taaggacagcagctggtgcccc

SEQ ID NO: 6357479 - DNA, 14 bp, Homo sapiens
taaggacaggcagg

SEQ ID NO: 6357480 - DNA, 19 bp, Homo sapiens
taaggacatgatgctttta

SEQ ID NO: 6357481 - DNA, 21 bp, Homo sapiens
taaggacctgaaattccaaag

SEQ ID NO: 6357482 - DNA, 17 bp, Homo sapiens
taaggacgtgtgtaaat

SEQ ID NO: 6357483 - DNA, 15 bp, Homo sapiens
taaggactcaagtgt

SEQ ID NO: 6357484 - DNA, 18 bp, Homo sapiens
taaggactgactgaggca

SEQ ID NO: 6357485 - DNA, 14 bp, Homo sapiens
taaggactgcatgg

SEQ ID NO: 6357486 - DNA, 22 bp, Homo sapiens
taaggacttctttaattttgga

SEQ ID NO: 6357487 - DNA, 22 bp, Homo sapiens
taaggagaaagaaagtacccag

SEQ ID NO: 6357488 - DNA, 16 bp, Homo sapiens
taaggagaggagagca

SEQ ID NO: 6357489 - DNA, 16 bp, Homo sapiens
taaggagatataatat

SEQ ID NO: 6357490 - DNA, 16 bp, Homo sapiens
taaggagatgggcctt

SEQ ID NO: 6357491 - DNA, 16 bp, Homo sapiens
taaggagctaaagctg

SEQ ID NO: 6357492 - DNA, 17 bp, Homo sapiens
taaggagctaaagctga

SEQ ID NO: 6357493 - DNA, 15 bp, Homo sapiens
taaggagctggggct

SEQ ID NO: 6357494 - DNA, 14 bp, Homo sapiens
taaggagctggggg

SEQ ID NO: 6357495 - DNA, 14 bp, Homo sapiens
taaggaggagaaaa

SEQ ID NO: 6357496 - DNA, 19 bp, Homo sapiens
taaggaggaggagggagaa

SEQ ID NO: 6357497 - DNA, 20 bp, Homo sapiens
taaggagtttttttgtcaga

SEQ ID NO: 6357498 - DNA, 17 bp, Homo sapiens
taaggataatgaaataa

SEQ ID NO: 6357499 - DNA, 15 bp, Homo sapiens
taaggataattttcc

SEQ ID NO: 6357500 - DNA, 15 bp, Homo sapiens
taaggatagcctttg

SEQ ID NO: 6357501 - DNA, 17 bp, Homo sapiens
taaggatagcctttgta

SEQ ID NO: 6357502 - DNA, 17 bp, Homo sapiens
taaggatagggaaaggg

SEQ ID NO: 6357503 - DNA, 18 bp, Homo sapiens
taaggatagtgtgaagat

SEQ ID NO: 6357504 - DNA, 18 bp, Homo sapiens
taaggatcaccccagccc

SEQ ID NO: 6357505 - DNA, 18 bp, Homo sapiens
taaggatgacttttttat

SEQ ID NO: 6357506 - DNA, 20 bp, Homo sapiens
taaggatgcttgtacataat

SEQ ID NO: 6357507 - DNA, 21 bp, Homo sapiens
taaggatgcttgtacataatg

SEQ ID NO: 6357508 - DNA, 11 bp, Homo sapiens
taaggatggat

SEQ ID NO: 6357509 - DNA, 12 bp, Homo sapiens
taaggatggatg

SEQ ID NO: 6357510 - DNA, 18 bp, Homo sapiens
taaggatggatggcaccc

SEQ ID NO: 6357511 - DNA, 17 bp, Homo sapiens
taaggatgtagcttttc

SEQ ID NO: 6357512 - DNA, 22 bp, Homo sapiens
taaggatgtagcttttcacctt

SEQ ID NO: 6357513 - DNA, 20 bp, Homo sapiens
taaggatgtcacagggccaa

SEQ ID NO: 6357514 - DNA, 13 bp, Homo sapiens
taaggatgtgtga

SEQ ID NO: 6357515 - DNA, 13 bp, Homo sapiens
taaggattctgca

SEQ ID NO: 6357516 - DNA, 17 bp, Homo sapiens
taaggattctgcagaaa

SEQ ID NO: 6357517 - DNA, 15 bp, Homo sapiens
taaggattctggaat

SEQ ID NO: 6357518 - DNA, 17 bp, Homo sapiens
taaggatttattctcag

SEQ ID NO: 6357519 - DNA, 12 bp, Homo sapiens
taaggcaaaaaa

SEQ ID NO: 6357520 - DNA, 15 bp, Homo sapiens
taaggcaacattcct

SEQ ID NO: 6357521 - DNA, 16 bp, Homo sapiens
taaggcaacattcctt

SEQ ID NO: 6357522 - DNA, 14 bp, Homo sapiens
taaggcaatcatgg

SEQ ID NO: 6357523 - DNA, 20 bp, Homo sapiens
taaggcacagtgggagctga

SEQ ID NO: 6357524 - DNA, 23 bp, Homo sapiens
taaggcacagtgggagctgagct

SEQ ID NO: 6357525 - DNA, 16 bp, Homo sapiens
taaggcagaactagga

SEQ ID NO: 6357526 - DNA, 14 bp, Homo sapiens
taaggcagacagga

SEQ ID NO: 6357527 - DNA, 16 bp, Homo sapiens
taaggcagacaggaag

SEQ ID NO: 6357528 - DNA, 19 bp, Homo sapiens
taaggcagctgatccaggc

SEQ ID NO: 6357529 - DNA, 21 bp, Homo sapiens
taaggcaggaggatcacttga

SEQ ID NO: 6357530 - DNA, 21 bp, Homo sapiens
taaggcaggtgggcagacagt

SEQ ID NO: 6357531 - DNA, 15 bp, Homo sapiens
taaggcagtagttct

SEQ ID NO: 6357532 - DNA, 15 bp, Homo sapiens
taaggccaaggcctc

SEQ ID NO: 6357533 - DNA, 20 bp, Homo sapiens
taaggccaaggcctcaggag

SEQ ID NO: 6357534 - DNA, 15 bp, Homo sapiens
taaggccactgtttt

SEQ ID NO: 6357535 - DNA, 20 bp, Homo sapiens
taaggccactgttttaaaag

SEQ ID NO: 6357536 - DNA, 19 bp, Homo sapiens
taaggccagaaactccttt

SEQ ID NO: 6357537 - DNA, 20 bp, Homo sapiens
taaggccagaaactcctttt

SEQ ID NO: 6357538 - DNA, 15 bp, Homo sapiens
taaggccagccattt

SEQ ID NO: 6357539 - DNA, 17 bp, Homo sapiens
taaggcccagctgccag

SEQ ID NO: 6357540 - DNA, 16 bp, Homo sapiens
taaggccgaagaaggg

SEQ ID NO: 6357541 - DNA, 14 bp, Homo sapiens
taaggcctaaggaa

SEQ ID NO: 6357542 - DNA, 20 bp, Homo sapiens
taaggcctaaggaagccagt

SEQ ID NO: 6357543 - DNA, 20 bp, Homo sapiens
taaggcctaggattctaaaa

SEQ ID NO: 6357544 - DNA, 12 bp, Homo sapiens
taaggcctgccc

SEQ ID NO: 6357545 - DNA, 14 bp, Homo sapiens
taaggcctgccctc

SEQ ID NO: 6357546 - DNA, 14 bp, Homo sapiens
taaggccttggtgc

SEQ ID NO: 6357547 - DNA, 18 bp, Homo sapiens
taaggccttttatgtaat

SEQ ID NO: 6357548 - DNA, 22 bp, Homo sapiens
taaggccttttatgtaatttct

SEQ ID NO: 6357549 - DNA, 18 bp, Homo sapiens
taaggcgtgagccactgc

SEQ ID NO: 6357550 - DNA, 16 bp, Homo sapiens
taaggcgtggagctgc

SEQ ID NO: 6357551 - DNA, 10 bp, Homo sapiens
taaggctcag

SEQ ID NO: 6357552 - DNA, 13 bp, Homo sapiens
taaggctcctcct

SEQ ID NO: 6357553 - DNA, 12 bp, Homo sapiens
taaggctctaga

SEQ ID NO: 6357554 - DNA, 19 bp, Homo sapiens
taaggctctatgagtctag

SEQ ID NO: 6357555 - DNA, 14 bp, Homo sapiens
taaggctctgagag

SEQ ID NO: 6357556 - DNA, 20 bp, Homo sapiens
taaggctgaggaaaggccag

SEQ ID NO: 6357557 - DNA, 14 bp, Homo sapiens
taaggctgctggct

SEQ ID NO: 6357558 - DNA, 23 bp, Homo sapiens
taaggctgctggcttcagggagg

SEQ ID NO: 6357559 - DNA, 18 bp, Homo sapiens
taaggctggatgggaaag

SEQ ID NO: 6357560 - DNA, 14 bp, Homo sapiens
taaggctgtacata

SEQ ID NO: 6357561 - DNA, 21 bp, Homo sapiens
taaggcttaggtgccaggctg

SEQ ID NO: 6357562 - DNA, 11 bp, Homo sapiens
taagggaaaaa

SEQ ID NO: 6357563 - DNA, 15 bp, Homo sapiens
taagggaaaaagttg

SEQ ID NO: 6357564 - DNA, 15 bp, Homo sapiens
taagggaagacattt

SEQ ID NO: 6357565 - DNA, 18 bp, Homo sapiens
taagggaagacatttctt

SEQ ID NO: 6357566 - DNA, 16 bp, Homo sapiens
taagggaataaatttt

SEQ ID NO: 6357567 - DNA, 15 bp, Homo sapiens
taagggaccttcagg

SEQ ID NO: 6357568 - DNA, 16 bp, Homo sapiens
taagggaccttcaggg

SEQ ID NO: 6357569 - DNA, 18 bp, Homo sapiens
taagggactgatgtttgt

SEQ ID NO: 6357570 - DNA, 12 bp, Homo sapiens
taagggagagct

SEQ ID NO: 6357571 - DNA, 16 bp, Homo sapiens
taagggaggaggagct

SEQ ID NO: 6357572 - DNA, 15 bp, Homo sapiens
taagggagggaaggg

SEQ ID NO: 6357573 - DNA, 20 bp, Homo sapiens
taagggagggaaggggaatg

SEQ ID NO: 6357574 - DNA, 19 bp, Homo sapiens
taagggatccagagacctg

SEQ ID NO: 6357575 - DNA, 17 bp, Homo sapiens
taagggattagtatttt

SEQ ID NO: 6357576 - DNA, 14 bp, Homo sapiens
taagggatttctta

SEQ ID NO: 6357577 - DNA, 16 bp, Homo sapiens
taagggatttcttagg

SEQ ID NO: 6357578 - DNA, 17 bp, Homo sapiens
taagggatttcttaggg

SEQ ID NO: 6357579 - DNA, 14 bp, Homo sapiens
taagggcactgacg

SEQ ID NO: 6357580 - DNA, 14 bp, Homo sapiens
taagggcagagtca

SEQ ID NO: 6357581 - DNA, 12 bp, Homo sapiens
taagggcagccc

SEQ ID NO: 6357582 - DNA, 14 bp, Homo sapiens
taagggcagccctc

SEQ ID NO: 6357583 - DNA, 18 bp, Homo sapiens
taagggcatgccttgtgc

SEQ ID NO: 6357584 - DNA, 19 bp, Homo sapiens
taagggccagaaatatctt

SEQ ID NO: 6357585 - DNA, 16 bp, Homo sapiens
taagggcccaggtcag

SEQ ID NO: 6357586 - DNA, 18 bp, Homo sapiens
taagggccctgccctgta

SEQ ID NO: 6357587 - DNA, 12 bp, Homo sapiens
taagggccgggg

SEQ ID NO: 6357588 - DNA, 15 bp, Homo sapiens
taagggcctgctgga

SEQ ID NO: 6357589 - DNA, 19 bp, Homo sapiens
taagggcgtggctctgggt

SEQ ID NO: 6357590 - DNA, 23 bp, Homo sapiens
taagggcttgtttttcttcagca

SEQ ID NO: 6357591 - DNA, 14 bp, Homo sapiens
taagggctttaaat

SEQ ID NO: 6357592 - DNA, 15 bp, Homo sapiens
taaggggaagaatga

SEQ ID NO: 6357593 - DNA, 16 bp, Homo sapiens
taaggggaagaatgaa

SEQ ID NO: 6357594 - DNA, 15 bp, Homo sapiens
taaggggaagataag

SEQ ID NO: 6357595 - DNA, 22 bp, Homo sapiens
taaggggaattaacaattgcca

SEQ ID NO: 6357596 - DNA, 18 bp, Homo sapiens
taaggggccttgctctga

SEQ ID NO: 6357597 - DNA, 17 bp, Homo sapiens
taagggggtccctgtgc

SEQ ID NO: 6357598 - DNA, 23 bp, Homo sapiens
taaggggtttgccatttgatacc

SEQ ID NO: 6357599 - DNA, 21 bp, Homo sapiens
taagggtctgttgtaaatgac

SEQ ID NO: 6357600 - DNA, 18 bp, Homo sapiens
taagggtggaaaaatgcc

SEQ ID NO: 6357601 - DNA, 15 bp, Homo sapiens
taagggttaagaaaa

SEQ ID NO: 6357602 - DNA, 19 bp, Homo sapiens
taagggttaccccaccctg

SEQ ID NO: 6357603 - DNA, 22 bp, Homo sapiens
taagggtttcccccaacatata

SEQ ID NO: 6357604 - DNA, 22 bp, Homo sapiens
taagggttttttttttttcctt

SEQ ID NO: 6357605 - DNA, 14 bp, Homo sapiens
taaggtacacactt

SEQ ID NO: 6357606 - DNA, 12 bp, Homo sapiens
taaggtacatca

SEQ ID NO: 6357607 - DNA, 17 bp, Homo sapiens
taaggtacatcattatt

SEQ ID NO: 6357608 - DNA, 19 bp, Homo sapiens
taaggtacatcattattgt

SEQ ID NO: 6357609 - DNA, 18 bp, Homo sapiens
taaggtagaacctcacct

SEQ ID NO: 6357610 - DNA, 19 bp, Homo sapiens
taaggtataaggatctttt

SEQ ID NO: 6357611 - DNA, 22 bp, Homo sapiens
taaggtatatcattctaaagat

SEQ ID NO: 6357612 - DNA, 14 bp, Homo sapiens
taaggtatatttag

SEQ ID NO: 6357613 - DNA, 15 bp, Homo sapiens
taaggtattgtgcat

SEQ ID NO: 6357614 - DNA, 18 bp, Homo sapiens
taaggtcattaccacagg

SEQ ID NO: 6357615 - DNA, 13 bp, Homo sapiens
taaggtccctgct

SEQ ID NO: 6357616 - DNA, 14 bp, Homo sapiens
taaggtctaactgt

SEQ ID NO: 6357617 - DNA, 20 bp, Homo sapiens
taaggtctaactgtggaata

SEQ ID NO: 6357618 - DNA, 18 bp, Homo sapiens
taaggtctaatcagtgat

SEQ ID NO: 6357619 - DNA, 19 bp, Homo sapiens
taaggtctgtttgctgttg

SEQ ID NO: 6357620 - DNA, 12 bp, Homo sapiens
taaggtcttatt

SEQ ID NO: 6357621 - DNA, 20 bp, Homo sapiens
taaggtcttcttgtgtcctg

SEQ ID NO: 6357622 - DNA, 13 bp, Homo sapiens
taaggtctttgta

SEQ ID NO: 6357623 - DNA, 19 bp, Homo sapiens
taaggtgaaggtgaatcta

SEQ ID NO: 6357624 - DNA, 19 bp, Homo sapiens
taaggtgactttctgaaac

SEQ ID NO: 6357625 - DNA, 15 bp, Homo sapiens
taaggtgaggcctgt

SEQ ID NO: 6357626 - DNA, 18 bp, Homo sapiens
taaggtgatatatttaaa

SEQ ID NO: 6357627 - DNA, 20 bp, Homo sapiens
taaggtgatatatttaaaaa

SEQ ID NO: 6357628 - DNA, 12 bp, Homo sapiens
taaggtgcagtt

SEQ ID NO: 6357629 - DNA, 16 bp, Homo sapiens
taaggtggaaaatgga

SEQ ID NO: 6357630 - DNA, 18 bp, Homo sapiens
taaggtggaaaatggact

SEQ ID NO: 6357631 - DNA, 16 bp, Homo sapiens
taaggtggaaagtgtt

SEQ ID NO: 6357632 - DNA, 19 bp, Homo sapiens
taaggtggaaagtgttcat

SEQ ID NO: 6357633 - DNA, 12 bp, Homo sapiens
taaggtggcttc

SEQ ID NO: 6357634 - DNA, 16 bp, Homo sapiens
taaggtgggaaaaaaa

SEQ ID NO: 6357635 - DNA, 16 bp, Homo sapiens
taaggtgggtccagga

SEQ ID NO: 6357636 - DNA, 16 bp, Homo sapiens
taaggtgtgcaaagat

SEQ ID NO: 6357637 - DNA, 19 bp, Homo sapiens
taaggtgtgtactcagggc

SEQ ID NO: 6357638 - DNA, 20 bp, Homo sapiens
taaggtgtttgaaaatagtt

SEQ ID NO: 6357639 - DNA, 20 bp, Homo sapiens
taaggtgttttctgtgtaac

SEQ ID NO: 6357640 - DNA, 16 bp, Homo sapiens
taaggttaattatggt

SEQ ID NO: 6357641 - DNA, 18 bp, Homo sapiens
taaggttacctttgttcc

SEQ ID NO: 6357642 - DNA, 20 bp, Homo sapiens
taaggttgaactttgccaaa

SEQ ID NO: 6357643 - DNA, 23 bp, Homo sapiens
taaggttgggttagcaatattta

SEQ ID NO: 6357644 - DNA, 15 bp, Homo sapiens
taaggttgtgcaggg

SEQ ID NO: 6357645 - DNA, 21 bp, Homo sapiens
taaggtttcaacaaatttcat

SEQ ID NO: 6357646 - DNA, 17 bp, Homo sapiens
taaggttttttttgtac

SEQ ID NO: 6357647 - DNA, 18 bp, Homo sapiens
taagtaaaaatatgtcat

SEQ ID NO: 6357648 - DNA, 18 bp, Homo sapiens
taagtaaaaatattaact

SEQ ID NO: 6357649 - DNA, 18 bp, Homo sapiens
taagtaaaaccacagcag

SEQ ID NO: 6357650 - DNA, 19 bp, Homo sapiens
taagtaaaagtctacctgt

SEQ ID NO: 6357651 - DNA, 14 bp, Homo sapiens
taagtaaacaacat

SEQ ID NO: 6357652 - DNA, 15 bp, Homo sapiens
taagtaaacaacata

SEQ ID NO: 6357653 - DNA, 14 bp, Homo sapiens
taagtaaactaatg

SEQ ID NO: 6357654 - DNA, 14 bp, Homo sapiens
taagtaaagacagc

SEQ ID NO: 6357655 - DNA, 18 bp, Homo sapiens
taagtaaatatattatat

SEQ ID NO: 6357656 - DNA, 13 bp, Homo sapiens
taagtaaatgctg

SEQ ID NO: 6357657 - DNA, 12 bp, Homo sapiens
taagtaaatgta

SEQ ID NO: 6357658 - DNA, 15 bp, Homo sapiens
taagtaaatgtcttc

SEQ ID NO: 6357659 - DNA, 14 bp, Homo sapiens
taagtaacacagta

SEQ ID NO: 6357660 - DNA, 16 bp, Homo sapiens
taagtaacacagtatt

SEQ ID NO: 6357661 - DNA, 13 bp, Homo sapiens
taagtaacatata

SEQ ID NO: 6357662 - DNA, 15 bp, Homo sapiens
taagtaacatataaa

SEQ ID NO: 6357663 - DNA, 18 bp, Homo sapiens
taagtaacatataaatta

SEQ ID NO: 6357664 - DNA, 21 bp, Homo sapiens
taagtaacttatttatgaaag

SEQ ID NO: 6357665 - DNA, 20 bp, Homo sapiens
taagtaacttcacattaaaa

SEQ ID NO: 6357666 - DNA, 14 bp, Homo sapiens
taagtaagaaacac

SEQ ID NO: 6357667 - DNA, 14 bp, Homo sapiens
taagtaagaaagaa

SEQ ID NO: 6357668 - DNA, 17 bp, Homo sapiens
taagtaagaaagaaggc

SEQ ID NO: 6357669 - DNA, 14 bp, Homo sapiens
taagtaagaaattt

SEQ ID NO: 6357670 - DNA, 13 bp, Homo sapiens
taagtaagacttt

SEQ ID NO: 6357671 - DNA, 18 bp, Homo sapiens
taagtaaggggcaaaaaa

SEQ ID NO: 6357672 - DNA, 15 bp, Homo sapiens
taagtaagtgtctgt

SEQ ID NO: 6357673 - DNA, 18 bp, Homo sapiens
taagtaagtttcttcctg

SEQ ID NO: 6357674 - DNA, 20 bp, Homo sapiens
taagtaatcaataaagaaaa

SEQ ID NO: 6357675 - DNA, 21 bp, Homo sapiens
taagtaatctttttacagttg

SEQ ID NO: 6357676 - DNA, 21 bp, Homo sapiens
taagtaattgcatttctgctc

SEQ ID NO: 6357677 - DNA, 14 bp, Homo sapiens
taagtaatttagaa

SEQ ID NO: 6357678 - DNA, 17 bp, Homo sapiens
taagtaatttagaagat

SEQ ID NO: 6357679 - DNA, 23 bp, Homo sapiens
taagtaatttagaagatattatt

SEQ ID NO: 6357680 - DNA, 14 bp, Homo sapiens
taagtacaaaaaca

SEQ ID NO: 6357681 - DNA, 18 bp, Homo sapiens
taagtacacaataagcaa

SEQ ID NO: 6357682 - DNA, 22 bp, Homo sapiens
taagtacagagaagccatcacc

SEQ ID NO: 6357683 - DNA, 15 bp, Homo sapiens
taagtaccaatggga

SEQ ID NO: 6357684 - DNA, 19 bp, Homo sapiens
taagtaccaatgggaagca

SEQ ID NO: 6357685 - DNA, 19 bp, Homo sapiens
taagtacctttcctacatt

SEQ ID NO: 6357686 - DNA, 21 bp, Homo sapiens
taagtacctttcctacatttt

SEQ ID NO: 6357687 - DNA, 16 bp, Homo sapiens
taagtactatctttgt

SEQ ID NO: 6357688 - DNA, 16 bp, Homo sapiens
taagtactgtttacca

SEQ ID NO: 6357689 - DNA, 22 bp, Homo sapiens
taagtacttccacttgtgtata

SEQ ID NO: 6357690 - DNA, 13 bp, Homo sapiens
taagtagaaaaat

SEQ ID NO: 6357691 - DNA, 20 bp, Homo sapiens
taagtagaaaaattgtttcc

SEQ ID NO: 6357692 - DNA, 14 bp, Homo sapiens
taagtagaggtggc

SEQ ID NO: 6357693 - DNA, 15 bp, Homo sapiens
taagtagataagcag

SEQ ID NO: 6357694 - DNA, 16 bp, Homo sapiens
taagtagataagcaga

SEQ ID NO: 6357695 - DNA, 21 bp, Homo sapiens
taagtagatctgctttctgtt

SEQ ID NO: 6357696 - DNA, 23 bp, Homo sapiens
taagtagatctgctttctgttca

SEQ ID NO: 6357697 - DNA, 18 bp, Homo sapiens
taagtagcaaccctgtga

SEQ ID NO: 6357698 - DNA, 16 bp, Homo sapiens
taagtagcattcatgt

SEQ ID NO: 6357699 - DNA, 20 bp, Homo sapiens
taagtagggctaagccagtt

SEQ ID NO: 6357700 - DNA, 16 bp, Homo sapiens
taagtagtgtcattca

SEQ ID NO: 6357701 - DNA, 17 bp, Homo sapiens
taagtagtgtcattcat

SEQ ID NO: 6357702 - DNA, 16 bp, Homo sapiens
taagtagttggtttgt

SEQ ID NO: 6357703 - DNA, 12 bp, Homo sapiens
taagtagtttct

SEQ ID NO: 6357704 - DNA, 15 bp, Homo sapiens
taagtataacaaact

SEQ ID NO: 6357705 - DNA, 19 bp, Homo sapiens
taagtataacaaactatgt

SEQ ID NO: 6357706 - DNA, 14 bp, Homo sapiens
taagtatacagttc

SEQ ID NO: 6357707 - DNA, 14 bp, Homo sapiens
taagtatatagtat

SEQ ID NO: 6357708 - DNA, 23 bp, Homo sapiens
taagtatatagtatatttatact

SEQ ID NO: 6357709 - DNA, 22 bp, Homo sapiens
taagtatatcatgtaaagaaat

SEQ ID NO: 6357710 - DNA, 18 bp, Homo sapiens
taagtatatcttaagaat

SEQ ID NO: 6357711 - DNA, 13 bp, Homo sapiens
taagtatatttgt

SEQ ID NO: 6357712 - DNA, 15 bp, Homo sapiens
taagtatatttgtaa

SEQ ID NO: 6357713 - DNA, 17 bp, Homo sapiens
taagtatatttgtaaaa

SEQ ID NO: 6357714 - DNA, 21 bp, Homo sapiens
taagtatatttgtaaaagcta

SEQ ID NO: 6357715 - DNA, 20 bp, Homo sapiens
taagtatcaagtatagaaaa

SEQ ID NO: 6357716 - DNA, 19 bp, Homo sapiens
taagtatcaggggaaaaaa

SEQ ID NO: 6357717 - DNA, 22 bp, Homo sapiens
taagtatctgggattattcttt

SEQ ID NO: 6357718 - DNA, 17 bp, Homo sapiens
taagtatcttcatgtat

SEQ ID NO: 6357719 - DNA, 14 bp, Homo sapiens
taagtatgttattt

SEQ ID NO: 6357720 - DNA, 14 bp, Homo sapiens
taagtattcaagaa

SEQ ID NO: 6357721 - DNA, 23 bp, Homo sapiens
taagtattccttggcccagcagc

SEQ ID NO: 6357722 - DNA, 21 bp, Homo sapiens
taagtattcttatttaatgaa

SEQ ID NO: 6357723 - DNA, 16 bp, Homo sapiens
taagtatttaaatgtt

SEQ ID NO: 6357724 - DNA, 13 bp, Homo sapiens
taagtatttcaaa

SEQ ID NO: 6357725 - DNA, 13 bp, Homo sapiens
taagtatttggaa

SEQ ID NO: 6357726 - DNA, 14 bp, Homo sapiens
taagtatttggaat

SEQ ID NO: 6357727 - DNA, 23 bp, Homo sapiens
taagtcaaaaggaacaaaaatta

SEQ ID NO: 6357728 - DNA, 18 bp, Homo sapiens
taagtcaaaataatctga

SEQ ID NO: 6357729 - DNA, 15 bp, Homo sapiens
taagtcaacagtaaa

SEQ ID NO: 6357730 - DNA, 14 bp, Homo sapiens
taagtcaagcacat

SEQ ID NO: 6357731 - DNA, 16 bp, Homo sapiens
taagtcaagcacatgt

SEQ ID NO: 6357732 - DNA, 23 bp, Homo sapiens
taagtcagggaagagcagtgctg

SEQ ID NO: 6357733 - DNA, 14 bp, Homo sapiens
taagtcagtgttga

SEQ ID NO: 6357734 - DNA, 15 bp, Homo sapiens
taagtcagtgttgag

SEQ ID NO: 6357735 - DNA, 17 bp, Homo sapiens
taagtcagtgttgagat

SEQ ID NO: 6357736 - DNA, 18 bp, Homo sapiens
taagtcatccacagccca

SEQ ID NO: 6357737 - DNA, 19 bp, Homo sapiens
taagtcatctacttaataa

SEQ ID NO: 6357738 - DNA, 13 bp, Homo sapiens
taagtcatggtcc

SEQ ID NO: 6357739 - DNA, 17 bp, Homo sapiens
taagtcatggtcctggc

SEQ ID NO: 6357740 - DNA, 19 bp, Homo sapiens
taagtcatgttccttcaag

SEQ ID NO: 6357741 - DNA, 21 bp, Homo sapiens
taagtcatgttccttcaagat

SEQ ID NO: 6357742 - DNA, 22 bp, Homo sapiens
taagtcatgttccttcaagatc

SEQ ID NO: 6357743 - DNA, 13 bp, Homo sapiens
taagtcatttaac

SEQ ID NO: 6357744 - DNA, 17 bp, Homo sapiens
taagtcattttttactt

SEQ ID NO: 6357745 - DNA, 19 bp, Homo sapiens
taagtccaactactaaact

SEQ ID NO: 6357746 - DNA, 18 bp, Homo sapiens
taagtccacatcttctca

SEQ ID NO: 6357747 - DNA, 17 bp, Homo sapiens
taagtccagctctcccc

SEQ ID NO: 6357748 - DNA, 22 bp, Homo sapiens
taagtccagtccagtcctatct

SEQ ID NO: 6357749 - DNA, 15 bp, Homo sapiens
taagtcccatgaata

SEQ ID NO: 6357750 - DNA, 15 bp, Homo sapiens
taagtccctgccccc

SEQ ID NO: 6357751 - DNA, 18 bp, Homo sapiens
taagtccctgccccctcc

SEQ ID NO: 6357752 - DNA, 13 bp, Homo sapiens
taagtcccttcct

SEQ ID NO: 6357753 - DNA, 14 bp, Homo sapiens
taagtcccttccta

SEQ ID NO: 6357754 - DNA, 22 bp, Homo sapiens
taagtcccttcctattctcctg

SEQ ID NO: 6357755 - DNA, 18 bp, Homo sapiens
gtccctcactgccttcca

SEQ ID NO: 6357756 - DNA, 18 bp, Homo sapiens
gtccctcagaggccttgg

SEQ ID NO: 6357757 - DNA, 21 bp, Homo sapiens
gtccctccaaggctgtcttct

SEQ ID NO: 6357758 - DNA, 20 bp, Homo sapiens
gtccctccacgttcacccct

SEQ ID NO: 6357759 - DNA, 21 bp, Homo sapiens
gtccctccacgttcacccctc

SEQ ID NO: 6357760 - DNA, 17 bp, Homo sapiens
gtccctcccactccctg

SEQ ID NO: 6357761 - DNA, 14 bp, Homo sapiens
gtccctcccaggtc

SEQ ID NO: 6357762 - DNA, 16 bp, Homo sapiens
gtccctcccctgggca

SEQ ID NO: 6357763 - DNA, 16 bp, Homo sapiens
gtccctccctcctggc

SEQ ID NO: 6357764 - DNA, 20 bp, Homo sapiens
gtccctccctcctggctcac

SEQ ID NO: 6357765 - DNA, 22 bp, Homo sapiens
gtccctccctcctggctcacag

SEQ ID NO: 6357766 - DNA, 11 bp, Homo sapiens
gtccctccctg

SEQ ID NO: 6357767 - DNA, 19 bp, Homo sapiens
gtccctccctgcctgaggg

SEQ ID NO: 6357768 - DNA, 14 bp, Homo sapiens
gtccctcccttgct

SEQ ID NO: 6357769 - DNA, 20 bp, Homo sapiens
gtccctcccttgctgaacac

SEQ ID NO: 6357770 - DNA, 13 bp, Homo sapiens
gtccctccgagct

SEQ ID NO: 6357771 - DNA, 16 bp, Homo sapiens
gtccctccgagcttgg

SEQ ID NO: 6357772 - DNA, 20 bp, Homo sapiens
gtccctccgcggctggagcg

SEQ ID NO: 6357773 - DNA, 18 bp, Homo sapiens
gtccctcctctcacctct

SEQ ID NO: 6357774 - DNA, 21 bp, Homo sapiens
gtccctcctgggatctgctcg

SEQ ID NO: 6357775 - DNA, 22 bp, Homo sapiens
gtccctcctggtgtcaccccag

SEQ ID NO: 6357776 - DNA, 23 bp, Homo sapiens
gtccctcctggtgtcaccccaga

SEQ ID NO: 6357777 - DNA, 19 bp, Homo sapiens
gtccctcgagctctgtagc

SEQ ID NO: 6357778 - DNA, 23 bp, Homo sapiens
gtccctcgagctctgtagcctgg

SEQ ID NO: 6357779 - DNA, 22 bp, Homo sapiens
gtccctcgccgtccctcccagg

SEQ ID NO: 6357780 - DNA, 16 bp, Homo sapiens
gtccctcggagctgcc

SEQ ID NO: 6357781 - DNA, 22 bp, Homo sapiens
gtccctcggagctgccagccgg

SEQ ID NO: 6357782 - DNA, 15 bp, Homo sapiens
gtccctcgtccacag

SEQ ID NO: 6357783 - DNA, 12 bp, Homo sapiens
gtccctctcact

SEQ ID NO: 6357784 - DNA, 13 bp, Homo sapiens
gtccctctcagat

SEQ ID NO: 6357785 - DNA, 21 bp, Homo sapiens
gtccctctcagatacccagtg

SEQ ID NO: 6357786 - DNA, 13 bp, Homo sapiens
gtccctctcaggc

SEQ ID NO: 6357787 - DNA, 14 bp, Homo sapiens
gtccctctcaggca

SEQ ID NO: 6357788 - DNA, 17 bp, Homo sapiens
gtccctctcagtgcctt

SEQ ID NO: 6357789 - DNA, 20 bp, Homo sapiens
gtccctctcagtgccttctc

SEQ ID NO: 6357790 - DNA, 23 bp, Homo sapiens
gtccctctcagtgccttctctca

SEQ ID NO: 6357791 - DNA, 22 bp, Homo sapiens
gtccctctcatttagcctgtcc

SEQ ID NO: 6357792 - DNA, 23 bp, Homo sapiens
gtccctctcctatgtggcagctg

SEQ ID NO: 6357793 - DNA, 20 bp, Homo sapiens
gtccctctcgccctggccag

SEQ ID NO: 6357794 - DNA, 13 bp, Homo sapiens
gtccctctctctg

SEQ ID NO: 6357795 - DNA, 14 bp, Homo sapiens
gtccctctctctgg

SEQ ID NO: 6357796 - DNA, 11 bp, Homo sapiens
gtccctctctt

SEQ ID NO: 6357797 - DNA, 20 bp, Homo sapiens
gtccctctgccccatcctcc

SEQ ID NO: 6357798 - DNA, 21 bp, Homo sapiens
gtccctctgccccatcctcca

SEQ ID NO: 6357799 - DNA, 12 bp, Homo sapiens
gtccctctgtgg

SEQ ID NO: 6357800 - DNA, 13 bp, Homo sapiens
gtccctctgtgta

SEQ ID NO: 6357801 - DNA, 14 bp, Homo sapiens
gtccctctgtgtat

SEQ ID NO: 6357802 - DNA, 21 bp, Homo sapiens
gtccctctgtgtctgctctca

SEQ ID NO: 6357803 - DNA, 15 bp, Homo sapiens
gtccctctttggcag

SEQ ID NO: 6357804 - DNA, 13 bp, Homo sapiens
gtccctgaagtct

SEQ ID NO: 6357805 - DNA, 14 bp, Homo sapiens
gtccctgacttccc

SEQ ID NO: 6357806 - DNA, 23 bp, Homo sapiens
gtccctgacttcccagctggcag

SEQ ID NO: 6357807 - DNA, 23 bp, Homo sapiens
gtccctgagaagcctcatgggag

SEQ ID NO: 6357808 - DNA, 12 bp, Homo sapiens
gtccctgaggat

SEQ ID NO: 6357809 - DNA, 22 bp, Homo sapiens
gtccctgaggatgggtcagagc

SEQ ID NO: 6357810 - DNA, 22 bp, Homo sapiens
gtccctgaggcaggtccccaga

SEQ ID NO: 6357811 - DNA, 15 bp, Homo sapiens
gtccctgagggccct

SEQ ID NO: 6357812 - DNA, 18 bp, Homo sapiens
gtccctgagggcccttcc

SEQ ID NO: 6357813 - DNA, 15 bp, Homo sapiens
gtccctgcactgtgc

SEQ ID NO: 6357814 - DNA, 16 bp, Homo sapiens
gtccctgcacttgcag

SEQ ID NO: 6357815 - DNA, 14 bp, Homo sapiens
gtccctgcagggcc

SEQ ID NO: 6357816 - DNA, 21 bp, Homo sapiens
gtccctgcagggccatctgac

SEQ ID NO: 6357817 - DNA, 24 bp, Homo sapiens
gtccctgccacactcagtccccca

SEQ ID NO: 6357818 - DNA, 12 bp, Homo sapiens
gtccctgccccg

SEQ ID NO: 6357819 - DNA, 16 bp, Homo sapiens
gtccctgccccgcccc

SEQ ID NO: 6357820 - DNA, 17 bp, Homo sapiens
gtccctgccccgccccc

SEQ ID NO: 6357821 - DNA, 12 bp, Homo sapiens
gtccctgccctc

SEQ ID NO: 6357822 - DNA, 22 bp, Homo sapiens
gtccctgccctcccctgctccc

SEQ ID NO: 6357823 - DNA, 14 bp, Homo sapiens
gtccctgcctggac

SEQ ID NO: 6357824 - DNA, 22 bp, Homo sapiens
gtccctgcctggaccagcctct

SEQ ID NO: 6357825 - DNA, 14 bp, Homo sapiens
gtccctgcctggcc

SEQ ID NO: 6357826 - DNA, 15 bp, Homo sapiens
gtccctgcctggccc

SEQ ID NO: 6357827 - DNA, 21 bp, Homo sapiens
gtccctgcgcctttccttttc

SEQ ID NO: 6357828 - DNA, 12 bp, Homo sapiens
gtccctgctagt

SEQ ID NO: 6357829 - DNA, 14 bp, Homo sapiens
gtccctgctcagcc

SEQ ID NO: 6357830 - DNA, 11 bp, Homo sapiens
gtccctgctcc

SEQ ID NO: 6357831 - DNA, 12 bp, Homo sapiens
gtccctgctccc

SEQ ID NO: 6357832 - DNA, 17 bp, Homo sapiens
gtccctgctgccagctt

SEQ ID NO: 6357833 - DNA, 18 bp, Homo sapiens
gtccctgctgccagcttc

SEQ ID NO: 6357834 - DNA, 14 bp, Homo sapiens
gtccctgctgggga

SEQ ID NO: 6357835 - DNA, 15 bp, Homo sapiens
gtccctgctggggtc

SEQ ID NO: 6357836 - DNA, 21 bp, Homo sapiens
gtccctgctggggtctcaggt

SEQ ID NO: 6357837 - DNA, 12 bp, Homo sapiens
gtccctggacac

SEQ ID NO: 6357838 - DNA, 14 bp, Homo sapiens
gtccctggacacag

SEQ ID NO: 6357839 - DNA, 15 bp, Homo sapiens
gtccctggacacagc

SEQ ID NO: 6357840 - DNA, 17 bp, Homo sapiens
gtccctggacacagctc

SEQ ID NO: 6357841 - DNA, 18 bp, Homo sapiens
gtccctggacacagctct

SEQ ID NO: 6357842 - DNA, 14 bp, Homo sapiens
gtccctggagggca

SEQ ID NO: 6357843 - DNA, 13 bp, Homo sapiens
gtccctggcaaga

SEQ ID NO: 6357844 - DNA, 17 bp, Homo sapiens
gtccctggcgcaggtgg

SEQ ID NO: 6357845 - DNA, 15 bp, Homo sapiens
gtccctggcttcctt

SEQ ID NO: 6357846 - DNA, 22 bp, Homo sapiens
gtccctgggagcaagttgcagt

SEQ ID NO: 6357847 - DNA, 23 bp, Homo sapiens
gtccctgggagcaagttgcagtc

SEQ ID NO: 6357848 - DNA, 21 bp, Homo sapiens
gtccctgggagtgttcccgtg

SEQ ID NO: 6357849 - DNA, 17 bp, Homo sapiens
gtccctgggccagggtc

SEQ ID NO: 6357850 - DNA, 19 bp, Homo sapiens
gtccctgggccagggtctg

SEQ ID NO: 6357851 - DNA, 11 bp, Homo sapiens
gtccctggggc

SEQ ID NO: 6357852 - DNA, 12 bp, Homo sapiens
gtccctggggca

SEQ ID NO: 6357853 - DNA, 20 bp, Homo sapiens
gtccctggggcactccccca

SEQ ID NO: 6357854 - DNA, 22 bp, Homo sapiens
gtccctggggctagggggagcc

SEQ ID NO: 6357855 - DNA, 22 bp, Homo sapiens
gtccctgggggaagccctggat

SEQ ID NO: 6357856 - DNA, 23 bp, Homo sapiens
gtccctgggggaagccctggatt

SEQ ID NO: 6357857 - DNA, 15 bp, Homo sapiens
gtccctggtccctcg

SEQ ID NO: 6357858 - DNA, 16 bp, Homo sapiens
gtccctggtccctcgt

SEQ ID NO: 6357859 - DNA, 19 bp, Homo sapiens
gtccctggtccctcgtcca

SEQ ID NO: 6357860 - DNA, 14 bp, Homo sapiens
gtccctggtccttc

SEQ ID NO: 6357861 - DNA, 20 bp, Homo sapiens
gtccctggttcctagatgtg

SEQ ID NO: 6357862 - DNA, 21 bp, Homo sapiens
gtccctggttcctagatgtgt

SEQ ID NO: 6357863 - DNA, 18 bp, Homo sapiens
gtccctgtagctcagtca

SEQ ID NO: 6357864 - DNA, 17 bp, Homo sapiens
gtccctgtcacctcttc

SEQ ID NO: 6357865 - DNA, 16 bp, Homo sapiens
gtccctgtccccaggc

SEQ ID NO: 6357866 - DNA, 22 bp, Homo sapiens
gtccctgtccccaggcccagcc

SEQ ID NO: 6357867 - DNA, 16 bp, Homo sapiens
gtccctgtcccccagc

SEQ ID NO: 6357868 - DNA, 17 bp, Homo sapiens
gtccctgtcccccagca

SEQ ID NO: 6357869 - DNA, 20 bp, Homo sapiens
gtccctgtcccccagcatcg

SEQ ID NO: 6357870 - DNA, 16 bp, Homo sapiens
gtccctgtccctctag

SEQ ID NO: 6357871 - DNA, 17 bp, Homo sapiens
gtccctgtccctgcccc

SEQ ID NO: 6357872 - DNA, 15 bp, Homo sapiens
gtccctgtccttcta

SEQ ID NO: 6357873 - DNA, 22 bp, Homo sapiens
gtccctgtgggctcacaccggc

SEQ ID NO: 6357874 - DNA, 11 bp, Homo sapiens
gtccctgtggt

SEQ ID NO: 6357875 - DNA, 19 bp, Homo sapiens
gtccctgtgtgtaggctgg

SEQ ID NO: 6357876 - DNA, 21 bp, Homo sapiens
gtccctgtgtgtaggctgggg

SEQ ID NO: 6357877 - DNA, 16 bp, Homo sapiens
gtccctgtgttgtccc

SEQ ID NO: 6357878 - DNA, 21 bp, Homo sapiens
gtccctgtgttgtcccatctg

SEQ ID NO: 6357879 - DNA, 12 bp, Homo sapiens
gtccctgttctc

SEQ ID NO: 6357880 - DNA, 15 bp, Homo sapiens
gtccctgttctcagc

SEQ ID NO: 6357881 - DNA, 18 bp, Homo sapiens
gtccctgttctcagctcc

SEQ ID NO: 6357882 - DNA, 18 bp, Homo sapiens
gtccctgtttcaaactga

SEQ ID NO: 6357883 - DNA, 17 bp, Homo sapiens
gtccctgttttctgagc

SEQ ID NO: 6357884 - DNA, 19 bp, Homo sapiens
gtccctgttttctgagccc

SEQ ID NO: 6357885 - DNA, 23 bp, Homo sapiens
gtcccttaataaaaatatatatt

SEQ ID NO: 6357886 - DNA, 15 bp, Homo sapiens
gtcccttcaatttct

SEQ ID NO: 6357887 - DNA, 18 bp, Homo sapiens
gtcccttcacctcctcgc

SEQ ID NO: 6357888 - DNA, 19 bp, Homo sapiens
gtcccttcagactggccct

SEQ ID NO: 6357889 - DNA, 11 bp, Homo sapiens
gtcccttcagt

SEQ ID NO: 6357890 - DNA, 17 bp, Homo sapiens
gtcccttccaagctgtg

SEQ ID NO: 6357891 - DNA, 20 bp, Homo sapiens
gtcccttccacacccccacc

SEQ ID NO: 6357892 - DNA, 18 bp, Homo sapiens
gtcccttccatgccctgg

SEQ ID NO: 6357893 - DNA, 21 bp, Homo sapiens
gtcccttccatgccctgggat

SEQ ID NO: 6357894 - DNA, 17 bp, Homo sapiens
gtcccttccccatgctt

SEQ ID NO: 6357895 - DNA, 20 bp, Homo sapiens
gtcccttccccatgcttcct

SEQ ID NO: 6357896 - DNA, 14 bp, Homo sapiens
gtcccttcccctcc

SEQ ID NO: 6357897 - DNA, 17 bp, Homo sapiens
gtcccttccccttcacc

SEQ ID NO: 6357898 - DNA, 21 bp, Homo sapiens
gtcccttcctattctcctgcc

SEQ ID NO: 6357899 - DNA, 24 bp, Homo sapiens
gtcccttcctattctcctgccatg

SEQ ID NO: 6357900 - DNA, 15 bp, Homo sapiens
gtcccttcctttctc

SEQ ID NO: 6357901 - DNA, 19 bp, Homo sapiens
gtcccttctcttaatttaa

SEQ ID NO: 6357902 - DNA, 15 bp, Homo sapiens
gtcccttgaaaaagt

SEQ ID NO: 6357903 - DNA, 17 bp, Homo sapiens
gtcccttgacctttcca

SEQ ID NO: 6357904 - DNA, 16 bp, Homo sapiens
gtcccttgagacctca

SEQ ID NO: 6357905 - DNA, 19 bp, Homo sapiens
gtcccttgatgcacagaga

SEQ ID NO: 6357906 - DNA, 23 bp, Homo sapiens
gtcccttgatgggtgctgccctc

SEQ ID NO: 6357907 - DNA, 15 bp, Homo sapiens
gtcccttgcccccct

SEQ ID NO: 6357908 - DNA, 16 bp, Homo sapiens
gtcccttgcctctgcc

SEQ ID NO: 6357909 - DNA, 23 bp, Homo sapiens
gtcccttgcctctgccctggatt

SEQ ID NO: 6357910 - DNA, 20 bp, Homo sapiens
gtcccttgcttgcctgcagg

SEQ ID NO: 6357911 - DNA, 20 bp, Homo sapiens
gtcccttggaaagttcagcc

SEQ ID NO: 6357912 - DNA, 19 bp, Homo sapiens
gtcccttggatcagaggtc

SEQ ID NO: 6357913 - DNA, 20 bp, Homo sapiens
gtcccttggatcagaggtca

SEQ ID NO: 6357914 - DNA, 17 bp, Homo sapiens
gtcccttgtttccagct

SEQ ID NO: 6357915 - DNA, 14 bp, Homo sapiens
gtccctttcacact

SEQ ID NO: 6357916 - DNA, 10 bp, Homo sapiens
gtccctttcc

SEQ ID NO: 6357917 - DNA, 15 bp, Homo sapiens
gtccctttcttggcc

SEQ ID NO: 6357918 - DNA, 17 bp, Homo sapiens
gtccctttcttggccag

SEQ ID NO: 6357919 - DNA, 22 bp, Homo sapiens
gtccctttcttggccagttatc

SEQ ID NO: 6357920 - DNA, 14 bp, Homo sapiens
gtccctttgctccc

SEQ ID NO: 6357921 - DNA, 20 bp, Homo sapiens
gtccctttttctccacactc

SEQ ID NO: 6357922 - DNA, 24 bp, Homo sapiens
gtccctttttctccacactccact

SEQ ID NO: 6357923 - DNA, 19 bp, Homo sapiens
gtccctttttgcaggggac

SEQ ID NO: 6357924 - DNA, 21 bp, Homo sapiens
gtccgaaagggacttggaagc

SEQ ID NO: 6357925 - DNA, 18 bp, Homo sapiens
gtccgagaaggcggaaac

SEQ ID NO: 6357926 - DNA, 12 bp, Homo sapiens
gtccgagaggct

SEQ ID NO: 6357927 - DNA, 16 bp, Homo sapiens
gtccgagctctgtcct

SEQ ID NO: 6357928 - DNA, 19 bp, Homo sapiens
gtccgaggcctggctctgg

SEQ ID NO: 6357929 - DNA, 20 bp, Homo sapiens
gtccgaggcctggctctgga

SEQ ID NO: 6357930 - DNA, 15 bp, Homo sapiens
gtccgataatatctt

SEQ ID NO: 6357931 - DNA, 13 bp, Homo sapiens
gtccgatgctgga

SEQ ID NO: 6357932 - DNA, 18 bp, Homo sapiens
gtccgatggcccgagagc

SEQ ID NO: 6357933 - DNA, 23 bp, Homo sapiens
taagtcctactttacatatgctt

SEQ ID NO: 6357934 - DNA, 14 bp, Homo sapiens
taagtcctctcttc

SEQ ID NO: 6357935 - DNA, 17 bp, Homo sapiens
taagtccttccacctgc

SEQ ID NO: 6357936 - DNA, 20 bp, Homo sapiens
taagtccttgcaagaatcag

SEQ ID NO: 6357937 - DNA, 18 bp, Homo sapiens
taagtcctttcaattcca

SEQ ID NO: 6357938 - DNA, 19 bp, Homo sapiens
taagtcgggaaattctgct

SEQ ID NO: 6357939 - DNA, 21 bp, Homo sapiens
taagtcgggaaattctgctgc

SEQ ID NO: 6357940 - DNA, 19 bp, Homo sapiens
taagtcgtgcactttctcg

SEQ ID NO: 6357941 - DNA, 17 bp, Homo sapiens
taagtcgttgagggaat

SEQ ID NO: 6357942 - DNA, 18 bp, Homo sapiens
taagtctaaatatttcct

SEQ ID NO: 6357943 - DNA, 15 bp, Homo sapiens
taagtctacattaaa

SEQ ID NO: 6357944 - DNA, 22 bp, Homo sapiens
taagtctatactaatgcttaca

SEQ ID NO: 6357945 - DNA, 22 bp, Homo sapiens
taagtctatctggtattaaatg

SEQ ID NO: 6357946 - DNA, 13 bp, Homo sapiens
taagtctcaactg

SEQ ID NO: 6357947 - DNA, 16 bp, Homo sapiens
taagtctcaaggtagg

SEQ ID NO: 6357948 - DNA, 19 bp, Homo sapiens
taagtctcgaatgtaattg

SEQ ID NO: 6357949 - DNA, 15 bp, Homo sapiens
taagtctctgactct

SEQ ID NO: 6357950 - DNA, 12 bp, Homo sapiens
taagtctctgtg

SEQ ID NO: 6357951 - DNA, 17 bp, Homo sapiens
taagtctcttttttaca

SEQ ID NO: 6357952 - DNA, 21 bp, Homo sapiens
taagtctgatgttctttccat

SEQ ID NO: 6357953 - DNA, 22 bp, Homo sapiens
taagtctgtattataataagca

SEQ ID NO: 6357954 - DNA, 20 bp, Homo sapiens
taagtctgttattgttttgt

SEQ ID NO: 6357955 - DNA, 16 bp, Homo sapiens
taagtctgttttatga

SEQ ID NO: 6357956 - DNA, 20 bp, Homo sapiens
taagtctgttttatgacttc

SEQ ID NO: 6357957 - DNA, 16 bp, Homo sapiens
taagtcttacaggaag

SEQ ID NO: 6357958 - DNA, 20 bp, Homo sapiens
taagtcttacataaaccatt

SEQ ID NO: 6357959 - DNA, 16 bp, Homo sapiens
taagtcttccttaaat

SEQ ID NO: 6357960 - DNA, 19 bp, Homo sapiens
taagtcttccttaaatgac

SEQ ID NO: 6357961 - DNA, 17 bp, Homo sapiens
taagtcttggtaacaaa

SEQ ID NO: 6357962 - DNA, 16 bp, Homo sapiens
taagtcttgtctcatt

SEQ ID NO: 6357963 - DNA, 19 bp, Homo sapiens
taagtcttttttttttcca

SEQ ID NO: 6357964 - DNA, 21 bp, Homo sapiens
taagtcttttttttttccaaa

SEQ ID NO: 6357965 - DNA, 16 bp, Homo sapiens
taagtgaaaaggtcat

SEQ ID NO: 6357966 - DNA, 13 bp, Homo sapiens
taagtgaaataag

SEQ ID NO: 6357967 - DNA, 13 bp, Homo sapiens
taagtgaaattta

SEQ ID NO: 6357968 - DNA, 20 bp, Homo sapiens
taagtgaaattttaaaagtc

SEQ ID NO: 6357969 - DNA, 20 bp, Homo sapiens
taagtgaacaactggaaata

SEQ ID NO: 6357970 - DNA, 22 bp, Homo sapiens
taagtgaactaccatgctttgt

SEQ ID NO: 6357971 - DNA, 21 bp, Homo sapiens
taagtgacaatgcttatggaa

SEQ ID NO: 6357972 - DNA, 12 bp, Homo sapiens
taagtgacacag

SEQ ID NO: 6357973 - DNA, 16 bp, Homo sapiens
taagtgacacagacat

SEQ ID NO: 6357974 - DNA, 20 bp, Homo sapiens
taagtgacagtttaactttt

SEQ ID NO: 6357975 - DNA, 10 bp, Homo sapiens
taagtgacat

SEQ ID NO: 6357976 - DNA, 15 bp, Homo sapiens
taagtgacatttgta

SEQ ID NO: 6357977 - DNA, 15 bp, Homo sapiens
taagtgagagagaca

SEQ ID NO: 6357978 - DNA, 19 bp, Homo sapiens
taagtgaggaaatcaaagt

SEQ ID NO: 6357979 - DNA, 21 bp, Homo sapiens
taagtgaggaaatcaaagtgc

SEQ ID NO: 6357980 - DNA, 20 bp, Homo sapiens
taagtgataaatctagaaaa

SEQ ID NO: 6357981 - DNA, 21 bp, Homo sapiens
taagtgataaatctagaaaat

SEQ ID NO: 6357982 - DNA, 17 bp, Homo sapiens
taagtgatgtcatttga

SEQ ID NO: 6357983 - DNA, 19 bp, Homo sapiens
taagtgatgtgctgaattt

SEQ ID NO: 6357984 - DNA, 18 bp, Homo sapiens
taagtgatttaaaaaaat

SEQ ID NO: 6357985 - DNA, 17 bp, Homo sapiens
taagtgatttccacagg

SEQ ID NO: 6357986 - DNA, 19 bp, Homo sapiens
taagtgcaaacacagcatg

SEQ ID NO: 6357987 - DNA, 23 bp, Homo sapiens
taagtgcaacatttctgtatact

SEQ ID NO: 6357988 - DNA, 17 bp, Homo sapiens
taagtgcacacagaaat

SEQ ID NO: 6357989 - DNA, 22 bp, Homo sapiens
taagtgcatgcattgagctgcc

SEQ ID NO: 6357990 - DNA, 23 bp, Homo sapiens
taagtgccacaggttttaaggat

SEQ ID NO: 6357991 - DNA, 10 bp, Homo sapiens
taagtgccca

SEQ ID NO: 6357992 - DNA, 14 bp, Homo sapiens
taagtgccctctcc

SEQ ID NO: 6357993 - DNA, 16 bp, Homo sapiens
taagtgcctccaagtt

SEQ ID NO: 6357994 - DNA, 16 bp, Homo sapiens
taagtgcctgctgtat

SEQ ID NO: 6357995 - DNA, 14 bp, Homo sapiens
taagtgccttccat

SEQ ID NO: 6357996 - DNA, 16 bp, Homo sapiens
taagtgcgtgtgtaga

SEQ ID NO: 6357997 - DNA, 19 bp, Homo sapiens
taagtgctacataaattgg

SEQ ID NO: 6357998 - DNA, 16 bp, Homo sapiens
taagtgctatgcatat

SEQ ID NO: 6357999 - DNA, 18 bp, Homo sapiens
taagtgctgcatttaaaa

SEQ ID NO: 6358000 - DNA, 14 bp, Homo sapiens
taagtgctgctgtg

SEQ ID NO: 6358001 - DNA, 12 bp, Homo sapiens
taagtgctgtat

SEQ ID NO: 6358002 - DNA, 17 bp, Homo sapiens
taagtgctgtataaaat

SEQ ID NO: 6358003 - DNA, 19 bp, Homo sapiens
taagtgctgtataaaatca

SEQ ID NO: 6358004 - DNA, 20 bp, Homo sapiens
taagtgcttcacatttgtat

SEQ ID NO: 6358005 - DNA, 20 bp, Homo sapiens
taagtgcttggttgaaaaga

SEQ ID NO: 6358006 - DNA, 18 bp, Homo sapiens
taagtggaaaaaagagaa

SEQ ID NO: 6358007 - DNA, 17 bp, Homo sapiens
taagtggaagacagaga

SEQ ID NO: 6358008 - DNA, 16 bp, Homo sapiens
taagtggactctctga

SEQ ID NO: 6358009 - DNA, 18 bp, Homo sapiens
taagtggactctctgaca

SEQ ID NO: 6358010 - DNA, 21 bp, Homo sapiens
taagtggactctctgacaaag

SEQ ID NO: 6358011 - DNA, 15 bp, Homo sapiens
taagtggactgtatt

SEQ ID NO: 6358012 - DNA, 16 bp, Homo sapiens
taagtggcaggaccct

SEQ ID NO: 6358013 - DNA, 19 bp, Homo sapiens
taagtggcctgcaggggcc

SEQ ID NO: 6358014 - DNA, 13 bp, Homo sapiens
taagtggctgctg

SEQ ID NO: 6358015 - DNA, 20 bp, Homo sapiens
taagtggctgtgattaatta

SEQ ID NO: 6358016 - DNA, 24 bp, Homo sapiens
taagtggctgtgattaattattga

SEQ ID NO: 6358017 - DNA, 19 bp, Homo sapiens
taagtgggacattagtaac

SEQ ID NO: 6358018 - DNA, 18 bp, Homo sapiens
taagtgggcccacccggt

SEQ ID NO: 6358019 - DNA, 19 bp, Homo sapiens
taagtgggctcctgacaat

SEQ ID NO: 6358020 - DNA, 18 bp, Homo sapiens
taagtgggtttttatgaa

SEQ ID NO: 6358021 - DNA, 22 bp, Homo sapiens
taagtggttctttggttccagt

SEQ ID NO: 6358022 - DNA, 18 bp, Homo sapiens
taagtggttttaataaaa

SEQ ID NO: 6358023 - DNA, 16 bp, Homo sapiens
taagtgtaaaaaatgt

SEQ ID NO: 6358024 - DNA, 14 bp, Homo sapiens
taagtgtaaatata

SEQ ID NO: 6358025 - DNA, 14 bp, Homo sapiens
taagtgtaaatgaa

SEQ ID NO: 6358026 - DNA, 12 bp, Homo sapiens
taagtgtacaat

SEQ ID NO: 6358027 - DNA, 22 bp, Homo sapiens
taagtgtacaattgatcttttt

SEQ ID NO: 6358028 - DNA, 22 bp, Homo sapiens
taagtgtacatatgtaaaatat

SEQ ID NO: 6358029 - DNA, 15 bp, Homo sapiens
taagtgtactaatta

SEQ ID NO: 6358030 - DNA, 18 bp, Homo sapiens
taagtgtatttttcaata

SEQ ID NO: 6358031 - DNA, 17 bp, Homo sapiens
taagtgtcaagtcctga

SEQ ID NO: 6358032 - DNA, 22 bp, Homo sapiens
taagtgtccattatttaccttg

SEQ ID NO: 6358033 - DNA, 14 bp, Homo sapiens
taagtgtgaactgg

SEQ ID NO: 6358034 - DNA, 18 bp, Homo sapiens
taagtgtgccaaatcagt

SEQ ID NO: 6358035 - DNA, 21 bp, Homo sapiens
taagtgtgcttagttttaata

SEQ ID NO: 6358036 - DNA, 18 bp, Homo sapiens
taagtgtggatgttcaga

SEQ ID NO: 6358037 - DNA, 18 bp, Homo sapiens
taagtgtggttttgtaat

SEQ ID NO: 6358038 - DNA, 22 bp, Homo sapiens
taagtgtgtcttcctagaattc

SEQ ID NO: 6358039 - DNA, 24 bp, Homo sapiens
taagtgtgtcttcctagaattcga

SEQ ID NO: 6358040 - DNA, 20 bp, Homo sapiens
taagtgtgtggtagaaacaa

SEQ ID NO: 6358041 - DNA, 19 bp, Homo sapiens
taagtgtgtgtatactgta

SEQ ID NO: 6358042 - DNA, 17 bp, Homo sapiens
taagtgtgtgtttttca

SEQ ID NO: 6358043 - DNA, 16 bp, Homo sapiens
taagtgttcagtgttg

SEQ ID NO: 6358044 - DNA, 19 bp, Homo sapiens
taagtgttcagtgttgaca

SEQ ID NO: 6358045 - DNA, 23 bp, Homo sapiens
taagtgttcagtgttgacatagc

SEQ ID NO: 6358046 - DNA, 14 bp, Homo sapiens
taagtgttcatttt

SEQ ID NO: 6358047 - DNA, 14 bp, Homo sapiens
taagtgttctcatg

SEQ ID NO: 6358048 - DNA, 20 bp, Homo sapiens
taagtgttctcatgaagcag

SEQ ID NO: 6358049 - DNA, 15 bp, Homo sapiens
taagtgttctgtggc

SEQ ID NO: 6358050 - DNA, 21 bp, Homo sapiens
taagtgttctgtggctgattt

SEQ ID NO: 6358051 - DNA, 17 bp, Homo sapiens
taagtgttggaaaaaat

SEQ ID NO: 6358052 - DNA, 14 bp, Homo sapiens
taagtgttggccat

SEQ ID NO: 6358053 - DNA, 22 bp, Homo sapiens
taagtgttgtacaattactgtg

SEQ ID NO: 6358054 - DNA, 17 bp, Homo sapiens
taagtgtttcacagtgt

SEQ ID NO: 6358055 - DNA, 11 bp, Homo sapiens
taagtgtttcg

SEQ ID NO: 6358056 - DNA, 21 bp, Homo sapiens
taagtgtttcgtaagacaaaa

SEQ ID NO: 6358057 - DNA, 20 bp, Homo sapiens
taagttaaaggcagtccaga

SEQ ID NO: 6358058 - DNA, 16 bp, Homo sapiens
taagttaataagcaaa

SEQ ID NO: 6358059 - DNA, 13 bp, Homo sapiens
taagttaataatg

SEQ ID NO: 6358060 - DNA, 15 bp, Homo sapiens
taagttaatgaaata

SEQ ID NO: 6358061 - DNA, 17 bp, Homo sapiens
taagttaatgaaataaa

SEQ ID NO: 6358062 - DNA, 19 bp, Homo sapiens
taagttaatgaaataaaat

SEQ ID NO: 6358063 - DNA, 23 bp, Homo sapiens
taagttaatgaaataaaatttga

SEQ ID NO: 6358064 - DNA, 19 bp, Homo sapiens
taagttacaattacatctc

SEQ ID NO: 6358065 - DNA, 14 bp, Homo sapiens
taagttacttgaaa

SEQ ID NO: 6358066 - DNA, 19 bp, Homo sapiens
taagttacttgaaataagt

SEQ ID NO: 6358067 - DNA, 23 bp, Homo sapiens
taagttaggcagtcttctaccaa

SEQ ID NO: 6358068 - DNA, 17 bp, Homo sapiens
taagttagttccactga

SEQ ID NO: 6358069 - DNA, 16 bp, Homo sapiens
taagttatgtgtgtgg

SEQ ID NO: 6358070 - DNA, 20 bp, Homo sapiens
taagttattaagaggtaaga

SEQ ID NO: 6358071 - DNA, 22 bp, Homo sapiens
taagttattaagaggtaagact

SEQ ID NO: 6358072 - DNA, 22 bp, Homo sapiens
taagttattgatttttgtaata

SEQ ID NO: 6358073 - DNA, 16 bp, Homo sapiens
taagttattgcagttt

SEQ ID NO: 6358074 - DNA, 13 bp, Homo sapiens
taagttattgctg

SEQ ID NO: 6358075 - DNA, 16 bp, Homo sapiens
taagttattgctgcat

SEQ ID NO: 6358076 - DNA, 17 bp, Homo sapiens
taagttattttaaaaaa

SEQ ID NO: 6358077 - DNA, 13 bp, Homo sapiens
taagttattttat

SEQ ID NO: 6358078 - DNA, 23 bp, Homo sapiens
taagttattttatgacatgaaaa

SEQ ID NO: 6358079 - DNA, 17 bp, Homo sapiens
taagttatttttgtaca

SEQ ID NO: 6358080 - DNA, 20 bp, Homo sapiens
taagttcaaattcttctgaa

SEQ ID NO: 6358081 - DNA, 16 bp, Homo sapiens
taagttcacattagaa

SEQ ID NO: 6358082 - DNA, 17 bp, Homo sapiens
taagttcacattagaat

SEQ ID NO: 6358083 - DNA, 12 bp, Homo sapiens
taagttcaccgt

SEQ ID NO: 6358084 - DNA, 15 bp, Homo sapiens
taagttcactttttt

SEQ ID NO: 6358085 - DNA, 14 bp, Homo sapiens
taagttcatacaat

SEQ ID NO: 6358086 - DNA, 14 bp, Homo sapiens
taagttcattaaac

SEQ ID NO: 6358087 - DNA, 18 bp, Homo sapiens
taagttcattaaacagaa

SEQ ID NO: 6358088 - DNA, 15 bp, Homo sapiens
taagttccactgagc

SEQ ID NO: 6358089 - DNA, 12 bp, Homo sapiens
taagttcccttc

SEQ ID NO: 6358090 - DNA, 19 bp, Homo sapiens
taagttcctgctgcctggg

SEQ ID NO: 6358091 - DNA, 19 bp, Homo sapiens
taagttcgaacatgtttca

SEQ ID NO: 6358092 - DNA, 22 bp, Homo sapiens
taagttcgaacatgtttcactt

SEQ ID NO: 6358093 - DNA, 23 bp, Homo sapiens
taagttctatcagtgacttctga

SEQ ID NO: 6358094 - DNA, 20 bp, Homo sapiens
taagttctatgaagagtatt

SEQ ID NO: 6358095 - DNA, 12 bp, Homo sapiens
taagttctattc

SEQ ID NO: 6358096 - DNA, 14 bp, Homo sapiens
taagttctcccaac

SEQ ID NO: 6358097 - DNA, 23 bp, Homo sapiens
taagttctcccaacaacatgaaa

SEQ ID NO: 6358098 - DNA, 16 bp, Homo sapiens
taagttctgtgcagtt

SEQ ID NO: 6358099 - DNA, 14 bp, Homo sapiens
taagttcttagata

SEQ ID NO: 6358100 - DNA, 17 bp, Homo sapiens
taagttcttagatatct

SEQ ID NO: 6358101 - DNA, 21 bp, Homo sapiens
taagttcttatgaggagggga

SEQ ID NO: 6358102 - DNA, 13 bp, Homo sapiens
taagttctttgat

SEQ ID NO: 6358103 - DNA, 23 bp, Homo sapiens
taagttctttgatttgtaccatt

SEQ ID NO: 6358104 - DNA, 15 bp, Homo sapiens
taagttgaaaaagga

SEQ ID NO: 6358105 - DNA, 20 bp, Homo sapiens
taagttgaaaagtaaaaaat

SEQ ID NO: 6358106 - DNA, 15 bp, Homo sapiens
taagttgaagggaaa

SEQ ID NO: 6358107 - DNA, 17 bp, Homo sapiens
taagttgaatggcctgc

SEQ ID NO: 6358108 - DNA, 13 bp, Homo sapiens
taagttgaccttt

SEQ ID NO: 6358109 - DNA, 17 bp, Homo sapiens
taagttgacctttattt

SEQ ID NO: 6358110 - DNA, 18 bp, Homo sapiens
taagttgacctttattta

SEQ ID NO: 6358111 - DNA, 19 bp, Homo sapiens
gtccgcaagttcagggaag

SEQ ID NO: 6358112 - DNA, 13 bp, Homo sapiens
gtccgcaccagct

SEQ ID NO: 6358113 - DNA, 19 bp, Homo sapiens
gtccgcaccagctgctctg

SEQ ID NO: 6358114 - DNA, 22 bp, Homo sapiens
gtccgcaccagctgctctgccc

SEQ ID NO: 6358115 - DNA, 20 bp, Homo sapiens
gtccgcatccctgcttctgg

SEQ ID NO: 6358116 - DNA, 14 bp, Homo sapiens
gtccgccatccagg

SEQ ID NO: 6358117 - DNA, 20 bp, Homo sapiens
gtccgccatccagggtctgg

SEQ ID NO: 6358118 - DNA, 15 bp, Homo sapiens
gtccgcccatccctg

SEQ ID NO: 6358119 - DNA, 21 bp, Homo sapiens
gtccgccccgtgctcctctgc

SEQ ID NO: 6358120 - DNA, 22 bp, Homo sapiens
gtccgccccgtgctcctctgcc

SEQ ID NO: 6358121 - DNA, 15 bp, Homo sapiens
gtccgcccgcccacc

SEQ ID NO: 6358122 - DNA, 16 bp, Homo sapiens
gtccgcccgcccaccc

SEQ ID NO: 6358123 - DNA, 12 bp, Homo sapiens
gtccgccctgct

SEQ ID NO: 6358124 - DNA, 20 bp, Homo sapiens
gtccgccctgctcctccctg

SEQ ID NO: 6358125 - DNA, 23 bp, Homo sapiens
gtccgcgcgccagcacagaaaca

SEQ ID NO: 6358126 - DNA, 14 bp, Homo sapiens
gtccgcggcctgca

SEQ ID NO: 6358127 - DNA, 18 bp, Homo sapiens
gtccgcggcctgcaccga

SEQ ID NO: 6358128 - DNA, 16 bp, Homo sapiens
gtccgcgggtcccggc

SEQ ID NO: 6358129 - DNA, 17 bp, Homo sapiens
gtccgctaaatatttac

SEQ ID NO: 6358130 - DNA, 16 bp, Homo sapiens
gtccgctgctgctttc

SEQ ID NO: 6358131 - DNA, 17 bp, Homo sapiens
gtccgctttcctggagc

SEQ ID NO: 6358132 - DNA, 17 bp, Homo sapiens
gtccggacactcctaga

SEQ ID NO: 6358133 - DNA, 19 bp, Homo sapiens
gtccggacccacctcaccc

SEQ ID NO: 6358134 - DNA, 16 bp, Homo sapiens
gtccggatgtcactca

SEQ ID NO: 6358135 - DNA, 15 bp, Homo sapiens
gtccggcagcttctg

SEQ ID NO: 6358136 - DNA, 20 bp, Homo sapiens
gtccggcccagtgccagctc

SEQ ID NO: 6358137 - DNA, 21 bp, Homo sapiens
gtccggcctctccctgcctgt

SEQ ID NO: 6358138 - DNA, 15 bp, Homo sapiens
gtccggcctgcagcc

SEQ ID NO: 6358139 - DNA, 13 bp, Homo sapiens
gtccggcgccccg

SEQ ID NO: 6358140 - DNA, 21 bp, Homo sapiens
gtccggtccctgtcccagtgc

SEQ ID NO: 6358141 - DNA, 15 bp, Homo sapiens
gtccggtgccttcca

SEQ ID NO: 6358142 - DNA, 20 bp, Homo sapiens
gtccggtgccttccaccctg

SEQ ID NO: 6358143 - DNA, 24 bp, Homo sapiens
gtccggtgtccttttcactacacc

SEQ ID NO: 6358144 - DNA, 14 bp, Homo sapiens
gtccggtgttctaa

SEQ ID NO: 6358145 - DNA, 18 bp, Homo sapiens
gtccgtagctcccctggc

SEQ ID NO: 6358146 - DNA, 15 bp, Homo sapiens
gtccgtccaccacct

SEQ ID NO: 6358147 - DNA, 18 bp, Homo sapiens
gtccgtccacccttccat

SEQ ID NO: 6358148 - DNA, 20 bp, Homo sapiens
gtccgtccacccttccatca

SEQ ID NO: 6358149 - DNA, 14 bp, Homo sapiens
gtccgtccagagcc

SEQ ID NO: 6358150 - DNA, 15 bp, Homo sapiens
gtccgtccagagccg

SEQ ID NO: 6358151 - DNA, 21 bp, Homo sapiens
gtccgtccgcccgcccacccc

SEQ ID NO: 6358152 - DNA, 13 bp, Homo sapiens
gtccgtcctgctc

SEQ ID NO: 6358153 - DNA, 15 bp, Homo sapiens
gtccgtcctggcaca

SEQ ID NO: 6358154 - DNA, 16 bp, Homo sapiens
gtccgtcctggcacag

SEQ ID NO: 6358155 - DNA, 17 bp, Homo sapiens
gtccgtctctcttgctt

SEQ ID NO: 6358156 - DNA, 23 bp, Homo sapiens
gtccgtctgtctcgatgcctgat

SEQ ID NO: 6358157 - DNA, 15 bp, Homo sapiens
gtccgtgaaagttgt

SEQ ID NO: 6358158 - DNA, 13 bp, Homo sapiens
gtccgtgcccctt

SEQ ID NO: 6358159 - DNA, 20 bp, Homo sapiens
gtccgtgcgggaaattcagt

SEQ ID NO: 6358160 - DNA, 15 bp, Homo sapiens
gtccgtgctaaggac

SEQ ID NO: 6358161 - DNA, 21 bp, Homo sapiens
gtccgtggtagaggcctgggg

SEQ ID NO: 6358162 - DNA, 16 bp, Homo sapiens
gtccgtgtgcctcctg

SEQ ID NO: 6358163 - DNA, 13 bp, Homo sapiens
gtccgttccagga

SEQ ID NO: 6358164 - DNA, 14 bp, Homo sapiens
gtccgtttactcca

SEQ ID NO: 6358165 - DNA, 21 bp, Homo sapiens
gtcctaaaacttggatggact

SEQ ID NO: 6358166 - DNA, 18 bp, Homo sapiens
gtcctaaagggacaataa

SEQ ID NO: 6358167 - DNA, 17 bp, Homo sapiens
gtcctaacaaatgctcc

SEQ ID NO: 6358168 - DNA, 22 bp, Homo sapiens
gtcctaacctcgggcctgctgc

SEQ ID NO: 6358169 - DNA, 16 bp, Homo sapiens
gtcctaactggtatag

SEQ ID NO: 6358170 - DNA, 22 bp, Homo sapiens
gtcctaagaaagaggagtgctt

SEQ ID NO: 6358171 - DNA, 13 bp, Homo sapiens
gtcctaagagatt

SEQ ID NO: 6358172 - DNA, 19 bp, Homo sapiens
gtcctaagagatttatctt

SEQ ID NO: 6358173 - DNA, 20 bp, Homo sapiens
gtcctaagtgctaagtgctt

SEQ ID NO: 6358174 - DNA, 22 bp, Homo sapiens
gtcctaatgtgctgtgtgacat

SEQ ID NO: 6358175 - DNA, 19 bp, Homo sapiens
gtcctaattcttctgtcct

SEQ ID NO: 6358176 - DNA, 12 bp, Homo sapiens
gtcctaatttga

SEQ ID NO: 6358177 - DNA, 15 bp, Homo sapiens
gtcctacagaaaaac

SEQ ID NO: 6358178 - DNA, 21 bp, Homo sapiens
gtcctacagtgactccctggg

SEQ ID NO: 6358179 - DNA, 18 bp, Homo sapiens
gtcctaccatcagctctg

SEQ ID NO: 6358180 - DNA, 19 bp, Homo sapiens
gtcctaccatcagctctgc

SEQ ID NO: 6358181 - DNA, 23 bp, Homo sapiens
gtcctaccatcagctctgccttg

SEQ ID NO: 6358182 - DNA, 12 bp, Homo sapiens
gtcctactctgt

SEQ ID NO: 6358183 - DNA, 21 bp, Homo sapiens
gtcctactggggaaacttcct

SEQ ID NO: 6358184 - DNA, 23 bp, Homo sapiens
gtcctagaaattccccaccctga

SEQ ID NO: 6358185 - DNA, 18 bp, Homo sapiens
gtcctagaatgtttcatt

SEQ ID NO: 6358186 - DNA, 15 bp, Homo sapiens
gtcctagagctcctg

SEQ ID NO: 6358187 - DNA, 22 bp, Homo sapiens
gtcctagagctcctgtccctac

SEQ ID NO: 6358188 - DNA, 18 bp, Homo sapiens
gtcctagcaggatctgcc

SEQ ID NO: 6358189 - DNA, 13 bp, Homo sapiens
gtcctagcccagt

SEQ ID NO: 6358190 - DNA, 18 bp, Homo sapiens
gtcctagcccttccctga

SEQ ID NO: 6358191 - DNA, 12 bp, Homo sapiens
gtcctaggagta

SEQ ID NO: 6358192 - DNA, 18 bp, Homo sapiens
gtcctaggcccctgccct

SEQ ID NO: 6358193 - DNA, 14 bp, Homo sapiens
gtcctaggcctcaa

SEQ ID NO: 6358194 - DNA, 22 bp, Homo sapiens
gtcctaggtgaccccatctctg

SEQ ID NO: 6358195 - DNA, 14 bp, Homo sapiens
gtcctagtaagaag

SEQ ID NO: 6358196 - DNA, 22 bp, Homo sapiens
gtcctagtgtctattccctgga

SEQ ID NO: 6358197 - DNA, 22 bp, Homo sapiens
gtcctatccccggaccggacgc

SEQ ID NO: 6358198 - DNA, 22 bp, Homo sapiens
gtcctatccccggacgcatgca

SEQ ID NO: 6358199 - DNA, 14 bp, Homo sapiens
gtcctatccctgga

SEQ ID NO: 6358200 - DNA, 16 bp, Homo sapiens
gtcctatcgactttat

SEQ ID NO: 6358201 - DNA, 13 bp, Homo sapiens
gtcctatctcccc

SEQ ID NO: 6358202 - DNA, 23 bp, Homo sapiens
gtcctatctcccccaacccacct

SEQ ID NO: 6358203 - DNA, 14 bp, Homo sapiens
gtcctatctgggct

SEQ ID NO: 6358204 - DNA, 15 bp, Homo sapiens
gtcctatctgggctt

SEQ ID NO: 6358205 - DNA, 19 bp, Homo sapiens
gtcctatctgggcttcctg

SEQ ID NO: 6358206 - DNA, 24 bp, Homo sapiens
gtcctatctgggcttcctggagca

SEQ ID NO: 6358207 - DNA, 16 bp, Homo sapiens
gtcctatgaatgcttt

SEQ ID NO: 6358208 - DNA, 14 bp, Homo sapiens
gtcctatgcaataa

SEQ ID NO: 6358209 - DNA, 16 bp, Homo sapiens
gtcctatgcaataaaa

SEQ ID NO: 6358210 - DNA, 13 bp, Homo sapiens
gtcctatggaaac

SEQ ID NO: 6358211 - DNA, 19 bp, Homo sapiens
gtcctatggacaacttatt

SEQ ID NO: 6358212 - DNA, 20 bp, Homo sapiens
gtcctatggacaacttattt

SEQ ID NO: 6358213 - DNA, 14 bp, Homo sapiens
gtcctatggcctca

SEQ ID NO: 6358214 - DNA, 16 bp, Homo sapiens
gtcctatggcctcatg

SEQ ID NO: 6358215 - DNA, 19 bp, Homo sapiens
gtcctatgtacagagcttt

SEQ ID NO: 6358216 - DNA, 13 bp, Homo sapiens
gtcctatgtgtga

SEQ ID NO: 6358217 - DNA, 21 bp, Homo sapiens
gtcctattatattcattcttt

SEQ ID NO: 6358218 - DNA, 14 bp, Homo sapiens
gtcctcaaagaagt

SEQ ID NO: 6358219 - DNA, 18 bp, Homo sapiens
gtcctcacacacggaggc

SEQ ID NO: 6358220 - DNA, 13 bp, Homo sapiens
gtcctcacactca

SEQ ID NO: 6358221 - DNA, 13 bp, Homo sapiens
gtcctcacagcag

SEQ ID NO: 6358222 - DNA, 20 bp, Homo sapiens
gtcctcacagcagtcacagg

SEQ ID NO: 6358223 - DNA, 21 bp, Homo sapiens
gtcctcacagcctaggaccag

SEQ ID NO: 6358224 - DNA, 18 bp, Homo sapiens
gtcctcacagcctctccc

SEQ ID NO: 6358225 - DNA, 22 bp, Homo sapiens
gtcctcacatgcccgctgtccc

SEQ ID NO: 6358226 - DNA, 15 bp, Homo sapiens
gtcctcacccctgtc

SEQ ID NO: 6358227 - DNA, 12 bp, Homo sapiens
gtcctcaccctg

SEQ ID NO: 6358228 - DNA, 19 bp, Homo sapiens
gtcctcacctggttgaccc

SEQ ID NO: 6358229 - DNA, 17 bp, Homo sapiens
gtcctcaccttctgttt

SEQ ID NO: 6358230 - DNA, 20 bp, Homo sapiens
gtcctcacgccccctgtgac

SEQ ID NO: 6358231 - DNA, 18 bp, Homo sapiens
gtcctcactcccagtcca

SEQ ID NO: 6358232 - DNA, 19 bp, Homo sapiens
gtcctcactgctccctgaa

SEQ ID NO: 6358233 - DNA, 14 bp, Homo sapiens
gtcctcactggtct

SEQ ID NO: 6358234 - DNA, 16 bp, Homo sapiens
gtcctcactgtcctgt

SEQ ID NO: 6358235 - DNA, 18 bp, Homo sapiens
gtcctcacttctgtctcc

SEQ ID NO: 6358236 - DNA, 19 bp, Homo sapiens
gtcctcacttctgtctcct

SEQ ID NO: 6358237 - DNA, 21 bp, Homo sapiens
gtcctcacttgggggaaaaaa

SEQ ID NO: 6358238 - DNA, 21 bp, Homo sapiens
gtcctcagagggtccctaggt

SEQ ID NO: 6358239 - DNA, 18 bp, Homo sapiens
gtcctcagcaccccactc

SEQ ID NO: 6358240 - DNA, 20 bp, Homo sapiens
gtcctcagcaccccactcct

SEQ ID NO: 6358241 - DNA, 23 bp, Homo sapiens
gtcctcagcaccccactcctcag

SEQ ID NO: 6358242 - DNA, 12 bp, Homo sapiens
gtcctcagcccc

SEQ ID NO: 6358243 - DNA, 16 bp, Homo sapiens
gtcctcagccttgcca

SEQ ID NO: 6358244 - DNA, 21 bp, Homo sapiens
gtcctcagccttgccagagat

SEQ ID NO: 6358245 - DNA, 17 bp, Homo sapiens
gtcctcagctgctccca

SEQ ID NO: 6358246 - DNA, 23 bp, Homo sapiens
gtcctcagcttgggcttcttcct

SEQ ID NO: 6358247 - DNA, 13 bp, Homo sapiens
gtcctcaggaagg

SEQ ID NO: 6358248 - DNA, 18 bp, Homo sapiens
gtcctcaggaagggggcc

SEQ ID NO: 6358249 - DNA, 22 bp, Homo sapiens
gtcctcagggagcagggaaggc

SEQ ID NO: 6358250 - DNA, 23 bp, Homo sapiens
gtcctcagggctcagtcttttga

SEQ ID NO: 6358251 - DNA, 20 bp, Homo sapiens
gtcctcagggctctaccaag

SEQ ID NO: 6358252 - DNA, 13 bp, Homo sapiens
gtcctcaggtaca

SEQ ID NO: 6358253 - DNA, 15 bp, Homo sapiens
gtcctcaggtacagc

SEQ ID NO: 6358254 - DNA, 17 bp, Homo sapiens
gtcctcaggtcagctgg

SEQ ID NO: 6358255 - DNA, 14 bp, Homo sapiens
gtcctcaggtggcc

SEQ ID NO: 6358256 - DNA, 16 bp, Homo sapiens
gtcctcagtccattta

SEQ ID NO: 6358257 - DNA, 17 bp, Homo sapiens
gtcctcatctgcaaagc

SEQ ID NO: 6358258 - DNA, 13 bp, Homo sapiens
gtcctcatggaga

SEQ ID NO: 6358259 - DNA, 15 bp, Homo sapiens
gtcctcattataaaa

SEQ ID NO: 6358260 - DNA, 18 bp, Homo sapiens
gtcctcattgaatcctca

SEQ ID NO: 6358261 - DNA, 16 bp, Homo sapiens
gtcctcattgttcaga

SEQ ID NO: 6358262 - DNA, 17 bp, Homo sapiens
gtcctcattgttcagaa

SEQ ID NO: 6358263 - DNA, 19 bp, Homo sapiens
gtcctcattgttcagaaaa

SEQ ID NO: 6358264 - DNA, 21 bp, Homo sapiens
gtcctcattgttcagaaaagc

SEQ ID NO: 6358265 - DNA, 18 bp, Homo sapiens
gtcctcatttcccctccc

SEQ ID NO: 6358266 - DNA, 15 bp, Homo sapiens
gtcctccaaaacaca

SEQ ID NO: 6358267 - DNA, 22 bp, Homo sapiens
gtcctccaacaataaagagctc

SEQ ID NO: 6358268 - DNA, 14 bp, Homo sapiens
gtcctccaagccag

SEQ ID NO: 6358269 - DNA, 19 bp, Homo sapiens
gtcctccaccatgcactca

SEQ ID NO: 6358270 - DNA, 18 bp, Homo sapiens
gtcctccagaagcctctg

SEQ ID NO: 6358271 - DNA, 17 bp, Homo sapiens
gtcctccagaccaccag

SEQ ID NO: 6358272 - DNA, 16 bp, Homo sapiens
gtcctccagcctcggc

SEQ ID NO: 6358273 - DNA, 18 bp, Homo sapiens
gtcctccagcctcggcct

SEQ ID NO: 6358274 - DNA, 23 bp, Homo sapiens
gtcctccagcttcccctcgctgt

SEQ ID NO: 6358275 - DNA, 15 bp, Homo sapiens
gtcctccagggcgag

SEQ ID NO: 6358276 - DNA, 21 bp, Homo sapiens
gtcctccatccacgtggcctc

SEQ ID NO: 6358277 - DNA, 23 bp, Homo sapiens
gtcctccatccacgtggcctctc

SEQ ID NO: 6358278 - DNA, 23 bp, Homo sapiens
gtcctccatcccaacagccatgc

SEQ ID NO: 6358279 - DNA, 19 bp, Homo sapiens
gtcctccatcttccaggat

SEQ ID NO: 6358280 - DNA, 16 bp, Homo sapiens
gtcctcccaagctgtg

SEQ ID NO: 6358281 - DNA, 19 bp, Homo sapiens
gtcctcccaagctgtgctg

SEQ ID NO: 6358282 - DNA, 21 bp, Homo sapiens
gtcctcccaatttcagactcc

SEQ ID NO: 6358283 - DNA, 14 bp, Homo sapiens
gtcctcccacagac

SEQ ID NO: 6358284 - DNA, 21 bp, Homo sapiens
gtcctcccacagacctgcagt

SEQ ID NO: 6358285 - DNA, 22 bp, Homo sapiens
gtcctcccacagacctgcagtg

SEQ ID NO: 6358286 - DNA, 18 bp, Homo sapiens
gtcctcccaccttggcct

SEQ ID NO: 6358287 - DNA, 14 bp, Homo sapiens
gtcctcccagctga

SEQ ID NO: 6358288 - DNA, 15 bp, Homo sapiens
gtcctcccagctgac

SEQ ID NO: 6358289 - DNA, 23 bp, Homo sapiens
taagttgacctttatttattaaa

SEQ ID NO: 6358290 - DNA, 21 bp, Homo sapiens
taagttgagatagttttcatc

SEQ ID NO: 6358291 - DNA, 23 bp, Homo sapiens
taagttgagcgtgcgcactgcat

SEQ ID NO: 6358292 - DNA, 16 bp, Homo sapiens
taagttgattctgtcc

SEQ ID NO: 6358293 - DNA, 17 bp, Homo sapiens
taagttgattctgtccc

SEQ ID NO: 6358294 - DNA, 14 bp, Homo sapiens
taagttgctgtaaa

SEQ ID NO: 6358295 - DNA, 16 bp, Homo sapiens
taagttgctgtaaaat

SEQ ID NO: 6358296 - DNA, 22 bp, Homo sapiens
taagttgctgtaaaatttgtgt

SEQ ID NO: 6358297 - DNA, 15 bp, Homo sapiens
taagttggaaacact

SEQ ID NO: 6358298 - DNA, 16 bp, Homo sapiens
taagttggaaacacta

SEQ ID NO: 6358299 - DNA, 18 bp, Homo sapiens
taagttggaaacactaaa

SEQ ID NO: 6358300 - DNA, 21 bp, Homo sapiens
taagttggaaacactaaatgt

SEQ ID NO: 6358301 - DNA, 20 bp, Homo sapiens
taagttggaccagaggaagc

SEQ ID NO: 6358302 - DNA, 20 bp, Homo sapiens
taagttggcttctgtttcta

SEQ ID NO: 6358303 - DNA, 22 bp, Homo sapiens
taagttgggcttgctattctgt

SEQ ID NO: 6358304 - DNA, 15 bp, Homo sapiens
taagttgtaaaatgt

SEQ ID NO: 6358305 - DNA, 18 bp, Homo sapiens
taagttgtaaaatgtcaa

SEQ ID NO: 6358306 - DNA, 15 bp, Homo sapiens
taagttgtacaaatg

SEQ ID NO: 6358307 - DNA, 22 bp, Homo sapiens
taagttgtacaaatgtattttg

SEQ ID NO: 6358308 - DNA, 19 bp, Homo sapiens
taagttgtcaaagaagctt

SEQ ID NO: 6358309 - DNA, 16 bp, Homo sapiens
taagttgttgaaagta

SEQ ID NO: 6358310 - DNA, 22 bp, Homo sapiens
taagttgttggtttatactgta

SEQ ID NO: 6358311 - DNA, 15 bp, Homo sapiens
taagttgtttgcatg

SEQ ID NO: 6358312 - DNA, 22 bp, Homo sapiens
taagtttaaaaaacagaaaaac

SEQ ID NO: 6358313 - DNA, 18 bp, Homo sapiens
taagtttagaaattacaa

SEQ ID NO: 6358314 - DNA, 17 bp, Homo sapiens
taagtttatccaaatct

SEQ ID NO: 6358315 - DNA, 20 bp, Homo sapiens
taagtttatgtctaaagagc

SEQ ID NO: 6358316 - DNA, 16 bp, Homo sapiens
taagtttcaggtgaca

SEQ ID NO: 6358317 - DNA, 17 bp, Homo sapiens
taagtttcaggtgacat

SEQ ID NO: 6358318 - DNA, 18 bp, Homo sapiens
taagtttcattctaaaat

SEQ ID NO: 6358319 - DNA, 21 bp, Homo sapiens
taagtttccttccagcccaga

SEQ ID NO: 6358320 - DNA, 15 bp, Homo sapiens
taagtttccttccct

SEQ ID NO: 6358321 - DNA, 16 bp, Homo sapiens
taagtttctaagattc

SEQ ID NO: 6358322 - DNA, 17 bp, Homo sapiens
taagtttctaagattct

SEQ ID NO: 6358323 - DNA, 15 bp, Homo sapiens
taagtttctcatccc

SEQ ID NO: 6358324 - DNA, 17 bp, Homo sapiens
taagtttctctgcagaa

SEQ ID NO: 6358325 - DNA, 15 bp, Homo sapiens
taagtttctcttcac

SEQ ID NO: 6358326 - DNA, 14 bp, Homo sapiens
taagtttctttaga

SEQ ID NO: 6358327 - DNA, 16 bp, Homo sapiens
taagtttgatcaaatc

SEQ ID NO: 6358328 - DNA, 16 bp, Homo sapiens
taagtttgatttcatt

SEQ ID NO: 6358329 - DNA, 12 bp, Homo sapiens
taagtttgcact

SEQ ID NO: 6358330 - DNA, 17 bp, Homo sapiens
taagtttgcactcaaat

SEQ ID NO: 6358331 - DNA, 20 bp, Homo sapiens
taagtttggagcactagttt

SEQ ID NO: 6358332 - DNA, 12 bp, Homo sapiens
taagtttgtagt

SEQ ID NO: 6358333 - DNA, 18 bp, Homo sapiens
taagtttgtgaatgtgac

SEQ ID NO: 6358334 - DNA, 20 bp, Homo sapiens
taagtttgtgttagaaaagt

SEQ ID NO: 6358335 - DNA, 23 bp, Homo sapiens
taagttttaaataaacctataat

SEQ ID NO: 6358336 - DNA, 17 bp, Homo sapiens
taagttttagaatcttt

SEQ ID NO: 6358337 - DNA, 20 bp, Homo sapiens
taagttttagaatcttttaa

SEQ ID NO: 6358338 - DNA, 21 bp, Homo sapiens
taagttttagaatcttttaaa

SEQ ID NO: 6358339 - DNA, 14 bp, Homo sapiens
taagttttatttaa

SEQ ID NO: 6358340 - DNA, 13 bp, Homo sapiens
taagttttctctt

SEQ ID NO: 6358341 - DNA, 21 bp, Homo sapiens
taagttttgattaatgtttct

SEQ ID NO: 6358342 - DNA, 20 bp, Homo sapiens
taagtttttatggcttttgt

SEQ ID NO: 6358343 - DNA, 12 bp, Homo sapiens
taagtttttcca

SEQ ID NO: 6358344 - DNA, 14 bp, Homo sapiens
taagtttttccaaa

SEQ ID NO: 6358345 - DNA, 18 bp, Homo sapiens
taagtttttccaaaacct

SEQ ID NO: 6358346 - DNA, 14 bp, Homo sapiens
taagtttttcttta

SEQ ID NO: 6358347 - DNA, 13 bp, Homo sapiens
taagtttttgcta

SEQ ID NO: 6358348 - DNA, 20 bp, Homo sapiens
taagtttttgctaaatgtga

SEQ ID NO: 6358349 - DNA, 20 bp, Homo sapiens
taagttttttacttccacag

SEQ ID NO: 6358350 - DNA, 15 bp, Homo sapiens
taagttttttatgcc

SEQ ID NO: 6358351 - DNA, 18 bp, Homo sapiens
taagtttttttttaaaaa

SEQ ID NO: 6358352 - DNA, 22 bp, Homo sapiens
taagttttttttttctcctctc

SEQ ID NO: 6358353 - DNA, 23 bp, Homo sapiens
taataaaaaacatttattttcat

SEQ ID NO: 6358354 - DNA, 19 bp, Homo sapiens
taataaaaaatggaaagaa

SEQ ID NO: 6358355 - DNA, 20 bp, Homo sapiens
taataaaaaatggaaagaat

SEQ ID NO: 6358356 - DNA, 14 bp, Homo sapiens
taataaaaagaaag

SEQ ID NO: 6358357 - DNA, 20 bp, Homo sapiens
taataaaaagccaccacaca

SEQ ID NO: 6358358 - DNA, 16 bp, Homo sapiens
taataaaaagcctctt

SEQ ID NO: 6358359 - DNA, 23 bp, Homo sapiens
taataaaaaggaaatatttttca

SEQ ID NO: 6358360 - DNA, 14 bp, Homo sapiens
taataaaaaggcac

SEQ ID NO: 6358361 - DNA, 19 bp, Homo sapiens
taataaaaagtaacacacc

SEQ ID NO: 6358362 - DNA, 20 bp, Homo sapiens
taataaaaagtaacacacca

SEQ ID NO: 6358363 - DNA, 13 bp, Homo sapiens
taataaaaataaa

SEQ ID NO: 6358364 - DNA, 15 bp, Homo sapiens
taataaaaataattt

SEQ ID NO: 6358365 - DNA, 15 bp, Homo sapiens
taataaaaatacaca

SEQ ID NO: 6358366 - DNA, 18 bp, Homo sapiens
taataaaaatacacatga

SEQ ID NO: 6358367 - DNA, 11 bp, Homo sapiens
taataaaacaa

SEQ ID NO: 6358368 - DNA, 23 bp, Homo sapiens
taataaaacaacaacaaaaacag

SEQ ID NO: 6358369 - DNA, 13 bp, Homo sapiens
taataaaaccaaa

SEQ ID NO: 6358370 - DNA, 16 bp, Homo sapiens
taataaaaccaaagaa

SEQ ID NO: 6358371 - DNA, 18 bp, Homo sapiens
taataaaactgcacagtg

SEQ ID NO: 6358372 - DNA, 20 bp, Homo sapiens
taataaaactgcacagtgct

SEQ ID NO: 6358373 - DNA, 12 bp, Homo sapiens
taataaaactgt

SEQ ID NO: 6358374 - DNA, 13 bp, Homo sapiens
taataaaactgtg

SEQ ID NO: 6358375 - DNA, 14 bp, Homo sapiens
taataaaagaaaat

SEQ ID NO: 6358376 - DNA, 15 bp, Homo sapiens
taataaaagaatcat

SEQ ID NO: 6358377 - DNA, 13 bp, Homo sapiens
taataaaagattt

SEQ ID NO: 6358378 - DNA, 15 bp, Homo sapiens
taataaaagatttac

SEQ ID NO: 6358379 - DNA, 16 bp, Homo sapiens
taataaaagatttaca

SEQ ID NO: 6358380 - DNA, 18 bp, Homo sapiens
taataaaagatttacatt

SEQ ID NO: 6358381 - DNA, 22 bp, Homo sapiens
taataaaagctttgactccctg

SEQ ID NO: 6358382 - DNA, 16 bp, Homo sapiens
taataaaagtattctt

SEQ ID NO: 6358383 - DNA, 12 bp, Homo sapiens
taataaaagtga

SEQ ID NO: 6358384 - DNA, 23 bp, Homo sapiens
taataaaagtgccttagcatgtg

SEQ ID NO: 6358385 - DNA, 13 bp, Homo sapiens
taataaaataagt

SEQ ID NO: 6358386 - DNA, 16 bp, Homo sapiens
taataaaataattcta

SEQ ID NO: 6358387 - DNA, 16 bp, Homo sapiens
taataaaataattctc

SEQ ID NO: 6358388 - DNA, 13 bp, Homo sapiens
taataaaatatca

SEQ ID NO: 6358389 - DNA, 15 bp, Homo sapiens
taataaaatatcatt

SEQ ID NO: 6358390 - DNA, 21 bp, Homo sapiens
taataaaatatcattcagcaa

SEQ ID NO: 6358391 - DNA, 14 bp, Homo sapiens
taataaaatatttt

SEQ ID NO: 6358392 - DNA, 16 bp, Homo sapiens
taataaaatgcaaatg

SEQ ID NO: 6358393 - DNA, 18 bp, Homo sapiens
taataaaatgcaaatgaa

SEQ ID NO: 6358394 - DNA, 19 bp, Homo sapiens
taataaaatggcaccttcc

SEQ ID NO: 6358395 - DNA, 15 bp, Homo sapiens
taataaaattcagaa

SEQ ID NO: 6358396 - DNA, 14 bp, Homo sapiens
taataaaattcatt

SEQ ID NO: 6358397 - DNA, 12 bp, Homo sapiens
taataaaattga

SEQ ID NO: 6358398 - DNA, 12 bp, Homo sapiens
taataaacactg

SEQ ID NO: 6358399 - DNA, 19 bp, Homo sapiens
taataaacactggctctgg

SEQ ID NO: 6358400 - DNA, 11 bp, Homo sapiens
taataaaccag

SEQ ID NO: 6358401 - DNA, 12 bp, Homo sapiens
taataaaccagt

SEQ ID NO: 6358402 - DNA, 18 bp, Homo sapiens
taataaacgaagataaat

SEQ ID NO: 6358403 - DNA, 21 bp, Homo sapiens
taataaacgatgttgtgatgt

SEQ ID NO: 6358404 - DNA, 19 bp, Homo sapiens
taataaactaataattgca

SEQ ID NO: 6358405 - DNA, 20 bp, Homo sapiens
taataaactaataattgcag

SEQ ID NO: 6358406 - DNA, 12 bp, Homo sapiens
taataaactctc

SEQ ID NO: 6358407 - DNA, 14 bp, Homo sapiens
taataaactctcta

SEQ ID NO: 6358408 - DNA, 15 bp, Homo sapiens
taataaactgcaaat

SEQ ID NO: 6358409 - DNA, 20 bp, Homo sapiens
taataaactgcaaatgtgca

SEQ ID NO: 6358410 - DNA, 15 bp, Homo sapiens
taataaactgcaagt

SEQ ID NO: 6358411 - DNA, 15 bp, Homo sapiens
taataaactgtatta

SEQ ID NO: 6358412 - DNA, 20 bp, Homo sapiens
taataaactgtattaaatct

SEQ ID NO: 6358413 - DNA, 12 bp, Homo sapiens
taataaactgtt

SEQ ID NO: 6358414 - DNA, 15 bp, Homo sapiens
taataaactgtttaa

SEQ ID NO: 6358415 - DNA, 18 bp, Homo sapiens
taataaacttagaataaa

SEQ ID NO: 6358416 - DNA, 22 bp, Homo sapiens
taataaactttgaataaaagaa

SEQ ID NO: 6358417 - DNA, 21 bp, Homo sapiens
taataaagacactggcagaga

SEQ ID NO: 6358418 - DNA, 13 bp, Homo sapiens
taataaagacagg

SEQ ID NO: 6358419 - DNA, 15 bp, Homo sapiens
taataaagactctac

SEQ ID NO: 6358420 - DNA, 12 bp, Homo sapiens
taataaagagaa

SEQ ID NO: 6358421 - DNA, 14 bp, Homo sapiens
taataaagagaaat

SEQ ID NO: 6358422 - DNA, 19 bp, Homo sapiens
taataaagagatagttcta

SEQ ID NO: 6358423 - DNA, 20 bp, Homo sapiens
taataaagatgattgaatcc

SEQ ID NO: 6358424 - DNA, 14 bp, Homo sapiens
taataaagatgctc

SEQ ID NO: 6358425 - DNA, 13 bp, Homo sapiens
taataaagatgtg

SEQ ID NO: 6358426 - DNA, 14 bp, Homo sapiens
taataaagattcca

SEQ ID NO: 6358427 - DNA, 16 bp, Homo sapiens
taataaagcaatctga

SEQ ID NO: 6358428 - DNA, 11 bp, Homo sapiens
taataaagcat

SEQ ID NO: 6358429 - DNA, 14 bp, Homo sapiens
taataaagccattt

SEQ ID NO: 6358430 - DNA, 15 bp, Homo sapiens
taataaagctactga

SEQ ID NO: 6358431 - DNA, 16 bp, Homo sapiens
taataaagctactgat

SEQ ID NO: 6358432 - DNA, 12 bp, Homo sapiens
taataaagctgt

SEQ ID NO: 6358433 - DNA, 14 bp, Homo sapiens
taataaagctttat

SEQ ID NO: 6358434 - DNA, 15 bp, Homo sapiens
taataaagctttata

SEQ ID NO: 6358435 - DNA, 16 bp, Homo sapiens
taataaaggactgtaa

SEQ ID NO: 6358436 - DNA, 13 bp, Homo sapiens
taataaaggttgt

SEQ ID NO: 6358437 - DNA, 14 bp, Homo sapiens
taataaagtatatt

SEQ ID NO: 6358438 - DNA, 22 bp, Homo sapiens
taataaagtatgaatatttcat

SEQ ID NO: 6358439 - DNA, 18 bp, Homo sapiens
taataaagtattccacct

SEQ ID NO: 6358440 - DNA, 22 bp, Homo sapiens
taataaagtattccaccttaaa

SEQ ID NO: 6358441 - DNA, 10 bp, Homo sapiens
taataaagtg

SEQ ID NO: 6358442 - DNA, 12 bp, Homo sapiens
taataaagtgaa

SEQ ID NO: 6358443 - DNA, 19 bp, Homo sapiens
taataaagtgttttcagag

SEQ ID NO: 6358444 - DNA, 18 bp, Homo sapiens
taataaagtttttttcca

SEQ ID NO: 6358445 - DNA, 14 bp, Homo sapiens
taataaataaatgt

SEQ ID NO: 6358446 - DNA, 12 bp, Homo sapiens
taataaatataa

SEQ ID NO: 6358447 - DNA, 16 bp, Homo sapiens
taataaatataattta

SEQ ID NO: 6358448 - DNA, 17 bp, Homo sapiens
taataaatatactatga

SEQ ID NO: 6358449 - DNA, 14 bp, Homo sapiens
taataaatatatac

SEQ ID NO: 6358450 - DNA, 22 bp, Homo sapiens
taataaatattgtcctgtttct

SEQ ID NO: 6358451 - DNA, 15 bp, Homo sapiens
taataaatcacacat

SEQ ID NO: 6358452 - DNA, 18 bp, Homo sapiens
taataaatcatgttttga

SEQ ID NO: 6358453 - DNA, 19 bp, Homo sapiens
taataaatgaatgtcactt

SEQ ID NO: 6358454 - DNA, 12 bp, Homo sapiens
taataaatgacc

SEQ ID NO: 6358455 - DNA, 16 bp, Homo sapiens
taataaatgaccagtt

SEQ ID NO: 6358456 - DNA, 18 bp, Homo sapiens
taataaatgggaaatgtc

SEQ ID NO: 6358457 - DNA, 11 bp, Homo sapiens
taataaattaa

SEQ ID NO: 6358458 - DNA, 14 bp, Homo sapiens
taataaattccaat

SEQ ID NO: 6358459 - DNA, 20 bp, Homo sapiens
taataaattgaaattgtgaa

SEQ ID NO: 6358460 - DNA, 13 bp, Homo sapiens
taataaattgatt

SEQ ID NO: 6358461 - DNA, 12 bp, Homo sapiens
taataaattgct

SEQ ID NO: 6358462 - DNA, 15 bp, Homo sapiens
taataaattttccat

SEQ ID NO: 6358463 - DNA, 17 bp, Homo sapiens
taataaattttctaaaa

SEQ ID NO: 6358464 - DNA, 19 bp, Homo sapiens
taataacaacaacttaatg

SEQ ID NO: 6358465 - DNA, 20 bp, Homo sapiens
taataacaaggagatttctt

SEQ ID NO: 6358466 - DNA, 22 bp, Homo sapiens
taataacaatatatagaattgt

SEQ ID NO: 6358467 - DNA, 17 bp, Homo sapiens
taataacacttcacctt

SEQ ID NO: 6358468 - DNA, 17 bp, Homo sapiens
taataacagaaatacat

SEQ ID NO: 6358469 - DNA, 19 bp, Homo sapiens
taataacagaaatacatca

SEQ ID NO: 6358470 - DNA, 15 bp, Homo sapiens
taataacagctcctt

SEQ ID NO: 6358471 - DNA, 20 bp, Homo sapiens
gtcctcccatcccctcaaca

SEQ ID NO: 6358472 - DNA, 20 bp, Homo sapiens
gtcctcccatcccctggact

SEQ ID NO: 6358473 - DNA, 13 bp, Homo sapiens
gtcctccccaccc

SEQ ID NO: 6358474 - DNA, 19 bp, Homo sapiens
gtcctccccctgccagtgc

SEQ ID NO: 6358475 - DNA, 15 bp, Homo sapiens
gtcctcccctatttt

SEQ ID NO: 6358476 - DNA, 18 bp, Homo sapiens
gtcctcccctattttaag

SEQ ID NO: 6358477 - DNA, 11 bp, Homo sapiens
gtcctcccctc

SEQ ID NO: 6358478 - DNA, 12 bp, Homo sapiens
gtcctcccctca

SEQ ID NO: 6358479 - DNA, 15 bp, Homo sapiens
gtcctcccctcaagg

SEQ ID NO: 6358480 - DNA, 15 bp, Homo sapiens
gtcctcccctcacag

SEQ ID NO: 6358481 - DNA, 19 bp, Homo sapiens
gtcctcccctcacagcctc

SEQ ID NO: 6358482 - DNA, 22 bp, Homo sapiens
gtcctcccctcacagcctctga

SEQ ID NO: 6358483 - DNA, 14 bp, Homo sapiens
gtcctccccttggg

SEQ ID NO: 6358484 - DNA, 21 bp, Homo sapiens
gtcctcccgagctcctcttcc

SEQ ID NO: 6358485 - DNA, 22 bp, Homo sapiens
gtcctcccgagctcctcttcca

SEQ ID NO: 6358486 - DNA, 14 bp, Homo sapiens
gtcctccctcagcc

SEQ ID NO: 6358487 - DNA, 15 bp, Homo sapiens
gtcctccctcagcct

SEQ ID NO: 6358488 - DNA, 19 bp, Homo sapiens
gtcctccctcagcctcccc

SEQ ID NO: 6358489 - DNA, 23 bp, Homo sapiens
gtcctccctcagcctccccttct

SEQ ID NO: 6358490 - DNA, 13 bp, Homo sapiens
gtcctccctccca

SEQ ID NO: 6358491 - DNA, 14 bp, Homo sapiens
gtcctccctcccaa

SEQ ID NO: 6358492 - DNA, 17 bp, Homo sapiens
gtcctccctcctgcagg

SEQ ID NO: 6358493 - DNA, 19 bp, Homo sapiens
gtcctccctcctgcaggct

SEQ ID NO: 6358494 - DNA, 20 bp, Homo sapiens
gtcctccctgatcccacccc

SEQ ID NO: 6358495 - DNA, 20 bp, Homo sapiens
gtcctccggggctcagccct

SEQ ID NO: 6358496 - DNA, 22 bp, Homo sapiens
gtcctcctatctccctggctca

SEQ ID NO: 6358497 - DNA, 15 bp, Homo sapiens
gtcctcctcacctca

SEQ ID NO: 6358498 - DNA, 13 bp, Homo sapiens
gtcctcctccagg

SEQ ID NO: 6358499 - DNA, 17 bp, Homo sapiens
gtcctcctccagggaca

SEQ ID NO: 6358500 - DNA, 18 bp, Homo sapiens
gtcctcctctacctctct

SEQ ID NO: 6358501 - DNA, 14 bp, Homo sapiens
gtcctcctctgagg

SEQ ID NO: 6358502 - DNA, 22 bp, Homo sapiens
gtcctcctctgtgaaactggga

SEQ ID NO: 6358503 - DNA, 11 bp, Homo sapiens
gtcctcctgct

SEQ ID NO: 6358504 - DNA, 15 bp, Homo sapiens
gtcctcctgctctgc

SEQ ID NO: 6358505 - DNA, 17 bp, Homo sapiens
gtcctcctgctctgctt

SEQ ID NO: 6358506 - DNA, 21 bp, Homo sapiens
gtcctcctgctctgcttcctc

SEQ ID NO: 6358507 - DNA, 16 bp, Homo sapiens
gtcctcctgctgccag

SEQ ID NO: 6358508 - DNA, 17 bp, Homo sapiens
gtcctcctgctgccagt

SEQ ID NO: 6358509 - DNA, 15 bp, Homo sapiens
gtcctcctggcacct

SEQ ID NO: 6358510 - DNA, 14 bp, Homo sapiens
gtcctcctgtgcta

SEQ ID NO: 6358511 - DNA, 14 bp, Homo sapiens
gtcctcctgttact

SEQ ID NO: 6358512 - DNA, 15 bp, Homo sapiens
gtcctccttcccagc

SEQ ID NO: 6358513 - DNA, 18 bp, Homo sapiens
gtcctccttcccagctct

SEQ ID NO: 6358514 - DNA, 21 bp, Homo sapiens
gtcctccttcccagctctaca

SEQ ID NO: 6358515 - DNA, 18 bp, Homo sapiens
gtcctccttcctgggacc

SEQ ID NO: 6358516 - DNA, 12 bp, Homo sapiens
gtcctcggagct

SEQ ID NO: 6358517 - DNA, 17 bp, Homo sapiens
gtcctcggcccatctgt

SEQ ID NO: 6358518 - DNA, 19 bp, Homo sapiens
gtcctcggcccatctgtcc

SEQ ID NO: 6358519 - DNA, 20 bp, Homo sapiens
gtcctcggcccatctgtcca

SEQ ID NO: 6358520 - DNA, 15 bp, Homo sapiens
gtcctcggccctgta

SEQ ID NO: 6358521 - DNA, 19 bp, Homo sapiens
gtcctcgggcccctgagcc

SEQ ID NO: 6358522 - DNA, 21 bp, Homo sapiens
gtcctcggtcttacccccacc

SEQ ID NO: 6358523 - DNA, 17 bp, Homo sapiens
gtcctcgttcaaaacat

SEQ ID NO: 6358524 - DNA, 18 bp, Homo sapiens
gtcctcgttcaaaacatt

SEQ ID NO: 6358525 - DNA, 22 bp, Homo sapiens
gtcctcgttcaaaacattccaa

SEQ ID NO: 6358526 - DNA, 23 bp, Homo sapiens
gtcctcgttcaaaacattccaag

SEQ ID NO: 6358527 - DNA, 14 bp, Homo sapiens
gtcctcgtttgtgt

SEQ ID NO: 6358528 - DNA, 16 bp, Homo sapiens
gtcctctaaacacact

SEQ ID NO: 6358529 - DNA, 23 bp, Homo sapiens
gtcctctagaaataggttaaact

SEQ ID NO: 6358530 - DNA, 17 bp, Homo sapiens
gtcctctagcaggccta

SEQ ID NO: 6358531 - DNA, 21 bp, Homo sapiens
gtcctctagcccactccctgc

SEQ ID NO: 6358532 - DNA, 15 bp, Homo sapiens
gtcctctcagaactc

SEQ ID NO: 6358533 - DNA, 17 bp, Homo sapiens
gtcctctcagaactcct

SEQ ID NO: 6358534 - DNA, 17 bp, Homo sapiens
gtcctctcagagcctca

SEQ ID NO: 6358535 - DNA, 22 bp, Homo sapiens
gtcctctcatcccagtcctgat

SEQ ID NO: 6358536 - DNA, 20 bp, Homo sapiens
gtcctctccacctagtggct

SEQ ID NO: 6358537 - DNA, 21 bp, Homo sapiens
gtcctctccccagcctggcac

SEQ ID NO: 6358538 - DNA, 23 bp, Homo sapiens
gtcctctcccccaaccccctgca

SEQ ID NO: 6358539 - DNA, 12 bp, Homo sapiens
gtcctctcccct

SEQ ID NO: 6358540 - DNA, 18 bp, Homo sapiens
gtcctctcccctccagcc

SEQ ID NO: 6358541 - DNA, 21 bp, Homo sapiens
gtcctctcccctctgccctgt

SEQ ID NO: 6358542 - DNA, 23 bp, Homo sapiens
gtcctctcccgcgggcctggaca

SEQ ID NO: 6358543 - DNA, 18 bp, Homo sapiens
gtcctctccctcctggcc

SEQ ID NO: 6358544 - DNA, 16 bp, Homo sapiens
gtcctctccctgccaa

SEQ ID NO: 6358545 - DNA, 21 bp, Homo sapiens
gtcctctcgtagaacctgcgc

SEQ ID NO: 6358546 - DNA, 13 bp, Homo sapiens
gtcctctctctgt

SEQ ID NO: 6358547 - DNA, 21 bp, Homo sapiens
gtcctctctgagtcaaatcca

SEQ ID NO: 6358548 - DNA, 17 bp, Homo sapiens
gtcctctctggctgggg

SEQ ID NO: 6358549 - DNA, 18 bp, Homo sapiens
gtcctctctggctgggga

SEQ ID NO: 6358550 - DNA, 13 bp, Homo sapiens
gtcctctcttcca

SEQ ID NO: 6358551 - DNA, 15 bp, Homo sapiens
gtcctctgagactcc

SEQ ID NO: 6358552 - DNA, 19 bp, Homo sapiens
gtcctctgagactccagac

SEQ ID NO: 6358553 - DNA, 20 bp, Homo sapiens
gtcctctgaggcactcatct

SEQ ID NO: 6358554 - DNA, 19 bp, Homo sapiens
gtcctctgatacccagagc

SEQ ID NO: 6358555 - DNA, 23 bp, Homo sapiens
gtcctctgcactgggaatttatt

SEQ ID NO: 6358556 - DNA, 12 bp, Homo sapiens
gtcctctgcctc

SEQ ID NO: 6358557 - DNA, 16 bp, Homo sapiens
gtcctctgcctgggct

SEQ ID NO: 6358558 - DNA, 17 bp, Homo sapiens
gtcctctgcctgggctc

SEQ ID NO: 6358559 - DNA, 18 bp, Homo sapiens
gtcctctgcctgggctct

SEQ ID NO: 6358560 - DNA, 13 bp, Homo sapiens
gtcctctgctcca

SEQ ID NO: 6358561 - DNA, 14 bp, Homo sapiens
gtcctctgctccag

SEQ ID NO: 6358562 - DNA, 18 bp, Homo sapiens
gtcctctgctccagcaac

SEQ ID NO: 6358563 - DNA, 18 bp, Homo sapiens
gtcctctgcttcctgagc

SEQ ID NO: 6358564 - DNA, 11 bp, Homo sapiens
gtcctctggat

SEQ ID NO: 6358565 - DNA, 21 bp, Homo sapiens
gtcctctggatggcaccagag

SEQ ID NO: 6358566 - DNA, 12 bp, Homo sapiens
gtcctctgtagt

SEQ ID NO: 6358567 - DNA, 14 bp, Homo sapiens
gtcctctgtagtat

SEQ ID NO: 6358568 - DNA, 16 bp, Homo sapiens
gtcctctgtcagtcat

SEQ ID NO: 6358569 - DNA, 21 bp, Homo sapiens
gtcctcttaggtcccgggagg

SEQ ID NO: 6358570 - DNA, 14 bp, Homo sapiens
gtcctcttattcct

SEQ ID NO: 6358571 - DNA, 15 bp, Homo sapiens
gtcctcttcctcaaa

SEQ ID NO: 6358572 - DNA, 16 bp, Homo sapiens
gtcctcttcctcaaag

SEQ ID NO: 6358573 - DNA, 21 bp, Homo sapiens
gtcctctttactcccttcctg

SEQ ID NO: 6358574 - DNA, 17 bp, Homo sapiens
gtcctctttcagaaaac

SEQ ID NO: 6358575 - DNA, 19 bp, Homo sapiens
gtcctctttcagaaaacag

SEQ ID NO: 6358576 - DNA, 17 bp, Homo sapiens
gtcctctttcagctcct

SEQ ID NO: 6358577 - DNA, 19 bp, Homo sapiens
gtcctctttcagctcctga

SEQ ID NO: 6358578 - DNA, 21 bp, Homo sapiens
gtcctcttttcctggcagctg

SEQ ID NO: 6358579 - DNA, 23 bp, Homo sapiens
gtcctcttttcctggcagctgct

SEQ ID NO: 6358580 - DNA, 19 bp, Homo sapiens
gtcctgaaacatgaaccca

SEQ ID NO: 6358581 - DNA, 16 bp, Homo sapiens
gtcctgaaagcggctg

SEQ ID NO: 6358582 - DNA, 19 bp, Homo sapiens
gtcctgaaagcggctgcct

SEQ ID NO: 6358583 - DNA, 21 bp, Homo sapiens
gtcctgaaagcggctgcctcc

SEQ ID NO: 6358584 - DNA, 23 bp, Homo sapiens
gtcctgaaagcggctgcctccat

SEQ ID NO: 6358585 - DNA, 16 bp, Homo sapiens
gtcctgaagaggcggg

SEQ ID NO: 6358586 - DNA, 21 bp, Homo sapiens
gtcctgaagaggcgggccagc

SEQ ID NO: 6358587 - DNA, 18 bp, Homo sapiens
gtcctgaagcccagcgac

SEQ ID NO: 6358588 - DNA, 12 bp, Homo sapiens
gtcctgaagctg

SEQ ID NO: 6358589 - DNA, 14 bp, Homo sapiens
gtcctgaaggcctg

SEQ ID NO: 6358590 - DNA, 21 bp, Homo sapiens
gtcctgaagtgacctcactgg

SEQ ID NO: 6358591 - DNA, 13 bp, Homo sapiens
gtcctgaatggct

SEQ ID NO: 6358592 - DNA, 12 bp, Homo sapiens
gtcctgacacct

SEQ ID NO: 6358593 - DNA, 12 bp, Homo sapiens
gtcctgaccacc

SEQ ID NO: 6358594 - DNA, 14 bp, Homo sapiens
gtcctgaccaccct

SEQ ID NO: 6358595 - DNA, 17 bp, Homo sapiens
gtcctgaccaccctccc

SEQ ID NO: 6358596 - DNA, 15 bp, Homo sapiens
gtcctgaccaggatg

SEQ ID NO: 6358597 - DNA, 15 bp, Homo sapiens
gtcctgacctgtctc

SEQ ID NO: 6358598 - DNA, 14 bp, Homo sapiens
gtcctgacgccctg

SEQ ID NO: 6358599 - DNA, 17 bp, Homo sapiens
gtcctgacgccctgcgt

SEQ ID NO: 6358600 - DNA, 21 bp, Homo sapiens
gtcctgacggcgcccccagtg

SEQ ID NO: 6358601 - DNA, 20 bp, Homo sapiens
gtcctgactccgtcaagctg

SEQ ID NO: 6358602 - DNA, 16 bp, Homo sapiens
gtcctgactgggctgg

SEQ ID NO: 6358603 - DNA, 20 bp, Homo sapiens
gtcctgagatggaaaagtgt

SEQ ID NO: 6358604 - DNA, 14 bp, Homo sapiens
gtcctgagcactgc

SEQ ID NO: 6358605 - DNA, 19 bp, Homo sapiens
gtcctgagcactgccagga

SEQ ID NO: 6358606 - DNA, 20 bp, Homo sapiens
gtcctgagcactgccaggag

SEQ ID NO: 6358607 - DNA, 18 bp, Homo sapiens
gtcctgagccccagggag

SEQ ID NO: 6358608 - DNA, 23 bp, Homo sapiens
gtcctgagccccctgcacccacc

SEQ ID NO: 6358609 - DNA, 12 bp, Homo sapiens
gtcctgagcgaa

SEQ ID NO: 6358610 - DNA, 21 bp, Homo sapiens
gtcctgagcgaaaacaggaga

SEQ ID NO: 6358611 - DNA, 18 bp, Homo sapiens
gtcctgagctcagcgtgg

SEQ ID NO: 6358612 - DNA, 12 bp, Homo sapiens
gtcctgaggagc

SEQ ID NO: 6358613 - DNA, 14 bp, Homo sapiens
gtcctgaggagccc

SEQ ID NO: 6358614 - DNA, 18 bp, Homo sapiens
gtcctgaggagccctgag

SEQ ID NO: 6358615 - DNA, 21 bp, Homo sapiens
gtcctgaggagccctgaggac

SEQ ID NO: 6358616 - DNA, 13 bp, Homo sapiens
gtcctgaggcaga

SEQ ID NO: 6358617 - DNA, 18 bp, Homo sapiens
gtcctgagggggaagtga

SEQ ID NO: 6358618 - DNA, 18 bp, Homo sapiens
gtcctgagggtccccacc

SEQ ID NO: 6358619 - DNA, 18 bp, Homo sapiens
gtcctgatgcccgttgtc

SEQ ID NO: 6358620 - DNA, 18 bp, Homo sapiens
gtcctgatggtcagctcc

SEQ ID NO: 6358621 - DNA, 19 bp, Homo sapiens
gtcctgatggtcagctccc

SEQ ID NO: 6358622 - DNA, 23 bp, Homo sapiens
gtcctgatggtcagctcccttct

SEQ ID NO: 6358623 - DNA, 13 bp, Homo sapiens
gtcctgatttgtg

SEQ ID NO: 6358624 - DNA, 18 bp, Homo sapiens
gtcctgcaatctccaggg

SEQ ID NO: 6358625 - DNA, 20 bp, Homo sapiens
gtcctgcaatctccagggct

SEQ ID NO: 6358626 - DNA, 18 bp, Homo sapiens
gtcctgcacaccctgggc

SEQ ID NO: 6358627 - DNA, 21 bp, Homo sapiens
gtcctgcacagattcccaggc

SEQ ID NO: 6358628 - DNA, 23 bp, Homo sapiens
gtcctgcacagattcccaggcca

SEQ ID NO: 6358629 - DNA, 24 bp, Homo sapiens
gtcctgcacagattcccaggccag

SEQ ID NO: 6358630 - DNA, 12 bp, Homo sapiens
gtcctgcacatg

SEQ ID NO: 6358631 - DNA, 15 bp, Homo sapiens
gtcctgcacatgagt

SEQ ID NO: 6358632 - DNA, 13 bp, Homo sapiens
gtcctgcactgtc

SEQ ID NO: 6358633 - DNA, 17 bp, Homo sapiens
gtcctgcagagctgggg

SEQ ID NO: 6358634 - DNA, 10 bp, Homo sapiens
gtcctgcagc

SEQ ID NO: 6358635 - DNA, 20 bp, Homo sapiens
gtcctgcagcaaacactcca

SEQ ID NO: 6358636 - DNA, 14 bp, Homo sapiens
gtcctgcagcctgc

SEQ ID NO: 6358637 - DNA, 18 bp, Homo sapiens
gtcctgcaggagtgctgg

SEQ ID NO: 6358638 - DNA, 22 bp, Homo sapiens
gtcctgcagggggaggaggact

SEQ ID NO: 6358639 - DNA, 14 bp, Homo sapiens
gtcctgcagtgtga

SEQ ID NO: 6358640 - DNA, 22 bp, Homo sapiens
gtcctgcatttctcagtcggtg

SEQ ID NO: 6358641 - DNA, 23 bp, Homo sapiens
gtcctgccaagtggtttctatga

SEQ ID NO: 6358642 - DNA, 16 bp, Homo sapiens
gtcctgccaccaccct

SEQ ID NO: 6358643 - DNA, 20 bp, Homo sapiens
gtcctgccacccagccccag

SEQ ID NO: 6358644 - DNA, 11 bp, Homo sapiens
gtcctgccagc

SEQ ID NO: 6358645 - DNA, 12 bp, Homo sapiens
gtcctgccagct

SEQ ID NO: 6358646 - DNA, 14 bp, Homo sapiens
gtcctgccagctgg

SEQ ID NO: 6358647 - DNA, 15 bp, Homo sapiens
gtcctgcccaatgcc

SEQ ID NO: 6358648 - DNA, 16 bp, Homo sapiens
gtcctgcccatgtgtc

SEQ ID NO: 6358649 - DNA, 17 bp, Homo sapiens
gtcctgcccatgtgtcc

SEQ ID NO: 6358650 - DNA, 17 bp, Homo sapiens
taataacagctccttta

SEQ ID NO: 6358651 - DNA, 21 bp, Homo sapiens
taataacattaccttactgtg

SEQ ID NO: 6358652 - DNA, 12 bp, Homo sapiens
taataacattta

SEQ ID NO: 6358653 - DNA, 14 bp, Homo sapiens
taataacatttaat

SEQ ID NO: 6358654 - DNA, 15 bp, Homo sapiens
taataacatttaatt

SEQ ID NO: 6358655 - DNA, 13 bp, Homo sapiens
taataaccagaca

SEQ ID NO: 6358656 - DNA, 14 bp, Homo sapiens
taataaccagacac

SEQ ID NO: 6358657 - DNA, 15 bp, Homo sapiens
taataaccagacaca

SEQ ID NO: 6358658 - DNA, 14 bp, Homo sapiens
taataaccctgcca

SEQ ID NO: 6358659 - DNA, 20 bp, Homo sapiens
taataacctgccagtcccag

SEQ ID NO: 6358660 - DNA, 22 bp, Homo sapiens
taataactatggtaaataactg

SEQ ID NO: 6358661 - DNA, 13 bp, Homo sapiens
taataactgcagt

SEQ ID NO: 6358662 - DNA, 18 bp, Homo sapiens
taataactgtcttctgga

SEQ ID NO: 6358663 - DNA, 15 bp, Homo sapiens
taataactgtgaagt

SEQ ID NO: 6358664 - DNA, 17 bp, Homo sapiens
taataactgtgtactgt

SEQ ID NO: 6358665 - DNA, 14 bp, Homo sapiens
taataactttattg

SEQ ID NO: 6358666 - DNA, 19 bp, Homo sapiens
taataactttattgcatat

SEQ ID NO: 6358667 - DNA, 20 bp, Homo sapiens
taataactttattgcatata

SEQ ID NO: 6358668 - DNA, 15 bp, Homo sapiens
taataagaacagatc

SEQ ID NO: 6358669 - DNA, 18 bp, Homo sapiens
taataagaagtgccaagt

SEQ ID NO: 6358670 - DNA, 14 bp, Homo sapiens
taataagacataac

SEQ ID NO: 6358671 - DNA, 19 bp, Homo sapiens
taataagacataacgtttt

SEQ ID NO: 6358672 - DNA, 19 bp, Homo sapiens
taataagaccccactggag

SEQ ID NO: 6358673 - DNA, 17 bp, Homo sapiens
taataagagaatgttcc

SEQ ID NO: 6358674 - DNA, 19 bp, Homo sapiens
taataagagaatgttccta

SEQ ID NO: 6358675 - DNA, 20 bp, Homo sapiens
taataagatttttcaaaatc

SEQ ID NO: 6358676 - DNA, 15 bp, Homo sapiens
taataagcactgtaa

SEQ ID NO: 6358677 - DNA, 16 bp, Homo sapiens
taataagcactgtaaa

SEQ ID NO: 6358678 - DNA, 17 bp, Homo sapiens
taataagcacttgcctg

SEQ ID NO: 6358679 - DNA, 19 bp, Homo sapiens
taataagcacttgcctgga

SEQ ID NO: 6358680 - DNA, 21 bp, Homo sapiens
taataagcacttgcctggaat

SEQ ID NO: 6358681 - DNA, 23 bp, Homo sapiens
taataagcacttgcctggaataa

SEQ ID NO: 6358682 - DNA, 12 bp, Homo sapiens
taataagctagt

SEQ ID NO: 6358683 - DNA, 12 bp, Homo sapiens
taataaggaaaa

SEQ ID NO: 6358684 - DNA, 20 bp, Homo sapiens
taataaggaaaagtttaata

SEQ ID NO: 6358685 - DNA, 14 bp, Homo sapiens
taataagggaaaaa

SEQ ID NO: 6358686 - DNA, 17 bp, Homo sapiens
taataagggaaaaatca

SEQ ID NO: 6358687 - DNA, 18 bp, Homo sapiens
taataagggaaaaatcaa

SEQ ID NO: 6358688 - DNA, 23 bp, Homo sapiens
taataagggaaaaatcaagtatt

SEQ ID NO: 6358689 - DNA, 13 bp, Homo sapiens
taataaggtttta

SEQ ID NO: 6358690 - DNA, 14 bp, Homo sapiens
taataaggttttaa

SEQ ID NO: 6358691 - DNA, 16 bp, Homo sapiens
taataaggttttaatt

SEQ ID NO: 6358692 - DNA, 21 bp, Homo sapiens
taataaggttttaatttagta

SEQ ID NO: 6358693 - DNA, 15 bp, Homo sapiens
taataagtatatctt

SEQ ID NO: 6358694 - DNA, 15 bp, Homo sapiens
taataagttgatgtt

SEQ ID NO: 6358695 - DNA, 19 bp, Homo sapiens
taataagttgatgttttct

SEQ ID NO: 6358696 - DNA, 13 bp, Homo sapiens
taataagtttgtg

SEQ ID NO: 6358697 - DNA, 20 bp, Homo sapiens
taataagttttgatataatc

SEQ ID NO: 6358698 - DNA, 13 bp, Homo sapiens
taataataaatag

SEQ ID NO: 6358699 - DNA, 14 bp, Homo sapiens
taataataaatgca

SEQ ID NO: 6358700 - DNA, 14 bp, Homo sapiens
taataataataaca

SEQ ID NO: 6358701 - DNA, 12 bp, Homo sapiens
taataataatga

SEQ ID NO: 6358702 - DNA, 15 bp, Homo sapiens
taataataatgaatg

SEQ ID NO: 6358703 - DNA, 13 bp, Homo sapiens
taataataatgcc

SEQ ID NO: 6358704 - DNA, 16 bp, Homo sapiens
taataataatgggttt

SEQ ID NO: 6358705 - DNA, 15 bp, Homo sapiens
taataataatttgca

SEQ ID NO: 6358706 - DNA, 11 bp, Homo sapiens
taataatacaa

SEQ ID NO: 6358707 - DNA, 13 bp, Homo sapiens
taataatacctca

SEQ ID NO: 6358708 - DNA, 20 bp, Homo sapiens
taataatacctcaatgtttg

SEQ ID NO: 6358709 - DNA, 12 bp, Homo sapiens
taataatataat

SEQ ID NO: 6358710 - DNA, 14 bp, Homo sapiens
taataatatacttg

SEQ ID NO: 6358711 - DNA, 16 bp, Homo sapiens
taataatatacttgtg

SEQ ID NO: 6358712 - DNA, 15 bp, Homo sapiens
taataatatgtacaa

SEQ ID NO: 6358713 - DNA, 17 bp, Homo sapiens
taataatatgtacaaat

SEQ ID NO: 6358714 - DNA, 22 bp, Homo sapiens
taataatattttagaaaatgtt

SEQ ID NO: 6358715 - DNA, 12 bp, Homo sapiens
taataatcaaga

SEQ ID NO: 6358716 - DNA, 16 bp, Homo sapiens
taataatcctgcaaag

SEQ ID NO: 6358717 - DNA, 18 bp, Homo sapiens
taataatcttgtttctga

SEQ ID NO: 6358718 - DNA, 17 bp, Homo sapiens
taataatgccaatgaac

SEQ ID NO: 6358719 - DNA, 23 bp, Homo sapiens
taataatgccaatgaacatctca

SEQ ID NO: 6358720 - DNA, 19 bp, Homo sapiens
taataatgcccttaatgtg

SEQ ID NO: 6358721 - DNA, 20 bp, Homo sapiens
taataatgcccttaatgtga

SEQ ID NO: 6358722 - DNA, 17 bp, Homo sapiens
taataatggttactcat

SEQ ID NO: 6358723 - DNA, 16 bp, Homo sapiens
taataatgtaacatga

SEQ ID NO: 6358724 - DNA, 12 bp, Homo sapiens
taataatgtaat

SEQ ID NO: 6358725 - DNA, 18 bp, Homo sapiens
taataatgtaatactgta

SEQ ID NO: 6358726 - DNA, 20 bp, Homo sapiens
taataatgtaatactgtaga

SEQ ID NO: 6358727 - DNA, 13 bp, Homo sapiens
taataatgtacct

SEQ ID NO: 6358728 - DNA, 13 bp, Homo sapiens
taataatgtattg

SEQ ID NO: 6358729 - DNA, 18 bp, Homo sapiens
taataatgttaaccaagg

SEQ ID NO: 6358730 - DNA, 22 bp, Homo sapiens
taataatgttaaccaaggaaat

SEQ ID NO: 6358731 - DNA, 12 bp, Homo sapiens
taataattaaag

SEQ ID NO: 6358732 - DNA, 15 bp, Homo sapiens
taataattatatgct

SEQ ID NO: 6358733 - DNA, 22 bp, Homo sapiens
taataattatatgctatttcta

SEQ ID NO: 6358734 - DNA, 12 bp, Homo sapiens
taataattgtat

SEQ ID NO: 6358735 - DNA, 22 bp, Homo sapiens
taataatttagacttcaagcat

SEQ ID NO: 6358736 - DNA, 13 bp, Homo sapiens
taataatttctaa

SEQ ID NO: 6358737 - DNA, 14 bp, Homo sapiens
taataatttgcact

SEQ ID NO: 6358738 - DNA, 15 bp, Homo sapiens
taataatttgtaaat

SEQ ID NO: 6358739 - DNA, 19 bp, Homo sapiens
taataatttttacctaatc

SEQ ID NO: 6358740 - DNA, 13 bp, Homo sapiens
taatacaaaacta

SEQ ID NO: 6358741 - DNA, 13 bp, Homo sapiens
taatacaaggtat

SEQ ID NO: 6358742 - DNA, 20 bp, Homo sapiens
taatacaaggtataataaaa

SEQ ID NO: 6358743 - DNA, 19 bp, Homo sapiens
taatacaagtaatattatt

SEQ ID NO: 6358744 - DNA, 20 bp, Homo sapiens
taatacaatgatgctatttg

SEQ ID NO: 6358745 - DNA, 16 bp, Homo sapiens
taatacacaaaatcaa

SEQ ID NO: 6358746 - DNA, 18 bp, Homo sapiens
taatacaccaaatagctt

SEQ ID NO: 6358747 - DNA, 20 bp, Homo sapiens
taatacaccaaatagctttt

SEQ ID NO: 6358748 - DNA, 16 bp, Homo sapiens
taatacaccactacat

SEQ ID NO: 6358749 - DNA, 18 bp, Homo sapiens
taatacaccactacattc

SEQ ID NO: 6358750 - DNA, 20 bp, Homo sapiens
taatacactaattcctttct

SEQ ID NO: 6358751 - DNA, 22 bp, Homo sapiens
taatacactaattcctttctat

SEQ ID NO: 6358752 - DNA, 20 bp, Homo sapiens
taatacagagtacgttaaaa

SEQ ID NO: 6358753 - DNA, 19 bp, Homo sapiens
taatacagatttgtaacat

SEQ ID NO: 6358754 - DNA, 19 bp, Homo sapiens
taatacagcagtgtcatca

SEQ ID NO: 6358755 - DNA, 23 bp, Homo sapiens
taatacagcagtgtcatcagaag

SEQ ID NO: 6358756 - DNA, 15 bp, Homo sapiens
taatacagctgagct

SEQ ID NO: 6358757 - DNA, 21 bp, Homo sapiens
taatacaggacttttaaatgg

SEQ ID NO: 6358758 - DNA, 22 bp, Homo sapiens
taatacataaagttctctgtaa

SEQ ID NO: 6358759 - DNA, 17 bp, Homo sapiens
taatacatactaatgaa

SEQ ID NO: 6358760 - DNA, 12 bp, Homo sapiens
taatacatcaca

SEQ ID NO: 6358761 - DNA, 16 bp, Homo sapiens
taatacatccattcta

SEQ ID NO: 6358762 - DNA, 16 bp, Homo sapiens
taatacattaaagcag

SEQ ID NO: 6358763 - DNA, 16 bp, Homo sapiens
taatacattacatgta

SEQ ID NO: 6358764 - DNA, 17 bp, Homo sapiens
taatacattacatgtaa

SEQ ID NO: 6358765 - DNA, 22 bp, Homo sapiens
taatacattacatgtaaattaa

SEQ ID NO: 6358766 - DNA, 17 bp, Homo sapiens
taatacattatatttct

SEQ ID NO: 6358767 - DNA, 20 bp, Homo sapiens
taatacattccaactcgtat

SEQ ID NO: 6358768 - DNA, 14 bp, Homo sapiens
taataccaaatatt

SEQ ID NO: 6358769 - DNA, 16 bp, Homo sapiens
taataccaaatatttt

SEQ ID NO: 6358770 - DNA, 17 bp, Homo sapiens
taataccacagctattt

SEQ ID NO: 6358771 - DNA, 21 bp, Homo sapiens
taataccaccaacaaatatag

SEQ ID NO: 6358772 - DNA, 16 bp, Homo sapiens
taataccaccatttaa

SEQ ID NO: 6358773 - DNA, 23 bp, Homo sapiens
taatacctctaatagtataaacc

SEQ ID NO: 6358774 - DNA, 15 bp, Homo sapiens
taatacctctgtgtg

SEQ ID NO: 6358775 - DNA, 18 bp, Homo sapiens
taatacctgattgatcac

SEQ ID NO: 6358776 - DNA, 21 bp, Homo sapiens
taatacgccaaccagtcaagt

SEQ ID NO: 6358777 - DNA, 21 bp, Homo sapiens
taatacgtgccagatataact

SEQ ID NO: 6358778 - DNA, 15 bp, Homo sapiens
taatactaaaactca

SEQ ID NO: 6358779 - DNA, 13 bp, Homo sapiens
taatactaaaata

SEQ ID NO: 6358780 - DNA, 18 bp, Homo sapiens
taatactaagtcctcaga

SEQ ID NO: 6358781 - DNA, 23 bp, Homo sapiens
taatactaattttccataagcta

SEQ ID NO: 6358782 - DNA, 14 bp, Homo sapiens
taatactaccttga

SEQ ID NO: 6358783 - DNA, 23 bp, Homo sapiens
taatactagttgtgaccttagtg

SEQ ID NO: 6358784 - DNA, 18 bp, Homo sapiens
taatactataaatatatt

SEQ ID NO: 6358785 - DNA, 13 bp, Homo sapiens
taatactgaacca

SEQ ID NO: 6358786 - DNA, 22 bp, Homo sapiens
taatactgaaccacttgtagat

SEQ ID NO: 6358787 - DNA, 14 bp, Homo sapiens
taatactgctgaga

SEQ ID NO: 6358788 - DNA, 20 bp, Homo sapiens
taatactggaataatttgta

SEQ ID NO: 6358789 - DNA, 19 bp, Homo sapiens
taatactggttatcctgtg

SEQ ID NO: 6358790 - DNA, 22 bp, Homo sapiens
taatactgtgttaccttttaaa

SEQ ID NO: 6358791 - DNA, 20 bp, Homo sapiens
taatactgttattctttgca

SEQ ID NO: 6358792 - DNA, 14 bp, Homo sapiens
taatacttaaataa

SEQ ID NO: 6358793 - DNA, 20 bp, Homo sapiens
taatacttaaataaacatga

SEQ ID NO: 6358794 - DNA, 19 bp, Homo sapiens
taatacttcatttggtgct

SEQ ID NO: 6358795 - DNA, 16 bp, Homo sapiens
taatacttccttataa

SEQ ID NO: 6358796 - DNA, 21 bp, Homo sapiens
taatacttccttataaaaatt

SEQ ID NO: 6358797 - DNA, 21 bp, Homo sapiens
taatactttcggagaaattct

SEQ ID NO: 6358798 - DNA, 20 bp, Homo sapiens
taatactttgtatacaagta

SEQ ID NO: 6358799 - DNA, 15 bp, Homo sapiens
taatagaaaactgaa

SEQ ID NO: 6358800 - DNA, 16 bp, Homo sapiens
taatagaaaattaaaa

SEQ ID NO: 6358801 - DNA, 17 bp, Homo sapiens
taatagaaagtcagatg

SEQ ID NO: 6358802 - DNA, 15 bp, Homo sapiens
taatagaaatgcata

SEQ ID NO: 6358803 - DNA, 12 bp, Homo sapiens
taatagaacttg

SEQ ID NO: 6358804 - DNA, 14 bp, Homo sapiens
taatagaacttgtt

SEQ ID NO: 6358805 - DNA, 16 bp, Homo sapiens
taatagaataaaggca

SEQ ID NO: 6358806 - DNA, 17 bp, Homo sapiens
taatagactaaatgaaa

SEQ ID NO: 6358807 - DNA, 19 bp, Homo sapiens
taatagactgagtcagatg

SEQ ID NO: 6358808 - DNA, 22 bp, Homo sapiens
taatagacttctcttacatttt

SEQ ID NO: 6358809 - DNA, 20 bp, Homo sapiens
taatagagtacttaatatac

SEQ ID NO: 6358810 - DNA, 15 bp, Homo sapiens
taatagataactgct

SEQ ID NO: 6358811 - DNA, 14 bp, Homo sapiens
taatagatgtttga

SEQ ID NO: 6358812 - DNA, 16 bp, Homo sapiens
taatagattatttcat

SEQ ID NO: 6358813 - DNA, 21 bp, Homo sapiens
taatagattttttttaaagtt

SEQ ID NO: 6358814 - DNA, 14 bp, Homo sapiens
taatagcatttttg

SEQ ID NO: 6358815 - DNA, 15 bp, Homo sapiens
taatagcatttttgt

SEQ ID NO: 6358816 - DNA, 23 bp, Homo sapiens
taatagccaaagatttcatatct

SEQ ID NO: 6358817 - DNA, 21 bp, Homo sapiens
taatagcctaaaagattttgt

SEQ ID NO: 6358818 - DNA, 22 bp, Homo sapiens
taatagcctaaaagattttgtg

SEQ ID NO: 6358819 - DNA, 14 bp, Homo sapiens
taatagcctcacct

SEQ ID NO: 6358820 - DNA, 19 bp, Homo sapiens
taatagcgggttactttca

SEQ ID NO: 6358821 - DNA, 23 bp, Homo sapiens
taatagctaataataaatgcata

SEQ ID NO: 6358822 - DNA, 15 bp, Homo sapiens
taatagctcacagca

SEQ ID NO: 6358823 - DNA, 16 bp, Homo sapiens
taatagctcacagcac

SEQ ID NO: 6358824 - DNA, 18 bp, Homo sapiens
taatagctcacagcacat

SEQ ID NO: 6358825 - DNA, 15 bp, Homo sapiens
taatagctgaacctg

SEQ ID NO: 6358826 - DNA, 17 bp, Homo sapiens
taatagcttctgtgtgt

SEQ ID NO: 6358827 - DNA, 19 bp, Homo sapiens
taatagctttagtgaatta

SEQ ID NO: 6358828 - DNA, 21 bp, Homo sapiens
taatagcttttattgtataaa

SEQ ID NO: 6358829 - DNA, 18 bp, Homo sapiens
taatagcttttgattagt

SEQ ID NO: 6358830 - DNA, 23 bp, Homo sapiens
gtcctgcccccgacagcccagcc

SEQ ID NO: 6358831 - DNA, 18 bp, Homo sapiens
gtcctgccctccggagga

SEQ ID NO: 6358832 - DNA, 21 bp, Homo sapiens
gtcctgccctccggaggagca

SEQ ID NO: 6358833 - DNA, 14 bp, Homo sapiens
gtcctgccctgccc

SEQ ID NO: 6358834 - DNA, 16 bp, Homo sapiens
gtcctgccggagagga

SEQ ID NO: 6358835 - DNA, 19 bp, Homo sapiens
gtcctgcctaaaatgaatt

SEQ ID NO: 6358836 - DNA, 15 bp, Homo sapiens
gtcctgcctcctcat

SEQ ID NO: 6358837 - DNA, 22 bp, Homo sapiens
gtcctgcctctctgctccagag

SEQ ID NO: 6358838 - DNA, 14 bp, Homo sapiens
gtcctgcctcttgt

SEQ ID NO: 6358839 - DNA, 21 bp, Homo sapiens
gtcctgcctcttgtttctgtg

SEQ ID NO: 6358840 - DNA, 13 bp, Homo sapiens
gtcctgcctggca

SEQ ID NO: 6358841 - DNA, 14 bp, Homo sapiens
gtcctgcctggcac

SEQ ID NO: 6358842 - DNA, 13 bp, Homo sapiens
gtcctgcctggcc

SEQ ID NO: 6358843 - DNA, 19 bp, Homo sapiens
gtcctgcctggccaggcag

SEQ ID NO: 6358844 - DNA, 14 bp, Homo sapiens
gtcctgcctgtctg

SEQ ID NO: 6358845 - DNA, 15 bp, Homo sapiens
gtcctgcctgtctgc

SEQ ID NO: 6358846 - DNA, 16 bp, Homo sapiens
gtcctgcctgtctgcc

SEQ ID NO: 6358847 - DNA, 21 bp, Homo sapiens
gtcctgcctgtctgccccagc

SEQ ID NO: 6358848 - DNA, 13 bp, Homo sapiens
gtcctgccttctt

SEQ ID NO: 6358849 - DNA, 22 bp, Homo sapiens
gtcctgccttcttccttgaggg

SEQ ID NO: 6358850 - DNA, 23 bp, Homo sapiens
gtcctgccttgatgaagcctgtg

SEQ ID NO: 6358851 - DNA, 18 bp, Homo sapiens
gtcctgcgttcagcccct

SEQ ID NO: 6358852 - DNA, 17 bp, Homo sapiens
gtcctgctacctttgtc

SEQ ID NO: 6358853 - DNA, 13 bp, Homo sapiens
gtcctgctagctg

SEQ ID NO: 6358854 - DNA, 22 bp, Homo sapiens
gtcctgctagctgtctctcttg

SEQ ID NO: 6358855 - DNA, 21 bp, Homo sapiens
gtcctgctcacgtctgtgagt

SEQ ID NO: 6358856 - DNA, 15 bp, Homo sapiens
gtcctgctcagcagt

SEQ ID NO: 6358857 - DNA, 11 bp, Homo sapiens
gtcctgctcca

SEQ ID NO: 6358858 - DNA, 16 bp, Homo sapiens
gtcctgctccacagtg

SEQ ID NO: 6358859 - DNA, 17 bp, Homo sapiens
gtcctgctccacagtgt

SEQ ID NO: 6358860 - DNA, 12 bp, Homo sapiens
gtcctgctccag

SEQ ID NO: 6358861 - DNA, 17 bp, Homo sapiens
gtcctgctccgctgcct

SEQ ID NO: 6358862 - DNA, 14 bp, Homo sapiens
gtcctgctcgccct

SEQ ID NO: 6358863 - DNA, 16 bp, Homo sapiens
gtcctgctcgccctgt

SEQ ID NO: 6358864 - DNA, 22 bp, Homo sapiens
gtcctgctctctacccagccca

SEQ ID NO: 6358865 - DNA, 23 bp, Homo sapiens
gtcctgctctctacccagcccat

SEQ ID NO: 6358866 - DNA, 19 bp, Homo sapiens
gtcctgctgcagttgccag

SEQ ID NO: 6358867 - DNA, 14 bp, Homo sapiens
gtcctgctgccctc

SEQ ID NO: 6358868 - DNA, 23 bp, Homo sapiens
gtcctgctgccctcccacagcct

SEQ ID NO: 6358869 - DNA, 15 bp, Homo sapiens
gtcctgctgcctgga

SEQ ID NO: 6358870 - DNA, 14 bp, Homo sapiens
gtcctgctgctcgg

SEQ ID NO: 6358871 - DNA, 22 bp, Homo sapiens
gtcctgctgctcgggaaggcct

SEQ ID NO: 6358872 - DNA, 16 bp, Homo sapiens
gtcctgctggcctgct

SEQ ID NO: 6358873 - DNA, 17 bp, Homo sapiens
gtcctgctggcctgctc

SEQ ID NO: 6358874 - DNA, 23 bp, Homo sapiens
gtcctgctggcttccagcttcag

SEQ ID NO: 6358875 - DNA, 13 bp, Homo sapiens
gtcctgctgtccc

SEQ ID NO: 6358876 - DNA, 18 bp, Homo sapiens
gtcctgctgtccctgtca

SEQ ID NO: 6358877 - DNA, 11 bp, Homo sapiens
gtcctgctgtg

SEQ ID NO: 6358878 - DNA, 20 bp, Homo sapiens
gtcctgcttgaactgctgcc

SEQ ID NO: 6358879 - DNA, 14 bp, Homo sapiens
gtcctgctttctcc

SEQ ID NO: 6358880 - DNA, 21 bp, Homo sapiens
gtcctggaagcgcgagggcct

SEQ ID NO: 6358881 - DNA, 19 bp, Homo sapiens
gtcctggaatgaagcatgt

SEQ ID NO: 6358882 - DNA, 20 bp, Homo sapiens
gtcctggaatgaagcatgta

SEQ ID NO: 6358883 - DNA, 21 bp, Homo sapiens
gtcctggacacctcccagggg

SEQ ID NO: 6358884 - DNA, 17 bp, Homo sapiens
gtcctggagcaatcaca

SEQ ID NO: 6358885 - DNA, 19 bp, Homo sapiens
gtcctggagcagaccaccc

SEQ ID NO: 6358886 - DNA, 20 bp, Homo sapiens
gtcctggaggggctggggac

SEQ ID NO: 6358887 - DNA, 17 bp, Homo sapiens
gtcctggatgttgtgtg

SEQ ID NO: 6358888 - DNA, 17 bp, Homo sapiens
gtcctggattcactggc

SEQ ID NO: 6358889 - DNA, 18 bp, Homo sapiens
gtcctggcacagaagagg

SEQ ID NO: 6358890 - DNA, 13 bp, Homo sapiens
gtcctggcagctg

SEQ ID NO: 6358891 - DNA, 22 bp, Homo sapiens
gtcctggcagctggaccatctc

SEQ ID NO: 6358892 - DNA, 14 bp, Homo sapiens
gtcctggcagggcg

SEQ ID NO: 6358893 - DNA, 21 bp, Homo sapiens
gtcctggccagatggcccgga

SEQ ID NO: 6358894 - DNA, 16 bp, Homo sapiens
gtcctggccatcccac

SEQ ID NO: 6358895 - DNA, 11 bp, Homo sapiens
gtcctggccct

SEQ ID NO: 6358896 - DNA, 23 bp, Homo sapiens
gtcctggcccttcagtctgctcc

SEQ ID NO: 6358897 - DNA, 17 bp, Homo sapiens
gtcctggcctggcttct

SEQ ID NO: 6358898 - DNA, 15 bp, Homo sapiens
gtcctggctacatcc

SEQ ID NO: 6358899 - DNA, 17 bp, Homo sapiens
gtcctggctacatccca

SEQ ID NO: 6358900 - DNA, 22 bp, Homo sapiens
gtcctggctacatcccagcctg

SEQ ID NO: 6358901 - DNA, 11 bp, Homo sapiens
gtcctggctcc

SEQ ID NO: 6358902 - DNA, 17 bp, Homo sapiens
gtcctggctcctgaggg

SEQ ID NO: 6358903 - DNA, 14 bp, Homo sapiens
gtcctggctgcact

SEQ ID NO: 6358904 - DNA, 16 bp, Homo sapiens
gtcctggctgcactct

SEQ ID NO: 6358905 - DNA, 13 bp, Homo sapiens
gtcctggctgctc

SEQ ID NO: 6358906 - DNA, 23 bp, Homo sapiens
gtcctggctggccgcatgaccac

SEQ ID NO: 6358907 - DNA, 14 bp, Homo sapiens
gtcctggctgtgca

SEQ ID NO: 6358908 - DNA, 15 bp, Homo sapiens
gtcctggcttcaggc

SEQ ID NO: 6358909 - DNA, 15 bp, Homo sapiens
gtcctgggagaggac

SEQ ID NO: 6358910 - DNA, 19 bp, Homo sapiens
gtcctgggagaggacaggg

SEQ ID NO: 6358911 - DNA, 22 bp, Homo sapiens
gtcctgggagaggacagggact

SEQ ID NO: 6358912 - DNA, 15 bp, Homo sapiens
gtcctgggaggagag

SEQ ID NO: 6358913 - DNA, 14 bp, Homo sapiens
gtcctgggaggctg

SEQ ID NO: 6358914 - DNA, 20 bp, Homo sapiens
gtcctgggaggctgcagcca

SEQ ID NO: 6358915 - DNA, 15 bp, Homo sapiens
gtcctgggagtgagc

SEQ ID NO: 6358916 - DNA, 21 bp, Homo sapiens
gtcctgggcaggtgggagctg

SEQ ID NO: 6358917 - DNA, 19 bp, Homo sapiens
gtcctgggcatgggtccag

SEQ ID NO: 6358918 - DNA, 20 bp, Homo sapiens
gtcctgggcatgggtccagg

SEQ ID NO: 6358919 - DNA, 10 bp, Homo sapiens
gtcctgggcc

SEQ ID NO: 6358920 - DNA, 19 bp, Homo sapiens
gtcctgggccccctgggag

SEQ ID NO: 6358921 - DNA, 14 bp, Homo sapiens
gtcctgggcctgca

SEQ ID NO: 6358922 - DNA, 16 bp, Homo sapiens
gtcctgggcgccctgg

SEQ ID NO: 6358923 - DNA, 17 bp, Homo sapiens
gtcctgggcgccctgga

SEQ ID NO: 6358924 - DNA, 19 bp, Homo sapiens
gtcctgggcgccctggaag

SEQ ID NO: 6358925 - DNA, 21 bp, Homo sapiens
gtcctgggcgtgacccgtcca

SEQ ID NO: 6358926 - DNA, 15 bp, Homo sapiens
gtcctgggctggggc

SEQ ID NO: 6358927 - DNA, 14 bp, Homo sapiens
gtcctggggaggct

SEQ ID NO: 6358928 - DNA, 20 bp, Homo sapiens
gtcctggggaggctgagact

SEQ ID NO: 6358929 - DNA, 21 bp, Homo sapiens
gtcctggggaggctgagactg

SEQ ID NO: 6358930 - DNA, 14 bp, Homo sapiens
gtcctggggcctcg

SEQ ID NO: 6358931 - DNA, 16 bp, Homo sapiens
gtcctggggctctgtg

SEQ ID NO: 6358932 - DNA, 20 bp, Homo sapiens
gtcctgggggatgcaaataa

SEQ ID NO: 6358933 - DNA, 11 bp, Homo sapiens
gtcctgggggc

SEQ ID NO: 6358934 - DNA, 15 bp, Homo sapiens
gtcctgggggcctga

SEQ ID NO: 6358935 - DNA, 17 bp, Homo sapiens
gtcctgggggcctgacc

SEQ ID NO: 6358936 - DNA, 18 bp, Homo sapiens
gtcctgggggctgctgca

SEQ ID NO: 6358937 - DNA, 17 bp, Homo sapiens
gtcctgggtgctgtcat

SEQ ID NO: 6358938 - DNA, 20 bp, Homo sapiens
gtcctgggttgtttccagga

SEQ ID NO: 6358939 - DNA, 22 bp, Homo sapiens
gtcctgggttgtttccaggaga

SEQ ID NO: 6358940 - DNA, 19 bp, Homo sapiens
gtcctggtaattcctctcc

SEQ ID NO: 6358941 - DNA, 22 bp, Homo sapiens
gtcctggtaattcctctccagg

SEQ ID NO: 6358942 - DNA, 21 bp, Homo sapiens
gtcctggtacagcagggtctt

SEQ ID NO: 6358943 - DNA, 18 bp, Homo sapiens
gtcctggtcagttttcac

SEQ ID NO: 6358944 - DNA, 24 bp, Homo sapiens
gtcctggtcagttttcacagaggc

SEQ ID NO: 6358945 - DNA, 17 bp, Homo sapiens
gtcctggtcctgatgcc

SEQ ID NO: 6358946 - DNA, 12 bp, Homo sapiens
gtcctggtgccc

SEQ ID NO: 6358947 - DNA, 23 bp, Homo sapiens
gtcctggtgccctggatgcccag

SEQ ID NO: 6358948 - DNA, 15 bp, Homo sapiens
gtcctggtgctctct

SEQ ID NO: 6358949 - DNA, 19 bp, Homo sapiens
gtcctggtgctctctgcca

SEQ ID NO: 6358950 - DNA, 22 bp, Homo sapiens
gtcctggtgctgccgagggctg

SEQ ID NO: 6358951 - DNA, 15 bp, Homo sapiens
gtcctggtggctggg

SEQ ID NO: 6358952 - DNA, 20 bp, Homo sapiens
gtcctggtgggtcagcccag

SEQ ID NO: 6358953 - DNA, 22 bp, Homo sapiens
gtcctggtgggtcagcccagca

SEQ ID NO: 6358954 - DNA, 13 bp, Homo sapiens
gtcctggtgtcac

SEQ ID NO: 6358955 - DNA, 16 bp, Homo sapiens
gtcctggtgtcactta

SEQ ID NO: 6358956 - DNA, 17 bp, Homo sapiens
gtcctggttgtctgaac

SEQ ID NO: 6358957 - DNA, 20 bp, Homo sapiens
gtcctggttgtctgaaccca

SEQ ID NO: 6358958 - DNA, 21 bp, Homo sapiens
gtcctggttgtctgaacccag

SEQ ID NO: 6358959 - DNA, 23 bp, Homo sapiens
gtcctggttgtctgaacccaggc

SEQ ID NO: 6358960 - DNA, 18 bp, Homo sapiens
gtcctggtttcctcagcc

SEQ ID NO: 6358961 - DNA, 19 bp, Homo sapiens
gtcctggtttcctcagcct

SEQ ID NO: 6358962 - DNA, 16 bp, Homo sapiens
gtcctggtttcctggc

SEQ ID NO: 6358963 - DNA, 17 bp, Homo sapiens
gtcctgtaagaagcggc

SEQ ID NO: 6358964 - DNA, 18 bp, Homo sapiens
gtcctgtaagaagcggca

SEQ ID NO: 6358965 - DNA, 13 bp, Homo sapiens
gtcctgtactgta

SEQ ID NO: 6358966 - DNA, 16 bp, Homo sapiens
gtcctgtagagagaga

SEQ ID NO: 6358967 - DNA, 19 bp, Homo sapiens
gtcctgtagcacgctgcct

SEQ ID NO: 6358968 - DNA, 20 bp, Homo sapiens
gtcctgtagttttattttat

SEQ ID NO: 6358969 - DNA, 22 bp, Homo sapiens
gtcctgtagttttattttatgt

SEQ ID NO: 6358970 - DNA, 15 bp, Homo sapiens
gtcctgtatgtctgt

SEQ ID NO: 6358971 - DNA, 18 bp, Homo sapiens
gtcctgtatgtctgtcat

SEQ ID NO: 6358972 - DNA, 17 bp, Homo sapiens
gtcctgtcaccctggcc

SEQ ID NO: 6358973 - DNA, 22 bp, Homo sapiens
gtcctgtcaccctggccccaac

SEQ ID NO: 6358974 - DNA, 16 bp, Homo sapiens
gtcctgtcagtgccgc

SEQ ID NO: 6358975 - DNA, 16 bp, Homo sapiens
gtcctgtcatcatcat

SEQ ID NO: 6358976 - DNA, 22 bp, Homo sapiens
gtcctgtccacacccagctcag

SEQ ID NO: 6358977 - DNA, 13 bp, Homo sapiens
gtcctgtcccaga

SEQ ID NO: 6358978 - DNA, 16 bp, Homo sapiens
gtcctgtcccagaggt

SEQ ID NO: 6358979 - DNA, 17 bp, Homo sapiens
gtcctgtctcccctctg

SEQ ID NO: 6358980 - DNA, 18 bp, Homo sapiens
gtcctgtctcccctctgc

SEQ ID NO: 6358981 - DNA, 18 bp, Homo sapiens
gtcctgtctctgcacaga

SEQ ID NO: 6358982 - DNA, 16 bp, Homo sapiens
gtcctgtctctgcctg

SEQ ID NO: 6358983 - DNA, 16 bp, Homo sapiens
gtcctgtctgctgggc

SEQ ID NO: 6358984 - DNA, 17 bp, Homo sapiens
gtcctgtctgctgggct

SEQ ID NO: 6358985 - DNA, 12 bp, Homo sapiens
gtcctgtgaatg

SEQ ID NO: 6358986 - DNA, 18 bp, Homo sapiens
gtcctgtgaatgccactg

SEQ ID NO: 6358987 - DNA, 19 bp, Homo sapiens
gtcctgtgaatgccactgc

SEQ ID NO: 6358988 - DNA, 17 bp, Homo sapiens
gtcctgtgacaacactc

SEQ ID NO: 6358989 - DNA, 20 bp, Homo sapiens
gtcctgtgaggtttcccaat

SEQ ID NO: 6358990 - DNA, 20 bp, Homo sapiens
gtcctgtgatcttatttttc

SEQ ID NO: 6358991 - DNA, 14 bp, Homo sapiens
gtcctgtgctttct

SEQ ID NO: 6358992 - DNA, 15 bp, Homo sapiens
gtcctgtggcaggca

SEQ ID NO: 6358993 - DNA, 16 bp, Homo sapiens
gtcctgtggcaggcag

SEQ ID NO: 6358994 - DNA, 21 bp, Homo sapiens
gtcctgtggcaggcagcgcca

SEQ ID NO: 6358995 - DNA, 17 bp, Homo sapiens
gtcctgtgtcagtttat

SEQ ID NO: 6358996 - DNA, 18 bp, Homo sapiens
gtcctgtgttaaacacta

SEQ ID NO: 6358997 - DNA, 22 bp, Homo sapiens
gtcctgttaggccaactgcctc

SEQ ID NO: 6358998 - DNA, 19 bp, Homo sapiens
gtcctgttatgtcattgtg

SEQ ID NO: 6358999 - DNA, 16 bp, Homo sapiens
gtcctgttccctaccc

SEQ ID NO: 6359000 - DNA, 20 bp, Homo sapiens
gtcctgttgaagacttcctc

SEQ ID NO: 6359001 - DNA, 15 bp, Homo sapiens
gtcctgttttctaaa

SEQ ID NO: 6359002 - DNA, 17 bp, Homo sapiens
gtcctgttttcttaggc

SEQ ID NO: 6359003 - DNA, 13 bp, Homo sapiens
gtccttaaaatgt

SEQ ID NO: 6359004 - DNA, 23 bp, Homo sapiens
gtccttaaacagggcatctccag

SEQ ID NO: 6359005 - DNA, 22 bp, Homo sapiens
gtccttaatgaagagccagccc

SEQ ID NO: 6359006 - DNA, 20 bp, Homo sapiens
gtccttaatgatccgttcca

SEQ ID NO: 6359007 - DNA, 15 bp, Homo sapiens
gtccttaccagcaga

SEQ ID NO: 6359008 - DNA, 13 bp, Homo sapiens
taatagcttttta

SEQ ID NO: 6359009 - DNA, 20 bp, Homo sapiens
taataggaaagatttaatgt

SEQ ID NO: 6359010 - DNA, 16 bp, Homo sapiens
taataggaacaatctt

SEQ ID NO: 6359011 - DNA, 23 bp, Homo sapiens
taataggaacaatctttgctgta

SEQ ID NO: 6359012 - DNA, 20 bp, Homo sapiens
taataggaatcaccctccta

SEQ ID NO: 6359013 - DNA, 18 bp, Homo sapiens
taataggctctgcctgac

SEQ ID NO: 6359014 - DNA, 20 bp, Homo sapiens
taatagggcaattaattcct

SEQ ID NO: 6359015 - DNA, 22 bp, Homo sapiens
taataggtagcctgctgtgggg

SEQ ID NO: 6359016 - DNA, 19 bp, Homo sapiens
taataggtagtttggatat

SEQ ID NO: 6359017 - DNA, 18 bp, Homo sapiens
taataggtcatatgttgt

SEQ ID NO: 6359018 - DNA, 20 bp, Homo sapiens
taataggtgggggaaaatga

SEQ ID NO: 6359019 - DNA, 17 bp, Homo sapiens
taatagtaatttgtaaa

SEQ ID NO: 6359020 - DNA, 15 bp, Homo sapiens
taatagtagttagct

SEQ ID NO: 6359021 - DNA, 14 bp, Homo sapiens
taatagtataaacc

SEQ ID NO: 6359022 - DNA, 22 bp, Homo sapiens
taatagtatccagcacagattt

SEQ ID NO: 6359023 - DNA, 14 bp, Homo sapiens
taatagtccatgga

SEQ ID NO: 6359024 - DNA, 20 bp, Homo sapiens
taatagtgttaatcaattta

SEQ ID NO: 6359025 - DNA, 15 bp, Homo sapiens
taatagttagccctc

SEQ ID NO: 6359026 - DNA, 17 bp, Homo sapiens
taatagttcaggatttg

SEQ ID NO: 6359027 - DNA, 17 bp, Homo sapiens
taatagtttgtctattt

SEQ ID NO: 6359028 - DNA, 18 bp, Homo sapiens
taatagtttgtctatttt

SEQ ID NO: 6359029 - DNA, 19 bp, Homo sapiens
taatagtttgtctatttta

SEQ ID NO: 6359030 - DNA, 20 bp, Homo sapiens
taatagtttgtctattttaa

SEQ ID NO: 6359031 - DNA, 15 bp, Homo sapiens
taatataaaaacatt

SEQ ID NO: 6359032 - DNA, 14 bp, Homo sapiens
taatataaaagata

SEQ ID NO: 6359033 - DNA, 16 bp, Homo sapiens
taatataaaagatctt

SEQ ID NO: 6359034 - DNA, 15 bp, Homo sapiens
taatataaagtttta

SEQ ID NO: 6359035 - DNA, 15 bp, Homo sapiens
taatataaatcgtaa

SEQ ID NO: 6359036 - DNA, 13 bp, Homo sapiens
taatataaattca

SEQ ID NO: 6359037 - DNA, 13 bp, Homo sapiens
taatataaattta

SEQ ID NO: 6359038 - DNA, 14 bp, Homo sapiens
taatataagaatca

SEQ ID NO: 6359039 - DNA, 15 bp, Homo sapiens
taatataagaatcat

SEQ ID NO: 6359040 - DNA, 23 bp, Homo sapiens
taatataagtgaacaactggaaa

SEQ ID NO: 6359041 - DNA, 14 bp, Homo sapiens
taatataatgaatt

SEQ ID NO: 6359042 - DNA, 19 bp, Homo sapiens
taatataatggaagagaaa

SEQ ID NO: 6359043 - DNA, 15 bp, Homo sapiens
taatatacaatctat

SEQ ID NO: 6359044 - DNA, 16 bp, Homo sapiens
taatatacctggttta

SEQ ID NO: 6359045 - DNA, 21 bp, Homo sapiens
taatatactcagggattcctt

SEQ ID NO: 6359046 - DNA, 15 bp, Homo sapiens
taatatacttgtgga

SEQ ID NO: 6359047 - DNA, 13 bp, Homo sapiens
taatatagaaaga

SEQ ID NO: 6359048 - DNA, 16 bp, Homo sapiens
taatatagctgagact

SEQ ID NO: 6359049 - DNA, 14 bp, Homo sapiens
taatatagggtttg

SEQ ID NO: 6359050 - DNA, 21 bp, Homo sapiens
taatatagtaggggttgaaga

SEQ ID NO: 6359051 - DNA, 23 bp, Homo sapiens
taatatagtaggggttgaagaaa

SEQ ID NO: 6359052 - DNA, 15 bp, Homo sapiens
taatatataaacaat

SEQ ID NO: 6359053 - DNA, 15 bp, Homo sapiens
taatatataatttaa

SEQ ID NO: 6359054 - DNA, 21 bp, Homo sapiens
taatatataatttaatgtaaa

SEQ ID NO: 6359055 - DNA, 22 bp, Homo sapiens
taatatataatttaatgtaaat

SEQ ID NO: 6359056 - DNA, 14 bp, Homo sapiens
taatatatatatat

SEQ ID NO: 6359057 - DNA, 20 bp, Homo sapiens
taatatatatatatatcagt

SEQ ID NO: 6359058 - DNA, 14 bp, Homo sapiens
taatatatatattt

SEQ ID NO: 6359059 - DNA, 13 bp, Homo sapiens
taatatatatcta

SEQ ID NO: 6359060 - DNA, 17 bp, Homo sapiens
taatatatatctgctgt

SEQ ID NO: 6359061 - DNA, 13 bp, Homo sapiens
taatatatcctgt

SEQ ID NO: 6359062 - DNA, 21 bp, Homo sapiens
taatatatctgtaacactatt

SEQ ID NO: 6359063 - DNA, 16 bp, Homo sapiens
taatatattaggcact

SEQ ID NO: 6359064 - DNA, 14 bp, Homo sapiens
taatatattgctgc

SEQ ID NO: 6359065 - DNA, 15 bp, Homo sapiens
taatatattgtacaa

SEQ ID NO: 6359066 - DNA, 23 bp, Homo sapiens
taatatattgtgttttaacacca

SEQ ID NO: 6359067 - DNA, 17 bp, Homo sapiens
taatatatttaaaaata

SEQ ID NO: 6359068 - DNA, 15 bp, Homo sapiens
taatatatttatata

SEQ ID NO: 6359069 - DNA, 17 bp, Homo sapiens
taatatatttatatact

SEQ ID NO: 6359070 - DNA, 14 bp, Homo sapiens
taatatatttccat

SEQ ID NO: 6359071 - DNA, 21 bp, Homo sapiens
taatatattttctgttttctt

SEQ ID NO: 6359072 - DNA, 22 bp, Homo sapiens
taatatatttttatatttagtt

SEQ ID NO: 6359073 - DNA, 15 bp, Homo sapiens
taatatcaaaagaaa

SEQ ID NO: 6359074 - DNA, 14 bp, Homo sapiens
taatatcaaataaa

SEQ ID NO: 6359075 - DNA, 18 bp, Homo sapiens
taatatcaactctgaagc

SEQ ID NO: 6359076 - DNA, 16 bp, Homo sapiens
taatatcactcattaa

SEQ ID NO: 6359077 - DNA, 18 bp, Homo sapiens
taatatcactcattaatt

SEQ ID NO: 6359078 - DNA, 21 bp, Homo sapiens
taatatcactcattaattaac

SEQ ID NO: 6359079 - DNA, 14 bp, Homo sapiens
taatatcattcact

SEQ ID NO: 6359080 - DNA, 14 bp, Homo sapiens
taatatcattttat

SEQ ID NO: 6359081 - DNA, 18 bp, Homo sapiens
taatatcattttattcac

SEQ ID NO: 6359082 - DNA, 22 bp, Homo sapiens
taatatccaacacaactatcaa

SEQ ID NO: 6359083 - DNA, 22 bp, Homo sapiens
taatatccaggtcaacagaatg

SEQ ID NO: 6359084 - DNA, 17 bp, Homo sapiens
taatatccctacatgta

SEQ ID NO: 6359085 - DNA, 18 bp, Homo sapiens
taatatccctacatgtat

SEQ ID NO: 6359086 - DNA, 21 bp, Homo sapiens
taatatccctggagttcctca

SEQ ID NO: 6359087 - DNA, 17 bp, Homo sapiens
taatatcctaaacatca

SEQ ID NO: 6359088 - DNA, 16 bp, Homo sapiens
taatatcctgaataac

SEQ ID NO: 6359089 - DNA, 16 bp, Homo sapiens
taatatctaaagttat

SEQ ID NO: 6359090 - DNA, 16 bp, Homo sapiens
taatatctgactgaaa

SEQ ID NO: 6359091 - DNA, 19 bp, Homo sapiens
taatatctgagaagtgtat

SEQ ID NO: 6359092 - DNA, 21 bp, Homo sapiens
taatatctgagaagtgtatat

SEQ ID NO: 6359093 - DNA, 18 bp, Homo sapiens
taatatctggcactgtta

SEQ ID NO: 6359094 - DNA, 16 bp, Homo sapiens
taatatcttcatttct

SEQ ID NO: 6359095 - DNA, 16 bp, Homo sapiens
taatatcttgaagaat

SEQ ID NO: 6359096 - DNA, 18 bp, Homo sapiens
taatatcttgaagaatat

SEQ ID NO: 6359097 - DNA, 12 bp, Homo sapiens
taatatctttaa

SEQ ID NO: 6359098 - DNA, 14 bp, Homo sapiens
taatatctttcagt

SEQ ID NO: 6359099 - DNA, 22 bp, Homo sapiens
taatatctttctgcacacaaat

SEQ ID NO: 6359100 - DNA, 14 bp, Homo sapiens
taatatctttgtga

SEQ ID NO: 6359101 - DNA, 20 bp, Homo sapiens
taatatctttgtgataattt

SEQ ID NO: 6359102 - DNA, 16 bp, Homo sapiens
taatatgaaaacttat

SEQ ID NO: 6359103 - DNA, 16 bp, Homo sapiens
taatatgaagcctttg

SEQ ID NO: 6359104 - DNA, 13 bp, Homo sapiens
taatatgaagtat

SEQ ID NO: 6359105 - DNA, 19 bp, Homo sapiens
taatatgaatatatacata

SEQ ID NO: 6359106 - DNA, 24 bp, Homo sapiens
taatatgacaaacatcattgttta

SEQ ID NO: 6359107 - DNA, 13 bp, Homo sapiens
taatatgacagat

SEQ ID NO: 6359108 - DNA, 12 bp, Homo sapiens
taatatgagaat

SEQ ID NO: 6359109 - DNA, 18 bp, Homo sapiens
taatatgagaatgtatta

SEQ ID NO: 6359110 - DNA, 14 bp, Homo sapiens
taatatgagcttca

SEQ ID NO: 6359111 - DNA, 22 bp, Homo sapiens
taatatgagcttcaatataaga

SEQ ID NO: 6359112 - DNA, 15 bp, Homo sapiens
taatatgatgactgt

SEQ ID NO: 6359113 - DNA, 14 bp, Homo sapiens
taatatgatgcaaa

SEQ ID NO: 6359114 - DNA, 19 bp, Homo sapiens
taatatgcatatatatgta

SEQ ID NO: 6359115 - DNA, 13 bp, Homo sapiens
taatatgctctca

SEQ ID NO: 6359116 - DNA, 16 bp, Homo sapiens
taatatgctgccaaat

SEQ ID NO: 6359117 - DNA, 18 bp, Homo sapiens
taatatgcttaaaataag

SEQ ID NO: 6359118 - DNA, 22 bp, Homo sapiens
taatatggaaccttccctccaa

SEQ ID NO: 6359119 - DNA, 17 bp, Homo sapiens
taatatggatcagagca

SEQ ID NO: 6359120 - DNA, 21 bp, Homo sapiens
taatatggatcagagcattta

SEQ ID NO: 6359121 - DNA, 18 bp, Homo sapiens
taatatggcaaaaatggc

SEQ ID NO: 6359122 - DNA, 22 bp, Homo sapiens
taatatggccacagtagtcttg

SEQ ID NO: 6359123 - DNA, 21 bp, Homo sapiens
taatatggctatgcttaaaag

SEQ ID NO: 6359124 - DNA, 15 bp, Homo sapiens
taatatgggcattgt

SEQ ID NO: 6359125 - DNA, 19 bp, Homo sapiens
taatatgggcattgtagtt

SEQ ID NO: 6359126 - DNA, 17 bp, Homo sapiens
taatatgggttcttttt

SEQ ID NO: 6359127 - DNA, 14 bp, Homo sapiens
taatatggtgactt

SEQ ID NO: 6359128 - DNA, 24 bp, Homo sapiens
taatatggttttgttttcaatgaa

SEQ ID NO: 6359129 - DNA, 12 bp, Homo sapiens
taatatgtacaa

SEQ ID NO: 6359130 - DNA, 13 bp, Homo sapiens
taatatgtacaaa

SEQ ID NO: 6359131 - DNA, 18 bp, Homo sapiens
taatatgtacaaataata

SEQ ID NO: 6359132 - DNA, 14 bp, Homo sapiens
taatatgtactttt

SEQ ID NO: 6359133 - DNA, 15 bp, Homo sapiens
taatatgtattttat

SEQ ID NO: 6359134 - DNA, 14 bp, Homo sapiens
taatatgtctgcca

SEQ ID NO: 6359135 - DNA, 15 bp, Homo sapiens
taatatgtgccttaa

SEQ ID NO: 6359136 - DNA, 20 bp, Homo sapiens
taatatgttaacctcagtgt

SEQ ID NO: 6359137 - DNA, 20 bp, Homo sapiens
taatatgtttaatgttcatt

SEQ ID NO: 6359138 - DNA, 12 bp, Homo sapiens
taatatgtttag

SEQ ID NO: 6359139 - DNA, 14 bp, Homo sapiens
taatattaaaaaga

SEQ ID NO: 6359140 - DNA, 18 bp, Homo sapiens
taatattaaaaatatgga

SEQ ID NO: 6359141 - DNA, 22 bp, Homo sapiens
taatattaaaaatatggaactt

SEQ ID NO: 6359142 - DNA, 13 bp, Homo sapiens
taatattaaagcc

SEQ ID NO: 6359143 - DNA, 21 bp, Homo sapiens
taatattaaagccatgtttat

SEQ ID NO: 6359144 - DNA, 12 bp, Homo sapiens
taatattaaatt

SEQ ID NO: 6359145 - DNA, 23 bp, Homo sapiens
taatattaactaaataaacagat

SEQ ID NO: 6359146 - DNA, 19 bp, Homo sapiens
taatattaactacagaaaa

SEQ ID NO: 6359147 - DNA, 17 bp, Homo sapiens
taatattaacttttaat

SEQ ID NO: 6359148 - DNA, 19 bp, Homo sapiens
taatattaatttatttaat

SEQ ID NO: 6359149 - DNA, 22 bp, Homo sapiens
taatattaattttctacaaata

SEQ ID NO: 6359150 - DNA, 17 bp, Homo sapiens
taatattacatttcatt

SEQ ID NO: 6359151 - DNA, 20 bp, Homo sapiens
taatattacatttcatttat

SEQ ID NO: 6359152 - DNA, 16 bp, Homo sapiens
taatattagcttgctt

SEQ ID NO: 6359153 - DNA, 12 bp, Homo sapiens
taatattatata

SEQ ID NO: 6359154 - DNA, 11 bp, Homo sapiens
taatattatta

SEQ ID NO: 6359155 - DNA, 13 bp, Homo sapiens
taatattattggg

SEQ ID NO: 6359156 - DNA, 14 bp, Homo sapiens
taatattattgggg

SEQ ID NO: 6359157 - DNA, 17 bp, Homo sapiens
taatattattggggttg

SEQ ID NO: 6359158 - DNA, 20 bp, Homo sapiens
taatattatttatctaaagt

SEQ ID NO: 6359159 - DNA, 13 bp, Homo sapiens
taatattcatgct

SEQ ID NO: 6359160 - DNA, 16 bp, Homo sapiens
taatattcattgtata

SEQ ID NO: 6359161 - DNA, 11 bp, Homo sapiens
taatattccaa

SEQ ID NO: 6359162 - DNA, 19 bp, Homo sapiens
taatattcccattttatta

SEQ ID NO: 6359163 - DNA, 16 bp, Homo sapiens
taatattcctcagttc

SEQ ID NO: 6359164 - DNA, 18 bp, Homo sapiens
taatattcttcaaatgta

SEQ ID NO: 6359165 - DNA, 22 bp, Homo sapiens
taatattcttttgttattaaaa

SEQ ID NO: 6359166 - DNA, 22 bp, Homo sapiens
taatattcttttgtttccatgg

SEQ ID NO: 6359167 - DNA, 16 bp, Homo sapiens
taatattgaaaatgtc

SEQ ID NO: 6359168 - DNA, 22 bp, Homo sapiens
taatattgaaaattgaaaagta

SEQ ID NO: 6359169 - DNA, 16 bp, Homo sapiens
taatattgacttgtat

SEQ ID NO: 6359170 - DNA, 18 bp, Homo sapiens
taatattgacttgtatat

SEQ ID NO: 6359171 - DNA, 14 bp, Homo sapiens
taatattgagaaag

SEQ ID NO: 6359172 - DNA, 13 bp, Homo sapiens
taatattgagaat

SEQ ID NO: 6359173 - DNA, 17 bp, Homo sapiens
taatattgagaatcagg

SEQ ID NO: 6359174 - DNA, 20 bp, Homo sapiens
taatattgatgtcagtattt

SEQ ID NO: 6359175 - DNA, 14 bp, Homo sapiens
taatattgcagttc

SEQ ID NO: 6359176 - DNA, 19 bp, Homo sapiens
taatattgccttgatgttt

SEQ ID NO: 6359177 - DNA, 12 bp, Homo sapiens
taatattgcttc

SEQ ID NO: 6359178 - DNA, 18 bp, Homo sapiens
taatattgcttcttgtgt

SEQ ID NO: 6359179 - DNA, 12 bp, Homo sapiens
taatattgtaaa

SEQ ID NO: 6359180 - DNA, 14 bp, Homo sapiens
taatattgtaaata

SEQ ID NO: 6359181 - DNA, 18 bp, Homo sapiens
taatattgtattgctgct

SEQ ID NO: 6359182 - DNA, 21 bp, Homo sapiens
taatattgtattgctgctgtg

SEQ ID NO: 6359183 - DNA, 21 bp, Homo sapiens
taatattgttgtataatttcg

SEQ ID NO: 6359184 - DNA, 20 bp, Homo sapiens
taatattgtttggtaaatgt

SEQ ID NO: 6359185 - DNA, 13 bp, Homo sapiens
taatatttaaaat

SEQ ID NO: 6359186 - DNA, 21 bp, Homo sapiens
taatatttaaacagcagtgtt

SEQ ID NO: 6359187 - DNA, 19 bp, Homo sapiens
taatatttacaatgtatta

SEQ ID NO: 6359188 - DNA, 14 bp, Homo sapiens
gtccttacctcggg

SEQ ID NO: 6359189 - DNA, 16 bp, Homo sapiens
gtccttactcagagct

SEQ ID NO: 6359190 - DNA, 17 bp, Homo sapiens
gtccttactcagagctg

SEQ ID NO: 6359191 - DNA, 13 bp, Homo sapiens
gtccttactcctg

SEQ ID NO: 6359192 - DNA, 18 bp, Homo sapiens
gtccttactcctgtggga

SEQ ID NO: 6359193 - DNA, 22 bp, Homo sapiens
gtccttactcctgtgggagcct

SEQ ID NO: 6359194 - DNA, 18 bp, Homo sapiens
gtccttagactccttctc

SEQ ID NO: 6359195 - DNA, 14 bp, Homo sapiens
gtccttagcctgga

SEQ ID NO: 6359196 - DNA, 20 bp, Homo sapiens
gtccttagcctggacctctg

SEQ ID NO: 6359197 - DNA, 23 bp, Homo sapiens
gtccttagcctggacctctgaca

SEQ ID NO: 6359198 - DNA, 19 bp, Homo sapiens
gtccttagcctgggcctcc

SEQ ID NO: 6359199 - DNA, 15 bp, Homo sapiens
gtccttaggctactg

SEQ ID NO: 6359200 - DNA, 15 bp, Homo sapiens
gtccttatgtcctgt

SEQ ID NO: 6359201 - DNA, 17 bp, Homo sapiens
gtccttattatcccagc

SEQ ID NO: 6359202 - DNA, 17 bp, Homo sapiens
gtccttattcttctcat

SEQ ID NO: 6359203 - DNA, 23 bp, Homo sapiens
gtccttattcttgtggttaaaaa

SEQ ID NO: 6359204 - DNA, 14 bp, Homo sapiens
gtccttatttattt

SEQ ID NO: 6359205 - DNA, 18 bp, Homo sapiens
gtccttatttatttaact

SEQ ID NO: 6359206 - DNA, 13 bp, Homo sapiens
gtccttcaaaggc

SEQ ID NO: 6359207 - DNA, 22 bp, Homo sapiens
gtccttcaagattccatttctt

SEQ ID NO: 6359208 - DNA, 22 bp, Homo sapiens
gtccttcaattttcttcacact

SEQ ID NO: 6359209 - DNA, 17 bp, Homo sapiens
gtccttcactggcgcct

SEQ ID NO: 6359210 - DNA, 22 bp, Homo sapiens
gtccttcactggcgccttctcg

SEQ ID NO: 6359211 - DNA, 18 bp, Homo sapiens
gtccttccaacctgttca

SEQ ID NO: 6359212 - DNA, 19 bp, Homo sapiens
gtccttccatatccctgcc

SEQ ID NO: 6359213 - DNA, 21 bp, Homo sapiens
gtccttccctctccccaagac

SEQ ID NO: 6359214 - DNA, 11 bp, Homo sapiens
gtccttccctg

SEQ ID NO: 6359215 - DNA, 15 bp, Homo sapiens
gtccttccctgatgg

SEQ ID NO: 6359216 - DNA, 15 bp, Homo sapiens
gtccttccctgccac

SEQ ID NO: 6359217 - DNA, 16 bp, Homo sapiens
gtccttccctgccact

SEQ ID NO: 6359218 - DNA, 17 bp, Homo sapiens
gtccttccctgccactt

SEQ ID NO: 6359219 - DNA, 15 bp, Homo sapiens
gtccttcctgaaact

SEQ ID NO: 6359220 - DNA, 16 bp, Homo sapiens
gtccttctactccagc

SEQ ID NO: 6359221 - DNA, 12 bp, Homo sapiens
gtccttctcctc

SEQ ID NO: 6359222 - DNA, 18 bp, Homo sapiens
gtccttctcgtttgctct

SEQ ID NO: 6359223 - DNA, 18 bp, Homo sapiens
gtccttctctcacctcct

SEQ ID NO: 6359224 - DNA, 14 bp, Homo sapiens
gtccttcttcctca

SEQ ID NO: 6359225 - DNA, 18 bp, Homo sapiens
gtccttgaacccaacagt

SEQ ID NO: 6359226 - DNA, 20 bp, Homo sapiens
gtccttgaactgaggccctg

SEQ ID NO: 6359227 - DNA, 23 bp, Homo sapiens
gtccttgaactgaggccctgtga

SEQ ID NO: 6359228 - DNA, 20 bp, Homo sapiens
gtccttgaagcttgtatctg

SEQ ID NO: 6359229 - DNA, 17 bp, Homo sapiens
gtccttgatgccagagg

SEQ ID NO: 6359230 - DNA, 22 bp, Homo sapiens
gtccttgatgccagagggccag

SEQ ID NO: 6359231 - DNA, 14 bp, Homo sapiens
gtccttgatttcaa

SEQ ID NO: 6359232 - DNA, 16 bp, Homo sapiens
gtccttgcaagaatgg

SEQ ID NO: 6359233 - DNA, 22 bp, Homo sapiens
gtccttgcacactcccctgcac

SEQ ID NO: 6359234 - DNA, 20 bp, Homo sapiens
gtccttgcacctgagcctgt

SEQ ID NO: 6359235 - DNA, 16 bp, Homo sapiens
gtccttgcacctgcat

SEQ ID NO: 6359236 - DNA, 16 bp, Homo sapiens
gtccttgcagacagaa

SEQ ID NO: 6359237 - DNA, 15 bp, Homo sapiens
gtccttgccccactc

SEQ ID NO: 6359238 - DNA, 16 bp, Homo sapiens
gtccttgccccactcc

SEQ ID NO: 6359239 - DNA, 12 bp, Homo sapiens
gtccttgccctt

SEQ ID NO: 6359240 - DNA, 20 bp, Homo sapiens
gtccttgcctcctggaagaa

SEQ ID NO: 6359241 - DNA, 14 bp, Homo sapiens
gtccttgctcctgg

SEQ ID NO: 6359242 - DNA, 22 bp, Homo sapiens
gtccttgctcctggaacctggc

SEQ ID NO: 6359243 - DNA, 14 bp, Homo sapiens
gtccttgctttggg

SEQ ID NO: 6359244 - DNA, 20 bp, Homo sapiens
gtccttggactgttttgaaa

SEQ ID NO: 6359245 - DNA, 15 bp, Homo sapiens
gtccttggcaacttt

SEQ ID NO: 6359246 - DNA, 13 bp, Homo sapiens
gtccttggctgta

SEQ ID NO: 6359247 - DNA, 15 bp, Homo sapiens
gtccttggctgtatc

SEQ ID NO: 6359248 - DNA, 13 bp, Homo sapiens
gtccttgggcctg

SEQ ID NO: 6359249 - DNA, 24 bp, Homo sapiens
gtccttgggcctggccagtcttcc

SEQ ID NO: 6359250 - DNA, 13 bp, Homo sapiens
gtccttgggcgtc

SEQ ID NO: 6359251 - DNA, 22 bp, Homo sapiens
gtccttggggaggggtcagctc

SEQ ID NO: 6359252 - DNA, 13 bp, Homo sapiens
gtccttgggttgc

SEQ ID NO: 6359253 - DNA, 21 bp, Homo sapiens
gtccttgtataaggagctttg

SEQ ID NO: 6359254 - DNA, 20 bp, Homo sapiens
gtccttgttcatggagagct

SEQ ID NO: 6359255 - DNA, 12 bp, Homo sapiens
gtcctttagaaa

SEQ ID NO: 6359256 - DNA, 16 bp, Homo sapiens
gtcctttaggcagcct

SEQ ID NO: 6359257 - DNA, 22 bp, Homo sapiens
gtcctttatgtggaaaacagaa

SEQ ID NO: 6359258 - DNA, 20 bp, Homo sapiens
gtcctttcaattccaccagg

SEQ ID NO: 6359259 - DNA, 15 bp, Homo sapiens
gtcctttcagtctga

SEQ ID NO: 6359260 - DNA, 15 bp, Homo sapiens
gtcctttccagtggc

SEQ ID NO: 6359261 - DNA, 23 bp, Homo sapiens
gtcctttccagtggcctggctcc

SEQ ID NO: 6359262 - DNA, 20 bp, Homo sapiens
gtcctttcccaccattcctg

SEQ ID NO: 6359263 - DNA, 19 bp, Homo sapiens
gtcctttcccctctctgcc

SEQ ID NO: 6359264 - DNA, 13 bp, Homo sapiens
gtcctttccctcc

SEQ ID NO: 6359265 - DNA, 15 bp, Homo sapiens
gtcctttccctccac

SEQ ID NO: 6359266 - DNA, 13 bp, Homo sapiens
gtcctttccctgg

SEQ ID NO: 6359267 - DNA, 21 bp, Homo sapiens
gtcctttcctctcctctctgg

SEQ ID NO: 6359268 - DNA, 16 bp, Homo sapiens
gtcctttctccaggcc

SEQ ID NO: 6359269 - DNA, 20 bp, Homo sapiens
gtcctttctgatcctctctt

SEQ ID NO: 6359270 - DNA, 19 bp, Homo sapiens
gtcctttctgccttggcct

SEQ ID NO: 6359271 - DNA, 15 bp, Homo sapiens
gtcctttgagaaaga

SEQ ID NO: 6359272 - DNA, 18 bp, Homo sapiens
gtcctttgagaaagaaat

SEQ ID NO: 6359273 - DNA, 16 bp, Homo sapiens
gtcctttgaggcccca

SEQ ID NO: 6359274 - DNA, 12 bp, Homo sapiens
gtcctttggaca

SEQ ID NO: 6359275 - DNA, 14 bp, Homo sapiens
gtcctttggcaggc

SEQ ID NO: 6359276 - DNA, 16 bp, Homo sapiens
gtcctttgtctttctt

SEQ ID NO: 6359277 - DNA, 15 bp, Homo sapiens
gtcctttgttgctgt

SEQ ID NO: 6359278 - DNA, 16 bp, Homo sapiens
gtcctttgttggcttc

SEQ ID NO: 6359279 - DNA, 17 bp, Homo sapiens
gtccttttaaagttgga

SEQ ID NO: 6359280 - DNA, 19 bp, Homo sapiens
gtccttttactacagctat

SEQ ID NO: 6359281 - DNA, 15 bp, Homo sapiens
gtccttttcagaagt

SEQ ID NO: 6359282 - DNA, 21 bp, Homo sapiens
gtccttttcataggtctgaaa

SEQ ID NO: 6359283 - DNA, 22 bp, Homo sapiens
gtccttttcataggtctgaaat

SEQ ID NO: 6359284 - DNA, 20 bp, Homo sapiens
gtccttttcccctacagaat

SEQ ID NO: 6359285 - DNA, 16 bp, Homo sapiens
gtccttttcttgctta

SEQ ID NO: 6359286 - DNA, 12 bp, Homo sapiens
gtccttttggtt

SEQ ID NO: 6359287 - DNA, 12 bp, Homo sapiens
gtccttttgtaa

SEQ ID NO: 6359288 - DNA, 13 bp, Homo sapiens
gtccttttgtaaa

SEQ ID NO: 6359289 - DNA, 15 bp, Homo sapiens
gtccttttgtgaaat

SEQ ID NO: 6359290 - DNA, 21 bp, Homo sapiens
gtcctttttcactttgaaaag

SEQ ID NO: 6359291 - DNA, 16 bp, Homo sapiens
gtcgaatttttattat

SEQ ID NO: 6359292 - DNA, 13 bp, Homo sapiens
gtcgagctgggaa

SEQ ID NO: 6359293 - DNA, 14 bp, Homo sapiens
gtcgaggacaggga

SEQ ID NO: 6359294 - DNA, 16 bp, Homo sapiens
gtcgaggacagggagg

SEQ ID NO: 6359295 - DNA, 21 bp, Homo sapiens
gtcgaggctggtaagggacct

SEQ ID NO: 6359296 - DNA, 14 bp, Homo sapiens
gtcgaggggctctc

SEQ ID NO: 6359297 - DNA, 16 bp, Homo sapiens
gtcgaggggctctcag

SEQ ID NO: 6359298 - DNA, 15 bp, Homo sapiens
gtcgagtcaaaatgt

SEQ ID NO: 6359299 - DNA, 18 bp, Homo sapiens
gtcgagtgatatggcttg

SEQ ID NO: 6359300 - DNA, 14 bp, Homo sapiens
gtcgatagagctgt

SEQ ID NO: 6359301 - DNA, 22 bp, Homo sapiens
gtcgcaaaggtgaacactcatg

SEQ ID NO: 6359302 - DNA, 23 bp, Homo sapiens
gtcgcacacacatttggaatgca

SEQ ID NO: 6359303 - DNA, 17 bp, Homo sapiens
gtcgcagaccagagctg

SEQ ID NO: 6359304 - DNA, 19 bp, Homo sapiens
gtcgcagaccagagctgtc

SEQ ID NO: 6359305 - DNA, 23 bp, Homo sapiens
gtcgcagctaccctcagcctcca

SEQ ID NO: 6359306 - DNA, 21 bp, Homo sapiens
gtcgcaggatccgctgccacc

SEQ ID NO: 6359307 - DNA, 22 bp, Homo sapiens
gtcgcatcaagatttggcagga

SEQ ID NO: 6359308 - DNA, 16 bp, Homo sapiens
gtcgccaaaaatacag

SEQ ID NO: 6359309 - DNA, 16 bp, Homo sapiens
gtcgccagtgaaatag

SEQ ID NO: 6359310 - DNA, 16 bp, Homo sapiens
gtcgcccacccagctg

SEQ ID NO: 6359311 - DNA, 21 bp, Homo sapiens
gtcgcccacccagctggtcct

SEQ ID NO: 6359312 - DNA, 12 bp, Homo sapiens
gtcgcccaggag

SEQ ID NO: 6359313 - DNA, 13 bp, Homo sapiens
gtcgcccaggaga

SEQ ID NO: 6359314 - DNA, 15 bp, Homo sapiens
gtcgcccaggctgga

SEQ ID NO: 6359315 - DNA, 23 bp, Homo sapiens
gtcgcccagtctggaatgcagtg

SEQ ID NO: 6359316 - DNA, 20 bp, Homo sapiens
gtcgcccatgctggagtgca

SEQ ID NO: 6359317 - DNA, 14 bp, Homo sapiens
gtcgccccaggccc

SEQ ID NO: 6359318 - DNA, 16 bp, Homo sapiens
gtcgccccaggccctc

SEQ ID NO: 6359319 - DNA, 17 bp, Homo sapiens
gtcgccccgtgtttgcg

SEQ ID NO: 6359320 - DNA, 12 bp, Homo sapiens
gtcgcccctcag

SEQ ID NO: 6359321 - DNA, 18 bp, Homo sapiens
gtcgcccctcagagcatg

SEQ ID NO: 6359322 - DNA, 14 bp, Homo sapiens
gtcgcccctcctcg

SEQ ID NO: 6359323 - DNA, 16 bp, Homo sapiens
gtcgcccctcctcggg

SEQ ID NO: 6359324 - DNA, 15 bp, Homo sapiens
gtcgccctcccaggc

SEQ ID NO: 6359325 - DNA, 15 bp, Homo sapiens
gtcgccctctgtgcc

SEQ ID NO: 6359326 - DNA, 18 bp, Homo sapiens
gtcgccctctgtgcctaa

SEQ ID NO: 6359327 - DNA, 23 bp, Homo sapiens
gtcgccctctgtgcctaataaag

SEQ ID NO: 6359328 - DNA, 18 bp, Homo sapiens
gtcgcccttctcccggcc

SEQ ID NO: 6359329 - DNA, 21 bp, Homo sapiens
gtcgcccttctcccggccctc

SEQ ID NO: 6359330 - DNA, 21 bp, Homo sapiens
gtcgccctttgctgcatggca

SEQ ID NO: 6359331 - DNA, 18 bp, Homo sapiens
gtcgccgtccctctgcct

SEQ ID NO: 6359332 - DNA, 20 bp, Homo sapiens
gtcgccttagcatgtttgct

SEQ ID NO: 6359333 - DNA, 21 bp, Homo sapiens
gtcgcctttcagcaggcagcc

SEQ ID NO: 6359334 - DNA, 14 bp, Homo sapiens
gtcgcgatgatggg

SEQ ID NO: 6359335 - DNA, 15 bp, Homo sapiens
gtcgcgatgatgggc

SEQ ID NO: 6359336 - DNA, 17 bp, Homo sapiens
gtcgcgctgcctgtgtg

SEQ ID NO: 6359337 - DNA, 15 bp, Homo sapiens
gtcgctatgtgactt

SEQ ID NO: 6359338 - DNA, 13 bp, Homo sapiens
gtcgctcaggctg

SEQ ID NO: 6359339 - DNA, 14 bp, Homo sapiens
gtcgctcagtctgt

SEQ ID NO: 6359340 - DNA, 17 bp, Homo sapiens
gtcgctcagtctgttca

SEQ ID NO: 6359341 - DNA, 16 bp, Homo sapiens
gtcgctcatgtgtgca

SEQ ID NO: 6359342 - DNA, 21 bp, Homo sapiens
gtcgctcatgtgtgcaacagg

SEQ ID NO: 6359343 - DNA, 15 bp, Homo sapiens
gtcgctcctgcccac

SEQ ID NO: 6359344 - DNA, 18 bp, Homo sapiens
gtcgctctcatgaagccc

SEQ ID NO: 6359345 - DNA, 20 bp, Homo sapiens
gtcgctctcatgaagccctt

SEQ ID NO: 6359346 - DNA, 18 bp, Homo sapiens
gtcgctctgctggcctgg

SEQ ID NO: 6359347 - DNA, 20 bp, Homo sapiens
gtcgctctgctggcctggcc

SEQ ID NO: 6359348 - DNA, 18 bp, Homo sapiens
gtcgctgcagggagcacc

SEQ ID NO: 6359349 - DNA, 13 bp, Homo sapiens
gtcgctgcctcca

SEQ ID NO: 6359350 - DNA, 15 bp, Homo sapiens
gtcgctgggctgtgg

SEQ ID NO: 6359351 - DNA, 18 bp, Homo sapiens
gtcgctgggtcctctgca

SEQ ID NO: 6359352 - DNA, 18 bp, Homo sapiens
gtcgctgtaaattttatg

SEQ ID NO: 6359353 - DNA, 11 bp, Homo sapiens
gtcgctgtccg

SEQ ID NO: 6359354 - DNA, 15 bp, Homo sapiens
gtcgctgtccgtcct

SEQ ID NO: 6359355 - DNA, 17 bp, Homo sapiens
gtcgctgtccgtcctgc

SEQ ID NO: 6359356 - DNA, 16 bp, Homo sapiens
gtcgctgtgccacagg

SEQ ID NO: 6359357 - DNA, 13 bp, Homo sapiens
gtcgcttgccaaa

SEQ ID NO: 6359358 - DNA, 21 bp, Homo sapiens
gtcggaaaacatgctacacac

SEQ ID NO: 6359359 - DNA, 14 bp, Homo sapiens
gtcggaacagcaga

SEQ ID NO: 6359360 - DNA, 14 bp, Homo sapiens
gtcggaagcctgtc

SEQ ID NO: 6359361 - DNA, 17 bp, Homo sapiens
gtcggactgcccccaga

SEQ ID NO: 6359362 - DNA, 22 bp, Homo sapiens
gtcggagcaagtttcatcagcc

SEQ ID NO: 6359363 - DNA, 15 bp, Homo sapiens
gtcggaggaaagaca

SEQ ID NO: 6359364 - DNA, 17 bp, Homo sapiens
gtcggaggcttgggacc

SEQ ID NO: 6359365 - DNA, 15 bp, Homo sapiens
gtcggagtagaaatt

SEQ ID NO: 6359366 - DNA, 19 bp, Homo sapiens
gtcggatctagccatggct

SEQ ID NO: 6359367 - DNA, 17 bp, Homo sapiens
gtcggcacgtcccatgt

SEQ ID NO: 6359368 - DNA, 20 bp, Homo sapiens
taatatttacaatgtattaa

SEQ ID NO: 6359369 - DNA, 16 bp, Homo sapiens
taatatttacataaag

SEQ ID NO: 6359370 - DNA, 15 bp, Homo sapiens
taatatttaccaaag

SEQ ID NO: 6359371 - DNA, 16 bp, Homo sapiens
taatatttaccaaagt

SEQ ID NO: 6359372 - DNA, 13 bp, Homo sapiens
taatatttactgt

SEQ ID NO: 6359373 - DNA, 18 bp, Homo sapiens
taatatttactgttagaa

SEQ ID NO: 6359374 - DNA, 16 bp, Homo sapiens
taatatttagctgtaa

SEQ ID NO: 6359375 - DNA, 15 bp, Homo sapiens
taatatttaggcaag

SEQ ID NO: 6359376 - DNA, 16 bp, Homo sapiens
taatatttaggcaaga

SEQ ID NO: 6359377 - DNA, 13 bp, Homo sapiens
taatatttataga

SEQ ID NO: 6359378 - DNA, 23 bp, Homo sapiens
taatatttatgtctatttaagcc

SEQ ID NO: 6359379 - DNA, 15 bp, Homo sapiens
taatatttatgtgtt

SEQ ID NO: 6359380 - DNA, 18 bp, Homo sapiens
taatatttatgtgtttta

SEQ ID NO: 6359381 - DNA, 15 bp, Homo sapiens
taatatttattgctt

SEQ ID NO: 6359382 - DNA, 17 bp, Homo sapiens
taatatttattgcttta

SEQ ID NO: 6359383 - DNA, 20 bp, Homo sapiens
taatatttattgctttataa

SEQ ID NO: 6359384 - DNA, 23 bp, Homo sapiens
taatatttccaatgtgaaagatt

SEQ ID NO: 6359385 - DNA, 14 bp, Homo sapiens
taatatttctaaaa

SEQ ID NO: 6359386 - DNA, 15 bp, Homo sapiens
taatatttgaacaaa

SEQ ID NO: 6359387 - DNA, 22 bp, Homo sapiens
taatatttgaagcagctctgcc

SEQ ID NO: 6359388 - DNA, 19 bp, Homo sapiens
taatatttgcacatgggat

SEQ ID NO: 6359389 - DNA, 14 bp, Homo sapiens
taatatttgctgac

SEQ ID NO: 6359390 - DNA, 18 bp, Homo sapiens
taatatttgtctgtgtgc

SEQ ID NO: 6359391 - DNA, 19 bp, Homo sapiens
taatatttgtgctttgaaa

SEQ ID NO: 6359392 - DNA, 20 bp, Homo sapiens
taatatttgtgctttgaaaa

SEQ ID NO: 6359393 - DNA, 16 bp, Homo sapiens
taatattttacataca

SEQ ID NO: 6359394 - DNA, 19 bp, Homo sapiens
taatattttagaaaatgtt

SEQ ID NO: 6359395 - DNA, 18 bp, Homo sapiens
taatattttatgtgtaaa

SEQ ID NO: 6359396 - DNA, 19 bp, Homo sapiens
taatattttatttgaaaaa

SEQ ID NO: 6359397 - DNA, 13 bp, Homo sapiens
taatattttgcac

SEQ ID NO: 6359398 - DNA, 15 bp, Homo sapiens
taatattttgtaata

SEQ ID NO: 6359399 - DNA, 18 bp, Homo sapiens
taatattttgtaatattc

SEQ ID NO: 6359400 - DNA, 23 bp, Homo sapiens
taatatttttagctctgttcttt

SEQ ID NO: 6359401 - DNA, 14 bp, Homo sapiens
taatatttttcaaa

SEQ ID NO: 6359402 - DNA, 15 bp, Homo sapiens
taatatttttcaaaa

SEQ ID NO: 6359403 - DNA, 14 bp, Homo sapiens
taatatttttgtca

SEQ ID NO: 6359404 - DNA, 16 bp, Homo sapiens
taatatttttgtcatg

SEQ ID NO: 6359405 - DNA, 13 bp, Homo sapiens
taatcaaaccaaa

SEQ ID NO: 6359406 - DNA, 15 bp, Homo sapiens
taatcaaaccaaaga

SEQ ID NO: 6359407 - DNA, 17 bp, Homo sapiens
taatcaaaccaaagagt

SEQ ID NO: 6359408 - DNA, 17 bp, Homo sapiens
taatcaaatgattcatt

SEQ ID NO: 6359409 - DNA, 16 bp, Homo sapiens
taatcaaatgatttca

SEQ ID NO: 6359410 - DNA, 21 bp, Homo sapiens
taatcaaatgatttcatattg

SEQ ID NO: 6359411 - DNA, 23 bp, Homo sapiens
taatcaacatggctacttgcttt

SEQ ID NO: 6359412 - DNA, 17 bp, Homo sapiens
taatcaactgaaagtgt

SEQ ID NO: 6359413 - DNA, 15 bp, Homo sapiens
taatcaagagaaact

SEQ ID NO: 6359414 - DNA, 18 bp, Homo sapiens
taatcaagagaaacttca

SEQ ID NO: 6359415 - DNA, 14 bp, Homo sapiens
taatcaagagcctt

SEQ ID NO: 6359416 - DNA, 20 bp, Homo sapiens
taatcaagagccttaaaaca

SEQ ID NO: 6359417 - DNA, 23 bp, Homo sapiens
taatcaagagccttaaaacatca

SEQ ID NO: 6359418 - DNA, 19 bp, Homo sapiens
taatcaagagtctctccag

SEQ ID NO: 6359419 - DNA, 11 bp, Homo sapiens
taatcaagatt

SEQ ID NO: 6359420 - DNA, 14 bp, Homo sapiens
taatcaagcctctg

SEQ ID NO: 6359421 - DNA, 21 bp, Homo sapiens
taatcaagtaaggatgtatgt

SEQ ID NO: 6359422 - DNA, 21 bp, Homo sapiens
taatcaagtagaacaaaaact

SEQ ID NO: 6359423 - DNA, 21 bp, Homo sapiens
taatcaagttgtaacttatat

SEQ ID NO: 6359424 - DNA, 16 bp, Homo sapiens
taatcaataaacgatt

SEQ ID NO: 6359425 - DNA, 14 bp, Homo sapiens
taatcaatactttg

SEQ ID NO: 6359426 - DNA, 22 bp, Homo sapiens
taatcaatactttgaacacaaa

SEQ ID NO: 6359427 - DNA, 14 bp, Homo sapiens
taatcaatgtgaca

SEQ ID NO: 6359428 - DNA, 16 bp, Homo sapiens
taatcacaactcagca

SEQ ID NO: 6359429 - DNA, 13 bp, Homo sapiens
taatcaccaaagt

SEQ ID NO: 6359430 - DNA, 14 bp, Homo sapiens
taatcaccaaagta

SEQ ID NO: 6359431 - DNA, 15 bp, Homo sapiens
taatcaccatgtaag

SEQ ID NO: 6359432 - DNA, 20 bp, Homo sapiens
taatcaccatgtaagcactc

SEQ ID NO: 6359433 - DNA, 22 bp, Homo sapiens
taatcacgagtaagattaagag

SEQ ID NO: 6359434 - DNA, 18 bp, Homo sapiens
taatcacgctttcctgaa

SEQ ID NO: 6359435 - DNA, 13 bp, Homo sapiens
taatcactactgt

SEQ ID NO: 6359436 - DNA, 16 bp, Homo sapiens
taatcactcagagcag

SEQ ID NO: 6359437 - DNA, 15 bp, Homo sapiens
taatcactgtgtata

SEQ ID NO: 6359438 - DNA, 16 bp, Homo sapiens
taatcactgtgtatat

SEQ ID NO: 6359439 - DNA, 22 bp, Homo sapiens
taatcactgtgtatatttgatt

SEQ ID NO: 6359440 - DNA, 23 bp, Homo sapiens
taatcagaaaagtaattttgtca

SEQ ID NO: 6359441 - DNA, 20 bp, Homo sapiens
taatcagaaagaaaaaattt

SEQ ID NO: 6359442 - DNA, 15 bp, Homo sapiens
taatcagaaattttt

SEQ ID NO: 6359443 - DNA, 20 bp, Homo sapiens
taatcagaaatttttatcag

SEQ ID NO: 6359444 - DNA, 15 bp, Homo sapiens
taatcagaatatcag

SEQ ID NO: 6359445 - DNA, 15 bp, Homo sapiens
taatcagacaccaga

SEQ ID NO: 6359446 - DNA, 21 bp, Homo sapiens
taatcagacaggtttaaaagt

SEQ ID NO: 6359447 - DNA, 22 bp, Homo sapiens
taatcagattgcttaaaagcat

SEQ ID NO: 6359448 - DNA, 19 bp, Homo sapiens
taatcagcatatgtgtaaa

SEQ ID NO: 6359449 - DNA, 20 bp, Homo sapiens
taatcagccccagagtgctt

SEQ ID NO: 6359450 - DNA, 14 bp, Homo sapiens
taatcagcctctta

SEQ ID NO: 6359451 - DNA, 23 bp, Homo sapiens
taatcagctctcctggctccctc

SEQ ID NO: 6359452 - DNA, 17 bp, Homo sapiens
taatcaggcaaggagga

SEQ ID NO: 6359453 - DNA, 16 bp, Homo sapiens
taatcagggaaactaa

SEQ ID NO: 6359454 - DNA, 23 bp, Homo sapiens
taatcagtgactgaaaccatttt

SEQ ID NO: 6359455 - DNA, 20 bp, Homo sapiens
taatcagtgattatttttcc

SEQ ID NO: 6359456 - DNA, 21 bp, Homo sapiens
taatcagtgattatttttcca

SEQ ID NO: 6359457 - DNA, 17 bp, Homo sapiens
taatcagtggaactcaa

SEQ ID NO: 6359458 - DNA, 22 bp, Homo sapiens
taatcagtggaactcaatatat

SEQ ID NO: 6359459 - DNA, 11 bp, Homo sapiens
taatcagtgtc

SEQ ID NO: 6359460 - DNA, 16 bp, Homo sapiens
taatcagtgtctcaca

SEQ ID NO: 6359461 - DNA, 22 bp, Homo sapiens
taatcatacaaactctcaccat

SEQ ID NO: 6359462 - DNA, 13 bp, Homo sapiens
taatcatataaat

SEQ ID NO: 6359463 - DNA, 17 bp, Homo sapiens
taatcatataaatagaa

SEQ ID NO: 6359464 - DNA, 19 bp, Homo sapiens
taatcatataaatagaatg

SEQ ID NO: 6359465 - DNA, 20 bp, Homo sapiens
taatcatataaatagaatgt

SEQ ID NO: 6359466 - DNA, 20 bp, Homo sapiens
taatcatatgtgtctttata

SEQ ID NO: 6359467 - DNA, 22 bp, Homo sapiens
taatcatatttgaaaaccatat

SEQ ID NO: 6359468 - DNA, 18 bp, Homo sapiens
taatcatcaagtaataca

SEQ ID NO: 6359469 - DNA, 17 bp, Homo sapiens
taatcatccaatgctca

SEQ ID NO: 6359470 - DNA, 19 bp, Homo sapiens
taatcatctgcagttcttt

SEQ ID NO: 6359471 - DNA, 15 bp, Homo sapiens
taatcatcttctctt

SEQ ID NO: 6359472 - DNA, 13 bp, Homo sapiens
taatcatgaaatt

SEQ ID NO: 6359473 - DNA, 18 bp, Homo sapiens
taatcatgaaattactta

SEQ ID NO: 6359474 - DNA, 13 bp, Homo sapiens
taatcatgaatat

SEQ ID NO: 6359475 - DNA, 16 bp, Homo sapiens
taatcatgaatgtgta

SEQ ID NO: 6359476 - DNA, 16 bp, Homo sapiens
taatcatgagcctgtt

SEQ ID NO: 6359477 - DNA, 20 bp, Homo sapiens
taatcatgagcctgtttatt

SEQ ID NO: 6359478 - DNA, 16 bp, Homo sapiens
taatcatgggttcctc

SEQ ID NO: 6359479 - DNA, 15 bp, Homo sapiens
taatcatgtaaatgc

SEQ ID NO: 6359480 - DNA, 18 bp, Homo sapiens
taatcatgtgaaatgttt

SEQ ID NO: 6359481 - DNA, 20 bp, Homo sapiens
taatcatgtgggtgagccag

SEQ ID NO: 6359482 - DNA, 21 bp, Homo sapiens
taatcatgtgggtgagccagt

SEQ ID NO: 6359483 - DNA, 18 bp, Homo sapiens
taatcattatctcacttt

SEQ ID NO: 6359484 - DNA, 13 bp, Homo sapiens
taatcattcattt

SEQ ID NO: 6359485 - DNA, 15 bp, Homo sapiens
taatcattgcctggt

SEQ ID NO: 6359486 - DNA, 14 bp, Homo sapiens
taatcatttatctt

SEQ ID NO: 6359487 - DNA, 15 bp, Homo sapiens
taatcatttccagca

SEQ ID NO: 6359488 - DNA, 22 bp, Homo sapiens
taatcatttccagcaaaatata

SEQ ID NO: 6359489 - DNA, 20 bp, Homo sapiens
taatcatttgatttaaacaa

SEQ ID NO: 6359490 - DNA, 14 bp, Homo sapiens
taatcatttgttta

SEQ ID NO: 6359491 - DNA, 21 bp, Homo sapiens
taatcatttgtttacatttga

SEQ ID NO: 6359492 - DNA, 18 bp, Homo sapiens
taatcattttaaattcca

SEQ ID NO: 6359493 - DNA, 17 bp, Homo sapiens
taatcattttagaatta

SEQ ID NO: 6359494 - DNA, 12 bp, Homo sapiens
taatcattttca

SEQ ID NO: 6359495 - DNA, 12 bp, Homo sapiens
taatcatttttt

SEQ ID NO: 6359496 - DNA, 22 bp, Homo sapiens
taatccaagcaaatgtgaatca

SEQ ID NO: 6359497 - DNA, 20 bp, Homo sapiens
taatccaatccactaacact

SEQ ID NO: 6359498 - DNA, 19 bp, Homo sapiens
taatccaatgggtttttcc

SEQ ID NO: 6359499 - DNA, 17 bp, Homo sapiens
taatccacagtatgtta

SEQ ID NO: 6359500 - DNA, 21 bp, Homo sapiens
taatccacctggtggccctgc

SEQ ID NO: 6359501 - DNA, 18 bp, Homo sapiens
taatccacgctcatcttg

SEQ ID NO: 6359502 - DNA, 17 bp, Homo sapiens
taatccaggcagatcca

SEQ ID NO: 6359503 - DNA, 23 bp, Homo sapiens
taatccaggcagatccaggacta

SEQ ID NO: 6359504 - DNA, 19 bp, Homo sapiens
taatccaggtaactttgaa

SEQ ID NO: 6359505 - DNA, 19 bp, Homo sapiens
taatccagttataagaaga

SEQ ID NO: 6359506 - DNA, 23 bp, Homo sapiens
taatccagttataagaagaagtt

SEQ ID NO: 6359507 - DNA, 20 bp, Homo sapiens
taatccatgtgctgctgtgg

SEQ ID NO: 6359508 - DNA, 17 bp, Homo sapiens
taatccattatccttta

SEQ ID NO: 6359509 - DNA, 12 bp, Homo sapiens
taatccatttca

SEQ ID NO: 6359510 - DNA, 15 bp, Homo sapiens
taatccatttcagga

SEQ ID NO: 6359511 - DNA, 19 bp, Homo sapiens
taatccatttcaggactct

SEQ ID NO: 6359512 - DNA, 16 bp, Homo sapiens
taatcccacccacctc

SEQ ID NO: 6359513 - DNA, 21 bp, Homo sapiens
taatcccagcactttgggagg

SEQ ID NO: 6359514 - DNA, 23 bp, Homo sapiens
taatcccagcactttgggaggcc

SEQ ID NO: 6359515 - DNA, 20 bp, Homo sapiens
taatcccagctactcaggag

SEQ ID NO: 6359516 - DNA, 15 bp, Homo sapiens
taatcccagctactg

SEQ ID NO: 6359517 - DNA, 17 bp, Homo sapiens
taatcccattgcaaaca

SEQ ID NO: 6359518 - DNA, 19 bp, Homo sapiens
taatccccagttcgcctgg

SEQ ID NO: 6359519 - DNA, 17 bp, Homo sapiens
taatccccatcattact

SEQ ID NO: 6359520 - DNA, 19 bp, Homo sapiens
taatcccctaaaataacag

SEQ ID NO: 6359521 - DNA, 14 bp, Homo sapiens
taatccccttctcc

SEQ ID NO: 6359522 - DNA, 15 bp, Homo sapiens
taatccccttctccc

SEQ ID NO: 6359523 - DNA, 21 bp, Homo sapiens
taatccccttctcccctgcac

SEQ ID NO: 6359524 - DNA, 16 bp, Homo sapiens
taatcccgtgcccctt

SEQ ID NO: 6359525 - DNA, 13 bp, Homo sapiens
taatccctccctc

SEQ ID NO: 6359526 - DNA, 13 bp, Homo sapiens
taatccctgcttt

SEQ ID NO: 6359527 - DNA, 14 bp, Homo sapiens
taatccctgggcat

SEQ ID NO: 6359528 - DNA, 19 bp, Homo sapiens
taatccctgggcattgctt

SEQ ID NO: 6359529 - DNA, 14 bp, Homo sapiens
taatccctgtaata

SEQ ID NO: 6359530 - DNA, 13 bp, Homo sapiens
taatccctgtctt

SEQ ID NO: 6359531 - DNA, 21 bp, Homo sapiens
taatccgaatctctttttgct

SEQ ID NO: 6359532 - DNA, 16 bp, Homo sapiens
taatccgccaatatta

SEQ ID NO: 6359533 - DNA, 16 bp, Homo sapiens
taatccgttcatagaa

SEQ ID NO: 6359534 - DNA, 22 bp, Homo sapiens
taatcctagccccgagacacca

SEQ ID NO: 6359535 - DNA, 22 bp, Homo sapiens
taatcctattaaaacacagctt

SEQ ID NO: 6359536 - DNA, 18 bp, Homo sapiens
taatcctcaagagaaaat

SEQ ID NO: 6359537 - DNA, 21 bp, Homo sapiens
taatcctcctgagtagctggg

SEQ ID NO: 6359538 - DNA, 23 bp, Homo sapiens
taatcctgtaccaaatctgacat

SEQ ID NO: 6359539 - DNA, 18 bp, Homo sapiens
taatcctgtaggaaggta

SEQ ID NO: 6359540 - DNA, 23 bp, Homo sapiens
taatcctgtaggaaggtactgta

SEQ ID NO: 6359541 - DNA, 16 bp, Homo sapiens
taatccttaataacta

SEQ ID NO: 6359542 - DNA, 18 bp, Homo sapiens
taatccttaataactatg

SEQ ID NO: 6359543 - DNA, 14 bp, Homo sapiens
taatccttccaggc

SEQ ID NO: 6359544 - DNA, 21 bp, Homo sapiens
taatccttctaactaaactaa

SEQ ID NO: 6359545 - DNA, 21 bp, Homo sapiens
taatccttctagtttcccaca

SEQ ID NO: 6359546 - DNA, 22 bp, Homo sapiens
gtcggcacgtcccatgtgcatg

SEQ ID NO: 6359547 - DNA, 16 bp, Homo sapiens
gtcggcatgccaggac

SEQ ID NO: 6359548 - DNA, 20 bp, Homo sapiens
gtcggccacaccccagactc

SEQ ID NO: 6359549 - DNA, 21 bp, Homo sapiens
gtcggccctgcgtcggccctg

SEQ ID NO: 6359550 - DNA, 16 bp, Homo sapiens
gtcggccgaccaggct

SEQ ID NO: 6359551 - DNA, 18 bp, Homo sapiens
gtcggccgaccaggctgg

SEQ ID NO: 6359552 - DNA, 23 bp, Homo sapiens
gtcggcctctaaccccaggcccc

SEQ ID NO: 6359553 - DNA, 11 bp, Homo sapiens
gtcggctccag

SEQ ID NO: 6359554 - DNA, 11 bp, Homo sapiens
gtcggctcctg

SEQ ID NO: 6359555 - DNA, 14 bp, Homo sapiens
gtcggctcctgatg

SEQ ID NO: 6359556 - DNA, 13 bp, Homo sapiens
gtcggctgggcag

SEQ ID NO: 6359557 - DNA, 23 bp, Homo sapiens
gtcggctgggcagggccgcaggg

SEQ ID NO: 6359558 - DNA, 17 bp, Homo sapiens
gtcggctgtgaggcggg

SEQ ID NO: 6359559 - DNA, 13 bp, Homo sapiens
gtcgggacagctg

SEQ ID NO: 6359560 - DNA, 15 bp, Homo sapiens
gtcgggacagctgtg

SEQ ID NO: 6359561 - DNA, 20 bp, Homo sapiens
gtcgggagaggggacgcagg

SEQ ID NO: 6359562 - DNA, 22 bp, Homo sapiens
gtcgggatatttgggtgcagag

SEQ ID NO: 6359563 - DNA, 22 bp, Homo sapiens
gtcgggcatggtggctcatgcc

SEQ ID NO: 6359564 - DNA, 18 bp, Homo sapiens
gtcgggcccctgcctgcc

SEQ ID NO: 6359565 - DNA, 20 bp, Homo sapiens
gtcgggcccctgcctgcctt

SEQ ID NO: 6359566 - DNA, 22 bp, Homo sapiens
gtcgggcccctgcctgccttct

SEQ ID NO: 6359567 - DNA, 21 bp, Homo sapiens
gtcgggcccgcactcaggagc

SEQ ID NO: 6359568 - DNA, 12 bp, Homo sapiens
gtcgggctcagc

SEQ ID NO: 6359569 - DNA, 17 bp, Homo sapiens
gtcggggcaggccaggg

SEQ ID NO: 6359570 - DNA, 18 bp, Homo sapiens
gtcggggcatctggcctg

SEQ ID NO: 6359571 - DNA, 18 bp, Homo sapiens
gtcgggggaggagcaccc

SEQ ID NO: 6359572 - DNA, 15 bp, Homo sapiens
gtcgggggatgagga

SEQ ID NO: 6359573 - DNA, 16 bp, Homo sapiens
gtcgggggctggccta

SEQ ID NO: 6359574 - DNA, 20 bp, Homo sapiens
gtcggggggcgagggagggg

SEQ ID NO: 6359575 - DNA, 22 bp, Homo sapiens
gtcggggggcgagggaggggag

SEQ ID NO: 6359576 - DNA, 12 bp, Homo sapiens
gtcggggtgggg

SEQ ID NO: 6359577 - DNA, 15 bp, Homo sapiens
gtcggggttggggtg

SEQ ID NO: 6359578 - DNA, 23 bp, Homo sapiens
gtcgggttttattgtttaaaatc

SEQ ID NO: 6359579 - DNA, 15 bp, Homo sapiens
gtcggtctgctttgg

SEQ ID NO: 6359580 - DNA, 14 bp, Homo sapiens
gtcggtgccttcaa

SEQ ID NO: 6359581 - DNA, 19 bp, Homo sapiens
gtcggtgtttggaggctgc

SEQ ID NO: 6359582 - DNA, 21 bp, Homo sapiens
gtcggtgtttggaggctgctg

SEQ ID NO: 6359583 - DNA, 22 bp, Homo sapiens
gtcggtgtttggaggctgctgc

SEQ ID NO: 6359584 - DNA, 14 bp, Homo sapiens
gtcgtaacagcagg

SEQ ID NO: 6359585 - DNA, 23 bp, Homo sapiens
gtcgtagagccctccacattttc

SEQ ID NO: 6359586 - DNA, 17 bp, Homo sapiens
gtcgtcatcagatgctt

SEQ ID NO: 6359587 - DNA, 23 bp, Homo sapiens
gtcgtccccagaccagtagtgac

SEQ ID NO: 6359588 - DNA, 17 bp, Homo sapiens
gtcgtccttactcctgt

SEQ ID NO: 6359589 - DNA, 11 bp, Homo sapiens
gtcgtctgtga

SEQ ID NO: 6359590 - DNA, 13 bp, Homo sapiens
gtcgtctgtgaat

SEQ ID NO: 6359591 - DNA, 15 bp, Homo sapiens
gtcgtctgtgaatgc

SEQ ID NO: 6359592 - DNA, 18 bp, Homo sapiens
gtcgtctgtgaatgctaa

SEQ ID NO: 6359593 - DNA, 17 bp, Homo sapiens
gtcgtgagctcttgtga

SEQ ID NO: 6359594 - DNA, 15 bp, Homo sapiens
gtcgtgcactttctc

SEQ ID NO: 6359595 - DNA, 16 bp, Homo sapiens
gtcgtgcactttctcg

SEQ ID NO: 6359596 - DNA, 21 bp, Homo sapiens
gtcgtgcctccttccacctcc

SEQ ID NO: 6359597 - DNA, 15 bp, Homo sapiens
gtcgtgcctgtgtcc

SEQ ID NO: 6359598 - DNA, 17 bp, Homo sapiens
gtcgtgcctgtgtccat

SEQ ID NO: 6359599 - DNA, 20 bp, Homo sapiens
gtcgtggagagctaggagca

SEQ ID NO: 6359600 - DNA, 22 bp, Homo sapiens
gtcgtggcagataatcagcctc

SEQ ID NO: 6359601 - DNA, 13 bp, Homo sapiens
gtcgtgggaagga

SEQ ID NO: 6359602 - DNA, 14 bp, Homo sapiens
gtcgtgggatggca

SEQ ID NO: 6359603 - DNA, 17 bp, Homo sapiens
gtcgtggggtgtgctgg

SEQ ID NO: 6359604 - DNA, 16 bp, Homo sapiens
gtcgtggttcttaaat

SEQ ID NO: 6359605 - DNA, 15 bp, Homo sapiens
gtcgtgtaattggcc

SEQ ID NO: 6359606 - DNA, 14 bp, Homo sapiens
gtcgtgtctgctgt

SEQ ID NO: 6359607 - DNA, 16 bp, Homo sapiens
gtcgtgtttacaaaag

SEQ ID NO: 6359608 - DNA, 23 bp, Homo sapiens
gtcgttcccttgtgtctgttgct

SEQ ID NO: 6359609 - DNA, 17 bp, Homo sapiens
gtcgttgactttaggga

SEQ ID NO: 6359610 - DNA, 15 bp, Homo sapiens
gtcgttggagactga

SEQ ID NO: 6359611 - DNA, 13 bp, Homo sapiens
gtcgttgtgaggg

SEQ ID NO: 6359612 - DNA, 16 bp, Homo sapiens
gtcgttgttgtggaag

SEQ ID NO: 6359613 - DNA, 15 bp, Homo sapiens
gtcgttttaaaaaca

SEQ ID NO: 6359614 - DNA, 13 bp, Homo sapiens
gtcgttttagtgt

SEQ ID NO: 6359615 - DNA, 11 bp, Homo sapiens
gtcgttttcca

SEQ ID NO: 6359616 - DNA, 12 bp, Homo sapiens
gtcgttttccaa

SEQ ID NO: 6359617 - DNA, 16 bp, Homo sapiens
gtcgttttccaaagag

SEQ ID NO: 6359618 - DNA, 21 bp, Homo sapiens
gtcgttttttttttgtttgtt

SEQ ID NO: 6359619 - DNA, 12 bp, Homo sapiens
gtctaaaaacac

SEQ ID NO: 6359620 - DNA, 13 bp, Homo sapiens
gtctaaaaacatt

SEQ ID NO: 6359621 - DNA, 15 bp, Homo sapiens
gtctaaaaacatttg

SEQ ID NO: 6359622 - DNA, 14 bp, Homo sapiens
gtctaaaacaataa

SEQ ID NO: 6359623 - DNA, 20 bp, Homo sapiens
gtctaaaatttttaaggact

SEQ ID NO: 6359624 - DNA, 17 bp, Homo sapiens
gtctaaacaaaattgca

SEQ ID NO: 6359625 - DNA, 14 bp, Homo sapiens
gtctaaacaatgaa

SEQ ID NO: 6359626 - DNA, 21 bp, Homo sapiens
gtctaaacacacttagaatac

SEQ ID NO: 6359627 - DNA, 10 bp, Homo sapiens
gtctaaactg

SEQ ID NO: 6359628 - DNA, 14 bp, Homo sapiens
gtctaaagagcttt

SEQ ID NO: 6359629 - DNA, 21 bp, Homo sapiens
gtctaaagatggagtttctaa

SEQ ID NO: 6359630 - DNA, 16 bp, Homo sapiens
gtctaaatatttcctt

SEQ ID NO: 6359631 - DNA, 15 bp, Homo sapiens
gtctaaatgctgaaa

SEQ ID NO: 6359632 - DNA, 15 bp, Homo sapiens
gtctaaatttattat

SEQ ID NO: 6359633 - DNA, 13 bp, Homo sapiens
gtctaaatttgaa

SEQ ID NO: 6359634 - DNA, 17 bp, Homo sapiens
gtctaaattttctaaat

SEQ ID NO: 6359635 - DNA, 13 bp, Homo sapiens
gtctaacaacaag

SEQ ID NO: 6359636 - DNA, 12 bp, Homo sapiens
gtctaacagttt

SEQ ID NO: 6359637 - DNA, 12 bp, Homo sapiens
gtctaacatatt

SEQ ID NO: 6359638 - DNA, 22 bp, Homo sapiens
gtctaaccacagctccttttcc

SEQ ID NO: 6359639 - DNA, 17 bp, Homo sapiens
gtctaactgtggaatat

SEQ ID NO: 6359640 - DNA, 21 bp, Homo sapiens
gtctaacttggggaaggggcc

SEQ ID NO: 6359641 - DNA, 15 bp, Homo sapiens
gtctaagataaaagc

SEQ ID NO: 6359642 - DNA, 18 bp, Homo sapiens
gtctaagatgattcaaag

SEQ ID NO: 6359643 - DNA, 15 bp, Homo sapiens
gtctaagattctaga

SEQ ID NO: 6359644 - DNA, 16 bp, Homo sapiens
gtctaagattctagat

SEQ ID NO: 6359645 - DNA, 18 bp, Homo sapiens
gtctaagattctagatca

SEQ ID NO: 6359646 - DNA, 22 bp, Homo sapiens
gtctaagcaagatgttttgtat

SEQ ID NO: 6359647 - DNA, 18 bp, Homo sapiens
gtctaagtgtaaatgtta

SEQ ID NO: 6359648 - DNA, 12 bp, Homo sapiens
gtctaataaaca

SEQ ID NO: 6359649 - DNA, 16 bp, Homo sapiens
gtctaatcagtgatta

SEQ ID NO: 6359650 - DNA, 20 bp, Homo sapiens
gtctaatgattcaaatgttt

SEQ ID NO: 6359651 - DNA, 19 bp, Homo sapiens
gtctaatgggggcagtctc

SEQ ID NO: 6359652 - DNA, 23 bp, Homo sapiens
gtctaatgggggcagtctcccct

SEQ ID NO: 6359653 - DNA, 22 bp, Homo sapiens
gtctaatgtttgtgagaagctt

SEQ ID NO: 6359654 - DNA, 20 bp, Homo sapiens
gtctaattcatttactcacc

SEQ ID NO: 6359655 - DNA, 14 bp, Homo sapiens
gtctaattgtcccc

SEQ ID NO: 6359656 - DNA, 12 bp, Homo sapiens
gtctacagaaaa

SEQ ID NO: 6359657 - DNA, 14 bp, Homo sapiens
gtctacagaaaatg

SEQ ID NO: 6359658 - DNA, 19 bp, Homo sapiens
gtctacagaaaatgctggc

SEQ ID NO: 6359659 - DNA, 21 bp, Homo sapiens
gtctacagctccagatgtttc

SEQ ID NO: 6359660 - DNA, 13 bp, Homo sapiens
gtctacagctccc

SEQ ID NO: 6359661 - DNA, 21 bp, Homo sapiens
gtctacagctcccccagctcc

SEQ ID NO: 6359662 - DNA, 19 bp, Homo sapiens
gtctacaggcctttcagga

SEQ ID NO: 6359663 - DNA, 17 bp, Homo sapiens
gtctacagttgtcctga

SEQ ID NO: 6359664 - DNA, 22 bp, Homo sapiens
gtctacataactaatacagctg

SEQ ID NO: 6359665 - DNA, 14 bp, Homo sapiens
gtctacatgtgcca

SEQ ID NO: 6359666 - DNA, 17 bp, Homo sapiens
gtctacatttctgcaga

SEQ ID NO: 6359667 - DNA, 20 bp, Homo sapiens
gtctaccaatctgggaagat

SEQ ID NO: 6359668 - DNA, 15 bp, Homo sapiens
gtctaccaattataa

SEQ ID NO: 6359669 - DNA, 13 bp, Homo sapiens
gtctaccatctcc

SEQ ID NO: 6359670 - DNA, 17 bp, Homo sapiens
gtctacccagagaagcc

SEQ ID NO: 6359671 - DNA, 23 bp, Homo sapiens
gtctacccctcccggccctgcct

SEQ ID NO: 6359672 - DNA, 17 bp, Homo sapiens
gtctacctgccttgcct

SEQ ID NO: 6359673 - DNA, 14 bp, Homo sapiens
gtctacctgctgga

SEQ ID NO: 6359674 - DNA, 19 bp, Homo sapiens
gtctacctgctggacagcc

SEQ ID NO: 6359675 - DNA, 21 bp, Homo sapiens
gtctacgggggcacttggagg

SEQ ID NO: 6359676 - DNA, 18 bp, Homo sapiens
gtctacgtatgcatgcta

SEQ ID NO: 6359677 - DNA, 21 bp, Homo sapiens
gtctactctaggactgggccc

SEQ ID NO: 6359678 - DNA, 13 bp, Homo sapiens
gtctactctgaag

SEQ ID NO: 6359679 - DNA, 23 bp, Homo sapiens
gtctactcttaagccatcttggt

SEQ ID NO: 6359680 - DNA, 22 bp, Homo sapiens
gtctactggacaatcttatgtt

SEQ ID NO: 6359681 - DNA, 11 bp, Homo sapiens
gtctactgtgg

SEQ ID NO: 6359682 - DNA, 22 bp, Homo sapiens
gtctactgtggtgatctgtaga

SEQ ID NO: 6359683 - DNA, 21 bp, Homo sapiens
gtctacttctgtgtctgtcac

SEQ ID NO: 6359684 - DNA, 13 bp, Homo sapiens
gtctactttctct

SEQ ID NO: 6359685 - DNA, 16 bp, Homo sapiens
gtctactttttaattt

SEQ ID NO: 6359686 - DNA, 21 bp, Homo sapiens
gtctactttttaatttttaag

SEQ ID NO: 6359687 - DNA, 22 bp, Homo sapiens
gtctactttttaatttttaaga

SEQ ID NO: 6359688 - DNA, 21 bp, Homo sapiens
gtctagaaaccagtatggaag

SEQ ID NO: 6359689 - DNA, 22 bp, Homo sapiens
gtctagaaagtaagaaaacaat

SEQ ID NO: 6359690 - DNA, 21 bp, Homo sapiens
gtctagaagttgtttgtcatc

SEQ ID NO: 6359691 - DNA, 18 bp, Homo sapiens
gtctagaatggatttttc

SEQ ID NO: 6359692 - DNA, 19 bp, Homo sapiens
gtctagacacaatttcatt

SEQ ID NO: 6359693 - DNA, 15 bp, Homo sapiens
gtctagagagaacca

SEQ ID NO: 6359694 - DNA, 13 bp, Homo sapiens
gtctagagaggga

SEQ ID NO: 6359695 - DNA, 14 bp, Homo sapiens
gtctagagagggag

SEQ ID NO: 6359696 - DNA, 16 bp, Homo sapiens
gtctagagagggaggc

SEQ ID NO: 6359697 - DNA, 21 bp, Homo sapiens
gtctagaggctattcctaggc

SEQ ID NO: 6359698 - DNA, 14 bp, Homo sapiens
gtctagagttgatg

SEQ ID NO: 6359699 - DNA, 23 bp, Homo sapiens
gtctagatggatgaattatgata

SEQ ID NO: 6359700 - DNA, 15 bp, Homo sapiens
gtctagatggctcct

SEQ ID NO: 6359701 - DNA, 16 bp, Homo sapiens
gtctagatggctcctc

SEQ ID NO: 6359702 - DNA, 18 bp, Homo sapiens
gtctagatggctcctctc

SEQ ID NO: 6359703 - DNA, 20 bp, Homo sapiens
gtctagatggctcctctcag

SEQ ID NO: 6359704 - DNA, 21 bp, Homo sapiens
gtctagatggctcctctcagt

SEQ ID NO: 6359705 - DNA, 20 bp, Homo sapiens
gtctagattaatactctatt

SEQ ID NO: 6359706 - DNA, 11 bp, Homo sapiens
gtctagattca

SEQ ID NO: 6359707 - DNA, 21 bp, Homo sapiens
gtctagattcaaaggttctag

SEQ ID NO: 6359708 - DNA, 14 bp, Homo sapiens
gtctagcaaagcca

SEQ ID NO: 6359709 - DNA, 19 bp, Homo sapiens
gtctagcagagcaggggca

SEQ ID NO: 6359710 - DNA, 14 bp, Homo sapiens
gtctagcatgccaa

SEQ ID NO: 6359711 - DNA, 14 bp, Homo sapiens
gtctagccactccc

SEQ ID NO: 6359712 - DNA, 21 bp, Homo sapiens
gtctagccactccctcccaga

SEQ ID NO: 6359713 - DNA, 18 bp, Homo sapiens
gtctagccgctgccctgg

SEQ ID NO: 6359714 - DNA, 23 bp, Homo sapiens
gtctagcctatgtggattttttc

SEQ ID NO: 6359715 - DNA, 21 bp, Homo sapiens
gtctagcctcattttgttttt

SEQ ID NO: 6359716 - DNA, 19 bp, Homo sapiens
gtctaggaactccctcaga

SEQ ID NO: 6359717 - DNA, 15 bp, Homo sapiens
gtctaggactgcagt

SEQ ID NO: 6359718 - DNA, 16 bp, Homo sapiens
gtctaggactgcagtg

SEQ ID NO: 6359719 - DNA, 20 bp, Homo sapiens
gtctaggactttagggatct

SEQ ID NO: 6359720 - DNA, 22 bp, Homo sapiens
gtctaggactttagggatctgg

SEQ ID NO: 6359721 - DNA, 19 bp, Homo sapiens
gtctaggagctccttctgg

SEQ ID NO: 6359722 - DNA, 13 bp, Homo sapiens
gtctaggagctgg

SEQ ID NO: 6359723 - DNA, 15 bp, Homo sapiens
gtctaggagctgtct

SEQ ID NO: 6359724 - DNA, 22 bp, Homo sapiens
gtctaggataacttgctttctt

SEQ ID NO: 6359725 - DNA, 20 bp, Homo sapiens
taatcctttctgccgacccc

SEQ ID NO: 6359726 - DNA, 14 bp, Homo sapiens
taatcctttggaaa

SEQ ID NO: 6359727 - DNA, 23 bp, Homo sapiens
taatcctttgttttctgactaat

SEQ ID NO: 6359728 - DNA, 18 bp, Homo sapiens
taatcgaagcaaaagtaa

SEQ ID NO: 6359729 - DNA, 16 bp, Homo sapiens
taatcgacctgcctcg

SEQ ID NO: 6359730 - DNA, 22 bp, Homo sapiens
taatcggctcccgcttgctctc

SEQ ID NO: 6359731 - DNA, 17 bp, Homo sapiens
taatcgttatgtgtgta

SEQ ID NO: 6359732 - DNA, 19 bp, Homo sapiens
taatctaaaagctctgttc

SEQ ID NO: 6359733 - DNA, 13 bp, Homo sapiens
taatctaaatata

SEQ ID NO: 6359734 - DNA, 12 bp, Homo sapiens
taatctaaatgg

SEQ ID NO: 6359735 - DNA, 22 bp, Homo sapiens
taatctacaccaatgaaaacat

SEQ ID NO: 6359736 - DNA, 18 bp, Homo sapiens
taatctacattataataa

SEQ ID NO: 6359737 - DNA, 13 bp, Homo sapiens
taatctaccagtg

SEQ ID NO: 6359738 - DNA, 14 bp, Homo sapiens
taatctactgcatt

SEQ ID NO: 6359739 - DNA, 11 bp, Homo sapiens
taatctactgt

SEQ ID NO: 6359740 - DNA, 13 bp, Homo sapiens
taatctactgtat

SEQ ID NO: 6359741 - DNA, 23 bp, Homo sapiens
taatctactgtatcaataaaatt

SEQ ID NO: 6359742 - DNA, 13 bp, Homo sapiens
taatctagaaaat

SEQ ID NO: 6359743 - DNA, 16 bp, Homo sapiens
taatctagaaaatgaa

SEQ ID NO: 6359744 - DNA, 19 bp, Homo sapiens
taatctagaaaatgaaaag

SEQ ID NO: 6359745 - DNA, 22 bp, Homo sapiens
taatctagagctatgcacacca

SEQ ID NO: 6359746 - DNA, 20 bp, Homo sapiens
taatctagtttacagaaaaa

SEQ ID NO: 6359747 - DNA, 23 bp, Homo sapiens
taatctatatgattaaagaaaat

SEQ ID NO: 6359748 - DNA, 16 bp, Homo sapiens
taatctatattaaatg

SEQ ID NO: 6359749 - DNA, 12 bp, Homo sapiens
taatctatgtgc

SEQ ID NO: 6359750 - DNA, 23 bp, Homo sapiens
taatctatgtgtttctgtaacaa

SEQ ID NO: 6359751 - DNA, 22 bp, Homo sapiens
taatctattcctgtaaataaga

SEQ ID NO: 6359752 - DNA, 16 bp, Homo sapiens
taatctcaaaggagaa

SEQ ID NO: 6359753 - DNA, 18 bp, Homo sapiens
taatctcaaaggagaaaa

SEQ ID NO: 6359754 - DNA, 15 bp, Homo sapiens
taatctcaatttaag

SEQ ID NO: 6359755 - DNA, 14 bp, Homo sapiens
taatctcacagcat

SEQ ID NO: 6359756 - DNA, 16 bp, Homo sapiens
taatctcacagcattt

SEQ ID NO: 6359757 - DNA, 20 bp, Homo sapiens
taatctcacttcatcaatca

SEQ ID NO: 6359758 - DNA, 16 bp, Homo sapiens
taatctcagtgctttc

SEQ ID NO: 6359759 - DNA, 16 bp, Homo sapiens
taatctcatcccccca

SEQ ID NO: 6359760 - DNA, 14 bp, Homo sapiens
taatctcatgctgt

SEQ ID NO: 6359761 - DNA, 12 bp, Homo sapiens
taatctcatttc

SEQ ID NO: 6359762 - DNA, 15 bp, Homo sapiens
taatctccaacttta

SEQ ID NO: 6359763 - DNA, 23 bp, Homo sapiens
taatctccaactttattttgaat

SEQ ID NO: 6359764 - DNA, 21 bp, Homo sapiens
taatctccacccaatgaatga

SEQ ID NO: 6359765 - DNA, 17 bp, Homo sapiens
taatctcctctgctcat

SEQ ID NO: 6359766 - DNA, 21 bp, Homo sapiens
taatctcctctgctcattaaa

SEQ ID NO: 6359767 - DNA, 20 bp, Homo sapiens
taatctcggaaggctgaggc

SEQ ID NO: 6359768 - DNA, 17 bp, Homo sapiens
taatctcgtttcaaaaa

SEQ ID NO: 6359769 - DNA, 19 bp, Homo sapiens
taatctcgtttcaaaaaca

SEQ ID NO: 6359770 - DNA, 20 bp, Homo sapiens
taatctctaaaattctagtc

SEQ ID NO: 6359771 - DNA, 18 bp, Homo sapiens
taatctctccaccttcca

SEQ ID NO: 6359772 - DNA, 23 bp, Homo sapiens
taatctctctgccgaaagtcaaa

SEQ ID NO: 6359773 - DNA, 22 bp, Homo sapiens
taatctctgattaaatttaata

SEQ ID NO: 6359774 - DNA, 14 bp, Homo sapiens
taatctctggaaat

SEQ ID NO: 6359775 - DNA, 12 bp, Homo sapiens
taatctctgtta

SEQ ID NO: 6359776 - DNA, 24 bp, Homo sapiens
taatctctgttatgtactgtacta

SEQ ID NO: 6359777 - DNA, 15 bp, Homo sapiens
taatctcttattcta

SEQ ID NO: 6359778 - DNA, 14 bp, Homo sapiens
taatctcttcttat

SEQ ID NO: 6359779 - DNA, 21 bp, Homo sapiens
taatctctttattaaaacagt

SEQ ID NO: 6359780 - DNA, 21 bp, Homo sapiens
taatctctttggttcctgtat

SEQ ID NO: 6359781 - DNA, 12 bp, Homo sapiens
taatctgaaaca

SEQ ID NO: 6359782 - DNA, 15 bp, Homo sapiens
taatctgaaattcta

SEQ ID NO: 6359783 - DNA, 13 bp, Homo sapiens
taatctgaagata

SEQ ID NO: 6359784 - DNA, 22 bp, Homo sapiens
taatctgaataaagtgtaacaa

SEQ ID NO: 6359785 - DNA, 20 bp, Homo sapiens
taatctgacaaagtcatgaa

SEQ ID NO: 6359786 - DNA, 14 bp, Homo sapiens
taatctgagcaggt

SEQ ID NO: 6359787 - DNA, 18 bp, Homo sapiens
taatctgagctgcagcct

SEQ ID NO: 6359788 - DNA, 23 bp, Homo sapiens
taatctgagctgcagcctggctg

SEQ ID NO: 6359789 - DNA, 15 bp, Homo sapiens
taatctgatgtataa

SEQ ID NO: 6359790 - DNA, 20 bp, Homo sapiens
taatctgcaaaatgtagaaa

SEQ ID NO: 6359791 - DNA, 21 bp, Homo sapiens
taatctgcaaagaatgagaag

SEQ ID NO: 6359792 - DNA, 11 bp, Homo sapiens
taatctgcctg

SEQ ID NO: 6359793 - DNA, 16 bp, Homo sapiens
taatctgcctggtttt

SEQ ID NO: 6359794 - DNA, 19 bp, Homo sapiens
taatctgcctggttttatt

SEQ ID NO: 6359795 - DNA, 21 bp, Homo sapiens
taatctgctttgttaatgaaa

SEQ ID NO: 6359796 - DNA, 18 bp, Homo sapiens
taatctggactcctctgt

SEQ ID NO: 6359797 - DNA, 19 bp, Homo sapiens
taatctggactcctctgtc

SEQ ID NO: 6359798 - DNA, 20 bp, Homo sapiens
taatctggactcctctgtcc

SEQ ID NO: 6359799 - DNA, 20 bp, Homo sapiens
taatctgggcagacattatg

SEQ ID NO: 6359800 - DNA, 18 bp, Homo sapiens
taatctgggccagaattt

SEQ ID NO: 6359801 - DNA, 23 bp, Homo sapiens
taatctgggccagaatttcaaac

SEQ ID NO: 6359802 - DNA, 16 bp, Homo sapiens
taatctggtgacaaat

SEQ ID NO: 6359803 - DNA, 21 bp, Homo sapiens
taatctggtgttcttgctaac

SEQ ID NO: 6359804 - DNA, 15 bp, Homo sapiens
taatctgtaaatgaa

SEQ ID NO: 6359805 - DNA, 18 bp, Homo sapiens
taatctgtacattttgtt

SEQ ID NO: 6359806 - DNA, 22 bp, Homo sapiens
taatctgtacattttgttgtaa

SEQ ID NO: 6359807 - DNA, 15 bp, Homo sapiens
taatctgtcaaaaca

SEQ ID NO: 6359808 - DNA, 17 bp, Homo sapiens
taatctgtcaaaacact

SEQ ID NO: 6359809 - DNA, 19 bp, Homo sapiens
taatctgtcaaaacactgt

SEQ ID NO: 6359810 - DNA, 20 bp, Homo sapiens
taatctgtcaaaacactgtg

SEQ ID NO: 6359811 - DNA, 23 bp, Homo sapiens
taatctgtcaaaacactgtggaa

SEQ ID NO: 6359812 - DNA, 17 bp, Homo sapiens
taatctgtcgcatttca

SEQ ID NO: 6359813 - DNA, 22 bp, Homo sapiens
taatctgtgctgtttcaaagtt

SEQ ID NO: 6359814 - DNA, 13 bp, Homo sapiens
taatctgtgtaca

SEQ ID NO: 6359815 - DNA, 16 bp, Homo sapiens
taatctgttgtttgaa

SEQ ID NO: 6359816 - DNA, 16 bp, Homo sapiens
taatcttaaatcagaa

SEQ ID NO: 6359817 - DNA, 17 bp, Homo sapiens
taatcttaaatcagaat

SEQ ID NO: 6359818 - DNA, 14 bp, Homo sapiens
taatcttagctttt

SEQ ID NO: 6359819 - DNA, 13 bp, Homo sapiens
taatcttatacaa

SEQ ID NO: 6359820 - DNA, 15 bp, Homo sapiens
taatcttatacaaca

SEQ ID NO: 6359821 - DNA, 13 bp, Homo sapiens
taatcttattagg

SEQ ID NO: 6359822 - DNA, 21 bp, Homo sapiens
taatcttattcattttctcta

SEQ ID NO: 6359823 - DNA, 17 bp, Homo sapiens
taatcttattttatctt

SEQ ID NO: 6359824 - DNA, 22 bp, Homo sapiens
taatcttcagaggtgctaaatt

SEQ ID NO: 6359825 - DNA, 21 bp, Homo sapiens
taatcttcaggtgaacactta

SEQ ID NO: 6359826 - DNA, 20 bp, Homo sapiens
taatcttcagttttatcttt

SEQ ID NO: 6359827 - DNA, 14 bp, Homo sapiens
taatcttctgcctt

SEQ ID NO: 6359828 - DNA, 23 bp, Homo sapiens
taatcttgaaggaacacaaagat

SEQ ID NO: 6359829 - DNA, 15 bp, Homo sapiens
taatcttgaatgttt

SEQ ID NO: 6359830 - DNA, 22 bp, Homo sapiens
taatcttgaattgtaactgttc

SEQ ID NO: 6359831 - DNA, 15 bp, Homo sapiens
taatcttgctctgct

SEQ ID NO: 6359832 - DNA, 15 bp, Homo sapiens
taatcttgctttctt

SEQ ID NO: 6359833 - DNA, 22 bp, Homo sapiens
taatcttgtagacacttacttg

SEQ ID NO: 6359834 - DNA, 13 bp, Homo sapiens
taatcttgtgtag

SEQ ID NO: 6359835 - DNA, 19 bp, Homo sapiens
taatcttgtgtagtcttca

SEQ ID NO: 6359836 - DNA, 18 bp, Homo sapiens
taatctttaactgaactc

SEQ ID NO: 6359837 - DNA, 14 bp, Homo sapiens
taatctttaatata

SEQ ID NO: 6359838 - DNA, 15 bp, Homo sapiens
taatctttattttat

SEQ ID NO: 6359839 - DNA, 17 bp, Homo sapiens
taatctttcacttgaaa

SEQ ID NO: 6359840 - DNA, 20 bp, Homo sapiens
taatctttcggtctccttaa

SEQ ID NO: 6359841 - DNA, 18 bp, Homo sapiens
taatctttctttacctga

SEQ ID NO: 6359842 - DNA, 12 bp, Homo sapiens
taatctttgggt

SEQ ID NO: 6359843 - DNA, 18 bp, Homo sapiens
taatcttttaaaaatgat

SEQ ID NO: 6359844 - DNA, 15 bp, Homo sapiens
taatcttttacattg

SEQ ID NO: 6359845 - DNA, 19 bp, Homo sapiens
taatcttttcacaaataaa

SEQ ID NO: 6359846 - DNA, 16 bp, Homo sapiens
taatctttttacagtt

SEQ ID NO: 6359847 - DNA, 13 bp, Homo sapiens
taatctttttctc

SEQ ID NO: 6359848 - DNA, 17 bp, Homo sapiens
taatcttttttttaaaa

SEQ ID NO: 6359849 - DNA, 18 bp, Homo sapiens
taatgaaaaacaaaaagc

SEQ ID NO: 6359850 - DNA, 19 bp, Homo sapiens
taatgaaaaatctgaattt

SEQ ID NO: 6359851 - DNA, 22 bp, Homo sapiens
taatgaaaaatctgaatttcta

SEQ ID NO: 6359852 - DNA, 19 bp, Homo sapiens
taatgaaaacctttactag

SEQ ID NO: 6359853 - DNA, 17 bp, Homo sapiens
taatgaaaagaaacaag

SEQ ID NO: 6359854 - DNA, 16 bp, Homo sapiens
taatgaaaaggaagtt

SEQ ID NO: 6359855 - DNA, 16 bp, Homo sapiens
taatgaaaataaaaca

SEQ ID NO: 6359856 - DNA, 18 bp, Homo sapiens
taatgaaaatgaatatct

SEQ ID NO: 6359857 - DNA, 22 bp, Homo sapiens
taatgaaaatgtctcagtattt

SEQ ID NO: 6359858 - DNA, 17 bp, Homo sapiens
taatgaaacaaagagtt

SEQ ID NO: 6359859 - DNA, 14 bp, Homo sapiens
taatgaaacttgga

SEQ ID NO: 6359860 - DNA, 15 bp, Homo sapiens
taatgaaacttggat

SEQ ID NO: 6359861 - DNA, 18 bp, Homo sapiens
taatgaaagactgtacaa

SEQ ID NO: 6359862 - DNA, 19 bp, Homo sapiens
taatgaaagactgtacaaa

SEQ ID NO: 6359863 - DNA, 19 bp, Homo sapiens
taatgaaagtgatgacata

SEQ ID NO: 6359864 - DNA, 22 bp, Homo sapiens
taatgaaagtgatgacatattt

SEQ ID NO: 6359865 - DNA, 20 bp, Homo sapiens
taatgaaataaaatttgaaa

SEQ ID NO: 6359866 - DNA, 17 bp, Homo sapiens
taatgaaataatcagtg

SEQ ID NO: 6359867 - DNA, 21 bp, Homo sapiens
taatgaaatgataaagacttt

SEQ ID NO: 6359868 - DNA, 16 bp, Homo sapiens
taatgaaatgtttact

SEQ ID NO: 6359869 - DNA, 14 bp, Homo sapiens
taatgaacaaatat

SEQ ID NO: 6359870 - DNA, 17 bp, Homo sapiens
taatgaacaaatatgct

SEQ ID NO: 6359871 - DNA, 19 bp, Homo sapiens
taatgaacaaatatgcttt

SEQ ID NO: 6359872 - DNA, 13 bp, Homo sapiens
taatgaacagcag

SEQ ID NO: 6359873 - DNA, 18 bp, Homo sapiens
taatgaaccgctgaatat

SEQ ID NO: 6359874 - DNA, 16 bp, Homo sapiens
taatgaactgtgacag

SEQ ID NO: 6359875 - DNA, 17 bp, Homo sapiens
taatgaactgtgacagg

SEQ ID NO: 6359876 - DNA, 14 bp, Homo sapiens
taatgaactttgaa

SEQ ID NO: 6359877 - DNA, 16 bp, Homo sapiens
taatgaagaacactgt

SEQ ID NO: 6359878 - DNA, 14 bp, Homo sapiens
taatgaagaatcac

SEQ ID NO: 6359879 - DNA, 13 bp, Homo sapiens
taatgaagagaaa

SEQ ID NO: 6359880 - DNA, 16 bp, Homo sapiens
taatgaagagaaaaaa

SEQ ID NO: 6359881 - DNA, 14 bp, Homo sapiens
taatgaagatctaa

SEQ ID NO: 6359882 - DNA, 18 bp, Homo sapiens
taatgaagctattgagaa

SEQ ID NO: 6359883 - DNA, 20 bp, Homo sapiens
taatgaaggtgtgctacaga

SEQ ID NO: 6359884 - DNA, 16 bp, Homo sapiens
taatgaagtattacat

SEQ ID NO: 6359885 - DNA, 13 bp, Homo sapiens
taatgaagtttga

SEQ ID NO: 6359886 - DNA, 15 bp, Homo sapiens
taatgaagtttgaat

SEQ ID NO: 6359887 - DNA, 14 bp, Homo sapiens
taatgaataaacag

SEQ ID NO: 6359888 - DNA, 11 bp, Homo sapiens
taatgaataat

SEQ ID NO: 6359889 - DNA, 17 bp, Homo sapiens
taatgaatgaaacattt

SEQ ID NO: 6359890 - DNA, 18 bp, Homo sapiens
taatgaatttaaggcaaa

SEQ ID NO: 6359891 - DNA, 20 bp, Homo sapiens
taatgaatttaaggcaaaaa

SEQ ID NO: 6359892 - DNA, 22 bp, Homo sapiens
taatgaattttaaaagcatata

SEQ ID NO: 6359893 - DNA, 15 bp, Homo sapiens
taatgaattttatgt

SEQ ID NO: 6359894 - DNA, 16 bp, Homo sapiens
taatgaattttatgtg

SEQ ID NO: 6359895 - DNA, 16 bp, Homo sapiens
taatgaatttttatga

SEQ ID NO: 6359896 - DNA, 16 bp, Homo sapiens
taatgacaagtgactt

SEQ ID NO: 6359897 - DNA, 20 bp, Homo sapiens
taatgacacggtaggccaag

SEQ ID NO: 6359898 - DNA, 18 bp, Homo sapiens
taatgacactgtttcctg

SEQ ID NO: 6359899 - DNA, 17 bp, Homo sapiens
taatgacagagagttct

SEQ ID NO: 6359900 - DNA, 15 bp, Homo sapiens
taatgacagattgtt

SEQ ID NO: 6359901 - DNA, 17 bp, Homo sapiens
taatgacagccttgcaa

SEQ ID NO: 6359902 - DNA, 15 bp, Homo sapiens
taatgacaggcctgt

SEQ ID NO: 6359903 - DNA, 20 bp, Homo sapiens
taatgacatcaccacagttt

SEQ ID NO: 6359904 - DNA, 17 bp, Homo sapiens
gtctaggattgggcctc

SEQ ID NO: 6359905 - DNA, 23 bp, Homo sapiens
gtctaggcaggacctgtggccaa

SEQ ID NO: 6359906 - DNA, 19 bp, Homo sapiens
gtctaggctggaagagcca

SEQ ID NO: 6359907 - DNA, 15 bp, Homo sapiens
gtctaggtctcctca

SEQ ID NO: 6359908 - DNA, 18 bp, Homo sapiens
gtctaggtctcctcaggg

SEQ ID NO: 6359909 - DNA, 17 bp, Homo sapiens
gtctaggttaaagctaa

SEQ ID NO: 6359910 - DNA, 21 bp, Homo sapiens
gtctaggttaaagctaaactg

SEQ ID NO: 6359911 - DNA, 23 bp, Homo sapiens
gtctagtggaaagattgtgtctg

SEQ ID NO: 6359912 - DNA, 19 bp, Homo sapiens
gtctagttaacatttcaag

SEQ ID NO: 6359913 - DNA, 18 bp, Homo sapiens
gtctagttattggatcag

SEQ ID NO: 6359914 - DNA, 23 bp, Homo sapiens
gtctagttgccaaatctggctcc

SEQ ID NO: 6359915 - DNA, 12 bp, Homo sapiens
gtctagttttat

SEQ ID NO: 6359916 - DNA, 15 bp, Homo sapiens
gtctataaaataaac

SEQ ID NO: 6359917 - DNA, 17 bp, Homo sapiens
gtctataaaataaactt

SEQ ID NO: 6359918 - DNA, 21 bp, Homo sapiens
gtctataaaataaacttctta

SEQ ID NO: 6359919 - DNA, 24 bp, Homo sapiens
gtctataaaataaacttcttaaca

SEQ ID NO: 6359920 - DNA, 21 bp, Homo sapiens
gtctataatcccagcactttg

SEQ ID NO: 6359921 - DNA, 23 bp, Homo sapiens
gtctataattccttaaaattttc

SEQ ID NO: 6359922 - DNA, 16 bp, Homo sapiens
gtctataccttaagaa

SEQ ID NO: 6359923 - DNA, 14 bp, Homo sapiens
gtctatactacagt

SEQ ID NO: 6359924 - DNA, 13 bp, Homo sapiens
gtctatatataca

SEQ ID NO: 6359925 - DNA, 22 bp, Homo sapiens
gtctatcaaccccagacactgg

SEQ ID NO: 6359926 - DNA, 18 bp, Homo sapiens
gtctatcaagtcaatcat

SEQ ID NO: 6359927 - DNA, 17 bp, Homo sapiens
gtctatctaatgacatg

SEQ ID NO: 6359928 - DNA, 18 bp, Homo sapiens
gtctatctctaataaaaa

SEQ ID NO: 6359929 - DNA, 20 bp, Homo sapiens
gtctatctggtattaaatgc

SEQ ID NO: 6359930 - DNA, 12 bp, Homo sapiens
gtctatgaacta

SEQ ID NO: 6359931 - DNA, 22 bp, Homo sapiens
gtctatgaactagagactctgt

SEQ ID NO: 6359932 - DNA, 22 bp, Homo sapiens
gtctatgacatgaacaatgtgt

SEQ ID NO: 6359933 - DNA, 16 bp, Homo sapiens
gtctatgattgtactt

SEQ ID NO: 6359934 - DNA, 13 bp, Homo sapiens
gtctatggagcag

SEQ ID NO: 6359935 - DNA, 14 bp, Homo sapiens
gtctatggagcagc

SEQ ID NO: 6359936 - DNA, 14 bp, Homo sapiens
gtctatgggactca

SEQ ID NO: 6359937 - DNA, 22 bp, Homo sapiens
gtctatgtaaatgcatctgtcc

SEQ ID NO: 6359938 - DNA, 23 bp, Homo sapiens
gtctatgtagctgaaaataaaat

SEQ ID NO: 6359939 - DNA, 18 bp, Homo sapiens
gtctatgtcgagagctgg

SEQ ID NO: 6359940 - DNA, 13 bp, Homo sapiens
gtctatgtgtata

SEQ ID NO: 6359941 - DNA, 17 bp, Homo sapiens
gtctattaaagatattt

SEQ ID NO: 6359942 - DNA, 14 bp, Homo sapiens
gtctattatcacat

SEQ ID NO: 6359943 - DNA, 15 bp, Homo sapiens
gtctattattatgaa

SEQ ID NO: 6359944 - DNA, 15 bp, Homo sapiens
gtctattccagctca

SEQ ID NO: 6359945 - DNA, 16 bp, Homo sapiens
gtctattccagctcat

SEQ ID NO: 6359946 - DNA, 20 bp, Homo sapiens
gtctattccagctcattcat

SEQ ID NO: 6359947 - DNA, 21 bp, Homo sapiens
gtctattccagctcattcatt

SEQ ID NO: 6359948 - DNA, 23 bp, Homo sapiens
gtctattccattcccttcggcca

SEQ ID NO: 6359949 - DNA, 17 bp, Homo sapiens
gtctattctccagctga

SEQ ID NO: 6359950 - DNA, 16 bp, Homo sapiens
gtctattctgagcctt

SEQ ID NO: 6359951 - DNA, 12 bp, Homo sapiens
gtctatttaagc

SEQ ID NO: 6359952 - DNA, 16 bp, Homo sapiens
gtctatttaagcctca

SEQ ID NO: 6359953 - DNA, 20 bp, Homo sapiens
gtctatttcatcagaacagc

SEQ ID NO: 6359954 - DNA, 22 bp, Homo sapiens
gtctatttcatcagaacagctg

SEQ ID NO: 6359955 - DNA, 17 bp, Homo sapiens
gtctatttctgctgaat

SEQ ID NO: 6359956 - DNA, 20 bp, Homo sapiens
gtctatttggattattcttt

SEQ ID NO: 6359957 - DNA, 15 bp, Homo sapiens
gtctattttaaaata

SEQ ID NO: 6359958 - DNA, 21 bp, Homo sapiens
gtctattttataagggcacta

SEQ ID NO: 6359959 - DNA, 20 bp, Homo sapiens
gtctattttgtaactgtaaa

SEQ ID NO: 6359960 - DNA, 20 bp, Homo sapiens
gtctattttgtatatttgta

SEQ ID NO: 6359961 - DNA, 18 bp, Homo sapiens
gtctatttttgtacaaaa

SEQ ID NO: 6359962 - DNA, 16 bp, Homo sapiens
gtctatttttgtctta

SEQ ID NO: 6359963 - DNA, 23 bp, Homo sapiens
gtctcaaaaaaagggcaataaat

SEQ ID NO: 6359964 - DNA, 13 bp, Homo sapiens
gtctcaaaatcaa

SEQ ID NO: 6359965 - DNA, 20 bp, Homo sapiens
gtctcaaactcctgacctca

SEQ ID NO: 6359966 - DNA, 22 bp, Homo sapiens
gtctcaaactcctgacctcagg

SEQ ID NO: 6359967 - DNA, 19 bp, Homo sapiens
gtctcaaagcatcaaataa

SEQ ID NO: 6359968 - DNA, 20 bp, Homo sapiens
gtctcaacatgtgtttctga

SEQ ID NO: 6359969 - DNA, 23 bp, Homo sapiens
gtctcaactgctcttttatactg

SEQ ID NO: 6359970 - DNA, 15 bp, Homo sapiens
gtctcaagagggcac

SEQ ID NO: 6359971 - DNA, 19 bp, Homo sapiens
gtctcaagcactaaaaagt

SEQ ID NO: 6359972 - DNA, 22 bp, Homo sapiens
gtctcaagtgcaatgccccctc

SEQ ID NO: 6359973 - DNA, 23 bp, Homo sapiens
gtctcaatagctccaagctgtta

SEQ ID NO: 6359974 - DNA, 14 bp, Homo sapiens
gtctcaatgctcat

SEQ ID NO: 6359975 - DNA, 23 bp, Homo sapiens
gtctcaattctgaaggggaaaac

SEQ ID NO: 6359976 - DNA, 17 bp, Homo sapiens
gtctcacactcctcctg

SEQ ID NO: 6359977 - DNA, 22 bp, Homo sapiens
gtctcacactcctcctgccagc

SEQ ID NO: 6359978 - DNA, 15 bp, Homo sapiens
gtctcacactggcgt

SEQ ID NO: 6359979 - DNA, 17 bp, Homo sapiens
gtctcacagagaagctc

SEQ ID NO: 6359980 - DNA, 15 bp, Homo sapiens
gtctcacagaggcag

SEQ ID NO: 6359981 - DNA, 15 bp, Homo sapiens
gtctcacatattcat

SEQ ID NO: 6359982 - DNA, 21 bp, Homo sapiens
gtctcacatattcatcagcag

SEQ ID NO: 6359983 - DNA, 16 bp, Homo sapiens
gtctcaccacacataa

SEQ ID NO: 6359984 - DNA, 15 bp, Homo sapiens
gtctcaccagctcag

SEQ ID NO: 6359985 - DNA, 15 bp, Homo sapiens
gtctcaccatttccc

SEQ ID NO: 6359986 - DNA, 19 bp, Homo sapiens
gtctcaccatttccccagg

SEQ ID NO: 6359987 - DNA, 20 bp, Homo sapiens
gtctcaccatttccccaggg

SEQ ID NO: 6359988 - DNA, 21 bp, Homo sapiens
gtctcaccatttccccagggc

SEQ ID NO: 6359989 - DNA, 20 bp, Homo sapiens
gtctcacgcagccagtgcac

SEQ ID NO: 6359990 - DNA, 23 bp, Homo sapiens
gtctcactagtttttcctgtgca

SEQ ID NO: 6359991 - DNA, 18 bp, Homo sapiens
gtctcactatgttgccca

SEQ ID NO: 6359992 - DNA, 21 bp, Homo sapiens
gtctcactatgttgcccaggc

SEQ ID NO: 6359993 - DNA, 23 bp, Homo sapiens
gtctcactatgttgcccaggcag

SEQ ID NO: 6359994 - DNA, 14 bp, Homo sapiens
gtctcactctctgg

SEQ ID NO: 6359995 - DNA, 11 bp, Homo sapiens
gtctcactctg

SEQ ID NO: 6359996 - DNA, 16 bp, Homo sapiens
gtctcactctgtcgcc

SEQ ID NO: 6359997 - DNA, 22 bp, Homo sapiens
gtctcactctgtcgcccagtct

SEQ ID NO: 6359998 - DNA, 16 bp, Homo sapiens
gtctcactcttctgtc

SEQ ID NO: 6359999 - DNA, 15 bp, Homo sapiens
gtctcactgaaacat

SEQ ID NO: 6360000 - DNA, 21 bp, Homo sapiens
gtctcactgaaacatttaaat

SEQ ID NO: 6360001 - DNA, 14 bp, Homo sapiens
gtctcactgcttga

SEQ ID NO: 6360002 - DNA, 15 bp, Homo sapiens
gtctcactgcttgaa

SEQ ID NO: 6360003 - DNA, 16 bp, Homo sapiens
gtctcactgtctgctg

SEQ ID NO: 6360004 - DNA, 22 bp, Homo sapiens
gtctcactgtgggaaggccagc

SEQ ID NO: 6360005 - DNA, 23 bp, Homo sapiens
gtctcactgtgggaaggccagct

SEQ ID NO: 6360006 - DNA, 19 bp, Homo sapiens
gtctcactgtgttgcccag

SEQ ID NO: 6360007 - DNA, 21 bp, Homo sapiens
gtctcactgtgttgcccaggc

SEQ ID NO: 6360008 - DNA, 16 bp, Homo sapiens
gtctcactgttctgca

SEQ ID NO: 6360009 - DNA, 13 bp, Homo sapiens
gtctcactgttgc

SEQ ID NO: 6360010 - DNA, 17 bp, Homo sapiens
gtctcactgttgcccag

SEQ ID NO: 6360011 - DNA, 22 bp, Homo sapiens
gtctcacttgtgcagtgttgac

SEQ ID NO: 6360012 - DNA, 13 bp, Homo sapiens
gtctcagaagagg

SEQ ID NO: 6360013 - DNA, 13 bp, Homo sapiens
gtctcagaaggct

SEQ ID NO: 6360014 - DNA, 16 bp, Homo sapiens
gtctcagaatctttcc

SEQ ID NO: 6360015 - DNA, 17 bp, Homo sapiens
gtctcagaatctttcct

SEQ ID NO: 6360016 - DNA, 20 bp, Homo sapiens
gtctcagaatctttccttcc

SEQ ID NO: 6360017 - DNA, 19 bp, Homo sapiens
gtctcagacttttgtacat

SEQ ID NO: 6360018 - DNA, 20 bp, Homo sapiens
gtctcagacttttgtacatc

SEQ ID NO: 6360019 - DNA, 16 bp, Homo sapiens
gtctcagagaccagca

SEQ ID NO: 6360020 - DNA, 16 bp, Homo sapiens
gtctcagagagttaat

SEQ ID NO: 6360021 - DNA, 14 bp, Homo sapiens
gtctcagagcacag

SEQ ID NO: 6360022 - DNA, 13 bp, Homo sapiens
gtctcagagcctt

SEQ ID NO: 6360023 - DNA, 13 bp, Homo sapiens
gtctcagatttta

SEQ ID NO: 6360024 - DNA, 15 bp, Homo sapiens
gtctcagattttatt

SEQ ID NO: 6360025 - DNA, 17 bp, Homo sapiens
gtctcagattttattat

SEQ ID NO: 6360026 - DNA, 21 bp, Homo sapiens
gtctcagattttattatgtaa

SEQ ID NO: 6360027 - DNA, 20 bp, Homo sapiens
gtctcagcaaattcttgaat

SEQ ID NO: 6360028 - DNA, 21 bp, Homo sapiens
gtctcagcagcgaccacccct

SEQ ID NO: 6360029 - DNA, 22 bp, Homo sapiens
gtctcagcatgtagggcttctg

SEQ ID NO: 6360030 - DNA, 16 bp, Homo sapiens
gtctcagcccgggaca

SEQ ID NO: 6360031 - DNA, 15 bp, Homo sapiens
gtctcagcctctgcc

SEQ ID NO: 6360032 - DNA, 11 bp, Homo sapiens
gtctcagcctg

SEQ ID NO: 6360033 - DNA, 23 bp, Homo sapiens
gtctcagcctgggcccctcagcc

SEQ ID NO: 6360034 - DNA, 22 bp, Homo sapiens
gtctcagctgctgacacgcagc

SEQ ID NO: 6360035 - DNA, 15 bp, Homo sapiens
gtctcaggaaaacag

SEQ ID NO: 6360036 - DNA, 15 bp, Homo sapiens
gtctcaggacctagg

SEQ ID NO: 6360037 - DNA, 12 bp, Homo sapiens
gtctcaggagca

SEQ ID NO: 6360038 - DNA, 23 bp, Homo sapiens
gtctcaggagcaccctgtcttct

SEQ ID NO: 6360039 - DNA, 16 bp, Homo sapiens
gtctcaggagcatggg

SEQ ID NO: 6360040 - DNA, 16 bp, Homo sapiens
gtctcaggaggaggct

SEQ ID NO: 6360041 - DNA, 19 bp, Homo sapiens
gtctcaggaggaggctgcc

SEQ ID NO: 6360042 - DNA, 17 bp, Homo sapiens
gtctcaggagtctctgg

SEQ ID NO: 6360043 - DNA, 23 bp, Homo sapiens
gtctcaggcagcaccacactggg

SEQ ID NO: 6360044 - DNA, 13 bp, Homo sapiens
gtctcaggcctcc

SEQ ID NO: 6360045 - DNA, 18 bp, Homo sapiens
gtctcaggctggtgggag

SEQ ID NO: 6360046 - DNA, 17 bp, Homo sapiens
gtctcagggtgcagagg

SEQ ID NO: 6360047 - DNA, 14 bp, Homo sapiens
gtctcaggtccagc

SEQ ID NO: 6360048 - DNA, 16 bp, Homo sapiens
gtctcaggtccctgca

SEQ ID NO: 6360049 - DNA, 15 bp, Homo sapiens
gtctcaggttctgtg

SEQ ID NO: 6360050 - DNA, 20 bp, Homo sapiens
gtctcaggtttgttttgtga

SEQ ID NO: 6360051 - DNA, 22 bp, Homo sapiens
gtctcaggtttgttttgtgaat

SEQ ID NO: 6360052 - DNA, 15 bp, Homo sapiens
gtctcagtattttag

SEQ ID NO: 6360053 - DNA, 23 bp, Homo sapiens
gtctcagtccagatgccttcctg

SEQ ID NO: 6360054 - DNA, 15 bp, Homo sapiens
gtctcagtgaagact

SEQ ID NO: 6360055 - DNA, 19 bp, Homo sapiens
gtctcagtgccccttaaat

SEQ ID NO: 6360056 - DNA, 24 bp, Homo sapiens
gtctcagttcgtgtttgattccat

SEQ ID NO: 6360057 - DNA, 15 bp, Homo sapiens
gtctcagttggaaat

SEQ ID NO: 6360058 - DNA, 18 bp, Homo sapiens
gtctcataggttaaaaaa

SEQ ID NO: 6360059 - DNA, 12 bp, Homo sapiens
gtctcatatatt

SEQ ID NO: 6360060 - DNA, 11 bp, Homo sapiens
gtctcatccca

SEQ ID NO: 6360061 - DNA, 15 bp, Homo sapiens
gtctcatcctcccat

SEQ ID NO: 6360062 - DNA, 21 bp, Homo sapiens
gtctcatcctcccattgccca

SEQ ID NO: 6360063 - DNA, 14 bp, Homo sapiens
gtctcatcctcctg

SEQ ID NO: 6360064 - DNA, 19 bp, Homo sapiens
gtctcatcctcctttcagt

SEQ ID NO: 6360065 - DNA, 14 bp, Homo sapiens
gtctcatctcctga

SEQ ID NO: 6360066 - DNA, 17 bp, Homo sapiens
gtctcatctcctgaccc

SEQ ID NO: 6360067 - DNA, 22 bp, Homo sapiens
gtctcatctcctgaccctccca

SEQ ID NO: 6360068 - DNA, 15 bp, Homo sapiens
gtctcatctggggag

SEQ ID NO: 6360069 - DNA, 22 bp, Homo sapiens
gtctcatctggggagcaggcag

SEQ ID NO: 6360070 - DNA, 19 bp, Homo sapiens
gtctcatgatgtaaaaaat

SEQ ID NO: 6360071 - DNA, 14 bp, Homo sapiens
gtctcatgccagca

SEQ ID NO: 6360072 - DNA, 23 bp, Homo sapiens
gtctcatgccagtaacaggctca

SEQ ID NO: 6360073 - DNA, 23 bp, Homo sapiens
gtctcatgcccactcccccagga

SEQ ID NO: 6360074 - DNA, 13 bp, Homo sapiens
gtctcatgcctga

SEQ ID NO: 6360075 - DNA, 16 bp, Homo sapiens
gtctcatgcctgagaa

SEQ ID NO: 6360076 - DNA, 16 bp, Homo sapiens
gtctcatgctgttgct

SEQ ID NO: 6360077 - DNA, 19 bp, Homo sapiens
gtctcatggtatgtaactc

SEQ ID NO: 6360078 - DNA, 16 bp, Homo sapiens
gtctcatgtaaaataa

SEQ ID NO: 6360079 - DNA, 19 bp, Homo sapiens
gtctcatgtaatttgcatt

SEQ ID NO: 6360080 - DNA, 18 bp, Homo sapiens
gtctcatgtcctgctggc

SEQ ID NO: 6360081 - DNA, 16 bp, Homo sapiens
taatgacatgcctata

SEQ ID NO: 6360082 - DNA, 19 bp, Homo sapiens
taatgaccaacctgtttct

SEQ ID NO: 6360083 - DNA, 18 bp, Homo sapiens
taatgaccatgaaagact

SEQ ID NO: 6360084 - DNA, 13 bp, Homo sapiens
taatgaccatgtt

SEQ ID NO: 6360085 - DNA, 17 bp, Homo sapiens
taatgaccatgttatat

SEQ ID NO: 6360086 - DNA, 21 bp, Homo sapiens
taatgacccagatatggaaac

SEQ ID NO: 6360087 - DNA, 14 bp, Homo sapiens
taatgacctgaatt

SEQ ID NO: 6360088 - DNA, 17 bp, Homo sapiens
taatgacctgaattgaa

SEQ ID NO: 6360089 - DNA, 16 bp, Homo sapiens
taatgacgtattgtga

SEQ ID NO: 6360090 - DNA, 21 bp, Homo sapiens
taatgacgtattgtgaaattt

SEQ ID NO: 6360091 - DNA, 16 bp, Homo sapiens
taatgactctaaagaa

SEQ ID NO: 6360092 - DNA, 15 bp, Homo sapiens
taatgactgagattt

SEQ ID NO: 6360093 - DNA, 24 bp, Homo sapiens
taatgacttgtacaaacagtattt

SEQ ID NO: 6360094 - DNA, 16 bp, Homo sapiens
taatgactttatgtat

SEQ ID NO: 6360095 - DNA, 14 bp, Homo sapiens
taatgactttttat

SEQ ID NO: 6360096 - DNA, 18 bp, Homo sapiens
taatgactttttataatg

SEQ ID NO: 6360097 - DNA, 19 bp, Homo sapiens
taatgactttttataatgt

SEQ ID NO: 6360098 - DNA, 13 bp, Homo sapiens
taatgagaataga

SEQ ID NO: 6360099 - DNA, 18 bp, Homo sapiens
taatgagatatatcttta

SEQ ID NO: 6360100 - DNA, 17 bp, Homo sapiens
taatgagatgtaataca

SEQ ID NO: 6360101 - DNA, 20 bp, Homo sapiens
taatgagatgttattactgt

SEQ ID NO: 6360102 - DNA, 17 bp, Homo sapiens
taatgagcaatatctgc

SEQ ID NO: 6360103 - DNA, 18 bp, Homo sapiens
taatgagcaatatctgct

SEQ ID NO: 6360104 - DNA, 23 bp, Homo sapiens
taatgagccaataaagctcacac

SEQ ID NO: 6360105 - DNA, 18 bp, Homo sapiens
taatgagctagtgtctta

SEQ ID NO: 6360106 - DNA, 18 bp, Homo sapiens
taatgagcttaagaaatt

SEQ ID NO: 6360107 - DNA, 19 bp, Homo sapiens
taatgaggaaaaaatggta

SEQ ID NO: 6360108 - DNA, 13 bp, Homo sapiens
taatgaggaaact

SEQ ID NO: 6360109 - DNA, 23 bp, Homo sapiens
taatgaggagagaaaatatatgt

SEQ ID NO: 6360110 - DNA, 16 bp, Homo sapiens
taatgaggcattacaa

SEQ ID NO: 6360111 - DNA, 20 bp, Homo sapiens
taatgagggaaatctgtaaa

SEQ ID NO: 6360112 - DNA, 15 bp, Homo sapiens
taatgagggactgga

SEQ ID NO: 6360113 - DNA, 21 bp, Homo sapiens
taatgaggtggtactatgatt

SEQ ID NO: 6360114 - DNA, 15 bp, Homo sapiens
taatgagtaatgcag

SEQ ID NO: 6360115 - DNA, 23 bp, Homo sapiens
taatgagtaatgcagacatttac

SEQ ID NO: 6360116 - DNA, 22 bp, Homo sapiens
taatgagtatatgtaacagttt

SEQ ID NO: 6360117 - DNA, 23 bp, Homo sapiens
taatgagtatatgtaacagttta

SEQ ID NO: 6360118 - DNA, 15 bp, Homo sapiens
taatgagtatttggt

SEQ ID NO: 6360119 - DNA, 18 bp, Homo sapiens
taatgagtcacaaaataa

SEQ ID NO: 6360120 - DNA, 24 bp, Homo sapiens
taatgagtgcacctgcctccacca

SEQ ID NO: 6360121 - DNA, 21 bp, Homo sapiens
taatgagttgctggaaaatca

SEQ ID NO: 6360122 - DNA, 13 bp, Homo sapiens
taatgagtttaaa

SEQ ID NO: 6360123 - DNA, 17 bp, Homo sapiens
taatgagttttacatta

SEQ ID NO: 6360124 - DNA, 15 bp, Homo sapiens
taatgataaaataaa

SEQ ID NO: 6360125 - DNA, 21 bp, Homo sapiens
taatgataaaataaataattt

SEQ ID NO: 6360126 - DNA, 18 bp, Homo sapiens
taatgataaactcagatc

SEQ ID NO: 6360127 - DNA, 16 bp, Homo sapiens
taatgataactaaaat

SEQ ID NO: 6360128 - DNA, 17 bp, Homo sapiens
taatgataactggaaac

SEQ ID NO: 6360129 - DNA, 22 bp, Homo sapiens
taatgataactggaaacttcag

SEQ ID NO: 6360130 - DNA, 18 bp, Homo sapiens
taatgatactgattatga

SEQ ID NO: 6360131 - DNA, 22 bp, Homo sapiens
taatgatactgattatgaaatg

SEQ ID NO: 6360132 - DNA, 23 bp, Homo sapiens
taatgatactgattatgaaatgt

SEQ ID NO: 6360133 - DNA, 24 bp, Homo sapiens
taatgatactgtctaagaataatg

SEQ ID NO: 6360134 - DNA, 17 bp, Homo sapiens
taatgatcaaaacatgc

SEQ ID NO: 6360135 - DNA, 20 bp, Homo sapiens
taatgatctcggatgaccaa

SEQ ID NO: 6360136 - DNA, 15 bp, Homo sapiens
taatgatcttccaaa

SEQ ID NO: 6360137 - DNA, 16 bp, Homo sapiens
taatgatcttccaaat

SEQ ID NO: 6360138 - DNA, 19 bp, Homo sapiens
taatgatcttccaaatatt

SEQ ID NO: 6360139 - DNA, 19 bp, Homo sapiens
taatgatgagcatttagca

SEQ ID NO: 6360140 - DNA, 15 bp, Homo sapiens
taatgatgcttcagt

SEQ ID NO: 6360141 - DNA, 22 bp, Homo sapiens
taatgatggatttaacagcatg

SEQ ID NO: 6360142 - DNA, 13 bp, Homo sapiens
taatgatggcaga

SEQ ID NO: 6360143 - DNA, 15 bp, Homo sapiens
taatgatggcagagg

SEQ ID NO: 6360144 - DNA, 22 bp, Homo sapiens
taatgatggcccattctacttg

SEQ ID NO: 6360145 - DNA, 18 bp, Homo sapiens
taatgatgtaacagtgca

SEQ ID NO: 6360146 - DNA, 22 bp, Homo sapiens
taatgatgttatcttaacactg

SEQ ID NO: 6360147 - DNA, 17 bp, Homo sapiens
taatgatgttgataatt

SEQ ID NO: 6360148 - DNA, 18 bp, Homo sapiens
taatgattatataaaata

SEQ ID NO: 6360149 - DNA, 23 bp, Homo sapiens
taatgattcaaatgttttaaagt

SEQ ID NO: 6360150 - DNA, 14 bp, Homo sapiens
taatgattcaatgt

SEQ ID NO: 6360151 - DNA, 13 bp, Homo sapiens
taatgattctgaa

SEQ ID NO: 6360152 - DNA, 17 bp, Homo sapiens
taatgattcttgtgtca

SEQ ID NO: 6360153 - DNA, 12 bp, Homo sapiens
taatgattgttt

SEQ ID NO: 6360154 - DNA, 12 bp, Homo sapiens
taatgatttctt

SEQ ID NO: 6360155 - DNA, 20 bp, Homo sapiens
taatgcaaatgaaggaatgc

SEQ ID NO: 6360156 - DNA, 13 bp, Homo sapiens
taatgcaaattaa

SEQ ID NO: 6360157 - DNA, 18 bp, Homo sapiens
taatgcaaattaaaacat

SEQ ID NO: 6360158 - DNA, 21 bp, Homo sapiens
taatgcaagagaacattttac

SEQ ID NO: 6360159 - DNA, 23 bp, Homo sapiens
taatgcaagcaaagtatcaaaga

SEQ ID NO: 6360160 - DNA, 18 bp, Homo sapiens
taatgcaatagaagtgct

SEQ ID NO: 6360161 - DNA, 19 bp, Homo sapiens
taatgcaatgcatatctgt

SEQ ID NO: 6360162 - DNA, 13 bp, Homo sapiens
taatgcacaattt

SEQ ID NO: 6360163 - DNA, 17 bp, Homo sapiens
taatgcacaatttagaa

SEQ ID NO: 6360164 - DNA, 20 bp, Homo sapiens
taatgcacaatttagaaaac

SEQ ID NO: 6360165 - DNA, 19 bp, Homo sapiens
taatgcacatcctcattca

SEQ ID NO: 6360166 - DNA, 23 bp, Homo sapiens
taatgcacgacattgattgctgc

SEQ ID NO: 6360167 - DNA, 10 bp, Homo sapiens
taatgcactg

SEQ ID NO: 6360168 - DNA, 22 bp, Homo sapiens
taatgcactgagtatgcaatgc

SEQ ID NO: 6360169 - DNA, 19 bp, Homo sapiens
taatgcactggggtaccac

SEQ ID NO: 6360170 - DNA, 12 bp, Homo sapiens
taatgcactttc

SEQ ID NO: 6360171 - DNA, 13 bp, Homo sapiens
taatgcagaattg

SEQ ID NO: 6360172 - DNA, 16 bp, Homo sapiens
taatgcagaattgcta

SEQ ID NO: 6360173 - DNA, 21 bp, Homo sapiens
taatgcagacatttacatgtt

SEQ ID NO: 6360174 - DNA, 21 bp, Homo sapiens
taatgcagataaatacattta

SEQ ID NO: 6360175 - DNA, 21 bp, Homo sapiens
taatgcagcggtgtggaccga

SEQ ID NO: 6360176 - DNA, 16 bp, Homo sapiens
taatgcagtatggtac

SEQ ID NO: 6360177 - DNA, 22 bp, Homo sapiens
taatgcagttgtggtgtgccat

SEQ ID NO: 6360178 - DNA, 18 bp, Homo sapiens
taatgcagtttttaaaaa

SEQ ID NO: 6360179 - DNA, 20 bp, Homo sapiens
taatgcagtttttaaaaacc

SEQ ID NO: 6360180 - DNA, 17 bp, Homo sapiens
taatgcatatttataag

SEQ ID NO: 6360181 - DNA, 19 bp, Homo sapiens
taatgcatgtggtatgagt

SEQ ID NO: 6360182 - DNA, 16 bp, Homo sapiens
taatgcatgttaggaa

SEQ ID NO: 6360183 - DNA, 17 bp, Homo sapiens
taatgcattaaacctgt

SEQ ID NO: 6360184 - DNA, 22 bp, Homo sapiens
taatgcattaaacctgtctcca

SEQ ID NO: 6360185 - DNA, 16 bp, Homo sapiens
taatgcattaactttt

SEQ ID NO: 6360186 - DNA, 22 bp, Homo sapiens
taatgcattattttgtcataaa

SEQ ID NO: 6360187 - DNA, 13 bp, Homo sapiens
taatgcattcaaa

SEQ ID NO: 6360188 - DNA, 14 bp, Homo sapiens
taatgcattgcctg

SEQ ID NO: 6360189 - DNA, 16 bp, Homo sapiens
taatgcattgttgtaa

SEQ ID NO: 6360190 - DNA, 21 bp, Homo sapiens
taatgcattgttgtaaagtat

SEQ ID NO: 6360191 - DNA, 20 bp, Homo sapiens
taatgcattttgcactagaa

SEQ ID NO: 6360192 - DNA, 21 bp, Homo sapiens
taatgcattttgcactagaac

SEQ ID NO: 6360193 - DNA, 20 bp, Homo sapiens
taatgccaagggtaaacaag

SEQ ID NO: 6360194 - DNA, 16 bp, Homo sapiens
taatgccaatgaacat

SEQ ID NO: 6360195 - DNA, 22 bp, Homo sapiens
taatgccacggcagccaccctg

SEQ ID NO: 6360196 - DNA, 13 bp, Homo sapiens
taatgccagggcc

SEQ ID NO: 6360197 - DNA, 19 bp, Homo sapiens
taatgcccagacatttttt

SEQ ID NO: 6360198 - DNA, 22 bp, Homo sapiens
taatgcccagccagccacccct

SEQ ID NO: 6360199 - DNA, 15 bp, Homo sapiens
taatgccccaaggac

SEQ ID NO: 6360200 - DNA, 22 bp, Homo sapiens
taatgccccaaggacaaggggc

SEQ ID NO: 6360201 - DNA, 15 bp, Homo sapiens
taatgccctatgtgt

SEQ ID NO: 6360202 - DNA, 16 bp, Homo sapiens
taatgccctatgtgta

SEQ ID NO: 6360203 - DNA, 22 bp, Homo sapiens
taatgccggtgagaataagaga

SEQ ID NO: 6360204 - DNA, 17 bp, Homo sapiens
taatgcctaccttgtga

SEQ ID NO: 6360205 - DNA, 18 bp, Homo sapiens
taatgcctataacttttt

SEQ ID NO: 6360206 - DNA, 16 bp, Homo sapiens
taatgcctctcccgca

SEQ ID NO: 6360207 - DNA, 17 bp, Homo sapiens
taatgcctctcccgcac

SEQ ID NO: 6360208 - DNA, 20 bp, Homo sapiens
taatgcctgctttttggaaa

SEQ ID NO: 6360209 - DNA, 21 bp, Homo sapiens
taatgccttactcttcttgaa

SEQ ID NO: 6360210 - DNA, 14 bp, Homo sapiens
taatgcctttttgg

SEQ ID NO: 6360211 - DNA, 21 bp, Homo sapiens
taatgctaaatgtaagaatca

SEQ ID NO: 6360212 - DNA, 18 bp, Homo sapiens
taatgctaaatgtgtaat

SEQ ID NO: 6360213 - DNA, 14 bp, Homo sapiens
taatgctaagaaat

SEQ ID NO: 6360214 - DNA, 17 bp, Homo sapiens
taatgctaatcttgtga

SEQ ID NO: 6360215 - DNA, 14 bp, Homo sapiens
taatgctacaattt

SEQ ID NO: 6360216 - DNA, 20 bp, Homo sapiens
taatgctaccaggatgctaa

SEQ ID NO: 6360217 - DNA, 22 bp, Homo sapiens
taatgctacgtgtgatttttct

SEQ ID NO: 6360218 - DNA, 18 bp, Homo sapiens
taatgctccttgttccta

SEQ ID NO: 6360219 - DNA, 24 bp, Homo sapiens
taatgctgcaaacttaatgttctt

SEQ ID NO: 6360220 - DNA, 23 bp, Homo sapiens
taatgctgcacaccagttactgt

SEQ ID NO: 6360221 - DNA, 13 bp, Homo sapiens
taatgctggagcg

SEQ ID NO: 6360222 - DNA, 16 bp, Homo sapiens
taatgctggcctgact

SEQ ID NO: 6360223 - DNA, 18 bp, Homo sapiens
taatgctggcctgactgg

SEQ ID NO: 6360224 - DNA, 17 bp, Homo sapiens
taatgctgtctttgtgg

SEQ ID NO: 6360225 - DNA, 14 bp, Homo sapiens
taatgctgttgcct

SEQ ID NO: 6360226 - DNA, 20 bp, Homo sapiens
taatgctgtttctaagaaaa

SEQ ID NO: 6360227 - DNA, 20 bp, Homo sapiens
taatgcttcattcaatattg

SEQ ID NO: 6360228 - DNA, 14 bp, Homo sapiens
taatgcttccaatc

SEQ ID NO: 6360229 - DNA, 17 bp, Homo sapiens
taatgcttccaatcttg

SEQ ID NO: 6360230 - DNA, 20 bp, Homo sapiens
taatgcttccaatcttgctt

SEQ ID NO: 6360231 - DNA, 22 bp, Homo sapiens
taatgcttccaatcttgctttg

SEQ ID NO: 6360232 - DNA, 16 bp, Homo sapiens
taatgcttgaatatta

SEQ ID NO: 6360233 - DNA, 17 bp, Homo sapiens
taatgctttcacaacat

SEQ ID NO: 6360234 - DNA, 13 bp, Homo sapiens
taatgctttctga

SEQ ID NO: 6360235 - DNA, 16 bp, Homo sapiens
taatgctttggaaaaa

SEQ ID NO: 6360236 - DNA, 14 bp, Homo sapiens
taatgcttttatat

SEQ ID NO: 6360237 - DNA, 14 bp, Homo sapiens
taatgcttttctaa

SEQ ID NO: 6360238 - DNA, 15 bp, Homo sapiens
taatggaaaaatagt

SEQ ID NO: 6360239 - DNA, 15 bp, Homo sapiens
taatggaaaactgtt

SEQ ID NO: 6360240 - DNA, 16 bp, Homo sapiens
taatggaaaactgtta

SEQ ID NO: 6360241 - DNA, 12 bp, Homo sapiens
taatggaaacat

SEQ ID NO: 6360242 - DNA, 17 bp, Homo sapiens
taatggaaaccaagcca

SEQ ID NO: 6360243 - DNA, 20 bp, Homo sapiens
taatggaaagcagcagcttg

SEQ ID NO: 6360244 - DNA, 19 bp, Homo sapiens
taatggaactgaccccctc

SEQ ID NO: 6360245 - DNA, 15 bp, Homo sapiens
taatggaattatgta

SEQ ID NO: 6360246 - DNA, 16 bp, Homo sapiens
taatggactcagctct

SEQ ID NO: 6360247 - DNA, 23 bp, Homo sapiens
taatggactcttaaggcattgag

SEQ ID NO: 6360248 - DNA, 20 bp, Homo sapiens
taatggactgtgaatttcaa

SEQ ID NO: 6360249 - DNA, 23 bp, Homo sapiens
taatggactgtgaatttcaaaaa

SEQ ID NO: 6360250 - DNA, 19 bp, Homo sapiens
taatggagaattaaaactt

SEQ ID NO: 6360251 - DNA, 18 bp, Homo sapiens
taatggaggtcccagccc

SEQ ID NO: 6360252 - DNA, 21 bp, Homo sapiens
taatggaggtcccagccctgg

SEQ ID NO: 6360253 - DNA, 23 bp, Homo sapiens
taatggaggtcccagccctgggg

SEQ ID NO: 6360254 - DNA, 20 bp, Homo sapiens
taatggagtgtttgaaaact

SEQ ID NO: 6360255 - DNA, 15 bp, Homo sapiens
taatggatatttctc

SEQ ID NO: 6360256 - DNA, 21 bp, Homo sapiens
taatggatcatagaattgcag

SEQ ID NO: 6360257 - DNA, 14 bp, Homo sapiens
gtctcatgtctccc

SEQ ID NO: 6360258 - DNA, 18 bp, Homo sapiens
gtctcattcgcctttgtc

SEQ ID NO: 6360259 - DNA, 20 bp, Homo sapiens
gtctcattcgcctttgtctt

SEQ ID NO: 6360260 - DNA, 11 bp, Homo sapiens
gtctcattctg

SEQ ID NO: 6360261 - DNA, 14 bp, Homo sapiens
gtctcattgccagt

SEQ ID NO: 6360262 - DNA, 17 bp, Homo sapiens
gtctcattgtcacctct

SEQ ID NO: 6360263 - DNA, 10 bp, Homo sapiens
gtctcatttt

SEQ ID NO: 6360264 - DNA, 16 bp, Homo sapiens
gtctcattttgtatgt

SEQ ID NO: 6360265 - DNA, 17 bp, Homo sapiens
gtctcattttgtatgta

SEQ ID NO: 6360266 - DNA, 19 bp, Homo sapiens
gtctcattttgtatgtatg

SEQ ID NO: 6360267 - DNA, 22 bp, Homo sapiens
gtctcattttgtatgtatgtgt

SEQ ID NO: 6360268 - DNA, 23 bp, Homo sapiens
gtctcattttgtatgtatgtgta

SEQ ID NO: 6360269 - DNA, 22 bp, Homo sapiens
gtctccaagtagtccaccttca

SEQ ID NO: 6360270 - DNA, 11 bp, Homo sapiens
gtctccacatc

SEQ ID NO: 6360271 - DNA, 20 bp, Homo sapiens
gtctccaccaggaacctctt

SEQ ID NO: 6360272 - DNA, 13 bp, Homo sapiens
gtctccacccctc

SEQ ID NO: 6360273 - DNA, 20 bp, Homo sapiens
gtctccacctacacccctgt

SEQ ID NO: 6360274 - DNA, 23 bp, Homo sapiens
gtctccacctacacccctgtgct

SEQ ID NO: 6360275 - DNA, 19 bp, Homo sapiens
gtctccacctcaggggaga

SEQ ID NO: 6360276 - DNA, 15 bp, Homo sapiens
gtctccacctgcaca

SEQ ID NO: 6360277 - DNA, 14 bp, Homo sapiens
gtctccacctgtgc

SEQ ID NO: 6360278 - DNA, 18 bp, Homo sapiens
gtctccacctgtgcttgg

SEQ ID NO: 6360279 - DNA, 23 bp, Homo sapiens
gtctccactaaatgagctcctgc

SEQ ID NO: 6360280 - DNA, 12 bp, Homo sapiens
gtctccactgtg

SEQ ID NO: 6360281 - DNA, 14 bp, Homo sapiens
gtctccacttgtat

SEQ ID NO: 6360282 - DNA, 13 bp, Homo sapiens
gtctccagaaagc

SEQ ID NO: 6360283 - DNA, 20 bp, Homo sapiens
gtctccagaaagccccaccc

SEQ ID NO: 6360284 - DNA, 23 bp, Homo sapiens
gtctccagaaagccccacccagg

SEQ ID NO: 6360285 - DNA, 17 bp, Homo sapiens
gtctccagacccccacc

SEQ ID NO: 6360286 - DNA, 20 bp, Homo sapiens
gtctccagacccccacccct

SEQ ID NO: 6360287 - DNA, 22 bp, Homo sapiens
gtctccagccccttctcagaat

SEQ ID NO: 6360288 - DNA, 10 bp, Homo sapiens
gtctccagct

SEQ ID NO: 6360289 - DNA, 12 bp, Homo sapiens
gtctccagctcc

SEQ ID NO: 6360290 - DNA, 20 bp, Homo sapiens
gtctccagggacccttgcct

SEQ ID NO: 6360291 - DNA, 17 bp, Homo sapiens
gtctccagggcccccca

SEQ ID NO: 6360292 - DNA, 18 bp, Homo sapiens
gtctccaggggcctgcag

SEQ ID NO: 6360293 - DNA, 21 bp, Homo sapiens
gtctccagtatccactttgca

SEQ ID NO: 6360294 - DNA, 18 bp, Homo sapiens
gtctccagtggttgctgt

SEQ ID NO: 6360295 - DNA, 19 bp, Homo sapiens
gtctccagtggttgctgtt

SEQ ID NO: 6360296 - DNA, 20 bp, Homo sapiens
gtctccagtggttgctgttg

SEQ ID NO: 6360297 - DNA, 22 bp, Homo sapiens
gtctccagttggttatctgaat

SEQ ID NO: 6360298 - DNA, 20 bp, Homo sapiens
gtctccatatcagctctctg

SEQ ID NO: 6360299 - DNA, 23 bp, Homo sapiens
gtctccatcgtctcatcctcctt

SEQ ID NO: 6360300 - DNA, 16 bp, Homo sapiens
gtctccatctctggtt

SEQ ID NO: 6360301 - DNA, 23 bp, Homo sapiens
gtctccatgaagagcttgtgtcc

SEQ ID NO: 6360302 - DNA, 22 bp, Homo sapiens
gtctccatgaggtactggtccc

SEQ ID NO: 6360303 - DNA, 14 bp, Homo sapiens
gtctccatgataac

SEQ ID NO: 6360304 - DNA, 14 bp, Homo sapiens
gtctccatggccct

SEQ ID NO: 6360305 - DNA, 22 bp, Homo sapiens
gtctccatgtgtgtgccaagcc

SEQ ID NO: 6360306 - DNA, 17 bp, Homo sapiens
gtctccattgtgtgatc

SEQ ID NO: 6360307 - DNA, 22 bp, Homo sapiens
gtctccattttcttctctgtga

SEQ ID NO: 6360308 - DNA, 18 bp, Homo sapiens
gtctccatttttcccagg

SEQ ID NO: 6360309 - DNA, 19 bp, Homo sapiens
gtctccatttttcccagga

SEQ ID NO: 6360310 - DNA, 18 bp, Homo sapiens
gtctcccaaagtgctggg

SEQ ID NO: 6360311 - DNA, 19 bp, Homo sapiens
gtctcccaaagtgctggga

SEQ ID NO: 6360312 - DNA, 11 bp, Homo sapiens
gtctcccaaca

SEQ ID NO: 6360313 - DNA, 17 bp, Homo sapiens
gtctcccacacccaccc

SEQ ID NO: 6360314 - DNA, 18 bp, Homo sapiens
gtctcccacacccaccct

SEQ ID NO: 6360315 - DNA, 19 bp, Homo sapiens
gtctcccacacccaccctt

SEQ ID NO: 6360316 - DNA, 22 bp, Homo sapiens
gtctcccactgcaacttgtgaa

SEQ ID NO: 6360317 - DNA, 23 bp, Homo sapiens
gtctcccactgcaacttgtgaac

SEQ ID NO: 6360318 - DNA, 17 bp, Homo sapiens
gtctcccaggccccctg

SEQ ID NO: 6360319 - DNA, 19 bp, Homo sapiens
gtctcccaggccccctgca

SEQ ID NO: 6360320 - DNA, 13 bp, Homo sapiens
gtctcccaggctg

SEQ ID NO: 6360321 - DNA, 16 bp, Homo sapiens
gtctcccaggctgctg

SEQ ID NO: 6360322 - DNA, 20 bp, Homo sapiens
gtctcccaggctggagtgca

SEQ ID NO: 6360323 - DNA, 18 bp, Homo sapiens
gtctcccaggtgcatttc

SEQ ID NO: 6360324 - DNA, 19 bp, Homo sapiens
gtctcccaggtgcatttct

SEQ ID NO: 6360325 - DNA, 12 bp, Homo sapiens
gtctcccagtcg

SEQ ID NO: 6360326 - DNA, 19 bp, Homo sapiens
gtctcccatatgcagaaat

SEQ ID NO: 6360327 - DNA, 15 bp, Homo sapiens
gtctcccatcctgat

SEQ ID NO: 6360328 - DNA, 21 bp, Homo sapiens
gtctcccatcctgatcccaga

SEQ ID NO: 6360329 - DNA, 12 bp, Homo sapiens
gtctcccattct

SEQ ID NO: 6360330 - DNA, 19 bp, Homo sapiens
gtctccccaattctcccct

SEQ ID NO: 6360331 - DNA, 13 bp, Homo sapiens
gtctccccactcc

SEQ ID NO: 6360332 - DNA, 21 bp, Homo sapiens
gtctccccagaagacacagga

SEQ ID NO: 6360333 - DNA, 18 bp, Homo sapiens
gtctccccagttccacag

SEQ ID NO: 6360334 - DNA, 20 bp, Homo sapiens
gtctccccatgctgggctca

SEQ ID NO: 6360335 - DNA, 18 bp, Homo sapiens
gtctcccccaacagctgg

SEQ ID NO: 6360336 - DNA, 15 bp, Homo sapiens
gtctccccgcagccc

SEQ ID NO: 6360337 - DNA, 21 bp, Homo sapiens
gtctccccgcagccctctcca

SEQ ID NO: 6360338 - DNA, 15 bp, Homo sapiens
gtctcccctcctgca

SEQ ID NO: 6360339 - DNA, 11 bp, Homo sapiens
gtctcccctcg

SEQ ID NO: 6360340 - DNA, 14 bp, Homo sapiens
gtctcccctctgct

SEQ ID NO: 6360341 - DNA, 17 bp, Homo sapiens
gtctcccctgatccaga

SEQ ID NO: 6360342 - DNA, 23 bp, Homo sapiens
gtctcccctgttcccctctccct

SEQ ID NO: 6360343 - DNA, 18 bp, Homo sapiens
gtctccccttctctgcct

SEQ ID NO: 6360344 - DNA, 19 bp, Homo sapiens
gtctccccttctctgcctc

SEQ ID NO: 6360345 - DNA, 23 bp, Homo sapiens
gtctcccgcttggggcatttgtg

SEQ ID NO: 6360346 - DNA, 16 bp, Homo sapiens
gtctccctaaaataaa

SEQ ID NO: 6360347 - DNA, 23 bp, Homo sapiens
gtctccctaaaataaaaaccaga

SEQ ID NO: 6360348 - DNA, 19 bp, Homo sapiens
gtctccctccgactccaga

SEQ ID NO: 6360349 - DNA, 20 bp, Homo sapiens
gtctccctctcctgcctact

SEQ ID NO: 6360350 - DNA, 21 bp, Homo sapiens
gtctccctctcctgcctactc

SEQ ID NO: 6360351 - DNA, 12 bp, Homo sapiens
gtctccctgagc

SEQ ID NO: 6360352 - DNA, 16 bp, Homo sapiens
gtctccctgagcctgc

SEQ ID NO: 6360353 - DNA, 19 bp, Homo sapiens
gtctccctgatggaccctc

SEQ ID NO: 6360354 - DNA, 16 bp, Homo sapiens
gtctccctggagtgca

SEQ ID NO: 6360355 - DNA, 12 bp, Homo sapiens
gtctccctggcc

SEQ ID NO: 6360356 - DNA, 14 bp, Homo sapiens
gtctccctggccac

SEQ ID NO: 6360357 - DNA, 15 bp, Homo sapiens
gtctccctggcccca

SEQ ID NO: 6360358 - DNA, 16 bp, Homo sapiens
gtctccctggccccag

SEQ ID NO: 6360359 - DNA, 18 bp, Homo sapiens
gtctccctggccctcaag

SEQ ID NO: 6360360 - DNA, 21 bp, Homo sapiens
gtctccctggcctcagggctc

SEQ ID NO: 6360361 - DNA, 13 bp, Homo sapiens
gtctccctgggag

SEQ ID NO: 6360362 - DNA, 19 bp, Homo sapiens
gtctccctgggcaccctgc

SEQ ID NO: 6360363 - DNA, 22 bp, Homo sapiens
gtctccctgggcaccctgcagg

SEQ ID NO: 6360364 - DNA, 13 bp, Homo sapiens
gtctccctgtgtt

SEQ ID NO: 6360365 - DNA, 14 bp, Homo sapiens
gtctccctgtgtta

SEQ ID NO: 6360366 - DNA, 13 bp, Homo sapiens
gtctcccttctct

SEQ ID NO: 6360367 - DNA, 19 bp, Homo sapiens
gtctcccttggccacggcc

SEQ ID NO: 6360368 - DNA, 14 bp, Homo sapiens
gtctcccttttata

SEQ ID NO: 6360369 - DNA, 18 bp, Homo sapiens
gtctccgaaatgctgtct

SEQ ID NO: 6360370 - DNA, 20 bp, Homo sapiens
gtctccgaaatgctgtcttt

SEQ ID NO: 6360371 - DNA, 23 bp, Homo sapiens
gtctccgaagaaaagatatgtat

SEQ ID NO: 6360372 - DNA, 13 bp, Homo sapiens
gtctccgagagag

SEQ ID NO: 6360373 - DNA, 15 bp, Homo sapiens
gtctccgctcccgca

SEQ ID NO: 6360374 - DNA, 21 bp, Homo sapiens
gtctccgctcccgcagcgggc

SEQ ID NO: 6360375 - DNA, 19 bp, Homo sapiens
gtctccggcctctccagcc

SEQ ID NO: 6360376 - DNA, 17 bp, Homo sapiens
gtctcctaaaactggga

SEQ ID NO: 6360377 - DNA, 16 bp, Homo sapiens
gtctcctactttgaaa

SEQ ID NO: 6360378 - DNA, 14 bp, Homo sapiens
gtctcctatcctgg

SEQ ID NO: 6360379 - DNA, 20 bp, Homo sapiens
gtctcctcaacccacatggg

SEQ ID NO: 6360380 - DNA, 16 bp, Homo sapiens
gtctcctcaagcctgt

SEQ ID NO: 6360381 - DNA, 18 bp, Homo sapiens
gtctcctcaagcctgtgg

SEQ ID NO: 6360382 - DNA, 14 bp, Homo sapiens
gtctcctcactccc

SEQ ID NO: 6360383 - DNA, 19 bp, Homo sapiens
gtctcctcactctgtccct

SEQ ID NO: 6360384 - DNA, 17 bp, Homo sapiens
gtctcctcactgccact

SEQ ID NO: 6360385 - DNA, 14 bp, Homo sapiens
gtctcctcaggacc

SEQ ID NO: 6360386 - DNA, 13 bp, Homo sapiens
gtctcctcagggt

SEQ ID NO: 6360387 - DNA, 12 bp, Homo sapiens
gtctcctccacc

SEQ ID NO: 6360388 - DNA, 21 bp, Homo sapiens
gtctcctccaccgccatggct

SEQ ID NO: 6360389 - DNA, 23 bp, Homo sapiens
gtctcctcccagcggcctccggc

SEQ ID NO: 6360390 - DNA, 13 bp, Homo sapiens
gtctcctcccagg

SEQ ID NO: 6360391 - DNA, 12 bp, Homo sapiens
gtctcctcccct

SEQ ID NO: 6360392 - DNA, 20 bp, Homo sapiens
gtctcctcccctactctgcc

SEQ ID NO: 6360393 - DNA, 12 bp, Homo sapiens
gtctcctccctc

SEQ ID NO: 6360394 - DNA, 15 bp, Homo sapiens
gtctcctccctcagc

SEQ ID NO: 6360395 - DNA, 16 bp, Homo sapiens
gtctcctccctgggct

SEQ ID NO: 6360396 - DNA, 17 bp, Homo sapiens
gtctcctccctgggcta

SEQ ID NO: 6360397 - DNA, 20 bp, Homo sapiens
gtctcctcctcgaagccatg

SEQ ID NO: 6360398 - DNA, 15 bp, Homo sapiens
gtctcctctcagccc

SEQ ID NO: 6360399 - DNA, 17 bp, Homo sapiens
gtctcctctcagcttct

SEQ ID NO: 6360400 - DNA, 13 bp, Homo sapiens
gtctcctctccat

SEQ ID NO: 6360401 - DNA, 16 bp, Homo sapiens
gtctcctctctgagac

SEQ ID NO: 6360402 - DNA, 19 bp, Homo sapiens
gtctcctctgattatcagg

SEQ ID NO: 6360403 - DNA, 14 bp, Homo sapiens
gtctcctctgtcag

SEQ ID NO: 6360404 - DNA, 21 bp, Homo sapiens
gtctcctctgtcagtttgtga

SEQ ID NO: 6360405 - DNA, 22 bp, Homo sapiens
gtctcctctgtcagtttgtgaa

SEQ ID NO: 6360406 - DNA, 22 bp, Homo sapiens
gtctcctcttaaaaaataaaaa

SEQ ID NO: 6360407 - DNA, 23 bp, Homo sapiens
gtctcctcttaaaaaataaaaac

SEQ ID NO: 6360408 - DNA, 13 bp, Homo sapiens
gtctcctctttaa

SEQ ID NO: 6360409 - DNA, 18 bp, Homo sapiens
gtctcctctttaaaacaa

SEQ ID NO: 6360410 - DNA, 19 bp, Homo sapiens
gtctcctctttgttttgtt

SEQ ID NO: 6360411 - DNA, 12 bp, Homo sapiens
gtctcctgacat

SEQ ID NO: 6360412 - DNA, 15 bp, Homo sapiens
gtctcctgcccactc

SEQ ID NO: 6360413 - DNA, 15 bp, Homo sapiens
gtctcctgcccccac

SEQ ID NO: 6360414 - DNA, 11 bp, Homo sapiens
gtctcctgccg

SEQ ID NO: 6360415 - DNA, 16 bp, Homo sapiens
gtctcctgggcatctg

SEQ ID NO: 6360416 - DNA, 18 bp, Homo sapiens
gtctcctgggcatctggc

SEQ ID NO: 6360417 - DNA, 21 bp, Homo sapiens
gtctcctgggcatctggccct

SEQ ID NO: 6360418 - DNA, 17 bp, Homo sapiens
gtctcctggtctgtgct

SEQ ID NO: 6360419 - DNA, 15 bp, Homo sapiens
gtctcctgtatcatt

SEQ ID NO: 6360420 - DNA, 20 bp, Homo sapiens
gtctcctgtcttcagagcaa

SEQ ID NO: 6360421 - DNA, 21 bp, Homo sapiens
gtctcctgtgcccacatccca

SEQ ID NO: 6360422 - DNA, 18 bp, Homo sapiens
gtctccttactctgagcc

SEQ ID NO: 6360423 - DNA, 14 bp, Homo sapiens
gtctccttcccact

SEQ ID NO: 6360424 - DNA, 15 bp, Homo sapiens
gtctccttcccactg

SEQ ID NO: 6360425 - DNA, 19 bp, Homo sapiens
gtctccttcccactgtcct

SEQ ID NO: 6360426 - DNA, 21 bp, Homo sapiens
gtctccttctcttctcttctt

SEQ ID NO: 6360427 - DNA, 15 bp, Homo sapiens
gtctccttgattttt

SEQ ID NO: 6360428 - DNA, 14 bp, Homo sapiens
gtctccttgcactt

SEQ ID NO: 6360429 - DNA, 15 bp, Homo sapiens
gtctccttgggccct

SEQ ID NO: 6360430 - DNA, 16 bp, Homo sapiens
gtctcctttaagagct

SEQ ID NO: 6360431 - DNA, 21 bp, Homo sapiens
gtctcctttctcagccacaaa

SEQ ID NO: 6360432 - DNA, 13 bp, Homo sapiens
gtctcctttctga

SEQ ID NO: 6360433 - DNA, 15 bp, Homo sapiens
gtctcctttgcactg

SEQ ID NO: 6360434 - DNA, 13 bp, Homo sapiens
gtctcctttgctc

SEQ ID NO: 6360435 - DNA, 16 bp, Homo sapiens
gtctccttttgtctga

SEQ ID NO: 6360436 - DNA, 22 bp, Homo sapiens
taatggattataatcagaatgg

SEQ ID NO: 6360437 - DNA, 15 bp, Homo sapiens
taatggattgttaat

SEQ ID NO: 6360438 - DNA, 14 bp, Homo sapiens
taatggatttttga

SEQ ID NO: 6360439 - DNA, 17 bp, Homo sapiens
taatggcacttatcatt

SEQ ID NO: 6360440 - DNA, 20 bp, Homo sapiens
taatggcagcagaaaacttg

SEQ ID NO: 6360441 - DNA, 20 bp, Homo sapiens
taatggcagctagtgccttt

SEQ ID NO: 6360442 - DNA, 20 bp, Homo sapiens
taatggccaagtgtacattt

SEQ ID NO: 6360443 - DNA, 21 bp, Homo sapiens
taatggcccctccatttattt

SEQ ID NO: 6360444 - DNA, 17 bp, Homo sapiens
taatggccggctggaaa

SEQ ID NO: 6360445 - DNA, 19 bp, Homo sapiens
taatggccttccataataa

SEQ ID NO: 6360446 - DNA, 18 bp, Homo sapiens
taatgggaatcattccac

SEQ ID NO: 6360447 - DNA, 22 bp, Homo sapiens
taatgggatctatttttgcact

SEQ ID NO: 6360448 - DNA, 20 bp, Homo sapiens
taatgggccaattaaaatat

SEQ ID NO: 6360449 - DNA, 16 bp, Homo sapiens
taatgggcctgcccaa

SEQ ID NO: 6360450 - DNA, 18 bp, Homo sapiens
taatgggcttagagcagt

SEQ ID NO: 6360451 - DNA, 15 bp, Homo sapiens
taatggggattaatt

SEQ ID NO: 6360452 - DNA, 17 bp, Homo sapiens
taatgggggtagcagct

SEQ ID NO: 6360453 - DNA, 18 bp, Homo sapiens
taatgggggtagcagctg

SEQ ID NO: 6360454 - DNA, 22 bp, Homo sapiens
taatggggtcctggccatccca

SEQ ID NO: 6360455 - DNA, 17 bp, Homo sapiens
taatggggtctgtaaat

SEQ ID NO: 6360456 - DNA, 16 bp, Homo sapiens
taatgggtaattctga

SEQ ID NO: 6360457 - DNA, 18 bp, Homo sapiens
taatgggtttcatatttc

SEQ ID NO: 6360458 - DNA, 16 bp, Homo sapiens
taatggtaatagaata

SEQ ID NO: 6360459 - DNA, 13 bp, Homo sapiens
taatggtaattta

SEQ ID NO: 6360460 - DNA, 16 bp, Homo sapiens
taatggtaatttagtg

SEQ ID NO: 6360461 - DNA, 16 bp, Homo sapiens
taatggtaccagataa

SEQ ID NO: 6360462 - DNA, 18 bp, Homo sapiens
taatggtaccagataaaa

SEQ ID NO: 6360463 - DNA, 19 bp, Homo sapiens
taatggtaccagataaaat

SEQ ID NO: 6360464 - DNA, 22 bp, Homo sapiens
taatggtatcatattaacatat

SEQ ID NO: 6360465 - DNA, 18 bp, Homo sapiens
taatggtatcctactgag

SEQ ID NO: 6360466 - DNA, 14 bp, Homo sapiens
taatggtatctgtt

SEQ ID NO: 6360467 - DNA, 21 bp, Homo sapiens
taatggtcccatccaggcagt

SEQ ID NO: 6360468 - DNA, 21 bp, Homo sapiens
taatggtctaaaaataaacca

SEQ ID NO: 6360469 - DNA, 16 bp, Homo sapiens
taatggtctaaaacag

SEQ ID NO: 6360470 - DNA, 22 bp, Homo sapiens
taatggtgatgcagtcttagat

SEQ ID NO: 6360471 - DNA, 11 bp, Homo sapiens
taatggtgctt

SEQ ID NO: 6360472 - DNA, 22 bp, Homo sapiens
taatggttaagaactgtgaaat

SEQ ID NO: 6360473 - DNA, 13 bp, Homo sapiens
taatggtttactg

SEQ ID NO: 6360474 - DNA, 17 bp, Homo sapiens
taatggtttactgctgt

SEQ ID NO: 6360475 - DNA, 19 bp, Homo sapiens
taatggtttactgctgtca

SEQ ID NO: 6360476 - DNA, 17 bp, Homo sapiens
taatggtttattctttg

SEQ ID NO: 6360477 - DNA, 19 bp, Homo sapiens
taatggtttttatttctcg

SEQ ID NO: 6360478 - DNA, 20 bp, Homo sapiens
taatggtttttgttagttca

SEQ ID NO: 6360479 - DNA, 19 bp, Homo sapiens
taatgtaaaattcatagca

SEQ ID NO: 6360480 - DNA, 19 bp, Homo sapiens
taatgtaaactttgtcatg

SEQ ID NO: 6360481 - DNA, 13 bp, Homo sapiens
taatgtaaataaa

SEQ ID NO: 6360482 - DNA, 16 bp, Homo sapiens
taatgtaaataaaaca

SEQ ID NO: 6360483 - DNA, 15 bp, Homo sapiens
taatgtaaataaact

SEQ ID NO: 6360484 - DNA, 13 bp, Homo sapiens
taatgtaacatga

SEQ ID NO: 6360485 - DNA, 18 bp, Homo sapiens
taatgtaacttaattata

SEQ ID NO: 6360486 - DNA, 14 bp, Homo sapiens
taatgtaagaaaat

SEQ ID NO: 6360487 - DNA, 20 bp, Homo sapiens
taatgtaataaagtgaactt

SEQ ID NO: 6360488 - DNA, 15 bp, Homo sapiens
taatgtaatactgta

SEQ ID NO: 6360489 - DNA, 19 bp, Homo sapiens
taatgtaatactgtagaaa

SEQ ID NO: 6360490 - DNA, 21 bp, Homo sapiens
taatgtaatactgtagaaata

SEQ ID NO: 6360491 - DNA, 19 bp, Homo sapiens
taatgtaatcatttatctt

SEQ ID NO: 6360492 - DNA, 18 bp, Homo sapiens
taatgtaattcaggactc

SEQ ID NO: 6360493 - DNA, 15 bp, Homo sapiens
taatgtaatttagtc

SEQ ID NO: 6360494 - DNA, 15 bp, Homo sapiens
taatgtacaagtttt

SEQ ID NO: 6360495 - DNA, 21 bp, Homo sapiens
taatgtacagaggaagctgtt

SEQ ID NO: 6360496 - DNA, 20 bp, Homo sapiens
taatgtactgaattctttat

SEQ ID NO: 6360497 - DNA, 18 bp, Homo sapiens
taatgtactgatttcagt

SEQ ID NO: 6360498 - DNA, 21 bp, Homo sapiens
taatgtactgtacataaattc

SEQ ID NO: 6360499 - DNA, 13 bp, Homo sapiens
taatgtacttttt

SEQ ID NO: 6360500 - DNA, 18 bp, Homo sapiens
taatgtactttttattgc

SEQ ID NO: 6360501 - DNA, 21 bp, Homo sapiens
taatgtactttttattgcatg

SEQ ID NO: 6360502 - DNA, 22 bp, Homo sapiens
taatgtactttttattgcatgg

SEQ ID NO: 6360503 - DNA, 14 bp, Homo sapiens
taatgtagaaatgt

SEQ ID NO: 6360504 - DNA, 14 bp, Homo sapiens
taatgtagccatgg

SEQ ID NO: 6360505 - DNA, 20 bp, Homo sapiens
taatgtagcgtgtttacatg

SEQ ID NO: 6360506 - DNA, 14 bp, Homo sapiens
taatgtagctattt

SEQ ID NO: 6360507 - DNA, 21 bp, Homo sapiens
taatgtaggatgacaggctct

SEQ ID NO: 6360508 - DNA, 16 bp, Homo sapiens
taatgtagggcagaat

SEQ ID NO: 6360509 - DNA, 17 bp, Homo sapiens
taatgtagggttatatt

SEQ ID NO: 6360510 - DNA, 15 bp, Homo sapiens
taatgtagttactgt

SEQ ID NO: 6360511 - DNA, 16 bp, Homo sapiens
taatgtatacttgaaa

SEQ ID NO: 6360512 - DNA, 13 bp, Homo sapiens
taatgtatataaa

SEQ ID NO: 6360513 - DNA, 16 bp, Homo sapiens
taatgtatataaaaat

SEQ ID NO: 6360514 - DNA, 22 bp, Homo sapiens
taatgtatatgaacttaacatg

SEQ ID NO: 6360515 - DNA, 14 bp, Homo sapiens
taatgtatatttgc

SEQ ID NO: 6360516 - DNA, 19 bp, Homo sapiens
taatgtatcaaatacattt

SEQ ID NO: 6360517 - DNA, 21 bp, Homo sapiens
taatgtatcttatttatatat

SEQ ID NO: 6360518 - DNA, 17 bp, Homo sapiens
taatgtatgaattttgt

SEQ ID NO: 6360519 - DNA, 19 bp, Homo sapiens
taatgtatgaattttgtaa

SEQ ID NO: 6360520 - DNA, 22 bp, Homo sapiens
taatgtatgaattttgtaagta

SEQ ID NO: 6360521 - DNA, 17 bp, Homo sapiens
taatgtattaataccac

SEQ ID NO: 6360522 - DNA, 18 bp, Homo sapiens
taatgtattagtatggtt

SEQ ID NO: 6360523 - DNA, 15 bp, Homo sapiens
taatgtattcatatt

SEQ ID NO: 6360524 - DNA, 16 bp, Homo sapiens
taatgtattcatattt

SEQ ID NO: 6360525 - DNA, 17 bp, Homo sapiens
taatgtatttgaaaatt

SEQ ID NO: 6360526 - DNA, 20 bp, Homo sapiens
taatgtatttgttcatgttt

SEQ ID NO: 6360527 - DNA, 21 bp, Homo sapiens
taatgtatttgttcatgtttg

SEQ ID NO: 6360528 - DNA, 13 bp, Homo sapiens
taatgtattttca

SEQ ID NO: 6360529 - DNA, 21 bp, Homo sapiens
taatgtattttcagctcaatt

SEQ ID NO: 6360530 - DNA, 13 bp, Homo sapiens
taatgtcaaactt

SEQ ID NO: 6360531 - DNA, 13 bp, Homo sapiens
taatgtcaaatga

SEQ ID NO: 6360532 - DNA, 19 bp, Homo sapiens
taatgtcaacaccagaaag

SEQ ID NO: 6360533 - DNA, 16 bp, Homo sapiens
taatgtcactgttttt

SEQ ID NO: 6360534 - DNA, 23 bp, Homo sapiens
taatgtcactgtttttattcctt

SEQ ID NO: 6360535 - DNA, 15 bp, Homo sapiens
taatgtcagaacaga

SEQ ID NO: 6360536 - DNA, 17 bp, Homo sapiens
taatgtcctttccctgg

SEQ ID NO: 6360537 - DNA, 21 bp, Homo sapiens
taatgtctagattttgaaaaa

SEQ ID NO: 6360538 - DNA, 22 bp, Homo sapiens
taatgtctagattttgaaaaat

SEQ ID NO: 6360539 - DNA, 15 bp, Homo sapiens
taatgtctcaaaata

SEQ ID NO: 6360540 - DNA, 16 bp, Homo sapiens
taatgtctcactgttc

SEQ ID NO: 6360541 - DNA, 19 bp, Homo sapiens
taatgtctcactgttctgc

SEQ ID NO: 6360542 - DNA, 14 bp, Homo sapiens
taatgtctcacttt

SEQ ID NO: 6360543 - DNA, 21 bp, Homo sapiens
taatgtctcactttactttca

SEQ ID NO: 6360544 - DNA, 11 bp, Homo sapiens
taatgtctctg

SEQ ID NO: 6360545 - DNA, 17 bp, Homo sapiens
taatgtctcttctaaca

SEQ ID NO: 6360546 - DNA, 14 bp, Homo sapiens
taatgtctgtcaga

SEQ ID NO: 6360547 - DNA, 19 bp, Homo sapiens
taatgtcttcagtggaaca

SEQ ID NO: 6360548 - DNA, 14 bp, Homo sapiens
taatgtcttcataa

SEQ ID NO: 6360549 - DNA, 14 bp, Homo sapiens
taatgtcttgttaa

SEQ ID NO: 6360550 - DNA, 22 bp, Homo sapiens
taatgtcttgttaatattcttt

SEQ ID NO: 6360551 - DNA, 11 bp, Homo sapiens
taatgtcttta

SEQ ID NO: 6360552 - DNA, 14 bp, Homo sapiens
taatgtgaaatgta

SEQ ID NO: 6360553 - DNA, 11 bp, Homo sapiens
taatgtgaact

SEQ ID NO: 6360554 - DNA, 13 bp, Homo sapiens
taatgtgaactag

SEQ ID NO: 6360555 - DNA, 20 bp, Homo sapiens
taatgtgaactctcccctcc

SEQ ID NO: 6360556 - DNA, 16 bp, Homo sapiens
taatgtgaatgtgagt

SEQ ID NO: 6360557 - DNA, 22 bp, Homo sapiens
taatgtgacctagcaataggca

SEQ ID NO: 6360558 - DNA, 21 bp, Homo sapiens
taatgtgacttggattcaatt

SEQ ID NO: 6360559 - DNA, 17 bp, Homo sapiens
taatgtgagacagcaag

SEQ ID NO: 6360560 - DNA, 18 bp, Homo sapiens
taatgtgagacagcaagt

SEQ ID NO: 6360561 - DNA, 19 bp, Homo sapiens
taatgtgagggtttgtaat

SEQ ID NO: 6360562 - DNA, 21 bp, Homo sapiens
taatgtgagtgtgaagctttg

SEQ ID NO: 6360563 - DNA, 15 bp, Homo sapiens
taatgtgatcatatg

SEQ ID NO: 6360564 - DNA, 19 bp, Homo sapiens
taatgtgatgatgtaattg

SEQ ID NO: 6360565 - DNA, 21 bp, Homo sapiens
taatgtgcccaaagctctgaa

SEQ ID NO: 6360566 - DNA, 22 bp, Homo sapiens
taatgtgcccaaagctctgaat

SEQ ID NO: 6360567 - DNA, 14 bp, Homo sapiens
taatgtgctctgta

SEQ ID NO: 6360568 - DNA, 22 bp, Homo sapiens
taatgtggaagaaaatggttta

SEQ ID NO: 6360569 - DNA, 18 bp, Homo sapiens
taatgtggaaggtcatca

SEQ ID NO: 6360570 - DNA, 18 bp, Homo sapiens
taatgtggatttcctatt

SEQ ID NO: 6360571 - DNA, 22 bp, Homo sapiens
taatgtgggttatcctcctctc

SEQ ID NO: 6360572 - DNA, 16 bp, Homo sapiens
taatgtggttatttct

SEQ ID NO: 6360573 - DNA, 16 bp, Homo sapiens
taatgtgtaaaattgg

SEQ ID NO: 6360574 - DNA, 18 bp, Homo sapiens
taatgtgtaaaattggat

SEQ ID NO: 6360575 - DNA, 19 bp, Homo sapiens
taatgtgtaaaattggatt

SEQ ID NO: 6360576 - DNA, 17 bp, Homo sapiens
taatgtgtactggtcag

SEQ ID NO: 6360577 - DNA, 18 bp, Homo sapiens
taatgtgtagttcatgta

SEQ ID NO: 6360578 - DNA, 19 bp, Homo sapiens
taatgtgtagttcatgtaa

SEQ ID NO: 6360579 - DNA, 15 bp, Homo sapiens
taatgtgtatgtctg

SEQ ID NO: 6360580 - DNA, 19 bp, Homo sapiens
taatgtgtattacaaatat

SEQ ID NO: 6360581 - DNA, 13 bp, Homo sapiens
taatgtgtctgtg

SEQ ID NO: 6360582 - DNA, 19 bp, Homo sapiens
taatgtgtctgtggaccct

SEQ ID NO: 6360583 - DNA, 15 bp, Homo sapiens
taatgtgtggattgc

SEQ ID NO: 6360584 - DNA, 18 bp, Homo sapiens
taatgtgtggtggcctca

SEQ ID NO: 6360585 - DNA, 19 bp, Homo sapiens
taatgtgtggtggcctcag

SEQ ID NO: 6360586 - DNA, 18 bp, Homo sapiens
taatgtgtgtatgtgtat

SEQ ID NO: 6360587 - DNA, 13 bp, Homo sapiens
taatgttaaattt

SEQ ID NO: 6360588 - DNA, 16 bp, Homo sapiens
taatgttaaatttgta

SEQ ID NO: 6360589 - DNA, 14 bp, Homo sapiens
taatgttaaccaag

SEQ ID NO: 6360590 - DNA, 15 bp, Homo sapiens
taatgttaactttca

SEQ ID NO: 6360591 - DNA, 16 bp, Homo sapiens
taatgttaactttcaa

SEQ ID NO: 6360592 - DNA, 18 bp, Homo sapiens
taatgttaactttcaaat

SEQ ID NO: 6360593 - DNA, 11 bp, Homo sapiens
taatgttactg

SEQ ID NO: 6360594 - DNA, 13 bp, Homo sapiens
taatgttactgat

SEQ ID NO: 6360595 - DNA, 15 bp, Homo sapiens
taatgttactgatca

SEQ ID NO: 6360596 - DNA, 14 bp, Homo sapiens
taatgttagaattt

SEQ ID NO: 6360597 - DNA, 16 bp, Homo sapiens
taatgttatcctcttg

SEQ ID NO: 6360598 - DNA, 16 bp, Homo sapiens
taatgttatcggctct

SEQ ID NO: 6360599 - DNA, 19 bp, Homo sapiens
taatgttattattactcta

SEQ ID NO: 6360600 - DNA, 13 bp, Homo sapiens
taatgttattcat

SEQ ID NO: 6360601 - DNA, 15 bp, Homo sapiens
taatgttattttcct

SEQ ID NO: 6360602 - DNA, 17 bp, Homo sapiens
taatgttcattttgaaa

SEQ ID NO: 6360603 - DNA, 18 bp, Homo sapiens
taatgttcattttgaaaa

SEQ ID NO: 6360604 - DNA, 22 bp, Homo sapiens
taatgttcattttgaaaatatg

SEQ ID NO: 6360605 - DNA, 20 bp, Homo sapiens
taatgttctccactgacaca

SEQ ID NO: 6360606 - DNA, 22 bp, Homo sapiens
taatgttctccactgacacaaa

SEQ ID NO: 6360607 - DNA, 22 bp, Homo sapiens
taatgttctctgggtaggtgtt

SEQ ID NO: 6360608 - DNA, 22 bp, Homo sapiens
taatgttctgaataatttctta

SEQ ID NO: 6360609 - DNA, 22 bp, Homo sapiens
taatgttcttatgcaaaatgga

SEQ ID NO: 6360610 - DNA, 14 bp, Homo sapiens
taatgttctttata

SEQ ID NO: 6360611 - DNA, 13 bp, Homo sapiens
taatgttgaacaa

SEQ ID NO: 6360612 - DNA, 11 bp, Homo sapiens
taatgttgaat

SEQ ID NO: 6360613 - DNA, 13 bp, Homo sapiens
taatgttgatcag

SEQ ID NO: 6360614 - DNA, 21 bp, Homo sapiens
taatgttggaaaacatatgaa

SEQ ID NO: 6360615 - DNA, 17 bp, Homo sapiens
gtctcgaactcctgacc

SEQ ID NO: 6360616 - DNA, 18 bp, Homo sapiens
gtctcgaactcctgacct

SEQ ID NO: 6360617 - DNA, 19 bp, Homo sapiens
gtctcgaactcctgacctt

SEQ ID NO: 6360618 - DNA, 16 bp, Homo sapiens
gtctcgaccctgtccc

SEQ ID NO: 6360619 - DNA, 22 bp, Homo sapiens
gtctcgactgctgttcccctct

SEQ ID NO: 6360620 - DNA, 13 bp, Homo sapiens
gtctcgagcgccc

SEQ ID NO: 6360621 - DNA, 14 bp, Homo sapiens
gtctcgagcgccct

SEQ ID NO: 6360622 - DNA, 21 bp, Homo sapiens
gtctcgagcgccctgcagacc

SEQ ID NO: 6360623 - DNA, 20 bp, Homo sapiens
gtctcgatgccataatcaga

SEQ ID NO: 6360624 - DNA, 17 bp, Homo sapiens
gtctcgatgcctgattc

SEQ ID NO: 6360625 - DNA, 15 bp, Homo sapiens
gtctcgatgctgctg

SEQ ID NO: 6360626 - DNA, 17 bp, Homo sapiens
gtctcgatgctgctggc

SEQ ID NO: 6360627 - DNA, 19 bp, Homo sapiens
gtctcgatgctgctggcct

SEQ ID NO: 6360628 - DNA, 20 bp, Homo sapiens
gtctcgatgctgctggcctc

SEQ ID NO: 6360629 - DNA, 21 bp, Homo sapiens
gtctcgatgctgctggcctcc

SEQ ID NO: 6360630 - DNA, 13 bp, Homo sapiens
gtctcgcagcctg

SEQ ID NO: 6360631 - DNA, 18 bp, Homo sapiens
gtctcgcagcctgaagcc

SEQ ID NO: 6360632 - DNA, 19 bp, Homo sapiens
gtctcgcagcctgaagcct

SEQ ID NO: 6360633 - DNA, 20 bp, Homo sapiens
gtctcgcagcctgaagcctg

SEQ ID NO: 6360634 - DNA, 17 bp, Homo sapiens
gtctcgccagaagactc

SEQ ID NO: 6360635 - DNA, 11 bp, Homo sapiens
gtctcgcctgc

SEQ ID NO: 6360636 - DNA, 18 bp, Homo sapiens
gtctcgcgcgactgagaa

SEQ ID NO: 6360637 - DNA, 16 bp, Homo sapiens
gtctcgctctgctgcc

SEQ ID NO: 6360638 - DNA, 13 bp, Homo sapiens
gtctcgctctgtc

SEQ ID NO: 6360639 - DNA, 18 bp, Homo sapiens
gtctcgctgatgctgggc

SEQ ID NO: 6360640 - DNA, 14 bp, Homo sapiens
gtctcgctgtcact

SEQ ID NO: 6360641 - DNA, 16 bp, Homo sapiens
gtctcgctttgttgcc

SEQ ID NO: 6360642 - DNA, 17 bp, Homo sapiens
gtctcgctttgttgccc

SEQ ID NO: 6360643 - DNA, 23 bp, Homo sapiens
gtctcgctttgttgcccaggctg

SEQ ID NO: 6360644 - DNA, 20 bp, Homo sapiens
gtctcggatcaggctcccag

SEQ ID NO: 6360645 - DNA, 13 bp, Homo sapiens
gtctcggcagagg

SEQ ID NO: 6360646 - DNA, 17 bp, Homo sapiens
gtctcggcagaggtggt

SEQ ID NO: 6360647 - DNA, 23 bp, Homo sapiens
gtctcggcatagtccccagagct

SEQ ID NO: 6360648 - DNA, 17 bp, Homo sapiens
gtctcggccctgaacca

SEQ ID NO: 6360649 - DNA, 15 bp, Homo sapiens
gtctcggccttcaca

SEQ ID NO: 6360650 - DNA, 22 bp, Homo sapiens
gtctcggggcttgccccactct

SEQ ID NO: 6360651 - DNA, 23 bp, Homo sapiens
gtctcgggtggctagtcagagag

SEQ ID NO: 6360652 - DNA, 16 bp, Homo sapiens
gtctcggtggtaccag

SEQ ID NO: 6360653 - DNA, 22 bp, Homo sapiens
gtctcggtggtaccaggtctcc

SEQ ID NO: 6360654 - DNA, 18 bp, Homo sapiens
gtctcgtcaggaggtgcc

SEQ ID NO: 6360655 - DNA, 14 bp, Homo sapiens
gtctcgtctctttt

SEQ ID NO: 6360656 - DNA, 13 bp, Homo sapiens
gtctcgtggcccc

SEQ ID NO: 6360657 - DNA, 13 bp, Homo sapiens
gtctcgtggtagg

SEQ ID NO: 6360658 - DNA, 19 bp, Homo sapiens
gtctcgtggtaggactgta

SEQ ID NO: 6360659 - DNA, 19 bp, Homo sapiens
gtctcgtggttggaagcct

SEQ ID NO: 6360660 - DNA, 16 bp, Homo sapiens
gtctctaaaaagaagc

SEQ ID NO: 6360661 - DNA, 14 bp, Homo sapiens
gtctctaaagcact

SEQ ID NO: 6360662 - DNA, 19 bp, Homo sapiens
gtctctaagtgtaaaagta

SEQ ID NO: 6360663 - DNA, 22 bp, Homo sapiens
gtctctaatgtgactgttgagg

SEQ ID NO: 6360664 - DNA, 21 bp, Homo sapiens
gtctctacaaaaaataaaata

SEQ ID NO: 6360665 - DNA, 21 bp, Homo sapiens
gtctctaccaaaaaaaggaag

SEQ ID NO: 6360666 - DNA, 16 bp, Homo sapiens
gtctctacccctttct

SEQ ID NO: 6360667 - DNA, 18 bp, Homo sapiens
gtctctactaaaaataag

SEQ ID NO: 6360668 - DNA, 22 bp, Homo sapiens
gtctctactaaaaatatgaaat

SEQ ID NO: 6360669 - DNA, 15 bp, Homo sapiens
gtctctactgtggca

SEQ ID NO: 6360670 - DNA, 19 bp, Homo sapiens
gtctctagagggttgctgc

SEQ ID NO: 6360671 - DNA, 14 bp, Homo sapiens
gtctctagcagtga

SEQ ID NO: 6360672 - DNA, 14 bp, Homo sapiens
gtctctagccactt

SEQ ID NO: 6360673 - DNA, 14 bp, Homo sapiens
gtctctaggcctga

SEQ ID NO: 6360674 - DNA, 15 bp, Homo sapiens
gtctctaggctgggg

SEQ ID NO: 6360675 - DNA, 14 bp, Homo sapiens
gtctctagtgctgt

SEQ ID NO: 6360676 - DNA, 18 bp, Homo sapiens
gtctctagtgctgtgaaa

SEQ ID NO: 6360677 - DNA, 20 bp, Homo sapiens
gtctctataccaataaagtg

SEQ ID NO: 6360678 - DNA, 16 bp, Homo sapiens
gtctctatattatgtc

SEQ ID NO: 6360679 - DNA, 22 bp, Homo sapiens
gtctctatattatgtcttcttt

SEQ ID NO: 6360680 - DNA, 16 bp, Homo sapiens
gtctctatcattaaag

SEQ ID NO: 6360681 - DNA, 18 bp, Homo sapiens
gtctctatcattaaagtt

SEQ ID NO: 6360682 - DNA, 23 bp, Homo sapiens
gtctctatgccagctcagtccca

SEQ ID NO: 6360683 - DNA, 18 bp, Homo sapiens
gtctctattagctgggtt

SEQ ID NO: 6360684 - DNA, 14 bp, Homo sapiens
gtctctcacagaca

SEQ ID NO: 6360685 - DNA, 17 bp, Homo sapiens
gtctctcacctagacct

SEQ ID NO: 6360686 - DNA, 21 bp, Homo sapiens
gtctctcactgtcgcccaggc

SEQ ID NO: 6360687 - DNA, 17 bp, Homo sapiens
gtctctcagggccaggc

SEQ ID NO: 6360688 - DNA, 13 bp, Homo sapiens
gtctctccactgc

SEQ ID NO: 6360689 - DNA, 14 bp, Homo sapiens
gtctctccactgct

SEQ ID NO: 6360690 - DNA, 12 bp, Homo sapiens
gtctctccagcc

SEQ ID NO: 6360691 - DNA, 14 bp, Homo sapiens
gtctctccagcctc

SEQ ID NO: 6360692 - DNA, 18 bp, Homo sapiens
gtctctccagcctcacag

SEQ ID NO: 6360693 - DNA, 20 bp, Homo sapiens
gtctctccctaccctcttct

SEQ ID NO: 6360694 - DNA, 23 bp, Homo sapiens
gtctctccctaccctcttctcag

SEQ ID NO: 6360695 - DNA, 20 bp, Homo sapiens
gtctctccctcccccagagc

SEQ ID NO: 6360696 - DNA, 23 bp, Homo sapiens
gtctctccctcccccagagcccc

SEQ ID NO: 6360697 - DNA, 15 bp, Homo sapiens
gtctctccctggggt

SEQ ID NO: 6360698 - DNA, 21 bp, Homo sapiens
gtctctcctagcccctctctc

SEQ ID NO: 6360699 - DNA, 15 bp, Homo sapiens
gtctctcctggctgg

SEQ ID NO: 6360700 - DNA, 18 bp, Homo sapiens
gtctctcctggctgggcc

SEQ ID NO: 6360701 - DNA, 21 bp, Homo sapiens
gtctctcctgtaagccaaaga

SEQ ID NO: 6360702 - DNA, 21 bp, Homo sapiens
gtctctccttcctcttggctg

SEQ ID NO: 6360703 - DNA, 23 bp, Homo sapiens
gtctctccttttcttttgttact

SEQ ID NO: 6360704 - DNA, 22 bp, Homo sapiens
gtctctcgtagtgttaagttat

SEQ ID NO: 6360705 - DNA, 21 bp, Homo sapiens
gtctctctaagacaaatgcag

SEQ ID NO: 6360706 - DNA, 21 bp, Homo sapiens
gtctctctccaggtcagcctg

SEQ ID NO: 6360707 - DNA, 22 bp, Homo sapiens
gtctctctccaggtcagcctgg

SEQ ID NO: 6360708 - DNA, 23 bp, Homo sapiens
gtctctctccaggtcagcctgga

SEQ ID NO: 6360709 - DNA, 23 bp, Homo sapiens
gtctctctcccatggagccccag

SEQ ID NO: 6360710 - DNA, 15 bp, Homo sapiens
gtctctctccctacc

SEQ ID NO: 6360711 - DNA, 18 bp, Homo sapiens
gtctctctccctacctcc

SEQ ID NO: 6360712 - DNA, 23 bp, Homo sapiens
gtctctctccctacctccctcct

SEQ ID NO: 6360713 - DNA, 13 bp, Homo sapiens
gtctctctccctc

SEQ ID NO: 6360714 - DNA, 15 bp, Homo sapiens
gtctctctccctctg

SEQ ID NO: 6360715 - DNA, 22 bp, Homo sapiens
gtctctctgcctgctgggctct

SEQ ID NO: 6360716 - DNA, 18 bp, Homo sapiens
gtctctctgtgaatacaa

SEQ ID NO: 6360717 - DNA, 16 bp, Homo sapiens
gtctctcttaaagttg

SEQ ID NO: 6360718 - DNA, 21 bp, Homo sapiens
gtctctcttcagactctcagc

SEQ ID NO: 6360719 - DNA, 22 bp, Homo sapiens
gtctctcttcagactctcagcc

SEQ ID NO: 6360720 - DNA, 22 bp, Homo sapiens
gtctctcttcggtggccttgag

SEQ ID NO: 6360721 - DNA, 15 bp, Homo sapiens
gtctctcttctctcc

SEQ ID NO: 6360722 - DNA, 19 bp, Homo sapiens
gtctctcttctctccagct

SEQ ID NO: 6360723 - DNA, 23 bp, Homo sapiens
gtctctcttctctccagctgact

SEQ ID NO: 6360724 - DNA, 17 bp, Homo sapiens
gtctctcttggacccac

SEQ ID NO: 6360725 - DNA, 19 bp, Homo sapiens
gtctctcttgtcacatgga

SEQ ID NO: 6360726 - DNA, 11 bp, Homo sapiens
gtctctctttg

SEQ ID NO: 6360727 - DNA, 20 bp, Homo sapiens
gtctctctttggactctccc

SEQ ID NO: 6360728 - DNA, 21 bp, Homo sapiens
gtctctctttggactctcccc

SEQ ID NO: 6360729 - DNA, 15 bp, Homo sapiens
gtctctgaagtgaaa

SEQ ID NO: 6360730 - DNA, 17 bp, Homo sapiens
gtctctgaatacacagt

SEQ ID NO: 6360731 - DNA, 19 bp, Homo sapiens
gtctctgaatgaagctgaa

SEQ ID NO: 6360732 - DNA, 17 bp, Homo sapiens
gtctctgacaaagtgtg

SEQ ID NO: 6360733 - DNA, 20 bp, Homo sapiens
gtctctgactcttgcctttc

SEQ ID NO: 6360734 - DNA, 14 bp, Homo sapiens
gtctctgagcagtg

SEQ ID NO: 6360735 - DNA, 20 bp, Homo sapiens
gtctctgagccccctgtgcc

SEQ ID NO: 6360736 - DNA, 10 bp, Homo sapiens
gtctctgagg

SEQ ID NO: 6360737 - DNA, 12 bp, Homo sapiens
gtctctgaggct

SEQ ID NO: 6360738 - DNA, 18 bp, Homo sapiens
gtctctgaggctctccaa

SEQ ID NO: 6360739 - DNA, 14 bp, Homo sapiens
gtctctgagggctt

SEQ ID NO: 6360740 - DNA, 21 bp, Homo sapiens
gtctctgagggcttcctttgg

SEQ ID NO: 6360741 - DNA, 15 bp, Homo sapiens
gtctctgaggggtgg

SEQ ID NO: 6360742 - DNA, 17 bp, Homo sapiens
gtctctgagtcctttgc

SEQ ID NO: 6360743 - DNA, 15 bp, Homo sapiens
gtctctgatgcagct

SEQ ID NO: 6360744 - DNA, 18 bp, Homo sapiens
gtctctgattagttgaca

SEQ ID NO: 6360745 - DNA, 20 bp, Homo sapiens
gtctctgattagttgacagt

SEQ ID NO: 6360746 - DNA, 17 bp, Homo sapiens
gtctctgcaaactgcct

SEQ ID NO: 6360747 - DNA, 17 bp, Homo sapiens
gtctctgcagtgtccat

SEQ ID NO: 6360748 - DNA, 13 bp, Homo sapiens
gtctctgcatctc

SEQ ID NO: 6360749 - DNA, 15 bp, Homo sapiens
gtctctgcatcttca

SEQ ID NO: 6360750 - DNA, 14 bp, Homo sapiens
gtctctgccaccca

SEQ ID NO: 6360751 - DNA, 15 bp, Homo sapiens
gtctctgccacccac

SEQ ID NO: 6360752 - DNA, 16 bp, Homo sapiens
gtctctgccacccact

SEQ ID NO: 6360753 - DNA, 21 bp, Homo sapiens
gtctctgccacccactcagga

SEQ ID NO: 6360754 - DNA, 22 bp, Homo sapiens
gtctctgccacccactcaggat

SEQ ID NO: 6360755 - DNA, 20 bp, Homo sapiens
gtctctgccagttacttggg

SEQ ID NO: 6360756 - DNA, 15 bp, Homo sapiens
gtctctgccatgtgg

SEQ ID NO: 6360757 - DNA, 19 bp, Homo sapiens
gtctctgccatgtggcaga

SEQ ID NO: 6360758 - DNA, 20 bp, Homo sapiens
gtctctgccctgggctcctc

SEQ ID NO: 6360759 - DNA, 18 bp, Homo sapiens
gtctctgccggctctttc

SEQ ID NO: 6360760 - DNA, 12 bp, Homo sapiens
gtctctgcctcc

SEQ ID NO: 6360761 - DNA, 18 bp, Homo sapiens
gtctctgcctccctcacc

SEQ ID NO: 6360762 - DNA, 15 bp, Homo sapiens
gtctctgcctcttcc

SEQ ID NO: 6360763 - DNA, 19 bp, Homo sapiens
gtctctgcctggagcaggg

SEQ ID NO: 6360764 - DNA, 16 bp, Homo sapiens
gtctctgccttgcctt

SEQ ID NO: 6360765 - DNA, 15 bp, Homo sapiens
gtctctgctccagca

SEQ ID NO: 6360766 - DNA, 23 bp, Homo sapiens
gtctctgctcgccctcctttctg

SEQ ID NO: 6360767 - DNA, 15 bp, Homo sapiens
gtctctgctcttgcc

SEQ ID NO: 6360768 - DNA, 18 bp, Homo sapiens
gtctctgctcttgcctgc

SEQ ID NO: 6360769 - DNA, 19 bp, Homo sapiens
gtctctgctcttgcctgca

SEQ ID NO: 6360770 - DNA, 12 bp, Homo sapiens
gtctctgctgcc

SEQ ID NO: 6360771 - DNA, 14 bp, Homo sapiens
gtctctgctgccgc

SEQ ID NO: 6360772 - DNA, 15 bp, Homo sapiens
gtctctgctggccca

SEQ ID NO: 6360773 - DNA, 16 bp, Homo sapiens
gtctctgctggcccag

SEQ ID NO: 6360774 - DNA, 12 bp, Homo sapiens
gtctctgctggg

SEQ ID NO: 6360775 - DNA, 13 bp, Homo sapiens
gtctctgcttcca

SEQ ID NO: 6360776 - DNA, 17 bp, Homo sapiens
gtctctgcttccatggc

SEQ ID NO: 6360777 - DNA, 21 bp, Homo sapiens
gtctctgctttccttttctct

SEQ ID NO: 6360778 - DNA, 22 bp, Homo sapiens
gtctctgctttccttttctctg

SEQ ID NO: 6360779 - DNA, 19 bp, Homo sapiens
gtctctggaaaagctgggg

SEQ ID NO: 6360780 - DNA, 19 bp, Homo sapiens
gtctctggaagaagagcag

SEQ ID NO: 6360781 - DNA, 21 bp, Homo sapiens
gtctctggcagttctggaatg

SEQ ID NO: 6360782 - DNA, 19 bp, Homo sapiens
gtctctggctactccctgg

SEQ ID NO: 6360783 - DNA, 12 bp, Homo sapiens
gtctctgggagc

SEQ ID NO: 6360784 - DNA, 17 bp, Homo sapiens
gtctctgggagcccaga

SEQ ID NO: 6360785 - DNA, 19 bp, Homo sapiens
gtctctgggccacttggag

SEQ ID NO: 6360786 - DNA, 13 bp, Homo sapiens
gtctctgggcctg

SEQ ID NO: 6360787 - DNA, 13 bp, Homo sapiens
gtctctgggctga

SEQ ID NO: 6360788 - DNA, 10 bp, Homo sapiens
gtctctgggg

SEQ ID NO: 6360789 - DNA, 11 bp, Homo sapiens
gtctctgggga

SEQ ID NO: 6360790 - DNA, 16 bp, Homo sapiens
gtctctggtagcctgc

SEQ ID NO: 6360791 - DNA, 16 bp, Homo sapiens
gtctctggttcctccc

SEQ ID NO: 6360792 - DNA, 11 bp, Homo sapiens
gtctctgtaga

SEQ ID NO: 6360793 - DNA, 17 bp, Homo sapiens
gtctctgtataatctat

SEQ ID NO: 6360794 - DNA, 21 bp, Homo sapiens
taatgttggacacctttaggt

SEQ ID NO: 6360795 - DNA, 21 bp, Homo sapiens
taatgttggacagacactgtt

SEQ ID NO: 6360796 - DNA, 20 bp, Homo sapiens
taatgttgggatttatatct

SEQ ID NO: 6360797 - DNA, 22 bp, Homo sapiens
taatgttgggatttatatctat

SEQ ID NO: 6360798 - DNA, 13 bp, Homo sapiens
taatgttgtccag

SEQ ID NO: 6360799 - DNA, 21 bp, Homo sapiens
taatgttgtctttttaatgtt

SEQ ID NO: 6360800 - DNA, 14 bp, Homo sapiens
taatgttgtgaata

SEQ ID NO: 6360801 - DNA, 23 bp, Homo sapiens
taatgttgtgaataattacagtg

SEQ ID NO: 6360802 - DNA, 18 bp, Homo sapiens
taatgttgttatttaaag

SEQ ID NO: 6360803 - DNA, 21 bp, Homo sapiens
taatgttgtttacaatataga

SEQ ID NO: 6360804 - DNA, 11 bp, Homo sapiens
taatgtttaaa

SEQ ID NO: 6360805 - DNA, 21 bp, Homo sapiens
taatgtttaaatcatgtatgt

SEQ ID NO: 6360806 - DNA, 21 bp, Homo sapiens
taatgtttaagatctgtttta

SEQ ID NO: 6360807 - DNA, 22 bp, Homo sapiens
taatgtttaagcagaattggaa

SEQ ID NO: 6360808 - DNA, 12 bp, Homo sapiens
taatgtttacta

SEQ ID NO: 6360809 - DNA, 15 bp, Homo sapiens
taatgtttataagct

SEQ ID NO: 6360810 - DNA, 19 bp, Homo sapiens
taatgtttattatttacat

SEQ ID NO: 6360811 - DNA, 17 bp, Homo sapiens
taatgtttatttagctc

SEQ ID NO: 6360812 - DNA, 22 bp, Homo sapiens
taatgtttcaaacatatataac

SEQ ID NO: 6360813 - DNA, 13 bp, Homo sapiens
taatgtttctgat

SEQ ID NO: 6360814 - DNA, 19 bp, Homo sapiens
taatgtttcttaaatggaa

SEQ ID NO: 6360815 - DNA, 22 bp, Homo sapiens
taatgtttgtaagcaattctaa

SEQ ID NO: 6360816 - DNA, 18 bp, Homo sapiens
taatgtttgttacctcca

SEQ ID NO: 6360817 - DNA, 17 bp, Homo sapiens
taatgttttgtacaatt

SEQ ID NO: 6360818 - DNA, 21 bp, Homo sapiens
taatgttttgtatatacagtt

SEQ ID NO: 6360819 - DNA, 23 bp, Homo sapiens
taatgttttgtatatacagttat

SEQ ID NO: 6360820 - DNA, 21 bp, Homo sapiens
taatgtttttatttcaattgt

SEQ ID NO: 6360821 - DNA, 22 bp, Homo sapiens
taatgtttttatttcaattgtt

SEQ ID NO: 6360822 - DNA, 16 bp, Homo sapiens
taatgtttttctggaa

SEQ ID NO: 6360823 - DNA, 22 bp, Homo sapiens
taatgttttttggaaattcaga

SEQ ID NO: 6360824 - DNA, 15 bp, Homo sapiens
taattaaaaaatcaa

SEQ ID NO: 6360825 - DNA, 16 bp, Homo sapiens
taattaaaaacagaaa

SEQ ID NO: 6360826 - DNA, 17 bp, Homo sapiens
taattaaaaacagaaaa

SEQ ID NO: 6360827 - DNA, 12 bp, Homo sapiens
taattaaaaact

SEQ ID NO: 6360828 - DNA, 20 bp, Homo sapiens
taattaaaaactagtagttc

SEQ ID NO: 6360829 - DNA, 13 bp, Homo sapiens
taattaaaaactt

SEQ ID NO: 6360830 - DNA, 15 bp, Homo sapiens
taattaaaaacttta

SEQ ID NO: 6360831 - DNA, 17 bp, Homo sapiens
taattaaaaactttaaa

SEQ ID NO: 6360832 - DNA, 18 bp, Homo sapiens
taattaaaaagttaatct

SEQ ID NO: 6360833 - DNA, 15 bp, Homo sapiens
taattaaaacacttt

SEQ ID NO: 6360834 - DNA, 19 bp, Homo sapiens
taattaaaactatttagtg

SEQ ID NO: 6360835 - DNA, 18 bp, Homo sapiens
taattaaaagcaaatcat

SEQ ID NO: 6360836 - DNA, 12 bp, Homo sapiens
taattaaaatct

SEQ ID NO: 6360837 - DNA, 13 bp, Homo sapiens
taattaaaatctg

SEQ ID NO: 6360838 - DNA, 22 bp, Homo sapiens
taattaaaatctggaaatctgt

SEQ ID NO: 6360839 - DNA, 12 bp, Homo sapiens
taattaaaatgt

SEQ ID NO: 6360840 - DNA, 19 bp, Homo sapiens
taattaaaatgtgcagtat

SEQ ID NO: 6360841 - DNA, 16 bp, Homo sapiens
taattaaaattgtgca

SEQ ID NO: 6360842 - DNA, 15 bp, Homo sapiens
taattaaaatttatc

SEQ ID NO: 6360843 - DNA, 17 bp, Homo sapiens
taattaaactagtttaa

SEQ ID NO: 6360844 - DNA, 13 bp, Homo sapiens
taattaaactgat

SEQ ID NO: 6360845 - DNA, 15 bp, Homo sapiens
taattaaagaaaatt

SEQ ID NO: 6360846 - DNA, 18 bp, Homo sapiens
taattaaagaaaattgcc

SEQ ID NO: 6360847 - DNA, 22 bp, Homo sapiens
taattaaagaaaattgccaaaa

SEQ ID NO: 6360848 - DNA, 17 bp, Homo sapiens
taattaaagactcaaga

SEQ ID NO: 6360849 - DNA, 15 bp, Homo sapiens
taattaaagatgcca

SEQ ID NO: 6360850 - DNA, 21 bp, Homo sapiens
taattaaagatgccatagcat

SEQ ID NO: 6360851 - DNA, 19 bp, Homo sapiens
taattaaagcccacaatcc

SEQ ID NO: 6360852 - DNA, 12 bp, Homo sapiens
taattaaagtgt

SEQ ID NO: 6360853 - DNA, 12 bp, Homo sapiens
taattaaatata

SEQ ID NO: 6360854 - DNA, 12 bp, Homo sapiens
taattaaatgaa

SEQ ID NO: 6360855 - DNA, 18 bp, Homo sapiens
taattaaatgaaatactt

SEQ ID NO: 6360856 - DNA, 14 bp, Homo sapiens
taattaacatatca

SEQ ID NO: 6360857 - DNA, 19 bp, Homo sapiens
taattaacatgttaaacca

SEQ ID NO: 6360858 - DNA, 17 bp, Homo sapiens
taattaactatgtgatg

SEQ ID NO: 6360859 - DNA, 16 bp, Homo sapiens
taattaactgaaacat

SEQ ID NO: 6360860 - DNA, 16 bp, Homo sapiens
taattaacttaactga

SEQ ID NO: 6360861 - DNA, 14 bp, Homo sapiens
taattaagctctca

SEQ ID NO: 6360862 - DNA, 22 bp, Homo sapiens
taattaagctctcatagctcat

SEQ ID NO: 6360863 - DNA, 18 bp, Homo sapiens
taattaaggtacatcatt

SEQ ID NO: 6360864 - DNA, 12 bp, Homo sapiens
taattaagtaaa

SEQ ID NO: 6360865 - DNA, 18 bp, Homo sapiens
taattaagtatctgggat

SEQ ID NO: 6360866 - DNA, 23 bp, Homo sapiens
taattaataaaaatcagtttctt

SEQ ID NO: 6360867 - DNA, 13 bp, Homo sapiens
taattaatagaat

SEQ ID NO: 6360868 - DNA, 17 bp, Homo sapiens
taattaatatattaaaa

SEQ ID NO: 6360869 - DNA, 20 bp, Homo sapiens
taattaatgaaatatctgta

SEQ ID NO: 6360870 - DNA, 21 bp, Homo sapiens
taattaatgaaatatctgtat

SEQ ID NO: 6360871 - DNA, 15 bp, Homo sapiens
taattaatgtttgtg

SEQ ID NO: 6360872 - DNA, 14 bp, Homo sapiens
taattaattaacat

SEQ ID NO: 6360873 - DNA, 11 bp, Homo sapiens
taattaatttc

SEQ ID NO: 6360874 - DNA, 19 bp, Homo sapiens
taattaatttgattaacaa

SEQ ID NO: 6360875 - DNA, 16 bp, Homo sapiens
taattacaaacaataa

SEQ ID NO: 6360876 - DNA, 18 bp, Homo sapiens
taattacaatatttctga

SEQ ID NO: 6360877 - DNA, 21 bp, Homo sapiens
taattacaatgtaatagaagc

SEQ ID NO: 6360878 - DNA, 21 bp, Homo sapiens
taattacagccttatttttgt

SEQ ID NO: 6360879 - DNA, 19 bp, Homo sapiens
taattacaggagggaacat

SEQ ID NO: 6360880 - DNA, 21 bp, Homo sapiens
taattacaggagggaacattt

SEQ ID NO: 6360881 - DNA, 19 bp, Homo sapiens
taattacagtgcctaaaat

SEQ ID NO: 6360882 - DNA, 22 bp, Homo sapiens
taattacagtgcctaaaataag

SEQ ID NO: 6360883 - DNA, 19 bp, Homo sapiens
taattacatatttgactct

SEQ ID NO: 6360884 - DNA, 15 bp, Homo sapiens
taattacatccagaa

SEQ ID NO: 6360885 - DNA, 16 bp, Homo sapiens
taattaccaacctgtt

SEQ ID NO: 6360886 - DNA, 21 bp, Homo sapiens
taattaccatacataaactgt

SEQ ID NO: 6360887 - DNA, 14 bp, Homo sapiens
taattacctggtga

SEQ ID NO: 6360888 - DNA, 21 bp, Homo sapiens
taattacctgtcatctgggcc

SEQ ID NO: 6360889 - DNA, 16 bp, Homo sapiens
taattacgtttaaagt

SEQ ID NO: 6360890 - DNA, 13 bp, Homo sapiens
taattactaattt

SEQ ID NO: 6360891 - DNA, 19 bp, Homo sapiens
taattactacattagggaa

SEQ ID NO: 6360892 - DNA, 14 bp, Homo sapiens
taattactctttga

SEQ ID NO: 6360893 - DNA, 21 bp, Homo sapiens
taattactggaattcttctgc

SEQ ID NO: 6360894 - DNA, 20 bp, Homo sapiens
taattactgtgtgtgagcca

SEQ ID NO: 6360895 - DNA, 21 bp, Homo sapiens
taattactttcagaatatttt

SEQ ID NO: 6360896 - DNA, 19 bp, Homo sapiens
taattactttcagaatgtt

SEQ ID NO: 6360897 - DNA, 14 bp, Homo sapiens
taattacttttgaa

SEQ ID NO: 6360898 - DNA, 20 bp, Homo sapiens
taattagaaacacacttttg

SEQ ID NO: 6360899 - DNA, 23 bp, Homo sapiens
taattagaaacgtgataaatata

SEQ ID NO: 6360900 - DNA, 12 bp, Homo sapiens
taattagagcag

SEQ ID NO: 6360901 - DNA, 16 bp, Homo sapiens
taattagatcaacact

SEQ ID NO: 6360902 - DNA, 18 bp, Homo sapiens
taattagatccattaatt

SEQ ID NO: 6360903 - DNA, 23 bp, Homo sapiens
taattagatccattaatttaaat

SEQ ID NO: 6360904 - DNA, 16 bp, Homo sapiens
taattagcatctcagg

SEQ ID NO: 6360905 - DNA, 13 bp, Homo sapiens
taattagcattct

SEQ ID NO: 6360906 - DNA, 22 bp, Homo sapiens
taattagctatatttttatata

SEQ ID NO: 6360907 - DNA, 15 bp, Homo sapiens
taattagctctgggg

SEQ ID NO: 6360908 - DNA, 20 bp, Homo sapiens
taattagctctggggggcag

SEQ ID NO: 6360909 - DNA, 13 bp, Homo sapiens
taattagctgtgc

SEQ ID NO: 6360910 - DNA, 14 bp, Homo sapiens
taattaggaaaaaa

SEQ ID NO: 6360911 - DNA, 18 bp, Homo sapiens
taattaggataactaaaa

SEQ ID NO: 6360912 - DNA, 20 bp, Homo sapiens
taattagggcatcctgcccc

SEQ ID NO: 6360913 - DNA, 21 bp, Homo sapiens
taattagggtacatttataat

SEQ ID NO: 6360914 - DNA, 16 bp, Homo sapiens
taattaggttaactat

SEQ ID NO: 6360915 - DNA, 14 bp, Homo sapiens
taattagtgccact

SEQ ID NO: 6360916 - DNA, 22 bp, Homo sapiens
taattagtgccacttaatgtat

SEQ ID NO: 6360917 - DNA, 15 bp, Homo sapiens
taattagtgctaagt

SEQ ID NO: 6360918 - DNA, 21 bp, Homo sapiens
taattagtgctaagtgtgaac

SEQ ID NO: 6360919 - DNA, 12 bp, Homo sapiens
taattagtttat

SEQ ID NO: 6360920 - DNA, 21 bp, Homo sapiens
taattagtttatattactctc

SEQ ID NO: 6360921 - DNA, 16 bp, Homo sapiens
taattataaaaaatta

SEQ ID NO: 6360922 - DNA, 14 bp, Homo sapiens
taattataaacagc

SEQ ID NO: 6360923 - DNA, 11 bp, Homo sapiens
taattataaga

SEQ ID NO: 6360924 - DNA, 14 bp, Homo sapiens
taattataataaag

SEQ ID NO: 6360925 - DNA, 16 bp, Homo sapiens
taattataataaaggt

SEQ ID NO: 6360926 - DNA, 17 bp, Homo sapiens
taattataggaagttct

SEQ ID NO: 6360927 - DNA, 19 bp, Homo sapiens
taattataggaagttcttt

SEQ ID NO: 6360928 - DNA, 16 bp, Homo sapiens
taattatataactgta

SEQ ID NO: 6360929 - DNA, 16 bp, Homo sapiens
taattatatctaaaat

SEQ ID NO: 6360930 - DNA, 19 bp, Homo sapiens
taattatatctgaggaatt

SEQ ID NO: 6360931 - DNA, 21 bp, Homo sapiens
taattatatgctatttctata

SEQ ID NO: 6360932 - DNA, 15 bp, Homo sapiens
taattatatgttgta

SEQ ID NO: 6360933 - DNA, 16 bp, Homo sapiens
taattatattatgaat

SEQ ID NO: 6360934 - DNA, 13 bp, Homo sapiens
taattatatttct

SEQ ID NO: 6360935 - DNA, 18 bp, Homo sapiens
taattatcggaagcagtg

SEQ ID NO: 6360936 - DNA, 19 bp, Homo sapiens
taattatcggaagcagtgc

SEQ ID NO: 6360937 - DNA, 21 bp, Homo sapiens
taattatcggaagcagtgcct

SEQ ID NO: 6360938 - DNA, 18 bp, Homo sapiens
taattatcgggaacagtg

SEQ ID NO: 6360939 - DNA, 20 bp, Homo sapiens
taattatcgggaacagtgtt

SEQ ID NO: 6360940 - DNA, 21 bp, Homo sapiens
taattatcgggaacagtgttt

SEQ ID NO: 6360941 - DNA, 21 bp, Homo sapiens
taattatctcctaattgtatg

SEQ ID NO: 6360942 - DNA, 18 bp, Homo sapiens
taattatctgtgatggat

SEQ ID NO: 6360943 - DNA, 18 bp, Homo sapiens
taattatgaaaagaaata

SEQ ID NO: 6360944 - DNA, 14 bp, Homo sapiens
taattatgatttgg

SEQ ID NO: 6360945 - DNA, 21 bp, Homo sapiens
taattatggttagtagaggta

SEQ ID NO: 6360946 - DNA, 14 bp, Homo sapiens
taattatgtaaata

SEQ ID NO: 6360947 - DNA, 14 bp, Homo sapiens
taattatgtaacct

SEQ ID NO: 6360948 - DNA, 16 bp, Homo sapiens
taattatgtagctctt

SEQ ID NO: 6360949 - DNA, 17 bp, Homo sapiens
taattatgtgatataaa

SEQ ID NO: 6360950 - DNA, 19 bp, Homo sapiens
taattatgtgatataaaat

SEQ ID NO: 6360951 - DNA, 20 bp, Homo sapiens
taattatgtgtagttataaa

SEQ ID NO: 6360952 - DNA, 21 bp, Homo sapiens
taattatgttatttagtcatt

SEQ ID NO: 6360953 - DNA, 14 bp, Homo sapiens
taattatgtttacc

SEQ ID NO: 6360954 - DNA, 15 bp, Homo sapiens
taattatgtttacct

SEQ ID NO: 6360955 - DNA, 20 bp, Homo sapiens
taattattaactacatttat

SEQ ID NO: 6360956 - DNA, 19 bp, Homo sapiens
taattattataaaaatatt

SEQ ID NO: 6360957 - DNA, 13 bp, Homo sapiens
taattattattat

SEQ ID NO: 6360958 - DNA, 14 bp, Homo sapiens
taattattattatt

SEQ ID NO: 6360959 - DNA, 12 bp, Homo sapiens
taattattattc

SEQ ID NO: 6360960 - DNA, 22 bp, Homo sapiens
taattattattcagaaatgact

SEQ ID NO: 6360961 - DNA, 22 bp, Homo sapiens
taattattatttatatatgtat

SEQ ID NO: 6360962 - DNA, 19 bp, Homo sapiens
taattattgtaatgtaata

SEQ ID NO: 6360963 - DNA, 13 bp, Homo sapiens
taattatttaaag

SEQ ID NO: 6360964 - DNA, 13 bp, Homo sapiens
taattatttaaat

SEQ ID NO: 6360965 - DNA, 14 bp, Homo sapiens
taattatttatgta

SEQ ID NO: 6360966 - DNA, 18 bp, Homo sapiens
taattatttatgtatggt

SEQ ID NO: 6360967 - DNA, 17 bp, Homo sapiens
taattatttattacata

SEQ ID NO: 6360968 - DNA, 16 bp, Homo sapiens
taattattttaataat

SEQ ID NO: 6360969 - DNA, 20 bp, Homo sapiens
taattattttaattaggtta

SEQ ID NO: 6360970 - DNA, 18 bp, Homo sapiens
taattattttattgtgta

SEQ ID NO: 6360971 - DNA, 15 bp, Homo sapiens
taattattttccaaa

SEQ ID NO: 6360972 - DNA, 21 bp, Homo sapiens
taattattttccaaaatctaa

SEQ ID NO: 6360973 - DNA, 20 bp, Homo sapiens
gtctctgtataatctattta

SEQ ID NO: 6360974 - DNA, 17 bp, Homo sapiens
gtctctgtccctcactg

SEQ ID NO: 6360975 - DNA, 18 bp, Homo sapiens
gtctctgtccctcactgc

SEQ ID NO: 6360976 - DNA, 23 bp, Homo sapiens
gtctctgtccgcgtcctttcctc

SEQ ID NO: 6360977 - DNA, 17 bp, Homo sapiens
gtctctgtcgtggacac

SEQ ID NO: 6360978 - DNA, 19 bp, Homo sapiens
gtctctgtcgtggacacgc

SEQ ID NO: 6360979 - DNA, 23 bp, Homo sapiens
gtctctgtctctcctagcccctc

SEQ ID NO: 6360980 - DNA, 18 bp, Homo sapiens
gtctctgtctgatcctgt

SEQ ID NO: 6360981 - DNA, 15 bp, Homo sapiens
gtctctgtgagactc

SEQ ID NO: 6360982 - DNA, 19 bp, Homo sapiens
gtctctgtgggtgggaatg

SEQ ID NO: 6360983 - DNA, 15 bp, Homo sapiens
gtctctgtgtaacca

SEQ ID NO: 6360984 - DNA, 11 bp, Homo sapiens
gtctctgtgtg

SEQ ID NO: 6360985 - DNA, 13 bp, Homo sapiens
gtctctgtgtgtg

SEQ ID NO: 6360986 - DNA, 21 bp, Homo sapiens
gtctctgttaacatctagcct

SEQ ID NO: 6360987 - DNA, 15 bp, Homo sapiens
gtctctgttgtaaat

SEQ ID NO: 6360988 - DNA, 15 bp, Homo sapiens
gtctctgtttcctga

SEQ ID NO: 6360989 - DNA, 18 bp, Homo sapiens
gtctctgtttcctgaaat

SEQ ID NO: 6360990 - DNA, 22 bp, Homo sapiens
gtctcttacatctccttgatca

SEQ ID NO: 6360991 - DNA, 20 bp, Homo sapiens
gtctcttagaatttgtttca

SEQ ID NO: 6360992 - DNA, 23 bp, Homo sapiens
gtctcttatggatgtccccagca

SEQ ID NO: 6360993 - DNA, 11 bp, Homo sapiens
gtctcttccac

SEQ ID NO: 6360994 - DNA, 21 bp, Homo sapiens
gtctcttccagtttgctttgc

SEQ ID NO: 6360995 - DNA, 23 bp, Homo sapiens
gtctcttcctctgttctatccca

SEQ ID NO: 6360996 - DNA, 15 bp, Homo sapiens
gtctcttctcagagc

SEQ ID NO: 6360997 - DNA, 16 bp, Homo sapiens
gtctcttctcagagca

SEQ ID NO: 6360998 - DNA, 17 bp, Homo sapiens
gtctcttctcagagcag

SEQ ID NO: 6360999 - DNA, 15 bp, Homo sapiens
gtctcttctccactg

SEQ ID NO: 6361000 - DNA, 17 bp, Homo sapiens
gtctcttctcccagaat

SEQ ID NO: 6361001 - DNA, 14 bp, Homo sapiens
gtctcttctgagct

SEQ ID NO: 6361002 - DNA, 22 bp, Homo sapiens
gtctcttctgagctatttcatc

SEQ ID NO: 6361003 - DNA, 23 bp, Homo sapiens
gtctcttctgggcgtctgagctg

SEQ ID NO: 6361004 - DNA, 23 bp, Homo sapiens
gtctcttcttggggcccagtgca

SEQ ID NO: 6361005 - DNA, 16 bp, Homo sapiens
gtctcttgagcatcaa

SEQ ID NO: 6361006 - DNA, 15 bp, Homo sapiens
gtctcttgcctgcca

SEQ ID NO: 6361007 - DNA, 12 bp, Homo sapiens
gtctcttgcttg

SEQ ID NO: 6361008 - DNA, 22 bp, Homo sapiens
gtctcttggaaatgttaagaaa

SEQ ID NO: 6361009 - DNA, 17 bp, Homo sapiens
gtctcttggtcctgctg

SEQ ID NO: 6361010 - DNA, 11 bp, Homo sapiens
gtctcttgttt

SEQ ID NO: 6361011 - DNA, 17 bp, Homo sapiens
gtctctttaagggcatg

SEQ ID NO: 6361012 - DNA, 23 bp, Homo sapiens
gtctctttaagggcatgccttgt

SEQ ID NO: 6361013 - DNA, 16 bp, Homo sapiens
gtctctttattcctag

SEQ ID NO: 6361014 - DNA, 12 bp, Homo sapiens
gtctctttctca

SEQ ID NO: 6361015 - DNA, 12 bp, Homo sapiens
gtctctttctgt

SEQ ID NO: 6361016 - DNA, 14 bp, Homo sapiens
gtctctttcttcct

SEQ ID NO: 6361017 - DNA, 15 bp, Homo sapiens
gtctctttcttcctt

SEQ ID NO: 6361018 - DNA, 16 bp, Homo sapiens
gtctctttcttccttt

SEQ ID NO: 6361019 - DNA, 17 bp, Homo sapiens
gtctctttcttcctttc

SEQ ID NO: 6361020 - DNA, 15 bp, Homo sapiens
gtctctttctttcca

SEQ ID NO: 6361021 - DNA, 16 bp, Homo sapiens
gtctctttctttccaa

SEQ ID NO: 6361022 - DNA, 20 bp, Homo sapiens
gtctctttctttccaaaggt

SEQ ID NO: 6361023 - DNA, 23 bp, Homo sapiens
gtctctttggggagagctggcag

SEQ ID NO: 6361024 - DNA, 15 bp, Homo sapiens
gtctctttgttcaat

SEQ ID NO: 6361025 - DNA, 22 bp, Homo sapiens
gtctcttttaccctggcccctc

SEQ ID NO: 6361026 - DNA, 14 bp, Homo sapiens
gtctcttttctcta

SEQ ID NO: 6361027 - DNA, 15 bp, Homo sapiens
gtctctttttctcac

SEQ ID NO: 6361028 - DNA, 18 bp, Homo sapiens
gtctcttttttacaaagg

SEQ ID NO: 6361029 - DNA, 20 bp, Homo sapiens
gtctcttttttacaaaggct

SEQ ID NO: 6361030 - DNA, 21 bp, Homo sapiens
gtctctttttttggcccaggc

SEQ ID NO: 6361031 - DNA, 14 bp, Homo sapiens
gtctgaaaaagtgt

SEQ ID NO: 6361032 - DNA, 23 bp, Homo sapiens
gtctgaaaaatgcctgctgctgc

SEQ ID NO: 6361033 - DNA, 20 bp, Homo sapiens
gtctgaaaagaggagccaga

SEQ ID NO: 6361034 - DNA, 14 bp, Homo sapiens
gtctgaaaagctgt

SEQ ID NO: 6361035 - DNA, 14 bp, Homo sapiens
gtctgaaaatgttg

SEQ ID NO: 6361036 - DNA, 17 bp, Homo sapiens
gtctgaaacatttcata

SEQ ID NO: 6361037 - DNA, 15 bp, Homo sapiens
gtctgaaaccagaag

SEQ ID NO: 6361038 - DNA, 20 bp, Homo sapiens
gtctgaaaccagaagactgg

SEQ ID NO: 6361039 - DNA, 14 bp, Homo sapiens
gtctgaaactggct

SEQ ID NO: 6361040 - DNA, 13 bp, Homo sapiens
gtctgaaaggggt

SEQ ID NO: 6361041 - DNA, 11 bp, Homo sapiens
gtctgaaatgg

SEQ ID NO: 6361042 - DNA, 21 bp, Homo sapiens
gtctgaaattttctagaatac

SEQ ID NO: 6361043 - DNA, 15 bp, Homo sapiens
gtctgaacatagaaa

SEQ ID NO: 6361044 - DNA, 13 bp, Homo sapiens
gtctgaacccagg

SEQ ID NO: 6361045 - DNA, 15 bp, Homo sapiens
gtctgaacccaggca

SEQ ID NO: 6361046 - DNA, 19 bp, Homo sapiens
gtctgaacccaggcagctg

SEQ ID NO: 6361047 - DNA, 22 bp, Homo sapiens
gtctgaacccaggcagctggca

SEQ ID NO: 6361048 - DNA, 23 bp, Homo sapiens
gtctgaacccaggcagctggcag

SEQ ID NO: 6361049 - DNA, 15 bp, Homo sapiens
gtctgaacccttgtg

SEQ ID NO: 6361050 - DNA, 20 bp, Homo sapiens
gtctgaacgaccgtcttttg

SEQ ID NO: 6361051 - DNA, 11 bp, Homo sapiens
gtctgaacttt

SEQ ID NO: 6361052 - DNA, 18 bp, Homo sapiens
gtctgaagaaggaaggcc

SEQ ID NO: 6361053 - DNA, 14 bp, Homo sapiens
gtctgaagcccaaa

SEQ ID NO: 6361054 - DNA, 17 bp, Homo sapiens
gtctgaagctcgcatcc

SEQ ID NO: 6361055 - DNA, 21 bp, Homo sapiens
gtctgaaggactggattggcc

SEQ ID NO: 6361056 - DNA, 22 bp, Homo sapiens
gtctgaaggactggattggcca

SEQ ID NO: 6361057 - DNA, 15 bp, Homo sapiens
gtctgaaggagagga

SEQ ID NO: 6361058 - DNA, 16 bp, Homo sapiens
gtctgaaggagaggag

SEQ ID NO: 6361059 - DNA, 17 bp, Homo sapiens
gtctgaaggagaggagt

SEQ ID NO: 6361060 - DNA, 15 bp, Homo sapiens
gtctgaaggcctcca

SEQ ID NO: 6361061 - DNA, 21 bp, Homo sapiens
gtctgaaggcctccatttgta

SEQ ID NO: 6361062 - DNA, 14 bp, Homo sapiens
gtctgaaggctggg

SEQ ID NO: 6361063 - DNA, 19 bp, Homo sapiens
gtctgaaggctgggttctg

SEQ ID NO: 6361064 - DNA, 21 bp, Homo sapiens
gtctgaagtacaaacatgaaa

SEQ ID NO: 6361065 - DNA, 17 bp, Homo sapiens
gtctgaagtcactgcac

SEQ ID NO: 6361066 - DNA, 19 bp, Homo sapiens
gtctgaagtcactgcacag

SEQ ID NO: 6361067 - DNA, 16 bp, Homo sapiens
gtctgaagttggcccc

SEQ ID NO: 6361068 - DNA, 17 bp, Homo sapiens
gtctgaatattctagaa

SEQ ID NO: 6361069 - DNA, 16 bp, Homo sapiens
gtctgaatcatgtctg

SEQ ID NO: 6361070 - DNA, 18 bp, Homo sapiens
gtctgaatcatgtctgta

SEQ ID NO: 6361071 - DNA, 14 bp, Homo sapiens
gtctgaatctccca

SEQ ID NO: 6361072 - DNA, 18 bp, Homo sapiens
gtctgaatctcccaagga

SEQ ID NO: 6361073 - DNA, 19 bp, Homo sapiens
gtctgaatctcccaaggag

SEQ ID NO: 6361074 - DNA, 15 bp, Homo sapiens
gtctgaatgtattta

SEQ ID NO: 6361075 - DNA, 16 bp, Homo sapiens
gtctgaattgagaaaa

SEQ ID NO: 6361076 - DNA, 18 bp, Homo sapiens
gtctgaattgagaaaaga

SEQ ID NO: 6361077 - DNA, 19 bp, Homo sapiens
gtctgaattgagaaaagag

SEQ ID NO: 6361078 - DNA, 15 bp, Homo sapiens
gtctgacaaatgtgt

SEQ ID NO: 6361079 - DNA, 14 bp, Homo sapiens
gtctgacacatgct

SEQ ID NO: 6361080 - DNA, 14 bp, Homo sapiens
gtctgacaggaaga

SEQ ID NO: 6361081 - DNA, 18 bp, Homo sapiens
gtctgacaggcaatgctg

SEQ ID NO: 6361082 - DNA, 20 bp, Homo sapiens
gtctgacaggcaatgctggc

SEQ ID NO: 6361083 - DNA, 23 bp, Homo sapiens
gtctgacaggcaatgctggctgt

SEQ ID NO: 6361084 - DNA, 14 bp, Homo sapiens
gtctgacagtagct

SEQ ID NO: 6361085 - DNA, 20 bp, Homo sapiens
gtctgacagtagctcttaga

SEQ ID NO: 6361086 - DNA, 21 bp, Homo sapiens
gtctgacagtagctcttagac

SEQ ID NO: 6361087 - DNA, 24 bp, Homo sapiens
gtctgacatcagaggtatcttact

SEQ ID NO: 6361088 - DNA, 14 bp, Homo sapiens
gtctgaccagagaa

SEQ ID NO: 6361089 - DNA, 15 bp, Homo sapiens
gtctgaccagagaat

SEQ ID NO: 6361090 - DNA, 17 bp, Homo sapiens
gtctgaccccagcccag

SEQ ID NO: 6361091 - DNA, 21 bp, Homo sapiens
gtctgaccccagcccagacag

SEQ ID NO: 6361092 - DNA, 23 bp, Homo sapiens
gtctgaccccagtggaaaacaaa

SEQ ID NO: 6361093 - DNA, 14 bp, Homo sapiens
gtctgaccctctcc

SEQ ID NO: 6361094 - DNA, 17 bp, Homo sapiens
gtctgacctaatatttg

SEQ ID NO: 6361095 - DNA, 18 bp, Homo sapiens
gtctgactacaacatgca

SEQ ID NO: 6361096 - DNA, 12 bp, Homo sapiens
gtctgactccaa

SEQ ID NO: 6361097 - DNA, 16 bp, Homo sapiens
gtctgactccaaagct

SEQ ID NO: 6361098 - DNA, 16 bp, Homo sapiens
gtctgactccagagtc

SEQ ID NO: 6361099 - DNA, 18 bp, Homo sapiens
gtctgactccagagtctg

SEQ ID NO: 6361100 - DNA, 22 bp, Homo sapiens
gtctgactccagagtctgagcc

SEQ ID NO: 6361101 - DNA, 14 bp, Homo sapiens
gtctgactccctcc

SEQ ID NO: 6361102 - DNA, 17 bp, Homo sapiens
gtctgactctccactcc

SEQ ID NO: 6361103 - DNA, 15 bp, Homo sapiens
gtctgactctgggtt

SEQ ID NO: 6361104 - DNA, 19 bp, Homo sapiens
gtctgactgtgcccaagtg

SEQ ID NO: 6361105 - DNA, 14 bp, Homo sapiens
gtctgactgtgtgt

SEQ ID NO: 6361106 - DNA, 19 bp, Homo sapiens
gtctgactttcttttttga

SEQ ID NO: 6361107 - DNA, 20 bp, Homo sapiens
gtctgagaatgcccaactct

SEQ ID NO: 6361108 - DNA, 20 bp, Homo sapiens
gtctgagacaggtgcctaac

SEQ ID NO: 6361109 - DNA, 19 bp, Homo sapiens
gtctgagagaccatctcct

SEQ ID NO: 6361110 - DNA, 13 bp, Homo sapiens
gtctgagagaggc

SEQ ID NO: 6361111 - DNA, 22 bp, Homo sapiens
gtctgagaggttagaatgatca

SEQ ID NO: 6361112 - DNA, 23 bp, Homo sapiens
gtctgagcatccatcaatacctg

SEQ ID NO: 6361113 - DNA, 18 bp, Homo sapiens
gtctgagccaaagagaat

SEQ ID NO: 6361114 - DNA, 15 bp, Homo sapiens
gtctgagccacagca

SEQ ID NO: 6361115 - DNA, 16 bp, Homo sapiens
gtctgagccacagcag

SEQ ID NO: 6361116 - DNA, 20 bp, Homo sapiens
gtctgagccacagcagcatt

SEQ ID NO: 6361117 - DNA, 21 bp, Homo sapiens
gtctgagccacagcagcattt

SEQ ID NO: 6361118 - DNA, 16 bp, Homo sapiens
gtctgagcccatttct

SEQ ID NO: 6361119 - DNA, 12 bp, Homo sapiens
gtctgagccccc

SEQ ID NO: 6361120 - DNA, 17 bp, Homo sapiens
gtctgagcggccgcctg

SEQ ID NO: 6361121 - DNA, 20 bp, Homo sapiens
gtctgagcggcgcagagccc

SEQ ID NO: 6361122 - DNA, 13 bp, Homo sapiens
gtctgagctagct

SEQ ID NO: 6361123 - DNA, 16 bp, Homo sapiens
gtctgagctgtcccaa

SEQ ID NO: 6361124 - DNA, 18 bp, Homo sapiens
gtctgaggaatccagacc

SEQ ID NO: 6361125 - DNA, 19 bp, Homo sapiens
gtctgaggaatccagaccc

SEQ ID NO: 6361126 - DNA, 13 bp, Homo sapiens
gtctgaggactgt

SEQ ID NO: 6361127 - DNA, 20 bp, Homo sapiens
gtctgaggactgtcctccca

SEQ ID NO: 6361128 - DNA, 21 bp, Homo sapiens
gtctgaggagtaagtgtacaa

SEQ ID NO: 6361129 - DNA, 16 bp, Homo sapiens
gtctgaggataccttc

SEQ ID NO: 6361130 - DNA, 19 bp, Homo sapiens
gtctgaggccccaggccct

SEQ ID NO: 6361131 - DNA, 14 bp, Homo sapiens
gtctgaggcccctg

SEQ ID NO: 6361132 - DNA, 22 bp, Homo sapiens
gtctgaggcctcatccctcgga

SEQ ID NO: 6361133 - DNA, 18 bp, Homo sapiens
gtctgaggtcctgagcac

SEQ ID NO: 6361134 - DNA, 17 bp, Homo sapiens
gtctgagtagtggccac

SEQ ID NO: 6361135 - DNA, 19 bp, Homo sapiens
gtctgagtagtggccactg

SEQ ID NO: 6361136 - DNA, 12 bp, Homo sapiens
gtctgagtcatc

SEQ ID NO: 6361137 - DNA, 19 bp, Homo sapiens
gtctgagtcatcaaaaaga

SEQ ID NO: 6361138 - DNA, 22 bp, Homo sapiens
gtctgagtcctgtctctgcctg

SEQ ID NO: 6361139 - DNA, 23 bp, Homo sapiens
gtctgagtcctgtctctgcctgc

SEQ ID NO: 6361140 - DNA, 14 bp, Homo sapiens
gtctgagtctatgt

SEQ ID NO: 6361141 - DNA, 17 bp, Homo sapiens
gtctgagtctatgttca

SEQ ID NO: 6361142 - DNA, 20 bp, Homo sapiens
gtctgagtggggcttcctgg

SEQ ID NO: 6361143 - DNA, 23 bp, Homo sapiens
gtctgatagagtttaacagatat

SEQ ID NO: 6361144 - DNA, 18 bp, Homo sapiens
gtctgatattaatcaaaa

SEQ ID NO: 6361145 - DNA, 14 bp, Homo sapiens
gtctgatccctgcc

SEQ ID NO: 6361146 - DNA, 13 bp, Homo sapiens
gtctgatctgtgc

SEQ ID NO: 6361147 - DNA, 17 bp, Homo sapiens
gtctgatgccaaagctg

SEQ ID NO: 6361148 - DNA, 18 bp, Homo sapiens
gtctgatggatcccgaag

SEQ ID NO: 6361149 - DNA, 15 bp, Homo sapiens
gtctgatggtgagca

SEQ ID NO: 6361150 - DNA, 16 bp, Homo sapiens
gtctgatgtgtgccca

SEQ ID NO: 6361151 - DNA, 18 bp, Homo sapiens
gtctgatgtgtgcccaga

SEQ ID NO: 6361152 - DNA, 12 bp, Homo sapiens
taattcaaagca

SEQ ID NO: 6361153 - DNA, 14 bp, Homo sapiens
taattcaagaaatg

SEQ ID NO: 6361154 - DNA, 19 bp, Homo sapiens
taattcaagaaatgacagt

SEQ ID NO: 6361155 - DNA, 13 bp, Homo sapiens
taattcaagaggc

SEQ ID NO: 6361156 - DNA, 20 bp, Homo sapiens
taattcaagcctctaaacag

SEQ ID NO: 6361157 - DNA, 22 bp, Homo sapiens
taattcaaggaatttcttaact

SEQ ID NO: 6361158 - DNA, 14 bp, Homo sapiens
taattcaattaaaa

SEQ ID NO: 6361159 - DNA, 18 bp, Homo sapiens
taattcaattaaaaccat

SEQ ID NO: 6361160 - DNA, 14 bp, Homo sapiens
taattcacagtgct

SEQ ID NO: 6361161 - DNA, 16 bp, Homo sapiens
taattcaccaatttcc

SEQ ID NO: 6361162 - DNA, 17 bp, Homo sapiens
taattcaccaatttcct

SEQ ID NO: 6361163 - DNA, 16 bp, Homo sapiens
taattcacctatgtta

SEQ ID NO: 6361164 - DNA, 17 bp, Homo sapiens
taattcacctatgttat

SEQ ID NO: 6361165 - DNA, 17 bp, Homo sapiens
taattcacctcttcttt

SEQ ID NO: 6361166 - DNA, 23 bp, Homo sapiens
taattcactaggctcgtgtttgc

SEQ ID NO: 6361167 - DNA, 12 bp, Homo sapiens
taattcactcaa

SEQ ID NO: 6361168 - DNA, 12 bp, Homo sapiens
taattcagaaaa

SEQ ID NO: 6361169 - DNA, 14 bp, Homo sapiens
taattcagatggat

SEQ ID NO: 6361170 - DNA, 21 bp, Homo sapiens
taattcagcactgatttcaca

SEQ ID NO: 6361171 - DNA, 22 bp, Homo sapiens
taattcagcactgatttcacaa

SEQ ID NO: 6361172 - DNA, 18 bp, Homo sapiens
taattcagccatgtacag

SEQ ID NO: 6361173 - DNA, 15 bp, Homo sapiens
taattcagctttgtc

SEQ ID NO: 6361174 - DNA, 12 bp, Homo sapiens
taattcaggact

SEQ ID NO: 6361175 - DNA, 13 bp, Homo sapiens
taattcaggtatg

SEQ ID NO: 6361176 - DNA, 22 bp, Homo sapiens
taattcaggtgataactcacca

SEQ ID NO: 6361177 - DNA, 16 bp, Homo sapiens
taattcaggtttttcc

SEQ ID NO: 6361178 - DNA, 21 bp, Homo sapiens
taattcaggtttttccttttt

SEQ ID NO: 6361179 - DNA, 18 bp, Homo sapiens
taattcaggttttttagt

SEQ ID NO: 6361180 - DNA, 18 bp, Homo sapiens
taattcagtatgatttat

SEQ ID NO: 6361181 - DNA, 20 bp, Homo sapiens
taattcagtgtatttcagtt

SEQ ID NO: 6361182 - DNA, 14 bp, Homo sapiens
taattcataattag

SEQ ID NO: 6361183 - DNA, 16 bp, Homo sapiens
taattcataattagaa

SEQ ID NO: 6361184 - DNA, 18 bp, Homo sapiens
taattcataattagaaca

SEQ ID NO: 6361185 - DNA, 19 bp, Homo sapiens
taattcatatctaaatagt

SEQ ID NO: 6361186 - DNA, 15 bp, Homo sapiens
taattcatattcttc

SEQ ID NO: 6361187 - DNA, 11 bp, Homo sapiens
taattcatctt

SEQ ID NO: 6361188 - DNA, 16 bp, Homo sapiens
taattcattaaaaaca

SEQ ID NO: 6361189 - DNA, 19 bp, Homo sapiens
taattcattaaaagtttta

SEQ ID NO: 6361190 - DNA, 19 bp, Homo sapiens
taattcattaatctgtttg

SEQ ID NO: 6361191 - DNA, 13 bp, Homo sapiens
taattcatttgta

SEQ ID NO: 6361192 - DNA, 14 bp, Homo sapiens
taattcatttgtat

SEQ ID NO: 6361193 - DNA, 21 bp, Homo sapiens
taattccaagtgtttctgttt

SEQ ID NO: 6361194 - DNA, 14 bp, Homo sapiens
taattccacagctg

SEQ ID NO: 6361195 - DNA, 19 bp, Homo sapiens
taattccacaggtcatcag

SEQ ID NO: 6361196 - DNA, 13 bp, Homo sapiens
taattccacatca

SEQ ID NO: 6361197 - DNA, 11 bp, Homo sapiens
taattccatga

SEQ ID NO: 6361198 - DNA, 19 bp, Homo sapiens
taattcccatctgctttat

SEQ ID NO: 6361199 - DNA, 17 bp, Homo sapiens
taattcccattttgcaa

SEQ ID NO: 6361200 - DNA, 18 bp, Homo sapiens
taattcccattttgcaaa

SEQ ID NO: 6361201 - DNA, 13 bp, Homo sapiens
taattcctatgaa

SEQ ID NO: 6361202 - DNA, 22 bp, Homo sapiens
taattcctctcactaaacttta

SEQ ID NO: 6361203 - DNA, 17 bp, Homo sapiens
taattcctctccaggcc

SEQ ID NO: 6361204 - DNA, 15 bp, Homo sapiens
taattcctgtatgtt

SEQ ID NO: 6361205 - DNA, 18 bp, Homo sapiens
taattccttaaatgaact

SEQ ID NO: 6361206 - DNA, 18 bp, Homo sapiens
taattccttatcctagcc

SEQ ID NO: 6361207 - DNA, 20 bp, Homo sapiens
taattccttcagcactttag

SEQ ID NO: 6361208 - DNA, 22 bp, Homo sapiens
taattccttctgcctaacttgt

SEQ ID NO: 6361209 - DNA, 19 bp, Homo sapiens
taattcctttccaggtatt

SEQ ID NO: 6361210 - DNA, 21 bp, Homo sapiens
taattcggaagggaaaacagt

SEQ ID NO: 6361211 - DNA, 21 bp, Homo sapiens
taattcgtacataataagttt

SEQ ID NO: 6361212 - DNA, 14 bp, Homo sapiens
taattcgtttgcta

SEQ ID NO: 6361213 - DNA, 15 bp, Homo sapiens
taattctaaaagaga

SEQ ID NO: 6361214 - DNA, 22 bp, Homo sapiens
taattctaaaagagaagggagc

SEQ ID NO: 6361215 - DNA, 17 bp, Homo sapiens
taattctaaacttagaa

SEQ ID NO: 6361216 - DNA, 13 bp, Homo sapiens
taattctaaccag

SEQ ID NO: 6361217 - DNA, 16 bp, Homo sapiens
taattctaaccagagc

SEQ ID NO: 6361218 - DNA, 17 bp, Homo sapiens
taattctaaccagagca

SEQ ID NO: 6361219 - DNA, 19 bp, Homo sapiens
taattctaaccagagcaag

SEQ ID NO: 6361220 - DNA, 13 bp, Homo sapiens
taattctaaggaa

SEQ ID NO: 6361221 - DNA, 21 bp, Homo sapiens
taattctaaggaatatgagct

SEQ ID NO: 6361222 - DNA, 19 bp, Homo sapiens
taattctaagttatttact

SEQ ID NO: 6361223 - DNA, 16 bp, Homo sapiens
taattctatgattaaa

SEQ ID NO: 6361224 - DNA, 15 bp, Homo sapiens
taattctattgaaag

SEQ ID NO: 6361225 - DNA, 22 bp, Homo sapiens
taattctattgaaagtttttaa

SEQ ID NO: 6361226 - DNA, 16 bp, Homo sapiens
taattctcaaataata

SEQ ID NO: 6361227 - DNA, 23 bp, Homo sapiens
taattctcagaagtgaaaaagac

SEQ ID NO: 6361228 - DNA, 17 bp, Homo sapiens
taattctcatttgttct

SEQ ID NO: 6361229 - DNA, 17 bp, Homo sapiens
taattctccttcccaga

SEQ ID NO: 6361230 - DNA, 22 bp, Homo sapiens
taattctcttttcaaacacaca

SEQ ID NO: 6361231 - DNA, 12 bp, Homo sapiens
taattctgaaac

SEQ ID NO: 6361232 - DNA, 13 bp, Homo sapiens
taattctgaaaca

SEQ ID NO: 6361233 - DNA, 14 bp, Homo sapiens
taattctgaaacaa

SEQ ID NO: 6361234 - DNA, 12 bp, Homo sapiens
taattctgaacc

SEQ ID NO: 6361235 - DNA, 17 bp, Homo sapiens
taattctgagttttgtg

SEQ ID NO: 6361236 - DNA, 18 bp, Homo sapiens
taattctgattagagata

SEQ ID NO: 6361237 - DNA, 15 bp, Homo sapiens
taattctgctttaga

SEQ ID NO: 6361238 - DNA, 17 bp, Homo sapiens
taattctgggaagggag

SEQ ID NO: 6361239 - DNA, 15 bp, Homo sapiens
taattctgtaaatgt

SEQ ID NO: 6361240 - DNA, 14 bp, Homo sapiens
taattctgtactga

SEQ ID NO: 6361241 - DNA, 17 bp, Homo sapiens
taattctgtactgattt

SEQ ID NO: 6361242 - DNA, 23 bp, Homo sapiens
taattctgtactgatttttgtaa

SEQ ID NO: 6361243 - DNA, 16 bp, Homo sapiens
taattctgttaactga

SEQ ID NO: 6361244 - DNA, 15 bp, Homo sapiens
taattctgttctgat
